United States Patent 12,644,137 (MATERIALS AND METHODS FOR TREATMENT OF HEMOGLOBINOPATHIES) - sequence listing, part 4

SEQ ID NO: 66630 - DNA, 24 bp, Artificial Sequence
  Synthetic oligonucleotide; TTAGAAT chr11 5222802 5222825 5222822 +
gagtggtattaatttaacatgatt

SEQ ID NO: 66631 - DNA, 24 bp, Artificial Sequence
  Synthetic oligonucleotide; GAAGAAA chr11 5222809 5222832 5222829 +
attaatttaacatgattttagaat

SEQ ID NO: 66632 - DNA, 24 bp, Artificial Sequence
  Synthetic oligonucleotide; GCAGAAA chr11 5222860 5222883 5222880 +
accaaaagtaacaatgtatttcca

SEQ ID NO: 66633 - DNA, 24 bp, Artificial Sequence
  Synthetic oligonucleotide; TCAGAAA chr11 5222886 5222909 5222906 +
agaaagagataatattaaggataa

SEQ ID NO: 66634 - DNA, 24 bp, Artificial Sequence
  Synthetic oligonucleotide; ATAGAAT chr11 5222896 5222919 5222916 +
aatattaaggataatcagaaaaaa

SEQ ID NO: 66635 - DNA, 24 bp, Artificial Sequence
  Synthetic oligonucleotide; AGAGAAT chr11 5222911 5222934 5222931 +
cagaaaaaaatagaataaacttag

SEQ ID NO: 66636 - DNA, 24 bp, Artificial Sequence
  Synthetic oligonucleotide; TTAGAAA chr11 5222919 5222942 5222939 +
aatagaataaacttagagagaatg

SEQ ID NO: 66637 - DNA, 24 bp, Artificial Sequence
  Synthetic oligonucleotide; GAAGAAA chr11 5222927 5222950 5222947 +
aaacttagagagaatgttagaaat

SEQ ID NO: 66638 - DNA, 24 bp, Artificial Sequence
  Synthetic oligonucleotide; CTAGAAA chr11 5222992 5223015 5223012 +
tttcttcactatttaataataaca

SEQ ID NO: 66639 - DNA, 24 bp, Artificial Sequence
  Synthetic oligonucleotide; CAAGAAT chr11 5223148 5223171 5223168 +
aatggatatttgtatctgaaaaat

SEQ ID NO: 66640 - DNA, 24 bp, Artificial Sequence
  Synthetic oligonucleotide; GGAGAAA chr11 5223487 5223510 5223507 +
caggcggatcagcctgaccaacat

SEQ ID NO: 66641 - DNA, 24 bp, Artificial Sequence
  Synthetic oligonucleotide; CTAGAAT chr11 5223756 5223779 5223776 +
gtcacgatgctgtacattagatat

SEQ ID NO: 66642 - DNA, 24 bp, Artificial Sequence
  Synthetic oligonucleotide; TAAGAAA chr11 5224089 5224112 5224109 +
attttggatattaaccaaaatatt

SEQ ID NO: 66643 - DNA, 24 bp, Artificial Sequence
  Synthetic oligonucleotide; TTAGAAT chr11 5224260 5224283 5224280 +
caaaaaacggctgcaacgtgaata

SEQ ID NO: 66644 - DNA, 24 bp, Artificial Sequence
  Synthetic oligonucleotide; TCAGAAT chr11 5224466 5224489 5224486 +
tattactgattatatgccttgatt

SEQ ID NO: 66645 - DNA, 24 bp, Artificial Sequence
  Synthetic oligonucleotide; TCAGAAT chr11 5224487 5224510 5224507 +
atttcagaatcttgccaactagat

SEQ ID NO: 66646 - DNA, 24 bp, Artificial Sequence
  Synthetic oligonucleotide; CCAGAAT chr11 5224541 5224564 5224561 +
ccacttgagactcatattttattt

SEQ ID NO: 66647 - DNA, 24 bp, Artificial Sequence
  Synthetic oligonucleotide; TAAGAAA chr11 5224575 5224598 5224595 +
gcatctacctacctaggtattgaa

SEQ ID NO: 66648 - DNA, 24 bp, Artificial Sequence
  Synthetic oligonucleotide; GAAGAAT chr11 5224711 5224734 5224731 +
aatgctaatcttaaacatcctgag

SEQ ID NO: 66649 - DNA, 24 bp, Artificial Sequence
  Synthetic oligonucleotide; GGAGAAA chr11 5225021 5225044 5225041 +
aactaaggctgagtggccaggcga

SEQ ID NO: 66650 - DNA, 24 bp, Artificial Sequence
  Synthetic oligonucleotide; TCAGAAA chr11 5225417 5225440 5225437 +
cacattccctttttagtaaaatat

SEQ ID NO: 66651 - DNA, 24 bp, Artificial Sequence
  Synthetic oligonucleotide; GCAGAAT chr11 5225469 5225492 5225489 +
atgaaaataaatgttttttattag

SEQ ID NO: 66652 - DNA, 24 bp, Artificial Sequence
  Synthetic oligonucleotide; ATAGAAA chr11 5225546 5225569 5225566 +
acttagggaacaaaggaaccttta

SEQ ID NO: 66653 - DNA, 24 bp, Artificial Sequence
  Synthetic oligonucleotide; CAAGAAA chr11 5225561 5225584 5225581 +
gaacctttaatagaaattggacag

SEQ ID NO: 66654 - DNA, 24 bp, Artificial Sequence
  Synthetic oligonucleotide; TCAGAAT chr11 5225759 5225782 5225779 +
ttagcaaaagggcctagcttggac

SEQ ID NO: 66655 - DNA, 24 bp, Artificial Sequence
  Synthetic oligonucleotide; GCAGAAT chr11 5225797 5225820 5225817 +
ccttatcccaaccataaaataaaa

SEQ ID NO: 66656 - DNA, 24 bp, Artificial Sequence
  Synthetic oligonucleotide; GCAGAAA chr11 5225866 5225889 5225886 +
tcttacatcagttacaatttatat

SEQ ID NO: 66657 - DNA, 24 bp, Artificial Sequence
  Synthetic oligonucleotide; CCAGAAA chr11 5225907 5225930 5225927 +
cagagatattgctattgccttaac

SEQ ID NO: 66658 - DNA, 24 bp, Artificial Sequence
  Synthetic oligonucleotide; TTAGAAT chr11 5225930 5225953 5225950 +
cccagaaattatcactgttattct

SEQ ID NO: 66659 - DNA, 24 bp, Artificial Sequence
  Synthetic oligonucleotide; AAAGAAA chr11 5225977 5226000 5225997 +
atacattgtatcattattgccctg

SEQ ID NO: 66660 - DNA, 24 bp, Artificial Sequence
  Synthetic oligonucleotide; TTAGAAA chr11 5226000 5226023 5226020 +
gaaagaaagagattagggaaagta

SEQ ID NO: 66661 - DNA, 24 bp, Artificial Sequence
  Synthetic oligonucleotide; GAAGAAA chr11 5226034 5226057 5226054 +
gataaacaaaaaagtatattaaaa

SEQ ID NO: 66662 - DNA, 24 bp, Artificial Sequence
  Synthetic oligonucleotide; AAAGAAA chr11 5226159 5226182 5226179 +
atgattatgtatcaattaaaaata

SEQ ID NO: 66663 - DNA, 24 bp, Artificial Sequence
  Synthetic oligonucleotide; GAAGAAA chr11 5226336 5226359 5226356 +
aagtataatagtaaaaattgcgga

SEQ ID NO: 66664 - DNA, 24 bp, Artificial Sequence
  Synthetic oligonucleotide; AAAGAAA chr11 5226346 5226369 5226366 +
gtaaaaattgcggagaagaaaaaa

SEQ ID NO: 66665 - DNA, 24 bp, Artificial Sequence
  Synthetic oligonucleotide; CAAGAAT chr11 5226354 5226377 5226374 +
tgcggagaagaaaaaaaaagaaag

SEQ ID NO: 66666 - DNA, 24 bp, Artificial Sequence
  Synthetic oligonucleotide; AAAGAAA chr11 5226367 5226390 5226387 +
aaaaaagaaagcaagaattaaaca

SEQ ID NO: 66667 - DNA, 24 bp, Artificial Sequence
  Synthetic oligonucleotide; AAAGAAA chr11 5226397 5226420 5226417 +
aacaattgttatgaacagcaaata

SEQ ID NO: 66668 - DNA, 24 bp, Artificial Sequence
  Synthetic oligonucleotide; ATAGAAA chr11 5226507 5226530 5226527 +
ccttcctatgacatgaacttaacc

SEQ ID NO: 66669 - DNA, 24 bp, Artificial Sequence
  Synthetic oligonucleotide; AAAGAAA chr11 5226522 5226545 5226542 +
aacttaaccatagaaaagaagggg

SEQ ID NO: 66670 - DNA, 24 bp, Artificial Sequence
  Synthetic oligonucleotide; TCAGAAA chr11 5226822 5226845 5226842 +
ataggcagagagagtcagtgccta

SEQ ID NO: 66671 - DNA, 24 bp, Artificial Sequence
  Synthetic oligonucleotide; CCAGAAT chr11 5227466 5227489 5227486 +
gtagatggatctcttcctgcgtct

SEQ ID NO: 66672 - DNA, 24 bp, Artificial Sequence
  Synthetic oligonucleotide; ACAGAAT chr11 5227491 5227514 5227511 +
cagaatatgcaaaatacttacagg

SEQ ID NO: 66673 - DNA, 24 bp, Artificial Sequence
  Synthetic oligonucleotide; TAAGAAA chr11 5227560 5227583 5227580 +
cttatttggattaaaaccttctgg

SEQ ID NO: 66674 - DNA, 24 bp, Artificial Sequence
  Synthetic oligonucleotide; AAAGAAA chr11 5227565 5227588 5227585 +
ttggattaaaaccttctggtaaga

SEQ ID NO: 66675 - DNA, 24 bp, Artificial Sequence
  Synthetic oligonucleotide; ATAGAAT chr11 5227685 5227708 5227705 +
catgctaataaattatgtctaaaa

SEQ ID NO: 66676 - DNA, 24 bp, Artificial Sequence
  Synthetic oligonucleotide; TTAGAAA chr11 5227936 5227959 5227956 +
gggggaacaaaaagcctctgtgac

SEQ ID NO: 66677 - DNA, 24 bp, Artificial Sequence
  Synthetic oligonucleotide; TAAGAAT chr11 5228005 5228028 5228025 +
gattatttttttcctctagtccac

SEQ ID NO: 66678 - DNA, 24 bp, Artificial Sequence
  Synthetic oligonucleotide; AAAGAAA chr11 5228495 5228518 5228515 +
atgaaataaaatttaggttaacca

SEQ ID NO: 66679 - DNA, 24 bp, Artificial Sequence
  Synthetic oligonucleotide; GCAGAAA chr11 5228682 5228705 5228702 +
ctcactctgattattctcacacac

SEQ ID NO: 66680 - DNA, 24 bp, Artificial Sequence
  Synthetic oligonucleotide; TGAGAAA chr11 5228846 5228869 5228866 +
aggatctaggcacacgtgtatccc

SEQ ID NO: 66681 - DNA, 24 bp, Artificial Sequence
  Synthetic oligonucleotide; AAAGAAA chr11 5229098 5229121 5229118 +
tgtcttttgcaaatatcctgggtc

SEQ ID NO: 66682 - DNA, 24 bp, Artificial Sequence
  Synthetic oligonucleotide; GCAGAAA chr11 5229198 5229221 5229218 +
gcaagagctttgaaatcctgattg

SEQ ID NO: 66683 - DNA, 24 bp, Artificial Sequence
  Synthetic oligonucleotide; TCAGAAA chr11 5229245 5229268 5229265 +
gacttaccctacaacttcttatgc

SEQ ID NO: 66684 - DNA, 24 bp, Artificial Sequence
  Synthetic oligonucleotide; TCAGAAT chr11 5229819 5229842 5229839 +
tttcttaagtcctaatgttttata

SEQ ID NO: 66685 - DNA, 24 bp, Artificial Sequence
  Synthetic oligonucleotide; TCAGAAT chr11 5230099 5230122 5230119 +
tcagtaaacacaactcagcagctc

SEQ ID NO: 66686 - DNA, 24 bp, Artificial Sequence
  Synthetic oligonucleotide; CAAGAAA chr11 5230135 5230158 5230155 +
aattaaaatgaaataaaaatgctc

SEQ ID NO: 66687 - DNA, 24 bp, Artificial Sequence
  Synthetic oligonucleotide; ATAGAAA chr11 5230152 5230175 5230172 +
aatgctccaagaaaaccagaaccc

SEQ ID NO: 66688 - DNA, 24 bp, Artificial Sequence
  Synthetic oligonucleotide; ACAGAAA chr11 5230287 5230310 5230307 +
tgctaaagtatatgcataattatt

SEQ ID NO: 66689 - DNA, 24 bp, Artificial Sequence
  Synthetic oligonucleotide; TCAGAAT chr11 5230356 5230379 5230376 +
cctccactgggctcagattttcat

SEQ ID NO: 66690 - DNA, 24 bp, Artificial Sequence
  Synthetic oligonucleotide; GTAGAAT chr11 5230460 5230483 5230480 +
atttgagattgcatctctttagag

SEQ ID NO: 66691 - DNA, 24 bp, Artificial Sequence
  Synthetic oligonucleotide; TGAGAAA chr11 5230724 5230747 5230744 +
atagtttataaagcaacgccatag

SEQ ID NO: 66692 - DNA, 24 bp, Artificial Sequence
  Synthetic oligonucleotide; AAAGAAA chr11 5230729 5230752 5230749 +
ttataaagcaacgccatagtgaga

SEQ ID NO: 66693 - DNA, 24 bp, Artificial Sequence
  Synthetic oligonucleotide; GGAGAAA chr11 5231322 5231345 5231342 +
atttgctctttttttttgactttt

SEQ ID NO: 66694 - DNA, 24 bp, Artificial Sequence
  Synthetic oligonucleotide; TGAGAAA chr11 5231801 5231824 5231821 +
cagatttttaaaaatgtatacaac

SEQ ID NO: 66695 - DNA, 24 bp, Artificial Sequence
  Synthetic oligonucleotide; TCAGAAA chr11 5231878 5231901 5231898 +
aggaaaaaaatattactcctatga

SEQ ID NO: 66696 - DNA, 24 bp, Artificial Sequence
  Synthetic oligonucleotide; AAAGAAA chr11 5231946 5231969 5231966 +
tttgtatgttgtagcattaacaac

SEQ ID NO: 66697 - DNA, 24 bp, Artificial Sequence
  Synthetic oligonucleotide; AGAGAAT chr11 5232134 5232157 5232154 +
ggcacagtaggcatgtaagaaggt

SEQ ID NO: 66698 - DNA, 24 bp, Artificial Sequence
  Synthetic oligonucleotide; GCAGAAT chr11 5232143 5232166 5232163 +
ggcatgtaagaaggtagagaatag

SEQ ID NO: 66699 - DNA, 24 bp, Artificial Sequence
  Synthetic oligonucleotide; TAAGAAA chr11 5232191 5232214 5232211 +
gtgtgtgtgtgtgcatgaaataaa

SEQ ID NO: 66700 - DNA, 24 bp, Artificial Sequence
  Synthetic oligonucleotide; GAAGAAA chr11 5232458 5232481 5232478 +
acaatgtgcaggcaaaggaaggag

SEQ ID NO: 66701 - DNA, 24 bp, Artificial Sequence
  Synthetic oligonucleotide; TCAGAAA chr11 5232878 5232901 5232898 +
gaagtaggcattgtgttcccaagt

SEQ ID NO: 66702 - DNA, 24 bp, Artificial Sequence
  Synthetic oligonucleotide; ATAGAAT chr11 5232885 5232908 5232905 +
gcattgtgttcccaagttcagaaa

SEQ ID NO: 66703 - DNA, 24 bp, Artificial Sequence
  Synthetic oligonucleotide; AGAGAAA chr11 5233109 5233132 5233129 +
ggcagatacatgcatatggttaac

SEQ ID NO: 66704 - DNA, 24 bp, Artificial Sequence
  Synthetic oligonucleotide; TGAGAAA chr11 5233130 5233153 5233150 +
aacagagaaataaagactggcttc

SEQ ID NO: 66705 - DNA, 24 bp, Artificial Sequence
  Synthetic oligonucleotide; ACAGAAT chr11 5233538 5233561 5233558 +
actttcctttccattccatttact

SEQ ID NO: 66706 - DNA, 24 bp, Artificial Sequence
  Synthetic oligonucleotide; GCAGAAT chr11 5233673 5233696 5233693 +
agagacaaaaggattattctaagt

SEQ ID NO: 66707 - DNA, 24 bp, Artificial Sequence
  Synthetic oligonucleotide; AGAGAAA chr11 5233751 5233774 5233771 +
gaaaaatgaagggagggggttggg

SEQ ID NO: 66708 - DNA, 24 bp, Artificial Sequence
  Synthetic oligonucleotide; GCAGAAT chr11 5233809 5233832 5233829 +
caagattgtgaggaaggaaaaaat

SEQ ID NO: 66709 - DNA, 24 bp, Artificial Sequence
  Synthetic oligonucleotide; TTAGAAA chr11 5233924 5233947 5233944 +
aggtaaaagaaccaaaatgtaaga

SEQ ID NO: 66710 - DNA, 24 bp, Artificial Sequence
  Synthetic oligonucleotide; AGAGAAA chr11 5233937 5233960 5233957 +
aaaatgtaagattagaaagtaaaa

SEQ ID NO: 66711 - DNA, 24 bp, Artificial Sequence
  Synthetic oligonucleotide; TGAGAAA chr11 5234019 5234042 5234039 +
ttgtcacagtgcagctcactcagc

SEQ ID NO: 66712 - DNA, 24 bp, Artificial Sequence
  Synthetic oligonucleotide; TCAGAAA chr11 5234234 5234257 5234254 +
caagggacagagagtcagtgccta

SEQ ID NO: 66713 - DNA, 24 bp, Artificial Sequence
  Synthetic oligonucleotide; GAAGAAA chr11 5234449 5234472 5234469 +
ttgctagtgaacactgttatgtca

SEQ ID NO: 66714 - DNA, 24 bp, Artificial Sequence
  Synthetic oligonucleotide; TGAGAAT chr11 5234557 5234580 5234577 +
gataagcagggtttcattagtttg

SEQ ID NO: 66715 - DNA, 24 bp, Artificial Sequence
  Synthetic oligonucleotide; TCAGAAA chr11 5234637 5234660 5234657 +
ctgttctgtcatgtgtgtcttgac

SEQ ID NO: 66716 - DNA, 24 bp, Artificial Sequence
  Synthetic oligonucleotide; TAAGAAA chr11 5234795 5234818 5234815 +
ttatttgtttctgtcactttatac

SEQ ID NO: 66717 - DNA, 24 bp, Artificial Sequence
  Synthetic oligonucleotide; AAAGAAT chr11 5235011 5235034 5235031 +
ttatattgaaataaatatccatta

SEQ ID NO: 66718 - DNA, 24 bp, Artificial Sequence
  Synthetic oligonucleotide; AAAGAAA chr11 5235158 5235181 5235178 +
aatgtttaaaattatggtatgact

SEQ ID NO: 66719 - DNA, 24 bp, Artificial Sequence
  Synthetic oligonucleotide; AAAGAAT chr11 5235162 5235185 5235182 +
tttaaaattatggtatgactaaag

SEQ ID NO: 66720 - DNA, 24 bp, Artificial Sequence
  Synthetic oligonucleotide; GAAGAAA chr11 5235405 5235428 5235425 +
aggaaggattgaaggaaagaggag

SEQ ID NO: 66721 - DNA, 24 bp, Artificial Sequence
  Synthetic oligonucleotide; GGAGAAA chr11 5235413 5235436 5235433 +
ttgaaggaaagaggaggaagaaat

SEQ ID NO: 66722 - DNA, 24 bp, Artificial Sequence
  Synthetic oligonucleotide; GGAGAAA chr11 5235496 5235519 5235516 +
gaaaaataaataatggagaggaga

SEQ ID NO: 66723 - DNA, 24 bp, Artificial Sequence
  Synthetic oligonucleotide; AGAGAAA chr11 5235537 5235560 5235557 +
agaggagaggagaagggataggga

SEQ ID NO: 66724 - DNA, 24 bp, Artificial Sequence
  Synthetic oligonucleotide; AGAGAAA chr11 5235543 5235566 5235563 +
gaggagaagggatagggaagagaa

SEQ ID NO: 66725 - DNA, 24 bp, Artificial Sequence
  Synthetic oligonucleotide; AGAGAAA chr11 5235581 5235604 5235601 +
gaagagaggaaagaagagaagagg

SEQ ID NO: 66726 - DNA, 24 bp, Artificial Sequence
  Synthetic oligonucleotide; AAAGAAA chr11 5235586 5235609 5235606 +
gaggaaagaagagaagaggagaga

SEQ ID NO: 66727 - DNA, 24 bp, Artificial Sequence
  Synthetic oligonucleotide; ATAGAAA chr11 5235687 5235710 5235707 +
aaattttggtggtgatatggatca

SEQ ID NO: 66728 - DNA, 24 bp, Artificial Sequence
  Synthetic oligonucleotide; TCAGAAA chr11 5235812 5235835 5235832 +
cctagcaattacatttttagatat

SEQ ID NO: 66729 - DNA, 24 bp, Artificial Sequence
  Synthetic oligonucleotide; ATAGAAA chr11 5235848 5235871 5235868 +
gcatgtgtgtatccaaagacatgt

SEQ ID NO: 66730 - DNA, 24 bp, Artificial Sequence
  Synthetic oligonucleotide; GTAGAAT chr11 5235917 5235940 5235937 +
tagccacttaaatgcttaccaaca

SEQ ID NO: 66731 - DNA, 24 bp, Artificial Sequence
  Synthetic oligonucleotide; AAAGAAT chr11 5235944 5235967 5235964 +
gaattgataaattacggtatagtc

SEQ ID NO: 66732 - DNA, 24 bp, Artificial Sequence
  Synthetic oligonucleotide; ATAGAAT chr11 5235949 5235972 5235969 +
gataaattacggtatagtcaaaga

SEQ ID NO: 66733 - DNA, 24 bp, Artificial Sequence
  Synthetic oligonucleotide; ACAGAAA chr11 5235961 5235984 5235981 +
tatagtcaaagaatagaatattac

SEQ ID NO: 66734 - DNA, 24 bp, Artificial Sequence
  Synthetic oligonucleotide; AAAGAAT chr11 5235971 5235994 5235991 +
gaatagaatattacacagaaatga

SEQ ID NO: 66735 - DNA, 24 bp, Artificial Sequence
  Synthetic oligonucleotide; ATAGAAA chr11 5236078 5236101 5236098 +
caaactatatgactttatttgtat

SEQ ID NO: 66736 - DNA, 24 bp, Artificial Sequence
  Synthetic oligonucleotide; CAAGAAA chr11 5236224 5236247 5236244 +
gccaacgaaagatattgaataatt

SEQ ID NO: 66737 - DNA, 24 bp, Artificial Sequence
  Synthetic oligonucleotide; GAAGAAA chr11 5236281 5236304 5236301 +
tttaaaagattattctcacttagt

SEQ ID NO: 66738 - DNA, 24 bp, Artificial Sequence
  Synthetic oligonucleotide; AGAGAAA chr11 5236302 5236325 5236322 +
agtgaagaaatgtattttagaagt

SEQ ID NO: 66739 - DNA, 24 bp, Artificial Sequence
  Synthetic oligonucleotide; GAAGAAA chr11 5236345 5236368 5236365 +
tagctgggcttctgttgcagtagg

SEQ ID NO: 66740 - DNA, 24 bp, Artificial Sequence
  Synthetic oligonucleotide; CAAGAAT chr11 5236411 5236434 5236431 +
tgacggtgatgtcagtcgtgaaca

SEQ ID NO: 66741 - DNA, 24 bp, Artificial Sequence
  Synthetic oligonucleotide; TCAGAAA chr11 5236453 5236476 5236473 +
tgtgagtttagtggtacgataaaa

SEQ ID NO: 66742 - DNA, 24 bp, Artificial Sequence
  Synthetic oligonucleotide; TCAGAAA chr11 5236537 5236560 5236557 +
tacttagatatgtggatctggagc

SEQ ID NO: 66743 - DNA, 24 bp, Artificial Sequence
  Synthetic oligonucleotide; AAAGAAT chr11 5236541 5236564 5236561 +
tagatatgtggatctggagctcag

SEQ ID NO: 66744 - DNA, 24 bp, Artificial Sequence
  Synthetic oligonucleotide; CAAGAAT chr11 5236558 5236581 5236578 +
agctcagaaagaatacaaccaggt

SEQ ID NO: 66745 - DNA, 24 bp, Artificial Sequence
  Synthetic oligonucleotide; ACAGAAT chr11 5236565 5236588 5236585 +
aaagaatacaaccaggtcaagaat

SEQ ID NO: 66746 - DNA, 24 bp, Artificial Sequence
  Synthetic oligonucleotide; TTAGAAT chr11 5236675 5236698 5236695 +
cttcatcaatatctccttaaaatc

SEQ ID NO: 66747 - DNA, 24 bp, Artificial Sequence
  Synthetic oligonucleotide; TAAGAAA chr11 5236720 5236743 5236740 +
ggaattatgtttccaattcatata

SEQ ID NO: 66748 - DNA, 24 bp, Artificial Sequence
  Synthetic oligonucleotide; ACAGAAT chr11 5236911 5236934 5236931 +
gattgcattgagaggatttgtata

SEQ ID NO: 66749 - DNA, 24 bp, Artificial Sequence
  Synthetic oligonucleotide; AAAGAAT chr11 5237244 5237267 5237264 +
agccaggataaggtctaaaagtgg

SEQ ID NO: 66750 - DNA, 24 bp, Artificial Sequence
  Synthetic oligonucleotide; GCAGAAT chr11 5237331 5237354 5237351 +
attaatagatagggacaaattgaa

SEQ ID NO: 66751 - DNA, 24 bp, Artificial Sequence
  Synthetic oligonucleotide; AGAGAAA chr11 5237432 5237455 5237452 +
atgactaaaatggaaaacactgga

SEQ ID NO: 66752 - DNA, 24 bp, Artificial Sequence
  Synthetic oligonucleotide; TTAGAAA chr11 5237561 5237584 5237581 +
ggcactgaggttggaggtcagagg

SEQ ID NO: 66753 - DNA, 24 bp, Artificial Sequence
  Synthetic oligonucleotide; TTAGAAT chr11 5237787 5237810 5237807 +
taattagtgtaatgccaatgtggg

SEQ ID NO: 66754 - DNA, 24 bp, Artificial Sequence
  Synthetic oligonucleotide; AGAGAAA chr11 5237959 5237982 5237979 +
aggtatactaaggactctagggtc

SEQ ID NO: 66755 - DNA, 24 bp, Artificial Sequence
  Synthetic oligonucleotide; ATAGAAA chr11 5238125 5238148 5238145 +
ggtgaaaccccctatctactaaaa

SEQ ID NO: 66756 - DNA, 24 bp, Artificial Sequence
  Synthetic oligonucleotide; GGAGAAT chr11 5238192 5238215 5238212 +
ccagctacttgggaggctgaggca

SEQ ID NO: 66757 - DNA, 24 bp, Artificial Sequence
  Synthetic oligonucleotide; TCAGAAA chr11 5238284 5238307 5238304 +
gggcaaccatagcaatgctctatc

SEQ ID NO: 66758 - DNA, 24 bp, Artificial Sequence
  Synthetic oligonucleotide; GTAGAAA chr11 5239348 5239371 5239368 +
tatggatagtgtaatactcataat

SEQ ID NO: 66759 - DNA, 24 bp, Artificial Sequence
  Synthetic oligonucleotide; TAAGAAA chr11 5239520 5239543 5239540 +
tagtaggaaaaacactaaatatta

SEQ ID NO: 66760 - DNA, 24 bp, Artificial Sequence
  Synthetic oligonucleotide; GCAGAAA chr11 5239718 5239741 5239738 +
tgtacaaagctaacagagtcaaat

SEQ ID NO: 66761 - DNA, 24 bp, Artificial Sequence
  Synthetic oligonucleotide; TAAGAAA chr11 5239830 5239853 5239850 +
catggaatgtttgttcatggagca

SEQ ID NO: 66762 - DNA, 24 bp, Artificial Sequence
  Synthetic oligonucleotide; AGAGAAT chr11 5239874 5239897 5239894 +
tagacacatctgtatgtgtatatc

SEQ ID NO: 66763 - DNA, 24 bp, Artificial Sequence
  Synthetic oligonucleotide; CGAGAAA chr11 5240012 5240035 5240032 +
aaggtgaatgtgaaaactcctcat

SEQ ID NO: 66764 - DNA, 24 bp, Artificial Sequence
  Synthetic oligonucleotide; AAAGAAT chr11 5240149 5240172 5240169 +
attgtttggacacagtaattattc

SEQ ID NO: 66765 - DNA, 24 bp, Artificial Sequence
  Synthetic oligonucleotide; TGAGAAA chr11 5240372 5240395 5240392 +
ggtggacacatagaggaaatactt

SEQ ID NO: 66766 - DNA, 24 bp, Artificial Sequence
  Synthetic oligonucleotide; GAAGAAA chr11 5240405 5240428 5240425 +
ggttttgggattaatgaaactgga

SEQ ID NO: 66767 - DNA, 24 bp, Artificial Sequence
  Synthetic oligonucleotide; ACAGAAT chr11 5240512 5240535 5240532 +
gtacaggagtttgaagtgattgcc

SEQ ID NO: 66768 - DNA, 24 bp, Artificial Sequence
  Synthetic oligonucleotide; CAAGAAA chr11 5240869 5240892 5240889 +
tatttattatgtcactctcatatg

SEQ ID NO: 66769 - DNA, 24 bp, Artificial Sequence
  Synthetic oligonucleotide; ATAGAAA chr11 5241150 5241173 5241170 +
atgcacacatgtgtgtgtatatat

SEQ ID NO: 66770 - DNA, 24 bp, Artificial Sequence
  Synthetic oligonucleotide; AGAGAAT chr11 5241156 5241179 5241176 +
acatgtgtgtgtatatatatagaa

SEQ ID NO: 66771 - DNA, 24 bp, Artificial Sequence
  Synthetic oligonucleotide; ATAGAAA chr11 5241204 5241227 5241224 +
aaacaataaaacttgtacatattt

SEQ ID NO: 66772 - DNA, 24 bp, Artificial Sequence
  Synthetic oligonucleotide; AGAGAAA chr11 5241462 5241485 5241482 +
ctattaataccattgaagacgtta

SEQ ID NO: 66773 - DNA, 24 bp, Artificial Sequence
  Synthetic oligonucleotide; CAAGAAA chr11 5241807 5241830 5241827 +
gttctctcttttcttgcaggattg

SEQ ID NO: 66774 - DNA, 24 bp, Artificial Sequence
  Synthetic oligonucleotide; TCAGAAA chr11 5241862 5241885 5241882 +
cattctccaacattctcatttcca

SEQ ID NO: 66775 - DNA, 24 bp, Artificial Sequence
  Synthetic oligonucleotide; ACAGAAA chr11 5241908 5241931 5241928 +
gctgaatcagggtaaaatataaag

SEQ ID NO: 66776 - DNA, 24 bp, Artificial Sequence
  Synthetic oligonucleotide; AAAGAAA chr11 5242246 5242269 5242266 +
agctggggagggagtgaagataaa

SEQ ID NO: 66777 - DNA, 24 bp, Artificial Sequence
  Synthetic oligonucleotide; AAAGAAT chr11 5242599 5242622 5242619 +
acaattttcccaaacactcataac

SEQ ID NO: 66778 - DNA, 24 bp, Artificial Sequence
  Synthetic oligonucleotide; GCAGAAA chr11 5242718 5242741 5242738 +
tctttttctaacctccaggactat

SEQ ID NO: 66779 - DNA, 24 bp, Artificial Sequence
  Synthetic oligonucleotide; ATAGAAA chr11 5242742 5242765 5242762 +
gcagaaaagtgactattaattttt

SEQ ID NO: 66780 - DNA, 24 bp, Artificial Sequence
  Synthetic oligonucleotide; CCAGAAT chr11 5242831 5242854 5242851 +
caaaaacactcagtttgattttgg

SEQ ID NO: 66781 - DNA, 24 bp, Artificial Sequence
  Synthetic oligonucleotide; AGAGAAA chr11 5242996 5243019 5243016 +
atcccatagctgactcataacaca

SEQ ID NO: 66782 - DNA, 24 bp, Artificial Sequence
  Synthetic oligonucleotide; GAAGAAA chr11 5243052 5243075 5243072 +
atagtgcaaatatctaagggtaaa

SEQ ID NO: 66783 - DNA, 24 bp, Artificial Sequence
  Synthetic oligonucleotide; TCAGAAA chr11 5243375 5243398 5243395 +
taagacaacgggctaatccctctt

SEQ ID NO: 66784 - DNA, 24 bp, Artificial Sequence
  Synthetic oligonucleotide; CCAGAAT chr11 5243430 5243453 5243450 +
tcccggcttccagtacctacctgc

SEQ ID NO: 66785 - DNA, 24 bp, Artificial Sequence
  Synthetic oligonucleotide; ATAGAAT chr11 5243764 5243787 5243784 +
gcaagatggacattcgagtttctg

SEQ ID NO: 66786 - DNA, 24 bp, Artificial Sequence
  Synthetic oligonucleotide; TAAGAAT chr11 5243952 5243975 5243972 +
ggaataagttacaactgaaaagga

SEQ ID NO: 66787 - DNA, 24 bp, Artificial Sequence
  Synthetic oligonucleotide; TTAGAAT chr11 5244458 5244481 5244478 +
gcgcccggccaatttcatcacttt

SEQ ID NO: 66788 - DNA, 24 bp, Artificial Sequence
  Synthetic oligonucleotide; ATAGAAA chr11 5244463 5244486 5244483 +
cggccaatttcatcactttttaga

SEQ ID NO: 66789 - DNA, 24 bp, Artificial Sequence
  Synthetic oligonucleotide; GAAGAAA chr11 5244497 5244520 5244517 +
acacctctatccagcatcaacttg

SEQ ID NO: 66790 - DNA, 24 bp, Artificial Sequence
  Synthetic oligonucleotide; GCAGAAT chr11 5244504 5244527 5244524 +
tatccagcatcaacttggaagaaa

SEQ ID NO: 66791 - DNA, 24 bp, Artificial Sequence
  Synthetic oligonucleotide; TAAGAAA chr11 5244510 5244533 5244530 +
gcatcaacttggaagaaagcagaa

SEQ ID NO: 66792 - DNA, 24 bp, Artificial Sequence
  Synthetic oligonucleotide; CAAGAAA chr11 5245042 5245065 5245062 +
tgttacccctgagataaatcctta

SEQ ID NO: 66793 - DNA, 24 bp, Artificial Sequence
  Synthetic oligonucleotide; GAAGAAA chr11 5245280 5245303 5245300 +
tttaagagcagagatcgatgatat

SEQ ID NO: 66794 - DNA, 24 bp, Artificial Sequence
  Synthetic oligonucleotide; AAAGAAT chr11 5245400 5245423 5245420 +
taatggccctaaaactcattccca

SEQ ID NO: 66795 - DNA, 24 bp, Artificial Sequence
  Synthetic oligonucleotide; TGAGAAT chr11 5245803 5245826 5245823 +
tatgccatccatttttcttaattc

SEQ ID NO: 66796 - DNA, 24 bp, Artificial Sequence
  Synthetic oligonucleotide; AAAGAAA chr11 5245890 5245913 5245910 +
cagaggagaccagcatacatacta

SEQ ID NO: 66797 - DNA, 24 bp, Artificial Sequence
  Synthetic oligonucleotide; GAAGAAA chr11 5245935 5245958 5245955 +
atttcagatggtattatatgactt

SEQ ID NO: 66798 - DNA, 24 bp, Artificial Sequence
  Synthetic oligonucleotide; TTAGAAA chr11 5245973 5245996 5245993 +
ttgtacctacaaccatctggtctt

SEQ ID NO: 66799 - DNA, 24 bp, Artificial Sequence
  Synthetic oligonucleotide; CTAGAAA chr11 5246149 5246172 5246169 +
gaaaaaccccaaactataaaaagc

SEQ ID NO: 66800 - DNA, 24 bp, Artificial Sequence
  Synthetic oligonucleotide; AAAGAAA chr11 5246287 5246310 5246307 +
aaactaaagagctcctgctcagca

SEQ ID NO: 66801 - DNA, 24 bp, Artificial Sequence
  Synthetic oligonucleotide; ACAGAAT chr11 5246319 5246342 5246339 +
taccatcagagcgaaagacaatct

SEQ ID NO: 66802 - DNA, 24 bp, Artificial Sequence
  Synthetic oligonucleotide; CAAGAAA chr11 5246381 5246404 5246401 +
caaaggcctaatatccagagtaaa

SEQ ID NO: 66803 - DNA, 24 bp, Artificial Sequence
  Synthetic oligonucleotide; CAAGAAA chr11 5246402 5246425 5246422 +
aaacaagaaacttaaacaacttta

SEQ ID NO: 66804 - DNA, 24 bp, Artificial Sequence
  Synthetic oligonucleotide; AAAGAAA chr11 5246509 5246532 5246529 +
ttaaggtaacagtaaattaaatta

SEQ ID NO: 66805 - DNA, 24 bp, Artificial Sequence
  Synthetic oligonucleotide; TCAGAAA chr11 5246531 5246554 5246551 +
taaaagaaaaatgccatggcaatg

SEQ ID NO: 66806 - DNA, 24 bp, Artificial Sequence
  Synthetic oligonucleotide; CAAGAAA chr11 5246600 5246623 5246620 +
tccaaaacttgtttaacatatcat

SEQ ID NO: 66807 - DNA, 24 bp, Artificial Sequence
  Synthetic oligonucleotide; CAAGAAA chr11 5246686 5246709 5246706 +
cattcgtttatttctttactctct

SEQ ID NO: 66808 - DNA, 24 bp, Artificial Sequence
  Synthetic oligonucleotide; AAAGAAA chr11 5246725 5246748 5246745 +
gacttaaaaaaaacaaaaaacaaa

SEQ ID NO: 66809 - DNA, 24 bp, Artificial Sequence
  Synthetic oligonucleotide; AAAGAAA chr11 5246729 5246752 5246749 +
taaaaaaaacaaaaaacaaaaaag

SEQ ID NO: 66810 - DNA, 24 bp, Artificial Sequence
  Synthetic oligonucleotide; GGAGAAA chr11 5246860 5246883 5246880 +
gcatgtgccaaattctgaggctga

SEQ ID NO: 66811 - DNA, 24 bp, Artificial Sequence
  Synthetic oligonucleotide; AAAGAAA chr11 5246867 5246890 5246887 +
ccaaattctgaggctgaggagaaa

SEQ ID NO: 66812 - DNA, 24 bp, Artificial Sequence
  Synthetic oligonucleotide; AAAGAAA chr11 5246871 5246894 5246891 +
attctgaggctgaggagaaaaaag

SEQ ID NO: 66813 - DNA, 24 bp, Artificial Sequence
  Synthetic oligonucleotide; AAAGAAA chr11 5246875 5246898 5246895 +
tgaggctgaggagaaaaaagaaag

SEQ ID NO: 66814 - DNA, 24 bp, Artificial Sequence
  Synthetic oligonucleotide; AAAGAAT chr11 5246883 5246906 5246903 +
aggagaaaaaagaaagaaagaaaa

SEQ ID NO: 66815 - DNA, 24 bp, Artificial Sequence
  Synthetic oligonucleotide; GGAGAAA chr11 5246960 5246983 5246980 +
gtaaagcatgttgaagtaaaaata

SEQ ID NO: 66816 - DNA, 24 bp, Artificial Sequence
  Synthetic oligonucleotide; AGAGAAA chr11 5247295 5247318 5247315 +
tcactgtgtcctcaccgggaggaa

SEQ ID NO: 66817 - DNA, 24 bp, Artificial Sequence
  Synthetic oligonucleotide; TTAGAAA chr11 5247801 5247824 5247821 +
agggctgtgaaaagctaagtgcca

SEQ ID NO: 66818 - DNA, 24 bp, Artificial Sequence
  Synthetic oligonucleotide; ATAGAAT chr11 5247827 5247850 5247847 +
agaaatagtattcctcctaataaa

SEQ ID NO: 66819 - DNA, 24 bp, Artificial Sequence
  Synthetic oligonucleotide; GCAGAAA chr11 5248155 5248178 5248175 +
cacaccacaaacacaaacaggcat

SEQ ID NO: 66820 - DNA, 24 bp, Artificial Sequence
  Synthetic oligonucleotide; GAAGAAA chr11 5248234 5248257 5248254 +
taaaaagatgtaaaaaaaagagct

SEQ ID NO: 66821 - DNA, 24 bp, Artificial Sequence
  Synthetic oligonucleotide; GCAGAAT chr11 5248259 5248282 5248279 +
aagaaaatcatgtgtgatctctca

SEQ ID NO: 66822 - DNA, 24 bp, Artificial Sequence
  Synthetic oligonucleotide; GCAGAAT chr11 5248288 5248311 5248308 +
atagatttattatttgtattgctt

SEQ ID NO: 66823 - DNA, 24 bp, Artificial Sequence
  Synthetic oligonucleotide; CCAGAAT chr11 5248555 5248578 5248575 +
gataactacacaccaagcttccac

SEQ ID NO: 66824 - DNA, 24 bp, Artificial Sequence
  Synthetic oligonucleotide; AAAGAAA chr11 5248716 5248739 5248736 +
gtatgttgtaggctgaagacgtta

SEQ ID NO: 66825 - DNA, 24 bp, Artificial Sequence
  Synthetic oligonucleotide; AAAGAAA chr11 5249090 5249113 5249110 +
aagttctttctactggaatctaat

SEQ ID NO: 66826 - DNA, 24 bp, Artificial Sequence
  Synthetic oligonucleotide; TTAGAAA chr11 5250549 5250572 5250569 +
gaaataaatcatgactgtttcatc

SEQ ID NO: 66827 - DNA, 24 bp, Artificial Sequence
  Synthetic oligonucleotide; GTAGAAT chr11 5250685 5250708 5250705 +
cttctatgctcagtaaagatgatg

SEQ ID NO: 66828 - DNA, 24 bp, Artificial Sequence
  Synthetic oligonucleotide; TTAGAAT chr11 5250714 5250737 5250734 +
atgttctttggcaggtactgtgga

SEQ ID NO: 66829 - DNA, 24 bp, Artificial Sequence
  Synthetic oligonucleotide; CCAGAAA chr11 5251209 5251232 5251229 +
tcattgatacagatggctaaaagg

SEQ ID NO: 66830 - DNA, 24 bp, Artificial Sequence
  Synthetic oligonucleotide; AAAGAAA chr11 5251508 5251531 5251528 +
tgttttactaaaaaaaaaaaggac

SEQ ID NO: 66831 - DNA, 24 bp, Artificial Sequence
  Synthetic oligonucleotide; AAAGAAA chr11 5251512 5251535 5251532 +
ttactaaaaaaaaaaaggacaaag

SEQ ID NO: 66832 - DNA, 24 bp, Artificial Sequence
  Synthetic oligonucleotide; GGAGAAA chr11 5251600 5251623 5251620 +
gatggagccaggcagaagacgttt

SEQ ID NO: 66833 - DNA, 24 bp, Artificial Sequence
  Synthetic oligonucleotide; AAAGAAA chr11 5251660 5251683 5251680 +
gaaaactctgaggctgaggaaaaa

SEQ ID NO: 66834 - DNA, 24 bp, Artificial Sequence
  Synthetic oligonucleotide; AAAGAAA chr11 5251664 5251687 5251684 +
actctgaggctgaggaaaaaaaag

SEQ ID NO: 66835 - DNA, 24 bp, Artificial Sequence
  Synthetic oligonucleotide; AAAGAAA chr11 5251668 5251691 5251688 +
tgaggctgaggaaaaaaaagaaag

SEQ ID NO: 66836 - DNA, 24 bp, Artificial Sequence
  Synthetic oligonucleotide; AAAGAAA chr11 5251678 5251701 5251698 +
gaaaaaaaagaaagaaagaaatat

SEQ ID NO: 66837 - DNA, 24 bp, Artificial Sequence
  Synthetic oligonucleotide; GAAGAAA chr11 5251735 5251758 5251755 +
cacattacaagcctaaagtacgtt

SEQ ID NO: 66838 - DNA, 24 bp, Artificial Sequence
  Synthetic oligonucleotide; ATAGAAT chr11 5251744 5251767 5251764 +
agcctaaagtacgttgaagaaaaa

SEQ ID NO: 66839 - DNA, 24 bp, Artificial Sequence
  Synthetic oligonucleotide; AGAGAAA chr11 5252074 5252097 5252094 +
cccactgtgtcctcaccagaagga

SEQ ID NO: 66840 - DNA, 24 bp, Artificial Sequence
  Synthetic oligonucleotide; AAAGAAA chr11 5252621 5252644 5252641 +
atcacttcattgtagttaccgtgg

SEQ ID NO: 66841 - DNA, 24 bp, Artificial Sequence
  Synthetic oligonucleotide; TGAGAAA chr11 5252687 5252710 5252707 +
ctccctgtagagcctcacaagggc

SEQ ID NO: 66842 - DNA, 24 bp, Artificial Sequence
  Synthetic oligonucleotide; ATAGAAT chr11 5252732 5252755 5252752 +
ggaaatagtattgcccctaataaa

SEQ ID NO: 66843 - DNA, 24 bp, Artificial Sequence
  Synthetic oligonucleotide; GCAGAAT chr11 5253178 5253201 5253198 +
aagacaaccatgtgtgatctctta

SEQ ID NO: 66844 - DNA, 24 bp, Artificial Sequence
  Synthetic oligonucleotide; GCAGAAT chr11 5253206 5253229 5253226 +
aatagatttattatttgattgctt

SEQ ID NO: 66845 - DNA, 24 bp, Artificial Sequence
  Synthetic oligonucleotide; CCAGAAT chr11 5253473 5253496 5253493 +
gataactacacaccaagcttccac

SEQ ID NO: 66846 - DNA, 24 bp, Artificial Sequence
  Synthetic oligonucleotide; AAAGAAA chr11 5253634 5253657 5253654 +
gtatgctgtaggctgaaaacgtta

SEQ ID NO: 66847 - DNA, 24 bp, Artificial Sequence
  Synthetic oligonucleotide; AAAGAAA chr11 5254014 5254037 5254034 +
aagttctttctaccgaaatctaat

SEQ ID NO: 66848 - DNA, 24 bp, Artificial Sequence
  Synthetic oligonucleotide; GTAGAAT chr11 5255616 5255639 5255636 +
cttctatgctcggtaaagatgatg

SEQ ID NO: 66849 - DNA, 24 bp, Artificial Sequence
  Synthetic oligonucleotide; TTAGAAT chr11 5255645 5255668 5255665 +
atgctctttaccagatactatgga

SEQ ID NO: 66850 - DNA, 24 bp, Artificial Sequence
  Synthetic oligonucleotide; TCAGAAA chr11 5255984 5256007 5256004 +
ccatgaccttggtagattatgacg

SEQ ID NO: 66851 - DNA, 24 bp, Artificial Sequence
  Synthetic oligonucleotide; CCAGAAA chr11 5256140 5256163 5256160 +
tcaaagtgttaggcggctaaaaga

SEQ ID NO: 66852 - DNA, 24 bp, Artificial Sequence
  Synthetic oligonucleotide; TAAGAAA chr11 5256219 5256242 5256239 +
ttggaagttaaaataaaagttgaa

SEQ ID NO: 66853 - DNA, 24 bp, Artificial Sequence
  Synthetic oligonucleotide; AAAGAAA chr11 5256228 5256251 5256248 +
aaaataaaagttgaataagaaagg

SEQ ID NO: 66854 - DNA, 24 bp, Artificial Sequence
  Synthetic oligonucleotide; TGAGAAA chr11 5256309 5256332 5256329 +
gacttctctcaatctaaggatggg

SEQ ID NO: 66855 - DNA, 24 bp, Artificial Sequence
  Synthetic oligonucleotide; TAAGAAT chr11 5256467 5256490 5256487 +
gttccatttgtagagcctgacctt

SEQ ID NO: 66856 - DNA, 24 bp, Artificial Sequence
  Synthetic oligonucleotide; AGAGAAT chr11 5257219 5257242 5257239 +
gtgggcatttaagttaaataagtc

SEQ ID NO: 66857 - DNA, 24 bp, Artificial Sequence
  Synthetic oligonucleotide; TAAGAAT chr11 5257317 5257340 5257337 +
aaaataatttcagatattattaac

SEQ ID NO: 66858 - DNA, 24 bp, Artificial Sequence
  Synthetic oligonucleotide; GGAGAAA chr11 5257332 5257355 5257352 +
attattaactaagaatgaaattaa

SEQ ID NO: 66859 - DNA, 24 bp, Artificial Sequence
  Synthetic oligonucleotide; GAAGAAA chr11 5257439 5257462 5257459 +
tagtaaattcaaagctctgaagca

SEQ ID NO: 66860 - DNA, 24 bp, Artificial Sequence
  Synthetic oligonucleotide; GGAGAAT chr11 5257505 5257528 5257525 +
accagtgccgttgatatgtaaagt

SEQ ID NO: 66861 - DNA, 24 bp, Artificial Sequence
  Synthetic oligonucleotide; ATAGAAT chr11 5257590 5257613 5257610 +
agtggtagggagtgagaagccatt

SEQ ID NO: 66862 - DNA, 24 bp, Artificial Sequence
  Synthetic oligonucleotide; TAAGAAT chr11 5257657 5257680 5257677 +
gtactattggctggattactattc

SEQ ID NO: 66863 - DNA, 24 bp, Artificial Sequence
  Synthetic oligonucleotide; GAAGAAA chr11 5257935 5257958 5257955 +
aaagggcagtatagttttggggga

SEQ ID NO: 66864 - DNA, 24 bp, Artificial Sequence
  Synthetic oligonucleotide; AGAGAAA chr11 5257951 5257974 5257971 +
ttgggggagaagaaaaagagagag

SEQ ID NO: 66865 - DNA, 24 bp, Artificial Sequence
  Synthetic oligonucleotide; GCAGAAA chr11 5258103 5258126 5258123 +
ggaattttttttgcagaaccacct

SEQ ID NO: 66866 - DNA, 24 bp, Artificial Sequence
  Synthetic oligonucleotide; CAAGAAA chr11 5258115 5258138 5258135 +
gcagaaccacctgcagaaataaat

SEQ ID NO: 66867 - DNA, 24 bp, Artificial Sequence
  Synthetic oligonucleotide; AAAGAAA chr11 5258466 5258489 5258486 +
ggaactgggaaaagatgacaggaa

SEQ ID NO: 66868 - DNA, 24 bp, Artificial Sequence
  Synthetic oligonucleotide; ACAGAAA chr11 5258842 5258865 5258862 +
cacccccatcctcccacagtagcc

SEQ ID NO: 66869 - DNA, 24 bp, Artificial Sequence
  Synthetic oligonucleotide; CTAGAAA chr11 5259017 5259040 5259037 +
cctgactgcctctgctgatgcttt

SEQ ID NO: 66870 - DNA, 24 bp, Artificial Sequence
  Synthetic oligonucleotide; CCAGAAA chr11 5259404 5259427 5259424 +
agagcctacccaagtgagaaggaa

SEQ ID NO: 66871 - DNA, 24 bp, Artificial Sequence
  Synthetic oligonucleotide; GAAGAAA chr11 5259495 5259518 5259515 +
tcaccagcaatgcatccaaaccaa

SEQ ID NO: 66872 - DNA, 24 bp, Artificial Sequence
  Synthetic oligonucleotide; CAAGAAA chr11 5259607 5259630 5259627 +
tttaaaaaaaccaaaaatatgata

SEQ ID NO: 66873 - DNA, 24 bp, Artificial Sequence
  Synthetic oligonucleotide; GGAGAAA chr11 5259619 5259642 5259639 +
aaaaatatgatacaagaaatgagg

SEQ ID NO: 66874 - DNA, 24 bp, Artificial Sequence
  Synthetic oligonucleotide; ATAGAAA chr11 5259699 5259722 5259719 +
aacaatggatgaatggatgcactt

SEQ ID NO: 66875 - DNA, 24 bp, Artificial Sequence
  Synthetic oligonucleotide; CTAGAAA chr11 5259717 5259740 5259737 +
gcacttatagaaatgcaaaatgct

SEQ ID NO: 66876 - DNA, 24 bp, Artificial Sequence
  Synthetic oligonucleotide; ATAGAAT chr11 5259733 5259756 5259753 +
aaaatgctctagaaagtctcagca

SEQ ID NO: 66877 - DNA, 24 bp, Artificial Sequence
  Synthetic oligonucleotide; GAAGAAA chr11 5259747 5259770 5259767 +
agtctcagcaatagaatccaagca

SEQ ID NO: 66878 - DNA, 24 bp, Artificial Sequence
  Synthetic oligonucleotide; AAAGAAA chr11 5259803 5259826 5259823 +
gaattaacccaatccaacaaagac

SEQ ID NO: 66879 - DNA, 24 bp, Artificial Sequence
  Synthetic oligonucleotide; AAAGAAT chr11 5259810 5259833 5259830 +
cccaatccaacaaagacaaagaaa

SEQ ID NO: 66880 - DNA, 24 bp, Artificial Sequence
  Synthetic oligonucleotide; TAAGAAA chr11 5259816 5259839 5259836 +
ccaacaaagacaaagaaaaaagaa

SEQ ID NO: 66881 - DNA, 24 bp, Artificial Sequence
  Synthetic oligonucleotide; CAAGAAA chr11 5259839 5259862 5259859 +
ataagaaaatatgaacaaagcctc

SEQ ID NO: 66882 - DNA, 24 bp, Artificial Sequence
  Synthetic oligonucleotide; TAAGAAT chr11 5259873 5259896 5259893 +
gggattatgttaaacaatcaaacc

SEQ ID NO: 66883 - DNA, 24 bp, Artificial Sequence
  Synthetic oligonucleotide; TGAGAAA chr11 5259892 5259915 5259912 +
aaacctaagaataatcagcattcc

SEQ ID NO: 66884 - DNA, 24 bp, Artificial Sequence
  Synthetic oligonucleotide; AGAGAAA chr11 5259901 5259924 5259921 +
aataatcagcattcctgagaaaga

SEQ ID NO: 66885 - DNA, 24 bp, Artificial Sequence
  Synthetic oligonucleotide; AGAGAAT chr11 5260082 5260105 5260102 +
gtatccaaagttatctaaagacaa

SEQ ID NO: 66886 - DNA, 24 bp, Artificial Sequence
  Synthetic oligonucleotide; AAAGAAA chr11 5260127 5260150 5260147 +
ggtgaaactaccaggtaacctatg

SEQ ID NO: 66887 - DNA, 24 bp, Artificial Sequence
  Synthetic oligonucleotide; GCAGAAA chr11 5260162 5260185 5260182 +
atcagattaacagcagatttctca

SEQ ID NO: 66888 - DNA, 24 bp, Artificial Sequence
  Synthetic oligonucleotide; CAAGAAT chr11 5260232 5260255 5260252 +
ttcttaaacaaaacaattatcagc

SEQ ID NO: 66889 - DNA, 24 bp, Artificial Sequence
  Synthetic oligonucleotide; GAAGAAA chr11 5260270 5260293 5260290 +
ccagtgaaactaagcttcacaaat

SEQ ID NO: 66890 - DNA, 24 bp, Artificial Sequence
  Synthetic oligonucleotide; TCAGAAA chr11 5260291 5260314 5260311 +
aatgaagaaaatacacagtgtttt

SEQ ID NO: 66891 - DNA, 24 bp, Artificial Sequence
  Synthetic oligonucleotide; AGAGAAT chr11 5260309 5260332 5260329 +
tgtttttcagaaaaacaaatgctg

SEQ ID NO: 66892 - DNA, 24 bp, Artificial Sequence
  Synthetic oligonucleotide; GAAGAAT chr11 5260478 5260501 5260498 +
agatacacaggcaacaaataccac

SEQ ID NO: 66893 - DNA, 24 bp, Artificial Sequence
  Synthetic oligonucleotide; ACAGAAT chr11 5260552 5260575 5260572 +
gactaaatgctccacttaaaagat

SEQ ID NO: 66894 - DNA, 24 bp, Artificial Sequence
  Synthetic oligonucleotide; GCAGAAT chr11 5260560 5260583 5260580 +
gctccacttaaaagatacagaatt

SEQ ID NO: 66895 - DNA, 24 bp, Artificial Sequence
  Synthetic oligonucleotide; TAAGAAT chr11 5260570 5260593 5260590 +
aaagatacagaattgcagaatgaa

SEQ ID NO: 66896 - DNA, 24 bp, Artificial Sequence
  Synthetic oligonucleotide; AAAGAAA chr11 5260731 5260754 5260751 +
cttatgtcagacaaaacaaacttt

SEQ ID NO: 66897 - DNA, 24 bp, Artificial Sequence
  Synthetic oligonucleotide; GGAGAAT chr11 5260796 5260819 5260816 +
aatgataaaagcccttgtccaatg

SEQ ID NO: 66898 - DNA, 24 bp, Artificial Sequence
  Synthetic oligonucleotide; AAAGAAA chr11 5260948 5260971 5260968 +
aggcaggtcatcaagacagtctac

SEQ ID NO: 66899 - DNA, 24 bp, Artificial Sequence
  Synthetic oligonucleotide; GCAGAAT chr11 5261016 5261039 5261036 +
tacaggacattctacccaacaact

SEQ ID NO: 66900 - DNA, 24 bp, Artificial Sequence
  Synthetic oligonucleotide; GTAGAAT chr11 5261143 5261166 5261163 +
tatcaagcactctctcagaccaca

SEQ ID NO: 66901 - DNA, 24 bp, Artificial Sequence
  Synthetic oligonucleotide; AGAGAAA chr11 5261361 5261384 5261381 +
agttctcgccaggacaatcaggca

SEQ ID NO: 66902 - DNA, 24 bp, Artificial Sequence
  Synthetic oligonucleotide; AAAGAAA chr11 5261365 5261388 5261385 +
ctcgccaggacaatcaggcaagag

SEQ ID NO: 66903 - DNA, 24 bp, Artificial Sequence
  Synthetic oligonucleotide; GCAGAAA chr11 5261520 5261543 5261540 +
agtctcaagatacaaaatcagtgt

SEQ ID NO: 66904 - DNA, 24 bp, Artificial Sequence
  Synthetic oligonucleotide; AGAGAAT chr11 5261606 5261629 5261626 +
aactcccattcacaattgctgcaa

SEQ ID NO: 66905 - DNA, 24 bp, Artificial Sequence
  Synthetic oligonucleotide; CTAGAAA chr11 5261625 5261648 5261645 +
tgcaaagagaataaaataaaatac

SEQ ID NO: 66906 - DNA, 24 bp, Artificial Sequence
  Synthetic oligonucleotide; ATAGAAA chr11 5261743 5261766 5261763 +
tggaaaaacattccatgctcatag

SEQ ID NO: 66907 - DNA, 24 bp, Artificial Sequence
  Synthetic oligonucleotide; AAAGAAT chr11 5261747 5261770 5261767 +
aaaacattccatgctcatagatag

SEQ ID NO: 66908 - DNA, 24 bp, Artificial Sequence
  Synthetic oligonucleotide; AAAGAAT chr11 5261836 5261859 5261856 +
atcaagctaccactgacttttttc

SEQ ID NO: 66909 - DNA, 24 bp, Artificial Sequence
  Synthetic oligonucleotide; TTAGAAA chr11 5261842 5261865 5261862 +
ctaccactgacttttttcaaagaa

SEQ ID NO: 66910 - DNA, 24 bp, Artificial Sequence
  Synthetic oligonucleotide; TCAGAAA chr11 5262037 5262060 5262057 +
gaccagtggaacagaacagaagcc

SEQ ID NO: 66911 - DNA, 24 bp, Artificial Sequence
  Synthetic oligonucleotide; GGAGAAA chr11 5262097 5262120 5262117 +
tttgacaaacatcacaaaagcaat

SEQ ID NO: 66912 - DNA, 24 bp, Artificial Sequence
  Synthetic oligonucleotide; AAAGAAT chr11 5262101 5262124 5262121 +
acaaacatcacaaaagcaatggag

SEQ ID NO: 66913 - DNA, 24 bp, Artificial Sequence
  Synthetic oligonucleotide; ACAGAAT chr11 5262417 5262440 5262437 +
atcatcagagtgaacaggcaacct

SEQ ID NO: 66914 - DNA, 24 bp, Artificial Sequence
  Synthetic oligonucleotide; GGAGAAA chr11 5262425 5262448 5262445 +
agtgaacaggcaacctacagaatg

SEQ ID NO: 66915 - DNA, 24 bp, Artificial Sequence
  Synthetic oligonucleotide; CAAGAAA chr11 5262500 5262523 5262520 +
ctacaaagaacttcaacaaattta

SEQ ID NO: 66916 - DNA, 24 bp, Artificial Sequence
  Synthetic oligonucleotide; CAAGAAA chr11 5262581 5262604 5262601 +
ctctaaagaagtcatttatgtggc

SEQ ID NO: 66917 - DNA, 24 bp, Artificial Sequence
  Synthetic oligonucleotide; AGAGAAA chr11 5262621 5262644 5262641 +
agaagctcatcatcactggtcatt

SEQ ID NO: 66918 - DNA, 24 bp, Artificial Sequence
  Synthetic oligonucleotide; TTAGAAT chr11 5262667 5262690 5262687 +
caatgagataccatctcatgccag

SEQ ID NO: 66919 - DNA, 24 bp, Artificial Sequence
  Synthetic oligonucleotide; GAAGAAT chr11 5262721 5262744 5262741 +
acaaaaggtgctggagaggatgtg

SEQ ID NO: 66920 - DNA, 24 bp, Artificial Sequence
  Synthetic oligonucleotide; CCAGAAA chr11 5262813 5262836 5262833 +
tggcgattcctcaaggatctagaa

SEQ ID NO: 66921 - DNA, 24 bp, Artificial Sequence
  Synthetic oligonucleotide; AAAGAAT chr11 5262860 5262883 5262880 +
aatcccattactgggtatataccc

SEQ ID NO: 66922 - DNA, 24 bp, Artificial Sequence
  Synthetic oligonucleotide; TTAGAAA chr11 5262866 5262889 5262886 +
attactgggtatatacccaaagaa

SEQ ID NO: 66923 - DNA, 24 bp, Artificial Sequence
  Synthetic oligonucleotide; AAAGAAA chr11 5262977 5263000 5262997 +
atggccatcagcgatataatggat

SEQ ID NO: 66924 - DNA, 24 bp, Artificial Sequence
  Synthetic oligonucleotide; AGAGAAA chr11 5263100 5263123 5263120 +
ttctgagcaaactaacacaggaac

SEQ ID NO: 66925 - DNA, 24 bp, Artificial Sequence
  Synthetic oligonucleotide; AAAGAAA chr11 5263232 5263255 5263252 +
ggggttaggagagggataacatta

SEQ ID NO: 66926 - DNA, 24 bp, Artificial Sequence
  Synthetic oligonucleotide; CAAGAAA chr11 5263509 5263532 5263529 +
gacagacaatataaggtcacacca

SEQ ID NO: 66927 - DNA, 24 bp, Artificial Sequence
  Synthetic oligonucleotide; AGAGAAA chr11 5263518 5263541 5263538 +
tataaggtcacaccacaagaaact

SEQ ID NO: 66928 - DNA, 24 bp, Artificial Sequence
  Synthetic oligonucleotide; AAAGAAA chr11 5263553 5263576 5263573 +
aacaaacagaaccaaaacccagca

SEQ ID NO: 66929 - DNA, 24 bp, Artificial Sequence
  Synthetic oligonucleotide; CAAGAAA chr11 5263691 5263714 5263711 +
tgatagaccattagcaagattaac

SEQ ID NO: 66930 - DNA, 24 bp, Artificial Sequence
  Synthetic oligonucleotide; TTAGAAA chr11 5263725 5263748 5263745 +
ggagagaagtgcaaataaactcaa

SEQ ID NO: 66931 - DNA, 24 bp, Artificial Sequence
  Synthetic oligonucleotide; ACAGAAA chr11 5263760 5263783 5263780 +
acaggagatactattactgatacc

SEQ ID NO: 66932 - DNA, 24 bp, Artificial Sequence
  Synthetic oligonucleotide; CTAGAAA chr11 5263814 5263837 5263834 +
tatgaacacctttacatgcataaa

SEQ ID NO: 66933 - DNA, 24 bp, Artificial Sequence
  Synthetic oligonucleotide; GAAGAAT chr11 5263876 5263899 5263896 +
atacagggctctagcttaagtcag

SEQ ID NO: 66934 - DNA, 24 bp, Artificial Sequence
  Synthetic oligonucleotide; GAAGAAT chr11 5264002 5264025 5264022 +
gctgaattctaccagacattcaaa

SEQ ID NO: 66935 - DNA, 24 bp, Artificial Sequence
  Synthetic oligonucleotide; AGAGAAA chr11 5264043 5264066 5264063 +
cctattgacagtattctacaagat

SEQ ID NO: 66936 - DNA, 24 bp, Artificial Sequence
  Synthetic oligonucleotide; AGAGAAT chr11 5264051 5264074 5264071 +
cagtattctacaagatagagaaag

SEQ ID NO: 66937 - DNA, 24 bp, Artificial Sequence
  Synthetic oligonucleotide; AGAGAAT chr11 5264300 5264323 5264320 +
caataagtgtgatacacaacataa

SEQ ID NO: 66938 - DNA, 24 bp, Artificial Sequence
  Synthetic oligonucleotide; ACAGAAA chr11 5264341 5264364 5264361 +
aatcatgtgattatctcaatagcc

SEQ ID NO: 66939 - DNA, 24 bp, Artificial Sequence
  Synthetic oligonucleotide; AGAGAAA chr11 5264581 5264604 5264601 +
agtcctagcaagagcaatcagaca

SEQ ID NO: 66940 - DNA, 24 bp, Artificial Sequence
  Synthetic oligonucleotide; AGAGAAA chr11 5264614 5264637 5264634 +
agtaaagcacatccaaattgttaa

SEQ ID NO: 66941 - DNA, 24 bp, Artificial Sequence
  Synthetic oligonucleotide; GTAGAAA chr11 5264660 5264683 5264680 +
tttgctgatgatatgattgtgtat

SEQ ID NO: 66942 - DNA, 24 bp, Artificial Sequence
  Synthetic oligonucleotide; TGAGAAT chr11 5264784 5264807 5264804 +
cttacataccagcaatgaccaagc

SEQ ID NO: 66943 - DNA, 24 bp, Artificial Sequence
  Synthetic oligonucleotide; GTAGAAT chr11 5264974 5264997 5264994 +
aacacatgccattctcatagatgg

SEQ ID NO: 66944 - DNA, 24 bp, Artificial Sequence
  Synthetic oligonucleotide; CTAGAAA chr11 5265069 5265092 5265089 +
ataccaccattagtcttcacagaa

SEQ ID NO: 66945 - DNA, 24 bp, Artificial Sequence
  Synthetic oligonucleotide; ACAGAAT chr11 5265247 5265270 5265267 +
caaataggcacatcgaccaatgga

SEQ ID NO: 66946 - DNA, 24 bp, Artificial Sequence
  Synthetic oligonucleotide; CCAGAAA chr11 5265261 5265284 5265281 +
gaccaatggaacagaatagagaac

SEQ ID NO: 66947 - DNA, 24 bp, Artificial Sequence
  Synthetic oligonucleotide; GGAGAAT chr11 5265382 5265405 5265402 +
gggatagctggcaagctacatgta

SEQ ID NO: 66948 - DNA, 24 bp, Artificial Sequence
  Synthetic oligonucleotide; CTAGAAA chr11 5265477 5265500 5265497 +
ctaagccctgaaactgtaacaatt

SEQ ID NO: 66949 - DNA, 24 bp, Artificial Sequence
  Synthetic oligonucleotide; AAAGAAA chr11 5265565 5265588 5265585 +
acacaaatgcaaatacataaaaac

SEQ ID NO: 66950 - DNA, 24 bp, Artificial Sequence
  Synthetic oligonucleotide; GCAGAAT chr11 5265626 5265649 5265646 +
tttgcatggcaaaaggaagagtct

SEQ ID NO: 66951 - DNA, 24 bp, Artificial Sequence
  Synthetic oligonucleotide; GGAGAAA chr11 5265654 5265677 5265674 +
aataaacagacaacccacagagtg

SEQ ID NO: 66952 - DNA, 24 bp, Artificial Sequence
  Synthetic oligonucleotide; AAAGAAT chr11 5265686 5265709 5265706 +
tcttcacaatctatacatctgaca

SEQ ID NO: 66953 - DNA, 24 bp, Artificial Sequence
  Synthetic oligonucleotide; CAAGAAA chr11 5265729 5265752 5265749 +
ctaaaatgaacacaaatagattat

SEQ ID NO: 66954 - DNA, 24 bp, Artificial Sequence
  Synthetic oligonucleotide; TCAGAAA chr11 5265787 5265810 5265807 +
gctaaggacatgaacagacaattc

SEQ ID NO: 66955 - DNA, 24 bp, Artificial Sequence
  Synthetic oligonucleotide; GGAGAAA chr11 5265950 5265973 5265970 +
aataacagatccttgtgaggatat

SEQ ID NO: 66956 - DNA, 24 bp, Artificial Sequence
  Synthetic oligonucleotide; AAAGAAA chr11 5266095 5266118 5266115 +
atctcactagtggttatttatcca

SEQ ID NO: 66957 - DNA, 24 bp, Artificial Sequence
  Synthetic oligonucleotide; AAAGAAT chr11 5266250 5266273 5266270 +
tgcacagtactattttgccatgaa

SEQ ID NO: 66958 - DNA, 24 bp, Artificial Sequence
  Synthetic oligonucleotide; ACAGAAA chr11 5266381 5266404 5266401 +
gatagataataaaataagccagat

SEQ ID NO: 66959 - DNA, 24 bp, Artificial Sequence
  Synthetic oligonucleotide; GTAGAAT chr11 5266453 5266476 5266473 +
aagtgggtctcatggtggtagaga

SEQ ID NO: 66960 - DNA, 24 bp, Artificial Sequence
  Synthetic oligonucleotide; CTAGAAA chr11 5266626 5266649 5266646 +
tatttattatatatttcaaaatgg

SEQ ID NO: 66961 - DNA, 24 bp, Artificial Sequence
  Synthetic oligonucleotide; ATAGAAA chr11 5266658 5266681 5266678 +
gaggatttgaaattttctcaatac

SEQ ID NO: 66962 - DNA, 24 bp, Artificial Sequence
  Synthetic oligonucleotide; TTAGAAT chr11 5267644 5267667 5267664 +
tcacgaagccctagcttgctggtt

SEQ ID NO: 66963 - DNA, 24 bp, Artificial Sequence
  Synthetic oligonucleotide; GAAGAAA chr11 5268333 5268356 5268353 +
ataaaattgcaatttttgattact

SEQ ID NO: 66964 - DNA, 24 bp, Artificial Sequence
  Synthetic oligonucleotide; CCAGAAT chr11 5268543 5268566 5268563 +
tgaactccttgccaaagtgagtag

SEQ ID NO: 66965 - DNA, 24 bp, Artificial Sequence
  Synthetic oligonucleotide; GTAGAAT chr11 5268884 5268907 5268904 +
agcaattgtctaatttttgtaaat

SEQ ID NO: 66966 - DNA, 24 bp, Artificial Sequence
  Synthetic oligonucleotide; TTAGAAA chr11 5268991 5269014 5269011 +
tactgatgggaaatttaacatatt

SEQ ID NO: 66967 - DNA, 24 bp, Artificial Sequence
  Synthetic oligonucleotide; CAAGAAA chr11 5270218 5270241 5270238 +
tccatctctcccattctccttttc

SEQ ID NO: 66968 - DNA, 24 bp, Artificial Sequence
  Synthetic oligonucleotide; AAAGAAA chr11 5270331 5270354 5270351 +
cagtgacaaaaacagggccaagga

SEQ ID NO: 66969 - DNA, 24 bp, Artificial Sequence
  Synthetic oligonucleotide; ACAGAAT chr11 5270352 5270375 5270372 +
ggaaaagaaaataaagctgttaaa

SEQ ID NO: 66970 - DNA, 24 bp, Artificial Sequence
  Synthetic oligonucleotide; CTAGAAA chr11 5270453 5270476 5270473 +
gacaaaaaccgtacatagttcctt

SEQ ID NO: 66971 - DNA, 24 bp, Artificial Sequence
  Synthetic oligonucleotide; ACAGAAT chr11 5270464 5270487 5270484 +
tacatagttccttctagaaactga

SEQ ID NO: 66972 - DNA, 24 bp, Artificial Sequence
  Synthetic oligonucleotide; ACAGAAA chr11 5270547 5270570 5270567 +
ggggtgattccctagagaggacag

SEQ ID NO: 66973 - DNA, 24 bp, Artificial Sequence
  Synthetic oligonucleotide; AGAGAAT chr11 5270574 5270597 5270594 +
gaaaagattacatccagtgcttcc

SEQ ID NO: 66974 - DNA, 24 bp, Artificial Sequence
  Synthetic oligonucleotide; CCAGAAT chr11 5270732 5270755 5270752 +
ctaaaatcctaaaattatttaaag

SEQ ID NO: 66975 - DNA, 24 bp, Artificial Sequence
  Synthetic oligonucleotide; AGAGAAA chr11 5270751 5270774 5270771 +
taaagccagaatttgtcatcaaac

SEQ ID NO: 66976 - DNA, 24 bp, Artificial Sequence
  Synthetic oligonucleotide; GAAGAAT chr11 5270925 5270948 5270945 +
gtattcaattcgatccatgtgcct

SEQ ID NO: 66977 - DNA, 24 bp, Artificial Sequence
  Synthetic oligonucleotide; TTAGAAT chr11 5270992 5271015 5271012 +
taccattgtcattatcctcatatt

SEQ ID NO: 66978 - DNA, 24 bp, Artificial Sequence
  Synthetic oligonucleotide; ACAGAAA chr11 5271013 5271036 5271033 +
attttagaatcaaggaataaattc

SEQ ID NO: 66979 - DNA, 24 bp, Artificial Sequence
  Synthetic oligonucleotide; TAAGAAT chr11 5271748 5271771 5271768 +
aaaaaaaaaaacacttgtggcaag

SEQ ID NO: 66980 - DNA, 24 bp, Artificial Sequence
  Synthetic oligonucleotide; GGAGAAT chr11 5272385 5272408 5272405 +
ccagctactcaggaggccaaggca

SEQ ID NO: 66981 - DNA, 24 bp, Artificial Sequence
  Synthetic oligonucleotide; GAAGAAA chr11 5272607 5272630 5272627 +
agtttgtcctttgcattcaaagta

SEQ ID NO: 66982 - DNA, 24 bp, Artificial Sequence
  Synthetic oligonucleotide; CAAGAAA chr11 5273287 5273310 5273307 +
gctaaaggtggtagggaggagctt

SEQ ID NO: 66983 - DNA, 24 bp, Artificial Sequence
  Synthetic oligonucleotide; TCAGAAA chr11 5273553 5273576 5273573 +
agtgttatggccatccaggataga

SEQ ID NO: 66984 - DNA, 24 bp, Artificial Sequence
  Synthetic oligonucleotide; TCAGAAA chr11 5273570 5273593 5273590 +
ggatagatcagaaagattagacag

SEQ ID NO: 66985 - DNA, 24 bp, Artificial Sequence
  Synthetic oligonucleotide; TAAGAAT chr11 5273587 5273610 5273607 +
tagacagtcagaaaaagtaatcag

SEQ ID NO: 66986 - DNA, 24 bp, Artificial Sequence
  Synthetic oligonucleotide; TTAGAAA chr11 5273673 5273696 5273693 +
aagacatttaagtataaaggactt

SEQ ID NO: 66987 - DNA, 24 bp, Artificial Sequence
  Synthetic oligonucleotide; AAAGAAA chr11 5273677 5273700 5273697 +
catttaagtataaaggacttttag

SEQ ID NO: 66988 - DNA, 24 bp, Artificial Sequence
  Synthetic oligonucleotide; TAAGAAA chr11 5273971 5273994 5273991 +
ctgaatgtttttcatggtattatc

SEQ ID NO: 66989 - DNA, 24 bp, Artificial Sequence
  Synthetic oligonucleotide; AAAGAAT chr11 5274296 5274319 5274316 +
gtggctattttctagtgtaattgt

SEQ ID NO: 66990 - DNA, 24 bp, Artificial Sequence
  Synthetic oligonucleotide; AGAGAAT chr11 5274304 5274327 5274324 +
tttctagtgtaattgtaaagaatg

SEQ ID NO: 66991 - DNA, 24 bp, Artificial Sequence
  Synthetic oligonucleotide; GTAGAAA chr11 5274807 5274830 5274827 +
agggatctttaatgggaaaaagga

SEQ ID NO: 66992 - DNA, 24 bp, Artificial Sequence
  Synthetic oligonucleotide; CCAGAAT chr11 5274815 5274838 5274835 +
ttaatgggaaaaaggagtagaaag

SEQ ID NO: 66993 - DNA, 24 bp, Artificial Sequence
  Synthetic oligonucleotide; TTAGAAA chr11 5274886 5274909 5274906 +
aggttaaaacttgagtctgtcaac

SEQ ID NO: 66994 - DNA, 24 bp, Artificial Sequence
  Synthetic oligonucleotide; TAAGAAA chr11 5275007 5275030 5275027 +
catttattttcatgattaaaattc

SEQ ID NO: 66995 - DNA, 24 bp, Artificial Sequence
  Synthetic oligonucleotide; ATAGAAA chr11 5275069 5275092 5275089 +
ctaatgtatttatgaactaagaac

SEQ ID NO: 66996 - DNA, 24 bp, Artificial Sequence
  Synthetic oligonucleotide; TCAGAAT chr11 5275098 5275121 5275118 +
aataaaacaatactctgaagtagt

SEQ ID NO: 66997 - DNA, 24 bp, Artificial Sequence
  Synthetic oligonucleotide; CTAGAAA chr11 5275175 5275198 5275195 +
agtgcagggctttgaatcttatgt

SEQ ID NO: 66998 - DNA, 24 bp, Artificial Sequence
  Synthetic oligonucleotide; AAAGAAA chr11 5275671 5275694 5275691 +
ttgaggctaaggcatctgtgaagg

SEQ ID NO: 66999 - DNA, 24 bp, Artificial Sequence
  Synthetic oligonucleotide; TCAGAAA chr11 5275913 5275936 5275933 +
tgggatggtgatagctgggcagcg

SEQ ID NO: 67000 - DNA, 24 bp, Artificial Sequence
  Synthetic oligonucleotide; TCAGAAT chr11 5275998 5276021 5276018 +
gggcctagctaaaggcagtgagag

SEQ ID NO: 67001 - DNA, 24 bp, Artificial Sequence
  Synthetic oligonucleotide; ATAGAAA chr11 5276059 5276082 5276079 +
cttggtttctacacaagtagatac

SEQ ID NO: 67002 - DNA, 24 bp, Artificial Sequence
  Synthetic oligonucleotide; TCAGAAA chr11 5276108 5276131 5276128 +
tgagagtcctgcatgattagttgc

SEQ ID NO: 67003 - DNA, 24 bp, Artificial Sequence
  Synthetic oligonucleotide; GGAGAAA chr11 5276421 5276444 5276441 +
ggggctaggggaaggatagcatta

SEQ ID NO: 67004 - DNA, 24 bp, Artificial Sequence
  Synthetic oligonucleotide; ACAGAAT chr11 5276583 5276606 5276603 +
cccacaattcttaactataatctt

SEQ ID NO: 67005 - DNA, 24 bp, Artificial Sequence
  Synthetic oligonucleotide; ACAGAAA chr11 5276645 5276668 5276665 +
agagatttggacagccaggaaagc

SEQ ID NO: 67006 - DNA, 24 bp, Artificial Sequence
  Synthetic oligonucleotide; TAAGAAT chr11 5277204 5277227 5277224 +
attcattcaaaattgtaaaattgc

SEQ ID NO: 67007 - DNA, 24 bp, Artificial Sequence
  Synthetic oligonucleotide; ACAGAAT chr11 5277222 5277245 5277242 +
aattgctaagaatacagcacaaaa

SEQ ID NO: 67008 - DNA, 24 bp, Artificial Sequence
  Synthetic oligonucleotide; GGAGAAA chr11 5277330 5277353 5277350 +
tataccaatgagattaggtgctat

SEQ ID NO: 67009 - DNA, 24 bp, Artificial Sequence
  Synthetic oligonucleotide; TTAGAAT chr11 5277547 5277570 5277567 +
aaataccctaaagatgtaagatgc

SEQ ID NO: 67010 - DNA, 24 bp, Artificial Sequence
  Synthetic oligonucleotide; GGAGAAT chr11 5277602 5277625 5277622 +
atgtaggatgagattcggtgaagg

SEQ ID NO: 67011 - DNA, 24 bp, Artificial Sequence
  Synthetic oligonucleotide; TAAGAAA chr11 5277679 5277702 5277699 +
aataatacctacatcatagagttg

SEQ ID NO: 67012 - DNA, 24 bp, Artificial Sequence
  Synthetic oligonucleotide; AGAGAAT chr11 5277787 5277810 5277807 +
aatatatgcatgaacaactattgt

SEQ ID NO: 67013 - DNA, 24 bp, Artificial Sequence
  Synthetic oligonucleotide; GAAGAAA chr11 5277908 5277931 5277928 +
agactaatttggatagtatattgg

SEQ ID NO: 67014 - DNA, 24 bp, Artificial Sequence
  Synthetic oligonucleotide; AGAGAAT chr11 5278079 5278102 5278099 +
gaaaaaccaacaggattttctgac

SEQ ID NO: 67015 - DNA, 24 bp, Artificial Sequence
  Synthetic oligonucleotide; TCAGAAT chr11 5278241 5278264 5278261 +
tgtttgttcatcacagtctctacc

SEQ ID NO: 67016 - DNA, 24 bp, Artificial Sequence
  Synthetic oligonucleotide; TGAGAAA chr11 5278288 5278311 5278308 +
aagctgggtgggtggatatggaaa

SEQ ID NO: 67017 - DNA, 24 bp, Artificial Sequence
  Synthetic oligonucleotide; ACAGAAT chr11 5278455 5278478 5278475 +
gtagataagtcagagaacaatcag

SEQ ID NO: 67018 - DNA, 24 bp, Artificial Sequence
  Synthetic oligonucleotide; GTAGAAT chr11 5278959 5278982 5278979 +
ccctgatgagtttttcctccatgt

SEQ ID NO: 67019 - DNA, 24 bp, Artificial Sequence
  Synthetic oligonucleotide; ATAGAAT chr11 5278978 5279001 5278998 +
catgtgtagaattgaataagaagg

SEQ ID NO: 67020 - DNA, 24 bp, Artificial Sequence
  Synthetic oligonucleotide; AGAGAAA chr11 5279048 5279071 5279068 +
attgtgctgacaactatgttagag

SEQ ID NO: 67021 - DNA, 24 bp, Artificial Sequence
  Synthetic oligonucleotide; CTAGAAT chr11 5280542 5280565 5280562 +
tatatattcaggaaataatatatt

SEQ ID NO: 67022 - DNA, 24 bp, Artificial Sequence
  Synthetic oligonucleotide; ACAGAAA chr11 5280883 5280906 5280903 +
atgggaggtcactaatggagacac

SEQ ID NO: 67023 - DNA, 24 bp, Artificial Sequence
  Synthetic oligonucleotide; TAAGAAT chr11 5281053 5281076 5281073 +
tattttcagtgcttgaatcataaa

SEQ ID NO: 67024 - DNA, 24 bp, Artificial Sequence
  Synthetic oligonucleotide; AAAGAAT chr11 5281427 5281450 5281447 +
tagaggtatttatgggatggggga

SEQ ID NO: 67025 - DNA, 24 bp, Artificial Sequence
  Synthetic oligonucleotide; GGAGAAT chr11 5281465 5281488 5281485 +
tcactgtggattattttagagagt

SEQ ID NO: 67026 - DNA, 24 bp, Artificial Sequence
  Synthetic oligonucleotide; TAAGAAA chr11 5281493 5281516 5281513 +
aatggtcaagatttttttaaaaat

SEQ ID NO: 67027 - DNA, 24 bp, Artificial Sequence
  Synthetic oligonucleotide; TGAGAAA chr11 5281515 5281538 5281535 +
attaagaaaacataagttggacct

SEQ ID NO: 67028 - DNA, 24 bp, Artificial Sequence
  Synthetic oligonucleotide; TCAGAAA chr11 5281708 5281731 5281728 +
gcctttctcctctctcctttctca

SEQ ID NO: 67029 - DNA, 24 bp, Artificial Sequence
  Synthetic oligonucleotide; TAAGAAA chr11 5281748 5281771 5281768 +
tctactagggtcaggcagatcaca

SEQ ID NO: 67030 - DNA, 24 bp, Artificial Sequence
  Synthetic oligonucleotide; CCAGAAA chr11 5281868 5281891 5281888 +
gagattaggaggggccaaatgagc

SEQ ID NO: 67031 - DNA, 24 bp, Artificial Sequence
  Synthetic oligonucleotide; ATAGAAT chr11 5281960 5281983 5281980 +
taggatgataatatgtattagcta

SEQ ID NO: 67032 - DNA, 24 bp, Artificial Sequence
  Synthetic oligonucleotide; AAAGAAT chr11 5282090 5282113 5282110 +
actattacagttgcatgctacctt

SEQ ID NO: 67033 - DNA, 24 bp, Artificial Sequence
  Synthetic oligonucleotide; TGAGAAA chr11 5282404 5282427 5282424 +
ggaaatacaataatggctaatttt

SEQ ID NO: 67034 - DNA, 24 bp, Artificial Sequence
  Synthetic oligonucleotide; TGAGAAA chr11 5282482 5282505 5282502 +
gagttcttccattctttttacaga

SEQ ID NO: 67035 - DNA, 24 bp, Artificial Sequence
  Synthetic oligonucleotide; GGAGAAA chr11 5282531 5282554 5282551 +
atgattttaaagtagttagcatat

SEQ ID NO: 67036 - DNA, 24 bp, Artificial Sequence
  Synthetic oligonucleotide; AGAGAAT chr11 5282597 5282620 5282617 +
gtcagacccggcaaagggagatgc

SEQ ID NO: 67037 - DNA, 24 bp, Artificial Sequence
  Synthetic oligonucleotide; TTAGAAT chr11 5282693 5282716 5282713 +
agggccctcagttcttgacgctag

SEQ ID NO: 67038 - DNA, 24 bp, Artificial Sequence
  Synthetic oligonucleotide; AGAGAAA chr11 5282942 5282965 5282962 +
tcatatgacaatctctgtaaccca

SEQ ID NO: 67039 - DNA, 24 bp, Artificial Sequence
  Synthetic oligonucleotide; GAAGAAA chr11 5283011 5283034 5283031 +
cctttttctccctcaaactttcct

SEQ ID NO: 67040 - DNA, 24 bp, Artificial Sequence
  Synthetic oligonucleotide; ACAGAAT chr11 5283901 5283924 5283921 +
agtatgttcaataatacatatctc

SEQ ID NO: 67041 - DNA, 24 bp, Artificial Sequence
  Synthetic oligonucleotide; ATAGAAA chr11 5283956 5283979 5283976 +
atatcataaaatggcacctgacat

SEQ ID NO: 67042 - DNA, 24 bp, Artificial Sequence
  Synthetic oligonucleotide; GTAGAAT chr11 5284614 5284637 5284634 +
ataggggagcagtcccatgtagta

SEQ ID NO: 67043 - DNA, 24 bp, Artificial Sequence
  Synthetic oligonucleotide; ACAGAAT chr11 5284977 5285000 5284997 +
tcttcatggctgtctcctttatcc

SEQ ID NO: 67044 - DNA, 24 bp, Artificial Sequence
  Synthetic oligonucleotide; GGAGAAA chr11 5285629 5285652 5285649 +
tcaactagccaggggctggactgt

SEQ ID NO: 67045 - DNA, 24 bp, Artificial Sequence
  Synthetic oligonucleotide; CAAGAAT chr11 5285943 5285966 5285963 +
tgttgataatctgattcatgcaac

SEQ ID NO: 67046 - DNA, 24 bp, Artificial Sequence
  Synthetic oligonucleotide; CAAGAAA chr11 5286015 5286038 5286035 +
ttgtgcatatgatggggtagcaga

SEQ ID NO: 67047 - DNA, 24 bp, Artificial Sequence
  Synthetic oligonucleotide; GTAGAAA chr11 5286093 5286116 5286113 +
atcaagaccagccttttgctcagg

SEQ ID NO: 67048 - DNA, 24 bp, Artificial Sequence
  Synthetic oligonucleotide; GAAGAAT chr11 5286220 5286243 5286240 +
atgtttatgaaattcttacacaca

SEQ ID NO: 67049 - DNA, 24 bp, Artificial Sequence
  Synthetic oligonucleotide; AAAGAAT chr11 5286861 5286884 5286881 +
ggggataataatagtatctacctg

SEQ ID NO: 67050 - DNA, 24 bp, Artificial Sequence
  Synthetic oligonucleotide; CAAGAAT chr11 5287006 5287029 5287026 +
cagaacactagttttcacctgcag

SEQ ID NO: 67051 - DNA, 24 bp, Artificial Sequence
  Synthetic oligonucleotide; GAAGAAA chr11 5287454 5287477 5287474 +
taaaaaaccctccattttacagat

SEQ ID NO: 67052 - DNA, 24 bp, Artificial Sequence
  Synthetic oligonucleotide; AGAGAAA chr11 5287480 5287503 5287500 +
agaaactgagtcatacaactacta

SEQ ID NO: 67053 - DNA, 24 bp, Artificial Sequence
  Synthetic oligonucleotide; TGAGAAT chr11 5287647 5287670 5287667 +
gctaagttctttcctaaaggtatg

SEQ ID NO: 67054 - DNA, 24 bp, Artificial Sequence
  Synthetic oligonucleotide; TGAGAAT chr11 5287734 5287757 5287754 +
acactcagtgggcctgggtgaagg

SEQ ID NO: 67055 - DNA, 24 bp, Artificial Sequence
  Synthetic oligonucleotide; AGAGAAA chr11 5287910 5287933 5287930 +
tactccagactcctacttataaaa

SEQ ID NO: 67056 - DNA, 24 bp, Artificial Sequence
  Synthetic oligonucleotide; AGAGAAA chr11 5288329 5288352 5288349 +
catctcatagctgctgagtgggag

SEQ ID NO: 67057 - DNA, 24 bp, Artificial Sequence
  Synthetic oligonucleotide; TAAGAAA chr11 5288385 5288408 5288405 +
tcatggctattcttattctcacac

SEQ ID NO: 67058 - DNA, 24 bp, Artificial Sequence
  Synthetic oligonucleotide; AAAGAAT chr11 5288391 5288414 5288411 +
ctattcttattctcacactaagaa

SEQ ID NO: 67059 - DNA, 24 bp, Artificial Sequence
  Synthetic oligonucleotide; GTAGAAA chr11 5288646 5288669 5288666 +
tgttattcctgtttcaatggctta

SEQ ID NO: 67060 - DNA, 24 bp, Artificial Sequence
  Synthetic oligonucleotide; TAAGAAA chr11 5288771 5288794 5288791 +
aataactttatattgttactactc

SEQ ID NO: 67061 - DNA, 24 bp, Artificial Sequence
  Synthetic oligonucleotide; AGAGAAA chr11 5288798 5288821 5288818 +
gaaagttacaacatggtgaataca

SEQ ID NO: 67062 - DNA, 24 bp, Artificial Sequence
  Synthetic oligonucleotide; CCAGAAA chr11 5288817 5288840 5288837 +
atacaagagaaagctattacaagt

SEQ ID NO: 67063 - DNA, 24 bp, Artificial Sequence
  Synthetic oligonucleotide; TTAGAAT chr11 5289398 5289421 5289418 +
gtgactgtagggttgagagggaga

SEQ ID NO: 67064 - DNA, 24 bp, Artificial Sequence
  Synthetic oligonucleotide; CCAGAAA chr11 5289587 5289610 5289607 +
actacctggggataaatatttcct

SEQ ID NO: 67065 - DNA, 24 bp, Artificial Sequence
  Synthetic oligonucleotide; AAAGAAA chr11 5289662 5289685 5289682 +
ttgtctattttccctgaagttctc

SEQ ID NO: 67066 - DNA, 24 bp, Artificial Sequence
  Synthetic oligonucleotide; TGAGAAT chr11 5289805 5289828 5289825 +
ttccaaggtctgttgcatcaagag

SEQ ID NO: 67067 - DNA, 24 bp, Artificial Sequence
  Synthetic oligonucleotide; TCAGAAA chr11 5289931 5289954 5289951 +
catctacaaagcatgagttgtggg

SEQ ID NO: 67068 - DNA, 24 bp, Artificial Sequence
  Synthetic oligonucleotide; TCAGAAT chr11 5289970 5289993 5289990 +
cacatcttttgacttcctttgaca

SEQ ID NO: 67069 - DNA, 24 bp, Artificial Sequence
  Synthetic oligonucleotide; TGAGAAT chr11 5290361 5290384 5290381 +
tctttcaacatcctcataataact

SEQ ID NO: 67070 - DNA, 24 bp, Artificial Sequence
  Synthetic oligonucleotide; TAAGAAT chr11 5290602 5290625 5290622 +
cttattatagttcctagcacaaag

SEQ ID NO: 67071 - DNA, 24 bp, Artificial Sequence
  Synthetic oligonucleotide; TGAGAAA chr11 5290791 5290814 5290811 +
caggttacatagctagtatataac

SEQ ID NO: 67072 - DNA, 24 bp, Artificial Sequence
  Synthetic oligonucleotide; TTAGAAA chr11 5290901 5290924 5290921 +
accttctcaatatcacttcttcac

SEQ ID NO: 67073 - DNA, 24 bp, Artificial Sequence
  Synthetic oligonucleotide; TGAGAAA chr11 5290954 5290977 5290974 +
atgaatcctttcaaaatatacttc

SEQ ID NO: 67074 - DNA, 24 bp, Artificial Sequence
  Synthetic oligonucleotide; AGAGAAA chr11 5290967 5290990 5290987 +
aaatatacttctgagaaatgagag

SEQ ID NO: 67075 - DNA, 24 bp, Artificial Sequence
  Synthetic oligonucleotide; AAAGAAA chr11 5291029 5291052 5291049 +
agagacagggaaggaggtgtgggg

SEQ ID NO: 67076 - DNA, 24 bp, Artificial Sequence
  Synthetic oligonucleotide; AAAGAAA chr11 5291124 5291147 5291144 +
ttgccatttctggactcttgaaat

SEQ ID NO: 67077 - DNA, 24 bp, Artificial Sequence
  Synthetic oligonucleotide; TTAGAAA chr11 5291215 5291238 5291235 +
tactaactagcctttgctttatta

SEQ ID NO: 67078 - DNA, 24 bp, Artificial Sequence
  Synthetic oligonucleotide; GGAGAAA chr11 5291277 5291300 5291297 +
gatatattaggaaaaagggaaact

SEQ ID NO: 67079 - DNA, 24 bp, Artificial Sequence
  Synthetic oligonucleotide; AGAGAAA chr11 5291501 5291524 5291521 +
aggaaatataatccactaataaaa

SEQ ID NO: 67080 - DNA, 24 bp, Artificial Sequence
  Synthetic oligonucleotide; GGAGAAA chr11 5291863 5291886 5291883 +
gtgaagcacgtccaagtgaaggca

SEQ ID NO: 67081 - DNA, 24 bp, Artificial Sequence
  Synthetic oligonucleotide; CAAGAAA chr11 5291879 5291902 5291899 +
tgaaggcaggagaaatgagaggag

SEQ ID NO: 67082 - DNA, 24 bp, Artificial Sequence
  Synthetic oligonucleotide; CAAGAAT chr11 5291901 5291924 5291921 +
agcaagaaagaggagccatttgat

SEQ ID NO: 67083 - DNA, 24 bp, Artificial Sequence
  Synthetic oligonucleotide; GCAGAAA chr11 5291909 5291932 5291929 +
agaggagccatttgatcaagaata

SEQ ID NO: 67084 - DNA, 24 bp, Artificial Sequence
  Synthetic oligonucleotide; GAAGAAT chr11 5292078 5292101 5292098 +
ttccataaaggagaacctaaagag

SEQ ID NO: 67085 - DNA, 24 bp, Artificial Sequence
  Synthetic oligonucleotide; AGAGAAA chr11 5292270 5292293 5292290 +
tgatgatacccatataaataacgt

SEQ ID NO: 67086 - DNA, 24 bp, Artificial Sequence
  Synthetic oligonucleotide; TTAGAAA chr11 5292642 5292665 5292662 +
atgtgtcaggatgcagtaatagat

SEQ ID NO: 67087 - DNA, 24 bp, Artificial Sequence
  Synthetic oligonucleotide; TGAGAAA chr11 5292708 5292731 5292728 +
tcaatcgaggaaaacctatgaaaa

SEQ ID NO: 67088 - DNA, 24 bp, Artificial Sequence
  Synthetic oligonucleotide; GCAGAAT chr11 5292813 5292836 5292833 +
taaagaacttgaaattgcattata

SEQ ID NO: 67089 - DNA, 24 bp, Artificial Sequence
  Synthetic oligonucleotide; TCAGAAT chr11 5293040 5293063 5293060 +
cttcctgtgattgactttatcatt

SEQ ID NO: 67090 - DNA, 24 bp, Artificial Sequence
  Synthetic oligonucleotide; AGAGAAT chr11 5293078 5293101 5293098 +
tttctgccacatagaggaagggaa

SEQ ID NO: 67091 - DNA, 24 bp, Artificial Sequence
  Synthetic oligonucleotide; CAAGAAT chr11 5293274 5293297 5293294 +
gtgggttcttggtttcactgactt

SEQ ID NO: 67092 - DNA, 24 bp, Artificial Sequence
  Synthetic oligonucleotide; CCAGAAA chr11 5294798 5294821 5294818 +
gagccggctctggccttggccagc

SEQ ID NO: 67093 - DNA, 24 bp, Artificial Sequence
  Synthetic oligonucleotide; GCAGAAA chr11 5295618 5295641 5295638 +
tagtctctttcagagaacatcatg

SEQ ID NO: 67094 - DNA, 24 bp, Artificial Sequence
  Synthetic oligonucleotide; AGAGAAT chr11 5295635 5295658 5295655 +
catcatggcagaaacattttttca

SEQ ID NO: 67095 - DNA, 24 bp, Artificial Sequence
  Synthetic oligonucleotide; ACAGAAA chr11 5295912 5295935 5295932 +
gaagcaactagaaccaagttacac

SEQ ID NO: 67096 - DNA, 24 bp, Artificial Sequence
  Synthetic oligonucleotide; TGAGAAT chr11 5296124 5296147 5296144 +
ttctgagatgtttatagtgataag

SEQ ID NO: 67097 - DNA, 24 bp, Artificial Sequence
  Synthetic oligonucleotide; GAAGAAA chr11 5296244 5296267 5296264 +
cagcagatttgtattattttatgt

SEQ ID NO: 67098 - DNA, 24 bp, Artificial Sequence
  Synthetic oligonucleotide; TCAGAAT chr11 5296252 5296275 5296272 +
ttgtattattttatgtgaagaaac

SEQ ID NO: 67099 - DNA, 24 bp, Artificial Sequence
  Synthetic oligonucleotide; AAAGAAA chr11 5296585 5296608 5296605 +
ttgtaacatgatgaggagacatgg

SEQ ID NO: 67100 - DNA, 24 bp, Artificial Sequence
  Synthetic oligonucleotide; TGAGAAT chr11 5296927 5296950 5296947 +
atgttcactatgatacctacttat

SEQ ID NO: 67101 - DNA, 24 bp, Artificial Sequence
  Synthetic oligonucleotide; GCAGAAA chr11 5297078 5297101 5297098 +
tattcataaacattgccaatgcat

SEQ ID NO: 67102 - DNA, 24 bp, Artificial Sequence
  Synthetic oligonucleotide; ACAGAAA chr11 5297225 5297248 5297245 +
tccccacacccaaatcttcaacag

SEQ ID NO: 67103 - DNA, 24 bp, Artificial Sequence
  Synthetic oligonucleotide; AGAGAAA chr11 5297306 5297329 5297326 +
tattcatctgacagcataggaagg

SEQ ID NO: 67104 - DNA, 24 bp, Artificial Sequence
  Synthetic oligonucleotide; AGAGAAA chr11 5297624 5297647 5297644 +
tatctaggcttttcaaactacctt

SEQ ID NO: 67105 - DNA, 24 bp, Artificial Sequence
  Synthetic oligonucleotide; AGAGAAT chr11 5297922 5297945 5297942 +
tgagggaatattcatgagacaaac

SEQ ID NO: 67106 - DNA, 24 bp, Artificial Sequence
  Synthetic oligonucleotide; AAAGAAA chr11 5297929 5297952 5297949 +
atattcatgagacaaacagagaat

SEQ ID NO: 67107 - DNA, 24 bp, Artificial Sequence
  Synthetic oligonucleotide; CTAGAAA chr11 5297984 5298007 5298004 +
ggcatgttaatatacaagtgattt

SEQ ID NO: 67108 - DNA, 24 bp, Artificial Sequence
  Synthetic oligonucleotide; CTAGAAA chr11 5298008 5298031 5298028 +
ctagaaagtgcatgaataagacag

SEQ ID NO: 67109 - DNA, 24 bp, Artificial Sequence
  Synthetic oligonucleotide; ATAGAAA chr11 5298016 5298039 5298036 +
tgcatgaataagacagctagaaag

SEQ ID NO: 67110 - DNA, 24 bp, Artificial Sequence
  Synthetic oligonucleotide; AGAGAAA chr11 5298064 5298087 5298084 +
gtgaatgtgaaacagttctggctg

SEQ ID NO: 67111 - DNA, 24 bp, Artificial Sequence
  Synthetic oligonucleotide; ACAGAAT chr11 5298510 5298533 5298530 +
ctgcattaataaatttgggggttt

SEQ ID NO: 67112 - DNA, 24 bp, Artificial Sequence
  Synthetic oligonucleotide; AGAGAAT chr11 5298595 5298618 5298615 +
ccctgactaaactcacagtatgac

SEQ ID NO: 67113 - DNA, 24 bp, Artificial Sequence
  Synthetic oligonucleotide; TAAGAAA chr11 5298930 5298953 5298950 +
aaaacgcataaatatacatttact

SEQ ID NO: 67114 - DNA, 24 bp, Artificial Sequence
  Synthetic oligonucleotide; CAAGAAA chr11 5299209 5299232 5299229 +
tgtaggctgtcttcttataacaat

SEQ ID NO: 67115 - DNA, 24 bp, Artificial Sequence
  Synthetic oligonucleotide; CCAGAAA chr11 5299409 5299432 5299429 +
ttttagaccaaacaacaaaggcaa

SEQ ID NO: 67116 - DNA, 24 bp, Artificial Sequence
  Synthetic oligonucleotide; ATAGAAT chr11 5299429 5299452 5299449 +
gcaaccagaaaacgacgtttctaa

SEQ ID NO: 67117 - DNA, 24 bp, Artificial Sequence
  Synthetic oligonucleotide; AGAGAAT chr11 5299483 5299506 5299503 +
aaaacaaataaataaattttacac

SEQ ID NO: 67118 - DNA, 24 bp, Artificial Sequence
  Synthetic oligonucleotide; GGAGAAA chr11 5299633 5299656 5299653 +
gcatccaaatgggccttctaattt

SEQ ID NO: 67119 - DNA, 24 bp, Artificial Sequence
  Synthetic oligonucleotide; AGAGAAT chr11 5299759 5299782 5299779 +
tgaaagatttcttaagtgaagcag

SEQ ID NO: 67120 - DNA, 24 bp, Artificial Sequence
  Synthetic oligonucleotide; TTAGAAT chr11 5299766 5299789 5299786 +
tttcttaagtgaagcagagagaat

SEQ ID NO: 67121 - DNA, 24 bp, Artificial Sequence
  Synthetic oligonucleotide; TCAGAAA chr11 5299812 5299835 5299832 +
tgggttctgaacatggactttcaa

SEQ ID NO: 67122 - DNA, 24 bp, Artificial Sequence
  Synthetic oligonucleotide; AAAGAAA chr11 5299817 5299840 5299837 +
tctgaacatggactttcaatcaga

SEQ ID NO: 67123 - DNA, 24 bp, Artificial Sequence
  Synthetic oligonucleotide; GAAGAAA chr11 5299860 5299883 5299880 +
agctcaacgagaacttaaaaattg

SEQ ID NO: 67124 - DNA, 24 bp, Artificial Sequence
  Synthetic oligonucleotide; GAAGAAA chr11 5299960 5299983 5299980 +
actagcgcagaactagcagtagat

SEQ ID NO: 67125 - DNA, 24 bp, Artificial Sequence
  Synthetic oligonucleotide; GAAGAAA chr11 5300063 5300086 5300083 +
caaacactttgaagaagattgaag

SEQ ID NO: 67126 - DNA, 24 bp, Artificial Sequence
  Synthetic oligonucleotide; ATAGAAA chr11 5300196 5300219 5300216 +
tttatgtgagaagcaagaggggaa

SEQ ID NO: 67127 - DNA, 24 bp, Artificial Sequence
  Synthetic oligonucleotide; GAAGAAA chr11 5300244 5300267 5300264 +
atttatagttggttatttttttca

SEQ ID NO: 67128 - DNA, 24 bp, Artificial Sequence
  Synthetic oligonucleotide; ATAGAAA chr11 5300267 5300290 5300287 +
agaagaaaaatgtcaggagacaaa

SEQ ID NO: 67129 - DNA, 24 bp, Artificial Sequence
  Synthetic oligonucleotide; GAAGAAA chr11 5300282 5300305 5300302 +
ggagacaaaatagaaagctggaaa

SEQ ID NO: 67130 - DNA, 24 bp, Artificial Sequence
  Synthetic oligonucleotide; TAAGAAA chr11 5300363 5300386 5300383 +
ggatatctggcttccacgagatga

SEQ ID NO: 67131 - DNA, 24 bp, Artificial Sequence
  Synthetic oligonucleotide; CCAGAAA chr11 5300951 5300974 5300971 +
ttccttttcagtaatgggagaggc

SEQ ID NO: 67132 - DNA, 24 bp, Artificial Sequence
  Synthetic oligonucleotide; CCAGAAA chr11 5301006 5301029 5301026 +
ataagggctcaagccctactctgc

SEQ ID NO: 67133 - DNA, 24 bp, Artificial Sequence
  Synthetic oligonucleotide; AGAGAAA chr11 5301085 5301108 5301105 +
tgataggattcacgaatggaggaa

SEQ ID NO: 67134 - DNA, 24 bp, Artificial Sequence
  Synthetic oligonucleotide; TAAGAAA chr11 5301279 5301302 5301299 +
atcactgtcttgaggattagtata

SEQ ID NO: 67135 - DNA, 24 bp, Artificial Sequence
  Synthetic oligonucleotide; AAAGAAT chr11 5301448 5301471 5301468 +
cacaatatgggtagcagtagagtg

SEQ ID NO: 67136 - DNA, 24 bp, Artificial Sequence
  Synthetic oligonucleotide; TAAGAAT chr11 5301523 5301546 5301543 +
ctatgttcatcactcgggaattgg

SEQ ID NO: 67137 - DNA, 24 bp, Artificial Sequence
  Synthetic oligonucleotide; CTAGAAT chr11 5302108 5302131 5302128 +
agcctgtactcacaaggcctttcc

SEQ ID NO: 67138 - DNA, 24 bp, Artificial Sequence
  Synthetic oligonucleotide; TCAGAAT chr11 5302136 5302159 5302156 +
aataacaaataacaaaaatcatgg

SEQ ID NO: 67139 - DNA, 24 bp, Artificial Sequence
  Synthetic oligonucleotide; ATAGAAA chr11 5302406 5302429 5302426 +
accactgaggaaaatgcttattca

SEQ ID NO: 67140 - DNA, 24 bp, Artificial Sequence
  Synthetic oligonucleotide; TGAGAAA chr11 5302417 5302440 5302437 +
aaatgcttattcaatagaaatgac

SEQ ID NO: 67141 - DNA, 24 bp, Artificial Sequence
  Synthetic oligonucleotide; AAAGAAA chr11 5302517 5302540 5302537 +
tagaccctgcctccaccaaaaaaa

SEQ ID NO: 67142 - DNA, 24 bp, Artificial Sequence
  Synthetic oligonucleotide; AAAGAAA chr11 5302669 5302692 5302689 +
taaaaaataaaataaaataaaacg

SEQ ID NO: 67143 - DNA, 24 bp, Artificial Sequence
  Synthetic oligonucleotide; ACAGAAA chr11 5302700 5302723 5302720 +
ataactcatctattgtgagtttcc

SEQ ID NO: 67144 - DNA, 24 bp, Artificial Sequence
  Synthetic oligonucleotide; TTAGAAA chr11 5302748 5302771 5302768 +
gtgggtaaagttagtaaactcatt

SEQ ID NO: 67145 - DNA, 24 bp, Artificial Sequence
  Synthetic oligonucleotide; AGAGAAA chr11 5303047 5303070 5303067 +
tagggaaaagataagcactcccag

SEQ ID NO: 67146 - DNA, 24 bp, Artificial Sequence
  Synthetic oligonucleotide; TGAGAAA chr11 5303127 5303150 5303147 +
attatgaatctgtaagactcgtat

SEQ ID NO: 67147 - DNA, 24 bp, Artificial Sequence
  Synthetic oligonucleotide; CAAGAAA chr11 5303241 5303264 5303261 +
tcaagatttttgttgttgtgatac

SEQ ID NO: 67148 - DNA, 24 bp, Artificial Sequence
  Synthetic oligonucleotide; ATAGAAA chr11 5303450 5303473 5303470 +
accttttttattttataaaaacct

SEQ ID NO: 67149 - DNA, 24 bp, Artificial Sequence
  Synthetic oligonucleotide; TCAGAAT chr11 5303475 5303498 5303495 +
tagaaacaataataattatatgtt

SEQ ID NO: 67150 - DNA, 24 bp, Artificial Sequence
  Synthetic oligonucleotide; AGAGAAT chr11 5303783 5303806 5303803 +
ttaaccttccaatgttgccttata

SEQ ID NO: 67151 - DNA, 24 bp, Artificial Sequence
  Synthetic oligonucleotide; CCAGAAA chr11 5304110 5304133 5304130 +
ttaattgtggcaaatttggtagta

SEQ ID NO: 67152 - DNA, 24 bp, Artificial Sequence
  Synthetic oligonucleotide; GGAGAAT chr11 5304142 5304165 5304162 +
tgtccacatacccaaatattccag

SEQ ID NO: 67153 - DNA, 24 bp, Artificial Sequence
  Synthetic oligonucleotide; CTAGAAT chr11 5304176 5304199 5304196 +
tgccctaatagtttagggagtctc

SEQ ID NO: 67154 - DNA, 24 bp, Artificial Sequence
  Synthetic oligonucleotide; AGAGAAT chr11 5304473 5304496 5304493 +
ataaactaaaatgagaagacaaaa

SEQ ID NO: 67155 - DNA, 24 bp, Artificial Sequence
  Synthetic oligonucleotide; GAAGAAA chr11 5304609 5304632 5304629 +
ttgccccaaaattgtgttcctata

SEQ ID NO: 67156 - DNA, 24 bp, Artificial Sequence
  Synthetic oligonucleotide; GGAGAAT chr11 5304939 5304962 5304959 +
ccagctactcgggaggctgaggca

SEQ ID NO: 67157 - DNA, 24 bp, Artificial Sequence
  Synthetic oligonucleotide; AGAGAAA chr11 5305064 5305087 5305084 +
aaaaaaaaaaaaaaaaaggtttgg

SEQ ID NO: 67158 - DNA, 24 bp, Artificial Sequence
  Synthetic oligonucleotide; AAAGAAA chr11 5305106 5305129 5305126 +
taggacaaattttgctctcagtaa

SEQ ID NO: 67159 - DNA, 24 bp, Artificial Sequence
  Synthetic oligonucleotide; ATAGAAT chr11 5305245 5305268 5305265 +
tatggtaggttaatagtgaaaaat

SEQ ID NO: 67160 - DNA, 24 bp, Artificial Sequence
  Synthetic oligonucleotide; GCAGAAA chr11 5305332 5305355 5305352 +
aatattgacaatttcaacataatg

SEQ ID NO: 67161 - DNA, 24 bp, Artificial Sequence
  Synthetic oligonucleotide; TGAGAAT chr11 5305569 5305592 5305589 +
ccagctactctggaggctgaggca

SEQ ID NO: 67162 - DNA, 24 bp, Artificial Sequence
  Synthetic oligonucleotide; AGAGAAA chr11 5305644 5305667 5305664 +
ccactgcactctagcctgggcaac

SEQ ID NO: 67163 - DNA, 24 bp, Artificial Sequence
  Synthetic oligonucleotide; AGAGAAA chr11 5305669 5305692 5305689 +
gagaaaaatctgttaaagagagag

SEQ ID NO: 67164 - DNA, 24 bp, Artificial Sequence
  Synthetic oligonucleotide; AAAGAAA chr11 5305674 5305697 5305694 +
aaatctgttaaagagagagagaga

SEQ ID NO: 67165 - DNA, 24 bp, Artificial Sequence
  Synthetic oligonucleotide; CAAGAAA chr11 5305694 5305717 5305714 +
gagaaaagaaaagtgagtaaaaaa

SEQ ID NO: 67166 - DNA, 24 bp, Artificial Sequence
  Synthetic oligonucleotide; CCAGAAT chr11 5306659 5306682 5306679 +
actccttatatttaggtctgatct

SEQ ID NO: 67167 - DNA, 24 bp, Artificial Sequence
  Synthetic oligonucleotide; CCAGAAT chr11 5307182 5307205 5307202 +
aggtcatacagcaataaatgcatt

SEQ ID NO: 67168 - DNA, 24 bp, Artificial Sequence
  Synthetic oligonucleotide; AGAGAAA chr11 5307558 5307581 5307578 +
taatttttacatcaatcatggttc

SEQ ID NO: 67169 - DNA, 24 bp, Artificial Sequence
  Synthetic oligonucleotide; GAAGAAA chr11 5307583 5307606 5307603 +
gagaaaaatccataacaacatcaa

SEQ ID NO: 67170 - DNA, 24 bp, Artificial Sequence
  Synthetic oligonucleotide; AAAGAAA chr11 5308127 5308150 5308147 +
ctaaatagctagaccaatacatga

SEQ ID NO: 67171 - DNA, 24 bp, Artificial Sequence
  Synthetic oligonucleotide; AGAGAAA chr11 5308236 5308259 5308256 +
tatcagttatgttaccatatagga

SEQ ID NO: 67172 - DNA, 24 bp, Artificial Sequence
  Synthetic oligonucleotide; AAAGAAA chr11 5308240 5308263 5308260 +
agttatgttaccatataggaagag

SEQ ID NO: 67173 - DNA, 24 bp, Artificial Sequence
  Synthetic oligonucleotide; GCAGAAA chr11 5308908 5308931 5308928 +
aaaactataacttgaagtttcata

SEQ ID NO: 67174 - DNA, 24 bp, Artificial Sequence
  Synthetic oligonucleotide; TGAGAAA chr11 5308938 5308961 5308958 +
agttggcatctttctcactaagca

SEQ ID NO: 67175 - DNA, 24 bp, Artificial Sequence
  Synthetic oligonucleotide; TGAGAAA chr11 5309257 5309280 5309277 +
attaggaacttactgggcacatta

SEQ ID NO: 67176 - DNA, 24 bp, Artificial Sequence
  Synthetic oligonucleotide; ACAGAAA chr11 5309431 5309454 5309451 +
gaaaaagttttaatacaaggacat

SEQ ID NO: 67177 - DNA, 24 bp, Artificial Sequence
  Synthetic oligonucleotide; GGAGAAT chr11 5309720 5309743 5309740 +
ccagctactcgggaggctgaggca

SEQ ID NO: 67178 - DNA, 24 bp, Artificial Sequence
  Synthetic oligonucleotide; CCAGAAA chr11 5310106 5310129 5310126 +
caaggcactgaaaacttcctttct

SEQ ID NO: 67179 - DNA, 24 bp, Artificial Sequence
  Synthetic oligonucleotide; GCAGAAT chr11 5310166 5310189 5310186 +
attccaaggaatattctttgaaaa

SEQ ID NO: 67180 - DNA, 24 bp, Artificial Sequence
  Synthetic oligonucleotide; GTAGAAT chr11 5310208 5310231 5310228 +
gaggaagtagagagatatatttag

SEQ ID NO: 67181 - DNA, 24 bp, Artificial Sequence
  Synthetic oligonucleotide; ATAGAAA chr11 5310262 5310285 5310282 +
tcaataattcacagtagccaagga

SEQ ID NO: 67182 - DNA, 24 bp, Artificial Sequence
  Synthetic oligonucleotide; ATAGAAT chr11 5310324 5310347 5310344 +
tcaacaaaatgtcttatatatgtg

SEQ ID NO: 67183 - DNA, 24 bp, Artificial Sequence
  Synthetic oligonucleotide; CTAGAAT chr11 5310454 5310477 5310474 +
tctgatttcacttacatgagctat

SEQ ID NO: 67184 - DNA, 24 bp, Artificial Sequence
  Synthetic oligonucleotide; TTAGAAA chr11 5310577 5310600 5310597 +
ttttatttggtgtaatacaaaatt

SEQ ID NO: 67185 - DNA, 24 bp, Artificial Sequence
  Synthetic oligonucleotide; ATAGAAT chr11 5310896 5310919 5310916 +
agaccatttatttgattttaataa

SEQ ID NO: 67186 - DNA, 24 bp, Artificial Sequence
  Synthetic oligonucleotide; AGAGAAA chr11 5310931 5310954 5310951 +
tggttgactcaacaatttcacttg

SEQ ID NO: 67187 - DNA, 24 bp, Artificial Sequence
  Synthetic oligonucleotide; AAAGAAT chr11 5310935 5310958 5310955 +
tgactcaacaatttcacttgagag

SEQ ID NO: 67188 - DNA, 24 bp, Artificial Sequence
  Synthetic oligonucleotide; TCAGAAT chr11 5311097 5311120 5311117 +
cttgttatttactcatctggtaat

SEQ ID NO: 67189 - DNA, 24 bp, Artificial Sequence
  Synthetic oligonucleotide; CAAGAAA chr11 5311249 5311272 5311269 +
gggtctacttcagtgaatgacacc

SEQ ID NO: 67190 - DNA, 24 bp, Artificial Sequence
  Synthetic oligonucleotide; AAAGAAA chr11 5311428 5311451 5311448 +
ctatgactcttcatgatcaggcaa

SEQ ID NO: 67191 - DNA, 24 bp, Artificial Sequence
  Synthetic oligonucleotide; TCAGAAA chr11 5311678 5311701 5311698 +
cactgcctttcttccaagaacatg

SEQ ID NO: 67192 - DNA, 24 bp, Artificial Sequence
  Synthetic oligonucleotide; TTAGAAT chr11 5312102 5312125 5312122 +
gtctccacacacactccttcagtc

SEQ ID NO: 67193 - DNA, 24 bp, Artificial Sequence
  Synthetic oligonucleotide; GAAGAAA chr11 5312338 5312361 5312358 +
tccccacttatttgaagactttaa

SEQ ID NO: 67194 - DNA, 24 bp, Artificial Sequence
  Synthetic oligonucleotide; TAAGAAA chr11 5312550 5312573 5312570 +
gtacaaataaattaggcaaaagta

SEQ ID NO: 67195 - DNA, 24 bp, Artificial Sequence
  Synthetic oligonucleotide; ACAGAAA chr11 5312680 5312703 5312700 +
taaattgtgtatatagcaagacaa

SEQ ID NO: 67196 - DNA, 24 bp, Artificial Sequence
  Synthetic oligonucleotide; TTAGAAT chr11 5312848 5312871 5312868 +
caaattgagatcacttgtgattta

SEQ ID NO: 67197 - DNA, 24 bp, Artificial Sequence
  Synthetic oligonucleotide; TCAGAAA chr11 5312916 5312939 5312936 +
attatatttcatctattggacata

SEQ ID NO: 67198 - DNA, 24 bp, Artificial Sequence
  Synthetic oligonucleotide; AAAGAAA chr11 5312959 5312982 5312979 +
gcatttagagagaacacaagatca

SEQ ID NO: 67199 - DNA, 24 bp, Artificial Sequence
  Synthetic oligonucleotide; AAAGAAA chr11 5313056 5313079 5313076 +
tatagatgacattgtatcattttg

SEQ ID NO: 67200 - DNA, 24 bp, Artificial Sequence
  Synthetic oligonucleotide; AAAGAAA chr11 5313140 5313163 5313160 +
aaattaaagagcttctgcacagca

SEQ ID NO: 67201 - DNA, 24 bp, Artificial Sequence
  Synthetic oligonucleotide; ACAGAAT chr11 5313173 5313196 5313193 +
atcatcagagataacagacaacct

SEQ ID NO: 67202 - DNA, 24 bp, Artificial Sequence
  Synthetic oligonucleotide; GAAGAAA chr11 5313181 5313204 5313201 +
agataacagacaacctacagaata

SEQ ID NO: 67203 - DNA, 24 bp, Artificial Sequence
  Synthetic oligonucleotide; CAAGAAA chr11 5313256 5313279 5313276 +
ctatgaggaactaaaacaaattta

SEQ ID NO: 67204 - DNA, 24 bp, Artificial Sequence
  Synthetic oligonucleotide; TTAGAAA chr11 5313374 5313397 5313394 +
aaaaaagctcaaccttactggtca

SEQ ID NO: 67205 - DNA, 24 bp, Artificial Sequence
  Synthetic oligonucleotide; TCAGAAT chr11 5313422 5313445 5313442 +
caatgggataccatctcacaccag

SEQ ID NO: 67206 - DNA, 24 bp, Artificial Sequence
  Synthetic oligonucleotide; CAAGAAA chr11 5313446 5313469 5313466 +
tcagaatggcaattattaaaaagt

SEQ ID NO: 67207 - DNA, 24 bp, Artificial Sequence
  Synthetic oligonucleotide; AGAGAAA chr11 5313477 5313500 5313497 +
caacagttgctggcaaggttgcag

SEQ ID NO: 67208 - DNA, 24 bp, Artificial Sequence
  Synthetic oligonucleotide; GCAGAAA chr11 5313573 5313596 5313593 +
tagcctttcctcaaagatgtagaa

SEQ ID NO: 67209 - DNA, 24 bp, Artificial Sequence
  Synthetic oligonucleotide; AAAGAAA chr11 5313737 5313760 5313757 +
atgtccatcaatgatagagtggat

SEQ ID NO: 67210 - DNA, 24 bp, Artificial Sequence
  Synthetic oligonucleotide; ACAGAAA chr11 5313860 5313883 5313880 +
tatcctcatcaaactaacacagga

SEQ ID NO: 67211 - DNA, 24 bp, Artificial Sequence
  Synthetic oligonucleotide; ACAGAAA chr11 5313888 5313911 5313908 +
aaaaccaaacacacatgttctcac

SEQ ID NO: 67212 - DNA, 24 bp, Artificial Sequence
  Synthetic oligonucleotide; GAAGAAT chr11 5313991 5314014 5314011 +
tggggaggagagggagagcaccag

SEQ ID NO: 67213 - DNA, 24 bp, Artificial Sequence
  Synthetic oligonucleotide; CCAGAAA chr11 5314709 5314732 5314729 +
ctcctttccaattactcaaaaggc

SEQ ID NO: 67214 - DNA, 24 bp, Artificial Sequence
  Synthetic oligonucleotide; CCAGAAA chr11 5314764 5314787 5314784 +
aaaagggctcaagccattctgtgc

SEQ ID NO: 67215 - DNA, 24 bp, Artificial Sequence
  Synthetic oligonucleotide; AAAGAAA chr11 5314842 5314865 5314862 +
taatagggttcatgaatggaggaa

SEQ ID NO: 67216 - DNA, 24 bp, Artificial Sequence
  Synthetic oligonucleotide; TAAGAAA chr11 5315037 5315060 5315057 +
ttaactgttttaaggatcaggata

SEQ ID NO: 67217 - DNA, 24 bp, Artificial Sequence
  Synthetic oligonucleotide; GAAGAAA chr11 5315066 5315089 5315086 +
aaagacaatgatcagagcgtctag

SEQ ID NO: 67218 - DNA, 24 bp, Artificial Sequence
  Synthetic oligonucleotide; CCAGAAT chr11 5315083 5315106 5315103 +
cgtctaggaagaaaatcaaagcaa

SEQ ID NO: 67219 - DNA, 24 bp, Artificial Sequence
  Synthetic oligonucleotide; GGAGAAA chr11 5315149 5315172 5315169 +
aggcaagtttcaggacatcttgat

SEQ ID NO: 67220 - DNA, 24 bp, Artificial Sequence
  Synthetic oligonucleotide; GCAGAAT chr11 5315206 5315229 5315226 +
gacaatatgggaagcaatggagtg

SEQ ID NO: 67221 - DNA, 24 bp, Artificial Sequence
  Synthetic oligonucleotide; GTAGAAA chr11 5315277 5315300 5315297 +
agttctatcttcacccaagattta

SEQ ID NO: 67222 - DNA, 24 bp, Artificial Sequence
  Synthetic oligonucleotide; GGAGAAT chr11 5315339 5315362 5315359 +
tgaaacggtcataggccattgaca

SEQ ID NO: 67223 - DNA, 24 bp, Artificial Sequence
  Synthetic oligonucleotide; ATAGAAA chr11 5315691 5315714 5315711 +
tgttcacaagtggcaagtagcttt

SEQ ID NO: 67224 - DNA, 24 bp, Artificial Sequence
  Synthetic oligonucleotide; TTAGAAA chr11 5316141 5316164 5316161 +
tcatgatatagacatagtgttttg

SEQ ID NO: 67225 - DNA, 24 bp, Artificial Sequence
  Synthetic oligonucleotide; ATAGAAT chr11 5316171 5316194 5316191 +
aacttttctttgtttagttttgaa

SEQ ID NO: 67226 - DNA, 24 bp, Artificial Sequence
  Synthetic oligonucleotide; GGAGAAA chr11 5316222 5316245 5316242 +
taacaaaagccatgagccctctgt

SEQ ID NO: 67227 - DNA, 24 bp, Artificial Sequence
  Synthetic oligonucleotide; TGAGAAA chr11 5316747 5316770 5316767 +
ttcaggtatttctccaaggatgga

SEQ ID NO: 67228 - DNA, 24 bp, Artificial Sequence
  Synthetic oligonucleotide; TGAGAAT chr11 5317350 5317373 5317370 +
caatgtttagcttccacttataaa

SEQ ID NO: 67229 - DNA, 24 bp, Artificial Sequence
  Synthetic oligonucleotide; TGAGAAT chr11 5317763 5317786 5317783 +
tgttcccttttctccatagcctca

SEQ ID NO: 67230 - DNA, 24 bp, Artificial Sequence
  Synthetic oligonucleotide; TGAGAAT chr11 5318383 5318406 5318403 +
ttttttgtccttgtgatagtttgc

SEQ ID NO: 67231 - DNA, 24 bp, Artificial Sequence
  Synthetic oligonucleotide; GAAGAAT chr11 5319388 5319411 5319408 +
ttaaactagtttttctaatactgt

SEQ ID NO: 67232 - DNA, 24 bp, Artificial Sequence
  Synthetic oligonucleotide; ATAGAAA chr11 5319410 5319433 5319430 +
gtgaagaatgacattggtaattgg

SEQ ID NO: 67233 - DNA, 24 bp, Artificial Sequence
  Synthetic oligonucleotide; TGAGAAA chr11 5319606 5319629 5319626 +
aaccatatgatcatctcaatagac

SEQ ID NO: 67234 - DNA, 24 bp, Artificial Sequence
  Synthetic oligonucleotide; AAAGAAT chr11 5319688 5319711 5319708 +
taggcatcaaaggaacatacctca

SEQ ID NO: 67235 - DNA, 24 bp, Artificial Sequence
  Synthetic oligonucleotide; AGAGAAA chr11 5319848 5319871 5319868 +
agtcctaaccagggcaatcaggcg

SEQ ID NO: 67236 - DNA, 24 bp, Artificial Sequence
  Synthetic oligonucleotide; AAAGAAA chr11 5319852 5319875 5319872 +
ctaaccagggcaatcaggcgagag

SEQ ID NO: 67237 - DNA, 24 bp, Artificial Sequence
  Synthetic oligonucleotide; AAAGAAA chr11 5319856 5319879 5319876 +
ccagggcaatcaggcgagagaaag

SEQ ID NO: 67238 - DNA, 24 bp, Artificial Sequence
  Synthetic oligonucleotide; TTAGAAA chr11 5319924 5319947 5319944 +
tttgctgatgatatgactctatac

SEQ ID NO: 67239 - DNA, 24 bp, Artificial Sequence
  Synthetic oligonucleotide; AAAGAAA chr11 5320090 5320113 5320110 +
cacaatcccattaagaacagccac

SEQ ID NO: 67240 - DNA, 24 bp, Artificial Sequence
  Synthetic oligonucleotide; CTAGAAA chr11 5320150 5320173 5320170 +
tgaaatttaaaacccaagcaggca

SEQ ID NO: 67241 - DNA, 24 bp, Artificial Sequence
  Synthetic oligonucleotide; AAAGAAA chr11 5320154 5320177 5320174 +
atttaaaacccaagcaggcactag

SEQ ID NO: 67242 - DNA, 24 bp, Artificial Sequence
  Synthetic oligonucleotide; GAAGAAA chr11 5320263 5320286 5320283 +
tctgggatcagggaacattttcca

SEQ ID NO: 67243 - DNA, 24 bp, Artificial Sequence
  Synthetic oligonucleotide; TGAGAAT chr11 5320282 5320305 5320302 +
ttccagaagaaatgctacttaagc

SEQ ID NO: 67244 - DNA, 24 bp, Artificial Sequence
  Synthetic oligonucleotide; AGAGAAA chr11 5320523 5320546 5320543 +
caacaatacatgaaaaaaagcttg

SEQ ID NO: 67245 - DNA, 24 bp, Artificial Sequence
  Synthetic oligonucleotide; TGAGAAA chr11 5320685 5320708 5320705 +
tttaaagttactatggctacagta

SEQ ID NO: 67246 - DNA, 24 bp, Artificial Sequence
  Synthetic oligonucleotide; TTAGAAA chr11 5320794 5320817 5320814 +
tttgactagttgttatcagtagca

SEQ ID NO: 67247 - DNA, 24 bp, Artificial Sequence
  Synthetic oligonucleotide; TTAGAAT chr11 5320829 5320852 5320849 +
tgaatagaagagagattctatgac

SEQ ID NO: 67248 - DNA, 24 bp, Artificial Sequence
  Synthetic oligonucleotide; AGAGAAA chr11 5320866 5320889 5320886 +
gagtgattgaaggtagtagattaa

SEQ ID NO: 67249 - DNA, 24 bp, Artificial Sequence
  Synthetic oligonucleotide; GTAGAAA chr11 5321035 5321058 5321055 +
atgagtgttttacatgctgacttt

SEQ ID NO: 67250 - DNA, 24 bp, Artificial Sequence
  Synthetic oligonucleotide; AGAGAAT chr11 5321048 5321071 5321068 +
atgctgactttgtagaaaagatga

SEQ ID NO: 67251 - DNA, 24 bp, Artificial Sequence
  Synthetic oligonucleotide; GGAGAAA chr11 5321091 5321114 5321111 +
agtgctttgcacaaaggataccct

SEQ ID NO: 67252 - DNA, 24 bp, Artificial Sequence
  Synthetic oligonucleotide; AGAGAAT chr11 5321246 5321269 5321266 +
gaataaggatattattttgttttt

SEQ ID NO: 67253 - DNA, 24 bp, Artificial Sequence
  Synthetic oligonucleotide; TTAGAAT chr11 5321462 5321485 5321482 +
tgctagtggattcagatcaccctc

SEQ ID NO: 67254 - DNA, 24 bp, Artificial Sequence
  Synthetic oligonucleotide; AGAGAAT chr11 5321516 5321539 5321536 +
aacaaccatgaaggcaccaagaac

SEQ ID NO: 67255 - DNA, 24 bp, Artificial Sequence
  Synthetic oligonucleotide; AGAGAAA chr11 5322084 5322107 5322104 +
acctcatggtcacatataaggaac

SEQ ID NO: 67256 - DNA, 24 bp, Artificial Sequence
  Synthetic oligonucleotide; AGAGAAA chr11 5322355 5322378 5322375 +
tatagagagtttacagtagatgtc

SEQ ID NO: 67257 - DNA, 24 bp, Artificial Sequence
  Synthetic oligonucleotide; AAAGAAT chr11 5322374 5322397 5322394 +
atgtcagagaaagtatttatggca

SEQ ID NO: 67258 - DNA, 24 bp, Artificial Sequence
  Synthetic oligonucleotide; CTAGAAT chr11 5322460 5322483 5322480 +
taatgatgtctcatatttttcatt

SEQ ID NO: 67259 - DNA, 24 bp, Artificial Sequence
  Synthetic oligonucleotide; AAAGAAT chr11 5322640 5322663 5322660 +
ttccttctaagatttttttgggca

SEQ ID NO: 67260 - DNA, 24 bp, Artificial Sequence
  Synthetic oligonucleotide; GAAGAAT chr11 5322654 5322677 5322674 +
tttttgggcaaaagaatatttata

SEQ ID NO: 67261 - DNA, 24 bp, Artificial Sequence
  Synthetic oligonucleotide; AAAGAAA chr11 5322666 5322689 5322686 +
agaatatttatagaagaatgaggt

SEQ ID NO: 67262 - DNA, 24 bp, Artificial Sequence
  Synthetic oligonucleotide; TTAGAAA chr11 5322766 5322789 5322786 +
tctgtaagtgacttacgactgtat

SEQ ID NO: 67263 - DNA, 24 bp, Artificial Sequence
  Synthetic oligonucleotide; TGAGAAT chr11 5322900 5322923 5322920 +
agtttcttatcactatatttgcca

SEQ ID NO: 67264 - DNA, 24 bp, Artificial Sequence
  Synthetic oligonucleotide; TAAGAAT chr11 5322922 5322945 5322942 +
catgagaataatgaaaattttaaa

SEQ ID NO: 67265 - DNA, 24 bp, Artificial Sequence
  Synthetic oligonucleotide; AGAGAAT chr11 5322937 5322960 5322957 +
aattttaaataagaatttatttct

SEQ ID NO: 67266 - DNA, 24 bp, Artificial Sequence
  Synthetic oligonucleotide; GAAGAAT chr11 5323107 5323130 5323127 +
ggctaatttcaggtgcatttgaaa

SEQ ID NO: 67267 - DNA, 24 bp, Artificial Sequence
  Synthetic oligonucleotide; TAAGAAA chr11 5323259 5323282 5323279 +
ttccagtatacccttgctctttgc

SEQ ID NO: 67268 - DNA, 24 bp, Artificial Sequence
  Synthetic oligonucleotide; TAAGAAT chr11 5323613 5323636 5323633 +
cagaagcaatgcctatgacagtat

SEQ ID NO: 67269 - DNA, 24 bp, Artificial Sequence
  Synthetic oligonucleotide; TTAGAAT chr11 5323619 5323642 5323639 +
caatgcctatgacagtattaagaa

SEQ ID NO: 67270 - DNA, 24 bp, Artificial Sequence
  Synthetic oligonucleotide; GCAGAAA chr11 5323743 5323766 5323763 +
cagtctcatgatttcttggtggag

SEQ ID NO: 67271 - DNA, 24 bp, Artificial Sequence
  Synthetic oligonucleotide; TTAGAAA chr11 5323829 5323852 5323849 +
caggcaggatggatacaaaacccc

SEQ ID NO: 67272 - DNA, 24 bp, Artificial Sequence
  Synthetic oligonucleotide; TGAGAAT chr11 5323871 5323894 5323891 +
ctaacgctatgactctagtattgg

SEQ ID NO: 67273 - DNA, 24 bp, Artificial Sequence
  Synthetic oligonucleotide; ACAGAAA chr11 5323954 5323977 5323974 +
gccaggagggaacctgattccaca

SEQ ID NO: 67274 - DNA, 24 bp, Artificial Sequence
  Synthetic oligonucleotide; GAAGAAT chr11 5324393 5324416 5324413 +
tgactctgcaactattttcctgaa

SEQ ID NO: 67275 - DNA, 24 bp, Artificial Sequence
  Synthetic oligonucleotide; TTAGAAA chr11 5324430 5324453 5324450 +
tacagactatggttttttccctaa

SEQ ID NO: 67276 - DNA, 24 bp, Artificial Sequence
  Synthetic oligonucleotide; ATAGAAA chr11 5324999 5325022 5325019 +
ttcatacctaatccatctttcgag

SEQ ID NO: 67277 - DNA, 24 bp, Artificial Sequence
  Synthetic oligonucleotide; GGAGAAA chr11 5325320 5325343 5325340 +
ttgccacgatccaagaggggtatg

SEQ ID NO: 67278 - DNA, 24 bp, Artificial Sequence
  Synthetic oligonucleotide; CGAGAAA chr11 5325366 5325389 5325386 +
cagctctgctgcagtcttatttaa

SEQ ID NO: 67279 - DNA, 24 bp, Artificial Sequence
  Synthetic oligonucleotide; TCAGAAT chr11 5325374 5325397 5325394 +
ctgcagtcttatttaacgagaaat

SEQ ID NO: 67280 - DNA, 24 bp, Artificial Sequence
  Synthetic oligonucleotide; TCAGAAT chr11 5325446 5325469 5325466 +
aatggcctcagtatcaaaaataaa

SEQ ID NO: 67281 - DNA, 24 bp, Artificial Sequence
  Synthetic oligonucleotide; GAAGAAA chr11 5325455 5325478 5325475 +
agtatcaaaaataaatcagaatca

SEQ ID NO: 67282 - DNA, 24 bp, Artificial Sequence
  Synthetic oligonucleotide; AGAGAAT chr11 5325717 5325740 5325737 +
tgtacggaatgaggtataggagga

SEQ ID NO: 67283 - DNA, 24 bp, Artificial Sequence
  Synthetic oligonucleotide; AGAGAAA chr11 5325732 5325755 5325752 +
ataggaggaagagaatggcagatt

SEQ ID NO: 67284 - DNA, 24 bp, Artificial Sequence
  Synthetic oligonucleotide; GAAGAAA chr11 5325777 5325800 5325797 +
cacatattctgaagggtaaacata

SEQ ID NO: 67285 - DNA, 24 bp, Artificial Sequence
  Synthetic oligonucleotide; AAAGAAA chr11 5325845 5325868 5325865 +
attttaaaaataaaaaatttttaa

SEQ ID NO: 67286 - DNA, 24 bp, Artificial Sequence
  Synthetic oligonucleotide; AGAGAAA chr11 5325969 5325992 5325989 +
tccttaaaaaacaataacgtcttt

SEQ ID NO: 67287 - DNA, 24 bp, Artificial Sequence
  Synthetic oligonucleotide; AAAGAAA chr11 5326002 5326025 5326022 +
ggccataaaacacttgaaaccaaa

SEQ ID NO: 67288 - DNA, 24 bp, Artificial Sequence
  Synthetic oligonucleotide; GCAGAAA chr11 5326029 5326052 5326049 +
gaaagttttttattatatttatga

SEQ ID NO: 67289 - DNA, 24 bp, Artificial Sequence
  Synthetic oligonucleotide; AAAGAAA chr11 5326114 5326137 5326134 +
agacagggaaggttatggtacctc

SEQ ID NO: 67290 - DNA, 24 bp, Artificial Sequence
  Synthetic oligonucleotide; AAAGAAA chr11 5326157 5326180 5326177 +
tcatgtctgagattttgggaataa

SEQ ID NO: 67291 - DNA, 24 bp, Artificial Sequence
  Synthetic oligonucleotide; TAAGAAA chr11 5326371 5326394 5326391 +
gatggcttagctattaacaagtgt

SEQ ID NO: 67292 - DNA, 24 bp, Artificial Sequence
  Synthetic oligonucleotide; ACAGAAT chr11 5326628 5326651 5326648 +
ggaaaatgactattttgagtcagc

SEQ ID NO: 67293 - DNA, 24 bp, Artificial Sequence
  Synthetic oligonucleotide; GCAGAAT chr11 5326770 5326793 5326790 +
ttaatattctcccttcaattttat

SEQ ID NO: 67294 - DNA, 24 bp, Artificial Sequence
  Synthetic oligonucleotide; TGAGAAA chr11 5326820 5326843 5326840 +
acaggatccataatgctgaaaact

SEQ ID NO: 67295 - DNA, 24 bp, Artificial Sequence
  Synthetic oligonucleotide; CAAGAAA chr11 5327100 5327123 5327120 +
cagacaggaaagatctgttagcct

SEQ ID NO: 67296 - DNA, 24 bp, Artificial Sequence
  Synthetic oligonucleotide; CTAGAAT chr11 5327269 5327292 5327289 +
ttcctaaggagatgggccctgtct

SEQ ID NO: 67297 - DNA, 24 bp, Artificial Sequence
  Synthetic oligonucleotide; TCAGAAT chr11 5327731 5327754 5327751 +
cttttctaagcctttcaactcgat

SEQ ID NO: 67298 - DNA, 24 bp, Artificial Sequence
  Synthetic oligonucleotide; AGAGAAA chr11 5327754 5327777 5327774 +
ttcagaattttttgtctactcttc

SEQ ID NO: 67299 - DNA, 24 bp, Artificial Sequence
  Synthetic oligonucleotide; ATAGAAT chr11 5328012 5328035 5328032 +
aaaatgaatgtattacaataaaaa

SEQ ID NO: 67300 - DNA, 24 bp, Artificial Sequence
  Synthetic oligonucleotide; GAAGAAA chr11 5328109 5328132 5328129 +
gtgataacaaagctgttttggaat

SEQ ID NO: 67301 - DNA, 24 bp, Artificial Sequence
  Synthetic oligonucleotide; ATAGAAA chr11 5328148 5328171 5328168 +
gaaaaaaaagctataaacatctac

SEQ ID NO: 67302 - DNA, 24 bp, Artificial Sequence
  Synthetic oligonucleotide; TAAGAAT chr11 5328161 5328184 5328181 +
taaacatctacatagaaaaatgag

SEQ ID NO: 67303 - DNA, 24 bp, Artificial Sequence
  Synthetic oligonucleotide; TTAGAAA chr11 5328232 5328255 5328252 +
ttatgccaatccaagggtcccaga

SEQ ID NO: 67304 - DNA, 24 bp, Artificial Sequence
  Synthetic oligonucleotide; AAAGAAA chr11 5328277 5328300 5328297 +
cagttccttaaatactctttcaaa

SEQ ID NO: 67305 - DNA, 24 bp, Artificial Sequence
  Synthetic oligonucleotide; GAAGAAT chr11 5328679 5328702 5328699 +
cctcgggattttcaggtgtttcct

SEQ ID NO: 67306 - DNA, 24 bp, Artificial Sequence
  Synthetic oligonucleotide; ACAGAAT chr11 5329369 5329392 5329389 +
caatgaggagcatagtctttattc

SEQ ID NO: 67307 - DNA, 24 bp, Artificial Sequence
  Synthetic oligonucleotide; AAAGAAA chr11 5329394 5329417 5329414 +
cagaatgtaaatagtgtgtaatat

SEQ ID NO: 67308 - DNA, 24 bp, Artificial Sequence
  Synthetic oligonucleotide; ACAGAAA chr11 5329467 5329490 5329487 +
atggtagcatgctaaagggagccc

SEQ ID NO: 67309 - DNA, 24 bp, Artificial Sequence
  Synthetic oligonucleotide; AAAGAAA chr11 5329503 5329526 5329523 +
tttggggcaggggaaaatttctca

SEQ ID NO: 67310 - DNA, 24 bp, Artificial Sequence
  Synthetic oligonucleotide; GAAGAAA chr11 5329588 5329611 5329608 +
ataagtggggtacagtttataaag

SEQ ID NO: 67311 - DNA, 24 bp, Artificial Sequence
  Synthetic oligonucleotide; AGAGAAA chr11 5329616 5329639 5329636 +
aaaaaatacacaggctatggggaa

SEQ ID NO: 67312 - DNA, 24 bp, Artificial Sequence
  Synthetic oligonucleotide; AGAGAAT chr11 5329642 5329665 5329662 +
agaaaatatgacaaactcaaatca

SEQ ID NO: 67313 - DNA, 24 bp, Artificial Sequence
  Synthetic oligonucleotide; CCAGAAT chr11 5329659 5329682 5329679 +
caaatcaagagaattctagcagag

SEQ ID NO: 67314 - DNA, 24 bp, Artificial Sequence
  Synthetic oligonucleotide; TGAGAAA chr11 5329677 5329700 5329697 +
gcagagccagaataacaaaacatg

SEQ ID NO: 67315 - DNA, 24 bp, Artificial Sequence
  Synthetic oligonucleotide; AGAGAAT chr11 5329695 5329718 5329715 +
aacatgtgagaaaattgaacacaa

SEQ ID NO: 67316 - DNA, 24 bp, Artificial Sequence
  Synthetic oligonucleotide; TGAGAAT chr11 5330027 5330050 5330047 +
ttttttgtccttgcgatagtttgc

SEQ ID NO: 67317 - DNA, 24 bp, Artificial Sequence
  Synthetic oligonucleotide; TGAGAAA chr11 5330610 5330633 5330630 +
ttaaaaaccagaacacagctaatg

SEQ ID NO: 67318 - DNA, 24 bp, Artificial Sequence
  Synthetic oligonucleotide; TCAGAAT chr11 5330680 5330703 5330700 +
caattcccatgaccttcttaagga

SEQ ID NO: 67319 - DNA, 24 bp, Artificial Sequence
  Synthetic oligonucleotide; CAAGAAA chr11 5330714 5330737 5330734 +
agagataaggataagcacaaagtc

SEQ ID NO: 67320 - DNA, 24 bp, Artificial Sequence
  Synthetic oligonucleotide; GCAGAAA chr11 5330803 5330826 5330823 +
ccagtttgatcacatctggtgcag

SEQ ID NO: 67321 - DNA, 24 bp, Artificial Sequence
  Synthetic oligonucleotide; TGAGAAT chr11 5330934 5330957 5330954 +
ctatcttcaccaccttagcattgg

SEQ ID NO: 67322 - DNA, 24 bp, Artificial Sequence
  Synthetic oligonucleotide; GGAGAAA chr11 5331303 5331326 5331323 +
tctccagacctggaaagccagtga

SEQ ID NO: 67323 - DNA, 24 bp, Artificial Sequence
  Synthetic oligonucleotide; GGAGAAA chr11 5331350 5331373 5331370 +
gtgggtgacatggtggatacctga

SEQ ID NO: 67324 - DNA, 24 bp, Artificial Sequence
  Synthetic oligonucleotide; AAAGAAA chr11 5331461 5331484 5331481 +
tggtagtcacattaaaaggagtaa

SEQ ID NO: 67325 - DNA, 24 bp, Artificial Sequence
  Synthetic oligonucleotide; ACAGAAA chr11 5331618 5331641 5331638 +
cttcaaaatcgagtgtttacactt

SEQ ID NO: 67326 - DNA, 24 bp, Artificial Sequence
  Synthetic oligonucleotide; TAAGAAT chr11 5331756 5331779 5331776 +
cattgtgcttcatcaaaaaaatgt

SEQ ID NO: 67327 - DNA, 24 bp, Artificial Sequence
  Synthetic oligonucleotide; AAAGAAA chr11 5331807 5331830 5331827 +
tttaaaactaacacatatattgga

SEQ ID NO: 67328 - DNA, 24 bp, Artificial Sequence
  Synthetic oligonucleotide; GGAGAAT chr11 5332059 5332082 5332079 +
aagcagagttttcaccaagtagta

SEQ ID NO: 67329 - DNA, 24 bp, Artificial Sequence
  Synthetic oligonucleotide; TGAGAAA chr11 5332090 5332113 5332110 +
aggaagccagacatattcaaaatt

SEQ ID NO: 67330 - DNA, 24 bp, Artificial Sequence
  Synthetic oligonucleotide; GGAGAAT chr11 5332467 5332490 5332487 +
ccagctacttgggaaactgaggca

SEQ ID NO: 67331 - DNA, 24 bp, Artificial Sequence
  Synthetic oligonucleotide; AAAGAAA chr11 5332578 5332601 5332598 +
ccatctcaaaaaaaaaaaaaaaaa

SEQ ID NO: 67332 - DNA, 24 bp, Artificial Sequence
  Synthetic oligonucleotide; AAAGAAA chr11 5332588 5332611 5332608 +
aaaaaaaaaaaaaaaaagaaaaaa

SEQ ID NO: 67333 - DNA, 24 bp, Artificial Sequence
  Synthetic oligonucleotide; ATAGAAA chr11 5332742 5332765 5332762 +
ttaagcctatgagagtgcagacct

SEQ ID NO: 67334 - DNA, 24 bp, Artificial Sequence
  Synthetic oligonucleotide; ATAGAAA chr11 5332810 5332833 5332830 +
agttgcagtaatttatgtataaca

SEQ ID NO: 67335 - DNA, 24 bp, Artificial Sequence
  Synthetic oligonucleotide; ACAGAAT chr11 5332928 5332951 5332948 +
ttattgtatcatttatctattatc

SEQ ID NO: 67336 - DNA, 24 bp, Artificial Sequence
  Synthetic oligonucleotide; GCAGAAA chr11 5333600 5333623 5333620 +
gctacaaagtagaggaggaagaag

SEQ ID NO: 67337 - DNA, 24 bp, Artificial Sequence
  Synthetic oligonucleotide; AGAGAAA chr11 5333630 5333653 5333650 +
agggaacataggtggatgtaagat

SEQ ID NO: 67338 - DNA, 24 bp, Artificial Sequence
  Synthetic oligonucleotide; AAAGAAA chr11 5333761 5333784 5333781 +
tctctttcctctcctgcctcttcc

SEQ ID NO: 67339 - DNA, 24 bp, Artificial Sequence
  Synthetic oligonucleotide; GCAGAAT chr11 5333943 5333966 5333963 +
ttatgttggaggttgatacacccg

SEQ ID NO: 67340 - DNA, 24 bp, Artificial Sequence
  Synthetic oligonucleotide; AGAGAAT chr11 5334013 5334036 5334033 +
ctcttgcaacaactatgtggtgga

SEQ ID NO: 67341 - DNA, 24 bp, Artificial Sequence
  Synthetic oligonucleotide; TCAGAAA chr11 5334099 5334122 5334119 +
gtcactagagcctgacctggggta

SEQ ID NO: 67342 - DNA, 24 bp, Artificial Sequence
  Synthetic oligonucleotide; GTAGAAA chr11 5334137 5334160 5334157 +
gagaggtaattgctgagtcctggt

SEQ ID NO: 67343 - DNA, 24 bp, Artificial Sequence
  Synthetic oligonucleotide; AAAGAAA chr11 5334335 5334358 5334355 +
taaagccccatattttctttgcaa

SEQ ID NO: 67344 - DNA, 24 bp, Artificial Sequence
  Synthetic oligonucleotide; ACAGAAT chr11 5334342 5334365 5334362 +
ccatattttctttgcaaaaagaaa

SEQ ID NO: 67345 - DNA, 24 bp, Artificial Sequence
  Synthetic oligonucleotide; CAAGAAT chr11 5334627 5334650 5334647 +
ttctgtctcttggtaagtcttgcc

SEQ ID NO: 67346 - DNA, 24 bp, Artificial Sequence
  Synthetic oligonucleotide; AGAGAAA chr11 5334790 5334813 5334810 +
aatacaatcatctcatagtctgtc

SEQ ID NO: 67347 - DNA, 24 bp, Artificial Sequence
  Synthetic oligonucleotide; TGAGAAT chr11 5334805 5334828 5334825 +
tagtctgtcagagaaataaggatc

SEQ ID NO: 67348 - DNA, 24 bp, Artificial Sequence
  Synthetic oligonucleotide; GCAGAAT chr11 5334994 5335017 5335014 +
gctcataggtcttcctaaatgtaa

SEQ ID NO: 67349 - DNA, 24 bp, Artificial Sequence
  Synthetic oligonucleotide; AGAGAAT chr11 5335372 5335395 5335392 +
actgttggtggaggataagcctcc

SEQ ID NO: 67350 - DNA, 24 bp, Artificial Sequence
  Synthetic oligonucleotide; TTAGAAT chr11 5335704 5335727 5335724 +
ctaaatcacataacacaatattta

SEQ ID NO: 67351 - DNA, 24 bp, Artificial Sequence
  Synthetic oligonucleotide; TTAGAAA chr11 5335744 5335767 5335764 +
gaaaatactcaggcagccacatta

SEQ ID NO: 67352 - DNA, 24 bp, Artificial Sequence
  Synthetic oligonucleotide; AGAGAAT chr11 5336301 5336324 5336321 +
aagtctgacccttccccaaatcag

SEQ ID NO: 67353 - DNA, 24 bp, Artificial Sequence
  Synthetic oligonucleotide; ATAGAAT chr11 5337156 5337179 5337176 +
catacatgtgcatgtatcttagta

SEQ ID NO: 67354 - DNA, 24 bp, Artificial Sequence
  Synthetic oligonucleotide; GCAGAAA chr11 5337598 5337621 5337618 +
agacctttgtcagatgggtagatt

SEQ ID NO: 67355 - DNA, 24 bp, Artificial Sequence
  Synthetic oligonucleotide; ACAGAAA chr11 5338972 5338995 5338992 +
tcatttctaagattggcttagtct

SEQ ID NO: 67356 - DNA, 24 bp, Artificial Sequence
  Synthetic oligonucleotide; AAAGAAA chr11 5339075 5339098 5339095 +
tacacaagtatattattatttgaa

SEQ ID NO: 67357 - DNA, 24 bp, Artificial Sequence
  Synthetic oligonucleotide; ACAGAAA chr11 5339732 5339755 5339752 +
ccacaggaagacttgtaggagatc

SEQ ID NO: 67358 - DNA, 24 bp, Artificial Sequence
  Synthetic oligonucleotide; ATAGAAA chr11 5339802 5339825 5339822 +
gttgattgttacaatgggttttga

SEQ ID NO: 67359 - DNA, 24 bp, Artificial Sequence
  Synthetic oligonucleotide; TCAGAAA chr11 5339958 5339981 5339978 +
tttagtttcacacttactttcaag

SEQ ID NO: 67360 - DNA, 24 bp, Artificial Sequence
  Synthetic oligonucleotide; TTAGAAA chr11 5340053 5340076 5340073 +
tttttaggttccatttcctgtatt

SEQ ID NO: 67361 - DNA, 24 bp, Artificial Sequence
  Synthetic oligonucleotide; GGAGAAA chr11 5340579 5340602 5340599 +
aacaatatttttggagtagaagga

SEQ ID NO: 67362 - DNA, 24 bp, Artificial Sequence
  Synthetic oligonucleotide; TCAGAAA chr11 5340589 5340612 5340609 +
ttggagtagaaggaggagaaattt

SEQ ID NO: 67363 - DNA, 24 bp, Artificial Sequence
  Synthetic oligonucleotide; AAAGAAA chr11 5340595 5340618 5340615 +
tagaaggaggagaaattttcagaa

SEQ ID NO: 67364 - DNA, 24 bp, Artificial Sequence
  Synthetic oligonucleotide; CAAGAAA chr11 5340790 5340813 5340810 +
cttttttatattaaatttccccat

SEQ ID NO: 67365 - DNA, 24 bp, Artificial Sequence
  Synthetic oligonucleotide; ACAGAAT chr11 5341058 5341081 5341078 +
ttcacaattacatctcttaatgaa

SEQ ID NO: 67366 - DNA, 24 bp, Artificial Sequence
  Synthetic oligonucleotide; GCAGAAA chr11 5341341 5341364 5341361 +
ctgctgagttgagaacaacaacct

SEQ ID NO: 67367 - DNA, 24 bp, Artificial Sequence
  Synthetic oligonucleotide; GCAGAAA chr11 5341348 5341371 5341368 +
gttgagaacaacaacctgcagaaa

SEQ ID NO: 67368 - DNA, 24 bp, Artificial Sequence
  Synthetic oligonucleotide; TGAGAAT chr11 5341582 5341605 5341602 +
actcatcagacaattttaatcaaa

SEQ ID NO: 67369 - DNA, 24 bp, Artificial Sequence
  Synthetic oligonucleotide; TCAGAAT chr11 5341633 5341656 5341653 +
gaaatttacacttattacatggaa

SEQ ID NO: 67370 - DNA, 24 bp, Artificial Sequence
  Synthetic oligonucleotide; ACAGAAA chr11 5341646 5341669 5341666 +
attacatggaatcagaatgtatgt

SEQ ID NO: 67371 - DNA, 24 bp, Artificial Sequence
  Synthetic oligonucleotide; GCAGAAA chr11 5341674 5341697 5341694 +
aaagcaatcattcttcaaaaaaat

SEQ ID NO: 67372 - DNA, 24 bp, Artificial Sequence
  Synthetic oligonucleotide; GTAGAAT chr11 5341818 5341841 5341838 +
acattggagctagcaactagggta

SEQ ID NO: 67373 - DNA, 24 bp, Artificial Sequence
  Synthetic oligonucleotide; TAAGAAT chr11 5341824 5341847 5341844 +
gagctagcaactagggtagtagaa

SEQ ID NO: 67374 - DNA, 24 bp, Artificial Sequence
  Synthetic oligonucleotide; AGAGAAA chr11 5342132 5342155 5342152 +
cccattgtttgtatggacacctgc

SEQ ID NO: 67375 - DNA, 24 bp, Artificial Sequence
  Synthetic oligonucleotide; AGAGAAA chr11 5342341 5342364 5342361 +
tcacaataatttagtggaaagctt

SEQ ID NO: 67376 - DNA, 24 bp, Artificial Sequence
  Synthetic oligonucleotide; GAAGAAT chr11 5342594 5342617 5342614 +
caattctatgggtagtaaaaaggt

SEQ ID NO: 67377 - DNA, 24 bp, Artificial Sequence
  Synthetic oligonucleotide; ACAGAAA chr11 5342660 5342683 5342680 +
ttataggattcattagtggaggga

SEQ ID NO: 67378 - DNA, 24 bp, Artificial Sequence
  Synthetic oligonucleotide; GCAGAAT chr11 5342970 5342993 5342990 +
gagtttaatgacatcctggtgaag

SEQ ID NO: 67379 - DNA, 24 bp, Artificial Sequence
  Synthetic oligonucleotide; ACAGAAA chr11 5343005 5343028 5343025 +
gtgaaagaacatgggagtgacaat

SEQ ID NO: 67380 - DNA, 24 bp, Artificial Sequence
  Synthetic oligonucleotide; GCAGAAT chr11 5343161 5343184 5343181 +
taaaacggtcataggccatggcaa

SEQ ID NO: 67381 - DNA, 24 bp, Artificial Sequence
  Synthetic oligonucleotide; CGAGAAA chr11 5343176 5343199 5343196 +
ccatggcaagcagaatgccagact

SEQ ID NO: 67382 - DNA, 24 bp, Artificial Sequence
  Synthetic oligonucleotide; CCAGAAA chr11 5343317 5343340 5343337 +
ccaggtctgtggcagccagcatgg

SEQ ID NO: 67383 - DNA, 24 bp, Artificial Sequence
  Synthetic oligonucleotide; CAAGAAA chr11 5343411 5343434 5343431 +
aaaaaggatggatatatacatgaa

SEQ ID NO: 67384 - DNA, 24 bp, Artificial Sequence
  Synthetic oligonucleotide; GAAGAAA chr11 5343515 5343538 5343535 +
tggacgacatcctgggtttatata

SEQ ID NO: 67385 - DNA, 24 bp, Artificial Sequence
  Synthetic oligonucleotide; TCAGAAT chr11 5343593 5343616 5343613 +
ggtatcacttcgactatatcattc

SEQ ID NO: 67386 - DNA, 24 bp, Artificial Sequence
  Synthetic oligonucleotide; TCAGAAA chr11 5343770 5343793 5343790 +
tttatatgcatttaagcattctct

SEQ ID NO: 67387 - DNA, 24 bp, Artificial Sequence
  Synthetic oligonucleotide; AAAGAAT chr11 5343831 5343854 5343851 +
gttacccttaactatgcagatttt

SEQ ID NO: 67388 - DNA, 24 bp, Artificial Sequence
  Synthetic oligonucleotide; CCAGAAA chr11 5343868 5343891 5343888 +
tctatggggcattcaaggggattt

SEQ ID NO: 67389 - DNA, 24 bp, Artificial Sequence
  Synthetic oligonucleotide; TAAGAAA chr11 5344000 5344023 5344020 +
ttatcagctaaagtctcaacagcc

SEQ ID NO: 67390 - DNA, 24 bp, Artificial Sequence
  Synthetic oligonucleotide; AAAGAAA chr11 5344004 5344027 5344024 +
cagctaaagtctcaacagcctaag

SEQ ID NO: 67391 - DNA, 24 bp, Artificial Sequence
  Synthetic oligonucleotide; AGAGAAA chr11 5344020 5344043 5344040 +
agcctaagaaagaaaagtgtggga

SEQ ID NO: 67392 - DNA, 24 bp, Artificial Sequence
  Synthetic oligonucleotide; TGAGAAA chr11 5344064 5344087 5344084 +
actgtagctaaggagcagtcagat

SEQ ID NO: 67393 - DNA, 24 bp, Artificial Sequence
  Synthetic oligonucleotide; GTAGAAT chr11 5344146 5344169 5344166 +
acgattagtgtgaattaccctctt

SEQ ID NO: 67394 - DNA, 24 bp, Artificial Sequence
  Synthetic oligonucleotide; CTAGAAT chr11 5344357 5344380 5344377 +
ctataggcctactgaagtaattcc

SEQ ID NO: 67395 - DNA, 24 bp, Artificial Sequence
  Synthetic oligonucleotide; AAAGAAA chr11 5344943 5344966 5344963 +
catttgaactgagacctcaataca

SEQ ID NO: 67396 - DNA, 24 bp, Artificial Sequence
  Synthetic oligonucleotide; TAAGAAA chr11 5345016 5345039 5345036 +
aaaatcagcatgactggcatttga

SEQ ID NO: 67397 - DNA, 24 bp, Artificial Sequence
  Synthetic oligonucleotide; CAAGAAA chr11 5345255 5345278 5345275 +
atgtgaagaagactaagcaagaga

SEQ ID NO: 67398 - DNA, 24 bp, Artificial Sequence
  Synthetic oligonucleotide; TTAGAAA chr11 5345271 5345294 5345291 +
gcaagagacaagaaaagagatgag

SEQ ID NO: 67399 - DNA, 24 bp, Artificial Sequence
  Synthetic oligonucleotide; AGAGAAA chr11 5345348 5345371 5345368 +
agagaagcaggggaaatgaaaaaa

SEQ ID NO: 67400 - DNA, 24 bp, Artificial Sequence
  Synthetic oligonucleotide; ATAGAAA chr11 5345356 5345379 5345376 +
aggggaaatgaaaaaaagagaaaa

SEQ ID NO: 67401 - DNA, 24 bp, Artificial Sequence
  Synthetic oligonucleotide; AAAGAAT chr11 5345480 5345503 5345500 +
cctagatttctgtttgaacaaatg

SEQ ID NO: 67402 - DNA, 24 bp, Artificial Sequence
  Synthetic oligonucleotide; AAAGAAT chr11 5345838 5345861 5345858 +
gtgaggcaacaactcagcactttg

SEQ ID NO: 67403 - DNA, 24 bp, Artificial Sequence
  Synthetic oligonucleotide; CCAGAAT chr11 5345890 5345913 5345910 +
tgtcctaggactgagagacataaa

SEQ ID NO: 67404 - DNA, 24 bp, Artificial Sequence
  Synthetic oligonucleotide; AGAGAAT chr11 5346099 5346122 5346119 +
ctttgtgaaaaattccttcttatc

SEQ ID NO: 67405 - DNA, 24 bp, Artificial Sequence
  Synthetic oligonucleotide; CAAGAAT chr11 5346216 5346239 5346236 +
taaagtttcctccttctccattcc

SEQ ID NO: 67406 - DNA, 24 bp, Artificial Sequence
  Synthetic oligonucleotide; GAAGAAA chr11 5346334 5346357 5346354 +
ctagtcgtggctcttggtttctga

SEQ ID NO: 67407 - DNA, 24 bp, Artificial Sequence
  Synthetic oligonucleotide; CTAGAAA chr11 5346442 5346465 5346462 +
caagaagattctataatggaacac

SEQ ID NO: 67408 - DNA, 24 bp, Artificial Sequence
  Synthetic oligonucleotide; GTAGAAT chr11 5346514 5346537 5346534 +
gctttgtttaaaaagtaaaatgta

SEQ ID NO: 67409 - DNA, 24 bp, Artificial Sequence
  Synthetic oligonucleotide; TTAGAAA chr11 5346545 5346568 5346565 +
aagaggtgccttcctgttcatctt

SEQ ID NO: 67410 - DNA, 24 bp, Artificial Sequence
  Synthetic oligonucleotide; TAAGAAA chr11 5346969 5346992 5346989 +
cccttttatagccaacttggatct

SEQ ID NO: 67411 - DNA, 24 bp, Artificial Sequence
  Synthetic oligonucleotide; AGAGAAA chr11 5347220 5347243 5347240 +
tcaaatctttcccagtttatctca

SEQ ID NO: 67412 - DNA, 24 bp, Artificial Sequence
  Synthetic oligonucleotide; AGAGAAA chr11 5347291 5347314 5347311 +
tatatttcctgcttggtttagatc

SEQ ID NO: 67413 - DNA, 24 bp, Artificial Sequence
  Synthetic oligonucleotide; AGAGAAA chr11 5347721 5347744 5347741 +
cacaaggctgagggcacaaataat

SEQ ID NO: 67414 - DNA, 24 bp, Artificial Sequence
  Synthetic oligonucleotide; GAAGAAT chr11 5347942 5347965 5347962 +
tgtgagatacatgactatggaact

SEQ ID NO: 67415 - DNA, 24 bp, Artificial Sequence
  Synthetic oligonucleotide; AGAGAAA chr11 5348064 5348087 5348084 +
gagatcgaagctgatttcttagca

SEQ ID NO: 67416 - DNA, 24 bp, Artificial Sequence
  Synthetic oligonucleotide; ATAGAAT chr11 5348394 5348417 5348414 +
tagaagtccagataagtgccaaat

SEQ ID NO: 67417 - DNA, 24 bp, Artificial Sequence
  Synthetic oligonucleotide; CTAGAAA chr11 5348461 5348484 5348481 +
aatcatcagaggttcaaatacttt

SEQ ID NO: 67418 - DNA, 24 bp, Artificial Sequence
  Synthetic oligonucleotide; ACAGAAA chr11 5348832 5348855 5348852 +
agtttgcactcaatattaaccatc

SEQ ID NO: 67419 - DNA, 24 bp, Artificial Sequence
  Synthetic oligonucleotide; ACAGAAA chr11 5348895 5348918 5348915 +
ggatggagatactaagtgcttgag

SEQ ID NO: 67420 - DNA, 24 bp, Artificial Sequence
  Synthetic oligonucleotide; AGAGAAT chr11 5348945 5348968 5348965 +
aggaaaaaagccaaagggaaggtg

SEQ ID NO: 67421 - DNA, 24 bp, Artificial Sequence
  Synthetic oligonucleotide; TGAGAAT chr11 5349033 5349056 5349053 +
tttatgcggcagagtttgagactt

SEQ ID NO: 67422 - DNA, 24 bp, Artificial Sequence
  Synthetic oligonucleotide; GTAGAAA chr11 5349305 5349328 5349325 +
ccccagtccaatacttgacacacg

SEQ ID NO: 67423 - DNA, 24 bp, Artificial Sequence
  Synthetic oligonucleotide; TAAGAAA chr11 5349499 5349522 5349519 +
tatttaggtatatttaaaatttgc

SEQ ID NO: 67424 - DNA, 24 bp, Artificial Sequence
  Synthetic oligonucleotide; AGAGAAA chr11 5349901 5349924 5349921 +
catatcacattttatctgctgatt

SEQ ID NO: 67425 - DNA, 24 bp, Artificial Sequence
  Synthetic oligonucleotide; ACAGAAA chr11 5349991 5350014 5350011 +
cttatatctgttcccaaggcttcc

SEQ ID NO: 67426 - DNA, 24 bp, Artificial Sequence
  Synthetic oligonucleotide; AGAGAAA chr11 5350052 5350075 5350072 +
gaataatcctgacatgtactcact

SEQ ID NO: 67427 - DNA, 24 bp, Artificial Sequence
  Synthetic oligonucleotide; AGAGAAA chr11 5350058 5350081 5350078 +
tcctgacatgtactcactagagaa

SEQ ID NO: 67428 - DNA, 24 bp, Artificial Sequence
  Synthetic oligonucleotide; AGAGAAT chr11 5350152 5350175 5350172 +
aacatttccccttactttgtgtca

SEQ ID NO: 67429 - DNA, 24 bp, Artificial Sequence
  Synthetic oligonucleotide; ACAGAAA chr11 5350169 5350192 5350189 +
tgtgtcaagagaatgactgagaag

SEQ ID NO: 67430 - DNA, 24 bp, Artificial Sequence
  Synthetic oligonucleotide; TTAGAAA chr11 5350245 5350268 5350265 +
attactttcccaagatcattattg

SEQ ID NO: 67431 - DNA, 24 bp, Artificial Sequence
  Synthetic oligonucleotide; ACAGAAA chr11 5350325 5350348 5350345 +
atcttggatgcattcttttcatgg

SEQ ID NO: 67432 - DNA, 24 bp, Artificial Sequence
  Synthetic oligonucleotide; TTAGAAT chr11 5350502 5350525 5350522 +
tggctgcctgcaccagctgaaatc

SEQ ID NO: 67433 - DNA, 24 bp, Artificial Sequence
  Synthetic oligonucleotide; GAAGAAA chr11 5350899 5350922 5350919 +
ttgaattttccctccaggaatatt

SEQ ID NO: 67434 - DNA, 24 bp, Artificial Sequence
  Synthetic oligonucleotide; GTAGAAT chr11 5351399 5351422 5351419 +
gactggtgaacatcttatgaacag

SEQ ID NO: 67435 - DNA, 24 bp, Artificial Sequence
  Synthetic oligonucleotide; GGAGAAA chr11 5352171 5352194 5352191 +
actgtcatgggcattggttctgga

SEQ ID NO: 67436 - DNA, 24 bp, Artificial Sequence
  Synthetic oligonucleotide; CTAGAAA chr11 5353063 5353086 5353083 +
catatatggagctggctgctgttt

SEQ ID NO: 67437 - DNA, 24 bp, Artificial Sequence
  Synthetic oligonucleotide; GAAGAAA chr11 5353079 5353102 5353099 +
tgctgtttctagaaaattgcacgt

SEQ ID NO: 67438 - DNA, 24 bp, Artificial Sequence
  Synthetic oligonucleotide; TGAGAAA chr11 5353193 5353216 5353213 +
atgagtctagggaaagtatctcta

SEQ ID NO: 67439 - DNA, 24 bp, Artificial Sequence
  Synthetic oligonucleotide; AAAGAAA chr11 5353637 5353660 5353657 +
atgataagttttaaattaatttta

SEQ ID NO: 67440 - DNA, 24 bp, Artificial Sequence
  Synthetic oligonucleotide; ACAGAAA chr11 5353789 5353812 5353809 +
atggctgcccacctactcttcatc

SEQ ID NO: 67441 - DNA, 24 bp, Artificial Sequence
  Synthetic oligonucleotide; AGAGAAA chr11 5353837 5353860 5353857 +
attcttgggatgtataaataacac

SEQ ID NO: 67442 - DNA, 24 bp, Artificial Sequence
  Synthetic oligonucleotide; AAAGAAA chr11 5354252 5354275 5354272 +
attcagggggatctaagccacatc

SEQ ID NO: 67443 - DNA, 24 bp, Artificial Sequence
  Synthetic oligonucleotide; CAAGAAT chr11 5354696 5354719 5354716 +
ccaacatcaagagggcatctttgc

SEQ ID NO: 67444 - DNA, 24 bp, Artificial Sequence
  Synthetic oligonucleotide; GAAGAAT chr11 5354784 5354807 5354804 +
gctgagacaaaagacaaacagttt

SEQ ID NO: 67445 - DNA, 24 bp, Artificial Sequence
  Synthetic oligonucleotide; TGAGAAA chr11 5354957 5354980 5354977 +
gcaggaaggtgtgaaaatggttgg

SEQ ID NO: 67446 - DNA, 24 bp, Artificial Sequence
  Synthetic oligonucleotide; GAAGAAT chr11 5355053 5355076 5355073 +
ctacctggaccaatttcctgactt

SEQ ID NO: 67447 - DNA, 24 bp, Artificial Sequence
  Synthetic oligonucleotide; GTAGAAT chr11 5355171 5355194 5355191 +
taggagcctctgtctaaggcagaa

SEQ ID NO: 67448 - DNA, 24 bp, Artificial Sequence
  Synthetic oligonucleotide; TCAGAAA chr11 5355179 5355202 5355199 +
tctgtctaaggcagaagtagaatt

SEQ ID NO: 67449 - DNA, 24 bp, Artificial Sequence
  Synthetic oligonucleotide; AGAGAAA chr11 5355190 5355213 5355210 +
cagaagtagaatttcagaaagcat

SEQ ID NO: 67450 - DNA, 24 bp, Artificial Sequence
  Synthetic oligonucleotide; CAAGAAA chr11 5355222 5355245 5355242 +
tttgaagagtttaatggtgactta

SEQ ID NO: 67451 - DNA, 24 bp, Artificial Sequence
  Synthetic oligonucleotide; ACAGAAA chr11 5355919 5355942 5355939 +
tcctgttagaaggaaaactaacaa

SEQ ID NO: 67452 - DNA, 24 bp, Artificial Sequence
  Synthetic oligonucleotide; GCAGAAA chr11 5356011 5356034 5356031 +
accacaaagatggggaaaaacaga

SEQ ID NO: 67453 - DNA, 24 bp, Artificial Sequence
  Synthetic oligonucleotide; AGAGAAT chr11 5356099 5356122 5356119 +
accagcaacggtacaaagctggac

SEQ ID NO: 67454 - DNA, 24 bp, Artificial Sequence
  Synthetic oligonucleotide; CTAGAAT chr11 5356227 5356250 5356247 +
aaaataaattagactaatggctaa

SEQ ID NO: 67455 - DNA, 24 bp, Artificial Sequence
  Synthetic oligonucleotide; GAAGAAA chr11 5356337 5356360 5356357 +
ctcagtagctgattcgatcaactg

SEQ ID NO: 67456 - DNA, 24 bp, Artificial Sequence
  Synthetic oligonucleotide; AGAGAAA chr11 5356397 5356420 5356417 +
gaaatgaagcaagaagagaagttt

SEQ ID NO: 67457 - DNA, 24 bp, Artificial Sequence
  Synthetic oligonucleotide; AAAGAAT chr11 5356404 5356427 5356424 +
agcaagaagagaagtttagagaaa

SEQ ID NO: 67458 - DNA, 24 bp, Artificial Sequence
  Synthetic oligonucleotide; AAAGAAA chr11 5356413 5356436 5356433 +
agaagtttagagaaaaaagaataa

SEQ ID NO: 67459 - DNA, 24 bp, Artificial Sequence
  Synthetic oligonucleotide; CAAGAAA chr11 5356433 5356456 5356453 +
ataaaaagaaatgaacaaagcctc

SEQ ID NO: 67460 - DNA, 24 bp, Artificial Sequence
  Synthetic oligonucleotide; GCAGAAT chr11 5356498 5356521 5356518 +
gattggtgtacctgaaagtgacgg

SEQ ID NO: 67461 - DNA, 24 bp, Artificial Sequence
  Synthetic oligonucleotide; AGAGAAA chr11 5356699 5356722 5356719 +
gggaaaaatgttaagggtagccag

SEQ ID NO: 67462 - DNA, 24 bp, Artificial Sequence
  Synthetic oligonucleotide; TCAGAAT chr11 5356734 5356757 5356754 +
gggttacccacaaagggaagccca

SEQ ID NO: 67463 - DNA, 24 bp, Artificial Sequence
  Synthetic oligonucleotide; GCAGAAA chr11 5356757 5356780 5356777 +
atcagaataacagcagatctctca

SEQ ID NO: 67464 - DNA, 24 bp, Artificial Sequence
  Synthetic oligonucleotide; AAAGAAT chr11 5356813 5356836 5356833 +
gccaatattcaacatccttaaagg

SEQ ID NO: 67465 - DNA, 24 bp, Artificial Sequence
  Synthetic oligonucleotide; ACAGAAT chr11 5356827 5356850 5356847 +
tccttaaaggaaagaattttcaac

SEQ ID NO: 67466 - DNA, 24 bp, Artificial Sequence
  Synthetic oligonucleotide; GGAGAAA chr11 5356868 5356891 5356888 +
gccaaactaagcttcataagtgaa

SEQ ID NO: 67467 - DNA, 24 bp, Artificial Sequence
  Synthetic oligonucleotide; GAAGAAA chr11 5357028 5357051 5357048 +
aattgtaaagaccattgaggctag

SEQ ID NO: 67468 - DNA, 24 bp, Artificial Sequence
  Synthetic oligonucleotide; CAAGAAA chr11 5357263 5357286 5357283 +
ataaagggatggaggaagatctac

SEQ ID NO: 67469 - DNA, 24 bp, Artificial Sequence
  Synthetic oligonucleotide; ACAGAAA chr11 5357562 5357585 5357582 +
atcaacattagacagatcaacgag

SEQ ID NO: 67470 - DNA, 24 bp, Artificial Sequence
  Synthetic oligonucleotide; ACAGAAT chr11 5357653 5357676 5357673 +
tacagaactctccaccccaaatca

SEQ ID NO: 67471 - DNA, 24 bp, Artificial Sequence
  Synthetic oligonucleotide; ACAGAAA chr11 5357746 5357769 5357766 +
gcactcctcagcaaatgtaaaaga

SEQ ID NO: 67472 - DNA, 24 bp, Artificial Sequence
  Synthetic oligonucleotide; TAAGAAA chr11 5357805 5357828 5357825 +
tgcaatcaaactagaactcaggat

SEQ ID NO: 67473 - DNA, 24 bp, Artificial Sequence
  Synthetic oligonucleotide; GCAGAAA chr11 5357890 5357913 5357910 +
tactgggttcataacaaaatgaag

SEQ ID NO: 67474 - DNA, 24 bp, Artificial Sequence
  Synthetic oligonucleotide; CCAGAAT chr11 5357940 5357963 5357960 +
caaagagaacaaagacacaacata

SEQ ID NO: 67475 - DNA, 24 bp, Artificial Sequence
  Synthetic oligonucleotide; AGAGAAA chr11 5358005 5358028 5358025 +
aatttatagcactaaacgcccaga

SEQ ID NO: 67476 - DNA, 24 bp, Artificial Sequence
  Synthetic oligonucleotide; CAAGAAA chr11 5358100 5358123 5358120 +
acacattcaaatgctagcagaagg

SEQ ID NO: 67477 - DNA, 24 bp, Artificial Sequence
  Synthetic oligonucleotide; GAAGAAA chr11 5358235 5358258 5358255 +
tagactgctagcaagactaataaa

SEQ ID NO: 67478 - DNA, 24 bp, Artificial Sequence
  Synthetic oligonucleotide; GAAGAAT chr11 5358247 5358270 5358267 +
aagactaataaagaagaaaagaga

SEQ ID NO: 67479 - DNA, 24 bp, Artificial Sequence
  Synthetic oligonucleotide; ACAGAAA chr11 5358302 5358325 5358322 +
aaagggtatatcaccaccgatccc

SEQ ID NO: 67480 - DNA, 24 bp, Artificial Sequence
  Synthetic oligonucleotide; AGAGAAT chr11 5358323 5358346 5358343 +
cccacagaaatacaaaccaccatc

SEQ ID NO: 67481 - DNA, 24 bp, Artificial Sequence
  Synthetic oligonucleotide; CTAGAAA chr11 5358356 5358379 5358376 +
tataaacacctctacacaaataaa

SEQ ID NO: 67482 - DNA, 24 bp, Artificial Sequence
  Synthetic oligonucleotide; GAAGAAA chr11 5358368 5358391 5358388 +
tacacaaataaactagaaaatcta

SEQ ID NO: 67483 - DNA, 24 bp, Artificial Sequence
  Synthetic oligonucleotide; AGAGAAT chr11 5358670 5358693 5358690 +
gccgggcagagacacaacaaaaaa

SEQ ID NO: 67484 - DNA, 24 bp, Artificial Sequence
  Synthetic oligonucleotide; GCAGAAA chr11 5358890 5358913 5358910 +
aaccacatgattatctcaatagat

SEQ ID NO: 67485 - DNA, 24 bp, Artificial Sequence
  Synthetic oligonucleotide; CTAGAAA chr11 5359210 5359233 5359230 +
tttgcagatgacacgattgtatat

SEQ ID NO: 67486 - DNA, 24 bp, Artificial Sequence
  Synthetic oligonucleotide; AGAGAAT chr11 5359379 5359402 5359399 +
aactcccattcacaattgcttcaa

SEQ ID NO: 67487 - DNA, 24 bp, Artificial Sequence
  Synthetic oligonucleotide; GAAGAAT chr11 5359511 5359534 5359531 +
agaacattccatgctcatgggtag

SEQ ID NO: 67488 - DNA, 24 bp, Artificial Sequence
  Synthetic oligonucleotide; ACAGAAT chr11 5359600 5359623 5359620 +
atcaagctaccaatgactttcttc

SEQ ID NO: 67489 - DNA, 24 bp, Artificial Sequence
  Synthetic oligonucleotide; TCAGAAA chr11 5359801 5359824 5359821 +
gaccaatggaacagaacagaggcc

SEQ ID NO: 67490 - DNA, 24 bp, Artificial Sequence
  Synthetic oligonucleotide; GCAGAAA chr11 5359919 5359942 5359939 +
gctgggaaaactggctaaccatac

SEQ ID NO: 67491 - DNA, 24 bp, Artificial Sequence
  Synthetic oligonucleotide; GAAGAAA chr11 5360020 5360043 5360040 +
agactgaaaaccataaaaactctg

SEQ ID NO: 67492 - DNA, 24 bp, Artificial Sequence
  Synthetic oligonucleotide; AAAGAAA chr11 5360155 5360178 5360175 +
aaactaaagagcttctgcacagca

SEQ ID NO: 67493 - DNA, 24 bp, Artificial Sequence
  Synthetic oligonucleotide; ACAGAAT chr11 5360188 5360211 5360208 +
accatcagagtgaacaggcaacat

SEQ ID NO: 67494 - DNA, 24 bp, Artificial Sequence
  Synthetic oligonucleotide; GGAGAAA chr11 5360196 5360219 5360216 +
agtgaacaggcaacatacagaatg

SEQ ID NO: 67495 - DNA, 24 bp, Artificial Sequence
  Synthetic oligonucleotide; CCAGAAT chr11 5360240 5360263 5360260 +
actcatccgacaaagggctaatat

SEQ ID NO: 67496 - DNA, 24 bp, Artificial Sequence
  Synthetic oligonucleotide; CAAGAAA chr11 5360271 5360294 5360291 +
ctatgatgaactcaaacaaattta

SEQ ID NO: 67497 - DNA, 24 bp, Artificial Sequence
  Synthetic oligonucleotide; AGAGAAA chr11 5360388 5360411 5360408 +
aaatgctcatcatcactggccatc

SEQ ID NO: 67498 - DNA, 24 bp, Artificial Sequence
  Synthetic oligonucleotide; TTAGAAT chr11 5360434 5360457 5360454 +
cagtgagataccatctcacaccag

SEQ ID NO: 67499 - DNA, 24 bp, Artificial Sequence
  Synthetic oligonucleotide; CTAGAAA chr11 5360580 5360603 5360600 +
tggcgattcctcagggatctagaa

SEQ ID NO: 67500 - DNA, 24 bp, Artificial Sequence
  Synthetic oligonucleotide; TAAGAAA chr11 5360744 5360767 5360764 +
atgtccaacaatgatagactggat

SEQ ID NO: 67501 - DNA, 24 bp, Artificial Sequence
  Synthetic oligonucleotide; AAAGAAA chr11 5361121 5361144 5361141 +
cctaaaacttaaagtataataata

SEQ ID NO: 67502 - DNA, 24 bp, Artificial Sequence
  Synthetic oligonucleotide; AAAGAAA chr11 5361125 5361148 5361145 +
aaacttaaagtataataataaaag

SEQ ID NO: 67503 - DNA, 24 bp, Artificial Sequence
  Synthetic oligonucleotide; AAAGAAA chr11 5361129 5361152 5361149 +
ttaaagtataataataaaagaaag

SEQ ID NO: 67504 - DNA, 24 bp, Artificial Sequence
  Synthetic oligonucleotide; AAAGAAA chr11 5361133 5361156 5361153 +
agtataataataaaagaaagaaag

SEQ ID NO: 67505 - DNA, 24 bp, Artificial Sequence
  Synthetic oligonucleotide; GAAGAAA chr11 5361248 5361271 5361268 +
gctaattccctaacctagatgcag

SEQ ID NO: 67506 - DNA, 24 bp, Artificial Sequence
  Synthetic oligonucleotide; GGAGAAT chr11 5361297 5361320 5361317 +
caaagttctaaatccctcaggctg

SEQ ID NO: 67507 - DNA, 24 bp, Artificial Sequence
  Synthetic oligonucleotide; TAAGAAT chr11 5361605 5361628 5361625 +
tatcagtcaagatgtgatggggta

SEQ ID NO: 67508 - DNA, 24 bp, Artificial Sequence
  Synthetic oligonucleotide; ACAGAAT chr11 5361767 5361790 5361787 +
atcaagttgaaaatccacgggaat

SEQ ID NO: 67509 - DNA, 24 bp, Artificial Sequence
  Synthetic oligonucleotide; ACAGAAA chr11 5361952 5361975 5361972 +
ctgtaatgacaagggtatagacta

SEQ ID NO: 67510 - DNA, 24 bp, Artificial Sequence
  Synthetic oligonucleotide; AAAGAAA chr11 5361956 5361979 5361976 +
aatgacaagggtatagactaacag

SEQ ID NO: 67511 - DNA, 24 bp, Artificial Sequence
  Synthetic oligonucleotide; CCAGAAA chr11 5362043 5362066 5362063 +
aatgctttaaattgctgcatattc

SEQ ID NO: 67512 - DNA, 24 bp, Artificial Sequence
  Synthetic oligonucleotide; TCAGAAA chr11 5362065 5362088 5362085 +
tcccagaaatgagcctagtatcca

SEQ ID NO: 67513 - DNA, 24 bp, Artificial Sequence
  Synthetic oligonucleotide; TGAGAAT chr11 5362421 5362444 5362441 +
aacattagttgttgagccttataa

SEQ ID NO: 67514 - DNA, 24 bp, Artificial Sequence
  Synthetic oligonucleotide; TCAGAAT chr11 5362463 5362486 5362483 +
atcaggtctactggatactatgaa

SEQ ID NO: 67515 - DNA, 24 bp, Artificial Sequence
  Synthetic oligonucleotide; TAAGAAA chr11 5362534 5362557 5362554 +
agatgaagtcaggaaagcaaaaga

SEQ ID NO: 67516 - DNA, 24 bp, Artificial Sequence
  Synthetic oligonucleotide; AAAGAAA chr11 5362954 5362977 5362974 +
cagatgtatggcattaaaaaaaaa

SEQ ID NO: 67517 - DNA, 24 bp, Artificial Sequence
  Synthetic oligonucleotide; AGAGAAA chr11 5363077 5363100 5363097 +
atgtctgagtggcattcctccatg

SEQ ID NO: 67518 - DNA, 24 bp, Artificial Sequence
  Synthetic oligonucleotide; GAAGAAA chr11 5363092 5363115 5363112 +
tcctccatgagagaaagcttaagg

SEQ ID NO: 67519 - DNA, 24 bp, Artificial Sequence
  Synthetic oligonucleotide; ACAGAAT chr11 5363136 5363159 5363156 +
tcttcaaaactcaaagttttacga

SEQ ID NO: 67520 - DNA, 24 bp, Artificial Sequence
  Synthetic oligonucleotide; GGAGAAA chr11 5363152 5363175 5363172 +
ttttacgaacagaatgattagtct

SEQ ID NO: 67521 - DNA, 24 bp, Artificial Sequence
  Synthetic oligonucleotide; GCAGAAA chr11 5363560 5363583 5363580 +
gataccaagtttttgagtgtgaat

SEQ ID NO: 67522 - DNA, 24 bp, Artificial Sequence
  Synthetic oligonucleotide; ACAGAAA chr11 5363636 5363659 5363656 +
atattgtctggaatcttatgtgac

SEQ ID NO: 67523 - DNA, 24 bp, Artificial Sequence
  Synthetic oligonucleotide; ATAGAAA chr11 5363800 5363823 5363820 +
catccagactatatttagtgtaca

SEQ ID NO: 67524 - DNA, 24 bp, Artificial Sequence
  Synthetic oligonucleotide; GAAGAAT chr11 5363947 5363970 5363967 +
gaggagaagcttgtgttaggaatg

SEQ ID NO: 67525 - DNA, 24 bp, Artificial Sequence
  Synthetic oligonucleotide; AAAGAAA chr11 5364107 5364130 5364127 +
taaaggaagaggtatctcaacact

SEQ ID NO: 67526 - DNA, 24 bp, Artificial Sequence
  Synthetic oligonucleotide; GCAGAAA chr11 5364328 5364351 5364348 +
gggtgatatggaggcaagccaaat

SEQ ID NO: 67527 - DNA, 24 bp, Artificial Sequence
  Synthetic oligonucleotide; TTAGAAA chr11 5364425 5364448 5364445 +
tatgagagctgcacatctttctgt

SEQ ID NO: 67528 - DNA, 24 bp, Artificial Sequence
  Synthetic oligonucleotide; TTAGAAT chr11 5365257 5365280 5365277 +
gggctggtggtgagaacagtgtta

SEQ ID NO: 67529 - DNA, 24 bp, Artificial Sequence
  Synthetic oligonucleotide; GTAGAAA chr11 5365399 5365422 5365419 +
atgagagacaagatcaagcatact

SEQ ID NO: 67530 - DNA, 24 bp, Artificial Sequence
  Synthetic oligonucleotide; TGAGAAA chr11 5365647 5365670 5365667 +
cctccaaatgtgttgaggccctaa

SEQ ID NO: 67531 - DNA, 24 bp, Artificial Sequence
  Synthetic oligonucleotide; TAAGAAA chr11 5366119 5366142 5366139 +
tagaggtgaacccagtgggcaaaa

SEQ ID NO: 67532 - DNA, 24 bp, Artificial Sequence
  Synthetic oligonucleotide; GGAGAAA chr11 5366218 5366241 5366238 +
cagtaggaaagtatagaagacaaa

SEQ ID NO: 67533 - DNA, 24 bp, Artificial Sequence
  Synthetic oligonucleotide; AGAGAAA chr11 5366230 5366253 5366250 +
atagaagacaaaggagaaagggcc

SEQ ID NO: 67534 - DNA, 24 bp, Artificial Sequence
  Synthetic oligonucleotide; GAAGAAT chr11 5366243 5366266 5366263 +
gagaaagggccagagaaacagaag

SEQ ID NO: 67535 - DNA, 24 bp, Artificial Sequence
  Synthetic oligonucleotide; AAAGAAA chr11 5366294 5366317 5366314 +
aggttcctctgtgggtagcctgtt

SEQ ID NO: 67536 - DNA, 24 bp, Artificial Sequence
  Synthetic oligonucleotide; GGAGAAT chr11 5366492 5366515 5366512 +
gcagctacacaggaggctgaggta

SEQ ID NO: 67537 - DNA, 24 bp, Artificial Sequence
  Synthetic oligonucleotide; TGAGAAA chr11 5366580 5366603 5366600 +
gcagcctggaaggcaaaagcaaga

SEQ ID NO: 67538 - DNA, 24 bp, Artificial Sequence
  Synthetic oligonucleotide; AAAGAAA chr11 5366584 5366607 5366604 +
cctggaaggcaaaagcaagatgag

SEQ ID NO: 67539 - DNA, 24 bp, Artificial Sequence
  Synthetic oligonucleotide; AGAGAAA chr11 5366592 5366615 5366612 +
gcaaaagcaagatgagaaagaaat

SEQ ID NO: 67540 - DNA, 24 bp, Artificial Sequence
  Synthetic oligonucleotide; GAAGAAA chr11 5366671 5366694 5366691 +
gaagaagaagaagaaggagaagga

SEQ ID NO: 67541 - DNA, 24 bp, Artificial Sequence
  Synthetic oligonucleotide; TTAGAAT chr11 5366751 5366774 5366771 +
gtattcacttgagattcaaagtct

SEQ ID NO: 67542 - DNA, 24 bp, Artificial Sequence
  Synthetic oligonucleotide; CCAGAAA chr11 5367201 5367224 5367221 +
agatttttgaagttaaaagcattg

SEQ ID NO: 67543 - DNA, 24 bp, Artificial Sequence
  Synthetic oligonucleotide; CAAGAAA chr11 5367254 5367277 5367274 +
gagagggttcttggatttcgtgcc

SEQ ID NO: 67544 - DNA, 24 bp, Artificial Sequence
  Synthetic oligonucleotide; AAAGAAT chr11 5367258 5367281 5367278 +
gggttcttggatttcgtgcccaag

SEQ ID NO: 67545 - DNA, 24 bp, Artificial Sequence
  Synthetic oligonucleotide; ACAGAAA chr11 5367280 5367303 5367300 +
agaaagaatttggggcaaatccat

SEQ ID NO: 67546 - DNA, 24 bp, Artificial Sequence
  Synthetic oligonucleotide; TAAGAAA chr11 5367304 5367327 5367324 +
acagaaaagtgaaagcaagttaat

SEQ ID NO: 67547 - DNA, 24 bp, Artificial Sequence
  Synthetic oligonucleotide; TGAGAAT chr11 5367647 5367670 5367667 +
caacctcttatctcatcctgtgac

SEQ ID NO: 67548 - DNA, 24 bp, Artificial Sequence
  Synthetic oligonucleotide; CCAGAAT chr11 5367786 5367809 5367806 +
atgttgtttctggtatgctagcac

SEQ ID NO: 67549 - DNA, 24 bp, Artificial Sequence
  Synthetic oligonucleotide; ATAGAAA chr11 5368426 5368449 5368446 +
agtgcctggtccattgtaagtatt

SEQ ID NO: 67550 - DNA, 24 bp, Artificial Sequence
  Synthetic oligonucleotide; AAAGAAA chr11 5368527 5368550 5368547 +
gaagatactctgtctagctctgac

SEQ ID NO: 67551 - DNA, 24 bp, Artificial Sequence
  Synthetic oligonucleotide; TGAGAAA chr11 5368633 5368656 5368653 +
tgttttattctcacatgcatcctg

SEQ ID NO: 67552 - DNA, 24 bp, Artificial Sequence
  Synthetic oligonucleotide; GCAGAAT chr11 5369041 5369064 5369061 +
ttcaccaagatgagtgcctttgaa

SEQ ID NO: 67553 - DNA, 24 bp, Artificial Sequence
  Synthetic oligonucleotide; CTAGAAT chr11 5369091 5369114 5369111 +
ccacctagagacatatggccatga

SEQ ID NO: 67554 - DNA, 24 bp, Artificial Sequence
  Synthetic oligonucleotide; ACAGAAA chr11 5369112 5369135 5369132 +
tgactagaatctaaggttagacat

SEQ ID NO: 67555 - DNA, 24 bp, Artificial Sequence
  Synthetic oligonucleotide; GTAGAAA chr11 5369261 5369284 5369281 +
atgtatgcccatgtgtgtggggta

SEQ ID NO: 67556 - DNA, 24 bp, Artificial Sequence
  Synthetic oligonucleotide; GGAGAAT chr11 5369376 5369399 5369396 +
tatttgcaaaatataacactttta

SEQ ID NO: 67557 - DNA, 24 bp, Artificial Sequence
  Synthetic oligonucleotide; ATAGAAA chr11 5369886 5369909 5369906 +
gacctcattggttttgctatcaac

SEQ ID NO: 67558 - DNA, 24 bp, Artificial Sequence
  Synthetic oligonucleotide; AAAGAAA chr11 5369890 5369913 5369910 +
tcattggttttgctatcaacatag

SEQ ID NO: 67559 - DNA, 24 bp, Artificial Sequence
  Synthetic oligonucleotide; ATAGAAA chr11 5370080 5370103 5370100 +
gtacagcatgtgcaagctgcttct

SEQ ID NO: 67560 - DNA, 24 bp, Artificial Sequence
  Synthetic oligonucleotide; ATAGAAA chr11 5370092 5370115 5370112 +
caagctgcttctatagaaatgcat

SEQ ID NO: 67561 - DNA, 24 bp, Artificial Sequence
  Synthetic oligonucleotide; CCAGAAA chr11 5370464 5370487 5370484 +
caatttgagggcaataatttaatg

SEQ ID NO: 67562 - DNA, 24 bp, Artificial Sequence
  Synthetic oligonucleotide; TTAGAAA chr11 5370546 5370569 5370566 +
ctccctttctcactctttctgtgt

SEQ ID NO: 67563 - DNA, 24 bp, Artificial Sequence
  Synthetic oligonucleotide; ATAGAAT chr11 5370559 5370582 5370579 +
tctttctgtgtttagaaatgaata

SEQ ID NO: 67564 - DNA, 24 bp, Artificial Sequence
  Synthetic oligonucleotide; AAAGAAA chr11 5370764 5370787 5370784 +
ttacaacctcatatagctgctatg

SEQ ID NO: 67565 - DNA, 24 bp, Artificial Sequence
  Synthetic oligonucleotide; AAAGAAA chr11 5370768 5370791 5370788 +
aacctcatatagctgctatgaaag

SEQ ID NO: 67566 - DNA, 24 bp, Artificial Sequence
  Synthetic oligonucleotide; AGAGAAT chr11 5370789 5370812 5370809 +
aagaaagaaaaaatttgatgcaat

SEQ ID NO: 67567 - DNA, 24 bp, Artificial Sequence
  Synthetic oligonucleotide; CTAGAAA chr11 5371168 5371191 5371188 +
gatatacaagggcactgaaatatt

SEQ ID NO: 67568 - DNA, 24 bp, Artificial Sequence
  Synthetic oligonucleotide; AAAGAAT chr11 5371395 5371418 5371415 +
gccggagatataaaatttcaacat

SEQ ID NO: 67569 - DNA, 24 bp, Artificial Sequence
  Synthetic oligonucleotide; AGAGAAA chr11 5371477 5371500 5371497 +
ctaaagagtactgatattaaaaat

SEQ ID NO: 67570 - DNA, 24 bp, Artificial Sequence
  Synthetic oligonucleotide; ACAGAAA chr11 5371564 5371587 5371584 +
tgaaggaccctaaacaattaggaa

SEQ ID NO: 67571 - DNA, 24 bp, Artificial Sequence
  Synthetic oligonucleotide; CTAGAAA chr11 5372223 5372246 5372243 +
attaacatgagagtgcagatagct

SEQ ID NO: 67572 - DNA, 24 bp, Artificial Sequence
  Synthetic oligonucleotide; AGAGAAA chr11 5372265 5372288 5372285 +
atttattttggatacatatacagc

SEQ ID NO: 67573 - DNA, 24 bp, Artificial Sequence
  Synthetic oligonucleotide; TGAGAAA chr11 5372308 5372331 5372328 +
acaataactctatttttagttgtt

SEQ ID NO: 67574 - DNA, 24 bp, Artificial Sequence
  Synthetic oligonucleotide; AGAGAAA chr11 5372538 5372561 5372558 +
cctgctgaccatttgcatgtcttc

SEQ ID NO: 67575 - DNA, 24 bp, Artificial Sequence
  Synthetic oligonucleotide; GCAGAAA chr11 5372712 5372735 5372732 +
tttgatgattgttttctttgctgt

SEQ ID NO: 67576 - DNA, 24 bp, Artificial Sequence
  Synthetic oligonucleotide; ACAGAAA chr11 5372785 5372808 5372805 +
gttacctgagctctggcacatttt

SEQ ID NO: 67577 - DNA, 24 bp, Artificial Sequence
  Synthetic oligonucleotide; TGAGAAA chr11 5372848 5372871 5372868 +
acccccaaatggccaaaacaatct

SEQ ID NO: 67578 - DNA, 24 bp, Artificial Sequence
  Synthetic oligonucleotide; AAAGAAA chr11 5372852 5372875 5372872 +
ccaaatggccaaaacaatcttgag

SEQ ID NO: 67579 - DNA, 24 bp, Artificial Sequence
  Synthetic oligonucleotide; ACAGAAT chr11 5372966 5372989 5372986 +
aaatagacacatagaccaaattga

SEQ ID NO: 67580 - DNA, 24 bp, Artificial Sequence
  Synthetic oligonucleotide; CCAGAAA chr11 5372980 5373003 5373000 +
accaaattgaacagaataaagagc

SEQ ID NO: 67581 - DNA, 24 bp, Artificial Sequence
  Synthetic oligonucleotide; AAAGAAT chr11 5373096 5373119 5373116 +
gggaaaactggatatccaaatgca

SEQ ID NO: 67582 - DNA, 24 bp, Artificial Sequence
  Synthetic oligonucleotide; GAAGAAA chr11 5373255 5373278 5373275 +
attttttagatattgtcttgattt

SEQ ID NO: 67583 - DNA, 24 bp, Artificial Sequence
  Synthetic oligonucleotide; ACAGAAA chr11 5374274 5374297 5374294 +
gtctgttagaaggaaaactaacaa

SEQ ID NO: 67584 - DNA, 24 bp, Artificial Sequence
  Synthetic oligonucleotide; GCAGAAA chr11 5374367 5374390 5374387 +
ccacaaagttggggaaaaaacaga

SEQ ID NO: 67585 - DNA, 24 bp, Artificial Sequence
  Synthetic oligonucleotide; GGAGAAT chr11 5374455 5374478 5374475 +
accagcaacggaacaaagctggat

SEQ ID NO: 67586 - DNA, 24 bp, Artificial Sequence
  Synthetic oligonucleotide; CTAGAAT chr11 5374584 5374607 5374604 +
aaaaaaatttagatgaatgtataa

SEQ ID NO: 67587 - DNA, 24 bp, Artificial Sequence
  Synthetic oligonucleotide; CGAGAAT chr11 5374643 5374666 5374663 +
ctgatggagctgaaagccaaggct

SEQ ID NO: 67588 - DNA, 24 bp, Artificial Sequence
  Synthetic oligonucleotide; GAAGAAT chr11 5374655 5374678 5374675 +
aaagccaaggctcgagaatgacgt

SEQ ID NO: 67589 - DNA, 24 bp, Artificial Sequence
  Synthetic oligonucleotide; GAAGAAA chr11 5374694 5374717 5374714 +
ctcaggagctgatgcgatcaactg

SEQ ID NO: 67590 - DNA, 24 bp, Artificial Sequence
  Synthetic oligonucleotide; AGAGAAA chr11 5374754 5374777 5374774 +
gaaatgaagcgagaagggaagttt

SEQ ID NO: 67591 - DNA, 24 bp, Artificial Sequence
  Synthetic oligonucleotide; AAAGAAT chr11 5374761 5374784 5374781 +
agcgagaagggaagtttagagaaa

SEQ ID NO: 67592 - DNA, 24 bp, Artificial Sequence
  Synthetic oligonucleotide; AAAGAAA chr11 5374770 5374793 5374790 +
ggaagtttagagaaaaaagaataa

SEQ ID NO: 67593 - DNA, 24 bp, Artificial Sequence
  Synthetic oligonucleotide; CAAGAAA chr11 5374790 5374813 5374810 +
ataaaaagaaatgaacaaagcctc

SEQ ID NO: 67594 - DNA, 24 bp, Artificial Sequence
  Synthetic oligonucleotide; GGAGAAT chr11 5374855 5374878 5374875 +
gattggtgtacctgaaagtgacgg

SEQ ID NO: 67595 - DNA, 24 bp, Artificial Sequence
  Synthetic oligonucleotide; AGAGAAA chr11 5375056 5375079 5375076 +
ggaaaaaatgttaagggcagccag

SEQ ID NO: 67596 - DNA, 24 bp, Artificial Sequence
  Synthetic oligonucleotide; GCAGAAA chr11 5375114 5375137 5375134 +
atcagactaacagcagctctcttg

SEQ ID NO: 67597 - DNA, 24 bp, Artificial Sequence
  Synthetic oligonucleotide; AAAGAAT chr11 5375170 5375193 5375190 +
gccaatattcaacatccttaaagg

SEQ ID NO: 67598 - DNA, 24 bp, Artificial Sequence
  Synthetic oligonucleotide; ACAGAAT chr11 5375184 5375207 5375204 +
tccttaaaggaaagaattttcaac

SEQ ID NO: 67599 - DNA, 24 bp, Artificial Sequence
  Synthetic oligonucleotide; GGAGAAA chr11 5375225 5375248 5375245 +
gccaaactaagcttcataagtgaa

SEQ ID NO: 67600 - DNA, 24 bp, Artificial Sequence
  Synthetic oligonucleotide; GAAGAAA chr11 5375385 5375408 5375405 +
aaatgtgaagaccatcaagactag

SEQ ID NO: 67601 - DNA, 24 bp, Artificial Sequence
  Synthetic oligonucleotide; ACAGAAA chr11 5375882 5375905 5375902 +
gtcaacattagacagatcaacgag

SEQ ID NO: 67602 - DNA, 24 bp, Artificial Sequence
  Synthetic oligonucleotide; ACAGAAT chr11 5375973 5375996 5375993 +
tacagaactctccaccccaaatca

SEQ ID NO: 67603 - DNA, 24 bp, Artificial Sequence
  Synthetic oligonucleotide; ACAGAAA chr11 5376067 5376090 5376087 +
gctctcctcagcaaatataaaaga

SEQ ID NO: 67604 - DNA, 24 bp, Artificial Sequence
  Synthetic oligonucleotide; TAAGAAA chr11 5376126 5376149 5376146 +
tgcaatcaaactagaactcaggat

SEQ ID NO: 67605 - DNA, 24 bp, Artificial Sequence
  Synthetic oligonucleotide; GCAGAAA chr11 5376211 5376234 5376231 +
tactgggtacataacgaaatgaag

SEQ ID NO: 67606 - DNA, 24 bp, Artificial Sequence
  Synthetic oligonucleotide; CCAGAAT chr11 5376261 5376284 5376281 +
caatgagaacaaagacacaacata

SEQ ID NO: 67607 - DNA, 24 bp, Artificial Sequence
  Synthetic oligonucleotide; AGAGAAA chr11 5376326 5376349 5376346 +
aatttatagcactaaacgcccaca

SEQ ID NO: 67608 - DNA, 24 bp, Artificial Sequence
  Synthetic oligonucleotide; CAAGAAA chr11 5376334 5376357 5376354 +
gcactaaacgcccacaagagaaag

SEQ ID NO: 67609 - DNA, 24 bp, Artificial Sequence
  Synthetic oligonucleotide; CAAGAAA chr11 5376421 5376444 5376441 +
acacattcaaaagctagcagaagt

SEQ ID NO: 67610 - DNA, 24 bp, Artificial Sequence
  Synthetic oligonucleotide; TAAGAAA chr11 5376551 5376574 5376571 +
ctgatagaccgctagcaagactaa

SEQ ID NO: 67611 - DNA, 24 bp, Artificial Sequence
  Synthetic oligonucleotide; GAAGAAT chr11 5376563 5376586 5376583 +
tagcaagactaataagaaaagaga

SEQ ID NO: 67612 - DNA, 24 bp, Artificial Sequence
  Synthetic oligonucleotide; ACAGAAA chr11 5376619 5376642 5376639 +
aaaggggatatcaccaccgatccc

SEQ ID NO: 67613 - DNA, 24 bp, Artificial Sequence
  Synthetic oligonucleotide; AGAGAAT chr11 5376640 5376663 5376660 +
cccacagaaatacaaactgccatc

SEQ ID NO: 67614 - DNA, 24 bp, Artificial Sequence
  Synthetic oligonucleotide; CTAGAAA chr11 5376673 5376696 5376693 +
tacaaacacctctacgcaaataaa

SEQ ID NO: 67615 - DNA, 24 bp, Artificial Sequence
  Synthetic oligonucleotide; GAAGAAA chr11 5376685 5376708 5376705 +
tacgcaaataaactagaaaatcta

SEQ ID NO: 67616 - DNA, 24 bp, Artificial Sequence
  Synthetic oligonucleotide; ACAGAAA chr11 5376901 5376924 5376921 +
ttccttctgaaactattccaatca

SEQ ID NO: 67617 - DNA, 24 bp, Artificial Sequence
  Synthetic oligonucleotide; CCAGAAA chr11 5376964 5376987 5376984 +
gccagcatcatcctaataccaaag

SEQ ID NO: 67618 - DNA, 24 bp, Artificial Sequence
  Synthetic oligonucleotide; AGAGAAT chr11 5376987 5377010 5377007 +
gccagaaagagacacaaccaaaaa

SEQ ID NO: 67619 - DNA, 24 bp, Artificial Sequence
  Synthetic oligonucleotide; GCAGAAA chr11 5377207 5377230 5377227 +
aaccacatgattatctcaatagat

SEQ ID NO: 67620 - DNA, 24 bp, Artificial Sequence
  Synthetic oligonucleotide; TAAGAAA chr11 5377475 5377498 5377495 +
agacaggaaaaaagggtattcaat

SEQ ID NO: 67621 - DNA, 24 bp, Artificial Sequence
  Synthetic oligonucleotide; CTAGAAA chr11 5377528 5377551 5377548 +
tttgcagacgacatgattgtatat

SEQ ID NO: 67622 - DNA, 24 bp, Artificial Sequence
  Synthetic oligonucleotide; AGAGAAT chr11 5377697 5377720 5377717 +
aactcccattcacaattgcttcaa

SEQ ID NO: 67623 - DNA, 24 bp, Artificial Sequence
  Synthetic oligonucleotide; GAAGAAT chr11 5377829 5377852 5377849 +
agaacattccatgcttatgggtag

SEQ ID NO: 67624 - DNA, 24 bp, Artificial Sequence
  Synthetic oligonucleotide; ACAGAAT chr11 5377918 5377941 5377938 +
atcaagctaccaatgattttcttc

SEQ ID NO: 67625 - DNA, 24 bp, Artificial Sequence
  Synthetic oligonucleotide; TCAGAAA chr11 5378118 5378141 5378138 +
gatcaatggaacagaacagagccc

SEQ ID NO: 67626 - DNA, 24 bp, Artificial Sequence
  Synthetic oligonucleotide; TGAGAAA chr11 5378165 5378188 5378185 +
caactatctgatctttgaaaaacc

SEQ ID NO: 67627 - DNA, 24 bp, Artificial Sequence
  Synthetic oligonucleotide; CAAGAAA chr11 5378174 5378197 5378194 +
gatctttgaaaaacctgagaaaaa

SEQ ID NO: 67628 - DNA, 24 bp, Artificial Sequence
  Synthetic oligonucleotide; GTAGAAT chr11 5378236 5378259 5378256 +
gctgggagaactggctagccatat

SEQ ID NO: 67629 - DNA, 24 bp, Artificial Sequence
  Synthetic oligonucleotide; GAAGAAA chr11 5378337 5378360 5378357 +
agacctaaaaccataaaaacccta

SEQ ID NO: 67630 - DNA, 24 bp, Artificial Sequence
  Synthetic oligonucleotide; AAAGAAA chr11 5378472 5378495 5378492 +
aaactaaagagcttctgcacagct

SEQ ID NO: 67631 - DNA, 24 bp, Artificial Sequence
  Synthetic oligonucleotide; GGAGAAA chr11 5378513 5378536 5378533 +
agtgaacaggcaacctacacaatg

SEQ ID NO: 67632 - DNA, 24 bp, Artificial Sequence
  Synthetic oligonucleotide; CCAGAAT chr11 5378557 5378580 5378577 +
actcatctgacaaagggctaatat

SEQ ID NO: 67633 - DNA, 24 bp, Artificial Sequence
  Synthetic oligonucleotide; CAAGAAA chr11 5378588 5378611 5378608 +
ctataatgaactcaaacaaattta

SEQ ID NO: 67634 - DNA, 24 bp, Artificial Sequence
  Synthetic oligonucleotide; AAAGAAA chr11 5378649 5378672 5378669 +
aaggatatgaacagacacttctca

SEQ ID NO: 67635 - DNA, 24 bp, Artificial Sequence
  Synthetic oligonucleotide; AGAGAAA chr11 5378709 5378732 5378729 +
aaatgctcatcatcactggccatc

SEQ ID NO: 67636 - DNA, 24 bp, Artificial Sequence
  Synthetic oligonucleotide; TTAGAAT chr11 5378755 5378778 5378775 +
caatgagataccatctcataccag

SEQ ID NO: 67637 - DNA, 24 bp, Artificial Sequence
  Synthetic oligonucleotide; GGAGAAA chr11 5378808 5378831 5378828 +
aacaacaggtgctggagaggatgt

SEQ ID NO: 67638 - DNA, 24 bp, Artificial Sequence
  Synthetic oligonucleotide; CTAGAAA chr11 5378901 5378924 5378921 +
tggcgattcctcagggatctagaa

SEQ ID NO: 67639 - DNA, 24 bp, Artificial Sequence
  Synthetic oligonucleotide; TAAGAAA chr11 5379065 5379088 5379085 +
atgtccaacaatgatagactggat

SEQ ID NO: 67640 - DNA, 24 bp, Artificial Sequence
  Synthetic oligonucleotide; TTAGAAT chr11 5379741 5379764 5379761 +
gtttaatccattttttgtttcctt

SEQ ID NO: 67641 - DNA, 24 bp, Artificial Sequence
  Synthetic oligonucleotide; CCAGAAT chr11 5379939 5379962 5379959 +
gcccgatcttggacttttaagtca

SEQ ID NO: 67642 - DNA, 24 bp, Artificial Sequence
  Synthetic oligonucleotide; TAAGAAA chr11 5380655 5380678 5380675 +
ccatctgtaaaaatctgaaaaagc

SEQ ID NO: 67643 - DNA, 24 bp, Artificial Sequence
  Synthetic oligonucleotide; GAAGAAT chr11 5380756 5380779 5380776 +
gagagaggaagatcatcctcaaag

SEQ ID NO: 67644 - DNA, 24 bp, Artificial Sequence
  Synthetic oligonucleotide; GAAGAAA chr11 5380823 5380846 5380843 +
tgaggacacgggaaggtggtgctg

SEQ ID NO: 67645 - DNA, 24 bp, Artificial Sequence
  Synthetic oligonucleotide; TCAGAAT chr11 5380876 5380899 5380896 +
gggatagtagggccttggtgctgg

SEQ ID NO: 67646 - DNA, 24 bp, Artificial Sequence
  Synthetic oligonucleotide; TCAGAAA chr11 5381454 5381477 5381474 +
catcctcctcttggcctccaggct

SEQ ID NO: 67647 - DNA, 24 bp, Artificial Sequence
  Synthetic oligonucleotide; TGAGAAT chr11 5381643 5381666 5381663 +
ttaatgcacgtcaatgaaaattga

SEQ ID NO: 67648 - DNA, 24 bp, Artificial Sequence
  Synthetic oligonucleotide; AAAGAAT chr11 5381731 5381754 5381751 +
aatctaaaggtcatttagagcaat

SEQ ID NO: 67649 - DNA, 24 bp, Artificial Sequence
  Synthetic oligonucleotide; AGAGAAA chr11 5381814 5381837 5381834 +
actggtccttcaattatataattc

SEQ ID NO: 67650 - DNA, 24 bp, Artificial Sequence
  Synthetic oligonucleotide; ATAGAAT chr11 5381820 5381843 5381840 +
ccttcaattatataattcagagaa

SEQ ID NO: 67651 - DNA, 24 bp, Artificial Sequence
  Synthetic oligonucleotide; AAAGAAA chr11 5382988 5383011 5383008 +
tggagaggttgtgtgtgagttttg

SEQ ID NO: 67652 - DNA, 24 bp, Artificial Sequence
  Synthetic oligonucleotide; AGAGAAA chr11 5382995 5383018 5383015 +
gttgtgtgtgagttttgaaagaaa

SEQ ID NO: 67653 - DNA, 24 bp, Artificial Sequence
  Synthetic oligonucleotide; CCAGAAA chr11 5383103 5383126 5383123 +
tctaaatgttgatggcatttgcta

SEQ ID NO: 67654 - DNA, 24 bp, Artificial Sequence
  Synthetic oligonucleotide; AGAGAAT chr11 5383362 5383385 5383382 +
gacaggaaaatgagtgcaggagtg

SEQ ID NO: 67655 - DNA, 24 bp, Artificial Sequence
  Synthetic oligonucleotide; AAAGAAA chr11 5383678 5383701 5383698 +
gcttcaggagacaggggtggagat

SEQ ID NO: 67656 - DNA, 24 bp, Artificial Sequence
  Synthetic oligonucleotide; GGAGAAA chr11 5383963 5383986 5383983 +
ttagggggacatgggagagaggag

SEQ ID NO: 67657 - DNA, 24 bp, Artificial Sequence
  Synthetic oligonucleotide; TTAGAAA chr11 5384166 5384189 5384186 +
ttgttgtttctttgtttgttgttt

SEQ ID NO: 67658 - DNA, 24 bp, Artificial Sequence
  Synthetic oligonucleotide; TTAGAAA chr11 5384350 5384373 5384370 +
atttttcacttggaaaatgaagtc

SEQ ID NO: 67659 - DNA, 24 bp, Artificial Sequence
  Synthetic oligonucleotide; ACAGAAT chr11 5384368 5384391 5384388 +
gaagtcttagaaaccagggttctc

SEQ ID NO: 67660 - DNA, 24 bp, Artificial Sequence
  Synthetic oligonucleotide; AGAGAAA chr11 5384416 5384439 5384436 +
gagtctatgcacagaaccagagcc

SEQ ID NO: 67661 - DNA, 24 bp, Artificial Sequence
  Synthetic oligonucleotide; ACAGAAA chr11 5384425 5384448 5384445 +
cacagaaccagagccagagaaaga

SEQ ID NO: 67662 - DNA, 24 bp, Artificial Sequence
  Synthetic oligonucleotide; TCAGAAA chr11 5384649 5384672 5384669 +
atacacaccctctccttactctca

SEQ ID NO: 67663 - DNA, 24 bp, Artificial Sequence
  Synthetic oligonucleotide; ATAGAAA chr11 5384716 5384739 5384736 +
attttatatgctggtccagttaac

SEQ ID NO: 67664 - DNA, 24 bp, Artificial Sequence
  Synthetic oligonucleotide; CAAGAAA chr11 5384952 5384975 5384972 +
gtcttttgcatattctcctattta

SEQ ID NO: 67665 - DNA, 24 bp, Artificial Sequence
  Synthetic oligonucleotide; AAAGAAT chr11 5385014 5385037 5385034 +
aataactaatattaaattcaaaca

SEQ ID NO: 67666 - DNA, 24 bp, Artificial Sequence
  Synthetic oligonucleotide; GGAGAAA chr11 5385244 5385267 5385264 +
catggataattatctctcttgcta

SEQ ID NO: 67667 - DNA, 24 bp, Artificial Sequence
  Synthetic oligonucleotide; AGAGAAA chr11 5385291 5385314 5385311 +
tcccaagaggaagtatactttcca

SEQ ID NO: 67668 - DNA, 24 bp, Artificial Sequence
  Synthetic oligonucleotide; AAAGAAT chr11 5385417 5385440 5385437 +
agctgacaacagaaccccaggcac

SEQ ID NO: 67669 - DNA, 24 bp, Artificial Sequence
  Synthetic oligonucleotide; AGAGAAT chr11 5385537 5385560 5385557 +
cactgtcaggctccaggggccttt

SEQ ID NO: 67670 - DNA, 24 bp, Artificial Sequence
  Synthetic oligonucleotide; AAAGAAT chr11 5385639 5385662 5385659 +
atttatgttctaaacatgtataat

SEQ ID NO: 67671 - DNA, 24 bp, Artificial Sequence
  Synthetic oligonucleotide; AAAGAAT chr11 5385798 5385821 5385818 +
atataaaaaatctataaagtatat

SEQ ID NO: 67672 - DNA, 24 bp, Artificial Sequence
  Synthetic oligonucleotide; AAAGAAT chr11 5385960 5385983 5385980 +
aagtatatataaatataaaaatat

SEQ ID NO: 67673 - DNA, 24 bp, Artificial Sequence
  Synthetic oligonucleotide; AGAGAAA chr11 5386018 5386041 5386038 +
acattacaggtactacgtgagaac

SEQ ID NO: 67674 - DNA, 24 bp, Artificial Sequence
  Synthetic oligonucleotide; CAAGAAA chr11 5386144 5386167 5386164 +
tggaaaaacaggggtggtttttgc

SEQ ID NO: 67675 - DNA, 24 bp, Artificial Sequence
  Synthetic oligonucleotide; GAAGAAT chr11 5386163 5386186 5386183 +
tttgccaagaaagcaataaatata

SEQ ID NO: 67676 - DNA, 24 bp, Artificial Sequence
  Synthetic oligonucleotide; CAAGAAA chr11 5386175 5386198 5386195 +
gcaataaatatagaagaataaaaa

SEQ ID NO: 67677 - DNA, 24 bp, Artificial Sequence
  Synthetic oligonucleotide; GAAGAAA chr11 5386199 5386222 5386219 +
caagaaaagtatgtgtagggaatt

SEQ ID NO: 67678 - DNA, 24 bp, Artificial Sequence
  Synthetic oligonucleotide; ACAGAAA chr11 5386785 5386808 5386805 +
aaagaacttagttaaaaattagat

SEQ ID NO: 67679 - DNA, 24 bp, Artificial Sequence
  Synthetic oligonucleotide; GAAGAAT chr11 5386884 5386907 5386904 +
attataaaaaatgcataaatatga

SEQ ID NO: 67680 - DNA, 24 bp, Artificial Sequence
  Synthetic oligonucleotide; GCAGAAA chr11 5386974 5386997 5386994 +
cttttggaaacacctagtgagaag

SEQ ID NO: 67681 - DNA, 24 bp, Artificial Sequence
  Synthetic oligonucleotide; TAAGAAT chr11 5387196 5387219 5387216 +
aagagaaccagcagatcttggcat

SEQ ID NO: 67682 - DNA, 24 bp, Artificial Sequence
  Synthetic oligonucleotide; AAAGAAA chr11 5387406 5387429 5387426 +
tggttgagtagtaaactgagaagt

SEQ ID NO: 67683 - DNA, 24 bp, Artificial Sequence
  Synthetic oligonucleotide; ATAGAAT chr11 5388010 5388033 5388030 +
cacaattacttttgcaccaaccta

SEQ ID NO: 67684 - DNA, 24 bp, Artificial Sequence
  Synthetic oligonucleotide; ACAGAAA chr11 5388275 5388298 5388295 +
aggaattcacattatagaagcaat

SEQ ID NO: 67685 - DNA, 24 bp, Artificial Sequence
  Synthetic oligonucleotide; GAAGAAT chr11 5388490 5388513 5388510 +
caggaaaaaatgtttttattccag

SEQ ID NO: 67686 - DNA, 24 bp, Artificial Sequence
  Synthetic oligonucleotide; GAAGAAT chr11 5388542 5388565 5388562 +
tgagcaagcatactagataaactg

SEQ ID NO: 67687 - DNA, 24 bp, Artificial Sequence
  Synthetic oligonucleotide; TAAGAAA chr11 5388597 5388620 5388617 +
atatacagaggaaattaggataga

SEQ ID NO: 67688 - DNA, 24 bp, Artificial Sequence
  Synthetic oligonucleotide; AGAGAAA chr11 5388619 5388642 5388639 +
gataagaaaataggatatacacgg

SEQ ID NO: 67689 - DNA, 24 bp, Artificial Sequence
  Synthetic oligonucleotide; TTAGAAT chr11 5388775 5388798 5388795 +
atagtcctgaaagagtgatctgaa

SEQ ID NO: 67690 - DNA, 24 bp, Artificial Sequence
  Synthetic oligonucleotide; ACAGAAA chr11 5388831 5388854 5388851 +
aaacagacttgaggtattcagtaa

SEQ ID NO: 67691 - DNA, 24 bp, Artificial Sequence
  Synthetic oligonucleotide; AGAGAAA chr11 5388976 5388999 5388996 +
ttgctagagtctggaaatcaaaag

SEQ ID NO: 67692 - DNA, 24 bp, Artificial Sequence
  Synthetic oligonucleotide; GAAGAAA chr11 5389061 5389084 5389081 +
aatcatggtagtggatgacattaa

SEQ ID NO: 67693 - DNA, 24 bp, Artificial Sequence
  Synthetic oligonucleotide; ATAGAAT chr11 5389070 5389093 5389090 +
agtggatgacattaagaagaaata

SEQ ID NO: 67694 - DNA, 24 bp, Artificial Sequence
  Synthetic oligonucleotide; AAAGAAA chr11 5389208 5389231 5389228 +
aaaactggtgagggcgaggttatc

SEQ ID NO: 67695 - DNA, 24 bp, Artificial Sequence
  Synthetic oligonucleotide; GCAGAAT chr11 5389237 5389260 5389257 +
aagttcaataaagtagtgagattg

SEQ ID NO: 67696 - DNA, 24 bp, Artificial Sequence
  Synthetic oligonucleotide; GAAGAAT chr11 5389323 5389346 5389343 +
gatgttgtgaatgttagtgaagct

SEQ ID NO: 67697 - DNA, 24 bp, Artificial Sequence
  Synthetic oligonucleotide; CCAGAAA chr11 5389336 5389359 5389356 +
ttagtgaagctgaagaattaataa

SEQ ID NO: 67698 - DNA, 24 bp, Artificial Sequence
  Synthetic oligonucleotide; TCAGAAA chr11 5390856 5390879 5390876 +
taactttcagacccccaagtcaca

SEQ ID NO: 67699 - DNA, 24 bp, Artificial Sequence
  Synthetic oligonucleotide; TGAGAAA chr11 5391094 5391117 5391114 +
gatattgaacaatgacatgtaacg

SEQ ID NO: 67700 - DNA, 24 bp, Artificial Sequence
  Synthetic oligonucleotide; TTAGAAT chr11 5391395 5391418 5391415 +
tatgaaggtgtgtgcatgtgtcca

SEQ ID NO: 67701 - DNA, 24 bp, Artificial Sequence
  Synthetic oligonucleotide; GAAGAAT chr11 5391953 5391976 5391973 +
cagctacctgggaggctgaggtgg

SEQ ID NO: 67702 - DNA, 24 bp, Artificial Sequence
  Synthetic oligonucleotide; TTAGAAT chr11 5392317 5392340 5392337 +
attactcaatagcagttccgagac

SEQ ID NO: 67703 - DNA, 24 bp, Artificial Sequence
  Synthetic oligonucleotide; GTAGAAT chr11 5392372 5392395 5392392 +
ttcctattctatagatctcatttg

SEQ ID NO: 67704 - DNA, 24 bp, Artificial Sequence
  Synthetic oligonucleotide; GAAGAAT chr11 5392580 5392603 5392600 +
ttaatttgttactaaacgaatatt

SEQ ID NO: 67705 - DNA, 24 bp, Artificial Sequence
  Synthetic oligonucleotide; GCAGAAT chr11 5392795 5392818 5392815 +
ccagctactcaggaggctggggca

SEQ ID NO: 67706 - DNA, 24 bp, Artificial Sequence
  Synthetic oligonucleotide; AAAGAAA chr11 5392900 5392923 5392920 +
agactccttctcaaaaacaaaaaa

SEQ ID NO: 67707 - DNA, 24 bp, Artificial Sequence
  Synthetic oligonucleotide; CCAGAAT chr11 5392961 5392984 5392981 +
tggtaaaagaggtattttcacata

SEQ ID NO: 67708 - DNA, 24 bp, Artificial Sequence
  Synthetic oligonucleotide; TCAGAAA chr11 5393043 5393066 5393063 +
ttgaaaatattcatgctctgtgtc

SEQ ID NO: 67709 - DNA, 24 bp, Artificial Sequence
  Synthetic oligonucleotide; TAAGAAT chr11 5393236 5393259 5393256 +
aatttgtgttattgttcataattt

SEQ ID NO: 67710 - DNA, 24 bp, Artificial Sequence
  Synthetic oligonucleotide; CTAGAAT chr11 5393260 5393283 5393280 +
taagaatgtaagcatacaaaatgt

SEQ ID NO: 67711 - DNA, 24 bp, Artificial Sequence
  Synthetic oligonucleotide; AAAGAAA chr11 5393422 5393445 5393442 +
aaaaggctataaatatttgtatca

SEQ ID NO: 67712 - DNA, 24 bp, Artificial Sequence
  Synthetic oligonucleotide; CTAGAAT chr11 5393963 5393986 5393983 +
ctccctaactttttgttccctttc

SEQ ID NO: 67713 - DNA, 24 bp, Artificial Sequence
  Synthetic oligonucleotide; ACAGAAA chr11 5394011 5394034 5394031 +
atttagtatcaggaaaagatagca

SEQ ID NO: 67714 - DNA, 24 bp, Artificial Sequence
  Synthetic oligonucleotide; ACAGAAA chr11 5394083 5394106 5394103 +
cttgattttaagagttatagattc

SEQ ID NO: 67715 - DNA, 24 bp, Artificial Sequence
  Synthetic oligonucleotide; ACAGAAT chr11 5394584 5394607 5394604 +
agatggctcatgtaattgaagttc

SEQ ID NO: 67716 - DNA, 24 bp, Artificial Sequence
  Synthetic oligonucleotide; AAAGAAA chr11 5394933 5394956 5394953 +
tctcaaggggacttttgtctggga

SEQ ID NO: 67717 - DNA, 24 bp, Artificial Sequence
  Synthetic oligonucleotide; AAAGAAA chr11 5394938 5394961 5394958 +
aggggacttttgtctgggaaaaga

SEQ ID NO: 67718 - DNA, 24 bp, Artificial Sequence
  Synthetic oligonucleotide; TGAGAAA chr11 5395285 5395308 5395305 +
ctggcatggagtggaagggctgca

SEQ ID NO: 67719 - DNA, 24 bp, Artificial Sequence
  Synthetic oligonucleotide; GAAGAAA chr11 5395303 5395326 5395323 +
gctgcatgagaaagaagctacaga

SEQ ID NO: 67720 - DNA, 24 bp, Artificial Sequence
  Synthetic oligonucleotide; AGAGAAT chr11 5395533 5395556 5395553 +
acttgttactgggctatgccttgt

SEQ ID NO: 67721 - DNA, 24 bp, Artificial Sequence
  Synthetic oligonucleotide; TTAGAAA chr11 5395711 5395734 5395731 +
tcaacatagtaaaaaagctaaggt

SEQ ID NO: 67722 - DNA, 24 bp, Artificial Sequence
  Synthetic oligonucleotide; GTAGAAT chr11 5395971 5395994 5395991 +
atggctctctaatctatggagtag

SEQ ID NO: 67723 - DNA, 24 bp, Artificial Sequence
  Synthetic oligonucleotide; GAAGAAA chr11 5395996 5396019 5396016 +
tagaattgtctcaatttttcagat

SEQ ID NO: 67724 - DNA, 24 bp, Artificial Sequence
  Synthetic oligonucleotide; AGAGAAA chr11 5396241 5396264 5396261 +
aataaaaggcattcaattatgtaa

SEQ ID NO: 67725 - DNA, 24 bp, Artificial Sequence
  Synthetic oligonucleotide; CTAGAAA chr11 5396287 5396310 5396307 +
tttgcagatgacgtgattgcatat

SEQ ID NO: 67726 - DNA, 24 bp, Artificial Sequence
  Synthetic oligonucleotide; AGAGAAT chr11 5396444 5396467 5396464 +
aactcccattcacaattgcttcag

SEQ ID NO: 67727 - DNA, 24 bp, Artificial Sequence
  Synthetic oligonucleotide; GAAGAAA chr11 5396571 5396594 5396591 +
agaacattccatgctcatggatag

SEQ ID NO: 67728 - DNA, 24 bp, Artificial Sequence
  Synthetic oligonucleotide; ACAGAAT chr11 5396660 5396683 5396680 +
atcaagctaccaatgactttcttc

SEQ ID NO: 67729 - DNA, 24 bp, Artificial Sequence
  Synthetic oligonucleotide; TCAGAAA chr11 5396861 5396884 5396881 +
gaccaatggaacaaaacagagccc

SEQ ID NO: 67730 - DNA, 24 bp, Artificial Sequence
  Synthetic oligonucleotide; TGAGAAA chr11 5396908 5396931 5396928 +
caactatctgatctttgacaaacc

SEQ ID NO: 67731 - DNA, 24 bp, Artificial Sequence
  Synthetic oligonucleotide; CAAGAAA chr11 5396917 5396940 5396937 +
gatctttgacaaacctgagaaaaa

SEQ ID NO: 67732 - DNA, 24 bp, Artificial Sequence
  Synthetic oligonucleotide; GAAGAAA chr11 5397080 5397103 5397100 +
agacctaaaaccataaaaactcta

SEQ ID NO: 67733 - DNA, 24 bp, Artificial Sequence
  Synthetic oligonucleotide; AAAGAAA chr11 5397215 5397238 5397235 +
aaactaaagatcttctgcacagca

SEQ ID NO: 67734 - DNA, 24 bp, Artificial Sequence
  Synthetic oligonucleotide; GGAGAAA chr11 5397256 5397279 5397276 +
agtgaacaggcaacctacacaatg

SEQ ID NO: 67735 - DNA, 24 bp, Artificial Sequence
  Synthetic oligonucleotide; CCAGAAT chr11 5397300 5397323 5397320 +
actcatctgacaaagggctaatat

SEQ ID NO: 67736 - DNA, 24 bp, Artificial Sequence
  Synthetic oligonucleotide; AGAGAAA chr11 5397333 5397356 5397353 +
acaatgaactcaaacaaatttaca

SEQ ID NO: 67737 - DNA, 24 bp, Artificial Sequence
  Synthetic oligonucleotide; AGAGAAA chr11 5397448 5397471 5397468 +
aaatgctcatcatcactggccatc

SEQ ID NO: 67738 - DNA, 24 bp, Artificial Sequence
  Synthetic oligonucleotide; TTAGAAT chr11 5397494 5397517 5397514 +
caatgagataccatctcacaccag

SEQ ID NO: 67739 - DNA, 24 bp, Artificial Sequence
  Synthetic oligonucleotide; GGAGAAA chr11 5397547 5397570 5397567 +
aacaacaggtgctggagaggatgt

SEQ ID NO: 67740 - DNA, 24 bp, Artificial Sequence
  Synthetic oligonucleotide; CTAGAAA chr11 5397640 5397663 5397660 +
tggtgattcctcagggatctagaa

SEQ ID NO: 67741 - DNA, 24 bp, Artificial Sequence
  Synthetic oligonucleotide; TAAGAAA chr11 5397804 5397827 5397824 +
atgtccaacaatgatagactggat

SEQ ID NO: 67742 - DNA, 24 bp, Artificial Sequence
  Synthetic oligonucleotide; TTAGAAA chr11 5398189 5398212 5398209 +
cttaaaagtataacaaaaaataag

SEQ ID NO: 67743 - DNA, 24 bp, Artificial Sequence
  Synthetic oligonucleotide; AAAGAAA chr11 5398196 5398219 5398216 +
gtataacaaaaaataagttagaaa

SEQ ID NO: 67744 - DNA, 24 bp, Artificial Sequence
  Synthetic oligonucleotide; TGAGAAT chr11 5398902 5398925 5398922 +
tcaggtagtatctttagagcagtg

SEQ ID NO: 67745 - DNA, 24 bp, Artificial Sequence
  Synthetic oligonucleotide; TGAGAAT chr11 5399313 5399336 5399333 +
aataagctgactgtgattgactcc

SEQ ID NO: 67746 - DNA, 24 bp, Artificial Sequence
  Synthetic oligonucleotide; AGAGAAT chr11 5399342 5399365 5399362 +
attcctgaaagagatatagagtgg

SEQ ID NO: 67747 - DNA, 24 bp, Artificial Sequence
  Synthetic oligonucleotide; GGAGAAT chr11 5399652 5399675 5399672 +
cttgtcaaacaaatcctaaactca

SEQ ID NO: 67748 - DNA, 24 bp, Artificial Sequence
  Synthetic oligonucleotide; CAAGAAA chr11 5399757 5399780 5399777 +
gaaggatgcaaaaaaaaaaaaatg

SEQ ID NO: 67749 - DNA, 24 bp, Artificial Sequence
  Synthetic oligonucleotide; AAAGAAA chr11 5399761 5399784 5399781 +
gatgcaaaaaaaaaaaaatgcaag

SEQ ID NO: 67750 - DNA, 24 bp, Artificial Sequence
  Synthetic oligonucleotide; GAAGAAA chr11 5399775 5399798 5399795 +
aaaatgcaagaaagaaaaaaaaag

SEQ ID NO: 67751 - DNA, 24 bp, Artificial Sequence
  Synthetic oligonucleotide; GAAGAAA chr11 5399886 5399909 5399889 -
cacacctcaaataaccggatattg

SEQ ID NO: 67752 - DNA, 24 bp, Artificial Sequence
  Synthetic oligonucleotide; TCAGAAA chr11 5399582 5399605 5399585 -
cccagtataataggacacaacaaa

SEQ ID NO: 67753 - DNA, 24 bp, Artificial Sequence
  Synthetic oligonucleotide; GTAGAAT chr11 5399571 5399594 5399574 -
aggacacaacaaatcagaaaaaaa

SEQ ID NO: 67754 - DNA, 24 bp, Artificial Sequence
  Synthetic oligonucleotide; ACAGAAT chr11 5399531 5399554 5399534 -
tgatgactgtacccctggagctgg

SEQ ID NO: 67755 - DNA, 24 bp, Artificial Sequence
  Synthetic oligonucleotide; CAAGAAT chr11 5399232 5399255 5399235 -
acatctgtgaggtaaacaaggaga

SEQ ID NO: 67756 - DNA, 24 bp, Artificial Sequence
  Synthetic oligonucleotide; CAAGAAT chr11 5399144 5399167 5399147 -
gataatatgatggcaaaactattt

SEQ ID NO: 67757 - DNA, 24 bp, Artificial Sequence
  Synthetic oligonucleotide; GGAGAAA chr11 5398392 5398415 5398395 -
gagtctctaggagtagagtaatgg

SEQ ID NO: 67758 - DNA, 24 bp, Artificial Sequence
  Synthetic oligonucleotide; TGAGAAT chr11 5397935 5397958 5397938 -
ctttttgtccttgtgatagtttgc

SEQ ID NO: 67759 - DNA, 24 bp, Artificial Sequence
  Synthetic oligonucleotide; GAAGAAA chr11 5396684 5396707 5396687 -
taaagtagttttttccaattctgt

SEQ ID NO: 67760 - DNA, 24 bp, Artificial Sequence
  Synthetic oligonucleotide; TAAGAAT chr11 5396416 5396439 5396419 -
cactgtttgtctgttattggtgta

SEQ ID NO: 67761 - DNA, 24 bp, Artificial Sequence
  Synthetic oligonucleotide; TAAGAAA chr11 5395866 5395889 5395869 -
agtgagcaatgttgcagtgagctc

SEQ ID NO: 67762 - DNA, 24 bp, Artificial Sequence
  Synthetic oligonucleotide; AGAGAAA chr11 5395680 5395703 5395683 -
ccacatgggccctgcctcttttcg

SEQ ID NO: 67763 - DNA, 24 bp, Artificial Sequence
  Synthetic oligonucleotide; TAAGAAA chr11 5395010 5395033 5395013 -
ttctctccccagctgccaacttca

SEQ ID NO: 67764 - DNA, 24 bp, Artificial Sequence
  Synthetic oligonucleotide; TCAGAAA chr11 5394818 5394841 5394821 -
ttaataagacacaaactctgtctt

SEQ ID NO: 67765 - DNA, 24 bp, Artificial Sequence
  Synthetic oligonucleotide; TTAGAAT chr11 5394197 5394220 5394200 -
agtgacttatagtgtattatgccc

SEQ ID NO: 67766 - DNA, 24 bp, Artificial Sequence
  Synthetic oligonucleotide; TAAGAAA chr11 5393872 5393895 5393875 -
ggagaggagtccagcataatggtt

SEQ ID NO: 67767 - DNA, 24 bp, Artificial Sequence
  Synthetic oligonucleotide; TGAGAAA chr11 5393725 5393748 5393728 -
tacctccctacttcacaggtttgg

SEQ ID NO: 67768 - DNA, 24 bp, Artificial Sequence
  Synthetic oligonucleotide; TCAGAAA chr11 5393522 5393545 5393525 -
gattataaaaccgaaatgtcttct

SEQ ID NO: 67769 - DNA, 24 bp, Artificial Sequence
  Synthetic oligonucleotide; AGAGAAA chr11 5393496 5393519 5393499 -
agaaaatttgtatacggcaaagat

SEQ ID NO: 67770 - DNA, 24 bp, Artificial Sequence
  Synthetic oligonucleotide; ATAGAAA chr11 5393484 5393507 5393487 -
tacggcaaagatagagaaatctat

SEQ ID NO: 67771 - DNA, 24 bp, Artificial Sequence
  Synthetic oligonucleotide; ATAGAAT chr11 5392384 5392407 5392387 -
accccattctaccaaatgagatct

SEQ ID NO: 67772 - DNA, 24 bp, Artificial Sequence
  Synthetic oligonucleotide; GAAGAAT chr11 5392355 5392378 5392358 -
ataggaatttcctctcaacatgga

SEQ ID NO: 67773 - DNA, 24 bp, Artificial Sequence
  Synthetic oligonucleotide; TTAGAAT chr11 5392287 5392310 5392290 -
tactatgtggatgtaaattaaagt

SEQ ID NO: 67774 - DNA, 24 bp, Artificial Sequence
  Synthetic oligonucleotide; GCAGAAA chr11 5392244 5392267 5392247 -
taaggagtgccagcctgtaaggct

SEQ ID NO: 67775 - DNA, 24 bp, Artificial Sequence
  Synthetic oligonucleotide; CAAGAAA chr11 5392154 5392177 5392157 -
catgagataccacacaaacataca

SEQ ID NO: 67776 - DNA, 24 bp, Artificial Sequence
  Synthetic oligonucleotide; GGAGAAT chr11 5391724 5391747 5391727 -
gcctcatggtaattttaacctgta

SEQ ID NO: 67777 - DNA, 24 bp, Artificial Sequence
  Synthetic oligonucleotide; GCAGAAA chr11 5391644 5391667 5391647 -
gatataccaccttgatggatgcca

SEQ ID NO: 67778 - DNA, 24 bp, Artificial Sequence
  Synthetic oligonucleotide; TTAGAAA chr11 5390949 5390972 5390952 -
atatggtcaggagagagcacaacc

SEQ ID NO: 67779 - DNA, 24 bp, Artificial Sequence
  Synthetic oligonucleotide; GAAGAAT chr11 5390909 5390932 5390912 -
gtgttgcttgaaacaggtgttgag

SEQ ID NO: 67780 - DNA, 24 bp, Artificial Sequence
  Synthetic oligonucleotide; ATAGAAA chr11 5390844 5390867 5390847 -
gtctgaaagttactgctgaccagg

SEQ ID NO: 67781 - DNA, 24 bp, Artificial Sequence
  Synthetic oligonucleotide; GAAGAAA chr11 5390830 5390853 5390833 -
gctgaccaggatagaaaaagatga

SEQ ID NO: 67782 - DNA, 24 bp, Artificial Sequence
  Synthetic oligonucleotide; AAAGAAT chr11 5390191 5390214 5390194 -
cagggacagccccatcatgggcac

SEQ ID NO: 67783 - DNA, 24 bp, Artificial Sequence
  Synthetic oligonucleotide; TCAGAAT chr11 5389574 5389597 5389577 -
gacgagggttggtcttaataatga

SEQ ID NO: 67784 - DNA, 24 bp, Artificial Sequence
  Synthetic oligonucleotide; AAAGAAA chr11 5389534 5389557 5389537 -
gcctgagatggcaaccatgtacat

SEQ ID NO: 67785 - DNA, 24 bp, Artificial Sequence
  Synthetic oligonucleotide; ATAGAAT chr11 5389474 5389497 5389477 -
ttccaatccaggaaagctggtgag

SEQ ID NO: 67786 - DNA, 24 bp, Artificial Sequence
  Synthetic oligonucleotide; ACAGAAA chr11 5387941 5387964 5387944 -
acctaggtactgaaaatacaatga

SEQ ID NO: 67787 - DNA, 24 bp, Artificial Sequence
  Synthetic oligonucleotide; GAAGAAA chr11 5387783 5387806 5387786 -
cctctctgagtaggtaattttaga

SEQ ID NO: 67788 - DNA, 24 bp, Artificial Sequence
  Synthetic oligonucleotide; CTAGAAA chr11 5387233 5387256 5387236 -
atgccttcctttttagagctctct

SEQ ID NO: 67789 - DNA, 24 bp, Artificial Sequence
  Synthetic oligonucleotide; GCAGAAA chr11 5386632 5386655 5386635 -
ctctactgcagccaccgagattat

SEQ ID NO: 67790 - DNA, 24 bp, Artificial Sequence
  Synthetic oligonucleotide; TTAGAAT chr11 5386571 5386594 5386574 -
tcagtacttcagtagctcctatca

SEQ ID NO: 67791 - DNA, 24 bp, Artificial Sequence
  Synthetic oligonucleotide; GGAGAAA chr11 5386429 5386452 5386432 -
aaacattttattactacttcacaa

SEQ ID NO: 67792 - DNA, 24 bp, Artificial Sequence
  Synthetic oligonucleotide; ATAGAAT chr11 5385861 5385884 5385864 -
tatagatttactcataaatacttt

SEQ ID NO: 67793 - DNA, 24 bp, Artificial Sequence
  Synthetic oligonucleotide; GTAGAAA chr11 5385368 5385391 5385371 -
gagatggacagggagaaggatctg

SEQ ID NO: 67794 - DNA, 24 bp, Artificial Sequence
  Synthetic oligonucleotide; GAAGAAA chr11 5385293 5385316 5385296 -
cttggaaagtatacttcctcttgg

SEQ ID NO: 67795 - DNA, 24 bp, Artificial Sequence
  Synthetic oligonucleotide; GGAGAAA chr11 5385117 5385140 5385120 -
agagtagattcatcttagatcaca

SEQ ID NO: 67796 - DNA, 24 bp, Artificial Sequence
  Synthetic oligonucleotide; GGAGAAT chr11 5384970 5384993 5384973 -
ggaggatactgtttcttgtaaata

SEQ ID NO: 67797 - DNA, 24 bp, Artificial Sequence
  Synthetic oligonucleotide; ACAGAAT chr11 5384507 5384530 5384510 -
cagccctgcctcctggccttccta

SEQ ID NO: 67798 - DNA, 24 bp, Artificial Sequence
  Synthetic oligonucleotide; TGAGAAT chr11 5384416 5384439 5384419 -
ggctctggttctgtgcatagactc

SEQ ID NO: 67799 - DNA, 24 bp, Artificial Sequence
  Synthetic oligonucleotide; GAAGAAT chr11 5384296 5384319 5384299 -
cacacttataatcctggcaacttg

SEQ ID NO: 67800 - DNA, 24 bp, Artificial Sequence
  Synthetic oligonucleotide; AAAGAAA chr11 5384179 5384202 5384182 -
acctcatttctaaaaacaacaaac

SEQ ID NO: 67801 - DNA, 24 bp, Artificial Sequence
  Synthetic oligonucleotide; AAAGAAA chr11 5384164 5384187 5384167 -
acaacaaacaaagaaacaacaaca

SEQ ID NO: 67802 - DNA, 24 bp, Artificial Sequence
  Synthetic oligonucleotide; AAAGAAA chr11 5384155 5384178 5384158 -
aaagaaacaacaacaaaagaaaac

SEQ ID NO: 67803 - DNA, 24 bp, Artificial Sequence
  Synthetic oligonucleotide; GAAGAAA chr11 5383872 5383895 5383875 -
gaagccaatgagtaggttccaaag

SEQ ID NO: 67804 - DNA, 24 bp, Artificial Sequence
  Synthetic oligonucleotide; TTAGAAA chr11 5383108 5383131 5383111 -
tctggtagcaaatgccatcaacat

SEQ ID NO: 67805 - DNA, 24 bp, Artificial Sequence
  Synthetic oligonucleotide; CCAGAAA chr11 5382616 5382639 5382619 -
ggcttgtaggagagggcaccacta

SEQ ID NO: 67806 - DNA, 24 bp, Artificial Sequence
  Synthetic oligonucleotide; TCAGAAA chr11 5382605 5382628 5382608 -
gagggcaccactaccagaaaaatt

SEQ ID NO: 67807 - DNA, 24 bp, Artificial Sequence
  Synthetic oligonucleotide; TAAGAAT chr11 5382333 5382356 5382336 -
ccaacctgagctatgaagactaat

SEQ ID NO: 67808 - DNA, 24 bp, Artificial Sequence
  Synthetic oligonucleotide; ATAGAAA chr11 5382307 5382330 5382310 -
agaatcaaccacagatagggcttt

SEQ ID NO: 67809 - DNA, 24 bp, Artificial Sequence
  Synthetic oligonucleotide; TGAGAAA chr11 5381633 5381656 5381636 -
ttgacgtgcattaagtgcgtcctg

SEQ ID NO: 67810 - DNA, 24 bp, Artificial Sequence
  Synthetic oligonucleotide; TTAGAAT chr11 5381299 5381322 5381302 -
attcaggccttaacctttaaggta

SEQ ID NO: 67811 - DNA, 24 bp, Artificial Sequence
  Synthetic oligonucleotide; AAAGAAT chr11 5381284 5381307 5381287 -
tttaaggtattagaattcattatt

SEQ ID NO: 67812 - DNA, 24 bp, Artificial Sequence
  Synthetic oligonucleotide; AGAGAAA chr11 5381165 5381188 5381168 -
tttgtgtgtgtgtgagagagagag

SEQ ID NO: 67813 - DNA, 24 bp, Artificial Sequence
  Synthetic oligonucleotide; CCAGAAT chr11 5381055 5381078 5381058 -
aagttttatttaaggaacctctat

SEQ ID NO: 67814 - DNA, 24 bp, Artificial Sequence
  Synthetic oligonucleotide; CAAGAAA chr11 5380869 5380892 5380872 -
caaggccctactatccccagggca

SEQ ID NO: 67815 - DNA, 24 bp, Artificial Sequence
  Synthetic oligonucleotide; CCAGAAA chr11 5380582 5380605 5380585 -
ccaagccttaaatccccactctga

SEQ ID NO: 67816 - DNA, 24 bp, Artificial Sequence
  Synthetic oligonucleotide; ACAGAAA chr11 5380496 5380519 5380499 -
agactctttttaggtgtctctgtc

SEQ ID NO: 67817 - DNA, 24 bp, Artificial Sequence
  Synthetic oligonucleotide; TAAGAAA chr11 5380332 5380355 5380335 -
tcttctggactggtccacagcccc

SEQ ID NO: 67818 - DNA, 24 bp, Artificial Sequence
  Synthetic oligonucleotide; TCAGAAA chr11 5380205 5380228 5380208 -
ccacatcttcccacagcaactctt

SEQ ID NO: 67819 - DNA, 24 bp, Artificial Sequence
  Synthetic oligonucleotide; GCAGAAA chr11 5379899 5379922 5379902 -
ggtctcatgctggttccaaacatg

SEQ ID NO: 67820 - DNA, 24 bp, Artificial Sequence
  Synthetic oligonucleotide; AGAGAAA chr11 5379836 5379859 5379839 -
acatgatgagagaggacgccaggg

SEQ ID NO: 67821 - DNA, 24 bp, Artificial Sequence
  Synthetic oligonucleotide; CCAGAAA chr11 5379828 5379851 5379831 -
agagaggacgccagggagagaaac

SEQ ID NO: 67822 - DNA, 24 bp, Artificial Sequence
  Synthetic oligonucleotide; TTAGAAT chr11 5379777 5379800 5379780 -
tcaagctgtccaccatatgtgaaa

SEQ ID NO: 67823 - DNA, 24 bp, Artificial Sequence
  Synthetic oligonucleotide; ATAGAAA chr11 5379574 5379597 5379577 -
tgtatgccaatcttaaaagcagac

SEQ ID NO: 67824 - DNA, 24 bp, Artificial Sequence
  Synthetic oligonucleotide; CAAGAAA chr11 5379552 5379575 5379555 -
acatagaaaaagacacattgcata

SEQ ID NO: 67825 - DNA, 24 bp, Artificial Sequence
  Synthetic oligonucleotide; TGAGAAT chr11 5379239 5379262 5379242 -
cattgttcagttcccatctatgag

SEQ ID NO: 67826 - DNA, 24 bp, Artificial Sequence
  Synthetic oligonucleotide; TGAGAAT chr11 5379195 5379218 5379198 -
ttttttgtccttgcgatagtttac

SEQ ID NO: 67827 - DNA, 24 bp, Artificial Sequence
  Synthetic oligonucleotide; GAAGAAA chr11 5377942 5377965 5377945 -
ttaaagtcgtttttccaattctgt

SEQ ID NO: 67828 - DNA, 24 bp, Artificial Sequence
  Synthetic oligonucleotide; TAAGAAT chr11 5377657 5377680 5377660 -
ctctgtttgtctgttattggtgta

SEQ ID NO: 67829 - DNA, 24 bp, Artificial Sequence
  Synthetic oligonucleotide; TTAGAAT chr11 5376874 5376897 5376877 -
taccaattcctccttgtacctctg

SEQ ID NO: 67830 - DNA, 24 bp, Artificial Sequence
  Synthetic oligonucleotide; TCAGAAA chr11 5373645 5373668 5373648 -
ctggtgcgccatttcctaagcctg

SEQ ID NO: 67831 - DNA, 24 bp, Artificial Sequence
  Synthetic oligonucleotide; GCAGAAA chr11 5373424 5373447 5373427 -
gaaccccatacctcagatggaaat

SEQ ID NO: 67832 - DNA, 24 bp, Artificial Sequence
  Synthetic oligonucleotide; AAAGAAA chr11 5373324 5373347 5373327 -
tcaaaaactggaactttatttgtg

SEQ ID NO: 67833 - DNA, 24 bp, Artificial Sequence
  Synthetic oligonucleotide; TGAGAAT chr11 5373044 5373067 5373047 -
cccctattgtgttggtggccttgt

SEQ ID NO: 67834 - DNA, 24 bp, Artificial Sequence
  Synthetic oligonucleotide; AAAGAAA chr11 5372731 5372754 5372734 -
caaactaaatattttctgcacagc

SEQ ID NO: 67835 - DNA, 24 bp, Artificial Sequence
  Synthetic oligonucleotide; GGAGAAA chr11 5372700 5372723 5372703 -
acaatcatcaaaaggaacagtttg

SEQ ID NO: 67836 - DNA, 24 bp, Artificial Sequence
  Synthetic oligonucleotide; GGAGAAA chr11 5372413 5372436 5372416 -
agagataggggttggagaggctgt

SEQ ID NO: 67837 - DNA, 24 bp, Artificial Sequence
  Synthetic oligonucleotide; ATAGAAA chr11 5372357 5372380 5372360 -
ggaatgtaagttaacatagccatt

SEQ ID NO: 67838 - DNA, 24 bp, Artificial Sequence
  Synthetic oligonucleotide; GAAGAAA chr11 5372303 5372326 5372306 -
ctaaaaatagagttattgtatgat

SEQ ID NO: 67839 - DNA, 24 bp, Artificial Sequence
  Synthetic oligonucleotide; ACAGAAA chr11 5372010 5372033 5372013 -
tttgctaagtgaaataaaccagac

SEQ ID NO: 67840 - DNA, 24 bp, Artificial Sequence
  Synthetic oligonucleotide; AAAGAAA chr11 5371965 5371988 5371968 -
atattacttatatgtggaatctca

SEQ ID NO: 67841 - DNA, 24 bp, Artificial Sequence
  Synthetic oligonucleotide; ATAGAAA chr11 5371943 5371966 5371946 -
caaaagaaaaataaggtcaaatgc

SEQ ID NO: 67842 - DNA, 24 bp, Artificial Sequence
  Synthetic oligonucleotide; GAAGAAA chr11 5371922 5371945 5371925 -
tgcatagaaacagtgtaaaaaggg

SEQ ID NO: 67843 - DNA, 24 bp, Artificial Sequence
  Synthetic oligonucleotide; AAAGAAA chr11 5371918 5371941 5371921 -
tagaaacagtgtaaaaaggggaag

SEQ ID NO: 67844 - DNA, 24 bp, Artificial Sequence
  Synthetic oligonucleotide; AGAGAAA chr11 5371912 5371935 5371915 -
cagtgtaaaaaggggaagaaagaa

SEQ ID NO: 67845 - DNA, 24 bp, Artificial Sequence
  Synthetic oligonucleotide; AAAGAAA chr11 5371762 5371785 5371765 -
agtagatgttagatgcccttacac

SEQ ID NO: 67846 - DNA, 24 bp, Artificial Sequence
  Synthetic oligonucleotide; AGAGAAT chr11 5371338 5371361 5371341 -
ctctattaaatgtttatgagccac

SEQ ID NO: 67847 - DNA, 24 bp, Artificial Sequence
  Synthetic oligonucleotide; TGAGAAT chr11 5371332 5371355 5371335 -
taaatgtttatgagccacagagaa

SEQ ID NO: 67848 - DNA, 24 bp, Artificial Sequence
  Synthetic oligonucleotide; TCAGAAT chr11 5371217 5371240 5371220 -
gctgtgtggcttagagtataaaca

SEQ ID NO: 67849 - DNA, 24 bp, Artificial Sequence
  Synthetic oligonucleotide; CTAGAAT chr11 5371196 5371219 5371199 -
acatcagaatgtgctatggacttt

SEQ ID NO: 67850 - DNA, 24 bp, Artificial Sequence
  Synthetic oligonucleotide; TCAGAAT chr11 5371167 5371190 5371170 -
atatttcagtgcccttgtatatcc

SEQ ID NO: 67851 - DNA, 24 bp, Artificial Sequence
  Synthetic oligonucleotide; AGAGAAT chr11 5370706 5370729 5370709 -
ttaaaatacaagcttcataggaac

SEQ ID NO: 67852 - DNA, 24 bp, Artificial Sequence
  Synthetic oligonucleotide; ACAGAAA chr11 5370568 5370591 5370571 -
ttattctattattcatttctaaac

SEQ ID NO: 67853 - DNA, 24 bp, Artificial Sequence
  Synthetic oligonucleotide; TGAGAAA chr11 5370558 5370581 5370561 -
attcatttctaaacacagaaagag

SEQ ID NO: 67854 - DNA, 24 bp, Artificial Sequence
  Synthetic oligonucleotide; GGAGAAA chr11 5370550 5370573 5370553 -
ctaaacacagaaagagtgagaaag

SEQ ID NO: 67855 - DNA, 24 bp, Artificial Sequence
  Synthetic oligonucleotide; ACAGAAA chr11 5370542 5370565 5370545 -
agaaagagtgagaaagggagaaag

SEQ ID NO: 67856 - DNA, 24 bp, Artificial Sequence
  Synthetic oligonucleotide; TAAGAAT chr11 5370534 5370557 5370537 -
tgagaaagggagaaagacagaaag

SEQ ID NO: 67857 - DNA, 24 bp, Artificial Sequence
  Synthetic oligonucleotide; AAAGAAA chr11 5370526 5370549 5370529 -
ggagaaagacagaaagtaagaatg

SEQ ID NO: 67858 - DNA, 24 bp, Artificial Sequence
  Synthetic oligonucleotide; AAAGAAT chr11 5370508 5370531 5370511 -
agaatgaaagaaagagagtgagat

SEQ ID NO: 67859 - DNA, 24 bp, Artificial Sequence
  Synthetic oligonucleotide; ACAGAAT chr11 5369988 5370011 5369991 -
aagatcttgttgatacagattgac

SEQ ID NO: 67860 - DNA, 24 bp, Artificial Sequence
  Synthetic oligonucleotide; TGAGAAA chr11 5369938 5369961 5369941 -
ctgcctttccttgagtaaaaatcc

SEQ ID NO: 67861 - DNA, 24 bp, Artificial Sequence
  Synthetic oligonucleotide; GTAGAAA chr11 5369703 5369726 5369706 -
gttcatatatgtatatataaatgt

SEQ ID NO: 67862 - DNA, 24 bp, Artificial Sequence
  Synthetic oligonucleotide; AGAGAAA chr11 5369690 5369713 5369693 -
tatataaatgtgtagaaaagttgc

SEQ ID NO: 67863 - DNA, 24 bp, Artificial Sequence
  Synthetic oligonucleotide; ATAGAAA chr11 5369644 5369667 5369647 -
aaagggaaattatctccagggagg

SEQ ID NO: 67864 - DNA, 24 bp, Artificial Sequence
  Synthetic oligonucleotide; CCAGAAA chr11 5369466 5369489 5369469 -
aaattatcagattttattttttat

SEQ ID NO: 67865 - DNA, 24 bp, Artificial Sequence
  Synthetic oligonucleotide; CTAGAAA chr11 5369224 5369247 5369227 -
atgttggcctcattcagtacagta

SEQ ID NO: 67866 - DNA, 24 bp, Artificial Sequence
  Synthetic oligonucleotide; AAAGAAA chr11 5368933 5368956 5368936 -
atcagatctgtaagcatgatccgg

SEQ ID NO: 67867 - DNA, 24 bp, Artificial Sequence
  Synthetic oligonucleotide; TAAGAAT chr11 5368870 5368893 5368873 -
gaaggaaacctctcttaatccaca

SEQ ID NO: 67868 - DNA, 24 bp, Artificial Sequence
  Synthetic oligonucleotide; AAAGAAA chr11 5368812 5368835 5368815 -
agaacactttgccctgggggaaaa

SEQ ID NO: 67869 - DNA, 24 bp, Artificial Sequence
  Synthetic oligonucleotide; TTAGAAA chr11 5368722 5368745 5368725 -
ataatattttgagtaactcaatgt

SEQ ID NO: 67870 - DNA, 24 bp, Artificial Sequence
  Synthetic oligonucleotide; TGAGAAT chr11 5368646 5368669 5368649 -
ctctgctttctcacaggatgcatg

SEQ ID NO: 67871 - DNA, 24 bp, Artificial Sequence
  Synthetic oligonucleotide; TTAGAAT chr11 5368620 5368643 5368623 -
agaataaaacacaaagtctttatg

SEQ ID NO: 67872 - DNA, 24 bp, Artificial Sequence
  Synthetic oligonucleotide; ACAGAAA chr11 5368328 5368351 5368331 -
acttaaagatgagtggaccaaaac

SEQ ID NO: 67873 - DNA, 24 bp, Artificial Sequence
  Synthetic oligonucleotide; AAAGAAA chr11 5368102 5368125 5368105 -
aatctgaatggcagaggaaaaaac

SEQ ID NO: 67874 - DNA, 24 bp, Artificial Sequence
  Synthetic oligonucleotide; GAAGAAT chr11 5367973 5367996 5367976 -
ctactctggtagaagtgaaacttt

SEQ ID NO: 67875 - DNA, 24 bp, Artificial Sequence
  Synthetic oligonucleotide; GCAGAAA chr11 5367877 5367900 5367880 -
atgaggacataaaaatagatatag

SEQ ID NO: 67876 - DNA, 24 bp, Artificial Sequence
  Synthetic oligonucleotide; CCAGAAA chr11 5367799 5367822 5367802 -
gcctctattctgggtgctagcata

SEQ ID NO: 67877 - DNA, 24 bp, Artificial Sequence
  Synthetic oligonucleotide; CCAGAAA chr11 5367692 5367715 5367695 -
gctgagacctactgggctgtattc

SEQ ID NO: 67878 - DNA, 24 bp, Artificial Sequence
  Synthetic oligonucleotide; TTAGAAA chr11 5367506 5367529 5367509 -
ctctcccaccagcactatgactgt

SEQ ID NO: 67879 - DNA, 24 bp, Artificial Sequence
  Synthetic oligonucleotide; AGAGAAT chr11 5367070 5367093 5367073 -
tcagaaccacattcctgagacttg

SEQ ID NO: 67880 - DNA, 24 bp, Artificial Sequence
  Synthetic oligonucleotide; AGAGAAT chr11 5367044 5367067 5367047 -
agaatgtctttggtctctgctgct

SEQ ID NO: 67881 - DNA, 24 bp, Artificial Sequence
  Synthetic oligonucleotide; TAAGAAT chr11 5365874 5365897 5365877 -
cccaagaggtaagcagagttcctc

SEQ ID NO: 67882 - DNA, 24 bp, Artificial Sequence
  Synthetic oligonucleotide; CCAGAAT chr11 5365476 5365499 5365479 -
ggaaaatggttgctgactggcaga

SEQ ID NO: 67883 - DNA, 24 bp, Artificial Sequence
  Synthetic oligonucleotide; GAAGAAA chr11 5365150 5365173 5365153 -
tgtctacagaactcaccagacaaa

SEQ ID NO: 67884 - DNA, 24 bp, Artificial Sequence
  Synthetic oligonucleotide; CAAGAAT chr11 5365027 5365050 5365030 -
tttgcccaagattcattgctgtga

SEQ ID NO: 67885 - DNA, 24 bp, Artificial Sequence
  Synthetic oligonucleotide; TGAGAAA chr11 5365000 5365023 5365003 -
gaatgacaagaagaagcagttact

SEQ ID NO: 67886 - DNA, 24 bp, Artificial Sequence
  Synthetic oligonucleotide; ATAGAAA chr11 5364855 5364878 5364858 -
actatattaaatggaaattcacca

SEQ ID NO: 67887 - DNA, 24 bp, Artificial Sequence
  Synthetic oligonucleotide; ACAGAAT chr11 5364573 5364596 5364576 -
gcttagtttattttttcatttaat

SEQ ID NO: 67888 - DNA, 24 bp, Artificial Sequence
  Synthetic oligonucleotide; TGAGAAT chr11 5364480 5364503 5364483 -
tagtccagcaaggagactgaccat

SEQ ID NO: 67889 - DNA, 24 bp, Artificial Sequence
  Synthetic oligonucleotide; ACAGAAA chr11 5364449 5364472 5364452 -
tacaaatatggcaggaatttctaa

SEQ ID NO: 67890 - DNA, 24 bp, Artificial Sequence
  Synthetic oligonucleotide; ACAGAAA chr11 5364418 5364441 5364421 -
gatgtgcagctctcatatcctgtc

SEQ ID NO: 67891 - DNA, 24 bp, Artificial Sequence
  Synthetic oligonucleotide; GGAGAAT chr11 5364076 5364099 5364079 -
tataatcgaccttattgcaaccat

SEQ ID NO: 67892 - DNA, 24 bp, Artificial Sequence
  Synthetic oligonucleotide; ACAGAAA chr11 5363943 5363966 5363946 -
cctaacacaagcttctcctccttt

SEQ ID NO: 67893 - DNA, 24 bp, Artificial Sequence
  Synthetic oligonucleotide; ATAGAAT chr11 5363775 5363798 5363778 -
attgcatatggtccctagttttta

SEQ ID NO: 67894 - DNA, 24 bp, Artificial Sequence
  Synthetic oligonucleotide; ACAGAAT chr11 5363734 5363757 5363737 -
atgctactttcccgctttccaata

SEQ ID NO: 67895 - DNA, 24 bp, Artificial Sequence
  Synthetic oligonucleotide; TGAGAAA chr11 5363619 5363642 5363622 -
acaatataatcttagtagtatcta

SEQ ID NO: 67896 - DNA, 24 bp, Artificial Sequence
  Synthetic oligonucleotide; ATAGAAA chr11 5362918 5362941 5362921 -
gcaacaggcgggacacttccagca

SEQ ID NO: 67897 - DNA, 24 bp, Artificial Sequence
  Synthetic oligonucleotide; AAAGAAA chr11 5362914 5362937 5362917 -
caggcgggacacttccagcaatag

SEQ ID NO: 67898 - DNA, 24 bp, Artificial Sequence
  Synthetic oligonucleotide; ACAGAAA chr11 5362235 5362258 5362238 -
ttccttatctactcccatcccccg

SEQ ID NO: 67899 - DNA, 24 bp, Artificial Sequence
  Synthetic oligonucleotide; AAAGAAA chr11 5361390 5361413 5361393 -
gactatactcagaagccaagctgc

SEQ ID NO: 67900 - DNA, 24 bp, Artificial Sequence
  Synthetic oligonucleotide; TCAGAAA chr11 5361376 5361399 5361379 -
gccaagctgcaaagaaaattagtt

SEQ ID NO: 67901 - DNA, 24 bp, Artificial Sequence
  Synthetic oligonucleotide; CCAGAAA chr11 5361241 5361264 5361244 -
taggttagggaattagccacatct

SEQ ID NO: 67902 - DNA, 24 bp, Artificial Sequence
  Synthetic oligonucleotide; GTAGAAA chr11 5361206 5361229 5361209 -
atttattttaagcatcacataggg

SEQ ID NO: 67903 - DNA, 24 bp, Artificial Sequence
  Synthetic oligonucleotide; AAAGAAA chr11 5361201 5361224 5361204 -
ttttaagcatcacataggggtaga

SEQ ID NO: 67904 - DNA, 24 bp, Artificial Sequence
  Synthetic oligonucleotide; TGAGAAT chr11 5360875 5360898 5360878 -
gtttttgtccttgcgatagtttgc

SEQ ID NO: 67905 - DNA, 24 bp, Artificial Sequence
  Synthetic oligonucleotide; TAAGAAA chr11 5359973 5359996 5359976 -
ttgaattaatttttgtataaggtg

SEQ ID NO: 67906 - DNA, 24 bp, Artificial Sequence
  Synthetic oligonucleotide; GAAGAAA chr11 5359624 5359647 5359627 -
taaagtagttttttccaattctgt

SEQ ID NO: 67907 - DNA, 24 bp, Artificial Sequence
  Synthetic oligonucleotide; TAAGAAT chr11 5359339 5359362 5359342 -
ctctgtttgtctgttattggtgta

SEQ ID NO: 67908 - DNA, 24 bp, Artificial Sequence
  Synthetic oligonucleotide; CCAGAAA chr11 5359140 5359163 5359143 -
ccttctcctgcctaattgccctgg

SEQ ID NO: 67909 - DNA, 24 bp, Artificial Sequence
  Synthetic oligonucleotide; GTAGAAT chr11 5358557 5358580 5358560 -
taccagctcctccttgtacctctg

SEQ ID NO: 67910 - DNA, 24 bp, Artificial Sequence
  Synthetic oligonucleotide; AAAGAAT chr11 5357695 5357718 5357698 -
ggaataggtgtggtgtggtgctga

SEQ ID NO: 67911 - DNA, 24 bp, Artificial Sequence
  Synthetic oligonucleotide; TAAGAAA chr11 5355816 5355839 5355819 -
gagcagggcattacattgatcctt

SEQ ID NO: 67912 - DNA, 24 bp, Artificial Sequence
  Synthetic oligonucleotide; TTAGAAA chr11 5355745 5355768 5355748 -
ttttttaatttttaaaggtaattg

SEQ ID NO: 67913 - DNA, 24 bp, Artificial Sequence
  Synthetic oligonucleotide; ACAGAAA chr11 5354433 5354456 5354436 -
cacatctcttcagtataaggaaga

SEQ ID NO: 67914 - DNA, 24 bp, Artificial Sequence
  Synthetic oligonucleotide; AGAGAAA chr11 5354420 5354443 5354423 -
tataaggaagaacagaaagggagg

SEQ ID NO: 67915 - DNA, 24 bp, Artificial Sequence
  Synthetic oligonucleotide; ACAGAAT chr11 5354383 5354406 5354386 -
gttgtcagtcaaatgtgtccattt

SEQ ID NO: 67916 - DNA, 24 bp, Artificial Sequence
  Synthetic oligonucleotide; CAAGAAA chr11 5354293 5354316 5354296 -
gatcactggacctagagggtgagt

SEQ ID NO: 67917 - DNA, 24 bp, Artificial Sequence
  Synthetic oligonucleotide; GAAGAAA chr11 5354232 5354255 5354235 -
gaattcattcccaaaagcccaagg

SEQ ID NO: 67918 - DNA, 24 bp, Artificial Sequence
  Synthetic oligonucleotide; ACAGAAA chr11 5354146 5354169 5354149 -
acagacagaagaactagcagacac

SEQ ID NO: 67919 - DNA, 24 bp, Artificial Sequence
  Synthetic oligonucleotide; AGAGAAA chr11 5353989 5354012 5353992 -
agcacacagtcaagaagctacaaa

SEQ ID NO: 67920 - DNA, 24 bp, Artificial Sequence
  Synthetic oligonucleotide; CAAGAAT chr11 5353844 5353867 5353847 -
tttctctgtgttatttatacatcc

SEQ ID NO: 67921 - DNA, 24 bp, Artificial Sequence
  Synthetic oligonucleotide; AAAGAAT chr11 5353678 5353701 5353681 -
acatcataccctgtattttggtca

SEQ ID NO: 67922 - DNA, 24 bp, Artificial Sequence
  Synthetic oligonucleotide; AAAGAAT chr11 5353565 5353588 5353568 -
cctcttctcatgcctagactctga

SEQ ID NO: 67923 - DNA, 24 bp, Artificial Sequence
  Synthetic oligonucleotide; CCAGAAA chr11 5353543 5353566 5353546 -
gaaaagaatcaaaagtatttggag

SEQ ID NO: 67924 - DNA, 24 bp, Artificial Sequence
  Synthetic oligonucleotide; TTAGAAA chr11 5353301 5353324 5353304 -
ctatcaagacaatggtcatctgaa

SEQ ID NO: 67925 - DNA, 24 bp, Artificial Sequence
  Synthetic oligonucleotide; GAAGAAA chr11 5353159 5353182 5353162 -
tgagggaaatggtttaccctcatt

SEQ ID NO: 67926 - DNA, 24 bp, Artificial Sequence
  Synthetic oligonucleotide; GAAGAAA chr11 5353123 5353146 5353126 -
tgagggaaatggcttactctcatt

SEQ ID NO: 67927 - DNA, 24 bp, Artificial Sequence
  Synthetic oligonucleotide; CTAGAAA chr11 5353091 5353114 5353094 -
tctcatttcttcacgtgcaatttt

SEQ ID NO: 67928 - DNA, 24 bp, Artificial Sequence
  Synthetic oligonucleotide; CAAGAAT chr11 5352936 5352959 5352939 -
tgccggtgacccaaatcatagacc

SEQ ID NO: 67929 - DNA, 24 bp, Artificial Sequence
  Synthetic oligonucleotide; TGAGAAA chr11 5352695 5352718 5352698 -
tcaaacaatgtgagttaaattacc

SEQ ID NO: 67930 - DNA, 24 bp, Artificial Sequence
  Synthetic oligonucleotide; AGAGAAT chr11 5352426 5352449 5352429 -
atgtcatgctctagagtgaggcag

SEQ ID NO: 67931 - DNA, 24 bp, Artificial Sequence
  Synthetic oligonucleotide; TGAGAAT chr11 5352169 5352192 5352172 -
cagaaccaatgcccatgacagtct

SEQ ID NO: 67932 - DNA, 24 bp, Artificial Sequence
  Synthetic oligonucleotide; GGAGAAA chr11 5352153 5352176 5352156 -
gacagtcttgagaatcaaaatgta

SEQ ID NO: 67933 - DNA, 24 bp, Artificial Sequence
  Synthetic oligonucleotide; TGAGAAA chr11 5352139 5352162 5352142 -
tcaaaatgtaggagaaaaagatga

SEQ ID NO: 67934 - DNA, 24 bp, Artificial Sequence
  Synthetic oligonucleotide; ACAGAAA chr11 5352039 5352062 5352042 -
tagcttgatgacatcttggtgtag

SEQ ID NO: 67935 - DNA, 24 bp, Artificial Sequence
  Synthetic oligonucleotide; ACAGAAA chr11 5351828 5351851 5351831 -
gcaagcaagacacctgactccatg

SEQ ID NO: 67936 - DNA, 24 bp, Artificial Sequence
  Synthetic oligonucleotide; TAAGAAA chr11 5351691 5351714 5351694 -
gaggtctgtagctgccaacatagc

SEQ ID NO: 67937 - DNA, 24 bp, Artificial Sequence
  Synthetic oligonucleotide; TGAGAAA chr11 5351647 5351670 5351650 -
catggaggttatgatcattcctga

SEQ ID NO: 67938 - DNA, 24 bp, Artificial Sequence
  Synthetic oligonucleotide; TGAGAAT chr11 5351435 5351458 5351438 -
atcagttgtataaaagttgctcct

SEQ ID NO: 67939 - DNA, 24 bp, Artificial Sequence
  Synthetic oligonucleotide; ATAGAAT chr11 5351335 5351358 5351338 -
ctgggagatcctaggtatgggaaa

SEQ ID NO: 67940 - DNA, 24 bp, Artificial Sequence
  Synthetic oligonucleotide; GCAGAAT chr11 5351253 5351276 5351256 -
tacgttggggatacagctattcat

SEQ ID NO: 67941 - DNA, 24 bp, Artificial Sequence
  Synthetic oligonucleotide; CCAGAAA chr11 5351213 5351236 5351216 -
tgaattcattgtaaatcatataac

SEQ ID NO: 67942 - DNA, 24 bp, Artificial Sequence
  Synthetic oligonucleotide; GAAGAAA chr11 5351189 5351212 5351192 -
ccagaaaataaaaacaaaatgaaa

SEQ ID NO: 67943 - DNA, 24 bp, Artificial Sequence
  Synthetic oligonucleotide; GTAGAAA chr11 5351051 5351074 5351054 -
ggctatgtgagacctaaaagatca

SEQ ID NO: 67944 - DNA, 24 bp, Artificial Sequence
  Synthetic oligonucleotide; TAAGAAA chr11 5350981 5351004 5350984 -
tatatggaaaaacaaatacacaag

SEQ ID NO: 67945 - DNA, 24 bp, Artificial Sequence
  Synthetic oligonucleotide; TTAGAAA chr11 5350870 5350893 5350873 -
gaagctccagagacttttgggtag

SEQ ID NO: 67946 - DNA, 24 bp, Artificial Sequence
  Synthetic oligonucleotide; AAAGAAT chr11 5350769 5350792 5350772 -
ccctagttattgatacactgcttc

SEQ ID NO: 67947 - DNA, 24 bp, Artificial Sequence
  Synthetic oligonucleotide; GAAGAAT chr11 5350740 5350763 5350743 -
attcaaattttcataatataaatt

SEQ ID NO: 67948 - DNA, 24 bp, Artificial Sequence
  Synthetic oligonucleotide; GGAGAAT chr11 5350607 5350630 5350610 -
aattggtaatttaggcaagatcaa

SEQ ID NO: 67949 - DNA, 24 bp, Artificial Sequence
  Synthetic oligonucleotide; TTAGAAT chr11 5350538 5350561 5350541 -
aaagtgagaaggctctgtgactca

SEQ ID NO: 67950 - DNA, 24 bp, Artificial Sequence
  Synthetic oligonucleotide; TGAGAAT chr11 5350497 5350520 5350500 -
cagctggtgcaggcagccaacctc

SEQ ID NO: 67951 - DNA, 24 bp, Artificial Sequence
  Synthetic oligonucleotide; AGAGAAA chr11 5350461 5350484 5350464 -
aattgtgtgttggtggcatgagcc

SEQ ID NO: 67952 - DNA, 24 bp, Artificial Sequence
  Synthetic oligonucleotide; AAAGAAT chr11 5350343 5350366 5350346 -
tacaagacctctttctgtccatga

SEQ ID NO: 67953 - DNA, 24 bp, Artificial Sequence
  Synthetic oligonucleotide; GAAGAAT chr11 5350306 5350329 5350309 -
aagattactggactttcattttca

SEQ ID NO: 67954 - DNA, 24 bp, Artificial Sequence
  Synthetic oligonucleotide; GGAGAAA chr11 5349882 5349905 5349885 -
atatgtctgggtgggaaagggaaa

SEQ ID NO: 67955 - DNA, 24 bp, Artificial Sequence
  Synthetic oligonucleotide; TGAGAAA chr11 5349767 5349790 5349770 -
gaaagcaactctgtcctcaaaaag

SEQ ID NO: 67956 - DNA, 24 bp, Artificial Sequence
  Synthetic oligonucleotide; TGAGAAA chr11 5349371 5349394 5349374 -
aataccagatagggaaaataaagc

SEQ ID NO: 67957 - DNA, 24 bp, Artificial Sequence
  Synthetic oligonucleotide; GAAGAAT chr11 5349281 5349304 5349284 -
cattatatacacctcattttttgg

SEQ ID NO: 67958 - DNA, 24 bp, Artificial Sequence
  Synthetic oligonucleotide; ATAGAAT chr11 5349100 5349123 5349103 -
tcaccctcttccagggtctctgtc

SEQ ID NO: 67959 - DNA, 24 bp, Artificial Sequence
  Synthetic oligonucleotide; TGAGAAA chr11 5349074 5349097 5349077 -
agaatagacttgagtttttattaa

SEQ ID NO: 67960 - DNA, 24 bp, Artificial Sequence
  Synthetic oligonucleotide; GAAGAAA chr11 5348680 5348703 5348683 -
tctaatcagctgccagggcggcta

SEQ ID NO: 67961 - DNA, 24 bp, Artificial Sequence
  Synthetic oligonucleotide; CTAGAAA chr11 5348489 5348512 5348492 -
tatggtcagatagtgacttttttt

SEQ ID NO: 67962 - DNA, 24 bp, Artificial Sequence
  Synthetic oligonucleotide; CAAGAAT chr11 5348444 5348467 5348447 -
gatgattacagaggtatacctcct

SEQ ID NO: 67963 - DNA, 24 bp, Artificial Sequence
  Synthetic oligonucleotide; TTAGAAT chr11 5348353 5348376 5348356 -
ttgggggcagggggactctcaggg

SEQ ID NO: 67964 - DNA, 24 bp, Artificial Sequence
  Synthetic oligonucleotide; AAAGAAT chr11 5348330 5348353 5348333 -
gttagaatggaagccagagagatt

SEQ ID NO: 67965 - DNA, 24 bp, Artificial Sequence
  Synthetic oligonucleotide; AGAGAAA chr11 5348312 5348335 5348315 -
gagattaaagaatcagtcaggtgg

SEQ ID NO: 67966 - DNA, 24 bp, Artificial Sequence
  Synthetic oligonucleotide; GTAGAAT chr11 5348251 5348274 5348254 -
caacacccatgctctggtttgttc

SEQ ID NO: 67967 - DNA, 24 bp, Artificial Sequence
  Synthetic oligonucleotide; CCAGAAT chr11 5348227 5348250 5348230 -
gtagaattgtttgccttatgtgtt

SEQ ID NO: 67968 - DNA, 24 bp, Artificial Sequence
  Synthetic oligonucleotide; AAAGAAA chr11 5348182 5348205 5348185 -
tttatatttgaagaggtaactctc

SEQ ID NO: 67969 - DNA, 24 bp, Artificial Sequence
  Synthetic oligonucleotide; TAAGAAA chr11 5348085 5348108 5348088 -
acaacactattacttttctcttgc

SEQ ID NO: 67970 - DNA, 24 bp, Artificial Sequence
  Synthetic oligonucleotide; TCAGAAT chr11 5347907 5347930 5347910 -
atgaaagatttgggcatcatcttt

SEQ ID NO: 67971 - DNA, 24 bp, Artificial Sequence
  Synthetic oligonucleotide; AGAGAAA chr11 5347463 5347486 5347466 -
tatgcctgctgcatcccctggaaa

SEQ ID NO: 67972 - DNA, 24 bp, Artificial Sequence
  Synthetic oligonucleotide; GCAGAAT chr11 5347411 5347434 5347414 -
agaagggaatagttagtgataact

SEQ ID NO: 67973 - DNA, 24 bp, Artificial Sequence
  Synthetic oligonucleotide; GTAGAAA chr11 5347291 5347314 5347294 -
gatctaaaccaagcaggaaatata

SEQ ID NO: 67974 - DNA, 24 bp, Artificial Sequence
  Synthetic oligonucleotide; AAAGAAA chr11 5347081 5347104 5347084 -
attcagccagtaacttatttgaaa

SEQ ID NO: 67975 - DNA, 24 bp, Artificial Sequence
  Synthetic oligonucleotide; AGAGAAA chr11 5346758 5346781 5346761 -
aggagactcctctataagctctcc

SEQ ID NO: 67976 - DNA, 24 bp, Artificial Sequence
  Synthetic oligonucleotide; AGAGAAA chr11 5346514 5346537 5346517 -
tacattttactttttaaacaaagc

SEQ ID NO: 67977 - DNA, 24 bp, Artificial Sequence
  Synthetic oligonucleotide; ATAGAAT chr11 5346456 5346479 5346459 -
atctgattttctaggtgttccatt

SEQ ID NO: 67978 - DNA, 24 bp, Artificial Sequence
  Synthetic oligonucleotide; TCAGAAA chr11 5346358 5346381 5346361 -
tctcttctctcattgtctttcttc

SEQ ID NO: 67979 - DNA, 24 bp, Artificial Sequence
  Synthetic oligonucleotide; CAAGAAT chr11 5346325 5346348 5346328 -
aagagccacgactagctgaggaca

SEQ ID NO: 67980 - DNA, 24 bp, Artificial Sequence
  Synthetic oligonucleotide; AGAGAAA chr11 5346030 5346053 5346033 -
cgtcagagaagtaagagtgttgac

SEQ ID NO: 67981 - DNA, 24 bp, Artificial Sequence
  Synthetic oligonucleotide; GAAGAAT chr11 5345962 5345985 5345965 -
ggattatctttgcgtctagtaact

SEQ ID NO: 67982 - DNA, 24 bp, Artificial Sequence
  Synthetic oligonucleotide; ACAGAAT chr11 5345893 5345916 5345896 -
tggtttatgtctctcagtcctagg

SEQ ID NO: 67983 - DNA, 24 bp, Artificial Sequence
  Synthetic oligonucleotide; CAAGAAA chr11 5345633 5345656 5345636 -
tcaagaagttgttctggcatgtga

SEQ ID NO: 67984 - DNA, 24 bp, Artificial Sequence
  Synthetic oligonucleotide; ACAGAAA chr11 5345493 5345516 5345496 -
ttcaccattctttcatttgttcaa

SEQ ID NO: 67985 - DNA, 24 bp, Artificial Sequence
  Synthetic oligonucleotide; TCAGAAT chr11 5345223 5345246 5345226 -
aagtgagtaatttaaaaatacaaa

SEQ ID NO: 67986 - DNA, 24 bp, Artificial Sequence
  Synthetic oligonucleotide; GAAGAAA chr11 5345149 5345172 5345152 -
atgtctttactacatttatagtaa

SEQ ID NO: 67987 - DNA, 24 bp, Artificial Sequence
  Synthetic oligonucleotide; TAAGAAA chr11 5344685 5344708 5344688 -
cgtgttcacaaatattaggtgaac

SEQ ID NO: 67988 - DNA, 24 bp, Artificial Sequence
  Synthetic oligonucleotide; ATAGAAA chr11 5344361 5344384 5344364 -
ctagggaattacttcagtaggcct

SEQ ID NO: 67989 - DNA, 24 bp, Artificial Sequence
  Synthetic oligonucleotide; AAAGAAA chr11 5344344 5344367 5344347 -
taggcctatagaaaaataatttaa

SEQ ID NO: 67990 - DNA, 24 bp, Artificial Sequence
  Synthetic oligonucleotide; TAAGAAA chr11 5344320 5344343 5344323 -
aaagaaaaagacactacttgtaaa

SEQ ID NO: 67991 - DNA, 24 bp, Artificial Sequence
  Synthetic oligonucleotide; CCAGAAA chr11 5343921 5343944 5343924 -
gcaattacaggtttaggtggtaga

SEQ ID NO: 67992 - DNA, 24 bp, Artificial Sequence
  Synthetic oligonucleotide; ATAGAAT chr11 5343873 5343896 5343876 -
tctggaaatccccttgaatgcccc

SEQ ID NO: 67993 - DNA, 24 bp, Artificial Sequence
  Synthetic oligonucleotide; AGAGAAT chr11 5343794 5343817 5343797 -
tagtttacataattttttttctga

SEQ ID NO: 67994 - DNA, 24 bp, Artificial Sequence
  Synthetic oligonucleotide; CAAGAAT chr11 5343758 5343781 5343761 -
aatgcatataaacagttgaaactc

SEQ ID NO: 67995 - DNA, 24 bp, Artificial Sequence
  Synthetic oligonucleotide; TAAGAAT chr11 5343711 5343734 5343714 -
gagatagatcctggaatgtgcagt

SEQ ID NO: 67996 - DNA, 24 bp, Artificial Sequence
  Synthetic oligonucleotide; TGAGAAT chr11 5343684 5343707 5343687 -
gaatacaaatagtatgagtaaccc

SEQ ID NO: 67997 - DNA, 24 bp, Artificial Sequence
  Synthetic oligonucleotide; TGAGAAA chr11 5343671 5343694 5343674 -
atgagtaaccctgagaatgtattt

SEQ ID NO: 67998 - DNA, 24 bp, Artificial Sequence
  Synthetic oligonucleotide; TGAGAAT chr11 5343620 5343643 5343623 -
attattatctttaggaaaaaattc

SEQ ID NO: 67999 - DNA, 24 bp, Artificial Sequence
  Synthetic oligonucleotide; ACAGAAA chr11 5343563 5343586 5343566 -
gtagaactgtgcactgtggtaata

SEQ ID NO: 68000 - DNA, 24 bp, Artificial Sequence
  Synthetic oligonucleotide; ACAGAAA chr11 5343557 5343580 5343560 -
ctgtgcactgtggtaataacagaa

SEQ ID NO: 68001 - DNA, 24 bp, Artificial Sequence
  Synthetic oligonucleotide; TCAGAAT chr11 5342635 5342658 5342638 -
atatagtgtcaagaccaagcagat

SEQ ID NO: 68002 - DNA, 24 bp, Artificial Sequence
  Synthetic oligonucleotide; ATAGAAT chr11 5342603 5342626 5342606 -
ccattcttcacctttttactaccc

SEQ ID NO: 68003 - DNA, 24 bp, Artificial Sequence
  Synthetic oligonucleotide; ACAGAAT chr11 5342562 5342585 5342565 -
tctccaatcatcacagtcactctc

SEQ ID NO: 68004 - DNA, 24 bp, Artificial Sequence
  Synthetic oligonucleotide; ACAGAAT chr11 5342258 5342281 5342261 -
atggtataaagttagcagatagga

SEQ ID NO: 68005 - DNA, 24 bp, Artificial Sequence
  Synthetic oligonucleotide; AAAGAAT chr11 5342088 5342111 5342091 -
gaagtccaggaattttcctgcaaa

SEQ ID NO: 68006 - DNA, 24 bp, Artificial Sequence
  Synthetic oligonucleotide; GAAGAAT chr11 5341690 5341713 5341693 -
aaaaataggtttctgcattttttt

SEQ ID NO: 68007 - DNA, 24 bp, Artificial Sequence
  Synthetic oligonucleotide; AAAGAAT chr11 5341631 5341654 5341634 -
ccatgtaataagtgtaaatttccc

SEQ ID NO: 68008 - DNA, 24 bp, Artificial Sequence
  Synthetic oligonucleotide; ACAGAAT chr11 5341422 5341445 5341425 -
ttggtgttttaccccgatcatttt

SEQ ID NO: 68009 - DNA, 24 bp, Artificial Sequence
  Synthetic oligonucleotide; GAAGAAA chr11 5341329 5341352 5341332 -
tcaactcagcaggaaatgtcttat

SEQ ID NO: 68010 - DNA, 24 bp, Artificial Sequence
  Synthetic oligonucleotide; TAAGAAA chr11 5341115 5341138 5341118 -
gtattgctcatagagagtccaact

SEQ ID NO: 68011 - DNA, 24 bp, Artificial Sequence
  Synthetic oligonucleotide; AAAGAAT chr11 5340512 5340535 5340515 -
accgcagtagaagaacttttttaa

SEQ ID NO: 68012 - DNA, 24 bp, Artificial Sequence
  Synthetic oligonucleotide; GTAGAAT chr11 5340460 5340483 5340463 -
aaaaaaaagagtaatgcttttgtt

SEQ ID NO: 68013 - DNA, 24 bp, Artificial Sequence
  Synthetic oligonucleotide; TTAGAAT chr11 5340437 5340460 5340440 -
tgtagaattactaaaatgcaatgc

SEQ ID NO: 68014 - DNA, 24 bp, Artificial Sequence
  Synthetic oligonucleotide; AAAGAAA chr11 5340359 5340382 5340362 -
aaatatttagagtaaattatagat

SEQ ID NO: 68015 - DNA, 24 bp, Artificial Sequence
  Synthetic oligonucleotide; AAAGAAT chr11 5340339 5340362 5340342 -
agataaagaaatgataataaataa

SEQ ID NO: 68016 - DNA, 24 bp, Artificial Sequence
  Synthetic oligonucleotide; ACAGAAA chr11 5339687 5339710 5339690 -
aagccttagcaaattaatacagga

SEQ ID NO: 68017 - DNA, 24 bp, Artificial Sequence
  Synthetic oligonucleotide; GTAGAAT chr11 5339348 5339371 5339351 -
catgaatttgtattcataagaaga

SEQ ID NO: 68018 - DNA, 24 bp, Artificial Sequence
  Synthetic oligonucleotide; GAAGAAT chr11 5339249 5339272 5339252 -
gcttttcatcattcaagactgaaa

SEQ ID NO: 68019 - DNA, 24 bp, Artificial Sequence
  Synthetic oligonucleotide; AAAGAAT chr11 5339147 5339170 5339150 -
tagttatgggaaatctaaggtgta

SEQ ID NO: 68020 - DNA, 24 bp, Artificial Sequence
  Synthetic oligonucleotide; TAAGAAT chr11 5339048 5339071 5339051 -
tgggcttgaagggataacatacca

SEQ ID NO: 68021 - DNA, 24 bp, Artificial Sequence
  Synthetic oligonucleotide; TTAGAAA chr11 5338982 5339005 5338985 -
gcatttctgtagactaagccaatc

SEQ ID NO: 68022 - DNA, 24 bp, Artificial Sequence
  Synthetic oligonucleotide; GAAGAAT chr11 5338959 5338982 5338962 -
cttagaaatgattaagaagacgtg

SEQ ID NO: 68023 - DNA, 24 bp, Artificial Sequence
  Synthetic oligonucleotide; TTAGAAA chr11 5338718 5338741 5338721 -
tattaaattgggcagcaaggatga

SEQ ID NO: 68024 - DNA, 24 bp, Artificial Sequence
  Synthetic oligonucleotide; AAAGAAT chr11 5338678 5338701 5338681 -
acccagaggtctccatgtccaatt

SEQ ID NO: 68025 - DNA, 24 bp, Artificial Sequence
  Synthetic oligonucleotide; CCAGAAA chr11 5338471 5338494 5338474 -
tggccctatgttagtcatggttct

SEQ ID NO: 68026 - DNA, 24 bp, Artificial Sequence
  Synthetic oligonucleotide; ATAGAAT chr11 5338463 5338486 5338466 -
tgttagtcatggttctccagaaaa

SEQ ID NO: 68027 - DNA, 24 bp, Artificial Sequence
  Synthetic oligonucleotide; ACAGAAT chr11 5338359 5338382 5338362 -
caaacagacacactgactaatgga

SEQ ID NO: 68028 - DNA, 24 bp, Artificial Sequence
  Synthetic oligonucleotide; GCAGAAA chr11 5338227 5338250 5338230 -
gctgggagaactggctagccatat

SEQ ID NO: 68029 - DNA, 24 bp, Artificial Sequence
  Synthetic oligonucleotide; GAAGAAA chr11 5338126 5338149 5338129 -
aaacccaaaactataaaaacttta

SEQ ID NO: 68030 - DNA, 24 bp, Artificial Sequence
  Synthetic oligonucleotide; GGAGAAT chr11 5337815 5337838 5337818 -
tcagctactcaggaggctgaggca

SEQ ID NO: 68031 - DNA, 24 bp, Artificial Sequence
  Synthetic oligonucleotide; AAAGAAA chr11 5337717 5337740 5337720 -
aagagtgagacttcatctcaaaat

SEQ ID NO: 68032 - DNA, 24 bp, Artificial Sequence
  Synthetic oligonucleotide; ACAGAAT chr11 5337645 5337668 5337648 -
atcatcagagcgaacaggcaacct

SEQ ID NO: 68033 - DNA, 24 bp, Artificial Sequence
  Synthetic oligonucleotide; GGAGAAA chr11 5337637 5337660 5337640 -
agcgaacaggcaacctacagaatg

SEQ ID NO: 68034 - DNA, 24 bp, Artificial Sequence
  Synthetic oligonucleotide; CCAGAAT chr11 5337593 5337616 5337596 -
acccatctgacaaaggtctaatat

SEQ ID NO: 68035 - DNA, 24 bp, Artificial Sequence
  Synthetic oligonucleotide; AAAGAAA chr11 5337560 5337583 5337563 -
atgaggaacttagacatatttaca

SEQ ID NO: 68036 - DNA, 24 bp, Artificial Sequence
  Synthetic oligonucleotide; TAAGAAA chr11 5337479 5337502 5337482 -
ctcaaaagaagacatttatgtggc

SEQ ID NO: 68037 - DNA, 24 bp, Artificial Sequence
  Synthetic oligonucleotide; AGAGAAA chr11 5337439 5337462 5337442 -
aaagtctcaatgtcactgatcatt

SEQ ID NO: 68038 - DNA, 24 bp, Artificial Sequence
  Synthetic oligonucleotide; TCAGAAT chr11 5337393 5337416 5337396 -
caatgaaataccatctgacaccag

SEQ ID NO: 68039 - DNA, 24 bp, Artificial Sequence
  Synthetic oligonucleotide; CAAGAAA chr11 5337371 5337394 5337374 -
agtcagaatggtggtttttaaagt

SEQ ID NO: 68040 - DNA, 24 bp, Artificial Sequence
  Synthetic oligonucleotide; AGAGAAA chr11 5337342 5337365 5337345 -
aacaacagatgctagcaaggttgc

SEQ ID NO: 68041 - DNA, 24 bp, Artificial Sequence
  Synthetic oligonucleotide; CCAGAAA chr11 5337249 5337272 5337252 -
tggcaattcctcaaagatttagaa

SEQ ID NO: 68042 - DNA, 24 bp, Artificial Sequence
  Synthetic oligonucleotide; ATAGAAT chr11 5337124 5337147 5337127 -
agcactattcacaatagcaaagac

SEQ ID NO: 68043 - DNA, 24 bp, Artificial Sequence
  Synthetic oligonucleotide; ACAGAAA chr11 5336964 5336987 5336967 -
tatcttcagtaaactaatgcagga

SEQ ID NO: 68044 - DNA, 24 bp, Artificial Sequence
  Synthetic oligonucleotide; TGAGAAT chr11 5336914 5336937 5336917 -
cacttagaagtgggagctgaacaa

SEQ ID NO: 68045 - DNA, 24 bp, Artificial Sequence
  Synthetic oligonucleotide; TTAGAAA chr11 5336831 5336854 5336834 -
catggggtgtggtgaaggggagca

SEQ ID NO: 68046 - DNA, 24 bp, Artificial Sequence
  Synthetic oligonucleotide; GCAGAAA chr11 5336381 5336404 5336384 -
ttgatgtttcagttcaatctaaag

SEQ ID NO: 68047 - DNA, 24 bp, Artificial Sequence
  Synthetic oligonucleotide; CTAGAAT chr11 5336179 5336202 5336182 -
ctaaaaacaccctcacaaaaacat

SEQ ID NO: 68048 - DNA, 24 bp, Artificial Sequence
  Synthetic oligonucleotide; ATAGAAT chr11 5336037 5336060 5336040 -
tggaatccagaaggctgacagata

SEQ ID NO: 68049 - DNA, 24 bp, Artificial Sequence
  Synthetic oligonucleotide; ACAGAAA chr11 5336022 5336045 5336025 -
tgacagataatagaatcaaactac

SEQ ID NO: 68050 - DNA, 24 bp, Artificial Sequence
  Synthetic oligonucleotide; CCAGAAA chr11 5335810 5335833 5335813 -
accaagagccaaggaataggaaga

SEQ ID NO: 68051 - DNA, 24 bp, Artificial Sequence
  Synthetic oligonucleotide; TTAGAAA chr11 5335708 5335731 5335711 -
ctaataaatattgtgttatgtgat

SEQ ID NO: 68052 - DNA, 24 bp, Artificial Sequence
  Synthetic oligonucleotide; AAAGAAT chr11 5335554 5335577 5335557 -
caggcaatacagcaggaaatatga

SEQ ID NO: 68053 - DNA, 24 bp, Artificial Sequence
  Synthetic oligonucleotide; TTAGAAA chr11 5335537 5335560 5335540 -
aatatgaaaagaatgaacaaggtc

SEQ ID NO: 68054 - DNA, 24 bp, Artificial Sequence
  Synthetic oligonucleotide; GCAGAAT chr11 5334996 5335019 5334999 -
gcttacatttaggaagacctatga

SEQ ID NO: 68055 - DNA, 24 bp, Artificial Sequence
  Synthetic oligonucleotide; ATAGAAA chr11 5334842 5334865 5334845 -
ttaggatttaagactgatgagaca

SEQ ID NO: 68056 - DNA, 24 bp, Artificial Sequence
  Synthetic oligonucleotide; AAAGAAT chr11 5334758 5334781 5334761 -
aattgtcagacaaagccagggatt

SEQ ID NO: 68057 - DNA, 24 bp, Artificial Sequence
  Synthetic oligonucleotide; ACAGAAA chr11 5334633 5334656 5334636 -
ttcttgggcaagacttaccaagag

SEQ ID NO: 68058 - DNA, 24 bp, Artificial Sequence
  Synthetic oligonucleotide; CAAGAAA chr11 5334550 5334573 5334553 -
ataacaaacaatcttatttgaaac

SEQ ID NO: 68059 - DNA, 24 bp, Artificial Sequence
  Synthetic oligonucleotide; AAAGAAA chr11 5334355 5334378 5334358 -
gctacaattctgttttctttttgc

SEQ ID NO: 68060 - DNA, 24 bp, Artificial Sequence
  Synthetic oligonucleotide; GGAGAAT chr11 5334095 5334118 5334098 -
ccaggtcaggctctagtgactatg

SEQ ID NO: 68061 - DNA, 24 bp, Artificial Sequence
  Synthetic oligonucleotide; AGAGAAA chr11 5334006 5334029 5334009 -
catagttgttgcaagagggtaaat

SEQ ID NO: 68062 - DNA, 24 bp, Artificial Sequence
  Synthetic oligonucleotide; ATAGAAA chr11 5333800 5333823 5333803 -
gctattaagaacacttttcctaca

SEQ ID NO: 68063 - DNA, 24 bp, Artificial Sequence
  Synthetic oligonucleotide; AAAGAAT chr11 5333295 5333318 5333298 -
gccactaggtctgagagactagta

SEQ ID NO: 68064 - DNA, 24 bp, Artificial Sequence
  Synthetic oligonucleotide; ATAGAAA chr11 5333189 5333212 5333192 -
agagagggcaaaataagagacaat

SEQ ID NO: 68065 - DNA, 24 bp, Artificial Sequence
  Synthetic oligonucleotide; GCAGAAA chr11 5333082 5333105 5333085 -
accctatgtacctgagcagatggt

SEQ ID NO: 68066 - DNA, 24 bp, Artificial Sequence
  Synthetic oligonucleotide; GAAGAAT chr11 5332664 5332687 5332667 -
gggctcttatccaaaggctctggg

SEQ ID NO: 68067 - DNA, 24 bp, Artificial Sequence
  Synthetic oligonucleotide; CTAGAAA chr11 5331929 5331952 5331932 -
tgatattgtatcatattcacagtc

SEQ ID NO: 68068 - DNA, 24 bp, Artificial Sequence
  Synthetic oligonucleotide; GTAGAAA chr11 5331902 5331925 5331905 -
gaaattaggataggaaatcttgtg

SEQ ID NO: 68069 - DNA, 24 bp, Artificial Sequence
  Synthetic oligonucleotide; GTAGAAA chr11 5331744 5331767 5331747 -
tgaagcacaatgtctgaaagggtg

SEQ ID NO: 68070 - DNA, 24 bp, Artificial Sequence
  Synthetic oligonucleotide; TCAGAAT chr11 5331656 5331679 5331659 -
acagtagcatctggttagcttgag

SEQ ID NO: 68071 - DNA, 24 bp, Artificial Sequence
  Synthetic oligonucleotide; GAAGAAT chr11 5331622 5331645 5331625 -
ctgtaagtgtaaacactcgatttt

SEQ ID NO: 68072 - DNA, 24 bp, Artificial Sequence
  Synthetic oligonucleotide; TAAGAAT chr11 5330555 5330578 5330558 -
cactgtgcttcatcaaaaaaatgt

SEQ ID NO: 68073 - DNA, 24 bp, Artificial Sequence
  Synthetic oligonucleotide; TTAGAAT chr11 5330468 5330491 5330471 -
caaagagataccatctcacaccag

SEQ ID NO: 68074 - DNA, 24 bp, Artificial Sequence
  Synthetic oligonucleotide; GGAGAAA chr11 5330415 5330438 5330418 -
aacaacaggtgctggagaggatgt

SEQ ID NO: 68075 - DNA, 24 bp, Artificial Sequence
  Synthetic oligonucleotide; CTAGAAA chr11 5330322 5330345 5330325 -
tggcgattcctcagggatctagaa

SEQ ID NO: 68076 - DNA, 24 bp, Artificial Sequence
  Synthetic oligonucleotide; TAAGAAA chr11 5330158 5330181 5330161 -
atgtccaacaatgatagactgaat

SEQ ID NO: 68077 - DNA, 24 bp, Artificial Sequence
  Synthetic oligonucleotide; CTAGAAT chr11 5329678 5329701 5329681 -
acatgttttgttattctggctctg

SEQ ID NO: 68078 - DNA, 24 bp, Artificial Sequence
  Synthetic oligonucleotide; TGAGAAA chr11 5329527 5329550 5329530 -
tattagcttaaataatatttcttt

SEQ ID NO: 68079 - DNA, 24 bp, Artificial Sequence
  Synthetic oligonucleotide; GGAGAAT chr11 5329108 5329131 5329111 -
ccagcttctcaggaggctgtggca

SEQ ID NO: 68080 - DNA, 24 bp, Artificial Sequence
  Synthetic oligonucleotide; CTAGAAA chr11 5328606 5328629 5328609 -
gagatcaaggggtctcctgagatg

SEQ ID NO: 68081 - DNA, 24 bp, Artificial Sequence
  Synthetic oligonucleotide; AGAGAAT chr11 5328148 5328171 5328151 -
gtagatgtttatagcttttttttc

SEQ ID NO: 68082 - DNA, 24 bp, Artificial Sequence
  Synthetic oligonucleotide; GCAGAAA chr11 5328000 5328023 5328003 -
tacattcatttttgaaaataagaa

SEQ ID NO: 68083 - DNA, 24 bp, Artificial Sequence
  Synthetic oligonucleotide; CCAGAAA chr11 5327857 5327880 5327860 -
gaaatcaactcagtttttgtttat

SEQ ID NO: 68084 - DNA, 24 bp, Artificial Sequence
  Synthetic oligonucleotide; TTAGAAA chr11 5327740 5327763 5327743 -
aaattctgaatcgagttgaaaggc

SEQ ID NO: 68085 - DNA, 24 bp, Artificial Sequence
  Synthetic oligonucleotide; TAAGAAA chr11 5327713 5327736 5327716 -
gaaaagggcagccaaattaagatc

SEQ ID NO: 68086 - DNA, 24 bp, Artificial Sequence
  Synthetic oligonucleotide; ATAGAAA chr11 5327614 5327637 5327617 -
caggaggaatttaacttgtggaca

SEQ ID NO: 68087 - DNA, 24 bp, Artificial Sequence
  Synthetic oligonucleotide; ATAGAAA chr11 5327455 5327478 5327458 -
cactctgctaagatcctgaaattt

SEQ ID NO: 68088 - DNA, 24 bp, Artificial Sequence
  Synthetic oligonucleotide; AAAGAAA chr11 5327451 5327474 5327454 -
ctgctaagatcctgaaatttatag

SEQ ID NO: 68089 - DNA, 24 bp, Artificial Sequence
  Synthetic oligonucleotide; CTAGAAA chr11 5327308 5327331 5327311 -
ggcatgagtagtcagtgggactca

SEQ ID NO: 68090 - DNA, 24 bp, Artificial Sequence
  Synthetic oligonucleotide; CTAGAAA chr11 5326935 5326958 5326938 -
tacaagtataggaatcttattcat

SEQ ID NO: 68091 - DNA, 24 bp, Artificial Sequence
  Synthetic oligonucleotide; CTAGAAT chr11 5326893 5326916 5326896 -
gtgaaattcaggtcaatagaacat

SEQ ID NO: 68092 - DNA, 24 bp, Artificial Sequence
  Synthetic oligonucleotide; CTAGAAT chr11 5326882 5326905 5326885 -
gtcaatagaacatctagaatgaag

SEQ ID NO: 68093 - DNA, 24 bp, Artificial Sequence
  Synthetic oligonucleotide; GGAGAAT chr11 5326782 5326805 5326785 -
gcaatattctgcataaaattgaag

SEQ ID NO: 68094 - DNA, 24 bp, Artificial Sequence
  Synthetic oligonucleotide; CCAGAAA chr11 5326436 5326459 5326439 -
cagccatagctgctccacctttat

SEQ ID NO: 68095 - DNA, 24 bp, Artificial Sequence
  Synthetic oligonucleotide; CTAGAAT chr11 5326259 5326282 5326262 -
gtttgatgacagtatctagctctc

SEQ ID NO: 68096 - DNA, 24 bp, Artificial Sequence
  Synthetic oligonucleotide; TCAGAAT chr11 5325789 5325812 5325792 -
gtgactttcttctatgtttaccct

SEQ ID NO: 68097 - DNA, 24 bp, Artificial Sequence
  Synthetic oligonucleotide; GAAGAAA chr11 5325442 5325465 5325445 -
tttttgatactgaggccattttat

SEQ ID NO: 68098 - DNA, 24 bp, Artificial Sequence
  Synthetic oligonucleotide; CAAGAAA chr11 5325319 5325342 5325322 -
atacccctcttggatcgtggcaac

SEQ ID NO: 68099 - DNA, 24 bp, Artificial Sequence
  Synthetic oligonucleotide; ACAGAAA chr11 5325312 5325335 5325315 -
tcttggatcgtggcaaccaagaaa

SEQ ID NO: 68100 - DNA, 24 bp, Artificial Sequence
  Synthetic oligonucleotide; ACAGAAA chr11 5325188 5325211 5325191 -
gaaaagcagagagaggtaagaagg

SEQ ID NO: 68101 - DNA, 24 bp, Artificial Sequence
  Synthetic oligonucleotide; GCAGAAA chr11 5325133 5325156 5325136 -
aaataatgttggaaagggcaagtg

SEQ ID NO: 68102 - DNA, 24 bp, Artificial Sequence
  Synthetic oligonucleotide; AAAGAAA chr11 5325129 5325152 5325132 -
aatgttggaaagggcaagtggcag

SEQ ID NO: 68103 - DNA, 24 bp, Artificial Sequence
  Synthetic oligonucleotide; AAAGAAA chr11 5325108 5325131 5325111 -
cagaaagaaagccagtaaatggtg

SEQ ID NO: 68104 - DNA, 24 bp, Artificial Sequence
  Synthetic oligonucleotide; GGAGAAA chr11 5325071 5325094 5325074 -
aaagataattgtatgaagatattt

SEQ ID NO: 68105 - DNA, 24 bp, Artificial Sequence
  Synthetic oligonucleotide; TGAGAAA chr11 5325063 5325086 5325066 -
ttgtatgaagatatttggagaaaa

SEQ ID NO: 68106 - DNA, 24 bp, Artificial Sequence
  Synthetic oligonucleotide; TCAGAAT chr11 5324925 5324948 5324928 -
ggacctgaaaaaagcgaatttgat

SEQ ID NO: 68107 - DNA, 24 bp, Artificial Sequence
  Synthetic oligonucleotide; GCAGAAT chr11 5324908 5324931 5324911 -
atttgattcagaatgttggaaggg

SEQ ID NO: 68108 - DNA, 24 bp, Artificial Sequence
  Synthetic oligonucleotide; TGAGAAA chr11 5324730 5324753 5324733 -
ctgacattcaatttccaaaaaaaa

SEQ ID NO: 68109 - DNA, 24 bp, Artificial Sequence
  Synthetic oligonucleotide; TGAGAAA chr11 5324492 5324515 5324495 -
aaattaatgaaaaatttttgaatt

SEQ ID NO: 68110 - DNA, 24 bp, Artificial Sequence
  Synthetic oligonucleotide; CAAGAAA chr11 5324330 5324353 5324333 -
tggaggctcctggtttcaaggttt

SEQ ID NO: 68111 - DNA, 24 bp, Artificial Sequence
  Synthetic oligonucleotide; CAAGAAA chr11 5323761 5323784 5323764 -
atcacacgtgctttctgcctccac

SEQ ID NO: 68112 - DNA, 24 bp, Artificial Sequence
  Synthetic oligonucleotide; GAAGAAT chr11 5323510 5323533 5323513 -
tttgacattcatttacagatttgg

SEQ ID NO: 68113 - DNA, 24 bp, Artificial Sequence
  Synthetic oligonucleotide; GGAGAAT chr11 5323349 5323372 5323352 -
ggtttagtagttaaactcggatct

SEQ ID NO: 68114 - DNA, 24 bp, Artificial Sequence
  Synthetic oligonucleotide; CCAGAAT chr11 5323319 5323342 5323322 -
tcagacacagacataaaaatgaag

SEQ ID NO: 68115 - DNA, 24 bp, Artificial Sequence
  Synthetic oligonucleotide; CTAGAAA chr11 5322963 5322986 5322966 -
aaaaaaaaagttgatcatcattct

SEQ ID NO: 68116 - DNA, 24 bp, Artificial Sequence
  Synthetic oligonucleotide; TAAGAAA chr11 5322909 5322932 5322912 -
ttattctcatggcaaatatagtga

SEQ ID NO: 68117 - DNA, 24 bp, Artificial Sequence
  Synthetic oligonucleotide; ATAGAAA chr11 5322506 5322529 5322509 -
gaagggtcaaggctctattcaaaa

SEQ ID NO: 68118 - DNA, 24 bp, Artificial Sequence
  Synthetic oligonucleotide; CTAGAAT chr11 5322488 5322511 5322491 -
tcaaaaatagaaaatatagccatt

SEQ ID NO: 68119 - DNA, 24 bp, Artificial Sequence
  Synthetic oligonucleotide; TTAGAAA chr11 5322417 5322440 5322420 -
tttatatatgttcagagggaaaaa

SEQ ID NO: 68120 - DNA, 24 bp, Artificial Sequence
  Synthetic oligonucleotide; AGAGAAA chr11 5322334 5322357 5322337 -
atattaggaagaccaacaatgttg

SEQ ID NO: 68121 - DNA, 24 bp, Artificial Sequence
  Synthetic oligonucleotide; TGAGAAA chr11 5321770 5321793 5321773 -
tagtttaattacctgccacatgtg

SEQ ID NO: 68122 - DNA, 24 bp, Artificial Sequence
  Synthetic oligonucleotide; AAAGAAA chr11 5321515 5321538 5321518 -
ttcttggtgccttcatggttgttt

SEQ ID NO: 68123 - DNA, 24 bp, Artificial Sequence
  Synthetic oligonucleotide; TTAGAAA chr11 5321148 5321171 5321151 -
tttacctatatgttaatgaaactg

SEQ ID NO: 68124 - DNA, 24 bp, Artificial Sequence
  Synthetic oligonucleotide; AAAGAAA chr11 5321143 5321166 5321146 -
ctatatgttaatgaaactgttaga

SEQ ID NO: 68125 - DNA, 24 bp, Artificial Sequence
  Synthetic oligonucleotide; TCAGAAA chr11 5320928 5320951 5320931 -
gaactactctccattcagcaaaac

SEQ ID NO: 68126 - DNA, 24 bp, Artificial Sequence
  Synthetic oligonucleotide; ATAGAAT chr11 5320850 5320873 5320853 -
aatcactcagttctattctaagtc

SEQ ID NO: 68127 - DNA, 24 bp, Artificial Sequence
  Synthetic oligonucleotide; CCAGAAA chr11 5320268 5320291 5320271 -
tcttctggaaaatgttccctgatc

SEQ ID NO: 68128 - DNA, 24 bp, Artificial Sequence
  Synthetic oligonucleotide; GAAGAAT chr11 5319971 5319994 5319974 -
tttatcagttctagcagccttttg

SEQ ID NO: 68129 - DNA, 24 bp, Artificial Sequence
  Synthetic oligonucleotide; TGAGAAT chr11 5319822 5319845 5319825 -
caattttatgttcactaggagtgg

SEQ ID NO: 68130 - DNA, 24 bp, Artificial Sequence
  Synthetic oligonucleotide; GGAGAAT chr11 5319786 5319809 5319789 -
tccttgtcttgttgcagttttcga

SEQ ID NO: 68131 - DNA, 24 bp, Artificial Sequence
  Synthetic oligonucleotide; AAAGAAA chr11 5319559 5319582 5319562 -
aaggagaactacaaaacactgctg

SEQ ID NO: 68132 - DNA, 24 bp, Artificial Sequence
  Synthetic oligonucleotide; TCAGAAA chr11 5319552 5319575 5319555 -
actacaaaacactgctgaaagaaa

SEQ ID NO: 68133 - DNA, 24 bp, Artificial Sequence
  Synthetic oligonucleotide; GAAGAAT chr11 5319502 5319525 5319505 -
aaagctttccaggctcatggattg

SEQ ID NO: 68134 - DNA, 24 bp, Artificial Sequence
  Synthetic oligonucleotide; TTAGAAA chr11 5319406 5319429 5319409 -
ttaccaatgtcattcttcacagta

SEQ ID NO: 68135 - DNA, 24 bp, Artificial Sequence
  Synthetic oligonucleotide; GCAGAAA chr11 5319341 5319364 5319344 -
cctgaacaggcaaagcaatcttaa

SEQ ID NO: 68136 - DNA, 24 bp, Artificial Sequence
  Synthetic oligonucleotide; GGAGAAT chr11 5319105 5319128 5319108 -
ccagctactcggaaggctgaggca

SEQ ID NO: 68137 - DNA, 24 bp, Artificial Sequence
  Synthetic oligonucleotide; AAAGAAA chr11 5319005 5319028 5319008 -
gagtgaaactctgaaaaaataaaa

SEQ ID NO: 68138 - DNA, 24 bp, Artificial Sequence
  Synthetic oligonucleotide; AAAGAAA chr11 5319001 5319024 5319004 -
gaaactctgaaaaaataaaaaaag

SEQ ID NO: 68139 - DNA, 24 bp, Artificial Sequence
  Synthetic oligonucleotide; AAAGAAA chr11 5318996 5319019 5318999 -
tctgaaaaaataaaaaaagaaaga

SEQ ID NO: 68140 - DNA, 24 bp, Artificial Sequence
  Synthetic oligonucleotide; AAAGAAA chr11 5318992 5319015 5318995 -
aaaaaataaaaaaagaaagaaaag

SEQ ID NO: 68141 - DNA, 24 bp, Artificial Sequence
  Synthetic oligonucleotide; GAAGAAA chr11 5318979 5319002 5318982 -
agaaagaaaagaaagaaagagagg

SEQ ID NO: 68142 - DNA, 24 bp, Artificial Sequence
  Synthetic oligonucleotide; AAAGAAA chr11 5318970 5318993 5318973 -
agaaagaaagagagggaagaaagg

SEQ ID NO: 68143 - DNA, 24 bp, Artificial Sequence
  Synthetic oligonucleotide; ATAGAAA chr11 5318888 5318911 5318891 -
agacacattgactaaggaaacaca

SEQ ID NO: 68144 - DNA, 24 bp, Artificial Sequence
  Synthetic oligonucleotide; GAAGAAT chr11 5318758 5318781 5318761 -
ggaatacgtggctagccatatgca

SEQ ID NO: 68145 - DNA, 24 bp, Artificial Sequence
  Synthetic oligonucleotide; AGAGAAA chr11 5318723 5318746 5318726 -
ctagacccttaccttacaccattt

SEQ ID NO: 68146 - DNA, 24 bp, Artificial Sequence
  Synthetic oligonucleotide; AAAGAAA chr11 5318618 5318641 5318621 -
agcccccaaaagcaattgcaatgc

SEQ ID NO: 68147 - DNA, 24 bp, Artificial Sequence
  Synthetic oligonucleotide; ATAGAAT chr11 5318525 5318548 5318528 -
aaccaacccaaatgtccaacaatg

SEQ ID NO: 68148 - DNA, 24 bp, Artificial Sequence
  Synthetic oligonucleotide; TAAGAAA chr11 5318514 5318537 5318517 -
atgtccaacaatgatagaatggat

SEQ ID NO: 68149 - DNA, 24 bp, Artificial Sequence
  Synthetic oligonucleotide; GAAGAAA chr11 5318107 5318130 5318110 -
aataaaaagagcttctgtgcagca

SEQ ID NO: 68150 - DNA, 24 bp, Artificial Sequence
  Synthetic oligonucleotide; GGAGAAA chr11 5318066 5318089 5318069 -
agtaaactgacaatctacaggata

SEQ ID NO: 68151 - DNA, 24 bp, Artificial Sequence
  Synthetic oligonucleotide; TCAGAAT chr11 5318022 5318045 5318025 -
gtgcatctggaaaaggtctaatat

SEQ ID NO: 68152 - DNA, 24 bp, Artificial Sequence
  Synthetic oligonucleotide; AGAGAAA chr11 5317873 5317896 5317876 -
caaaaatgatcatcatcactaatg

SEQ ID NO: 68153 - DNA, 24 bp, Artificial Sequence
  Synthetic oligonucleotide; TCAGAAT chr11 5317828 5317851 5317831 -
acaagagatactatctcataccag

SEQ ID NO: 68154 - DNA, 24 bp, Artificial Sequence
  Synthetic oligonucleotide; GGAGAAA chr11 5317778 5317801 5317781 -
aaaaacagattctcatgaggctat

SEQ ID NO: 68155 - DNA, 24 bp, Artificial Sequence
  Synthetic oligonucleotide; GCAGAAA chr11 5317722 5317745 5317725 -
gggatgtaaattagttcaaccact

SEQ ID NO: 68156 - DNA, 24 bp, Artificial Sequence
  Synthetic oligonucleotide; TTAGAAT chr11 5317576 5317599 5317579 -
cttgcatgttcactgtaatgctgt

SEQ ID NO: 68157 - DNA, 24 bp, Artificial Sequence
  Synthetic oligonucleotide; AAAGAAA chr11 5317521 5317544 5317524 -
gtgtctatcaaaggcggacgggat

SEQ ID NO: 68158 - DNA, 24 bp, Artificial Sequence
  Synthetic oligonucleotide; AAAGAAA chr11 5317170 5317193 5317173 -
tctaaagtaaatgttgaaaattta

SEQ ID NO: 68159 - DNA, 24 bp, Artificial Sequence
  Synthetic oligonucleotide; TCAGAAA chr11 5316997 5317020 5317000 -
atcagaactgattttcccaaagta

SEQ ID NO: 68160 - DNA, 24 bp, Artificial Sequence
  Synthetic oligonucleotide; GGAGAAA chr11 5316762 5316785 5316765 -
atgcagcttttctcatccatcctt

SEQ ID NO: 68161 - DNA, 24 bp, Artificial Sequence
  Synthetic oligonucleotide; CAAGAAA chr11 5316536 5316559 5316539 -
agcaggaatgggtccttattccag

SEQ ID NO: 68162 - DNA, 24 bp, Artificial Sequence
  Synthetic oligonucleotide; TTAGAAT chr11 5316225 5316248 5316228 -
tccacagagggctcatggcttttg

SEQ ID NO: 68163 - DNA, 24 bp, Artificial Sequence
  Synthetic oligonucleotide; AAAGAAA chr11 5316182 5316205 5316185 -
taacattctatttcaaaactaaac

SEQ ID NO: 68164 - DNA, 24 bp, Artificial Sequence
  Synthetic oligonucleotide; TAAGAAT chr11 5315947 5315970 5315950 -
ttttttaaaatgtgttttttagat

SEQ ID NO: 68165 - DNA, 24 bp, Artificial Sequence
  Synthetic oligonucleotide; GAAGAAA chr11 5315914 5315937 5315917 -
ttaactacttaattattcataact

SEQ ID NO: 68166 - DNA, 24 bp, Artificial Sequence
  Synthetic oligonucleotide; TAAGAAA chr11 5315856 5315879 5315859 -
gtctataaatgtattgctcttcta

SEQ ID NO: 68167 - DNA, 24 bp, Artificial Sequence
  Synthetic oligonucleotide; GCAGAAA chr11 5315785 5315808 5315788 -
aatatgaatattaggattgaggct

SEQ ID NO: 68168 - DNA, 24 bp, Artificial Sequence
  Synthetic oligonucleotide; GCAGAAT chr11 5315382 5315405 5315385 -
attatccactcccattatccactt

SEQ ID NO: 68169 - DNA, 24 bp, Artificial Sequence
  Synthetic oligonucleotide; CCAGAAA chr11 5315026 5315049 5315029 -
ttaaaacagttaaaggtattgcct

SEQ ID NO: 68170 - DNA, 24 bp, Artificial Sequence
  Synthetic oligonucleotide; ACAGAAT chr11 5314786 5314809 5314789 -
gcattgttcgcctattttctgggc

SEQ ID NO: 68171 - DNA, 24 bp, Artificial Sequence
  Synthetic oligonucleotide; TCAGAAT chr11 5314763 5314786 5314766 -
cacagaatggcttgagcccttttt

SEQ ID NO: 68172 - DNA, 24 bp, Artificial Sequence
  Synthetic oligonucleotide; ACAGAAA chr11 5314140 5314163 5314143 -
taggtgcaaaggtaattgcagttc

SEQ ID NO: 68173 - DNA, 24 bp, Artificial Sequence
  Synthetic oligonucleotide; GGAGAAA chr11 5313229 5313252 5313232 -
ccagatattagacttttgtcagat

SEQ ID NO: 68174 - DNA, 24 bp, Artificial Sequence
  Synthetic oligonucleotide; ATAGAAA chr11 5312956 5312979 5312959 -
tcttgtgttctctctaaatgctgg

SEQ ID NO: 68175 - DNA, 24 bp, Artificial Sequence
  Synthetic oligonucleotide; AAAGAAT chr11 5312335 5312358 5312338 -
aagtcttcaaataagtggggactc

SEQ ID NO: 68176 - DNA, 24 bp, Artificial Sequence
  Synthetic oligonucleotide; AAAGAAA chr11 5312327 5312350 5312330 -
aaataagtggggactcaaagaata

SEQ ID NO: 68177 - DNA, 24 bp, Artificial Sequence
  Synthetic oligonucleotide; GCAGAAA chr11 5312284 5312307 5312287 -
acaagtgctgtgattaatcataaa

SEQ ID NO: 68178 - DNA, 24 bp, Artificial Sequence
  Synthetic oligonucleotide; TGAGAAA chr11 5312204 5312227 5312207 -
gcttgaaataagggtaagattccc

SEQ ID NO: 68179 - DNA, 24 bp, Artificial Sequence
  Synthetic oligonucleotide; TTAGAAA chr11 5312167 5312190 5312170 -
cttcagctgagacctgaaaatgga

SEQ ID NO: 68180 - DNA, 24 bp, Artificial Sequence
  Synthetic oligonucleotide; CAAGAAT chr11 5312140 5312163 5312143 -
gaaactaactggtgaaaatacaga

SEQ ID NO: 68181 - DNA, 24 bp, Artificial Sequence
  Synthetic oligonucleotide; GCAGAAT chr11 5311880 5311903 5311883 -
ggaattgagggaggcagggaaagg

SEQ ID NO: 68182 - DNA, 24 bp, Artificial Sequence
  Synthetic oligonucleotide; GAAGAAA chr11 5311860 5311883 5311863 -
aagggcagaatattagagtaattt

SEQ ID NO: 68183 - DNA, 24 bp, Artificial Sequence
  Synthetic oligonucleotide; TTAGAAA chr11 5311761 5311784 5311764 -
aatataataaggtttacaggttat

SEQ ID NO: 68184 - DNA, 24 bp, Artificial Sequence
  Synthetic oligonucleotide; AAAGAAA chr11 5311746 5311769 5311749 -
acaggttatttagaaaagcagagg

SEQ ID NO: 68185 - DNA, 24 bp, Artificial Sequence
  Synthetic oligonucleotide; GAAGAAA chr11 5311692 5311715 5311695 -
ccatcaatttctgacatgttcttg

SEQ ID NO: 68186 - DNA, 24 bp, Artificial Sequence
  Synthetic oligonucleotide; AAAGAAA chr11 5311675 5311698 5311678 -
gttcttggaagaaaggcagtgcca

SEQ ID NO: 68187 - DNA, 24 bp, Artificial Sequence
  Synthetic oligonucleotide; GAAGAAT chr11 5311635 5311658 5311638 -
tgattatgtattgtctataaataa

SEQ ID NO: 68188 - DNA, 24 bp, Artificial Sequence
  Synthetic oligonucleotide; TGAGAAT chr11 5311600 5311623 5311603 -
ataatttttaaagttgtgggacac

SEQ ID NO: 68189 - DNA, 24 bp, Artificial Sequence
  Synthetic oligonucleotide; TAAGAAA chr11 5311568 5311591 5311571 -
agtcaaaataataaacatgtgatt

SEQ ID NO: 68190 - DNA, 24 bp, Artificial Sequence
  Synthetic oligonucleotide; TCAGAAA chr11 5311411 5311434 5311414 -
gtcatagtaaaggcaagacatatg

SEQ ID NO: 68191 - DNA, 24 bp, Artificial Sequence
  Synthetic oligonucleotide; TGAGAAT chr11 5311400 5311423 5311403 -
ggcaagacatatgtcagaaaatga

SEQ ID NO: 68192 - DNA, 24 bp, Artificial Sequence
  Synthetic oligonucleotide; ACAGAAA chr11 5311377 5311400 5311380 -
atgagaatttacagatgcaagaca

SEQ ID NO: 68193 - DNA, 24 bp, Artificial Sequence
  Synthetic oligonucleotide; AGAGAAT chr11 5311338 5311361 5311341 -
agcagatgacacccaaagaaggtc

SEQ ID NO: 68194 - DNA, 24 bp, Artificial Sequence
  Synthetic oligonucleotide; GGAGAAA chr11 5311305 5311328 5311308 -
gtgaaacagtggctcactatccta

SEQ ID NO: 68195 - DNA, 24 bp, Artificial Sequence
  Synthetic oligonucleotide; CAAGAAT chr11 5311101 5311124 5311104 -
ctgaattaccagatgagtaaataa

SEQ ID NO: 68196 - DNA, 24 bp, Artificial Sequence
  Synthetic oligonucleotide; AAAGAAT chr11 5310185 5310208 5310188 -
ctcactctgaatattctgcttttc

SEQ ID NO: 68197 - DNA, 24 bp, Artificial Sequence
  Synthetic oligonucleotide; GAAGAAA chr11 5310155 5310178 5310158 -
tattccttggaatattccatggaa

SEQ ID NO: 68198 - DNA, 24 bp, Artificial Sequence
  Synthetic oligonucleotide; GGAGAAA chr11 5310132 5310155 5310135 -
agaagaaaatgagacaagctttct

SEQ ID NO: 68199 - DNA, 24 bp, Artificial Sequence
  Synthetic oligonucleotide; AAAGAAA chr11 5310060 5310083 5310063 -
gcctcctgggttcagttttcagtt

SEQ ID NO: 68200 - DNA, 24 bp, Artificial Sequence
  Synthetic oligonucleotide; GGAGAAA chr11 5309931 5309954 5309934 -
cacattttacaggtacattttcac

SEQ ID NO: 68201 - DNA, 24 bp, Artificial Sequence
  Synthetic oligonucleotide; AGAGAAA chr11 5309517 5309540 5309520 -
tattgggaagacataaaaatgtgg

SEQ ID NO: 68202 - DNA, 24 bp, Artificial Sequence
  Synthetic oligonucleotide; GAAGAAT chr11 5309145 5309168 5309148 -
agactgtctttgtaagttattttg

SEQ ID NO: 68203 - DNA, 24 bp, Artificial Sequence
  Synthetic oligonucleotide; ATAGAAA chr11 5309140 5309163 5309143 -
gtctttgtaagttattttggaaga

SEQ ID NO: 68204 - DNA, 24 bp, Artificial Sequence
  Synthetic oligonucleotide; TGAGAAA chr11 5308955 5308978 5308958 -
tctgttagtttttctcatgcttag

SEQ ID NO: 68205 - DNA, 24 bp, Artificial Sequence
  Synthetic oligonucleotide; GAAGAAA chr11 5308882 5308905 5308885 -
caataacctgcaatttacgtccaa

SEQ ID NO: 68206 - DNA, 24 bp, Artificial Sequence
  Synthetic oligonucleotide; CCAGAAA chr11 5308396 5308419 5308399 -
ctgtaacttctttcaacgtaatct

SEQ ID NO: 68207 - DNA, 24 bp, Artificial Sequence
  Synthetic oligonucleotide; TGAGAAT chr11 5308170 5308193 5308173 -
tattgttggggtacagttctttat

SEQ ID NO: 68208 - DNA, 24 bp, Artificial Sequence
  Synthetic oligonucleotide; GGAGAAT chr11 5308040 5308063 5308043 -
caaagtagtcttttcattggaatg

SEQ ID NO: 68209 - DNA, 24 bp, Artificial Sequence
  Synthetic oligonucleotide; AAAGAAA chr11 5307806 5307829 5307809 -
caagacactgtctcaaaagagagg

SEQ ID NO: 68210 - DNA, 24 bp, Artificial Sequence
  Synthetic oligonucleotide; AAAGAAA chr11 5307801 5307824 5307804 -
cactgtctcaaaagagaggaaaga

SEQ ID NO: 68211 - DNA, 24 bp, Artificial Sequence
  Synthetic oligonucleotide; AGAGAAT chr11 5307794 5307817 5307797 -
tcaaaagagaggaaagaaaagaaa

SEQ ID NO: 68212 - DNA, 24 bp, Artificial Sequence
  Synthetic oligonucleotide; GGAGAAA chr11 5307767 5307790 5307770 -
gaataaaaggaaaggaaaggaaag

SEQ ID NO: 68213 - DNA, 24 bp, Artificial Sequence
  Synthetic oligonucleotide; AAAGAAA chr11 5307763 5307786 5307766 -
aaaaggaaaggaaaggaaagggag

SEQ ID NO: 68214 - DNA, 24 bp, Artificial Sequence
  Synthetic oligonucleotide; GAAGAAA chr11 5307747 5307770 5307750 -
aaagggagaaagaaaggaaggaag

SEQ ID NO: 68215 - DNA, 24 bp, Artificial Sequence
  Synthetic oligonucleotide; AGAGAAA chr11 5307733 5307756 5307736 -
aggaaggaaggaagaaaaagagag

SEQ ID NO: 68216 - DNA, 24 bp, Artificial Sequence
  Synthetic oligonucleotide; AAAGAAA chr11 5307721 5307744 5307724 -
agaaaaagagagagagaaataagg

SEQ ID NO: 68217 - DNA, 24 bp, Artificial Sequence
  Synthetic oligonucleotide; AAAGAAA chr11 5307717 5307740 5307720 -
aaagagagagagaaataaggaaag

SEQ ID NO: 68218 - DNA, 24 bp, Artificial Sequence
  Synthetic oligonucleotide; AAAGAAA chr11 5307710 5307733 5307713 -
gagagaaataaggaaagaaagaaa

SEQ ID NO: 68219 - DNA, 24 bp, Artificial Sequence
  Synthetic oligonucleotide; AAAGAAA chr11 5307535 5307558 5307538 -
agagacatcgaagtactaaacaat

SEQ ID NO: 68220 - DNA, 24 bp, Artificial Sequence
  Synthetic oligonucleotide; CAAGAAT chr11 5307424 5307447 5307427 -
gctacaaaaccaatggcttgatca

SEQ ID NO: 68221 - DNA, 24 bp, Artificial Sequence
  Synthetic oligonucleotide; CTAGAAT chr11 5307240 5307263 5307243 -
agccgtcacttcttagctacaagt

SEQ ID NO: 68222 - DNA, 24 bp, Artificial Sequence
  Synthetic oligonucleotide; GTAGAAT chr11 5307062 5307085 5307065 -
tgctgcgagtgtcacatatattat

SEQ ID NO: 68223 - DNA, 24 bp, Artificial Sequence
  Synthetic oligonucleotide; ATAGAAA chr11 5306952 5306975 5306955 -
tctgcacgatcttagactacttaa

SEQ ID NO: 68224 - DNA, 24 bp, Artificial Sequence
  Synthetic oligonucleotide; TCAGAAT chr11 5306914 5306937 5306917 -
cataatccaatgaaaaaagagatt

SEQ ID NO: 68225 - DNA, 24 bp, Artificial Sequence
  Synthetic oligonucleotide; CTAGAAA chr11 5306738 5306761 5306741 -
tttaatgcagatatctttatacat

SEQ ID NO: 68226 - DNA, 24 bp, Artificial Sequence
  Synthetic oligonucleotide; ATAGAAA chr11 5306455 5306478 5306458 -
ggtagggtagtgagttttgaatca

SEQ ID NO: 68227 - DNA, 24 bp, Artificial Sequence
  Synthetic oligonucleotide; AAAGAAT chr11 5306451 5306474 5306454 -
gggtagtgagttttgaatcaatag

SEQ ID NO: 68228 - DNA, 24 bp, Artificial Sequence
  Synthetic oligonucleotide; AGAGAAT chr11 5306368 5306391 5306371 -
aaggattttgtaaagggttgaatt

SEQ ID NO: 68229 - DNA, 24 bp, Artificial Sequence
  Synthetic oligonucleotide; AAAGAAA chr11 5306196 5306219 5306199 -
acttctcttagagactctccttcc

SEQ ID NO: 68230 - DNA, 24 bp, Artificial Sequence
  Synthetic oligonucleotide; AGAGAAT chr11 5306129 5306152 5306132 -
atctttcccaggttggggaggaaa

SEQ ID NO: 68231 - DNA, 24 bp, Artificial Sequence
  Synthetic oligonucleotide; CTAGAAT chr11 5306081 5306104 5306084 -
ccaaatatcctatgtggaaatgag

SEQ ID NO: 68232 - DNA, 24 bp, Artificial Sequence
  Synthetic oligonucleotide; TCAGAAT chr11 5306034 5306057 5306037 -
tttgtgtaacaaatatatctctca

SEQ ID NO: 68233 - DNA, 24 bp, Artificial Sequence
  Synthetic oligonucleotide; TCAGAAA chr11 5305978 5306001 5305981 -
aaacaaccaatattcaggtcatgc

SEQ ID NO: 68234 - DNA, 24 bp, Artificial Sequence
  Synthetic oligonucleotide; AGAGAAA chr11 5305965 5305988 5305968 -
tcaggtcatgctcagaaaccgcaa

SEQ ID NO: 68235 - DNA, 24 bp, Artificial Sequence
  Synthetic oligonucleotide; TAAGAAA chr11 5305945 5305968 5305948 -
gcaaagagaaaactgtggctcagg

SEQ ID NO: 68236 - DNA, 24 bp, Artificial Sequence
  Synthetic oligonucleotide; TGAGAAT chr11 5305880 5305903 5305883 -
catttccatttgatggacattggt

SEQ ID NO: 68237 - DNA, 24 bp, Artificial Sequence
  Synthetic oligonucleotide; TCAGAAA chr11 5304384 5304407 5304387 -
ctggatgatggatctatgttacct

SEQ ID NO: 68238 - DNA, 24 bp, Artificial Sequence
  Synthetic oligonucleotide; AAAGAAT chr11 5304348 5304371 5304351 -
gaggactctgggatagttgctgtc

SEQ ID NO: 68239 - DNA, 24 bp, Artificial Sequence
  Synthetic oligonucleotide; TCAGAAA chr11 5304327 5304350 5304330 -
gtcaaagaatcagtccaaaggcac

SEQ ID NO: 68240 - DNA, 24 bp, Artificial Sequence
  Synthetic oligonucleotide; TAAGAAT chr11 5303927 5303950 5303930 -
ggttttgaaaacacgactatagtt

SEQ ID NO: 68241 - DNA, 24 bp, Artificial Sequence
  Synthetic oligonucleotide; ACAGAAT chr11 5303349 5303372 5303352 -
tattttaaaagactctggacacat

SEQ ID NO: 68242 - DNA, 24 bp, Artificial Sequence
  Synthetic oligonucleotide; GGAGAAA chr11 5303330 5303353 5303333 -
cacatacagaatcaattgaatttg

SEQ ID NO: 68243 - DNA, 24 bp, Artificial Sequence
  Synthetic oligonucleotide; AGAGAAA chr11 5302374 5302397 5302377 -
aatacagctgtcccattagtttca

SEQ ID NO: 68244 - DNA, 24 bp, Artificial Sequence
  Synthetic oligonucleotide; AGAGAAT chr11 5302287 5302310 5302290 -
ataggaggaggaataaaagagtaa

SEQ ID NO: 68245 - DNA, 24 bp, Artificial Sequence
  Synthetic oligonucleotide; CCAGAAA chr11 5302083 5302106 5302086 -
acaattaattaagtatgagacaat

SEQ ID NO: 68246 - DNA, 24 bp, Artificial Sequence
  Synthetic oligonucleotide; AGAGAAA chr11 5302020 5302043 5302023 -
atgatgtgctacaagaagattgtg

SEQ ID NO: 68247 - DNA, 24 bp, Artificial Sequence
  Synthetic oligonucleotide; AAAGAAA chr11 5302013 5302036 5302016 -
gctacaagaagattgtgagagaaa

SEQ ID NO: 68248 - DNA, 24 bp, Artificial Sequence
  Synthetic oligonucleotide; GTAGAAT chr11 5301629 5301652 5301632 -
tccttcattcattcactggccatt

SEQ ID NO: 68249 - DNA, 24 bp, Artificial Sequence
  Synthetic oligonucleotide; TCAGAAT chr11 5301005 5301028 5301008 -
cagagtagggcttgagcccttatt

SEQ ID NO: 68250 - DNA, 24 bp, Artificial Sequence
  Synthetic oligonucleotide; CGAGAAA chr11 5300873 5300896 5300876 -
atcacatgaaaaagctgatgtgag

SEQ ID NO: 68251 - DNA, 24 bp, Artificial Sequence
  Synthetic oligonucleotide; GAAGAAA chr11 5300784 5300807 5300787 -
taaagagggaatgccagtgatgct

SEQ ID NO: 68252 - DNA, 24 bp, Artificial Sequence
  Synthetic oligonucleotide; AAAGAAT chr11 5300778 5300801 5300781 -
gggaatgccagtgatgctgaagaa

SEQ ID NO: 68253 - DNA, 24 bp, Artificial Sequence
  Synthetic oligonucleotide; TCAGAAA chr11 5300722 5300745 5300725 -
tccaaaagaagagtaactatgatt

SEQ ID NO: 68254 - DNA, 24 bp, Artificial Sequence
  Synthetic oligonucleotide; AAAGAAA chr11 5300666 5300689 5300669 -
gcttgggtcaaatacagttcatct

SEQ ID NO: 68255 - DNA, 24 bp, Artificial Sequence
  Synthetic oligonucleotide; TTAGAAA chr11 5300120 5300143 5300123 -
acttggcaaaggtaatgttatatt

SEQ ID NO: 68256 - DNA, 24 bp, Artificial Sequence
  Synthetic oligonucleotide; TAAGAAA chr11 5299773 5299796 5299776 -
attctaaattctctctgcttcact

SEQ ID NO: 68257 - DNA, 24 bp, Artificial Sequence
  Synthetic oligonucleotide; TAAGAAA chr11 5299706 5299729 5299709 -
tctgaaaatattccagagatttga

SEQ ID NO: 68258 - DNA, 24 bp, Artificial Sequence
  Synthetic oligonucleotide; TTAGAAA chr11 5299453 5299476 5299456 -
gttggcatacagagtttattctat

SEQ ID NO: 68259 - DNA, 24 bp, Artificial Sequence
  Synthetic oligonucleotide; TAAGAAA chr11 5299142 5299165 5299145 -
aaaataaggtatgatagcgaagtc

SEQ ID NO: 68260 - DNA, 24 bp, Artificial Sequence
  Synthetic oligonucleotide; AGAGAAA chr11 5298176 5298199 5298179 -
ctcctaatgatagggacaggaggc

SEQ ID NO: 68261 - DNA, 24 bp, Artificial Sequence
  Synthetic oligonucleotide; GCAGAAA chr11 5298163 5298186 5298166 -
ggacaggaggcagagaaattttag

SEQ ID NO: 68262 - DNA, 24 bp, Artificial Sequence
  Synthetic oligonucleotide; CTAGAAA chr11 5298012 5298035 5298015 -
ctagctgtcttattcatgcacttt

SEQ ID NO: 68263 - DNA, 24 bp, Artificial Sequence
  Synthetic oligonucleotide; ACAGAAA chr11 5297758 5297781 5297761 -
tccaaaagtattgaccaataagga

SEQ ID NO: 68264 - DNA, 24 bp, Artificial Sequence
  Synthetic oligonucleotide; ATAGAAA chr11 5297625 5297648 5297628 -
taaggtagtttgaaaagcctagat

SEQ ID NO: 68265 - DNA, 24 bp, Artificial Sequence
  Synthetic oligonucleotide; ACAGAAT chr11 5297584 5297607 5297587 -
acatgagttcagtatataattgta

SEQ ID NO: 68266 - DNA, 24 bp, Artificial Sequence
  Synthetic oligonucleotide; ATAGAAA chr11 5297375 5297398 5297378 -
tgtagaacctaagctgattcggcc

SEQ ID NO: 68267 - DNA, 24 bp, Artificial Sequence
  Synthetic oligonucleotide; ATAGAAT chr11 5297301 5297324 5297304 -
ctatgctgtcagatgaatactgag

SEQ ID NO: 68268 - DNA, 24 bp, Artificial Sequence
  Synthetic oligonucleotide; ACAGAAA chr11 5297177 5297200 5297180 -
gatggatgaaggcaggtgactcta

SEQ ID NO: 68269 - DNA, 24 bp, Artificial Sequence
  Synthetic oligonucleotide; ATAGAAA chr11 5296747 5296770 5296750 -
aatttgtgtaggttgaaatgagct

SEQ ID NO: 68270 - DNA, 24 bp, Artificial Sequence
  Synthetic oligonucleotide; GGAGAAA chr11 5296634 5296657 5296637 -
taactaatgtgaagtgactttaaa

SEQ ID NO: 68271 - DNA, 24 bp, Artificial Sequence
  Synthetic oligonucleotide; GGAGAAA chr11 5296432 5296455 5296435 -
aggaacctgtagatacaaaaagtt

SEQ ID NO: 68272 - DNA, 24 bp, Artificial Sequence
  Synthetic oligonucleotide; ATAGAAA chr11 5296387 5296410 5296390 -
atgacaaaaatctattaatccttg

SEQ ID NO: 68273 - DNA, 24 bp, Artificial Sequence
  Synthetic oligonucleotide; AAAGAAA chr11 5296351 5296374 5296354 -
aagagataaaacactggtttacat

SEQ ID NO: 68274 - DNA, 24 bp, Artificial Sequence
  Synthetic oligonucleotide; TGAGAAA chr11 5296303 5296326 5296306 -
cagatccttataaaagtgataatt

SEQ ID NO: 68275 - DNA, 24 bp, Artificial Sequence
  Synthetic oligonucleotide; TCAGAAA chr11 5296130 5296153 5296133 -
ttctcacttatcactataaacatc

SEQ ID NO: 68276 - DNA, 24 bp, Artificial Sequence
  Synthetic oligonucleotide; GTAGAAA chr11 5296078 5296101 5296081 -
gcattttaaatagttaggaataat

SEQ ID NO: 68277 - DNA, 24 bp, Artificial Sequence
  Synthetic oligonucleotide; TCAGAAA chr11 5295910 5295933 5295913 -
gtaacttggttctagttgcttctt

SEQ ID NO: 68278 - DNA, 24 bp, Artificial Sequence
  Synthetic oligonucleotide; GAAGAAA chr11 5295812 5295835 5295815 -
ctaactactttttagtacatctaa

SEQ ID NO: 68279 - DNA, 24 bp, Artificial Sequence
  Synthetic oligonucleotide; AGAGAAA chr11 5295601 5295624 5295604 -
gagactaaccttccctcgctttgc

SEQ ID NO: 68280 - DNA, 24 bp, Artificial Sequence
  Synthetic oligonucleotide; CTAGAAT chr11 5295237 5295260 5295240 -
taattcaactcatgatatttggct

SEQ ID NO: 68281 - DNA, 24 bp, Artificial Sequence
  Synthetic oligonucleotide; TGAGAAA chr11 5295139 5295162 5295142 -
tctgaaataagacataatttgggg

SEQ ID NO: 68282 - DNA, 24 bp, Artificial Sequence
  Synthetic oligonucleotide; AGAGAAT chr11 5293710 5293733 5293713 -
gcaggatgtgggtggggccagata

SEQ ID NO: 68283 - DNA, 24 bp, Artificial Sequence
  Synthetic oligonucleotide; GAAGAAA chr11 5293401 5293424 5293404 -
gcgagaccacgaacccatcagaag

SEQ ID NO: 68284 - DNA, 24 bp, Artificial Sequence
  Synthetic oligonucleotide; TCAGAAA chr11 5293255 5293278 5293258 -
cccaccaattccggacacagtatg

SEQ ID NO: 68285 - DNA, 24 bp, Artificial Sequence
  Synthetic oligonucleotide; GCAGAAA chr11 5293085 5293108 5293088 -
attctctttcccttcctctatgtg

SEQ ID NO: 68286 - DNA, 24 bp, Artificial Sequence
  Synthetic oligonucleotide; AAAGAAA chr11 5292967 5292990 5292970 -
aacatctgactgtgacgtagcaat

SEQ ID NO: 68287 - DNA, 24 bp, Artificial Sequence
  Synthetic oligonucleotide; CGAGAAA chr11 5292808 5292831 5292811 -
tgcaatttcaagttctttacaggc

SEQ ID NO: 68288 - DNA, 24 bp, Artificial Sequence
  Synthetic oligonucleotide; ACAGAAT chr11 5291620 5291643 5291623 -
gatttttcccacagtctgttggtc

SEQ ID NO: 68289 - DNA, 24 bp, Artificial Sequence
  Synthetic oligonucleotide; TGAGAAT chr11 5291587 5291610 5291590 -
cctgagtgattactgatgaaagag

SEQ ID NO: 68290 - DNA, 24 bp, Artificial Sequence
  Synthetic oligonucleotide; CCAGAAA chr11 5291137 5291160 5291140 -
tcggtctttctttatttcaagagt

SEQ ID NO: 68291 - DNA, 24 bp, Artificial Sequence
  Synthetic oligonucleotide; AGAGAAA chr11 5291079 5291102 5291082 -
atggaaagagctctttcaagagac

SEQ ID NO: 68292 - DNA, 24 bp, Artificial Sequence
  Synthetic oligonucleotide; AAAGAAT chr11 5291074 5291097 5291077 -
aagagctctttcaagagacagaga

SEQ ID NO: 68293 - DNA, 24 bp, Artificial Sequence
  Synthetic oligonucleotide; TTAGAAT chr11 5290852 5290875 5290855 -
tttagtttatatacatctgtattg

SEQ ID NO: 68294 - DNA, 24 bp, Artificial Sequence
  Synthetic oligonucleotide; GTAGAAT chr11 5290261 5290284 5290264 -
agggaccacagggttaagggggca

SEQ ID NO: 68295 - DNA, 24 bp, Artificial Sequence
  Synthetic oligonucleotide; AAAGAAT chr11 5290143 5290166 5290146 -
tttaaatgtataaataagtggatg

SEQ ID NO: 68296 - DNA, 24 bp, Artificial Sequence
  Synthetic oligonucleotide; ATAGAAT chr11 5290107 5290130 5290110 -
gatagatagacagatagatgatag

SEQ ID NO: 68297 - DNA, 24 bp, Artificial Sequence
  Synthetic oligonucleotide; GGAGAAA chr11 5289774 5289797 5289777 -
ggagagctgaacttggtcaacaaa

SEQ ID NO: 68298 - DNA, 24 bp, Artificial Sequence
  Synthetic oligonucleotide; ACAGAAT chr11 5289026 5289049 5289029 -
cagagtgaaaccttgcctcacgaa

SEQ ID NO: 68299 - DNA, 24 bp, Artificial Sequence
  Synthetic oligonucleotide; CTAGAAA chr11 5288883 5288906 5288886 -
aattttgtaatattgatattattc

SEQ ID NO: 68300 - DNA, 24 bp, Artificial Sequence
  Synthetic oligonucleotide; AAAGAAT chr11 5288635 5288658 5288638 -
aacaggaataacagaacaagattg

SEQ ID NO: 68301 - DNA, 24 bp, Artificial Sequence
  Synthetic oligonucleotide; TGAGAAT chr11 5288406 5288429 5288409 -
gacatctcattctttttcttagtg

SEQ ID NO: 68302 - DNA, 24 bp, Artificial Sequence
  Synthetic oligonucleotide; TAAGAAT chr11 5288400 5288423 5288403 -
tcattctttttcttagtgtgagaa

SEQ ID NO: 68303 - DNA, 24 bp, Artificial Sequence
  Synthetic oligonucleotide; AAAGAAA chr11 5288146 5288169 5288149 -
catttaaatgatatatttatttta

SEQ ID NO: 68304 - DNA, 24 bp, Artificial Sequence
  Synthetic oligonucleotide; GTAGAAT chr11 5288097 5288120 5288100 -
ccctggctgtgacatggaaactat

SEQ ID NO: 68305 - DNA, 24 bp, Artificial Sequence
  Synthetic oligonucleotide; ACAGAAA chr11 5288023 5288046 5288026 -
aggggctcactgcacatacactag

SEQ ID NO: 68306 - DNA, 24 bp, Artificial Sequence
  Synthetic oligonucleotide; TGAGAAA chr11 5287973 5287996 5287976 -
agcctgatcatttccatgtcatac

SEQ ID NO: 68307 - DNA, 24 bp, Artificial Sequence
  Synthetic oligonucleotide; TGAGAAA chr11 5287441 5287464 5287444 -
agggttttttaattagtttgtttt

SEQ ID NO: 68308 - DNA, 24 bp, Artificial Sequence
  Synthetic oligonucleotide; CTAGAAA chr11 5287076 5287099 5287079 -
agtgacttataaatgctaactact

SEQ ID NO: 68309 - DNA, 24 bp, Artificial Sequence
  Synthetic oligonucleotide; GTAGAAT chr11 5286778 5286801 5286781 -
acaaacataaactactagcaaata

SEQ ID NO: 68310 - DNA, 24 bp, Artificial Sequence
  Synthetic oligonucleotide; TCAGAAA chr11 5286613 5286636 5286616 -
ggcctcccaggccaagttatccat

SEQ ID NO: 68311 - DNA, 24 bp, Artificial Sequence
  Synthetic oligonucleotide; TCAGAAT chr11 5286319 5286342 5286322 -
ttatttaacaaatgcatgaatgct

SEQ ID NO: 68312 - DNA, 24 bp, Artificial Sequence
  Synthetic oligonucleotide; TAAGAAT chr11 5286238 5286261 5286241 -
aggattagaagattcttctgtgtg

SEQ ID NO: 68313 - DNA, 24 bp, Artificial Sequence
  Synthetic oligonucleotide; ATAGAAA chr11 5286168 5286191 5286171 -
gaaaatctgtgagctcctcaccat

SEQ ID NO: 68314 - DNA, 24 bp, Artificial Sequence
  Synthetic oligonucleotide; TGAGAAA chr11 5286070 5286093 5286073 -
ttaattcccaaactcatatagctc

SEQ ID NO: 68315 - DNA, 24 bp, Artificial Sequence
  Synthetic oligonucleotide; ACAGAAA chr11 5285946 5285969 5285949 -
ttggttgcatgaatcagattatca

SEQ ID NO: 68316 - DNA, 24 bp, Artificial Sequence
  Synthetic oligonucleotide; GTAGAAA chr11 5285848 5285871 5285851 -
cctgcccattcagggctccagcat

SEQ ID NO: 68317 - DNA, 24 bp, Artificial Sequence
  Synthetic oligonucleotide; GGAGAAT chr11 5285461 5285484 5285464 -
accctgctgagatgatctatgtgg

SEQ ID NO: 68318 - DNA, 24 bp, Artificial Sequence
  Synthetic oligonucleotide; TGAGAAA chr11 5285446 5285469 5285449 -
tctatgtggggagaatggcttctt

SEQ ID NO: 68319 - DNA, 24 bp, Artificial Sequence
  Synthetic oligonucleotide; CCAGAAT chr11 5285395 5285418 5285398 -
tgcccctcattcccactttaatat

SEQ ID NO: 68320 - DNA, 24 bp, Artificial Sequence
  Synthetic oligonucleotide; GAAGAAT chr11 5285380 5285403 5285383 -
ctttaatatccagaatcactataa

SEQ ID NO: 68321 - DNA, 24 bp, Artificial Sequence
  Synthetic oligonucleotide; TGAGAAA chr11 5284134 5284157 5284137 -
catggaagcccaaggttctgaaca

SEQ ID NO: 68322 - DNA, 24 bp, Artificial Sequence
  Synthetic oligonucleotide; CTAGAAA chr11 5284077 5284100 5284080 -
gagggaaacaagatggtgaaggga

SEQ ID NO: 68323 - DNA, 24 bp, Artificial Sequence
  Synthetic oligonucleotide; CTAGAAT chr11 5283853 5283876 5283856 -
cacctcttgagtacttagtatatg

SEQ ID NO: 68324 - DNA, 24 bp, Artificial Sequence
  Synthetic oligonucleotide; GGAGAAT chr11 5283619 5283642 5283622 -
ccagctactcaggaggctgaggca

SEQ ID NO: 68325 - DNA, 24 bp, Artificial Sequence
  Synthetic oligonucleotide; CGAGAAA chr11 5283163 5283186 5283166 -
acacaaactcagatattgtggatg

SEQ ID NO: 68326 - DNA, 24 bp, Artificial Sequence
  Synthetic oligonucleotide; GGAGAAA chr11 5283022 5283045 5283025 -
tgcatttcttcaggaaagtttgag

SEQ ID NO: 68327 - DNA, 24 bp, Artificial Sequence
  Synthetic oligonucleotide; AAAGAAA chr11 5283010 5283033 5283013 -
ggaaagtttgagggagaaaaaggt

SEQ ID NO: 68328 - DNA, 24 bp, Artificial Sequence
  Synthetic oligonucleotide; TTAGAAA chr11 5283000 5283023 5283003 -
agggagaaaaaggtaaagaaaaat

SEQ ID NO: 68329 - DNA, 24 bp, Artificial Sequence
  Synthetic oligonucleotide; TCAGAAT chr11 5282988 5283011 5282991 -
gtaaagaaaaatttagaaacaact

SEQ ID NO: 68330 - DNA, 24 bp, Artificial Sequence
  Synthetic oligonucleotide; TGAGAAA chr11 5282923 5282946 5282926 -
tatgacaaattataagcagacact

SEQ ID NO: 68331 - DNA, 24 bp, Artificial Sequence
  Synthetic oligonucleotide; TCAGAAA chr11 5282766 5282789 5282769 -
tcatcctgcagtgacctcagtgcc

SEQ ID NO: 68332 - DNA, 24 bp, Artificial Sequence
  Synthetic oligonucleotide; CAAGAAA chr11 5282651 5282674 5282654 -
tgctgtggtgctgtgataggtaca

SEQ ID NO: 68333 - DNA, 24 bp, Artificial Sequence
  Synthetic oligonucleotide; GAAGAAA chr11 5282641 5282664 5282644 -
ctgtgataggtacacaagaaatga

SEQ ID NO: 68334 - DNA, 24 bp, Artificial Sequence
  Synthetic oligonucleotide; AAAGAAT chr11 5282499 5282522 5282502 -
tcacattgtctttctcatctgtaa

SEQ ID NO: 68335 - DNA, 24 bp, Artificial Sequence
  Synthetic oligonucleotide; TGAGAAA chr11 5282279 5282302 5282282 -
gaggtgggtgaatgagagggtaag

SEQ ID NO: 68336 - DNA, 24 bp, Artificial Sequence
  Synthetic oligonucleotide; CAAGAAA chr11 5282155 5282178 5282158 -
gaatctgctgccaacattaacagt

SEQ ID NO: 68337 - DNA, 24 bp, Artificial Sequence
  Synthetic oligonucleotide; ACAGAAA chr11 5282061 5282084 5282064 -
gtatatatttatcataatactgta

SEQ ID NO: 68338 - DNA, 24 bp, Artificial Sequence
  Synthetic oligonucleotide; TGAGAAA chr11 5281732 5281755 5281735 -
ctagtagacttatgaaatttctga

SEQ ID NO: 68339 - DNA, 24 bp, Artificial Sequence
  Synthetic oligonucleotide; GGAGAAA chr11 5281718 5281741 5281721 -
aaatttctgatgagaaaggagaga

SEQ ID NO: 68340 - DNA, 24 bp, Artificial Sequence
  Synthetic oligonucleotide; AGAGAAT chr11 5281584 5281607 5281587 -
ttacagcttgccctgatgggagat

SEQ ID NO: 68341 - DNA, 24 bp, Artificial Sequence
  Synthetic oligonucleotide; AGAGAAA chr11 5281466 5281489 5281469 -
cactctctaaaataatccacagtg

SEQ ID NO: 68342 - DNA, 24 bp, Artificial Sequence
  Synthetic oligonucleotide; GGAGAAT chr11 5281224 5281247 5281227 -
ccagctattagggtggctgaggca

SEQ ID NO: 68343 - DNA, 24 bp, Artificial Sequence
  Synthetic oligonucleotide; AAAGAAA chr11 5280607 5280630 5280610 -
aaactccacctcaaacggcatcat

SEQ ID NO: 68344 - DNA, 24 bp, Artificial Sequence
  Synthetic oligonucleotide; ACAGAAT chr11 5280587 5280610 5280590 -
tcataaagaaaatggatgcctgag

SEQ ID NO: 68345 - DNA, 24 bp, Artificial Sequence
  Synthetic oligonucleotide; CTAGAAT chr11 5280570 5280593 5280573 -
gcctgagacagaatgtgacatatt

SEQ ID NO: 68346 - DNA, 24 bp, Artificial Sequence
  Synthetic oligonucleotide; ATAGAAT chr11 5280481 5280504 5280484 -
atatatttgttgttatcaattgcc

SEQ ID NO: 68347 - DNA, 24 bp, Artificial Sequence
  Synthetic oligonucleotide; GCAGAAT chr11 5280417 5280440 5280420 -
aggtggcctctatacctagaagcg

SEQ ID NO: 68348 - DNA, 24 bp, Artificial Sequence
  Synthetic oligonucleotide; AAAGAAA chr11 5280315 5280338 5280318 -
gaagaggaaggcatgaaaacagga

SEQ ID NO: 68349 - DNA, 24 bp, Artificial Sequence
  Synthetic oligonucleotide; AAAGAAA chr11 5280115 5280138 5280118 -
gtaggcaactctgatcctgagagg

SEQ ID NO: 68350 - DNA, 24 bp, Artificial Sequence
  Synthetic oligonucleotide; GGAGAAA chr11 5280011 5280034 5280014 -
tgacagacagacataatgcttgtg

SEQ ID NO: 68351 - DNA, 24 bp, Artificial Sequence
  Synthetic oligonucleotide; GAAGAAT chr11 5279970 5279993 5279973 -
tcaaggggatagagaaggcttcca

SEQ ID NO: 68352 - DNA, 24 bp, Artificial Sequence
  Synthetic oligonucleotide; TCAGAAA chr11 5279917 5279940 5279920 -
ggagttcacagtggcaaagatgtt

SEQ ID NO: 68353 - DNA, 24 bp, Artificial Sequence
  Synthetic oligonucleotide; ATAGAAA chr11 5279560 5279583 5279563 -
ttttggttcaagtgtatgtttgtg

SEQ ID NO: 68354 - DNA, 24 bp, Artificial Sequence
  Synthetic oligonucleotide; TAAGAAA chr11 5279509 5279532 5279512 -
catatctaacataaacacaaacat

SEQ ID NO: 68355 - DNA, 24 bp, Artificial Sequence
  Synthetic oligonucleotide; TTAGAAA chr11 5279392 5279415 5279395 -
tgagccatttaaatcacaaattaa

SEQ ID NO: 68356 - DNA, 24 bp, Artificial Sequence
  Synthetic oligonucleotide; CTAGAAA chr11 5279352 5279375 5279355 -
ggggaaaaaattccatggatgggt

SEQ ID NO: 68357 - DNA, 24 bp, Artificial Sequence
  Synthetic oligonucleotide; CTAGAAT chr11 5279268 5279291 5279271 -
aacttgaaatatgtggctaaataa

SEQ ID NO: 68358 - DNA, 24 bp, Artificial Sequence
  Synthetic oligonucleotide; CTAGAAA chr11 5279126 5279149 5279129 -
attcattttcattttatattgggc

SEQ ID NO: 68359 - DNA, 24 bp, Artificial Sequence
  Synthetic oligonucleotide; GGAGAAT chr11 5278639 5278662 5278642 -
ccaactacttgggaggctgaggca

SEQ ID NO: 68360 - DNA, 24 bp, Artificial Sequence
  Synthetic oligonucleotide; AAAGAAA chr11 5278552 5278575 5278555 -
agcctccagagcgagactctgtct

SEQ ID NO: 68361 - DNA, 24 bp, Artificial Sequence
  Synthetic oligonucleotide; ACAGAAT chr11 5278491 5278514 5278494 -
aaacccatcaaattccctgaccga

SEQ ID NO: 68362 - DNA, 24 bp, Artificial Sequence
  Synthetic oligonucleotide; AAAGAAA chr11 5278441 5278464 5278444 -
acttatctaccattttccctcctt

SEQ ID NO: 68363 - DNA, 24 bp, Artificial Sequence
  Synthetic oligonucleotide; CAAGAAA chr11 5278380 5278403 5278383 -
gctcagaagcctctggtcagcatc

SEQ ID NO: 68364 - DNA, 24 bp, Artificial Sequence
  Synthetic oligonucleotide; CCAGAAA chr11 5278170 5278193 5278173 -
ccttactctgacatatactcacag

SEQ ID NO: 68365 - DNA, 24 bp, Artificial Sequence
  Synthetic oligonucleotide; TCAGAAA chr11 5278102 5278125 5278105 -
cacacaccaattccatattctctg

SEQ ID NO: 68366 - DNA, 24 bp, Artificial Sequence
  Synthetic oligonucleotide; AAAGAAA chr11 5277130 5277153 5277133 -
acacatccactgctatgcacacac

SEQ ID NO: 68367 - DNA, 24 bp, Artificial Sequence
  Synthetic oligonucleotide; CTAGAAT chr11 5277039 5277062 5277042 -
gagccttgatgggattactgagtt

SEQ ID NO: 68368 - DNA, 24 bp, Artificial Sequence
  Synthetic oligonucleotide; AAAGAAA chr11 5276862 5276885 5276865 -
ttgtttcatcagtcaggtaaaagt

SEQ ID NO: 68369 - DNA, 24 bp, Artificial Sequence
  Synthetic oligonucleotide; TGAGAAT chr11 5276621 5276644 5276624 -
aatgataagcatacttctattcaa

SEQ ID NO: 68370 - DNA, 24 bp, Artificial Sequence
  Synthetic oligonucleotide; TAAGAAT chr11 5276596 5276619 5276599 -
gagaatattctgtaagattatagt

SEQ ID NO: 68371 - DNA, 24 bp, Artificial Sequence
  Synthetic oligonucleotide; GTAGAAA chr11 5276071 5276094 5276074 -
agccttttctatgtatctacttgt

SEQ ID NO: 68372 - DNA, 24 bp, Artificial Sequence
  Synthetic oligonucleotide; AAAGAAA chr11 5275908 5275931 5275911 -
cccagctatcaccatcccaagtct

SEQ ID NO: 68373 - DNA, 24 bp, Artificial Sequence
  Synthetic oligonucleotide; TTAGAAA chr11 5275872 5275895 5275875 -
aatgggtttgcccatctctgttga

SEQ ID NO: 68374 - DNA, 24 bp, Artificial Sequence
  Synthetic oligonucleotide; CCAGAAA chr11 5275834 5275857 5275837 -
aaaataaaataagcccctaagctc

SEQ ID NO: 68375 - DNA, 24 bp, Artificial Sequence
  Synthetic oligonucleotide; GAAGAAA chr11 5275806 5275829 5275809 -
aaaacatgactaaaccagcaagaa

SEQ ID NO: 68376 - DNA, 24 bp, Artificial Sequence
  Synthetic oligonucleotide; ACAGAAA chr11 5275744 5275767 5275747 -
ctagtgtctgaatgaggcttgagt

SEQ ID NO: 68377 - DNA, 24 bp, Artificial Sequence
  Synthetic oligonucleotide; CTAGAAT chr11 5275623 5275646 5275626 -
ctttcagaacaaactcctgtgggg

SEQ ID NO: 68378 - DNA, 24 bp, Artificial Sequence
  Synthetic oligonucleotide; AGAGAAA chr11 5275419 5275442 5275422 -
caatcctcagttttaaccttctcc

SEQ ID NO: 68379 - DNA, 24 bp, Artificial Sequence
  Synthetic oligonucleotide; CAAGAAA chr11 5275331 5275354 5275334 -
agtactgaagatagcatgcatagg

SEQ ID NO: 68380 - DNA, 24 bp, Artificial Sequence
  Synthetic oligonucleotide; TCAGAAT chr11 5275296 5275319 5275299 -
ccttagctttatgttgctgttgtt

SEQ ID NO: 68381 - DNA, 24 bp, Artificial Sequence
  Synthetic oligonucleotide; CAAGAAT chr11 5275044 5275067 5275047 -
caatgcaatttaattaaaaaaacc

SEQ ID NO: 68382 - DNA, 24 bp, Artificial Sequence
  Synthetic oligonucleotide; TTAGAAT chr11 5275034 5275057 5275037 -
taattaaaaaaacccaagaatttc

SEQ ID NO: 68383 - DNA, 24 bp, Artificial Sequence
  Synthetic oligonucleotide; AAAGAAA chr11 5274972 5274995 5274975 -
acttactcaaggtcccaaaaggtc

SEQ ID NO: 68384 - DNA, 24 bp, Artificial Sequence
  Synthetic oligonucleotide; TGAGAAT chr11 5274691 5274714 5274694 -
gttgccagagagagagattactct

SEQ ID NO: 68385 - DNA, 24 bp, Artificial Sequence
  Synthetic oligonucleotide; CAAGAAA chr11 5274370 5274393 5274373 -
tgaacttaaaataaaagttgaaaa

SEQ ID NO: 68386 - DNA, 24 bp, Artificial Sequence
  Synthetic oligonucleotide; CTAGAAA chr11 5274311 5274334 5274314 -
attctctcattctttacaattaca

SEQ ID NO: 68387 - DNA, 24 bp, Artificial Sequence
  Synthetic oligonucleotide; ACAGAAT chr11 5274276 5274299 5274279 -
ccacaggcttcctgcaaggcagcc

SEQ ID NO: 68388 - DNA, 24 bp, Artificial Sequence
  Synthetic oligonucleotide; GTAGAAT chr11 5274211 5274234 5274214 -
atgcaaaatctaacacaaaatcta

SEQ ID NO: 68389 - DNA, 24 bp, Artificial Sequence
  Synthetic oligonucleotide; TGAGAAT chr11 5274179 5274202 5274182 -
atttgcttacatctatttttgttc

SEQ ID NO: 68390 - DNA, 24 bp, Artificial Sequence
  Synthetic oligonucleotide; GCAGAAT chr11 5274149 5274172 5274152 -
tatagatttagatacataatggaa

SEQ ID NO: 68391 - DNA, 24 bp, Artificial Sequence
  Synthetic oligonucleotide; TTAGAAT chr11 5274123 5274146 5274126 -
agaataatttaaaatctggctaat

SEQ ID NO: 68392 - DNA, 24 bp, Artificial Sequence
  Synthetic oligonucleotide; AAAGAAT chr11 5274026 5274049 5274029 -
aaaataaagtaagttatttgtggt

SEQ ID NO: 68393 - DNA, 24 bp, Artificial Sequence
  Synthetic oligonucleotide; CAAGAAT chr11 5273945 5273968 5273948 -
aagtgaagggcctactttacttaa

SEQ ID NO: 68394 - DNA, 24 bp, Artificial Sequence
  Synthetic oligonucleotide; CCAGAAA chr11 5273853 5273876 5273856 -
ggttaaacatatgtcataaattag

SEQ ID NO: 68395 - DNA, 24 bp, Artificial Sequence
  Synthetic oligonucleotide; TAAGAAA chr11 5273842 5273865 5273845 -
tgtcataaattagccagaaagatt

SEQ ID NO: 68396 - DNA, 24 bp, Artificial Sequence
  Synthetic oligonucleotide; TTAGAAT chr11 5273793 5273816 5273796 -
tttaaattaggcatcttacagttt

SEQ ID NO: 68397 - DNA, 24 bp, Artificial Sequence
  Synthetic oligonucleotide; TAAGAAA chr11 5273773 5273796 5273776 -
gtttttagaatcctgcatagaact

SEQ ID NO: 68398 - DNA, 24 bp, Artificial Sequence
  Synthetic oligonucleotide; AAAGAAA chr11 5273521 5273544 5273524 -
tgaactttgggcttttaatatagg

SEQ ID NO: 68399 - DNA, 24 bp, Artificial Sequence
  Synthetic oligonucleotide; GAAGAAA chr11 5273217 5273240 5273220 -
ctggaaccataggcagtaaggaga

SEQ ID NO: 68400 - DNA, 24 bp, Artificial Sequence
  Synthetic oligonucleotide; GAAGAAT chr11 5273118 5273141 5273121 -
gactggtgtccatactctgaatgg

SEQ ID NO: 68401 - DNA, 24 bp, Artificial Sequence
  Synthetic oligonucleotide; GGAGAAA chr11 5273082 5273105 5273085 -
gattacccatagggcttgttttag

SEQ ID NO: 68402 - DNA, 24 bp, Artificial Sequence
  Synthetic oligonucleotide; ATAGAAA chr11 5272687 5272710 5272690 -
aacactagggggctggtgaagttt

SEQ ID NO: 68403 - DNA, 24 bp, Artificial Sequence
  Synthetic oligonucleotide; CTAGAAT chr11 5272609 5272632 5272612 -
tctactttgaatgcaaaggacaaa

SEQ ID NO: 68404 - DNA, 24 bp, Artificial Sequence
  Synthetic oligonucleotide; AGAGAAA chr11 5272571 5272594 5272574 -
tcagtacctattgcatagttataa

SEQ ID NO: 68405 - DNA, 24 bp, Artificial Sequence
  Synthetic oligonucleotide; TTAGAAT chr11 5271924 5271947 5271927 -
ggttttgtctgtgttagccaatgg

SEQ ID NO: 68406 - DNA, 24 bp, Artificial Sequence
  Synthetic oligonucleotide; TCAGAAA chr11 5271911 5271934 5271914 -
ttagccaatggttagaatatatgc

SEQ ID NO: 68407 - DNA, 24 bp, Artificial Sequence
  Synthetic oligonucleotide; AAAGAAA chr11 5271883 5271906 5271886 -
aaagataccattggttaatagcta

SEQ ID NO: 68408 - DNA, 24 bp, Artificial Sequence
  Synthetic oligonucleotide; GTAGAAA chr11 5271871 5271894 5271874 -
ggttaatagctaaaagaaaatgga

SEQ ID NO: 68409 - DNA, 24 bp, Artificial Sequence
  Synthetic oligonucleotide; GGAGAAA chr11 5271798 5271821 5271801 -
caggtgaagacttctggaatcatg

SEQ ID NO: 68410 - DNA, 24 bp, Artificial Sequence
  Synthetic oligonucleotide; TAAGAAA chr11 5271728 5271751 5271731 -
ttttttttttttttatcacaaaca

SEQ ID NO: 68411 - DNA, 24 bp, Artificial Sequence
  Synthetic oligonucleotide; AGAGAAA chr11 5271689 5271712 5271692 -
aataacaaagtcaggttatagaag

SEQ ID NO: 68412 - DNA, 24 bp, Artificial Sequence
  Synthetic oligonucleotide; ACAGAAA chr11 5271560 5271583 5271563 -
ctgaacatacaggaaattgtagga

SEQ ID NO: 68413 - DNA, 24 bp, Artificial Sequence
  Synthetic oligonucleotide; GGAGAAA chr11 5271521 5271544 5271524 -
tctggtggggcaaggggagccata

SEQ ID NO: 68414 - DNA, 24 bp, Artificial Sequence
  Synthetic oligonucleotide; AAAGAAA chr11 5271517 5271540 5271520 -
gtggggcaaggggagccataggag

SEQ ID NO: 68415 - DNA, 24 bp, Artificial Sequence
  Synthetic oligonucleotide; GTAGAAA chr11 5271508 5271531 5271511 -
ggggagccataggagaaagaaatg

SEQ ID NO: 68416 - DNA, 24 bp, Artificial Sequence
  Synthetic oligonucleotide; GGAGAAT chr11 5271344 5271367 5271347 -
ccagctgctcgggaggctgaggca

SEQ ID NO: 68417 - DNA, 24 bp, Artificial Sequence
  Synthetic oligonucleotide; AAAGAAA chr11 5271239 5271262 5271242 -
gactccgtctcaaaaaaaaaaaaa

SEQ ID NO: 68418 - DNA, 24 bp, Artificial Sequence
  Synthetic oligonucleotide; AAAGAAA chr11 5271235 5271258 5271238 -
ccgtctcaaaaaaaaaaaaaaaag

SEQ ID NO: 68419 - DNA, 24 bp, Artificial Sequence
  Synthetic oligonucleotide; AAAGAAA chr11 5271231 5271254 5271234 -
ctcaaaaaaaaaaaaaaaagaaag

SEQ ID NO: 68420 - DNA, 24 bp, Artificial Sequence
  Synthetic oligonucleotide; AAAGAAA chr11 5271226 5271249 5271229 -
aaaaaaaaaaaaaagaaagaaaga

SEQ ID NO: 68421 - DNA, 24 bp, Artificial Sequence
  Synthetic oligonucleotide; AAAGAAA chr11 5271220 5271243 5271223 -
aaaaaaaagaaagaaagaaaagaa

SEQ ID NO: 68422 - DNA, 24 bp, Artificial Sequence
  Synthetic oligonucleotide; AAAGAAA chr11 5271213 5271236 5271216 -
agaaagaaagaaaagaaaaagaaa

SEQ ID NO: 68423 - DNA, 24 bp, Artificial Sequence
  Synthetic oligonucleotide; ATAGAAT chr11 5271129 5271152 5271132 -
attatggtgatgtaagggactttt

SEQ ID NO: 68424 - DNA, 24 bp, Artificial Sequence
  Synthetic oligonucleotide; ACAGAAA chr11 5270855 5270878 5270858 -
agcaagtcatcaaaatggggacat

SEQ ID NO: 68425 - DNA, 24 bp, Artificial Sequence
  Synthetic oligonucleotide; AGAGAAA chr11 5270626 5270649 5270629 -
gtagccaatgtcccctgtggtcat

SEQ ID NO: 68426 - DNA, 24 bp, Artificial Sequence
  Synthetic oligonucleotide; AGAGAAA chr11 5270448 5270471 5270451 -
actatgtacggtttttgtctccct

SEQ ID NO: 68427 - DNA, 24 bp, Artificial Sequence
  Synthetic oligonucleotide; GGAGAAT chr11 5270237 5270260 5270240 -
tttatatgaggctttcttggaaaa

SEQ ID NO: 68428 - DNA, 24 bp, Artificial Sequence
  Synthetic oligonucleotide; AAAGAAT chr11 5269979 5270002 5269982 -
acagggggccagaacttcggcagt

SEQ ID NO: 68429 - DNA, 24 bp, Artificial Sequence
  Synthetic oligonucleotide; TCAGAAA chr11 5269363 5269386 5269366 -
ttattggaaagaccaacaaagatc

SEQ ID NO: 68430 - DNA, 24 bp, Artificial Sequence
  Synthetic oligonucleotide; AGAGAAT chr11 5269204 5269227 5269207 -
gccagaacttgatgtgtttatccc

SEQ ID NO: 68431 - DNA, 24 bp, Artificial Sequence
  Synthetic oligonucleotide; ATAGAAT chr11 5269191 5269214 5269194 -
gtgtttatcccagagaattgtatt

SEQ ID NO: 68432 - DNA, 24 bp, Artificial Sequence
  Synthetic oligonucleotide; GAAGAAT chr11 5269169 5269192 5269172 -
ttatagaattgtagacttgtgaaa

SEQ ID NO: 68433 - DNA, 24 bp, Artificial Sequence
  Synthetic oligonucleotide; ATAGAAA chr11 5269122 5269145 5269125 -
tagatgaaagtccatttcaaggaa

SEQ ID NO: 68434 - DNA, 24 bp, Artificial Sequence
  Synthetic oligonucleotide; TTAGAAA chr11 5269081 5269104 5269084 -
tatgtgggtcatgataattgaggt

SEQ ID NO: 68435 - DNA, 24 bp, Artificial Sequence
  Synthetic oligonucleotide; AAAGAAA chr11 5269041 5269064 5269044 -
gcaaaaaaaataaaagatttgctc

SEQ ID NO: 68436 - DNA, 24 bp, Artificial Sequence
  Synthetic oligonucleotide; AAAGAAA chr11 5268883 5268906 5268886 -
tttacaaaaattagacaattgctt

SEQ ID NO: 68437 - DNA, 24 bp, Artificial Sequence
  Synthetic oligonucleotide; GTAGAAT chr11 5268813 5268836 5268816 -
ggaagggggtgagggtgtaggtag

SEQ ID NO: 68438 - DNA, 24 bp, Artificial Sequence
  Synthetic oligonucleotide; ATAGAAT chr11 5268790 5268813 5268793 -
ggtagaatgttgaatgtagggctc

SEQ ID NO: 68439 - DNA, 24 bp, Artificial Sequence
  Synthetic oligonucleotide; AGAGAAA chr11 5268394 5268417 5268397 -
acatggggactgggcttggccttg

SEQ ID NO: 68440 - DNA, 24 bp, Artificial Sequence
  Synthetic oligonucleotide; AGAGAAA chr11 5268275 5268298 5268278 -
aagtgttcatgggctgagggatgg

SEQ ID NO: 68441 - DNA, 24 bp, Artificial Sequence
  Synthetic oligonucleotide; TAAGAAA chr11 5268244 5268267 5268247 -
cataggaagaaccaagagcttcct

SEQ ID NO: 68442 - DNA, 24 bp, Artificial Sequence
  Synthetic oligonucleotide; GGAGAAT chr11 5268201 5268224 5268204 -
tgtaaaattaatgtggatgttatg

SEQ ID NO: 68443 - DNA, 24 bp, Artificial Sequence
  Synthetic oligonucleotide; GGAGAAA chr11 5268166 5268189 5268169 -
ggattccaaggaggatgatatgat

SEQ ID NO: 68444 - DNA, 24 bp, Artificial Sequence
  Synthetic oligonucleotide; TGAGAAA chr11 5268063 5268086 5268066 -
aaagaaggagctgttagtggtacc

SEQ ID NO: 68445 - DNA, 24 bp, Artificial Sequence
  Synthetic oligonucleotide; CTAGAAT chr11 5267976 5267999 5267979 -
cttcatagatatccaagatatagg

SEQ ID NO: 68446 - DNA, 24 bp, Artificial Sequence
  Synthetic oligonucleotide; ATAGAAT chr11 5267787 5267810 5267790 -
gatatcattgtgcattatcttctg

SEQ ID NO: 68447 - DNA, 24 bp, Artificial Sequence
  Synthetic oligonucleotide; ATAGAAT chr11 5267698 5267721 5267701 -
tgtgatgaagactttccgtgggag

SEQ ID NO: 68448 - DNA, 24 bp, Artificial Sequence
  Synthetic oligonucleotide; TGAGAAA chr11 5267323 5267346 5267326 -
tttgaaggatggacaaaggtgggg

SEQ ID NO: 68449 - DNA, 24 bp, Artificial Sequence
  Synthetic oligonucleotide; CCAGAAT chr11 5266971 5266994 5266974 -
acttttgaatttggctgtatatat

SEQ ID NO: 68450 - DNA, 24 bp, Artificial Sequence
  Synthetic oligonucleotide; TGAGAAA chr11 5266678 5266701 5266681 -
tgagcatttatcatttctatgtat

SEQ ID NO: 68451 - DNA, 24 bp, Artificial Sequence
  Synthetic oligonucleotide; TGAGAAA chr11 5266060 5266083 5266063 -
atgatagttctgtttttagtttac

SEQ ID NO: 68452 - DNA, 24 bp, Artificial Sequence
  Synthetic oligonucleotide; TAAGAAA chr11 5265997 5266020 5266000 -
ttttacattcccaccaacagtgtg

SEQ ID NO: 68453 - DNA, 24 bp, Artificial Sequence
  Synthetic oligonucleotide; TGAGAAT chr11 5265859 5265882 5265862 -
catttccctgatcattagtgatgt

SEQ ID NO: 68454 - DNA, 24 bp, Artificial Sequence
  Synthetic oligonucleotide; TGAGAAT chr11 5265814 5265837 5265817 -
gttggtcatttgtatatctttttc

SEQ ID NO: 68455 - DNA, 24 bp, Artificial Sequence
  Synthetic oligonucleotide; CTAGAAT chr11 5265505 5265528 5265508 -
gaagggtttttccgatgttatttt

SEQ ID NO: 68456 - DNA, 24 bp, Artificial Sequence
  Synthetic oligonucleotide; TAAGAAT chr11 5265120 5265143 5265123 -
ttattgggctcttttttggttcca

SEQ ID NO: 68457 - DNA, 24 bp, Artificial Sequence
  Synthetic oligonucleotide; TGAGAAT chr11 5264991 5265014 5264994 -
cacaatattgattctacccatcta

SEQ ID NO: 68458 - DNA, 24 bp, Artificial Sequence
  Synthetic oligonucleotide; TAAGAAA chr11 5264788 5264811 5264791 -
ctcagcttggtcattgctggtatg

SEQ ID NO: 68459 - DNA, 24 bp, Artificial Sequence
  Synthetic oligonucleotide; CCAGAAA chr11 5264751 5264774 5264754 -
cattggtgtacgttaattttgtat

SEQ ID NO: 68460 - DNA, 24 bp, Artificial Sequence
  Synthetic oligonucleotide; ACAGAAT chr11 5264519 5264542 5264522 -
tccttgtctcattccagttttcag

SEQ ID NO: 68461 - DNA, 24 bp, Artificial Sequence
  Synthetic oligonucleotide; ATAGAAT chr11 5264101 5264124 5264104 -
tggtattaaggtgatactggcttc

SEQ ID NO: 68462 - DNA, 24 bp, Artificial Sequence
  Synthetic oligonucleotide; GTAGAAT chr11 5264062 5264085 5264065 -
gaggattctctctttctctatctt

SEQ ID NO: 68463 - DNA, 24 bp, Artificial Sequence
  Synthetic oligonucleotide; GTAGAAT chr11 5264014 5264037 5264017 -
tatcaattcttctttgaatgtctg

SEQ ID NO: 68464 - DNA, 24 bp, Artificial Sequence
  Synthetic oligonucleotide; GCAGAAT chr11 5263346 5263369 5263349 -
tactttaagttctgggatacatgt

SEQ ID NO: 68465 - DNA, 24 bp, Artificial Sequence
  Synthetic oligonucleotide; TCAGAAT chr11 5263106 5263129 5263109 -
ttctctgttcctgtgttagtttgc

SEQ ID NO: 68466 - DNA, 24 bp, Artificial Sequence
  Synthetic oligonucleotide; GTAGAAT chr11 5262906 5262929 5262909 -
catacgtgtgcacgtgtctttata

SEQ ID NO: 68467 - DNA, 24 bp, Artificial Sequence
  Synthetic oligonucleotide; GGAGAAA chr11 5261082 5261105 5261085 -
gtggcatatcatatggcctatctt

SEQ ID NO: 68468 - DNA, 24 bp, Artificial Sequence
  Synthetic oligonucleotide; ATAGAAT chr11 5261058 5261081 5261061 -
ggagaaagttccatgtgctgatga

SEQ ID NO: 68469 - DNA, 24 bp, Artificial Sequence
  Synthetic oligonucleotide; GTAGAAT chr11 5261031 5261054 5261034 -
gaatgtgtattctgcagttgttgg

SEQ ID NO: 68470 - DNA, 24 bp, Artificial Sequence
  Synthetic oligonucleotide; TAAGAAT chr11 5260840 5260863 5260843 -
ctccagtattagatgcatatatat

SEQ ID NO: 68471 - DNA, 24 bp, Artificial Sequence
  Synthetic oligonucleotide; TAAGAAT chr11 5260735 5260758 5260738 -
ctttaaagtttgttttgtctgaca

SEQ ID NO: 68472 - DNA, 24 bp, Artificial Sequence
  Synthetic oligonucleotide; TGAGAAA chr11 5260186 5260209 5260189 -
acttctagcttttacggtttctgc

SEQ ID NO: 68473 - DNA, 24 bp, Artificial Sequence
  Synthetic oligonucleotide; CTAGAAA chr11 5259045 5259068 5259048 -
cctcctgccaggaggtggcacttt

SEQ ID NO: 68474 - DNA, 24 bp, Artificial Sequence
  Synthetic oligonucleotide; CAAGAAT chr11 5258979 5259002 5258982 -
ggggctggggcaccctagaactcc

SEQ ID NO: 68475 - DNA, 24 bp, Artificial Sequence
  Synthetic oligonucleotide; GCAGAAA chr11 5258430 5258453 5258433 -
cccaaatgacccctgtgaggcaag

SEQ ID NO: 68476 - DNA, 24 bp, Artificial Sequence
  Synthetic oligonucleotide; TCAGAAT chr11 5258321 5258344 5258324 -
aaattgactcagctccaggtaagg

SEQ ID NO: 68477 - DNA, 24 bp, Artificial Sequence
  Synthetic oligonucleotide; AAAGAAT chr11 5257757 5257780 5257760 -
gcatgacaagatttttaatagttg

SEQ ID NO: 68478 - DNA, 24 bp, Artificial Sequence
  Synthetic oligonucleotide; TTAGAAT chr11 5257684 5257707 5257687 -
acagttgtgataaacaggtcattc

SEQ ID NO: 68479 - DNA, 24 bp, Artificial Sequence
  Synthetic oligonucleotide; AAAGAAT chr11 5257154 5257177 5257157 -
aacaaatgtttgaaaatacatggg

SEQ ID NO: 68480 - DNA, 24 bp, Artificial Sequence
  Synthetic oligonucleotide; AAAGAAA chr11 5257119 5257142 5257122 -
gaaaacacttgaaattgcttgtgt

SEQ ID NO: 68481 - DNA, 24 bp, Artificial Sequence
  Synthetic oligonucleotide; GGAGAAA chr11 5257033 5257056 5257036 -
gaggaataagacagttatggataa

SEQ ID NO: 68482 - DNA, 24 bp, Artificial Sequence
  Synthetic oligonucleotide; CCAGAAT chr11 5256822 5256845 5256825 -
gagtggtggctcacgcctgtaatc

SEQ ID NO: 68483 - DNA, 24 bp, Artificial Sequence
  Synthetic oligonucleotide; GGAGAAT chr11 5256664 5256687 5256667 -
ccagctacttgggaggctgaggaa

SEQ ID NO: 68484 - DNA, 24 bp, Artificial Sequence
  Synthetic oligonucleotide; AGAGAAA chr11 5255975 5255998 5255978 -
ctaccaaggtcatggatcgagttc

SEQ ID NO: 68485 - DNA, 24 bp, Artificial Sequence
  Synthetic oligonucleotide; AAAGAAA chr11 5255927 5255950 5255930 -
aacctaccaaaaaataaaaatccc

SEQ ID NO: 68486 - DNA, 24 bp, Artificial Sequence
  Synthetic oligonucleotide; AAAGAAA chr11 5255916 5255939 5255919 -
aaataaaaatcccaaagaaaaaat

SEQ ID NO: 68487 - DNA, 24 bp, Artificial Sequence
  Synthetic oligonucleotide; TCAGAAA chr11 5255866 5255889 5255869 -
ctgccatgttaagtggccaatatg

SEQ ID NO: 68488 - DNA, 24 bp, Artificial Sequence
  Synthetic oligonucleotide; TTAGAAT chr11 5255727 5255750 5255730 -
ccatgcaaatacatgtcttatgtc

SEQ ID NO: 68489 - DNA, 24 bp, Artificial Sequence
  Synthetic oligonucleotide; GAAGAAA chr11 5255093 5255116 5255096 -
gtcctggtatcttctatggtggga

SEQ ID NO: 68490 - DNA, 24 bp, Artificial Sequence
  Synthetic oligonucleotide; GAAGAAT chr11 5255074 5255097 5255077 -
tgggagaagaaaactagctaaagg

SEQ ID NO: 68491 - DNA, 24 bp, Artificial Sequence
  Synthetic oligonucleotide; AGAGAAA chr11 5255062 5255085 5255065 -
actagctaaagggaagaataaatt

SEQ ID NO: 68492 - DNA, 24 bp, Artificial Sequence
  Synthetic oligonucleotide; GAAGAAT chr11 5254817 5254840 5254820 -
aggggccggcggctggctagggat

SEQ ID NO: 68493 - DNA, 24 bp, Artificial Sequence
  Synthetic oligonucleotide; GGAGAAA chr11 5254654 5254677 5254657 -
aaggtgaatgtggaagatgctgga

SEQ ID NO: 68494 - DNA, 24 bp, Artificial Sequence
  Synthetic oligonucleotide; GAAGAAA chr11 5254175 5254198 5254178 -
tttgaagatactggggttgggagt

SEQ ID NO: 68495 - DNA, 24 bp, Artificial Sequence
  Synthetic oligonucleotide; TGAGAAA chr11 5254079 5254102 5254082 -
aatctagatggacaactttgactt

SEQ ID NO: 68496 - DNA, 24 bp, Artificial Sequence
  Synthetic oligonucleotide; GTAGAAA chr11 5254027 5254050 5254030 -
atgacttttctttattagatttcg

SEQ ID NO: 68497 - DNA, 24 bp, Artificial Sequence
  Synthetic oligonucleotide; AAAGAAT chr11 5253361 5253384 5253364 -
accgttttggcaatccatttcggc

SEQ ID NO: 68498 - DNA, 24 bp, Artificial Sequence
  Synthetic oligonucleotide; AAAGAAA chr11 5253005 5253028 5253008 -
gagcaaataaaagaactaggcaat

SEQ ID NO: 68499 - DNA, 24 bp, Artificial Sequence
  Synthetic oligonucleotide; GGAGAAA chr11 5252958 5252981 5252961 -
ctgcaagtgggagtaaaaggtgca

SEQ ID NO: 68500 - DNA, 24 bp, Artificial Sequence
  Synthetic oligonucleotide; GAAGAAA chr11 5252943 5252966 5252946 -
aaaggtgcaggagaaatctggttg

SEQ ID NO: 68501 - DNA, 24 bp, Artificial Sequence
  Synthetic oligonucleotide; TCAGAAA chr11 5252914 5252937 5252917 -
aagacctctataggacaggactcc

SEQ ID NO: 68502 - DNA, 24 bp, Artificial Sequence
  Synthetic oligonucleotide; GAAGAAA chr11 5252815 5252838 5252818 -
acagcagcgaggaaggggctcaac

SEQ ID NO: 68503 - DNA, 24 bp, Artificial Sequence
  Synthetic oligonucleotide; GAAGAAT chr11 5252382 5252405 5252385 -
cacggtcagatgaaaatatagtgt

SEQ ID NO: 68504 - DNA, 24 bp, Artificial Sequence
  Synthetic oligonucleotide; CCAGAAA chr11 5252253 5252276 5252256 -
gttatgaacttaacgcttgtgtct

SEQ ID NO: 68505 - DNA, 24 bp, Artificial Sequence
  Synthetic oligonucleotide; ATAGAAT chr11 5252145 5252168 5252148 -
agctcatgagagcagatccccatc

SEQ ID NO: 68506 - DNA, 24 bp, Artificial Sequence
  Synthetic oligonucleotide; GCAGAAA chr11 5252028 5252051 5252031 -
gaagagagccctgaccaggaacca

SEQ ID NO: 68507 - DNA, 24 bp, Artificial Sequence
  Synthetic oligonucleotide; TGAGAAA chr11 5252019 5252042 5252022 -
cctgaccaggaaccagcagaaaag

SEQ ID NO: 68508 - DNA, 24 bp, Artificial Sequence
  Synthetic oligonucleotide; GAAGAAA chr11 5251943 5251966 5251946 -
caccttgcactaagtaaggcagat

SEQ ID NO: 68509 - DNA, 24 bp, Artificial Sequence
  Synthetic oligonucleotide; AGAGAAA chr11 5251937 5251960 5251940 -
gcactaagtaaggcagatgaagaa

SEQ ID NO: 68510 - DNA, 24 bp, Artificial Sequence
  Synthetic oligonucleotide; TTAGAAA chr11 5251905 5251928 5251908 -
aaataagcttcggtgttcagtgga

SEQ ID NO: 68511 - DNA, 24 bp, Artificial Sequence
  Synthetic oligonucleotide; TCAGAAT chr11 5251853 5251876 5251856 -
aaatctccacttgtcctctgtgtt

SEQ ID NO: 68512 - DNA, 24 bp, Artificial Sequence
  Synthetic oligonucleotide; AAAGAAT chr11 5251174 5251197 5251177 -
ctttacacaggatcatgaaggatg

SEQ ID NO: 68513 - DNA, 24 bp, Artificial Sequence
  Synthetic oligonucleotide; CCAGAAT chr11 5251085 5251108 5251088 -
aagatacagcttgcctccgataag

SEQ ID NO: 68514 - DNA, 24 bp, Artificial Sequence
  Synthetic oligonucleotide; AGAGAAA chr11 5251024 5251047 5251027 -
ggttagagatcatggatcactttc

SEQ ID NO: 68515 - DNA, 24 bp, Artificial Sequence
  Synthetic oligonucleotide; TCAGAAA chr11 5250936 5250959 5250939 -
ctaccctgttaatggtccaatatg

SEQ ID NO: 68516 - DNA, 24 bp, Artificial Sequence
  Synthetic oligonucleotide; TTAGAAA chr11 5250919 5250942 5250922 -
caatatgtcagaaacagcactgtg

SEQ ID NO: 68517 - DNA, 24 bp, Artificial Sequence
  Synthetic oligonucleotide; ATAGAAA chr11 5250460 5250483 5250463 -
ttactgcgctgaaactgtggcttt

SEQ ID NO: 68518 - DNA, 24 bp, Artificial Sequence
  Synthetic oligonucleotide; TGAGAAA chr11 5250435 5250458 5250438 -
tagaaattgttttcactgcactat

SEQ ID NO: 68519 - DNA, 24 bp, Artificial Sequence
  Synthetic oligonucleotide; TTAGAAA chr11 5250367 5250390 5250370 -
aaaaagaagtatagcactttttcc

SEQ ID NO: 68520 - DNA, 24 bp, Artificial Sequence
  Synthetic oligonucleotide; GAAGAAT chr11 5250146 5250169 5250149 -
tgggagaaggaaactagctaaagg

SEQ ID NO: 68521 - DNA, 24 bp, Artificial Sequence
  Synthetic oligonucleotide; AGAGAAA chr11 5250134 5250157 5250137 -
actagctaaagggaagaataaatt

SEQ ID NO: 68522 - DNA, 24 bp, Artificial Sequence
  Synthetic oligonucleotide; GAAGAAT chr11 5249893 5249916 5249896 -
aggggccggcggctggctagggat

SEQ ID NO: 68523 - DNA, 24 bp, Artificial Sequence
  Synthetic oligonucleotide; GGAGAAA chr11 5249730 5249753 5249733 -
aaggtgaatgtggaagatgctgga

SEQ ID NO: 68524 - DNA, 24 bp, Artificial Sequence
  Synthetic oligonucleotide; GAAGAAA chr11 5249251 5249274 5249254 -
tttgaagatactggggttgggggt

SEQ ID NO: 68525 - DNA, 24 bp, Artificial Sequence
  Synthetic oligonucleotide; TGAGAAA chr11 5249155 5249178 5249158 -
aatctagatggacaattttgactt

SEQ ID NO: 68526 - DNA, 24 bp, Artificial Sequence
  Synthetic oligonucleotide; GTAGAAA chr11 5249103 5249126 5249106 -
atgacttttctttattagattcca

SEQ ID NO: 68527 - DNA, 24 bp, Artificial Sequence
  Synthetic oligonucleotide; AAAGAAT chr11 5248443 5248466 5248446 -
accgttttggcaatccatttcggc

SEQ ID NO: 68528 - DNA, 24 bp, Artificial Sequence
  Synthetic oligonucleotide; GGAGAAA chr11 5248048 5248071 5248051 -
ctgcaagtgggagtaaatggtgta

SEQ ID NO: 68529 - DNA, 24 bp, Artificial Sequence
  Synthetic oligonucleotide; GAAGAAA chr11 5248033 5248056 5248036 -
aatggtgtaggagaaatccggtgg

SEQ ID NO: 68530 - DNA, 24 bp, Artificial Sequence
  Synthetic oligonucleotide; TCAGAAA chr11 5248004 5248027 5248007 -
aagacctctataggacaggacttc

SEQ ID NO: 68531 - DNA, 24 bp, Artificial Sequence
  Synthetic oligonucleotide; TAAGAAA chr11 5247791 5247814 5247794 -
cttttcacagcccttgtggatgcc

SEQ ID NO: 68532 - DNA, 24 bp, Artificial Sequence
  Synthetic oligonucleotide; TAAGAAA chr11 5247686 5247709 5247689 -
ctgggggaggtggggacttaggtg

SEQ ID NO: 68533 - DNA, 24 bp, Artificial Sequence
  Synthetic oligonucleotide; TGAGAAA chr11 5247636 5247659 5247639 -
aagtcagcatgagcatgttatgtc

SEQ ID NO: 68534 - DNA, 24 bp, Artificial Sequence
  Synthetic oligonucleotide; GAAGAAT chr11 5247597 5247620 5247600 -
cactgtgagatcaaaatgtagtgg

SEQ ID NO: 68535 - DNA, 24 bp, Artificial Sequence
  Synthetic oligonucleotide; TCAGAAA chr11 5247244 5247267 5247247 -
agaaccctgaccacgagtcagcct

SEQ ID NO: 68536 - DNA, 24 bp, Artificial Sequence
  Synthetic oligonucleotide; TGAGAAA chr11 5247235 5247258 5247238 -
accacgagtcagccttcagaaatg

SEQ ID NO: 68537 - DNA, 24 bp, Artificial Sequence
  Synthetic oligonucleotide; GGAGAAA chr11 5247153 5247176 5247156 -
gcactgagtaaggcagatgaagaa

SEQ ID NO: 68538 - DNA, 24 bp, Artificial Sequence
  Synthetic oligonucleotide; TCAGAAT chr11 5246878 5246901 5246881 -
tttctttcttttttctcctcagcc

SEQ ID NO: 68539 - DNA, 24 bp, Artificial Sequence
  Synthetic oligonucleotide; TCAGAAT chr11 5246773 5246796 5246776 -
acttcaaatgcagtcactaccgtt

SEQ ID NO: 68540 - DNA, 24 bp, Artificial Sequence
  Synthetic oligonucleotide; AAAGAAA chr11 5246703 5246726 5246706 -
tcaaagcaaatttcttgagagagt

SEQ ID NO: 68541 - DNA, 24 bp, Artificial Sequence
  Synthetic oligonucleotide; GAAGAAT chr11 5246378 5246401 5246381 -
actctggatattaggcctttgtca

SEQ ID NO: 68542 - DNA, 24 bp, Artificial Sequence
  Synthetic oligonucleotide; AGAGAAT chr11 5245863 5245886 5245866 -
actatagtgagggcaccattagcc

SEQ ID NO: 68543 - DNA, 24 bp, Artificial Sequence
  Synthetic oligonucleotide; TCAGAAT chr11 5245830 5245853 5245833 -
gtctgtctagttcatgtaagattc

SEQ ID NO: 68544 - DNA, 24 bp, Artificial Sequence
  Synthetic oligonucleotide; TAAGAAA chr11 5245823 5245846 5245826 -
tagttcatgtaagattctcagaat

SEQ ID NO: 68545 - DNA, 24 bp, Artificial Sequence
  Synthetic oligonucleotide; CAAGAAA chr11 5245621 5245644 5245624 -
ttggaaatggggaacagccacaaa

SEQ ID NO: 68546 - DNA, 24 bp, Artificial Sequence
  Synthetic oligonucleotide; AAAGAAT chr11 5245617 5245640 5245620 -
aaatggggaacagccacaaacaag

SEQ ID NO: 68547 - DNA, 24 bp, Artificial Sequence
  Synthetic oligonucleotide; AGAGAAA chr11 5245562 5245585 5245565 -
aggtcacttttcctggagcgggtg

SEQ ID NO: 68548 - DNA, 24 bp, Artificial Sequence
  Synthetic oligonucleotide; ACAGAAA chr11 5245437 5245460 5245440 -
taaggatatgaggtatggcaatga

SEQ ID NO: 68549 - DNA, 24 bp, Artificial Sequence
  Synthetic oligonucleotide; TCAGAAA chr11 5245162 5245185 5245165 -
gactaaaatattgtgtctctaata

SEQ ID NO: 68550 - DNA, 24 bp, Artificial Sequence
  Synthetic oligonucleotide; TAAGAAT chr11 5244997 5245020 5245000 -
tctaagtatgaggacagtaagcct

SEQ ID NO: 68551 - DNA, 24 bp, Artificial Sequence
  Synthetic oligonucleotide; GAAGAAT chr11 5244863 5244886 5244866 -
agcagcctgtggaatattgtcagt

SEQ ID NO: 68552 - DNA, 24 bp, Artificial Sequence
  Synthetic oligonucleotide; GGAGAAT chr11 5244280 5244303 5244283 -
ccagctactcgggaggctgaggca

SEQ ID NO: 68553 - DNA, 24 bp, Artificial Sequence
  Synthetic oligonucleotide; AAAGAAA chr11 5244168 5244191 5244171 -
ccatctcaaaaaaaaaaaaaaaaa

SEQ ID NO: 68554 - DNA, 24 bp, Artificial Sequence
  Synthetic oligonucleotide; AAAGAAA chr11 5244162 5244185 5244165 -
caaaaaaaaaaaaaaaaaaaagaa

SEQ ID NO: 68555 - DNA, 24 bp, Artificial Sequence
  Synthetic oligonucleotide; AAAGAAA chr11 5244158 5244181 5244161 -
aaaaaaaaaaaaaaaaagaaaaag

SEQ ID NO: 68556 - DNA, 24 bp, Artificial Sequence
  Synthetic oligonucleotide; AAAGAAA chr11 5244154 5244177 5244157 -
aaaaaaaaaaaaagaaaaagaaag

SEQ ID NO: 68557 - DNA, 24 bp, Artificial Sequence
  Synthetic oligonucleotide; AAAGAAA chr11 5244150 5244173 5244153 -
aaaaaaaaagaaaaagaaagaaag

SEQ ID NO: 68558 - DNA, 24 bp, Artificial Sequence
  Synthetic oligonucleotide; AGAGAAT chr11 5244106 5244129 5244109 -
aattgtgtattcaatgtagtctca

SEQ ID NO: 68559 - DNA, 24 bp, Artificial Sequence
  Synthetic oligonucleotide; CAAGAAA chr11 5244092 5244115 5244095 -
tgtagtctcaagagaattgaaaac

SEQ ID NO: 68560 - DNA, 24 bp, Artificial Sequence
  Synthetic oligonucleotide; TGAGAAA chr11 5243908 5243931 5243911 -
attagcggctgctggcgaagtcct

SEQ ID NO: 68561 - DNA, 24 bp, Artificial Sequence
  Synthetic oligonucleotide; TCAGAAA chr11 5243789 5243812 5243792 -
cctgagaaggccacctggattcta

SEQ ID NO: 68562 - DNA, 24 bp, Artificial Sequence
  Synthetic oligonucleotide; GCAGAAA chr11 5243424 5243447 5243427 -
aggtactggaagccgggacaaggt

SEQ ID NO: 68563 - DNA, 24 bp, Artificial Sequence
  Synthetic oligonucleotide; GCAGAAA chr11 5243416 5243439 5243419 -
gaagccgggacaaggtgcagaaag

SEQ ID NO: 68564 - DNA, 24 bp, Artificial Sequence
  Synthetic oligonucleotide; AGAGAAA chr11 5242808 5242831 5242811 -
ggatgagggaacagaagttgagat

SEQ ID NO: 68565 - DNA, 24 bp, Artificial Sequence
  Synthetic oligonucleotide; TTAGAAA chr11 5242729 5242752 5242732 -
cacttttctgcatagtcctggagg

SEQ ID NO: 68566 - DNA, 24 bp, Artificial Sequence
  Synthetic oligonucleotide; ATAGAAT chr11 5241984 5242007 5241987 -
tgattcagttcctgcatgataaaa

SEQ ID NO: 68567 - DNA, 24 bp, Artificial Sequence
  Synthetic oligonucleotide; AAAGAAA chr11 5241977 5242000 5241980 -
gttcctgcatgataaaaatagaat

SEQ ID NO: 68568 - DNA, 24 bp, Artificial Sequence
  Synthetic oligonucleotide; TAAGAAA chr11 5241961 5241984 5241964 -
aatagaataaagaaatatgctctc

SEQ ID NO: 68569 - DNA, 24 bp, Artificial Sequence
  Synthetic oligonucleotide; TGAGAAT chr11 5241880 5241903 5241883 -
aggacgcactatttctgatggaaa

SEQ ID NO: 68570 - DNA, 24 bp, Artificial Sequence
  Synthetic oligonucleotide; GGAGAAT chr11 5241870 5241893 5241873 -
atttctgatggaaatgagaatgtt

SEQ ID NO: 68571 - DNA, 24 bp, Artificial Sequence
  Synthetic oligonucleotide; CAAGAAA chr11 5241823 5241846 5241826 -
agaagatactttcttgcaatcctg

SEQ ID NO: 68572 - DNA, 24 bp, Artificial Sequence
  Synthetic oligonucleotide; CTAGAAT chr11 5241757 5241780 5241760 -
actcctaggaaggggaaatcgtct

SEQ ID NO: 68573 - DNA, 24 bp, Artificial Sequence
  Synthetic oligonucleotide; ACAGAAA chr11 5241736 5241759 5241739 -
tctctagaataagacaatgttttt

SEQ ID NO: 68574 - DNA, 24 bp, Artificial Sequence
  Synthetic oligonucleotide; AGAGAAT chr11 5241464 5241487 5241467 -
cttaacgtcttcaatggtattaat

SEQ ID NO: 68575 - DNA, 24 bp, Artificial Sequence
  Synthetic oligonucleotide; GGAGAAT chr11 5241012 5241035 5241015 -
agcacgttaagtcaagttgataga

SEQ ID NO: 68576 - DNA, 24 bp, Artificial Sequence
  Synthetic oligonucleotide; TAAGAAA chr11 5240940 5240963 5240943 -
actggatgcagagaccagatgaag

SEQ ID NO: 68577 - DNA, 24 bp, Artificial Sequence
  Synthetic oligonucleotide; GTAGAAA chr11 5240862 5240885 5240865 -
gagtgacataataaatagggaaac

SEQ ID NO: 68578 - DNA, 24 bp, Artificial Sequence
  Synthetic oligonucleotide; TAAGAAA chr11 5240726 5240749 5240729 -
tgaagttgatggaaacaatgaagt

SEQ ID NO: 68579 - DNA, 24 bp, Artificial Sequence
  Synthetic oligonucleotide; AAAGAAA chr11 5240467 5240490 5240470 -
tagcaccctcaaacctaaaacctc

SEQ ID NO: 68580 - DNA, 24 bp, Artificial Sequence
  Synthetic oligonucleotide; GCAGAAT chr11 5240253 5240276 5240256 -
gagtccccactaataacccacaaa

SEQ ID NO: 68581 - DNA, 24 bp, Artificial Sequence
  Synthetic oligonucleotide; AGAGAAT chr11 5239761 5239784 5239764 -
tgacaaaattaccccagtcaatct

SEQ ID NO: 68582 - DNA, 24 bp, Artificial Sequence
  Synthetic oligonucleotide; TCAGAAT chr11 5239201 5239224 5239204 -
gcatgtgtcatgcatttattcaca

SEQ ID NO: 68583 - DNA, 24 bp, Artificial Sequence
  Synthetic oligonucleotide; CTAGAAT chr11 5239097 5239120 5239100 -
acaaaccattatcagttactcaac

SEQ ID NO: 68584 - DNA, 24 bp, Artificial Sequence
  Synthetic oligonucleotide; GCAGAAA chr11 5239023 5239046 5239026 -
ctaaaatatcaaataaaggacagt

SEQ ID NO: 68585 - DNA, 24 bp, Artificial Sequence
  Synthetic oligonucleotide; TCAGAAA chr11 5238999 5239022 5239002 -
gcagaaatctagatgttagtaaca

SEQ ID NO: 68586 - DNA, 24 bp, Artificial Sequence
  Synthetic oligonucleotide; GGAGAAA chr11 5238959 5238982 5238962 -
gccattaggcctagaagggcagaa

SEQ ID NO: 68587 - DNA, 24 bp, Artificial Sequence
  Synthetic oligonucleotide; CCAGAAA chr11 5238770 5238793 5238773 -
gatccgttcagagagagagagaga

SEQ ID NO: 68588 - DNA, 24 bp, Artificial Sequence
  Synthetic oligonucleotide; GCAGAAT chr11 5238723 5238746 5238726 -
ttccctcagccagtgtttaccatt

SEQ ID NO: 68589 - DNA, 24 bp, Artificial Sequence
  Synthetic oligonucleotide; TGAGAAA chr11 5238642 5238665 5238645 -
atacagagaacactgagggaagga

SEQ ID NO: 68590 - DNA, 24 bp, Artificial Sequence
  Synthetic oligonucleotide; ACAGAAT chr11 5238510 5238533 5238513 -
gtattgataagataatatgaaaac

SEQ ID NO: 68591 - DNA, 24 bp, Artificial Sequence
  Synthetic oligonucleotide; TTAGAAT chr11 5238482 5238505 5238485 -
aattcaaacagcagtgaactgaga

SEQ ID NO: 68592 - DNA, 24 bp, Artificial Sequence
  Synthetic oligonucleotide; TAAGAAT chr11 5238456 5238479 5238459 -
agaattgtggagagcactggcatt

SEQ ID NO: 68593 - DNA, 24 bp, Artificial Sequence
  Synthetic oligonucleotide; TTAGAAT chr11 5238442 5238465 5238445 -
cactggcatttaagaatgtcacac

SEQ ID NO: 68594 - DNA, 24 bp, Artificial Sequence
  Synthetic oligonucleotide; CAAGAAT chr11 5238026 5238049 5238029 -
caggcgtgagccaccacacccagc

SEQ ID NO: 68595 - DNA, 24 bp, Artificial Sequence
  Synthetic oligonucleotide; GGAGAAT chr11 5237061 5237084 5237064 -
ccagctattcaggtggctgaggca

SEQ ID NO: 68596 - DNA, 24 bp, Artificial Sequence
  Synthetic oligonucleotide; AGAGAAA chr11 5236964 5236987 5236967 -
atagggatgaaactccatctcaga

SEQ ID NO: 68597 - DNA, 24 bp, Artificial Sequence
  Synthetic oligonucleotide; AAAGAAA chr11 5236959 5236982 5236962 -
gatgaaactccatctcagaagaga

SEQ ID NO: 68598 - DNA, 24 bp, Artificial Sequence
  Synthetic oligonucleotide; ATAGAAT chr11 5236908 5236931 5236911 -
acaaatcctctcaatgcaatccat

SEQ ID NO: 68599 - DNA, 24 bp, Artificial Sequence
  Synthetic oligonucleotide; ACAGAAT chr11 5236855 5236878 5236858 -
atgtgtaaaatcatttcaggtaga

SEQ ID NO: 68600 - DNA, 24 bp, Artificial Sequence
  Synthetic oligonucleotide; TAAGAAT chr11 5236785 5236808 5236788 -
atcaaataacagtcctcatggcct

SEQ ID NO: 68601 - DNA, 24 bp, Artificial Sequence
  Synthetic oligonucleotide; TTAGAAT chr11 5236762 5236785 5236765 -
ttaagaatttacctaacatttttt

SEQ ID NO: 68602 - DNA, 24 bp, Artificial Sequence
  Synthetic oligonucleotide; ATAGAAA chr11 5236395 5236418 5236398 -
caccgtcatggtccaagtctgata

SEQ ID NO: 68603 - DNA, 24 bp, Artificial Sequence
  Synthetic oligonucleotide; TGAGAAT chr11 5236299 5236322 5236302 -
tctaaaatacatttcttcactaag

SEQ ID NO: 68604 - DNA, 24 bp, Artificial Sequence
  Synthetic oligonucleotide; ACAGAAA chr11 5236215 5236238 5236218 -
atatctttcgttggcttccaggtt

SEQ ID NO: 68605 - DNA, 24 bp, Artificial Sequence
  Synthetic oligonucleotide; TCAGAAT chr11 5236135 5236158 5236138 -
attttataacatttccccttgtga

SEQ ID NO: 68606 - DNA, 24 bp, Artificial Sequence
  Synthetic oligonucleotide; TCAGAAA chr11 5235352 5235375 5235355 -
ctgccattgtggcattatttgaat

SEQ ID NO: 68607 - DNA, 24 bp, Artificial Sequence
  Synthetic oligonucleotide; GAAGAAT chr11 5234987 5235010 5234990 -
taaaaaattagagttttattatag

SEQ ID NO: 68608 - DNA, 24 bp, Artificial Sequence
  Synthetic oligonucleotide; ACAGAAA chr11 5234809 5234832 5234812 -
gataagttttcttagtataaagtg

SEQ ID NO: 68609 - DNA, 24 bp, Artificial Sequence
  Synthetic oligonucleotide; TTAGAAA chr11 5234723 5234746 5234726 -
aaaaatgaaactaggaggatattt

SEQ ID NO: 68610 - DNA, 24 bp, Artificial Sequence
  Synthetic oligonucleotide; TTAGAAT chr11 5233695 5233718 5233698 -
agctctcacctgctaattctgcac

SEQ ID NO: 68611 - DNA, 24 bp, Artificial Sequence
  Synthetic oligonucleotide; ATAGAAT chr11 5233631 5233654 5233634 -
ggctccaactcaaagatgagaggc

SEQ ID NO: 68612 - DNA, 24 bp, Artificial Sequence
  Synthetic oligonucleotide; GCAGAAA chr11 5233187 5233210 5233190 -
ggatcagttttgtctaagatttgg

SEQ ID NO: 68613 - DNA, 24 bp, Artificial Sequence
  Synthetic oligonucleotide; AAAGAAT chr11 5232856 5232879 5232859 -
tcaagggtatggcttctgcctaat

SEQ ID NO: 68614 - DNA, 24 bp, Artificial Sequence
  Synthetic oligonucleotide; AGAGAAA chr11 5232728 5232751 5232731 -
attttacaaagagtacatgggaaa

SEQ ID NO: 68615 - DNA, 24 bp, Artificial Sequence
  Synthetic oligonucleotide; GCAGAAA chr11 5232670 5232693 5232673 -
gggtgacacttctacctccaaaga

SEQ ID NO: 68616 - DNA, 24 bp, Artificial Sequence
  Synthetic oligonucleotide; TGAGAAA chr11 5232549 5232572 5232552 -
ctacgattaaactccaacaattac

SEQ ID NO: 68617 - DNA, 24 bp, Artificial Sequence
  Synthetic oligonucleotide; CAAGAAA chr11 5232421 5232444 5232424 -
ataccccatcaagtgttcctgctc

SEQ ID NO: 68618 - DNA, 24 bp, Artificial Sequence
  Synthetic oligonucleotide; AAAGAAT chr11 5232377 5232400 5232380 -
ttacttgccccagaacatctctgt

SEQ ID NO: 68619 - DNA, 24 bp, Artificial Sequence
  Synthetic oligonucleotide; GCAGAAA chr11 5232113 5232136 5232116 -
gcctcatattaaattcatcaatgg

SEQ ID NO: 68620 - DNA, 24 bp, Artificial Sequence
  Synthetic oligonucleotide; AAAGAAA chr11 5232109 5232132 5232112 -
catattaaattcatcaatgggcag

SEQ ID NO: 68621 - DNA, 24 bp, Artificial Sequence
  Synthetic oligonucleotide; CAAGAAA chr11 5232093 5232116 5232096 -
atgggcagaaagaaaatatttatt

SEQ ID NO: 68622 - DNA, 24 bp, Artificial Sequence
  Synthetic oligonucleotide; ACAGAAT chr11 5231756 5231779 5231759 -
ttttaaacttacttgaatacctaa

SEQ ID NO: 68623 - DNA, 24 bp, Artificial Sequence
  Synthetic oligonucleotide; CCAGAAT chr11 5231697 5231720 5231700 -
ttcacagtaactctgtctgtactg

SEQ ID NO: 68624 - DNA, 24 bp, Artificial Sequence
  Synthetic oligonucleotide; AGAGAAT chr11 5231237 5231260 5231240 -
gttggccctaaaaatccaaatacc

SEQ ID NO: 68625 - DNA, 24 bp, Artificial Sequence
  Synthetic oligonucleotide; GGAGAAT chr11 5230599 5230622 5230602 -
tttcaataaaataatttaatgtca

SEQ ID NO: 68626 - DNA, 24 bp, Artificial Sequence
  Synthetic oligonucleotide; TAAGAAA chr11 5230253 5230276 5230256 -
tatgttgactttattgctttttgg

SEQ ID NO: 68627 - DNA, 24 bp, Artificial Sequence
  Synthetic oligonucleotide; TAAGAAA chr11 5229826 5229849 5229829 -
attctgatataaaacattaggact

SEQ ID NO: 68628 - DNA, 24 bp, Artificial Sequence
  Synthetic oligonucleotide; GTAGAAT chr11 5229695 5229718 5229698 -
gtggtcagtggggctggaataaaa

SEQ ID NO: 68629 - DNA, 24 bp, Artificial Sequence
  Synthetic oligonucleotide; ATAGAAA chr11 5229445 5229468 5229448 -
tgtccctgcagggtattatgggta

SEQ ID NO: 68630 - DNA, 24 bp, Artificial Sequence
  Synthetic oligonucleotide; AAAGAAA chr11 5229441 5229464 5229444 -
cctgcagggtattatgggtaatag

SEQ ID NO: 68631 - DNA, 24 bp, Artificial Sequence
  Synthetic oligonucleotide; AAAGAAA chr11 5229306 5229329 5229309 -
aggatccatagttcatcatttaaa

SEQ ID NO: 68632 - DNA, 24 bp, Artificial Sequence
  Synthetic oligonucleotide; ATAGAAA chr11 5229294 5229317 5229297 -
tcatcatttaaaaaagaaaacaaa

SEQ ID NO: 68633 - DNA, 24 bp, Artificial Sequence
  Synthetic oligonucleotide; TCAGAAT chr11 5229180 5229203 5229183 -
tcttgctttgacaattttggtctt

SEQ ID NO: 68634 - DNA, 24 bp, Artificial Sequence
  Synthetic oligonucleotide; AAAGAAA chr11 5228811 5228834 5228814 -
ttttttacagaggaatgaatataa

SEQ ID NO: 68635 - DNA, 24 bp, Artificial Sequence
  Synthetic oligonucleotide; TGAGAAT chr11 5228701 5228724 5228704 -
agaaccaaacactttctgcgtgtg

SEQ ID NO: 68636 - DNA, 24 bp, Artificial Sequence
  Synthetic oligonucleotide; GTAGAAA chr11 5228647 5228670 5228650 -
agtacctgatgagggttgagacag

SEQ ID NO: 68637 - DNA, 24 bp, Artificial Sequence
  Synthetic oligonucleotide; AGAGAAA chr11 5228608 5228631 5228611 -
gatctctatttatttagcaataat

SEQ ID NO: 68638 - DNA, 24 bp, Artificial Sequence
  Synthetic oligonucleotide; AGAGAAT chr11 5228594 5228617 5228597 -
tagcaataatagagaaagcattta

SEQ ID NO: 68639 - DNA, 24 bp, Artificial Sequence
  Synthetic oligonucleotide; TAAGAAA chr11 5228574 5228597 5228577 -
tttaagagaataaagcaatggaaa

SEQ ID NO: 68640 - DNA, 24 bp, Artificial Sequence
  Synthetic oligonucleotide; CTAGAAA chr11 5228545 5228568 5228548 -
aatttgtaaatttccttctgataa

SEQ ID NO: 68641 - DNA, 24 bp, Artificial Sequence
  Synthetic oligonucleotide; GGAGAAA chr11 5228415 5228438 5228418 -
tgttagagctgaaaggaagaagta

SEQ ID NO: 68642 - DNA, 24 bp, Artificial Sequence
  Synthetic oligonucleotide; GGAGAAA chr11 5228162 5228185 5228165 -
aaggggaaaaagtacagggggatg

SEQ ID NO: 68643 - DNA, 24 bp, Artificial Sequence
  Synthetic oligonucleotide; AGAGAAA chr11 5228133 5228156 5228136 -
aaggcgatcacgttgggaagctat

SEQ ID NO: 68644 - DNA, 24 bp, Artificial Sequence
  Synthetic oligonucleotide; AGAGAAA chr11 5228081 5228104 5228084 -
gaggtttaaacaaacaaaatataa

SEQ ID NO: 68645 - DNA, 24 bp, Artificial Sequence
  Synthetic oligonucleotide; GCAGAAA chr11 5227912 5227935 5227915 -
agacactcttgcagattagtccag

SEQ ID NO: 68646 - DNA, 24 bp, Artificial Sequence
  Synthetic oligonucleotide; TAAGAAA chr11 5227674 5227697 5227677 -
atttattagcatgcatgagcaaat

SEQ ID NO: 68647 - DNA, 24 bp, Artificial Sequence
  Synthetic oligonucleotide; TAAGAAA chr11 5227396 5227419 5227399 -
tgcatcaacttcttatttgtgtaa

SEQ ID NO: 68648 - DNA, 24 bp, Artificial Sequence
  Synthetic oligonucleotide; ATAGAAA chr11 5226892 5226915 5226895 -
tacaagacaggtttaaggagacca

SEQ ID NO: 68649 - DNA, 24 bp, Artificial Sequence
  Synthetic oligonucleotide; CAAGAAA chr11 5226698 5226721 5226701 -
caaccctaaggtgaaggctcatgg

SEQ ID NO: 68650 - DNA, 24 bp, Artificial Sequence
  Synthetic oligonucleotide; TTAGAAT chr11 5226486 5226509 5226489 -
aggggataagtaacagggtacagt

SEQ ID NO: 68651 - DNA, 24 bp, Artificial Sequence
  Synthetic oligonucleotide; AAAGAAT chr11 5225956 5225979 5225959 -
tatcatgcctctttgcaccattct

SEQ ID NO: 68652 - DNA, 24 bp, Artificial Sequence
  Synthetic oligonucleotide; AAAGAAT chr11 5225682 5225705 5225685 -
tgtgtgctggcccatcactttggc

SEQ ID NO: 68653 - DNA, 24 bp, Artificial Sequence
  Synthetic oligonucleotide; TCAGAAA chr11 5225650 5225673 5225653 -
caccccaccagtgcaggctgccta

SEQ ID NO: 68654 - DNA, 24 bp, Artificial Sequence
  Synthetic oligonucleotide; AAAGAAA chr11 5225394 5225417 5225397 -
gggaggtcagtgcatttaaaacat

SEQ ID NO: 68655 - DNA, 24 bp, Artificial Sequence
  Synthetic oligonucleotide; TCAGAAA chr11 5225265 5225288 5225268 -
tgatgcatatgccttattcatccc

SEQ ID NO: 68656 - DNA, 24 bp, Artificial Sequence
  Synthetic oligonucleotide; GAAGAAT chr11 5224828 5224851 5224831 -
cttagtatgaaaagttaggactga

SEQ ID NO: 68657 - DNA, 24 bp, Artificial Sequence
  Synthetic oligonucleotide; GAAGAAT chr11 5224444 5224467 5224447 -
taagtgatgatagaagggtatata

SEQ ID NO: 68658 - DNA, 24 bp, Artificial Sequence
  Synthetic oligonucleotide; AAAGAAT chr11 5224349 5224372 5224352 -
aacaaaaataaatttgaatgggtt

SEQ ID NO: 68659 - DNA, 24 bp, Artificial Sequence
  Synthetic oligonucleotide; AAAGAAA chr11 5224311 5224334 5224314 -
agacctaaaaccataaaaattttt

SEQ ID NO: 68660 - DNA, 24 bp, Artificial Sequence
  Synthetic oligonucleotide; GAAGAAA chr11 5224298 5224321 5224301 -
taaaaatttttaaagaaatcaaaa

SEQ ID NO: 68661 - DNA, 24 bp, Artificial Sequence
  Synthetic oligonucleotide; TAAGAAA chr11 5224086 5224109 5224089 -
attttggttaatatccaaaatata

SEQ ID NO: 68662 - DNA, 24 bp, Artificial Sequence
  Synthetic oligonucleotide; GAAGAAA chr11 5224021 5224044 5224024 -
ataggaaaataaaaaaattaaaaa

SEQ ID NO: 68663 - DNA, 24 bp, Artificial Sequence
  Synthetic oligonucleotide; GCAGAAT chr11 5223999 5224022 5224002 -
aagaagaaaatcctgccatttatg

SEQ ID NO: 68664 - DNA, 24 bp, Artificial Sequence
  Synthetic oligonucleotide; TAAGAAA chr11 5223968 5223991 5223971 -
tgatgaacctggaggatgtaaaac

SEQ ID NO: 68665 - DNA, 24 bp, Artificial Sequence
  Synthetic oligonucleotide; GGAGAAT chr11 5223846 5223869 5223849 -
tatggtttccaggggttgggggtg

SEQ ID NO: 68666 - DNA, 24 bp, Artificial Sequence
  Synthetic oligonucleotide; CAAGAAA chr11 5223408 5223431 5223411 -
agtagatcttaaaagcatttacca

SEQ ID NO: 68667 - DNA, 24 bp, Artificial Sequence
  Synthetic oligonucleotide; GAAGAAT chr11 5223260 5223283 5223263 -
tgtgaatgatacctcaataaagtt

SEQ ID NO: 68668 - DNA, 24 bp, Artificial Sequence
  Synthetic oligonucleotide; AAAGAAT chr11 5223247 5223270 5223250 -
tcaataaagttgaagaataataaa

SEQ ID NO: 68669 - DNA, 24 bp, Artificial Sequence
  Synthetic oligonucleotide; TTAGAAT chr11 5223189 5223212 5223192 -
aaataaaaaaatgcatcttgatga

SEQ ID NO: 68670 - DNA, 24 bp, Artificial Sequence
  Synthetic oligonucleotide; GAAGAAA chr11 5222999 5223022 5223002 -
tttctagtgttattattaaatagt

SEQ ID NO: 68671 - DNA, 24 bp, Artificial Sequence
  Synthetic oligonucleotide; ATAGAAA chr11 5222777 5222800 5222780 -
tgtgtaagtaagatagtggaataa

SEQ ID NO: 68672 - DNA, 24 bp, Artificial Sequence
  Synthetic oligonucleotide; CTAGAAT chr11 5222575 5222598 5222578 -
aggtaaaattcagtcacgaaaaaa

SEQ ID NO: 68673 - DNA, 24 bp, Artificial Sequence
  Synthetic oligonucleotide; GTAGAAA chr11 5222504 5222527 5222507 -
ctgttatttaattatcaacccaaa

SEQ ID NO: 68674 - DNA, 24 bp, Artificial Sequence
  Synthetic oligonucleotide; GGAGAAA chr11 5222489 5222512 5222492 -
caacccaaagtagaaactatcaag

SEQ ID NO: 68675 - DNA, 24 bp, Artificial Sequence
  Synthetic oligonucleotide; GGAGAAT chr11 5222253 5222276 5222256 -
ccagcaatttgggaggctgaggca

SEQ ID NO: 68676 - DNA, 24 bp, Artificial Sequence
  Synthetic oligonucleotide; AAAGAAA chr11 5222153 5222176 5222156 -
gcatgagactccgtcacaaaaaaa

SEQ ID NO: 68677 - DNA, 24 bp, Artificial Sequence
  Synthetic oligonucleotide; AAAGAAA chr11 5221891 5221914 5221894 -
gtcagggaattccctttcctagtc

SEQ ID NO: 68678 - DNA, 24 bp, Artificial Sequence
  Synthetic oligonucleotide; ACAGAAA chr11 5221179 5221202 5221182 -
gactgttagaaggaaaactaacaa

SEQ ID NO: 68679 - DNA, 24 bp, Artificial Sequence
  Synthetic oligonucleotide; GCAGAAA chr11 5221086 5221109 5221089 -
ccataaagatggggaaaaagcaga

SEQ ID NO: 68680 - DNA, 24 bp, Artificial Sequence
  Synthetic oligonucleotide; AGAGAAT chr11 5220998 5221021 5221001 -
accagcaatggaacaaagctgggc

SEQ ID NO: 68681 - DNA, 24 bp, Artificial Sequence
  Synthetic oligonucleotide; CTAGAAT chr11 5220870 5220893 5220873 -
aaaaaaaattagatgaatggataa

SEQ ID NO: 68682 - DNA, 24 bp, Artificial Sequence
  Synthetic oligonucleotide; GAAGAAA chr11 5220760 5220783 5220763 -
ctcagtaaccgatgagatcaactg

SEQ ID NO: 68683 - DNA, 24 bp, Artificial Sequence
  Synthetic oligonucleotide; AGAGAAA chr11 5220700 5220723 5220703 -
gaaatgaagcatgaagagaagttt

SEQ ID NO: 68684 - DNA, 24 bp, Artificial Sequence
  Synthetic oligonucleotide; AAAGAAT chr11 5220693 5220716 5220696 -
agcatgaagagaagtttagagaaa

SEQ ID NO: 68685 - DNA, 24 bp, Artificial Sequence
  Synthetic oligonucleotide; AAAGAAA chr11 5220684 5220707 5220687 -
agaagtttagagaaaaaagaataa

SEQ ID NO: 68686 - DNA, 24 bp, Artificial Sequence
  Synthetic oligonucleotide; CAAGAAA chr11 5220664 5220687 5220667 -
ataaaaagaaacgaacaaagcctc

SEQ ID NO: 68687 - DNA, 24 bp, Artificial Sequence
  Synthetic oligonucleotide; GGAGAAT chr11 5220599 5220622 5220602 -
aattggtgtagctgaaagtgatgg

SEQ ID NO: 68688 - DNA, 24 bp, Artificial Sequence
  Synthetic oligonucleotide; AGAGAAA chr11 5220477 5220500 5220480 -
agagaacgccacaaagatactcct

SEQ ID NO: 68689 - DNA, 24 bp, Artificial Sequence
  Synthetic oligonucleotide; AGAGAAA chr11 5220398 5220421 5220401 -
ggaaaaaatgttaagggcagccag

SEQ ID NO: 68690 - DNA, 24 bp, Artificial Sequence
  Synthetic oligonucleotide; GCAGAAA chr11 5220340 5220363 5220343 -
atcagactaacagctgatctatcg

SEQ ID NO: 68691 - DNA, 24 bp, Artificial Sequence
  Synthetic oligonucleotide; GAAGAAA chr11 5220321 5220344 5220324 -
tatcggcagaaactctacaagcca

SEQ ID NO: 68692 - DNA, 24 bp, Artificial Sequence
  Synthetic oligonucleotide; AAAGAAA chr11 5220289 5220312 5220292 -
tgggggccaatattcaacattgtt

SEQ ID NO: 68693 - DNA, 24 bp, Artificial Sequence
  Synthetic oligonucleotide; AAAGAAT chr11 5220284 5220307 5220287 -
gccaatattcaacattgttaaaga

SEQ ID NO: 68694 - DNA, 24 bp, Artificial Sequence
  Synthetic oligonucleotide; CCAGAAT chr11 5220270 5220293 5220273 -
ttgttaaagaaaagaattttcaac

SEQ ID NO: 68695 - DNA, 24 bp, Artificial Sequence
  Synthetic oligonucleotide; GGAGAAA chr11 5220229 5220252 5220232 -
gccaaactaagcttcataagtgaa

SEQ ID NO: 68696 - DNA, 24 bp, Artificial Sequence
  Synthetic oligonucleotide; GAAGAAA chr11 5220069 5220092 5220072 -
aattgtaaagaccatcaaggctag

SEQ ID NO: 68697 - DNA, 24 bp, Artificial Sequence
  Synthetic oligonucleotide; ACAGAAA chr11 5219553 5219576 5219556 -
gtcaacattagacagatcaacgag

SEQ ID NO: 68698 - DNA, 24 bp, Artificial Sequence
  Synthetic oligonucleotide; ACAGAAT chr11 5219462 5219485 5219465 -
tacagaactctccaccccaaatca

SEQ ID NO: 68699 - DNA, 24 bp, Artificial Sequence
  Synthetic oligonucleotide; ACAGAAA chr11 5219369 5219392 5219372 -
gctctcctcagcaaatgtaaaaga

SEQ ID NO: 68700 - DNA, 24 bp, Artificial Sequence
  Synthetic oligonucleotide; TAAGAAA chr11 5219310 5219333 5219313 -
tgcaatcaaactagaactcaggat

SEQ ID NO: 68701 - DNA, 24 bp, Artificial Sequence
  Synthetic oligonucleotide; GCAGAAA chr11 5219225 5219248 5219228 -
tactgggtacataacaaaatgaag

SEQ ID NO: 68702 - DNA, 24 bp, Artificial Sequence
  Synthetic oligonucleotide; CCAGAAT chr11 5219175 5219198 5219178 -
caacgagaacaaagacacaacaca

SEQ ID NO: 68703 - DNA, 24 bp, Artificial Sequence
  Synthetic oligonucleotide; CAAGAAA chr11 5219016 5219039 5219019 -
acacattcaaaagctaacagaaga

SEQ ID NO: 68704 - DNA, 24 bp, Artificial Sequence
  Synthetic oligonucleotide; GAAGAAA chr11 5218880 5218903 5218883 -
tagactgctagcaagactaataaa

SEQ ID NO: 68705 - DNA, 24 bp, Artificial Sequence
  Synthetic oligonucleotide; GAAGAAT chr11 5218868 5218891 5218871 -
aagactaataaagaagaaaagaga

SEQ ID NO: 68706 - DNA, 24 bp, Artificial Sequence
  Synthetic oligonucleotide; ACAGAAA chr11 5218815 5218838 5218818 -
acacggggtatcaccactgatccc

SEQ ID NO: 68707 - DNA, 24 bp, Artificial Sequence
  Synthetic oligonucleotide; AGAGAAT chr11 5218794 5218817 5218797 -
cccacagaaatacaaactaccgtc

SEQ ID NO: 68708 - DNA, 24 bp, Artificial Sequence
  Synthetic oligonucleotide; CTAGAAA chr11 5218761 5218784 5218764 -
tataaacacctctacgcaaataaa

SEQ ID NO: 68709 - DNA, 24 bp, Artificial Sequence
  Synthetic oligonucleotide; GAAGAAA chr11 5218749 5218772 5218752 -
tacgcaaataaactagaaaatcta

SEQ ID NO: 68710 - DNA, 24 bp, Artificial Sequence
  Synthetic oligonucleotide; ATAGAAA chr11 5218533 5218556 5218536 -
ttccttctgaaactattccaatca

SEQ ID NO: 68711 - DNA, 24 bp, Artificial Sequence
  Synthetic oligonucleotide; AGAGAAT chr11 5218447 5218470 5218450 -
gcctgacagagacacaacaaaaaa

SEQ ID NO: 68712 - DNA, 24 bp, Artificial Sequence
  Synthetic oligonucleotide; GCAGAAA chr11 5218252 5218275 5218255 -
aaccatatgattatctcaatagat

SEQ ID NO: 68713 - DNA, 24 bp, Artificial Sequence
  Synthetic oligonucleotide; CTAGAAA chr11 5217931 5217954 5217934 -
tttgcagatgacatgattgtatat

SEQ ID NO: 68714 - DNA, 24 bp, Artificial Sequence
  Synthetic oligonucleotide; AGAGAAT chr11 5217762 5217785 5217765 -
aactcccattcacaattgcttcaa

SEQ ID NO: 68715 - DNA, 24 bp, Artificial Sequence
  Synthetic oligonucleotide; GAAGAAT chr11 5217630 5217653 5217633 -
agaacattccatgctcatgggtag

SEQ ID NO: 68716 - DNA, 24 bp, Artificial Sequence
  Synthetic oligonucleotide; TCAGAAA chr11 5217340 5217363 5217343 -
gaccaatggaacagaacagagccc

SEQ ID NO: 68717 - DNA, 24 bp, Artificial Sequence
  Synthetic oligonucleotide; AGAGAAA chr11 5217291 5217314 5217294 -
actatctgatctttgacaaacctg

SEQ ID NO: 68718 - DNA, 24 bp, Artificial Sequence
  Synthetic oligonucleotide; GTAGAAA chr11 5217222 5217245 5217225 -
gctgggaaaactggctagccatat

SEQ ID NO: 68719 - DNA, 24 bp, Artificial Sequence
  Synthetic oligonucleotide; CTAGAAA chr11 5217124 5217147 5217127 -
gttagacctaaaaccataaaaacc

SEQ ID NO: 68720 - DNA, 24 bp, Artificial Sequence
  Synthetic oligonucleotide; AAAGAAA chr11 5216986 5217009 5216989 -
aaactaaagagcttctgcacagct

SEQ ID NO: 68721 - DNA, 24 bp, Artificial Sequence
  Synthetic oligonucleotide; GGAGAAA chr11 5216945 5216968 5216948 -
agtgaacaggcaacctacaaaatg

SEQ ID NO: 68722 - DNA, 24 bp, Artificial Sequence
  Synthetic oligonucleotide; CCAGAAT chr11 5216901 5216924 5216904 -
actcatctgacaaagggctaatat

SEQ ID NO: 68723 - DNA, 24 bp, Artificial Sequence
  Synthetic oligonucleotide; CAAGAAA chr11 5216870 5216893 5216873 -
ctacaatgaactcaaacaaattta

SEQ ID NO: 68724 - DNA, 24 bp, Artificial Sequence
  Synthetic oligonucleotide; AGAGAAA chr11 5216750 5216773 5216753 -
aaatgctcatcatcactagccatc

SEQ ID NO: 68725 - DNA, 24 bp, Artificial Sequence
  Synthetic oligonucleotide; TTAGAAT chr11 5216704 5216727 5216707 -
caatgagataccatctcacaccag

SEQ ID NO: 68726 - DNA, 24 bp, Artificial Sequence
  Synthetic oligonucleotide; GGAGAAA chr11 5216651 5216674 5216654 -
aacaacaggtgctggagaggatgt

SEQ ID NO: 68727 - DNA, 24 bp, Artificial Sequence
  Synthetic oligonucleotide; CTAGAAA chr11 5216557 5216580 5216560 -
tggcaattcctcaggaatctagaa

SEQ ID NO: 68728 - DNA, 24 bp, Artificial Sequence
  Synthetic oligonucleotide; TAAGAAA chr11 5216393 5216416 5216396 -
atgtccaacaacgatagactggat

SEQ ID NO: 68729 - DNA, 24 bp, Artificial Sequence
  Synthetic oligonucleotide; GGAGAAT chr11 5216272 5216295 5216275 -
atcattctcagcaaactatcacaa

SEQ ID NO: 68730 - DNA, 24 bp, Artificial Sequence
  Synthetic oligonucleotide; ACAGAAA chr11 5215942 5215965 5215945 -
atcaagtctttctctttgaaatag

SEQ ID NO: 68731 - DNA, 24 bp, Artificial Sequence
  Synthetic oligonucleotide; TAAGAAT chr11 5215809 5215832 5215812 -
agagtcttccttcttatttgttta

SEQ ID NO: 68732 - DNA, 24 bp, Artificial Sequence
  Synthetic oligonucleotide; GTAGAAA chr11 5215779 5215802 5215782 -
tttagtaaatggcaatattgagaa

SEQ ID NO: 68733 - DNA, 24 bp, Artificial Sequence
  Synthetic oligonucleotide; CTAGAAT chr11 5215705 5215728 5215708 -
agcaatactaaacaggagccaagc

SEQ ID NO: 68734 - DNA, 24 bp, Artificial Sequence
  Synthetic oligonucleotide; AAAGAAA chr11 5215558 5215581 5215561 -
aaacaaagtgaccaattaaaataa

SEQ ID NO: 68735 - DNA, 24 bp, Artificial Sequence
  Synthetic oligonucleotide; AGAGAAA chr11 5215047 5215070 5215050 -
tctggggagggggacatagagttg

SEQ ID NO: 68736 - DNA, 24 bp, Artificial Sequence
  Synthetic oligonucleotide; GAAGAAA chr11 5214278 5214301 5214281 -
taggtcctcccaaggctgaaccag

SEQ ID NO: 68737 - DNA, 24 bp, Artificial Sequence
  Synthetic oligonucleotide; AAAGAAA chr11 5214027 5214050 5214030 -
cctgatagacacacaacaacaaaa

SEQ ID NO: 68738 - DNA, 24 bp, Artificial Sequence
  Synthetic oligonucleotide; ACAGAAA chr11 5213849 5213872 5213852 -
ttcatcatatatacagcactaaaa

SEQ ID NO: 68739 - DNA, 24 bp, Artificial Sequence
  Synthetic oligonucleotide; ACAGAAT chr11 5213695 5213718 5213698 -
tgacaaacccacagccaacatcat

SEQ ID NO: 68740 - DNA, 24 bp, Artificial Sequence
  Synthetic oligonucleotide; AGAGAAA chr11 5213545 5213568 5213548 -
aataaagggcatccaaataggaag

SEQ ID NO: 68741 - DNA, 24 bp, Artificial Sequence
  Synthetic oligonucleotide; CTAGAAA chr11 5213513 5213536 5213516 -
tcaaagtatccctgttttctgtat

SEQ ID NO: 68742 - DNA, 24 bp, Artificial Sequence
  Synthetic oligonucleotide; AAAGAAT chr11 5213348 5213371 5213351 -
caatcccatttaccgttgccacaa

SEQ ID NO: 68743 - DNA, 24 bp, Artificial Sequence
  Synthetic oligonucleotide; AAAGAAA chr11 5213271 5213294 5213274 -
aatgagatttacaaaacactgctc

SEQ ID NO: 68744 - DNA, 24 bp, Artificial Sequence
  Synthetic oligonucleotide; ATAGAAA chr11 5213255 5213278 5213258 -
cactgctcaaagaaatcagagctg

SEQ ID NO: 68745 - DNA, 24 bp, Artificial Sequence
  Synthetic oligonucleotide; AAAGAAT chr11 5213216 5213239 5213219 -
aaaactttccatgctcatggataa

SEQ ID NO: 68746 - DNA, 24 bp, Artificial Sequence
  Synthetic oligonucleotide; CTAGAAA chr11 5213121 5213144 5213124 -
ctaccaatgacattcttcacagaa

SEQ ID NO: 68747 - DNA, 24 bp, Artificial Sequence
  Synthetic oligonucleotide; AGAGAAA chr11 5212827 5212850 5212830 -
aacttagagtacaaaaaaaaaaaa

SEQ ID NO: 68748 - DNA, 24 bp, Artificial Sequence
  Synthetic oligonucleotide; AAAGAAA chr11 5212821 5212844 5212824 -
gagtacaaaaaaaaaaaaagagaa

SEQ ID NO: 68749 - DNA, 24 bp, Artificial Sequence
  Synthetic oligonucleotide; ACAGAAA chr11 5212738 5212761 5212741 -
taaccaaaacagtgtggtactgtt

SEQ ID NO: 68750 - DNA, 24 bp, Artificial Sequence
  Synthetic oligonucleotide; ACAGAAT chr11 5212712 5212735 5212715 -
agaaaagacacacagacaaatgga

SEQ ID NO: 68751 - DNA, 24 bp, Artificial Sequence
  Synthetic oligonucleotide; CCAGAAA chr11 5212698 5212721 5212701 -
gacaaatggaacagaatagagagc

SEQ ID NO: 68752 - DNA, 24 bp, Artificial Sequence
  Synthetic oligonucleotide; AAAGAAA chr11 5212348 5212371 5212351 -
ttaaaataaagtttctgcacagca

SEQ ID NO: 68753 - DNA, 24 bp, Artificial Sequence
  Synthetic oligonucleotide; ATAGAAT chr11 5212319 5212342 5212322 -
aactatcaactgagtaaacaacct

SEQ ID NO: 68754 - DNA, 24 bp, Artificial Sequence
  Synthetic oligonucleotide; GGAGAAA chr11 5212311 5212334 5212314 -
actgagtaaacaacctatagaatg

SEQ ID NO: 68755 - DNA, 24 bp, Artificial Sequence
  Synthetic oligonucleotide; TCAGAAT chr11 5212267 5212290 5212270 -
atgcatccaacaaaggcctaatat

SEQ ID NO: 68756 - DNA, 24 bp, Artificial Sequence
  Synthetic oligonucleotide; AGAGAAA chr11 5212117 5212140 5212120 -
aaaagctcagtgtcactgatcatt

SEQ ID NO: 68757 - DNA, 24 bp, Artificial Sequence
  Synthetic oligonucleotide; GGAGAAA chr11 5212018 5212041 5212021 -
aataacagatgtgggtaaggttgt

SEQ ID NO: 68758 - DNA, 24 bp, Artificial Sequence
  Synthetic oligonucleotide; ACAGAAA chr11 5211925 5211948 5211928 -
tggcaattccctaaagacctaaaa

SEQ ID NO: 68759 - DNA, 24 bp, Artificial Sequence
  Synthetic oligonucleotide; ATAGAAT chr11 5211801 5211824 5211804 -
cagcataatcacaatagcaaagac

SEQ ID NO: 68760 - DNA, 24 bp, Artificial Sequence
  Synthetic oligonucleotide; AAAGAAT chr11 5211718 5211741 5211721 -
catggaatactatgtggccataaa

SEQ ID NO: 68761 - DNA, 24 bp, Artificial Sequence
  Synthetic oligonucleotide; ACAGAAA chr11 5211643 5211666 5211646 -
tatccttaacaaactaatgtaaga

SEQ ID NO: 68762 - DNA, 24 bp, Artificial Sequence
  Synthetic oligonucleotide; TGAGAAA chr11 5211593 5211616 5211596 -
cacttacaagtaggaactaaatga

SEQ ID NO: 68763 - DNA, 24 bp, Artificial Sequence
  Synthetic oligonucleotide; GCAGAAA chr11 5211515 5211538 5211518 -
tggagggtgggaacggggagaaga

SEQ ID NO: 68764 - DNA, 24 bp, Artificial Sequence
  Synthetic oligonucleotide; GGAGAAA chr11 5210526 5210549 5210529 -
ctaagccatcctgcagagcaagtg

SEQ ID NO: 68765 - DNA, 24 bp, Artificial Sequence
  Synthetic oligonucleotide; GAAGAAT chr11 5210258 5210281 5210261 -
ttgaggccagcttgcttcccacta

SEQ ID NO: 68766 - DNA, 24 bp, Artificial Sequence
  Synthetic oligonucleotide; TGAGAAT chr11 5210126 5210149 5210129 -
gagtgcaatttcttcaactacaaa

SEQ ID NO: 68767 - DNA, 24 bp, Artificial Sequence
  Synthetic oligonucleotide; AGAGAAA chr11 5210022 5210045 5210025 -
tctgggcacatgcaggctgctata

SEQ ID NO: 68768 - DNA, 24 bp, Artificial Sequence
  Synthetic oligonucleotide; ACAGAAT chr11 5209902 5209925 5209905 -
gcatattttatgacctagcaattt

SEQ ID NO: 68769 - DNA, 24 bp, Artificial Sequence
  Synthetic oligonucleotide; TAAGAAT chr11 5209878 5209901 5209881 -
acagaatatatatacaaaaatata

SEQ ID NO: 68770 - DNA, 24 bp, Artificial Sequence
  Synthetic oligonucleotide; ATAGAAT chr11 5209774 5209797 5209777 -
aatatattgtggtatatacataaa

SEQ ID NO: 68771 - DNA, 24 bp, Artificial Sequence
  Synthetic oligonucleotide; TCAGAAA chr11 5209762 5209785 5209765 -
tatatacataaaatagaatgacat

SEQ ID NO: 68772 - DNA, 24 bp, Artificial Sequence
  Synthetic oligonucleotide; TTAGAAA chr11 5209410 5209433 5209413 -
aaaatattaaaataaaaactaaat

SEQ ID NO: 68773 - DNA, 24 bp, Artificial Sequence
  Synthetic oligonucleotide; GAAGAAA chr11 5209235 5209258 5209238 -
tgtcttaacttcctgaagaagagg

SEQ ID NO: 68774 - DNA, 24 bp, Artificial Sequence
  Synthetic oligonucleotide; ACAGAAA chr11 5209209 5209232 5209212 -
agaaataatgaaaaaaggaaaata

SEQ ID NO: 68775 - DNA, 24 bp, Artificial Sequence
  Synthetic oligonucleotide; CAAGAAA chr11 5208987 5209010 5208990 -
tgtcttcactacatggtactatgt

SEQ ID NO: 68776 - DNA, 24 bp, Artificial Sequence
  Synthetic oligonucleotide; AGAGAAA chr11 5208981 5209004 5208984 -
cactacatggtactatgtcaagaa

SEQ ID NO: 68777 - DNA, 24 bp, Artificial Sequence
  Synthetic oligonucleotide; CTAGAAT chr11 5208675 5208698 5208678 -
tatttaataatcaatttctcacaa

SEQ ID NO: 68778 - DNA, 24 bp, Artificial Sequence
  Synthetic oligonucleotide; TAAGAAA chr11 5208546 5208569 5208549 -
gtgttgagctaaaaattatatacc

SEQ ID NO: 68779 - DNA, 24 bp, Artificial Sequence
  Synthetic oligonucleotide; ACAGAAA chr11 5207875 5207898 5207878 -
taataaataaataaaataaataaa

SEQ ID NO: 68780 - DNA, 24 bp, Artificial Sequence
  Synthetic oligonucleotide; AGAGAAT chr11 5207624 5207647 5207627 -
agataataaacctttgtcacctct

SEQ ID NO: 68781 - DNA, 24 bp, Artificial Sequence
  Synthetic oligonucleotide; TTAGAAA chr11 5207600 5207623 5207603 -
agagaattctaaaaatccacagat

SEQ ID NO: 68782 - DNA, 24 bp, Artificial Sequence
  Synthetic oligonucleotide; CAAGAAA chr11 5207582 5207605 5207585 -
acagatttagaaattctaggaatc

SEQ ID NO: 68783 - DNA, 24 bp, Artificial Sequence
  Synthetic oligonucleotide; AGAGAAA chr11 5207405 5207428 5207408 -
tatcacaatagatgacacctgcat

SEQ ID NO: 68784 - DNA, 24 bp, Artificial Sequence
  Synthetic oligonucleotide; TCAGAAT chr11 5206903 5206926 5206906 -
atccatctctcctatgttctgagg

SEQ ID NO: 68785 - DNA, 24 bp, Artificial Sequence
  Synthetic oligonucleotide; ACAGAAA chr11 5206773 5206796 5206776 -
ttacttctcacattcttttcttga

SEQ ID NO: 68786 - DNA, 24 bp, Artificial Sequence
  Synthetic oligonucleotide; TGAGAAA chr11 5206541 5206564 5206544 -
tattcttattccactgtgtggtga

SEQ ID NO: 68787 - DNA, 24 bp, Artificial Sequence
  Synthetic oligonucleotide; GGAGAAA chr11 5206473 5206496 5206476 -
tccctgaagccatagtaaccccct

SEQ ID NO: 68788 - DNA, 24 bp, Artificial Sequence
  Synthetic oligonucleotide; TTAGAAA chr11 5206421 5206444 5206424 -
gcctaggtatgggtactcgatttc

SEQ ID NO: 68789 - DNA, 24 bp, Artificial Sequence
  Synthetic oligonucleotide; GTAGAAT chr11 5206373 5206396 5206376 -
tatcttaaaaataagggtattgaa

SEQ ID NO: 68790 - DNA, 24 bp, Artificial Sequence
  Synthetic oligonucleotide; CTAGAAT chr11 5206365 5206388 5206368 -
aaataagggtattgaagtagaatt

SEQ ID NO: 68791 - DNA, 24 bp, Artificial Sequence
  Synthetic oligonucleotide; ATAGAAA chr11 5206237 5206260 5206240 -
aaagttgatttcataaaaacggga

SEQ ID NO: 68792 - DNA, 24 bp, Artificial Sequence
  Synthetic oligonucleotide; GAAGAAA chr11 5205746 5205769 5205749 -
attttaagctgtctcacattttct

SEQ ID NO: 68793 - DNA, 24 bp, Artificial Sequence
  Synthetic oligonucleotide; ATAGAAA chr11 5205526 5205549 5205529 -
ttagtaatgatgggaatattattt

SEQ ID NO: 68794 - DNA, 24 bp, Artificial Sequence
  Synthetic oligonucleotide; TCAGAAT chr11 5205141 5205164 5205144 -
tagattctctctgaactagcatat

SEQ ID NO: 68795 - DNA, 24 bp, Artificial Sequence
  Synthetic oligonucleotide; ATAGAAT chr11 5205103 5205126 5205106 -
cagtcagttctttggacaagtctt

SEQ ID NO: 68796 - DNA, 24 bp, Artificial Sequence
  Synthetic oligonucleotide; GAAGAAA chr11 5205003 5205026 5205006 -
ttatgcatcactgaagtagggagg

SEQ ID NO: 68797 - DNA, 24 bp, Artificial Sequence
  Synthetic oligonucleotide; CCAGAAA chr11 5204963 5204986 5204966 -
actacttctgacccctagtggtgt

SEQ ID NO: 68798 - DNA, 24 bp, Artificial Sequence
  Synthetic oligonucleotide; ATAGAAT chr11 5204815 5204838 5204818 -
ggcaaataggaatgttttagttct

SEQ ID NO: 68799 - DNA, 24 bp, Artificial Sequence
  Synthetic oligonucleotide; ACAGAAA chr11 5204689 5204712 5204692 -
cacacagggaattattctgaaaag

SEQ ID NO: 68800 - DNA, 24 bp, Artificial Sequence
  Synthetic oligonucleotide; TCAGAAA chr11 5204627 5204650 5204630 -
taggtcagttttaatcagagggca

SEQ ID NO: 68801 - DNA, 24 bp, Artificial Sequence
  Synthetic oligonucleotide; AAAGAAT chr11 5204611 5204634 5204614 -
agagggcatcagaaaagactcctg

SEQ ID NO: 68802 - DNA, 24 bp, Artificial Sequence
  Synthetic oligonucleotide; GAAGAAA chr11 5204061 5204084 5204064 -
gtctgaagcctttgtagtcagtct

SEQ ID NO: 68803 - DNA, 24 bp, Artificial Sequence
  Synthetic oligonucleotide; ACAGAAT chr11 5203706 5203729 5203709 -
tacttttaacacatacctacattc

SEQ ID NO: 68804 - DNA, 24 bp, Artificial Sequence
  Synthetic oligonucleotide; AGAGAAA chr11 5203638 5203661 5203641 -
tatgtctgagtcaggctggaaatg

SEQ ID NO: 68805 - DNA, 24 bp, Artificial Sequence
  Synthetic oligonucleotide; TCAGAAA chr11 5203520 5203543 5203523 -
gatgactcaattggtggccaaagg

SEQ ID NO: 68806 - DNA, 24 bp, Artificial Sequence
  Synthetic oligonucleotide; ATAGAAT chr11 5203417 5203440 5203420 -
ctgtgattgtctagctcttatttc

SEQ ID NO: 68807 - DNA, 24 bp, Artificial Sequence
  Synthetic oligonucleotide; GAAGAAA chr11 5203220 5203243 5203223 -
gagagtaagttagttaagggggtt

SEQ ID NO: 68808 - DNA, 24 bp, Artificial Sequence
  Synthetic oligonucleotide; TTAGAAA chr11 5203187 5203210 5203190 -
agataatctaggtggggagcagta

SEQ ID NO: 68809 - DNA, 24 bp, Artificial Sequence
  Synthetic oligonucleotide; AAAGAAT chr11 5202931 5202954 5202934 -
tatacaaggctttttgactatgat

SEQ ID NO: 68810 - DNA, 24 bp, Artificial Sequence
  Synthetic oligonucleotide; GTAGAAA chr11 5202842 5202865 5202845 -
gtttgtgtgatttagtagatgttt

SEQ ID NO: 68811 - DNA, 24 bp, Artificial Sequence
  Synthetic oligonucleotide; GTAGAAA chr11 5202650 5202673 5202653 -
gggcctatctgggatgtgtttctg

SEQ ID NO: 68812 - DNA, 24 bp, Artificial Sequence
  Synthetic oligonucleotide; GTAGAAA chr11 5202641 5202664 5202644 -
tgggatgtgtttctggtagaaatg

SEQ ID NO: 68813 - DNA, 24 bp, Artificial Sequence
  Synthetic oligonucleotide; AGAGAAA chr11 5202594 5202617 5202597 -
tggagagaggaaagggaaggaaag

SEQ ID NO: 68814 - DNA, 24 bp, Artificial Sequence
  Synthetic oligonucleotide; GGAGAAA chr11 5202514 5202537 5202517 -
tggtggagtcactttataatatta

SEQ ID NO: 68815 - DNA, 24 bp, Artificial Sequence
  Synthetic oligonucleotide; ACAGAAA chr11 5202503 5202526 5202506 -
ctttataatattaggagaaaaggg

SEQ ID NO: 68816 - DNA, 24 bp, Artificial Sequence
  Synthetic oligonucleotide; TAAGAAA chr11 5202341 5202364 5202344 -
ggtgcaaatgttagtttcaaataa

SEQ ID NO: 68817 - DNA, 24 bp, Artificial Sequence
  Synthetic oligonucleotide; TGAGAAT chr11 5202305 5202328 5202308 -
gacatagtctgcacattaaggaac

SEQ ID NO: 68818 - DNA, 24 bp, Artificial Sequence
  Synthetic oligonucleotide; TAAGAAA chr11 5202160 5202183 5202163 -
atagatatatggataaatttgtct

SEQ ID NO: 68819 - DNA, 24 bp, Artificial Sequence
  Synthetic oligonucleotide; GAAGAAA chr11 5202104 5202127 5202107 -
gcaagatcgttttaaaaagggtag

SEQ ID NO: 68820 - DNA, 24 bp, Artificial Sequence
  Synthetic oligonucleotide; CGAGAAA chr11 5202055 5202078 5202058 -
ataatttaggcagatagaacattt

SEQ ID NO: 68821 - DNA, 24 bp, Artificial Sequence
  Synthetic oligonucleotide; AGAGAAA chr11 5202034 5202057 5202037 -
tttcgagaaaaattttacgaaaga

SEQ ID NO: 68822 - DNA, 24 bp, Artificial Sequence
  Synthetic oligonucleotide; AGAGAAA chr11 5202019 5202042 5202022 -
tacgaaagaagagaaattcgattt

SEQ ID NO: 68823 - DNA, 24 bp, Artificial Sequence
  Synthetic oligonucleotide; CAAGAAA chr11 5201972 5201995 5201975 -
ttcaaaagactgaaaaatcctctg

SEQ ID NO: 68824 - DNA, 24 bp, Artificial Sequence
  Synthetic oligonucleotide; GAAGAAA chr11 5201964 5201987 5201967 -
actgaaaaatcctctgcaagaaac

SEQ ID NO: 68825 - DNA, 24 bp, Artificial Sequence
  Synthetic oligonucleotide; GGAGAAA chr11 5201942 5201965 5201945 -
acgaagaaacttcaagcattctat

SEQ ID NO: 68826 - DNA, 24 bp, Artificial Sequence
  Synthetic oligonucleotide; CAAGAAA chr11 5201883 5201906 5201886 -
ttcaatgctgagaaggagtcaggg

SEQ ID NO: 68827 - DNA, 24 bp, Artificial Sequence
  Synthetic oligonucleotide; GAAGAAA chr11 5201824 5201847 5201827 -
agtgtagtatagagagtacattga

SEQ ID NO: 68828 - DNA, 24 bp, Artificial Sequence
  Synthetic oligonucleotide; TAAGAAA chr11 5201514 5201537 5201517 -
tgtgatctgtagaactgcaggttc

SEQ ID NO: 68829 - DNA, 24 bp, Artificial Sequence
  Synthetic oligonucleotide; AAAGAAA chr11 5201510 5201533 5201513 -
atctgtagaactgcaggttctaag

SEQ ID NO: 68830 - DNA, 24 bp, Artificial Sequence
  Synthetic oligonucleotide; TGAGAAA chr11 5201322 5201345 5201325 -
catctcaagaggccagagctccag

SEQ ID NO: 68831 - DNA, 24 bp, Artificial Sequence
  Synthetic oligonucleotide; GAAGAAA chr11 5201264 5201287 5201267 -
tattcctgtctgcttatcaccaat

SEQ ID NO: 68832 - DNA, 24 bp, Artificial Sequence
  Synthetic oligonucleotide; GGAGAAA chr11 5201227 5201250 5201230 -
ttgctggctacgtcatctggaggg

SEQ ID NO: 68833 - DNA, 24 bp, Artificial Sequence
  Synthetic oligonucleotide; GGAGAAA chr11 5201192 5201215 5201195 -
gagtatcttcattaaatagtattt

SEQ ID NO: 68834 - DNA, 24 bp, Artificial Sequence
  Synthetic oligonucleotide; GAAGAAA chr11 5201068 5201091 5201071 -
ttcgaatgtttaatgaattggaga

SEQ ID NO: 68835 - DNA, 24 bp, Artificial Sequence
  Synthetic oligonucleotide; AAAGAAA chr11 5200823 5200846 5200826 -
caaaggcaatggatactatgtctc

SEQ ID NO: 68836 - DNA, 24 bp, Artificial Sequence
  Synthetic oligonucleotide; ACAGAAT chr11 5200817 5200840 5200820 -
caatggatactatgtctcaaagaa

SEQ ID NO: 68837 - DNA, 24 bp, Artificial Sequence
  Synthetic oligonucleotide; TTAGAAA chr11 5200761 5200784 5200764 -
taagttttagggtatttcatttac

SEQ ID NO: 68838 - DNA, 24 bp, Artificial Sequence
  Synthetic oligonucleotide; CCAGAAT chr11 5200688 5200711 5200691 -
aatactctcacatgtttctcagtt

SEQ ID NO: 68839 - DNA, 24 bp, Artificial Sequence
  Synthetic oligonucleotide; CCAGAAT chr11 5200259 5200282 5200262 -
gttattcctccatcctgactaatt

SEQ ID NO: 68840 - DNA, 24 bp, Artificial Sequence
  Synthetic oligonucleotide; CCAGAAT chr11 5199773 5199796 5199776 -
gtgtcaagacccaacagattcata

SEQ ID NO: 68841 - DNA, 24 bp, Artificial Sequence
  Synthetic oligonucleotide; AAAGAAA chr11 5199708 5199731 5199711 -
atattgagatgtattgcctaaaaa

SEQ ID NO: 68842 - DNA, 24 bp, Artificial Sequence
  Synthetic oligonucleotide; AAAGAAA chr11 5199704 5199727 5199707 -
tgagatgtattgcctaaaaaaaag

SEQ ID NO: 68843 - DNA, 24 bp, Artificial Sequence
  Synthetic oligonucleotide; AAAGAAA chr11 5199660 5199683 5199663 -
ataaacaaaaatcagtgccataaa

SEQ ID NO: 68844 - DNA, 24 bp, Artificial Sequence
  Synthetic oligonucleotide; AGAGAAT chr11 5199584 5199607 5199587 -
cttaaaaaatatttaaatatagtc

SEQ ID NO: 68845 - DNA, 24 bp, Artificial Sequence
  Synthetic oligonucleotide; TAAGAAA chr11 5199512 5199535 5199515 -
tcactctatcagtctgaccatatt

SEQ ID NO: 68846 - DNA, 24 bp, Artificial Sequence
  Synthetic oligonucleotide; GTAGAAA chr11 5199408 5199431 5199411 -
aaacctaggttttcaagtttcaaa

SEQ ID NO: 68847 - DNA, 24 bp, Artificial Sequence
  Synthetic oligonucleotide; CCAGAAT chr11 5199306 5199329 5199309 -
ggaatgttgtgatatctgtatgga

SEQ ID NO: 68848 - DNA, 24 bp, Artificial Sequence
  Synthetic oligonucleotide; AAAGAAA chr11 5199060 5199083 5199063 -
agctacagttcataaagaggacac

SEQ ID NO: 68849 - DNA, 24 bp, Artificial Sequence
  Synthetic oligonucleotide; TTAGAAT chr11 5199014 5199037 5199017 -
aacttctaccatgtctaatttaaa

SEQ ID NO: 68850 - DNA, 24 bp, Artificial Sequence
  Synthetic oligonucleotide; AAAGAAA chr11 5198866 5198889 5198869 -
cgctaccgacttattctgagttta

SEQ ID NO: 68851 - DNA, 24 bp, Artificial Sequence
  Synthetic oligonucleotide; AAAGAAA chr11 5198797 5198820 5198800 -
gctagtgcagctttccaaagaagg

SEQ ID NO: 68852 - DNA, 24 bp, Artificial Sequence
  Synthetic oligonucleotide; CAAGAAA chr11 5198755 5198778 5198758 -
aggtacaaaactatgcatggataa

SEQ ID NO: 68853 - DNA, 24 bp, Artificial Sequence
  Synthetic oligonucleotide; TTAGAAA chr11 5198436 5198459 5198439 -
ttctggacagagtaaagtatctgg

SEQ ID NO: 68854 - DNA, 24 bp, Artificial Sequence
  Synthetic oligonucleotide; CAAGAAA chr11 5198137 5198160 5198140 -
aaccccgtctctactaaaaaaaca

SEQ ID NO: 68855 - DNA, 24 bp, Artificial Sequence
  Synthetic oligonucleotide; GGAGAAT chr11 5198074 5198097 5198077 -
ccaggtactcgggaggctgagaca

SEQ ID NO: 68856 - DNA, 24 bp, Artificial Sequence
  Synthetic oligonucleotide; AGAGAAA chr11 5197965 5197988 5197968 -
tctgtctcaaaaaaaaaaaaaaaa

SEQ ID NO: 68857 - DNA, 24 bp, Artificial Sequence
  Synthetic oligonucleotide; AAAGAAA chr11 5197955 5197978 5197958 -
aaaaaaaaaaaaaaagagaaaaaa

SEQ ID NO: 68858 - DNA, 24 bp, Artificial Sequence
  Synthetic oligonucleotide; AGAGAAT chr11 5197670 5197693 5197673 -
gagctgacacaacactggggaagc

SEQ ID NO: 68859 - DNA, 24 bp, Artificial Sequence
  Synthetic oligonucleotide; TCAGAAT chr11 5197614 5197637 5197617 -
ccaccagccactcatagggaagca

SEQ ID NO: 68860 - DNA, 24 bp, Artificial Sequence
  Synthetic oligonucleotide; ATAGAAT chr11 5197464 5197487 5197467 -
tttgtgcttcagattaggcaacct

SEQ ID NO: 68861 - DNA, 24 bp, Artificial Sequence
  Synthetic oligonucleotide; TCAGAAA chr11 5197390 5197413 5197393 -
aataaaaaatacctaagagtatcc

SEQ ID NO: 68862 - DNA, 24 bp, Artificial Sequence
  Synthetic oligonucleotide; TCAGAAT chr11 5197325 5197348 5197328 -
tgatgataagatttatgaagaact

SEQ ID NO: 68863 - DNA, 24 bp, Artificial Sequence
  Synthetic oligonucleotide; ACAGAAA chr11 5197229 5197252 5197232 -
ctttatatgattactgggctttat

SEQ ID NO: 68864 - DNA, 24 bp, Artificial Sequence
  Synthetic oligonucleotide; AAAGAAA chr11 5197225 5197248 5197228 -
atatgattactgggctttatacag

SEQ ID NO: 68865 - DNA, 24 bp, Artificial Sequence
  Synthetic oligonucleotide; GAAGAAA chr11 5197125 5197148 5197128 -
aaaaataactaaacctctcctgag

SEQ ID NO: 68866 - DNA, 24 bp, Artificial Sequence
  Synthetic oligonucleotide; TGAGAAA chr11 5196844 5196867 5196847 -
tgcaaggctactatccagcgtcac

SEQ ID NO: 68867 - DNA, 24 bp, Artificial Sequence
  Synthetic oligonucleotide; GGAGAAA chr11 5196712 5196735 5196715 -
atgaagtcacggttattataataa

SEQ ID NO: 68868 - DNA, 24 bp, Artificial Sequence
  Synthetic oligonucleotide; TCAGAAA chr11 5196666 5196689 5196669 -
agaacaaggtgacaaaagtaagat

SEQ ID NO: 68869 - DNA, 24 bp, Artificial Sequence
  Synthetic oligonucleotide; TCAGAAA chr11 5196658 5196681 5196661 -
gtgacaaaagtaagattcagaaaa

SEQ ID NO: 68870 - DNA, 24 bp, Artificial Sequence
  Synthetic oligonucleotide; GGAGAAA chr11 5196592 5196615 5196595 -
acaccgaaaagctaaggtccagtg

SEQ ID NO: 68871 - DNA, 24 bp, Artificial Sequence
  Synthetic oligonucleotide; TTAGAAA chr11 5196548 5196571 5196551 -
gaagtgagaggacatgattcagga

SEQ ID NO: 68872 - DNA, 24 bp, Artificial Sequence
  Synthetic oligonucleotide; TGAGAAT chr11 5196328 5196351 5196331 -
acctagatcccttgcatgcctcta

SEQ ID NO: 68873 - DNA, 24 bp, Artificial Sequence
  Synthetic oligonucleotide; GCAGAAA chr11 5195998 5196021 5196001 -
agtccattttcccagaagtctctt

SEQ ID NO: 68874 - DNA, 24 bp, Artificial Sequence
  Synthetic oligonucleotide; ATAGAAA chr11 5195873 5195896 5195876 -
agtcttggcaccatgtaatggcac

SEQ ID NO: 68875 - DNA, 24 bp, Artificial Sequence
  Synthetic oligonucleotide; TAAGAAA chr11 5195684 5195707 5195687 -
gtactgaataataaaatataaatt

SEQ ID NO: 68876 - DNA, 24 bp, Artificial Sequence
  Synthetic oligonucleotide; GAAGAAA chr11 5195569 5195592 5195572 -
tatagatgtacacagagacactgt

SEQ ID NO: 68877 - DNA, 24 bp, Artificial Sequence
  Synthetic oligonucleotide; ACAGAAA chr11 5195469 5195492 5195472 -
ggataatctgaaatctatatgtct

SEQ ID NO: 68878 - DNA, 24 bp, Artificial Sequence
  Synthetic oligonucleotide; TGAGAAA chr11 5195452 5195475 5195455 -
tatgtctacagaaaaggataccaa

SEQ ID NO: 68879 - DNA, 24 bp, Artificial Sequence
  Synthetic oligonucleotide; ACAGAAA chr11 5195410 5195433 5195413 -
gcaaagagcattttctggaaaaac

SEQ ID NO: 68880 - DNA, 24 bp, Artificial Sequence
  Synthetic oligonucleotide; GTAGAAA chr11 5195364 5195387 5195367 -
tcgtgaggggtagggctaaaaatg

SEQ ID NO: 68881 - DNA, 24 bp, Artificial Sequence
  Synthetic oligonucleotide; AAAGAAT chr11 5195182 5195205 5195185 -
tatatgaaacagagagattatgca

SEQ ID NO: 68882 - DNA, 24 bp, Artificial Sequence
  Synthetic oligonucleotide; AGAGAAA chr11 5195147 5195170 5195150 -
attgaatgatgataaactgtctca

SEQ ID NO: 68883 - DNA, 24 bp, Artificial Sequence
  Synthetic oligonucleotide; ATAGAAA chr11 5195035 5195058 5195038 -
cagataactaattgtaccgtgttc

SEQ ID NO: 68884 - DNA, 24 bp, Artificial Sequence
  Synthetic oligonucleotide; TGAGAAT chr11 5194720 5194743 5194723 -
tttttcgtccttgcgatagtttac

SEQ ID NO: 68885 - DNA, 24 bp, Artificial Sequence
  Synthetic oligonucleotide; AAAGAAT chr11 5194478 5194501 5194481 -
gttccatatttcatggtgaggaac

SEQ ID NO: 68886 - DNA, 24 bp, Artificial Sequence
  Synthetic oligonucleotide; GAAGAAA chr11 5193783 5193806 5193786 -
gcaagaccgtgaacacaccagaag

SEQ ID NO: 68887 - DNA, 24 bp, Artificial Sequence
  Synthetic oligonucleotide; TAAGAAT chr11 5193717 5193740 5193720 -
accatcctttgaacacaccatctt

SEQ ID NO: 68888 - DNA, 24 bp, Artificial Sequence
  Synthetic oligonucleotide; CTAGAAT chr11 5193574 5193597 5193577 -
tccaccaacacaaaaattacatac

SEQ ID NO: 68889 - DNA, 24 bp, Artificial Sequence
  Synthetic oligonucleotide; AAAGAAA chr11 5193557 5193580 5193560 -
tacatacctagaatcaattttaat

SEQ ID NO: 68890 - DNA, 24 bp, Artificial Sequence
  Synthetic oligonucleotide; GCAGAAA chr11 5193523 5193546 5193526 -
tatttggagcacagcttattcagg

SEQ ID NO: 68891 - DNA, 24 bp, Artificial Sequence
  Synthetic oligonucleotide; ACAGAAT chr11 5193437 5193460 5193440 -
tcattttagatccttgatatttga

SEQ ID NO: 68892 - DNA, 24 bp, Artificial Sequence
  Synthetic oligonucleotide; GCAGAAA chr11 5193330 5193353 5193333 -
gggacaggaagtagatttaagagt

SEQ ID NO: 68893 - DNA, 24 bp, Artificial Sequence
  Synthetic oligonucleotide; AGAGAAT chr11 5193090 5193113 5193093 -
aaaataaaaattcatggtaagtta

SEQ ID NO: 68894 - DNA, 24 bp, Artificial Sequence
  Synthetic oligonucleotide; TAAGAAA chr11 5192873 5192896 5192876 -
aatatactcagtaacacatgtcat

SEQ ID NO: 68895 - DNA, 24 bp, Artificial Sequence
  Synthetic oligonucleotide; TGAGAAA chr11 5192736 5192759 5192739 -
actctcacttattgcttgtaggga

SEQ ID NO: 68896 - DNA, 24 bp, Artificial Sequence
  Synthetic oligonucleotide; ATAGAAT chr11 5192513 5192536 5192516 -
gataaactgtggaacatccatagg

SEQ ID NO: 68897 - DNA, 24 bp, Artificial Sequence
  Synthetic oligonucleotide; TGAGAAA chr11 5192365 5192388 5192368 -
cattaacctattttatcttgctgt

SEQ ID NO: 68898 - DNA, 24 bp, Artificial Sequence
  Synthetic oligonucleotide; ATAGAAT chr11 5192226 5192249 5192229 -
gacttagtttcagacagctattgc

SEQ ID NO: 68899 - DNA, 24 bp, Artificial Sequence
  Synthetic oligonucleotide; GAAGAAA chr11 5192028 5192051 5192031 -
cacattgagtatcaaaggaaggaa

SEQ ID NO: 68900 - DNA, 24 bp, Artificial Sequence
  Synthetic oligonucleotide; CAAGAAA chr11 5191828 5191851 5191831 -
tctgctcagcttctagggagacct

SEQ ID NO: 68901 - DNA, 24 bp, Artificial Sequence
  Synthetic oligonucleotide; AGAGAAA chr11 5191314 5191337 5191317 -
gggtacaaattcccattccaaaag

SEQ ID NO: 68902 - DNA, 24 bp, Artificial Sequence
  Synthetic oligonucleotide; AAAGAAA chr11 5191300 5191323 5191303 -
attccaaaagagagaaatgcacca

SEQ ID NO: 68903 - DNA, 24 bp, Artificial Sequence
  Synthetic oligonucleotide; GTAGAAA chr11 5191272 5191295 5191275 -
aaaggggctaaagatcccacacga

SEQ ID NO: 68904 - DNA, 24 bp, Artificial Sequence
  Synthetic oligonucleotide; TTAGAAA chr11 5189934 5189957 5189937 -
gacacatcttgaacaccttgctgc

SEQ ID NO: 68905 - DNA, 24 bp, Artificial Sequence
  Synthetic oligonucleotide; TCAGAAT chr11 5189745 5189768 5189748 -
tggacttcattgtccatatcacta

SEQ ID NO: 68906 - DNA, 24 bp, Artificial Sequence
  Synthetic oligonucleotide; CTAGAAA chr11 5189712 5189735 5189715 -
tggtcacaaccattccacaagtct

SEQ ID NO: 68907 - DNA, 24 bp, Artificial Sequence
  Synthetic oligonucleotide; AGAGAAA chr11 5189403 5189426 5189406 -
tcaggaaacttataatcatggcag

SEQ ID NO: 68908 - DNA, 24 bp, Artificial Sequence
  Synthetic oligonucleotide; AAAGAAA chr11 5188940 5188963 5188943 -
gcaggtcctggtgtatccttcctt

SEQ ID NO: 68909 - DNA, 24 bp, Artificial Sequence
  Synthetic oligonucleotide; TGAGAAA chr11 5188737 5188760 5188740 -
tctgcaaatattgattccaaccac

SEQ ID NO: 68910 - DNA, 24 bp, Artificial Sequence
  Synthetic oligonucleotide; TAAGAAA chr11 5188601 5188624 5188604 -
gtcccataaaatctcataatgttt

SEQ ID NO: 68911 - DNA, 24 bp, Artificial Sequence
  Synthetic oligonucleotide; GAAGAAA chr11 5188503 5188526 5188506 -
cttgctctacagcctacaaacaag

SEQ ID NO: 68912 - DNA, 24 bp, Artificial Sequence
  Synthetic oligonucleotide; GAAGAAA chr11 5188412 5188435 5188415 -
ccagctttactaacttacaaatga

SEQ ID NO: 68913 - DNA, 24 bp, Artificial Sequence
  Synthetic oligonucleotide; GAAGAAA chr11 5188373 5188396 5188376 -
ccaattatgccaaattacttgttc

SEQ ID NO: 68914 - DNA, 24 bp, Artificial Sequence
  Synthetic oligonucleotide; ATAGAAA chr11 5188062 5188085 5188065 -
catttatccatttccttgaaatcc

SEQ ID NO: 68915 - DNA, 24 bp, Artificial Sequence
  Synthetic oligonucleotide; TGAGAAT chr11 5187986 5188009 5187989 -
ggcaatttctgacatgaacttatg

SEQ ID NO: 68916 - DNA, 24 bp, Artificial Sequence
  Synthetic oligonucleotide; TAAGAAA chr11 5187769 5187792 5187772 -
tggctcaaagactgtagacttcta

SEQ ID NO: 68917 - DNA, 24 bp, Artificial Sequence
  Synthetic oligonucleotide; ATAGAAT chr11 5187715 5187738 5187718 -
atcaataactattatttcatctgc

SEQ ID NO: 68918 - DNA, 24 bp, Artificial Sequence
  Synthetic oligonucleotide; TCAGAAA chr11 5187618 5187641 5187621 -
ctgccctcttgcatattatattta

SEQ ID NO: 68919 - DNA, 24 bp, Artificial Sequence
  Synthetic oligonucleotide; TCAGAAA chr11 5186996 5187019 5186999 -
cttctagggattctttgaaaaata

SEQ ID NO: 68920 - DNA, 24 bp, Artificial Sequence
  Synthetic oligonucleotide; AGAGAAT chr11 5186961 5186984 5186964 -
cagatatatggaaggctccacttg

SEQ ID NO: 68921 - DNA, 24 bp, Artificial Sequence
  Synthetic oligonucleotide; AGAGAAT chr11 5186829 5186852 5186832 -
tattcctcattaaagtatccttca

SEQ ID NO: 68922 - DNA, 24 bp, Artificial Sequence
  Synthetic oligonucleotide; CAAGAAA chr11 5186757 5186780 5186760 -
attctgacccatttaccatgtgac

SEQ ID NO: 68923 - DNA, 24 bp, Artificial Sequence
  Synthetic oligonucleotide; AGAGAAT chr11 5186703 5186726 5186706 -
taaaaattaaagggaaataaaatg

SEQ ID NO: 68924 - DNA, 24 bp, Artificial Sequence
  Synthetic oligonucleotide; GAAGAAA chr11 5186536 5186559 5186539 -
cttaggtgtcagagagtggtggct

SEQ ID NO: 68925 - DNA, 24 bp, Artificial Sequence
  Synthetic oligonucleotide; AGAGAAT chr11 5186506 5186529 5186509 -
aaaaaatgcacaaattataatgaa

SEQ ID NO: 68926 - DNA, 24 bp, Artificial Sequence
  Synthetic oligonucleotide; CTAGAAA chr11 5186299 5186322 5186302 -
aacctgctaaatatcttcaggatt

SEQ ID NO: 68927 - DNA, 24 bp, Artificial Sequence
  Synthetic oligonucleotide; GTAGAAA chr11 5186253 5186276 5186256 -
ctgagttatgctcaatgaaaactt

SEQ ID NO: 68928 - DNA, 24 bp, Artificial Sequence
  Synthetic oligonucleotide; CCAGAAA chr11 5186240 5186263 5186243 -
aatgaaaacttgtagaaaataaca

SEQ ID NO: 68929 - DNA, 24 bp, Artificial Sequence
  Synthetic oligonucleotide; CAAGAAA chr11 5186224 5186247 5186227 -
aaataacaccagaaaaaaaaaagg

SEQ ID NO: 68930 - DNA, 24 bp, Artificial Sequence
  Synthetic oligonucleotide; AAAGAAT chr11 5186069 5186092 5186072 -
ttgtattaagtaagtcattttcaa

SEQ ID NO: 68931 - DNA, 24 bp, Artificial Sequence
  Synthetic oligonucleotide; TTAGAAT chr11 5186048 5186071 5186051 -
caaaaagaatattttagttttctc

SEQ ID NO: 68932 - DNA, 24 bp, Artificial Sequence
  Synthetic oligonucleotide; TAAGAAA chr11 5185661 5185684 5185664 -
ccaattgataccatgtgcccagta

SEQ ID NO: 68933 - DNA, 24 bp, Artificial Sequence
  Synthetic oligonucleotide; TCAGAAA chr11 5185435 5185458 5185438 -
agctaccttcctaagacactgact

SEQ ID NO: 68934 - DNA, 24 bp, Artificial Sequence
  Synthetic oligonucleotide; TCAGAAT chr11 5185336 5185359 5185339 -
aatgacgtgtccagggtcatagag

SEQ ID NO: 68935 - DNA, 24 bp, Artificial Sequence
  Synthetic oligonucleotide; TCAGAAT chr11 5185227 5185250 5185230 -
tccgtggatacattcatgattcag

SEQ ID NO: 68936 - DNA, 24 bp, Artificial Sequence
  Synthetic oligonucleotide; TCAGAAA chr11 5185214 5185237 5185217 -
tcatgattcagtcagaatatgctg

SEQ ID NO: 68937 - DNA, 24 bp, Artificial Sequence
  Synthetic oligonucleotide; CTAGAAT chr11 5185203 5185226 5185206 -
tcagaatatgctgtcagaaatatc

SEQ ID NO: 68938 - DNA, 24 bp, Artificial Sequence
  Synthetic oligonucleotide; CCAGAAA chr11 5185085 5185108 5185088 -
aaccataggtatcacaaaagatca

SEQ ID NO: 68939 - DNA, 24 bp, Artificial Sequence
  Synthetic oligonucleotide; CCAGAAA chr11 5185067 5185090 5185070 -
agatcaccagaaaaaatttaaagg

SEQ ID NO: 68940 - DNA, 24 bp, Artificial Sequence
  Synthetic oligonucleotide; CCAGAAT chr11 5184622 5184645 5184625 -
atttccatcatataaaatttgaga

SEQ ID NO: 68941 - DNA, 24 bp, Artificial Sequence
  Synthetic oligonucleotide; TGAGAAA chr11 5184461 5184484 5184464 -
caagaactttagccagcttttact

SEQ ID NO: 68942 - DNA, 24 bp, Artificial Sequence
  Synthetic oligonucleotide; GAAGAAT chr11 5183276 5183299 5183279 -
ggaataggtgtggtgtggtgctga

SEQ ID NO: 68943 - DNA, 24 bp, Artificial Sequence
  Synthetic oligonucleotide; TGAGAAT chr11 5182713 5182736 5182716 -
acatttaaggttaatattgttatg

SEQ ID NO: 68944 - DNA, 24 bp, Artificial Sequence
  Synthetic oligonucleotide; ATAGAAA chr11 5182374 5182397 5182377 -
ttccttctgaaactattccaatca

SEQ ID NO: 68945 - DNA, 24 bp, Artificial Sequence
  Synthetic oligonucleotide; AGAGAAT chr11 5182288 5182311 5182291 -
gcctagcagacacacaacaaaaaa

SEQ ID NO: 68946 - DNA, 24 bp, Artificial Sequence
  Synthetic oligonucleotide; GCAGAAA chr11 5182068 5182091 5182071 -
aaccacatgattatctcaatagat

SEQ ID NO: 68947 - DNA, 24 bp, Artificial Sequence
  Synthetic oligonucleotide; AGAGAAA chr11 5181826 5181849 5181829 -
agttctggccagggcaatcaggca

SEQ ID NO: 68948 - DNA, 24 bp, Artificial Sequence
  Synthetic oligonucleotide; AAAGAAA chr11 5181822 5181845 5181825 -
ctggccagggcaatcaggcaagag

SEQ ID NO: 68949 - DNA, 24 bp, Artificial Sequence
  Synthetic oligonucleotide; CTAGAAA chr11 5181747 5181770 5181750 -
tttgcagatgacgtgattgtatat

SEQ ID NO: 68950 - DNA, 24 bp, Artificial Sequence
  Synthetic oligonucleotide; TCAGAAA chr11 5181695 5181718 5181698 -
atctccttaagctgataagcaact

SEQ ID NO: 68951 - DNA, 24 bp, Artificial Sequence
  Synthetic oligonucleotide; AGAGAAT chr11 5181578 5181601 5181581 -
aactcccattcacaattgcctcaa

SEQ ID NO: 68952 - DNA, 24 bp, Artificial Sequence
  Synthetic oligonucleotide; GAAGAAT chr11 5181446 5181469 5181449 -
agaacattccatgctcatggatag

SEQ ID NO: 68953 - DNA, 24 bp, Artificial Sequence
  Synthetic oligonucleotide; ACAGAAT chr11 5181357 5181380 5181360 -
atcaagctaccaatgactttcttc

SEQ ID NO: 68954 - DNA, 24 bp, Artificial Sequence
  Synthetic oligonucleotide; TCAGAAA chr11 5181157 5181180 5181160 -
gaccaatggagcagaacagagctc

SEQ ID NO: 68955 - DNA, 24 bp, Artificial Sequence
  Synthetic oligonucleotide; GTAGAAA chr11 5181039 5181062 5181042 -
gctgggaaaactggctagccatat

SEQ ID NO: 68956 - DNA, 24 bp, Artificial Sequence
  Synthetic oligonucleotide; GAAGAAA chr11 5180938 5180961 5180941 -
agacctaaaaccataaaaacctta

SEQ ID NO: 68957 - DNA, 24 bp, Artificial Sequence
  Synthetic oligonucleotide; AAAGAAA chr11 5180803 5180826 5180806 -
aaactaaagagcttctgcacagca

SEQ ID NO: 68958 - DNA, 24 bp, Artificial Sequence
  Synthetic oligonucleotide; GGAGAAA chr11 5180762 5180785 5180765 -
agtgaacaggcaacctacacaatg

SEQ ID NO: 68959 - DNA, 24 bp, Artificial Sequence
  Synthetic oligonucleotide; CCAGAAT chr11 5180718 5180741 5180721 -
actcatctgacaaagggctaatat

SEQ ID NO: 68960 - DNA, 24 bp, Artificial Sequence
  Synthetic oligonucleotide; CAAGAAA chr11 5180687 5180710 5180690 -
ctacaatgaactcaaacaaattta

SEQ ID NO: 68961 - DNA, 24 bp, Artificial Sequence
  Synthetic oligonucleotide; AGAGAAA chr11 5180566 5180589 5180569 -
aaatgctcatcatcactggccatc

SEQ ID NO: 68962 - DNA, 24 bp, Artificial Sequence
  Synthetic oligonucleotide; TTAGAAT chr11 5180520 5180543 5180523 -
caatgagatatcatctcacaccag

SEQ ID NO: 68963 - DNA, 24 bp, Artificial Sequence
  Synthetic oligonucleotide; GGAGAAA chr11 5180467 5180490 5180470 -
aaccacaggtgctggagaggatgt

SEQ ID NO: 68964 - DNA, 24 bp, Artificial Sequence
  Synthetic oligonucleotide; CTAGAAA chr11 5180374 5180397 5180377 -
tggcaattcctcagggatctagaa

SEQ ID NO: 68965 - DNA, 24 bp, Artificial Sequence
  Synthetic oligonucleotide; TAAGAAA chr11 5180210 5180233 5180213 -
atgtccaacaatgatagactggat

SEQ ID NO: 68966 - DNA, 24 bp, Artificial Sequence
  Synthetic oligonucleotide; AAAGAAA chr11 5179778 5179801 5179781 -
attttcaatcagtgactgaagtgg

SEQ ID NO: 68967 - DNA, 24 bp, Artificial Sequence
  Synthetic oligonucleotide; TGAGAAA chr11 5179367 5179390 5179370 -
ttataatgttttatcctatatttt

SEQ ID NO: 68968 - DNA, 24 bp, Artificial Sequence
  Synthetic oligonucleotide; GTAGAAA chr11 5178997 5179020 5179000 -
agtctgtgggttttttttacatct

SEQ ID NO: 68969 - DNA, 24 bp, Artificial Sequence
  Synthetic oligonucleotide; GAAGAAA chr11 5178786 5178809 5178789 -
cccattttactctcctttcccaga

SEQ ID NO: 68970 - DNA, 24 bp, Artificial Sequence
  Synthetic oligonucleotide; AAAGAAA chr11 5178772 5178795 5178775 -
ctttcccagagaagaaaacattgg

SEQ ID NO: 68971 - DNA, 24 bp, Artificial Sequence
  Synthetic oligonucleotide; GCAGAAT chr11 5178326 5178349 5178329 -
ttcttcatacatttcatctttgtg

SEQ ID NO: 68972 - DNA, 24 bp, Artificial Sequence
  Synthetic oligonucleotide; GGAGAAA chr11 5178148 5178171 5178151 -
tggtataccgacttacatattgtg

SEQ ID NO: 68973 - DNA, 24 bp, Artificial Sequence
  Synthetic oligonucleotide; ATAGAAT chr11 5177691 5177714 5177694 -
agattaaaaagtctgttttaggga

SEQ ID NO: 68974 - DNA, 24 bp, Artificial Sequence
  Synthetic oligonucleotide; ATAGAAA chr11 5177673 5177696 5177676 -
tagggaatagaataaatacaatcc

SEQ ID NO: 68975 - DNA, 24 bp, Artificial Sequence
  Synthetic oligonucleotide; TCAGAAA chr11 5177550 5177573 5177553 -
actttaatgaaattctccattttt

SEQ ID NO: 68976 - DNA, 24 bp, Artificial Sequence
  Synthetic oligonucleotide; CGAGAAA chr11 5177500 5177523 5177503 -
aacttaaaaatatataaagataat

SEQ ID NO: 68977 - DNA, 24 bp, Artificial Sequence
  Synthetic oligonucleotide; AGAGAAA chr11 5177493 5177516 5177496 -
aaatatataaagataatcgagaaa

SEQ ID NO: 68978 - DNA, 24 bp, Artificial Sequence
  Synthetic oligonucleotide; CTAGAAT chr11 5177278 5177301 5177281 -
gttacttaagttaaaatgttatcc

SEQ ID NO: 68979 - DNA, 24 bp, Artificial Sequence
  Synthetic oligonucleotide; ACAGAAA chr11 5177055 5177078 5177058 -
catcaatggagcatcatggcatca

SEQ ID NO: 68980 - DNA, 24 bp, Artificial Sequence
  Synthetic oligonucleotide; GGAGAAT chr11 5176953 5176976 5176956 -
ttttaaaaagctagagaagattaa

SEQ ID NO: 68981 - DNA, 24 bp, Artificial Sequence
  Synthetic oligonucleotide; CAAGAAA chr11 5176940 5176963 5176943 -
gagaagattaaggagaatattttc

SEQ ID NO: 68982 - DNA, 24 bp, Artificial Sequence
  Synthetic oligonucleotide; AAAGAAT chr11 5176923 5176946 5176926 -
tattttccaagaaacttaaataaa

SEQ ID NO: 68983 - DNA, 24 bp, Artificial Sequence
  Synthetic oligonucleotide; TGAGAAT chr11 5176802 5176825 5176805 -
tcttaaaagcctagaacaatgcca

SEQ ID NO: 68984 - DNA, 24 bp, Artificial Sequence
  Synthetic oligonucleotide; AAAGAAA chr11 5176768 5176791 5176771 -
taaaaaatgaccttatttacacct

SEQ ID NO: 68985 - DNA, 24 bp, Artificial Sequence
  Synthetic oligonucleotide; TGAGAAA chr11 5176745 5176768 5176748 -
taaagaaagacaaaaaaaaaactt

SEQ ID NO: 68986 - DNA, 24 bp, Artificial Sequence
  Synthetic oligonucleotide; ATAGAAA chr11 5176667 5176690 5176670 -
tgcttagctttttctgtgattttt

SEQ ID NO: 68987 - DNA, 24 bp, Artificial Sequence
  Synthetic oligonucleotide; AAAGAAT chr11 5176509 5176532 5176512 -
cacacacacacacgtttgtgcacc

SEQ ID NO: 68988 - DNA, 24 bp, Artificial Sequence
  Synthetic oligonucleotide; TAAGAAA chr11 5176503 5176526 5176506 -
cacacacgtttgtgcaccaaagaa

SEQ ID NO: 68989 - DNA, 24 bp, Artificial Sequence
  Synthetic oligonucleotide; TTAGAAA chr11 5176495 5176518 5176498 -
tttgtgcaccaaagaataagaaag

SEQ ID NO: 68990 - DNA, 24 bp, Artificial Sequence
  Synthetic oligonucleotide; GGAGAAT chr11 5176455 5176478 5176458 -
tacagtatttccattattgggaag

SEQ ID NO: 68991 - DNA, 24 bp, Artificial Sequence
  Synthetic oligonucleotide; TAAGAAA chr11 5176137 5176160 5176140 -
tacttgattttagcagtggggagc

SEQ ID NO: 68992 - DNA, 24 bp, Artificial Sequence
  Synthetic oligonucleotide; GCAGAAA chr11 5175679 5175702 5175682 -
aggaaaggaaaggtccaaaaaagg

SEQ ID NO: 68993 - DNA, 24 bp, Artificial Sequence
  Synthetic oligonucleotide; ACAGAAT chr11 5175610 5175633 5175613 -
gctaaaactgatatggtgttctag

SEQ ID NO: 68994 - DNA, 24 bp, Artificial Sequence
  Synthetic oligonucleotide; TGAGAAT chr11 5175554 5175577 5175557 -
cagggtgctaagtgattgataagg

SEQ ID NO: 68995 - DNA, 24 bp, Artificial Sequence
  Synthetic oligonucleotide; GGAGAAA chr11 5175442 5175465 5175445 -
tcaagcaaaattttgatttcgggg

SEQ ID NO: 68996 - DNA, 24 bp, Artificial Sequence
  Synthetic oligonucleotide; ATAGAAT chr11 5175256 5175279 5175259 -
gcaactgcaagaaccaataggaaa

SEQ ID NO: 68997 - DNA, 24 bp, Artificial Sequence
  Synthetic oligonucleotide; GGAGAAT chr11 5175163 5175186 5175166 -
ccagctacatgggaggctgaggca

SEQ ID NO: 68998 - DNA, 24 bp, Artificial Sequence
  Synthetic oligonucleotide; AAAGAAA chr11 5175038 5175061 5175041 -
caaaaatacgtaaaacaaaaacaa

SEQ ID NO: 68999 - DNA, 24 bp, Artificial Sequence
  Synthetic oligonucleotide; TCAGAAA chr11 5174934 5174957 5174937 -
acattgtttattgtaacaattctc

SEQ ID NO: 69000 - DNA, 24 bp, Artificial Sequence
  Synthetic oligonucleotide; GCAGAAA chr11 5174690 5174713 5174693 -
tgccaaaactttttcatcatccaa

SEQ ID NO: 69001 - DNA, 24 bp, Artificial Sequence
  Synthetic oligonucleotide; CTAGAAA chr11 5173839 5173862 5173842 -
aatgttcatttgtatatcttcttt

SEQ ID NO: 69002 - DNA, 24 bp, Artificial Sequence
  Synthetic oligonucleotide; TAAGAAT chr11 5173592 5173615 5173595 -
tactcatactttttgtgtcatatc

SEQ ID NO: 69003 - DNA, 24 bp, Artificial Sequence
  Synthetic oligonucleotide; AAAGAAT chr11 5173465 5173488 5173468 -
atgctggcttttaatccttatttg

SEQ ID NO: 69004 - DNA, 24 bp, Artificial Sequence
  Synthetic oligonucleotide; ACAGAAT chr11 5173396 5173419 5173399 -
ttgaatatgaagttgtatataaaa

SEQ ID NO: 69005 - DNA, 24 bp, Artificial Sequence
  Synthetic oligonucleotide; ACAGAAA chr11 5173343 5173366 5173346 -
ggcaaaaaggacacagatcaaaca

SEQ ID NO: 69006 - DNA, 24 bp, Artificial Sequence
  Synthetic oligonucleotide; CTAGAAT chr11 5173331 5173354 5173334 -
acagatcaaacaacagaaaacagt

SEQ ID NO: 69007 - DNA, 24 bp, Artificial Sequence
  Synthetic oligonucleotide; TTAGAAA chr11 5173236 5173259 5173239 -
caacccttgatcttatacttggta

SEQ ID NO: 69008 - DNA, 24 bp, Artificial Sequence
  Synthetic oligonucleotide; TGAGAAT chr11 5173214 5173237 5173217 -
tattagaaaaattgtttatatgtt

SEQ ID NO: 69009 - DNA, 24 bp, Artificial Sequence
  Synthetic oligonucleotide; CAAGAAT chr11 5173154 5173177 5173157 -
ccccaaacaaatttcaggtggaat

SEQ ID NO: 69010 - DNA, 24 bp, Artificial Sequence
  Synthetic oligonucleotide; TAAGAAT chr11 5172993 5173016 5172996 -
tactttgtatatggaatagcttct

SEQ ID NO: 69011 - DNA, 24 bp, Artificial Sequence
  Synthetic oligonucleotide; TAAGAAA chr11 5172879 5172902 5172882 -
aagataagatgcgggggaagtata

SEQ ID NO: 69012 - DNA, 24 bp, Artificial Sequence
  Synthetic oligonucleotide; GGAGAAA chr11 5171985 5172008 5171988 -
ttttctaatctatggatagcaggt

SEQ ID NO: 69013 - DNA, 24 bp, Artificial Sequence
  Synthetic oligonucleotide; AAAGAAA chr11 5171961 5171984 5171964 -
ggagaaagagtgaactggtaagtt

SEQ ID NO: 69014 - DNA, 24 bp, Artificial Sequence
  Synthetic oligonucleotide; GGAGAAA chr11 5171931 5171954 5171934 -
aaaaatggaaaatactttattcta

SEQ ID NO: 69015 - DNA, 24 bp, Artificial Sequence
  Synthetic oligonucleotide; TCAGAAA chr11 5171449 5171472 5171452 -
ctgtggcttacctgtgcccttgtt

SEQ ID NO: 69016 - DNA, 24 bp, Artificial Sequence
  Synthetic oligonucleotide; GTAGAAA chr11 5171366 5171389 5171369 -
cagaacttgatgtgcaataactga

SEQ ID NO: 69017 - DNA, 24 bp, Artificial Sequence
  Synthetic oligonucleotide; AAAGAAA chr11 5170408 5170431 5170411 -
cccattgtctatagtatcaaaatc

SEQ ID NO: 69018 - DNA, 24 bp, Artificial Sequence
  Synthetic oligonucleotide; GAAGAAA chr11 5170222 5170245 5170225 -
aatgagctttaacattttgtagat

SEQ ID NO: 69019 - DNA, 24 bp, Artificial Sequence
  Synthetic oligonucleotide; TGAGAAT chr11 5170192 5170215 5170195 -
aaaaaacagttttatatatttccc

SEQ ID NO: 69020 - DNA, 24 bp, Artificial Sequence
  Synthetic oligonucleotide; GTAGAAA chr11 5170055 5170078 5170058 -
agtgacatttggttctgggaatat

SEQ ID NO: 69021 - DNA, 24 bp, Artificial Sequence
  Synthetic oligonucleotide; GAAGAAT chr11 5169864 5169887 5169867 -
ttacctctgatggatataaagatg

SEQ ID NO: 69022 - DNA, 24 bp, Artificial Sequence
  Synthetic oligonucleotide; CAAGAAT chr11 5169631 5169654 5169634 -
tagtgaatacaagtgtggaaaata

SEQ ID NO: 69023 - DNA, 24 bp, Artificial Sequence
  Synthetic oligonucleotide; TTAGAAA chr11 5169419 5169442 5169422 -
tggtcaggaggaaactgtttggct

SEQ ID NO: 69024 - DNA, 24 bp, Artificial Sequence
  Synthetic oligonucleotide; CTAGAAA chr11 5169385 5169408 5169388 -
attttatttttaatgagttcaata

SEQ ID NO: 69025 - DNA, 24 bp, Artificial Sequence
  Synthetic oligonucleotide; AAAGAAA chr11 5169381 5169404 5169384 -
tatttttaatgagttcaatactag

SEQ ID NO: 69026 - DNA, 24 bp, Artificial Sequence
  Synthetic oligonucleotide; GAAGAAA chr11 5169342 5169365 5169345 -
caactacttgaaaatactgtttta

SEQ ID NO: 69027 - DNA, 24 bp, Artificial Sequence
  Synthetic oligonucleotide; ACAGAAA chr11 5169324 5169347 5169327 -
gttttagaagaaaataactaaaaa

SEQ ID NO: 69028 - DNA, 24 bp, Artificial Sequence
  Synthetic oligonucleotide; GAAGAAT chr11 5169227 5169250 5169230 -
caaacaaaaaggtagggaggacca

SEQ ID NO: 69029 - DNA, 24 bp, Artificial Sequence
  Synthetic oligonucleotide; CTAGAAA chr11 5169219 5169242 5169222 -
aaggtagggaggaccagaagaatt

SEQ ID NO: 69030 - DNA, 24 bp, Artificial Sequence
  Synthetic oligonucleotide; TAAGAAA chr11 5168606 5168629 5168609 -
ataatttattcatttataaatgaa

SEQ ID NO: 69031 - DNA, 24 bp, Artificial Sequence
  Synthetic oligonucleotide; GAAGAAA chr11 5168292 5168315 5168295 -
atttaatccacggaacaaatatat

SEQ ID NO: 69032 - DNA, 24 bp, Artificial Sequence
  Synthetic oligonucleotide; GTAGAAA chr11 5168258 5168281 5168261 -
tcagtttgtctacatgttacaaat

SEQ ID NO: 69033 - DNA, 24 bp, Artificial Sequence
  Synthetic oligonucleotide; ACAGAAA chr11 5168252 5168275 5168255 -
tgtctacatgttacaaatgtagaa

SEQ ID NO: 69034 - DNA, 24 bp, Artificial Sequence
  Synthetic oligonucleotide; GCAGAAT chr11 5168197 5168220 5168200 -
cccaagtcaaagagttaataagtg

SEQ ID NO: 69035 - DNA, 24 bp, Artificial Sequence
  Synthetic oligonucleotide; TGAGAAA chr11 5167681 5167704 5167684 -
agatgatcctaaaagcagaagaga

SEQ ID NO: 69036 - DNA, 24 bp, Artificial Sequence
  Synthetic oligonucleotide; ATAGAAA chr11 5167626 5167649 5167629 -
aatcctgtgacaacaaacatctca

SEQ ID NO: 69037 - DNA, 24 bp, Artificial Sequence
  Synthetic oligonucleotide; AAAGAAA chr11 5167568 5167591 5167571 -
aaattttcaaagcgctcagggata

SEQ ID NO: 69038 - DNA, 24 bp, Artificial Sequence
  Synthetic oligonucleotide; CAAGAAT chr11 5167552 5167575 5167555 -
cagggataaaagaaaactgatatt

SEQ ID NO: 69039 - DNA, 24 bp, Artificial Sequence
  Synthetic oligonucleotide; AGAGAAT chr11 5167475 5167498 5167478 -
tctttcccagacaaacaaaagttg

SEQ ID NO: 69040 - DNA, 24 bp, Artificial Sequence
  Synthetic oligonucleotide; AAAGAAA chr11 5167415 5167438 5167418 -
tgctaaagggagttatgcaatctg

SEQ ID NO: 69041 - DNA, 24 bp, Artificial Sequence
  Synthetic oligonucleotide; AAAGAAA chr11 5167391 5167414 5167394 -
aaagaaaaaagacattaacatgca

SEQ ID NO: 69042 - DNA, 24 bp, Artificial Sequence
  Synthetic oligonucleotide; CTAGAAT chr11 5167335 5167358 5167338 -
gtaaaattaagtacatagacaaac

SEQ ID NO: 69043 - DNA, 24 bp, Artificial Sequence
  Synthetic oligonucleotide; GTAGAAT chr11 5167156 5167179 5167159 -
gtgggggtggagtggagttaaagt

SEQ ID NO: 69044 - DNA, 24 bp, Artificial Sequence
  Synthetic oligonucleotide; ATAGAAT chr11 5166814 5166837 5166817 -
gtctcagttccccaattaaaagta

SEQ ID NO: 69045 - DNA, 24 bp, Artificial Sequence
  Synthetic oligonucleotide; AAAGAAA chr11 5166796 5166819 5166799 -
aaagtaatagaatggtaaatggat

SEQ ID NO: 69046 - DNA, 24 bp, Artificial Sequence
  Synthetic oligonucleotide; CAAGAAA chr11 5166765 5166788 5166768 -
caatatccaactttatgcgatctt

SEQ ID NO: 69047 - DNA, 24 bp, Artificial Sequence
  Synthetic oligonucleotide; CCAGAAA chr11 5166689 5166712 5166692 -
gaaaaaaattccatgaactggaaa

SEQ ID NO: 69048 - DNA, 24 bp, Artificial Sequence
  Synthetic oligonucleotide; TAAGAAA chr11 5166627 5166650 5166630 -
aatagactacaaatttaaaaactg

SEQ ID NO: 69049 - DNA, 24 bp, Artificial Sequence
  Synthetic oligonucleotide; GTAGAAA chr11 5166234 5166257 5166237 -
taagtttgtacaaatttttcagaa

SEQ ID NO: 69050 - DNA, 24 bp, Artificial Sequence
  Synthetic oligonucleotide; CTAGAAA chr11 5166189 5166212 5166192 -
ttttctgaccacagtggaataaaa

SEQ ID NO: 69051 - DNA, 24 bp, Artificial Sequence
  Synthetic oligonucleotide; TCAGAAA chr11 5166164 5166187 5166167 -
tagaaatgaataacaagaagatca

SEQ ID NO: 69052 - DNA, 24 bp, Artificial Sequence
  Synthetic oligonucleotide; ATAGAAA chr11 5166155 5166178 5166158 -
ataacaagaagatcatcagaaaat

SEQ ID NO: 69053 - DNA, 24 bp, Artificial Sequence
  Synthetic oligonucleotide; TGAGAAA chr11 5165632 5165655 5165635 -
cctgtcctcctgctctttgctccg

SEQ ID NO: 69054 - DNA, 24 bp, Artificial Sequence
  Synthetic oligonucleotide; CAAGAAA chr11 5165587 5165610 5165590 -
ctcaggtcctcaaactgaccagcc

SEQ ID NO: 69055 - DNA, 24 bp, Artificial Sequence
  Synthetic oligonucleotide; CCAGAAA chr11 5164635 5164658 5164638 -
aaactcgacagtggttccaaatag

SEQ ID NO: 69056 - DNA, 24 bp, Artificial Sequence
  Synthetic oligonucleotide; CCAGAAA chr11 5163739 5163762 5163742 -
tcccccaggagcttgctacaagtg

SEQ ID NO: 69057 - DNA, 24 bp, Artificial Sequence
  Synthetic oligonucleotide; CTAGAAA chr11 5163658 5163681 5163661 -
gtgtcccatctgtgcaggacccca

SEQ ID NO: 69058 - DNA, 24 bp, Artificial Sequence
  Synthetic oligonucleotide; TCAGAAT chr11 5162885 5162908 5162888 -
accagacaagccttacaggttagt

SEQ ID NO: 69059 - DNA, 24 bp, Artificial Sequence
  Synthetic oligonucleotide; TCAGAAT chr11 5162464 5162487 5162467 -
ccttcctaggcatagttagtgcgg

SEQ ID NO: 69060 - DNA, 24 bp, Artificial Sequence
  Synthetic oligonucleotide; GTAGAAA chr11 5161919 5161942 5161922 -
cgaacctctcatttcctttccatc

SEQ ID NO: 69061 - DNA, 24 bp, Artificial Sequence
  Synthetic oligonucleotide; AAAGAAA chr11 5161903 5161926 5161906 -
tttccatcgtagaaatctatcctc

SEQ ID NO: 69062 - DNA, 24 bp, Artificial Sequence
  Synthetic oligonucleotide; TCAGAAT chr11 5161390 5161413 5161393 -
ctttctcagaagtcagacctgtcc

SEQ ID NO: 69063 - DNA, 24 bp, Artificial Sequence
  Synthetic oligonucleotide; TTAGAAT chr11 5161300 5161323 5161303 -
tctaattccagacaccagaccaac

SEQ ID NO: 69064 - DNA, 24 bp, Artificial Sequence
  Synthetic oligonucleotide; TGAGAAA chr11 5160817 5160840 5160820 -
ccctaatcccgctcgaagcagccc

SEQ ID NO: 69065 - DNA, 24 bp, Artificial Sequence
  Synthetic oligonucleotide; AAAGAAA chr11 5160274 5160297 5160277 -
aaactgaataaccaatgagtcact

SEQ ID NO: 69066 - DNA, 24 bp, Artificial Sequence
  Synthetic oligonucleotide; GTAGAAA chr11 5160138 5160161 5160141 -
caataaacacctatatccaaaaaa

SEQ ID NO: 69067 - DNA, 24 bp, Artificial Sequence
  Synthetic oligonucleotide; GGAGAAA chr11 5160051 5160074 5160054 -
accaaatgcaaaattaatagaagg

SEQ ID NO: 69068 - DNA, 24 bp, Artificial Sequence
  Synthetic oligonucleotide; TAAGAAA chr11 5160044 5160067 5160047 -
gcaaaattaatagaaggggagaaa

SEQ ID NO: 69069 - DNA, 24 bp, Artificial Sequence
  Synthetic oligonucleotide; GAAGAAA chr11 5160030 5160053 5160033 -
aggggagaaataagaaagatcaga

SEQ ID NO: 69070 - DNA, 24 bp, Artificial Sequence
  Synthetic oligonucleotide; ACAGAAA chr11 5159999 5160022 5160002 -
caaatgaaattgagaccaaaaaat

SEQ ID NO: 69071 - DNA, 24 bp, Artificial Sequence
  Synthetic oligonucleotide; TAAGAAA chr11 5159936 5159959 5159939 -
aggtaaacaaaatcaacaaaactt

SEQ ID NO: 69072 - DNA, 24 bp, Artificial Sequence
  Synthetic oligonucleotide; TTAGAAA chr11 5159913 5159936 5159916 -
ttaagaaaaaagagtcaaataaaa

SEQ ID NO: 69073 - DNA, 24 bp, Artificial Sequence
  Synthetic oligonucleotide; CTAGAAT chr11 5159814 5159837 5159817 -
ctgtattccaacaaattggaaaat

SEQ ID NO: 69074 - DNA, 24 bp, Artificial Sequence
  Synthetic oligonucleotide; GTAGAAA chr11 5159760 5159783 5159763 -
tacagcctagcaagactgaagcat

SEQ ID NO: 69075 - DNA, 24 bp, Artificial Sequence
  Synthetic oligonucleotide; ACAGAAA chr11 5159754 5159777 5159757 -
ctagcaagactgaagcatgtagaa

SEQ ID NO: 69076 - DNA, 24 bp, Artificial Sequence
  Synthetic oligonucleotide; AAAGAAA chr11 5159689 5159712 5159692 -
agttgtaatataaagtttcctatt

SEQ ID NO: 69077 - DNA, 24 bp, Artificial Sequence
  Synthetic oligonucleotide; AGAGAAA chr11 5159421 5159444 5159424 -
ccaagtgctaacattatgctgaac

SEQ ID NO: 69078 - DNA, 24 bp, Artificial Sequence
  Synthetic oligonucleotide; CAAGAAT chr11 5159379 5159402 5159382 -
tttcctctaaggactgaaataagg

SEQ ID NO: 69079 - DNA, 24 bp, Artificial Sequence
  Synthetic oligonucleotide; AGAGAAA chr11 5159325 5159348 5159328 -
aacataatattggaagtcttggaa

SEQ ID NO: 69080 - DNA, 24 bp, Artificial Sequence
  Synthetic oligonucleotide; AGAGAAA chr11 5159311 5159334 5159314 -
agtcttggaaagagaaattcagga

SEQ ID NO: 69081 - DNA, 24 bp, Artificial Sequence
  Synthetic oligonucleotide; AAAGAAA chr11 5159307 5159330 5159310 -
ttggaaagagaaattcaggaagag

SEQ ID NO: 69082 - DNA, 24 bp, Artificial Sequence
  Synthetic oligonucleotide; TTAGAAA chr11 5159236 5159259 5159239 -
tttgtagatgacatgatcttatac

SEQ ID NO: 69083 - DNA, 24 bp, Artificial Sequence
  Synthetic oligonucleotide; TAAGAAA chr11 5159018 5159041 5159021 -
aacccaagaagtaaaagatctcta

SEQ ID NO: 69084 - DNA, 24 bp, Artificial Sequence
  Synthetic oligonucleotide; AAAGAAA chr11 5158993 5159016 5158996 -
aagaaaaattataaaactctggtg

SEQ ID NO: 69085 - DNA, 24 bp, Artificial Sequence
  Synthetic oligonucleotide; GAAGAAT chr11 5158935 5158958 5158938 -
acgatattccatgctcatgaacta

SEQ ID NO: 69086 - DNA, 24 bp, Artificial Sequence
  Synthetic oligonucleotide; ACAGAAA chr11 5158852 5158875 5158855 -
tctgtcaaaataccaatggcattc

SEQ ID NO: 69087 - DNA, 24 bp, Artificial Sequence
  Synthetic oligonucleotide; ATAGAAA chr11 5158846 5158869 5158849 -
aaaataccaatggcattcacagaa

SEQ ID NO: 69088 - DNA, 24 bp, Artificial Sequence
  Synthetic oligonucleotide; GGAGAAT chr11 5158390 5158413 5158393 -
ccagatactcaggaggctgaggca

SEQ ID NO: 69089 - DNA, 24 bp, Artificial Sequence
  Synthetic oligonucleotide; CAAGAAA chr11 5158261 5158284 5158264 -
aaaaaaaggtacaaacagtctttt

SEQ ID NO: 69090 - DNA, 24 bp, Artificial Sequence
  Synthetic oligonucleotide; GAAGAAA chr11 5158125 5158148 5158128 -
atacctgaaattatgaaactactg

SEQ ID NO: 69091 - DNA, 24 bp, Artificial Sequence
  Synthetic oligonucleotide; AAAGAAA chr11 5157998 5158021 5158001 -
ggattgtttgaagctctgcacagc

SEQ ID NO: 69092 - DNA, 24 bp, Artificial Sequence
  Synthetic oligonucleotide; AAAGAAT chr11 5157968 5157991 5157971 -
aataataaagtgaagagacaaccc

SEQ ID NO: 69093 - DNA, 24 bp, Artificial Sequence
  Synthetic oligonucleotide; GGAGAAA chr11 5157960 5157983 5157963 -
agtgaagagacaacccaaagaatg

SEQ ID NO: 69094 - DNA, 24 bp, Artificial Sequence
  Synthetic oligonucleotide; CCAGAAT chr11 5157916 5157939 5157919 -
atatattttacaaggaattgataa

SEQ ID NO: 69095 - DNA, 24 bp, Artificial Sequence
  Synthetic oligonucleotide; CAAGAAA chr11 5157906 5157929 5157909 -
caaggaattgataaccagaatatg

SEQ ID NO: 69096 - DNA, 24 bp, Artificial Sequence
  Synthetic oligonucleotide; ACAGAAA chr11 5157886 5157909 5157889 -
tatgcaagaaactcaagcaactca

SEQ ID NO: 69097 - DNA, 24 bp, Artificial Sequence
  Synthetic oligonucleotide; AAAGAAT chr11 5157534 5157557 5157537 -
atcactcctaggtatataccctta

SEQ ID NO: 69098 - DNA, 24 bp, Artificial Sequence
  Synthetic oligonucleotide; AAAGAAA chr11 5157420 5157443 5157423 -
gtattcgtcaacagataaatggat

SEQ ID NO: 69099 - DNA, 24 bp, Artificial Sequence
  Synthetic oligonucleotide; AAAGAAT chr11 5157356 5157379 5157359 -
aatggaatattattcaaccataaa

SEQ ID NO: 69100 - DNA, 24 bp, Artificial Sequence
  Synthetic oligonucleotide; ACAGAAA chr11 5157281 5157304 5157284 -
tacgttaagtgaaataagccaagc

SEQ ID NO: 69101 - DNA, 24 bp, Artificial Sequence
  Synthetic oligonucleotide; AAAGAAA chr11 5157277 5157300 5157280 -
ttaagtgaaataagccaagcacag

SEQ ID NO: 69102 - DNA, 24 bp, Artificial Sequence
  Synthetic oligonucleotide; GAAGAAA chr11 5157182 5157205 5157185 -
ttggtagttaccggcggcgggagg

SEQ ID NO: 69103 - DNA, 24 bp, Artificial Sequence
  Synthetic oligonucleotide; TGAGAAA chr11 5157171 5157194 5157174 -
cggcggcgggagggaagaaaggaa

SEQ ID NO: 69104 - DNA, 24 bp, Artificial Sequence
  Synthetic oligonucleotide; GGAGAAT chr11 5156805 5156828 5156808 -
ccacctacttgggaggcttgggca

SEQ ID NO: 69105 - DNA, 24 bp, Artificial Sequence
  Synthetic oligonucleotide; GGAGAAT chr11 5156439 5156462 5156442 -
ccagctactatggaggctgaggcg

SEQ ID NO: 69106 - DNA, 24 bp, Artificial Sequence
  Synthetic oligonucleotide; AAAGAAA chr11 5156339 5156362 5156342 -
cagagagagactctgtctcaaaaa

SEQ ID NO: 69107 - DNA, 24 bp, Artificial Sequence
  Synthetic oligonucleotide; GGAGAAA chr11 5156133 5156156 5156136 -
tgttcctgtgtacttggaacagag

SEQ ID NO: 69108 - DNA, 24 bp, Artificial Sequence
  Synthetic oligonucleotide; TTAGAAT chr11 5156032 5156055 5156035 -
agtcaccagcacatgtgaatagtt

SEQ ID NO: 69109 - DNA, 24 bp, Artificial Sequence
  Synthetic oligonucleotide; GAAGAAA chr11 5155960 5155983 5155963 -
aataaaatcagtataagagaagag

SEQ ID NO: 69110 - DNA, 24 bp, Artificial Sequence
  Synthetic oligonucleotide; AAAGAAT chr11 5155915 5155938 5155918 -
agtctaaattgtttcttagtgaca

SEQ ID NO: 69111 - DNA, 24 bp, Artificial Sequence
  Synthetic oligonucleotide; CAAGAAA chr11 5155667 5155690 5155670 -
tatcaagtgtctcttagctacatt

SEQ ID NO: 69112 - DNA, 24 bp, Artificial Sequence
  Synthetic oligonucleotide; CTAGAAA chr11 5155658 5155681 5155661 -
tctcttagctacattcaagaaagc

SEQ ID NO: 69113 - DNA, 24 bp, Artificial Sequence
  Synthetic oligonucleotide; GGAGAAT chr11 5155633 5155656 5155636 -
tagaaaccagctgtaaaatgtcaa

SEQ ID NO: 69114 - DNA, 24 bp, Artificial Sequence
  Synthetic oligonucleotide; TTAGAAT chr11 5155603 5155626 5155606 -
tagtgtcatatgcataagtcttgc

SEQ ID NO: 69115 - DNA, 24 bp, Artificial Sequence
  Synthetic oligonucleotide; TTAGAAT chr11 5155504 5155527 5155507 -
agactataatttttttcatttcat

SEQ ID NO: 69116 - DNA, 24 bp, Artificial Sequence
  Synthetic oligonucleotide; AAAGAAA chr11 5155449 5155472 5155452 -
taggaatataatgactgttttttg

SEQ ID NO: 69117 - DNA, 24 bp, Artificial Sequence
  Synthetic oligonucleotide; GAAGAAA chr11 5155420 5155443 5155423 -
aaaagaaggaaggaaagtaacaag

SEQ ID NO: 69118 - DNA, 24 bp, Artificial Sequence
  Synthetic oligonucleotide; AGAGAAA chr11 5155412 5155435 5155415 -
gaaggaaagtaacaaggaagaaag

SEQ ID NO: 69119 - DNA, 24 bp, Artificial Sequence
  Synthetic oligonucleotide; TTAGAAA chr11 5155339 5155362 5155342 -
cttccagctttacatttgtaggac

SEQ ID NO: 69120 - DNA, 24 bp, Artificial Sequence
  Synthetic oligonucleotide; TAAGAAT chr11 5155310 5155333 5155313 -
aatgtccattataatttgtcacta

SEQ ID NO: 69121 - DNA, 24 bp, Artificial Sequence
  Synthetic oligonucleotide; GAAGAAT chr11 5155254 5155277 5155257 -
aaaaacttcaataaaataaaatgg

SEQ ID NO: 69122 - DNA, 24 bp, Artificial Sequence
  Synthetic oligonucleotide; AGAGAAA chr11 5155170 5155193 5155173 -
cagatttttcttttctgaataaaa

SEQ ID NO: 69123 - DNA, 24 bp, Artificial Sequence
  Synthetic oligonucleotide; ATAGAAA chr11 5155110 5155133 5155113 -
atatttatttaaataggaattggc

SEQ ID NO: 69124 - DNA, 24 bp, Artificial Sequence
  Synthetic oligonucleotide; TTAGAAT chr11 5155082 5155105 5155085 -
aaacatgtttgcattaaatgggct

SEQ ID NO: 69125 - DNA, 24 bp, Artificial Sequence
  Synthetic oligonucleotide; ATAGAAA chr11 5155068 5155091 5155071 -
taaatgggctttagaattttgcaa

SEQ ID NO: 69126 - DNA, 24 bp, Artificial Sequence
  Synthetic oligonucleotide; GCAGAAA chr11 5155059 5155082 5155062 -
tttagaattttgcaaatagaaatg

SEQ ID NO: 69127 - DNA, 24 bp, Artificial Sequence
  Synthetic oligonucleotide; AGAGAAA chr11 5154989 5155012 5154992 -
attctgcatttagcctgtgggaaa

SEQ ID NO: 69128 - DNA, 24 bp, Artificial Sequence
  Synthetic oligonucleotide; AGAGAAA chr11 5154979 5155002 5154982 -
tagcctgtgggaaaagagaaaaag

SEQ ID NO: 69129 - DNA, 24 bp, Artificial Sequence
  Synthetic oligonucleotide; GTAGAAA chr11 5154956 5154979 5154959 -
gagagaaaggagatttctgcaagt

SEQ ID NO: 69130 - DNA, 24 bp, Artificial Sequence
  Synthetic oligonucleotide; TCAGAAT chr11 5154743 5154766 5154746 -
agctcaataaattcatcccgtgtt

SEQ ID NO: 69131 - DNA, 24 bp, Artificial Sequence
  Synthetic oligonucleotide; ACAGAAA chr11 5154519 5154542 5154522 -
tggatgctgttacacagagtgcag

SEQ ID NO: 69132 - DNA, 24 bp, Artificial Sequence
  Synthetic oligonucleotide; GAAGAAA chr11 5154459 5154482 5154462 -
gggaatgaagctggaatccttgga

SEQ ID NO: 69133 - DNA, 24 bp, Artificial Sequence
  Synthetic oligonucleotide; GAAGAAA chr11 5154134 5154157 5154137 -
attctaattgtgattatctttgga

SEQ ID NO: 69134 - DNA, 24 bp, Artificial Sequence
  Synthetic oligonucleotide; TTAGAAA chr11 5154114 5154137 5154117 -
tggagaagaaaaaatttgccccta

SEQ ID NO: 69135 - DNA, 24 bp, Artificial Sequence
  Synthetic oligonucleotide; AAAGAAT chr11 5153699 5153722 5153702 -
aacaactttattgaagtgtctagg

SEQ ID NO: 69136 - DNA, 24 bp, Artificial Sequence
  Synthetic oligonucleotide; TTAGAAA chr11 5153611 5153634 5153614 -
gtactgattcaaaatatgtaattt

SEQ ID NO: 69137 - DNA, 24 bp, Artificial Sequence
  Synthetic oligonucleotide; TCAGAAA chr11 5153552 5153575 5153555 -
ataaagcataagagcccaggtttt

SEQ ID NO: 69138 - DNA, 24 bp, Artificial Sequence
  Synthetic oligonucleotide; TAAGAAA chr11 5153421 5153444 5153424 -
tctagttctacatttgacttcttc

SEQ ID NO: 69139 - DNA, 24 bp, Artificial Sequence
  Synthetic oligonucleotide; AAAGAAA chr11 5153037 5153060 5153040 -
aaaaatataattccctttaacttt

SEQ ID NO: 69140 - DNA, 24 bp, Artificial Sequence
  Synthetic oligonucleotide; AAAGAAA chr11 5152934 5152957 5152937 -
ctctttacattattctgaatataa

SEQ ID NO: 69141 - DNA, 24 bp, Artificial Sequence
  Synthetic oligonucleotide; AAAGAAA chr11 5152815 5152838 5152818 -
aatttgcttgtctaaaatgttctt

SEQ ID NO: 69142 - DNA, 24 bp, Artificial Sequence
  Synthetic oligonucleotide; AAAGAAA chr11 5152685 5152708 5152688 -
ttttttttttgtccacaggtctgg

SEQ ID NO: 69143 - DNA, 24 bp, Artificial Sequence
  Synthetic oligonucleotide; GGAGAAA chr11 5152452 5152475 5152455 -
agacagactcaatataatgagttt

SEQ ID NO: 69144 - DNA, 24 bp, Artificial Sequence
  Synthetic oligonucleotide; TCAGAAA chr11 5152444 5152467 5152447 -
tcaatataatgagtttggagaaaa

SEQ ID NO: 69145 - DNA, 24 bp, Artificial Sequence
  Synthetic oligonucleotide; TGAGAAA chr11 5152412 5152435 5152415 -
cagaagaggaacagtaacactgac

SEQ ID NO: 69146 - DNA, 24 bp, Artificial Sequence
  Synthetic oligonucleotide; CTAGAAT chr11 5152307 5152330 5152310 -
ttgacactagtagggatcccaggc

SEQ ID NO: 69147 - DNA, 24 bp, Artificial Sequence
  Synthetic oligonucleotide; TAAGAAT chr11 5151166 5151189 5151169 -
tagcccctggttgagttattcttc

SEQ ID NO: 69148 - DNA, 24 bp, Artificial Sequence
  Synthetic oligonucleotide; AAAGAAA chr11 5150981 5151004 5150984 -
gtacatgttaactgtgttcttgtc

SEQ ID NO: 69149 - DNA, 24 bp, Artificial Sequence
  Synthetic oligonucleotide; ACAGAAT chr11 5150769 5150792 5150772 -
ctgcaatattaaaaatactatact

SEQ ID NO: 69150 - DNA, 24 bp, Artificial Sequence
  Synthetic oligonucleotide; AGAGAAA chr11 5150643 5150666 5150646 -
gaatgggcaggcaagggaaagaag

SEQ ID NO: 69151 - DNA, 24 bp, Artificial Sequence
  Synthetic oligonucleotide; AGAGAAT chr11 5150604 5150627 5150607 -
gtacacataggatgtggagttcag

SEQ ID NO: 69152 - DNA, 24 bp, Artificial Sequence
  Synthetic oligonucleotide; TAAGAAT chr11 5150114 5150137 5150117 -
ctatattgtctaaaattagtggca

SEQ ID NO: 69153 - DNA, 24 bp, Artificial Sequence
  Synthetic oligonucleotide; AAAAAC chr11 5150387 5150410 5150407 +
taccttgcactcataccatattga

SEQ ID NO: 69154 - DNA, 24 bp, Artificial Sequence
  Synthetic oligonucleotide; AAAAAC chr11 5150518 5150541 5150538 +
gaatcagaggtaactacctaacca

SEQ ID NO: 69155 - DNA, 24 bp, Artificial Sequence
  Synthetic oligonucleotide; AAAAAC chr11 5150824 5150847 5150844 +
gtaaattttgaggttagcaaaaaa

SEQ ID NO: 69156 - DNA, 24 bp, Artificial Sequence
  Synthetic oligonucleotide; TAAAAC chr11 5151281 5151304 5151301 +
tgattgatatgagccatgatgatc

SEQ ID NO: 69157 - DNA, 24 bp, Artificial Sequence
  Synthetic oligonucleotide; AAAAAC chr11 5151659 5151682 5151679 +
cctagcctccttctggggcaaacg

SEQ ID NO: 69158 - DNA, 24 bp, Artificial Sequence
  Synthetic oligonucleotide; AAAAAC chr11 5153527 5153550 5153547 +
tttcactgatgattgaattttctg

SEQ ID NO: 69159 - DNA, 24 bp, Artificial Sequence
  Synthetic oligonucleotide; TAAAAC chr11 5154687 5154710 5154707 +
catctttgtgtgctcatcccccag

SEQ ID NO: 69160 - DNA, 24 bp, Artificial Sequence
  Synthetic oligonucleotide; CAAAAC chr11 5154851 5154874 5154871 +
atgagggatttcctagttgatagc

SEQ ID NO: 69161 - DNA, 24 bp, Artificial Sequence
  Synthetic oligonucleotide; AAAAAC chr11 5155427 5155450 5155447 +
ctttccttccttctttttctttca

SEQ ID NO: 69162 - DNA, 24 bp, Artificial Sequence
  Synthetic oligonucleotide; TAAAAC chr11 5155808 5155831 5155828 +
cagaatttcctctgtgaaggagca

SEQ ID NO: 69163 - DNA, 24 bp, Artificial Sequence
  Synthetic oligonucleotide; TAAAAC chr11 5156005 5156028 5156025 +
gttctatcttgggtcatttcattc

SEQ ID NO: 69164 - DNA, 24 bp, Artificial Sequence
  Synthetic oligonucleotide; TAAAAC chr11 5160713 5160736 5160733 +
gtcttcttatattaataagaaaaa

SEQ ID NO: 69165 - DNA, 24 bp, Artificial Sequence
  Synthetic oligonucleotide; AAAAAC chr11 5160956 5160979 5160976 +
ctggatacggttttgtatggattg

SEQ ID NO: 69166 - DNA, 24 bp, Artificial Sequence
  Synthetic oligonucleotide; AAAAAC chr11 5160983 5161006 5161003 +
aaccaaatggaataagagaaggag

SEQ ID NO: 69167 - DNA, 24 bp, Artificial Sequence
  Synthetic oligonucleotide; AAAAAC chr11 5161151 5161174 5161171 +
gagatatcagctgtgatggcttgg

SEQ ID NO: 69168 - DNA, 24 bp, Artificial Sequence
  Synthetic oligonucleotide; AAAAAC chr11 5161539 5161562 5161559 +
gttttactgaatactaagagcctg

SEQ ID NO: 69169 - DNA, 24 bp, Artificial Sequence
  Synthetic oligonucleotide; TAAAAC chr11 5162366 5162389 5162386 +
tgcatgcagacctgagggctaggc

SEQ ID NO: 69170 - DNA, 24 bp, Artificial Sequence
  Synthetic oligonucleotide; CAAAAC chr11 5162827 5162850 5162847 +
gtttggcaccatggggtggatagg

SEQ ID NO: 69171 - DNA, 24 bp, Artificial Sequence
  Synthetic oligonucleotide; GAAAAC chr11 5163155 5163178 5163175 +
tgtgaaggaggctttgaactgggg

SEQ ID NO: 69172 - DNA, 24 bp, Artificial Sequence
  Synthetic oligonucleotide; TAAAAC chr11 5165383 5165406 5165403 +
gcaccggagttttgggtccacgga

SEQ ID NO: 69173 - DNA, 24 bp, Artificial Sequence
  Synthetic oligonucleotide; AAAAAC chr11 5167109 5167132 5167129 +
aaataaaggaatataaacaagggc

SEQ ID NO: 69174 - DNA, 24 bp, Artificial Sequence
  Synthetic oligonucleotide; TAAAAC chr11 5167756 5167779 5167776 +
acacttagaatgaataatatgtaa

SEQ ID NO: 69175 - DNA, 24 bp, Artificial Sequence
  Synthetic oligonucleotide; GAAAAC chr11 5167942 5167965 5167962 +
ccccttttataaagatcctcttga

SEQ ID NO: 69176 - DNA, 24 bp, Artificial Sequence
  Synthetic oligonucleotide; GAAAAC chr11 5168988 5169011 5169008 +
ttaagtccataaattaatttcgag

SEQ ID NO: 69177 - DNA, 24 bp, Artificial Sequence
  Synthetic oligonucleotide; GAAAAC chr11 5169147 5169170 5169167 +
catggaaattcaaaattatctgaa

SEQ ID NO: 69178 - DNA, 24 bp, Artificial Sequence
  Synthetic oligonucleotide; TAAAAC chr11 5169318 5169341 5169338 +
ttctgttttttagttattttcttc

SEQ ID NO: 69179 - DNA, 24 bp, Artificial Sequence
  Synthetic oligonucleotide; CAAAAC chr11 5169759 5169782 5169779 +
agctgtaccgttttgacaaattga

SEQ ID NO: 69180 - DNA, 24 bp, Artificial Sequence
  Synthetic oligonucleotide; TAAAAC chr11 5170178 5170201 5170198 +
atttcctattctcagggaaatata

SEQ ID NO: 69181 - DNA, 24 bp, Artificial Sequence
  Synthetic oligonucleotide; GAAAAC chr11 5170964 5170987 5170984 +
tccataagagtgaaagagtgcata

SEQ ID NO: 69182 - DNA, 24 bp, Artificial Sequence
  Synthetic oligonucleotide; CAAAAC chr11 5170989 5171012 5171009 +
aaaacatctggagcaggcaaccac

SEQ ID NO: 69183 - DNA, 24 bp, Artificial Sequence
  Synthetic oligonucleotide; GAAAAC chr11 5171270 5171293 5171290 +
aggtgtgaatgttatggaacgttt

SEQ ID NO: 69184 - DNA, 24 bp, Artificial Sequence
  Synthetic oligonucleotide; AAAAAC chr11 5171556 5171579 5171576 +
caagttgggtcatctatggcagtg

SEQ ID NO: 69185 - DNA, 24 bp, Artificial Sequence
  Synthetic oligonucleotide; CAAAAC chr11 5172775 5172798 5172795 +
cataagaacatgccaatgtcaatg

SEQ ID NO: 69186 - DNA, 24 bp, Artificial Sequence
  Synthetic oligonucleotide; CAAAAC chr11 5172907 5172930 5172927 +
aattttttcatacacaatcattta

SEQ ID NO: 69187 - DNA, 24 bp, Artificial Sequence
  Synthetic oligonucleotide; AAAAAC chr11 5173751 5173774 5173771 +
atgtatgaaaaagtcctacaactc

SEQ ID NO: 69188 - DNA, 24 bp, Artificial Sequence
  Synthetic oligonucleotide; CAAAAC chr11 5173857 5173880 5173877 +
aacattggcacataaaatgcaaac

SEQ ID NO: 69189 - DNA, 24 bp, Artificial Sequence
  Synthetic oligonucleotide; CAAAAC chr11 5173915 5173938 5173935 +
agaatgtctatactttaagagaaa

SEQ ID NO: 69190 - DNA, 24 bp, Artificial Sequence
  Synthetic oligonucleotide; AAAAAC chr11 5174034 5174057 5174054 +
tagaaaatattttgacagttcttc

SEQ ID NO: 69191 - DNA, 24 bp, Artificial Sequence
  Synthetic oligonucleotide; TAAAAC chr11 5174335 5174358 5174355 +
atggcaactttaagtgaaatgatg

SEQ ID NO: 69192 - DNA, 24 bp, Artificial Sequence
  Synthetic oligonucleotide; CAAAAC chr11 5174535 5174558 5174555 +
atgttgggtaaaataagccagaca

SEQ ID NO: 69193 - DNA, 24 bp, Artificial Sequence
  Synthetic oligonucleotide; TAAAAC chr11 5174847 5174870 5174867 +
tcacaataaaaatggaaagaaatt

SEQ ID NO: 69194 - DNA, 24 bp, Artificial Sequence
  Synthetic oligonucleotide; TAAAAC chr11 5175257 5175280 5175277 +
ttcctattggttcttgcagttgca

SEQ ID NO: 69195 - DNA, 24 bp, Artificial Sequence
  Synthetic oligonucleotide; TAAAAC chr11 5175467 5175490 5175487 +
tgatattaactaagacctcagtta

SEQ ID NO: 69196 - DNA, 24 bp, Artificial Sequence
  Synthetic oligonucleotide; CAAAAC chr11 5175620 5175643 5175640 +
atatcagttttagctaagtgcttc

SEQ ID NO: 69197 - DNA, 24 bp, Artificial Sequence
  Synthetic oligonucleotide; GAAAAC chr11 5175832 5175855 5175852 +
ctggttaaggagacagtagaacat

SEQ ID NO: 69198 - DNA, 24 bp, Artificial Sequence
  Synthetic oligonucleotide; CAAAAC chr11 5176269 5176292 5176289 +
gtgtaaatttcacattagaatgtc

SEQ ID NO: 69199 - DNA, 24 bp, Artificial Sequence
  Synthetic oligonucleotide; AAAAAC chr11 5176293 5176316 5176313 +
caaaacattgtgtagagtagaaaa

SEQ ID NO: 69200 - DNA, 24 bp, Artificial Sequence
  Synthetic oligonucleotide; CAAAAC chr11 5177401 5177424 5177421 +
ctataaaaagcccagtgactgact

SEQ ID NO: 69201 - DNA, 24 bp, Artificial Sequence
  Synthetic oligonucleotide; CAAAAC chr11 5177561 5177584 5177581 +
atttcattaaagtatttttttttt

SEQ ID NO: 69202 - DNA, 24 bp, Artificial Sequence
  Synthetic oligonucleotide; TAAAAC chr11 5177671 5177694 5177691 +
atggattgtatttattctattccc

SEQ ID NO: 69203 - DNA, 24 bp, Artificial Sequence
  Synthetic oligonucleotide; AAAAAC chr11 5178982 5179005 5179002 +
tactattatttctacagatgtaaa

SEQ ID NO: 69204 - DNA, 24 bp, Artificial Sequence
  Synthetic oligonucleotide; TAAAAC chr11 5179093 5179116 5179113 +
accatccaatgctgcctatcaagg

SEQ ID NO: 69205 - DNA, 24 bp, Artificial Sequence
  Synthetic oligonucleotide; TAAAAC chr11 5179105 5179128 5179125 +
tgcctatcaaggtaaaactagata

SEQ ID NO: 69206 - DNA, 24 bp, Artificial Sequence
  Synthetic oligonucleotide; TAAAAC chr11 5179354 5179377 5179374 +
aatctatttctcaaaaatatagga

SEQ ID NO: 69207 - DNA, 24 bp, Artificial Sequence
  Synthetic oligonucleotide; CAAAAC chr11 5179511 5179534 5179531 +
tcaggagttccagaccagcttgac

SEQ ID NO: 69208 - DNA, 24 bp, Artificial Sequence
  Synthetic oligonucleotide; AAAAAC chr11 5182586 5182609 5182606 +
gaaacaaccagtaccagccactgc

SEQ ID NO: 69209 - DNA, 24 bp, Artificial Sequence
  Synthetic oligonucleotide; GAAAAC chr11 5182868 5182891 5182888 +
ggaggaagatctaccaagcaaatg

SEQ ID NO: 69210 - DNA, 24 bp, Artificial Sequence
  Synthetic oligonucleotide; TAAAAC chr11 5182909 5182932 5182929 +
agggtttgcaatcttagtctctga

SEQ ID NO: 69211 - DNA, 24 bp, Artificial Sequence
  Synthetic oligonucleotide; CAAAAC chr11 5183397 5183420 5183417 +
gaactcaggattaagaaactcact

SEQ ID NO: 69212 - DNA, 24 bp, Artificial Sequence
  Synthetic oligonucleotide; CAAAAC chr11 5183515 5183538 5183535 +
aaaccaacgagaataaagatacaa

SEQ ID NO: 69213 - DNA, 24 bp, Artificial Sequence
  Synthetic oligonucleotide; AAAAAC chr11 5183726 5183749 5183746 +
agaagtgaaggagattgagacaca

SEQ ID NO: 69214 - DNA, 24 bp, Artificial Sequence
  Synthetic oligonucleotide; TAAAAC chr11 5184119 5184142 5184139 +
aagtaatttaatgttttcacatta

SEQ ID NO: 69215 - DNA, 24 bp, Artificial Sequence
  Synthetic oligonucleotide; GAAAAC chr11 5185026 5185049 5185046 +
acaggaatgaagataagggggaaa

SEQ ID NO: 69216 - DNA, 24 bp, Artificial Sequence
  Synthetic oligonucleotide; TAAAAC chr11 5185116 5185139 5185136 +
atttgtttgtttttttgtttttcc

SEQ ID NO: 69217 - DNA, 24 bp, Artificial Sequence
  Synthetic oligonucleotide; GAAAAC chr11 5186026 5186049 5186046 +
gcattatttaaacatattctaaga

SEQ ID NO: 69218 - DNA, 24 bp, Artificial Sequence
  Synthetic oligonucleotide; AAAAAC chr11 5186878 5186901 5186898 +
aaataccatgatattcatggaatt

SEQ ID NO: 69219 - DNA, 24 bp, Artificial Sequence
  Synthetic oligonucleotide; TAAAAC chr11 5187015 5187038 5187035 +
agaagcttttttcacctatagtag

SEQ ID NO: 69220 - DNA, 24 bp, Artificial Sequence
  Synthetic oligonucleotide; TAAAAC chr11 5187038 5187061 5187058 +
gtaaaacttagtaaaaaaaaatag

SEQ ID NO: 69221 - DNA, 24 bp, Artificial Sequence
  Synthetic oligonucleotide; TAAAAC chr11 5187538 5187561 5187558 +
taatgtttttaaatctggggactc

SEQ ID NO: 69222 - DNA, 24 bp, Artificial Sequence
  Synthetic oligonucleotide; TAAAAC chr11 5187664 5187687 5187684 +
gatacaagtaccatgttactactt

SEQ ID NO: 69223 - DNA, 24 bp, Artificial Sequence
  Synthetic oligonucleotide; TAAAAC chr11 5188575 5188598 5188595 +
gaatgctatccaacacaactttct

SEQ ID NO: 69224 - DNA, 24 bp, Artificial Sequence
  Synthetic oligonucleotide; GAAAAC chr11 5190058 5190081 5190078 +
aattatctgctcggccatgtggta

SEQ ID NO: 69225 - DNA, 24 bp, Artificial Sequence
  Synthetic oligonucleotide; TAAAAC chr11 5191047 5191070 5191067 +
catgtgcaagggaaatgcccttta

SEQ ID NO: 69226 - DNA, 24 bp, Artificial Sequence
  Synthetic oligonucleotide; AAAAAC chr11 5191099 5191122 5191119 +
tcactatcatgagaacagcatgtg

SEQ ID NO: 69227 - DNA, 24 bp, Artificial Sequence
  Synthetic oligonucleotide; GAAAAC chr11 5191195 5191218 5191215 +
ctattcaagaagaaatttgggtgg

SEQ ID NO: 69228 - DNA, 24 bp, Artificial Sequence
  Synthetic oligonucleotide; GAAAAC chr11 5191926 5191949 5191946 +
tcaggtatttttttacagcagtgt

SEQ ID NO: 69229 - DNA, 24 bp, Artificial Sequence
  Synthetic oligonucleotide; AAAAAC chr11 5194715 5194738 5194735 +
tctcagtaaactatcgcaaggacg

SEQ ID NO: 69230 - DNA, 24 bp, Artificial Sequence
  Synthetic oligonucleotide; TAAAAC chr11 5194945 5194968 5194965 +
cctgcacattgtgcacatgtaccc

SEQ ID NO: 69231 - DNA, 24 bp, Artificial Sequence
  Synthetic oligonucleotide; AAAAAC chr11 5196436 5196459 5196456 +
tccacaaaagcagtccctggtacc

SEQ ID NO: 69232 - DNA, 24 bp, Artificial Sequence
  Synthetic oligonucleotide; AAAAAC chr11 5196508 5196531 5196528 +
tattattagcagatcatttttact

SEQ ID NO: 69233 - DNA, 24 bp, Artificial Sequence
  Synthetic oligonucleotide; GAAAAC chr11 5196934 5196957 5196954 +
tcagctgttgttgcctaattcatg

SEQ ID NO: 69234 - DNA, 24 bp, Artificial Sequence
  Synthetic oligonucleotide; CAAAAC chr11 5197010 5197033 5197030 +
ccacctggctactatgtagctttt

SEQ ID NO: 69235 - DNA, 24 bp, Artificial Sequence
  Synthetic oligonucleotide; CAAAAC chr11 5197156 5197179 5197176 +
attgcttccagatagaggcctttg

SEQ ID NO: 69236 - DNA, 24 bp, Artificial Sequence
  Synthetic oligonucleotide; GAAAAC chr11 5197613 5197636 5197633 +
atgcttccctatgagtggctggtg

SEQ ID NO: 69237 - DNA, 24 bp, Artificial Sequence
  Synthetic oligonucleotide; TAAAAC chr11 5197800 5197823 5197820 +
agcagctaacttctcttttcatta

SEQ ID NO: 69238 - DNA, 24 bp, Artificial Sequence
  Synthetic oligonucleotide; TAAAAC chr11 5198712 5198735 5198732 +
atacctaatagaatataggaagat

SEQ ID NO: 69239 - DNA, 24 bp, Artificial Sequence
  Synthetic oligonucleotide; GAAAAC chr11 5199394 5199417 5199414 +
ttcaagttttctactttgaaactt

SEQ ID NO: 69240 - DNA, 24 bp, Artificial Sequence
  Synthetic oligonucleotide; CAAAAC chr11 5199857 5199880 5199877 +
gggccacgggggaaaggtgcttgc

SEQ ID NO: 69241 - DNA, 24 bp, Artificial Sequence
  Synthetic oligonucleotide; AAAAAC chr11 5200190 5200213 5200210 +
agatgatggggggtgtaataaaga

SEQ ID NO: 69242 - DNA, 24 bp, Artificial Sequence
  Synthetic oligonucleotide; TAAAAC chr11 5200468 5200491 5200488 +
gtgagggccagcatggacaggaag

SEQ ID NO: 69243 - DNA, 24 bp, Artificial Sequence
  Synthetic oligonucleotide; TAAAAC chr11 5200752 5200775 5200772 +
aatttctaagtaaatgaaataccc

SEQ ID NO: 69244 - DNA, 24 bp, Artificial Sequence
  Synthetic oligonucleotide; AAAAAC chr11 5200771 5200794 5200791 +
taccctaaaacttactgacttaaa

SEQ ID NO: 69245 - DNA, 24 bp, Artificial Sequence
  Synthetic oligonucleotide; AAAAAC chr11 5200907 5200930 5200927 +
aacatatccttagaagccataagc

SEQ ID NO: 69246 - DNA, 24 bp, Artificial Sequence
  Synthetic oligonucleotide; TAAAAC chr11 5202090 5202113 5202110 +
tcctcaatttcttcctaccctttt

SEQ ID NO: 69247 - DNA, 24 bp, Artificial Sequence
  Synthetic oligonucleotide; TAAAAC chr11 5202188 5202211 5202208 +
ttggtatcatgtttcaattttaaa

SEQ ID NO: 69248 - DNA, 24 bp, Artificial Sequence
  Synthetic oligonucleotide; AAAAAC chr11 5202851 5202874 5202871 +
ctaaatcacacaaacctttgttga

SEQ ID NO: 69249 - DNA, 24 bp, Artificial Sequence
  Synthetic oligonucleotide; CAAAAC chr11 5203013 5203036 5203033 +
atatttaggtatctttatcttcct

SEQ ID NO: 69250 - DNA, 24 bp, Artificial Sequence
  Synthetic oligonucleotide; TAAAAC chr11 5203543 5203566 5203563 +
catataccaagtttgaatggttta

SEQ ID NO: 69251 - DNA, 24 bp, Artificial Sequence
  Synthetic oligonucleotide; TAAAAC chr11 5203834 5203857 5203854 +
aaaatggtgaaaccctgtctctac

SEQ ID NO: 69252 - DNA, 24 bp, Artificial Sequence
  Synthetic oligonucleotide; AAAAAC chr11 5204291 5204314 5204311 +
aggtaaataaatgaagatttaaag

SEQ ID NO: 69253 - DNA, 24 bp, Artificial Sequence
  Synthetic oligonucleotide; AAAAAC chr11 5204340 5204363 5204360 +
tgccagatgctccacctgtattta

SEQ ID NO: 69254 - DNA, 24 bp, Artificial Sequence
  Synthetic oligonucleotide; TAAAAC chr11 5204614 5204637 5204634 +
gagtcttttctgatgccctctgat

SEQ ID NO: 69255 - DNA, 24 bp, Artificial Sequence
  Synthetic oligonucleotide; TAAAAC chr11 5204796 5204819 5204816 +
agcttctttataattctatagaac

SEQ ID NO: 69256 - DNA, 24 bp, Artificial Sequence
  Synthetic oligonucleotide; GAAAAC chr11 5205787 5205810 5205807 +
actggtaaacactgaatgaaagaa

SEQ ID NO: 69257 - DNA, 24 bp, Artificial Sequence
  Synthetic oligonucleotide; AAAAAC chr11 5205836 5205859 5205856 +
aggttacaaataaatttatatttt

SEQ ID NO: 69258 - DNA, 24 bp, Artificial Sequence
  Synthetic oligonucleotide; TAAAAC chr11 5206118 5206141 5206138 +
tcactatgcagtgtgagagatcac

SEQ ID NO: 69259 - DNA, 24 bp, Artificial Sequence
  Synthetic oligonucleotide; TAAAAC chr11 5206297 5206320 5206317 +
gttaaatttatgaggataaataat

SEQ ID NO: 69260 - DNA, 24 bp, Artificial Sequence
  Synthetic oligonucleotide; CAAAAC chr11 5208220 5208243 5208240 +
aggcatagagaagtaacttatcct

SEQ ID NO: 69261 - DNA, 24 bp, Artificial Sequence
  Synthetic oligonucleotide; AAAAAC chr11 5208424 5208447 5208444 +
cagggaatacctgagaggaaaaaa

SEQ ID NO: 69262 - DNA, 24 bp, Artificial Sequence
  Synthetic oligonucleotide; AAAAAC chr11 5208593 5208616 5208613 +
attgttggtatgatgataatatat

SEQ ID NO: 69263 - DNA, 24 bp, Artificial Sequence
  Synthetic oligonucleotide; AAAAAC chr11 5210160 5210183 5210180 +
aaattgctcctggctacatcccag

SEQ ID NO: 69264 - DNA, 24 bp, Artificial Sequence
  Synthetic oligonucleotide; TAAAAC chr11 5211281 5211304 5211301 +
attaaattactttcataatgcgca

SEQ ID NO: 69265 - DNA, 24 bp, Artificial Sequence
  Synthetic oligonucleotide; AAAAAC chr11 5211304 5211327 5211324 +
ataaaacaacattttgttagactt

SEQ ID NO: 69266 - DNA, 24 bp, Artificial Sequence
  Synthetic oligonucleotide; GAAAAC chr11 5213494 5213517 5213514 +
tgactatggtgttttctagataca

SEQ ID NO: 69267 - DNA, 24 bp, Artificial Sequence
  Synthetic oligonucleotide; TAAAAC chr11 5214276 5214299 5214296 +
tcctggttcagccttgggaggacc

SEQ ID NO: 69268 - DNA, 24 bp, Artificial Sequence
  Synthetic oligonucleotide; GAAAAC chr11 5214370 5214393 5214390 +
agatttcaagactaatgaatagct

SEQ ID NO: 69269 - DNA, 24 bp, Artificial Sequence
  Synthetic oligonucleotide; GAAAAC chr11 5214433 5214456 5214453 +
ctgaatgaattttgggtaaataat

SEQ ID NO: 69270 - DNA, 24 bp, Artificial Sequence
  Synthetic oligonucleotide; TAAAAC chr11 5214689 5214712 5214709 +
agatcaaagctaactgaaggatat

SEQ ID NO: 69271 - DNA, 24 bp, Artificial Sequence
  Synthetic oligonucleotide; AAAAAC chr11 5214869 5214892 5214889 +
cccacagaaatacaaataatcatc

SEQ ID NO: 69272 - DNA, 24 bp, Artificial Sequence
  Synthetic oligonucleotide; CAAAAC chr11 5215307 5215330 5215327 +
tgttggagaatatcatcaccgtaa

SEQ ID NO: 69273 - DNA, 24 bp, Artificial Sequence
  Synthetic oligonucleotide; AAAAAC chr11 5215729 5215752 5215749 +
gctttgagattgttctggttcatg

SEQ ID NO: 69274 - DNA, 24 bp, Artificial Sequence
  Synthetic oligonucleotide; GAAAAC chr11 5215899 5215922 5215919 +
gttgaaggaatgttaactgactga

SEQ ID NO: 69275 - DNA, 24 bp, Artificial Sequence
  Synthetic oligonucleotide; AAAAAC chr11 5218902 5218925 5218922 +
tatcaattttgttgatcttttcaa

SEQ ID NO: 69276 - DNA, 24 bp, Artificial Sequence
  Synthetic oligonucleotide; CAAAAC chr11 5222940 5222963 5222960 +
atgttagaaatgaagaaaagcatg

SEQ ID NO: 69277 - DNA, 24 bp, Artificial Sequence
  Synthetic oligonucleotide; TAAAAC chr11 5223009 5223032 5223029 +
aataacactagaaaatctagggag

SEQ ID NO: 69278 - DNA, 24 bp, Artificial Sequence
  Synthetic oligonucleotide; CAAAAC chr11 5223655 5223678 5223675 +
gcactccagcctggacaacaagag

SEQ ID NO: 69279 - DNA, 24 bp, Artificial Sequence
  Synthetic oligonucleotide; AAAAAC chr11 5224238 5224261 5224258 +
cctttgcttctcatatcaaattca

SEQ ID NO: 69280 - DNA, 24 bp, Artificial Sequence
  Synthetic oligonucleotide; TAAAAC chr11 5225039 5225062 5225059 +
aggcgaggagaaaccatctcgccg

SEQ ID NO: 69281 - DNA, 24 bp, Artificial Sequence
  Synthetic oligonucleotide; TAAAAC chr11 5225162 5225185 5225182 +
tgaaaagacattcatgaggacagc

SEQ ID NO: 69282 - DNA, 24 bp, Artificial Sequence
  Synthetic oligonucleotide; CAAAAC chr11 5225194 5225217 5225214 +
taagtaatgtaaaatacagcatag

SEQ ID NO: 69283 - DNA, 24 bp, Artificial Sequence
  Synthetic oligonucleotide; TAAAAC chr11 5226101 5226124 5226121 +
tttggtcaatatgtgtacacatat

SEQ ID NO: 69284 - DNA, 24 bp, Artificial Sequence
  Synthetic oligonucleotide; GAAAAC chr11 5226370 5226393 5226390 +
aaagaaagcaagaattaaacaaaa

SEQ ID NO: 69285 - DNA, 24 bp, Artificial Sequence
  Synthetic oligonucleotide; TAAAAC chr11 5226405 5226428 5226425 +
ttatgaacagcaaataaaagaaac

SEQ ID NO: 69286 - DNA, 24 bp, Artificial Sequence
  Synthetic oligonucleotide; GAAAAC chr11 5226525 5226548 5226545 +
ttaaccatagaaaagaaggggaaa

SEQ ID NO: 69287 - DNA, 24 bp, Artificial Sequence
  Synthetic oligonucleotide; AAAAAC chr11 5227283 5227306 5227303 +
ataccatcagtacaaattgctact

SEQ ID NO: 69288 - DNA, 24 bp, Artificial Sequence
  Synthetic oligonucleotide; GAAAAC chr11 5227502 5227525 5227522 +
aaatacttacaggacagaatggat

SEQ ID NO: 69289 - DNA, 24 bp, Artificial Sequence
  Synthetic oligonucleotide; TAAAAC chr11 5227547 5227570 5227567 +
agcatatcttctccttatttggat

SEQ ID NO: 69290 - DNA, 24 bp, Artificial Sequence
  Synthetic oligonucleotide; AAAAAC chr11 5227753 5227776 5227773 +
ttaggttttgggaaacaagagata

SEQ ID NO: 69291 - DNA, 24 bp, Artificial Sequence
  Synthetic oligonucleotide; AAAAAC chr11 5228188 5228211 5228208 +
actaaattaactcctcaggtgagg

SEQ ID NO: 69292 - DNA, 24 bp, Artificial Sequence
  Synthetic oligonucleotide; TAAAAC chr11 5228238 5228261 5228258 +
cttcctgctattaaaagatgtaat

SEQ ID NO: 69293 - DNA, 24 bp, Artificial Sequence
  Synthetic oligonucleotide; TAAAAC chr11 5228459 5228482 5228479 +
aaaataaaataaaataaaataaaa

SEQ ID NO: 69294 - DNA, 24 bp, Artificial Sequence
  Synthetic oligonucleotide; AAAAAC chr11 5228806 5228829 5228826 +
tctttttatattcattcctctgta

SEQ ID NO: 69295 - DNA, 24 bp, Artificial Sequence
  Synthetic oligonucleotide; TAAAAC chr11 5228906 5228929 5228926 +
acgtctttaaaatattttaaatgt

SEQ ID NO: 69296 - DNA, 24 bp, Artificial Sequence
  Synthetic oligonucleotide; AAAAAC chr11 5229580 5229603 5229600 +
ctaaatcagcattcaaagttcctg

SEQ ID NO: 69297 - DNA, 24 bp, Artificial Sequence
  Synthetic oligonucleotide; GAAAAC chr11 5230138 5230161 5230158 +
taaaatgaaataaaaatgctccaa

SEQ ID NO: 69298 - DNA, 24 bp, Artificial Sequence
  Synthetic oligonucleotide; AAAAAC chr11 5230733 5230756 5230753 +
aaagcaacgccatagtgagaaaag

SEQ ID NO: 69299 - DNA, 24 bp, Artificial Sequence
  Synthetic oligonucleotide; GAAAAC chr11 5231578 5231601 5231598 +
gcctactatgtataatgacttaag

SEQ ID NO: 69300 - DNA, 24 bp, Artificial Sequence
  Synthetic oligonucleotide; CAAAAC chr11 5231634 5231657 5231654 +
ccagtcaattcaaaatgttgtgat

SEQ ID NO: 69301 - DNA, 24 bp, Artificial Sequence
  Synthetic oligonucleotide; CAAAAC chr11 5233175 5233198 5233195 +
atttttttctgcccaaatcttaga

SEQ ID NO: 69302 - DNA, 24 bp, Artificial Sequence
  Synthetic oligonucleotide; TAAAAC chr11 5233591 5233614 5233611 +
tattgtaaaatgatttatagcctc

SEQ ID NO: 69303 - DNA, 24 bp, Artificial Sequence
  Synthetic oligonucleotide; GAAAAC chr11 5234200 5234223 5234220 +
agaccaccagtaatctgagggtag

SEQ ID NO: 69304 - DNA, 24 bp, Artificial Sequence
  Synthetic oligonucleotide; GAAAAC chr11 5234798 5234821 5234818 +
tttgtttctgtcactttatactaa

SEQ ID NO: 69305 - DNA, 24 bp, Artificial Sequence
  Synthetic oligonucleotide; TAAAAC chr11 5234969 5234992 5234989 +
tcttttggtaaattcttcctataa

SEQ ID NO: 69306 - DNA, 24 bp, Artificial Sequence
  Synthetic oligonucleotide; GAAAAC chr11 5235738 5235761 5235758 +
ctgtacaatagtataacccctttg

SEQ ID NO: 69307 - DNA, 24 bp, Artificial Sequence
  Synthetic oligonucleotide; AAAAAC chr11 5235877 5235900 5235897 +
aatgcttatgacagcaataatcat

SEQ ID NO: 69308 - DNA, 24 bp, Artificial Sequence
  Synthetic oligonucleotide; GAAAAC chr11 5237420 5237443 5237440 +
agtagctatctaatgactaaaatg

SEQ ID NO: 69309 - DNA, 24 bp, Artificial Sequence
  Synthetic oligonucleotide; AAAAAC chr11 5239503 5239526 5239523 +
gagcagattaagtacattagtagg

SEQ ID NO: 69310 - DNA, 24 bp, Artificial Sequence
  Synthetic oligonucleotide; GAAAAC chr11 5239999 5240022 5240019 +
gtgttttccactaaaggtgaatgt

SEQ ID NO: 69311 - DNA, 24 bp, Artificial Sequence
  Synthetic oligonucleotide; TAAAAC chr11 5240427 5240450 5240447 +
gagaagaaagggtattatatcttc

SEQ ID NO: 69312 - DNA, 24 bp, Artificial Sequence
  Synthetic oligonucleotide; CAAAAC chr11 5240893 5240916 5240913 +
caagaaacttcagtgatttttgct

SEQ ID NO: 69313 - DNA, 24 bp, Artificial Sequence
  Synthetic oligonucleotide; AAAAAC chr11 5241178 5241201 5241198 +
aaagagaataaaatcactaccact

SEQ ID NO: 69314 - DNA, 24 bp, Artificial Sequence
  Synthetic oligonucleotide; TAAAAC chr11 5241186 5241209 5241206 +
taaaatcactaccactaaaaacaa

SEQ ID NO: 69315 - DNA, 24 bp, Artificial Sequence
  Synthetic oligonucleotide; GAAAAC chr11 5241396 5241419 5241416 +
agaggtagcagatgaagtacagat

SEQ ID NO: 69316 - DNA, 24 bp, Artificial Sequence
  Synthetic oligonucleotide; AAAAAC chr11 5241712 5241735 5241732 +
acctccattgacctccctttctgt

SEQ ID NO: 69317 - DNA, 24 bp, Artificial Sequence
  Synthetic oligonucleotide; CAAAAC chr11 5242194 5242217 5242214 +
aaaatcctcgctgaagtgggttgc

SEQ ID NO: 69318 - DNA, 24 bp, Artificial Sequence
  Synthetic oligonucleotide; AAAAAC chr11 5242808 5242831 5242828 +
atctcaacttctgttccctcatcc

SEQ ID NO: 69319 - DNA, 24 bp, Artificial Sequence
  Synthetic oligonucleotide; CAAAAC chr11 5243258 5243281 5243278 +
ttgcacagtcagagcccagatatc

SEQ ID NO: 69320 - DNA, 24 bp, Artificial Sequence
  Synthetic oligonucleotide; GAAAAC chr11 5244536 5244559 5244556 +
agaaacaaactagggaagtaaggg

SEQ ID NO: 69321 - DNA, 24 bp, Artificial Sequence
  Synthetic oligonucleotide; CAAAAC chr11 5245240 5245263 5245260 +
tttgtagtgacaaacagtttgagg

SEQ ID NO: 69322 - DNA, 24 bp, Artificial Sequence
  Synthetic oligonucleotide; TAAAAC chr11 5245385 5245408 5245405 +
tcaggtcatgtcctttaatggccc

SEQ ID NO: 69323 - DNA, 24 bp, Artificial Sequence
  Synthetic oligonucleotide; TAAAAC chr11 5245449 5245472 5245469 +
ctcatatccttaggtacatacatc

SEQ ID NO: 69324 - DNA, 24 bp, Artificial Sequence
  Synthetic oligonucleotide; AAAAAC chr11 5246126 5246149 5246146 +
ccagatggattagagacttaaatg

SEQ ID NO: 69325 - DNA, 24 bp, Artificial Sequence
  Synthetic oligonucleotide; AAAAAC chr11 5246411 5246434 5246431 +
acttaaacaactttacaagaaaaa

SEQ ID NO: 69326 - DNA, 24 bp, Artificial Sequence
  Synthetic oligonucleotide; TAAAAC chr11 5246421 5246444 5246441 +
ctttacaagaaaaaaaaaacccat

SEQ ID NO: 69327 - DNA, 24 bp, Artificial Sequence
  Synthetic oligonucleotide; TAAAAC chr11 5246446 5246469 5246466 +
aaaaccatggcacacttttaccta

SEQ ID NO: 69328 - DNA, 24 bp, Artificial Sequence
  Synthetic oligonucleotide; CAAAAC chr11 5246578 5246601 5246598 +
taaaaagagaaggcataaataatc

SEQ ID NO: 69329 - DNA, 24 bp, Artificial Sequence
  Synthetic oligonucleotide; AAAAAC chr11 5246709 5246732 5246729 +
tcaagaaatttgctttgacttaaa

SEQ ID NO: 69330 - DNA, 24 bp, Artificial Sequence
  Synthetic oligonucleotide; AAAAAC chr11 5246716 5246739 5246736 +
atttgctttgacttaaaaaaaaca

SEQ ID NO: 69331 - DNA, 24 bp, Artificial Sequence
  Synthetic oligonucleotide; CAAAAC chr11 5247103 5247126 5247123 +
gataaacatggtctgtagtccact

SEQ ID NO: 69332 - DNA, 24 bp, Artificial Sequence
  Synthetic oligonucleotide; CAAAAC chr11 5247962 5247985 5247982 +
cactgaaccttttcccatctcttc

SEQ ID NO: 69333 - DNA, 24 bp, Artificial Sequence
  Synthetic oligonucleotide; CAAAAC chr11 5248434 5248457 5248454 +
gaattctttgccgaaatggattgc

SEQ ID NO: 69334 - DNA, 24 bp, Artificial Sequence
  Synthetic oligonucleotide; TAAAAC chr11 5249038 5249061 5249058 +
tgtcctgcctccagatagatgttt

SEQ ID NO: 69335 - DNA, 24 bp, Artificial Sequence
  Synthetic oligonucleotide; TAAAAC chr11 5249177 5249200 5249197 +
tttttagaggcactccttaggccc

SEQ ID NO: 69336 - DNA, 24 bp, Artificial Sequence
  Synthetic oligonucleotide; GAAAAC chr11 5250421 5250444 5250441 +
ctcttaatttctcaatagtgcagt

SEQ ID NO: 69337 - DNA, 24 bp, Artificial Sequence
  Synthetic oligonucleotide; GAAAAC chr11 5250795 5250818 5250815 +
agacataagatgtgcgtgtacatg

SEQ ID NO: 69338 - DNA, 24 bp, Artificial Sequence
  Synthetic oligonucleotide; GAAAAC chr11 5251636 5251659 5251656 +
tcctgaaagtaggaagggcatgtg

SEQ ID NO: 69339 - DNA, 24 bp, Artificial Sequence
  Synthetic oligonucleotide; AAAAAC chr11 5252625 5252648 5252645 +
cttcattgtagttaccgtggaaag

SEQ ID NO: 69340 - DNA, 24 bp, Artificial Sequence
  Synthetic oligonucleotide; CAAAAC chr11 5252872 5252895 5252892 +
cactgaacctttccccatctcttc

SEQ ID NO: 69341 - DNA, 24 bp, Artificial Sequence
  Synthetic oligonucleotide; CAAAAC chr11 5253007 5253030 5253027 +
tgcctagttcttttatttgctcat

SEQ ID NO: 69342 - DNA, 24 bp, Artificial Sequence
  Synthetic oligonucleotide; TAAAAC chr11 5253105 5253128 5253125 +
tacacataaacacatccctcaaca

SEQ ID NO: 69343 - DNA, 24 bp, Artificial Sequence
  Synthetic oligonucleotide; CAAAAC chr11 5253352 5253375 5253372 +
gaattctttgccgaaatggattgc

SEQ ID NO: 69344 - DNA, 24 bp, Artificial Sequence
  Synthetic oligonucleotide; GAAAAC chr11 5253624 5253647 5253644 +
catgaaccctgtatgctgtaggct

SEQ ID NO: 69345 - DNA, 24 bp, Artificial Sequence
  Synthetic oligonucleotide; TAAAAC chr11 5253958 5253981 5253978 +
tgtcctgcctccagatagatgttt

SEQ ID NO: 69346 - DNA, 24 bp, Artificial Sequence
  Synthetic oligonucleotide; TAAAAC chr11 5254101 5254124 5254121 +
ttttcagaggcactccttaggccc

SEQ ID NO: 69347 - DNA, 24 bp, Artificial Sequence
  Synthetic oligonucleotide; GAAAAC chr11 5255726 5255749 5255746 +
agacataagacatgtatttgcatg

SEQ ID NO: 69348 - DNA, 24 bp, Artificial Sequence
  Synthetic oligonucleotide; AAAAAC chr11 5256915 5256938 5256935 +
ttcaaacaacttccccatttatcc

SEQ ID NO: 69349 - DNA, 24 bp, Artificial Sequence
  Synthetic oligonucleotide; TAAAAC chr11 5257080 5257103 5257100 +
tgacattgattaaatcctaactga

SEQ ID NO: 69350 - DNA, 24 bp, Artificial Sequence
  Synthetic oligonucleotide; TAAAAC chr11 5257225 5257248 5257245 +
atttaagttaaataagtcagagaa

SEQ ID NO: 69351 - DNA, 24 bp, Artificial Sequence
  Synthetic oligonucleotide; GAAAAC chr11 5257442 5257465 5257462 +
taaattcaaagctctgaagcagaa

SEQ ID NO: 69352 - DNA, 24 bp, Artificial Sequence
  Synthetic oligonucleotide; GAAAAC chr11 5259407 5259430 5259427 +
gcctacccaagtgagaaggaacca

SEQ ID NO: 69353 - DNA, 24 bp, Artificial Sequence
  Synthetic oligonucleotide; AAAAAC chr11 5259429 5259452 5259449 +
cagaaaactaactctggtaatatg

SEQ ID NO: 69354 - DNA, 24 bp, Artificial Sequence
  Synthetic oligonucleotide; AAAAAC chr11 5259588 5259611 5259608 +
gaggaaggtgaagtccaattttaa

SEQ ID NO: 69355 - DNA, 24 bp, Artificial Sequence
  Synthetic oligonucleotide; AAAAAC chr11 5259653 5259676 5259673 +
tcagttaaagagatagcataaata

SEQ ID NO: 69356 - DNA, 24 bp, Artificial Sequence
  Synthetic oligonucleotide; CAAAAC chr11 5259662 5259685 5259682 +
gagatagcataaataaaaaacatt

SEQ ID NO: 69357 - DNA, 24 bp, Artificial Sequence
  Synthetic oligonucleotide; GAAAAC chr11 5259920 5259943 5259940 +
aaagaagagaaatctaaaagtttg

SEQ ID NO: 69358 - DNA, 24 bp, Artificial Sequence
  Synthetic oligonucleotide; GAAAAC chr11 5259947 5259970 5259967 +
aacttatccagggaaataatcaag

SEQ ID NO: 69359 - DNA, 24 bp, Artificial Sequence
  Synthetic oligonucleotide; GAAAAC chr11 5260130 5260153 5260150 +
gaaactaccaggtaacctatgaaa

SEQ ID NO: 69360 - DNA, 24 bp, Artificial Sequence
  Synthetic oligonucleotide; CAAAAC chr11 5260216 5260239 5260236 +
ggccctatcttcagccttcttaaa

SEQ ID NO: 69361 - DNA, 24 bp, Artificial Sequence
  Synthetic oligonucleotide; AAAAAC chr11 5260295 5260318 5260315 +
aagaaaatacacagtgtttttcag

SEQ ID NO: 69362 - DNA, 24 bp, Artificial Sequence
  Synthetic oligonucleotide; CAAAAC chr11 5260391 5260414 5260411 +
ttgaaataaaccctggaagcacat

SEQ ID NO: 69363 - DNA, 24 bp, Artificial Sequence
  Synthetic oligonucleotide; CAAAAC chr11 5260718 5260741 5260738 +
caaagcagctattcttatgtcaga

SEQ ID NO: 69364 - DNA, 24 bp, Artificial Sequence
  Synthetic oligonucleotide; TAAAAC chr11 5260852 5260875 5260872 +
ctaatactggagatcccaaattta

SEQ ID NO: 69365 - DNA, 24 bp, Artificial Sequence
  Synthetic oligonucleotide; CAAAAC chr11 5261081 5261104 5261101 +
caagataggccatatgatatgcca

SEQ ID NO: 69366 - DNA, 24 bp, Artificial Sequence
  Synthetic oligonucleotide; CAAAAC chr11 5261181 5261204 5261201 +
gaaatcaactacaaaaggaacctt

SEQ ID NO: 69367 - DNA, 24 bp, Artificial Sequence
  Synthetic oligonucleotide; GAAAAC chr11 5261279 5261302 5261299 +
ggaaatttaaaaatcatttgcttt

SEQ ID NO: 69368 - DNA, 24 bp, Artificial Sequence
  Synthetic oligonucleotide; AAAAAC chr11 5261722 5261745 5261742 +
ataagagaggacacaaacaaatgg

SEQ ID NO: 69369 - DNA, 24 bp, Artificial Sequence
  Synthetic oligonucleotide; AAAAAC chr11 5261847 5261870 5261867 +
actgacttttttcaaagaattaga

SEQ ID NO: 69370 - DNA, 24 bp, Artificial Sequence
  Synthetic oligonucleotide; AAAAAC chr11 5261976 5261999 5261996 +
actatactacaaggctacagtaac

SEQ ID NO: 69371 - DNA, 24 bp, Artificial Sequence
  Synthetic oligonucleotide; CAAAAC chr11 5261998 5262021 5262018 +
acaaaaacagcatggtactggtac

SEQ ID NO: 69372 - DNA, 24 bp, Artificial Sequence
  Synthetic oligonucleotide; AAAAAC chr11 5262132 5262155 5262152 +
tccctatttaataaatggtgctgg

SEQ ID NO: 69373 - DNA, 24 bp, Artificial Sequence
  Synthetic oligonucleotide; TAAAAC chr11 5262154 5262177 5262174 +
ggaaaaactggctagcaatatgca

SEQ ID NO: 69374 - DNA, 24 bp, Artificial Sequence
  Synthetic oligonucleotide; TAAAAC chr11 5262233 5262256 5262253 +
gattaaagacttaaatgtgcaacc

SEQ ID NO: 69375 - DNA, 24 bp, Artificial Sequence
  Synthetic oligonucleotide; TAAAAC chr11 5262307 5262330 5262327 +
taggcatgggcaaaaattcacgac

SEQ ID NO: 69376 - DNA, 24 bp, Artificial Sequence
  Synthetic oligonucleotide; AAAAAC chr11 5262505 5262528 5262525 +
aagaacttcaacaaatttacaaga

SEQ ID NO: 69377 - DNA, 24 bp, Artificial Sequence
  Synthetic oligonucleotide; CAAAAC chr11 5262635 5262658 5262655 +
actggtcattagagaaatgcaaat

SEQ ID NO: 69378 - DNA, 24 bp, Artificial Sequence
  Synthetic oligonucleotide; CAAAAC chr11 5263399 5263422 5263419 +
accgacaatagtgacacaacctat

SEQ ID NO: 69379 - DNA, 24 bp, Artificial Sequence
  Synthetic oligonucleotide; AAAAAC chr11 5263526 5263549 5263546 +
cacaccacaagaaactagagaaac

SEQ ID NO: 69380 - DNA, 24 bp, Artificial Sequence
  Synthetic oligonucleotide; CAAAAC chr11 5263541 5263564 5263561 +
tagagaaacaaaaacaaacagaac

SEQ ID NO: 69381 - DNA, 24 bp, Artificial Sequence
  Synthetic oligonucleotide; TAAAAC chr11 5263596 5263619 5263616 +
gataagaggagaactaaatgaaat

SEQ ID NO: 69382 - DNA, 24 bp, Artificial Sequence
  Synthetic oligonucleotide; TAAAAC chr11 5263661 5263684 5263681 +
aagctggttctttgaaaagataaa

SEQ ID NO: 69383 - DNA, 24 bp, Artificial Sequence
  Synthetic oligonucleotide; CAAAAC chr11 5263732 5263755 5263752 +
agtgcaaataaactcaattagaaa

SEQ ID NO: 69384 - DNA, 24 bp, Artificial Sequence
  Synthetic oligonucleotide; GAAAAC chr11 5263817 5263840 5263837 +
gaacacctttacatgcataaacta

SEQ ID NO: 69385 - DNA, 24 bp, Artificial Sequence
  Synthetic oligonucleotide; CAAAAC chr11 5264099 5264122 5264119 +
atgaagccagtatcaccttaatac

SEQ ID NO: 69386 - DNA, 24 bp, Artificial Sequence
  Synthetic oligonucleotide; AAAAAC chr11 5264129 5264152 5264149 +
tgggaaagaacataaccaaaaaaa

SEQ ID NO: 69387 - DNA, 24 bp, Artificial Sequence
  Synthetic oligonucleotide; CAAAAC chr11 5264214 5264237 5264234 +
agctaatagcatccgacagcatat

SEQ ID NO: 69388 - DNA, 24 bp, Artificial Sequence
  Synthetic oligonucleotide; TAAAAC chr11 5264382 5264405 5264402 +
caaaattcaacatcactttatgac

SEQ ID NO: 69389 - DNA, 24 bp, Artificial Sequence
  Synthetic oligonucleotide; GAAAAC chr11 5264497 5264520 5264517 +
gaaaaagttaaaagcattctgtct

SEQ ID NO: 69390 - DNA, 24 bp, Artificial Sequence
  Synthetic oligonucleotide; GAAAAC chr11 5264663 5264686 5264683 +
gctgatgatatgattgtgtatgta

SEQ ID NO: 69391 - DNA, 24 bp, Artificial Sequence
  Synthetic oligonucleotide; CAAAAC chr11 5264683 5264706 5264703 +
tgtagaaaactctaaagactcctc

SEQ ID NO: 69392 - DNA, 24 bp, Artificial Sequence
  Synthetic oligonucleotide; AAAAAC chr11 5264827 5264850 5264847 +
tcaaccccttttacaatagctgca

SEQ ID NO: 69393 - DNA, 24 bp, Artificial Sequence
  Synthetic oligonucleotide; CAAAAC chr11 5264832 5264855 5264852 +
cccttttacaatagctgcaaaaaa

SEQ ID NO: 69394 - DNA, 24 bp, Artificial Sequence
  Synthetic oligonucleotide; CAAAAC chr11 5264837 5264860 5264857 +
ttacaatagctgcaaaaaacaaaa

SEQ ID NO: 69395 - DNA, 24 bp, Artificial Sequence
  Synthetic oligonucleotide; CAAAAC chr11 5264842 5264865 5264862 +
atagctgcaaaaaacaaaacaaaa

SEQ ID NO: 69396 - DNA, 24 bp, Artificial Sequence
  Synthetic oligonucleotide; AAAAAC chr11 5264848 5264871 5264868 +
gcaaaaaacaaaacaaaacaaaac

SEQ ID NO: 69397 - DNA, 24 bp, Artificial Sequence
  Synthetic oligonucleotide; GAAAAC chr11 5264898 5264921 5264918 +
aaggaggtgaaagacatctacaag

SEQ ID NO: 69398 - DNA, 24 bp, Artificial Sequence
  Synthetic oligonucleotide; CAAAAC chr11 5264906 5264929 5264926 +
gaaagacatctacaaggaaaacta

SEQ ID NO: 69399 - DNA, 24 bp, Artificial Sequence
  Synthetic oligonucleotide; AAAAAC chr11 5265074 5265097 5265094 +
accattagtcttcacagaactaga

SEQ ID NO: 69400 - DNA, 24 bp, Artificial Sequence
  Synthetic oligonucleotide; CAAAAC chr11 5265200 5265223 5265220 +
actatacaataaggccatagtcac

SEQ ID NO: 69401 - DNA, 24 bp, Artificial Sequence
  Synthetic oligonucleotide; AAAAAC chr11 5265312 5265335 5265332 +
caactgatctttgacaaagcaaac

SEQ ID NO: 69402 - DNA, 24 bp, Artificial Sequence
  Synthetic oligonucleotide; AAAAAC chr11 5265494 5265517 5265514 +
aacaattctagaaaataacatcgg

SEQ ID NO: 69403 - DNA, 24 bp, Artificial Sequence
  Synthetic oligonucleotide; AAAAAC chr11 5265559 5265582 5265579 +
ccaagaacacaaatgcaaatacat

SEQ ID NO: 69404 - DNA, 24 bp, Artificial Sequence
  Synthetic oligonucleotide; CAAAAC chr11 5265864 5265887 5265884 +
actaatgatcagggaaatgcaaat

SEQ ID NO: 69405 - DNA, 24 bp, Artificial Sequence
  Synthetic oligonucleotide; TAAAAC chr11 5265897 5265920 5265917 +
aatgagatatctacttactctagt

SEQ ID NO: 69406 - DNA, 24 bp, Artificial Sequence
  Synthetic oligonucleotide; GAAAAC chr11 5266013 5266036 5266033 +
atgtaaaatagtacaaccattatg

SEQ ID NO: 69407 - DNA, 24 bp, Artificial Sequence
  Synthetic oligonucleotide; AAAAAC chr11 5266043 5266066 5266063 +
agtatgaagatttctcagtaaact

SEQ ID NO: 69408 - DNA, 24 bp, Artificial Sequence
  Synthetic oligonucleotide; AAAAAC chr11 5266330 5266353 5266350 +
taattgaaagccctgaagcagaac

SEQ ID NO: 69409 - DNA, 24 bp, Artificial Sequence
  Synthetic oligonucleotide; CAAAAC chr11 5267104 5267127 5267124 +
atgaaagacacaagacctgaaggt

SEQ ID NO: 69410 - DNA, 24 bp, Artificial Sequence
  Synthetic oligonucleotide; AAAAAC chr11 5267704 5267727 5267724 +
cggaaagtcttcatcacactctcc

SEQ ID NO: 69411 - DNA, 24 bp, Artificial Sequence
  Synthetic oligonucleotide; TAAAAC chr11 5267887 5267910 5267907 +
catcttatctccaaatcaatttca

SEQ ID NO: 69412 - DNA, 24 bp, Artificial Sequence
  Synthetic oligonucleotide; AAAAAC chr11 5268075 5268098 5268095 +
agctccttctttccccggtgcagt

SEQ ID NO: 69413 - DNA, 24 bp, Artificial Sequence
  Synthetic oligonucleotide; GAAAAC chr11 5268625 5268648 5268645 +
caggcatgttgagtagaagtttcc

SEQ ID NO: 69414 - DNA, 24 bp, Artificial Sequence
  Synthetic oligonucleotide; AAAAAC chr11 5268641 5268664 5268661 +
aagtttccgaaaacaacttgatga

SEQ ID NO: 69415 - DNA, 24 bp, Artificial Sequence
  Synthetic oligonucleotide; AAAAAC chr11 5268659 5268682 5268679 +
tgatgaaaaaacaaacaaacaaac

SEQ ID NO: 69416 - DNA, 24 bp, Artificial Sequence
  Synthetic oligonucleotide; AAAAAC chr11 5270314 5270337 5270334 +
tgccttaaaggtggtgacagtgac

SEQ ID NO: 69417 - DNA, 24 bp, Artificial Sequence
  Synthetic oligonucleotide; TAAAAC chr11 5270348 5270371 5270368 +
ccaaggaaaagaaaataaagctgt

SEQ ID NO: 69418 - DNA, 24 bp, Artificial Sequence
  Synthetic oligonucleotide; CAAAAC chr11 5270398 5270421 5270418 +
ctctcttaaggagtgcattgtaaa

SEQ ID NO: 69419 - DNA, 24 bp, Artificial Sequence
  Synthetic oligonucleotide; AAAAAC chr11 5270432 5270455 5270452 +
gtaccttagtttctctagggagac

SEQ ID NO: 69420 - DNA, 24 bp, Artificial Sequence
  Synthetic oligonucleotide; AAAAAC chr11 5271730 5271753 5271750 +
tttgtgataaaaaaaaaaaaaaaa

SEQ ID NO: 69421 - DNA, 24 bp, Artificial Sequence
  Synthetic oligonucleotide; CAAAAC chr11 5271917 5271940 5271937 +
attctaaccattggctaacacaga

SEQ ID NO: 69422 - DNA, 24 bp, Artificial Sequence
  Synthetic oligonucleotide; AAAAAC chr11 5272483 5272506 5272503 +
taagagcgaaactccatctcaaac

SEQ ID NO: 69423 - DNA, 24 bp, Artificial Sequence
  Synthetic oligonucleotide; AAAAAC chr11 5272489 5272512 5272509 +
cgaaactccatctcaaacaaaaac

SEQ ID NO: 69424 - DNA, 24 bp, Artificial Sequence
  Synthetic oligonucleotide; TAAAAC chr11 5273059 5273082 5273079 +
gagtttggagaacaggtttctccc

SEQ ID NO: 69425 - DNA, 24 bp, Artificial Sequence
  Synthetic oligonucleotide; AAAAAC chr11 5273767 5273790 5273787 +
ttcttaagttctatgcaggattct

SEQ ID NO: 69426 - DNA, 24 bp, Artificial Sequence
  Synthetic oligonucleotide; TAAAAC chr11 5274866 5274889 5274886 +
tcctacatgatgggcactgaaggt

SEQ ID NO: 69427 - DNA, 24 bp, Artificial Sequence
  Synthetic oligonucleotide; GAAAAC chr11 5274889 5274912 5274909 +
ttaaaacttgagtctgtcaactta

SEQ ID NO: 69428 - DNA, 24 bp, Artificial Sequence
  Synthetic oligonucleotide; TAAAAC chr11 5275076 5275099 5275096 +
atttatgaactaagaacatagaaa

SEQ ID NO: 69429 - DNA, 24 bp, Artificial Sequence
  Synthetic oligonucleotide; AAAAAC chr11 5275187 5275210 5275207 +
tgaatcttatgtctagaaattttg

SEQ ID NO: 69430 - DNA, 24 bp, Artificial Sequence
  Synthetic oligonucleotide; TAAAAC chr11 5275404 5275427 5275424 +
aatgtgtatttctctggagaaggt

SEQ ID NO: 69431 - DNA, 24 bp, Artificial Sequence
  Synthetic oligonucleotide; GAAAAC chr11 5275504 5275527 5275524 +
gatcatccatcatgaggaaatatg

SEQ ID NO: 69432 - DNA, 24 bp, Artificial Sequence
  Synthetic oligonucleotide; CAAAAC chr11 5276223 5276246 5276243 +
tgtttacaaatatgtgattatcat

SEQ ID NO: 69433 - DNA, 24 bp, Artificial Sequence
  Synthetic oligonucleotide; AAAAAC chr11 5276324 5276347 5276344 +
taactgagactttaaaaaaaaaaa

SEQ ID NO: 69434 - DNA, 24 bp, Artificial Sequence
  Synthetic oligonucleotide; AAAAAC chr11 5276334 5276357 5276354 +
tttaaaaaaaaaaaaaaaacaaaa

SEQ ID NO: 69435 - DNA, 24 bp, Artificial Sequence
  Synthetic oligonucleotide; AAAAAC chr11 5276505 5276528 5276525 +
accccagaacttaaagcatattaa

SEQ ID NO: 69436 - DNA, 24 bp, Artificial Sequence
  Synthetic oligonucleotide; AAAAAC chr11 5276910 5276933 5276930 +
gctctagttataaattccagtgta

SEQ ID NO: 69437 - DNA, 24 bp, Artificial Sequence
  Synthetic oligonucleotide; CAAAAC chr11 5276991 5277014 5277011 +
ttttcaagagcaaatctcagccta

SEQ ID NO: 69438 - DNA, 24 bp, Artificial Sequence
  Synthetic oligonucleotide; AAAAAC chr11 5277218 5277241 5277238 +
gtaaaattgctaagaatacagcac

SEQ ID NO: 69439 - DNA, 24 bp, Artificial Sequence
  Synthetic oligonucleotide; AAAAAC chr11 5277341 5277364 5277361 +
gattaggtgctatggagaaaaaaa

SEQ ID NO: 69440 - DNA, 24 bp, Artificial Sequence
  Synthetic oligonucleotide; AAAAAC chr11 5277684 5277707 5277704 +
tacctacatcatagagttgtaaga

SEQ ID NO: 69441 - DNA, 24 bp, Artificial Sequence
  Synthetic oligonucleotide; GAAAAC chr11 5278039 5278062 5278059 +
ggtgaaggcaaggggtcagcctct

SEQ ID NO: 69442 - DNA, 24 bp, Artificial Sequence
  Synthetic oligonucleotide; AAAAAC chr11 5278056 5278079 5278076 +
agcctctgaaaacatcctttcacg

SEQ ID NO: 69443 - DNA, 24 bp, Artificial Sequence
  Synthetic oligonucleotide; TAAAAC chr11 5279305 5279328 5279325 +
ccctttaaacactgccactcaacc

SEQ ID NO: 69444 - DNA, 24 bp, Artificial Sequence
  Synthetic oligonucleotide; AAAAAC chr11 5279694 5279717 5279714 +
gtcattcattcacaaatgaataca

SEQ ID NO: 69445 - DNA, 24 bp, Artificial Sequence
  Synthetic oligonucleotide; CAAAAC chr11 5279743 5279766 5279763 +
gtcctgtaatgggtcctgggcctg

SEQ ID NO: 69446 - DNA, 24 bp, Artificial Sequence
  Synthetic oligonucleotide; AAAAAC chr11 5280907 5280930 5280927 +
acagaaatgtaacaggaactaagg

SEQ ID NO: 69447 - DNA, 24 bp, Artificial Sequence
  Synthetic oligonucleotide; TAAAAC chr11 5281059 5281082 5281079 +
cagtgcttgaatcataaataagaa

SEQ ID NO: 69448 - DNA, 24 bp, Artificial Sequence
  Synthetic oligonucleotide; GAAAAC chr11 5281496 5281519 5281516 +
ggtcaagatttttttaaaaattaa

SEQ ID NO: 69449 - DNA, 24 bp, Artificial Sequence
  Synthetic oligonucleotide; AAAAAC chr11 5283174 5283197 5283194 +
tctgagtttgtgttttgctgtgga

SEQ ID NO: 69450 - DNA, 24 bp, Artificial Sequence
  Synthetic oligonucleotide; TAAAAC chr11 5283458 5283481 5283478 +
tctacttctgagtattggtgtgag

SEQ ID NO: 69451 - DNA, 24 bp, Artificial Sequence
  Synthetic oligonucleotide; GAAAAC chr11 5284550 5284573 5284570 +
tcttactttatagatgatgatcct

SEQ ID NO: 69452 - DNA, 24 bp, Artificial Sequence
  Synthetic oligonucleotide; GAAAAC chr11 5285193 5285216 5285213 +
ttttatggagttagcgtgaggatg

SEQ ID NO: 69453 - DNA, 24 bp, Artificial Sequence
  Synthetic oligonucleotide; GAAAAC chr11 5286018 5286041 5286038 +
tgcatatgatggggtagcagacaa

SEQ ID NO: 69454 - DNA, 24 bp, Artificial Sequence
  Synthetic oligonucleotide; CAAAAC chr11 5286416 5286439 5286436 +
catctaactgaagacagcagcaat

SEQ ID NO: 69455 - DNA, 24 bp, Artificial Sequence
  Synthetic oligonucleotide; AAAAAC chr11 5286550 5286573 5286570 +
agtgtaattttttagtcacttagg

SEQ ID NO: 69456 - DNA, 24 bp, Artificial Sequence
  Synthetic oligonucleotide; TAAAAC chr11 5287136 5287159 5287156 +
tgcagaacaatcttatgagcctgt

SEQ ID NO: 69457 - DNA, 24 bp, Artificial Sequence
  Synthetic oligonucleotide; AAAAAC chr11 5287416 5287439 5287436 +
ggtgacagagtgagaccctttctc

SEQ ID NO: 69458 - DNA, 24 bp, Artificial Sequence
  Synthetic oligonucleotide; AAAAAC chr11 5287432 5287455 5287452 +
cctttctcaaaaacaaactaatta

SEQ ID NO: 69459 - DNA, 24 bp, Artificial Sequence
  Synthetic oligonucleotide; AAAAAC chr11 5288737 5288760 5288757 +
ggtcgttgtgtttgctgtgtttgc

SEQ ID NO: 69460 - DNA, 24 bp, Artificial Sequence
  Synthetic oligonucleotide; TAAAAC chr11 5290815 5290838 5290835 +
tgagaaataattttatttatatta

SEQ ID NO: 69461 - DNA, 24 bp, Artificial Sequence
  Synthetic oligonucleotide; AAAAAC chr11 5290850 5290873 5290870 +
aacaatacagatgtatataaacta

SEQ ID NO: 69462 - DNA, 24 bp, Artificial Sequence
  Synthetic oligonucleotide; AAAAAC chr11 5290906 5290929 5290926 +
ctcaatatcacttcttcacttaga

SEQ ID NO: 69463 - DNA, 24 bp, Artificial Sequence
  Synthetic oligonucleotide; TAAAAC chr11 5291764 5291787 5291784 +
tgcataggaaataataatggacca

SEQ ID NO: 69464 - DNA, 24 bp, Artificial Sequence
  Synthetic oligonucleotide; GAAAAC chr11 5292273 5292296 5292293 +
tgatacccatataaataacgtaga

SEQ ID NO: 69465 - DNA, 24 bp, Artificial Sequence
  Synthetic oligonucleotide; GAAAAC chr11 5292559 5292582 5292579 +
cttcacatacttattttttgtggt

SEQ ID NO: 69466 - DNA, 24 bp, Artificial Sequence
  Synthetic oligonucleotide; GAAAAC chr11 5292645 5292668 5292665 +
tgtcaggatgcagtaatagattta

SEQ ID NO: 69467 - DNA, 24 bp, Artificial Sequence
  Synthetic oligonucleotide; GAAAAC chr11 5292693 5292716 5292713 +
aatcatgaataatgatcaatcgag

SEQ ID NO: 69468 - DNA, 24 bp, Artificial Sequence
  Synthetic oligonucleotide; CAAAAC chr11 5292848 5292871 5292868 +
gccttgagtggattgatgtggaag

SEQ ID NO: 69469 - DNA, 24 bp, Artificial Sequence
  Synthetic oligonucleotide; AAAAAC chr11 5292885 5292908 5292905 +
aaataaagacaaatgtgcaacatc

SEQ ID NO: 69470 - DNA, 24 bp, Artificial Sequence
  Synthetic oligonucleotide; CAAAAC chr11 5295772 5295795 5295792 +
tttgactcagaggtggataagaga

SEQ ID NO: 69471 - DNA, 24 bp, Artificial Sequence
  Synthetic oligonucleotide; TAAAAC chr11 5296496 5296519 5296516 +
taacactccaagatagatttagat

SEQ ID NO: 69472 - DNA, 24 bp, Artificial Sequence
  Synthetic oligonucleotide; GAAAAC chr11 5296588 5296611 5296608 +
taacatgatgaggagacatggaaa

SEQ ID NO: 69473 - DNA, 24 bp, Artificial Sequence
  Synthetic oligonucleotide; AAAAAC chr11 5298257 5298280 5298277 +
catgatcccatatttacaaaaaat

SEQ ID NO: 69474 - DNA, 24 bp, Artificial Sequence
  Synthetic oligonucleotide; TAAAAC chr11 5298905 5298928 5298925 +
ataggttatgaatataattaaaat

SEQ ID NO: 69475 - DNA, 24 bp, Artificial Sequence
  Synthetic oligonucleotide; GAAAAC chr11 5299212 5299235 5299232 +
aggctgtcttcttataacaatcaa

SEQ ID NO: 69476 - DNA, 24 bp, Artificial Sequence
  Synthetic oligonucleotide; AAAAAC chr11 5299262 5299285 5299282 +
acaaatacatttgccatttttaca

SEQ ID NO: 69477 - DNA, 24 bp, Artificial Sequence
  Synthetic oligonucleotide; GAAAAC chr11 5299412 5299435 5299432 +
tagaccaaacaacaaaggcaacca

SEQ ID NO: 69478 - DNA, 24 bp, Artificial Sequence
  Synthetic oligonucleotide; AAAAAC chr11 5299458 5299481 5299478 +
ataaactctgtatgccaactttgg

SEQ ID NO: 69479 - DNA, 24 bp, Artificial Sequence
  Synthetic oligonucleotide; CAAAAC chr11 5300135 5300158 5300155 +
ttgccaagtttttgcattaattat

SEQ ID NO: 69480 - DNA, 24 bp, Artificial Sequence
  Synthetic oligonucleotide; GAAAAC chr11 5300326 5300349 5300346 +
gtttcagcagacaatgggaagaag

SEQ ID NO: 69481 - DNA, 24 bp, Artificial Sequence
  Synthetic oligonucleotide; TAAAAC chr11 5300916 5300939 5300936 +
tctgaggaaaaaaaagtgtggata

SEQ ID NO: 69482 - DNA, 24 bp, Artificial Sequence
  Synthetic oligonucleotide; TAAAAC chr11 5301472 5301495 5301492 +
aaagaattatgggcaaaatggaca

SEQ ID NO: 69483 - DNA, 24 bp, Artificial Sequence
  Synthetic oligonucleotide; CAAAAC chr11 5301578 5301601 5301598 +
gatggcaatgaaacagtcataggc

SEQ ID NO: 69484 - DNA, 24 bp, Artificial Sequence
  Synthetic oligonucleotide; CAAAAC chr11 5302037 5302060 5302057 +
acatcatcaggccattttttacct

SEQ ID NO: 69485 - DNA, 24 bp, Artificial Sequence
  Synthetic oligonucleotide; TAAAAC chr11 5302662 5302685 5302682 +
gtctctataaaaaataaaataaaa

SEQ ID NO: 69486 - DNA, 24 bp, Artificial Sequence
  Synthetic oligonucleotide; GAAAAC chr11 5303268 5303291 5303288 +
gaaattttgtagcaggtttattgg

SEQ ID NO: 69487 - DNA, 24 bp, Artificial Sequence
  Synthetic oligonucleotide; AAAAAC chr11 5303442 5303465 5303462 +
atctttgcaccttttttattttat

SEQ ID NO: 69488 - DNA, 24 bp, Artificial Sequence
  Synthetic oligonucleotide; AAAAAC chr11 5303649 5303672 5303669 +
agagactatgttcatatggatact

SEQ ID NO: 69489 - DNA, 24 bp, Artificial Sequence
  Synthetic oligonucleotide; CAAAAC chr11 5303920 5303943 5303940 +
attcttaaactatagtcgtgtttt

SEQ ID NO: 69490 - DNA, 24 bp, Artificial Sequence
  Synthetic oligonucleotide; TAAAAC chr11 5303966 5303989 5303986 +
acatgcggatgcacagggttttat

SEQ ID NO: 69491 - DNA, 24 bp, Artificial Sequence
  Synthetic oligonucleotide; CAAAAC chr11 5304066 5304089 5304086 +
ctatttaacatctgcagtctctag

SEQ ID NO: 69492 - DNA, 24 bp, Artificial Sequence
  Synthetic oligonucleotide; AAAAAC chr11 5304954 5304977 5304974 +
gctgaggcaggagaattgctttaa

SEQ ID NO: 69493 - DNA, 24 bp, Artificial Sequence
  Synthetic oligonucleotide; AAAAAC chr11 5305184 5305207 5305204 +
agcaaagttgatctgtatttacaa

SEQ ID NO: 69494 - DNA, 24 bp, Artificial Sequence
  Synthetic oligonucleotide; AAAAAC chr11 5305374 5305397 5305394 +
tgactgtgagacaaaaagtgagta

SEQ ID NO: 69495 - DNA, 24 bp, Artificial Sequence
  Synthetic oligonucleotide; CAAAAC chr11 5305482 5305505 5305502 +
tcgagaccagctgggccaacatgg

SEQ ID NO: 69496 - DNA, 24 bp, Artificial Sequence
  Synthetic oligonucleotide; AAAAAC chr11 5305689 5305712 5305709 +
agagagagaaaagaaaagtgagta

SEQ ID NO: 69497 - DNA, 24 bp, Artificial Sequence
  Synthetic oligonucleotide; CAAAAC chr11 5305833 5305856 5305853 +
attcaaacacaggtttatctaacc

SEQ ID NO: 69498 - DNA, 24 bp, Artificial Sequence
  Synthetic oligonucleotide; CAAAAC chr11 5306436 5306459 5306456 +
atttatttattctttctattgatt

SEQ ID NO: 69499 - DNA, 24 bp, Artificial Sequence
  Synthetic oligonucleotide; AAAAAC chr11 5306735 5306758 5306755 +
tagatgtataaagatatctgcatt

SEQ ID NO: 69500 - DNA, 24 bp, Artificial Sequence
  Synthetic oligonucleotide; CAAAAC chr11 5306980 5307003 5307000 +
caactctaccctaaactcttatct

SEQ ID NO: 69501 - DNA, 24 bp, Artificial Sequence
  Synthetic oligonucleotide; AAAAAC chr11 5307102 5307125 5307122 +
atcacctgtttatacttaggggaa

SEQ ID NO: 69502 - DNA, 24 bp, Artificial Sequence
  Synthetic oligonucleotide; CAAAAC chr11 5307144 5307167 5307164 +
tcatatattcaggtaagattttgc

SEQ ID NO: 69503 - DNA, 24 bp, Artificial Sequence
  Synthetic oligonucleotide; TAAAAC chr11 5307285 5307308 5307305 +
agtcagttctctttgtactcacag

SEQ ID NO: 69504 - DNA, 24 bp, Artificial Sequence
  Synthetic oligonucleotide; CAAAAC chr11 5307290 5307313 5307310 +
gttctctttgtactcacagtaaaa

SEQ ID NO: 69505 - DNA, 24 bp, Artificial Sequence
  Synthetic oligonucleotide; TAAAAC chr11 5308355 5308378 5308375 +
cattttaaggttgaaggtatgcag

SEQ ID NO: 69506 - DNA, 24 bp, Artificial Sequence
  Synthetic oligonucleotide; CAAAAC chr11 5308555 5308578 5308575 +
gagtaagattttgtgtcaactaaa

SEQ ID NO: 69507 - DNA, 24 bp, Artificial Sequence
  Synthetic oligonucleotide; AAAAAC chr11 5308883 5308906 5308903 +
tggacgtaaattgcaggttattga

SEQ ID NO: 69508 - DNA, 24 bp, Artificial Sequence
  Synthetic oligonucleotide; AAAAAC chr11 5308942 5308965 5308962 +
ggcatctttctcactaagcatgag

SEQ ID NO: 69509 - DNA, 24 bp, Artificial Sequence
  Synthetic oligonucleotide; GAAAAC chr11 5309434 5309457 5309454 +
aaagttttaatacaaggacataca

SEQ ID NO: 69510 - DNA, 24 bp, Artificial Sequence
  Synthetic oligonucleotide; TAAAAC chr11 5309517 5309540 5309537 +
ccacatttttatgtcttcccaata

SEQ ID NO: 69511 - DNA, 24 bp, Artificial Sequence
  Synthetic oligonucleotide; AAAAAC chr11 5309813 5309836 5309833 +
ggcgacagagcgagactccatctc

SEQ ID NO: 69512 - DNA, 24 bp, Artificial Sequence
  Synthetic oligonucleotide; CAAAAC chr11 5309818 5309841 5309838 +
cagagcgagactccatctcaaaaa

SEQ ID NO: 69513 - DNA, 24 bp, Artificial Sequence
  Synthetic oligonucleotide; CAAAAC chr11 5309823 5309846 5309843 +
cgagactccatctcaaaaacaaaa

SEQ ID NO: 69514 - DNA, 24 bp, Artificial Sequence
  Synthetic oligonucleotide; AAAAAC chr11 5309837 5309860 5309857 +
aaaaacaaaacaaaacaaagcaaa

SEQ ID NO: 69515 - DNA, 24 bp, Artificial Sequence
  Synthetic oligonucleotide; GAAAAC chr11 5310040 5310063 5310060 +
atttgttaaatcatttctttaact

SEQ ID NO: 69516 - DNA, 24 bp, Artificial Sequence
  Synthetic oligonucleotide; GAAAAC chr11 5310091 5310114 5310111 +
gcagtcagccgagatcaaggcact

SEQ ID NO: 69517 - DNA, 24 bp, Artificial Sequence
  Synthetic oligonucleotide; AAAAAC chr11 5310386 5310409 5310406 +
atgctacaacatgaataaacctta

SEQ ID NO: 69518 - DNA, 24 bp, Artificial Sequence
  Synthetic oligonucleotide; TAAAAC chr11 5310687 5310710 5310707 +
ttgtatatattaccactataaaaa

SEQ ID NO: 69519 - DNA, 24 bp, Artificial Sequence
  Synthetic oligonucleotide; AAAAAC chr11 5310735 5310758 5310755 +
cattaaatttattgtgaaaggttt

SEQ ID NO: 69520 - DNA, 24 bp, Artificial Sequence
  Synthetic oligonucleotide; AAAAAC chr11 5311049 5311072 5311069 +
ggtaactaacataagcactcatga

SEQ ID NO: 69521 - DNA, 24 bp, Artificial Sequence
  Synthetic oligonucleotide; TAAAAC chr11 5311218 5311241 5311238 +
gcagtattttttggactgctattt

SEQ ID NO: 69522 - DNA, 24 bp, Artificial Sequence
  Synthetic oligonucleotide; AAAAAC chr11 5311253 5311276 5311273 +
ctacttcagtgaatgacacccaag

SEQ ID NO: 69523 - DNA, 24 bp, Artificial Sequence
  Synthetic oligonucleotide; TAAAAC chr11 5311907 5311930 5311927 +
ttataaataatattgaagtaattt

SEQ ID NO: 69524 - DNA, 24 bp, Artificial Sequence
  Synthetic oligonucleotide; GAAAAC chr11 5312683 5312706 5312703 +
attgtgtatatagcaagacaaaca

SEQ ID NO: 69525 - DNA, 24 bp, Artificial Sequence
  Synthetic oligonucleotide; TAAAAC chr11 5312712 5312735 5312732 +
ctgggaaaatacgtacactaaaaa

SEQ ID NO: 69526 - DNA, 24 bp, Artificial Sequence
  Synthetic oligonucleotide; TAAAAC chr11 5313024 5313047 5313044 +
tatgaatttagagagtctctactg

SEQ ID NO: 69527 - DNA, 24 bp, Artificial Sequence
  Synthetic oligonucleotide; GAAAAC chr11 5313059 5313082 5313079 +
agatgacattgtatcattttgaaa

SEQ ID NO: 69528 - DNA, 24 bp, Artificial Sequence
  Synthetic oligonucleotide; TAAAAC chr11 5313243 5313266 5313263 +
taatatctggagtctatgaggaac

SEQ ID NO: 69529 - DNA, 24 bp, Artificial Sequence
  Synthetic oligonucleotide; AAAAAC chr11 5313262 5313285 5313282 +
ggaactaaaacaaatttacaagaa

SEQ ID NO: 69530 - DNA, 24 bp, Artificial Sequence
  Synthetic oligonucleotide; CAAAAC chr11 5313390 5313413 5313410 +
actggtcattagaaaaatgcaaat

SEQ ID NO: 69531 - DNA, 24 bp, Artificial Sequence
  Synthetic oligonucleotide; GAAAAC chr11 5313740 5313763 5313760 +
tccatcaatgatagagtggataaa

SEQ ID NO: 69532 - DNA, 24 bp, Artificial Sequence
  Synthetic oligonucleotide; GAAAAC chr11 5313863 5313886 5313883 +
cctcatcaaactaacacaggaaca

SEQ ID NO: 69533 - DNA, 24 bp, Artificial Sequence
  Synthetic oligonucleotide; CAAAAC chr11 5314280 5314303 5314300 +
tgctataattcatctttatatggc

SEQ ID NO: 69534 - DNA, 24 bp, Artificial Sequence
  Synthetic oligonucleotide; AAAAAC chr11 5315928 5315951 5315948 +
aagtagttaagcattcttaatcta

SEQ ID NO: 69535 - DNA, 24 bp, Artificial Sequence
  Synthetic oligonucleotide; GAAAAC chr11 5316144 5316167 5316164 +
tgatatagacatagtgttttgtta

SEQ ID NO: 69536 - DNA, 24 bp, Artificial Sequence
  Synthetic oligonucleotide; AAAAAC chr11 5319610 5319633 5319630 +
atatgatcatctcaatagactgag

SEQ ID NO: 69537 - DNA, 24 bp, Artificial Sequence
  Synthetic oligonucleotide; AAAAAC chr11 5319647 5319670 5319667 +
taaaattcaacatcccttcatgat

SEQ ID NO: 69538 - DNA, 24 bp, Artificial Sequence
  Synthetic oligonucleotide; AAAAAC chr11 5319709 5319732 5319729 +
tcaaaagaataaaagccacgtatg

SEQ ID NO: 69539 - DNA, 24 bp, Artificial Sequence
  Synthetic oligonucleotide; CAAAAC chr11 5319722 5319745 5319742 +
agccacgtatgaaaaacccataac

SEQ ID NO: 69540 - DNA, 24 bp, Artificial Sequence
  Synthetic oligonucleotide; GAAAAC chr11 5319764 5319787 5319784 +
gcaaaagctggaactattctcctc

SEQ ID NO: 69541 - DNA, 24 bp, Artificial Sequence
  Synthetic oligonucleotide; TAAAAC chr11 5320133 5320156 5320153 +
ggacttgttctttttattgaaatt

SEQ ID NO: 69542 - DNA, 24 bp, Artificial Sequence
  Synthetic oligonucleotide; CAAAAC chr11 5320367 5320390 5320387 +
gcgtacaggtgaaaagaacaaaca

SEQ ID NO: 69543 - DNA, 24 bp, Artificial Sequence
  Synthetic oligonucleotide; TAAAAC chr11 5320582 5320605 5320602 +
tcacaatatatcttgcaaatcatg

SEQ ID NO: 69544 - DNA, 24 bp, Artificial Sequence
  Synthetic oligonucleotide; TAAAAC chr11 5320617 5320640 5320637 +
gacattaccataagggaatgaata

SEQ ID NO: 69545 - DNA, 24 bp, Artificial Sequence
  Synthetic oligonucleotide; TAAAAC chr11 5321831 5321854 5321851 +
gtccttccatcaaatgtatcactg

SEQ ID NO: 69546 - DNA, 24 bp, Artificial Sequence
  Synthetic oligonucleotide; AAAAAC chr11 5322253 5322276 5322273 +
gaagcttttagtacacagtcacac

SEQ ID NO: 69547 - DNA, 24 bp, Artificial Sequence
  Synthetic oligonucleotide; AAAAAC chr11 5322564 5322587 5322584 +
catctgaagagcaaacatactctt

SEQ ID NO: 69548 - DNA, 24 bp, Artificial Sequence
  Synthetic oligonucleotide; CAAAAC chr11 5323820 5323843 5323840 +
gcaaaattacaggcaggatggata

SEQ ID NO: 69549 - DNA, 24 bp, Artificial Sequence
  Synthetic oligonucleotide; AAAAAC chr11 5324554 5324577 5324574 +
aatatttgcaacaacagtgataac

SEQ ID NO: 69550 - DNA, 24 bp, Artificial Sequence
  Synthetic oligonucleotide; CAAAAC chr11 5324941 5324964 5324961 +
tcaggtcctcaggtgattccagtg

SEQ ID NO: 69551 - DNA, 24 bp, Artificial Sequence
  Synthetic oligonucleotide; AAAAAC chr11 5325666 5325689 5325686 +
accttcgaaagatccttcatgctt

SEQ ID NO: 69552 - DNA, 24 bp, Artificial Sequence
  Synthetic oligonucleotide; AAAAAC chr11 5325951 5325974 5325971 +
aaaatgtttgtgagcttttcctta

SEQ ID NO: 69553 - DNA, 24 bp, Artificial Sequence
  Synthetic oligonucleotide; TAAAAC chr11 5325983 5326006 5326003 +
taacgtctttagagaaattggcca

SEQ ID NO: 69554 - DNA, 24 bp, Artificial Sequence
  Synthetic oligonucleotide; GAAAAC chr11 5326813 5326836 5326833 +
tgtctcaacaggatccataatgct

SEQ ID NO: 69555 - DNA, 24 bp, Artificial Sequence
  Synthetic oligonucleotide; AAAAAC chr11 5327758 5327781 5327778 +
gaattttttgtctactcttcagag

SEQ ID NO: 69556 - DNA, 24 bp, Artificial Sequence
  Synthetic oligonucleotide; AAAAAC chr11 5327839 5327862 5327859 +
aaaataagccctttctggataaac

SEQ ID NO: 69557 - DNA, 24 bp, Artificial Sequence
  Synthetic oligonucleotide; GAAAAC chr11 5328235 5328258 5328255 +
tgccaatccaagggtcccagatta

SEQ ID NO: 69558 - DNA, 24 bp, Artificial Sequence
  Synthetic oligonucleotide; GAAAAC chr11 5328349 5328372 5328369 +
tctttacctctaggcagacctctg

SEQ ID NO: 69559 - DNA, 24 bp, Artificial Sequence
  Synthetic oligonucleotide; AAAAAC chr11 5328709 5328732 5328729 +
tggggtgaggaaaatttgaaattc

SEQ ID NO: 69560 - DNA, 24 bp, Artificial Sequence
  Synthetic oligonucleotide; AAAAAC chr11 5329531 5329554 5329551 +
aaatattatttaagctaataattg

SEQ ID NO: 69561 - DNA, 24 bp, Artificial Sequence
  Synthetic oligonucleotide; CAAAAC chr11 5329668 5329691 5329688 +
agaattctagcagagccagaataa

SEQ ID NO: 69562 - DNA, 24 bp, Artificial Sequence
  Synthetic oligonucleotide; AAAAAC chr11 5330588 5330611 5330608 +
gtggtagcccaatcaagtgacatt

SEQ ID NO: 69563 - DNA, 24 bp, Artificial Sequence
  Synthetic oligonucleotide; TAAAAC chr11 5330973 5330996 5330993 +
atctcaggggattatggatgccaa

SEQ ID NO: 69564 - DNA, 24 bp, Artificial Sequence
  Synthetic oligonucleotide; CAAAAC chr11 5331365 5331388 5331385 +
gatacctgaggagaaacaaacaaa

SEQ ID NO: 69565 - DNA, 24 bp, Artificial Sequence
  Synthetic oligonucleotide; TAAAAC chr11 5331785 5331808 5331805 +
ataaaaattatttcacacatactt

SEQ ID NO: 69566 - DNA, 24 bp, Artificial Sequence
  Synthetic oligonucleotide; AAAAAC chr11 5331864 5331887 5331884 +
aaatggtgtgataggcataatttt

SEQ ID NO: 69567 - DNA, 24 bp, Artificial Sequence
  Synthetic oligonucleotide; AAAAAC chr11 5332211 5332234 5332231 +
taacagcctgcaaacaaacaaaca

SEQ ID NO: 69568 - DNA, 24 bp, Artificial Sequence
  Synthetic oligonucleotide; AAAAAC chr11 5332217 5332240 5332237 +
cctgcaaacaaacaaacaaaaaac

SEQ ID NO: 69569 - DNA, 24 bp, Artificial Sequence
  Synthetic oligonucleotide; AAAAAC chr11 5332223 5332246 5332243 +
aacaaacaaacaaaaaacaaaaac

SEQ ID NO: 69570 - DNA, 24 bp, Artificial Sequence
  Synthetic oligonucleotide; GAAAAC chr11 5332813 5332836 5332833 +
tgcagtaatttatgtataacaata

SEQ ID NO: 69571 - DNA, 24 bp, Artificial Sequence
  Synthetic oligonucleotide; TAAAAC chr11 5333233 5333256 5333253 +
ttttgcatcacccagactttagca

SEQ ID NO: 69572 - DNA, 24 bp, Artificial Sequence
  Synthetic oligonucleotide; AAAAAC chr11 5333312 5333335 5333332 +
tagtggctctaactcattgtagta

SEQ ID NO: 69573 - DNA, 24 bp, Artificial Sequence
  Synthetic oligonucleotide; GAAAAC chr11 5333633 5333656 5333653 +
gaacataggtggatgtaagataga

SEQ ID NO: 69574 - DNA, 24 bp, Artificial Sequence
  Synthetic oligonucleotide; TAAAAC chr11 5333868 5333891 5333888 +
ttattcatgtaagcacccatcaca

SEQ ID NO: 69575 - DNA, 24 bp, Artificial Sequence
  Synthetic oligonucleotide; GAAAAC chr11 5334338 5334361 5334358 +
agccccatattttctttgcaaaaa

SEQ ID NO: 69576 - DNA, 24 bp, Artificial Sequence
  Synthetic oligonucleotide; GAAAAC chr11 5336257 5336280 5336277 +
gcaggcggcttcctccaatcagtt

SEQ ID NO: 69577 - DNA, 24 bp, Artificial Sequence
  Synthetic oligonucleotide; CAAAAC chr11 5336378 5336401 5336398 +
tgcctttagattgaactgaaacat

SEQ ID NO: 69578 - DNA, 24 bp, Artificial Sequence
  Synthetic oligonucleotide; AAAAAC chr11 5337352 5337375 5337372 +
tagcatctgttgtttcttgacttt

SEQ ID NO: 69579 - DNA, 24 bp, Artificial Sequence
  Synthetic oligonucleotide; AAAAAC chr11 5338633 5338656 5338653 +
tctaaggatttaggctataaaatc

SEQ ID NO: 69580 - DNA, 24 bp, Artificial Sequence
  Synthetic oligonucleotide; AAAAAC chr11 5339806 5339829 5339826 +
attgttacaatgggttttgaatag

SEQ ID NO: 69581 - DNA, 24 bp, Artificial Sequence
  Synthetic oligonucleotide; CAAAAC chr11 5340197 5340220 5340217 +
aaactcaactgaaactaggctgaa

SEQ ID NO: 69582 - DNA, 24 bp, Artificial Sequence
  Synthetic oligonucleotide; GAAAAC chr11 5340282 5340305 5340302 +
gtcctccttgtcactgagtctcag

SEQ ID NO: 69583 - DNA, 24 bp, Artificial Sequence
  Synthetic oligonucleotide; AAAAAC chr11 5340387 5340410 5340407 +
tagtttgaagtcacttgcctgatg

SEQ ID NO: 69584 - DNA, 24 bp, Artificial Sequence
  Synthetic oligonucleotide; GAAAAC chr11 5340793 5340816 5340813 +
ttttatattaaatttccccatcaa

SEQ ID NO: 69585 - DNA, 24 bp, Artificial Sequence
  Synthetic oligonucleotide; GAAAAC chr11 5340897 5340920 5340917 +
acatgtttggttttatgaatgatt

SEQ ID NO: 69586 - DNA, 24 bp, Artificial Sequence
  Synthetic oligonucleotide; AAAAAC chr11 5340908 5340931 5340928 +
tttatgaatgattgaaaacaggac

SEQ ID NO: 69587 - DNA, 24 bp, Artificial Sequence
  Synthetic oligonucleotide; AAAAAC chr11 5340994 5341017 5341014 +
aggtgacatggcgtgacaaggata

SEQ ID NO: 69588 - DNA, 24 bp, Artificial Sequence
  Synthetic oligonucleotide; TAAAAC chr11 5341411 5341434 5341431 +
cacaattctgtaaaatgatcgggg

SEQ ID NO: 69589 - DNA, 24 bp, Artificial Sequence
  Synthetic oligonucleotide; CAAAAC chr11 5342714 5342737 5342734 +
gaacaatatgtggaacctgctttc

SEQ ID NO: 69590 - DNA, 24 bp, Artificial Sequence
  Synthetic oligonucleotide; AAAAAC chr11 5342754 5342777 5342774 +
agacaatccaatcactgtgacata

SEQ ID NO: 69591 - DNA, 24 bp, Artificial Sequence
  Synthetic oligonucleotide; TAAAAC chr11 5343137 5343160 5343157 +
atctaagagggttgcagatggcaa

SEQ ID NO: 69592 - DNA, 24 bp, Artificial Sequence
  Synthetic oligonucleotide; GAAAAC chr11 5343455 5343478 5343475 +
agtgatgagcttcctccaagcctg

SEQ ID NO: 69593 - DNA, 24 bp, Artificial Sequence
  Synthetic oligonucleotide; TAAAAC chr11 5344822 5344845 5344842 +
acaaatataaatgcaagtttaaca

SEQ ID NO: 69594 - DNA, 24 bp, Artificial Sequence
  Synthetic oligonucleotide; GAAAAC chr11 5344946 5344969 5344966 +
ttgaactgagacctcaatacaaaa

SEQ ID NO: 69595 - DNA, 24 bp, Artificial Sequence
  Synthetic oligonucleotide; GAAAAC chr11 5344974 5344997 5344994 +
acctgaccgtatacagacctagag

SEQ ID NO: 69596 - DNA, 24 bp, Artificial Sequence
  Synthetic oligonucleotide; GAAAAC chr11 5345019 5345042 5345039 +
atcagcatgactggcatttgataa

SEQ ID NO: 69597 - DNA, 24 bp, Artificial Sequence
  Synthetic oligonucleotide; AAAAAC chr11 5345360 5345383 5345380 +
gaaatgaaaaaaagagaaaaatag

SEQ ID NO: 69598 - DNA, 24 bp, Artificial Sequence
  Synthetic oligonucleotide; GAAAAC chr11 5347630 5347653 5347650 +
caaaatattcaacctccaacagag

SEQ ID NO: 69599 - DNA, 24 bp, Artificial Sequence
  Synthetic oligonucleotide; AAAAAC chr11 5348031 5348054 5348051 +
tcattgcaggaaccaaggcaaaaa

SEQ ID NO: 69600 - DNA, 24 bp, Artificial Sequence
  Synthetic oligonucleotide; TAAAAC chr11 5348141 5348164 5348161 +
gtcctaaagactccctgacatctc

SEQ ID NO: 69601 - DNA, 24 bp, Artificial Sequence
  Synthetic oligonucleotide; AAAAAC chr11 5349055 5349078 5349075 +
tttgagaattagtttctcattaat

SEQ ID NO: 69602 - DNA, 24 bp, Artificial Sequence
  Synthetic oligonucleotide; GAAAAC chr11 5349218 5349241 5349238 +
gtgaaagcactcagttttcaatat

SEQ ID NO: 69603 - DNA, 24 bp, Artificial Sequence
  Synthetic oligonucleotide; TAAAAC chr11 5349614 5349637 5349634 +
tcatttaacaatgaatacctataa

SEQ ID NO: 69604 - DNA, 24 bp, Artificial Sequence
  Synthetic oligonucleotide; AAAAAC chr11 5349950 5349973 5349970 +
atttaaagtcaaacacaggctcct

SEQ ID NO: 69605 - DNA, 24 bp, Artificial Sequence
  Synthetic oligonucleotide; AAAAAC chr11 5350090 5350113 5350110 +
gaggtacttctctgaaacaataac

SEQ ID NO: 69606 - DNA, 24 bp, Artificial Sequence
  Synthetic oligonucleotide; CAAAAC chr11 5350125 5350148 5350145 +
aataaaaaaattatccactcttta

SEQ ID NO: 69607 - DNA, 24 bp, Artificial Sequence
  Synthetic oligonucleotide; TAAAAC chr11 5352359 5352382 5352379 +
tatgaacccatttatctatagcat

SEQ ID NO: 69608 - DNA, 24 bp, Artificial Sequence
  Synthetic oligonucleotide; TAAAAC chr11 5353210 5353233 5353230 +
atctctatgagaaatgtgttcagt

SEQ ID NO: 69609 - DNA, 24 bp, Artificial Sequence
  Synthetic oligonucleotide; GAAAAC chr11 5353254 5353277 5353274 +
atcaaataatattgataataattt

SEQ ID NO: 69610 - DNA, 24 bp, Artificial Sequence
  Synthetic oligonucleotide; AAAAAC chr11 5353426 5353449 5353446 +
ggcatgtgcaaaatagcagagttg

SEQ ID NO: 69611 - DNA, 24 bp, Artificial Sequence
  Synthetic oligonucleotide; GAAAAC chr11 5353840 5353863 5353860 +
cttgggatgtataaataacacaga

SEQ ID NO: 69612 - DNA, 24 bp, Artificial Sequence
  Synthetic oligonucleotide; GAAAAC chr11 5354730 5354753 5354750 +
tggaagagactcagccactcacag

SEQ ID NO: 69613 - DNA, 24 bp, Artificial Sequence
  Synthetic oligonucleotide; AAAAAC chr11 5354992 5355015 5355012 +
atgtgctctgggaggatatccaca

SEQ ID NO: 69614 - DNA, 24 bp, Artificial Sequence
  Synthetic oligonucleotide; GAAAAC chr11 5355024 5355047 5355044 +
atggatgcatccttgctaacactg

SEQ ID NO: 69615 - DNA, 24 bp, Artificial Sequence
  Synthetic oligonucleotide; AAAAAC chr11 5355279 5355302 5355299 +
attggattttatattaatactttc

SEQ ID NO: 69616 - DNA, 24 bp, Artificial Sequence
  Synthetic oligonucleotide; GAAAAC chr11 5355907 5355930 5355927 +
gcaagctgagggtcctgttagaag

SEQ ID NO: 69617 - DNA, 24 bp, Artificial Sequence
  Synthetic oligonucleotide; AAAAAC chr11 5355939 5355962 5355959 +
acaaacagaaaggacatccacacc

SEQ ID NO: 69618 - DNA, 24 bp, Artificial Sequence
  Synthetic oligonucleotide; TAAAAC chr11 5355983 5356006 5356003 +
ccatcatcaaagaccaaaggtaga

SEQ ID NO: 69619 - DNA, 24 bp, Artificial Sequence
  Synthetic oligonucleotide; AAAAAC chr11 5356002 5356025 5356022 +
gtagataaaaccacaaagatgggg

SEQ ID NO: 69620 - DNA, 24 bp, Artificial Sequence
  Synthetic oligonucleotide; AAAAAC chr11 5356015 5356038 5356035 +
caaagatggggaaaaacagagcag

SEQ ID NO: 69621 - DNA, 24 bp, Artificial Sequence
  Synthetic oligonucleotide; AAAAAC chr11 5356193 5356216 5356213 +
gctcgaacccatggcaaaaaagtt

SEQ ID NO: 69622 - DNA, 24 bp, Artificial Sequence
  Synthetic oligonucleotide; GAAAAC chr11 5356273 5356296 5356293 +
gtccttaaaggacctgatggagct

SEQ ID NO: 69623 - DNA, 24 bp, Artificial Sequence
  Synthetic oligonucleotide; GAAAAC chr11 5356517 5356540 5356537 +
gacgggcagaatggaaccaagttg

SEQ ID NO: 69624 - DNA, 24 bp, Artificial Sequence
  Synthetic oligonucleotide; AAAAAC chr11 5356992 5357015 5357012 +
ggcacaaccggtaccagccactgc

SEQ ID NO: 69625 - DNA, 24 bp, Artificial Sequence
  Synthetic oligonucleotide; GAAAAC chr11 5357273 5357296 5357293 +
ggaggaagatctaccaagaaaatg

SEQ ID NO: 69626 - DNA, 24 bp, Artificial Sequence
  Synthetic oligonucleotide; TAAAAC chr11 5357313 5357336 5357333 +
aggggttgcaatcctcatctctga

SEQ ID NO: 69627 - DNA, 24 bp, Artificial Sequence
  Synthetic oligonucleotide; CAAAAC chr11 5357818 5357841 5357838 +
gaactcaggattaagaaactcact

SEQ ID NO: 69628 - DNA, 24 bp, Artificial Sequence
  Synthetic oligonucleotide; AAAAAC chr11 5358148 5358171 5358168 +
gaactgaaggaaatagagacacaa

SEQ ID NO: 69629 - DNA, 24 bp, Artificial Sequence
  Synthetic oligonucleotide; AAAAAC chr11 5358491 5358514 5358511 +
gcaataattaatagcttaccaacc

SEQ ID NO: 69630 - DNA, 24 bp, Artificial Sequence
  Synthetic oligonucleotide; AAAAAC chr11 5358710 5358733 5358730 +
atatccctgatggacatcgatgca

SEQ ID NO: 69631 - DNA, 24 bp, Artificial Sequence
  Synthetic oligonucleotide; AAAAAC chr11 5358863 5358886 5358883 +
cagcatataaacagaaccaaagac

SEQ ID NO: 69632 - DNA, 24 bp, Artificial Sequence
  Synthetic oligonucleotide; AAAAAC chr11 5358931 5358954 5358951 +
caaaattcaacaacccttcatgct

SEQ ID NO: 69633 - DNA, 24 bp, Artificial Sequence
  Synthetic oligonucleotide; AAAAAC chr11 5359026 5359049 5359046 +
cagccaatatcatactgaatggac

SEQ ID NO: 69634 - DNA, 24 bp, Artificial Sequence
  Synthetic oligonucleotide; GAAAAC chr11 5359048 5359071 5359068 +
acaaaaactggaagcattcccttt

SEQ ID NO: 69635 - DNA, 24 bp, Artificial Sequence
  Synthetic oligonucleotide; GAAAAC chr11 5359213 5359236 5359233 +
gcagatgacacgattgtatatcta

SEQ ID NO: 69636 - DNA, 24 bp, Artificial Sequence
  Synthetic oligonucleotide; AAAAAC chr11 5359611 5359634 5359631 +
aatgactttcttcacagaattgga

SEQ ID NO: 69637 - DNA, 24 bp, Artificial Sequence
  Synthetic oligonucleotide; CAAAAC chr11 5359740 5359763 5359760 +
actatactacaaggctacagtaac

SEQ ID NO: 69638 - DNA, 24 bp, Artificial Sequence
  Synthetic oligonucleotide; CAAAAC chr11 5359762 5359785 5359782 +
accaaaacagcatggtactggtac

SEQ ID NO: 69639 - DNA, 24 bp, Artificial Sequence
  Synthetic oligonucleotide; AAAAAC chr11 5359855 5359878 5359875 +
ctgatctttgacaaacctgacaaa

SEQ ID NO: 69640 - DNA, 24 bp, Artificial Sequence
  Synthetic oligonucleotide; GAAAAC chr11 5359900 5359923 5359920 +
tccctatttaataaatggtgctgg

SEQ ID NO: 69641 - DNA, 24 bp, Artificial Sequence
  Synthetic oligonucleotide; GAAAAC chr11 5360001 5360024 5360021 +
gattacagacttaaatgttagact

SEQ ID NO: 69642 - DNA, 24 bp, Artificial Sequence
  Synthetic oligonucleotide; AAAAAC chr11 5360010 5360033 5360030 +
cttaaatgttagactgaaaaccat

SEQ ID NO: 69643 - DNA, 24 bp, Artificial Sequence
  Synthetic oligonucleotide; GAAAAC chr11 5360023 5360046 5360043 +
ctgaaaaccataaaaactctggaa

SEQ ID NO: 69644 - DNA, 24 bp, Artificial Sequence
  Synthetic oligonucleotide; TAAAAC chr11 5360076 5360099 5360096 +
aggcatgggcaaggacttcatgtc

SEQ ID NO: 69645 - DNA, 24 bp, Artificial Sequence
  Synthetic oligonucleotide; AAAAAC chr11 5360277 5360300 5360297 +
tgaactcaaacaaatttacaagaa

SEQ ID NO: 69646 - DNA, 24 bp, Artificial Sequence
  Synthetic oligonucleotide; CAAAAC chr11 5360402 5360425 5360422 +
actggccatcagagaaatacaaat

SEQ ID NO: 69647 - DNA, 24 bp, Artificial Sequence
  Synthetic oligonucleotide; GAAAAC chr11 5360747 5360770 5360767 +
tccaacaatgatagactggattaa

SEQ ID NO: 69648 - DNA, 24 bp, Artificial Sequence
  Synthetic oligonucleotide; AAAAAC chr11 5360869 5360892 5360889 +
ttctcagcaaactatcgcaaggac

SEQ ID NO: 69649 - DNA, 24 bp, Artificial Sequence
  Synthetic oligonucleotide; TAAAAC chr11 5361099 5361122 5361119 +
cctgcacgttgtgcaaatgtaccc

SEQ ID NO: 69650 - DNA, 24 bp, Artificial Sequence
  Synthetic oligonucleotide; AAAAAC chr11 5361960 5361983 5361980 +
acaagggtatagactaacagaaag

SEQ ID NO: 69651 - DNA, 24 bp, Artificial Sequence
  Synthetic oligonucleotide; GAAAAC chr11 5362997 5363020 5363017 +
ggcagggattggggcatgaaggtt

SEQ ID NO: 69652 - DNA, 24 bp, Artificial Sequence
  Synthetic oligonucleotide; CAAAAC chr11 5363116 5363139 5363136 +
gaagaaagagaccctgagtgtctt

SEQ ID NO: 69653 - DNA, 24 bp, Artificial Sequence
  Synthetic oligonucleotide; AAAAAC chr11 5363752 5363775 5363772 +
tagcattttcatgaggattctatt

SEQ ID NO: 69654 - DNA, 24 bp, Artificial Sequence
  Synthetic oligonucleotide; CAAAAC chr11 5364286 5364309 5364306 +
ccttgaccaccaatcttgacttca

SEQ ID NO: 69655 - DNA, 24 bp, Artificial Sequence
  Synthetic oligonucleotide; TAAAAC chr11 5365041 5365064 5365061 +
cttgggcaaataagggacactcaa

SEQ ID NO: 69656 - DNA, 24 bp, Artificial Sequence
  Synthetic oligonucleotide; GAAAAC chr11 5365287 5365310 5365307 +
taccactggtgtttgccagctgtg

SEQ ID NO: 69657 - DNA, 24 bp, Artificial Sequence
  Synthetic oligonucleotide; AAAAAC chr11 5365543 5365566 5365563 +
ttttcacaaagcatattgatacac

SEQ ID NO: 69658 - DNA, 24 bp, Artificial Sequence
  Synthetic oligonucleotide; AAAAAC chr11 5368536 5368559 5368556 +
ctgtctagctctgacaaagaaaat

SEQ ID NO: 69659 - DNA, 24 bp, Artificial Sequence
  Synthetic oligonucleotide; TAAAAC chr11 5368726 5368749 5368746 +
tgagttactcaaaatattatgctt

SEQ ID NO: 69660 - DNA, 24 bp, Artificial Sequence
  Synthetic oligonucleotide; CAAAAC chr11 5368741 5368764 5368761 +
attatgctttaaaactgaaggaag

SEQ ID NO: 69661 - DNA, 24 bp, Artificial Sequence
  Synthetic oligonucleotide; TAAAAC chr11 5369402 5369425 5369422 +
agaattacatctattatacctcag

SEQ ID NO: 69662 - DNA, 24 bp, Artificial Sequence
  Synthetic oligonucleotide; TAAAAC chr11 5371261 5371284 5371281 +
tctttcacattaggttaatttttt

SEQ ID NO: 69663 - DNA, 24 bp, Artificial Sequence
  Synthetic oligonucleotide; TAAAAC chr11 5371353 5371376 5371373 +
ttaatagagacattgatgaaactg

SEQ ID NO: 69664 - DNA, 24 bp, Artificial Sequence
  Synthetic oligonucleotide; AAAAAC chr11 5371481 5371504 5371501 +
agagtactgatattaaaaatagag

SEQ ID NO: 69665 - DNA, 24 bp, Artificial Sequence
  Synthetic oligonucleotide; GAAAAC chr11 5372788 5372811 5372808 +
acctgagctctggcacattttaca

SEQ ID NO: 69666 - DNA, 24 bp, Artificial Sequence
  Synthetic oligonucleotide; CAAAAC chr11 5372837 5372860 5372857 +
aaccacagaacacccccaaatggc

SEQ ID NO: 69667 - DNA, 24 bp, Artificial Sequence
  Synthetic oligonucleotide; AAAAAC chr11 5372856 5372879 5372876 +
atggccaaaacaatcttgagaaag

SEQ ID NO: 69668 - DNA, 24 bp, Artificial Sequence
  Synthetic oligonucleotide; GAAAAC chr11 5373074 5373097 5373094 +
agtctcctcaacaaatagtgttgg

SEQ ID NO: 69669 - DNA, 24 bp, Artificial Sequence
  Synthetic oligonucleotide; CAAAAC chr11 5373177 5373200 5373197 +
acataaatgtaagacctgaaatca

SEQ ID NO: 69670 - DNA, 24 bp, Artificial Sequence
  Synthetic oligonucleotide; CAAAAC chr11 5374105 5374128 5374125 +
acacggccaggtactcctctgaga

SEQ ID NO: 69671 - DNA, 24 bp, Artificial Sequence
  Synthetic oligonucleotide; GAAAAC chr11 5374262 5374285 5374282 +
gctgagggtcctgtctgttagaag

SEQ ID NO: 69672 - DNA, 24 bp, Artificial Sequence
  Synthetic oligonucleotide; AAAAAC chr11 5374294 5374317 5374314 +
acaaacagaaaggacatccacacc

SEQ ID NO: 69673 - DNA, 24 bp, Artificial Sequence
  Synthetic oligonucleotide; AAAAAC chr11 5374358 5374381 5374378 +
tagatacaaccacaaagttgggga

SEQ ID NO: 69674 - DNA, 24 bp, Artificial Sequence
  Synthetic oligonucleotide; AAAAAC chr11 5374371 5374394 5374391 +
aaagttggggaaaaaacagagcag

SEQ ID NO: 69675 - DNA, 24 bp, Artificial Sequence
  Synthetic oligonucleotide; AAAAAC chr11 5374549 5374572 5374569 +
attcaaaccaaaggcaaagaagat

SEQ ID NO: 69676 - DNA, 24 bp, Artificial Sequence
  Synthetic oligonucleotide; GAAAAC chr11 5374874 5374897 5374894 +
gacggggagaatcgaaccaagttg

SEQ ID NO: 69677 - DNA, 24 bp, Artificial Sequence
  Synthetic oligonucleotide; GAAAAC chr11 5375608 5375631 5375628 +
ggaggaagatctaccaagcaaatg

SEQ ID NO: 69678 - DNA, 24 bp, Artificial Sequence
  Synthetic oligonucleotide; TAAAAC chr11 5375648 5375671 5375668 +
aggggttgcaatcctagtctctga

SEQ ID NO: 69679 - DNA, 24 bp, Artificial Sequence
  Synthetic oligonucleotide; CAAAAC chr11 5376139 5376162 5376159 +
gaactcaggattaagaaactcact

SEQ ID NO: 69680 - DNA, 24 bp, Artificial Sequence
  Synthetic oligonucleotide; AAAAAC chr11 5376468 5376491 5376488 +
agaactgaaggaaacagagacaca

SEQ ID NO: 69681 - DNA, 24 bp, Artificial Sequence
  Synthetic oligonucleotide; CAAAAC chr11 5376522 5376545 5376542 +
gagctggttttttgaaaggatcaa

SEQ ID NO: 69682 - DNA, 24 bp, Artificial Sequence
  Synthetic oligonucleotide; AAAAAC chr11 5377180 5377203 5377200 +
cagcatataaacagaaccaaagac

SEQ ID NO: 69683 - DNA, 24 bp, Artificial Sequence
  Synthetic oligonucleotide; AAAAAC chr11 5377248 5377271 5377268 +
caaaattcaacaacccttcatgct

SEQ ID NO: 69684 - DNA, 24 bp, Artificial Sequence
  Synthetic oligonucleotide; AAAAAC chr11 5377343 5377366 5377363 +
cagccaatatcatactgaatgggc

SEQ ID NO: 69685 - DNA, 24 bp, Artificial Sequence
  Synthetic oligonucleotide; GAAAAC chr11 5377531 5377554 5377551 +
gcagacgacatgattgtatatcta

SEQ ID NO: 69686 - DNA, 24 bp, Artificial Sequence
  Synthetic oligonucleotide; CAAAAC chr11 5377599 5377622 5377619 +
caacttcagcaaagcctcaggata

SEQ ID NO: 69687 - DNA, 24 bp, Artificial Sequence
  Synthetic oligonucleotide; AAAAAC chr11 5377928 5377951 5377948 +
caatgattttcttcacagaattgg

SEQ ID NO: 69688 - DNA, 24 bp, Artificial Sequence
  Synthetic oligonucleotide; CAAAAC chr11 5378057 5378080 5378077 +
actatactacaaggctacagtaac

SEQ ID NO: 69689 - DNA, 24 bp, Artificial Sequence
  Synthetic oligonucleotide; CAAAAC chr11 5378079 5378102 5378099 +
accaaaacagcatgttactggtac

SEQ ID NO: 69690 - DNA, 24 bp, Artificial Sequence
  Synthetic oligonucleotide; AAAAAC chr11 5378158 5378181 5378178 +
atatctacaactatctgatctttg

SEQ ID NO: 69691 - DNA, 24 bp, Artificial Sequence
  Synthetic oligonucleotide; AAAAAC chr11 5378169 5378192 5378189 +
tatctgatctttgaaaaacctgag

SEQ ID NO: 69692 - DNA, 24 bp, Artificial Sequence
  Synthetic oligonucleotide; TAAAAC chr11 5378318 5378341 5378338 +
gattaaagacttaaacattagacc

SEQ ID NO: 69693 - DNA, 24 bp, Artificial Sequence
  Synthetic oligonucleotide; AAAAAC chr11 5378327 5378350 5378347 +
cttaaacattagacctaaaaccat

SEQ ID NO: 69694 - DNA, 24 bp, Artificial Sequence
  Synthetic oligonucleotide; GAAAAC chr11 5378340 5378363 5378360 +
cctaaaaccataaaaaccctagaa

SEQ ID NO: 69695 - DNA, 24 bp, Artificial Sequence
  Synthetic oligonucleotide; TAAAAC chr11 5378393 5378416 5378413 +
aggcatgggcaaggacttcatgtc

SEQ ID NO: 69696 - DNA, 24 bp, Artificial Sequence
  Synthetic oligonucleotide; AAAAAC chr11 5378594 5378617 5378614 +
tgaactcaaacaaatttacaagaa

SEQ ID NO: 69697 - DNA, 24 bp, Artificial Sequence
  Synthetic oligonucleotide; GAAAAC chr11 5378652 5378675 5378672 +
gatatgaacagacacttctcaaaa

SEQ ID NO: 69698 - DNA, 24 bp, Artificial Sequence
  Synthetic oligonucleotide; CAAAAC chr11 5378723 5378746 5378743 +
actggccatcagagaaatgcaaat

SEQ ID NO: 69699 - DNA, 24 bp, Artificial Sequence
  Synthetic oligonucleotide; AAAAAC chr11 5379190 5379213 5379210 +
tctcagtaaactatcgcaaggaca

SEQ ID NO: 69700 - DNA, 24 bp, Artificial Sequence
  Synthetic oligonucleotide; AAAAAC chr11 5379711 5379734 5379731 +
aaacattcagtcaataattcctca

SEQ ID NO: 69701 - DNA, 24 bp, Artificial Sequence
  Synthetic oligonucleotide; CAAAAC chr11 5379957 5379980 5379977 +
aagtcaccagaatcatgaaccaaa

SEQ ID NO: 69702 - DNA, 24 bp, Artificial Sequence
  Synthetic oligonucleotide; TAAAAC chr11 5380034 5380057 5380054 +
caaatcaaaatatgcaaaatacac

SEQ ID NO: 69703 - DNA, 24 bp, Artificial Sequence
  Synthetic oligonucleotide; GAAAAC chr11 5380658 5380681 5380678 +
tctgtaaaaatctgaaaaagctaa

SEQ ID NO: 69704 - DNA, 24 bp, Artificial Sequence
  Synthetic oligonucleotide; GAAAAC chr11 5380928 5380951 5380948 +
atgctccccctggtggctacattg

SEQ ID NO: 69705 - DNA, 24 bp, Artificial Sequence
  Synthetic oligonucleotide; TAAAAC chr11 5381047 5381070 5381067 +
aattctggatagaggttccttaaa

SEQ ID NO: 69706 - DNA, 24 bp, Artificial Sequence
  Synthetic oligonucleotide; GAAAAC chr11 5381181 5381204 5381201 +
cacacaaacaatattacatgcaat

SEQ ID NO: 69707 - DNA, 24 bp, Artificial Sequence
  Synthetic oligonucleotide; TAAAAC chr11 5381700 5381723 5381720 +
aaagaggactattttgtgatatga

SEQ ID NO: 69708 - DNA, 24 bp, Artificial Sequence
  Synthetic oligonucleotide; CAAAAC chr11 5382206 5382229 5382226 +
atcaccggaaaatcttatagttct

SEQ ID NO: 69709 - DNA, 24 bp, Artificial Sequence
  Synthetic oligonucleotide; GAAAAC chr11 5383475 5383498 5383495 +
catatactacatccgacctctctg

SEQ ID NO: 69710 - DNA, 24 bp, Artificial Sequence
  Synthetic oligonucleotide; CAAAAC chr11 5383613 5383636 5383633 +
tgttgcagcagatgtctgtgtagc

SEQ ID NO: 69711 - DNA, 24 bp, Artificial Sequence
  Synthetic oligonucleotide; GAAAAC chr11 5384428 5384451 5384448 +
agaaccagagccagagaaagaaca

SEQ ID NO: 69712 - DNA, 24 bp, Artificial Sequence
  Synthetic oligonucleotide; AAAAAC chr11 5384653 5384676 5384673 +
acaccctctccttactctcatcag

SEQ ID NO: 69713 - DNA, 24 bp, Artificial Sequence
  Synthetic oligonucleotide; AAAAAC chr11 5384827 5384850 5384847 +
tccaaaatcctcctctatcctact

SEQ ID NO: 69714 - DNA, 24 bp, Artificial Sequence
  Synthetic oligonucleotide; AAAAAC chr11 5386123 5386146 5386143 +
gatccgcaagtgtttactggttgg

SEQ ID NO: 69715 - DNA, 24 bp, Artificial Sequence
  Synthetic oligonucleotide; AAAAAC chr11 5386170 5386193 5386190 +
agaaagcaataaatatagaagaat

SEQ ID NO: 69716 - DNA, 24 bp, Artificial Sequence
  Synthetic oligonucleotide; CAAAAC chr11 5386255 5386278 5386275 +
gaaaagatgggtttggaaaggtgc

SEQ ID NO: 69717 - DNA, 24 bp, Artificial Sequence
  Synthetic oligonucleotide; GAAAAC chr11 5386569 5386592 5386589 +
aatgataggagctactgaagtact

SEQ ID NO: 69718 - DNA, 24 bp, Artificial Sequence
  Synthetic oligonucleotide; AAAAAC chr11 5387363 5387386 5387383 +
tgctttagctaagtgggttttaaa

SEQ ID NO: 69719 - DNA, 24 bp, Artificial Sequence
  Synthetic oligonucleotide; AAAAAC chr11 5387980 5388003 5388000 +
gttcttgccattgaaagtaatggt

SEQ ID NO: 69720 - DNA, 24 bp, Artificial Sequence
  Synthetic oligonucleotide; AAAAAC chr11 5388672 5388695 5388692 +
attttaaaccttttttacttcatt

SEQ ID NO: 69721 - DNA, 24 bp, Artificial Sequence
  Synthetic oligonucleotide; TAAAAC chr11 5388902 5388925 5388922 +
gatgtgatatggagaagtctaaca

SEQ ID NO: 69722 - DNA, 24 bp, Artificial Sequence
  Synthetic oligonucleotide; GAAAAC chr11 5389183 5389206 5389203 +
aactgaaataattgaaatacagag

SEQ ID NO: 69723 - DNA, 24 bp, Artificial Sequence
  Synthetic oligonucleotide; TAAAAC chr11 5390366 5390389 5390386 +
aggccagtaaatgagtcctggggc

SEQ ID NO: 69724 - DNA, 24 bp, Artificial Sequence
  Synthetic oligonucleotide; AAAAAC chr11 5390509 5390532 5390529 +
tttatgtctggagttgtggcttta

SEQ ID NO: 69725 - DNA, 24 bp, Artificial Sequence
  Synthetic oligonucleotide; TAAAAC chr11 5390629 5390652 5390649 +
attgaaggtcatcatcaatgtaac

SEQ ID NO: 69726 - DNA, 24 bp, Artificial Sequence
  Synthetic oligonucleotide; AAAAAC chr11 5390651 5390674 5390671 +
actaaaactaaaatgaaactaaat

SEQ ID NO: 69727 - DNA, 24 bp, Artificial Sequence
  Synthetic oligonucleotide; GAAAAC chr11 5392049 5392072 5392069 +
agaccccgattcaaaaataaaaag

SEQ ID NO: 69728 - DNA, 24 bp, Artificial Sequence
  Synthetic oligonucleotide; GAAAAC chr11 5392511 5392534 5392531 +
atacgtacaggtaataacatattt

SEQ ID NO: 69729 - DNA, 24 bp, Artificial Sequence
  Synthetic oligonucleotide; AAAAAC chr11 5392888 5392911 5392908 +
ggcaacagagcaagactccttctc

SEQ ID NO: 69730 - DNA, 24 bp, Artificial Sequence
  Synthetic oligonucleotide; GAAAAC chr11 5392968 5392991 5392988 +
agaggtattttcacataccagaat

SEQ ID NO: 69731 - DNA, 24 bp, Artificial Sequence
  Synthetic oligonucleotide; AAAAAC chr11 5392996 5393019 5393016 +
acataatttaatttgccttttata

SEQ ID NO: 69732 - DNA, 24 bp, Artificial Sequence
  Synthetic oligonucleotide; AAAAAC chr11 5393426 5393449 5393446 +
ggctataaatatttgtatcaaaag

SEQ ID NO: 69733 - DNA, 24 bp, Artificial Sequence
  Synthetic oligonucleotide; GAAAAC chr11 5394014 5394037 5394034 +
tagtatcaggaaaagatagcaaca

SEQ ID NO: 69734 - DNA, 24 bp, Artificial Sequence
  Synthetic oligonucleotide; AAAAAC chr11 5394087 5394110 5394107 +
attttaagagttatagattcacag

SEQ ID NO: 69735 - DNA, 24 bp, Artificial Sequence
  Synthetic oligonucleotide; AAAAAC chr11 5394375 5394398 5394395 +
attcaacaacaacaacaaaccaaa

SEQ ID NO: 69736 - DNA, 24 bp, Artificial Sequence
  Synthetic oligonucleotide; TAAAAC chr11 5394552 5394575 5394572 +
cctttgaaattgatactgtatttg

SEQ ID NO: 69737 - DNA, 24 bp, Artificial Sequence
  Synthetic oligonucleotide; AAAAAC chr11 5395758 5395781 5395778 +
caaagccatatggaaggattgtcc

SEQ ID NO: 69738 - DNA, 24 bp, Artificial Sequence
  Synthetic oligonucleotide; GAAAAC chr11 5396290 5396313 5396310 +
gcagatgacgtgattgcatatcta

SEQ ID NO: 69739 - DNA, 24 bp, Artificial Sequence
  Synthetic oligonucleotide; AAAAAC chr11 5396671 5396694 5396691 +
aatgactttcttcacagaattgga

SEQ ID NO: 69740 - DNA, 24 bp, Artificial Sequence
  Synthetic oligonucleotide; CAAAAC chr11 5396800 5396823 5396820 +
actatactacaaggctacagtaac

SEQ ID NO: 69741 - DNA, 24 bp, Artificial Sequence
  Synthetic oligonucleotide; CAAAAC chr11 5396822 5396845 5396842 +
accaaaacagcatagtactggtac

SEQ ID NO: 69742 - DNA, 24 bp, Artificial Sequence
  Synthetic oligonucleotide; CAAAAC chr11 5396848 5396871 5396868 +
aaacagagatatagaccaatggaa

SEQ ID NO: 69743 - DNA, 24 bp, Artificial Sequence
  Synthetic oligonucleotide; AAAAAC chr11 5396912 5396935 5396932 +
tatctgatctttgacaaacctgag

SEQ ID NO: 69744 - DNA, 24 bp, Artificial Sequence
  Synthetic oligonucleotide; GAAAAC chr11 5396960 5396983 5396980 +
tccctgtttaataaatggtgctgg

SEQ ID NO: 69745 - DNA, 24 bp, Artificial Sequence
  Synthetic oligonucleotide; TAAAAC chr11 5397061 5397084 5397081 +
gattaaagacttaaatgttagacc

SEQ ID NO: 69746 - DNA, 24 bp, Artificial Sequence
  Synthetic oligonucleotide; AAAAAC chr11 5397070 5397093 5397090 +
cttaaatgttagacctaaaaccat

SEQ ID NO: 69747 - DNA, 24 bp, Artificial Sequence
  Synthetic oligonucleotide; GAAAAC chr11 5397083 5397106 5397103 +
cctaaaaccataaaaactctagaa

SEQ ID NO: 69748 - DNA, 24 bp, Artificial Sequence
  Synthetic oligonucleotide; TAAAAC chr11 5397136 5397159 5397156 +
aggcatgggcatggacttcatgtc

SEQ ID NO: 69749 - DNA, 24 bp, Artificial Sequence
  Synthetic oligonucleotide; AAAAAC chr11 5397340 5397363 5397360 +
actcaaacaaatttacaagagaaa

SEQ ID NO: 69750 - DNA, 24 bp, Artificial Sequence
  Synthetic oligonucleotide; CAAAAC chr11 5397462 5397485 5397482 +
actggccatcagagaaatgcaaat

SEQ ID NO: 69751 - DNA, 24 bp, Artificial Sequence
  Synthetic oligonucleotide; TAAAAC chr11 5398160 5398183 5398180 +
cctgcaccttgtgcacatgtaccc

SEQ ID NO: 69752 - DNA, 24 bp, Artificial Sequence
  Synthetic oligonucleotide; GAAAAC chr11 5399079 5399102 5399099 +
cacatcctaaattggtggcagatg

SEQ ID NO: 69753 - DNA, 24 bp, Artificial Sequence
  Synthetic oligonucleotide; CAAAAC chr11 5399084 5399107 5399104 +
cctaaattggtggcagatggaaaa

SEQ ID NO: 69754 - DNA, 24 bp, Artificial Sequence
  Synthetic oligonucleotide; AAAAAC chr11 5399090 5399113 5399110 +
ttggtggcagatggaaaacaaaac

SEQ ID NO: 69755 - DNA, 24 bp, Artificial Sequence
  Synthetic oligonucleotide; AAAAAC chr11 5399430 5399453 5399450 +
gtaagtattaacatctttatcttt

SEQ ID NO: 69756 - DNA, 24 bp, Artificial Sequence
  Synthetic oligonucleotide; GAAAAC chr11 5399778 5399801 5399798 +
atgcaagaaagaaaaaaaaaggaa

SEQ ID NO: 69757 - DNA, 24 bp, Artificial Sequence
  Synthetic oligonucleotide; TAAAAC chr11 5399695 5399718 5399698 -
gtcagatctccttgaaagagatct

SEQ ID NO: 69758 - DNA, 24 bp, Artificial Sequence
  Synthetic oligonucleotide; CAAAAC chr11 5399155 5399178 5399158 -
gagtaacccaagataatatgatgg

SEQ ID NO: 69759 - DNA, 24 bp, Artificial Sequence
  Synthetic oligonucleotide; GAAAAC chr11 5398756 5398779 5398759 -
caagagagagtgagcaagaagagg

SEQ ID NO: 69760 - DNA, 24 bp, Artificial Sequence
  Synthetic oligonucleotide; TAAAAC chr11 5398743 5398766 5398746 -
gcaagaagagggaaaactgcctta

SEQ ID NO: 69761 - DNA, 24 bp, Artificial Sequence
  Synthetic oligonucleotide; GAAAAC chr11 5398724 5398747 5398727 -
ccttataaaaccatcagatctcat

SEQ ID NO: 69762 - DNA, 24 bp, Artificial Sequence
  Synthetic oligonucleotide; AAAAAC chr11 5395513 5395536 5395516 -
aagtccagatctgtcttccccatc

SEQ ID NO: 69763 - DNA, 24 bp, Artificial Sequence
  Synthetic oligonucleotide; CAAAAC chr11 5395367 5395390 5395370 -
cactccaatgacttcctttatcca

SEQ ID NO: 69764 - DNA, 24 bp, Artificial Sequence
  Synthetic oligonucleotide; AAAAAC chr11 5394781 5394804 5394784 -
tcttctgcaggaggttgatgtgaa

SEQ ID NO: 69765 - DNA, 24 bp, Artificial Sequence
  Synthetic oligonucleotide; AAAAAC chr11 5394756 5394779 5394759 -
aaaactaacgtcccctgatgaagc

SEQ ID NO: 69766 - DNA, 24 bp, Artificial Sequence
  Synthetic oligonucleotide; GAAAAC chr11 5394661 5394684 5394664 -
ataggtaacattttagatagaggg

SEQ ID NO: 69767 - DNA, 24 bp, Artificial Sequence
  Synthetic oligonucleotide; CAAAAC chr11 5394626 5394649 5394629 -
caaaggctcagagttgtcacaaag

SEQ ID NO: 69768 - DNA, 24 bp, Artificial Sequence
  Synthetic oligonucleotide; TAAAAC chr11 5394361 5394384 5394364 -
gttgttgaatcagtggagcatagt

SEQ ID NO: 69769 - DNA, 24 bp, Artificial Sequence
  Synthetic oligonucleotide; AAAAAC chr11 5394164 5394187 5394167 -
tacctaggttataatatgtgctta

SEQ ID NO: 69770 - DNA, 24 bp, Artificial Sequence
  Synthetic oligonucleotide; GAAAAC chr11 5393929 5393952 5393932 -
tgggacttccttcagtataacatg

SEQ ID NO: 69771 - DNA, 24 bp, Artificial Sequence
  Synthetic oligonucleotide; TAAAAC chr11 5393769 5393792 5393772 -
ctgtgagcctcagtttcctaattt

SEQ ID NO: 69772 - DNA, 24 bp, Artificial Sequence
  Synthetic oligonucleotide; TAAAAC chr11 5393541 5393564 5393544 -
ttgtaaaatgctctttttagatta

SEQ ID NO: 69773 - DNA, 24 bp, Artificial Sequence
  Synthetic oligonucleotide; TAAAAC chr11 5391087 5391110 5391090 -
tgtcattgttcaatatcacacaac

SEQ ID NO: 69774 - DNA, 24 bp, Artificial Sequence
  Synthetic oligonucleotide; CAAAAC chr11 5390228 5390251 5390231 -
gaatagcaggtggggcatgcttcc

SEQ ID NO: 69775 - DNA, 24 bp, Artificial Sequence
  Synthetic oligonucleotide; GAAAAC chr11 5390050 5390073 5390053 -
gagcaccaggtccagcatcacagt

SEQ ID NO: 69776 - DNA, 24 bp, Artificial Sequence
  Synthetic oligonucleotide; AAAAAC chr11 5388507 5388530 5388510 -
ttgtattttcattcttcctggaat

SEQ ID NO: 69777 - DNA, 24 bp, Artificial Sequence
  Synthetic oligonucleotide; AAAAAC chr11 5387740 5387763 5387743 -
ggcaagtgtgtggctatcttaggg

SEQ ID NO: 69778 - DNA, 24 bp, Artificial Sequence
  Synthetic oligonucleotide; TAAAAC chr11 5387385 5387408 5387388 -
ccaaccaccctataatgttttttt

SEQ ID NO: 69779 - DNA, 24 bp, Artificial Sequence
  Synthetic oligonucleotide; GAAAAC chr11 5386426 5386449 5386429 -
cattttattactacttcacaagga

SEQ ID NO: 69780 - DNA, 24 bp, Artificial Sequence
  Synthetic oligonucleotide; AAAAAC chr11 5386166 5386189 5386169 -
ttctatatttattgctttcttggc

SEQ ID NO: 69781 - DNA, 24 bp, Artificial Sequence
  Synthetic oligonucleotide; AAAAAC chr11 5385629 5385652 5385632 -
tttagaacataaatttatattggc

SEQ ID NO: 69782 - DNA, 24 bp, Artificial Sequence
  Synthetic oligonucleotide; AAAAAC chr11 5385493 5385516 5385496 -
actatatatatatttttttgcatg

SEQ ID NO: 69783 - DNA, 24 bp, Artificial Sequence
  Synthetic oligonucleotide; AAAAAC chr11 5384192 5384215 5384195 -
gtaacagagctagacctcatttct

SEQ ID NO: 69784 - DNA, 24 bp, Artificial Sequence
  Synthetic oligonucleotide; GAAAAC chr11 5384161 5384184 5384164 -
acaaacaaagaaacaacaacaaaa

SEQ ID NO: 69785 - DNA, 24 bp, Artificial Sequence
  Synthetic oligonucleotide; CAAAAC chr11 5383152 5383175 5383155 -
gagccctacaacaagtagccttta

SEQ ID NO: 69786 - DNA, 24 bp, Artificial Sequence
  Synthetic oligonucleotide; CAAAAC chr11 5383012 5383035 5383015 -
catgtgtacatttctcttttcttt

SEQ ID NO: 69787 - DNA, 24 bp, Artificial Sequence
  Synthetic oligonucleotide; CAAAAC chr11 5382891 5382914 5382894 -
ttagagttgtgtggggatgagctc

SEQ ID NO: 69788 - DNA, 24 bp, Artificial Sequence
  Synthetic oligonucleotide; TAAAAC chr11 5382871 5382894 5382874 -
gctccaaaacggggcatacagatc

SEQ ID NO: 69789 - DNA, 24 bp, Artificial Sequence
  Synthetic oligonucleotide; GAAAAC chr11 5382455 5382478 5382458 -
gggcatctatcacacataagatag

SEQ ID NO: 69790 - DNA, 24 bp, Artificial Sequence
  Synthetic oligonucleotide; TAAAAC chr11 5382171 5382194 5382174 -
tttaagagagttaataccttggaa

SEQ ID NO: 69791 - DNA, 24 bp, Artificial Sequence
  Synthetic oligonucleotide; GAAAAC chr11 5381793 5381816 5381796 -
agtttccaagcaatagatttattt

SEQ ID NO: 69792 - DNA, 24 bp, Artificial Sequence
  Synthetic oligonucleotide; AAAAAC chr11 5380716 5380739 5380719 -
catatctacatcttacaaacacat

SEQ ID NO: 69793 - DNA, 24 bp, Artificial Sequence
  Synthetic oligonucleotide; GAAAAC chr11 5380129 5380152 5380132 -
ggaaccgattttcattttcattgt

SEQ ID NO: 69794 - DNA, 24 bp, Artificial Sequence
  Synthetic oligonucleotide; TAAAAC chr11 5379644 5379667 5379647 -
ccttgagcaatgtcaattaaaaaa

SEQ ID NO: 69795 - DNA, 24 bp, Artificial Sequence
  Synthetic oligonucleotide; AAAAAC chr11 5376534 5376557 5376537 -
ctatcagttttgttgatcctttca

SEQ ID NO: 69796 - DNA, 24 bp, Artificial Sequence
  Synthetic oligonucleotide; AAAAAC chr11 5373346 5373369 5373349 -
gttcctatttggccatcttggctc

SEQ ID NO: 69797 - DNA, 24 bp, Artificial Sequence
  Synthetic oligonucleotide; GAAAAC chr11 5372728 5372751 5372731 -
actaaatattttctgcacagcaaa

SEQ ID NO: 69798 - DNA, 24 bp, Artificial Sequence
  Synthetic oligonucleotide; CAAAAC chr11 5372491 5372514 5372494 -
accaatcatcaggaaaatgcaaat

SEQ ID NO: 69799 - DNA, 24 bp, Artificial Sequence
  Synthetic oligonucleotide; GAAAAC chr11 5372354 5372377 5372357 -
atgtaagttaacatagccattata

SEQ ID NO: 69800 - DNA, 24 bp, Artificial Sequence
  Synthetic oligonucleotide; TAAAAC chr11 5371549 5371572 5371552 -
ggtccttcatgttatttccactct

SEQ ID NO: 69801 - DNA, 24 bp, Artificial Sequence
  Synthetic oligonucleotide; CAAAAC chr11 5371144 5371167 5371147 -
ctcagaatgtgtggagagtaattc

SEQ ID NO: 69802 - DNA, 24 bp, Artificial Sequence
  Synthetic oligonucleotide; AAAAAC chr11 5371039 5371062 5371042 -
atcactcaaattatctgctcttgg

SEQ ID NO: 69803 - DNA, 24 bp, Artificial Sequence
  Synthetic oligonucleotide; CAAAAC chr11 5369902 5369925 5369905 -
ttccctttctttctatgttgatag

SEQ ID NO: 69804 - DNA, 24 bp, Artificial Sequence
  Synthetic oligonucleotide; AAAAAC chr11 5369015 5369038 5369018 -
aatatctagtcccagaaggaggct

SEQ ID NO: 69805 - DNA, 24 bp, Artificial Sequence
  Synthetic oligonucleotide; TAAAAC chr11 5368692 5368715 5368695 -
acctcaaattttgctcttgacaga

SEQ ID NO: 69806 - DNA, 24 bp, Artificial Sequence
  Synthetic oligonucleotide; TAAAAC chr11 5368640 5368663 5368643 -
tttctcacaggatgcatgtgagaa

SEQ ID NO: 69807 - DNA, 24 bp, Artificial Sequence
  Synthetic oligonucleotide; CAAAAC chr11 5368334 5368357 5368337 -
atccccacttaaagatgagtggac

SEQ ID NO: 69808 - DNA, 24 bp, Artificial Sequence
  Synthetic oligonucleotide; CAAAAC chr11 5368248 5368271 5368251 -
ttgtaaaccaaactgtttaattcc

SEQ ID NO: 69809 - DNA, 24 bp, Artificial Sequence
  Synthetic oligonucleotide; AAAAAC chr11 5368108 5368131 5368111 -
gcaacaaatctgaatggcagagga

SEQ ID NO: 69810 - DNA, 24 bp, Artificial Sequence
  Synthetic oligonucleotide; AAAAAC chr11 5367615 5367638 5367618 -
tacaggtcataaagaccttgctga

SEQ ID NO: 69811 - DNA, 24 bp, Artificial Sequence
  Synthetic oligonucleotide; TAAAAC chr11 5367161 5367184 5367164 -
tattccagttcacaatgaaataac

SEQ ID NO: 69812 - DNA, 24 bp, Artificial Sequence
  Synthetic oligonucleotide; TAAAAC chr11 5366920 5366943 5366923 -
atgacaccaagtccaggcagggac

SEQ ID NO: 69813 - DNA, 24 bp, Artificial Sequence
  Synthetic oligonucleotide; AAAAAC chr11 5365546 5365569 5365549 -
tttgtgtatcaatatgctttgtga

SEQ ID NO: 69814 - DNA, 24 bp, Artificial Sequence
  Synthetic oligonucleotide; TAAAAC chr11 5364883 5364906 5364886 -
aaattatttactaaaatcatttaa

SEQ ID NO: 69815 - DNA, 24 bp, Artificial Sequence
  Synthetic oligonucleotide; AAAAAC chr11 5363574 5363597 5363577 -
tatcttctttctgcattcacactc

SEQ ID NO: 69816 - DNA, 24 bp, Artificial Sequence
  Synthetic oligonucleotide; AAAAAC chr11 5363365 5363388 5363368 -
tcaacaccatagcttgaagtaaaa

SEQ ID NO: 69817 - DNA, 24 bp, Artificial Sequence
  Synthetic oligonucleotide; AAAAAC chr11 5363359 5363382 5363362 -
ccatagcttgaagtaaaaaaaaac

SEQ ID NO: 69818 - DNA, 24 bp, Artificial Sequence
  Synthetic oligonucleotide; AAAAAC chr11 5363349 5363372 5363352 -
aagtaaaaaaaaacaaaaaccaaa

SEQ ID NO: 69819 - DNA, 24 bp, Artificial Sequence
  Synthetic oligonucleotide; AAAAAC chr11 5363312 5363335 5363315 -
ccaatactgctgcatcatgacttg

SEQ ID NO: 69820 - DNA, 24 bp, Artificial Sequence
  Synthetic oligonucleotide; TAAAAC chr11 5363157 5363180 5363160 -
tctccagactaatcattctgttcg

SEQ ID NO: 69821 - DNA, 24 bp, Artificial Sequence
  Synthetic oligonucleotide; GAAAAC chr11 5362911 5362934 5362914 -
gcgggacacttccagcaatagaaa

SEQ ID NO: 69822 - DNA, 24 bp, Artificial Sequence
  Synthetic oligonucleotide; AAAAAC chr11 5358214 5358237 5358217 -
ctatcaattttgttgatctttttg

SEQ ID NO: 69823 - DNA, 24 bp, Artificial Sequence
  Synthetic oligonucleotide; GAAAAC chr11 5355705 5355728 5355708 -
gtttatttgaaatgacacaccact

SEQ ID NO: 69824 - DNA, 24 bp, Artificial Sequence
  Synthetic oligonucleotide; TAAAAC chr11 5353954 5353977 5353957 -
aatttcacacacagccaagttgag

SEQ ID NO: 69825 - DNA, 24 bp, Artificial Sequence
  Synthetic oligonucleotide; TAAAAC chr11 5353650 5353673 5353653 -
aatatctttcttttaaaattaatt

SEQ ID NO: 69826 - DNA, 24 bp, Artificial Sequence
  Synthetic oligonucleotide; GAAAAC chr11 5352692 5352715 5352695 -
aacaatgtgagttaaattacctga

SEQ ID NO: 69827 - DNA, 24 bp, Artificial Sequence
  Synthetic oligonucleotide; TAAAAC chr11 5352111 5352134 5352114 -
aaagtccaacaagaccattgcaaa

SEQ ID NO: 69828 - DNA, 24 bp, Artificial Sequence
  Synthetic oligonucleotide; AAAAAC chr11 5351204 5351227 5351207 -
tgtaaatcatataacccagaaaat

SEQ ID NO: 69829 - DNA, 24 bp, Artificial Sequence
  Synthetic oligonucleotide; AAAAAC chr11 5350998 5351021 5351001 -
aaagcagatataaagattatatgg

SEQ ID NO: 69830 - DNA, 24 bp, Artificial Sequence
  Synthetic oligonucleotide; TAAAAC chr11 5350592 5350615 5350595 -
caagatcaaggagaattttttttt

SEQ ID NO: 69831 - DNA, 24 bp, Artificial Sequence
  Synthetic oligonucleotide; AAAAAC chr11 5349410 5349433 5349413 -
aaacatataattgataaattaaaa

SEQ ID NO: 69832 - DNA, 24 bp, Artificial Sequence
  Synthetic oligonucleotide; GAAAAC chr11 5349237 5349260 5349240 -
gtttgtcttgtctgttttcatatt

SEQ ID NO: 69833 - DNA, 24 bp, Artificial Sequence
  Synthetic oligonucleotide; TAAAAC chr11 5349153 5349176 5349156 -
tgagtttcagaggggataaaaatc

SEQ ID NO: 69834 - DNA, 24 bp, Artificial Sequence
  Synthetic oligonucleotide; TAAAAC chr11 5347555 5347578 5347558 -
cattgcatttcatagtccttactg

SEQ ID NO: 69835 - DNA, 24 bp, Artificial Sequence
  Synthetic oligonucleotide; GAAAAC chr11 5347460 5347483 5347463 -
gcctgctgcatcccctggaaaaga

SEQ ID NO: 69836 - DNA, 24 bp, Artificial Sequence
  Synthetic oligonucleotide; CAAAAC chr11 5346313 5346336 5346316 -
tagctgaggacacaagaattttca

SEQ ID NO: 69837 - DNA, 24 bp, Artificial Sequence
  Synthetic oligonucleotide; AAAAAC chr11 5345667 5345690 5345670 -
acgaccatctttttaacttaggat

SEQ ID NO: 69838 - DNA, 24 bp, Artificial Sequence
  Synthetic oligonucleotide; GAAAAC chr11 5345146 5345169 5345149 -
tctttactacatttatagtaagaa

SEQ ID NO: 69839 - DNA, 24 bp, Artificial Sequence
  Synthetic oligonucleotide; CAAAAC chr11 5345141 5345164 5345144 -
actacatttatagtaagaagaaaa

SEQ ID NO: 69840 - DNA, 24 bp, Artificial Sequence
  Synthetic oligonucleotide; CAAAAC chr11 5345136 5345159 5345139 -
atttatagtaagaagaaaacaaaa

SEQ ID NO: 69841 - DNA, 24 bp, Artificial Sequence
  Synthetic oligonucleotide; TAAAAC chr11 5344575 5344598 5344578 -
ctagtctagtggcagaaggaatat

SEQ ID NO: 69842 - DNA, 24 bp, Artificial Sequence
  Synthetic oligonucleotide; AAAAAC chr11 5342553 5342576 5342556 -
atcacagtcactctcacagaatgt

SEQ ID NO: 69843 - DNA, 24 bp, Artificial Sequence
  Synthetic oligonucleotide; AAAAAC chr11 5341989 5342012 5341992 -
atcaaattataatgaatttgtctc

SEQ ID NO: 69844 - DNA, 24 bp, Artificial Sequence
  Synthetic oligonucleotide; AAAAAC chr11 5341111 5341134 5341114 -
tgctcatagagagtccaacttaag

SEQ ID NO: 69845 - DNA, 24 bp, Artificial Sequence
  Synthetic oligonucleotide; TAAAAC chr11 5340912 5340935 5340915 -
ttttgtcctgttttcaatcattca

SEQ ID NO: 69846 - DNA, 24 bp, Artificial Sequence
  Synthetic oligonucleotide; GAAAAC chr11 5340573 5340596 5340576 -
tactccaaaaatattgttccctat

SEQ ID NO: 69847 - DNA, 24 bp, Artificial Sequence
  Synthetic oligonucleotide; TAAAAC chr11 5340124 5340147 5340127 -
tgtgaatcttctctaactaatatt

SEQ ID NO: 69848 - DNA, 24 bp, Artificial Sequence
  Synthetic oligonucleotide; CAAAAC chr11 5339825 5339848 5339828 -
tccactcagacatgtttttctatt

SEQ ID NO: 69849 - DNA, 24 bp, Artificial Sequence
  Synthetic oligonucleotide; GAAAAC chr11 5339684 5339707 5339687 -
ccttagcaaattaatacaggaaca

SEQ ID NO: 69850 - DNA, 24 bp, Artificial Sequence
  Synthetic oligonucleotide; AAAAAC chr11 5338294 5338317 5338297 -
aatctgatcttcaacaaacctggt

SEQ ID NO: 69851 - DNA, 24 bp, Artificial Sequence
  Synthetic oligonucleotide; TAAAAC chr11 5338152 5338175 5338155 -
caagatgcattaaagacttaagtg

SEQ ID NO: 69852 - DNA, 24 bp, Artificial Sequence
  Synthetic oligonucleotide; CAAAAC chr11 5338145 5338168 5338148 -
cattaaagacttaagtgtaaaacc

SEQ ID NO: 69853 - DNA, 24 bp, Artificial Sequence
  Synthetic oligonucleotide; AAAAAC chr11 5338136 5338159 5338139 -
cttaagtgtaaaacccaaaactat

SEQ ID NO: 69854 - DNA, 24 bp, Artificial Sequence
  Synthetic oligonucleotide; GAAAAC chr11 5338123 5338146 5338126 -
cccaaaactataaaaactttagaa

SEQ ID NO: 69855 - DNA, 24 bp, Artificial Sequence
  Synthetic oligonucleotide; AAAAAC chr11 5338061 5338084 5338064 -
caaagatttcatgatgaaaatgtc

SEQ ID NO: 69856 - DNA, 24 bp, Artificial Sequence
  Synthetic oligonucleotide; CAAAAC chr11 5337425 5337448 5337428 -
actgatcattagagaaatgcaaat

SEQ ID NO: 69857 - DNA, 24 bp, Artificial Sequence
  Synthetic oligonucleotide; GAAAAC chr11 5336961 5336984 5336964 -
cttcagtaaactaatgcaggaaca

SEQ ID NO: 69858 - DNA, 24 bp, Artificial Sequence
  Synthetic oligonucleotide; AAAAAC chr11 5336623 5336646 5336626 -
actgcattaaaaaaaaataatggc

SEQ ID NO: 69859 - DNA, 24 bp, Artificial Sequence
  Synthetic oligonucleotide; GAAAAC chr11 5336522 5336545 5336525 -
atatgcagagtgagtcatcaagtt

SEQ ID NO: 69860 - DNA, 24 bp, Artificial Sequence
  Synthetic oligonucleotide; AAAAAC chr11 5336201 5336224 5336204 -
ccgatttaaatgttaatcttgcct

SEQ ID NO: 69861 - DNA, 24 bp, Artificial Sequence
  Synthetic oligonucleotide; AAAAAC chr11 5336187 5336210 5336190 -
aatcttgcctaaaaacaccctcac

SEQ ID NO: 69862 - DNA, 24 bp, Artificial Sequence
  Synthetic oligonucleotide; GAAAAC chr11 5334630 5334653 5334633 -
ttgggcaagacttaccaagagaca

SEQ ID NO: 69863 - DNA, 24 bp, Artificial Sequence
  Synthetic oligonucleotide; AAAAAC chr11 5333908 5333931 5333911 -
cctagcaaatgttaactctgaaat

SEQ ID NO: 69864 - DNA, 24 bp, Artificial Sequence
  Synthetic oligonucleotide; GAAAAC chr11 5333139 5333162 5333142 -
atggatataggaagaacgacacag

SEQ ID NO: 69865 - DNA, 24 bp, Artificial Sequence
  Synthetic oligonucleotide; GAAAAC chr11 5332072 5332095 5332075 -
cttcctattctcctactacttggt

SEQ ID NO: 69866 - DNA, 24 bp, Artificial Sequence
  Synthetic oligonucleotide; CAAAAC chr11 5331684 5331707 5331687 -
cgtatagtctagagctgtgctgtc

SEQ ID NO: 69867 - DNA, 24 bp, Artificial Sequence
  Synthetic oligonucleotide; TAAAAC chr11 5330526 5330549 5330529 -
ataaaaattatttcacacatactt

SEQ ID NO: 69868 - DNA, 24 bp, Artificial Sequence
  Synthetic oligonucleotide; CAAAAC chr11 5330500 5330523 5330503 -
aaactaacacgtcacaatgcaaat

SEQ ID NO: 69869 - DNA, 24 bp, Artificial Sequence
  Synthetic oligonucleotide; AAAAAC chr11 5330032 5330055 5330035 -
tctcagcaaactatcgcaaggaca

SEQ ID NO: 69870 - DNA, 24 bp, Artificial Sequence
  Synthetic oligonucleotide; TAAAAC chr11 5329802 5329825 5329805 -
cctgcacattgtgcacatgtaccc

SEQ ID NO: 69871 - DNA, 24 bp, Artificial Sequence
  Synthetic oligonucleotide; AAAAAC chr11 5329748 5329771 5329751 -
aaaaatacattattttggattaac

SEQ ID NO: 69872 - DNA, 24 bp, Artificial Sequence
  Synthetic oligonucleotide; AAAAAC chr11 5328900 5328923 5328903 -
ttttaccaaagtaacaggaaagac

SEQ ID NO: 69873 - DNA, 24 bp, Artificial Sequence
  Synthetic oligonucleotide; CAAAAC chr11 5328129 5328152 5328132 -
ttttcagagaatatttcttcattc

SEQ ID NO: 69874 - DNA, 24 bp, Artificial Sequence
  Synthetic oligonucleotide; AAAAAC chr11 5326432 5326455 5326435 -
catagctgctccacctttatccag

SEQ ID NO: 69875 - DNA, 24 bp, Artificial Sequence
  Synthetic oligonucleotide; AAAAAC chr11 5326039 5326062 5326042 -
ttttttctgctcataaatataata

SEQ ID NO: 69876 - DNA, 24 bp, Artificial Sequence
  Synthetic oligonucleotide; TAAAAC chr11 5325841 5325864 5325844 -
aaattttttatttttaaaattttt

SEQ ID NO: 69877 - DNA, 24 bp, Artificial Sequence
  Synthetic oligonucleotide; GAAAAC chr11 5325439 5325462 5325442 -
ttgatactgaggccattttatgaa

SEQ ID NO: 69878 - DNA, 24 bp, Artificial Sequence
  Synthetic oligonucleotide; GAAAAC chr11 5325316 5325339 5325319 -
cccctcttggatcgtggcaaccaa

SEQ ID NO: 69879 - DNA, 24 bp, Artificial Sequence
  Synthetic oligonucleotide; GAAAAC chr11 5325185 5325208 5325188 -
aagcagagagaggtaagaaggaca

SEQ ID NO: 69880 - DNA, 24 bp, Artificial Sequence
  Synthetic oligonucleotide; TAAAAC chr11 5324761 5324784 5324764 -
gatggtgatgcacgctatagtgca

SEQ ID NO: 69881 - DNA, 24 bp, Artificial Sequence
  Synthetic oligonucleotide; AAAAAC chr11 5324726 5324749 5324729 -
cattcaatttccaaaaaaaatgag

SEQ ID NO: 69882 - DNA, 24 bp, Artificial Sequence
  Synthetic oligonucleotide; AAAAAC chr11 5324708 5324731 5324711 -
aatgagaaaaactgcattaactga

SEQ ID NO: 69883 - DNA, 24 bp, Artificial Sequence
  Synthetic oligonucleotide; AAAAAC chr11 5324447 5324470 5324450 -
ctcagtattttttctaattaggga

SEQ ID NO: 69884 - DNA, 24 bp, Artificial Sequence
  Synthetic oligonucleotide; CAAAAC chr11 5323423 5323446 5323426 -
aatgaaccctgtcatctacagcat

SEQ ID NO: 69885 - DNA, 24 bp, Artificial Sequence
  Synthetic oligonucleotide; AAAAAC chr11 5323062 5323085 5323065 -
aaggcagaacatataatctctatg

SEQ ID NO: 69886 - DNA, 24 bp, Artificial Sequence
  Synthetic oligonucleotide; AAAAAC chr11 5322642 5322665 5322645 -
tttgcccaaaaaaatcttagaagg

SEQ ID NO: 69887 - DNA, 24 bp, Artificial Sequence
  Synthetic oligonucleotide; GAAAAC chr11 5322199 5322222 5322202 -
tttcatccacaaatttcaaaaggg

SEQ ID NO: 69888 - DNA, 24 bp, Artificial Sequence
  Synthetic oligonucleotide; AAAAAC chr11 5321270 5321293 5321273 -
aggacagcttcctttaaattctct

SEQ ID NO: 69889 - DNA, 24 bp, Artificial Sequence
  Synthetic oligonucleotide; TAAAAC chr11 5321047 5321070 5321050 -
catcttttctacaaagtcagcatg

SEQ ID NO: 69890 - DNA, 24 bp, Artificial Sequence
  Synthetic oligonucleotide; CAAAAC chr11 5320934 5320957 5320937 -
tcaatggaactactctccattcag

SEQ ID NO: 69891 - DNA, 24 bp, Artificial Sequence
  Synthetic oligonucleotide; CAAAAC chr11 5320798 5320821 5320801 -
ctaatgctactgataacaactagt

SEQ ID NO: 69892 - DNA, 24 bp, Artificial Sequence
  Synthetic oligonucleotide; CAAAAC chr11 5319572 5319595 5319575 -
gaaagatctctacaaggagaacta

SEQ ID NO: 69893 - DNA, 24 bp, Artificial Sequence
  Synthetic oligonucleotide; AAAAAC chr11 5319402 5319425 5319405 -
caatgtcattcttcacagtattag

SEQ ID NO: 69894 - DNA, 24 bp, Artificial Sequence
  Synthetic oligonucleotide; GAAAAC chr11 5318885 5318908 5318888 -
cacattgactaaggaaacacaata

SEQ ID NO: 69895 - DNA, 24 bp, Artificial Sequence
  Synthetic oligonucleotide; AAAAAC chr11 5318828 5318851 5318831 -
catctgatcttcaacaacactgac

SEQ ID NO: 69896 - DNA, 24 bp, Artificial Sequence
  Synthetic oligonucleotide; CAAAAC chr11 5318699 5318722 5318702 -
agagaaatcaactgaaaatgaatt

SEQ ID NO: 69897 - DNA, 24 bp, Artificial Sequence
  Synthetic oligonucleotide; AAAAAC chr11 5318388 5318411 5318391 -
tctcagcaaactatcacaaggaca

SEQ ID NO: 69898 - DNA, 24 bp, Artificial Sequence
  Synthetic oligonucleotide; CAAAAC chr11 5317859 5317882 5317862 -
atcactaatgagagaaatgcaaat

SEQ ID NO: 69899 - DNA, 24 bp, Artificial Sequence
  Synthetic oligonucleotide; AAAAAC chr11 5317802 5317825 5317805 -
agaatagctatttttaaaaagcca

SEQ ID NO: 69900 - DNA, 24 bp, Artificial Sequence
  Synthetic oligonucleotide; GAAAAC chr11 5317719 5317742 5317722 -
atgtaaattagttcaaccactgca

SEQ ID NO: 69901 - DNA, 24 bp, Artificial Sequence
  Synthetic oligonucleotide; GAAAAC chr11 5317634 5317657 5317637 -
ccgctactgggtatatatccatag

SEQ ID NO: 69902 - DNA, 24 bp, Artificial Sequence
  Synthetic oligonucleotide; AAAAAC chr11 5317220 5317243 5317223 -
cactgcatgcaatatatccatgta

SEQ ID NO: 69903 - DNA, 24 bp, Artificial Sequence
  Synthetic oligonucleotide; AAAAAC chr11 5317165 5317188 5317168 -
agtaaatgttgaaaatttaaaaga

SEQ ID NO: 69904 - DNA, 24 bp, Artificial Sequence
  Synthetic oligonucleotide; AAAAAC chr11 5317151 5317174 5317154 -
atttaaaagaaaaaacaaataaat

SEQ ID NO: 69905 - DNA, 24 bp, Artificial Sequence
  Synthetic oligonucleotide; GAAAAC chr11 5316307 5316330 5316310 -
gtggtgctcatggattagcttcag

SEQ ID NO: 69906 - DNA, 24 bp, Artificial Sequence
  Synthetic oligonucleotide; TAAAAC chr11 5316214 5316237 5316217 -
ctcatggcttttgttagaattcca

SEQ ID NO: 69907 - DNA, 24 bp, Artificial Sequence
  Synthetic oligonucleotide; CAAAAC chr11 5316193 5316216 5316196 -
ccataaaacattaacattctattt

SEQ ID NO: 69908 - DNA, 24 bp, Artificial Sequence
  Synthetic oligonucleotide; CAAAAC chr11 5316165 5316188 5316168 -
actaaacaaagaaaagttttctaa

SEQ ID NO: 69909 - DNA, 24 bp, Artificial Sequence
  Synthetic oligonucleotide; AAAAAC chr11 5315756 5315779 5315759 -
aatacagtttcacaagaaggtagt

SEQ ID NO: 69910 - DNA, 24 bp, Artificial Sequence
  Synthetic oligonucleotide; TAAAAC chr11 5315049 5315072 5315052 -
tgtcttttcttatatcctgatcct

SEQ ID NO: 69911 - DNA, 24 bp, Artificial Sequence
  Synthetic oligonucleotide; TAAAAC chr11 5314465 5314488 5314468 -
gtggaatactattgaatatggaga

SEQ ID NO: 69912 - DNA, 24 bp, Artificial Sequence
  Synthetic oligonucleotide; CAAAAC chr11 5314246 5314269 5314249 -
ggtcatggaactctactataatct

SEQ ID NO: 69913 - DNA, 24 bp, Artificial Sequence
  Synthetic oligonucleotide; TAAAAC chr11 5312312 5312335 5312315 -
caaagaataaaagaaatccaaatt

SEQ ID NO: 69914 - DNA, 24 bp, Artificial Sequence
  Synthetic oligonucleotide; AAAAAC chr11 5311520 5311543 5311523 -
ttcaaactgtagaactagactttt

SEQ ID NO: 69915 - DNA, 24 bp, Artificial Sequence
  Synthetic oligonucleotide; AAAAAC chr11 5310581 5310604 5310584 -
ctaaaattttgtattacaccaaat

SEQ ID NO: 69916 - DNA, 24 bp, Artificial Sequence
  Synthetic oligonucleotide; TAAAAC chr11 5309443 5309466 5309446 -
caagttttctgtatgtccttgtat

SEQ ID NO: 69917 - DNA, 24 bp, Artificial Sequence
  Synthetic oligonucleotide; TAAAAC chr11 5309416 5309439 5309419 -
aactttttcatactgaatcaattg

SEQ ID NO: 69918 - DNA, 24 bp, Artificial Sequence
  Synthetic oligonucleotide; TAAAAC chr11 5308985 5309008 5308988 -
taagttggctaaggcccttcaaat

SEQ ID NO: 69919 - DNA, 24 bp, Artificial Sequence
  Synthetic oligonucleotide; GAAAAC chr11 5308393 5308416 5308396 -
taacttctttcaacgtaatctcca

SEQ ID NO: 69920 - DNA, 24 bp, Artificial Sequence
  Synthetic oligonucleotide; AAAAAC chr11 5308075 5308098 5308078 -
gacttggtgtatttagacatcaac

SEQ ID NO: 69921 - DNA, 24 bp, Artificial Sequence
  Synthetic oligonucleotide; TAAAAC chr11 5308015 5308038 5308018 -
gagaatataagttccataagtggt

SEQ ID NO: 69922 - DNA, 24 bp, Artificial Sequence
  Synthetic oligonucleotide; AAAAAC chr11 5307965 5307988 5307968 -
tgcagccaaagtactaagaaggaa

SEQ ID NO: 69923 - DNA, 24 bp, Artificial Sequence
  Synthetic oligonucleotide; CAAAAC chr11 5307444 5307467 5307447 -
ttgtaaaggtctacaatttggcta

SEQ ID NO: 69924 - DNA, 24 bp, Artificial Sequence
  Synthetic oligonucleotide; GAAAAC chr11 5305962 5305985 5305965 -
ggtcatgctcagaaaccgcaaaga

SEQ ID NO: 69925 - DNA, 24 bp, Artificial Sequence
  Synthetic oligonucleotide; TAAAAC chr11 5303989 5304012 5303992 -
ccagtaattaccacacagttttaa

SEQ ID NO: 69926 - DNA, 24 bp, Artificial Sequence
  Synthetic oligonucleotide; GAAAAC chr11 5303945 5303968 5303948 -
tgtcccaaacgcagctcaggtttt

SEQ ID NO: 69927 - DNA, 24 bp, Artificial Sequence
  Synthetic oligonucleotide; CAAAAC chr11 5302844 5302867 5302847 -
ttttcatgtttgtccctaatgtgc

SEQ ID NO: 69928 - DNA, 24 bp, Artificial Sequence
  Synthetic oligonucleotide; GAAAAC chr11 5302010 5302033 5302013 -
acaagaagattgtgagagaaaaaa

SEQ ID NO: 69929 - DNA, 24 bp, Artificial Sequence
  Synthetic oligonucleotide; CAAAAC chr11 5301958 5301981 5301961 -
cctaaaaaatatcttctccacctg

SEQ ID NO: 69930 - DNA, 24 bp, Artificial Sequence
  Synthetic oligonucleotide; TAAAAC chr11 5301403 5301426 5301406 -
cattttgcctccatcaagatgtca

SEQ ID NO: 69931 - DNA, 24 bp, Artificial Sequence
  Synthetic oligonucleotide; AAAAAC chr11 5300148 5300171 5300151 -
tgaaatagttttgataattaatgc

SEQ ID NO: 69932 - DNA, 24 bp, Artificial Sequence
  Synthetic oligonucleotide; GAAAAC chr11 5299690 5299713 5299693 -
agatttgataagaaaatacttact

SEQ ID NO: 69933 - DNA, 24 bp, Artificial Sequence
  Synthetic oligonucleotide; AAAAAC chr11 5299624 5299647 5299627 -
ggcccatttggatgcaggaaaaat

SEQ ID NO: 69934 - DNA, 24 bp, Artificial Sequence
  Synthetic oligonucleotide; AAAAAC chr11 5299330 5299353 5299333 -
actgaaaggatgtctgtaagagta

SEQ ID NO: 69935 - DNA, 24 bp, Artificial Sequence
  Synthetic oligonucleotide; TAAAAC chr11 5297750 5297773 5297753 -
tattgaccaataaggaacagaaaa

SEQ ID NO: 69936 - DNA, 24 bp, Artificial Sequence
  Synthetic oligonucleotide; CAAAAC chr11 5297412 5297435 5297415 -
cttaggtaggttaagtaatttatc

SEQ ID NO: 69937 - DNA, 24 bp, Artificial Sequence
  Synthetic oligonucleotide; TAAAAC chr11 5296572 5296595 5296575 -
tcatgttacaataacggaagagat

SEQ ID NO: 69938 - DNA, 24 bp, Artificial Sequence
  Synthetic oligonucleotide; TAAAAC chr11 5296369 5296392 5296372 -
tccttgatagaaaatgagaagaga

SEQ ID NO: 69939 - DNA, 24 bp, Artificial Sequence
  Synthetic oligonucleotide; GAAAAC chr11 5296075 5296098 5296078 -
ttttaaatagttaggaataatgta

SEQ ID NO: 69940 - DNA, 24 bp, Artificial Sequence
  Synthetic oligonucleotide; TAAAAC chr11 5295055 5295078 5295058 -
cttatttttactgcttaaacataa

SEQ ID NO: 69941 - DNA, 24 bp, Artificial Sequence
  Synthetic oligonucleotide; CAAAAC chr11 5293763 5293786 5293766 -
taaatgcaccaatcagtgccctgt

SEQ ID NO: 69942 - DNA, 24 bp, Artificial Sequence
  Synthetic oligonucleotide; AAAAAC chr11 5292376 5292399 5292379 -
gtcatcctcacggtgactaacgca

SEQ ID NO: 69943 - DNA, 24 bp, Artificial Sequence
  Synthetic oligonucleotide; AAAAAC chr11 5291558 5291581 5291561 -
atgttattgatagtcacaatgaca

SEQ ID NO: 69944 - DNA, 24 bp, Artificial Sequence
  Synthetic oligonucleotide; GAAAAC chr11 5290748 5290771 5290751 -
tacaagctatacttaactcacttg

SEQ ID NO: 69945 - DNA, 24 bp, Artificial Sequence
  Synthetic oligonucleotide; AAAAAC chr11 5289970 5289993 5289973 -
tgtcaaaggaagtcaaaagatgtg

SEQ ID NO: 69946 - DNA, 24 bp, Artificial Sequence
  Synthetic oligonucleotide; TAAAAC chr11 5289440 5289463 5289443 -
gcctgatttaagcctttttggtca

SEQ ID NO: 69947 - DNA, 24 bp, Artificial Sequence
  Synthetic oligonucleotide; AAAAAC chr11 5289017 5289040 5289020 -
accttgcctcacgaaacagaatac

SEQ ID NO: 69948 - DNA, 24 bp, Artificial Sequence
  Synthetic oligonucleotide; AAAAAC chr11 5289002 5289025 5289005 -
acagaatacaaaaacaaacaaaca

SEQ ID NO: 69949 - DNA, 24 bp, Artificial Sequence
  Synthetic oligonucleotide; GAAAAC chr11 5288695 5288718 5288698 -
aaattgtctattgtcaatttatgg

SEQ ID NO: 69950 - DNA, 24 bp, Artificial Sequence
  Synthetic oligonucleotide; GAAAAC chr11 5287022 5287045 5287025 -
actgcaatcattcttgctgcaggt

SEQ ID NO: 69951 - DNA, 24 bp, Artificial Sequence
  Synthetic oligonucleotide; AAAAAC chr11 5286845 5286868 5286848 -
ttatccccattttactacagttaa

SEQ ID NO: 69952 - DNA, 24 bp, Artificial Sequence
  Synthetic oligonucleotide; GAAAAC chr11 5286399 5286422 5286402 -
ttagatggttaactttgtgaagtt

SEQ ID NO: 69953 - DNA, 24 bp, Artificial Sequence
  Synthetic oligonucleotide; AAAAAC chr11 5285195 5285218 5285198 -
tccatcctcacgctaactccataa

SEQ ID NO: 69954 - DNA, 24 bp, Artificial Sequence
  Synthetic oligonucleotide; CAAAAC chr11 5283191 5283214 5283194 -
ctgaagacagtgttttttccacag

SEQ ID NO: 69955 - DNA, 24 bp, Artificial Sequence
  Synthetic oligonucleotide; GAAAAC chr11 5282920 5282943 5282923 -
gacaaattataagcagacacttga

SEQ ID NO: 69956 - DNA, 24 bp, Artificial Sequence
  Synthetic oligonucleotide; GAAAAC chr11 5282058 5282081 5282061 -
tatatttatcataatactgtaaca

SEQ ID NO: 69957 - DNA, 24 bp, Artificial Sequence
  Synthetic oligonucleotide; CAAAAC chr11 5281029 5281052 5281032 -
gtgtttagcatccagcaggtgctt

SEQ ID NO: 69958 - DNA, 24 bp, Artificial Sequence
  Synthetic oligonucleotide; TAAAAC chr11 5280633 5280656 5280636 -
aaaaggagaagctgaccacctgac

SEQ ID NO: 69959 - DNA, 24 bp, Artificial Sequence
  Synthetic oligonucleotide; GAAAAC chr11 5280325 5280348 5280328 -
caaggatatggaagaggaaggcat

SEQ ID NO: 69960 - DNA, 24 bp, Artificial Sequence
  Synthetic oligonucleotide; GAAAAC chr11 5280312 5280335 5280315 -
gaggaaggcatgaaaacaggaaaa

SEQ ID NO: 69961 - DNA, 24 bp, Artificial Sequence
  Synthetic oligonucleotide; AAAAAC chr11 5280043 5280066 5280046 -
actgtgaaggactacaagaggatg

SEQ ID NO: 69962 - DNA, 24 bp, Artificial Sequence
  Synthetic oligonucleotide; AAAAAC chr11 5280006 5280029 5280009 -
gacagacataatgcttgtgggaga

SEQ ID NO: 69963 - DNA, 24 bp, Artificial Sequence
  Synthetic oligonucleotide; AAAAAC chr11 5279595 5279618 5279598 -
agagaagatttagtgatgctatgt

SEQ ID NO: 69964 - DNA, 24 bp, Artificial Sequence
  Synthetic oligonucleotide; AAAAAC chr11 5279385 5279408 5279388 -
tttaaatcacaaattaattagaaa

SEQ ID NO: 69965 - DNA, 24 bp, Artificial Sequence
  Synthetic oligonucleotide; AAAAAC chr11 5278974 5278997 5278977 -
cttattcaattctacacatggagg

SEQ ID NO: 69966 - DNA, 24 bp, Artificial Sequence
  Synthetic oligonucleotide; AAAAAC chr11 5278548 5278571 5278551 -
tccagagcgagactctgtctaaag

SEQ ID NO: 69967 - DNA, 24 bp, Artificial Sequence
  Synthetic oligonucleotide; GAAAAC chr11 5278542 5278565 5278545 -
gcgagactctgtctaaagaaaaac

SEQ ID NO: 69968 - DNA, 24 bp, Artificial Sequence
  Synthetic oligonucleotide; CAAAAC chr11 5278517 5278540 5278520 -
aaaacaaacaaacaaacaaacaaa

SEQ ID NO: 69969 - DNA, 24 bp, Artificial Sequence
  Synthetic oligonucleotide; TAAAAC chr11 5277836 5277859 5277839 -
gatagtttcctatatcatttataa

SEQ ID NO: 69970 - DNA, 24 bp, Artificial Sequence
  Synthetic oligonucleotide; GAAAAC chr11 5277276 5277299 5277279 -
agctctttccactatcaagtccat

SEQ ID NO: 69971 - DNA, 24 bp, Artificial Sequence
  Synthetic oligonucleotide; GAAAAC chr11 5276996 5277019 5276999 -
ttttgtaggctgagatttgctctt

SEQ ID NO: 69972 - DNA, 24 bp, Artificial Sequence
  Synthetic oligonucleotide; AAAAAC chr11 5276858 5276881 5276861 -
ttcatcagtcaggtaaaagtaaag

SEQ ID NO: 69973 - DNA, 24 bp, Artificial Sequence
  Synthetic oligonucleotide; CAAAAC chr11 5276720 5276743 5276723 -
tggacatcagtgttatgtgaggtt

SEQ ID NO: 69974 - DNA, 24 bp, Artificial Sequence
  Synthetic oligonucleotide; TAAAAC chr11 5276184 5276207 5276187 -
cacacacacacatatatatatata

SEQ ID NO: 69975 - DNA, 24 bp, Artificial Sequence
  Synthetic oligonucleotide; GAAAAC chr11 5275869 5275892 5275872 -
gggtttgcccatctctgttgatta

SEQ ID NO: 69976 - DNA, 24 bp, Artificial Sequence
  Synthetic oligonucleotide; CAAAAC chr11 5275864 5275887 5275867 -
tgcccatctctgttgattagaaaa

SEQ ID NO: 69977 - DNA, 24 bp, Artificial Sequence
  Synthetic oligonucleotide; GAAAAC chr11 5275831 5275854 5275834 -
ataaaataagcccctaagctccca

SEQ ID NO: 69978 - DNA, 24 bp, Artificial Sequence
  Synthetic oligonucleotide; CAAAAC chr11 5275552 5275575 5275555 -
tcagcatcctcacccttagtgaca

SEQ ID NO: 69979 - DNA, 24 bp, Artificial Sequence
  Synthetic oligonucleotide; AAAAAC chr11 5275051 5275074 5275054 -
cattaggcaatgcaatttaattaa

SEQ ID NO: 69980 - DNA, 24 bp, Artificial Sequence
  Synthetic oligonucleotide; GAAAAC chr11 5274375 5274398 5274378 -
acccctgaacttaaaataaaagtt

SEQ ID NO: 69981 - DNA, 24 bp, Artificial Sequence
  Synthetic oligonucleotide; AAAAAC chr11 5273983 5274006 5273986 -
atttatttcttagataataccatg

SEQ ID NO: 69982 - DNA, 24 bp, Artificial Sequence
  Synthetic oligonucleotide; GAAAAC chr11 5272942 5272965 5272945 -
gtggatctgtagcaaattccccct

SEQ ID NO: 69983 - DNA, 24 bp, Artificial Sequence
  Synthetic oligonucleotide; AAAAAC chr11 5272019 5272042 5272022 -
cctatgtatattatttgatgcaat

SEQ ID NO: 69984 - DNA, 24 bp, Artificial Sequence
  Synthetic oligonucleotide; AAAAAC chr11 5269541 5269564 5269544 -
ctgacttcctttggagatgctatt

SEQ ID NO: 69985 - DNA, 24 bp, Artificial Sequence
  Synthetic oligonucleotide; CAAAAC chr11 5269307 5269330 5269310 -
cagcagacttctagtgagcataac

SEQ ID NO: 69986 - DNA, 24 bp, Artificial Sequence
  Synthetic oligonucleotide; AAAAAC chr11 5268879 5268902 5268882 -
caaaaattagacaattgcttaaag

SEQ ID NO: 69987 - DNA, 24 bp, Artificial Sequence
  Synthetic oligonucleotide; AAAAAC chr11 5268026 5268049 5268029 -
ttgtggtacatgtcacttttcatt

SEQ ID NO: 69988 - DNA, 24 bp, Artificial Sequence
  Synthetic oligonucleotide; AAAAAC chr11 5268020 5268043 5268023 -
tacatgtcacttttcattaaaaac

SEQ ID NO: 69989 - DNA, 24 bp, Artificial Sequence
  Synthetic oligonucleotide; CAAAAC chr11 5268015 5268038 5268018 -
gtcacttttcattaaaaacaaaaa

SEQ ID NO: 69990 - DNA, 24 bp, Artificial Sequence
  Synthetic oligonucleotide; CAAAAC chr11 5268010 5268033 5268013 -
ttttcattaaaaacaaaaacaaaa

SEQ ID NO: 69991 - DNA, 24 bp, Artificial Sequence
  Synthetic oligonucleotide; CAAAAC chr11 5268005 5268028 5268008 -
attaaaaacaaaaacaaaacaaaa

SEQ ID NO: 69992 - DNA, 24 bp, Artificial Sequence
  Synthetic oligonucleotide; TAAAAC chr11 5267671 5267694 5267674 -
gaatactaataaaggcttaaattc

SEQ ID NO: 69993 - DNA, 24 bp, Artificial Sequence
  Synthetic oligonucleotide; AAAAAC chr11 5266432 5266455 5266435 -
cttttttagctcccacagatgaat

SEQ ID NO: 69994 - DNA, 24 bp, Artificial Sequence
  Synthetic oligonucleotide; AAAAAC chr11 5260316 5260339 5260319 -
attctctcagcatttgtttttctg

SEQ ID NO: 69995 - DNA, 24 bp, Artificial Sequence
  Synthetic oligonucleotide; AAAAAC chr11 5259803 5259826 5259806 -
gtctttgttggattgggttaattc

SEQ ID NO: 69996 - DNA, 24 bp, Artificial Sequence
  Synthetic oligonucleotide; CAAAAC chr11 5257954 5257977 5257957 -
tctctctctctttttcttctcccc

SEQ ID NO: 69997 - DNA, 24 bp, Artificial Sequence
  Synthetic oligonucleotide; CAAAAC chr11 5257712 5257735 5257715 -
cacaggcaataagggctttttaag

SEQ ID NO: 69998 - DNA, 24 bp, Artificial Sequence
  Synthetic oligonucleotide; GAAAAC chr11 5257143 5257166 5257146 -
gaaaatacatgggaaagaatgctt

SEQ ID NO: 69999 - DNA, 24 bp, Artificial Sequence
  Synthetic oligonucleotide; GAAAAC chr11 5256918 5256941 5256921 -
tttggataaatggggaagttgttt

SEQ ID NO: 70000 - DNA, 24 bp, Artificial Sequence
  Synthetic oligonucleotide; AAAAAC chr11 5255970 5255993 5255973 -
aaggtcatggatcgagttcagaga

SEQ ID NO: 70001 - DNA, 24 bp, Artificial Sequence
  Synthetic oligonucleotide; CAAAAC chr11 5255959 5255982 5255962 -
tcgagttcagagaaaaaacaaaag

SEQ ID NO: 70002 - DNA, 24 bp, Artificial Sequence
  Synthetic oligonucleotide; AAAAAC chr11 5255910 5255933 5255913 -
aaatcccaaagaaaaaataaagaa

SEQ ID NO: 70003 - DNA, 24 bp, Artificial Sequence
  Synthetic oligonucleotide; TAAAAC chr11 5255783 5255806 5255786 -
cacagtgtgtggactattagtcaa

SEQ ID NO: 70004 - DNA, 24 bp, Artificial Sequence
  Synthetic oligonucleotide; CAAAAC chr11 5255608 5255631 5255611 -
ttaccgagcatagaagagctacac

SEQ ID NO: 70005 - DNA, 24 bp, Artificial Sequence
  Synthetic oligonucleotide; TAAAAC chr11 5255341 5255364 5255344 -
atgagaacttaagagataatggcc

SEQ ID NO: 70006 - DNA, 24 bp, Artificial Sequence
  Synthetic oligonucleotide; TAAAAC chr11 5255231 5255254 5255234 -
catcaaaaatcctggacctatgcc

SEQ ID NO: 70007 - DNA, 24 bp, Artificial Sequence
  Synthetic oligonucleotide; AAAAAC chr11 5255137 5255160 5255140 -
actggagctacagacaagaaggtg

SEQ ID NO: 70008 - DNA, 24 bp, Artificial Sequence
  Synthetic oligonucleotide; GAAAAC chr11 5255090 5255113 5255093 -
ctggtatcttctatggtgggagaa

SEQ ID NO: 70009 - DNA, 24 bp, Artificial Sequence
  Synthetic oligonucleotide; TAAAAC chr11 5253984 5254007 5253987 -
ttcccctatttttgttattcgttt

SEQ ID NO: 70010 - DNA, 24 bp, Artificial Sequence
  Synthetic oligonucleotide; TAAAAC chr11 5251515 5251538 5251518 -
tttctttgtcctttttttttttag

SEQ ID NO: 70011 - DNA, 24 bp, Artificial Sequence
  Synthetic oligonucleotide; AAAAAC chr11 5251020 5251043 5251023 -
agagatcatggatcactttcagag

SEQ ID NO: 70012 - DNA, 24 bp, Artificial Sequence
  Synthetic oligonucleotide; AAAAAC chr11 5251014 5251037 5251017 -
catggatcactttcagagaaaaac

SEQ ID NO: 70013 - DNA, 24 bp, Artificial Sequence
  Synthetic oligonucleotide; CAAAAC chr11 5250994 5251017 5250997 -
aaacaaaaacaaactaaccaaaag

SEQ ID NO: 70014 - DNA, 24 bp, Artificial Sequence
  Synthetic oligonucleotide; AAAAAC chr11 5250981 5251004 5250984 -
ctaaccaaaagcaaaacagaacca

SEQ ID NO: 70015 - DNA, 24 bp, Artificial Sequence
  Synthetic oligonucleotide; AAAAAC chr11 5250852 5250875 5250855 -
atagtgtgtggactattagtcaat

SEQ ID NO: 70016 - DNA, 24 bp, Artificial Sequence
  Synthetic oligonucleotide; CAAAAC chr11 5250677 5250700 5250680 -
ttactgagcatagaagagctacgc

SEQ ID NO: 70017 - DNA, 24 bp, Artificial Sequence
  Synthetic oligonucleotide; TAAAAC chr11 5250303 5250326 5250306 -
cgtcaaaaatcctggacctatgcc

SEQ ID NO: 70018 - DNA, 24 bp, Artificial Sequence
  Synthetic oligonucleotide; AAAAAC chr11 5250209 5250232 5250212 -
actggagctagagacaagaaggta

SEQ ID NO: 70019 - DNA, 24 bp, Artificial Sequence
  Synthetic oligonucleotide; AAAAAC chr11 5250130 5250153 5250133 -
gctaaagggaagaataaattagag

SEQ ID NO: 70020 - DNA, 24 bp, Artificial Sequence
  Synthetic oligonucleotide; TAAAAC chr11 5249064 5249087 5249067 -
atctttccctcatttttgttgttt

SEQ ID NO: 70021 - DNA, 24 bp, Artificial Sequence
  Synthetic oligonucleotide; AAAAAC chr11 5247230 5247253 5247233 -
gagtcagccttcagaaatgtgaga

SEQ ID NO: 70022 - DNA, 24 bp, Artificial Sequence
  Synthetic oligonucleotide; GAAAAC chr11 5245653 5245676 5245656 -
atcacagtagaagcaataatcatg

SEQ ID NO: 70023 - DNA, 24 bp, Artificial Sequence
  Synthetic oligonucleotide; TAAAAC chr11 5245221 5245244 5245224 -
acaaactttccccatgttcctaag

SEQ ID NO: 70024 - DNA, 24 bp, Artificial Sequence
  Synthetic oligonucleotide; AAAAAC chr11 5244588 5244611 5244591 -
gtacactgactactaaatggatta

SEQ ID NO: 70025 - DNA, 24 bp, Artificial Sequence
  Synthetic oligonucleotide; TAAAAC chr11 5244575 5244598 5244578 -
taaatggattaaaaaacacagtaa

SEQ ID NO: 70026 - DNA, 24 bp, Artificial Sequence
  Synthetic oligonucleotide; AAAAAC chr11 5244142 5244165 5244145 -
agaaaaagaaagaaagaaagaaaa

SEQ ID NO: 70027 - DNA, 24 bp, Artificial Sequence
  Synthetic oligonucleotide; GAAAAC chr11 5244098 5244121 5244101 -
attcaatgtagtctcaagagaatt

SEQ ID NO: 70028 - DNA, 24 bp, Artificial Sequence
  Synthetic oligonucleotide; CAAAAC chr11 5243765 5243788 5243768 -
tcagaaactcgaatgtccatcttg

SEQ ID NO: 70029 - DNA, 24 bp, Artificial Sequence
  Synthetic oligonucleotide; AAAAAC chr11 5242882 5242905 5242885 -
gccacttaccatttgatagctctg

SEQ ID NO: 70030 - DNA, 24 bp, Artificial Sequence
  Synthetic oligonucleotide; GAAAAC chr11 5241099 5241122 5241102 -
aaaaaattattagcaatcaatatt

SEQ ID NO: 70031 - DNA, 24 bp, Artificial Sequence
  Synthetic oligonucleotide; GAAAAC chr11 5240674 5240697 5240677 -
tgtggcagtgattgcacagaactg

SEQ ID NO: 70032 - DNA, 24 bp, Artificial Sequence
  Synthetic oligonucleotide; TAAAAC chr11 5240476 5240499 5240479 -
ggaagtatgtagcaccctcaaacc

SEQ ID NO: 70033 - DNA, 24 bp, Artificial Sequence
  Synthetic oligonucleotide; CAAAAC chr11 5240412 5240435 5240415 -
tttcttctccagtttcattaatcc

SEQ ID NO: 70034 - DNA, 24 bp, Artificial Sequence
  Synthetic oligonucleotide; GAAAAC chr11 5240007 5240030 5240010 -
gagttttcacattcacctttagtg

SEQ ID NO: 70035 - DNA, 24 bp, Artificial Sequence
  Synthetic oligonucleotide; GAAAAC chr11 5238996 5239019 5238999 -
gaaatctagatgttagtaacatca

SEQ ID NO: 70036 - DNA, 24 bp, Artificial Sequence
  Synthetic oligonucleotide; AAAAAC chr11 5238826 5238849 5238829 -
gggggcatcaaagtatcagccata

SEQ ID NO: 70037 - DNA, 24 bp, Artificial Sequence
  Synthetic oligonucleotide; GAAAAC chr11 5238516 5238539 5238519 -
attaatgtattgataagataatat

SEQ ID NO: 70038 - DNA, 24 bp, Artificial Sequence
  Synthetic oligonucleotide; TAAAAC chr11 5237471 5237494 5237474 -
gcatgggtatttcacttgttatac

SEQ ID NO: 70039 - DNA, 24 bp, Artificial Sequence
  Synthetic oligonucleotide; AAAAAC chr11 5235339 5235362 5235342 -
attatttgaattcagaaaagagtg

SEQ ID NO: 70040 - DNA, 24 bp, Artificial Sequence
  Synthetic oligonucleotide; TAAAAC chr11 5234850 5234873 5234853 -
gaactttatattgagtcaacttgt

SEQ ID NO: 70041 - DNA, 24 bp, Artificial Sequence
  Synthetic oligonucleotide; TAAAAC chr11 5234761 5234784 5234764 -
aagatacattccactatattagcc

SEQ ID NO: 70042 - DNA, 24 bp, Artificial Sequence
  Synthetic oligonucleotide; TAAAAC chr11 5233381 5233404 5233384 -
atatgctatatacacatacaaaat

SEQ ID NO: 70043 - DNA, 24 bp, Artificial Sequence
  Synthetic oligonucleotide; GAAAAC chr11 5232090 5232113 5232093 -
ggcagaaagaaaatatttattcaa

SEQ ID NO: 70044 - DNA, 24 bp, Artificial Sequence
  Synthetic oligonucleotide; GAAAAC chr11 5231371 5231394 5231374 -
tgtagaccttatgatcttgatagg

SEQ ID NO: 70045 - DNA, 24 bp, Artificial Sequence
  Synthetic oligonucleotide; TAAAAC chr11 5230838 5230861 5230841 -
tacccccaaatttaaaatgaaagt

SEQ ID NO: 70046 - DNA, 24 bp, Artificial Sequence
  Synthetic oligonucleotide; TAAAAC chr11 5229934 5229957 5229937 -
aagtgctgcttttgaaacaaatga

SEQ ID NO: 70047 - DNA, 24 bp, Artificial Sequence
  Synthetic oligonucleotide; TAAAAC chr11 5229841 5229864 5229844 -
acccagactagggccattctgata

SEQ ID NO: 70048 - DNA, 24 bp, Artificial Sequence
  Synthetic oligonucleotide; GAAAAC chr11 5229303 5229326 5229306 -
atccatagttcatcatttaaaaaa

SEQ ID NO: 70049 - DNA, 24 bp, Artificial Sequence
  Synthetic oligonucleotide; GAAAAC chr11 5229284 5229307 5229287 -
aaaaagaaaacaaaatagaaaaag

SEQ ID NO: 70050 - DNA, 24 bp, Artificial Sequence
  Synthetic oligonucleotide; GAAAAC chr11 5229025 5229048 5229028 -
atcagggatgtgaaacagggtctt

SEQ ID NO: 70051 - DNA, 24 bp, Artificial Sequence
  Synthetic oligonucleotide; TAAAAC chr11 5229009 5229032 5229012 -
agggtcttgaaaactgtctaaatc

SEQ ID NO: 70052 - DNA, 24 bp, Artificial Sequence
  Synthetic oligonucleotide; TAAAAC chr11 5228047 5228070 5228050 -
gaacttgaatcaaggaaatgattt

SEQ ID NO: 70053 - DNA, 24 bp, Artificial Sequence
  Synthetic oligonucleotide; CAAAAC chr11 5227763 5227786 5227766 -
tctagttttttatctcttgtttcc

SEQ ID NO: 70054 - DNA, 24 bp, Artificial Sequence
  Synthetic oligonucleotide; AAAAAC chr11 5227670 5227693 5227673 -
attagcatgcatgagcaaattaag

SEQ ID NO: 70055 - DNA, 24 bp, Artificial Sequence
  Synthetic oligonucleotide; CAAAAC chr11 5227440 5227463 5227443 -
atcccaaagctgaattatggtaga

SEQ ID NO: 70056 - DNA, 24 bp, Artificial Sequence
  Synthetic oligonucleotide; GAAAAC chr11 5227384 5227407 5227387 -
ttatttgtgtaataagaaaattgg

SEQ ID NO: 70057 - DNA, 24 bp, Artificial Sequence
  Synthetic oligonucleotide; AAAAAC chr11 5226274 5226297 5226277 -
tgagatacattaagtaacttaaaa

SEQ ID NO: 70058 - DNA, 24 bp, Artificial Sequence
  Synthetic oligonucleotide; AAAAAC chr11 5225487 5225510 5225490 -
tgagcatctggattctgcctaata

SEQ ID NO: 70059 - DNA, 24 bp, Artificial Sequence
  Synthetic oligonucleotide; TAAAAC chr11 5225402 5225425 5225405 -
gggaatgtgggaggtcagtgcatt

SEQ ID NO: 70060 - DNA, 24 bp, Artificial Sequence
  Synthetic oligonucleotide; AAAAAC chr11 5224985 5225008 5224988 -
ttatagaggtctacttgaagaagg

SEQ ID NO: 70061 - DNA, 24 bp, Artificial Sequence
  Synthetic oligonucleotide; TAAAAC chr11 5224330 5224353 5224333 -
gggttaaagaattaaactaagacc

SEQ ID NO: 70062 - DNA, 24 bp, Artificial Sequence
  Synthetic oligonucleotide; AAAAAC chr11 5224182 5224205 5224185 -
atcaaactaaaaaatttccacaca

SEQ ID NO: 70063 - DNA, 24 bp, Artificial Sequence
  Synthetic oligonucleotide; CAAAAC chr11 5224177 5224200 5224180 -
actaaaaaatttccacacaaaaaa

SEQ ID NO: 70064 - DNA, 24 bp, Artificial Sequence
  Synthetic oligonucleotide; TAAAAC chr11 5223974 5223997 5223977 -
cagaattgatgaacctggaggatg

SEQ ID NO: 70065 - DNA, 24 bp, Artificial Sequence
  Synthetic oligonucleotide; TAAAAC chr11 5223327 5223350 5223330 -
tcatttcacaaggtatacatatat

SEQ ID NO: 70066 - DNA, 24 bp, Artificial Sequence
  Synthetic oligonucleotide; AAAAAC chr11 5223223 5223246 5223226 -
aaagaatagacatcacatgaatta

SEQ ID NO: 70067 - DNA, 24 bp, Artificial Sequence
  Synthetic oligonucleotide; CAAAAC chr11 5223130 5223153 5223133 -
tccatttgactgtttactcttttc

SEQ ID NO: 70068 - DNA, 24 bp, Artificial Sequence
  Synthetic oligonucleotide; AAAAAC chr11 5222767 5222790 5222770 -
agatagtggaataaatagaaatcc

SEQ ID NO: 70069 - DNA, 24 bp, Artificial Sequence
  Synthetic oligonucleotide; AAAAAC chr11 5222695 5222718 5222698 -
gcttttaaatttagcttggaaata

SEQ ID NO: 70070 - DNA, 24 bp, Artificial Sequence
  Synthetic oligonucleotide; AAAAAC chr11 5222580 5222603 5222583 -
tgtgaaggtaaaattcagtcacga

SEQ ID NO: 70071 - DNA, 24 bp, Artificial Sequence
  Synthetic oligonucleotide; AAAAAC chr11 5222315 5222338 5222318 -
aaacctcatcgctactaaaaatat

SEQ ID NO: 70072 - DNA, 24 bp, Artificial Sequence
  Synthetic oligonucleotide; CAAAAC chr11 5221348 5221371 5221351 -
cacatggctggtactcctctaaga

SEQ ID NO: 70073 - DNA, 24 bp, Artificial Sequence
  Synthetic oligonucleotide; GAAAAC chr11 5221263 5221286 5221266 -
gcagccaccgctgttgatacccag

SEQ ID NO: 70074 - DNA, 24 bp, Artificial Sequence
  Synthetic oligonucleotide; GAAAAC chr11 5221191 5221214 5221194 -
gctgagggtcctgactgttagaag

SEQ ID NO: 70075 - DNA, 24 bp, Artificial Sequence
  Synthetic oligonucleotide; AAAAAC chr11 5221159 5221182 5221162 -
acaaacagaaaggacatccacacc

SEQ ID NO: 70076 - DNA, 24 bp, Artificial Sequence
  Synthetic oligonucleotide; TAAAAC chr11 5221115 5221138 5221118 -
ccatcatcaaagaccaaaggtaga

SEQ ID NO: 70077 - DNA, 24 bp, Artificial Sequence
  Synthetic oligonucleotide; AAAAAC chr11 5221082 5221105 5221085 -
aaagatggggaaaaagcagagcag

SEQ ID NO: 70078 - DNA, 24 bp, Artificial Sequence
  Synthetic oligonucleotide; AAAAAC chr11 5220904 5220927 5220907 -
gttcgaacaaacggcaaagaagta

SEQ ID NO: 70079 - DNA, 24 bp, Artificial Sequence
  Synthetic oligonucleotide; GAAAAC chr11 5220824 5220847 5220827 -
gtccttaaaggacctgatggagct

SEQ ID NO: 70080 - DNA, 24 bp, Artificial Sequence
  Synthetic oligonucleotide; GAAAAC chr11 5220580 5220603 5220583 -
gatggggagaatggaaccaagttg

SEQ ID NO: 70081 - DNA, 24 bp, Artificial Sequence
  Synthetic oligonucleotide; AAAAAC chr11 5220105 5220128 5220108 -
ggaacaactagtatcagccactgc

SEQ ID NO: 70082 - DNA, 24 bp, Artificial Sequence
  Synthetic oligonucleotide; GAAAAC chr11 5219827 5219850 5219830 -
ggaggaatatctaccaagcaaatg

SEQ ID NO: 70083 - DNA, 24 bp, Artificial Sequence
  Synthetic oligonucleotide; TAAAAC chr11 5219787 5219810 5219790 -
aggggttgcaatcctagtctctga

SEQ ID NO: 70084 - DNA, 24 bp, Artificial Sequence
  Synthetic oligonucleotide; TAAAAC chr11 5219653 5219676 5219656 -
ccaatacaggagcacccagattca

SEQ ID NO: 70085 - DNA, 24 bp, Artificial Sequence
  Synthetic oligonucleotide; CAAAAC chr11 5219421 5219444 5219424 -
ttcagcaccacaccacacctattc

SEQ ID NO: 70086 - DNA, 24 bp, Artificial Sequence
  Synthetic oligonucleotide; CAAAAC chr11 5219297 5219320 5219300 -
gaactcaggattaagaaactcact

SEQ ID NO: 70087 - DNA, 24 bp, Artificial Sequence
  Synthetic oligonucleotide; AAAAAC chr11 5219063 5219086 5219066 -
attgacaccctaacatcacaatta

SEQ ID NO: 70088 - DNA, 24 bp, Artificial Sequence
  Synthetic oligonucleotide; AAAAAC chr11 5218968 5218991 5218971 -
gaagtgaaggacatagagacacaa

SEQ ID NO: 70089 - DNA, 24 bp, Artificial Sequence
  Synthetic oligonucleotide; AAAAAC chr11 5218211 5218234 5218214 -
caaaattcaacaacgcttcatgct

SEQ ID NO: 70090 - DNA, 24 bp, Artificial Sequence
  Synthetic oligonucleotide; AAAAAC chr11 5218116 5218139 5218119 -
cagccaatatcatactgagtggac

SEQ ID NO: 70091 - DNA, 24 bp, Artificial Sequence
  Synthetic oligonucleotide; GAAAAC chr11 5218094 5218117 5218097 -
acaaaaactggaagcattcccttt

SEQ ID NO: 70092 - DNA, 24 bp, Artificial Sequence
  Synthetic oligonucleotide; GAAAAC chr11 5217928 5217951 5217931 -
gcagatgacatgattgtatatcta

SEQ ID NO: 70093 - DNA, 24 bp, Artificial Sequence
  Synthetic oligonucleotide; AAAAAC chr11 5217530 5217553 5217533 -
aatgactttcttcacagaactgga

SEQ ID NO: 70094 - DNA, 24 bp, Artificial Sequence
  Synthetic oligonucleotide; CAAAAC chr11 5217401 5217424 5217404 -
actatactacaatgctacggtaac

SEQ ID NO: 70095 - DNA, 24 bp, Artificial Sequence
  Synthetic oligonucleotide; CAAAAC chr11 5217379 5217402 5217382 -
accaaaacagcatggtactggtac

SEQ ID NO: 70096 - DNA, 24 bp, Artificial Sequence
  Synthetic oligonucleotide; GAAAAC chr11 5217241 5217264 5217244 -
tccctatttaataaatggtgctgg

SEQ ID NO: 70097 - DNA, 24 bp, Artificial Sequence
  Synthetic oligonucleotide; TAAAAC chr11 5217140 5217163 5217143 -
gattaaagacttacatgttagacc

SEQ ID NO: 70098 - DNA, 24 bp, Artificial Sequence
  Synthetic oligonucleotide; AAAAAC chr11 5217131 5217154 5217134 -
cttacatgttagacctaaaaccat

SEQ ID NO: 70099 - DNA, 24 bp, Artificial Sequence
  Synthetic oligonucleotide; AAAAAC chr11 5217118 5217141 5217121 -
cctaaaaccataaaaaccctagaa

SEQ ID NO: 70100 - DNA, 24 bp, Artificial Sequence
  Synthetic oligonucleotide; TAAAAC chr11 5217065 5217088 5217068 -
aggcatgggcaaggacttcatgtc

SEQ ID NO: 70101 - DNA, 24 bp, Artificial Sequence
  Synthetic oligonucleotide; AAAAAC chr11 5216865 5216888 5216868 -
atgaactcaaacaaatttacaaga

SEQ ID NO: 70102 - DNA, 24 bp, Artificial Sequence
  Synthetic oligonucleotide; AAAAAC chr11 5216788 5216811 5216791 -
caaaagaagacatttatgtaatca

SEQ ID NO: 70103 - DNA, 24 bp, Artificial Sequence
  Synthetic oligonucleotide; CAAAAC chr11 5216736 5216759 5216739 -
actagccatcagagaaatgcaaat

SEQ ID NO: 70104 - DNA, 24 bp, Artificial Sequence
  Synthetic oligonucleotide; TAAAAC chr11 5216037 5216060 5216040 -
cctgcatgttgtgcacatgtaccc

SEQ ID NO: 70105 - DNA, 24 bp, Artificial Sequence
  Synthetic oligonucleotide; TAAAAC chr11 5215998 5216021 5216001 -
aataataaaaaaaagttatcctat

SEQ ID NO: 70106 - DNA, 24 bp, Artificial Sequence
  Synthetic oligonucleotide; GAAAAC chr11 5215584 5215607 5215587 -
atgattaaagataacaagaggtct

SEQ ID NO: 70107 - DNA, 24 bp, Artificial Sequence
  Synthetic oligonucleotide; AAAAAC chr11 5215397 5215420 5215400 -
gtgactgagatcctgtctctgagg

SEQ ID NO: 70108 - DNA, 24 bp, Artificial Sequence
  Synthetic oligonucleotide; AAAAAC chr11 5215378 5215401 5215381 -
tgaggaaaaacaaacaaacaagca

SEQ ID NO: 70109 - DNA, 24 bp, Artificial Sequence
  Synthetic oligonucleotide; CAAAAC chr11 5214764 5214787 5214767 -
tgatctaccttattaattttttca

SEQ ID NO: 70110 - DNA, 24 bp, Artificial Sequence
  Synthetic oligonucleotide; CAAAAC chr11 5214056 5214079 5214059 -
atgaggccagcatcatcctgatac

SEQ ID NO: 70111 - DNA, 24 bp, Artificial Sequence
  Synthetic oligonucleotide; GAAAAC chr11 5214024 5214047 5214027 -
gatagacacacaacaacaaaaaaa

SEQ ID NO: 70112 - DNA, 24 bp, Artificial Sequence
  Synthetic oligonucleotide; AAAAAC chr11 5213853 5213876 5213856 -
gtgattcatcatatatacagcact

SEQ ID NO: 70113 - DNA, 24 bp, Artificial Sequence
  Synthetic oligonucleotide; TAAAAC chr11 5213780 5213803 5213783 -
ataaaattcaacttcacttcatgt

SEQ ID NO: 70114 - DNA, 24 bp, Artificial Sequence
  Synthetic oligonucleotide; CAAAAC chr11 5213685 5213708 5213688 -
acagccaacatcatacagaatggg

SEQ ID NO: 70115 - DNA, 24 bp, Artificial Sequence
  Synthetic oligonucleotide; GAAAAC chr11 5213662 5213685 5213665 -
gcaaaacctggaagcattcttctt

SEQ ID NO: 70116 - DNA, 24 bp, Artificial Sequence
  Synthetic oligonucleotide; GAAAAC chr11 5213510 5213533 5213513 -
aagtatccctgttttctgtatcta

SEQ ID NO: 70117 - DNA, 24 bp, Artificial Sequence
  Synthetic oligonucleotide; CAAAAC chr11 5213284 5213307 5213287 -
gaaagatctctacaatgagattta

SEQ ID NO: 70118 - DNA, 24 bp, Artificial Sequence
  Synthetic oligonucleotide; AAAAAC chr11 5213241 5213264 5213244 -
atcagagctgatagaaacaaatgg

SEQ ID NO: 70119 - DNA, 24 bp, Artificial Sequence
  Synthetic oligonucleotide; CAAAAC chr11 5212758 5212781 5212761 -
accataccacagggctacagtaac

SEQ ID NO: 70120 - DNA, 24 bp, Artificial Sequence
  Synthetic oligonucleotide; AAAAAC chr11 5212647 5212670 5212650 -
catctgatctttgacaaagctgat

SEQ ID NO: 70121 - DNA, 24 bp, Artificial Sequence
  Synthetic oligonucleotide; CAAAAC chr11 5212506 5212529 5212509 -
caagatggattagagacttaaatg

SEQ ID NO: 70122 - DNA, 24 bp, Artificial Sequence
  Synthetic oligonucleotide; CAAAAC chr11 5212230 5212253 5212233 -
ggaacttaaatgaatctacaagaa

SEQ ID NO: 70123 - DNA, 24 bp, Artificial Sequence
  Synthetic oligonucleotide; AAAAAC chr11 5211929 5211952 5211932 -
agtgtggcaattccctaaagacct

SEQ ID NO: 70124 - DNA, 24 bp, Artificial Sequence
  Synthetic oligonucleotide; GAAAAC chr11 5211640 5211663 5211643 -
ccttaacaaactaatgtaagaaca

SEQ ID NO: 70125 - DNA, 24 bp, Artificial Sequence
  Synthetic oligonucleotide; GAAAAC chr11 5211590 5211613 5211593 -
ttacaagtaggaactaaatgatga

SEQ ID NO: 70126 - DNA, 24 bp, Artificial Sequence
  Synthetic oligonucleotide; AAAAAC chr11 5211211 5211234 5211214 -
attgtgttcctatatagtaaatat

SEQ ID NO: 70127 - DNA, 24 bp, Artificial Sequence
  Synthetic oligonucleotide; GAAAAC chr11 5210711 5210734 5210714 -
ttcgaggaactcaagtcctatctt

SEQ ID NO: 70128 - DNA, 24 bp, Artificial Sequence
  Synthetic oligonucleotide; GAAAAC chr11 5210019 5210042 5210022 -
gggcacatgcaggctgctataaga

SEQ ID NO: 70129 - DNA, 24 bp, Artificial Sequence
  Synthetic oligonucleotide; AAAAAC chr11 5209421 5209444 5209424 -
atgctgtacttaaaatattaaaat

SEQ ID NO: 70130 - DNA, 24 bp, Artificial Sequence
  Synthetic oligonucleotide; CAAAAC chr11 5208536 5208559 5208539 -
aaaaattatatacctaagaaatga

SEQ ID NO: 70131 - DNA, 24 bp, Artificial Sequence
  Synthetic oligonucleotide; TAAAAC chr11 5208062 5208085 5208065 -
tgatgatcatggtgatattaataa

SEQ ID NO: 70132 - DNA, 24 bp, Artificial Sequence
  Synthetic oligonucleotide; TAAAAC chr11 5207879 5207902 5207882 -
tctctaataaataaataaaataaa

SEQ ID NO: 70133 - DNA, 24 bp, Artificial Sequence
  Synthetic oligonucleotide; AAAAAC chr11 5207868 5207891 5207871 -
taaataaaataaataaaacagaaa

SEQ ID NO: 70134 - DNA, 24 bp, Artificial Sequence
  Synthetic oligonucleotide; AAAAAC chr11 5207263 5207286 5207266 -
tcctgacgagtttctataaaaaaa

SEQ ID NO: 70135 - DNA, 24 bp, Artificial Sequence
  Synthetic oligonucleotide; CAAAAC chr11 5206571 5206594 5206574 -
atggcattacttttttattgctgc

SEQ ID NO: 70136 - DNA, 24 bp, Artificial Sequence
  Synthetic oligonucleotide; AAAAAC chr11 5206247 5206270 5206250 -
aattttttaaaaagttgatttcat

SEQ ID NO: 70137 - DNA, 24 bp, Artificial Sequence
  Synthetic oligonucleotide; CAAAAC chr11 5205719 5205742 5205722 -
gaaaagggaacatattaaagccaa

SEQ ID NO: 70138 - DNA, 24 bp, Artificial Sequence
  Synthetic oligonucleotide; AAAAAC chr11 5205651 5205674 5205654 -
acaatcaaatgctataaatcttat

SEQ ID NO: 70139 - DNA, 24 bp, Artificial Sequence
  Synthetic oligonucleotide; AAAAAC chr11 5204856 5204879 5204859 -
cagtaattatgttctaagaacagc

SEQ ID NO: 70140 - DNA, 24 bp, Artificial Sequence
  Synthetic oligonucleotide; AAAAAC chr11 5204676 5204699 5204679 -
attctgaaaagacagaaaaaaaaa

SEQ ID NO: 70141 - DNA, 24 bp, Artificial Sequence
  Synthetic oligonucleotide; GAAAAC chr11 5204536 5204559 5204539 -
ccagacagtgctcagaggggatac

SEQ ID NO: 70142 - DNA, 24 bp, Artificial Sequence
  Synthetic oligonucleotide; GAAAAC chr11 5204389 5204412 5204392 -
agcataacacaacatgatgtcttg

SEQ ID NO: 70143 - DNA, 24 bp, Artificial Sequence
  Synthetic oligonucleotide; CAAAAC chr11 5204288 5204311 5204291 -
taaatcttcatttatttaccttat

SEQ ID NO: 70144 - DNA, 24 bp, Artificial Sequence
  Synthetic oligonucleotide; CAAAAC chr11 5204260 5204283 5204263 -
actatgctctttcatcctaccttt

SEQ ID NO: 70145 - DNA, 24 bp, Artificial Sequence
  Synthetic oligonucleotide; AAAAAC chr11 5203343 5203366 5203346 -
ccttatttttcatattcttgagca

SEQ ID NO: 70146 - DNA, 24 bp, Artificial Sequence
  Synthetic oligonucleotide; AAAAAC chr11 5201879 5201902 5201882 -
atgctgagaaggagtcagggcaag

SEQ ID NO: 70147 - DNA, 24 bp, Artificial Sequence
  Synthetic oligonucleotide; AAAAAC chr11 5201661 5201684 5201664 -
ctgtttacattattagagctttaa

SEQ ID NO: 70148 - DNA, 24 bp, Artificial Sequence
  Synthetic oligonucleotide; GAAAAC chr11 5201507 5201530 5201510 -
tgtagaactgcaggttctaagaaa

SEQ ID NO: 70149 - DNA, 24 bp, Artificial Sequence
  Synthetic oligonucleotide; GAAAAC chr11 5201224 5201247 5201227 -
ctggctacgtcatctggaggggga

SEQ ID NO: 70150 - DNA, 24 bp, Artificial Sequence
  Synthetic oligonucleotide; TAAAAC chr11 5200977 5201000 5200980 -
aaatgtctaagcaacgtatttttt

SEQ ID NO: 70151 - DNA, 24 bp, Artificial Sequence
  Synthetic oligonucleotide; TAAAAC chr11 5199451 5199474 5199454 -
tacttttgagcatttcctttgctg

SEQ ID NO: 70152 - DNA, 24 bp, Artificial Sequence
  Synthetic oligonucleotide; AAAAAC chr11 5199434 5199457 5199437 -
tttgctgtaaaacaaagctggatt

SEQ ID NO: 70153 - DNA, 24 bp, Artificial Sequence
  Synthetic oligonucleotide; GAAAAC chr11 5199405 5199428 5199408 -
cctaggttttcaagtttcaaagta

SEQ ID NO: 70154 - DNA, 24 bp, Artificial Sequence
  Synthetic oligonucleotide; CAAAAC chr11 5198774 5198797 5198777 -
gaaagaaaggaaggaaatcaggta

SEQ ID NO: 70155 - DNA, 24 bp, Artificial Sequence
  Synthetic oligonucleotide; TAAAAC chr11 5198619 5198642 5198622 -
ttatttttatttttagatatcaac

SEQ ID NO: 70156 - DNA, 24 bp, Artificial Sequence
  Synthetic oligonucleotide; GAAAAC chr11 5198292 5198315 5198295 -
tcttctggtatagctatcagaagt

SEQ ID NO: 70157 - DNA, 24 bp, Artificial Sequence
  Synthetic oligonucleotide; AAAAAC chr11 5198144 5198167 5198147 -
atggtgaaaccccgtctctactaa

SEQ ID NO: 70158 - DNA, 24 bp, Artificial Sequence
  Synthetic oligonucleotide; CAAAAC chr11 5197424 5197447 5197427 -
aatagtttgaaataatggccgtga

SEQ ID NO: 70159 - DNA, 24 bp, Artificial Sequence
  Synthetic oligonucleotide; TAAAAC chr11 5197053 5197076 5197056 -
gcagatggagacatcacaggtgtt

SEQ ID NO: 70160 - DNA, 24 bp, Artificial Sequence
  Synthetic oligonucleotide; GAAAAC chr11 5196831 5196854 5196834 -
tccagcgtcactgagaaacgttac

SEQ ID NO: 70161 - DNA, 24 bp, Artificial Sequence
  Synthetic oligonucleotide; GAAAAC chr11 5196709 5196732 5196712 -
aagtcacggttattataataagga

SEQ ID NO: 70162 - DNA, 24 bp, Artificial Sequence
  Synthetic oligonucleotide; AAAAAC chr11 5195505 5195528 5195508 -
tatacatttaaatatgatttttta

SEQ ID NO: 70163 - DNA, 24 bp, Artificial Sequence
  Synthetic oligonucleotide; AAAAAC chr11 5195447 5195470 5195450 -
ctacagaaaaggataccaatgaga

SEQ ID NO: 70164 - DNA, 24 bp, Artificial Sequence
  Synthetic oligonucleotide; AAAAAC chr11 5195416 5195439 5195419 -
ttatctgcaaagagcattttctgg

SEQ ID NO: 70165 - DNA, 24 bp, Artificial Sequence
  Synthetic oligonucleotide; CAAAAC chr11 5194205 5194228 5194208 -
taaatgcaccaatcagcactctgc

SEQ ID NO: 70166 - DNA, 24 bp, Artificial Sequence
  Synthetic oligonucleotide; GAAAAC chr11 5193554 5193577 5193557 -
atacctagaatcaattttaataaa

SEQ ID NO: 70167 - DNA, 24 bp, Artificial Sequence
  Synthetic oligonucleotide; AAAAAC chr11 5193080 5193103 5193083 -
ttcatggtaagttaagagaatgaa

SEQ ID NO: 70168 - DNA, 24 bp, Artificial Sequence
  Synthetic oligonucleotide; CAAAAC chr11 5193053 5193076 5193056 -
aacaagccacagagaacatatttg

SEQ ID NO: 70169 - DNA, 24 bp, Artificial Sequence
  Synthetic oligonucleotide; AAAAAC chr11 5192986 5193009 5192989 -
aagaacttttaaaattctacaata

SEQ ID NO: 70170 - DNA, 24 bp, Artificial Sequence
  Synthetic oligonucleotide; TAAAAC chr11 5192858 5192881 5192861 -
acatgtcattaagaaactgcacat

SEQ ID NO: 70171 - DNA, 24 bp, Artificial Sequence
  Synthetic oligonucleotide; CAAAAC chr11 5192691 5192714 5192694 -
tggaagacagtttacagtttctta

SEQ ID NO: 70172 - DNA, 24 bp, Artificial Sequence
  Synthetic oligonucleotide; AAAAAC chr11 5191384 5191407 5191387 -
ttcaacctatgagcctgtaaaatc

SEQ ID NO: 70173 - DNA, 24 bp, Artificial Sequence
  Synthetic oligonucleotide; GAAAAC chr11 5191269 5191292 5191272 -
ggggctaaagatcccacacgagta

SEQ ID NO: 70174 - DNA, 24 bp, Artificial Sequence
  Synthetic oligonucleotide; TAAAAC chr11 5190894 5190917 5190897 -
ctcgggtatttcttcatagcagtt

SEQ ID NO: 70175 - DNA, 24 bp, Artificial Sequence
  Synthetic oligonucleotide; AAAAAC chr11 5189399 5189422 5189402 -
gaaacttataatcatggcagagag

SEQ ID NO: 70176 - DNA, 24 bp, Artificial Sequence
  Synthetic oligonucleotide; CAAAAC chr11 5189107 5189130 5189110 -
tcaacaaaatacataaaatgtaag

SEQ ID NO: 70177 - DNA, 24 bp, Artificial Sequence
  Synthetic oligonucleotide; CAAAAC chr11 5189094 5189117 5189097 -
taaaatgtaagcaaaacacaacaa

SEQ ID NO: 70178 - DNA, 24 bp, Artificial Sequence
  Synthetic oligonucleotide; AAAAAC chr11 5188052 5188075 5188055 -
tttccttgaaatccatagaaattt

SEQ ID NO: 70179 - DNA, 24 bp, Artificial Sequence
  Synthetic oligonucleotide; GAAAAC chr11 5187766 5187789 5187769 -
ctcaaagactgtagacttctataa

SEQ ID NO: 70180 - DNA, 24 bp, Artificial Sequence
  Synthetic oligonucleotide; GAAAAC chr11 5187599 5187622 5187602 -
atttatcagaaatcattatttact

SEQ ID NO: 70181 - DNA, 24 bp, Artificial Sequence
  Synthetic oligonucleotide; AAAAAC chr11 5187548 5187571 5187551 -
tcaagttttagagtccccagattt

SEQ ID NO: 70182 - DNA, 24 bp, Artificial Sequence
  Synthetic oligonucleotide; GAAAAC chr11 5186410 5186433 5186413 -
gagtaaaattcgtcctcttaagct

SEQ ID NO: 70183 - DNA, 24 bp, Artificial Sequence
  Synthetic oligonucleotide; GAAAAC chr11 5186261 5186284 5186264 -
taagtaaactgagttatgctcaat

SEQ ID NO: 70184 - DNA, 24 bp, Artificial Sequence
  Synthetic oligonucleotide; TAAAAC chr11 5185961 5185984 5185964 -
tcaatgaatttatattctagtagt

SEQ ID NO: 70185 - DNA, 24 bp, Artificial Sequence
  Synthetic oligonucleotide; TAAAAC chr11 5185775 5185798 5185778 -
attatactggtgatggggcaaaaa

SEQ ID NO: 70186 - DNA, 24 bp, Artificial Sequence
  Synthetic oligonucleotide; AAAAAC chr11 5185138 5185161 5185141 -
catcacatatgacaatgttttagg

SEQ ID NO: 70187 - DNA, 24 bp, Artificial Sequence
  Synthetic oligonucleotide; AAAAAC chr11 5185130 5185153 5185133 -
atgacaatgttttaggaaaaacaa

SEQ ID NO: 70188 - DNA, 24 bp, Artificial Sequence
  Synthetic oligonucleotide; AAAAAC chr11 5185112 5185135 5185115 -
aaacaaaaaaacaaacaaatattt

SEQ ID NO: 70189 - DNA, 24 bp, Artificial Sequence
  Synthetic oligonucleotide; TAAAAC chr11 5184813 5184836 5184816 -
caatgtgagatatatattaaatag

SEQ ID NO: 70190 - DNA, 24 bp, Artificial Sequence
  Synthetic oligonucleotide; AAAAAC chr11 5184601 5184624 5184604 -
agaccagaatatttagcacttagc

SEQ ID NO: 70191 - DNA, 24 bp, Artificial Sequence
  Synthetic oligonucleotide; AAAAAC chr11 5184490 5184513 5184493 -
ttcttaagcccctgtgccacctca

SEQ ID NO: 70192 - DNA, 24 bp, Artificial Sequence
  Synthetic oligonucleotide; GAAAAC chr11 5184137 5184160 5184140 -
atatagactcctgttttataatgt

SEQ ID NO: 70193 - DNA, 24 bp, Artificial Sequence
  Synthetic oligonucleotide; AAAAAC chr11 5183792 5183815 5183795 -
ctatcaattttgttgatcttttca

SEQ ID NO: 70194 - DNA, 24 bp, Artificial Sequence
  Synthetic oligonucleotide; AAAAAC chr11 5182027 5182050 5182030 -
caaaattcaacaatgcttcatact

SEQ ID NO: 70195 - DNA, 24 bp, Artificial Sequence
  Synthetic oligonucleotide; AAAAAC chr11 5181932 5181955 5181935 -
cagccaatatcatactgaatggac

SEQ ID NO: 70196 - DNA, 24 bp, Artificial Sequence
  Synthetic oligonucleotide; GAAAAC chr11 5181910 5181933 5181913 -
acaaaaactggaagcattcccttt

SEQ ID NO: 70197 - DNA, 24 bp, Artificial Sequence
  Synthetic oligonucleotide; GAAAAC chr11 5181744 5181767 5181747 -
gcagatgacgtgattgtatatcta

SEQ ID NO: 70198 - DNA, 24 bp, Artificial Sequence
  Synthetic oligonucleotide; CAAAAC chr11 5181514 5181537 5181517 -
gaaggacctcttcaaggagaacaa

SEQ ID NO: 70199 - DNA, 24 bp, Artificial Sequence
  Synthetic oligonucleotide; AAAAAC chr11 5181346 5181369 5181349 -
aatgactttcttcacagaattgga

SEQ ID NO: 70200 - DNA, 24 bp, Artificial Sequence
  Synthetic oligonucleotide; CAAAAC chr11 5181218 5181241 5181221 -
aactatactacaaggtacagtaac

SEQ ID NO: 70201 - DNA, 24 bp, Artificial Sequence
  Synthetic oligonucleotide; CAAAAC chr11 5181196 5181219 5181199 -
accaaaacaacatggtactggtac

SEQ ID NO: 70202 - DNA, 24 bp, Artificial Sequence
  Synthetic oligonucleotide; AAAAAC chr11 5181106 5181129 5181109 -
tatctgatctttgacaaacctgac

SEQ ID NO: 70203 - DNA, 24 bp, Artificial Sequence
  Synthetic oligonucleotide; GAAAAC chr11 5181058 5181081 5181061 -
tccctatttaataaatgatgctgg

SEQ ID NO: 70204 - DNA, 24 bp, Artificial Sequence
  Synthetic oligonucleotide; TAAAAC chr11 5180957 5180980 5180960 -
gattaaagacttacatgttagacc

SEQ ID NO: 70205 - DNA, 24 bp, Artificial Sequence
  Synthetic oligonucleotide; AAAAAC chr11 5180948 5180971 5180951 -
cttacatgttagacctaaaaccat

SEQ ID NO: 70206 - DNA, 24 bp, Artificial Sequence
  Synthetic oligonucleotide; GAAAAC chr11 5180935 5180958 5180938 -
cctaaaaccataaaaaccttagaa

SEQ ID NO: 70207 - DNA, 24 bp, Artificial Sequence
  Synthetic oligonucleotide; TAAAAC chr11 5180882 5180905 5180885 -
aggcatgggcaaggacttcatgtc

SEQ ID NO: 70208 - DNA, 24 bp, Artificial Sequence
  Synthetic oligonucleotide; AAAAAC chr11 5180681 5180704 5180684 -
tgaactcaaacaaatttacaagaa

SEQ ID NO: 70209 - DNA, 24 bp, Artificial Sequence
  Synthetic oligonucleotide; AAAAAC chr11 5180604 5180627 5180607 -
caaaagaagacatttatgcagcca

SEQ ID NO: 70210 - DNA, 24 bp, Artificial Sequence
  Synthetic oligonucleotide; CAAAAC chr11 5180552 5180575 5180555 -
actggccatcagagaaatgcaaat

SEQ ID NO: 70211 - DNA, 24 bp, Artificial Sequence
  Synthetic oligonucleotide; AAAAAC chr11 5180084 5180107 5180087 -
tctgagcaaagtatcgcaaggacg

SEQ ID NO: 70212 - DNA, 24 bp, Artificial Sequence
  Synthetic oligonucleotide; AAAAAC chr11 5179430 5179453 5179433 -
cgtgccaggctggcatatagattt

SEQ ID NO: 70213 - DNA, 24 bp, Artificial Sequence
  Synthetic oligonucleotide; GAAAAC chr11 5178783 5178806 5178786 -
attttactctcctttcccagagaa

SEQ ID NO: 70214 - DNA, 24 bp, Artificial Sequence
  Synthetic oligonucleotide; GAAAAC chr11 5178769 5178792 5178772 -
tcccagagaagaaaacattggaaa

SEQ ID NO: 70215 - DNA, 24 bp, Artificial Sequence
  Synthetic oligonucleotide; TAAAAC chr11 5177865 5177888 5177868 -
atttcttgcccatcgctttggagg

SEQ ID NO: 70216 - DNA, 24 bp, Artificial Sequence
  Synthetic oligonucleotide; AAAAAC chr11 5176753 5176776 5176756 -
tttacacctaaagaaagacaaaaa

SEQ ID NO: 70217 - DNA, 24 bp, Artificial Sequence
  Synthetic oligonucleotide; TAAAAC chr11 5176445 5176468 5176448 -
ccattattgggaagggagaataca

SEQ ID NO: 70218 - DNA, 24 bp, Artificial Sequence
  Synthetic oligonucleotide; TAAAAC chr11 5175632 5175655 5175635 -
cagggagttttggaagcacttagc

SEQ ID NO: 70219 - DNA, 24 bp, Artificial Sequence
  Synthetic oligonucleotide; AAAAAC chr11 5175599 5175622 5175602 -
tatggtgttctagacagaattagc

SEQ ID NO: 70220 - DNA, 24 bp, Artificial Sequence
  Synthetic oligonucleotide; AAAAAC chr11 5175592 5175615 5175595 -
ttctagacagaattagcaaaaaca

SEQ ID NO: 70221 - DNA, 24 bp, Artificial Sequence
  Synthetic oligonucleotide; AAAAAC chr11 5175068 5175091 5175071 -
ccacagagagagactccatctcaa

SEQ ID NO: 70222 - DNA, 24 bp, Artificial Sequence
  Synthetic oligonucleotide; TAAAAC chr11 5175052 5175075 5175055 -
catctcaaaaaaaccaaaaatacg

SEQ ID NO: 70223 - DNA, 24 bp, Artificial Sequence
  Synthetic oligonucleotide; AAAAAC chr11 5175046 5175069 5175049 -
aaaaaaaccaaaaatacgtaaaac

SEQ ID NO: 70224 - DNA, 24 bp, Artificial Sequence
  Synthetic oligonucleotide; AAAAAC chr11 5175034 5175057 5175037 -
aatacgtaaaacaaaaacaaaaag

SEQ ID NO: 70225 - DNA, 24 bp, Artificial Sequence
  Synthetic oligonucleotide; TAAAAC chr11 5175022 5175045 5175025 -
aaaaacaaaaagaaaaacaaaaaa

SEQ ID NO: 70226 - DNA, 24 bp, Artificial Sequence
  Synthetic oligonucleotide; CAAAAC chr11 5174711 5174734 5174714 -
gccgctatcaccatgatctcatgc

SEQ ID NO: 70227 - DNA, 24 bp, Artificial Sequence
  Synthetic oligonucleotide; TAAAAC chr11 5174389 5174412 5174392 -
tttttctcatctaacagtgttggc

SEQ ID NO: 70228 - DNA, 24 bp, Artificial Sequence
  Synthetic oligonucleotide; AAAAAC chr11 5174331 5174354 5174334 -
atttcacttaaagttgccatttcc

SEQ ID NO: 70229 - DNA, 24 bp, Artificial Sequence
  Synthetic oligonucleotide; AAAAAC chr11 5173400 5173423 5173403 -
ccaattgaatatgaagttgtatat

SEQ ID NO: 70230 - DNA, 24 bp, Artificial Sequence
  Synthetic oligonucleotide; GAAAAC chr11 5173340 5173363 5173343 -
aaaaaggacacagatcaaacaaca

SEQ ID NO: 70231 - DNA, 24 bp, Artificial Sequence
  Synthetic oligonucleotide; TAAAAC chr11 5172377 5172400 5172380 -
gaaattgatcatggtaggagtcat

SEQ ID NO: 70232 - DNA, 24 bp, Artificial Sequence
  Synthetic oligonucleotide; AAAAAC chr11 5170215 5170238 5170218 -
tttaacattttgtagatgaagaaa

SEQ ID NO: 70233 - DNA, 24 bp, Artificial Sequence
  Synthetic oligonucleotide; CAAAAC chr11 5169774 5169797 5169777 -
ggtgacattgttttgtcaatttgt

SEQ ID NO: 70234 - DNA, 24 bp, Artificial Sequence
  Synthetic oligonucleotide; CAAAAC chr11 5169723 5169746 5169726 -
tttctaggtacatcaattttacat

SEQ ID NO: 70235 - DNA, 24 bp, Artificial Sequence
  Synthetic oligonucleotide; AAAAAC chr11 5169374 5169397 5169377 -
aatgagttcaatactagaaagaaa

SEQ ID NO: 70236 - DNA, 24 bp, Artificial Sequence
  Synthetic oligonucleotide; AAAAAC chr11 5169328 5169351 5169331 -
tactgttttagaagaaaataacta

SEQ ID NO: 70237 - DNA, 24 bp, Artificial Sequence
  Synthetic oligonucleotide; AAAAAC chr11 5168935 5168958 5168938 -
aagtgttcaatgtagtgaagtcat

SEQ ID NO: 70238 - DNA, 24 bp, Artificial Sequence
  Synthetic oligonucleotide; AAAAAC chr11 5168810 5168833 5168813 -
ttactattcttatggtatacatga

SEQ ID NO: 70239 - DNA, 24 bp, Artificial Sequence
  Synthetic oligonucleotide; GAAAAC chr11 5168764 5168787 5168767 -
taactttatcaagttcacacaatg

SEQ ID NO: 70240 - DNA, 24 bp, Artificial Sequence
  Synthetic oligonucleotide; CAAAAC chr11 5168183 5168206 5168186 -
ttaataagtggcagaatcacaact

SEQ ID NO: 70241 - DNA, 24 bp, Artificial Sequence
  Synthetic oligonucleotide; AAAAAC chr11 5168163 5168186 5168166 -
aactcaaaaccagacaatccaact

SEQ ID NO: 70242 - DNA, 24 bp, Artificial Sequence
  Synthetic oligonucleotide; GAAAAC chr11 5167565 5167588 5167568 -
ttttcaaagcgctcagggataaaa

SEQ ID NO: 70243 - DNA, 24 bp, Artificial Sequence
  Synthetic oligonucleotide; TAAAAC chr11 5167534 5167557 5167537 -
gatattcaagaatattttataggg

SEQ ID NO: 70244 - DNA, 24 bp, Artificial Sequence
  Synthetic oligonucleotide; GAAAAC chr11 5167388 5167411 5167391 -
gaaaaaagacattaacatgcaaaa

SEQ ID NO: 70245 - DNA, 24 bp, Artificial Sequence
  Synthetic oligonucleotide; AAAAAC chr11 5167271 5167294 5167274 -
cacagaactccagtatgaaaccca

SEQ ID NO: 70246 - DNA, 24 bp, Artificial Sequence
  Synthetic oligonucleotide; AAAAAC chr11 5167256 5167279 5167259 -
tgaaacccaaaaaacaaatctttc

SEQ ID NO: 70247 - DNA, 24 bp, Artificial Sequence
  Synthetic oligonucleotide; AAAAAC chr11 5166635 5166658 5166638 -
tcagataaaatagactacaaattt

SEQ ID NO: 70248 - DNA, 24 bp, Artificial Sequence
  Synthetic oligonucleotide; GAAAAC chr11 5166518 5166541 5166521 -
catcaaagttcccaagtatataag

SEQ ID NO: 70249 - DNA, 24 bp, Artificial Sequence
  Synthetic oligonucleotide; TAAAAC chr11 5166194 5166217 5166197 -
gtatattttctgaccacagtggaa

SEQ ID NO: 70250 - DNA, 24 bp, Artificial Sequence
  Synthetic oligonucleotide; TAAAAC chr11 5165839 5165862 5165842 -
tttcctttacctacccaaatctta

SEQ ID NO: 70251 - DNA, 24 bp, Artificial Sequence
  Synthetic oligonucleotide; CAAAAC chr11 5165397 5165420 5165400 -
ggagacatgttttatccgtggacc

SEQ ID NO: 70252 - DNA, 24 bp, Artificial Sequence
  Synthetic oligonucleotide; TAAAAC chr11 5164736 5164759 5164739 -
ccttagcctgtgctctcaagaact

SEQ ID NO: 70253 - DNA, 24 bp, Artificial Sequence
  Synthetic oligonucleotide; TAAAAC chr11 5164709 5164732 5164712 -
aacctcttcaactcacacctgacc

SEQ ID NO: 70254 - DNA, 24 bp, Artificial Sequence
  Synthetic oligonucleotide; TAAAAC chr11 5164579 5164602 5164582 -
tcaagatctaaataatttttgtcg

SEQ ID NO: 70255 - DNA, 24 bp, Artificial Sequence
  Synthetic oligonucleotide; AAAAAC chr11 5164118 5164141 5164121 -
gtttaggctctttcatcaaatatg

SEQ ID NO: 70256 - DNA, 24 bp, Artificial Sequence
  Synthetic oligonucleotide; TAAAAC chr11 5163986 5164009 5163989 -
acccaatctgctcctgacattaaa

SEQ ID NO: 70257 - DNA, 24 bp, Artificial Sequence
  Synthetic oligonucleotide; TAAAAC chr11 5163063 5163086 5163066 -
atcatgcgccccttaccatcccat

SEQ ID NO: 70258 - DNA, 24 bp, Artificial Sequence
  Synthetic oligonucleotide; TAAAAC chr11 5162913 5162936 5162916 -
accattcccccattttacctgtcc

SEQ ID NO: 70259 - DNA, 24 bp, Artificial Sequence
  Synthetic oligonucleotide; AAAAAC chr11 5162570 5162593 5162573 -
tacctatctcggcataattctcat

SEQ ID NO: 70260 - DNA, 24 bp, Artificial Sequence
  Synthetic oligonucleotide; CAAAAC chr11 5162506 5162529 5162509 -
tctcccaaacctcaatcccttcta

SEQ ID NO: 70261 - DNA, 24 bp, Artificial Sequence
  Synthetic oligonucleotide; TAAAAC chr11 5161545 5161568 5161548 -
gtttttcaggctcttagtattcag

SEQ ID NO: 70262 - DNA, 24 bp, Artificial Sequence
  Synthetic oligonucleotide; AAAAAC chr11 5161480 5161503 5161483 -
agtagaacggactaaatgtctttt

SEQ ID NO: 70263 - DNA, 24 bp, Artificial Sequence
  Synthetic oligonucleotide; AAAAAC chr11 5161284 5161307 5161287 -
agaccaacttagaatgtgccccaa

SEQ ID NO: 70264 - DNA, 24 bp, Artificial Sequence
  Synthetic oligonucleotide; CAAAAC chr11 5160971 5160994 5160974 -
ttccatttggtttttcaatccata

SEQ ID NO: 70265 - DNA, 24 bp, Artificial Sequence
  Synthetic oligonucleotide; TAAAAC chr11 5160428 5160451 5160431 -
tttcctttacctacccaaatctta

SEQ ID NO: 70266 - DNA, 24 bp, Artificial Sequence
  Synthetic oligonucleotide; TAAAAC chr11 5160252 5160275 5160255 -
ctaaagaaattaagaaggaaattt

SEQ ID NO: 70267 - DNA, 24 bp, Artificial Sequence
  Synthetic oligonucleotide; CAAAAC chr11 5160211 5160234 5160214 -
agtgaaaatggaaatacaacatac

SEQ ID NO: 70268 - DNA, 24 bp, Artificial Sequence
  Synthetic oligonucleotide; AAAAAC chr11 5159986 5160009 5159989 -
gaccaaaaaatacagaaaatcatt

SEQ ID NO: 70269 - DNA, 24 bp, Artificial Sequence
  Synthetic oligonucleotide; CAAAAC chr11 5159944 5159967 5159947 -
tcttggaaaggtaaacaaaatcaa

SEQ ID NO: 70270 - DNA, 24 bp, Artificial Sequence
  Synthetic oligonucleotide; GAAAAC chr11 5159751 5159774 5159754 -
gcaagactgaagcatgtagaaaca

SEQ ID NO: 70271 - DNA, 24 bp, Artificial Sequence
  Synthetic oligonucleotide; AAAAAC chr11 5159599 5159622 5159602 -
aattcctcaaacaaacaaacaaat

SEQ ID NO: 70272 - DNA, 24 bp, Artificial Sequence
  Synthetic oligonucleotide; AAAAAC chr11 5159464 5159487 5159467 -
agtaggaacatacctcaaaataat

SEQ ID NO: 70273 - DNA, 24 bp, Artificial Sequence
  Synthetic oligonucleotide; AAAAAC chr11 5159231 5159254 5159234 -
agatgacatgatcttatacttaga

SEQ ID NO: 70274 - DNA, 24 bp, Artificial Sequence
  Synthetic oligonucleotide; AAAAAC chr11 5159223 5159246 5159226 -
tgatcttatacttagaaaaaacct

SEQ ID NO: 70275 - DNA, 24 bp, Artificial Sequence
  Synthetic oligonucleotide; TAAAAC chr11 5159202 5159225 5159205 -
cctaaaaacttcactaaatactat

SEQ ID NO: 70276 - DNA, 24 bp, Artificial Sequence
  Synthetic oligonucleotide; TAAAAC chr11 5159098 5159121 5159101 -
ttatcaatctgcaaaaaaaatcaa

SEQ ID NO: 70277 - DNA, 24 bp, Artificial Sequence
  Synthetic oligonucleotide; TAAAAC chr11 5159006 5159029 5159009 -
aaaagatctctataagaaaaatta

SEQ ID NO: 70278 - DNA, 24 bp, Artificial Sequence
  Synthetic oligonucleotide; AAAAAC chr11 5158842 5158865 5158845 -
taccaatggcattcacagaaatag

SEQ ID NO: 70279 - DNA, 24 bp, Artificial Sequence
  Synthetic oligonucleotide; CAAAAC chr11 5158770 5158793 5158773 -
taaagcaatcctgagcaaaaagaa

SEQ ID NO: 70280 - DNA, 24 bp, Artificial Sequence
  Synthetic oligonucleotide; GAAAAC chr11 5158245 5158268 5158248 -
agtcttttcaagaaacagtgctag

SEQ ID NO: 70281 - DNA, 24 bp, Artificial Sequence
  Synthetic oligonucleotide; GAAAAC chr11 5158122 5158145 5158125 -
cctgaaattatgaaactactggaa

SEQ ID NO: 70282 - DNA, 24 bp, Artificial Sequence
  Synthetic oligonucleotide; CAAAAC chr11 5158043 5158066 5158046 -
tgagacttcaaaagcacaaataac

SEQ ID NO: 70283 - DNA, 24 bp, Artificial Sequence
  Synthetic oligonucleotide; CAAAAC chr11 5157761 5157784 5157764 -
aatatcactaatcaccagataaat

SEQ ID NO: 70284 - DNA, 24 bp, Artificial Sequence
  Synthetic oligonucleotide; CAAAAC chr11 5157713 5157736 5157716 -
caccttagttaaaatagcttataa

SEQ ID NO: 70285 - DNA, 24 bp, Artificial Sequence
  Synthetic oligonucleotide; AAAAAC chr11 5157239 5157262 5157242 -
catgttctaactcgtgtggaagtt

SEQ ID NO: 70286 - DNA, 24 bp, Artificial Sequence
  Synthetic oligonucleotide; AAAAAC chr11 5157156 5157179 5157159 -
agaaaggaatgagaaatcaagcaa

SEQ ID NO: 70287 - DNA, 24 bp, Artificial Sequence
  Synthetic oligonucleotide; AAAAAC chr11 5155278 5155301 5155281 -
ttacttaatttactaaaagataaa

SEQ ID NO: 70288 - DNA, 24 bp, Artificial Sequence
  Synthetic oligonucleotide; AAAAAC chr11 5155166 5155189 5155169 -
tttttcttttctgaataaaaagag

SEQ ID NO: 70289 - DNA, 24 bp, Artificial Sequence
  Synthetic oligonucleotide; CAAAAC chr11 5154386 5154409 5154389 -
tattcttcaggtatctggtaagag

SEQ ID NO: 70290 - DNA, 24 bp, Artificial Sequence
  Synthetic oligonucleotide; TAAAAC chr11 5154078 5154101 5154081 -
agtgacttatggatgggagtgtca

SEQ ID NO: 70291 - DNA, 24 bp, Artificial Sequence
  Synthetic oligonucleotide; TAAAAC chr11 5153726 5153749 5153729 -
agctgattcatgagcttactgaga

SEQ ID NO: 70292 - DNA, 24 bp, Artificial Sequence
  Synthetic oligonucleotide; TAAAAC chr11 5153275 5153298 5153278 -
tgctaattataactctgaacattt

SEQ ID NO: 70293 - DNA, 24 bp, Artificial Sequence
  Synthetic oligonucleotide; GAAAAC chr11 5152561 5152584 5152564 -
acagtgcctgtgaatgccccacct

SEQ ID NO: 70294 - DNA, 24 bp, Artificial Sequence
  Synthetic oligonucleotide; CAAAAC chr11 5152521 5152544 5152524 -
ctccatgaatccatcttttccttt

SEQ ID NO: 70295 - DNA, 24 bp, Artificial Sequence
  Synthetic oligonucleotide; CAAAAC chr11 5151377 5151400 5151380 -
tttcttttgcagtagtaaccatat

SEQ ID NO: 70296 - DNA, 24 bp, Artificial Sequence
  Synthetic oligonucleotide; CAAAAC chr11 5151372 5151395 5151375 -
tttgcagtagtaaccatatcaaaa

SEQ ID NO: 70297 - DNA, 24 bp, Artificial Sequence
  Synthetic oligonucleotide; AAAAAC chr11 5151365 5151388 5151368 -
tagtaaccatatcaaaacaaaaca

SEQ ID NO: 70298 - DNA, 24 bp, Artificial Sequence
  Synthetic oligonucleotide; GAAAAC chr11 5151069 5151092 5151072 -
ttctgaaacatccagggactcaat

SEQ ID NO: 70299 - DNA, 24 bp, Artificial Sequence
  Synthetic oligonucleotide; AAAAAC chr11 5150799 5150822 5150802 -
tctttattaattcatcattttatc

SEQ ID NO: 70300 - DNA, 24 bp, Artificial Sequence
  Synthetic oligonucleotide; AAAAAC chr11 5150084 5150107 5150087 -
tttacggctagtcaattgttcttg

SEQ ID NO: 70301 - DNA, 22 bp, Artificial Sequence
  Synthetic oligonucleotide; CTG chr11 5150003 5150024 5150020 5150025 +
gtaaatcaaagtatggacatct

SEQ ID NO: 70302 - DNA, 22 bp, Artificial Sequence
  Synthetic oligonucleotide; CTG chr11 5150026 5150047 5150043 5150048 +
cccatatgtgaatattttccat

SEQ ID NO: 70303 - DNA, 22 bp, Artificial Sequence
  Synthetic oligonucleotide; TTT chr11 5150043 5150064 5150060 5150065 +
tccataaccttgaaaaaaatga

SEQ ID NO: 70304 - DNA, 22 bp, Artificial Sequence
  Synthetic oligonucleotide; TTT chr11 5150044 5150065 5150061 5150066 +
ccataaccttgaaaaaaatgat

SEQ ID NO: 70305 - DNA, 22 bp, Artificial Sequence
  Synthetic oligonucleotide; TTC chr11 5150045 5150066 5150062 5150067 +
cataaccttgaaaaaaatgatc

SEQ ID NO: 70306 - DNA, 22 bp, Artificial Sequence
  Synthetic oligonucleotide; CTT chr11 5150054 5150075 5150071 5150076 +
gaaaaaaatgatctatgacctg

SEQ ID NO: 70307 - DNA, 22 bp, Artificial Sequence
  Synthetic oligonucleotide; TTG chr11 5150055 5150076 5150072 5150077 +
aaaaaaatgatctatgacctga

SEQ ID NO: 70308 - DNA, 22 bp, Artificial Sequence
  Synthetic oligonucleotide; CTA chr11 5150069 5150090 5150086 5150091 +
tgacctgaggtttttcaagaac

SEQ ID NO: 70309 - DNA, 22 bp, Artificial Sequence
  Synthetic oligonucleotide; CTG chr11 5150076 5150097 5150093 5150098 +
aggtttttcaagaacaattgac

SEQ ID NO: 70310 - DNA, 22 bp, Artificial Sequence
  Synthetic oligonucleotide; TTT chr11 5150082 5150103 5150099 5150104 +
ttcaagaacaattgactagccg

SEQ ID NO: 70311 - DNA, 22 bp, Artificial Sequence
  Synthetic oligonucleotide; TTT chr11 5150083 5150104 5150100 5150105 +
tcaagaacaattgactagccgt

SEQ ID NO: 70312 - DNA, 22 bp, Artificial Sequence
  Synthetic oligonucleotide; TTT chr11 5150084 5150105 5150101 5150106 +
caagaacaattgactagccgta

SEQ ID NO: 70313 - DNA, 22 bp, Artificial Sequence
  Synthetic oligonucleotide; TTC chr11 5150085 5150106 5150102 5150107 +
aagaacaattgactagccgtaa

SEQ ID NO: 70314 - DNA, 22 bp, Artificial Sequence
  Synthetic oligonucleotide; TTG chr11 5150096 5150117 5150113 5150118 +
actagccgtaaattcttatgcc

SEQ ID NO: 70315 - DNA, 22 bp, Artificial Sequence
  Synthetic oligonucleotide; CTA chr11 5150100 5150121 5150117 5150122 +
gccgtaaattcttatgccacta

SEQ ID NO: 70316 - DNA, 22 bp, Artificial Sequence
  Synthetic oligonucleotide; TTC chr11 5150111 5150132 5150128 5150133 +
ttatgccactaattttagacaa

SEQ ID NO: 70317 - DNA, 22 bp, Artificial Sequence
  Synthetic oligonucleotide; CTT chr11 5150113 5150134 5150130 5150135 +
atgccactaattttagacaata

SEQ ID NO: 70318 - DNA, 22 bp, Artificial Sequence
  Synthetic oligonucleotide; TTA chr11 5150114 5150135 5150131 5150136 +
tgccactaattttagacaatat

SEQ ID NO: 70319 - DNA, 22 bp, Artificial Sequence
  Synthetic oligonucleotide; CTA chr11 5150122 5150143 5150139 5150144 +
attttagacaatatagtcctcc

SEQ ID NO: 70320 - DNA, 22 bp, Artificial Sequence
  Synthetic oligonucleotide; TTT chr11 5150126 5150147 5150143 5150148 +
tagacaatatagtcctcctctt

SEQ ID NO: 70321 - DNA, 22 bp, Artificial Sequence
  Synthetic oligonucleotide; TTT chr11 5150127 5150148 5150144 5150149 +
agacaatatagtcctcctcttc

SEQ ID NO: 70322 - DNA, 22 bp, Artificial Sequence
  Synthetic oligonucleotide; TTA chr11 5150128 5150149 5150145 5150150 +
gacaatatagtcctcctcttca

SEQ ID NO: 70323 - DNA, 22 bp, Artificial Sequence
  Synthetic oligonucleotide; CTC chr11 5150143 5150164 5150160 5150165 +
ctcttcactaacacaatagccc

SEQ ID NO: 70324 - DNA, 22 bp, Artificial Sequence
  Synthetic oligonucleotide; CTC chr11 5150146 5150167 5150163 5150168 +
ttcactaacacaatagccctag

SEQ ID NO: 70325 - DNA, 22 bp, Artificial Sequence
  Synthetic oligonucleotide; CTT chr11 5150148 5150169 5150165 5150170 +
cactaacacaatagccctagac

SEQ ID NO: 70326 - DNA, 22 bp, Artificial Sequence
  Synthetic oligonucleotide; TTC chr11 5150149 5150170 5150166 5150171 +
actaacacaatagccctagact

SEQ ID NO: 70327 - DNA, 22 bp, Artificial Sequence
  Synthetic oligonucleotide; CTA chr11 5150153 5150174 5150170 5150175 +
acacaatagccctagacttatt

SEQ ID NO: 70328 - DNA, 22 bp, Artificial Sequence
  Synthetic oligonucleotide; CTA chr11 5150167 5150188 5150184 5150189 +
gacttatttatatttgctgtgt

SEQ ID NO: 70329 - DNA, 22 bp, Artificial Sequence
  Synthetic oligonucleotide; CTT chr11 5150172 5150193 5150189 5150194 +
atttatatttgctgtgtggtat

SEQ ID NO: 70330 - DNA, 22 bp, Artificial Sequence
  Synthetic oligonucleotide; TTA chr11 5150173 5150194 5150190 5150195 +
tttatatttgctgtgtggtatg

SEQ ID NO: 70331 - DNA, 22 bp, Artificial Sequence
  Synthetic oligonucleotide; TTT chr11 5150176 5150197 5150193 5150198 +
atatttgctgtgtggtatgctg

SEQ ID NO: 70332 - DNA, 22 bp, Artificial Sequence
  Synthetic oligonucleotide; TTA chr11 5150177 5150198 5150194 5150199 +
tatttgctgtgtggtatgctgc

SEQ ID NO: 70333 - DNA, 22 bp, Artificial Sequence
  Synthetic oligonucleotide; TTT chr11 5150182 5150203 5150199 5150204 +
gctgtgtggtatgctgccacat

SEQ ID NO: 70334 - DNA, 22 bp, Artificial Sequence
  Synthetic oligonucleotide; TTG chr11 5150183 5150204 5150200 5150205 +
ctgtgtggtatgctgccacatg

SEQ ID NO: 70335 - DNA, 22 bp, Artificial Sequence
  Synthetic oligonucleotide; CTG chr11 5150186 5150207 5150203 5150208 +
tgtggtatgctgccacatgccc

SEQ ID NO: 70336 - DNA, 22 bp, Artificial Sequence
  Synthetic oligonucleotide; CTG chr11 5150198 5150219 5150215 5150220 +
ccacatgcccaagcagacacac

SEQ ID NO: 70337 - DNA, 22 bp, Artificial Sequence
  Synthetic oligonucleotide; CTT chr11 5150255 5150276 5150272 5150277 +
acttgtagaacacaagcaaaca

SEQ ID NO: 70338 - DNA, 22 bp, Artificial Sequence
  Synthetic oligonucleotide; TTA chr11 5150256 5150277 5150273 5150278 +
cttgtagaacacaagcaaacaa

SEQ ID NO: 70339 - DNA, 22 bp, Artificial Sequence
  Synthetic oligonucleotide; CTT chr11 5150259 5150280 5150276 5150281 +
gtagaacacaagcaaacaaatg

SEQ ID NO: 70340 - DNA, 22 bp, Artificial Sequence
  Synthetic oligonucleotide; TTG chr11 5150260 5150281 5150277 5150282 +
tagaacacaagcaaacaaatga

SEQ ID NO: 70341 - DNA, 22 bp, Artificial Sequence
  Synthetic oligonucleotide; CTC chr11 5150288 5150309 5150305 5150310 +
tccaatggcacattatagcttt

SEQ ID NO: 70342 - DNA, 22 bp, Artificial Sequence
  Synthetic oligonucleotide; CTC chr11 5150290 5150311 5150307 5150312 +
caatggcacattatagcttttg

SEQ ID NO: 70343 - DNA, 22 bp, Artificial Sequence
  Synthetic oligonucleotide; TTA chr11 5150303 5150324 5150320 5150325 +
tagcttttggaataaagtccag

SEQ ID NO: 70344 - DNA, 22 bp, Artificial Sequence
  Synthetic oligonucleotide; CTT chr11 5150309 5150330 5150326 5150331 +
ttggaataaagtccagcaactc

SEQ ID NO: 70345 - DNA, 22 bp, Artificial Sequence
  Synthetic oligonucleotide; TTT chr11 5150310 5150331 5150327 5150332 +
tggaataaagtccagcaactct

SEQ ID NO: 70346 - DNA, 22 bp, Artificial Sequence
  Synthetic oligonucleotide; TTT chr11 5150311 5150332 5150328 5150333 +
ggaataaagtccagcaactctg

SEQ ID NO: 70347 - DNA, 22 bp, Artificial Sequence
  Synthetic oligonucleotide; TTG chr11 5150312 5150333 5150329 5150334 +
gaataaagtccagcaactctgc

SEQ ID NO: 70348 - DNA, 22 bp, Artificial Sequence
  Synthetic oligonucleotide; CTC chr11 5150331 5150352 5150348 5150353 +
tgcacaacattaatagccattt

SEQ ID NO: 70349 - DNA, 22 bp, Artificial Sequence
  Synthetic oligonucleotide; CTG chr11 5150333 5150354 5150350 5150355 +
cacaacattaatagccattttt

SEQ ID NO: 70350 - DNA, 22 bp, Artificial Sequence
  Synthetic oligonucleotide; TTA chr11 5150343 5150364 5150360 5150365 +
atagccatttttgatattcata

SEQ ID NO: 70351 - DNA, 22 bp, Artificial Sequence
  Synthetic oligonucleotide; TTT chr11 5150353 5150374 5150370 5150375 +
ttgatattcatattttccttgt

SEQ ID NO: 70352 - DNA, 22 bp, Artificial Sequence
  Synthetic oligonucleotide; TTT chr11 5150354 5150375 5150371 5150376 +
tgatattcatattttccttgtc

SEQ ID NO: 70353 - DNA, 22 bp, Artificial Sequence
  Synthetic oligonucleotide; TTT chr11 5150355 5150376 5150372 5150377 +
gatattcatattttccttgtct

SEQ ID NO: 70354 - DNA, 22 bp, Artificial Sequence
  Synthetic oligonucleotide; TTG chr11 5150356 5150377 5150373 5150378 +
atattcatattttccttgtctc

SEQ ID NO: 70355 - DNA, 22 bp, Artificial Sequence
  Synthetic oligonucleotide; TTC chr11 5150362 5150383 5150379 5150384 +
atattttccttgtctccccaag

SEQ ID NO: 70356 - DNA, 22 bp, Artificial Sequence
  Synthetic oligonucleotide; TTT chr11 5150368 5150389 5150385 5150390 +
tccttgtctccccaagttctac

SEQ ID NO: 70357 - DNA, 22 bp, Artificial Sequence
  Synthetic oligonucleotide; TTT chr11 5150369 5150390 5150386 5150391 +
ccttgtctccccaagttctacc

SEQ ID NO: 70358 - DNA, 22 bp, Artificial Sequence
  Synthetic oligonucleotide; TTC chr11 5150370 5150391 5150387 5150392 +
cttgtctccccaagttctacct

SEQ ID NO: 70359 - DNA, 22 bp, Artificial Sequence
  Synthetic oligonucleotide; CTT chr11 5150373 5150394 5150390 5150395 +
gtctccccaagttctaccttgc

SEQ ID NO: 70360 - DNA, 22 bp, Artificial Sequence
  Synthetic oligonucleotide; TTG chr11 5150374 5150395 5150391 5150396 +
tctccccaagttctaccttgca

SEQ ID NO: 70361 - DNA, 22 bp, Artificial Sequence
  Synthetic oligonucleotide; CTC chr11 5150378 5150399 5150395 5150400 +
cccaagttctaccttgcactca

SEQ ID NO: 70362 - DNA, 22 bp, Artificial Sequence
  Synthetic oligonucleotide; TTC chr11 5150387 5150408 5150404 5150409 +
taccttgcactcataccatatt

SEQ ID NO: 70363 - DNA, 22 bp, Artificial Sequence
  Synthetic oligonucleotide; CTA chr11 5150389 5150410 5150406 5150411 +
ccttgcactcataccatattga

SEQ ID NO: 70364 - DNA, 22 bp, Artificial Sequence
  Synthetic oligonucleotide; CTT chr11 5150393 5150414 5150410 5150415 +
gcactcataccatattgaaaaa

SEQ ID NO: 70365 - DNA, 22 bp, Artificial Sequence
  Synthetic oligonucleotide; TTG chr11 5150394 5150415 5150411 5150416 +
cactcataccatattgaaaaaa

SEQ ID NO: 70366 - DNA, 22 bp, Artificial Sequence
  Synthetic oligonucleotide; CTC chr11 5150399 5150420 5150416 5150421 +
ataccatattgaaaaaactaga

SEQ ID NO: 70367 - DNA, 22 bp, Artificial Sequence
  Synthetic oligonucleotide; TTG chr11 5150410 5150431 5150427 5150432 +
aaaaaactagagttaccttaaa

SEQ ID NO: 70368 - DNA, 22 bp, Artificial Sequence
  Synthetic oligonucleotide; CTA chr11 5150419 5150440 5150436 5150441 +
gagttaccttaaactacattat

SEQ ID NO: 70369 - DNA, 22 bp, Artificial Sequence
  Synthetic oligonucleotide; TTA chr11 5150425 5150446 5150442 5150447 +
ccttaaactacattatctagtt

SEQ ID NO: 70370 - DNA, 22 bp, Artificial Sequence
  Synthetic oligonucleotide; CTT chr11 5150429 5150450 5150446 5150451 +
aaactacattatctagtttaaa

SEQ ID NO: 70371 - DNA, 22 bp, Artificial Sequence
  Synthetic oligonucleotide; TTA chr11 5150430 5150451 5150447 5150452 +
aactacattatctagtttaaat

SEQ ID NO: 70372 - DNA, 22 bp, Artificial Sequence
  Synthetic oligonucleotide; CTA chr11 5150435 5150456 5150452 5150457 +
cattatctagtttaaatctcct

SEQ ID NO: 70373 - DNA, 22 bp, Artificial Sequence
  Synthetic oligonucleotide; TTA chr11 5150440 5150461 5150457 5150462 +
tctagtttaaatctcctctact

SEQ ID NO: 70374 - DNA, 22 bp, Artificial Sequence
  Synthetic oligonucleotide; CTA chr11 5150444 5150465 5150461 5150466 +
gtttaaatctcctctactatct

SEQ ID NO: 70375 - DNA, 22 bp, Artificial Sequence
  Synthetic oligonucleotide; TTT chr11 5150448 5150469 5150465 5150470 +
aaatctcctctactatctacct

SEQ ID NO: 70376 - DNA, 22 bp, Artificial Sequence
  Synthetic oligonucleotide; TTA chr11 5150449 5150470 5150466 5150471 +
aatctcctctactatctacctg

SEQ ID NO: 70377 - DNA, 22 bp, Artificial Sequence
  Synthetic oligonucleotide; CTC chr11 5150455 5150476 5150472 5150477 +
ctctactatctacctggcatga

SEQ ID NO: 70378 - DNA, 22 bp, Artificial Sequence
  Synthetic oligonucleotide; CTC chr11 5150458 5150479 5150475 5150480 +
tactatctacctggcatgatgt

SEQ ID NO: 70379 - DNA, 22 bp, Artificial Sequence
  Synthetic oligonucleotide; CTA chr11 5150460 5150481 5150477 5150482 +
ctatctacctggcatgatgtgt

SEQ ID NO: 70380 - DNA, 22 bp, Artificial Sequence
  Synthetic oligonucleotide; CTA chr11 5150463 5150484 5150480 5150485 +
tctacctggcatgatgtgttct

SEQ ID NO: 70381 - DNA, 22 bp, Artificial Sequence
  Synthetic oligonucleotide; CTA chr11 5150467 5150488 5150484 5150489 +
cctggcatgatgtgttcttact

SEQ ID NO: 70382 - DNA, 22 bp, Artificial Sequence
  Synthetic oligonucleotide; CTG chr11 5150471 5150492 5150488 5150493 +
gcatgatgtgttcttacttcct

SEQ ID NO: 70383 - DNA, 22 bp, Artificial Sequence
  Synthetic oligonucleotide; TTC chr11 5150484 5150505 5150501 5150506 +
ttacttccttggctactcatcc

SEQ ID NO: 70384 - DNA, 22 bp, Artificial Sequence
  Synthetic oligonucleotide; CTT chr11 5150486 5150507 5150503 5150508 +
acttccttggctactcatccat

SEQ ID NO: 70385 - DNA, 22 bp, Artificial Sequence
  Synthetic oligonucleotide; TTA chr11 5150487 5150508 5150504 5150509 +
cttccttggctactcatccatc

SEQ ID NO: 70386 - DNA, 22 bp, Artificial Sequence
  Synthetic oligonucleotide; CTT chr11 5150490 5150511 5150507 5150512 +
ccttggctactcatccatcatt

SEQ ID NO: 70387 - DNA, 22 bp, Artificial Sequence
  Synthetic oligonucleotide; TTC chr11 5150491 5150512 5150508 5150513 +
cttggctactcatccatcattc

SEQ ID NO: 70388 - DNA, 22 bp, Artificial Sequence
  Synthetic oligonucleotide; CTT chr11 5150494 5150515 5150511 5150516 +
ggctactcatccatcattcctc

SEQ ID NO: 70389 - DNA, 22 bp, Artificial Sequence
  Synthetic oligonucleotide; TTG chr11 5150495 5150516 5150512 5150517 +
gctactcatccatcattcctca

SEQ ID NO: 70390 - DNA, 22 bp, Artificial Sequence
  Synthetic oligonucleotide; CTA chr11 5150499 5150520 5150516 5150521 +
ctcatccatcattcctcaagaa

SEQ ID NO: 70391 - DNA, 22 bp, Artificial Sequence
  Synthetic oligonucleotide; CTC chr11 5150502 5150523 5150519 5150524 +
atccatcattcctcaagaatca

SEQ ID NO: 70392 - DNA, 22 bp, Artificial Sequence
  Synthetic oligonucleotide; TTC chr11 5150513 5150534 5150530 5150535 +
ctcaagaatcagaggtaactac

SEQ ID NO: 70393 - DNA, 22 bp, Artificial Sequence
  Synthetic oligonucleotide; CTC chr11 5150516 5150537 5150533 5150538 +
aagaatcagaggtaactaccta

SEQ ID NO: 70394 - DNA, 22 bp, Artificial Sequence
  Synthetic oligonucleotide; CTA chr11 5150534 5150555 5150551 5150556 +
cctaaccaaaaaacaaaataca

SEQ ID NO: 70395 - DNA, 22 bp, Artificial Sequence
  Synthetic oligonucleotide; CTA chr11 5150538 5150559 5150555 5150560 +
accaaaaaacaaaatacaataa

SEQ ID NO: 70396 - DNA, 22 bp, Artificial Sequence
  Synthetic oligonucleotide; CTC chr11 5150569 5150590 5150586 5150591 +
ccctgctttggttagatttcaa

SEQ ID NO: 70397 - DNA, 22 bp, Artificial Sequence
  Synthetic oligonucleotide; CTG chr11 5150574 5150595 5150591 5150596 +
ctttggttagatttcaatgctt

SEQ ID NO: 70398 - DNA, 22 bp, Artificial Sequence
  Synthetic oligonucleotide; CTT chr11 5150577 5150598 5150594 5150599 +
tggttagatttcaatgcttcat

SEQ ID NO: 70399 - DNA, 22 bp, Artificial Sequence
  Synthetic oligonucleotide; TTT chr11 5150578 5150599 5150595 5150600 +
ggttagatttcaatgcttcatt

SEQ ID NO: 70400 - DNA, 22 bp, Artificial Sequence
  Synthetic oligonucleotide; TTG chr11 5150579 5150600 5150596 5150601 +
gttagatttcaatgcttcattc

SEQ ID NO: 70401 - DNA, 22 bp, Artificial Sequence
  Synthetic oligonucleotide; TTA chr11 5150583 5150604 5150600 5150605 +
gatttcaatgcttcattctctc

SEQ ID NO: 70402 - DNA, 22 bp, Artificial Sequence
  Synthetic oligonucleotide; TTT chr11 5150588 5150609 5150605 5150610 +
caatgcttcattctctctgaac

SEQ ID NO: 70403 - DNA, 22 bp, Artificial Sequence
  Synthetic oligonucleotide; TTC chr11 5150589 5150610 5150606 5150611 +
aatgcttcattctctctgaact

SEQ ID NO: 70404 - DNA, 22 bp, Artificial Sequence
  Synthetic oligonucleotide; CTT chr11 5150596 5150617 5150613 5150618 +
cattctctctgaactccacatc

SEQ ID NO: 70405 - DNA, 22 bp, Artificial Sequence
  Synthetic oligonucleotide; TTC chr11 5150597 5150618 5150614 5150619 +
attctctctgaactccacatcc

SEQ ID NO: 70406 - DNA, 22 bp, Artificial Sequence
  Synthetic oligonucleotide; TTC chr11 5150601 5150622 5150618 5150623 +
tctctgaactccacatcctatg

SEQ ID NO: 70407 - DNA, 22 bp, Artificial Sequence
  Synthetic oligonucleotide; CTC chr11 5150603 5150624 5150620 5150625 +
tctgaactccacatcctatgtg

SEQ ID NO: 70408 - DNA, 22 bp, Artificial Sequence
  Synthetic oligonucleotide; CTC chr11 5150605 5150626 5150622 5150627 +
tgaactccacatcctatgtgta

SEQ ID NO: 70409 - DNA, 22 bp, Artificial Sequence
  Synthetic oligonucleotide; CTG chr11 5150607 5150628 5150624 5150629 +
aactccacatcctatgtgtaca

SEQ ID NO: 70410 - DNA, 22 bp, Artificial Sequence
  Synthetic oligonucleotide; CTC chr11 5150612 5150633 5150629 5150634 +
cacatcctatgtgtacacttgt

SEQ ID NO: 70411 - DNA, 22 bp, Artificial Sequence
  Synthetic oligonucleotide; CTA chr11 5150621 5150642 5150638 5150643 +
tgtgtacacttgttatttctct

SEQ ID NO: 70412 - DNA, 22 bp, Artificial Sequence
  Synthetic oligonucleotide; CTT chr11 5150632 5150653 5150649 5150654 +
gttatttctctcttctttccct

SEQ ID NO: 70413 - DNA, 22 bp, Artificial Sequence
  Synthetic oligonucleotide; TTG chr11 5150633 5150654 5150650 5150655 +
ttatttctctcttctttccctt

SEQ ID NO: 70414 - DNA, 22 bp, Artificial Sequence
  Synthetic oligonucleotide; TTA chr11 5150636 5150657 5150653 5150658 +
tttctctcttctttcccttgcc

SEQ ID NO: 70415 - DNA, 22 bp, Artificial Sequence
  Synthetic oligonucleotide; TTT chr11 5150639 5150660 5150656 5150661 +
ctctcttctttcccttgcctgc

SEQ ID NO: 70416 - DNA, 22 bp, Artificial Sequence
  Synthetic oligonucleotide; TTC chr11 5150640 5150661 5150657 5150662 +
tctcttctttcccttgcctgcc

SEQ ID NO: 70417 - DNA, 22 bp, Artificial Sequence
  Synthetic oligonucleotide; CTC chr11 5150642 5150663 5150659 5150664 +
tcttctttcccttgcctgccca

SEQ ID NO: 70418 - DNA, 22 bp, Artificial Sequence
  Synthetic oligonucleotide; CTC chr11 5150644 5150665 5150661 5150666 +
ttctttcccttgcctgcccatt

SEQ ID NO: 70419 - DNA, 22 bp, Artificial Sequence
  Synthetic oligonucleotide; CTT chr11 5150646 5150667 5150663 5150668 +
ctttcccttgcctgcccattcc

SEQ ID NO: 70420 - DNA, 22 bp, Artificial Sequence
  Synthetic oligonucleotide; TTC chr11 5150647 5150668 5150664 5150669 +
tttcccttgcctgcccattccc

SEQ ID NO: 70421 - DNA, 22 bp, Artificial Sequence
  Synthetic oligonucleotide; CTT chr11 5150649 5150670 5150666 5150671 +
tcccttgcctgcccattcccca

SEQ ID NO: 70422 - DNA, 22 bp, Artificial Sequence
  Synthetic oligonucleotide; TTT chr11 5150650 5150671 5150667 5150672 +
cccttgcctgcccattccccac

SEQ ID NO: 70423 - DNA, 22 bp, Artificial Sequence
  Synthetic oligonucleotide; TTC chr11 5150651 5150672 5150668 5150673 +
ccttgcctgcccattccccacc

SEQ ID NO: 70424 - DNA, 22 bp, Artificial Sequence
  Synthetic oligonucleotide; CTT chr11 5150655 5150676 5150672 5150677 +
gcctgcccattccccacctctc

SEQ ID NO: 70425 - DNA, 22 bp, Artificial Sequence
  Synthetic oligonucleotide; TTG chr11 5150656 5150677 5150673 5150678 +
cctgcccattccccacctctct

SEQ ID NO: 70426 - DNA, 22 bp, Artificial Sequence
  Synthetic oligonucleotide; CTG chr11 5150660 5150681 5150677 5150682 +
cccattccccacctctcttcct

SEQ ID NO: 70427 - DNA, 22 bp, Artificial Sequence
  Synthetic oligonucleotide; TTC chr11 5150667 5150688 5150684 5150689 +
cccacctctcttcctttcagtc

SEQ ID NO: 70428 - DNA, 22 bp, Artificial Sequence
  Synthetic oligonucleotide; CTC chr11 5150675 5150696 5150692 5150697 +
tcttcctttcagtctctctttt

SEQ ID NO: 70429 - DNA, 22 bp, Artificial Sequence
  Synthetic oligonucleotide; CTC chr11 5150677 5150698 5150694 5150699 +
ttcctttcagtctctcttttcc

SEQ ID NO: 70430 - DNA, 22 bp, Artificial Sequence
  Synthetic oligonucleotide; CTT chr11 5150679 5150700 5150696 5150701 +
cctttcagtctctcttttccag

SEQ ID NO: 70431 - DNA, 22 bp, Artificial Sequence
  Synthetic oligonucleotide; TTC chr11 5150680 5150701 5150697 5150702 +
ctttcagtctctcttttccaga

SEQ ID NO: 70432 - DNA, 22 bp, Artificial Sequence
  Synthetic oligonucleotide; CTT chr11 5150683 5150704 5150700 5150705 +
tcagtctctcttttccagaatt

SEQ ID NO: 70433 - DNA, 22 bp, Artificial Sequence
  Synthetic oligonucleotide; TTT chr11 5150684 5150705 5150701 5150706 +
cagtctctcttttccagaatta

SEQ ID NO: 70434 - DNA, 22 bp, Artificial Sequence
  Synthetic oligonucleotide; TTC chr11 5150685 5150706 5150702 5150707 +
agtctctcttttccagaattac

SEQ ID NO: 70435 - DNA, 22 bp, Artificial Sequence
  Synthetic oligonucleotide; CTC chr11 5150691 5150712 5150708 5150713 +
tcttttccagaattacataggt

SEQ ID NO: 70436 - DNA, 22 bp, Artificial Sequence
  Synthetic oligonucleotide; CTC chr11 5150693 5150714 5150710 5150715 +
ttttccagaattacataggtac

SEQ ID NO: 70437 - DNA, 22 bp, Artificial Sequence
  Synthetic oligonucleotide; CTT chr11 5150695 5150716 5150712 5150717 +
ttccagaattacataggtacaa

SEQ ID NO: 70438 - DNA, 22 bp, Artificial Sequence
  Synthetic oligonucleotide; TTT chr11 5150696 5150717 5150713 5150718 +
tccagaattacataggtacaaa

SEQ ID NO: 70439 - DNA, 22 bp, Artificial Sequence
  Synthetic oligonucleotide; TTT chr11 5150697 5150718 5150714 5150719 +
ccagaattacataggtacaaac

SEQ ID NO: 70440 - DNA, 22 bp, Artificial Sequence
  Synthetic oligonucleotide; TTC chr11 5150698 5150719 5150715 5150720 +
cagaattacataggtacaaact

SEQ ID NO: 70441 - DNA, 22 bp, Artificial Sequence
  Synthetic oligonucleotide; TTA chr11 5150706 5150727 5150723 5150728 +
cataggtacaaactcatgagaa

SEQ ID NO: 70442 - DNA, 22 bp, Artificial Sequence
  Synthetic oligonucleotide; CTC chr11 5150721 5150742 5150738 5150743 +
atgagaattattcactgtgcca

SEQ ID NO: 70443 - DNA, 22 bp, Artificial Sequence
  Synthetic oligonucleotide; TTA chr11 5150731 5150752 5150748 5150753 +
ttcactgtgccagatttactat

SEQ ID NO: 70444 - DNA, 22 bp, Artificial Sequence
  Synthetic oligonucleotide; TTC chr11 5150734 5150755 5150751 5150756 +
actgtgccagatttactattat

SEQ ID NO: 70445 - DNA, 22 bp, Artificial Sequence
  Synthetic oligonucleotide; CTG chr11 5150738 5150759 5150755 5150760 +
tgccagatttactattatgtca

SEQ ID NO: 70446 - DNA, 22 bp, Artificial Sequence
  Synthetic oligonucleotide; TTT chr11 5150748 5150769 5150765 5150770 +
actattatgtcacgattctgta

SEQ ID NO: 70447 - DNA, 22 bp, Artificial Sequence
  Synthetic oligonucleotide; TTA chr11 5150749 5150770 5150766 5150771 +
ctattatgtcacgattctgtag

SEQ ID NO: 70448 - DNA, 22 bp, Artificial Sequence
  Synthetic oligonucleotide; CTA chr11 5150752 5150773 5150769 5150774 +
ttatgtcacgattctgtagtat

SEQ ID NO: 70449 - DNA, 22 bp, Artificial Sequence
  Synthetic oligonucleotide; TTA chr11 5150755 5150776 5150772 5150777 +
tgtcacgattctgtagtatagt

SEQ ID NO: 70450 - DNA, 22 bp, Artificial Sequence
  Synthetic oligonucleotide; TTC chr11 5150766 5150787 5150783 5150788 +
tgtagtatagtatttttaatat

SEQ ID NO: 70451 - DNA, 22 bp, Artificial Sequence
  Synthetic oligonucleotide; CTG chr11 5150768 5150789 5150785 5150790 +
tagtatagtatttttaatattg

SEQ ID NO: 70452 - DNA, 22 bp, Artificial Sequence
  Synthetic oligonucleotide; TTT chr11 5150781 5150802 5150798 5150803 +
ttaatattgcaggtttttgata

SEQ ID NO: 70453 - DNA, 22 bp, Artificial Sequence
  Synthetic oligonucleotide; TTT chr11 5150782 5150803 5150799 5150804 +
taatattgcaggtttttgataa

SEQ ID NO: 70454 - DNA, 22 bp, Artificial Sequence
  Synthetic oligonucleotide; TTT chr11 5150783 5150804 5150800 5150805 +
aatattgcaggtttttgataaa

SEQ ID NO: 70455 - DNA, 22 bp, Artificial Sequence
  Synthetic oligonucleotide; TTA chr11 5150784 5150805 5150801 5150806 +
atattgcaggtttttgataaaa

SEQ ID NO: 70456 - DNA, 22 bp, Artificial Sequence
  Synthetic oligonucleotide; TTG chr11 5150790 5150811 5150807 5150812 +
caggtttttgataaaatgatga

SEQ ID NO: 70457 - DNA, 22 bp, Artificial Sequence
  Synthetic oligonucleotide; TTT chr11 5150797 5150818 5150814 5150819 +
ttgataaaatgatgaattaata

SEQ ID NO: 70458 - DNA, 22 bp, Artificial Sequence
  Synthetic oligonucleotide; TTT chr11 5150798 5150819 5150815 5150820 +
tgataaaatgatgaattaataa

SEQ ID NO: 70459 - DNA, 22 bp, Artificial Sequence
  Synthetic oligonucleotide; TTT chr11 5150799 5150820 5150816 5150821 +
gataaaatgatgaattaataaa

SEQ ID NO: 70460 - DNA, 22 bp, Artificial Sequence
  Synthetic oligonucleotide; TTG chr11 5150800 5150821 5150817 5150822 +
ataaaatgatgaattaataaag

SEQ ID NO: 70461 - DNA, 22 bp, Artificial Sequence
  Synthetic oligonucleotide; TTA chr11 5150816 5150837 5150833 5150838 +
ataaagaagtaaattttgaggt

SEQ ID NO: 70462 - DNA, 22 bp, Artificial Sequence
  Synthetic oligonucleotide; TTT chr11 5150832 5150853 5150849 5150854 +
tgaggttagcaaaaaaaaaaac

SEQ ID NO: 70463 - DNA, 22 bp, Artificial Sequence
  Synthetic oligonucleotide; TTT chr11 5150833 5150854 5150850 5150855 +
gaggttagcaaaaaaaaaaaca

SEQ ID NO: 70464 - DNA, 22 bp, Artificial Sequence
  Synthetic oligonucleotide; TTG chr11 5150834 5150855 5150851 5150856 +
aggttagcaaaaaaaaaaacaa

SEQ ID NO: 70465 - DNA, 22 bp, Artificial Sequence
  Synthetic oligonucleotide; TTA chr11 5150840 5150861 5150857 5150862 +
gcaaaaaaaaaaacaacaacat

SEQ ID NO: 70466 - DNA, 22 bp, Artificial Sequence
  Synthetic oligonucleotide; TTG chr11 5150864 5150885 5150881 5150886 +
atgtgtcaaatgcaacacctgg

SEQ ID NO: 70467 - DNA, 22 bp, Artificial Sequence
  Synthetic oligonucleotide; CTG chr11 5150885 5150906 5150902 5150907 +
gttctaatttttgtgcctgtaa

SEQ ID NO: 70468 - DNA, 22 bp, Artificial Sequence
  Synthetic oligonucleotide; TTC chr11 5150889 5150910 5150906 5150911 +
taatttttgtgcctgtaattcc

SEQ ID NO: 70469 - DNA, 22 bp, Artificial Sequence
  Synthetic oligonucleotide; CTA chr11 5150891 5150912 5150908 5150913 +
atttttgtgcctgtaattcctt

SEQ ID NO: 70470 - DNA, 22 bp, Artificial Sequence
  Synthetic oligonucleotide; TTT chr11 5150895 5150916 5150912 5150917 +
ttgtgcctgtaattccttgtat

SEQ ID NO: 70471 - DNA, 22 bp, Artificial Sequence
  Synthetic oligonucleotide; TTT chr11 5150896 5150917 5150913 5150918 +
tgtgcctgtaattccttgtatg

SEQ ID NO: 70472 - DNA, 22 bp, Artificial Sequence
  Synthetic oligonucleotide; TTT chr11 5150897 5150918 5150914 5150919 +
gtgcctgtaattccttgtatga

SEQ ID NO: 70473 - DNA, 22 bp, Artificial Sequence
  Synthetic oligonucleotide; TTG chr11 5150898 5150919 5150915 5150920 +
tgcctgtaattccttgtatgac

SEQ ID NO: 70474 - DNA, 22 bp, Artificial Sequence
  Synthetic oligonucleotide; CTG chr11 5150904 5150925 5150921 5150926 +
taattccttgtatgactctgaa

SEQ ID NO: 70475 - DNA, 22 bp, Artificial Sequence
  Synthetic oligonucleotide; TTC chr11 5150910 5150931 5150927 5150932 +
cttgtatgactctgaaaatgta

SEQ ID NO: 70476 - DNA, 22 bp, Artificial Sequence
  Synthetic oligonucleotide; CTT chr11 5150913 5150934 5150930 5150935 +
gtatgactctgaaaatgtattt

SEQ ID NO: 70477 - DNA, 22 bp, Artificial Sequence
  Synthetic oligonucleotide; TTG chr11 5150914 5150935 5150931 5150936 +
tatgactctgaaaatgtattta

SEQ ID NO: 70478 - DNA, 22 bp, Artificial Sequence
  Synthetic oligonucleotide; CTC chr11 5150922 5150943 5150939 5150944 +
tgaaaatgtatttaaattttta

SEQ ID NO: 70479 - DNA, 22 bp, Artificial Sequence
  Synthetic oligonucleotide; CTG chr11 5150924 5150945 5150941 5150946 +
aaaatgtatttaaatttttagg

SEQ ID NO: 70480 - DNA, 22 bp, Artificial Sequence
  Synthetic oligonucleotide; TTT chr11 5150935 5150956 5150952 5150957 +
aaatttttaggctttattgtct

SEQ ID NO: 70481 - DNA, 22 bp, Artificial Sequence
  Synthetic oligonucleotide; TTA chr11 5150936 5150957 5150953 5150958 +
aatttttaggctttattgtctc

SEQ ID NO: 70482 - DNA, 22 bp, Artificial Sequence
  Synthetic oligonucleotide; TTT chr11 5150941 5150962 5150958 5150963 +
ttaggctttattgtctcttgat

SEQ ID NO: 70483 - DNA, 22 bp, Artificial Sequence
  Synthetic oligonucleotide; TTT chr11 5150942 5150963 5150959 5150964 +
taggctttattgtctcttgata

SEQ ID NO: 70484 - DNA, 22 bp, Artificial Sequence
  Synthetic oligonucleotide; TTT chr11 5150943 5150964 5150960 5150965 +
aggctttattgtctcttgatat

SEQ ID NO: 70485 - DNA, 22 bp, Artificial Sequence
  Synthetic oligonucleotide; TTA chr11 5150944 5150965 5150961 5150966 +
ggctttattgtctcttgatatt

SEQ ID NO: 70486 - DNA, 22 bp, Artificial Sequence
  Synthetic oligonucleotide; CTT chr11 5150949 5150970 5150966 5150971 +
tattgtctcttgatattcataa

SEQ ID NO: 70487 - DNA, 22 bp, Artificial Sequence
  Synthetic oligonucleotide; TTT chr11 5150950 5150971 5150967 5150972 +
attgtctcttgatattcataag

SEQ ID NO: 70488 - DNA, 22 bp, Artificial Sequence
  Synthetic oligonucleotide; TTA chr11 5150951 5150972 5150968 5150973 +
ttgtctcttgatattcataaga

SEQ ID NO: 70489 - DNA, 22 bp, Artificial Sequence
  Synthetic oligonucleotide; TTG chr11 5150954 5150975 5150971 5150976 +
tctcttgatattcataagattt

SEQ ID NO: 70490 - DNA, 22 bp, Artificial Sequence
  Synthetic oligonucleotide; CTC chr11 5150958 5150979 5150975 5150980 +
ttgatattcataagattttctt

SEQ ID NO: 70491 - DNA, 22 bp, Artificial Sequence
  Synthetic oligonucleotide; CTT chr11 5150960 5150981 5150977 5150982 +
gatattcataagattttctttg

SEQ ID NO: 70492 - DNA, 22 bp, Artificial Sequence
  Synthetic oligonucleotide; TTG chr11 5150961 5150982 5150978 5150983 +
atattcataagattttctttga

SEQ ID NO: 70493 - DNA, 22 bp, Artificial Sequence
  Synthetic oligonucleotide; TTC chr11 5150967 5150988 5150984 5150989 +
ataagattttctttgacaagaa

SEQ ID NO: 70494 - DNA, 22 bp, Artificial Sequence
  Synthetic oligonucleotide; TTT chr11 5150976 5150997 5150993 5150998 +
tctttgacaagaacacagttaa

SEQ ID NO: 70495 - DNA, 22 bp, Artificial Sequence
  Synthetic oligonucleotide; TTT chr11 5150977 5150998 5150994 5150999 +
ctttgacaagaacacagttaac

SEQ ID NO: 70496 - DNA, 22 bp, Artificial Sequence
  Synthetic oligonucleotide; TTC chr11 5150978 5150999 5150995 5151000 +
tttgacaagaacacagttaaca

SEQ ID NO: 70497 - DNA, 22 bp, Artificial Sequence
  Synthetic oligonucleotide; CTT chr11 5150980 5151001 5150997 5151002 +
tgacaagaacacagttaacatg

SEQ ID NO: 70498 - DNA, 22 bp, Artificial Sequence
  Synthetic oligonucleotide; TTT chr11 5150981 5151002 5150998 5151003 +
gacaagaacacagttaacatgt

SEQ ID NO: 70499 - DNA, 22 bp, Artificial Sequence
  Synthetic oligonucleotide; TTG chr11 5150982 5151003 5150999 5151004 +
acaagaacacagttaacatgta

SEQ ID NO: 70500 - DNA, 22 bp, Artificial Sequence
  Synthetic oligonucleotide; TTA chr11 5150997 5151018 5151014 5151019 +
acatgtacttcctttgattttt

SEQ ID NO: 70501 - DNA, 22 bp, Artificial Sequence
  Synthetic oligonucleotide; CTT chr11 5151007 5151028 5151024 5151029 +
cctttgatttttttttttaagg

SEQ ID NO: 70502 - DNA, 22 bp, Artificial Sequence
  Synthetic oligonucleotide; TTC chr11 5151008 5151029 5151025 5151030 +
ctttgatttttttttttaaggc

SEQ ID NO: 70503 - DNA, 22 bp, Artificial Sequence
  Synthetic oligonucleotide; CTT chr11 5151011 5151032 5151028 5151033 +
tgatttttttttttaaggcagg

SEQ ID NO: 70504 - DNA, 22 bp, Artificial Sequence
  Synthetic oligonucleotide; TTT chr11 5151012 5151033 5151029 5151034 +
gatttttttttttaaggcaggg

SEQ ID NO: 70505 - DNA, 22 bp, Artificial Sequence
  Synthetic oligonucleotide; TTG chr11 5151013 5151034 5151030 5151035 +
atttttttttttaaggcaggga

SEQ ID NO: 70506 - DNA, 22 bp, Artificial Sequence
  Synthetic oligonucleotide; TTT chr11 5151017 5151038 5151034 5151039 +
ttttttttaaggcagggatgat

SEQ ID NO: 70507 - DNA, 22 bp, Artificial Sequence
  Synthetic oligonucleotide; TTT chr11 5151018 5151039 5151035 5151040 +
tttttttaaggcagggatgatc

SEQ ID NO: 70508 - DNA, 22 bp, Artificial Sequence
  Synthetic oligonucleotide; TTT chr11 5151019 5151040 5151036 5151041 +
ttttttaaggcagggatgatca

SEQ ID NO: 70509 - DNA, 22 bp, Artificial Sequence
  Synthetic oligonucleotide; TTT chr11 5151020 5151041 5151037 5151042 +
tttttaaggcagggatgatcaa

SEQ ID NO: 70510 - DNA, 22 bp, Artificial Sequence
  Synthetic oligonucleotide; TTT chr11 5151021 5151042 5151038 5151043 +
ttttaaggcagggatgatcaag

SEQ ID NO: 70511 - DNA, 22 bp, Artificial Sequence
  Synthetic oligonucleotide; TTT chr11 5151022 5151043 5151039 5151044 +
tttaaggcagggatgatcaaga

SEQ ID NO: 70512 - DNA, 22 bp, Artificial Sequence
  Synthetic oligonucleotide; TTT chr11 5151023 5151044 5151040 5151045 +
ttaaggcagggatgatcaagaa

SEQ ID NO: 70513 - DNA, 22 bp, Artificial Sequence
  Synthetic oligonucleotide; TTT chr11 5151024 5151045 5151041 5151046 +
taaggcagggatgatcaagaaa

SEQ ID NO: 70514 - DNA, 22 bp, Artificial Sequence
  Synthetic oligonucleotide; TTT chr11 5151025 5151046 5151042 5151047 +
aaggcagggatgatcaagaaaa

SEQ ID NO: 70515 - DNA, 22 bp, Artificial Sequence
  Synthetic oligonucleotide; TTA chr11 5151026 5151047 5151043 5151048 +
aggcagggatgatcaagaaaat

SEQ ID NO: 70516 - DNA, 22 bp, Artificial Sequence
  Synthetic oligonucleotide; CTT chr11 5151063 5151084 5151080 5151085 +
gttttcattgagtccctggatg

SEQ ID NO: 70517 - DNA, 22 bp, Artificial Sequence
  Synthetic oligonucleotide; TTG chr11 5151064 5151085 5151081 5151086 +
ttttcattgagtccctggatgt

SEQ ID NO: 70518 - DNA, 22 bp, Artificial Sequence
  Synthetic oligonucleotide; TTT chr11 5151067 5151088 5151084 5151089 +
tcattgagtccctggatgtttc

SEQ ID NO: 70519 - DNA, 22 bp, Artificial Sequence
  Synthetic oligonucleotide; TTT chr11 5151068 5151089 5151085 5151090 +
cattgagtccctggatgtttca

SEQ ID NO: 70520 - DNA, 22 bp, Artificial Sequence
  Synthetic oligonucleotide; TTC chr11 5151069 5151090 5151086 5151091 +
attgagtccctggatgtttcag

SEQ ID NO: 70521 - DNA, 22 bp, Artificial Sequence
  Synthetic oligonucleotide; TTG chr11 5151073 5151094 5151090 5151095 +
agtccctggatgtttcagaaca

SEQ ID NO: 70522 - DNA, 22 bp, Artificial Sequence
  Synthetic oligonucleotide; CTG chr11 5151081 5151102 5151098 5151103 +
gatgtttcagaacaacgagcct

SEQ ID NO: 70523 - DNA, 22 bp, Artificial Sequence
  Synthetic oligonucleotide; TTT chr11 5151088 5151109 5151105 5151110 +
cagaacaacgagccttaggtgc

SEQ ID NO: 70524 - DNA, 22 bp, Artificial Sequence
  Synthetic oligonucleotide; TTC chr11 5151089 5151110 5151106 5151111 +
agaacaacgagccttaggtgca

SEQ ID NO: 70525 - DNA, 22 bp, Artificial Sequence
  Synthetic oligonucleotide; CTT chr11 5151104 5151125 5151121 5151126 +
aggtgcatttaaattcagtgac

SEQ ID NO: 70526 - DNA, 22 bp, Artificial Sequence
  Synthetic oligonucleotide; TTA chr11 5151105 5151126 5151122 5151127 +
ggtgcatttaaattcagtgaca

SEQ ID NO: 70527 - DNA, 22 bp, Artificial Sequence
  Synthetic oligonucleotide; TTT chr11 5151114 5151135 5151131 5151136 +
aaattcagtgacaaaggcataa

SEQ ID NO: 70528 - DNA, 22 bp, Artificial Sequence
  Synthetic oligonucleotide; TTA chr11 5151115 5151136 5151132 5151137 +
aattcagtgacaaaggcataat

SEQ ID NO: 70529 - DNA, 22 bp, Artificial Sequence
  Synthetic oligonucleotide; TTC chr11 5151120 5151141 5151137 5151142 +
agtgacaaaggcataatttata

SEQ ID NO: 70530 - DNA, 22 bp, Artificial Sequence
  Synthetic oligonucleotide; TTT chr11 5151139 5151160 5151156 5151161 +
ataaatcctcctggagaaatat

SEQ ID NO: 70531 - DNA, 22 bp, Artificial Sequence
  Synthetic oligonucleotide; TTA chr11 5151140 5151161 5151157 5151162 +
taaatcctcctggagaaatatt

SEQ ID NO: 70532 - DNA, 22 bp, Artificial Sequence
  Synthetic oligonucleotide; CTC chr11 5151149 5151170 5151166 5151171 +
ctggagaaatattcttagaaga

SEQ ID NO: 70533 - DNA, 22 bp, Artificial Sequence
  Synthetic oligonucleotide; CTG chr11 5151152 5151173 5151169 5151174 +
gagaaatattcttagaagaata

SEQ ID NO: 70534 - DNA, 22 bp, Artificial Sequence
  Synthetic oligonucleotide; TTC chr11 5151163 5151184 5151180 5151185 +
ttagaagaataactcaaccagg

SEQ ID NO: 70535 - DNA, 22 bp, Artificial Sequence
  Synthetic oligonucleotide; CTT chr11 5151165 5151186 5151182 5151187 +
agaagaataactcaaccagggg

SEQ ID NO: 70536 - DNA, 22 bp, Artificial Sequence
  Synthetic oligonucleotide; TTA chr11 5151166 5151187 5151183 5151188 +
gaagaataactcaaccaggggc

SEQ ID NO: 70537 - DNA, 22 bp, Artificial Sequence
  Synthetic oligonucleotide; CTC chr11 5151178 5151199 5151195 5151200 +
aaccaggggctaaagaataaaa

SEQ ID NO: 70538 - DNA, 22 bp, Artificial Sequence
  Synthetic oligonucleotide; CTA chr11 5151190 5151211 5151207 5151212 +
aagaataaaagagaaaaaataa

SEQ ID NO: 70539 - DNA, 22 bp, Artificial Sequence
  Synthetic oligonucleotide; TTC chr11 5151221 5151242 5151238 5151243 +
actacttcactcatttcacact

SEQ ID NO: 70540 - DNA, 22 bp, Artificial Sequence
  Synthetic oligonucleotide; CTA chr11 5151225 5151246 5151242 5151247 +
cttcactcatttcacacttctc

SEQ ID NO: 70541 - DNA, 22 bp, Artificial Sequence
  Synthetic oligonucleotide; CTT chr11 5151228 5151249 5151245 5151250 +
cactcatttcacacttctcact

SEQ ID NO: 70542 - DNA, 22 bp, Artificial Sequence
  Synthetic oligonucleotide; TTC chr11 5151229 5151250 5151246 5151251 +
actcatttcacacttctcactt

SEQ ID NO: 70543 - DNA, 22 bp, Artificial Sequence
  Synthetic oligonucleotide; CTC chr11 5151233 5151254 5151250 5151255 +
atttcacacttctcactttcat

SEQ ID NO: 70544 - DNA, 22 bp, Artificial Sequence
  Synthetic oligonucleotide; TTT chr11 5151237 5151258 5151254 5151259 +
cacacttctcactttcattagt

SEQ ID NO: 70545 - DNA, 22 bp, Artificial Sequence
  Synthetic oligonucleotide; TTC chr11 5151238 5151259 5151255 5151260 +
acacttctcactttcattagtc

SEQ ID NO: 70546 - DNA, 22 bp, Artificial Sequence
  Synthetic oligonucleotide; CTT chr11 5151244 5151265 5151261 5151266 +
ctcactttcattagtcacgtag

SEQ ID NO: 70547 - DNA, 22 bp, Artificial Sequence
  Synthetic oligonucleotide; TTC chr11 5151245 5151266 5151262 5151267 +
tcactttcattagtcacgtaga

SEQ ID NO: 70548 - DNA, 22 bp, Artificial Sequence
  Synthetic oligonucleotide; CTC chr11 5151247 5151268 5151264 5151269 +
actttcattagtcacgtagaat

SEQ ID NO: 70549 - DNA, 22 bp, Artificial Sequence
  Synthetic oligonucleotide; CTT chr11 5151251 5151272 5151268 5151273 +
tcattagtcacgtagaattcac

SEQ ID NO: 70550 - DNA, 22 bp, Artificial Sequence
  Synthetic oligonucleotide; TTT chr11 5151252 5151273 5151269 5151274 +
cattagtcacgtagaattcaca

SEQ ID NO: 70551 - DNA, 22 bp, Artificial Sequence
  Synthetic oligonucleotide; TTC chr11 5151253 5151274 5151270 5151275 +
attagtcacgtagaattcacaa

SEQ ID NO: 70552 - DNA, 22 bp, Artificial Sequence
  Synthetic oligonucleotide; TTA chr11 5151257 5151278 5151274 5151279 +
gtcacgtagaattcacaatccc

SEQ ID NO: 70553 - DNA, 22 bp, Artificial Sequence
  Synthetic oligonucleotide; TTC chr11 5151271 5151292 5151288 5151293 +
acaatcccactgattgatatga

SEQ ID NO: 70554 - DNA, 22 bp, Artificial Sequence
  Synthetic oligonucleotide; CTG chr11 5151283 5151304 5151300 5151305 +
attgatatgagccatgatgatc

SEQ ID NO: 70555 - DNA, 22 bp, Artificial Sequence
  Synthetic oligonucleotide; TTG chr11 5151287 5151308 5151304 5151309 +
atatgagccatgatgatctaaa

SEQ ID NO: 70556 - DNA, 22 bp, Artificial Sequence
  Synthetic oligonucleotide; CTA chr11 5151307 5151328 5151324 5151329 +
aaaccagctattgtgctggcag

SEQ ID NO: 70557 - DNA, 22 bp, Artificial Sequence
  Synthetic oligonucleotide; CTA chr11 5151317 5151338 5151334 5151339 +
ttgtgctggcagatttcacaaa

SEQ ID NO: 70558 - DNA, 22 bp, Artificial Sequence
  Synthetic oligonucleotide; TTG chr11 5151320 5151341 5151337 5151342 +
tgctggcagatttcacaaaccc

SEQ ID NO: 70559 - DNA, 22 bp, Artificial Sequence
  Synthetic oligonucleotide; CTG chr11 5151325 5151346 5151342 5151347 +
gcagatttcacaaacccagcat

SEQ ID NO: 70560 - DNA, 22 bp, Artificial Sequence
  Synthetic oligonucleotide; TTT chr11 5151333 5151354 5151350 5151355 +
cacaaacccagcatctcaaata

SEQ ID NO: 70561 - DNA, 22 bp, Artificial Sequence
  Synthetic oligonucleotide; TTC chr11 5151334 5151355 5151351 5151356 +
acaaacccagcatctcaaataa

SEQ ID NO: 70562 - DNA, 22 bp, Artificial Sequence
  Synthetic oligonucleotide; CTC chr11 5151350 5151371 5151367 5151372 +
aaataatatgttttttgttttg

SEQ ID NO: 70563 - DNA, 22 bp, Artificial Sequence
  Synthetic oligonucleotide; TTT chr11 5151363 5151384 5151380 5151385 +
tttgttttgttttgatatggtt

SEQ ID NO: 70564 - DNA, 22 bp, Artificial Sequence
  Synthetic oligonucleotide; TTT chr11 5151364 5151385 5151381 5151386 +
ttgttttgttttgatatggtta

SEQ ID NO: 70565 - DNA, 22 bp, Artificial Sequence
  Synthetic oligonucleotide; TTT chr11 5151365 5151386 5151382 5151387 +
tgttttgttttgatatggttac

SEQ ID NO: 70566 - DNA, 22 bp, Artificial Sequence
  Synthetic oligonucleotide; TTT chr11 5151366 5151387 5151383 5151388 +
gttttgttttgatatggttact

SEQ ID NO: 70567 - DNA, 22 bp, Artificial Sequence
  Synthetic oligonucleotide; TTG chr11 5151367 5151388 5151384 5151389 +
ttttgttttgatatggttacta

SEQ ID NO: 70568 - DNA, 22 bp, Artificial Sequence
  Synthetic oligonucleotide; TTT chr11 5151370 5151391 5151387 5151392 +
tgttttgatatggttactactg

SEQ ID NO: 70569 - DNA, 22 bp, Artificial Sequence
  Synthetic oligonucleotide; TTT chr11 5151371 5151392 5151388 5151393 +
gttttgatatggttactactgc

SEQ ID NO: 70570 - DNA, 22 bp, Artificial Sequence
  Synthetic oligonucleotide; TTG chr11 5151372 5151393 5151389 5151394 +
ttttgatatggttactactgca

SEQ ID NO: 70571 - DNA, 22 bp, Artificial Sequence
  Synthetic oligonucleotide; TTT chr11 5151375 5151396 5151392 5151397 +
tgatatggttactactgcaaaa

SEQ ID NO: 70572 - DNA, 22 bp, Artificial Sequence
  Synthetic oligonucleotide; TTT chr11 5151376 5151397 5151393 5151398 +
gatatggttactactgcaaaag

SEQ ID NO: 70573 - DNA, 22 bp, Artificial Sequence
  Synthetic oligonucleotide; TTG chr11 5151377 5151398 5151394 5151399 +
atatggttactactgcaaaaga

SEQ ID NO: 70574 - DNA, 22 bp, Artificial Sequence
  Synthetic oligonucleotide; TTA chr11 5151386 5151407 5151403 5151408 +
ctactgcaaaagaaaaaagcat

SEQ ID NO: 70575 - DNA, 22 bp, Artificial Sequence
  Synthetic oligonucleotide; CTA chr11 5151389 5151410 5151406 5151411 +
ctgcaaaagaaaaaagcatgta

SEQ ID NO: 70576 - DNA, 22 bp, Artificial Sequence
  Synthetic oligonucleotide; CTG chr11 5151392 5151413 5151409 5151414 +
caaaagaaaaaagcatgtaggc

SEQ ID NO: 70577 - DNA, 22 bp, Artificial Sequence
  Synthetic oligonucleotide; TTA chr11 5151418 5151439 5151435 5151440 +
attaaggtggattttatgaaca

SEQ ID NO: 70578 - DNA, 22 bp, Artificial Sequence
  Synthetic oligonucleotide; TTA chr11 5151422 5151443 5151439 5151444 +
aggtggattttatgaacagaac

SEQ ID NO: 70579 - DNA, 22 bp, Artificial Sequence
  Synthetic oligonucleotide; TTT chr11 5151432 5151453 5151449 5151454 +
tatgaacagaacatttttacca

SEQ ID NO: 70580 - DNA, 22 bp, Artificial Sequence
  Synthetic oligonucleotide; TTT chr11 5151433 5151454 5151450 5151455 +
atgaacagaacatttttaccac

SEQ ID NO: 70581 - DNA, 22 bp, Artificial Sequence
  Synthetic oligonucleotide; TTA chr11 5151434 5151455 5151451 5151456 +
tgaacagaacatttttaccaca

SEQ ID NO: 70582 - DNA, 22 bp, Artificial Sequence
  Synthetic oligonucleotide; TTT chr11 5151448 5151469 5151465 5151470 +
ttaccacatgaatgcgaatctg

SEQ ID NO: 70583 - DNA, 22 bp, Artificial Sequence
  Synthetic oligonucleotide; TTT chr11 5151449 5151470 5151466 5151471 +
taccacatgaatgcgaatctgt

SEQ ID NO: 70584 - DNA, 22 bp, Artificial Sequence
  Synthetic oligonucleotide; TTT chr11 5151450 5151471 5151467 5151472 +
accacatgaatgcgaatctgtg

SEQ ID NO: 70585 - DNA, 22 bp, Artificial Sequence
  Synthetic oligonucleotide; TTA chr11 5151451 5151472 5151468 5151473 +
ccacatgaatgcgaatctgtgt

SEQ ID NO: 70586 - DNA, 22 bp, Artificial Sequence
  Synthetic oligonucleotide; CTG chr11 5151470 5151491 5151487 5151492 +
tgtggtctttgcaccatagaca

SEQ ID NO: 70587 - DNA, 22 bp, Artificial Sequence
  Synthetic oligonucleotide; CTT chr11 5151479 5151500 5151496 5151501 +
tgcaccatagacaagtggattg

SEQ ID NO: 70588 - DNA, 22 bp, Artificial Sequence
  Synthetic oligonucleotide; TTT chr11 5151480 5151501 5151497 5151502 +
gcaccatagacaagtggattga

SEQ ID NO: 70589 - DNA, 22 bp, Artificial Sequence
  Synthetic oligonucleotide; TTG chr11 5151481 5151502 5151498 5151503 +
caccatagacaagtggattgag

SEQ ID NO: 70590 - DNA, 22 bp, Artificial Sequence
  Synthetic oligonucleotide; TTG chr11 5151501 5151522 5151518 5151523 +
agaaatggagggaccagcaagt

SEQ ID NO: 70591 - DNA, 22 bp, Artificial Sequence
  Synthetic oligonucleotide; CTA chr11 5151531 5151552 5151548 5151553 +
gaaaagagaatatggatataag

SEQ ID NO: 70592 - DNA, 22 bp, Artificial Sequence
  Synthetic oligonucleotide; CTA chr11 5151576 5151597 5151593 5151598 +
tgtgtgaagaaggagaagaagg

SEQ ID NO: 70593 - DNA, 22 bp, Artificial Sequence
  Synthetic oligonucleotide; CTG chr11 5151614 5151635 5151631 5151636 +
gaggaagacacagatgtgagca

SEQ ID NO: 70594 - DNA, 22 bp, Artificial Sequence
  Synthetic oligonucleotide; TTG chr11 5151648 5151669 5151665 5151670 +
aatgctttaaacctagcctcct

SEQ ID NO: 70595 - DNA, 22 bp, Artificial Sequence
  Synthetic oligonucleotide; CTT chr11 5151655 5151676 5151672 5151677 +
taaacctagcctccttctgggg

SEQ ID NO: 70596 - DNA, 22 bp, Artificial Sequence
  Synthetic oligonucleotide; TTT chr11 5151656 5151677 5151673 5151678 +
aaacctagcctccttctggggc

SEQ ID NO: 70597 - DNA, 22 bp, Artificial Sequence
  Synthetic oligonucleotide; TTA chr11 5151657 5151678 5151674 5151679 +
aacctagcctccttctggggca

SEQ ID NO: 70598 - DNA, 22 bp, Artificial Sequence
  Synthetic oligonucleotide; CTA chr11 5151663 5151684 5151680 5151685 +
gcctccttctggggcaaacgaa

SEQ ID NO: 70599 - DNA, 22 bp, Artificial Sequence
  Synthetic oligonucleotide; CTC chr11 5151668 5151689 5151685 5151690 +
cttctggggcaaacgaaaaact

SEQ ID NO: 70600 - DNA, 22 bp, Artificial Sequence
  Synthetic oligonucleotide; CTT chr11 5151671 5151692 5151688 5151693 +
ctggggcaaacgaaaaactgtg

SEQ ID NO: 70601 - DNA, 22 bp, Artificial Sequence
  Synthetic oligonucleotide; TTC chr11 5151672 5151693 5151689 5151694 +
tggggcaaacgaaaaactgtga

SEQ ID NO: 70602 - DNA, 22 bp, Artificial Sequence
  Synthetic oligonucleotide; CTG chr11 5151674 5151695 5151691 5151696 +
gggcaaacgaaaaactgtgata

SEQ ID NO: 70603 - DNA, 22 bp, Artificial Sequence
  Synthetic oligonucleotide; CTG chr11 5151691 5151712 5151708 5151713 +
tgataaatatctggatgtagga

SEQ ID NO: 70604 - DNA, 22 bp, Artificial Sequence
  Synthetic oligonucleotide; CTG chr11 5151704 5151725 5151721 5151726 +
gatgtaggacaatgtgatgaat

SEQ ID NO: 70605 - DNA, 22 bp, Artificial Sequence
  Synthetic oligonucleotide; CTG chr11 5151742 5151763 5151759 5151764 +
ctacagtgaaggccacaaacaa

SEQ ID NO: 70606 - DNA, 22 bp, Artificial Sequence
  Synthetic oligonucleotide; CTA chr11 5151745 5151766 5151762 5151767 +
cagtgaaggccacaaacaaacc

SEQ ID NO: 70607 - DNA, 22 bp, Artificial Sequence
  Synthetic oligonucleotide; TTT chr11 5151775 5151796 5151792 5151797 +
tgttgacttgaacatttgctgc

SEQ ID NO: 70608 - DNA, 22 bp, Artificial Sequence
  Synthetic oligonucleotide; TTT chr11 5151776 5151797 5151793 5151798 +
gttgacttgaacatttgctgct

SEQ ID NO: 70609 - DNA, 22 bp, Artificial Sequence
  Synthetic oligonucleotide; TTG chr11 5151777 5151798 5151794 5151799 +
ttgacttgaacatttgctgctg

SEQ ID NO: 70610 - DNA, 22 bp, Artificial Sequence
  Synthetic oligonucleotide; TTG chr11 5151780 5151801 5151797 5151802 +
acttgaacatttgctgctgcta

SEQ ID NO: 70611 - DNA, 22 bp, Artificial Sequence
  Synthetic oligonucleotide; CTT chr11 5151784 5151805 5151801 5151806 +
gaacatttgctgctgctagttt

SEQ ID NO: 70612 - DNA, 22 bp, Artificial Sequence
  Synthetic oligonucleotide; TTG chr11 5151785 5151806 5151802 5151807 +
aacatttgctgctgctagtttc

SEQ ID NO: 70613 - DNA, 22 bp, Artificial Sequence
  Synthetic oligonucleotide; TTT chr11 5151792 5151813 5151809 5151814 +
gctgctgctagtttcacaatgg

SEQ ID NO: 70614 - DNA, 22 bp, Artificial Sequence
  Synthetic oligonucleotide; TTG chr11 5151793 5151814 5151810 5151815 +
ctgctgctagtttcacaatggc

SEQ ID NO: 70615 - DNA, 22 bp, Artificial Sequence
  Synthetic oligonucleotide; CTG chr11 5151796 5151817 5151813 5151818 +
ctgctagtttcacaatggccat

SEQ ID NO: 70616 - DNA, 22 bp, Artificial Sequence
  Synthetic oligonucleotide; CTG chr11 5151799 5151820 5151816 5151821 +
ctagtttcacaatggccatatg

SEQ ID NO: 70617 - DNA, 22 bp, Artificial Sequence
  Synthetic oligonucleotide; CTA chr11 5151802 5151823 5151819 5151824 +
gtttcacaatggccatatgctc

SEQ ID NO: 70618 - DNA, 22 bp, Artificial Sequence
  Synthetic oligonucleotide; TTT chr11 5151806 5151827 5151823 5151828 +
cacaatggccatatgctcacag

SEQ ID NO: 70619 - DNA, 22 bp, Artificial Sequence
  Synthetic oligonucleotide; TTC chr11 5151807 5151828 5151824 5151829 +
acaatggccatatgctcacagt

SEQ ID NO: 70620 - DNA, 22 bp, Artificial Sequence
  Synthetic oligonucleotide; CTC chr11 5151824 5151845 5151841 5151846 +
acagtaggagtgggagatgact

SEQ ID NO: 70621 - DNA, 22 bp, Artificial Sequence
  Synthetic oligonucleotide; CTG chr11 5151847 5151868 5151864 5151869 +
ttgtgtgataaaattgaaaccg

SEQ ID NO: 70622 - DNA, 22 bp, Artificial Sequence
  Synthetic oligonucleotide; TTG chr11 5151850 5151871 5151867 5151872 +
tgtgataaaattgaaaccggca

SEQ ID NO: 70623 - DNA, 22 bp, Artificial Sequence
  Synthetic oligonucleotide; TTG chr11 5151863 5151884 5151880 5151885 +
aaaccggcactttatcagtact

SEQ ID NO: 70624 - DNA, 22 bp, Artificial Sequence
  Synthetic oligonucleotide; CTT chr11 5151875 5151896 5151892 5151897 +
tatcagtactaggcatggggct

SEQ ID NO: 70625 - DNA, 22 bp, Artificial Sequence
  Synthetic oligonucleotide; TTT chr11 5151876 5151897 5151893 5151898 +
atcagtactaggcatggggcta

SEQ ID NO: 70626 - DNA, 22 bp, Artificial Sequence
  Synthetic oligonucleotide; TTA chr11 5151877 5151898 5151894 5151899 +
tcagtactaggcatggggctac

SEQ ID NO: 70627 - DNA, 22 bp, Artificial Sequence
  Synthetic oligonucleotide; CTA chr11 5151886 5151907 5151903 5151908 +
ggcatggggctacaagaatagc

SEQ ID NO: 70628 - DNA, 22 bp, Artificial Sequence
  Synthetic oligonucleotide; CTA chr11 5151898 5151919 5151915 5151920 +
caagaatagcagccctgagtac

SEQ ID NO: 70629 - DNA, 22 bp, Artificial Sequence
  Synthetic oligonucleotide; CTG chr11 5151915 5151936 5151932 5151937 +
agtacgaccatagttcctatct

SEQ ID NO: 70630 - DNA, 22 bp, Artificial Sequence
  Synthetic oligonucleotide; TTC chr11 5151931 5151952 5151948 5151953 +
ctatctgaatgacaagctggtg

SEQ ID NO: 70631 - DNA, 22 bp, Artificial Sequence
  Synthetic oligonucleotide; CTA chr11 5151934 5151955 5151951 5151956 +
tctgaatgacaagctggtgggt

SEQ ID NO: 70632 - DNA, 22 bp, Artificial Sequence
  Synthetic oligonucleotide; CTG chr11 5151938 5151959 5151955 5151960 +
aatgacaagctggtgggtgaag

SEQ ID NO: 70633 - DNA, 22 bp, Artificial Sequence
  Synthetic oligonucleotide; CTG chr11 5151950 5151971 5151967 5151972 +
gtgggtgaagatgttggcatgt

SEQ ID NO: 70634 - DNA, 22 bp, Artificial Sequence
  Synthetic oligonucleotide; TTG chr11 5151966 5151987 5151983 5151988 +
gcatgtcttagtggataacaga

SEQ ID NO: 70635 - DNA, 22 bp, Artificial Sequence
  Synthetic oligonucleotide; CTT chr11 5151975 5151996 5151992 5151997 +
agtggataacagatggccacat

SEQ ID NO: 70636 - DNA, 22 bp, Artificial Sequence
  Synthetic oligonucleotide; TTA chr11 5151976 5151997 5151993 5151998 +
gtggataacagatggccacata

SEQ ID NO: 70637 - DNA, 22 bp, Artificial Sequence
  Synthetic oligonucleotide; CTG chr11 5152030 5152051 5152047 5152052 +
actctataccctgcaatgtgtg

SEQ ID NO: 70638 - DNA, 22 bp, Artificial Sequence
  Synthetic oligonucleotide; CTC chr11 5152034 5152055 5152051 5152056 +
tataccctgcaatgtgtggatg

SEQ ID NO: 70639 - DNA, 22 bp, Artificial Sequence
  Synthetic oligonucleotide; CTA chr11 5152036 5152057 5152053 5152058 +
taccctgcaatgtgtggatgaa

SEQ ID NO: 70640 - DNA, 22 bp, Artificial Sequence
  Synthetic oligonucleotide; CTG chr11 5152043 5152064 5152060 5152065 +
caatgtgtggatgaaccacatt

SEQ ID NO: 70641 - DNA, 22 bp, Artificial Sequence
  Synthetic oligonucleotide; TTT chr11 5152066 5152087 5152083 5152088 +
gaagcaagcaggaatcaaaata

SEQ ID NO: 70642 - DNA, 22 bp, Artificial Sequence
  Synthetic oligonucleotide; TTG chr11 5152067 5152088 5152084 5152089 +
aagcaagcaggaatcaaaatag

SEQ ID NO: 70643 - DNA, 22 bp, Artificial Sequence
  Synthetic oligonucleotide; TTT chr11 5152093 5152114 5152110 5152115 +
caggcacattaaaccagaatat

SEQ ID NO: 70644 - DNA, 22 bp, Artificial Sequence
  Synthetic oligonucleotide; TTC chr11 5152094 5152115 5152111 5152116 +
aggcacattaaaccagaatatt

SEQ ID NO: 70645 - DNA, 22 bp, Artificial Sequence
  Synthetic oligonucleotide; TTA chr11 5152104 5152125 5152121 5152126 +
aaccagaatattccaagcatct

SEQ ID NO: 70646 - DNA, 22 bp, Artificial Sequence
  Synthetic oligonucleotide; TTC chr11 5152117 5152138 5152134 5152139 +
caagcatctttggcataatgct

SEQ ID NO: 70647 - DNA, 22 bp, Artificial Sequence
  Synthetic oligonucleotide; CTT chr11 5152127 5152148 5152144 5152149 +
tggcataatgctgctagcaagt

SEQ ID NO: 70648 - DNA, 22 bp, Artificial Sequence
  Synthetic oligonucleotide; TTT chr11 5152128 5152149 5152145 5152150 +
ggcataatgctgctagcaagtg

SEQ ID NO: 70649 - DNA, 22 bp, Artificial Sequence
  Synthetic oligonucleotide; TTG chr11 5152129 5152150 5152146 5152151 +
gcataatgctgctagcaagtgc

SEQ ID NO: 70650 - DNA, 22 bp, Artificial Sequence
  Synthetic oligonucleotide; CTG chr11 5152140 5152161 5152157 5152162 +
ctagcaagtgcaatgtctgtgg

SEQ ID NO: 70651 - DNA, 22 bp, Artificial Sequence
  Synthetic oligonucleotide; CTA chr11 5152143 5152164 5152160 5152165 +
gcaagtgcaatgtctgtggctc

SEQ ID NO: 70652 - DNA, 22 bp, Artificial Sequence
  Synthetic oligonucleotide; CTG chr11 5152159 5152180 5152176 5152181 +
tggctcctagcatgcctaagaa

SEQ ID NO: 70653 - DNA, 22 bp, Artificial Sequence
  Synthetic oligonucleotide; CTC chr11 5152165 5152186 5152182 5152187 +
ctagcatgcctaagaaaatgta

SEQ ID NO: 70654 - DNA, 22 bp, Artificial Sequence
  Synthetic oligonucleotide; CTA chr11 5152168 5152189 5152185 5152190 +
gcatgcctaagaaaatgtacaa

SEQ ID NO: 70655 - DNA, 22 bp, Artificial Sequence
  Synthetic oligonucleotide; CTA chr11 5152177 5152198 5152194 5152199 +
agaaaatgtacaagggctcatg

SEQ ID NO: 70656 - DNA, 22 bp, Artificial Sequence
  Synthetic oligonucleotide; CTC chr11 5152196 5152217 5152213 5152218 +
atggagactgcgctcagatttg

SEQ ID NO: 70657 - DNA, 22 bp, Artificial Sequence
  Synthetic oligonucleotide; CTG chr11 5152206 5152227 5152223 5152228 +
cgctcagatttgatgatgctca

SEQ ID NO: 70658 - DNA, 22 bp, Artificial Sequence
  Synthetic oligonucleotide; CTC chr11 5152211 5152232 5152228 5152233 +
agatttgatgatgctcagaagc

SEQ ID NO: 70659 - DNA, 22 bp, Artificial Sequence
  Synthetic oligonucleotide; TTT chr11 5152217 5152238 5152234 5152239 +
gatgatgctcagaagcaaggaa

SEQ ID NO: 70660 - DNA, 22 bp, Artificial Sequence
  Synthetic oligonucleotide; TTG chr11 5152218 5152239 5152235 5152240 +
atgatgctcagaagcaaggaat

SEQ ID NO: 70661 - DNA, 22 bp, Artificial Sequence
  Synthetic oligonucleotide; CTC chr11 5152227 5152248 5152244 5152249 +
agaagcaaggaatttccaatca

SEQ ID NO: 70662 - DNA, 22 bp, Artificial Sequence
  Synthetic oligonucleotide; TTT chr11 5152242 5152263 5152259 5152264 +
ccaatcatagcaatgagataaa

SEQ ID NO: 70663 - DNA, 22 bp, Artificial Sequence
  Synthetic oligonucleotide; TTC chr11 5152243 5152264 5152260 5152265 +
caatcatagcaatgagataaat

SEQ ID NO: 70664 - DNA, 22 bp, Artificial Sequence
  Synthetic oligonucleotide; CTG chr11 5152295 5152316 5152312 5152317 +
cacagattctaggcctgggatc

SEQ ID NO: 70665 - DNA, 22 bp, Artificial Sequence
  Synthetic oligonucleotide; TTC chr11 5152304 5152325 5152321 5152326 +
taggcctgggatccctactagt

SEQ ID NO: 70666 - DNA, 22 bp, Artificial Sequence
  Synthetic oligonucleotide; CTA chr11 5152306 5152327 5152323 5152328 +
ggcctgggatccctactagtgt

SEQ ID NO: 70667 - DNA, 22 bp, Artificial Sequence
  Synthetic oligonucleotide; CTG chr11 5152312 5152333 5152329 5152334 +
ggatccctactagtgtcaacac

SEQ ID NO: 70668 - DNA, 22 bp, Artificial Sequence
  Synthetic oligonucleotide; CTA chr11 5152321 5152342 5152338 5152343 +
ctagtgtcaacacagagggcat

SEQ ID NO: 70669 - DNA, 22 bp, Artificial Sequence
  Synthetic oligonucleotide; CTA chr11 5152324 5152345 5152341 5152346 +
gtgtcaacacagagggcatgta

SEQ ID NO: 70670 - DNA, 22 bp, Artificial Sequence
  Synthetic oligonucleotide; CTG chr11 5152351 5152372 5152368 5152373 +
tgatgttggaaatggacatagt

SEQ ID NO: 70671 - DNA, 22 bp, Artificial Sequence
  Synthetic oligonucleotide; TTG chr11 5152359 5152380 5152376 5152381 +
gaaatggacatagtgtcgttgg

SEQ ID NO: 70672 - DNA, 22 bp, Artificial Sequence
  Synthetic oligonucleotide; TTG chr11 5152380 5152401 5152397 5152402 +
ggtctcctgatgcaaacaaaag

SEQ ID NO: 70673 - DNA, 22 bp, Artificial Sequence
  Synthetic oligonucleotide; CTC chr11 5152386 5152407 5152403 5152408 +
ctgatgcaaacaaaagaagttt

SEQ ID NO: 70674 - DNA, 22 bp, Artificial Sequence
  Synthetic oligonucleotide; CTG chr11 5152389 5152410 5152406 5152411 +
atgcaaacaaaagaagtttctc

SEQ ID NO: 70675 - DNA, 22 bp, Artificial Sequence
  Synthetic oligonucleotide; TTT chr11 5152408 5152429 5152425 5152430 +
ctcagtcagtgttactgttcct

SEQ ID NO: 70676 - DNA, 22 bp, Artificial Sequence
  Synthetic oligonucleotide; TTC chr11 5152409 5152430 5152426 5152431 +
tcagtcagtgttactgttcctc

SEQ ID NO: 70677 - DNA, 22 bp, Artificial Sequence
  Synthetic oligonucleotide; CTC chr11 5152411 5152432 5152428 5152433 +
agtcagtgttactgttcctctt

SEQ ID NO: 70678 - DNA, 22 bp, Artificial Sequence
  Synthetic oligonucleotide; TTA chr11 5152422 5152443 5152439 5152444 +
ctgttcctcttctgctttctga

SEQ ID NO: 70679 - DNA, 22 bp, Artificial Sequence
  Synthetic oligonucleotide; CTG chr11 5152425 5152446 5152442 5152447 +
ttcctcttctgctttctgattt

SEQ ID NO: 70680 - DNA, 22 bp, Artificial Sequence
  Synthetic oligonucleotide; TTC chr11 5152428 5152449 5152445 5152450 +
ctcttctgctttctgattttct

SEQ ID NO: 70681 - DNA, 22 bp, Artificial Sequence
  Synthetic oligonucleotide; CTC chr11 5152431 5152452 5152448 5152453 +
ttctgctttctgattttctcca

SEQ ID NO: 70682 - DNA, 22 bp, Artificial Sequence
  Synthetic oligonucleotide; CTT chr11 5152433 5152454 5152450 5152455 +
ctgctttctgattttctccaaa

SEQ ID NO: 70683 - DNA, 22 bp, Artificial Sequence
  Synthetic oligonucleotide; TTC chr11 5152434 5152455 5152451 5152456 +
tgctttctgattttctccaaac

SEQ ID NO: 70684 - DNA, 22 bp, Artificial Sequence
  Synthetic oligonucleotide; CTG chr11 5152436 5152457 5152453 5152458 +
ctttctgattttctccaaactc

SEQ ID NO: 70685 - DNA, 22 bp, Artificial Sequence
  Synthetic oligonucleotide; CTT chr11 5152439 5152460 5152456 5152461 +
tctgattttctccaaactcatt

SEQ ID NO: 70686 - DNA, 22 bp, Artificial Sequence
  Synthetic oligonucleotide; TTT chr11 5152440 5152461 5152457 5152462 +
ctgattttctccaaactcatta

SEQ ID NO: 70687 - DNA, 22 bp, Artificial Sequence
  Synthetic oligonucleotide; TTC chr11 5152441 5152462 5152458 5152463 +
tgattttctccaaactcattat

SEQ ID NO: 70688 - DNA, 22 bp, Artificial Sequence
  Synthetic oligonucleotide; CTG chr11 5152443 5152464 5152460 5152465 +
attttctccaaactcattatat

SEQ ID NO: 70689 - DNA, 22 bp, Artificial Sequence
  Synthetic oligonucleotide; TTT chr11 5152447 5152468 5152464 5152469 +
tctccaaactcattatattgag

SEQ ID NO: 70690 - DNA, 22 bp, Artificial Sequence
  Synthetic oligonucleotide; TTT chr11 5152448 5152469 5152465 5152470 +
ctccaaactcattatattgagt

SEQ ID NO: 70691 - DNA, 22 bp, Artificial Sequence
  Synthetic oligonucleotide; TTC chr11 5152449 5152470 5152466 5152471 +
tccaaactcattatattgagtc

SEQ ID NO: 70692 - DNA, 22 bp, Artificial Sequence
  Synthetic oligonucleotide; CTC chr11 5152451 5152472 5152468 5152473 +
caaactcattatattgagtctg

SEQ ID NO: 70693 - DNA, 22 bp, Artificial Sequence
  Synthetic oligonucleotide; CTC chr11 5152458 5152479 5152475 5152480 +
attatattgagtctgtctgatt

SEQ ID NO: 70694 - DNA, 22 bp, Artificial Sequence
  Synthetic oligonucleotide; TTA chr11 5152462 5152483 5152479 5152484 +
tattgagtctgtctgatttggg

SEQ ID NO: 70695 - DNA, 22 bp, Artificial Sequence
  Synthetic oligonucleotide; TTG chr11 5152467 5152488 5152484 5152489 +
agtctgtctgatttgggtataa

SEQ ID NO: 70696 - DNA, 22 bp, Artificial Sequence
  Synthetic oligonucleotide; CTG chr11 5152473 5152494 5152490 5152495 +
tctgatttgggtataactctaa

SEQ ID NO: 70697 - DNA, 22 bp, Artificial Sequence
  Synthetic oligonucleotide; CTG chr11 5152477 5152498 5152494 5152499 +
atttgggtataactctaaaatc

SEQ ID NO: 70698 - DNA, 22 bp, Artificial Sequence
  Synthetic oligonucleotide; TTT chr11 5152481 5152502 5152498 5152503 +
gggtataactctaaaatcatcc

SEQ ID NO: 70699 - DNA, 22 bp, Artificial Sequence
  Synthetic oligonucleotide; TTG chr11 5152482 5152503 5152499 5152504 +
ggtataactctaaaatcatcca

SEQ ID NO: 70700 - DNA, 22 bp, Artificial Sequence
  Synthetic oligonucleotide; CTC chr11 5152492 5152513 5152509 5152514 +
taaaatcatccatcttattcac

SEQ ID NO: 70701 - DNA, 22 bp, Artificial Sequence
  Synthetic oligonucleotide; CTA chr11 5152494 5152515 5152511 5152516 +
aaatcatccatcttattcacag

SEQ ID NO: 70702 - DNA, 22 bp, Artificial Sequence
  Synthetic oligonucleotide; CTT chr11 5152508 5152529 5152525 5152530 +
attcacagttttgaaaggaaaa

SEQ ID NO: 70703 - DNA, 22 bp, Artificial Sequence
  Synthetic oligonucleotide; TTA chr11 5152509 5152530 5152526 5152531 +
ttcacagttttgaaaggaaaag

SEQ ID NO: 70704 - DNA, 22 bp, Artificial Sequence
  Synthetic oligonucleotide; TTC chr11 5152512 5152533 5152529 5152534 +
acagttttgaaaggaaaagatg

SEQ ID NO: 70705 - DNA, 22 bp, Artificial Sequence
  Synthetic oligonucleotide; TTT chr11 5152519 5152540 5152536 5152541 +
tgaaaggaaaagatggattcat

SEQ ID NO: 70706 - DNA, 22 bp, Artificial Sequence
  Synthetic oligonucleotide; TTT chr11 5152520 5152541 5152537 5152542 +
gaaaggaaaagatggattcatg

SEQ ID NO: 70707 - DNA, 22 bp, Artificial Sequence
  Synthetic oligonucleotide; TTG chr11 5152521 5152542 5152538 5152543 +
aaaggaaaagatggattcatgg

SEQ ID NO: 70708 - DNA, 22 bp, Artificial Sequence
  Synthetic oligonucleotide; TTC chr11 5152539 5152560 5152556 5152561 +
atggagatacatcactgttttc

SEQ ID NO: 70709 - DNA, 22 bp, Artificial Sequence
  Synthetic oligonucleotide; CTG chr11 5152556 5152577 5152573 5152578 +
ttttcaggtggggcattcacag

SEQ ID NO: 70710 - DNA, 22 bp, Artificial Sequence
  Synthetic oligonucleotide; TTT chr11 5152559 5152580 5152576 5152581 +
tcaggtggggcattcacaggca

SEQ ID NO: 70711 - DNA, 22 bp, Artificial Sequence
  Synthetic oligonucleotide; TTT chr11 5152560 5152581 5152577 5152582 +
caggtggggcattcacaggcac

SEQ ID NO: 70712 - DNA, 22 bp, Artificial Sequence
  Synthetic oligonucleotide; TTC chr11 5152561 5152582 5152578 5152583 +
aggtggggcattcacaggcact

SEQ ID NO: 70713 - DNA, 22 bp, Artificial Sequence
  Synthetic oligonucleotide; TTC chr11 5152574 5152595 5152591 5152596 +
acaggcactgtgccataatagg

SEQ ID NO: 70714 - DNA, 22 bp, Artificial Sequence
  Synthetic oligonucleotide; CTG chr11 5152584 5152605 5152601 5152606 +
tgccataataggatgttatgtg

SEQ ID NO: 70715 - DNA, 22 bp, Artificial Sequence
  Synthetic oligonucleotide; TTA chr11 5152602 5152623 5152619 5152624 +
tgtgcatggcaatccaaataca

SEQ ID NO: 70716 - DNA, 22 bp, Artificial Sequence
  Synthetic oligonucleotide; TTA chr11 5152627 5152648 5152644 5152649 +
gaaccagcaaaatcacctggac

SEQ ID NO: 70717 - DNA, 22 bp, Artificial Sequence
  Synthetic oligonucleotide; CTG chr11 5152646 5152667 5152663 5152668 +
gacaggggattggactactggc

SEQ ID NO: 70718 - DNA, 22 bp, Artificial Sequence
  Synthetic oligonucleotide; TTG chr11 5152658 5152679 5152675 5152680 +
gactactggccagtctgttatt

SEQ ID NO: 70719 - DNA, 22 bp, Artificial Sequence
  Synthetic oligonucleotide; CTA chr11 5152663 5152684 5152680 5152685 +
ctggccagtctgttatttcttt

SEQ ID NO: 70720 - DNA, 22 bp, Artificial Sequence
  Synthetic oligonucleotide; CTG chr11 5152666 5152687 5152683 5152688 +
gccagtctgttatttctttcca

SEQ ID NO: 70721 - DNA, 22 bp, Artificial Sequence
  Synthetic oligonucleotide; CTG chr11 5152675 5152696 5152692 5152697 +
ttatttctttccagacctgtgg

SEQ ID NO: 70722 - DNA, 22 bp, Artificial Sequence
  Synthetic oligonucleotide; TTA chr11 5152678 5152699 5152695 5152700 +
tttctttccagacctgtggaca

SEQ ID NO: 70723 - DNA, 22 bp, Artificial Sequence
  Synthetic oligonucleotide; TTT chr11 5152681 5152702 5152698 5152703 +
ctttccagacctgtggacaaaa

SEQ ID NO: 70724 - DNA, 22 bp, Artificial Sequence
  Synthetic oligonucleotide; TTC chr11 5152682 5152703 5152699 5152704 +
tttccagacctgtggacaaaaa

SEQ ID NO: 70725 - DNA, 22 bp, Artificial Sequence
  Synthetic oligonucleotide; CTT chr11 5152684 5152705 5152701 5152706 +
tccagacctgtggacaaaaaaa

SEQ ID NO: 70726 - DNA, 22 bp, Artificial Sequence
  Synthetic oligonucleotide; TTT chr11 5152685 5152706 5152702 5152707 +
ccagacctgtggacaaaaaaaa

SEQ ID NO: 70727 - DNA, 22 bp, Artificial Sequence
  Synthetic oligonucleotide; TTC chr11 5152686 5152707 5152703 5152708 +
cagacctgtggacaaaaaaaaa

SEQ ID NO: 70728 - DNA, 22 bp, Artificial Sequence
  Synthetic oligonucleotide; CTG chr11 5152694 5152715 5152711 5152716 +
tggacaaaaaaaaaaagaagtt

SEQ ID NO: 70729 - DNA, 22 bp, Artificial Sequence
  Synthetic oligonucleotide; TTT chr11 5152717 5152738 5152734 5152739 +
atttttattggacattgcattt

SEQ ID NO: 70730 - DNA, 22 bp, Artificial Sequence
  Synthetic oligonucleotide; TTA chr11 5152718 5152739 5152735 5152740 +
tttttattggacattgcatttt

SEQ ID NO: 70731 - DNA, 22 bp, Artificial Sequence
  Synthetic oligonucleotide; TTT chr11 5152721 5152742 5152738 5152743 +
ttattggacattgcattttaat

SEQ ID NO: 70732 - DNA, 22 bp, Artificial Sequence
  Synthetic oligonucleotide; TTT chr11 5152722 5152743 5152739 5152744 +
tattggacattgcattttaatt

SEQ ID NO: 70733 - DNA, 22 bp, Artificial Sequence
  Synthetic oligonucleotide; TTT chr11 5152723 5152744 5152740 5152745 +
attggacattgcattttaattt

SEQ ID NO: 70734 - DNA, 22 bp, Artificial Sequence
  Synthetic oligonucleotide; TTA chr11 5152724 5152745 5152741 5152746 +
ttggacattgcattttaatttg

SEQ ID NO: 70735 - DNA, 22 bp, Artificial Sequence
  Synthetic oligonucleotide; TTG chr11 5152727 5152748 5152744 5152749 +
gacattgcattttaatttggtt

SEQ ID NO: 70736 - DNA, 22 bp, Artificial Sequence
  Synthetic oligonucleotide; TTG chr11 5152734 5152755 5152751 5152756 +
cattttaatttggttaataaac

SEQ ID NO: 70737 - DNA, 22 bp, Artificial Sequence
  Synthetic oligonucleotide; TTT chr11 5152739 5152760 5152756 5152761 +
taatttggttaataaacctctc

SEQ ID NO: 70738 - DNA, 22 bp, Artificial Sequence
  Synthetic oligonucleotide; TTT chr11 5152740 5152761 5152757 5152762 +
aatttggttaataaacctctcc

SEQ ID NO: 70739 - DNA, 22 bp, Artificial Sequence
  Synthetic oligonucleotide; TTA chr11 5152741 5152762 5152758 5152763 +
atttggttaataaacctctcca

SEQ ID NO: 70740 - DNA, 22 bp, Artificial Sequence
  Synthetic oligonucleotide; TTT chr11 5152745 5152766 5152762 5152767 +
ggttaataaacctctccatatt

SEQ ID NO: 70741 - DNA, 22 bp, Artificial Sequence
  Synthetic oligonucleotide; TTG chr11 5152746 5152767 5152763 5152768 +
gttaataaacctctccatattt

SEQ ID NO: 70742 - DNA, 22 bp, Artificial Sequence
  Synthetic oligonucleotide; TTA chr11 5152750 5152771 5152767 5152772 +
ataaacctctccatatttcaca

SEQ ID NO: 70743 - DNA, 22 bp, Artificial Sequence
  Synthetic oligonucleotide; CTC chr11 5152759 5152780 5152776 5152781 +
tccatatttcacatttcagcta

SEQ ID NO: 70744 - DNA, 22 bp, Artificial Sequence
  Synthetic oligonucleotide; CTC chr11 5152761 5152782 5152778 5152783 +
catatttcacatttcagctatt

SEQ ID NO: 70745 - DNA, 22 bp, Artificial Sequence
  Synthetic oligonucleotide; TTT chr11 5152768 5152789 5152785 5152790 +
cacatttcagctattcctctag

SEQ ID NO: 70746 - DNA, 22 bp, Artificial Sequence
  Synthetic oligonucleotide; TTC chr11 5152769 5152790 5152786 5152791 +
acatttcagctattcctctagt

SEQ ID NO: 70747 - DNA, 22 bp, Artificial Sequence
  Synthetic oligonucleotide; TTT chr11 5152775 5152796 5152792 5152797 +
cagctattcctctagtatttaa

SEQ ID NO: 70748 - DNA, 22 bp, Artificial Sequence
  Synthetic oligonucleotide; TTC chr11 5152776 5152797 5152793 5152798 +
agctattcctctagtatttaac

SEQ ID NO: 70749 - DNA, 22 bp, Artificial Sequence
  Synthetic oligonucleotide; CTA chr11 5152781 5152802 5152798 5152803 +
ttcctctagtatttaactattt

SEQ ID NO: 70750 - DNA, 22 bp, Artificial Sequence
  Synthetic oligonucleotide; TTC chr11 5152784 5152805 5152801 5152806 +
ctctagtatttaactatttcca

SEQ ID NO: 70751 - DNA, 22 bp, Artificial Sequence
  Synthetic oligonucleotide; CTC chr11 5152787 5152808 5152804 5152809 +
tagtatttaactatttccaatt

SEQ ID NO: 70752 - DNA, 22 bp, Artificial Sequence
  Synthetic oligonucleotide; CTA chr11 5152789 5152810 5152806 5152811 +
gtatttaactatttccaatttt

SEQ ID NO: 70753 - DNA, 22 bp, Artificial Sequence
  Synthetic oligonucleotide; TTT chr11 5152795 5152816 5152812 5152817 +
aactatttccaattttctttaa

SEQ ID NO: 70754 - DNA, 22 bp, Artificial Sequence
  Synthetic oligonucleotide; TTA chr11 5152796 5152817 5152813 5152818 +
actatttccaattttctttaag

SEQ ID NO: 70755 - DNA, 22 bp, Artificial Sequence
  Synthetic oligonucleotide; CTA chr11 5152800 5152821 5152817 5152822 +
tttccaattttctttaagaaca

SEQ ID NO: 70756 - DNA, 22 bp, Artificial Sequence
  Synthetic oligonucleotide; TTT chr11 5152803 5152824 5152820 5152825 +
ccaattttctttaagaacattt

SEQ ID NO: 70757 - DNA, 22 bp, Artificial Sequence
  Synthetic oligonucleotide; TTC chr11 5152804 5152825 5152821 5152826 +
caattttctttaagaacatttt

SEQ ID NO: 70758 - DNA, 22 bp, Artificial Sequence
  Synthetic oligonucleotide; TTT chr11 5152810 5152831 5152827 5152832 +
tctttaagaacattttagacaa

SEQ ID NO: 70759 - DNA, 22 bp, Artificial Sequence
  Synthetic oligonucleotide; TTT chr11 5152811 5152832 5152828 5152833 +
ctttaagaacattttagacaag

SEQ ID NO: 70760 - DNA, 22 bp, Artificial Sequence
  Synthetic oligonucleotide; TTC chr11 5152812 5152833 5152829 5152834 +
tttaagaacattttagacaagc

SEQ ID NO: 70761 - DNA, 22 bp, Artificial Sequence
  Synthetic oligonucleotide; CTT chr11 5152814 5152835 5152831 5152836 +
taagaacattttagacaagcaa

SEQ ID NO: 70762 - DNA, 22 bp, Artificial Sequence
  Synthetic oligonucleotide; TTT chr11 5152815 5152836 5152832 5152837 +
aagaacattttagacaagcaaa

SEQ ID NO: 70763 - DNA, 22 bp, Artificial Sequence
  Synthetic oligonucleotide; TTA chr11 5152816 5152837 5152833 5152838 +
agaacattttagacaagcaaat

SEQ ID NO: 70764 - DNA, 22 bp, Artificial Sequence
  Synthetic oligonucleotide; TTT chr11 5152825 5152846 5152842 5152847 +
tagacaagcaaattaacagact

SEQ ID NO: 70765 - DNA, 22 bp, Artificial Sequence
  Synthetic oligonucleotide; TTT chr11 5152826 5152847 5152843 5152848 +
agacaagcaaattaacagactc

SEQ ID NO: 70766 - DNA, 22 bp, Artificial Sequence
  Synthetic oligonucleotide; TTA chr11 5152827 5152848 5152844 5152849 +
gacaagcaaattaacagactct

SEQ ID NO: 70767 - DNA, 22 bp, Artificial Sequence
  Synthetic oligonucleotide; TTA chr11 5152840 5152861 5152857 5152862 +
acagactctgaccagtacattg

SEQ ID NO: 70768 - DNA, 22 bp, Artificial Sequence
  Synthetic oligonucleotide; CTC chr11 5152848 5152869 5152865 5152870 +
tgaccagtacattggtgtaaaa

SEQ ID NO: 70769 - DNA, 22 bp, Artificial Sequence
  Synthetic oligonucleotide; CTG chr11 5152850 5152871 5152867 5152872 +
accagtacattggtgtaaaaga

SEQ ID NO: 70770 - DNA, 22 bp, Artificial Sequence
  Synthetic oligonucleotide; TTG chr11 5152862 5152883 5152879 5152884 +
gtgtaaaagattcccaatgaaa

SEQ ID NO: 70771 - DNA, 22 bp, Artificial Sequence
  Synthetic oligonucleotide; TTC chr11 5152875 5152896 5152892 5152897 +
ccaatgaaagagaatagaggta

SEQ ID NO: 70772 - DNA, 22 bp, Artificial Sequence
  Synthetic oligonucleotide; TTG chr11 5152907 5152928 5152924 5152929 +
acacccaagaacataatatatt

SEQ ID NO: 70773 - DNA, 22 bp, Artificial Sequence
  Synthetic oligonucleotide; TTT chr11 5152930 5152951 5152947 5152952 +
ctttttatattcagaataatgt

SEQ ID NO: 70774 - DNA, 22 bp, Artificial Sequence
  Synthetic oligonucleotide; TTC chr11 5152931 5152952 5152948 5152953 +
tttttatattcagaataatgta

SEQ ID NO: 70775 - DNA, 22 bp, Artificial Sequence
  Synthetic oligonucleotide; CTT chr11 5152933 5152954 5152950 5152955 +
tttatattcagaataatgtaaa

SEQ ID NO: 70776 - DNA, 22 bp, Artificial Sequence
  Synthetic oligonucleotide; TTT chr11 5152934 5152955 5152951 5152956 +
ttatattcagaataatgtaaag

SEQ ID NO: 70777 - DNA, 22 bp, Artificial Sequence
  Synthetic oligonucleotide; TTT chr11 5152935 5152956 5152952 5152957 +
tatattcagaataatgtaaaga

SEQ ID NO: 70778 - DNA, 22 bp, Artificial Sequence
  Synthetic oligonucleotide; TTT chr11 5152936 5152957 5152953 5152958 +
atattcagaataatgtaaagag

SEQ ID NO: 70779 - DNA, 22 bp, Artificial Sequence
  Synthetic oligonucleotide; TTA chr11 5152937 5152958 5152954 5152959 +
tattcagaataatgtaaagaga

SEQ ID NO: 70780 - DNA, 22 bp, Artificial Sequence
  Synthetic oligonucleotide; TTC chr11 5152942 5152963 5152959 5152964 +
agaataatgtaaagagaatgct

SEQ ID NO: 70781 - DNA, 22 bp, Artificial Sequence
  Synthetic oligonucleotide; CTT chr11 5152965 5152986 5152982 5152987 +
tagaaataattgaaatctttat

SEQ ID NO: 70782 - DNA, 22 bp, Artificial Sequence
  Synthetic oligonucleotide; TTT chr11 5152966 5152987 5152983 5152988 +
agaaataattgaaatctttata

SEQ ID NO: 70783 - DNA, 22 bp, Artificial Sequence
  Synthetic oligonucleotide; TTA chr11 5152967 5152988 5152984 5152989 +
gaaataattgaaatctttatac

SEQ ID NO: 70784 - DNA, 22 bp, Artificial Sequence
  Synthetic oligonucleotide; TTG chr11 5152977 5152998 5152994 5152999 +
aaatctttatacttttgacaaa

SEQ ID NO: 70785 - DNA, 22 bp, Artificial Sequence
  Synthetic oligonucleotide; CTT chr11 5152984 5153005 5153001 5153006 +
tatacttttgacaaatctgagc

SEQ ID NO: 70786 - DNA, 22 bp, Artificial Sequence
  Synthetic oligonucleotide; TTT chr11 5152985 5153006 5153002 5153007 +
atacttttgacaaatctgagcc

SEQ ID NO: 70787 - DNA, 22 bp, Artificial Sequence
  Synthetic oligonucleotide; TTA chr11 5152986 5153007 5153003 5153008 +
tacttttgacaaatctgagcca

SEQ ID NO: 70788 - DNA, 22 bp, Artificial Sequence
  Synthetic oligonucleotide; CTT chr11 5152991 5153012 5153008 5153013 +
ttgacaaatctgagccaaagct

SEQ ID NO: 70789 - DNA, 22 bp, Artificial Sequence
  Synthetic oligonucleotide; TTT chr11 5152992 5153013 5153009 5153014 +
tgacaaatctgagccaaagctc

SEQ ID NO: 70790 - DNA, 22 bp, Artificial Sequence
  Synthetic oligonucleotide; TTT chr11 5152993 5153014 5153010 5153015 +
gacaaatctgagccaaagctcc

SEQ ID NO: 70791 - DNA, 22 bp, Artificial Sequence
  Synthetic oligonucleotide; TTG chr11 5152994 5153015 5153011 5153016 +
acaaatctgagccaaagctcct

SEQ ID NO: 70792 - DNA, 22 bp, Artificial Sequence
  Synthetic oligonucleotide; CTG chr11 5153003 5153024 5153020 5153025 +
agccaaagctcctggttgcttt

SEQ ID NO: 70793 - DNA, 22 bp, Artificial Sequence
  Synthetic oligonucleotide; CTC chr11 5153014 5153035 5153031 5153036 +
ctggttgctttttatatttctt

SEQ ID NO: 70794 - DNA, 22 bp, Artificial Sequence
  Synthetic oligonucleotide; CTG chr11 5153017 5153038 5153034 5153039 +
gttgctttttatatttctttaa

SEQ ID NO: 70795 - DNA, 22 bp, Artificial Sequence
  Synthetic oligonucleotide; TTG chr11 5153021 5153042 5153038 5153043 +
ctttttatatttctttaaagtt

SEQ ID NO: 70796 - DNA, 22 bp, Artificial Sequence
  Synthetic oligonucleotide; CTT chr11 5153024 5153045 5153041 5153046 +
tttatatttctttaaagttaaa

SEQ ID NO: 70797 - DNA, 22 bp, Artificial Sequence
  Synthetic oligonucleotide; TTT chr11 5153025 5153046 5153042 5153047 +
ttatatttctttaaagttaaag

SEQ ID NO: 70798 - DNA, 22 bp, Artificial Sequence
  Synthetic oligonucleotide; TTT chr11 5153026 5153047 5153043 5153048 +
tatatttctttaaagttaaagg

SEQ ID NO: 70799 - DNA, 22 bp, Artificial Sequence
  Synthetic oligonucleotide; TTT chr11 5153027 5153048 5153044 5153049 +
atatttctttaaagttaaaggg

SEQ ID NO: 70800 - DNA, 22 bp, Artificial Sequence
  Synthetic oligonucleotide; TTA chr11 5153028 5153049 5153045 5153050 +
tatttctttaaagttaaaggga

SEQ ID NO: 70801 - DNA, 22 bp, Artificial Sequence
  Synthetic oligonucleotide; TTT chr11 5153033 5153054 5153050 5153055 +
ctttaaagttaaagggaattat

SEQ ID NO: 70802 - DNA, 22 bp, Artificial Sequence
  Synthetic oligonucleotide; TTC chr11 5153034 5153055 5153051 5153056 +
tttaaagttaaagggaattata

SEQ ID NO: 70803 - DNA, 22 bp, Artificial Sequence
  Synthetic oligonucleotide; CTT chr11 5153036 5153057 5153053 5153058 +
taaagttaaagggaattatatt

SEQ ID NO: 70804 - DNA, 22 bp, Artificial Sequence
  Synthetic oligonucleotide; TTT chr11 5153037 5153058 5153054 5153059 +
aaagttaaagggaattatattt

SEQ ID NO: 70805 - DNA, 22 bp, Artificial Sequence
  Synthetic oligonucleotide; TTA chr11 5153038 5153059 5153055 5153060 +
aagttaaagggaattatatttt

SEQ ID NO: 70806 - DNA, 22 bp, Artificial Sequence
  Synthetic oligonucleotide; TTA chr11 5153044 5153065 5153061 5153066 +
aagggaattatattttttccta

SEQ ID NO: 70807 - DNA, 22 bp, Artificial Sequence
  Synthetic oligonucleotide; TTA chr11 5153054 5153075 5153071 5153076 +
tattttttcctatatattttaa

SEQ ID NO: 70808 - DNA, 22 bp, Artificial Sequence
  Synthetic oligonucleotide; TTT chr11 5153059 5153080 5153076 5153081 +
tttcctatatattttaaacagc

SEQ ID NO: 70809 - DNA, 22 bp, Artificial Sequence
  Synthetic oligonucleotide; TTT chr11 5153060 5153081 5153077 5153082 +
ttcctatatattttaaacagct

SEQ ID NO: 70810 - DNA, 22 bp, Artificial Sequence
  Synthetic oligonucleotide; TTT chr11 5153061 5153082 5153078 5153083 +
tcctatatattttaaacagctg

SEQ ID NO: 70811 - DNA, 22 bp, Artificial Sequence
  Synthetic oligonucleotide; TTT chr11 5153062 5153083 5153079 5153084 +
cctatatattttaaacagctga

SEQ ID NO: 70812 - DNA, 22 bp, Artificial Sequence
  Synthetic oligonucleotide; TTC chr11 5153063 5153084 5153080 5153085 +
ctatatattttaaacagctgaa

SEQ ID NO: 70813 - DNA, 22 bp, Artificial Sequence
  Synthetic oligonucleotide; CTA chr11 5153066 5153087 5153083 5153088 +
tatattttaaacagctgaaact

SEQ ID NO: 70814 - DNA, 22 bp, Artificial Sequence
  Synthetic oligonucleotide; TTT chr11 5153073 5153094 5153090 5153095 +
taaacagctgaaactcttgaaa

SEQ ID NO: 70815 - DNA, 22 bp, Artificial Sequence
  Synthetic oligonucleotide; TTT chr11 5153074 5153095 5153091 5153096 +
aaacagctgaaactcttgaaat

SEQ ID NO: 70816 - DNA, 22 bp, Artificial Sequence
  Synthetic oligonucleotide; TTA chr11 5153075 5153096 5153092 5153097 +
aacagctgaaactcttgaaatg

SEQ ID NO: 70817 - DNA, 22 bp, Artificial Sequence
  Synthetic oligonucleotide; CTG chr11 5153083 5153104 5153100 5153105 +
aaactcttgaaatgttgtgagt

SEQ ID NO: 70818 - DNA, 22 bp, Artificial Sequence
  Synthetic oligonucleotide; CTC chr11 5153089 5153110 5153106 5153111 +
ttgaaatgttgtgagtttaaaa

SEQ ID NO: 70819 - DNA, 22 bp, Artificial Sequence
  Synthetic oligonucleotide; CTT chr11 5153091 5153112 5153108 5153113 +
gaaatgttgtgagtttaaaatt

SEQ ID NO: 70820 - DNA, 22 bp, Artificial Sequence
  Synthetic oligonucleotide; TTG chr11 5153092 5153113 5153109 5153114 +
aaatgttgtgagtttaaaattt

SEQ ID NO: 70821 - DNA, 22 bp, Artificial Sequence
  Synthetic oligonucleotide; TTG chr11 5153100 5153121 5153117 5153122 +
tgagtttaaaattttaatacac

SEQ ID NO: 70822 - DNA, 22 bp, Artificial Sequence
  Synthetic oligonucleotide; TTT chr11 5153107 5153128 5153124 5153129 +
aaaattttaatacactttatgg

SEQ ID NO: 70823 - DNA, 22 bp, Artificial Sequence
  Synthetic oligonucleotide; TTA chr11 5153108 5153129 5153125 5153130 +
aaattttaatacactttatgga

SEQ ID NO: 70824 - DNA, 22 bp, Artificial Sequence
  Synthetic oligonucleotide; TTT chr11 5153114 5153135 5153131 5153136 +
taatacactttatggaatatct

SEQ ID NO: 70825 - DNA, 22 bp, Artificial Sequence
  Synthetic oligonucleotide; TTT chr11 5153115 5153136 5153132 5153137 +
aatacactttatggaatatcta

SEQ ID NO: 70826 - DNA, 22 bp, Artificial Sequence
  Synthetic oligonucleotide; TTA chr11 5153116 5153137 5153133 5153138 +
atacactttatggaatatctag

SEQ ID NO: 70827 - DNA, 22 bp, Artificial Sequence
  Synthetic oligonucleotide; CTT chr11 5153124 5153145 5153141 5153146 +
tatggaatatctagagagaagg

SEQ ID NO: 70828 - DNA, 22 bp, Artificial Sequence
  Synthetic oligonucleotide; TTT chr11 5153125 5153146 5153142 5153147 +
atggaatatctagagagaagga

SEQ ID NO: 70829 - DNA, 22 bp, Artificial Sequence
  Synthetic oligonucleotide; TTA chr11 5153126 5153147 5153143 5153148 +
tggaatatctagagagaaggaa

SEQ ID NO: 70830 - DNA, 22 bp, Artificial Sequence
  Synthetic oligonucleotide; CTA chr11 5153137 5153158 5153154 5153159 +
gagagaaggaactgctaaggga

SEQ ID NO: 70831 - DNA, 22 bp, Artificial Sequence
  Synthetic oligonucleotide; CTG chr11 5153151 5153172 5153168 5153173 +
ctaagggacaagatgagcagca

SEQ ID NO: 70832 - DNA, 22 bp, Artificial Sequence
  Synthetic oligonucleotide; CTA chr11 5153154 5153175 5153171 5153176 +
agggacaagatgagcagcagca

SEQ ID NO: 70833 - DNA, 22 bp, Artificial Sequence
  Synthetic oligonucleotide; CTA chr11 5153183 5153204 5153200 5153205 +
cggcaagagaacttgctcctga

SEQ ID NO: 70834 - DNA, 22 bp, Artificial Sequence
  Synthetic oligonucleotide; CTT chr11 5153197 5153218 5153214 5153219 +
gctcctgataaaccacagatac

SEQ ID NO: 70835 - DNA, 22 bp, Artificial Sequence
  Synthetic oligonucleotide; TTG chr11 5153198 5153219 5153215 5153220 +
ctcctgataaaccacagatact

SEQ ID NO: 70836 - DNA, 22 bp, Artificial Sequence
  Synthetic oligonucleotide; CTC chr11 5153201 5153222 5153218 5153223 +
ctgataaaccacagatactgaa

SEQ ID NO: 70837 - DNA, 22 bp, Artificial Sequence
  Synthetic oligonucleotide; CTG chr11 5153204 5153225 5153221 5153226 +
ataaaccacagatactgaataa

SEQ ID NO: 70838 - DNA, 22 bp, Artificial Sequence
  Synthetic oligonucleotide; CTG chr11 5153221 5153242 5153238 5153243 +
aataatgggcaaatgaatcatt

SEQ ID NO: 70839 - DNA, 22 bp, Artificial Sequence
  Synthetic oligonucleotide; TTT chr11 5153244 5153265 5153261 5153266 +
agccagaatagagtccagtttc

SEQ ID NO: 70840 - DNA, 22 bp, Artificial Sequence
  Synthetic oligonucleotide; TTA chr11 5153245 5153266 5153262 5153267 +
gccagaatagagtccagtttcc

SEQ ID NO: 70841 - DNA, 22 bp, Artificial Sequence
  Synthetic oligonucleotide; TTT chr11 5153265 5153286 5153282 5153287 +
cctggttttaaaatgttcagag

SEQ ID NO: 70842 - DNA, 22 bp, Artificial Sequence
  Synthetic oligonucleotide; TTC chr11 5153266 5153287 5153283 5153288 +
ctggttttaaaatgttcagagt

SEQ ID NO: 70843 - DNA, 22 bp, Artificial Sequence
  Synthetic oligonucleotide; CTG chr11 5153269 5153290 5153286 5153291 +
gttttaaaatgttcagagttat

SEQ ID NO: 70844 - DNA, 22 bp, Artificial Sequence
  Synthetic oligonucleotide; TTT chr11 5153273 5153294 5153290 5153295 +
taaaatgttcagagttataatt

SEQ ID NO: 70845 - DNA, 22 bp, Artificial Sequence
  Synthetic oligonucleotide; TTT chr11 5153274 5153295 5153291 5153296 +
aaaatgttcagagttataatta

SEQ ID NO: 70846 - DNA, 22 bp, Artificial Sequence
  Synthetic oligonucleotide; TTA chr11 5153275 5153296 5153292 5153297 +
aaatgttcagagttataattag

SEQ ID NO: 70847 - DNA, 22 bp, Artificial Sequence
  Synthetic oligonucleotide; TTC chr11 5153283 5153304 5153300 5153305 +
agagttataattagcataatat

SEQ ID NO: 70848 - DNA, 22 bp, Artificial Sequence
  Synthetic oligonucleotide; TTA chr11 5153290 5153311 5153307 5153312 +
taattagcataatatagcccaa

SEQ ID NO: 70849 - DNA, 22 bp, Artificial Sequence
  Synthetic oligonucleotide; TTA chr11 5153296 5153317 5153313 5153318 +
gcataatatagcccaataaagg

SEQ ID NO: 70850 - DNA, 22 bp, Artificial Sequence
  Synthetic oligonucleotide; CTC chr11 5153321 5153342 5153338 5153343 +
attagttcttaatgaaatatag

SEQ ID NO: 70851 - DNA, 22 bp, Artificial Sequence
  Synthetic oligonucleotide; TTA chr11 5153325 5153346 5153342 5153347 +
gttcttaatgaaatataggtga

SEQ ID NO: 70852 - DNA, 22 bp, Artificial Sequence
  Synthetic oligonucleotide; TTC chr11 5153329 5153350 5153346 5153351 +
ttaatgaaatataggtgagatg

SEQ ID NO: 70853 - DNA, 22 bp, Artificial Sequence
  Synthetic oligonucleotide; CTT chr11 5153331 5153352 5153348 5153353 +
aatgaaatataggtgagatgct

SEQ ID NO: 70854 - DNA, 22 bp, Artificial Sequence
  Synthetic oligonucleotide; TTA chr11 5153332 5153353 5153349 5153354 +
atgaaatataggtgagatgctt

SEQ ID NO: 70855 - DNA, 22 bp, Artificial Sequence
  Synthetic oligonucleotide; CTT chr11 5153354 5153375 5153371 5153376 +
atataattttgtgagctctgac

SEQ ID NO: 70856 - DNA, 22 bp, Artificial Sequence
  Synthetic oligonucleotide; TTA chr11 5153355 5153376 5153372 5153377 +
tataattttgtgagctctgaca

SEQ ID NO: 70857 - DNA, 22 bp, Artificial Sequence
  Synthetic oligonucleotide; TTT chr11 5153363 5153384 5153380 5153385 +
tgtgagctctgacataagaaat

SEQ ID NO: 70858 - DNA, 22 bp, Artificial Sequence
  Synthetic oligonucleotide; TTT chr11 5153364 5153385 5153381 5153386 +
gtgagctctgacataagaaatt

SEQ ID NO: 70859 - DNA, 22 bp, Artificial Sequence
  Synthetic oligonucleotide; TTG chr11 5153365 5153386 5153382 5153387 +
tgagctctgacataagaaatta

SEQ ID NO: 70860 - DNA, 22 bp, Artificial Sequence
  Synthetic oligonucleotide; CTC chr11 5153372 5153393 5153389 5153394 +
tgacataagaaattagtaaaaa

SEQ ID NO: 70861 - DNA, 22 bp, Artificial Sequence
  Synthetic oligonucleotide; CTG chr11 5153374 5153395 5153391 5153396 +
acataagaaattagtaaaaata

SEQ ID NO: 70862 - DNA, 22 bp, Artificial Sequence
  Synthetic oligonucleotide; TTA chr11 5153387 5153408 5153404 5153409 +
gtaaaaataaaaaagctaaagg

SEQ ID NO: 70863 - DNA, 22 bp, Artificial Sequence
  Synthetic oligonucleotide; CTA chr11 5153405 5153426 5153422 5153427 +
aaggacagatttcttagaagaa

SEQ ID NO: 70864 - DNA, 22 bp, Artificial Sequence
  Synthetic oligonucleotide; TTT chr11 5153417 5153438 5153434 5153439 +
cttagaagaagtcaaatgtaga

SEQ ID NO: 70865 - DNA, 22 bp, Artificial Sequence
  Synthetic oligonucleotide; TTC chr11 5153418 5153439 5153435 5153440 +
ttagaagaagtcaaatgtagaa

SEQ ID NO: 70866 - DNA, 22 bp, Artificial Sequence
  Synthetic oligonucleotide; CTT chr11 5153420 5153441 5153437 5153442 +
agaagaagtcaaatgtagaact

SEQ ID NO: 70867 - DNA, 22 bp, Artificial Sequence
  Synthetic oligonucleotide; TTA chr11 5153421 5153442 5153438 5153443 +
gaagaagtcaaatgtagaacta

SEQ ID NO: 70868 - DNA, 22 bp, Artificial Sequence
  Synthetic oligonucleotide; CTA chr11 5153443 5153464 5153460 5153465 +
gacagggaagacaggacaaact

SEQ ID NO: 70869 - DNA, 22 bp, Artificial Sequence
  Synthetic oligonucleotide; CTT chr11 5153466 5153487 5153483 5153488 +
ggggagactaaaattgaggaaa

SEQ ID NO: 70870 - DNA, 22 bp, Artificial Sequence
  Synthetic oligonucleotide; TTG chr11 5153467 5153488 5153484 5153489 +
gggagactaaaattgaggaaag

SEQ ID NO: 70871 - DNA, 22 bp, Artificial Sequence
  Synthetic oligonucleotide; CTA chr11 5153476 5153497 5153493 5153498 +
aaattgaggaaagcactatgaa

SEQ ID NO: 70872 - DNA, 22 bp, Artificial Sequence
  Synthetic oligonucleotide; TTG chr11 5153482 5153503 5153499 5153504 +
aggaaagcactatgaataacca

SEQ ID NO: 70873 - DNA, 22 bp, Artificial Sequence
  Synthetic oligonucleotide; CTA chr11 5153494 5153515 5153511 5153516 +
tgaataaccaaagaaaatttag

SEQ ID NO: 70874 - DNA, 22 bp, Artificial Sequence
  Synthetic oligonucleotide; TTT chr11 5153514 5153535 5153531 5153536 +
agtcacttttcaatttcactga

SEQ ID NO: 70875 - DNA, 22 bp, Artificial Sequence
  Synthetic oligonucleotide; TTA chr11 5153515 5153536 5153532 5153537 +
gtcacttttcaatttcactgat

SEQ ID NO: 70876 - DNA, 22 bp, Artificial Sequence
  Synthetic oligonucleotide; CTT chr11 5153522 5153543 5153539 5153544 +
ttcaatttcactgatgattgaa

SEQ ID NO: 70877 - DNA, 22 bp, Artificial Sequence
  Synthetic oligonucleotide; TTT chr11 5153523 5153544 5153540 5153545 +
tcaatttcactgatgattgaat

SEQ ID NO: 70878 - DNA, 22 bp, Artificial Sequence
  Synthetic oligonucleotide; TTT chr11 5153524 5153545 5153541 5153546 +
caatttcactgatgattgaatt

SEQ ID NO: 70879 - DNA, 22 bp, Artificial Sequence
  Synthetic oligonucleotide; TTC chr11 5153525 5153546 5153542 5153547 +
aatttcactgatgattgaattt

SEQ ID NO: 70880 - DNA, 22 bp, Artificial Sequence
  Synthetic oligonucleotide; TTT chr11 5153530 5153551 5153547 5153552 +
cactgatgattgaattttctga

SEQ ID NO: 70881 - DNA, 22 bp, Artificial Sequence
  Synthetic oligonucleotide; TTC chr11 5153531 5153552 5153548 5153553 +
actgatgattgaattttctgaa

SEQ ID NO: 70882 - DNA, 22 bp, Artificial Sequence
  Synthetic oligonucleotide; CTG chr11 5153535 5153556 5153552 5153557 +
atgattgaattttctgaaaaac

SEQ ID NO: 70883 - DNA, 22 bp, Artificial Sequence
  Synthetic oligonucleotide; TTG chr11 5153542 5153563 5153559 5153564 +
aattttctgaaaaacctgggct

SEQ ID NO: 70884 - DNA, 22 bp, Artificial Sequence
  Synthetic oligonucleotide; TTT chr11 5153547 5153568 5153564 5153569 +
tctgaaaaacctgggctcttat

SEQ ID NO: 70885 - DNA, 22 bp, Artificial Sequence
  Synthetic oligonucleotide; TTT chr11 5153548 5153569 5153565 5153570 +
ctgaaaaacctgggctcttatg

SEQ ID NO: 70886 - DNA, 22 bp, Artificial Sequence
  Synthetic oligonucleotide; TTC chr11 5153549 5153570 5153566 5153571 +
tgaaaaacctgggctcttatgc

SEQ ID NO: 70887 - DNA, 22 bp, Artificial Sequence
  Synthetic oligonucleotide; CTG chr11 5153551 5153572 5153568 5153573 +
aaaaacctgggctcttatgctt

SEQ ID NO: 70888 - DNA, 22 bp, Artificial Sequence
  Synthetic oligonucleotide; CTG chr11 5153560 5153581 5153577 5153582 +
ggctcttatgctttatataaaa

SEQ ID NO: 70889 - DNA, 22 bp, Artificial Sequence
  Synthetic oligonucleotide; CTC chr11 5153565 5153586 5153582 5153587 +
ttatgctttatataaaagttct

SEQ ID NO: 70890 - DNA, 22 bp, Artificial Sequence
  Synthetic oligonucleotide; CTT chr11 5153567 5153588 5153584 5153589 +
atgctttatataaaagttctct

SEQ ID NO: 70891 - DNA, 22 bp, Artificial Sequence
  Synthetic oligonucleotide; TTA chr11 5153568 5153589 5153585 5153590 +
tgctttatataaaagttctctg

SEQ ID NO: 70892 - DNA, 22 bp, Artificial Sequence
  Synthetic oligonucleotide; CTT chr11 5153573 5153594 5153590 5153595 +
tatataaaagttctctgatcaa

SEQ ID NO: 70893 - DNA, 22 bp, Artificial Sequence
  Synthetic oligonucleotide; TTT chr11 5153574 5153595 5153591 5153596 +
atataaaagttctctgatcaaa

SEQ ID NO: 70894 - DNA, 22 bp, Artificial Sequence
  Synthetic oligonucleotide; TTA chr11 5153575 5153596 5153592 5153597 +
tataaaagttctctgatcaaaa

SEQ ID NO: 70895 - DNA, 22 bp, Artificial Sequence
  Synthetic oligonucleotide; TTC chr11 5153586 5153607 5153603 5153608 +
tctgatcaaaatagttattttc

SEQ ID NO: 70896 - DNA, 22 bp, Artificial Sequence
  Synthetic oligonucleotide; CTC chr11 5153588 5153609 5153605 5153610 +
tgatcaaaatagttattttcta

SEQ ID NO: 70897 - DNA, 22 bp, Artificial Sequence
  Synthetic oligonucleotide; CTG chr11 5153590 5153611 5153607 5153612 +
atcaaaatagttattttctaaa

SEQ ID NO: 70898 - DNA, 22 bp, Artificial Sequence
  Synthetic oligonucleotide; TTA chr11 5153603 5153624 5153620 5153625 +
ttttctaaaaattacatatttt

SEQ ID NO: 70899 - DNA, 22 bp, Artificial Sequence
  Synthetic oligonucleotide; TTT chr11 5153606 5153627 5153623 5153628 +
tctaaaaattacatattttgaa

SEQ ID NO: 70900 - DNA, 22 bp, Artificial Sequence
  Synthetic oligonucleotide; TTT chr11 5153607 5153628 5153624 5153629 +
ctaaaaattacatattttgaat

SEQ ID NO: 70901 - DNA, 22 bp, Artificial Sequence
  Synthetic oligonucleotide; TTC chr11 5153608 5153629 5153625 5153630 +
taaaaattacatattttgaatc

SEQ ID NO: 70902 - DNA, 22 bp, Artificial Sequence
  Synthetic oligonucleotide; CTA chr11 5153610 5153631 5153627 5153632 +
aaaattacatattttgaatcag

SEQ ID NO: 70903 - DNA, 22 bp, Artificial Sequence
  Synthetic oligonucleotide; TTA chr11 5153617 5153638 5153634 5153639 +
catattttgaatcagtacattt

SEQ ID NO: 70904 - DNA, 22 bp, Artificial Sequence
  Synthetic oligonucleotide; TTT chr11 5153624 5153645 5153641 5153646 +
tgaatcagtacattttaagcta

SEQ ID NO: 70905 - DNA, 22 bp, Artificial Sequence
  Synthetic oligonucleotide; TTT chr11 5153625 5153646 5153642 5153647 +
gaatcagtacattttaagctat

SEQ ID NO: 70906 - DNA, 22 bp, Artificial Sequence
  Synthetic oligonucleotide; TTG chr11 5153626 5153647 5153643 5153648 +
aatcagtacattttaagctata

SEQ ID NO: 70907 - DNA, 22 bp, Artificial Sequence
  Synthetic oligonucleotide; TTT chr11 5153639 5153660 5153656 5153661 +
taagctatacattagagaaatg

SEQ ID NO: 70908 - DNA, 22 bp, Artificial Sequence
  Synthetic oligonucleotide; TTT chr11 5153640 5153661 5153657 5153662 +
aagctatacattagagaaatgt

SEQ ID NO: 70909 - DNA, 22 bp, Artificial Sequence
  Synthetic oligonucleotide; TTA chr11 5153641 5153662 5153658 5153663 +
agctatacattagagaaatgtt

SEQ ID NO: 70910 - DNA, 22 bp, Artificial Sequence
  Synthetic oligonucleotide; CTA chr11 5153646 5153667 5153663 5153668 +
tacattagagaaatgtttgtga

SEQ ID NO: 70911 - DNA, 22 bp, Artificial Sequence
  Synthetic oligonucleotide; TTA chr11 5153653 5153674 5153670 5153675 +
gagaaatgtttgtgatacagtg

SEQ ID NO: 70912 - DNA, 22 bp, Artificial Sequence
  Synthetic oligonucleotide; TTT chr11 5153664 5153685 5153681 5153686 +
gtgatacagtgaaaagtaaagt

SEQ ID NO: 70913 - DNA, 22 bp, Artificial Sequence
  Synthetic oligonucleotide; TTG chr11 5153665 5153686 5153682 5153687 +
tgatacagtgaaaagtaaagtt

SEQ ID NO: 70914 - DNA, 22 bp, Artificial Sequence
  Synthetic oligonucleotide; TTA chr11 5153688 5153709 5153705 5153710 +
cttcattctttcctagacactt

SEQ ID NO: 70915 - DNA, 22 bp, Artificial Sequence
  Synthetic oligonucleotide; CTT chr11 5153691 5153712 5153708 5153713 +
cattctttcctagacacttcaa

SEQ ID NO: 70916 - DNA, 22 bp, Artificial Sequence
  Synthetic oligonucleotide; TTC chr11 5153692 5153713 5153709 5153714 +
attctttcctagacacttcaat

SEQ ID NO: 70917 - DNA, 22 bp, Artificial Sequence
  Synthetic oligonucleotide; TTC chr11 5153696 5153717 5153713 5153718 +
tttcctagacacttcaataaag

SEQ ID NO: 70918 - DNA, 22 bp, Artificial Sequence
  Synthetic oligonucleotide; CTT chr11 5153698 5153719 5153715 5153720 +
tcctagacacttcaataaagtt

SEQ ID NO: 70919 - DNA, 22 bp, Artificial Sequence
  Synthetic oligonucleotide; TTT chr11 5153699 5153720 5153716 5153721 +
cctagacacttcaataaagttg

SEQ ID NO: 70920 - DNA, 22 bp, Artificial Sequence
  Synthetic oligonucleotide; TTC chr11 5153700 5153721 5153717 5153722 +
ctagacacttcaataaagttgt

SEQ ID NO: 70921 - DNA, 22 bp, Artificial Sequence
  Synthetic oligonucleotide; CTA chr11 5153703 5153724 5153720 5153725 +
gacacttcaataaagttgtttt

SEQ ID NO: 70922 - DNA, 22 bp, Artificial Sequence
  Synthetic oligonucleotide; CTT chr11 5153710 5153731 5153727 5153732 +
caataaagttgttttatctcag

SEQ ID NO: 70923 - DNA, 22 bp, Artificial Sequence
  Synthetic oligonucleotide; TTC chr11 5153711 5153732 5153728 5153733 +
aataaagttgttttatctcagt

SEQ ID NO: 70924 - DNA, 22 bp, Artificial Sequence
  Synthetic oligonucleotide; TTG chr11 5153721 5153742 5153738 5153743 +
ttttatctcagtaagctcatga

SEQ ID NO: 70925 - DNA, 22 bp, Artificial Sequence
  Synthetic oligonucleotide; TTT chr11 5153724 5153745 5153741 5153746 +
tatctcagtaagctcatgaatc

SEQ ID NO: 70926 - DNA, 22 bp, Artificial Sequence
  Synthetic oligonucleotide; TTT chr11 5153725 5153746 5153742 5153747 +
atctcagtaagctcatgaatca

SEQ ID NO: 70927 - DNA, 22 bp, Artificial Sequence
  Synthetic oligonucleotide; TTA chr11 5153726 5153747 5153743 5153748 +
tctcagtaagctcatgaatcag

SEQ ID NO: 70928 - DNA, 22 bp, Artificial Sequence
  Synthetic oligonucleotide; CTC chr11 5153730 5153751 5153747 5153752 +
agtaagctcatgaatcagctaa

SEQ ID NO: 70929 - DNA, 22 bp, Artificial Sequence
  Synthetic oligonucleotide; CTC chr11 5153739 5153760 5153756 5153761 +
atgaatcagctaaccgtatgct

SEQ ID NO: 70930 - DNA, 22 bp, Artificial Sequence
  Synthetic oligonucleotide; CTA chr11 5153751 5153772 5153768 5153773 +
accgtatgcttcatgtcaccaa

SEQ ID NO: 70931 - DNA, 22 bp, Artificial Sequence
  Synthetic oligonucleotide; CTT chr11 5153762 5153783 5153779 5153784 +
catgtcaccaatatgctggaaa

SEQ ID NO: 70932 - DNA, 22 bp, Artificial Sequence
  Synthetic oligonucleotide; TTC chr11 5153763 5153784 5153780 5153785 +
atgtcaccaatatgctggaaat

SEQ ID NO: 70933 - DNA, 22 bp, Artificial Sequence
  Synthetic oligonucleotide; CTG chr11 5153780 5153801 5153797 5153802 +
gaaattcaggaagtagctgttc

SEQ ID NO: 70934 - DNA, 22 bp, Artificial Sequence
  Synthetic oligonucleotide; TTC chr11 5153787 5153808 5153804 5153809 +
aggaagtagctgttctttgaaa

SEQ ID NO: 70935 - DNA, 22 bp, Artificial Sequence
  Synthetic oligonucleotide; CTG chr11 5153799 5153820 5153816 5153821 +
ttctttgaaagaaaaagcagct

SEQ ID NO: 70936 - DNA, 22 bp, Artificial Sequence
  Synthetic oligonucleotide; TTC chr11 5153802 5153823 5153819 5153824 +
tttgaaagaaaaagcagctttt

SEQ ID NO: 70937 - DNA, 22 bp, Artificial Sequence
  Synthetic oligonucleotide; CTT chr11 5153804 5153825 5153821 5153826 +
tgaaagaaaaagcagctttttt

SEQ ID NO: 70938 - DNA, 22 bp, Artificial Sequence
  Synthetic oligonucleotide; TTT chr11 5153805 5153826 5153822 5153827 +
gaaagaaaaagcagcttttttt

SEQ ID NO: 70939 - DNA, 22 bp, Artificial Sequence
  Synthetic oligonucleotide; TTG chr11 5153806 5153827 5153823 5153828 +
aaagaaaaagcagctttttttt

SEQ ID NO: 70940 - DNA, 22 bp, Artificial Sequence
  Synthetic oligonucleotide; CTT chr11 5153822 5153843 5153839 5153844 +
tttttttttttttttttttgaa

SEQ ID NO: 70941 - DNA, 22 bp, Artificial Sequence
  Synthetic oligonucleotide; TTT chr11 5153823 5153844 5153840 5153845 +
ttttttttttttttttttgaaa

SEQ ID NO: 70942 - DNA, 22 bp, Artificial Sequence
  Synthetic oligonucleotide; TTT chr11 5153824 5153845 5153841 5153846 +
tttttttttttttttttgaaag

SEQ ID NO: 70943 - DNA, 22 bp, Artificial Sequence
  Synthetic oligonucleotide; TTT chr11 5153825 5153846 5153842 5153847 +
ttttttttttttttttgaaaga

SEQ ID NO: 70944 - DNA, 22 bp, Artificial Sequence
  Synthetic oligonucleotide; TTT chr11 5153826 5153847 5153843 5153848 +
tttttttttttttttgaaagaa

SEQ ID NO: 70945 - DNA, 22 bp, Artificial Sequence
  Synthetic oligonucleotide; TTT chr11 5153827 5153848 5153844 5153849 +
ttttttttttttttgaaagaaa

SEQ ID NO: 70946 - DNA, 22 bp, Artificial Sequence
  Synthetic oligonucleotide; TTT chr11 5153828 5153849 5153845 5153850 +
tttttttttttttgaaagaaaa

SEQ ID NO: 70947 - DNA, 22 bp, Artificial Sequence
  Synthetic oligonucleotide; TTT chr11 5153829 5153850 5153846 5153851 +
ttttttttttttgaaagaaaag

SEQ ID NO: 70948 - DNA, 22 bp, Artificial Sequence
  Synthetic oligonucleotide; TTT chr11 5153830 5153851 5153847 5153852 +
tttttttttttgaaagaaaagg

SEQ ID NO: 70949 - DNA, 22 bp, Artificial Sequence
  Synthetic oligonucleotide; TTT chr11 5153831 5153852 5153848 5153853 +
ttttttttttgaaagaaaagga

SEQ ID NO: 70950 - DNA, 22 bp, Artificial Sequence
  Synthetic oligonucleotide; TTT chr11 5153832 5153853 5153849 5153854 +
tttttttttgaaagaaaaggaa

SEQ ID NO: 70951 - DNA, 22 bp, Artificial Sequence
  Synthetic oligonucleotide; TTT chr11 5153833 5153854 5153850 5153855 +
ttttttttgaaagaaaaggaag

SEQ ID NO: 70952 - DNA, 22 bp, Artificial Sequence
  Synthetic oligonucleotide; TTT chr11 5153834 5153855 5153851 5153856 +
tttttttgaaagaaaaggaagg

SEQ ID NO: 70953 - DNA, 22 bp, Artificial Sequence
  Synthetic oligonucleotide; TTT chr11 5153835 5153856 5153852 5153857 +
ttttttgaaagaaaaggaaggt

SEQ ID NO: 70954 - DNA, 22 bp, Artificial Sequence
  Synthetic oligonucleotide; TTT chr11 5153836 5153857 5153853 5153858 +
tttttgaaagaaaaggaaggta

SEQ ID NO: 70955 - DNA, 22 bp, Artificial Sequence
  Synthetic oligonucleotide; TTT chr11 5153837 5153858 5153854 5153859 +
ttttgaaagaaaaggaaggtaa

SEQ ID NO: 70956 - DNA, 22 bp, Artificial Sequence
  Synthetic oligonucleotide; TTT chr11 5153838 5153859 5153855 5153860 +
tttgaaagaaaaggaaggtaag

SEQ ID NO: 70957 - DNA, 22 bp, Artificial Sequence
  Synthetic oligonucleotide; TTT chr11 5153839 5153860 5153856 5153861 +
ttgaaagaaaaggaaggtaagt

SEQ ID NO: 70958 - DNA, 22 bp, Artificial Sequence
  Synthetic oligonucleotide; TTT chr11 5153840 5153861 5153857 5153862 +
tgaaagaaaaggaaggtaagta

SEQ ID NO: 70959 - DNA, 22 bp, Artificial Sequence
  Synthetic oligonucleotide; TTT chr11 5153841 5153862 5153858 5153863 +
gaaagaaaaggaaggtaagtaa

SEQ ID NO: 70960 - DNA, 22 bp, Artificial Sequence
  Synthetic oligonucleotide; TTG chr11 5153842 5153863 5153859 5153864 +
aaagaaaaggaaggtaagtaac

SEQ ID NO: 70961 - DNA, 22 bp, Artificial Sequence
  Synthetic oligonucleotide; TTT chr11 5153901 5153922 5153918 5153923 +
actcaaatattcaacaacaaat

SEQ ID NO: 70962 - DNA, 22 bp, Artificial Sequence
  Synthetic oligonucleotide; TTA chr11 5153902 5153923 5153919 5153924 +
ctcaaatattcaacaacaaatg

SEQ ID NO: 70963 - DNA, 22 bp, Artificial Sequence
  Synthetic oligonucleotide; CTC chr11 5153905 5153926 5153922 5153927 +
aaatattcaacaacaaatgttc

SEQ ID NO: 70964 - DNA, 22 bp, Artificial Sequence
  Synthetic oligonucleotide; TTC chr11 5153913 5153934 5153930 5153935 +
aacaacaaatgttcaactgctg

SEQ ID NO: 70965 - DNA, 22 bp, Artificial Sequence
  Synthetic oligonucleotide; TTC chr11 5153927 5153948 5153944 5153949 +
aactgctgctaaacttcaaatg

SEQ ID NO: 70966 - DNA, 22 bp, Artificial Sequence
  Synthetic oligonucleotide; CTG chr11 5153932 5153953 5153949 5153954 +
ctgctaaacttcaaatgaaaga

SEQ ID NO: 70967 - DNA, 22 bp, Artificial Sequence
  Synthetic oligonucleotide; CTG chr11 5153935 5153956 5153952 5153957 +
ctaaacttcaaatgaaagaacc

SEQ ID NO: 70968 - DNA, 22 bp, Artificial Sequence
  Synthetic oligonucleotide; CTA chr11 5153938 5153959 5153955 5153960 +
aacttcaaatgaaagaaccaaa

SEQ ID NO: 70969 - DNA, 22 bp, Artificial Sequence
  Synthetic oligonucleotide; CTT chr11 5153943 5153964 5153960 5153965 +
caaatgaaagaaccaaatcagc

SEQ ID NO: 70970 - DNA, 22 bp, Artificial Sequence
  Synthetic oligonucleotide; TTC chr11 5153944 5153965 5153961 5153966 +
aaatgaaagaaccaaatcagca

SEQ ID NO: 70971 - DNA, 22 bp, Artificial Sequence
  Synthetic oligonucleotide; TTT chr11 5153976 5153997 5153993 5153998 +
catgacagggaggctgtatcag

SEQ ID NO: 70972 - DNA, 22 bp, Artificial Sequence
  Synthetic oligonucleotide; TTC chr11 5153977 5153998 5153994 5153999 +
atgacagggaggctgtatcagc

SEQ ID NO: 70973 - DNA, 22 bp, Artificial Sequence
  Synthetic oligonucleotide; CTG chr11 5153992 5154013 5154009 5154014 +
tatcagctaacatacatttacc

SEQ ID NO: 70974 - DNA, 22 bp, Artificial Sequence
  Synthetic oligonucleotide; CTA chr11 5154001 5154022 5154018 5154023 +
acatacatttaccgtaaactag

SEQ ID NO: 70975 - DNA, 22 bp, Artificial Sequence
  Synthetic oligonucleotide; TTT chr11 5154011 5154032 5154028 5154033 +
accgtaaactagtaggtcaatt

SEQ ID NO: 70976 - DNA, 22 bp, Artificial Sequence
  Synthetic oligonucleotide; TTA chr11 5154012 5154033 5154029 5154034 +
ccgtaaactagtaggtcaatta

SEQ ID NO: 70977 - DNA, 22 bp, Artificial Sequence
  Synthetic oligonucleotide; CTA chr11 5154022 5154043 5154039 5154044 +
gtaggtcaattaaatactttga

SEQ ID NO: 70978 - DNA, 22 bp, Artificial Sequence
  Synthetic oligonucleotide; TTA chr11 5154034 5154055 5154051 5154056 +
aatactttgatttccacagatt

SEQ ID NO: 70979 - DNA, 22 bp, Artificial Sequence
  Synthetic oligonucleotide; CTT chr11 5154041 5154062 5154058 5154063 +
tgatttccacagatttgatccc

SEQ ID NO: 70980 - DNA, 22 bp, Artificial Sequence
  Synthetic oligonucleotide; TTT chr11 5154042 5154063 5154059 5154064 +
gatttccacagatttgatcccc

SEQ ID NO: 70981 - DNA, 22 bp, Artificial Sequence
  Synthetic oligonucleotide; TTG chr11 5154043 5154064 5154060 5154065 +
atttccacagatttgatcccca

SEQ ID NO: 70982 - DNA, 22 bp, Artificial Sequence
  Synthetic oligonucleotide; TTT chr11 5154047 5154068 5154064 5154069 +
ccacagatttgatccccaatgc

SEQ ID NO: 70983 - DNA, 22 bp, Artificial Sequence
  Synthetic oligonucleotide; TTC chr11 5154048 5154069 5154065 5154070 +
cacagatttgatccccaatgct

SEQ ID NO: 70984 - DNA, 22 bp, Artificial Sequence
  Synthetic oligonucleotide; TTT chr11 5154057 5154078 5154074 5154079 +
gatccccaatgcttagttttat

SEQ ID NO: 70985 - DNA, 22 bp, Artificial Sequence
  Synthetic oligonucleotide; TTG chr11 5154058 5154079 5154075 5154080 +
atccccaatgcttagttttatg

SEQ ID NO: 70986 - DNA, 22 bp, Artificial Sequence
  Synthetic oligonucleotide; CTT chr11 5154071 5154092 5154088 5154093 +
agttttatgacactcccatcca

SEQ ID NO: 70987 - DNA, 22 bp, Artificial Sequence
  Synthetic oligonucleotide; TTA chr11 5154072 5154093 5154089 5154094 +
gttttatgacactcccatccat

SEQ ID NO: 70988 - DNA, 22 bp, Artificial Sequence
  Synthetic oligonucleotide; TTT chr11 5154076 5154097 5154093 5154098 +
tatgacactcccatccataagt

SEQ ID NO: 70989 - DNA, 22 bp, Artificial Sequence
  Synthetic oligonucleotide; TTT chr11 5154077 5154098 5154094 5154099 +
atgacactcccatccataagtc

SEQ ID NO: 70990 - DNA, 22 bp, Artificial Sequence
  Synthetic oligonucleotide; TTA chr11 5154078 5154099 5154095 5154100 +
tgacactcccatccataagtca

SEQ ID NO: 70991 - DNA, 22 bp, Artificial Sequence
  Synthetic oligonucleotide; CTC chr11 5154086 5154107 5154103 5154108 +
ccatccataagtcactggcttt

SEQ ID NO: 70992 - DNA, 22 bp, Artificial Sequence
  Synthetic oligonucleotide; CTG chr11 5154103 5154124 5154120 5154125 +
gctttttctaataggggcaaat

SEQ ID NO: 70993 - DNA, 22 bp, Artificial Sequence
  Synthetic oligonucleotide; CTT chr11 5154107 5154128 5154124 5154129 +
tttctaataggggcaaattttt

SEQ ID NO: 70994 - DNA, 22 bp, Artificial Sequence
  Synthetic oligonucleotide; TTT chr11 5154108 5154129 5154125 5154130 +
ttctaataggggcaaatttttt

SEQ ID NO: 70995 - DNA, 22 bp, Artificial Sequence
  Synthetic oligonucleotide; TTT chr11 5154109 5154130 5154126 5154131 +
tctaataggggcaaattttttc

SEQ ID NO: 70996 - DNA, 22 bp, Artificial Sequence
  Synthetic oligonucleotide; TTT chr11 5154110 5154131 5154127 5154132 +
ctaataggggcaaattttttct

SEQ ID NO: 70997 - DNA, 22 bp, Artificial Sequence
  Synthetic oligonucleotide; TTC chr11 5154111 5154132 5154128 5154133 +
taataggggcaaattttttctt

SEQ ID NO: 70998 - DNA, 22 bp, Artificial Sequence
  Synthetic oligonucleotide; CTA chr11 5154113 5154134 5154130 5154135 +
ataggggcaaattttttcttct

SEQ ID NO: 70999 - DNA, 22 bp, Artificial Sequence
  Synthetic oligonucleotide; TTT chr11 5154127 5154148 5154144 5154149 +
tttcttctccaaagataatcac

SEQ ID NO: 71000 - DNA, 22 bp, Artificial Sequence
  Synthetic oligonucleotide; TTT chr11 5154128 5154149 5154145 5154150 +
ttcttctccaaagataatcaca

SEQ ID NO: 71001 - DNA, 22 bp, Artificial Sequence
  Synthetic oligonucleotide; TTT chr11 5154129 5154150 5154146 5154151 +
tcttctccaaagataatcacaa

SEQ ID NO: 71002 - DNA, 22 bp, Artificial Sequence
  Synthetic oligonucleotide; TTT chr11 5154130 5154151 5154147 5154152 +
cttctccaaagataatcacaat

SEQ ID NO: 71003 - DNA, 22 bp, Artificial Sequence
  Synthetic oligonucleotide; TTC chr11 5154131 5154152 5154148 5154153 +
ttctccaaagataatcacaatt

SEQ ID NO: 71004 - DNA, 22 bp, Artificial Sequence
  Synthetic oligonucleotide; CTT chr11 5154133 5154154 5154150 5154155 +
ctccaaagataatcacaattag

SEQ ID NO: 71005 - DNA, 22 bp, Artificial Sequence
  Synthetic oligonucleotide; TTC chr11 5154134 5154155 5154151 5154156 +
tccaaagataatcacaattaga

SEQ ID NO: 71006 - DNA, 22 bp, Artificial Sequence
  Synthetic oligonucleotide; CTC chr11 5154136 5154157 5154153 5154158 +
caaagataatcacaattagaat

SEQ ID NO: 71007 - DNA, 22 bp, Artificial Sequence
  Synthetic oligonucleotide; TTA chr11 5154154 5154175 5154171 5154176 +
gaataagaatcctttaatggca

SEQ ID NO: 71008 - DNA, 22 bp, Artificial Sequence
  Synthetic oligonucleotide; CTT chr11 5154168 5154189 5154185 5154190 +
taatggcaatcacaatgtctga

SEQ ID NO: 71009 - DNA, 22 bp, Artificial Sequence
  Synthetic oligonucleotide; TTT chr11 5154169 5154190 5154186 5154191 +
aatggcaatcacaatgtctgac

SEQ ID NO: 71010 - DNA, 22 bp, Artificial Sequence
  Synthetic oligonucleotide; TTA chr11 5154170 5154191 5154187 5154192 +
atggcaatcacaatgtctgact

SEQ ID NO: 71011 - DNA, 22 bp, Artificial Sequence
  Synthetic oligonucleotide; CTG chr11 5154189 5154210 5154206 5154211 +
acttattcaagaccaaagagct

SEQ ID NO: 71012 - DNA, 22 bp, Artificial Sequence
  Synthetic oligonucleotide; CTT chr11 5154193 5154214 5154210 5154215 +
attcaagaccaaagagctgaca

SEQ ID NO: 71013 - DNA, 22 bp, Artificial Sequence
  Synthetic oligonucleotide; TTA chr11 5154194 5154215 5154211 5154216 +
ttcaagaccaaagagctgacat

SEQ ID NO: 71014 - DNA, 22 bp, Artificial Sequence
  Synthetic oligonucleotide; TTC chr11 5154197 5154218 5154214 5154219 +
aagaccaaagagctgacatgtg

SEQ ID NO: 71015 - DNA, 22 bp, Artificial Sequence
  Synthetic oligonucleotide; CTG chr11 5154212 5154233 5154229 5154234 +
acatgtgagtactacctgacag

SEQ ID NO: 71016 - DNA, 22 bp, Artificial Sequence
  Synthetic oligonucleotide; CTA chr11 5154226 5154247 5154243 5154248 +
cctgacaggcacagatagcagg

SEQ ID NO: 71017 - DNA, 22 bp, Artificial Sequence
  Synthetic oligonucleotide; CTG chr11 5154230 5154251 5154247 5154252 +
acaggcacagatagcagggttg

SEQ ID NO: 71018 - DNA, 22 bp, Artificial Sequence
  Synthetic oligonucleotide; TTG chr11 5154252 5154273 5154269 5154274 +
caggtggtggtgtatgtaagtt

SEQ ID NO: 71019 - DNA, 22 bp, Artificial Sequence
  Synthetic oligonucleotide; TTC chr11 5154275 5154296 5154292 5154297 +
ctggttagttggatagagtgat

SEQ ID NO: 71020 - DNA, 22 bp, Artificial Sequence
  Synthetic oligonucleotide; CTG chr11 5154278 5154299 5154295 5154300 +
gttagttggatagagtgattgt

SEQ ID NO: 71021 - DNA, 22 bp, Artificial Sequence
  Synthetic oligonucleotide; TTA chr11 5154282 5154303 5154299 5154304 +
gttggatagagtgattgttatt

SEQ ID NO: 71022 - DNA, 22 bp, Artificial Sequence
  Synthetic oligonucleotide; TTG chr11 5154286 5154307 5154303 5154308 +
gatagagtgattgttattggag

SEQ ID NO: 71023 - DNA, 22 bp, Artificial Sequence
  Synthetic oligonucleotide; TTG chr11 5154299 5154320 5154316 5154321 +
ttattggagaagctggtaatta

SEQ ID NO: 71024 - DNA, 22 bp, Artificial Sequence
  Synthetic oligonucleotide; TTA chr11 5154302 5154323 5154319 5154324 +
ttggagaagctggtaattaaat

SEQ ID NO: 71025 - DNA, 22 bp, Artificial Sequence
  Synthetic oligonucleotide; TTG chr11 5154305 5154326 5154322 5154327 +
gagaagctggtaattaaattat

SEQ ID NO: 71026 - DNA, 22 bp, Artificial Sequence
  Synthetic oligonucleotide; CTG chr11 5154314 5154335 5154331 5154336 +
gtaattaaattatggagaggaa

SEQ ID NO: 71027 - DNA, 22 bp, Artificial Sequence
  Synthetic oligonucleotide; TTA chr11 5154321 5154342 5154338 5154343 +
aattatggagaggaaacttgga

SEQ ID NO: 71028 - DNA, 22 bp, Artificial Sequence
  Synthetic oligonucleotide; TTA chr11 5154326 5154347 5154343 5154348 +
tggagaggaaacttggaatcgt

SEQ ID NO: 71029 - DNA, 22 bp, Artificial Sequence
  Synthetic oligonucleotide; CTT chr11 5154340 5154361 5154357 5154362 +
ggaatcgtgagacttactcctc

SEQ ID NO: 71030 - DNA, 22 bp, Artificial Sequence
  Synthetic oligonucleotide; TTG chr11 5154341 5154362 5154358 5154363 +
gaatcgtgagacttactcctca

SEQ ID NO: 71031 - DNA, 22 bp, Artificial Sequence
  Synthetic oligonucleotide; CTT chr11 5154355 5154376 5154372 5154377 +
actcctcaattattattgagag

SEQ ID NO: 71032 - DNA, 22 bp, Artificial Sequence
  Synthetic oligonucleotide; TTA chr11 5154356 5154377 5154373 5154378 +
ctcctcaattattattgagagc

SEQ ID NO: 71033 - DNA, 22 bp, Artificial Sequence
  Synthetic oligonucleotide; CTC chr11 5154359 5154380 5154376 5154381 +
ctcaattattattgagagctgg

SEQ ID NO: 71034 - DNA, 22 bp, Artificial Sequence
  Synthetic oligonucleotide; CTC chr11 5154362 5154383 5154379 5154384 +
aattattattgagagctggttt

SEQ ID NO: 71035 - DNA, 22 bp, Artificial Sequence
  Synthetic oligonucleotide; TTA chr11 5154367 5154388 5154384 5154389 +
ttattgagagctggttttgctc

SEQ ID NO: 71036 - DNA, 22 bp, Artificial Sequence
  Synthetic oligonucleotide; TTA chr11 5154370 5154391 5154387 5154392 +
ttgagagctggttttgctctta

SEQ ID NO: 71037 - DNA, 22 bp, Artificial Sequence
  Synthetic oligonucleotide; TTG chr11 5154373 5154394 5154390 5154395 +
agagctggttttgctcttacca

SEQ ID NO: 71038 - DNA, 22 bp, Artificial Sequence
  Synthetic oligonucleotide; CTG chr11 5154380 5154401 5154397 5154402 +
gttttgctcttaccagatacct

SEQ ID NO: 71039 - DNA, 22 bp, Artificial Sequence
  Synthetic oligonucleotide; TTT chr11 5154384 5154405 5154401 5154406 +
tgctcttaccagatacctgaag

SEQ ID NO: 71040 - DNA, 22 bp, Artificial Sequence
  Synthetic oligonucleotide; TTT chr11 5154385 5154406 5154402 5154407 +
gctcttaccagatacctgaaga

SEQ ID NO: 71041 - DNA, 22 bp, Artificial Sequence
  Synthetic oligonucleotide; TTG chr11 5154386 5154407 5154403 5154408 +
ctcttaccagatacctgaagaa

SEQ ID NO: 71042 - DNA, 22 bp, Artificial Sequence
  Synthetic oligonucleotide; CTC chr11 5154389 5154410 5154406 5154411 +
ttaccagatacctgaagaatat

SEQ ID NO: 71043 - DNA, 22 bp, Artificial Sequence
  Synthetic oligonucleotide; CTT chr11 5154391 5154412 5154408 5154413 +
accagatacctgaagaatattg

SEQ ID NO: 71044 - DNA, 22 bp, Artificial Sequence
  Synthetic oligonucleotide; TTA chr11 5154392 5154413 5154409 5154414 +
ccagatacctgaagaatattgt

SEQ ID NO: 71045 - DNA, 22 bp, Artificial Sequence
  Synthetic oligonucleotide; CTG chr11 5154403 5154424 5154420 5154425 +
aagaatattgtccatttttcat

SEQ ID NO: 71046 - DNA, 22 bp, Artificial Sequence
  Synthetic oligonucleotide; TTG chr11 5154413 5154434 5154430 5154435 +
tccatttttcataacactttca

SEQ ID NO: 71047 - DNA, 22 bp, Artificial Sequence
  Synthetic oligonucleotide; TTT chr11 5154420 5154441 5154437 5154442 +
ttcataacactttcattcatca

SEQ ID NO: 71048 - DNA, 22 bp, Artificial Sequence
  Synthetic oligonucleotide; TTT chr11 5154421 5154442 5154438 5154443 +
tcataacactttcattcatcac

SEQ ID NO: 71049 - DNA, 22 bp, Artificial Sequence
  Synthetic oligonucleotide; TTT chr11 5154422 5154443 5154439 5154444 +
cataacactttcattcatcact

SEQ ID NO: 71050 - DNA, 22 bp, Artificial Sequence
  Synthetic oligonucleotide; TTC chr11 5154423 5154444 5154440 5154445 +
ataacactttcattcatcactc

SEQ ID NO: 71051 - DNA, 22 bp, Artificial Sequence
  Synthetic oligonucleotide; CTT chr11 5154432 5154453 5154449 5154454 +
tcattcatcactcaccaatttt

SEQ ID NO: 71052 - DNA, 22 bp, Artificial Sequence
  Synthetic oligonucleotide; TTT chr11 5154433 5154454 5154450 5154455 +
cattcatcactcaccaattttt

SEQ ID NO: 71053 - DNA, 22 bp, Artificial Sequence
  Synthetic oligonucleotide; TTC chr11 5154434 5154455 5154451 5154456 +
attcatcactcaccaatttttc

SEQ ID NO: 71054 - DNA, 22 bp, Artificial Sequence
  Synthetic oligonucleotide; TTC chr11 5154438 5154459 5154455 5154460 +
atcactcaccaatttttcttct

SEQ ID NO: 71055 - DNA, 22 bp, Artificial Sequence
  Synthetic oligonucleotide; CTC chr11 5154445 5154466 5154462 5154467 +
accaatttttcttctccaagga

SEQ ID NO: 71056 - DNA, 22 bp, Artificial Sequence
  Synthetic oligonucleotide; TTT chr11 5154453 5154474 5154470 5154475 +
ttcttctccaaggattccagct

SEQ ID NO: 71057 - DNA, 22 bp, Artificial Sequence
  Synthetic oligonucleotide; TTT chr11 5154454 5154475 5154471 5154476 +
tcttctccaaggattccagctt

SEQ ID NO: 71058 - DNA, 22 bp, Artificial Sequence
  Synthetic oligonucleotide; TTT chr11 5154455 5154476 5154472 5154477 +
cttctccaaggattccagcttc

SEQ ID NO: 71059 - DNA, 22 bp, Artificial Sequence
  Synthetic oligonucleotide; TTC chr11 5154456 5154477 5154473 5154478 +
ttctccaaggattccagcttca

SEQ ID NO: 71060 - DNA, 22 bp, Artificial Sequence
  Synthetic oligonucleotide; CTT chr11 5154458 5154479 5154475 5154480 +
ctccaaggattccagcttcatt

SEQ ID NO: 71061 - DNA, 22 bp, Artificial Sequence
  Synthetic oligonucleotide; TTC chr11 5154459 5154480 5154476 5154481 +
tccaaggattccagcttcattc

SEQ ID NO: 71062 - DNA, 22 bp, Artificial Sequence
  Synthetic oligonucleotide; CTC chr11 5154461 5154482 5154478 5154483 +
caaggattccagcttcattccc

SEQ ID NO: 71063 - DNA, 22 bp, Artificial Sequence
  Synthetic oligonucleotide; TTC chr11 5154470 5154491 5154487 5154492 +
cagcttcattcccttaagttgt

SEQ ID NO: 71064 - DNA, 22 bp, Artificial Sequence
  Synthetic oligonucleotide; CTT chr11 5154476 5154497 5154493 5154498 +
cattcccttaagttgtgggttc

SEQ ID NO: 71065 - DNA, 22 bp, Artificial Sequence
  Synthetic oligonucleotide; TTC chr11 5154477 5154498 5154494 5154499 +
attcccttaagttgtgggttct

SEQ ID NO: 71066 - DNA, 22 bp, Artificial Sequence
  Synthetic oligonucleotide; TTC chr11 5154481 5154502 5154498 5154503 +
ccttaagttgtgggttctgtga

SEQ ID NO: 71067 - DNA, 22 bp, Artificial Sequence
  Synthetic oligonucleotide; CTT chr11 5154485 5154506 5154502 5154507 +
aagttgtgggttctgtgatggc

SEQ ID NO: 71068 - DNA, 22 bp, Artificial Sequence
  Synthetic oligonucleotide; TTA chr11 5154486 5154507 5154503 5154508 +
agttgtgggttctgtgatggct

SEQ ID NO: 71069 - DNA, 22 bp, Artificial Sequence
  Synthetic oligonucleotide; TTG chr11 5154491 5154512 5154508 5154513 +
tgggttctgtgatggctctact

SEQ ID NO: 71070 - DNA, 22 bp, Artificial Sequence
  Synthetic oligonucleotide; TTC chr11 5154498 5154519 5154515 5154520 +
tgtgatggctctactttctgtc

SEQ ID NO: 71071 - DNA, 22 bp, Artificial Sequence
  Synthetic oligonucleotide; CTG chr11 5154500 5154521 5154517 5154522 +
tgatggctctactttctgtctg

SEQ ID NO: 71072 - DNA, 22 bp, Artificial Sequence
  Synthetic oligonucleotide; CTC chr11 5154509 5154530 5154526 5154531 +
tactttctgtctgcactctgtg

SEQ ID NO: 71073 - DNA, 22 bp, Artificial Sequence
  Synthetic oligonucleotide; CTA chr11 5154511 5154532 5154528 5154533 +
ctttctgtctgcactctgtgta

SEQ ID NO: 71074 - DNA, 22 bp, Artificial Sequence
  Synthetic oligonucleotide; CTT chr11 5154514 5154535 5154531 5154536 +
tctgtctgcactctgtgtaaca

SEQ ID NO: 71075 - DNA, 22 bp, Artificial Sequence
  Synthetic oligonucleotide; TTT chr11 5154515 5154536 5154532 5154537 +
ctgtctgcactctgtgtaacag

SEQ ID NO: 71076 - DNA, 22 bp, Artificial Sequence
  Synthetic oligonucleotide; TTC chr11 5154516 5154537 5154533 5154538 +
tgtctgcactctgtgtaacagc

SEQ ID NO: 71077 - DNA, 22 bp, Artificial Sequence
  Synthetic oligonucleotide; CTG chr11 5154518 5154539 5154535 5154540 +
tctgcactctgtgtaacagcat

SEQ ID NO: 71078 - DNA, 22 bp, Artificial Sequence
  Synthetic oligonucleotide; CTG chr11 5154522 5154543 5154539 5154544 +
cactctgtgtaacagcatccag

SEQ ID NO: 71079 - DNA, 22 bp, Artificial Sequence
  Synthetic oligonucleotide; CTC chr11 5154527 5154548 5154544 5154549 +
tgtgtaacagcatccagctaat

SEQ ID NO: 71080 - DNA, 22 bp, Artificial Sequence
  Synthetic oligonucleotide; CTG chr11 5154529 5154550 5154546 5154551 +
tgtaacagcatccagctaatgt

SEQ ID NO: 71081 - DNA, 22 bp, Artificial Sequence
  Synthetic oligonucleotide; CTA chr11 5154547 5154568 5154564 5154569 +
atgtcataaattttactctgtt

SEQ ID NO: 71082 - DNA, 22 bp, Artificial Sequence
  Synthetic oligonucleotide; TTT chr11 5154560 5154581 5154577 5154582 +
tactctgtttggtgccaggata

SEQ ID NO: 71083 - DNA, 22 bp, Artificial Sequence
  Synthetic oligonucleotide; TTT chr11 5154561 5154582 5154578 5154583 +
actctgtttggtgccaggatat

SEQ ID NO: 71084 - DNA, 22 bp, Artificial Sequence
  Synthetic oligonucleotide; TTA chr11 5154562 5154583 5154579 5154584 +
ctctgtttggtgccaggatatg

SEQ ID NO: 71085 - DNA, 22 bp, Artificial Sequence
  Synthetic oligonucleotide; CTC chr11 5154565 5154586 5154582 5154587 +
tgtttggtgccaggatatgtgc

SEQ ID NO: 71086 - DNA, 22 bp, Artificial Sequence
  Synthetic oligonucleotide; CTG chr11 5154567 5154588 5154584 5154589 +
tttggtgccaggatatgtgcca

SEQ ID NO: 71087 - DNA, 22 bp, Artificial Sequence
  Synthetic oligonucleotide; TTT chr11 5154570 5154591 5154587 5154592 +
ggtgccaggatatgtgccaata

SEQ ID NO: 71088 - DNA, 22 bp, Artificial Sequence
  Synthetic oligonucleotide; TTG chr11 5154571 5154592 5154588 5154593 +
gtgccaggatatgtgccaatat

SEQ ID NO: 71089 - DNA, 22 bp, Artificial Sequence
  Synthetic oligonucleotide; CTG chr11 5154602 5154623 5154619 5154624 +
tggacattttgcagatgacttt

SEQ ID NO: 71090 - DNA, 22 bp, Artificial Sequence
  Synthetic oligonucleotide; TTT chr11 5154611 5154632 5154628 5154633 +
tgcagatgactttttacacttt

SEQ ID NO: 71091 - DNA, 22 bp, Artificial Sequence
  Synthetic oligonucleotide; TTT chr11 5154612 5154633 5154629 5154634 +
gcagatgactttttacactttt

SEQ ID NO: 71092 - DNA, 22 bp, Artificial Sequence
  Synthetic oligonucleotide; TTG chr11 5154613 5154634 5154630 5154635 +
cagatgactttttacacttttc

SEQ ID NO: 71093 - DNA, 22 bp, Artificial Sequence
  Synthetic oligonucleotide; CTT chr11 5154623 5154644 5154640 5154645 +
tttacacttttcatttatctct

SEQ ID NO: 71094 - DNA, 22 bp, Artificial Sequence
  Synthetic oligonucleotide; TTT chr11 5154624 5154645 5154641 5154646 +
ttacacttttcatttatctcta

SEQ ID NO: 71095 - DNA, 22 bp, Artificial Sequence
  Synthetic oligonucleotide; TTT chr11 5154625 5154646 5154642 5154647 +
tacacttttcatttatctctaa

SEQ ID NO: 71096 - DNA, 22 bp, Artificial Sequence
  Synthetic oligonucleotide; TTT chr11 5154626 5154647 5154643 5154648 +
acacttttcatttatctctaac

SEQ ID NO: 71097 - DNA, 22 bp, Artificial Sequence
  Synthetic oligonucleotide; TTA chr11 5154627 5154648 5154644 5154649 +
cacttttcatttatctctaaca

SEQ ID NO: 71098 - DNA, 22 bp, Artificial Sequence
  Synthetic oligonucleotide; CTT chr11 5154632 5154653 5154649 5154654 +
ttcatttatctctaacacggac

SEQ ID NO: 71099 - DNA, 22 bp, Artificial Sequence
  Synthetic oligonucleotide; TTT chr11 5154633 5154654 5154650 5154655 +
tcatttatctctaacacggaca

SEQ ID NO: 71100 - DNA, 22 bp, Artificial Sequence
  Synthetic oligonucleotide; TTT chr11 5154634 5154655 5154651 5154656 +
catttatctctaacacggacat

SEQ ID NO: 71101 - DNA, 22 bp, Artificial Sequence
  Synthetic oligonucleotide; TTC chr11 5154635 5154656 5154652 5154657 +
atttatctctaacacggacatc

SEQ ID NO: 71102 - DNA, 22 bp, Artificial Sequence
  Synthetic oligonucleotide; TTT chr11 5154639 5154660 5154656 5154661 +
atctctaacacggacatcttct

SEQ ID NO: 71103 - DNA, 22 bp, Artificial Sequence
  Synthetic oligonucleotide; TTA chr11 5154640 5154661 5154657 5154662 +
tctctaacacggacatcttctt

SEQ ID NO: 71104 - DNA, 22 bp, Artificial Sequence
  Synthetic oligonucleotide; CTC chr11 5154644 5154665 5154661 5154666 +
taacacggacatcttcttcttc

SEQ ID NO: 71105 - DNA, 22 bp, Artificial Sequence
  Synthetic oligonucleotide; CTA chr11 5154646 5154667 5154663 5154668 +
acacggacatcttcttcttctt

SEQ ID NO: 71106 - DNA, 22 bp, Artificial Sequence
  Synthetic oligonucleotide; CTT chr11 5154659 5154680 5154676 5154681 +
cttcttcttctggaagtctgtc

SEQ ID NO: 71107 - DNA, 22 bp, Artificial Sequence
  Synthetic oligonucleotide; TTC chr11 5154660 5154681 5154677 5154682 +
ttcttcttctggaagtctgtct

SEQ ID NO: 71108 - DNA, 22 bp, Artificial Sequence
  Synthetic oligonucleotide; CTT chr11 5154662 5154683 5154679 5154684 +
cttcttctggaagtctgtctca

SEQ ID NO: 71109 - DNA, 22 bp, Artificial Sequence
  Synthetic oligonucleotide; TTC chr11 5154663 5154684 5154680 5154685 +
ttcttctggaagtctgtctcag

SEQ ID NO: 71110 - DNA, 22 bp, Artificial Sequence
  Synthetic oligonucleotide; CTT chr11 5154665 5154686 5154682 5154687 +
cttctggaagtctgtctcagac

SEQ ID NO: 71111 - DNA, 22 bp, Artificial Sequence
  Synthetic oligonucleotide; TTC chr11 5154666 5154687 5154683 5154688 +
ttctggaagtctgtctcagacc

SEQ ID NO: 71112 - DNA, 22 bp, Artificial Sequence
  Synthetic oligonucleotide; CTT chr11 5154668 5154689 5154685 5154690 +
ctggaagtctgtctcagaccat

SEQ ID NO: 71113 - DNA, 22 bp, Artificial Sequence
  Synthetic oligonucleotide; TTC chr11 5154669 5154690 5154686 5154691 +
tggaagtctgtctcagaccatc

SEQ ID NO: 71114 - DNA, 22 bp, Artificial Sequence
  Synthetic oligonucleotide; CTG chr11 5154671 5154692 5154688 5154693 +
gaagtctgtctcagaccatctt

SEQ ID NO: 71115 - DNA, 22 bp, Artificial Sequence
  Synthetic oligonucleotide; CTG chr11 5154679 5154700 5154696 5154701 +
tctcagaccatctttgtgtgct

SEQ ID NO: 71116 - DNA, 22 bp, Artificial Sequence
  Synthetic oligonucleotide; CTC chr11 5154683 5154704 5154700 5154705 +
agaccatctttgtgtgctcatc

SEQ ID NO: 71117 - DNA, 22 bp, Artificial Sequence
  Synthetic oligonucleotide; CTT chr11 5154693 5154714 5154710 5154715 +
tgtgtgctcatcccccagtaaa

SEQ ID NO: 71118 - DNA, 22 bp, Artificial Sequence
  Synthetic oligonucleotide; TTT chr11 5154694 5154715 5154711 5154716 +
gtgtgctcatcccccagtaaaa

SEQ ID NO: 71119 - DNA, 22 bp, Artificial Sequence
  Synthetic oligonucleotide; TTG chr11 5154695 5154716 5154712 5154717 +
tgtgctcatcccccagtaaaac

SEQ ID NO: 71120 - DNA, 22 bp, Artificial Sequence
  Synthetic oligonucleotide; CTC chr11 5154702 5154723 5154719 5154724 +
atcccccagtaaaactcatagt

SEQ ID NO: 71121 - DNA, 22 bp, Artificial Sequence
  Synthetic oligonucleotide; CTC chr11 5154719 5154740 5154736 5154741 +
atagtgaggtctgtagcattct

SEQ ID NO: 71122 - DNA, 22 bp, Artificial Sequence
  Synthetic oligonucleotide; CTG chr11 5154732 5154753 5154749 5154754 +
tagcattctgaaacacgggatg

SEQ ID NO: 71123 - DNA, 22 bp, Artificial Sequence
  Synthetic oligonucleotide; TTC chr11 5154740 5154761 5154757 5154762 +
tgaaacacgggatgaatttatt

SEQ ID NO: 71124 - DNA, 22 bp, Artificial Sequence
  Synthetic oligonucleotide; CTG chr11 5154742 5154763 5154759 5154764 +
aaacacgggatgaatttattga

SEQ ID NO: 71125 - DNA, 22 bp, Artificial Sequence
  Synthetic oligonucleotide; TTT chr11 5154759 5154780 5154776 5154781 +
attgagctcaaattggagaaaa

SEQ ID NO: 71126 - DNA, 22 bp, Artificial Sequence
  Synthetic oligonucleotide; TTA chr11 5154760 5154781 5154777 5154782 +
ttgagctcaaattggagaaaaa

SEQ ID NO: 71127 - DNA, 22 bp, Artificial Sequence
  Synthetic oligonucleotide; TTG chr11 5154763 5154784 5154780 5154785 +
agctcaaattggagaaaaaagt

SEQ ID NO: 71128 - DNA, 22 bp, Artificial Sequence
  Synthetic oligonucleotide; CTC chr11 5154768 5154789 5154785 5154790 +
aaattggagaaaaaagtggcta

SEQ ID NO: 71129 - DNA, 22 bp, Artificial Sequence
  Synthetic oligonucleotide; TTG chr11 5154774 5154795 5154791 5154796 +
gagaaaaaagtggctatccacc

SEQ ID NO: 71130 - DNA, 22 bp, Artificial Sequence
  Synthetic oligonucleotide; CTA chr11 5154790 5154811 5154807 5154812 +
tccaccaatttaatattccttt

SEQ ID NO: 71131 - DNA, 22 bp, Artificial Sequence
  Synthetic oligonucleotide; TTT chr11 5154801 5154822 5154818 5154823 +
aatattcctttatgaatgtgtg

SEQ ID NO: 71132 - DNA, 22 bp, Artificial Sequence
  Synthetic oligonucleotide; TTA chr11 5154802 5154823 5154819 5154824 +
atattcctttatgaatgtgtgg

SEQ ID NO: 71133 - DNA, 22 bp, Artificial Sequence
  Synthetic oligonucleotide; TTC chr11 5154808 5154829 5154825 5154830 +
ctttatgaatgtgtggagaagt

SEQ ID NO: 71134 - DNA, 22 bp, Artificial Sequence
  Synthetic oligonucleotide; CTT chr11 5154811 5154832 5154828 5154833 +
tatgaatgtgtggagaagtagg

SEQ ID NO: 71135 - DNA, 22 bp, Artificial Sequence
  Synthetic oligonucleotide; TTT chr11 5154812 5154833 5154829 5154834 +
atgaatgtgtggagaagtagga

SEQ ID NO: 71136 - DNA, 22 bp, Artificial Sequence
  Synthetic oligonucleotide; TTA chr11 5154813 5154834 5154830 5154835 +
tgaatgtgtggagaagtaggag

SEQ ID NO: 71137 - DNA, 22 bp, Artificial Sequence
  Synthetic oligonucleotide; TTA chr11 5154841 5154862 5154858 5154863 +
tgagcatgaaatgagggatttc

SEQ ID NO: 71138 - DNA, 22 bp, Artificial Sequence
  Synthetic oligonucleotide; TTT chr11 5154862 5154883 5154879 5154884 +
cctagttgatagccaaaaccac

SEQ ID NO: 71139 - DNA, 22 bp, Artificial Sequence
  Synthetic oligonucleotide; TTC chr11 5154863 5154884 5154880 5154885 +
ctagttgatagccaaaaccacg

SEQ ID NO: 71140 - DNA, 22 bp, Artificial Sequence
  Synthetic oligonucleotide; CTA chr11 5154866 5154887 5154883 5154888 +
gttgatagccaaaaccacgagg

SEQ ID NO: 71141 - DNA, 22 bp, Artificial Sequence
  Synthetic oligonucleotide; TTG chr11 5154870 5154891 5154887 5154892 +
atagccaaaaccacgagggacc

SEQ ID NO: 71142 - DNA, 22 bp, Artificial Sequence
  Synthetic oligonucleotide; TTT chr11 5154902 5154923 5154919 5154924 +
taagtcagccctcttgggttca

SEQ ID NO: 71143 - DNA, 22 bp, Artificial Sequence
  Synthetic oligonucleotide; TTT chr11 5154903 5154924 5154920 5154925 +
aagtcagccctcttgggttcac

SEQ ID NO: 71144 - DNA, 22 bp, Artificial Sequence
  Synthetic oligonucleotide; TTA chr11 5154904 5154925 5154921 5154926 +
agtcagccctcttgggttcact

SEQ ID NO: 71145 - DNA, 22 bp, Artificial Sequence
  Synthetic oligonucleotide; CTC chr11 5154915 5154936 5154932 5154937 +
ttgggttcactggcacctaata

SEQ ID NO: 71146 - DNA, 22 bp, Artificial Sequence
  Synthetic oligonucleotide; CTT chr11 5154917 5154938 5154934 5154939 +
gggttcactggcacctaatatc

SEQ ID NO: 71147 - DNA, 22 bp, Artificial Sequence
  Synthetic oligonucleotide; TTG chr11 5154918 5154939 5154935 5154940 +
ggttcactggcacctaatatcc

SEQ ID NO: 71148 - DNA, 22 bp, Artificial Sequence
  Synthetic oligonucleotide; TTC chr11 5154923 5154944 5154940 5154945 +
actggcacctaatatccccgta

SEQ ID NO: 71149 - DNA, 22 bp, Artificial Sequence
  Synthetic oligonucleotide; CTG chr11 5154927 5154948 5154944 5154949 +
gcacctaatatccccgtaatta

SEQ ID NO: 71150 - DNA, 22 bp, Artificial Sequence
  Synthetic oligonucleotide; CTA chr11 5154934 5154955 5154951 5154956 +
atatccccgtaattatttctac

SEQ ID NO: 71151 - DNA, 22 bp, Artificial Sequence
  Synthetic oligonucleotide; TTA chr11 5154949 5154970 5154966 5154971 +
tttctacacttgcagaaatctc

SEQ ID NO: 71152 - DNA, 22 bp, Artificial Sequence
  Synthetic oligonucleotide; TTT chr11 5154952 5154973 5154969 5154974 +
ctacacttgcagaaatctcctt

SEQ ID NO: 71153 - DNA, 22 bp, Artificial Sequence
  Synthetic oligonucleotide; TTC chr11 5154953 5154974 5154970 5154975 +
tacacttgcagaaatctccttt

SEQ ID NO: 71154 - DNA, 22 bp, Artificial Sequence
  Synthetic oligonucleotide; CTA chr11 5154955 5154976 5154972 5154977 +
cacttgcagaaatctcctttct

SEQ ID NO: 71155 - DNA, 22 bp, Artificial Sequence
  Synthetic oligonucleotide; CTT chr11 5154960 5154981 5154977 5154982 +
gcagaaatctcctttctctctt

SEQ ID NO: 71156 - DNA, 22 bp, Artificial Sequence
  Synthetic oligonucleotide; TTG chr11 5154961 5154982 5154978 5154983 +
cagaaatctcctttctctcttt

SEQ ID NO: 71157 - DNA, 22 bp, Artificial Sequence
  Synthetic oligonucleotide; CTC chr11 5154971 5154992 5154988 5154993 +
ctttctctctttttctcttttc

SEQ ID NO: 71158 - DNA, 22 bp, Artificial Sequence
  Synthetic oligonucleotide; CTT chr11 5154974 5154995 5154991 5154996 +
tctctctttttctcttttccca

SEQ ID NO: 71159 - DNA, 22 bp, Artificial Sequence
  Synthetic oligonucleotide; TTT chr11 5154975 5154996 5154992 5154997 +
ctctctttttctcttttcccac

SEQ ID NO: 71160 - DNA, 22 bp, Artificial Sequence
  Synthetic oligonucleotide; TTC chr11 5154976 5154997 5154993 5154998 +
tctctttttctcttttcccaca

SEQ ID NO: 71161 - DNA, 22 bp, Artificial Sequence
  Synthetic oligonucleotide; CTC chr11 5154978 5154999 5154995 5155000 +
tctttttctcttttcccacagg

SEQ ID NO: 71162 - DNA, 22 bp, Artificial Sequence
  Synthetic oligonucleotide; CTC chr11 5154980 5155001 5154997 5155002 +
tttttctcttttcccacaggct

SEQ ID NO: 71163 - DNA, 22 bp, Artificial Sequence
  Synthetic oligonucleotide; CTT chr11 5154982 5155003 5154999 5155004 +
tttctcttttcccacaggctaa

SEQ ID NO: 71164 - DNA, 22 bp, Artificial Sequence
  Synthetic oligonucleotide; TTT chr11 5154983 5155004 5155000 5155005 +
ttctcttttcccacaggctaaa

SEQ ID NO: 71165 - DNA, 22 bp, Artificial Sequence
  Synthetic oligonucleotide; TTT chr11 5154984 5155005 5155001 5155006 +
tctcttttcccacaggctaaat

SEQ ID NO: 71166 - DNA, 22 bp, Artificial Sequence
  Synthetic oligonucleotide; TTT chr11 5154985 5155006 5155002 5155007 +
ctcttttcccacaggctaaatg

SEQ ID NO: 71167 - DNA, 22 bp, Artificial Sequence
  Synthetic oligonucleotide; TTC chr11 5154986 5155007 5155003 5155008 +
tcttttcccacaggctaaatgc

SEQ ID NO: 71168 - DNA, 22 bp, Artificial Sequence
  Synthetic oligonucleotide; CTC chr11 5154988 5155009 5155005 5155010 +
ttttcccacaggctaaatgcag

SEQ ID NO: 71169 - DNA, 22 bp, Artificial Sequence
  Synthetic oligonucleotide; CTT chr11 5154990 5155011 5155007 5155012 +
ttcccacaggctaaatgcagaa

SEQ ID NO: 71170 - DNA, 22 bp, Artificial Sequence
  Synthetic oligonucleotide; TTT chr11 5154991 5155012 5155008 5155013 +
tcccacaggctaaatgcagaat

SEQ ID NO: 71171 - DNA, 22 bp, Artificial Sequence
  Synthetic oligonucleotide; TTT chr11 5154992 5155013 5155009 5155014 +
cccacaggctaaatgcagaata

SEQ ID NO: 71172 - DNA, 22 bp, Artificial Sequence
  Synthetic oligonucleotide; TTC chr11 5154993 5155014 5155010 5155015 +
ccacaggctaaatgcagaataa

SEQ ID NO: 71173 - DNA, 22 bp, Artificial Sequence
  Synthetic oligonucleotide; CTA chr11 5155003 5155024 5155020 5155025 +
aatgcagaataattcatatgca

SEQ ID NO: 71174 - DNA, 22 bp, Artificial Sequence
  Synthetic oligonucleotide; TTC chr11 5155018 5155039 5155035 5155040 +
atatgcaaaaaatttttttaca

SEQ ID NO: 71175 - DNA, 22 bp, Artificial Sequence
  Synthetic oligonucleotide; TTT chr11 5155033 5155054 5155050 5155055 +
ttttacaagctatgttcctttt

SEQ ID NO: 71176 - DNA, 22 bp, Artificial Sequence
  Synthetic oligonucleotide; TTT chr11 5155034 5155055 5155051 5155056 +
tttacaagctatgttccttttc

SEQ ID NO: 71177 - DNA, 22 bp, Artificial Sequence
  Synthetic oligonucleotide; TTT chr11 5155035 5155056 5155052 5155057 +
ttacaagctatgttccttttct

SEQ ID NO: 71178 - DNA, 22 bp, Artificial Sequence
  Synthetic oligonucleotide; TTT chr11 5155036 5155057 5155053 5155058 +
tacaagctatgttccttttctg

SEQ ID NO: 71179 - DNA, 22 bp, Artificial Sequence
  Synthetic oligonucleotide; TTT chr11 5155037 5155058 5155054 5155059 +
acaagctatgttccttttctgc

SEQ ID NO: 71180 - DNA, 22 bp, Artificial Sequence
  Synthetic oligonucleotide; TTA chr11 5155038 5155059 5155055 5155060 +
caagctatgttccttttctgcc

SEQ ID NO: 71181 - DNA, 22 bp, Artificial Sequence
  Synthetic oligonucleotide; CTA chr11 5155045 5155066 5155062 5155067 +
tgttccttttctgccatttcta

SEQ ID NO: 71182 - DNA, 22 bp, Artificial Sequence
  Synthetic oligonucleotide; TTC chr11 5155050 5155071 5155067 5155072 +
cttttctgccatttctatttgc

SEQ ID NO: 71183 - DNA, 22 bp, Artificial Sequence
  Synthetic oligonucleotide; CTT chr11 5155053 5155074 5155070 5155075 +
ttctgccatttctatttgcaaa

SEQ ID NO: 71184 - DNA, 22 bp, Artificial Sequence
  Synthetic oligonucleotide; TTT chr11 5155054 5155075 5155071 5155076 +
tctgccatttctatttgcaaaa

SEQ ID NO: 71185 - DNA, 22 bp, Artificial Sequence
  Synthetic oligonucleotide; TTT chr11 5155055 5155076 5155072 5155077 +
ctgccatttctatttgcaaaat

SEQ ID NO: 71186 - DNA, 22 bp, Artificial Sequence
  Synthetic oligonucleotide; TTC chr11 5155056 5155077 5155073 5155078 +
tgccatttctatttgcaaaatt

SEQ ID NO: 71187 - DNA, 22 bp, Artificial Sequence
  Synthetic oligonucleotide; CTG chr11 5155058 5155079 5155075 5155080 +
ccatttctatttgcaaaattct

SEQ ID NO: 71188 - DNA, 22 bp, Artificial Sequence
  Synthetic oligonucleotide; TTT chr11 5155064 5155085 5155081 5155086 +
ctatttgcaaaattctaaagcc

SEQ ID NO: 71189 - DNA, 22 bp, Artificial Sequence
  Synthetic oligonucleotide; TTC chr11 5155065 5155086 5155082 5155087 +
tatttgcaaaattctaaagccc

SEQ ID NO: 71190 - DNA, 22 bp, Artificial Sequence
  Synthetic oligonucleotide; CTA chr11 5155067 5155088 5155084 5155089 +
tttgcaaaattctaaagcccat

SEQ ID NO: 71191 - DNA, 22 bp, Artificial Sequence
  Synthetic oligonucleotide; TTT chr11 5155070 5155091 5155087 5155092 +
gcaaaattctaaagcccattta

SEQ ID NO: 71192 - DNA, 22 bp, Artificial Sequence
  Synthetic oligonucleotide; TTG chr11 5155071 5155092 5155088 5155093 +
caaaattctaaagcccatttaa

SEQ ID NO: 71193 - DNA, 22 bp, Artificial Sequence
  Synthetic oligonucleotide; TTC chr11 5155079 5155100 5155096 5155101 +
taaagcccatttaatgcaaaca

SEQ ID NO: 71194 - DNA, 22 bp, Artificial Sequence
  Synthetic oligonucleotide; CTA chr11 5155081 5155102 5155098 5155103 +
aagcccatttaatgcaaacatg

SEQ ID NO: 71195 - DNA, 22 bp, Artificial Sequence
  Synthetic oligonucleotide; TTT chr11 5155091 5155112 5155108 5155113 +
aatgcaaacatgtttctatgcc

SEQ ID NO: 71196 - DNA, 22 bp, Artificial Sequence
  Synthetic oligonucleotide; TTA chr11 5155092 5155113 5155109 5155114 +
atgcaaacatgtttctatgcca

SEQ ID NO: 71197 - DNA, 22 bp, Artificial Sequence
  Synthetic oligonucleotide; TTT chr11 5155106 5155127 5155123 5155128 +
ctatgccaattcctatttaaat

SEQ ID NO: 71198 - DNA, 22 bp, Artificial Sequence
  Synthetic oligonucleotide; TTC chr11 5155107 5155128 5155124 5155129 +
tatgccaattcctatttaaata

SEQ ID NO: 71199 - DNA, 22 bp, Artificial Sequence
  Synthetic oligonucleotide; CTA chr11 5155109 5155130 5155126 5155131 +
tgccaattcctatttaaataaa

SEQ ID NO: 71200 - DNA, 22 bp, Artificial Sequence
  Synthetic oligonucleotide; TTC chr11 5155118 5155139 5155135 5155140 +
ctatttaaataaatatcttggt

SEQ ID NO: 71201 - DNA, 22 bp, Artificial Sequence
  Synthetic oligonucleotide; CTA chr11 5155121 5155142 5155138 5155143 +
tttaaataaatatcttggtgac

SEQ ID NO: 71202 - DNA, 22 bp, Artificial Sequence
  Synthetic oligonucleotide; TTT chr11 5155124 5155145 5155141 5155146 +
aaataaatatcttggtgacatt

SEQ ID NO: 71203 - DNA, 22 bp, Artificial Sequence
  Synthetic oligonucleotide; TTA chr11 5155125 5155146 5155142 5155147 +
aataaatatcttggtgacattt

SEQ ID NO: 71204 - DNA, 22 bp, Artificial Sequence
  Synthetic oligonucleotide; CTT chr11 5155137 5155158 5155154 5155159 +
ggtgacattttcactgaggcaa

SEQ ID NO: 71205 - DNA, 22 bp, Artificial Sequence
  Synthetic oligonucleotide; TTG chr11 5155138 5155159 5155155 5155160 +
gtgacattttcactgaggcaag

SEQ ID NO: 71206 - DNA, 22 bp, Artificial Sequence
  Synthetic oligonucleotide; TTT chr11 5155147 5155168 5155164 5155169 +
tcactgaggcaaggtttttctc

SEQ ID NO: 71207 - DNA, 22 bp, Artificial Sequence
  Synthetic oligonucleotide; TTT chr11 5155148 5155169 5155165 5155170 +
cactgaggcaaggtttttctct

SEQ ID NO: 71208 - DNA, 22 bp, Artificial Sequence
  Synthetic oligonucleotide; TTC chr11 5155149 5155170 5155166 5155171 +
actgaggcaaggtttttctctt

SEQ ID NO: 71209 - DNA, 22 bp, Artificial Sequence
  Synthetic oligonucleotide; CTG chr11 5155153 5155174 5155170 5155175 +
aggcaaggtttttctcttttta

SEQ ID NO: 71210 - DNA, 22 bp, Artificial Sequence
  Synthetic oligonucleotide; TTT chr11 5155164 5155185 5155181 5155186 +
ttctctttttattcagaaaaga

SEQ ID NO: 71211 - DNA, 22 bp, Artificial Sequence
  Synthetic oligonucleotide; TTT chr11 5155165 5155186 5155182 5155187 +
tctctttttattcagaaaagaa

SEQ ID NO: 71212 - DNA, 22 bp, Artificial Sequence
  Synthetic oligonucleotide; TTT chr11 5155166 5155187 5155183 5155188 +
ctctttttattcagaaaagaaa

SEQ ID NO: 71213 - DNA, 22 bp, Artificial Sequence
  Synthetic oligonucleotide; TTC chr11 5155167 5155188 5155184 5155189 +
tctttttattcagaaaagaaaa

SEQ ID NO: 71214 - DNA, 22 bp, Artificial Sequence
  Synthetic oligonucleotide; CTC chr11 5155169 5155190 5155186 5155191 +
tttttattcagaaaagaaaaat

SEQ ID NO: 71215 - DNA, 22 bp, Artificial Sequence
  Synthetic oligonucleotide; CTT chr11 5155171 5155192 5155188 5155193 +
tttattcagaaaagaaaaatct

SEQ ID NO: 71216 - DNA, 22 bp, Artificial Sequence
  Synthetic oligonucleotide; TTT chr11 5155172 5155193 5155189 5155194 +
ttattcagaaaagaaaaatctg

SEQ ID NO: 71217 - DNA, 22 bp, Artificial Sequence
  Synthetic oligonucleotide; TTT chr11 5155173 5155194 5155190 5155195 +
tattcagaaaagaaaaatctgt

SEQ ID NO: 71218 - DNA, 22 bp, Artificial Sequence
  Synthetic oligonucleotide; TTT chr11 5155174 5155195 5155191 5155196 +
attcagaaaagaaaaatctgta

SEQ ID NO: 71219 - DNA, 22 bp, Artificial Sequence
  Synthetic oligonucleotide; TTA chr11 5155175 5155196 5155192 5155197 +
ttcagaaaagaaaaatctgtat

SEQ ID NO: 71220 - DNA, 22 bp, Artificial Sequence
  Synthetic oligonucleotide; TTC chr11 5155178 5155199 5155195 5155200 +
agaaaagaaaaatctgtattca

SEQ ID NO: 71221 - DNA, 22 bp, Artificial Sequence
  Synthetic oligonucleotide; CTG chr11 5155194 5155215 5155211 5155216 +
tattcataactactttttacca

SEQ ID NO: 71222 - DNA, 22 bp, Artificial Sequence
  Synthetic oligonucleotide; TTC chr11 5155199 5155220 5155216 5155221 +
ataactactttttaccacacaa

SEQ ID NO: 71223 - DNA, 22 bp, Artificial Sequence
  Synthetic oligonucleotide; CTA chr11 5155206 5155227 5155223 5155228 +
ctttttaccacacaattacttc

SEQ ID NO: 71224 - DNA, 22 bp, Artificial Sequence
  Synthetic oligonucleotide; CTT chr11 5155209 5155230 5155226 5155231 +
tttaccacacaattacttcctc

SEQ ID NO: 71225 - DNA, 22 bp, Artificial Sequence
  Synthetic oligonucleotide; TTT chr11 5155210 5155231 5155227 5155232 +
ttaccacacaattacttcctca

SEQ ID NO: 71226 - DNA, 22 bp, Artificial Sequence
  Synthetic oligonucleotide; TTT chr11 5155211 5155232 5155228 5155233 +
taccacacaattacttcctcag

SEQ ID NO: 71227 - DNA, 22 bp, Artificial Sequence
  Synthetic oligonucleotide; TTT chr11 5155212 5155233 5155229 5155234 +
accacacaattacttcctcagt

SEQ ID NO: 71228 - DNA, 22 bp, Artificial Sequence
  Synthetic oligonucleotide; TTA chr11 5155213 5155234 5155230 5155235 +
ccacacaattacttcctcagtc

SEQ ID NO: 71229 - DNA, 22 bp, Artificial Sequence
  Synthetic oligonucleotide; TTA chr11 5155224 5155245 5155241 5155246 +
cttcctcagtcttcttcagtct

SEQ ID NO: 71230 - DNA, 22 bp, Artificial Sequence
  Synthetic oligonucleotide; CTT chr11 5155227 5155248 5155244 5155249 +
cctcagtcttcttcagtctcat

SEQ ID NO: 71231 - DNA, 22 bp, Artificial Sequence
  Synthetic oligonucleotide; TTC chr11 5155228 5155249 5155245 5155250 +
ctcagtcttcttcagtctcatt

SEQ ID NO: 71232 - DNA, 22 bp, Artificial Sequence
  Synthetic oligonucleotide; CTC chr11 5155231 5155252 5155248 5155253 +
agtcttcttcagtctcattctt

SEQ ID NO: 71233 - DNA, 22 bp, Artificial Sequence
  Synthetic oligonucleotide; CTT chr11 5155237 5155258 5155254 5155259 +
cttcagtctcattcttcccatt

SEQ ID NO: 71234 - DNA, 22 bp, Artificial Sequence
  Synthetic oligonucleotide; TTC chr11 5155238 5155259 5155255 5155260 +
ttcagtctcattcttcccattt

SEQ ID NO: 71235 - DNA, 22 bp, Artificial Sequence
  Synthetic oligonucleotide; CTT chr11 5155240 5155261 5155257 5155262 +
cagtctcattcttcccatttta

SEQ ID NO: 71236 - DNA, 22 bp, Artificial Sequence
  Synthetic oligonucleotide; TTC chr11 5155241 5155262 5155258 5155263 +
agtctcattcttcccattttat

SEQ ID NO: 71237 - DNA, 22 bp, Artificial Sequence
  Synthetic oligonucleotide; CTC chr11 5155247 5155268 5155264 5155269 +
attcttcccattttattttatt

SEQ ID NO: 71238 - DNA, 22 bp, Artificial Sequence
  Synthetic oligonucleotide; TTC chr11 5155251 5155272 5155268 5155273 +
ttcccattttattttattgaag

SEQ ID NO: 71239 - DNA, 22 bp, Artificial Sequence
  Synthetic oligonucleotide; CTT chr11 5155253 5155274 5155270 5155275 +
cccattttattttattgaagtt

SEQ ID NO: 71240 - DNA, 22 bp, Artificial Sequence
  Synthetic oligonucleotide; TTC chr11 5155254 5155275 5155271 5155276 +
ccattttattttattgaagttt

SEQ ID NO: 71241 - DNA, 22 bp, Artificial Sequence
  Synthetic oligonucleotide; TTT chr11 5155260 5155281 5155277 5155282 +
tattttattgaagtttttttta

SEQ ID NO: 71242 - DNA, 22 bp, Artificial Sequence
  Synthetic oligonucleotide; TTT chr11 5155261 5155282 5155278 5155283 +
attttattgaagttttttttat

SEQ ID NO: 71243 - DNA, 22 bp, Artificial Sequence
  Synthetic oligonucleotide; TTA chr11 5155262 5155283 5155279 5155284 +
ttttattgaagttttttttatc

SEQ ID NO: 71244 - DNA, 22 bp, Artificial Sequence
  Synthetic oligonucleotide; TTT chr11 5155265 5155286 5155282 5155287 +
tattgaagttttttttatcttt

SEQ ID NO: 71245 - DNA, 22 bp, Artificial Sequence
  Synthetic oligonucleotide; TTT chr11 5155266 5155287 5155283 5155288 +
attgaagttttttttatctttt

SEQ ID NO: 71246 - DNA, 22 bp, Artificial Sequence
  Synthetic oligonucleotide; TTA chr11 5155267 5155288 5155284 5155289 +
ttgaagttttttttatctttta

SEQ ID NO: 71247 - DNA, 22 bp, Artificial Sequence
  Synthetic oligonucleotide; TTG chr11 5155270 5155291 5155287 5155292 +
aagttttttttatcttttagta

SEQ ID NO: 71248 - DNA, 22 bp, Artificial Sequence
  Synthetic oligonucleotide; TTT chr11 5155276 5155297 5155293 5155298 +
tttttatcttttagtaaattaa

SEQ ID NO: 71249 - DNA, 22 bp, Artificial Sequence
  Synthetic oligonucleotide; TTT chr11 5155277 5155298 5155294 5155299 +
ttttatcttttagtaaattaag

SEQ ID NO: 71250 - DNA, 22 bp, Artificial Sequence
  Synthetic oligonucleotide; TTT chr11 5155278 5155299 5155295 5155300 +
tttatcttttagtaaattaagt

SEQ ID NO: 71251 - DNA, 22 bp, Artificial Sequence
  Synthetic oligonucleotide; TTT chr11 5155279 5155300 5155296 5155301 +
ttatcttttagtaaattaagta

SEQ ID NO: 71252 - DNA, 22 bp, Artificial Sequence
  Synthetic oligonucleotide; TTT chr11 5155280 5155301 5155297 5155302 +
tatcttttagtaaattaagtaa

SEQ ID NO: 71253 - DNA, 22 bp, Artificial Sequence
  Synthetic oligonucleotide; TTT chr11 5155281 5155302 5155298 5155303 +
atcttttagtaaattaagtaac

SEQ ID NO: 71254 - DNA, 22 bp, Artificial Sequence
  Synthetic oligonucleotide; TTA chr11 5155282 5155303 5155299 5155304 +
tcttttagtaaattaagtaaca

SEQ ID NO: 71255 - DNA, 22 bp, Artificial Sequence
  Synthetic oligonucleotide; CTT chr11 5155286 5155307 5155303 5155308 +
ttagtaaattaagtaacattct

SEQ ID NO: 71256 - DNA, 22 bp, Artificial Sequence
  Synthetic oligonucleotide; TTT chr11 5155287 5155308 5155304 5155309 +
tagtaaattaagtaacattctt

SEQ ID NO: 71257 - DNA, 22 bp, Artificial Sequence
  Synthetic oligonucleotide; TTT chr11 5155288 5155309 5155305 5155310 +
agtaaattaagtaacattctta

SEQ ID NO: 71258 - DNA, 22 bp, Artificial Sequence
  Synthetic oligonucleotide; TTA chr11 5155289 5155310 5155306 5155311 +
gtaaattaagtaacattcttat

SEQ ID NO: 71259 - DNA, 22 bp, Artificial Sequence
  Synthetic oligonucleotide; TTA chr11 5155297 5155318 5155314 5155319 +
agtaacattcttatagtgacaa

SEQ ID NO: 71260 - DNA, 22 bp, Artificial Sequence
  Synthetic oligonucleotide; TTC chr11 5155307 5155328 5155324 5155329 +
ttatagtgacaaattataatgg

SEQ ID NO: 71261 - DNA, 22 bp, Artificial Sequence
  Synthetic oligonucleotide; CTT chr11 5155309 5155330 5155326 5155331 +
atagtgacaaattataatggac

SEQ ID NO: 71262 - DNA, 22 bp, Artificial Sequence
  Synthetic oligonucleotide; TTA chr11 5155310 5155331 5155327 5155332 +
tagtgacaaattataatggaca

SEQ ID NO: 71263 - DNA, 22 bp, Artificial Sequence
  Synthetic oligonucleotide; TTA chr11 5155323 5155344 5155340 5155345 +
taatggacatttctaagtccta

SEQ ID NO: 71264 - DNA, 22 bp, Artificial Sequence
  Synthetic oligonucleotide; TTT chr11 5155335 5155356 5155352 5155357 +
ctaagtcctacaaatgtaaagc

SEQ ID NO: 71265 - DNA, 22 bp, Artificial Sequence
  Synthetic oligonucleotide; TTC chr11 5155336 5155357 5155353 5155358 +
taagtcctacaaatgtaaagct

SEQ ID NO: 71266 - DNA, 22 bp, Artificial Sequence
  Synthetic oligonucleotide; CTA chr11 5155338 5155359 5155355 5155360 +
agtcctacaaatgtaaagctgg

SEQ ID NO: 71267 - DNA, 22 bp, Artificial Sequence
  Synthetic oligonucleotide; CTA chr11 5155345 5155366 5155362 5155367 +
caaatgtaaagctggaagcaag

SEQ ID NO: 71268 - DNA, 22 bp, Artificial Sequence
  Synthetic oligonucleotide; CTG chr11 5155359 5155380 5155376 5155381 +
gaagcaagttgttgaacatttg

SEQ ID NO: 71269 - DNA, 22 bp, Artificial Sequence
  Synthetic oligonucleotide; TTG chr11 5155370 5155391 5155387 5155392 +
ttgaacatttgagtaaactggt

SEQ ID NO: 71270 - DNA, 22 bp, Artificial Sequence
  Synthetic oligonucleotide; TTG chr11 5155373 5155394 5155390 5155395 +
aacatttgagtaaactggtatc

SEQ ID NO: 71271 - DNA, 22 bp, Artificial Sequence
  Synthetic oligonucleotide; TTT chr11 5155380 5155401 5155397 5155402 +
gagtaaactggtatccatttcc

SEQ ID NO: 71272 - DNA, 22 bp, Artificial Sequence
  Synthetic oligonucleotide; TTG chr11 5155381 5155402 5155398 5155403 +
agtaaactggtatccatttcct

SEQ ID NO: 71273 - DNA, 22 bp, Artificial Sequence
  Synthetic oligonucleotide; CTG chr11 5155390 5155411 5155407 5155412 +
gtatccatttcctcttttctct

SEQ ID NO: 71274 - DNA, 22 bp, Artificial Sequence
  Synthetic oligonucleotide; TTT chr11 5155400 5155421 5155417 5155422 +
cctcttttctctctttcttcct

SEQ ID NO: 71275 - DNA, 22 bp, Artificial Sequence
  Synthetic oligonucleotide; TTC chr11 5155401 5155422 5155418 5155423 +
ctcttttctctctttcttcctt

SEQ ID NO: 71276 - DNA, 22 bp, Artificial Sequence
  Synthetic oligonucleotide; CTC chr11 5155404 5155425 5155421 5155426 +
ttttctctctttcttccttgtt

SEQ ID NO: 71277 - DNA, 22 bp, Artificial Sequence
  Synthetic oligonucleotide; CTT chr11 5155406 5155427 5155423 5155428 +
ttctctctttcttccttgttac

SEQ ID NO: 71278 - DNA, 22 bp, Artificial Sequence
  Synthetic oligonucleotide; TTT chr11 5155407 5155428 5155424 5155429 +
tctctctttcttccttgttact

SEQ ID NO: 71279 - DNA, 22 bp, Artificial Sequence
  Synthetic oligonucleotide; TTT chr11 5155408 5155429 5155425 5155430 +
ctctctttcttccttgttactt

SEQ ID NO: 71280 - DNA, 22 bp, Artificial Sequence
  Synthetic oligonucleotide; TTC chr11 5155409 5155430 5155426 5155431 +
tctctttcttccttgttacttt

SEQ ID NO: 71281 - DNA, 22 bp, Artificial Sequence
  Synthetic oligonucleotide; CTC chr11 5155411 5155432 5155428 5155433 +
tctttcttccttgttactttcc

SEQ ID NO: 71282 - DNA, 22 bp, Artificial Sequence
  Synthetic oligonucleotide; CTC chr11 5155413 5155434 5155430 5155435 +
tttcttccttgttactttcctt

SEQ ID NO: 71283 - DNA, 22 bp, Artificial Sequence
  Synthetic oligonucleotide; CTT chr11 5155415 5155436 5155432 5155437 +
tcttccttgttactttccttcc

SEQ ID NO: 71284 - DNA, 22 bp, Artificial Sequence
  Synthetic oligonucleotide; TTT chr11 5155416 5155437 5155433 5155438 +
cttccttgttactttccttcct

SEQ ID NO: 71285 - DNA, 22 bp, Artificial Sequence
  Synthetic oligonucleotide; TTC chr11 5155417 5155438 5155434 5155439 +
ttccttgttactttccttcctt

SEQ ID NO: 71286 - DNA, 22 bp, Artificial Sequence
  Synthetic oligonucleotide; CTT chr11 5155419 5155440 5155436 5155441 +
ccttgttactttccttccttct

SEQ ID NO: 71287 - DNA, 22 bp, Artificial Sequence
  Synthetic oligonucleotide; TTC chr11 5155420 5155441 5155437 5155442 +
cttgttactttccttccttctt

SEQ ID NO: 71288 - DNA, 22 bp, Artificial Sequence
  Synthetic oligonucleotide; CTT chr11 5155423 5155444 5155440 5155445 +
gttactttccttccttcttttt

SEQ ID NO: 71289 - DNA, 22 bp, Artificial Sequence
  Synthetic oligonucleotide; TTG chr11 5155424 5155445 5155441 5155446 +
ttactttccttccttctttttc

SEQ ID NO: 71290 - DNA, 22 bp, Artificial Sequence
  Synthetic oligonucleotide; TTA chr11 5155427 5155448 5155444 5155449 +
ctttccttccttctttttcttt

SEQ ID NO: 71291 - DNA, 22 bp, Artificial Sequence
  Synthetic oligonucleotide; CTT chr11 5155430 5155451 5155447 5155452 +
tccttccttctttttctttcaa

SEQ ID NO: 71292 - DNA, 22 bp, Artificial Sequence
  Synthetic oligonucleotide; TTT chr11 5155431 5155452 5155448 5155453 +
ccttccttctttttctttcaaa

SEQ ID NO: 71293 - DNA, 22 bp, Artificial Sequence
  Synthetic oligonucleotide; TTC chr11 5155432 5155453 5155449 5155454 +
cttccttctttttctttcaaaa

SEQ ID NO: 71294 - DNA, 22 bp, Artificial Sequence
  Synthetic oligonucleotide; CTT chr11 5155435 5155456 5155452 5155457 +
ccttctttttctttcaaaaaac

SEQ ID NO: 71295 - DNA, 22 bp, Artificial Sequence
  Synthetic oligonucleotide; TTC chr11 5155436 5155457 5155453 5155458 +
cttctttttctttcaaaaaaca

SEQ ID NO: 71296 - DNA, 22 bp, Artificial Sequence
  Synthetic oligonucleotide; CTT chr11 5155439 5155460 5155456 5155461 +
ctttttctttcaaaaaacagtc

SEQ ID NO: 71297 - DNA, 22 bp, Artificial Sequence
  Synthetic oligonucleotide; TTC chr11 5155440 5155461 5155457 5155462 +
tttttctttcaaaaaacagtca

SEQ ID NO: 71298 - DNA, 22 bp, Artificial Sequence
  Synthetic oligonucleotide; CTT chr11 5155442 5155463 5155459 5155464 +
tttctttcaaaaaacagtcatt

SEQ ID NO: 71299 - DNA, 22 bp, Artificial Sequence
  Synthetic oligonucleotide; TTT chr11 5155443 5155464 5155460 5155465 +
ttctttcaaaaaacagtcatta

SEQ ID NO: 71300 - DNA, 22 bp, Artificial Sequence
  Synthetic oligonucleotide; TTT chr11 5155444 5155465 5155461 5155466 +
tctttcaaaaaacagtcattat

SEQ ID NO: 71301 - DNA, 22 bp, Artificial Sequence
  Synthetic oligonucleotide; TTT chr11 5155445 5155466 5155462 5155467 +
ctttcaaaaaacagtcattata

SEQ ID NO: 71302 - DNA, 22 bp, Artificial Sequence
  Synthetic oligonucleotide; TTC chr11 5155446 5155467 5155463 5155468 +
tttcaaaaaacagtcattatat

SEQ ID NO: 71303 - DNA, 22 bp, Artificial Sequence
  Synthetic oligonucleotide; CTT chr11 5155448 5155469 5155465 5155470 +
tcaaaaaacagtcattatattc

SEQ ID NO: 71304 - DNA, 22 bp, Artificial Sequence
  Synthetic oligonucleotide; TTT chr11 5155449 5155470 5155466 5155471 +
caaaaaacagtcattatattcc

SEQ ID NO: 71305 - DNA, 22 bp, Artificial Sequence
  Synthetic oligonucleotide; TTC chr11 5155450 5155471 5155467 5155472 +
aaaaaacagtcattatattcct

SEQ ID NO: 71306 - DNA, 22 bp, Artificial Sequence
  Synthetic oligonucleotide; TTA chr11 5155465 5155486 5155482 5155487 +
tattcctactatttatgagtga

SEQ ID NO: 71307 - DNA, 22 bp, Artificial Sequence
  Synthetic oligonucleotide; TTC chr11 5155470 5155491 5155487 5155492 +
ctactatttatgagtgagatgt

SEQ ID NO: 71308 - DNA, 22 bp, Artificial Sequence
  Synthetic oligonucleotide; CTA chr11 5155473 5155494 5155490 5155495 +
ctatttatgagtgagatgttat

SEQ ID NO: 71309 - DNA, 22 bp, Artificial Sequence
  Synthetic oligonucleotide; CTA chr11 5155476 5155497 5155493 5155498 +
tttatgagtgagatgttatata

SEQ ID NO: 71310 - DNA, 22 bp, Artificial Sequence
  Synthetic oligonucleotide; TTT chr11 5155479 5155500 5155496 5155501 +
atgagtgagatgttatatattc

SEQ ID NO: 71311 - DNA, 22 bp, Artificial Sequence
  Synthetic oligonucleotide; TTA chr11 5155480 5155501 5155497 5155502 +
tgagtgagatgttatatattct

SEQ ID NO: 71312 - DNA, 22 bp, Artificial Sequence
  Synthetic oligonucleotide; TTA chr11 5155494 5155515 5155511 5155516 +
tatattctaaatgaaatgaaaa

SEQ ID NO: 71313 - DNA, 22 bp, Artificial Sequence
  Synthetic oligonucleotide; TTC chr11 5155501 5155522 5155518 5155523 +
taaatgaaatgaaaaaaattat

SEQ ID NO: 71314 - DNA, 22 bp, Artificial Sequence
  Synthetic oligonucleotide; CTA chr11 5155503 5155524 5155520 5155525 +
aatgaaatgaaaaaaattatag

SEQ ID NO: 71315 - DNA, 22 bp, Artificial Sequence
  Synthetic oligonucleotide; TTA chr11 5155522 5155543 5155539 5155544 +
tagtcttacctttaaattatta

SEQ ID NO: 71316 - DNA, 22 bp, Artificial Sequence
  Synthetic oligonucleotide; CTT chr11 5155529 5155550 5155546 5155551 +
acctttaaattattagtaaaat

SEQ ID NO: 71317 - DNA, 22 bp, Artificial Sequence
  Synthetic oligonucleotide; TTA chr11 5155530 5155551 5155547 5155552 +
cctttaaattattagtaaaatg

SEQ ID NO: 71318 - DNA, 22 bp, Artificial Sequence
  Synthetic oligonucleotide; CTT chr11 5155534 5155555 5155551 5155556 +
taaattattagtaaaatgggat

SEQ ID NO: 71319 - DNA, 22 bp, Artificial Sequence
  Synthetic oligonucleotide; TTT chr11 5155535 5155556 5155552 5155557 +
aaattattagtaaaatgggatt

SEQ ID NO: 71320 - DNA, 22 bp, Artificial Sequence
  Synthetic oligonucleotide; TTA chr11 5155536 5155557 5155553 5155558 +
aattattagtaaaatgggatta

SEQ ID NO: 71321 - DNA, 22 bp, Artificial Sequence
  Synthetic oligonucleotide; TTA chr11 5155541 5155562 5155558 5155563 +
ttagtaaaatgggattatgcat

SEQ ID NO: 71322 - DNA, 22 bp, Artificial Sequence
  Synthetic oligonucleotide; TTA chr11 5155544 5155565 5155561 5155566 +
gtaaaatgggattatgcattac

SEQ ID NO: 71323 - DNA, 22 bp, Artificial Sequence
  Synthetic oligonucleotide; TTA chr11 5155558 5155579 5155575 5155580 +
tgcattacaatttcatttatca

SEQ ID NO: 71324 - DNA, 22 bp, Artificial Sequence
  Synthetic oligonucleotide; TTA chr11 5155565 5155586 5155582 5155587 +
caatttcatttatcacgtaagt

SEQ ID NO: 71325 - DNA, 22 bp, Artificial Sequence
  Synthetic oligonucleotide; TTT chr11 5155571 5155592 5155588 5155593 +
catttatcacgtaagtatctga

SEQ ID NO: 71326 - DNA, 22 bp, Artificial Sequence
  Synthetic oligonucleotide; TTC chr11 5155572 5155593 5155589 5155594 +
atttatcacgtaagtatctgat

SEQ ID NO: 71327 - DNA, 22 bp, Artificial Sequence
  Synthetic oligonucleotide; TTT chr11 5155576 5155597 5155593 5155598 +
atcacgtaagtatctgataaat

SEQ ID NO: 71328 - DNA, 22 bp, Artificial Sequence
  Synthetic oligonucleotide; TTA chr11 5155577 5155598 5155594 5155599 +
tcacgtaagtatctgataaatt

SEQ ID NO: 71329 - DNA, 22 bp, Artificial Sequence
  Synthetic oligonucleotide; CTG chr11 5155592 5155613 5155609 5155614 +
ataaattctaagcaagacttat

SEQ ID NO: 71330 - DNA, 22 bp, Artificial Sequence
  Synthetic oligonucleotide; TTC chr11 5155600 5155621 5155617 5155622 +
taagcaagacttatgcatatga

SEQ ID NO: 71331 - DNA, 22 bp, Artificial Sequence
  Synthetic oligonucleotide; CTA chr11 5155602 5155623 5155619 5155624 +
agcaagacttatgcatatgaca

SEQ ID NO: 71332 - DNA, 22 bp, Artificial Sequence
  Synthetic oligonucleotide; CTT chr11 5155612 5155633 5155629 5155634 +
atgcatatgacactattctcct

SEQ ID NO: 71333 - DNA, 22 bp, Artificial Sequence
  Synthetic oligonucleotide; TTA chr11 5155613 5155634 5155630 5155635 +
tgcatatgacactattctcctt

SEQ ID NO: 71334 - DNA, 22 bp, Artificial Sequence
  Synthetic oligonucleotide; CTA chr11 5155627 5155648 5155644 5155649 +
ttctccttgacattttacagct

SEQ ID NO: 71335 - DNA, 22 bp, Artificial Sequence
  Synthetic oligonucleotide; TTC chr11 5155630 5155651 5155647 5155652 +
tccttgacattttacagctggt

SEQ ID NO: 71336 - DNA, 22 bp, Artificial Sequence
  Synthetic oligonucleotide; CTC chr11 5155632 5155653 5155649 5155654 +
cttgacattttacagctggttt

SEQ ID NO: 71337 - DNA, 22 bp, Artificial Sequence
  Synthetic oligonucleotide; CTT chr11 5155635 5155656 5155652 5155657 +
gacattttacagctggtttcta

SEQ ID NO: 71338 - DNA, 22 bp, Artificial Sequence
  Synthetic oligonucleotide; TTG chr11 5155636 5155657 5155653 5155658 +
acattttacagctggtttctag

SEQ ID NO: 71339 - DNA, 22 bp, Artificial Sequence
  Synthetic oligonucleotide; TTT chr11 5155642 5155663 5155659 5155664 +
tacagctggtttctaggctttc

SEQ ID NO: 71340 - DNA, 22 bp, Artificial Sequence
  Synthetic oligonucleotide; TTT chr11 5155643 5155664 5155660 5155665 +
acagctggtttctaggctttct

SEQ ID NO: 71341 - DNA, 22 bp, Artificial Sequence
  Synthetic oligonucleotide; TTA chr11 5155644 5155665 5155661 5155666 +
cagctggtttctaggctttctt

SEQ ID NO: 71342 - DNA, 22 bp, Artificial Sequence
  Synthetic oligonucleotide; CTG chr11 5155650 5155671 5155667 5155672 +
gtttctaggctttcttgaatgt

SEQ ID NO: 71343 - DNA, 22 bp, Artificial Sequence
  Synthetic oligonucleotide; TTT chr11 5155654 5155675 5155671 5155676 +
ctaggctttcttgaatgtagct

SEQ ID NO: 71344 - DNA, 22 bp, Artificial Sequence
  Synthetic oligonucleotide; TTC chr11 5155655 5155676 5155672 5155677 +
taggctttcttgaatgtagcta

SEQ ID NO: 71345 - DNA, 22 bp, Artificial Sequence
  Synthetic oligonucleotide; CTA chr11 5155657 5155678 5155674 5155679 +
ggctttcttgaatgtagctaag

SEQ ID NO: 71346 - DNA, 22 bp, Artificial Sequence
  Synthetic oligonucleotide; CTT chr11 5155662 5155683 5155679 5155684 +
tcttgaatgtagctaagagaca

SEQ ID NO: 71347 - DNA, 22 bp, Artificial Sequence
  Synthetic oligonucleotide; TTT chr11 5155663 5155684 5155680 5155685 +
cttgaatgtagctaagagacac

SEQ ID NO: 71348 - DNA, 22 bp, Artificial Sequence
  Synthetic oligonucleotide; TTC chr11 5155664 5155685 5155681 5155686 +
ttgaatgtagctaagagacact

SEQ ID NO: 71349 - DNA, 22 bp, Artificial Sequence
  Synthetic oligonucleotide; CTT chr11 5155666 5155687 5155683 5155688 +
gaatgtagctaagagacacttg

SEQ ID NO: 71350 - DNA, 22 bp, Artificial Sequence
  Synthetic oligonucleotide; TTG chr11 5155667 5155688 5155684 5155689 +
aatgtagctaagagacacttga

SEQ ID NO: 71351 - DNA, 22 bp, Artificial Sequence
  Synthetic oligonucleotide; CTA chr11 5155677 5155698 5155694 5155699 +
agagacacttgatataatgttt

SEQ ID NO: 71352 - DNA, 22 bp, Artificial Sequence
  Synthetic oligonucleotide; CTT chr11 5155687 5155708 5155704 5155709 +
gatataatgtttagacattggc

SEQ ID NO: 71353 - DNA, 22 bp, Artificial Sequence
  Synthetic oligonucleotide; TTG chr11 5155688 5155709 5155705 5155710 +
atataatgtttagacattggca

SEQ ID NO: 71354 - DNA, 22 bp, Artificial Sequence
  Synthetic oligonucleotide; TTT chr11 5155699 5155720 5155716 5155721 +
agacattggcaaatttaggaag

SEQ ID NO: 71355 - DNA, 22 bp, Artificial Sequence
  Synthetic oligonucleotide; TTA chr11 5155700 5155721 5155717 5155722 +
gacattggcaaatttaggaagc

SEQ ID NO: 71356 - DNA, 22 bp, Artificial Sequence
  Synthetic oligonucleotide; TTG chr11 5155707 5155728 5155724 5155729 +
gcaaatttaggaagcatactaa

SEQ ID NO: 71357 - DNA, 22 bp, Artificial Sequence
  Synthetic oligonucleotide; TTT chr11 5155715 5155736 5155732 5155737 +
aggaagcatactaatggtggag

SEQ ID NO: 71358 - DNA, 22 bp, Artificial Sequence
  Synthetic oligonucleotide; TTA chr11 5155716 5155737 5155733 5155738 +
ggaagcatactaatggtggaga

SEQ ID NO: 71359 - DNA, 22 bp, Artificial Sequence
  Synthetic oligonucleotide; CTA chr11 5155728 5155749 5155745 5155750 +
atggtggagaatatttataatg

SEQ ID NO: 71360 - DNA, 22 bp, Artificial Sequence
  Synthetic oligonucleotide; TTT chr11 5155744 5155765 5155761 5155766 +
ataatggatttccaggagaaca

SEQ ID NO: 71361 - DNA, 22 bp, Artificial Sequence
  Synthetic oligonucleotide; TTA chr11 5155745 5155766 5155762 5155767 +
taatggatttccaggagaacaa

SEQ ID NO: 71362 - DNA, 22 bp, Artificial Sequence
  Synthetic oligonucleotide; TTT chr11 5155755 5155776 5155772 5155777 +
ccaggagaacaaggaatacaga

SEQ ID NO: 71363 - DNA, 22 bp, Artificial Sequence
  Synthetic oligonucleotide; TTC chr11 5155756 5155777 5155773 5155778 +
caggagaacaaggaatacagat

SEQ ID NO: 71364 - DNA, 22 bp, Artificial Sequence
  Synthetic oligonucleotide; CTC chr11 5155804 5155825 5155821 5155826 +
tttccagaatttcctctgtgaa

SEQ ID NO: 71365 - DNA, 22 bp, Artificial Sequence
  Synthetic oligonucleotide; CTT chr11 5155806 5155827 5155823 5155828 +
tccagaatttcctctgtgaagg

SEQ ID NO: 71366 - DNA, 22 bp, Artificial Sequence
  Synthetic oligonucleotide; TTT chr11 5155807 5155828 5155824 5155829 +
ccagaatttcctctgtgaagga

SEQ ID NO: 71367 - DNA, 22 bp, Artificial Sequence
  Synthetic oligonucleotide; TTC chr11 5155808 5155829 5155825 5155830 +
cagaatttcctctgtgaaggag

SEQ ID NO: 71368 - DNA, 22 bp, Artificial Sequence
  Synthetic oligonucleotide; TTT chr11 5155816 5155837 5155833 5155838 +
cctctgtgaaggagcataaaac

SEQ ID NO: 71369 - DNA, 22 bp, Artificial Sequence
  Synthetic oligonucleotide; TTC chr11 5155817 5155838 5155834 5155839 +
ctctgtgaaggagcataaaaca

SEQ ID NO: 71370 - DNA, 22 bp, Artificial Sequence
  Synthetic oligonucleotide; CTC chr11 5155820 5155841 5155837 5155842 +
tgtgaaggagcataaaacaata

SEQ ID NO: 71371 - DNA, 22 bp, Artificial Sequence
  Synthetic oligonucleotide; CTG chr11 5155822 5155843 5155839 5155844 +
tgaaggagcataaaacaatagt

SEQ ID NO: 71372 - DNA, 22 bp, Artificial Sequence
  Synthetic oligonucleotide; CTG chr11 5155848 5155869 5155865 5155870 +
ttgcatgttgaatgaaattgat

SEQ ID NO: 71373 - DNA, 22 bp, Artificial Sequence
  Synthetic oligonucleotide; TTG chr11 5155851 5155872 5155868 5155873 +
catgttgaatgaaattgattca

SEQ ID NO: 71374 - DNA, 22 bp, Artificial Sequence
  Synthetic oligonucleotide; TTG chr11 5155858 5155879 5155875 5155880 +
aatgaaattgattcagagagca

SEQ ID NO: 71375 - DNA, 22 bp, Artificial Sequence
  Synthetic oligonucleotide; TTG chr11 5155868 5155889 5155885 5155890 +
attcagagagcatataggcagc

SEQ ID NO: 71376 - DNA, 22 bp, Artificial Sequence
  Synthetic oligonucleotide; TTC chr11 5155872 5155893 5155889 5155894 +
agagagcatataggcagctaat

SEQ ID NO: 71377 - DNA, 22 bp, Artificial Sequence
  Synthetic oligonucleotide; CTA chr11 5155892 5155913 5155909 5155914 +
atctaatattcaggttattctt

SEQ ID NO: 71378 - DNA, 22 bp, Artificial Sequence
  Synthetic oligonucleotide; CTA chr11 5155897 5155918 5155914 5155919 +
atattcaggttattcttttgtc

SEQ ID NO: 71379 - DNA, 22 bp, Artificial Sequence
  Synthetic oligonucleotide; TTC chr11 5155903 5155924 5155920 5155925 +
aggttattcttttgtcactaag

SEQ ID NO: 71380 - DNA, 22 bp, Artificial Sequence
  Synthetic oligonucleotide; TTA chr11 5155909 5155930 5155926 5155931 +
ttcttttgtcactaagaaacaa

SEQ ID NO: 71381 - DNA, 22 bp, Artificial Sequence
  Synthetic oligonucleotide; TTC chr11 5155912 5155933 5155929 5155934 +
ttttgtcactaagaaacaattt

SEQ ID NO: 71382 - DNA, 22 bp, Artificial Sequence
  Synthetic oligonucleotide; CTT chr11 5155914 5155935 5155931 5155936 +
ttgtcactaagaaacaatttag

SEQ ID NO: 71383 - DNA, 22 bp, Artificial Sequence
  Synthetic oligonucleotide; TTT chr11 5155915 5155936 5155932 5155937 +
tgtcactaagaaacaatttaga

SEQ ID NO: 71384 - DNA, 22 bp, Artificial Sequence
  Synthetic oligonucleotide; TTT chr11 5155916 5155937 5155933 5155938 +
gtcactaagaaacaatttagac

SEQ ID NO: 71385 - DNA, 22 bp, Artificial Sequence
  Synthetic oligonucleotide; TTG chr11 5155917 5155938 5155934 5155939 +
tcactaagaaacaatttagact

SEQ ID NO: 71386 - DNA, 22 bp, Artificial Sequence
  Synthetic oligonucleotide; CTA chr11 5155923 5155944 5155940 5155945 +
agaaacaatttagactagtata

SEQ ID NO: 71387 - DNA, 22 bp, Artificial Sequence
  Synthetic oligonucleotide; TTT chr11 5155934 5155955 5155951 5155956 +
agactagtataccatttggttt

SEQ ID NO: 71388 - DNA, 22 bp, Artificial Sequence
  Synthetic oligonucleotide; TTA chr11 5155935 5155956 5155952 5155957 +
gactagtataccatttggtttc

SEQ ID NO: 71389 - DNA, 22 bp, Artificial Sequence
  Synthetic oligonucleotide; CTA chr11 5155940 5155961 5155957 5155962 +
gtataccatttggtttcttcct

SEQ ID NO: 71390 - DNA, 22 bp, Artificial Sequence
  Synthetic oligonucleotide; TTT chr11 5155951 5155972 5155968 5155973 +
ggtttcttcctcttctcttata

SEQ ID NO: 71391 - DNA, 22 bp, Artificial Sequence
  Synthetic oligonucleotide; TTG chr11 5155952 5155973 5155969 5155974 +
gtttcttcctcttctcttatac

SEQ ID NO: 71392 - DNA, 22 bp, Artificial Sequence
  Synthetic oligonucleotide; TTT chr11 5155956 5155977 5155973 5155978 +
cttcctcttctcttatactgat

SEQ ID NO: 71393 - DNA, 22 bp, Artificial Sequence
  Synthetic oligonucleotide; TTC chr11 5155957 5155978 5155974 5155979 +
ttcctcttctcttatactgatt

SEQ ID NO: 71394 - DNA, 22 bp, Artificial Sequence
  Synthetic oligonucleotide; CTT chr11 5155959 5155980 5155976 5155981 +
cctcttctcttatactgatttt

SEQ ID NO: 71395 - DNA, 22 bp, Artificial Sequence
  Synthetic oligonucleotide; TTC chr11 5155960 5155981 5155977 5155982 +
ctcttctcttatactgatttta

SEQ ID NO: 71396 - DNA, 22 bp, Artificial Sequence
  Synthetic oligonucleotide; CTC chr11 5155963 5155984 5155980 5155985 +
ttctcttatactgattttattt

SEQ ID NO: 71397 - DNA, 22 bp, Artificial Sequence
  Synthetic oligonucleotide; CTT chr11 5155965 5155986 5155982 5155987 +
ctcttatactgattttatttaa

SEQ ID NO: 71398 - DNA, 22 bp, Artificial Sequence
  Synthetic oligonucleotide; TTC chr11 5155966 5155987 5155983 5155988 +
tcttatactgattttatttaaa

SEQ ID NO: 71399 - DNA, 22 bp, Artificial Sequence
  Synthetic oligonucleotide; CTC chr11 5155968 5155989 5155985 5155990 +
ttatactgattttatttaaatt

SEQ ID NO: 71400 - DNA, 22 bp, Artificial Sequence
  Synthetic oligonucleotide; CTT chr11 5155970 5155991 5155987 5155992 +
atactgattttatttaaatttg

SEQ ID NO: 71401 - DNA, 22 bp, Artificial Sequence
  Synthetic oligonucleotide; TTA chr11 5155971 5155992 5155988 5155993 +
tactgattttatttaaatttgg

SEQ ID NO: 71402 - DNA, 22 bp, Artificial Sequence
  Synthetic oligonucleotide; CTG chr11 5155976 5155997 5155993 5155998 +
attttatttaaatttgggggct

SEQ ID NO: 71403 - DNA, 22 bp, Artificial Sequence
  Synthetic oligonucleotide; TTT chr11 5155980 5156001 5155997 5156002 +
tatttaaatttgggggctctcc

SEQ ID NO: 71404 - DNA, 22 bp, Artificial Sequence
  Synthetic oligonucleotide; TTT chr11 5155981 5156002 5155998 5156003 +
atttaaatttgggggctctcca

SEQ ID NO: 71405 - DNA, 22 bp, Artificial Sequence
  Synthetic oligonucleotide; TTA chr11 5155982 5156003 5155999 5156004 +
tttaaatttgggggctctccaa

SEQ ID NO: 71406 - DNA, 22 bp, Artificial Sequence
  Synthetic oligonucleotide; TTT chr11 5155985 5156006 5156002 5156007 +
aaatttgggggctctccaaagt

SEQ ID NO: 71407 - DNA, 22 bp, Artificial Sequence
  Synthetic oligonucleotide; TTA chr11 5155986 5156007 5156003 5156008 +
aatttgggggctctccaaagtt

SEQ ID NO: 71408 - DNA, 22 bp, Artificial Sequence
  Synthetic oligonucleotide; TTT chr11 5155991 5156012 5156008 5156013 +
gggggctctccaaagttctatc

SEQ ID NO: 71409 - DNA, 22 bp, Artificial Sequence
  Synthetic oligonucleotide; TTG chr11 5155992 5156013 5156009 5156014 +
ggggctctccaaagttctatct

SEQ ID NO: 71410 - DNA, 22 bp, Artificial Sequence
  Synthetic oligonucleotide; CTC chr11 5155999 5156020 5156016 5156021 +
tccaaagttctatcttgggtca

SEQ ID NO: 71411 - DNA, 22 bp, Artificial Sequence
  Synthetic oligonucleotide; CTC chr11 5156001 5156022 5156018 5156023 +
caaagttctatcttgggtcatt

SEQ ID NO: 71412 - DNA, 22 bp, Artificial Sequence
  Synthetic oligonucleotide; TTC chr11 5156009 5156030 5156026 5156031 +
tatcttgggtcatttcattcta

SEQ ID NO: 71413 - DNA, 22 bp, Artificial Sequence
  Synthetic oligonucleotide; CTA chr11 5156011 5156032 5156028 5156033 +
tcttgggtcatttcattctaaa

SEQ ID NO: 71414 - DNA, 22 bp, Artificial Sequence
  Synthetic oligonucleotide; CTT chr11 5156015 5156036 5156032 5156037 +
gggtcatttcattctaaaacta

SEQ ID NO: 71415 - DNA, 22 bp, Artificial Sequence
  Synthetic oligonucleotide; TTG chr11 5156016 5156037 5156033 5156038 +
ggtcatttcattctaaaactat

SEQ ID NO: 71416 - DNA, 22 bp, Artificial Sequence
  Synthetic oligonucleotide; TTT chr11 5156024 5156045 5156041 5156046 +
cattctaaaactattcacatgt

SEQ ID NO: 71417 - DNA, 22 bp, Artificial Sequence
  Synthetic oligonucleotide; TTC chr11 5156025 5156046 5156042 5156047 +
attctaaaactattcacatgtg

SEQ ID NO: 71418 - DNA, 22 bp, Artificial Sequence
  Synthetic oligonucleotide; TTC chr11 5156029 5156050 5156046 5156051 +
taaaactattcacatgtgctgg

SEQ ID NO: 71419 - DNA, 22 bp, Artificial Sequence
  Synthetic oligonucleotide; CTA chr11 5156031 5156052 5156048 5156053 +
aaactattcacatgtgctggtg

SEQ ID NO: 71420 - DNA, 22 bp, Artificial Sequence
  Synthetic oligonucleotide; CTA chr11 5156037 5156058 5156054 5156059 +
ttcacatgtgctggtgactcca

SEQ ID NO: 71421 - DNA, 22 bp, Artificial Sequence
  Synthetic oligonucleotide; TTC chr11 5156040 5156061 5156057 5156062 +
acatgtgctggtgactccatct

SEQ ID NO: 71422 - DNA, 22 bp, Artificial Sequence
  Synthetic oligonucleotide; CTG chr11 5156050 5156071 5156067 5156072 +
gtgactccatctactccaaata

SEQ ID NO: 71423 - DNA, 22 bp, Artificial Sequence
  Synthetic oligonucleotide; CTC chr11 5156057 5156078 5156074 5156079 +
catctactccaaataatttagt

SEQ ID NO: 71424 - DNA, 22 bp, Artificial Sequence
  Synthetic oligonucleotide; CTA chr11 5156063 5156084 5156080 5156085 +
ctccaaataatttagttgtcac

SEQ ID NO: 71425 - DNA, 22 bp, Artificial Sequence
  Synthetic oligonucleotide; CTC chr11 5156066 5156087 5156083 5156088 +
caaataatttagttgtcacctt

SEQ ID NO: 71426 - DNA, 22 bp, Artificial Sequence
  Synthetic oligonucleotide; TTT chr11 5156076 5156097 5156093 5156098 +
agttgtcaccttcatgtgctaa

SEQ ID NO: 71427 - DNA, 22 bp, Artificial Sequence
  Synthetic oligonucleotide; TTA chr11 5156077 5156098 5156094 5156099 +
gttgtcaccttcatgtgctaac

SEQ ID NO: 71428 - DNA, 22 bp, Artificial Sequence
  Synthetic oligonucleotide; TTG chr11 5156081 5156102 5156098 5156103 +
tcaccttcatgtgctaactcct

SEQ ID NO: 71429 - DNA, 22 bp, Artificial Sequence
  Synthetic oligonucleotide; CTT chr11 5156088 5156109 5156105 5156110 +
catgtgctaactcctataacaa

SEQ ID NO: 71430 - DNA, 22 bp, Artificial Sequence
  Synthetic oligonucleotide; TTC chr11 5156089 5156110 5156106 5156111 +
atgtgctaactcctataacaat

SEQ ID NO: 71431 - DNA, 22 bp, Artificial Sequence
  Synthetic oligonucleotide; CTA chr11 5156097 5156118 5156114 5156119 +
actcctataacaatatttccag

SEQ ID NO: 71432 - DNA, 22 bp, Artificial Sequence
  Synthetic oligonucleotide; CTC chr11 5156101 5156122 5156118 5156123 +
ctataacaatatttccagccca

SEQ ID NO: 71433 - DNA, 22 bp, Artificial Sequence
  Synthetic oligonucleotide; CTA chr11 5156104 5156125 5156121 5156126 +
taacaatatttccagcccagat

SEQ ID NO: 71434 - DNA, 22 bp, Artificial Sequence
  Synthetic oligonucleotide; TTT chr11 5156115 5156136 5156132 5156137 +
ccagcccagattttctccctct

SEQ ID NO: 71435 - DNA, 22 bp, Artificial Sequence
  Synthetic oligonucleotide; TTC chr11 5156116 5156137 5156133 5156138 +
cagcccagattttctccctctg

SEQ ID NO: 71436 - DNA, 22 bp, Artificial Sequence
  Synthetic oligonucleotide; TTT chr11 5156128 5156149 5156145 5156150 +
tctccctctgttccaagtacac

SEQ ID NO: 71437 - DNA, 22 bp, Artificial Sequence
  Synthetic oligonucleotide; TTT chr11 5156129 5156150 5156146 5156151 +
ctccctctgttccaagtacaca

SEQ ID NO: 71438 - DNA, 22 bp, Artificial Sequence
  Synthetic oligonucleotide; TTC chr11 5156130 5156151 5156147 5156152 +
tccctctgttccaagtacacag

SEQ ID NO: 71439 - DNA, 22 bp, Artificial Sequence
  Synthetic oligonucleotide; CTC chr11 5156132 5156153 5156149 5156154 +
cctctgttccaagtacacagga

SEQ ID NO: 71440 - DNA, 22 bp, Artificial Sequence
  Synthetic oligonucleotide; CTC chr11 5156136 5156157 5156153 5156158 +
tgttccaagtacacaggaacag

SEQ ID NO: 71441 - DNA, 22 bp, Artificial Sequence
  Synthetic oligonucleotide; CTG chr11 5156138 5156159 5156155 5156160 +
ttccaagtacacaggaacagca

SEQ ID NO: 71442 - DNA, 22 bp, Artificial Sequence
  Synthetic oligonucleotide; TTC chr11 5156141 5156162 5156158 5156163 +
caagtacacaggaacagcatgt

SEQ ID NO: 71443 - DNA, 22 bp, Artificial Sequence
  Synthetic oligonucleotide; CTG chr11 5156167 5156188 5156184 5156189 +
cccaaattttagtttatccctc

SEQ ID NO: 71444 - DNA, 22 bp, Artificial Sequence
  Synthetic oligonucleotide; TTT chr11 5156176 5156197 5156193 5156198 +
tagtttatccctcacatccttt

SEQ ID NO: 71445 - DNA, 22 bp, Artificial Sequence
  Synthetic oligonucleotide; TTT chr11 5156177 5156198 5156194 5156199 +
agtttatccctcacatcctttg

SEQ ID NO: 71446 - DNA, 22 bp, Artificial Sequence
  Synthetic oligonucleotide; TTA chr11 5156178 5156199 5156195 5156200 +
gtttatccctcacatcctttga

SEQ ID NO: 71447 - DNA, 22 bp, Artificial Sequence
  Synthetic oligonucleotide; TTT chr11 5156182 5156203 5156199 5156204 +
atccctcacatcctttgaaaca

SEQ ID NO: 71448 - DNA, 22 bp, Artificial Sequence
  Synthetic oligonucleotide; TTA chr11 5156183 5156204 5156200 5156205 +
tccctcacatcctttgaaacat

SEQ ID NO: 71449 - DNA, 22 bp, Artificial Sequence
  Synthetic oligonucleotide; CTC chr11 5156189 5156210 5156206 5156211 +
acatcctttgaaacattgtcaa

SEQ ID NO: 71450 - DNA, 22 bp, Artificial Sequence
  Synthetic oligonucleotide; CTT chr11 5156197 5156218 5156214 5156219 +
tgaaacattgtcaatgagttct

SEQ ID NO: 71451 - DNA, 22 bp, Artificial Sequence
  Synthetic oligonucleotide; TTT chr11 5156198 5156219 5156215 5156220 +
gaaacattgtcaatgagttcta

SEQ ID NO: 71452 - DNA, 22 bp, Artificial Sequence
  Synthetic oligonucleotide; TTG chr11 5156199 5156220 5156216 5156221 +
aaacattgtcaatgagttctac

SEQ ID NO: 71453 - DNA, 22 bp, Artificial Sequence
  Synthetic oligonucleotide; TTG chr11 5156207 5156228 5156224 5156229 +
tcaatgagttctacacttaatt

SEQ ID NO: 71454 - DNA, 22 bp, Artificial Sequence
  Synthetic oligonucleotide; TTC chr11 5156218 5156239 5156235 5156240 +
tacacttaattcaaggttattt

SEQ ID NO: 71455 - DNA, 22 bp, Artificial Sequence
  Synthetic oligonucleotide; CTA chr11 5156220 5156241 5156237 5156242 +
cacttaattcaaggttattttt

SEQ ID NO: 71456 - DNA, 22 bp, Artificial Sequence
  Synthetic oligonucleotide; CTT chr11 5156225 5156246 5156242 5156247 +
aattcaaggttatttttttttc

SEQ ID NO: 71457 - DNA, 22 bp, Artificial Sequence
  Synthetic oligonucleotide; TTA chr11 5156226 5156247 5156243 5156248 +
attcaaggttatttttttttca

SEQ ID NO: 71458 - DNA, 22 bp, Artificial Sequence
  Synthetic oligonucleotide; TTC chr11 5156230 5156251 5156247 5156252 +
aaggttatttttttttcattgt

SEQ ID NO: 71459 - DNA, 22 bp, Artificial Sequence
  Synthetic oligonucleotide; TTA chr11 5156237 5156258 5156254 5156259 +
tttttttttcattgtacttgta

SEQ ID NO: 71460 - DNA, 22 bp, Artificial Sequence
  Synthetic oligonucleotide; TTT chr11 5156240 5156261 5156257 5156262 +
ttttttcattgtacttgtaaat

SEQ ID NO: 71461 - DNA, 22 bp, Artificial Sequence
  Synthetic oligonucleotide; TTT chr11 5156241 5156262 5156258 5156263 +
tttttcattgtacttgtaaata

SEQ ID NO: 71462 - DNA, 22 bp, Artificial Sequence
  Synthetic oligonucleotide; TTT chr11 5156242 5156263 5156259 5156264 +
ttttcattgtacttgtaaatat

SEQ ID NO: 71463 - DNA, 22 bp, Artificial Sequence
  Synthetic oligonucleotide; TTT chr11 5156243 5156264 5156260 5156265 +
tttcattgtacttgtaaatatt

SEQ ID NO: 71464 - DNA, 22 bp, Artificial Sequence
  Synthetic oligonucleotide; TTT chr11 5156244 5156265 5156261 5156266 +
ttcattgtacttgtaaatattg

SEQ ID NO: 71465 - DNA, 22 bp, Artificial Sequence
  Synthetic oligonucleotide; TTT chr11 5156245 5156266 5156262 5156267 +
tcattgtacttgtaaatattgg

SEQ ID NO: 71466 - DNA, 22 bp, Artificial Sequence
  Synthetic oligonucleotide; TTT chr11 5156246 5156267 5156263 5156268 +
cattgtacttgtaaatattgga

SEQ ID NO: 71467 - DNA, 22 bp, Artificial Sequence
  Synthetic oligonucleotide; TTC chr11 5156247 5156268 5156264 5156269 +
attgtacttgtaaatattggaa

SEQ ID NO: 71468 - DNA, 22 bp, Artificial Sequence
  Synthetic oligonucleotide; TTG chr11 5156251 5156272 5156268 5156273 +
tacttgtaaatattggaagact

SEQ ID NO: 71469 - DNA, 22 bp, Artificial Sequence
  Synthetic oligonucleotide; CTT chr11 5156256 5156277 5156273 5156278 +
gtaaatattggaagacttttac

SEQ ID NO: 71470 - DNA, 22 bp, Artificial Sequence
  Synthetic oligonucleotide; TTG chr11 5156257 5156278 5156274 5156279 +
taaatattggaagacttttaca

SEQ ID NO: 71471 - DNA, 22 bp, Artificial Sequence
  Synthetic oligonucleotide; TTG chr11 5156266 5156287 5156283 5156288 +
gaagacttttacatatgcatca

SEQ ID NO: 71472 - DNA, 22 bp, Artificial Sequence
  Synthetic oligonucleotide; CTT chr11 5156274 5156295 5156291 5156296 +
ttacatatgcatcaataactat

SEQ ID NO: 71473 - DNA, 22 bp, Artificial Sequence
  Synthetic oligonucleotide; TTT chr11 5156275 5156296 5156292 5156297 +
tacatatgcatcaataactatc

SEQ ID NO: 71474 - DNA, 22 bp, Artificial Sequence
  Synthetic oligonucleotide; TTT chr11 5156276 5156297 5156293 5156298 +
acatatgcatcaataactatct

SEQ ID NO: 71475 - DNA, 22 bp, Artificial Sequence
  Synthetic oligonucleotide; TTA chr11 5156277 5156298 5156294 5156299 +
catatgcatcaataactatctc

SEQ ID NO: 71476 - DNA, 22 bp, Artificial Sequence
  Synthetic oligonucleotide; CTA chr11 5156295 5156316 5156312 5156317 +
tctctggatttttttagctagt

SEQ ID NO: 71477 - DNA, 22 bp, Artificial Sequence
  Synthetic oligonucleotide; CTC chr11 5156299 5156320 5156316 5156321 +
tggatttttttagctagtctac

SEQ ID NO: 71478 - DNA, 22 bp, Artificial Sequence
  Synthetic oligonucleotide; CTG chr11 5156301 5156322 5156318 5156323 +
gatttttttagctagtctacta

SEQ ID NO: 71479 - DNA, 22 bp, Artificial Sequence
  Synthetic oligonucleotide; TTT chr11 5156306 5156327 5156323 5156328 +
ttttagctagtctactaaattt

SEQ ID NO: 71480 - DNA, 22 bp, Artificial Sequence
  Synthetic oligonucleotide; TTT chr11 5156307 5156328 5156324 5156329 +
tttagctagtctactaaatttt

SEQ ID NO: 71481 - DNA, 22 bp, Artificial Sequence
  Synthetic oligonucleotide; TTT chr11 5156308 5156329 5156325 5156330 +
ttagctagtctactaaattttt

SEQ ID NO: 71482 - DNA, 22 bp, Artificial Sequence
  Synthetic oligonucleotide; TTT chr11 5156309 5156330 5156326 5156331 +
tagctagtctactaaatttttt

SEQ ID NO: 71483 - DNA, 22 bp, Artificial Sequence
  Synthetic oligonucleotide; TTT chr11 5156310 5156331 5156327 5156332 +
agctagtctactaaattttttt

SEQ ID NO: 71484 - DNA, 22 bp, Artificial Sequence
  Synthetic oligonucleotide; TTA chr11 5156311 5156332 5156328 5156333 +
gctagtctactaaatttttttt

SEQ ID NO: 71485 - DNA, 22 bp, Artificial Sequence
  Synthetic oligonucleotide; CTA chr11 5156315 5156336 5156332 5156337 +
gtctactaaattttttttttct

SEQ ID NO: 71486 - DNA, 22 bp, Artificial Sequence
  Synthetic oligonucleotide; CTA chr11 5156320 5156341 5156337 5156342 +
ctaaattttttttttctttttt

SEQ ID NO: 71487 - DNA, 22 bp, Artificial Sequence
  Synthetic oligonucleotide; CTA chr11 5156323 5156344 5156340 5156345 +
aattttttttttcttttttttg

SEQ ID NO: 71488 - DNA, 22 bp, Artificial Sequence
  Synthetic oligonucleotide; TTT chr11 5156328 5156349 5156345 5156350 +
tttttttcttttttttgagaca

SEQ ID NO: 71489 - DNA, 22 bp, Artificial Sequence
  Synthetic oligonucleotide; TTT chr11 5156329 5156350 5156346 5156351 +
ttttttcttttttttgagacag

SEQ ID NO: 71490 - DNA, 22 bp, Artificial Sequence
  Synthetic oligonucleotide; TTT chr11 5156330 5156351 5156347 5156352 +
tttttcttttttttgagacaga

SEQ ID NO: 71491 - DNA, 22 bp, Artificial Sequence
  Synthetic oligonucleotide; TTT chr11 5156331 5156352 5156348 5156353 +
ttttcttttttttgagacagag

SEQ ID NO: 71492 - DNA, 22 bp, Artificial Sequence
  Synthetic oligonucleotide; TTT chr11 5156332 5156353 5156349 5156354 +
tttcttttttttgagacagagt

SEQ ID NO: 71493 - DNA, 22 bp, Artificial Sequence
  Synthetic oligonucleotide; TTT chr11 5156333 5156354 5156350 5156355 +
ttcttttttttgagacagagtc

SEQ ID NO: 71494 - DNA, 22 bp, Artificial Sequence
  Synthetic oligonucleotide; TTT chr11 5156334 5156355 5156351 5156356 +
tcttttttttgagacagagtct

SEQ ID NO: 71495 - DNA, 22 bp, Artificial Sequence
  Synthetic oligonucleotide; TTT chr11 5156335 5156356 5156352 5156357 +
cttttttttgagacagagtctc

SEQ ID NO: 71496 - DNA, 22 bp, Artificial Sequence
  Synthetic oligonucleotide; TTC chr11 5156336 5156357 5156353 5156358 +
ttttttttgagacagagtctct

SEQ ID NO: 71497 - DNA, 22 bp, Artificial Sequence
  Synthetic oligonucleotide; CTT chr11 5156338 5156359 5156355 5156360 +
ttttttgagacagagtctctct

SEQ ID NO: 71498 - DNA, 22 bp, Artificial Sequence
  Synthetic oligonucleotide; TTT chr11 5156339 5156360 5156356 5156361 +
tttttgagacagagtctctctc

SEQ ID NO: 71499 - DNA, 22 bp, Artificial Sequence
  Synthetic oligonucleotide; TTT chr11 5156340 5156361 5156357 5156362 +
ttttgagacagagtctctctct

SEQ ID NO: 71500 - DNA, 22 bp, Artificial Sequence
  Synthetic oligonucleotide; TTT chr11 5156341 5156362 5156358 5156363 +
tttgagacagagtctctctctg

SEQ ID NO: 71501 - DNA, 22 bp, Artificial Sequence
  Synthetic oligonucleotide; TTT chr11 5156342 5156363 5156359 5156364 +
ttgagacagagtctctctctgt

SEQ ID NO: 71502 - DNA, 22 bp, Artificial Sequence
  Synthetic oligonucleotide; TTT chr11 5156343 5156364 5156360 5156365 +
tgagacagagtctctctctgtc

SEQ ID NO: 71503 - DNA, 22 bp, Artificial Sequence
  Synthetic oligonucleotide; TTT chr11 5156344 5156365 5156361 5156366 +
gagacagagtctctctctgtcg

SEQ ID NO: 71504 - DNA, 22 bp, Artificial Sequence
  Synthetic oligonucleotide; TTG chr11 5156345 5156366 5156362 5156367 +
agacagagtctctctctgtcgc

SEQ ID NO: 71505 - DNA, 22 bp, Artificial Sequence
  Synthetic oligonucleotide; CTC chr11 5156357 5156378 5156374 5156379 +
tctctgtcgcccaggctggagt

SEQ ID NO: 71506 - DNA, 22 bp, Artificial Sequence
  Synthetic oligonucleotide; CTC chr11 5156359 5156380 5156376 5156381 +
tctgtcgcccaggctggagtgc

SEQ ID NO: 71507 - DNA, 22 bp, Artificial Sequence
  Synthetic oligonucleotide; CTC chr11 5156361 5156382 5156378 5156383 +
tgtcgcccaggctggagtgcag

SEQ ID NO: 71508 - DNA, 22 bp, Artificial Sequence
  Synthetic oligonucleotide; CTG chr11 5156363 5156384 5156380 5156385 +
tcgcccaggctggagtgcagtg

SEQ ID NO: 71509 - DNA, 22 bp, Artificial Sequence
  Synthetic oligonucleotide; CTG chr11 5156375 5156396 5156392 5156397 +
gagtgcagtggcccctgatctc

SEQ ID NO: 71510 - DNA, 22 bp, Artificial Sequence
  Synthetic oligonucleotide; CTG chr11 5156392 5156413 5156409 5156414 +
atctctgctcactgcaagctcc

SEQ ID NO: 71511 - DNA, 22 bp, Artificial Sequence
  Synthetic oligonucleotide; CTC chr11 5156397 5156418 5156414 5156419 +
tgctcactgcaagctccgcccc

SEQ ID NO: 71512 - DNA, 22 bp, Artificial Sequence
  Synthetic oligonucleotide; CTG chr11 5156399 5156420 5156416 5156421 +
ctcactgcaagctccgcccccc

SEQ ID NO: 71513 - DNA, 22 bp, Artificial Sequence
  Synthetic oligonucleotide; CTC chr11 5156402 5156423 5156419 5156424 +
actgcaagctccgccccccgcg

SEQ ID NO: 71514 - DNA, 22 bp, Artificial Sequence
  Synthetic oligonucleotide; CTG chr11 5156406 5156427 5156423 5156428 +
caagctccgccccccgcgttca

SEQ ID NO: 71515 - DNA, 22 bp, Artificial Sequence
  Synthetic oligonucleotide; CTC chr11 5156413 5156434 5156430 5156435 +
cgccccccgcgttcacgccatt

SEQ ID NO: 71516 - DNA, 22 bp, Artificial Sequence
  Synthetic oligonucleotide; TTC chr11 5156427 5156448 5156444 5156449 +
acgccattctcccgcctcagcc

SEQ ID NO: 71517 - DNA, 22 bp, Artificial Sequence
  Synthetic oligonucleotide; TTC chr11 5156436 5156457 5156453 5156458 +
tcccgcctcagcctccatagta

SEQ ID NO: 71518 - DNA, 22 bp, Artificial Sequence
  Synthetic oligonucleotide; CTC chr11 5156438 5156459 5156455 5156460 +
ccgcctcagcctccatagtagc

SEQ ID NO: 71519 - DNA, 22 bp, Artificial Sequence
  Synthetic oligonucleotide; CTC chr11 5156445 5156466 5156462 5156467 +
agcctccatagtagctgggact

SEQ ID NO: 71520 - DNA, 22 bp, Artificial Sequence
  Synthetic oligonucleotide; CTC chr11 5156451 5156472 5156468 5156473 +
catagtagctgggactacaggc

SEQ ID NO: 71521 - DNA, 22 bp, Artificial Sequence
  Synthetic oligonucleotide; CTG chr11 5156462 5156483 5156479 5156484 +
ggactacaggcacccgccacca

SEQ ID NO: 71522 - DNA, 22 bp, Artificial Sequence
  Synthetic oligonucleotide; CTA chr11 5156468 5156489 5156485 5156490 +
caggcacccgccaccaagcccg

SEQ ID NO: 71523 - DNA, 22 bp, Artificial Sequence
  Synthetic oligonucleotide; CTA chr11 5156494 5156515 5156511 5156516 +
attttttgtatttttttagtag

SEQ ID NO: 71524 - DNA, 22 bp, Artificial Sequence
  Synthetic oligonucleotide; TTT chr11 5156498 5156519 5156515 5156520 +
tttgtatttttttagtagagac

SEQ ID NO: 71525 - DNA, 22 bp, Artificial Sequence
  Synthetic oligonucleotide; TTT chr11 5156499 5156520 5156516 5156521 +
ttgtatttttttagtagagacg

SEQ ID NO: 71526 - DNA, 22 bp, Artificial Sequence
  Synthetic oligonucleotide; TTT chr11 5156500 5156521 5156517 5156522 +
tgtatttttttagtagagacgg

SEQ ID NO: 71527 - DNA, 22 bp, Artificial Sequence
  Synthetic oligonucleotide; TTT chr11 5156501 5156522 5156518 5156523 +
gtatttttttagtagagacggg

SEQ ID NO: 71528 - DNA, 22 bp, Artificial Sequence
  Synthetic oligonucleotide; TTG chr11 5156502 5156523 5156519 5156524 +
tatttttttagtagagacgggg

SEQ ID NO: 71529 - DNA, 22 bp, Artificial Sequence
  Synthetic oligonucleotide; TTT chr11 5156507 5156528 5156524 5156529 +
ttttagtagagacggggtttca

SEQ ID NO: 71530 - DNA, 22 bp, Artificial Sequence
  Synthetic oligonucleotide; TTT chr11 5156508 5156529 5156525 5156530 +
tttagtagagacggggtttcac

SEQ ID NO: 71531 - DNA, 22 bp, Artificial Sequence
  Synthetic oligonucleotide; TTT chr11 5156509 5156530 5156526 5156531 +
ttagtagagacggggtttcact

SEQ ID NO: 71532 - DNA, 22 bp, Artificial Sequence
  Synthetic oligonucleotide; TTT chr11 5156510 5156531 5156527 5156532 +
tagtagagacggggtttcactg

SEQ ID NO: 71533 - DNA, 22 bp, Artificial Sequence
  Synthetic oligonucleotide; TTT chr11 5156511 5156532 5156528 5156533 +
agtagagacggggtttcactgt

SEQ ID NO: 71534 - DNA, 22 bp, Artificial Sequence
  Synthetic oligonucleotide; TTA chr11 5156512 5156533 5156529 5156534 +
gtagagacggggtttcactgtg

SEQ ID NO: 71535 - DNA, 22 bp, Artificial Sequence
  Synthetic oligonucleotide; TTT chr11 5156527 5156548 5156544 5156549 +
cactgtgttagccaggatggtc

SEQ ID NO: 71536 - DNA, 22 bp, Artificial Sequence
  Synthetic oligonucleotide; TTC chr11 5156528 5156549 5156545 5156550 +
actgtgttagccaggatggtct

SEQ ID NO: 71537 - DNA, 22 bp, Artificial Sequence
  Synthetic oligonucleotide; CTG chr11 5156532 5156553 5156549 5156554 +
tgttagccaggatggtctcgat

SEQ ID NO: 71538 - DNA, 22 bp, Artificial Sequence
  Synthetic oligonucleotide; TTA chr11 5156537 5156558 5156554 5156559 +
gccaggatggtctcgatctcgc

SEQ ID NO: 71539 - DNA, 22 bp, Artificial Sequence
  Synthetic oligonucleotide; CTC chr11 5156551 5156572 5156568 5156573 +
gatctcgcgacctcgtgatcca

SEQ ID NO: 71540 - DNA, 22 bp, Artificial Sequence
  Synthetic oligonucleotide; CTC chr11 5156557 5156578 5156574 5156579 +
gcgacctcgtgatccacccgcc

SEQ ID NO: 71541 - DNA, 22 bp, Artificial Sequence
  Synthetic oligonucleotide; CTC chr11 5156565 5156586 5156582 5156587 +
gtgatccacccgcctccgcctc

SEQ ID NO: 71542 - DNA, 22 bp, Artificial Sequence
  Synthetic oligonucleotide; CTC chr11 5156581 5156602 5156598 5156603 +
cgcctcccaaagtgctgggatc

SEQ ID NO: 71543 - DNA, 22 bp, Artificial Sequence
  Synthetic oligonucleotide; CTC chr11 5156587 5156608 5156604 5156609 +
ccaaagtgctgggatcacaggc

SEQ ID NO: 71544 - DNA, 22 bp, Artificial Sequence
  Synthetic oligonucleotide; CTG chr11 5156598 5156619 5156615 5156620 +
ggatcacaggcgtgagccactg

SEQ ID NO: 71545 - DNA, 22 bp, Artificial Sequence
  Synthetic oligonucleotide; CTG chr11 5156620 5156641 5156637 5156642 +
cacccggcctactgaatatttt

SEQ ID NO: 71546 - DNA, 22 bp, Artificial Sequence
  Synthetic oligonucleotide; CTA chr11 5156631 5156652 5156648 5156653 +
ctgaatattttttaaatttatt

SEQ ID NO: 71547 - DNA, 22 bp, Artificial Sequence
  Synthetic oligonucleotide; CTG chr11 5156634 5156655 5156651 5156656 +
aatattttttaaatttattttt

SEQ ID NO: 71548 - DNA, 22 bp, Artificial Sequence
  Synthetic oligonucleotide; TTT chr11 5156641 5156662 5156658 5156663 +
tttaaatttatttttattaagg

SEQ ID NO: 71549 - DNA, 22 bp, Artificial Sequence
  Synthetic oligonucleotide; TTT chr11 5156642 5156663 5156659 5156664 +
ttaaatttatttttattaaggt

SEQ ID NO: 71550 - DNA, 22 bp, Artificial Sequence
  Synthetic oligonucleotide; TTT chr11 5156643 5156664 5156660 5156665 +
taaatttatttttattaaggta

SEQ ID NO: 71551 - DNA, 22 bp, Artificial Sequence
  Synthetic oligonucleotide; TTT chr11 5156644 5156665 5156661 5156666 +
aaatttatttttattaaggtaa

SEQ ID NO: 71552 - DNA, 22 bp, Artificial Sequence
  Synthetic oligonucleotide; TTA chr11 5156645 5156666 5156662 5156667 +
aatttatttttattaaggtaaa

SEQ ID NO: 71553 - DNA, 22 bp, Artificial Sequence
  Synthetic oligonucleotide; TTT chr11 5156650 5156671 5156667 5156672 +
atttttattaaggtaaaatata

SEQ ID NO: 71554 - DNA, 22 bp, Artificial Sequence
  Synthetic oligonucleotide; TTA chr11 5156651 5156672 5156668 5156673 +
tttttattaaggtaaaatatac

SEQ ID NO: 71555 - DNA, 22 bp, Artificial Sequence
  Synthetic oligonucleotide; TTT chr11 5156654 5156675 5156671 5156676 +
ttattaaggtaaaatatacata

SEQ ID NO: 71556 - DNA, 22 bp, Artificial Sequence
  Synthetic oligonucleotide; TTT chr11 5156655 5156676 5156672 5156677 +
tattaaggtaaaatatacatac

SEQ ID NO: 71557 - DNA, 22 bp, Artificial Sequence
  Synthetic oligonucleotide; TTT chr11 5156656 5156677 5156673 5156678 +
attaaggtaaaatatacatacg

SEQ ID NO: 71558 - DNA, 22 bp, Artificial Sequence
  Synthetic oligonucleotide; TTA chr11 5156657 5156678 5156674 5156679 +
ttaaggtaaaatatacatacgt

SEQ ID NO: 71559 - DNA, 22 bp, Artificial Sequence
  Synthetic oligonucleotide; TTA chr11 5156660 5156681 5156677 5156682 +
aggtaaaatatacatacgtaat

SEQ ID NO: 71560 - DNA, 22 bp, Artificial Sequence
  Synthetic oligonucleotide; TTT chr11 5156684 5156705 5156701 5156706 +
accgtctttacttttttttttt

SEQ ID NO: 71561 - DNA, 22 bp, Artificial Sequence
  Synthetic oligonucleotide; TTA chr11 5156685 5156706 5156702 5156707 +
ccgtctttactttttttttttc

SEQ ID NO: 71562 - DNA, 22 bp, Artificial Sequence
  Synthetic oligonucleotide; CTT chr11 5156692 5156713 5156709 5156714 +
tactttttttttttccttgaga

SEQ ID NO: 71563 - DNA, 22 bp, Artificial Sequence
  Synthetic oligonucleotide; TTT chr11 5156693 5156714 5156710 5156715 +
actttttttttttccttgagac

SEQ ID NO: 71564 - DNA, 22 bp, Artificial Sequence
  Synthetic oligonucleotide; TTA chr11 5156694 5156715 5156711 5156716 +
ctttttttttttccttgagacg

SEQ ID NO: 71565 - DNA, 22 bp, Artificial Sequence
  Synthetic oligonucleotide; CTT chr11 5156697 5156718 5156714 5156719 +
tttttttttccttgagacggag

SEQ ID NO: 71566 - DNA, 22 bp, Artificial Sequence
  Synthetic oligonucleotide; TTT chr11 5156698 5156719 5156715 5156720 +
ttttttttccttgagacggagt

SEQ ID NO: 71567 - DNA, 22 bp, Artificial Sequence
  Synthetic oligonucleotide; TTT chr11 5156699 5156720 5156716 5156721 +
tttttttccttgagacggagtc

SEQ ID NO: 71568 - DNA, 22 bp, Artificial Sequence
  Synthetic oligonucleotide; TTT chr11 5156700 5156721 5156717 5156722 +
ttttttccttgagacggagtct

SEQ ID NO: 71569 - DNA, 22 bp, Artificial Sequence
  Synthetic oligonucleotide; TTT chr11 5156701 5156722 5156718 5156723 +
tttttccttgagacggagtctc

SEQ ID NO: 71570 - DNA, 22 bp, Artificial Sequence
  Synthetic oligonucleotide; TTT chr11 5156702 5156723 5156719 5156724 +
ttttccttgagacggagtctcg

SEQ ID NO: 71571 - DNA, 22 bp, Artificial Sequence
  Synthetic oligonucleotide; TTT chr11 5156703 5156724 5156720 5156725 +
tttccttgagacggagtctcgc

SEQ ID NO: 71572 - DNA, 22 bp, Artificial Sequence
  Synthetic oligonucleotide; TTT chr11 5156704 5156725 5156721 5156726 +
ttccttgagacggagtctcgct

SEQ ID NO: 71573 - DNA, 22 bp, Artificial Sequence
  Synthetic oligonucleotide; TTT chr11 5156705 5156726 5156722 5156727 +
tccttgagacggagtctcgctc

SEQ ID NO: 71574 - DNA, 22 bp, Artificial Sequence
  Synthetic oligonucleotide; TTT chr11 5156706 5156727 5156723 5156728 +
ccttgagacggagtctcgctcc

SEQ ID NO: 71575 - DNA, 22 bp, Artificial Sequence
  Synthetic oligonucleotide; TTC chr11 5156707 5156728 5156724 5156729 +
cttgagacggagtctcgctccg

SEQ ID NO: 71576 - DNA, 22 bp, Artificial Sequence
  Synthetic oligonucleotide; CTT chr11 5156710 5156731 5156727 5156732 +
gagacggagtctcgctccgtca

SEQ ID NO: 71577 - DNA, 22 bp, Artificial Sequence
  Synthetic oligonucleotide; TTG chr11 5156711 5156732 5156728 5156733 +
agacggagtctcgctccgtcat

SEQ ID NO: 71578 - DNA, 22 bp, Artificial Sequence
  Synthetic oligonucleotide; CTC chr11 5156723 5156744 5156740 5156745 +
gctccgtcatccaggctggagt

SEQ ID NO: 71579 - DNA, 22 bp, Artificial Sequence
  Synthetic oligonucleotide; CTC chr11 5156727 5156748 5156744 5156749 +
cgtcatccaggctggagtgcag

SEQ ID NO: 71580 - DNA, 22 bp, Artificial Sequence
  Synthetic oligonucleotide; CTG chr11 5156741 5156762 5156758 5156763 +
gagtgcagtggtaggatcttgg

SEQ ID NO: 71581 - DNA, 22 bp, Artificial Sequence
  Synthetic oligonucleotide; CTT chr11 5156761 5156782 5156778 5156783 +
ggctcactgcaacctccgcccc

SEQ ID NO: 71582 - DNA, 22 bp, Artificial Sequence
  Synthetic oligonucleotide; TTG chr11 5156762 5156783 5156779 5156784 +
gctcactgcaacctccgccccc

SEQ ID NO: 71583 - DNA, 22 bp, Artificial Sequence
  Synthetic oligonucleotide; CTC chr11 5156766 5156787 5156783 5156788 +
actgcaacctccgcccccacca

SEQ ID NO: 71584 - DNA, 22 bp, Artificial Sequence
  Synthetic oligonucleotide; CTG chr11 5156770 5156791 5156787 5156792 +
caacctccgcccccaccaggtt

SEQ ID NO: 71585 - DNA, 22 bp, Artificial Sequence
  Synthetic oligonucleotide; CTC chr11 5156777 5156798 5156794 5156799 +
cgcccccaccaggttcaagcga

SEQ ID NO: 71586 - DNA, 22 bp, Artificial Sequence
  Synthetic oligonucleotide; TTC chr11 5156793 5156814 5156810 5156815 +
aagcgattctcctgcccaagcc

SEQ ID NO: 71587 - DNA, 22 bp, Artificial Sequence
  Synthetic oligonucleotide; TTC chr11 5156802 5156823 5156819 5156824 +
tcctgcccaagcctcccaagta

SEQ ID NO: 71588 - DNA, 22 bp, Artificial Sequence
  Synthetic oligonucleotide; CTC chr11 5156804 5156825 5156821 5156826 +
ctgcccaagcctcccaagtagg

SEQ ID NO: 71589 - DNA, 22 bp, Artificial Sequence
  Synthetic oligonucleotide; CTG chr11 5156807 5156828 5156824 5156829 +
cccaagcctcccaagtaggtgg

SEQ ID NO: 71590 - DNA, 22 bp, Artificial Sequence
  Synthetic oligonucleotide; CTC chr11 5156817 5156838 5156834 5156839 +
ccaagtaggtgggattacaggc

SEQ ID NO: 71591 - DNA, 22 bp, Artificial Sequence
  Synthetic oligonucleotide; TTA chr11 5156834 5156855 5156851 5156856 +
caggcgcctgccaccacgcctg

SEQ ID NO: 71592 - DNA, 22 bp, Artificial Sequence
  Synthetic oligonucleotide; CTG chr11 5156844 5156865 5156861 5156866 +
ccaccacgcctggctaattttt

SEQ ID NO: 71593 - DNA, 22 bp, Artificial Sequence
  Synthetic oligonucleotide; CTG chr11 5156856 5156877 5156873 5156878 +
gctaattttttgtatttttagt

SEQ ID NO: 71594 - DNA, 22 bp, Artificial Sequence
  Synthetic oligonucleotide; CTA chr11 5156860 5156881 5156877 5156882 +
attttttgtatttttagtagag

SEQ ID NO: 71595 - DNA, 22 bp, Artificial Sequence
  Synthetic oligonucleotide; TTT chr11 5156864 5156885 5156881 5156886 +
tttgtatttttagtagagacag

SEQ ID NO: 71596 - DNA, 22 bp, Artificial Sequence
  Synthetic oligonucleotide; TTT chr11 5156865 5156886 5156882 5156887 +
ttgtatttttagtagagacagg

SEQ ID NO: 71597 - DNA, 22 bp, Artificial Sequence
  Synthetic oligonucleotide; TTT chr11 5156866 5156887 5156883 5156888 +
tgtatttttagtagagacaggg

SEQ ID NO: 71598 - DNA, 22 bp, Artificial Sequence
  Synthetic oligonucleotide; TTT chr11 5156867 5156888 5156884 5156889 +
gtatttttagtagagacagggt

SEQ ID NO: 71599 - DNA, 22 bp, Artificial Sequence
  Synthetic oligonucleotide; TTG chr11 5156868 5156889 5156885 5156890 +
tatttttagtagagacagggtt

SEQ ID NO: 71600 - DNA, 22 bp, Artificial Sequence
  Synthetic oligonucleotide; TTT chr11 5156873 5156894 5156890 5156895 +
ttagtagagacagggtttcacc

SEQ ID NO: 71601 - DNA, 22 bp, Artificial Sequence
  Synthetic oligonucleotide; TTT chr11 5156874 5156895 5156891 5156896 +
tagtagagacagggtttcacca

SEQ ID NO: 71602 - DNA, 22 bp, Artificial Sequence
  Synthetic oligonucleotide; TTT chr11 5156875 5156896 5156892 5156897 +
agtagagacagggtttcaccat

SEQ ID NO: 71603 - DNA, 22 bp, Artificial Sequence
  Synthetic oligonucleotide; TTA chr11 5156876 5156897 5156893 5156898 +
gtagagacagggtttcaccatg

SEQ ID NO: 71604 - DNA, 22 bp, Artificial Sequence
  Synthetic oligonucleotide; TTT chr11 5156891 5156912 5156908 5156913 +
caccatgttggtcaggctggtc

SEQ ID NO: 71605 - DNA, 22 bp, Artificial Sequence
  Synthetic oligonucleotide; TTC chr11 5156892 5156913 5156909 5156914 +
accatgttggtcaggctggtct

SEQ ID NO: 71606 - DNA, 22 bp, Artificial Sequence
  Synthetic oligonucleotide; TTG chr11 5156901 5156922 5156918 5156923 +
gtcaggctggtcttggactcct

SEQ ID NO: 71607 - DNA, 22 bp, Artificial Sequence
  Synthetic oligonucleotide; CTG chr11 5156910 5156931 5156927 5156932 +
gtcttggactcctgacctcatg

SEQ ID NO: 71608 - DNA, 22 bp, Artificial Sequence
  Synthetic oligonucleotide; CTT chr11 5156915 5156936 5156932 5156937 +
ggactcctgacctcatgatcca

SEQ ID NO: 71609 - DNA, 22 bp, Artificial Sequence
  Synthetic oligonucleotide; TTG chr11 5156916 5156937 5156933 5156938 +
gactcctgacctcatgatccac

SEQ ID NO: 71610 - DNA, 22 bp, Artificial Sequence
  Synthetic oligonucleotide; CTC chr11 5156921 5156942 5156938 5156943 +
ctgacctcatgatccacctgcc

SEQ ID NO: 71611 - DNA, 22 bp, Artificial Sequence
  Synthetic oligonucleotide; CTG chr11 5156924 5156945 5156941 5156946 +
acctcatgatccacctgccttg

SEQ ID NO: 71612 - DNA, 22 bp, Artificial Sequence
  Synthetic oligonucleotide; CTC chr11 5156929 5156950 5156946 5156951 +
atgatccacctgccttggcctc

SEQ ID NO: 71613 - DNA, 22 bp, Artificial Sequence
  Synthetic oligonucleotide; CTG chr11 5156941 5156962 5156958 5156963 +
ccttggcctcccaaagtgctga

SEQ ID NO: 71614 - DNA, 22 bp, Artificial Sequence
  Synthetic oligonucleotide; CTT chr11 5156945 5156966 5156962 5156967 +
ggcctcccaaagtgctgagatt

SEQ ID NO: 71615 - DNA, 22 bp, Artificial Sequence
  Synthetic oligonucleotide; TTG chr11 5156946 5156967 5156963 5156968 +
gcctcccaaagtgctgagatta

SEQ ID NO: 71616 - DNA, 22 bp, Artificial Sequence
  Synthetic oligonucleotide; CTC chr11 5156951 5156972 5156968 5156973 +
ccaaagtgctgagattacaggc

SEQ ID NO: 71617 - DNA, 22 bp, Artificial Sequence
  Synthetic oligonucleotide; CTG chr11 5156962 5156983 5156979 5156984 +
agattacaggcattggccaccg

SEQ ID NO: 71618 - DNA, 22 bp, Artificial Sequence
  Synthetic oligonucleotide; TTA chr11 5156968 5156989 5156985 5156990 +
caggcattggccaccgcaccca

SEQ ID NO: 71619 - DNA, 22 bp, Artificial Sequence
  Synthetic oligonucleotide; TTG chr11 5156977 5156998 5156994 5156999 +
gccaccgcacccagcccatctt

SEQ ID NO: 71620 - DNA, 22 bp, Artificial Sequence
  Synthetic oligonucleotide; CTT chr11 5156999 5157020 5157016 5157021 +
taccatttttgagtgtacggtt

SEQ ID NO: 71621 - DNA, 22 bp, Artificial Sequence
  Synthetic oligonucleotide; TTT chr11 5157000 5157021 5157017 5157022 +
accatttttgagtgtacggttc

SEQ ID NO: 71622 - DNA, 22 bp, Artificial Sequence
  Synthetic oligonucleotide; TTA chr11 5157001 5157022 5157018 5157023 +
ccatttttgagtgtacggttca

SEQ ID NO: 71623 - DNA, 22 bp, Artificial Sequence
  Synthetic oligonucleotide; TTT chr11 5157007 5157028 5157024 5157029 +
ttgagtgtacggttcagtggta

SEQ ID NO: 71624 - DNA, 22 bp, Artificial Sequence
  Synthetic oligonucleotide; TTT chr11 5157008 5157029 5157025 5157030 +
tgagtgtacggttcagtggtaa

SEQ ID NO: 71625 - DNA, 22 bp, Artificial Sequence
  Synthetic oligonucleotide; TTT chr11 5157009 5157030 5157026 5157031 +
gagtgtacggttcagtggtaat

SEQ ID NO: 71626 - DNA, 22 bp, Artificial Sequence
  Synthetic oligonucleotide; TTG chr11 5157010 5157031 5157027 5157032 +
agtgtacggttcagtggtaata

SEQ ID NO: 71627 - DNA, 22 bp, Artificial Sequence
  Synthetic oligonucleotide; TTC chr11 5157022 5157043 5157039 5157044 +
agtggtaatacatacatacata

SEQ ID NO: 71628 - DNA, 22 bp, Artificial Sequence
  Synthetic oligonucleotide; TTT chr11 5157057 5157078 5157074 5157079 +
atatgtatacatacatattcac

SEQ ID NO: 71629 - DNA, 22 bp, Artificial Sequence
  Synthetic oligonucleotide; TTA chr11 5157058 5157079 5157075 5157080 +
tatgtatacatacatattcaca

SEQ ID NO: 71630 - DNA, 22 bp, Artificial Sequence
  Synthetic oligonucleotide; TTC chr11 5157077 5157098 5157094 5157099 +
acatttttatatatatatacac

SEQ ID NO: 71631 - DNA, 22 bp, Artificial Sequence
  Synthetic oligonucleotide; TTT chr11 5157083 5157104 5157100 5157105 +
ttatatatatatacacatacat

SEQ ID NO: 71632 - DNA, 22 bp, Artificial Sequence
  Synthetic oligonucleotide; TTT chr11 5157084 5157105 5157101 5157106 +
tatatatatatacacatacata

SEQ ID NO: 71633 - DNA, 22 bp, Artificial Sequence
  Synthetic oligonucleotide; TTT chr11 5157085 5157106 5157102 5157107 +
atatatatatacacatacatac

SEQ ID NO: 71634 - DNA, 22 bp, Artificial Sequence
  Synthetic oligonucleotide; TTA chr11 5157086 5157107 5157103 5157108 +
tatatatatacacatacataca

SEQ ID NO: 71635 - DNA, 22 bp, Artificial Sequence
  Synthetic oligonucleotide; TTT chr11 5157154 5157175 5157171 5157176 +
ttttgcttgatttctcattcct

SEQ ID NO: 71636 - DNA, 22 bp, Artificial Sequence
  Synthetic oligonucleotide; TTT chr11 5157155 5157176 5157172 5157177 +
tttgcttgatttctcattcctt

SEQ ID NO: 71637 - DNA, 22 bp, Artificial Sequence
  Synthetic oligonucleotide; TTT chr11 5157156 5157177 5157173 5157178 +
ttgcttgatttctcattccttt

SEQ ID NO: 71638 - DNA, 22 bp, Artificial Sequence
  Synthetic oligonucleotide; TTT chr11 5157157 5157178 5157174 5157179 +
tgcttgatttctcattcctttc

SEQ ID NO: 71639 - DNA, 22 bp, Artificial Sequence
  Synthetic oligonucleotide; TTT chr11 5157158 5157179 5157175 5157180 +
gcttgatttctcattcctttct

SEQ ID NO: 71640 - DNA, 22 bp, Artificial Sequence
  Synthetic oligonucleotide; TTG chr11 5157159 5157180 5157176 5157181 +
cttgatttctcattcctttctt

SEQ ID NO: 71641 - DNA, 22 bp, Artificial Sequence
  Synthetic oligonucleotide; CTT chr11 5157162 5157183 5157179 5157184 +
gatttctcattcctttcttccc

SEQ ID NO: 71642 - DNA, 22 bp, Artificial Sequence
  Synthetic oligonucleotide; TTG chr11 5157163 5157184 5157180 5157185 +
atttctcattcctttcttccct

SEQ ID NO: 71643 - DNA, 22 bp, Artificial Sequence
  Synthetic oligonucleotide; TTT chr11 5157167 5157188 5157184 5157189 +
ctcattcctttcttccctcccg

SEQ ID NO: 71644 - DNA, 22 bp, Artificial Sequence
  Synthetic oligonucleotide; TTC chr11 5157168 5157189 5157185 5157190 +
tcattcctttcttccctcccgc

SEQ ID NO: 71645 - DNA, 22 bp, Artificial Sequence
  Synthetic oligonucleotide; CTC chr11 5157170 5157191 5157187 5157192 +
attcctttcttccctcccgccg

SEQ ID NO: 71646 - DNA, 22 bp, Artificial Sequence
  Synthetic oligonucleotide; TTC chr11 5157174 5157195 5157191 5157196 +
ctttcttccctcccgccgccgg

SEQ ID NO: 71647 - DNA, 22 bp, Artificial Sequence
  Synthetic oligonucleotide; CTT chr11 5157177 5157198 5157194 5157199 +
tcttccctcccgccgccggtaa

SEQ ID NO: 71648 - DNA, 22 bp, Artificial Sequence
  Synthetic oligonucleotide; TTT chr11 5157178 5157199 5157195 5157200 +
cttccctcccgccgccggtaac

SEQ ID NO: 71649 - DNA, 22 bp, Artificial Sequence
  Synthetic oligonucleotide; TTC chr11 5157179 5157200 5157196 5157201 +
ttccctcccgccgccggtaact

SEQ ID NO: 71650 - DNA, 22 bp, Artificial Sequence
  Synthetic oligonucleotide; CTT chr11 5157181 5157202 5157198 5157203 +
ccctcccgccgccggtaactac

SEQ ID NO: 71651 - DNA, 22 bp, Artificial Sequence
  Synthetic oligonucleotide; TTC chr11 5157182 5157203 5157199 5157204 +
cctcccgccgccggtaactacc

SEQ ID NO: 71652 - DNA, 22 bp, Artificial Sequence
  Synthetic oligonucleotide; CTC chr11 5157186 5157207 5157203 5157208 +
ccgccgccggtaactaccaatc

SEQ ID NO: 71653 - DNA, 22 bp, Artificial Sequence
  Synthetic oligonucleotide; CTA chr11 5157202 5157223 5157219 5157224 +
ccaatctactctctgtcttcat

SEQ ID NO: 71654 - DNA, 22 bp, Artificial Sequence
  Synthetic oligonucleotide; CTA chr11 5157210 5157231 5157227 5157232 +
ctctctgtcttcataagatcca

SEQ ID NO: 71655 - DNA, 22 bp, Artificial Sequence
  Synthetic oligonucleotide; CTC chr11 5157213 5157234 5157230 5157235 +
tctgtcttcataagatccacgt

SEQ ID NO: 71656 - DNA, 22 bp, Artificial Sequence
  Synthetic oligonucleotide; CTC chr11 5157215 5157236 5157232 5157237 +
tgtcttcataagatccacgttt

SEQ ID NO: 71657 - DNA, 22 bp, Artificial Sequence
  Synthetic oligonucleotide; CTG chr11 5157217 5157238 5157234 5157239 +
tcttcataagatccacgttttt

SEQ ID NO: 71658 - DNA, 22 bp, Artificial Sequence
  Synthetic oligonucleotide; CTT chr11 5157221 5157242 5157238 5157243 +
cataagatccacgtttttaact

SEQ ID NO: 71659 - DNA, 22 bp, Artificial Sequence
  Synthetic oligonucleotide; TTC chr11 5157222 5157243 5157239 5157244 +
ataagatccacgtttttaactt

SEQ ID NO: 71660 - DNA, 22 bp, Artificial Sequence
  Synthetic oligonucleotide; TTT chr11 5157237 5157258 5157254 5157259 +
ttaacttccacacgagttagaa

SEQ ID NO: 71661 - DNA, 22 bp, Artificial Sequence
  Synthetic oligonucleotide; TTT chr11 5157238 5157259 5157255 5157260 +
taacttccacacgagttagaac

SEQ ID NO: 71662 - DNA, 22 bp, Artificial Sequence
  Synthetic oligonucleotide; TTT chr11 5157239 5157260 5157256 5157261 +
aacttccacacgagttagaaca

SEQ ID NO: 71663 - DNA, 22 bp, Artificial Sequence
  Synthetic oligonucleotide; TTA chr11 5157240 5157261 5157257 5157262 +
acttccacacgagttagaacat

SEQ ID NO: 71664 - DNA, 22 bp, Artificial Sequence
  Synthetic oligonucleotide; CTT chr11 5157244 5157265 5157261 5157266 +
ccacacgagttagaacatgtga

SEQ ID NO: 71665 - DNA, 22 bp, Artificial Sequence
  Synthetic oligonucleotide; TTC chr11 5157245 5157266 5157262 5157267 +
cacacgagttagaacatgtgat

SEQ ID NO: 71666 - DNA, 22 bp, Artificial Sequence
  Synthetic oligonucleotide; TTA chr11 5157256 5157277 5157273 5157278 +
gaacatgtgatatttttctttc

SEQ ID NO: 71667 - DNA, 22 bp, Artificial Sequence
  Synthetic oligonucleotide; TTT chr11 5157271 5157292 5157288 5157293 +
ttctttctgtgcttggcttatt

SEQ ID NO: 71668 - DNA, 22 bp, Artificial Sequence
  Synthetic oligonucleotide; TTT chr11 5157272 5157293 5157289 5157294 +
tctttctgtgcttggcttattt

SEQ ID NO: 71669 - DNA, 22 bp, Artificial Sequence
  Synthetic oligonucleotide; TTT chr11 5157273 5157294 5157290 5157295 +
ctttctgtgcttggcttatttc

SEQ ID NO: 71670 - DNA, 22 bp, Artificial Sequence
  Synthetic oligonucleotide; TTC chr11 5157274 5157295 5157291 5157296 +
tttctgtgcttggcttatttca

SEQ ID NO: 71671 - DNA, 22 bp, Artificial Sequence
  Synthetic oligonucleotide; CTT chr11 5157276 5157297 5157293 5157298 +
tctgtgcttggcttatttcact

SEQ ID NO: 71672 - DNA, 22 bp, Artificial Sequence
  Synthetic oligonucleotide; TTT chr11 5157277 5157298 5157294 5157299 +
ctgtgcttggcttatttcactt

SEQ ID NO: 71673 - DNA, 22 bp, Artificial Sequence
  Synthetic oligonucleotide; TTC chr11 5157278 5157299 5157295 5157300 +
tgtgcttggcttatttcactta

SEQ ID NO: 71674 - DNA, 22 bp, Artificial Sequence
  Synthetic oligonucleotide; CTG chr11 5157280 5157301 5157297 5157302 +
tgcttggcttatttcacttaac

SEQ ID NO: 71675 - DNA, 22 bp, Artificial Sequence
  Synthetic oligonucleotide; CTT chr11 5157285 5157306 5157302 5157307 +
ggcttatttcacttaacgtaat

SEQ ID NO: 71676 - DNA, 22 bp, Artificial Sequence
  Synthetic oligonucleotide; TTG chr11 5157286 5157307 5157303 5157308 +
gcttatttcacttaacgtaatt

SEQ ID NO: 71677 - DNA, 22 bp, Artificial Sequence
  Synthetic oligonucleotide; CTT chr11 5157290 5157311 5157307 5157312 +
atttcacttaacgtaattgctt

SEQ ID NO: 71678 - DNA, 22 bp, Artificial Sequence
  Synthetic oligonucleotide; TTA chr11 5157291 5157312 5157308 5157313 +
tttcacttaacgtaattgcttt

SEQ ID NO: 71679 - DNA, 22 bp, Artificial Sequence
  Synthetic oligonucleotide; TTT chr11 5157294 5157315 5157311 5157316 +
cacttaacgtaattgctttcag

SEQ ID NO: 71680 - DNA, 22 bp, Artificial Sequence
  Synthetic oligonucleotide; TTC chr11 5157295 5157316 5157312 5157317 +
acttaacgtaattgctttcagt

SEQ ID NO: 71681 - DNA, 22 bp, Artificial Sequence
  Synthetic oligonucleotide; CTT chr11 5157299 5157320 5157316 5157321 +
aacgtaattgctttcagtacca

SEQ ID NO: 71682 - DNA, 22 bp, Artificial Sequence
  Synthetic oligonucleotide; TTA chr11 5157300 5157321 5157317 5157322 +
acgtaattgctttcagtaccat

SEQ ID NO: 71683 - DNA, 22 bp, Artificial Sequence
  Synthetic oligonucleotide; TTG chr11 5157309 5157330 5157326 5157331 +
ctttcagtaccatttatgttac

SEQ ID NO: 71684 - DNA, 22 bp, Artificial Sequence
  Synthetic oligonucleotide; CTT chr11 5157312 5157333 5157329 5157334 +
tcagtaccatttatgttactgt

SEQ ID NO: 71685 - DNA, 22 bp, Artificial Sequence
  Synthetic oligonucleotide; TTT chr11 5157313 5157334 5157330 5157335 +
cagtaccatttatgttactgta

SEQ ID NO: 71686 - DNA, 22 bp, Artificial Sequence
  Synthetic oligonucleotide; TTC chr11 5157314 5157335 5157331 5157336 +
agtaccatttatgttactgtaa

SEQ ID NO: 71687 - DNA, 22 bp, Artificial Sequence
  Synthetic oligonucleotide; TTT chr11 5157324 5157345 5157341 5157346 +
atgttactgtaattgataatat

SEQ ID NO: 71688 - DNA, 22 bp, Artificial Sequence
  Synthetic oligonucleotide; TTA chr11 5157325 5157346 5157342 5157347 +
tgttactgtaattgataatatt

SEQ ID NO: 71689 - DNA, 22 bp, Artificial Sequence
  Synthetic oligonucleotide; TTA chr11 5157330 5157351 5157347 5157352 +
ctgtaattgataatatttcatt

SEQ ID NO: 71690 - DNA, 22 bp, Artificial Sequence
  Synthetic oligonucleotide; CTG chr11 5157333 5157354 5157350 5157355 +
taattgataatatttcattctt

SEQ ID NO: 71691 - DNA, 22 bp, Artificial Sequence
  Synthetic oligonucleotide; TTG chr11 5157339 5157360 5157356 5157361 +
ataatatttcattcttttttat

SEQ ID NO: 71692 - DNA, 22 bp, Artificial Sequence
  Synthetic oligonucleotide; TTT chr11 5157348 5157369 5157365 5157370 +
cattcttttttatggttgaata

SEQ ID NO: 71693 - DNA, 22 bp, Artificial Sequence
  Synthetic oligonucleotide; TTC chr11 5157349 5157370 5157366 5157371 +
attcttttttatggttgaataa

SEQ ID NO: 71694 - DNA, 22 bp, Artificial Sequence
  Synthetic oligonucleotide; TTC chr11 5157353 5157374 5157370 5157375 +
ttttttatggttgaataatatt

SEQ ID NO: 71695 - DNA, 22 bp, Artificial Sequence
  Synthetic oligonucleotide; CTT chr11 5157355 5157376 5157372 5157377 +
ttttatggttgaataatattcc

SEQ ID NO: 71696 - DNA, 22 bp, Artificial Sequence
  Synthetic oligonucleotide; TTT chr11 5157356 5157377 5157373 5157378 +
tttatggttgaataatattcca

SEQ ID NO: 71697 - DNA, 22 bp, Artificial Sequence
  Synthetic oligonucleotide; TTT chr11 5157357 5157378 5157374 5157379 +
ttatggttgaataatattccat

SEQ ID NO: 71698 - DNA, 22 bp, Artificial Sequence
  Synthetic oligonucleotide; TTT chr11 5157358 5157379 5157375 5157380 +
tatggttgaataatattccatt

SEQ ID NO: 71699 - DNA, 22 bp, Artificial Sequence
  Synthetic oligonucleotide; TTT chr11 5157359 5157380 5157376 5157381 +
atggttgaataatattccattg

SEQ ID NO: 71700 - DNA, 22 bp, Artificial Sequence
  Synthetic oligonucleotide; TTA chr11 5157360 5157381 5157377 5157382 +
tggttgaataatattccattgt

SEQ ID NO: 71701 - DNA, 22 bp, Artificial Sequence
  Synthetic oligonucleotide; TTG chr11 5157366 5157387 5157383 5157388 +
aataatattccattgtgtgtgt

SEQ ID NO: 71702 - DNA, 22 bp, Artificial Sequence
  Synthetic oligonucleotide; TTC chr11 5157376 5157397 5157393 5157398 +
cattgtgtgtgtgtgtgtgtgt

SEQ ID NO: 71703 - DNA, 22 bp, Artificial Sequence
  Synthetic oligonucleotide; TTG chr11 5157381 5157402 5157398 5157403 +
tgtgtgtgtgtgtgtgtgtgtg

SEQ ID NO: 71704 - DNA, 22 bp, Artificial Sequence
  Synthetic oligonucleotide; TTA chr11 5157412 5157433 5157429 5157434 +
ttttctttatccatttatctgt

SEQ ID NO: 71705 - DNA, 22 bp, Artificial Sequence
  Synthetic oligonucleotide; TTT chr11 5157415 5157436 5157432 5157437 +
tctttatccatttatctgttga

SEQ ID NO: 71706 - DNA, 22 bp, Artificial Sequence
  Synthetic oligonucleotide; TTT chr11 5157416 5157437 5157433 5157438 +
ctttatccatttatctgttgac

SEQ ID NO: 71707 - DNA, 22 bp, Artificial Sequence
  Synthetic oligonucleotide; TTC chr11 5157417 5157438 5157434 5157439 +
tttatccatttatctgttgacg

SEQ ID NO: 71708 - DNA, 22 bp, Artificial Sequence
  Synthetic oligonucleotide; CTT chr11 5157419 5157440 5157436 5157441 +
tatccatttatctgttgacgaa

SEQ ID NO: 71709 - DNA, 22 bp, Artificial Sequence
  Synthetic oligonucleotide; TTT chr11 5157420 5157441 5157437 5157442 +
atccatttatctgttgacgaat

SEQ ID NO: 71710 - DNA, 22 bp, Artificial Sequence
  Synthetic oligonucleotide; TTA chr11 5157421 5157442 5157438 5157443 +
tccatttatctgttgacgaata

SEQ ID NO: 71711 - DNA, 22 bp, Artificial Sequence
  Synthetic oligonucleotide; TTT chr11 5157428 5157449 5157445 5157450 +
atctgttgacgaatacatcagt

SEQ ID NO: 71712 - DNA, 22 bp, Artificial Sequence
  Synthetic oligonucleotide; TTA chr11 5157429 5157450 5157446 5157451 +
tctgttgacgaatacatcagtt

SEQ ID NO: 71713 - DNA, 22 bp, Artificial Sequence
  Synthetic oligonucleotide; CTG chr11 5157433 5157454 5157450 5157455 +
ttgacgaatacatcagttgatt

SEQ ID NO: 71714 - DNA, 22 bp, Artificial Sequence
  Synthetic oligonucleotide; TTG chr11 5157436 5157457 5157453 5157458 +
acgaatacatcagttgatttca

SEQ ID NO: 71715 - DNA, 22 bp, Artificial Sequence
  Synthetic oligonucleotide; TTG chr11 5157452 5157473 5157469 5157474 +
atttcaaatcttggcgtttgtg

SEQ ID NO: 71716 - DNA, 22 bp, Artificial Sequence
  Synthetic oligonucleotide; TTT chr11 5157456 5157477 5157473 5157478 +
caaatcttggcgtttgtgaata

SEQ ID NO: 71717 - DNA, 22 bp, Artificial Sequence
  Synthetic oligonucleotide; TTC chr11 5157457 5157478 5157474 5157479 +
aaatcttggcgtttgtgaatag

SEQ ID NO: 71718 - DNA, 22 bp, Artificial Sequence
  Synthetic oligonucleotide; CTT chr11 5157464 5157485 5157481 5157486 +
ggcgtttgtgaatagtgctata

SEQ ID NO: 71719 - DNA, 22 bp, Artificial Sequence
  Synthetic oligonucleotide; TTG chr11 5157465 5157486 5157482 5157487 +
gcgtttgtgaatagtgctataa

SEQ ID NO: 71720 - DNA, 22 bp, Artificial Sequence
  Synthetic oligonucleotide; TTT chr11 5157471 5157492 5157488 5157493 +
gtgaatagtgctataataaaga

SEQ ID NO: 71721 - DNA, 22 bp, Artificial Sequence
  Synthetic oligonucleotide; TTG chr11 5157472 5157493 5157489 5157494 +
tgaatagtgctataataaagat

SEQ ID NO: 71722 - DNA, 22 bp, Artificial Sequence
  Synthetic oligonucleotide; CTA chr11 5157484 5157505 5157501 5157506 +
taataaagatgggagtactgat

SEQ ID NO: 71723 - DNA, 22 bp, Artificial Sequence
  Synthetic oligonucleotide; CTG chr11 5157504 5157525 5157521 5157526 +
atatatcttcgacatactaatt

SEQ ID NO: 71724 - DNA, 22 bp, Artificial Sequence
  Synthetic oligonucleotide; CTT chr11 5157513 5157534 5157530 5157535 +
cgacatactaatttattctttt

SEQ ID NO: 71725 - DNA, 22 bp, Artificial Sequence
  Synthetic oligonucleotide; TTC chr11 5157514 5157535 5157531 5157536 +
gacatactaatttattctttta

SEQ ID NO: 71726 - DNA, 22 bp, Artificial Sequence
  Synthetic oligonucleotide; CTA chr11 5157523 5157544 5157540 5157545 +
atttattcttttaagggtatat

SEQ ID NO: 71727 - DNA, 22 bp, Artificial Sequence
  Synthetic oligonucleotide; TTT chr11 5157527 5157548 5157544 5157549 +
attcttttaagggtatatacct

SEQ ID NO: 71728 - DNA, 22 bp, Artificial Sequence
  Synthetic oligonucleotide; TTA chr11 5157528 5157549 5157545 5157550 +
ttcttttaagggtatataccta

SEQ ID NO: 71729 - DNA, 22 bp, Artificial Sequence
  Synthetic oligonucleotide; TTC chr11 5157531 5157552 5157548 5157553 +
ttttaagggtatatacctagga

SEQ ID NO: 71730 - DNA, 22 bp, Artificial Sequence
  Synthetic oligonucleotide; CTT chr11 5157533 5157554 5157550 5157555 +
ttaagggtatatacctaggagt

SEQ ID NO: 71731 - DNA, 22 bp, Artificial Sequence
  Synthetic oligonucleotide; TTT chr11 5157534 5157555 5157551 5157556 +
taagggtatatacctaggagtg

SEQ ID NO: 71732 - DNA, 22 bp, Artificial Sequence
  Synthetic oligonucleotide; TTT chr11 5157535 5157556 5157552 5157557 +
aagggtatatacctaggagtga

SEQ ID NO: 71733 - DNA, 22 bp, Artificial Sequence
  Synthetic oligonucleotide; TTA chr11 5157536 5157557 5157553 5157558 +
agggtatatacctaggagtgat

SEQ ID NO: 71734 - DNA, 22 bp, Artificial Sequence
  Synthetic oligonucleotide; CTA chr11 5157550 5157571 5157567 5157572 +
ggagtgatattgctggatcata

SEQ ID NO: 71735 - DNA, 22 bp, Artificial Sequence
  Synthetic oligonucleotide; TTG chr11 5157562 5157583 5157579 5157584 +
ctggatcatatggtagttctac

SEQ ID NO: 71736 - DNA, 22 bp, Artificial Sequence
  Synthetic oligonucleotide; CTG chr11 5157565 5157586 5157582 5157587 +
gatcatatggtagttctacttt

SEQ ID NO: 71737 - DNA, 22 bp, Artificial Sequence
  Synthetic oligonucleotide; TTC chr11 5157581 5157602 5157598 5157603 +
tactttacatttttgacaaatc

SEQ ID NO: 71738 - DNA, 22 bp, Artificial Sequence
  Synthetic oligonucleotide; CTA chr11 5157583 5157604 5157600 5157605 +
ctttacatttttgacaaatctc

SEQ ID NO: 71739 - DNA, 22 bp, Artificial Sequence
  Synthetic oligonucleotide; CTT chr11 5157586 5157607 5157603 5157608 +
tacatttttgacaaatctccat

SEQ ID NO: 71740 - DNA, 22 bp, Artificial Sequence
  Synthetic oligonucleotide; TTT chr11 5157587 5157608 5157604 5157609 +
acatttttgacaaatctccata

SEQ ID NO: 71741 - DNA, 22 bp, Artificial Sequence
  Synthetic oligonucleotide; TTA chr11 5157588 5157609 5157605 5157610 +
catttttgacaaatctccatac

SEQ ID NO: 71742 - DNA, 22 bp, Artificial Sequence
  Synthetic oligonucleotide; TTT chr11 5157593 5157614 5157610 5157615 +
ttgacaaatctccatactgtcc

SEQ ID NO: 71743 - DNA, 22 bp, Artificial Sequence
  Synthetic oligonucleotide; TTT chr11 5157594 5157615 5157611 5157616 +
tgacaaatctccatactgtcct

SEQ ID NO: 71744 - DNA, 22 bp, Artificial Sequence
  Synthetic oligonucleotide; TTT chr11 5157595 5157616 5157612 5157617 +
gacaaatctccatactgtcctt

SEQ ID NO: 71745 - DNA, 22 bp, Artificial Sequence
  Synthetic oligonucleotide; TTG chr11 5157596 5157617 5157613 5157618 +
acaaatctccatactgtccttc

SEQ ID NO: 71746 - DNA, 22 bp, Artificial Sequence
  Synthetic oligonucleotide; CTC chr11 5157605 5157626 5157622 5157627 +
catactgtccttcataattgct

SEQ ID NO: 71747 - DNA, 22 bp, Artificial Sequence
  Synthetic oligonucleotide; CTG chr11 5157612 5157633 5157629 5157634 +
tccttcataattgctgtaccaa

SEQ ID NO: 71748 - DNA, 22 bp, Artificial Sequence
  Synthetic oligonucleotide; CTT chr11 5157617 5157638 5157634 5157639 +
cataattgctgtaccaatttgt

SEQ ID NO: 71749 - DNA, 22 bp, Artificial Sequence
  Synthetic oligonucleotide; TTC chr11 5157618 5157639 5157635 5157640 +
ataattgctgtaccaatttgta

SEQ ID NO: 71750 - DNA, 22 bp, Artificial Sequence
  Synthetic oligonucleotide; TTG chr11 5157625 5157646 5157642 5157647 +
ctgtaccaatttgtactcccac

SEQ ID NO: 71751 - DNA, 22 bp, Artificial Sequence
  Synthetic oligonucleotide; CTG chr11 5157628 5157649 5157645 5157650 +
taccaatttgtactcccaccaa

SEQ ID NO: 71752 - DNA, 22 bp, Artificial Sequence
  Synthetic oligonucleotide; TTT chr11 5157637 5157658 5157654 5157659 +
gtactcccaccaacagtgtaag

SEQ ID NO: 71753 - DNA, 22 bp, Artificial Sequence
  Synthetic oligonucleotide; TTG chr11 5157638 5157659 5157655 5157660 +
tactcccaccaacagtgtaaga

SEQ ID NO: 71754 - DNA, 22 bp, Artificial Sequence
  Synthetic oligonucleotide; CTC chr11 5157643 5157664 5157660 5157665 +
ccaccaacagtgtaagagggtt

SEQ ID NO: 71755 - DNA, 22 bp, Artificial Sequence
  Synthetic oligonucleotide; TTT chr11 5157666 5157687 5157683 5157688 +
ccctttgtccacatccacacaa

SEQ ID NO: 71756 - DNA, 22 bp, Artificial Sequence
  Synthetic oligonucleotide; TTC chr11 5157667 5157688 5157684 5157689 +
cctttgtccacatccacacaag

SEQ ID NO: 71757 - DNA, 22 bp, Artificial Sequence
  Synthetic oligonucleotide; CTT chr11 5157671 5157692 5157688 5157693 +
tgtccacatccacacaagcatc

SEQ ID NO: 71758 - DNA, 22 bp, Artificial Sequence
  Synthetic oligonucleotide; TTT chr11 5157672 5157693 5157689 5157694 +
gtccacatccacacaagcatct

SEQ ID NO: 71759 - DNA, 22 bp, Artificial Sequence
  Synthetic oligonucleotide; TTG chr11 5157673 5157694 5157690 5157695 +
tccacatccacacaagcatctg

SEQ ID NO: 71760 - DNA, 22 bp, Artificial Sequence
  Synthetic oligonucleotide; CTG chr11 5157695 5157716 5157712 5157717 +
ttatttccttttgttttgttat

SEQ ID NO: 71761 - DNA, 22 bp, Artificial Sequence
  Synthetic oligonucleotide; TTA chr11 5157698 5157719 5157715 5157720 +
tttccttttgttttgttataag

SEQ ID NO: 71762 - DNA, 22 bp, Artificial Sequence
  Synthetic oligonucleotide; TTT chr11 5157701 5157722 5157718 5157723 +
ccttttgttttgttataagcta

SEQ ID NO: 71763 - DNA, 22 bp, Artificial Sequence
  Synthetic oligonucleotide; TTC chr11 5157702 5157723 5157719 5157724 +
cttttgttttgttataagctat

SEQ ID NO: 71764 - DNA, 22 bp, Artificial Sequence
  Synthetic oligonucleotide; CTT chr11 5157705 5157726 5157722 5157727 +
ttgttttgttataagctatttt

SEQ ID NO: 71765 - DNA, 22 bp, Artificial Sequence
  Synthetic oligonucleotide; TTT chr11 5157706 5157727 5157723 5157728 +
tgttttgttataagctatttta

SEQ ID NO: 71766 - DNA, 22 bp, Artificial Sequence
  Synthetic oligonucleotide; TTT chr11 5157707 5157728 5157724 5157729 +
gttttgttataagctattttaa

SEQ ID NO: 71767 - DNA, 22 bp, Artificial Sequence
  Synthetic oligonucleotide; TTG chr11 5157708 5157729 5157725 5157730 +
ttttgttataagctattttaac

SEQ ID NO: 71768 - DNA, 22 bp, Artificial Sequence
  Synthetic oligonucleotide; TTT chr11 5157711 5157732 5157728 5157733 +
tgttataagctattttaactaa

SEQ ID NO: 71769 - DNA, 22 bp, Artificial Sequence
  Synthetic oligonucleotide; TTT chr11 5157712 5157733 5157729 5157734 +
gttataagctattttaactaag

SEQ ID NO: 71770 - DNA, 22 bp, Artificial Sequence
  Synthetic oligonucleotide; TTG chr11 5157713 5157734 5157730 5157735 +
ttataagctattttaactaagg

SEQ ID NO: 71771 - DNA, 22 bp, Artificial Sequence
  Synthetic oligonucleotide; TTA chr11 5157716 5157737 5157733 5157738 +
taagctattttaactaaggtga

SEQ ID NO: 71772 - DNA, 22 bp, Artificial Sequence
  Synthetic oligonucleotide; CTA chr11 5157723 5157744 5157740 5157745 +
ttttaactaaggtgagatgata

SEQ ID NO: 71773 - DNA, 22 bp, Artificial Sequence
  Synthetic oligonucleotide; TTT chr11 5157726 5157747 5157743 5157748 +
taactaaggtgagatgatatca

SEQ ID NO: 71774 - DNA, 22 bp, Artificial Sequence
  Synthetic oligonucleotide; TTT chr11 5157727 5157748 5157744 5157749 +
aactaaggtgagatgatatcac

SEQ ID NO: 71775 - DNA, 22 bp, Artificial Sequence
  Synthetic oligonucleotide; TTA chr11 5157728 5157749 5157745 5157750 +
actaaggtgagatgatatcaca

SEQ ID NO: 71776 - DNA, 22 bp, Artificial Sequence
  Synthetic oligonucleotide; CTA chr11 5157732 5157753 5157749 5157754 +
aggtgagatgatatcacattgt

SEQ ID NO: 71777 - DNA, 22 bp, Artificial Sequence
  Synthetic oligonucleotide; TTG chr11 5157753 5157774 5157770 5157775 +
tggttttgatttatctggtgat

SEQ ID NO: 71778 - DNA, 22 bp, Artificial Sequence
  Synthetic oligonucleotide; TTT chr11 5157759 5157780 5157776 5157781 +
tgatttatctggtgattagtga

SEQ ID NO: 71779 - DNA, 22 bp, Artificial Sequence
  Synthetic oligonucleotide; TTT chr11 5157760 5157781 5157777 5157782 +
gatttatctggtgattagtgat

SEQ ID NO: 71780 - DNA, 22 bp, Artificial Sequence
  Synthetic oligonucleotide; TTG chr11 5157761 5157782 5157778 5157783 +
atttatctggtgattagtgata

SEQ ID NO: 71781 - DNA, 22 bp, Artificial Sequence
  Synthetic oligonucleotide; TTT chr11 5157765 5157786 5157782 5157787 +
atctggtgattagtgatattga

SEQ ID NO: 71782 - DNA, 22 bp, Artificial Sequence
  Synthetic oligonucleotide; TTA chr11 5157766 5157787 5157783 5157788 +
tctggtgattagtgatattgaa

SEQ ID NO: 71783 - DNA, 22 bp, Artificial Sequence
  Synthetic oligonucleotide; CTG chr11 5157770 5157791 5157787 5157792 +
gtgattagtgatattgaacatt

SEQ ID NO: 71784 - DNA, 22 bp, Artificial Sequence
  Synthetic oligonucleotide; TTA chr11 5157777 5157798 5157794 5157799 +
gtgatattgaacattttttcaa

SEQ ID NO: 71785 - DNA, 22 bp, Artificial Sequence
  Synthetic oligonucleotide; TTG chr11 5157786 5157807 5157803 5157808 +
aacattttttcaaatacctctg

SEQ ID NO: 71786 - DNA, 22 bp, Artificial Sequence
  Synthetic oligonucleotide; TTT chr11 5157793 5157814 5157810 5157815 +
tttcaaatacctctgggccatt

SEQ ID NO: 71787 - DNA, 22 bp, Artificial Sequence
  Synthetic oligonucleotide; TTT chr11 5157794 5157815 5157811 5157816 +
ttcaaatacctctgggccattt

SEQ ID NO: 71788 - DNA, 22 bp, Artificial Sequence
  Synthetic oligonucleotide; TTT chr11 5157795 5157816 5157812 5157817 +
tcaaatacctctgggccatttg

SEQ ID NO: 71789 - DNA, 22 bp, Artificial Sequence
  Synthetic oligonucleotide; TTT chr11 5157796 5157817 5157813 5157818 +
caaatacctctgggccatttgt

SEQ ID NO: 71790 - DNA, 22 bp, Artificial Sequence
  Synthetic oligonucleotide; TTC chr11 5157797 5157818 5157814 5157819 +
aaatacctctgggccatttgta

SEQ ID NO: 71791 - DNA, 22 bp, Artificial Sequence
  Synthetic oligonucleotide; CTC chr11 5157806 5157827 5157823 5157828 +
tgggccatttgtatggcttctt

SEQ ID NO: 71792 - DNA, 22 bp, Artificial Sequence
  Synthetic oligonucleotide; CTG chr11 5157808 5157829 5157825 5157830 +
ggccatttgtatggcttctttt

SEQ ID NO: 71793 - DNA, 22 bp, Artificial Sequence
  Synthetic oligonucleotide; TTT chr11 5157816 5157837 5157833 5157838 +
gtatggcttcttttgagaaata

SEQ ID NO: 71794 - DNA, 22 bp, Artificial Sequence
  Synthetic oligonucleotide; TTG chr11 5157817 5157838 5157834 5157839 +
tatggcttcttttgagaaatat

SEQ ID NO: 71795 - DNA, 22 bp, Artificial Sequence
  Synthetic oligonucleotide; CTT chr11 5157825 5157846 5157842 5157847 +
cttttgagaaatatctattcag

SEQ ID NO: 71796 - DNA, 22 bp, Artificial Sequence
  Synthetic oligonucleotide; TTC chr11 5157826 5157847 5157843 5157848 +
ttttgagaaatatctattcagg

SEQ ID NO: 71797 - DNA, 22 bp, Artificial Sequence
  Synthetic oligonucleotide; CTT chr11 5157828 5157849 5157845 5157850 +
ttgagaaatatctattcaggtc

SEQ ID NO: 71798 - DNA, 22 bp, Artificial Sequence
  Synthetic oligonucleotide; TTT chr11 5157829 5157850 5157846 5157851 +
tgagaaatatctattcaggtct

SEQ ID NO: 71799 - DNA, 22 bp, Artificial Sequence
  Synthetic oligonucleotide; TTT chr11 5157830 5157851 5157847 5157852 +
gagaaatatctattcaggtctt

SEQ ID NO: 71800 - DNA, 22 bp, Artificial Sequence
  Synthetic oligonucleotide; TTG chr11 5157831 5157852 5157848 5157853 +
agaaatatctattcaggtcttt

SEQ ID NO: 71801 - DNA, 22 bp, Artificial Sequence
  Synthetic oligonucleotide; CTA chr11 5157842 5157863 5157859 5157864 +
ttcaggtcttttggccattatt

SEQ ID NO: 71802 - DNA, 22 bp, Artificial Sequence
  Synthetic oligonucleotide; TTC chr11 5157845 5157866 5157862 5157867 +
aggtcttttggccattatttat

SEQ ID NO: 71803 - DNA, 22 bp, Artificial Sequence
  Synthetic oligonucleotide; CTT chr11 5157852 5157873 5157869 5157874 +
ttggccattatttatttattta

SEQ ID NO: 71804 - DNA, 22 bp, Artificial Sequence
  Synthetic oligonucleotide; TTT chr11 5157853 5157874 5157870 5157875 +
tggccattatttatttatttat

SEQ ID NO: 71805 - DNA, 22 bp, Artificial Sequence
  Synthetic oligonucleotide; TTT chr11 5157854 5157875 5157871 5157876 +
ggccattatttatttatttatt

SEQ ID NO: 71806 - DNA, 22 bp, Artificial Sequence
  Synthetic oligonucleotide; TTG chr11 5157855 5157876 5157872 5157877 +
gccattatttatttatttattt

SEQ ID NO: 71807 - DNA, 22 bp, Artificial Sequence
  Synthetic oligonucleotide; TTA chr11 5157862 5157883 5157879 5157884 +
tttatttatttatttattttct

SEQ ID NO: 71808 - DNA, 22 bp, Artificial Sequence
  Synthetic oligonucleotide; TTT chr11 5157865 5157886 5157882 5157887 +
atttatttatttattttctgtt

SEQ ID NO: 71809 - DNA, 22 bp, Artificial Sequence
  Synthetic oligonucleotide; TTA chr11 5157866 5157887 5157883 5157888 +
tttatttatttattttctgttg

SEQ ID NO: 71810 - DNA, 22 bp, Artificial Sequence
  Synthetic oligonucleotide; TTT chr11 5157869 5157890 5157886 5157891 +
atttatttattttctgttgagt

SEQ ID NO: 71811 - DNA, 22 bp, Artificial Sequence
  Synthetic oligonucleotide; TTA chr11 5157870 5157891 5157887 5157892 +
tttatttattttctgttgagtt

SEQ ID NO: 71812 - DNA, 22 bp, Artificial Sequence
  Synthetic oligonucleotide; TTT chr11 5157873 5157894 5157890 5157895 +
atttattttctgttgagttgct

SEQ ID NO: 71813 - DNA, 22 bp, Artificial Sequence
  Synthetic oligonucleotide; TTA chr11 5157874 5157895 5157891 5157896 +
tttattttctgttgagttgctt

SEQ ID NO: 71814 - DNA, 22 bp, Artificial Sequence
  Synthetic oligonucleotide; TTT chr11 5157877 5157898 5157894 5157899 +
attttctgttgagttgcttgag

SEQ ID NO: 71815 - DNA, 22 bp, Artificial Sequence
  Synthetic oligonucleotide; TTA chr11 5157878 5157899 5157895 5157900 +
ttttctgttgagttgcttgagt

SEQ ID NO: 71816 - DNA, 22 bp, Artificial Sequence
  Synthetic oligonucleotide; TTT chr11 5157881 5157902 5157898 5157903 +
tctgttgagttgcttgagtttc

SEQ ID NO: 71817 - DNA, 22 bp, Artificial Sequence
  Synthetic oligonucleotide; TTT chr11 5157882 5157903 5157899 5157904 +
ctgttgagttgcttgagtttct

SEQ ID NO: 71818 - DNA, 22 bp, Artificial Sequence
  Synthetic oligonucleotide; TTC chr11 5157883 5157904 5157900 5157905 +
tgttgagttgcttgagtttctt

SEQ ID NO: 71819 - DNA, 22 bp, Artificial Sequence
  Synthetic oligonucleotide; CTG chr11 5157885 5157906 5157902 5157907 +
ttgagttgcttgagtttcttgc

SEQ ID NO: 71820 - DNA, 22 bp, Artificial Sequence
  Synthetic oligonucleotide; TTG chr11 5157888 5157909 5157905 5157910 +
agttgcttgagtttcttgcata

SEQ ID NO: 71821 - DNA, 22 bp, Artificial Sequence
  Synthetic oligonucleotide; TTG chr11 5157893 5157914 5157910 5157915 +
cttgagtttcttgcatattctg

SEQ ID NO: 71822 - DNA, 22 bp, Artificial Sequence
  Synthetic oligonucleotide; CTT chr11 5157896 5157917 5157913 5157918 +
gagtttcttgcatattctggtt

SEQ ID NO: 71823 - DNA, 22 bp, Artificial Sequence
  Synthetic oligonucleotide; TTG chr11 5157897 5157918 5157914 5157919 +
agtttcttgcatattctggtta

SEQ ID NO: 71824 - DNA, 22 bp, Artificial Sequence
  Synthetic oligonucleotide; TTT chr11 5157902 5157923 5157919 5157924 +
cttgcatattctggttatcaat

SEQ ID NO: 71825 - DNA, 22 bp, Artificial Sequence
  Synthetic oligonucleotide; TTC chr11 5157903 5157924 5157920 5157925 +
ttgcatattctggttatcaatt

SEQ ID NO: 71826 - DNA, 22 bp, Artificial Sequence
  Synthetic oligonucleotide; CTT chr11 5157905 5157926 5157922 5157927 +
gcatattctggttatcaattcc

SEQ ID NO: 71827 - DNA, 22 bp, Artificial Sequence
  Synthetic oligonucleotide; TTG chr11 5157906 5157927 5157923 5157928 +
catattctggttatcaattcct

SEQ ID NO: 71828 - DNA, 22 bp, Artificial Sequence
  Synthetic oligonucleotide; TTC chr11 5157913 5157934 5157930 5157935 +
tggttatcaattccttgtaaaa

SEQ ID NO: 71829 - DNA, 22 bp, Artificial Sequence
  Synthetic oligonucleotide; CTG chr11 5157915 5157936 5157932 5157937 +
gttatcaattccttgtaaaata

SEQ ID NO: 71830 - DNA, 22 bp, Artificial Sequence
  Synthetic oligonucleotide; TTA chr11 5157919 5157940 5157936 5157941 +
tcaattccttgtaaaatatata

SEQ ID NO: 71831 - DNA, 22 bp, Artificial Sequence
  Synthetic oligonucleotide; TTC chr11 5157926 5157947 5157943 5157948 +
cttgtaaaatatatagtttgca

SEQ ID NO: 71832 - DNA, 22 bp, Artificial Sequence
  Synthetic oligonucleotide; CTT chr11 5157929 5157950 5157946 5157951 +
gtaaaatatatagtttgcaaat

SEQ ID NO: 71833 - DNA, 22 bp, Artificial Sequence
  Synthetic oligonucleotide; TTG chr11 5157930 5157951 5157947 5157952 +
taaaatatatagtttgcaaata

SEQ ID NO: 71834 - DNA, 22 bp, Artificial Sequence
  Synthetic oligonucleotide; TTT chr11 5157945 5157966 5157962 5157967 +
gcaaatattttctcccattctt

SEQ ID NO: 71835 - DNA, 22 bp, Artificial Sequence
  Synthetic oligonucleotide; TTG chr11 5157946 5157967 5157963 5157968 +
caaatattttctcccattcttt

SEQ ID NO: 71836 - DNA, 22 bp, Artificial Sequence
  Synthetic oligonucleotide; TTT chr11 5157955 5157976 5157972 5157977 +
tctcccattctttgggttgtct

SEQ ID NO: 71837 - DNA, 22 bp, Artificial Sequence
  Synthetic oligonucleotide; TTT chr11 5157956 5157977 5157973 5157978 +
ctcccattctttgggttgtctc

SEQ ID NO: 71838 - DNA, 22 bp, Artificial Sequence
  Synthetic oligonucleotide; TTC chr11 5157957 5157978 5157974 5157979 +
tcccattctttgggttgtctct

SEQ ID NO: 71839 - DNA, 22 bp, Artificial Sequence
  Synthetic oligonucleotide; CTC chr11 5157959 5157980 5157976 5157981 +
ccattctttgggttgtctcttc

SEQ ID NO: 71840 - DNA, 22 bp, Artificial Sequence
  Synthetic oligonucleotide; TTC chr11 5157965 5157986 5157982 5157987 +
tttgggttgtctcttcacttta

SEQ ID NO: 71841 - DNA, 22 bp, Artificial Sequence
  Synthetic oligonucleotide; CTT chr11 5157967 5157988 5157984 5157989 +
tgggttgtctcttcactttatt

SEQ ID NO: 71842 - DNA, 22 bp, Artificial Sequence
  Synthetic oligonucleotide; TTT chr11 5157968 5157989 5157985 5157990 +
gggttgtctcttcactttatta

SEQ ID NO: 71843 - DNA, 22 bp, Artificial Sequence
  Synthetic oligonucleotide; TTG chr11 5157969 5157990 5157986 5157991 +
ggttgtctcttcactttattat

SEQ ID NO: 71844 - DNA, 22 bp, Artificial Sequence
  Synthetic oligonucleotide; TTG chr11 5157974 5157995 5157991 5157996 +
tctcttcactttattattttct

SEQ ID NO: 71845 - DNA, 22 bp, Artificial Sequence
  Synthetic oligonucleotide; CTC chr11 5157978 5157999 5157995 5158000 +
ttcactttattattttctttgc

SEQ ID NO: 71846 - DNA, 22 bp, Artificial Sequence
  Synthetic oligonucleotide; CTT chr11 5157980 5158001 5157997 5158002 +
cactttattattttctttgctg

SEQ ID NO: 71847 - DNA, 22 bp, Artificial Sequence
  Synthetic oligonucleotide; TTC chr11 5157981 5158002 5157998 5158003 +
actttattattttctttgctgt

SEQ ID NO: 71848 - DNA, 22 bp, Artificial Sequence
  Synthetic oligonucleotide; CTT chr11 5157985 5158006 5158002 5158007 +
tattattttctttgctgtgcag

SEQ ID NO: 71849 - DNA, 22 bp, Artificial Sequence
  Synthetic oligonucleotide; TTT chr11 5157986 5158007 5158003 5158008 +
attattttctttgctgtgcaga

SEQ ID NO: 71850 - DNA, 22 bp, Artificial Sequence
  Synthetic oligonucleotide; TTA chr11 5157987 5158008 5158004 5158009 +
ttattttctttgctgtgcagag

SEQ ID NO: 71851 - DNA, 22 bp, Artificial Sequence
  Synthetic oligonucleotide; TTA chr11 5157990 5158011 5158007 5158012 +
ttttctttgctgtgcagagctt

SEQ ID NO: 71852 - DNA, 22 bp, Artificial Sequence
  Synthetic oligonucleotide; TTT chr11 5157993 5158014 5158010 5158015 +
tctttgctgtgcagagcttcaa

SEQ ID NO: 71853 - DNA, 22 bp, Artificial Sequence
  Synthetic oligonucleotide; TTT chr11 5157994 5158015 5158011 5158016 +
ctttgctgtgcagagcttcaaa

SEQ ID NO: 71854 - DNA, 22 bp, Artificial Sequence
  Synthetic oligonucleotide; TTC chr11 5157995 5158016 5158012 5158017 +
tttgctgtgcagagcttcaaac

SEQ ID NO: 71855 - DNA, 22 bp, Artificial Sequence
  Synthetic oligonucleotide; CTT chr11 5157997 5158018 5158014 5158019 +
tgctgtgcagagcttcaaacaa

SEQ ID NO: 71856 - DNA, 22 bp, Artificial Sequence
  Synthetic oligonucleotide; TTT chr11 5157998 5158019 5158015 5158020 +
gctgtgcagagcttcaaacaat

SEQ ID NO: 71857 - DNA, 22 bp, Artificial Sequence
  Synthetic oligonucleotide; TTG chr11 5157999 5158020 5158016 5158021 +
ctgtgcagagcttcaaacaatc

SEQ ID NO: 71858 - DNA, 22 bp, Artificial Sequence
  Synthetic oligonucleotide; CTG chr11 5158002 5158023 5158019 5158024 +
tgcagagcttcaaacaatccca

SEQ ID NO: 71859 - DNA, 22 bp, Artificial Sequence
  Synthetic oligonucleotide; CTT chr11 5158012 5158033 5158029 5158034 +
caaacaatcccaattgtctatt

SEQ ID NO: 71860 - DNA, 22 bp, Artificial Sequence
  Synthetic oligonucleotide; TTC chr11 5158013 5158034 5158030 5158035 +
aaacaatcccaattgtctattt

SEQ ID NO: 71861 - DNA, 22 bp, Artificial Sequence
  Synthetic oligonucleotide; TTG chr11 5158028 5158049 5158045 5158050 +
tctatttttgttttggttattt

SEQ ID NO: 71862 - DNA, 22 bp, Artificial Sequence
  Synthetic oligonucleotide; CTA chr11 5158032 5158053 5158049 5158054 +
tttttgttttggttatttgtgc

SEQ ID NO: 71863 - DNA, 22 bp, Artificial Sequence
  Synthetic oligonucleotide; TTT chr11 5158035 5158056 5158052 5158057 +
ttgttttggttatttgtgcttt

SEQ ID NO: 71864 - DNA, 22 bp, Artificial Sequence
  Synthetic oligonucleotide; TTT chr11 5158036 5158057 5158053 5158058 +
tgttttggttatttgtgctttt

SEQ ID NO: 71865 - DNA, 22 bp, Artificial Sequence
  Synthetic oligonucleotide; TTT chr11 5158037 5158058 5158054 5158059 +
gttttggttatttgtgcttttg

SEQ ID NO: 71866 - DNA, 22 bp, Artificial Sequence
  Synthetic oligonucleotide; TTG chr11 5158038 5158059 5158055 5158060 +
ttttggttatttgtgcttttga

SEQ ID NO: 71867 - DNA, 22 bp, Artificial Sequence
  Synthetic oligonucleotide; TTT chr11 5158041 5158062 5158058 5158063 +
tggttatttgtgcttttgaagt

SEQ ID NO: 71868 - DNA, 22 bp, Artificial Sequence
  Synthetic oligonucleotide; TTT chr11 5158042 5158063 5158059 5158064 +
ggttatttgtgcttttgaagtc

SEQ ID NO: 71869 - DNA, 22 bp, Artificial Sequence
  Synthetic oligonucleotide; TTG chr11 5158043 5158064 5158060 5158065 +
gttatttgtgcttttgaagtct

SEQ ID NO: 71870 - DNA, 22 bp, Artificial Sequence
  Synthetic oligonucleotide; TTA chr11 5158047 5158068 5158064 5158069 +
tttgtgcttttgaagtctcata

SEQ ID NO: 71871 - DNA, 22 bp, Artificial Sequence
  Synthetic oligonucleotide; TTT chr11 5158050 5158071 5158067 5158072 +
gtgcttttgaagtctcatagac

SEQ ID NO: 71872 - DNA, 22 bp, Artificial Sequence
  Synthetic oligonucleotide; TTG chr11 5158051 5158072 5158068 5158073 +
tgcttttgaagtctcatagaca

SEQ ID NO: 71873 - DNA, 22 bp, Artificial Sequence
  Synthetic oligonucleotide; CTT chr11 5158056 5158077 5158073 5158078 +
ttgaagtctcatagacagtatt

SEQ ID NO: 71874 - DNA, 22 bp, Artificial Sequence
  Synthetic oligonucleotide; TTT chr11 5158057 5158078 5158074 5158079 +
tgaagtctcatagacagtattt

SEQ ID NO: 71875 - DNA, 22 bp, Artificial Sequence
  Synthetic oligonucleotide; TTT chr11 5158058 5158079 5158075 5158080 +
gaagtctcatagacagtatttg

SEQ ID NO: 71876 - DNA, 22 bp, Artificial Sequence
  Synthetic oligonucleotide; TTG chr11 5158059 5158080 5158076 5158081 +
aagtctcatagacagtatttgc

SEQ ID NO: 71877 - DNA, 22 bp, Artificial Sequence
  Synthetic oligonucleotide; CTC chr11 5158066 5158087 5158083 5158088 +
atagacagtatttgcccaaatc

SEQ ID NO: 71878 - DNA, 22 bp, Artificial Sequence
  Synthetic oligonucleotide; TTT chr11 5158079 5158100 5158096 5158101 +
gcccaaatcaatgaatgccctg

SEQ ID NO: 71879 - DNA, 22 bp, Artificial Sequence
  Synthetic oligonucleotide; TTG chr11 5158080 5158101 5158097 5158102 +
cccaaatcaatgaatgccctgg

SEQ ID NO: 71880 - DNA, 22 bp, Artificial Sequence
  Synthetic oligonucleotide; CTG chr11 5158101 5158122 5158118 5158123 +
gagggtttccccactgttttct

SEQ ID NO: 71881 - DNA, 22 bp, Artificial Sequence
  Synthetic oligonucleotide; TTT chr11 5158109 5158130 5158126 5158131 +
ccccactgttttcttccagtag

SEQ ID NO: 71882 - DNA, 22 bp, Artificial Sequence
  Synthetic oligonucleotide; TTC chr11 5158110 5158131 5158127 5158132 +
cccactgttttcttccagtagt

SEQ ID NO: 71883 - DNA, 22 bp, Artificial Sequence
  Synthetic oligonucleotide; CTG chr11 5158117 5158138 5158134 5158139 +
ttttcttccagtagtttcataa

SEQ ID NO: 71884 - DNA, 22 bp, Artificial Sequence
  Synthetic oligonucleotide; TTT chr11 5158120 5158141 5158137 5158142 +
tcttccagtagtttcataattt

SEQ ID NO: 71885 - DNA, 22 bp, Artificial Sequence
  Synthetic oligonucleotide; TTT chr11 5158121 5158142 5158138 5158143 +
cttccagtagtttcataatttc

SEQ ID NO: 71886 - DNA, 22 bp, Artificial Sequence
  Synthetic oligonucleotide; TTC chr11 5158122 5158143 5158139 5158144 +
ttccagtagtttcataatttca

SEQ ID NO: 71887 - DNA, 22 bp, Artificial Sequence
  Synthetic oligonucleotide; CTT chr11 5158124 5158145 5158141 5158146 +
ccagtagtttcataatttcagg

SEQ ID NO: 71888 - DNA, 22 bp, Artificial Sequence
  Synthetic oligonucleotide; TTC chr11 5158125 5158146 5158142 5158147 +
cagtagtttcataatttcaggt

SEQ ID NO: 71889 - DNA, 22 bp, Artificial Sequence
  Synthetic oligonucleotide; TTT chr11 5158134 5158155 5158151 5158156 +
cataatttcaggtattggattc

SEQ ID NO: 71890 - DNA, 22 bp, Artificial Sequence
  Synthetic oligonucleotide; TTC chr11 5158135 5158156 5158152 5158157 +
ataatttcaggtattggattca

SEQ ID NO: 71891 - DNA, 22 bp, Artificial Sequence
  Synthetic oligonucleotide; TTT chr11 5158142 5158163 5158159 5158164 +
caggtattggattcaagtcttt

SEQ ID NO: 71892 - DNA, 22 bp, Artificial Sequence
  Synthetic oligonucleotide; TTC chr11 5158143 5158164 5158160 5158165 +
aggtattggattcaagtcttta

SEQ ID NO: 71893 - DNA, 22 bp, Artificial Sequence
  Synthetic oligonucleotide; TTG chr11 5158151 5158172 5158168 5158173 +
gattcaagtctttaatccatct

SEQ ID NO: 71894 - DNA, 22 bp, Artificial Sequence
  Synthetic oligonucleotide; TTC chr11 5158156 5158177 5158173 5158178 +
aagtctttaatccatcttgatt

SEQ ID NO: 71895 - DNA, 22 bp, Artificial Sequence
  Synthetic oligonucleotide; CTT chr11 5158163 5158184 5158180 5158185 +
taatccatcttgatttgatttt

SEQ ID NO: 71896 - DNA, 22 bp, Artificial Sequence
  Synthetic oligonucleotide; TTT chr11 5158164 5158185 5158181 5158186 +
aatccatcttgatttgattttt

SEQ ID NO: 71897 - DNA, 22 bp, Artificial Sequence
  Synthetic oligonucleotide; TTA chr11 5158165 5158186 5158182 5158187 +
atccatcttgatttgatttttg

SEQ ID NO: 71898 - DNA, 22 bp, Artificial Sequence
  Synthetic oligonucleotide; CTT chr11 5158174 5158195 5158191 5158196 +
gatttgatttttgtatatagtg

SEQ ID NO: 71899 - DNA, 22 bp, Artificial Sequence
  Synthetic oligonucleotide; TTG chr11 5158175 5158196 5158192 5158197 +
atttgatttttgtatatagtga

SEQ ID NO: 71900 - DNA, 22 bp, Artificial Sequence
  Synthetic oligonucleotide; TTT chr11 5158179 5158200 5158196 5158201 +
gatttttgtatatagtgagaga

SEQ ID NO: 71901 - DNA, 22 bp, Artificial Sequence
  Synthetic oligonucleotide; TTG chr11 5158180 5158201 5158197 5158202 +
atttttgtatatagtgagagat

SEQ ID NO: 71902 - DNA, 22 bp, Artificial Sequence
  Synthetic oligonucleotide; TTT chr11 5158184 5158205 5158201 5158206 +
ttgtatatagtgagagataggg

SEQ ID NO: 71903 - DNA, 22 bp, Artificial Sequence
  Synthetic oligonucleotide; TTT chr11 5158185 5158206 5158202 5158207 +
tgtatatagtgagagatagggg

SEQ ID NO: 71904 - DNA, 22 bp, Artificial Sequence
  Synthetic oligonucleotide; TTT chr11 5158186 5158207 5158203 5158208 +
gtatatagtgagagataggggt

SEQ ID NO: 71905 - DNA, 22 bp, Artificial Sequence
  Synthetic oligonucleotide; TTG chr11 5158187 5158208 5158204 5158209 +
tatatagtgagagataggggtc

SEQ ID NO: 71906 - DNA, 22 bp, Artificial Sequence
  Synthetic oligonucleotide; TTT chr11 5158215 5158236 5158232 5158237 +
tactcttttgcaaatggatatc

SEQ ID NO: 71907 - DNA, 22 bp, Artificial Sequence
  Synthetic oligonucleotide; TTT chr11 5158216 5158237 5158233 5158238 +
actcttttgcaaatggatatcc

SEQ ID NO: 71908 - DNA, 22 bp, Artificial Sequence
  Synthetic oligonucleotide; TTA chr11 5158217 5158238 5158234 5158239 +
ctcttttgcaaatggatatcca

SEQ ID NO: 71909 - DNA, 22 bp, Artificial Sequence
  Synthetic oligonucleotide; CTC chr11 5158220 5158241 5158237 5158242 +
ttttgcaaatggatatccagtt

SEQ ID NO: 71910 - DNA, 22 bp, Artificial Sequence
  Synthetic oligonucleotide; CTT chr11 5158222 5158243 5158239 5158244 +
ttgcaaatggatatccagtttt

SEQ ID NO: 71911 - DNA, 22 bp, Artificial Sequence
  Synthetic oligonucleotide; TTT chr11 5158223 5158244 5158240 5158245 +
tgcaaatggatatccagttttc

SEQ ID NO: 71912 - DNA, 22 bp, Artificial Sequence
  Synthetic oligonucleotide; TTT chr11 5158224 5158245 5158241 5158246 +
gcaaatggatatccagttttcc

SEQ ID NO: 71913 - DNA, 22 bp, Artificial Sequence
  Synthetic oligonucleotide; TTG chr11 5158225 5158246 5158242 5158247 +
caaatggatatccagttttcct

SEQ ID NO: 71914 - DNA, 22 bp, Artificial Sequence
  Synthetic oligonucleotide; TTT chr11 5158243 5158264 5158260 5158265 +
tcctagcactgtttcttgaaaa

SEQ ID NO: 71915 - DNA, 22 bp, Artificial Sequence
  Synthetic oligonucleotide; TTT chr11 5158244 5158265 5158261 5158266 +
cctagcactgtttcttgaaaag

SEQ ID NO: 71916 - DNA, 22 bp, Artificial Sequence
  Synthetic oligonucleotide; TTC chr11 5158245 5158266 5158262 5158267 +
ctagcactgtttcttgaaaaga

SEQ ID NO: 71917 - DNA, 22 bp, Artificial Sequence
  Synthetic oligonucleotide; CTA chr11 5158248 5158269 5158265 5158270 +
gcactgtttcttgaaaagactg

SEQ ID NO: 71918 - DNA, 22 bp, Artificial Sequence
  Synthetic oligonucleotide; CTG chr11 5158254 5158275 5158271 5158276 +
tttcttgaaaagactgtttgta

SEQ ID NO: 71919 - DNA, 22 bp, Artificial Sequence
  Synthetic oligonucleotide; TTT chr11 5158257 5158278 5158274 5158279 +
cttgaaaagactgtttgtacct

SEQ ID NO: 71920 - DNA, 22 bp, Artificial Sequence
  Synthetic oligonucleotide; TTC chr11 5158258 5158279 5158275 5158280 +
ttgaaaagactgtttgtacctt

SEQ ID NO: 71921 - DNA, 22 bp, Artificial Sequence
  Synthetic oligonucleotide; CTT chr11 5158260 5158281 5158277 5158282 +
gaaaagactgtttgtacctttt

SEQ ID NO: 71922 - DNA, 22 bp, Artificial Sequence
  Synthetic oligonucleotide; TTG chr11 5158261 5158282 5158278 5158283 +
aaaagactgtttgtaccttttt

SEQ ID NO: 71923 - DNA, 22 bp, Artificial Sequence
  Synthetic oligonucleotide; CTG chr11 5158270 5158291 5158287 5158292 +
tttgtacctttttttttttttt

SEQ ID NO: 71924 - DNA, 22 bp, Artificial Sequence
  Synthetic oligonucleotide; TTT chr11 5158273 5158294 5158290 5158295 +
gtaccttttttttttttttttt

SEQ ID NO: 71925 - DNA, 22 bp, Artificial Sequence
  Synthetic oligonucleotide; TTG chr11 5158274 5158295 5158291 5158296 +
tacctttttttttttttttttt

SEQ ID NO: 71926 - DNA, 22 bp, Artificial Sequence
  Synthetic oligonucleotide; CTT chr11 5158280 5158301 5158297 5158302 +
ttttttttttttttttgagatg

SEQ ID NO: 71927 - DNA, 22 bp, Artificial Sequence
  Synthetic oligonucleotide; TTT chr11 5158281 5158302 5158298 5158303 +
tttttttttttttttgagatgg

SEQ ID NO: 71928 - DNA, 22 bp, Artificial Sequence
  Synthetic oligonucleotide; TTT chr11 5158282 5158303 5158299 5158304 +
ttttttttttttttgagatgga

SEQ ID NO: 71929 - DNA, 22 bp, Artificial Sequence
  Synthetic oligonucleotide; TTT chr11 5158283 5158304 5158300 5158305 +
tttttttttttttgagatggag

SEQ ID NO: 71930 - DNA, 22 bp, Artificial Sequence
  Synthetic oligonucleotide; TTT chr11 5158284 5158305 5158301 5158306 +
ttttttttttttgagatggagt

SEQ ID NO: 71931 - DNA, 22 bp, Artificial Sequence
  Synthetic oligonucleotide; TTT chr11 5158285 5158306 5158302 5158307 +
tttttttttttgagatggagtc

SEQ ID NO: 71932 - DNA, 22 bp, Artificial Sequence
  Synthetic oligonucleotide; TTT chr11 5158286 5158307 5158303 5158308 +
ttttttttttgagatggagtct

SEQ ID NO: 71933 - DNA, 22 bp, Artificial Sequence
  Synthetic oligonucleotide; TTT chr11 5158287 5158308 5158304 5158309 +
tttttttttgagatggagtctc

SEQ ID NO: 71934 - DNA, 22 bp, Artificial Sequence
  Synthetic oligonucleotide; TTT chr11 5158288 5158309 5158305 5158310 +
ttttttttgagatggagtctca

SEQ ID NO: 71935 - DNA, 22 bp, Artificial Sequence
  Synthetic oligonucleotide; TTT chr11 5158289 5158310 5158306 5158311 +
tttttttgagatggagtctcac

SEQ ID NO: 71936 - DNA, 22 bp, Artificial Sequence
  Synthetic oligonucleotide; TTT chr11 5158290 5158311 5158307 5158312 +
ttttttgagatggagtctcact

SEQ ID NO: 71937 - DNA, 22 bp, Artificial Sequence
  Synthetic oligonucleotide; TTT chr11 5158291 5158312 5158308 5158313 +
tttttgagatggagtctcactg

SEQ ID NO: 71938 - DNA, 22 bp, Artificial Sequence
  Synthetic oligonucleotide; TTT chr11 5158292 5158313 5158309 5158314 +
ttttgagatggagtctcactgt

SEQ ID NO: 71939 - DNA, 22 bp, Artificial Sequence
  Synthetic oligonucleotide; TTT chr11 5158293 5158314 5158310 5158315 +
tttgagatggagtctcactgtt

SEQ ID NO: 71940 - DNA, 22 bp, Artificial Sequence
  Synthetic oligonucleotide; TTT chr11 5158294 5158315 5158311 5158316 +
ttgagatggagtctcactgttg

SEQ ID NO: 71941 - DNA, 22 bp, Artificial Sequence
  Synthetic oligonucleotide; TTT chr11 5158295 5158316 5158312 5158317 +
tgagatggagtctcactgttgc

SEQ ID NO: 71942 - DNA, 22 bp, Artificial Sequence
  Synthetic oligonucleotide; TTT chr11 5158296 5158317 5158313 5158318 +
gagatggagtctcactgttgcc

SEQ ID NO: 71943 - DNA, 22 bp, Artificial Sequence
  Synthetic oligonucleotide; TTG chr11 5158297 5158318 5158314 5158319 +
agatggagtctcactgttgccc

SEQ ID NO: 71944 - DNA, 22 bp, Artificial Sequence
  Synthetic oligonucleotide; CTC chr11 5158309 5158330 5158326 5158331 +
actgttgcccaggctggagtgc

SEQ ID NO: 71945 - DNA, 22 bp, Artificial Sequence
  Synthetic oligonucleotide; CTG chr11 5158313 5158334 5158330 5158335 +
ttgcccaggctggagtgcagtg

SEQ ID NO: 71946 - DNA, 22 bp, Artificial Sequence
  Synthetic oligonucleotide; TTG chr11 5158316 5158337 5158333 5158338 +
cccaggctggagtgcagtggca

SEQ ID NO: 71947 - DNA, 22 bp, Artificial Sequence
  Synthetic oligonucleotide; CTG chr11 5158325 5158346 5158342 5158347 +
gagtgcagtggcagcacaatct

SEQ ID NO: 71948 - DNA, 22 bp, Artificial Sequence
  Synthetic oligonucleotide; CTT chr11 5158348 5158369 5158365 5158370 +
ggatcactgcaacttctgcctc

SEQ ID NO: 71949 - DNA, 22 bp, Artificial Sequence
  Synthetic oligonucleotide; TTG chr11 5158349 5158370 5158366 5158371 +
gatcactgcaacttctgcctcc

SEQ ID NO: 71950 - DNA, 22 bp, Artificial Sequence
  Synthetic oligonucleotide; CTG chr11 5158357 5158378 5158374 5158379 +
caacttctgcctcccaggttca

SEQ ID NO: 71951 - DNA, 22 bp, Artificial Sequence
  Synthetic oligonucleotide; CTT chr11 5158363 5158384 5158380 5158385 +
ctgcctcccaggttcaagcgat

SEQ ID NO: 71952 - DNA, 22 bp, Artificial Sequence
  Synthetic oligonucleotide; TTC chr11 5158364 5158385 5158381 5158386 +
tgcctcccaggttcaagcgatt

SEQ ID NO: 71953 - DNA, 22 bp, Artificial Sequence
  Synthetic oligonucleotide; CTG chr11 5158366 5158387 5158383 5158388 +
cctcccaggttcaagcgattct

SEQ ID NO: 71954 - DNA, 22 bp, Artificial Sequence
  Synthetic oligonucleotide; CTC chr11 5158370 5158391 5158387 5158392 +
ccaggttcaagcgattctcctg

SEQ ID NO: 71955 - DNA, 22 bp, Artificial Sequence
  Synthetic oligonucleotide; TTC chr11 5158378 5158399 5158395 5158400 +
aagcgattctcctgcctcagcc

SEQ ID NO: 71956 - DNA, 22 bp, Artificial Sequence
  Synthetic oligonucleotide; TTC chr11 5158387 5158408 5158404 5158409 +
tcctgcctcagcctcctgagta

SEQ ID NO: 71957 - DNA, 22 bp, Artificial Sequence
  Synthetic oligonucleotide; CTC chr11 5158389 5158410 5158406 5158411 +
ctgcctcagcctcctgagtatc

SEQ ID NO: 71958 - DNA, 22 bp, Artificial Sequence
  Synthetic oligonucleotide; CTG chr11 5158392 5158413 5158409 5158414 +
cctcagcctcctgagtatctgg

SEQ ID NO: 71959 - DNA, 22 bp, Artificial Sequence
  Synthetic oligonucleotide; CTC chr11 5158396 5158417 5158413 5158418 +
agcctcctgagtatctgggatt

SEQ ID NO: 71960 - DNA, 22 bp, Artificial Sequence
  Synthetic oligonucleotide; CTC chr11 5158402 5158423 5158419 5158424 +
ctgagtatctgggattacagga

SEQ ID NO: 71961 - DNA, 22 bp, Artificial Sequence
  Synthetic oligonucleotide; CTG chr11 5158405 5158426 5158422 5158427 +
agtatctgggattacaggagcg

SEQ ID NO: 71962 - DNA, 22 bp, Artificial Sequence
  Synthetic oligonucleotide; CTG chr11 5158413 5158434 5158430 5158435 +
ggattacaggagcgccccacca

SEQ ID NO: 71963 - DNA, 22 bp, Artificial Sequence
  Synthetic oligonucleotide; TTA chr11 5158419 5158440 5158436 5158441 +
caggagcgccccaccatgcctg

SEQ ID NO: 71964 - DNA, 22 bp, Artificial Sequence
  Synthetic oligonucleotide; CTG chr11 5158441 5158462 5158458 5158463 +
gctaatttttgtatttttagta

SEQ ID NO: 71965 - DNA, 22 bp, Artificial Sequence
  Synthetic oligonucleotide; CTA chr11 5158445 5158466 5158462 5158467 +
atttttgtatttttagtagaga

SEQ ID NO: 71966 - DNA, 22 bp, Artificial Sequence
  Synthetic oligonucleotide; TTT chr11 5158449 5158470 5158466 5158471 +
ttgtatttttagtagagacgga

SEQ ID NO: 71967 - DNA, 22 bp, Artificial Sequence
  Synthetic oligonucleotide; TTT chr11 5158450 5158471 5158467 5158472 +
tgtatttttagtagagacggag

SEQ ID NO: 71968 - DNA, 22 bp, Artificial Sequence
  Synthetic oligonucleotide; TTT chr11 5158451 5158472 5158468 5158473 +
gtatttttagtagagacggagt

SEQ ID NO: 71969 - DNA, 22 bp, Artificial Sequence
  Synthetic oligonucleotide; TTG chr11 5158452 5158473 5158469 5158474 +
tatttttagtagagacggagtg

SEQ ID NO: 71970 - DNA, 22 bp, Artificial Sequence
  Synthetic oligonucleotide; TTT chr11 5158457 5158478 5158474 5158479 +
ttagtagagacggagtgtcacc

SEQ ID NO: 71971 - DNA, 22 bp, Artificial Sequence
  Synthetic oligonucleotide; TTT chr11 5158458 5158479 5158475 5158480 +
tagtagagacggagtgtcacca

SEQ ID NO: 71972 - DNA, 22 bp, Artificial Sequence
  Synthetic oligonucleotide; TTT chr11 5158459 5158480 5158476 5158481 +
agtagagacggagtgtcaccac

SEQ ID NO: 71973 - DNA, 22 bp, Artificial Sequence
  Synthetic oligonucleotide; TTA chr11 5158460 5158481 5158477 5158482 +
gtagagacggagtgtcaccacg

SEQ ID NO: 71974 - DNA, 22 bp, Artificial Sequence
  Synthetic oligonucleotide; TTG chr11 5158485 5158506 5158502 5158507 +
gtcaggctggtcttgaactcct

SEQ ID NO: 71975 - DNA, 22 bp, Artificial Sequence
  Synthetic oligonucleotide; CTG chr11 5158494 5158515 5158511 5158516 +
gtcttgaactcctgacctcgtg

SEQ ID NO: 71976 - DNA, 22 bp, Artificial Sequence
  Synthetic oligonucleotide; CTT chr11 5158499 5158520 5158516 5158521 +
gaactcctgacctcgtgatccc

SEQ ID NO: 71977 - DNA, 22 bp, Artificial Sequence
  Synthetic oligonucleotide; TTG chr11 5158500 5158521 5158517 5158522 +
aactcctgacctcgtgatcccc

SEQ ID NO: 71978 - DNA, 22 bp, Artificial Sequence
  Synthetic oligonucleotide; CTC chr11 5158505 5158526 5158522 5158527 +
ctgacctcgtgatccccccacc

SEQ ID NO: 71979 - DNA, 22 bp, Artificial Sequence
  Synthetic oligonucleotide; CTG chr11 5158508 5158529 5158525 5158530 +
acctcgtgatccccccacctca

SEQ ID NO: 71980 - DNA, 22 bp, Artificial Sequence
  Synthetic oligonucleotide; CTC chr11 5158513 5158534 5158530 5158535 +
gtgatccccccacctcagcctc

SEQ ID NO: 71981 - DNA, 22 bp, Artificial Sequence
  Synthetic oligonucleotide; CTC chr11 5158529 5158550 5158546 5158551 +
agcctcacaaagtgctgggatt

SEQ ID NO: 71982 - DNA, 22 bp, Artificial Sequence
  Synthetic oligonucleotide; CTC chr11 5158535 5158556 5158552 5158557 +
acaaagtgctgggattacaggt

SEQ ID NO: 71983 - DNA, 22 bp, Artificial Sequence
  Synthetic oligonucleotide; CTG chr11 5158546 5158567 5158563 5158568 +
ggattacaggtgtgagccactg

SEQ ID NO: 71984 - DNA, 22 bp, Artificial Sequence
  Synthetic oligonucleotide; TTA chr11 5158552 5158573 5158569 5158574 +
caggtgtgagccactgcacctg

SEQ ID NO: 71985 - DNA, 22 bp, Artificial Sequence
  Synthetic oligonucleotide; CTG chr11 5158568 5158589 5158585 5158590 +
cacctggcccatttgttcctat

SEQ ID NO: 71986 - DNA, 22 bp, Artificial Sequence
  Synthetic oligonucleotide; CTG chr11 5158574 5158595 5158591 5158596 +
gcccatttgttcctatttttat

SEQ ID NO: 71987 - DNA, 22 bp, Artificial Sequence
  Synthetic oligonucleotide; TTT chr11 5158582 5158603 5158599 5158604 +
gttcctatttttatgttcttga

SEQ ID NO: 71988 - DNA, 22 bp, Artificial Sequence
  Synthetic oligonucleotide; TTG chr11 5158583 5158604 5158600 5158605 +
ttcctatttttatgttcttgat

SEQ ID NO: 71989 - DNA, 22 bp, Artificial Sequence
  Synthetic oligonucleotide; TTC chr11 5158586 5158607 5158603 5158608 +
ctatttttatgttcttgatgcc

SEQ ID NO: 71990 - DNA, 22 bp, Artificial Sequence
  Synthetic oligonucleotide; CTA chr11 5158589 5158610 5158606 5158611 +
tttttatgttcttgatgccttt

SEQ ID NO: 71991 - DNA, 22 bp, Artificial Sequence
  Synthetic oligonucleotide; TTT chr11 5158592 5158613 5158609 5158614 +
ttatgttcttgatgcctttgtt

SEQ ID NO: 71992 - DNA, 22 bp, Artificial Sequence
  Synthetic oligonucleotide; TTT chr11 5158593 5158614 5158610 5158615 +
tatgttcttgatgcctttgtta

SEQ ID NO: 71993 - DNA, 22 bp, Artificial Sequence
  Synthetic oligonucleotide; TTT chr11 5158594 5158615 5158611 5158616 +
atgttcttgatgcctttgttaa

SEQ ID NO: 71994 - DNA, 22 bp, Artificial Sequence
  Synthetic oligonucleotide; TTA chr11 5158595 5158616 5158612 5158617 +
tgttcttgatgcctttgttaaa

SEQ ID NO: 71995 - DNA, 22 bp, Artificial Sequence
  Synthetic oligonucleotide; TTC chr11 5158600 5158621 5158617 5158622 +
ttgatgcctttgttaaagatga

SEQ ID NO: 71996 - DNA, 22 bp, Artificial Sequence
  Synthetic oligonucleotide; CTT chr11 5158602 5158623 5158619 5158624 +
gatgcctttgttaaagatgact

SEQ ID NO: 71997 - DNA, 22 bp, Artificial Sequence
  Synthetic oligonucleotide; TTG chr11 5158603 5158624 5158620 5158625 +
atgcctttgttaaagatgactt

SEQ ID NO: 71998 - DNA, 22 bp, Artificial Sequence
  Synthetic oligonucleotide; CTT chr11 5158610 5158631 5158627 5158632 +
tgttaaagatgacttggttgtt

SEQ ID NO: 71999 - DNA, 22 bp, Artificial Sequence
  Synthetic oligonucleotide; TTT chr11 5158611 5158632 5158628 5158633 +
gttaaagatgacttggttgtta

SEQ ID NO: 72000 - DNA, 22 bp, Artificial Sequence
  Synthetic oligonucleotide; TTG chr11 5158612 5158633 5158629 5158634 +
ttaaagatgacttggttgttaa

SEQ ID NO: 72001 - DNA, 22 bp, Artificial Sequence
  Synthetic oligonucleotide; TTA chr11 5158615 5158636 5158632 5158637 +
aagatgacttggttgttaagtg

SEQ ID NO: 72002 - DNA, 22 bp, Artificial Sequence
  Synthetic oligonucleotide; CTT chr11 5158625 5158646 5158642 5158647 +
ggttgttaagtgcctggatttg

SEQ ID NO: 72003 - DNA, 22 bp, Artificial Sequence
  Synthetic oligonucleotide; TTG chr11 5158626 5158647 5158643 5158648 +
gttgttaagtgcctggatttgc

SEQ ID NO: 72004 - DNA, 22 bp, Artificial Sequence
  Synthetic oligonucleotide; TTG chr11 5158630 5158651 5158647 5158652 +
ttaagtgcctggatttgcatct

SEQ ID NO: 72005 - DNA, 22 bp, Artificial Sequence
  Synthetic oligonucleotide; TTA chr11 5158633 5158654 5158650 5158655 +
agtgcctggatttgcatctggg

SEQ ID NO: 72006 - DNA, 22 bp, Artificial Sequence
  Synthetic oligonucleotide; CTG chr11 5158641 5158662 5158658 5158663 +
gatttgcatctgggttctctat

SEQ ID NO: 72007 - DNA, 22 bp, Artificial Sequence
  Synthetic oligonucleotide; TTT chr11 5158646 5158667 5158663 5158668 +
gcatctgggttctctatgctgt

SEQ ID NO: 72008 - DNA, 22 bp, Artificial Sequence
  Synthetic oligonucleotide; TTG chr11 5158647 5158668 5158664 5158669 +
catctgggttctctatgctgtt

SEQ ID NO: 72009 - DNA, 22 bp, Artificial Sequence
  Synthetic oligonucleotide; CTG chr11 5158653 5158674 5158670 5158675 +
ggttctctatgctgttccattg

SEQ ID NO: 72010 - DNA, 22 bp, Artificial Sequence
  Synthetic oligonucleotide; TTC chr11 5158658 5158679 5158675 5158680 +
tctatgctgttccattgggctg

SEQ ID NO: 72011 - DNA, 22 bp, Artificial Sequence
  Synthetic oligonucleotide; CTC chr11 5158660 5158681 5158677 5158682 +
tatgctgttccattgggctgta

SEQ ID NO: 72012 - DNA, 22 bp, Artificial Sequence
  Synthetic oligonucleotide; CTA chr11 5158662 5158683 5158679 5158684 +
tgctgttccattgggctgtatg

SEQ ID NO: 72013 - DNA, 22 bp, Artificial Sequence
  Synthetic oligonucleotide; CTG chr11 5158667 5158688 5158684 5158689 +
ttccattgggctgtatgtctgt

SEQ ID NO: 72014 - DNA, 22 bp, Artificial Sequence
  Synthetic oligonucleotide; TTC chr11 5158670 5158691 5158687 5158692 +
cattgggctgtatgtctgtctt

SEQ ID NO: 72015 - DNA, 22 bp, Artificial Sequence
  Synthetic oligonucleotide; TTG chr11 5158675 5158696 5158692 5158697 +
ggctgtatgtctgtctttatgc

SEQ ID NO: 72016 - DNA, 22 bp, Artificial Sequence
  Synthetic oligonucleotide; CTG chr11 5158680 5158701 5158697 5158702 +
tatgtctgtctttatgcagtac

SEQ ID NO: 72017 - DNA, 22 bp, Artificial Sequence
  Synthetic oligonucleotide; CTG chr11 5158688 5158709 5158705 5158710 +
tctttatgcagtactgtgctgt

SEQ ID NO: 72018 - DNA, 22 bp, Artificial Sequence
  Synthetic oligonucleotide; CTT chr11 5158692 5158713 5158709 5158714 +
tatgcagtactgtgctgtttgg

SEQ ID NO: 72019 - DNA, 22 bp, Artificial Sequence
  Synthetic oligonucleotide; TTT chr11 5158693 5158714 5158710 5158715 +
atgcagtactgtgctgtttggc

SEQ ID NO: 72020 - DNA, 22 bp, Artificial Sequence
  Synthetic oligonucleotide; TTA chr11 5158694 5158715 5158711 5158716 +
tgcagtactgtgctgtttggct

SEQ ID NO: 72021 - DNA, 22 bp, Artificial Sequence
  Synthetic oligonucleotide; CTG chr11 5158704 5158725 5158721 5158726 +
tgctgtttggctactgtagctt

SEQ ID NO: 72022 - DNA, 22 bp, Artificial Sequence
  Synthetic oligonucleotide; CTG chr11 5158709 5158730 5158726 5158731 +
tttggctactgtagctttgtag

SEQ ID NO: 72023 - DNA, 22 bp, Artificial Sequence
  Synthetic oligonucleotide; TTT chr11 5158712 5158733 5158729 5158734 +
ggctactgtagctttgtagtag

SEQ ID NO: 72024 - DNA, 22 bp, Artificial Sequence
  Synthetic oligonucleotide; TTG chr11 5158713 5158734 5158730 5158735 +
gctactgtagctttgtagtaga

SEQ ID NO: 72025 - DNA, 22 bp, Artificial Sequence
  Synthetic oligonucleotide; CTA chr11 5158717 5158738 5158734 5158739 +
ctgtagctttgtagtagatttt

SEQ ID NO: 72026 - DNA, 22 bp, Artificial Sequence
  Synthetic oligonucleotide; CTG chr11 5158720 5158741 5158737 5158742 +
tagctttgtagtagattttgaa

SEQ ID NO: 72027 - DNA, 22 bp, Artificial Sequence
  Synthetic oligonucleotide; CTT chr11 5158726 5158747 5158743 5158748 +
tgtagtagattttgaagtcata

SEQ ID NO: 72028 - DNA, 22 bp, Artificial Sequence
  Synthetic oligonucleotide; TTT chr11 5158727 5158748 5158744 5158749 +
gtagtagattttgaagtcatat

SEQ ID NO: 72029 - DNA, 22 bp, Artificial Sequence
  Synthetic oligonucleotide; TTG chr11 5158728 5158749 5158745 5158750 +
tagtagattttgaagtcatata

SEQ ID NO: 72030 - DNA, 22 bp, Artificial Sequence
  Synthetic oligonucleotide; TTT chr11 5158738 5158759 5158755 5158760 +
tgaagtcatatagtgtgatagc

SEQ ID NO: 72031 - DNA, 22 bp, Artificial Sequence
  Synthetic oligonucleotide; TTT chr11 5158739 5158760 5158756 5158761 +
gaagtcatatagtgtgatagct

SEQ ID NO: 72032 - DNA, 22 bp, Artificial Sequence
  Synthetic oligonucleotide; TTG chr11 5158740 5158761 5158757 5158762 +
aagtcatatagtgtgatagctt

SEQ ID NO: 72033 - DNA, 22 bp, Artificial Sequence
  Synthetic oligonucleotide; CTT chr11 5158762 5158783 5158779 5158784 +
tggttttgttctttttgctcag

SEQ ID NO: 72034 - DNA, 22 bp, Artificial Sequence
  Synthetic oligonucleotide; TTT chr11 5158763 5158784 5158780 5158785 +
ggttttgttctttttgctcagg

SEQ ID NO: 72035 - DNA, 22 bp, Artificial Sequence
  Synthetic oligonucleotide; TTG chr11 5158764 5158785 5158781 5158786 +
gttttgttctttttgctcagga

SEQ ID NO: 72036 - DNA, 22 bp, Artificial Sequence
  Synthetic oligonucleotide; TTT chr11 5158768 5158789 5158785 5158790 +
tgttctttttgctcaggattgc

SEQ ID NO: 72037 - DNA, 22 bp, Artificial Sequence
  Synthetic oligonucleotide; TTT chr11 5158769 5158790 5158786 5158791 +
gttctttttgctcaggattgct

SEQ ID NO: 72038 - DNA, 22 bp, Artificial Sequence
  Synthetic oligonucleotide; TTG chr11 5158770 5158791 5158787 5158792 +
ttctttttgctcaggattgctt

SEQ ID NO: 72039 - DNA, 22 bp, Artificial Sequence
  Synthetic oligonucleotide; TTC chr11 5158773 5158794 5158790 5158795 +
tttttgctcaggattgctttag

SEQ ID NO: 72040 - DNA, 22 bp, Artificial Sequence
  Synthetic oligonucleotide; CTT chr11 5158775 5158796 5158792 5158797 +
tttgctcaggattgctttagct

SEQ ID NO: 72041 - DNA, 22 bp, Artificial Sequence
  Synthetic oligonucleotide; TTT chr11 5158776 5158797 5158793 5158798 +
ttgctcaggattgctttagcta

SEQ ID NO: 72042 - DNA, 22 bp, Artificial Sequence
  Synthetic oligonucleotide; TTT chr11 5158777 5158798 5158794 5158799 +
tgctcaggattgctttagctat

SEQ ID NO: 72043 - DNA, 22 bp, Artificial Sequence
  Synthetic oligonucleotide; TTT chr11 5158778 5158799 5158795 5158800 +
gctcaggattgctttagctatt

SEQ ID NO: 72044 - DNA, 22 bp, Artificial Sequence
  Synthetic oligonucleotide; TTG chr11 5158779 5158800 5158796 5158801 +
ctcaggattgctttagctattg

SEQ ID NO: 72045 - DNA, 22 bp, Artificial Sequence
  Synthetic oligonucleotide; CTC chr11 5158782 5158803 5158799 5158804 +
aggattgctttagctattgggg

SEQ ID NO: 72046 - DNA, 22 bp, Artificial Sequence
  Synthetic oligonucleotide; TTG chr11 5158789 5158810 5158806 5158811 +
ctttagctattggggatctttt

SEQ ID NO: 72047 - DNA, 22 bp, Artificial Sequence
  Synthetic oligonucleotide; CTT chr11 5158792 5158813 5158809 5158814 +
tagctattggggatcttttgtg

SEQ ID NO: 72048 - DNA, 22 bp, Artificial Sequence
  Synthetic oligonucleotide; TTT chr11 5158793 5158814 5158810 5158815 +
agctattggggatcttttgtgg

SEQ ID NO: 72049 - DNA, 22 bp, Artificial Sequence
  Synthetic oligonucleotide; TTA chr11 5158794 5158815 5158811 5158816 +
gctattggggatcttttgtggt

SEQ ID NO: 72050 - DNA, 22 bp, Artificial Sequence
  Synthetic oligonucleotide; CTA chr11 5158798 5158819 5158815 5158820 +
ttggggatcttttgtggttcca

SEQ ID NO: 72051 - DNA, 22 bp, Artificial Sequence
  Synthetic oligonucleotide; TTG chr11 5158801 5158822 5158818 5158823 +
gggatcttttgtggttccatat

SEQ ID NO: 72052 - DNA, 22 bp, Artificial Sequence
  Synthetic oligonucleotide; CTT chr11 5158809 5158830 5158826 5158831 +
ttgtggttccatataaatatta

SEQ ID NO: 72053 - DNA, 22 bp, Artificial Sequence
  Synthetic oligonucleotide; TTT chr11 5158810 5158831 5158827 5158832 +
tgtggttccatataaatattag

SEQ ID NO: 72054 - DNA, 22 bp, Artificial Sequence
  Synthetic oligonucleotide; TTT chr11 5158811 5158832 5158828 5158833 +
gtggttccatataaatattagg

SEQ ID NO: 72055 - DNA, 22 bp, Artificial Sequence
  Synthetic oligonucleotide; TTG chr11 5158812 5158833 5158829 5158834 +
tggttccatataaatattagga

SEQ ID NO: 72056 - DNA, 22 bp, Artificial Sequence
  Synthetic oligonucleotide; TTC chr11 5158818 5158839 5158835 5158840 +
catataaatattaggattgttt

SEQ ID NO: 72057 - DNA, 22 bp, Artificial Sequence
  Synthetic oligonucleotide; TTA chr11 5158831 5158852 5158848 5158853 +
ggattgtttttctatttctgtg

SEQ ID NO: 72058 - DNA, 22 bp, Artificial Sequence
  Synthetic oligonucleotide; TTG chr11 5158837 5158858 5158854 5158859 +
tttttctatttctgtgaatgcc

SEQ ID NO: 72059 - DNA, 22 bp, Artificial Sequence
  Synthetic oligonucleotide; TTT chr11 5158840 5158861 5158857 5158862 +
ttctatttctgtgaatgccatt

SEQ ID NO: 72060 - DNA, 22 bp, Artificial Sequence
  Synthetic oligonucleotide; TTT chr11 5158841 5158862 5158858 5158863 +
tctatttctgtgaatgccattg

SEQ ID NO: 72061 - DNA, 22 bp, Artificial Sequence
  Synthetic oligonucleotide; TTT chr11 5158842 5158863 5158859 5158864 +
ctatttctgtgaatgccattgg

SEQ ID NO: 72062 - DNA, 22 bp, Artificial Sequence
  Synthetic oligonucleotide; TTC chr11 5158843 5158864 5158860 5158865 +
tatttctgtgaatgccattggt

SEQ ID NO: 72063 - DNA, 22 bp, Artificial Sequence
  Synthetic oligonucleotide; CTA chr11 5158845 5158866 5158862 5158867 +
tttctgtgaatgccattggtat

SEQ ID NO: 72064 - DNA, 22 bp, Artificial Sequence
  Synthetic oligonucleotide; TTT chr11 5158848 5158869 5158865 5158870 +
ctgtgaatgccattggtatttt

SEQ ID NO: 72065 - DNA, 22 bp, Artificial Sequence
  Synthetic oligonucleotide; TTC chr11 5158849 5158870 5158866 5158871 +
tgtgaatgccattggtattttg

SEQ ID NO: 72066 - DNA, 22 bp, Artificial Sequence
  Synthetic oligonucleotide; CTG chr11 5158851 5158872 5158868 5158873 +
tgaatgccattggtattttgac

SEQ ID NO: 72067 - DNA, 22 bp, Artificial Sequence
  Synthetic oligonucleotide; TTG chr11 5158863 5158884 5158880 5158885 +
gtattttgacagaaattgcact

SEQ ID NO: 72068 - DNA, 22 bp, Artificial Sequence
  Synthetic oligonucleotide; TTT chr11 5158869 5158890 5158886 5158891 +
tgacagaaattgcactgaatct

SEQ ID NO: 72069 - DNA, 22 bp, Artificial Sequence
  Synthetic oligonucleotide; TTT chr11 5158870 5158891 5158887 5158892 +
gacagaaattgcactgaatctg

SEQ ID NO: 72070 - DNA, 22 bp, Artificial Sequence
  Synthetic oligonucleotide; TTG chr11 5158871 5158892 5158888 5158893 +
acagaaattgcactgaatctgt

SEQ ID NO: 72071 - DNA, 22 bp, Artificial Sequence
  Synthetic oligonucleotide; TTG chr11 5158881 5158902 5158898 5158903 +
cactgaatctgtacattgcttt

SEQ ID NO: 72072 - DNA, 22 bp, Artificial Sequence
  Synthetic oligonucleotide; CTG chr11 5158886 5158907 5158903 5158908 +
aatctgtacattgctttgggta

SEQ ID NO: 72073 - DNA, 22 bp, Artificial Sequence
  Synthetic oligonucleotide; CTG chr11 5158892 5158913 5158909 5158914 +
tacattgctttgggtagtattg

SEQ ID NO: 72074 - DNA, 22 bp, Artificial Sequence
  Synthetic oligonucleotide; TTG chr11 5158899 5158920 5158916 5158921 +
ctttgggtagtattgtcatttt

SEQ ID NO: 72075 - DNA, 22 bp, Artificial Sequence
  Synthetic oligonucleotide; CTT chr11 5158902 5158923 5158919 5158924 +
tgggtagtattgtcattttaat

SEQ ID NO: 72076 - DNA, 22 bp, Artificial Sequence
  Synthetic oligonucleotide; TTT chr11 5158903 5158924 5158920 5158925 +
gggtagtattgtcattttaata

SEQ ID NO: 72077 - DNA, 22 bp, Artificial Sequence
  Synthetic oligonucleotide; TTG chr11 5158904 5158925 5158921 5158926 +
ggtagtattgtcattttaatat

SEQ ID NO: 72078 - DNA, 22 bp, Artificial Sequence
  Synthetic oligonucleotide; TTG chr11 5158914 5158935 5158931 5158936 +
tcattttaatattaattcttct

SEQ ID NO: 72079 - DNA, 22 bp, Artificial Sequence
  Synthetic oligonucleotide; TTT chr11 5158920 5158941 5158937 5158942 +
taatattaattcttctagttca

SEQ ID NO: 72080 - DNA, 22 bp, Artificial Sequence
  Synthetic oligonucleotide; TTT chr11 5158921 5158942 5158938 5158943 +
aatattaattcttctagttcat

SEQ ID NO: 72081 - DNA, 22 bp, Artificial Sequence
  Synthetic oligonucleotide; TTA chr11 5158922 5158943 5158939 5158944 +
atattaattcttctagttcatg

SEQ ID NO: 72082 - DNA, 22 bp, Artificial Sequence
  Synthetic oligonucleotide; TTA chr11 5158928 5158949 5158945 5158950 +
attcttctagttcatgagcatg

SEQ ID NO: 72083 - DNA, 22 bp, Artificial Sequence
  Synthetic oligonucleotide; TTC chr11 5158932 5158953 5158949 5158954 +
ttctagttcatgagcatggaat

SEQ ID NO: 72084 - DNA, 22 bp, Artificial Sequence
  Synthetic oligonucleotide; CTT chr11 5158934 5158955 5158951 5158956 +
ctagttcatgagcatggaatat

SEQ ID NO: 72085 - DNA, 22 bp, Artificial Sequence
  Synthetic oligonucleotide; TTC chr11 5158935 5158956 5158952 5158957 +
tagttcatgagcatggaatatc

SEQ ID NO: 72086 - DNA, 22 bp, Artificial Sequence
  Synthetic oligonucleotide; CTA chr11 5158937 5158958 5158954 5158959 +
gttcatgagcatggaatatcgt

SEQ ID NO: 72087 - DNA, 22 bp, Artificial Sequence
  Synthetic oligonucleotide; TTC chr11 5158941 5158962 5158958 5158963 +
atgagcatggaatatcgttcca

SEQ ID NO: 72088 - DNA, 22 bp, Artificial Sequence
  Synthetic oligonucleotide; TTC chr11 5158961 5158982 5158978 5158983 +
cattttatttgtgtgccctctt

SEQ ID NO: 72089 - DNA, 22 bp, Artificial Sequence
  Synthetic oligonucleotide; TTT chr11 5158966 5158987 5158983 5158988 +
tatttgtgtgccctcttctatt

SEQ ID NO: 72090 - DNA, 22 bp, Artificial Sequence
  Synthetic oligonucleotide; TTT chr11 5158967 5158988 5158984 5158989 +
atttgtgtgccctcttctattt

SEQ ID NO: 72091 - DNA, 22 bp, Artificial Sequence
  Synthetic oligonucleotide; TTA chr11 5158968 5158989 5158985 5158990 +
tttgtgtgccctcttctatttc

SEQ ID NO: 72092 - DNA, 22 bp, Artificial Sequence
  Synthetic oligonucleotide; TTT chr11 5158971 5158992 5158988 5158993 +
gtgtgccctcttctatttcttt

SEQ ID NO: 72093 - DNA, 22 bp, Artificial Sequence
  Synthetic oligonucleotide; TTG chr11 5158972 5158993 5158989 5158994 +
tgtgccctcttctatttctttc

SEQ ID NO: 72094 - DNA, 22 bp, Artificial Sequence
  Synthetic oligonucleotide; CTC chr11 5158981 5159002 5158998 5159003 +
ttctatttctttcaccagagtt

SEQ ID NO: 72095 - DNA, 22 bp, Artificial Sequence
  Synthetic oligonucleotide; CTT chr11 5158983 5159004 5159000 5159005 +
ctatttctttcaccagagtttt

SEQ ID NO: 72096 - DNA, 22 bp, Artificial Sequence
  Synthetic oligonucleotide; TTC chr11 5158984 5159005 5159001 5159006 +
tatttctttcaccagagtttta

SEQ ID NO: 72097 - DNA, 22 bp, Artificial Sequence
  Synthetic oligonucleotide; CTA chr11 5158986 5159007 5159003 5159008 +
tttctttcaccagagttttata

SEQ ID NO: 72098 - DNA, 22 bp, Artificial Sequence
  Synthetic oligonucleotide; TTT chr11 5158989 5159010 5159006 5159011 +
ctttcaccagagttttataatt

SEQ ID NO: 72099 - DNA, 22 bp, Artificial Sequence
  Synthetic oligonucleotide; TTC chr11 5158990 5159011 5159007 5159012 +
tttcaccagagttttataattt

SEQ ID NO: 72100 - DNA, 22 bp, Artificial Sequence
  Synthetic oligonucleotide; CTT chr11 5158992 5159013 5159009 5159014 +
tcaccagagttttataattttt

SEQ ID NO: 72101 - DNA, 22 bp, Artificial Sequence
  Synthetic oligonucleotide; TTT chr11 5158993 5159014 5159010 5159015 +
caccagagttttataatttttc

SEQ ID NO: 72102 - DNA, 22 bp, Artificial Sequence
  Synthetic oligonucleotide; TTC chr11 5158994 5159015 5159011 5159016 +
accagagttttataatttttct

SEQ ID NO: 72103 - DNA, 22 bp, Artificial Sequence
  Synthetic oligonucleotide; TTT chr11 5159004 5159025 5159021 5159026 +
tataatttttcttatagagatc

SEQ ID NO: 72104 - DNA, 22 bp, Artificial Sequence
  Synthetic oligonucleotide; TTT chr11 5159005 5159026 5159022 5159027 +
ataatttttcttatagagatct

SEQ ID NO: 72105 - DNA, 22 bp, Artificial Sequence
  Synthetic oligonucleotide; TTA chr11 5159006 5159027 5159023 5159028 +
taatttttcttatagagatctt

SEQ ID NO: 72106 - DNA, 22 bp, Artificial Sequence
  Synthetic oligonucleotide; TTT chr11 5159012 5159033 5159029 5159034 +
ttcttatagagatcttttactt

SEQ ID NO: 72107 - DNA, 22 bp, Artificial Sequence
  Synthetic oligonucleotide; TTT chr11 5159013 5159034 5159030 5159035 +
tcttatagagatcttttacttc

SEQ ID NO: 72108 - DNA, 22 bp, Artificial Sequence
  Synthetic oligonucleotide; TTT chr11 5159014 5159035 5159031 5159036 +
cttatagagatcttttacttct

SEQ ID NO: 72109 - DNA, 22 bp, Artificial Sequence
  Synthetic oligonucleotide; TTC chr11 5159015 5159036 5159032 5159037 +
ttatagagatcttttacttctt

SEQ ID NO: 72110 - DNA, 22 bp, Artificial Sequence
  Synthetic oligonucleotide; CTT chr11 5159017 5159038 5159034 5159039 +
atagagatcttttacttcttgg

SEQ ID NO: 72111 - DNA, 22 bp, Artificial Sequence
  Synthetic oligonucleotide; TTA chr11 5159018 5159039 5159035 5159040 +
tagagatcttttacttcttggg

SEQ ID NO: 72112 - DNA, 22 bp, Artificial Sequence
  Synthetic oligonucleotide; CTT chr11 5159028 5159049 5159045 5159050 +
ttacttcttgggttagattgac

SEQ ID NO: 72113 - DNA, 22 bp, Artificial Sequence
  Synthetic oligonucleotide; TTT chr11 5159029 5159050 5159046 5159051 +
tacttcttgggttagattgact

SEQ ID NO: 72114 - DNA, 22 bp, Artificial Sequence
  Synthetic oligonucleotide; TTT chr11 5159030 5159051 5159047 5159052 +
acttcttgggttagattgactc

SEQ ID NO: 72115 - DNA, 22 bp, Artificial Sequence
  Synthetic oligonucleotide; TTA chr11 5159031 5159052 5159048 5159053 +
cttcttgggttagattgactcc

SEQ ID NO: 72116 - DNA, 22 bp, Artificial Sequence
  Synthetic oligonucleotide; CTT chr11 5159034 5159055 5159051 5159056 +
cttgggttagattgactcctgg

SEQ ID NO: 72117 - DNA, 22 bp, Artificial Sequence
  Synthetic oligonucleotide; TTC chr11 5159035 5159056 5159052 5159057 +
ttgggttagattgactcctggg

SEQ ID NO: 72118 - DNA, 22 bp, Artificial Sequence
  Synthetic oligonucleotide; CTT chr11 5159037 5159058 5159054 5159059 +
gggttagattgactcctgggta

SEQ ID NO: 72119 - DNA, 22 bp, Artificial Sequence
  Synthetic oligonucleotide; TTG chr11 5159038 5159059 5159055 5159060 +
ggttagattgactcctgggtat

SEQ ID NO: 72120 - DNA, 22 bp, Artificial Sequence
  Synthetic oligonucleotide; TTA chr11 5159043 5159064 5159060 5159065 +
gattgactcctgggtattttat

SEQ ID NO: 72121 - DNA, 22 bp, Artificial Sequence
  Synthetic oligonucleotide; TTG chr11 5159048 5159069 5159065 5159070 +
actcctgggtattttatatttt

SEQ ID NO: 72122 - DNA, 22 bp, Artificial Sequence
  Synthetic oligonucleotide; CTC chr11 5159052 5159073 5159069 5159074 +
ctgggtattttatatttttatt

SEQ ID NO: 72123 - DNA, 22 bp, Artificial Sequence
  Synthetic oligonucleotide; CTG chr11 5159055 5159076 5159072 5159077 +
ggtattttatatttttattgct

SEQ ID NO: 72124 - DNA, 22 bp, Artificial Sequence
  Synthetic oligonucleotide; TTT chr11 5159062 5159083 5159079 5159084 +
tatatttttattgctattgtaa

SEQ ID NO: 72125 - DNA, 22 bp, Artificial Sequence
  Synthetic oligonucleotide; TTT chr11 5159063 5159084 5159080 5159085 +
atatttttattgctattgtaaa

SEQ ID NO: 72126 - DNA, 22 bp, Artificial Sequence
  Synthetic oligonucleotide; TTA chr11 5159064 5159085 5159081 5159086 +
tatttttattgctattgtaaat

SEQ ID NO: 72127 - DNA, 22 bp, Artificial Sequence
  Synthetic oligonucleotide; TTT chr11 5159069 5159090 5159086 5159091 +
ttattgctattgtaaataagat

SEQ ID NO: 72128 - DNA, 22 bp, Artificial Sequence
  Synthetic oligonucleotide; TTT chr11 5159070 5159091 5159087 5159092 +
tattgctattgtaaataagatt

SEQ ID NO: 72129 - DNA, 22 bp, Artificial Sequence
  Synthetic oligonucleotide; TTT chr11 5159071 5159092 5159088 5159093 +
attgctattgtaaataagattg

SEQ ID NO: 72130 - DNA, 22 bp, Artificial Sequence
  Synthetic oligonucleotide; TTA chr11 5159072 5159093 5159089 5159094 +
ttgctattgtaaataagattgt

SEQ ID NO: 72131 - DNA, 22 bp, Artificial Sequence
  Synthetic oligonucleotide; TTG chr11 5159075 5159096 5159092 5159097 +
ctattgtaaataagattgtttt

SEQ ID NO: 72132 - DNA, 22 bp, Artificial Sequence
  Synthetic oligonucleotide; CTA chr11 5159078 5159099 5159095 5159100 +
ttgtaaataagattgttttatt

SEQ ID NO: 72133 - DNA, 22 bp, Artificial Sequence
  Synthetic oligonucleotide; TTG chr11 5159081 5159102 5159098 5159103 +
taaataagattgttttattgat

SEQ ID NO: 72134 - DNA, 22 bp, Artificial Sequence
  Synthetic oligonucleotide; TTG chr11 5159093 5159114 5159110 5159115 +
ttttattgattttttttgcaga

SEQ ID NO: 72135 - DNA, 22 bp, Artificial Sequence
  Synthetic oligonucleotide; TTT chr11 5159096 5159117 5159113 5159118 +
tattgattttttttgcagattg

SEQ ID NO: 72136 - DNA, 22 bp, Artificial Sequence
  Synthetic oligonucleotide; TTT chr11 5159097 5159118 5159114 5159119 +
attgattttttttgcagattga

SEQ ID NO: 72137 - DNA, 22 bp, Artificial Sequence
  Synthetic oligonucleotide; TTA chr11 5159098 5159119 5159115 5159120 +
ttgattttttttgcagattgat

SEQ ID NO: 72138 - DNA, 22 bp, Artificial Sequence
  Synthetic oligonucleotide; TTG chr11 5159101 5159122 5159118 5159123 +
attttttttgcagattgataac

SEQ ID NO: 72139 - DNA, 22 bp, Artificial Sequence
  Synthetic oligonucleotide; TTT chr11 5159105 5159126 5159122 5159127 +
tttttgcagattgataactttt

SEQ ID NO: 72140 - DNA, 22 bp, Artificial Sequence
  Synthetic oligonucleotide; TTT chr11 5159106 5159127 5159123 5159128 +
ttttgcagattgataacttttt

SEQ ID NO: 72141 - DNA, 22 bp, Artificial Sequence
  Synthetic oligonucleotide; TTT chr11 5159107 5159128 5159124 5159129 +
tttgcagattgataacttttta

SEQ ID NO: 72142 - DNA, 22 bp, Artificial Sequence
  Synthetic oligonucleotide; TTT chr11 5159108 5159129 5159125 5159130 +
ttgcagattgataactttttat

SEQ ID NO: 72143 - DNA, 22 bp, Artificial Sequence
  Synthetic oligonucleotide; TTT chr11 5159109 5159130 5159126 5159131 +
tgcagattgataactttttata

SEQ ID NO: 72144 - DNA, 22 bp, Artificial Sequence
  Synthetic oligonucleotide; TTT chr11 5159110 5159131 5159127 5159132 +
gcagattgataactttttatat

SEQ ID NO: 72145 - DNA, 22 bp, Artificial Sequence
  Synthetic oligonucleotide; TTG chr11 5159111 5159132 5159128 5159133 +
cagattgataactttttatata

SEQ ID NO: 72146 - DNA, 22 bp, Artificial Sequence
  Synthetic oligonucleotide; TTG chr11 5159118 5159139 5159135 5159140 +
ataactttttatatatgaaatg

SEQ ID NO: 72147 - DNA, 22 bp, Artificial Sequence
  Synthetic oligonucleotide; CTT chr11 5159125 5159146 5159142 5159147 +
tttatatatgaaatgctactga

SEQ ID NO: 72148 - DNA, 22 bp, Artificial Sequence
  Synthetic oligonucleotide; TTT chr11 5159126 5159147 5159143 5159148 +
ttatatatgaaatgctactgat

SEQ ID NO: 72149 - DNA, 22 bp, Artificial Sequence
  Synthetic oligonucleotide; TTT chr11 5159127 5159148 5159144 5159149 +
tatatatgaaatgctactgatt

SEQ ID NO: 72150 - DNA, 22 bp, Artificial Sequence
  Synthetic oligonucleotide; TTT chr11 5159128 5159149 5159145 5159150 +
atatatgaaatgctactgattt

SEQ ID NO: 72151 - DNA, 22 bp, Artificial Sequence
  Synthetic oligonucleotide; TTA chr11 5159129 5159150 5159146 5159151 +
tatatgaaatgctactgatttt

SEQ ID NO: 72152 - DNA, 22 bp, Artificial Sequence
  Synthetic oligonucleotide; CTA chr11 5159143 5159164 5159160 5159165 +
ctgattttgtatttttatttca

SEQ ID NO: 72153 - DNA, 22 bp, Artificial Sequence
  Synthetic oligonucleotide; CTG chr11 5159146 5159167 5159163 5159168 +
attttgtatttttatttcatat

SEQ ID NO: 72154 - DNA, 22 bp, Artificial Sequence
  Synthetic oligonucleotide; TTT chr11 5159150 5159171 5159167 5159172 +
tgtatttttatttcatatcctg

SEQ ID NO: 72155 - DNA, 22 bp, Artificial Sequence
  Synthetic oligonucleotide; TTT chr11 5159151 5159172 5159168 5159173 +
gtatttttatttcatatcctgt

SEQ ID NO: 72156 - DNA, 22 bp, Artificial Sequence
  Synthetic oligonucleotide; TTG chr11 5159152 5159173 5159169 5159174 +
tatttttatttcatatcctgta

SEQ ID NO: 72157 - DNA, 22 bp, Artificial Sequence
  Synthetic oligonucleotide; TTT chr11 5159157 5159178 5159174 5159179 +
ttatttcatatcctgtaacttt

SEQ ID NO: 72158 - DNA, 22 bp, Artificial Sequence
  Synthetic oligonucleotide; TTT chr11 5159158 5159179 5159175 5159180 +
tatttcatatcctgtaacttta

SEQ ID NO: 72159 - DNA, 22 bp, Artificial Sequence
  Synthetic oligonucleotide; TTT chr11 5159159 5159180 5159176 5159181 +
atttcatatcctgtaactttat

SEQ ID NO: 72160 - DNA, 22 bp, Artificial Sequence
  Synthetic oligonucleotide; TTA chr11 5159160 5159181 5159177 5159182 +
tttcatatcctgtaactttatt

SEQ ID NO: 72161 - DNA, 22 bp, Artificial Sequence
  Synthetic oligonucleotide; TTT chr11 5159163 5159184 5159180 5159185 +
catatcctgtaactttattgat

SEQ ID NO: 72162 - DNA, 22 bp, Artificial Sequence
  Synthetic oligonucleotide; TTC chr11 5159164 5159185 5159181 5159186 +
atatcctgtaactttattgatt

SEQ ID NO: 72163 - DNA, 22 bp, Artificial Sequence
  Synthetic oligonucleotide; CTG chr11 5159172 5159193 5159189 5159194 +
taactttattgatttttttaaa

SEQ ID NO: 72164 - DNA, 22 bp, Artificial Sequence
  Synthetic oligonucleotide; CTT chr11 5159178 5159199 5159195 5159200 +
tattgatttttttaaatcgttt

SEQ ID NO: 72165 - DNA, 22 bp, Artificial Sequence
  Synthetic oligonucleotide; TTT chr11 5159179 5159200 5159196 5159201 +
attgatttttttaaatcgtttt

SEQ ID NO: 72166 - DNA, 22 bp, Artificial Sequence
  Synthetic oligonucleotide; TTA chr11 5159180 5159201 5159197 5159202 +
ttgatttttttaaatcgtttta

SEQ ID NO: 72167 - DNA, 22 bp, Artificial Sequence
  Synthetic oligonucleotide; TTG chr11 5159183 5159204 5159200 5159205 +
atttttttaaatcgttttaata

SEQ ID NO: 72168 - DNA, 22 bp, Artificial Sequence
  Synthetic oligonucleotide; TTT chr11 5159187 5159208 5159204 5159209 +
ttttaaatcgttttaatagtat

SEQ ID NO: 72169 - DNA, 22 bp, Artificial Sequence
  Synthetic oligonucleotide; TTT chr11 5159188 5159209 5159205 5159210 +
tttaaatcgttttaatagtatt

SEQ ID NO: 72170 - DNA, 22 bp, Artificial Sequence
  Synthetic oligonucleotide; TTT chr11 5159189 5159210 5159206 5159211 +
ttaaatcgttttaatagtattt

SEQ ID NO: 72171 - DNA, 22 bp, Artificial Sequence
  Synthetic oligonucleotide; TTT chr11 5159190 5159211 5159207 5159212 +
taaatcgttttaatagtattta

SEQ ID NO: 72172 - DNA, 22 bp, Artificial Sequence
  Synthetic oligonucleotide; TTT chr11 5159191 5159212 5159208 5159213 +
aaatcgttttaatagtatttag

SEQ ID NO: 72173 - DNA, 22 bp, Artificial Sequence
  Synthetic oligonucleotide; TTA chr11 5159192 5159213 5159209 5159214 +
aatcgttttaatagtatttagt

SEQ ID NO: 72174 - DNA, 22 bp, Artificial Sequence
  Synthetic oligonucleotide; TTT chr11 5159200 5159221 5159217 5159222 +
taatagtatttagtgaagtttt

SEQ ID NO: 72175 - DNA, 22 bp, Artificial Sequence
  Synthetic oligonucleotide; TTT chr11 5159201 5159222 5159218 5159223 +
aatagtatttagtgaagttttt

SEQ ID NO: 72176 - DNA, 22 bp, Artificial Sequence
  Synthetic oligonucleotide; TTA chr11 5159202 5159223 5159219 5159224 +
atagtatttagtgaagttttta

SEQ ID NO: 72177 - DNA, 22 bp, Artificial Sequence
  Synthetic oligonucleotide; TTT chr11 5159211 5159232 5159228 5159233 +
agtgaagtttttaggttttttc

SEQ ID NO: 72178 - DNA, 22 bp, Artificial Sequence
  Synthetic oligonucleotide; TTA chr11 5159212 5159233 5159229 5159234 +
gtgaagtttttaggttttttct

SEQ ID NO: 72179 - DNA, 22 bp, Artificial Sequence
  Synthetic oligonucleotide; TTT chr11 5159221 5159242 5159238 5159243 +
ttaggttttttctaagtataag

SEQ ID NO: 72180 - DNA, 22 bp, Artificial Sequence
  Synthetic oligonucleotide; TTT chr11 5159222 5159243 5159239 5159244 +
taggttttttctaagtataaga

SEQ ID NO: 72181 - DNA, 22 bp, Artificial Sequence
  Synthetic oligonucleotide; TTT chr11 5159223 5159244 5159240 5159245 +
aggttttttctaagtataagat

SEQ ID NO: 72182 - DNA, 22 bp, Artificial Sequence
  Synthetic oligonucleotide; TTA chr11 5159224 5159245 5159241 5159246 +
ggttttttctaagtataagatc

SEQ ID NO: 72183 - DNA, 22 bp, Artificial Sequence
  Synthetic oligonucleotide; TTT chr11 5159229 5159250 5159246 5159251 +
tttctaagtataagatcatgtc

SEQ ID NO: 72184 - DNA, 22 bp, Artificial Sequence
  Synthetic oligonucleotide; TTT chr11 5159230 5159251 5159247 5159252 +
ttctaagtataagatcatgtca

SEQ ID NO: 72185 - DNA, 22 bp, Artificial Sequence
  Synthetic oligonucleotide; TTT chr11 5159231 5159252 5159248 5159253 +
tctaagtataagatcatgtcat

SEQ ID NO: 72186 - DNA, 22 bp, Artificial Sequence
  Synthetic oligonucleotide; TTT chr11 5159232 5159253 5159249 5159254 +
ctaagtataagatcatgtcatc

SEQ ID NO: 72187 - DNA, 22 bp, Artificial Sequence
  Synthetic oligonucleotide; TTC chr11 5159233 5159254 5159250 5159255 +
taagtataagatcatgtcatct

SEQ ID NO: 72188 - DNA, 22 bp, Artificial Sequence
  Synthetic oligonucleotide; CTA chr11 5159235 5159256 5159252 5159257 +
agtataagatcatgtcatctac

SEQ ID NO: 72189 - DNA, 22 bp, Artificial Sequence
  Synthetic oligonucleotide; CTA chr11 5159256 5159277 5159273 5159278 +
caaactaggctaatttaacttc

SEQ ID NO: 72190 - DNA, 22 bp, Artificial Sequence
  Synthetic oligonucleotide; CTA chr11 5159263 5159284 5159280 5159285 +
ggctaatttaacttcttccttt

SEQ ID NO: 72191 - DNA, 22 bp, Artificial Sequence
  Synthetic oligonucleotide; CTA chr11 5159268 5159289 5159285 5159290 +
atttaacttcttcctttccaat

SEQ ID NO: 72192 - DNA, 22 bp, Artificial Sequence
  Synthetic oligonucleotide; TTT chr11 5159272 5159293 5159289 5159294 +
aacttcttcctttccaatttgg

SEQ ID NO: 72193 - DNA, 22 bp, Artificial Sequence
  Synthetic oligonucleotide; TTA chr11 5159273 5159294 5159290 5159295 +
acttcttcctttccaatttgga

SEQ ID NO: 72194 - DNA, 22 bp, Artificial Sequence
  Synthetic oligonucleotide; CTT chr11 5159277 5159298 5159294 5159299 +
cttcctttccaatttggatgca

SEQ ID NO: 72195 - DNA, 22 bp, Artificial Sequence
  Synthetic oligonucleotide; TTC chr11 5159278 5159299 5159295 5159300 +
ttcctttccaatttggatgcac

SEQ ID NO: 72196 - DNA, 22 bp, Artificial Sequence
  Synthetic oligonucleotide; CTT chr11 5159280 5159301 5159297 5159302 +
cctttccaatttggatgcactt

SEQ ID NO: 72197 - DNA, 22 bp, Artificial Sequence
  Synthetic oligonucleotide; TTC chr11 5159281 5159302 5159298 5159303 +
ctttccaatttggatgcacttt

SEQ ID NO: 72198 - DNA, 22 bp, Artificial Sequence
  Synthetic oligonucleotide; CTT chr11 5159284 5159305 5159301 5159306 +
tccaatttggatgcactttctt

SEQ ID NO: 72199 - DNA, 22 bp, Artificial Sequence
  Synthetic oligonucleotide; TTT chr11 5159285 5159306 5159302 5159307 +
ccaatttggatgcactttcttt

SEQ ID NO: 72200 - DNA, 22 bp, Artificial Sequence
  Synthetic oligonucleotide; TTC chr11 5159286 5159307 5159303 5159308 +
caatttggatgcactttctttc

SEQ ID NO: 72201 - DNA, 22 bp, Artificial Sequence
  Synthetic oligonucleotide; TTT chr11 5159292 5159313 5159309 5159314 +
ggatgcactttctttctcttcc

SEQ ID NO: 72202 - DNA, 22 bp, Artificial Sequence
  Synthetic oligonucleotide; TTG chr11 5159293 5159314 5159310 5159315 +
gatgcactttctttctcttcct

SEQ ID NO: 72203 - DNA, 22 bp, Artificial Sequence
  Synthetic oligonucleotide; CTT chr11 5159302 5159323 5159319 5159324 +
tctttctcttcctgaatttctc

SEQ ID NO: 72204 - DNA, 22 bp, Artificial Sequence
  Synthetic oligonucleotide; TTT chr11 5159303 5159324 5159320 5159325 +
ctttctcttcctgaatttctct

SEQ ID NO: 72205 - DNA, 22 bp, Artificial Sequence
  Synthetic oligonucleotide; TTC chr11 5159304 5159325 5159321 5159326 +
tttctcttcctgaatttctctt

SEQ ID NO: 72206 - DNA, 22 bp, Artificial Sequence
  Synthetic oligonucleotide; CTT chr11 5159306 5159327 5159323 5159328 +
tctcttcctgaatttctctttc

SEQ ID NO: 72207 - DNA, 22 bp, Artificial Sequence
  Synthetic oligonucleotide; TTT chr11 5159307 5159328 5159324 5159329 +
ctcttcctgaatttctctttcc

SEQ ID NO: 72208 - DNA, 22 bp, Artificial Sequence
  Synthetic oligonucleotide; TTC chr11 5159308 5159329 5159325 5159330 +
tcttcctgaatttctctttcca

SEQ ID NO: 72209 - DNA, 22 bp, Artificial Sequence
  Synthetic oligonucleotide; CTC chr11 5159310 5159331 5159327 5159332 +
ttcctgaatttctctttccaag

SEQ ID NO: 72210 - DNA, 22 bp, Artificial Sequence
  Synthetic oligonucleotide; CTT chr11 5159312 5159333 5159329 5159334 +
cctgaatttctctttccaagac

SEQ ID NO: 72211 - DNA, 22 bp, Artificial Sequence
  Synthetic oligonucleotide; TTC chr11 5159313 5159334 5159330 5159335 +
ctgaatttctctttccaagact

SEQ ID NO: 72212 - DNA, 22 bp, Artificial Sequence
  Synthetic oligonucleotide; CTG chr11 5159316 5159337 5159333 5159338 +
aatttctctttccaagacttcc

SEQ ID NO: 72213 - DNA, 22 bp, Artificial Sequence
  Synthetic oligonucleotide; TTT chr11 5159321 5159342 5159338 5159343 +
ctctttccaagacttccaatat

SEQ ID NO: 72214 - DNA, 22 bp, Artificial Sequence
  Synthetic oligonucleotide; TTC chr11 5159322 5159343 5159339 5159344 +
tctttccaagacttccaatatt

SEQ ID NO: 72215 - DNA, 22 bp, Artificial Sequence
  Synthetic oligonucleotide; CTC chr11 5159324 5159345 5159341 5159346 +
tttccaagacttccaatattat

SEQ ID NO: 72216 - DNA, 22 bp, Artificial Sequence
  Synthetic oligonucleotide; CTT chr11 5159326 5159347 5159343 5159348 +
tccaagacttccaatattatgt

SEQ ID NO: 72217 - DNA, 22 bp, Artificial Sequence
  Synthetic oligonucleotide; TTT chr11 5159327 5159348 5159344 5159349 +
ccaagacttccaatattatgtt

SEQ ID NO: 72218 - DNA, 22 bp, Artificial Sequence
  Synthetic oligonucleotide; TTC chr11 5159328 5159349 5159345 5159350 +
caagacttccaatattatgtta

SEQ ID NO: 72219 - DNA, 22 bp, Artificial Sequence
  Synthetic oligonucleotide; CTT chr11 5159336 5159357 5159353 5159358 +
ccaatattatgttaaataatgg

SEQ ID NO: 72220 - DNA, 22 bp, Artificial Sequence
  Synthetic oligonucleotide; TTC chr11 5159337 5159358 5159354 5159359 +
caatattatgttaaataatggc

SEQ ID NO: 72221 - DNA, 22 bp, Artificial Sequence
  Synthetic oligonucleotide; TTA chr11 5159345 5159366 5159362 5159367 +
tgttaaataatggcaatgaaag

SEQ ID NO: 72222 - DNA, 22 bp, Artificial Sequence
  Synthetic oligonucleotide; TTA chr11 5159350 5159371 5159367 5159372 +
aataatggcaatgaaagtgagc

SEQ ID NO: 72223 - DNA, 22 bp, Artificial Sequence
  Synthetic oligonucleotide; TTC chr11 5159376 5159397 5159393 5159398 +
ttgccttatttcagtccttaga

SEQ ID NO: 72224 - DNA, 22 bp, Artificial Sequence
  Synthetic oligonucleotide; CTT chr11 5159378 5159399 5159395 5159400 +
gccttatttcagtccttagagg

SEQ ID NO: 72225 - DNA, 22 bp, Artificial Sequence
  Synthetic oligonucleotide; TTG chr11 5159379 5159400 5159396 5159401 +
ccttatttcagtccttagagga

SEQ ID NO: 72226 - DNA, 22 bp, Artificial Sequence
  Synthetic oligonucleotide; CTT chr11 5159383 5159404 5159400 5159405 +
atttcagtccttagaggaaagg

SEQ ID NO: 72227 - DNA, 22 bp, Artificial Sequence
  Synthetic oligonucleotide; TTA chr11 5159384 5159405 5159401 5159406 +
tttcagtccttagaggaaaggc

SEQ ID NO: 72228 - DNA, 22 bp, Artificial Sequence
  Synthetic oligonucleotide; TTT chr11 5159387 5159408 5159404 5159409 +
cagtccttagaggaaaggcctt

SEQ ID NO: 72229 - DNA, 22 bp, Artificial Sequence
  Synthetic oligonucleotide; TTC chr11 5159388 5159409 5159405 5159410 +
agtccttagaggaaaggccttc

SEQ ID NO: 72230 - DNA, 22 bp, Artificial Sequence
  Synthetic oligonucleotide; CTT chr11 5159395 5159416 5159412 5159417 +
agaggaaaggccttcaatgttt

SEQ ID NO: 72231 - DNA, 22 bp, Artificial Sequence
  Synthetic oligonucleotide; TTA chr11 5159396 5159417 5159413 5159418 +
gaggaaaggccttcaatgtttc

SEQ ID NO: 72232 - DNA, 22 bp, Artificial Sequence
  Synthetic oligonucleotide; CTT chr11 5159409 5159430 5159426 5159431 +
caatgtttctctgttcagcata

SEQ ID NO: 72233 - DNA, 22 bp, Artificial Sequence
  Synthetic oligonucleotide; TTC chr11 5159410 5159431 5159427 5159432 +
aatgtttctctgttcagcataa

SEQ ID NO: 72234 - DNA, 22 bp, Artificial Sequence
  Synthetic oligonucleotide; TTT chr11 5159417 5159438 5159434 5159439 +
ctctgttcagcataatgttagc

SEQ ID NO: 72235 - DNA, 22 bp, Artificial Sequence
  Synthetic oligonucleotide; TTC chr11 5159418 5159439 5159435 5159440 +
tctgttcagcataatgttagca

SEQ ID NO: 72236 - DNA, 22 bp, Artificial Sequence
  Synthetic oligonucleotide; CTC chr11 5159420 5159441 5159437 5159442 +
tgttcagcataatgttagcact

SEQ ID NO: 72237 - DNA, 22 bp, Artificial Sequence
  Synthetic oligonucleotide; CTG chr11 5159422 5159443 5159439 5159444 +
ttcagcataatgttagcacttg

SEQ ID NO: 72238 - DNA, 22 bp, Artificial Sequence
  Synthetic oligonucleotide; TTC chr11 5159425 5159446 5159442 5159447 +
agcataatgttagcacttggtt

SEQ ID NO: 72239 - DNA, 22 bp, Artificial Sequence
  Synthetic oligonucleotide; TTA chr11 5159437 5159458 5159454 5159459 +
gcacttggtttgtcctatatgg

SEQ ID NO: 72240 - DNA, 22 bp, Artificial Sequence
  Synthetic oligonucleotide; CTT chr11 5159443 5159464 5159460 5159465 +
ggtttgtcctatatggttttta

SEQ ID NO: 72241 - DNA, 22 bp, Artificial Sequence
  Synthetic oligonucleotide; TTG chr11 5159444 5159465 5159461 5159466 +
gtttgtcctatatggtttttat

SEQ ID NO: 72242 - DNA, 22 bp, Artificial Sequence
  Synthetic oligonucleotide; TTT chr11 5159448 5159469 5159465 5159470 +
gtcctatatggtttttattatt

SEQ ID NO: 72243 - DNA, 22 bp, Artificial Sequence
  Synthetic oligonucleotide; TTG chr11 5159449 5159470 5159466 5159471 +
tcctatatggtttttattattt

SEQ ID NO: 72244 - DNA, 22 bp, Artificial Sequence
  Synthetic oligonucleotide; CTA chr11 5159454 5159475 5159471 5159476 +
tatggtttttattattttgagg

SEQ ID NO: 72245 - DNA, 22 bp, Artificial Sequence
  Synthetic oligonucleotide; TTT chr11 5159462 5159483 5159479 5159484 +
ttattattttgaggtatgttcc

SEQ ID NO: 72246 - DNA, 22 bp, Artificial Sequence
  Synthetic oligonucleotide; TTT chr11 5159463 5159484 5159480 5159485 +
tattattttgaggtatgttcct

SEQ ID NO: 72247 - DNA, 22 bp, Artificial Sequence
  Synthetic oligonucleotide; TTT chr11 5159464 5159485 5159481 5159486 +
attattttgaggtatgttccta

SEQ ID NO: 72248 - DNA, 22 bp, Artificial Sequence
  Synthetic oligonucleotide; TTA chr11 5159465 5159486 5159482 5159487 +
ttattttgaggtatgttcctac

SEQ ID NO: 72249 - DNA, 22 bp, Artificial Sequence
  Synthetic oligonucleotide; TTA chr11 5159468 5159489 5159485 5159490 +
ttttgaggtatgttcctactgt

SEQ ID NO: 72250 - DNA, 22 bp, Artificial Sequence
  Synthetic oligonucleotide; TTT chr11 5159471 5159492 5159488 5159493 +
tgaggtatgttcctactgtacc

SEQ ID NO: 72251 - DNA, 22 bp, Artificial Sequence
  Synthetic oligonucleotide; TTT chr11 5159472 5159493 5159489 5159494 +
gaggtatgttcctactgtacct

SEQ ID NO: 72252 - DNA, 22 bp, Artificial Sequence
  Synthetic oligonucleotide; TTG chr11 5159473 5159494 5159490 5159495 +
aggtatgttcctactgtacctc

SEQ ID NO: 72253 - DNA, 22 bp, Artificial Sequence
  Synthetic oligonucleotide; TTC chr11 5159483 5159504 5159500 5159505 +
ctactgtacctcctttgaggtg

SEQ ID NO: 72254 - DNA, 22 bp, Artificial Sequence
  Synthetic oligonucleotide; CTA chr11 5159486 5159507 5159503 5159508 +
ctgtacctcctttgaggtgcat

SEQ ID NO: 72255 - DNA, 22 bp, Artificial Sequence
  Synthetic oligonucleotide; CTG chr11 5159489 5159510 5159506 5159511 +
tacctcctttgaggtgcatttg

SEQ ID NO: 72256 - DNA, 22 bp, Artificial Sequence
  Synthetic oligonucleotide; CTC chr11 5159495 5159516 5159512 5159517 +
ctttgaggtgcatttgttgttg

SEQ ID NO: 72257 - DNA, 22 bp, Artificial Sequence
  Synthetic oligonucleotide; CTT chr11 5159498 5159519 5159515 5159520 +
tgaggtgcatttgttgttgtgt

SEQ ID NO: 72258 - DNA, 22 bp, Artificial Sequence
  Synthetic oligonucleotide; TTT chr11 5159499 5159520 5159516 5159521 +
gaggtgcatttgttgttgtgtc

SEQ ID NO: 72259 - DNA, 22 bp, Artificial Sequence
  Synthetic oligonucleotide; TTG chr11 5159500 5159521 5159517 5159522 +
aggtgcatttgttgttgtgtcc

SEQ ID NO: 72260 - DNA, 22 bp, Artificial Sequence
  Synthetic oligonucleotide; TTT chr11 5159510 5159531 5159527 5159532 +
gttgttgtgtcctggtctggtt

SEQ ID NO: 72261 - DNA, 22 bp, Artificial Sequence
  Synthetic oligonucleotide; TTG chr11 5159511 5159532 5159528 5159533 +
ttgttgtgtcctggtctggttt

SEQ ID NO: 72262 - DNA, 22 bp, Artificial Sequence
  Synthetic oligonucleotide; TTG chr11 5159514 5159535 5159531 5159536 +
ttgtgtcctggtctggtttggg

SEQ ID NO: 72263 - DNA, 22 bp, Artificial Sequence
  Synthetic oligonucleotide; TTG chr11 5159517 5159538 5159534 5159539 +
tgtcctggtctggtttgggtat

SEQ ID NO: 72264 - DNA, 22 bp, Artificial Sequence
  Synthetic oligonucleotide; CTG chr11 5159524 5159545 5159541 5159546 +
gtctggtttgggtatattagag

SEQ ID NO: 72265 - DNA, 22 bp, Artificial Sequence
  Synthetic oligonucleotide; CTG chr11 5159529 5159550 5159546 5159551 +
gtttgggtatattagagtaatg

SEQ ID NO: 72266 - DNA, 22 bp, Artificial Sequence
  Synthetic oligonucleotide; TTT chr11 5159533 5159554 5159550 5159555 +
gggtatattagagtaatgcttg

SEQ ID NO: 72267 - DNA, 22 bp, Artificial Sequence
  Synthetic oligonucleotide; TTG chr11 5159534 5159555 5159551 5159556 +
ggtatattagagtaatgcttgc

SEQ ID NO: 72268 - DNA, 22 bp, Artificial Sequence
  Synthetic oligonucleotide; TTA chr11 5159543 5159564 5159560 5159565 +
gagtaatgcttgcctcatagaa

SEQ ID NO: 72269 - DNA, 22 bp, Artificial Sequence
  Synthetic oligonucleotide; CTT chr11 5159554 5159575 5159571 5159576 +
gcctcatagaataagtttagaa

SEQ ID NO: 72270 - DNA, 22 bp, Artificial Sequence
  Synthetic oligonucleotide; TTG chr11 5159555 5159576 5159572 5159577 +
cctcatagaataagtttagaag

SEQ ID NO: 72271 - DNA, 22 bp, Artificial Sequence
  Synthetic oligonucleotide; CTC chr11 5159559 5159580 5159576 5159581 +
atagaataagtttagaagtagg

SEQ ID NO: 72272 - DNA, 22 bp, Artificial Sequence
  Synthetic oligonucleotide; TTT chr11 5159572 5159593 5159589 5159594 +
agaagtaggcccttcttttcag

SEQ ID NO: 72273 - DNA, 22 bp, Artificial Sequence
  Synthetic oligonucleotide; TTA chr11 5159573 5159594 5159590 5159595 +
gaagtaggcccttcttttcagt

SEQ ID NO: 72274 - DNA, 22 bp, Artificial Sequence
  Synthetic oligonucleotide; CTT chr11 5159586 5159607 5159603 5159608 +
cttttcagtttttatttgtttg

SEQ ID NO: 72275 - DNA, 22 bp, Artificial Sequence
  Synthetic oligonucleotide; TTC chr11 5159587 5159608 5159604 5159609 +
ttttcagtttttatttgtttgt

SEQ ID NO: 72276 - DNA, 22 bp, Artificial Sequence
  Synthetic oligonucleotide; CTT chr11 5159589 5159610 5159606 5159611 +
ttcagtttttatttgtttgttt

SEQ ID NO: 72277 - DNA, 22 bp, Artificial Sequence
  Synthetic oligonucleotide; TTT chr11 5159590 5159611 5159607 5159612 +
tcagtttttatttgtttgtttg

SEQ ID NO: 72278 - DNA, 22 bp, Artificial Sequence
  Synthetic oligonucleotide; TTT chr11 5159591 5159612 5159608 5159613 +
cagtttttatttgtttgtttgt

SEQ ID NO: 72279 - DNA, 22 bp, Artificial Sequence
  Synthetic oligonucleotide; TTC chr11 5159592 5159613 5159609 5159614 +
agtttttatttgtttgtttgtt

SEQ ID NO: 72280 - DNA, 22 bp, Artificial Sequence
  Synthetic oligonucleotide; TTT chr11 5159597 5159618 5159614 5159619 +
ttatttgtttgtttgtttgagg

SEQ ID NO: 72281 - DNA, 22 bp, Artificial Sequence
  Synthetic oligonucleotide; TTT chr11 5159598 5159619 5159615 5159620 +
tatttgtttgtttgtttgagga

SEQ ID NO: 72282 - DNA, 22 bp, Artificial Sequence
  Synthetic oligonucleotide; TTT chr11 5159599 5159620 5159616 5159621 +
atttgtttgtttgtttgaggaa

SEQ ID NO: 72283 - DNA, 22 bp, Artificial Sequence
  Synthetic oligonucleotide; TTA chr11 5159600 5159621 5159617 5159622 +
tttgtttgtttgtttgaggaat

SEQ ID NO: 72284 - DNA, 22 bp, Artificial Sequence
  Synthetic oligonucleotide; TTT chr11 5159603 5159624 5159620 5159625 +
gtttgtttgtttgaggaatttg

SEQ ID NO: 72285 - DNA, 22 bp, Artificial Sequence
  Synthetic oligonucleotide; TTG chr11 5159604 5159625 5159621 5159626 +
tttgtttgtttgaggaatttga

SEQ ID NO: 72286 - DNA, 22 bp, Artificial Sequence
  Synthetic oligonucleotide; TTT chr11 5159607 5159628 5159624 5159629 +
gtttgtttgaggaatttgagta

SEQ ID NO: 72287 - DNA, 22 bp, Artificial Sequence
  Synthetic oligonucleotide; TTG chr11 5159608 5159629 5159625 5159630 +
tttgtttgaggaatttgagtac

SEQ ID NO: 72288 - DNA, 22 bp, Artificial Sequence
  Synthetic oligonucleotide; TTT chr11 5159611 5159632 5159628 5159633 +
gtttgaggaatttgagtacgat

SEQ ID NO: 72289 - DNA, 22 bp, Artificial Sequence
  Synthetic oligonucleotide; TTG chr11 5159612 5159633 5159629 5159634 +
tttgaggaatttgagtacgatt

SEQ ID NO: 72290 - DNA, 22 bp, Artificial Sequence
  Synthetic oligonucleotide; TTT chr11 5159615 5159636 5159632 5159637 +
gaggaatttgagtacgattagt

SEQ ID NO: 72291 - DNA, 22 bp, Artificial Sequence
  Synthetic oligonucleotide; TTG chr11 5159616 5159637 5159633 5159638 +
aggaatttgagtacgattagta

SEQ ID NO: 72292 - DNA, 22 bp, Artificial Sequence
  Synthetic oligonucleotide; TTT chr11 5159624 5159645 5159641 5159646 +
gagtacgattagtattagttct

SEQ ID NO: 72293 - DNA, 22 bp, Artificial Sequence
  Synthetic oligonucleotide; TTG chr11 5159625 5159646 5159642 5159647 +
agtacgattagtattagttcta

SEQ ID NO: 72294 - DNA, 22 bp, Artificial Sequence
  Synthetic oligonucleotide; TTA chr11 5159635 5159656 5159652 5159657 +
gtattagttctacttgaaatgt

SEQ ID NO: 72295 - DNA, 22 bp, Artificial Sequence
  Synthetic oligonucleotide; TTA chr11 5159641 5159662 5159658 5159663 +
gttctacttgaaatgtttggta

SEQ ID NO: 72296 - DNA, 22 bp, Artificial Sequence
  Synthetic oligonucleotide; TTC chr11 5159645 5159666 5159662 5159667 +
tacttgaaatgtttggtagccc

SEQ ID NO: 72297 - DNA, 22 bp, Artificial Sequence
  Synthetic oligonucleotide; CTA chr11 5159647 5159668 5159664 5159669 +
cttgaaatgtttggtagcccat

SEQ ID NO: 72298 - DNA, 22 bp, Artificial Sequence
  Synthetic oligonucleotide; CTT chr11 5159650 5159671 5159667 5159672 +
gaaatgtttggtagcccatcga

SEQ ID NO: 72299 - DNA, 22 bp, Artificial Sequence
  Synthetic oligonucleotide; TTG chr11 5159651 5159672 5159668 5159673 +
aaatgtttggtagcccatcgag

SEQ ID NO: 72300 - DNA, 22 bp, Artificial Sequence
  Synthetic oligonucleotide; TTT chr11 5159659 5159680 5159676 5159681 +
ggtagcccatcgagtcctgggc

SEQ ID NO: 72301 - DNA, 22 bp, Artificial Sequence
  Synthetic oligonucleotide; TTG chr11 5159660 5159681 5159677 5159682 +
gtagcccatcgagtcctgggct

SEQ ID NO: 72302 - DNA, 22 bp, Artificial Sequence
  Synthetic oligonucleotide; CTG chr11 5159678 5159699 5159695 5159700 +
ggcttttctttaataggaaact

SEQ ID NO: 72303 - DNA, 22 bp, Artificial Sequence
  Synthetic oligonucleotide; CTT chr11 5159683 5159704 5159700 5159705 +
ttctttaataggaaactttata

SEQ ID NO: 72304 - DNA, 22 bp, Artificial Sequence
  Synthetic oligonucleotide; TTT chr11 5159684 5159705 5159701 5159706 +
tctttaataggaaactttatat

SEQ ID NO: 72305 - DNA, 22 bp, Artificial Sequence
  Synthetic oligonucleotide; TTT chr11 5159685 5159706 5159702 5159707 +
ctttaataggaaactttatatt

SEQ ID NO: 72306 - DNA, 22 bp, Artificial Sequence
  Synthetic oligonucleotide; TTC chr11 5159686 5159707 5159703 5159708 +
tttaataggaaactttatatta

SEQ ID NO: 72307 - DNA, 22 bp, Artificial Sequence
  Synthetic oligonucleotide; CTT chr11 5159688 5159709 5159705 5159710 +
taataggaaactttatattaca

SEQ ID NO: 72308 - DNA, 22 bp, Artificial Sequence
  Synthetic oligonucleotide; TTT chr11 5159689 5159710 5159706 5159711 +
aataggaaactttatattacaa

SEQ ID NO: 72309 - DNA, 22 bp, Artificial Sequence
  Synthetic oligonucleotide; TTA chr11 5159690 5159711 5159707 5159712 +
ataggaaactttatattacaac

SEQ ID NO: 72310 - DNA, 22 bp, Artificial Sequence
  Synthetic oligonucleotide; CTT chr11 5159701 5159722 5159718 5159723 +
tatattacaactttaatcttgt

SEQ ID NO: 72311 - DNA, 22 bp, Artificial Sequence
  Synthetic oligonucleotide; TTT chr11 5159702 5159723 5159719 5159724 +
atattacaactttaatcttgtt

SEQ ID NO: 72312 - DNA, 22 bp, Artificial Sequence
  Synthetic oligonucleotide; TTA chr11 5159703 5159724 5159720 5159725 +
tattacaactttaatcttgtta

SEQ ID NO: 72313 - DNA, 22 bp, Artificial Sequence
  Synthetic oligonucleotide; TTA chr11 5159708 5159729 5159725 5159730 +
caactttaatcttgttattcat

SEQ ID NO: 72314 - DNA, 22 bp, Artificial Sequence
  Synthetic oligonucleotide; CTT chr11 5159714 5159735 5159731 5159736 +
taatcttgttattcattattgt

SEQ ID NO: 72315 - DNA, 22 bp, Artificial Sequence
  Synthetic oligonucleotide; TTT chr11 5159715 5159736 5159732 5159737 +
aatcttgttattcattattgtt

SEQ ID NO: 72316 - DNA, 22 bp, Artificial Sequence
  Synthetic oligonucleotide; TTA chr11 5159716 5159737 5159733 5159738 +
atcttgttattcattattgttc

SEQ ID NO: 72317 - DNA, 22 bp, Artificial Sequence
  Synthetic oligonucleotide; CTT chr11 5159721 5159742 5159738 5159743 +
gttattcattattgttctattg

SEQ ID NO: 72318 - DNA, 22 bp, Artificial Sequence
  Synthetic oligonucleotide; TTG chr11 5159722 5159743 5159739 5159744 +
ttattcattattgttctattga

SEQ ID NO: 72319 - DNA, 22 bp, Artificial Sequence
  Synthetic oligonucleotide; TTA chr11 5159725 5159746 5159742 5159747 +
ttcattattgttctattgaggt

SEQ ID NO: 72320 - DNA, 22 bp, Artificial Sequence
  Synthetic oligonucleotide; TTC chr11 5159728 5159749 5159745 5159750 +
attattgttctattgaggtttt

SEQ ID NO: 72321 - DNA, 22 bp, Artificial Sequence
  Synthetic oligonucleotide; TTA chr11 5159732 5159753 5159749 5159754 +
ttgttctattgaggttttctgt

SEQ ID NO: 72322 - DNA, 22 bp, Artificial Sequence
  Synthetic oligonucleotide; TTG chr11 5159735 5159756 5159752 5159757 +
ttctattgaggttttctgtttc

SEQ ID NO: 72323 - DNA, 22 bp, Artificial Sequence
  Synthetic oligonucleotide; TTC chr11 5159738 5159759 5159755 5159760 +
tattgaggttttctgtttctac

SEQ ID NO: 72324 - DNA, 22 bp, Artificial Sequence
  Synthetic oligonucleotide; CTA chr11 5159740 5159761 5159757 5159762 +
ttgaggttttctgtttctacat

SEQ ID NO: 72325 - DNA, 22 bp, Artificial Sequence
  Synthetic oligonucleotide; TTG chr11 5159743 5159764 5159760 5159765 +
aggttttctgtttctacatgct

SEQ ID NO: 72326 - DNA, 22 bp, Artificial Sequence
  Synthetic oligonucleotide; TTT chr11 5159749 5159770 5159766 5159771 +
tctgtttctacatgcttcagtc

SEQ ID NO: 72327 - DNA, 22 bp, Artificial Sequence
  Synthetic oligonucleotide; TTT chr11 5159750 5159771 5159767 5159772 +
ctgtttctacatgcttcagtct

SEQ ID NO: 72328 - DNA, 22 bp, Artificial Sequence
  Synthetic oligonucleotide; TTC chr11 5159751 5159772 5159768 5159773 +
tgtttctacatgcttcagtctt

SEQ ID NO: 72329 - DNA, 22 bp, Artificial Sequence
  Synthetic oligonucleotide; CTG chr11 5159753 5159774 5159770 5159775 +
tttctacatgcttcagtcttgc

SEQ ID NO: 72330 - DNA, 22 bp, Artificial Sequence
  Synthetic oligonucleotide; TTT chr11 5159756 5159777 5159773 5159778 +
ctacatgcttcagtcttgctag

SEQ ID NO: 72331 - DNA, 22 bp, Artificial Sequence
  Synthetic oligonucleotide; TTC chr11 5159757 5159778 5159774 5159779 +
tacatgcttcagtcttgctagg

SEQ ID NO: 72332 - DNA, 22 bp, Artificial Sequence
  Synthetic oligonucleotide; CTA chr11 5159759 5159780 5159776 5159781 +
catgcttcagtcttgctaggct

SEQ ID NO: 72333 - DNA, 22 bp, Artificial Sequence
  Synthetic oligonucleotide; CTT chr11 5159766 5159787 5159783 5159788 +
cagtcttgctaggctgtatgtg

SEQ ID NO: 72334 - DNA, 22 bp, Artificial Sequence
  Synthetic oligonucleotide; TTC chr11 5159767 5159788 5159784 5159789 +
agtcttgctaggctgtatgtgt

SEQ ID NO: 72335 - DNA, 22 bp, Artificial Sequence
  Synthetic oligonucleotide; CTT chr11 5159773 5159794 5159790 5159795 +
gctaggctgtatgtgtccagga

SEQ ID NO: 72336 - DNA, 22 bp, Artificial Sequence
  Synthetic oligonucleotide; TTG chr11 5159774 5159795 5159791 5159796 +
ctaggctgtatgtgtccaggaa

SEQ ID NO: 72337 - DNA, 22 bp, Artificial Sequence
  Synthetic oligonucleotide; CTA chr11 5159777 5159798 5159794 5159799 +
ggctgtatgtgtccaggaattt

SEQ ID NO: 72338 - DNA, 22 bp, Artificial Sequence
  Synthetic oligonucleotide; CTG chr11 5159782 5159803 5159799 5159804 +
tatgtgtccaggaatttatcca

SEQ ID NO: 72339 - DNA, 22 bp, Artificial Sequence
  Synthetic oligonucleotide; TTT chr11 5159799 5159820 5159816 5159821 +
atccatttattctagattttcc

SEQ ID NO: 72340 - DNA, 22 bp, Artificial Sequence
  Synthetic oligonucleotide; TTA chr11 5159800 5159821 5159817 5159822 +
tccatttattctagattttcca

SEQ ID NO: 72341 - DNA, 22 bp, Artificial Sequence
  Synthetic oligonucleotide; TTT chr11 5159807 5159828 5159824 5159829 +
attctagattttccaatttgtt

SEQ ID NO: 72342 - DNA, 22 bp, Artificial Sequence
  Synthetic oligonucleotide; TTA chr11 5159808 5159829 5159825 5159830 +
ttctagattttccaatttgttg

SEQ ID NO: 72343 - DNA, 22 bp, Artificial Sequence
  Synthetic oligonucleotide; TTC chr11 5159811 5159832 5159828 5159833 +
tagattttccaatttgttggaa

SEQ ID NO: 72344 - DNA, 22 bp, Artificial Sequence
  Synthetic oligonucleotide; CTA chr11 5159813 5159834 5159830 5159835 +
gattttccaatttgttggaata

SEQ ID NO: 72345 - DNA, 22 bp, Artificial Sequence
  Synthetic oligonucleotide; TTT chr11 5159818 5159839 5159835 5159840 +
tccaatttgttggaatacagtt

SEQ ID NO: 72346 - DNA, 22 bp, Artificial Sequence
  Synthetic oligonucleotide; TTT chr11 5159819 5159840 5159836 5159841 +
ccaatttgttggaatacagttg

SEQ ID NO: 72347 - DNA, 22 bp, Artificial Sequence
  Synthetic oligonucleotide; TTC chr11 5159820 5159841 5159837 5159842 +
caatttgttggaatacagttgt

SEQ ID NO: 72348 - DNA, 22 bp, Artificial Sequence
  Synthetic oligonucleotide; TTT chr11 5159826 5159847 5159843 5159848 +
gttggaatacagttgttcataa

SEQ ID NO: 72349 - DNA, 22 bp, Artificial Sequence
  Synthetic oligonucleotide; TTG chr11 5159827 5159848 5159844 5159849 +
ttggaatacagttgttcataat

SEQ ID NO: 72350 - DNA, 22 bp, Artificial Sequence
  Synthetic oligonucleotide; TTG chr11 5159830 5159851 5159847 5159852 +
gaatacagttgttcataatagt

SEQ ID NO: 72351 - DNA, 22 bp, Artificial Sequence
  Synthetic oligonucleotide; TTG chr11 5159841 5159862 5159858 5159863 +
ttcataatagtatctaatgagt

SEQ ID NO: 72352 - DNA, 22 bp, Artificial Sequence
  Synthetic oligonucleotide; TTC chr11 5159844 5159865 5159861 5159866 +
ataatagtatctaatgagtctt

SEQ ID NO: 72353 - DNA, 22 bp, Artificial Sequence
  Synthetic oligonucleotide; CTA chr11 5159857 5159878 5159874 5159879 +
atgagtctttgtgttgctgagg

SEQ ID NO: 72354 - DNA, 22 bp, Artificial Sequence
  Synthetic oligonucleotide; CTT chr11 5159866 5159887 5159883 5159888 +
tgtgttgctgaggtctcaattg

SEQ ID NO: 72355 - DNA, 22 bp, Artificial Sequence
  Synthetic oligonucleotide; TTT chr11 5159867 5159888 5159884 5159889 +
gtgttgctgaggtctcaattgt

SEQ ID NO: 72356 - DNA, 22 bp, Artificial Sequence
  Synthetic oligonucleotide; TTG chr11 5159868 5159889 5159885 5159890 +
tgttgctgaggtctcaattgtt

SEQ ID NO: 72357 - DNA, 22 bp, Artificial Sequence
  Synthetic oligonucleotide; TTG chr11 5159873 5159894 5159890 5159895 +
ctgaggtctcaattgttatatc

SEQ ID NO: 72358 - DNA, 22 bp, Artificial Sequence
  Synthetic oligonucleotide; CTG chr11 5159876 5159897 5159893 5159898 +
aggtctcaattgttatatcctc

SEQ ID NO: 72359 - DNA, 22 bp, Artificial Sequence
  Synthetic oligonucleotide; CTC chr11 5159883 5159904 5159900 5159905 +
aattgttatatcctctttttca

SEQ ID NO: 72360 - DNA, 22 bp, Artificial Sequence
  Synthetic oligonucleotide; TTG chr11 5159888 5159909 5159905 5159910 +
ttatatcctctttttcattttc

SEQ ID NO: 72361 - DNA, 22 bp, Artificial Sequence
  Synthetic oligonucleotide; TTA chr11 5159891 5159912 5159908 5159913 +
tatcctctttttcattttctaa

SEQ ID NO: 72362 - DNA, 22 bp, Artificial Sequence
  Synthetic oligonucleotide; CTC chr11 5159898 5159919 5159915 5159920 +
tttttcattttctaattttatt

SEQ ID NO: 72363 - DNA, 22 bp, Artificial Sequence
  Synthetic oligonucleotide; CTT chr11 5159900 5159921 5159917 5159922 +
tttcattttctaattttatttg

SEQ ID NO: 72364 - DNA, 22 bp, Artificial Sequence
  Synthetic oligonucleotide; TTT chr11 5159901 5159922 5159918 5159923 +
ttcattttctaattttatttga

SEQ ID NO: 72365 - DNA, 22 bp, Artificial Sequence
  Synthetic oligonucleotide; TTT chr11 5159902 5159923 5159919 5159924 +
tcattttctaattttatttgac

SEQ ID NO: 72366 - DNA, 22 bp, Artificial Sequence
  Synthetic oligonucleotide; TTT chr11 5159903 5159924 5159920 5159925 +
cattttctaattttatttgact

SEQ ID NO: 72367 - DNA, 22 bp, Artificial Sequence
  Synthetic oligonucleotide; TTC chr11 5159904 5159925 5159921 5159926 +
attttctaattttatttgactc

SEQ ID NO: 72368 - DNA, 22 bp, Artificial Sequence
  Synthetic oligonucleotide; TTT chr11 5159908 5159929 5159925 5159930 +
tctaattttatttgactctttt

SEQ ID NO: 72369 - DNA, 22 bp, Artificial Sequence
  Synthetic oligonucleotide; TTT chr11 5159909 5159930 5159926 5159931 +
ctaattttatttgactcttttt

SEQ ID NO: 72370 - DNA, 22 bp, Artificial Sequence
  Synthetic oligonucleotide; TTC chr11 5159910 5159931 5159927 5159932 +
taattttatttgactctttttt

SEQ ID NO: 72371 - DNA, 22 bp, Artificial Sequence
  Synthetic oligonucleotide; CTA chr11 5159912 5159933 5159929 5159934 +
attttatttgactcttttttct

SEQ ID NO: 72372 - DNA, 22 bp, Artificial Sequence
  Synthetic oligonucleotide; TTT chr11 5159916 5159937 5159933 5159938 +
tatttgactcttttttcttaaa

SEQ ID NO: 72373 - DNA, 22 bp, Artificial Sequence
  Synthetic oligonucleotide; TTT chr11 5159917 5159938 5159934 5159939 +
atttgactcttttttcttaaag

SEQ ID NO: 72374 - DNA, 22 bp, Artificial Sequence
  Synthetic oligonucleotide; TTA chr11 5159918 5159939 5159935 5159940 +
tttgactcttttttcttaaagt

SEQ ID NO: 72375 - DNA, 22 bp, Artificial Sequence
  Synthetic oligonucleotide; TTT chr11 5159921 5159942 5159938 5159943 +
gactcttttttcttaaagtttt

SEQ ID NO: 72376 - DNA, 22 bp, Artificial Sequence
  Synthetic oligonucleotide; TTG chr11 5159922 5159943 5159939 5159944 +
actcttttttcttaaagttttg

SEQ ID NO: 72377 - DNA, 22 bp, Artificial Sequence
  Synthetic oligonucleotide; CTC chr11 5159926 5159947 5159943 5159948 +
ttttttcttaaagttttgttga

SEQ ID NO: 72378 - DNA, 22 bp, Artificial Sequence
  Synthetic oligonucleotide; CTT chr11 5159928 5159949 5159945 5159950 +
ttttcttaaagttttgttgatt

SEQ ID NO: 72379 - DNA, 22 bp, Artificial Sequence
  Synthetic oligonucleotide; TTT chr11 5159929 5159950 5159946 5159951 +
tttcttaaagttttgttgattt

SEQ ID NO: 72380 - DNA, 22 bp, Artificial Sequence
  Synthetic oligonucleotide; TTT chr11 5159930 5159951 5159947 5159952 +
ttcttaaagttttgttgatttt

SEQ ID NO: 72381 - DNA, 22 bp, Artificial Sequence
  Synthetic oligonucleotide; TTT chr11 5159931 5159952 5159948 5159953 +
tcttaaagttttgttgattttg

SEQ ID NO: 72382 - DNA, 22 bp, Artificial Sequence
  Synthetic oligonucleotide; TTT chr11 5159932 5159953 5159949 5159954 +
cttaaagttttgttgattttgt

SEQ ID NO: 72383 - DNA, 22 bp, Artificial Sequence
  Synthetic oligonucleotide; TTC chr11 5159933 5159954 5159950 5159955 +
ttaaagttttgttgattttgtt

SEQ ID NO: 72384 - DNA, 22 bp, Artificial Sequence
  Synthetic oligonucleotide; CTT chr11 5159935 5159956 5159952 5159957 +
aaagttttgttgattttgttta

SEQ ID NO: 72385 - DNA, 22 bp, Artificial Sequence
  Synthetic oligonucleotide; TTA chr11 5159936 5159957 5159953 5159958 +
aagttttgttgattttgtttac

SEQ ID NO: 72386 - DNA, 22 bp, Artificial Sequence
  Synthetic oligonucleotide; TTT chr11 5159942 5159963 5159959 5159964 +
tgttgattttgtttacctttcc

SEQ ID NO: 72387 - DNA, 22 bp, Artificial Sequence
  Synthetic oligonucleotide; TTT chr11 5159943 5159964 5159960 5159965 +
gttgattttgtttacctttcca

SEQ ID NO: 72388 - DNA, 22 bp, Artificial Sequence
  Synthetic oligonucleotide; TTG chr11 5159944 5159965 5159961 5159966 +
ttgattttgtttacctttccaa

SEQ ID NO: 72389 - DNA, 22 bp, Artificial Sequence
  Synthetic oligonucleotide; TTG chr11 5159947 5159968 5159964 5159969 +
attttgtttacctttccaagaa

SEQ ID NO: 72390 - DNA, 22 bp, Artificial Sequence
  Synthetic oligonucleotide; TTT chr11 5159951 5159972 5159968 5159973 +
tgtttacctttccaagaaagca

SEQ ID NO: 72391 - DNA, 22 bp, Artificial Sequence
  Synthetic oligonucleotide; TTT chr11 5159952 5159973 5159969 5159974 +
gtttacctttccaagaaagcaa

SEQ ID NO: 72392 - DNA, 22 bp, Artificial Sequence
  Synthetic oligonucleotide; TTG chr11 5159953 5159974 5159970 5159975 +
tttacctttccaagaaagcaac

SEQ ID NO: 72393 - DNA, 22 bp, Artificial Sequence
  Synthetic oligonucleotide; TTT chr11 5159956 5159977 5159973 5159978 +
acctttccaagaaagcaactgt

SEQ ID NO: 72394 - DNA, 22 bp, Artificial Sequence
  Synthetic oligonucleotide; TTA chr11 5159957 5159978 5159974 5159979 +
cctttccaagaaagcaactgtt

SEQ ID NO: 72395 - DNA, 22 bp, Artificial Sequence
  Synthetic oligonucleotide; CTT chr11 5159961 5159982 5159978 5159983 +
tccaagaaagcaactgtttgtt

SEQ ID NO: 72396 - DNA, 22 bp, Artificial Sequence
  Synthetic oligonucleotide; TTT chr11 5159962 5159983 5159979 5159984 +
ccaagaaagcaactgtttgttt

SEQ ID NO: 72397 - DNA, 22 bp, Artificial Sequence
  Synthetic oligonucleotide; TTC chr11 5159963 5159984 5159980 5159985 +
caagaaagcaactgtttgtttt

SEQ ID NO: 72398 - DNA, 22 bp, Artificial Sequence
  Synthetic oligonucleotide; CTG chr11 5159977 5159998 5159994 5159999 +
tttgtttttaatgattttctgt

SEQ ID NO: 72399 - DNA, 22 bp, Artificial Sequence
  Synthetic oligonucleotide; TTT chr11 5159980 5160001 5159997 5160002 +
gtttttaatgattttctgtatt

SEQ ID NO: 72400 - DNA, 22 bp, Artificial Sequence
  Synthetic oligonucleotide; TTG chr11 5159981 5160002 5159998 5160003 +
tttttaatgattttctgtattt

SEQ ID NO: 72401 - DNA, 22 bp, Artificial Sequence
  Synthetic oligonucleotide; TTT chr11 5159984 5160005 5160001 5160006 +
ttaatgattttctgtatttttt

SEQ ID NO: 72402 - DNA, 22 bp, Artificial Sequence
  Synthetic oligonucleotide; TTT chr11 5159985 5160006 5160002 5160007 +
taatgattttctgtattttttg

SEQ ID NO: 72403 - DNA, 22 bp, Artificial Sequence
  Synthetic oligonucleotide; TTT chr11 5159986 5160007 5160003 5160008 +
aatgattttctgtattttttgg

SEQ ID NO: 72404 - DNA, 22 bp, Artificial Sequence
  Synthetic oligonucleotide; TTA chr11 5159987 5160008 5160004 5160009 +
atgattttctgtattttttggt

SEQ ID NO: 72405 - DNA, 22 bp, Artificial Sequence
  Synthetic oligonucleotide; TTT chr11 5159994 5160015 5160011 5160016 +
tctgtattttttggtctcaatt

SEQ ID NO: 72406 - DNA, 22 bp, Artificial Sequence
  Synthetic oligonucleotide; TTT chr11 5159995 5160016 5160012 5160017 +
ctgtattttttggtctcaattt

SEQ ID NO: 72407 - DNA, 22 bp, Artificial Sequence
  Synthetic oligonucleotide; TTC chr11 5159996 5160017 5160013 5160018 +
tgtattttttggtctcaatttc

SEQ ID NO: 72408 - DNA, 22 bp, Artificial Sequence
  Synthetic oligonucleotide; CTG chr11 5159998 5160019 5160015 5160020 +
tattttttggtctcaatttcat

SEQ ID NO: 72409 - DNA, 22 bp, Artificial Sequence
  Synthetic oligonucleotide; TTT chr11 5160003 5160024 5160020 5160025 +
tttggtctcaatttcatttgtt

SEQ ID NO: 72410 - DNA, 22 bp, Artificial Sequence
  Synthetic oligonucleotide; TTT chr11 5160004 5160025 5160021 5160026 +
ttggtctcaatttcatttgttt

SEQ ID NO: 72411 - DNA, 22 bp, Artificial Sequence
  Synthetic oligonucleotide; TTT chr11 5160005 5160026 5160022 5160027 +
tggtctcaatttcatttgtttc

SEQ ID NO: 72412 - DNA, 22 bp, Artificial Sequence
  Synthetic oligonucleotide; TTT chr11 5160006 5160027 5160023 5160028 +
ggtctcaatttcatttgtttct

SEQ ID NO: 72413 - DNA, 22 bp, Artificial Sequence
  Synthetic oligonucleotide; TTG chr11 5160007 5160028 5160024 5160029 +
gtctcaatttcatttgtttctt

SEQ ID NO: 72414 - DNA, 22 bp, Artificial Sequence
  Synthetic oligonucleotide; CTC chr11 5160012 5160033 5160029 5160034 +
aatttcatttgtttcttctctg

SEQ ID NO: 72415 - DNA, 22 bp, Artificial Sequence
  Synthetic oligonucleotide; TTT chr11 5160017 5160038 5160034 5160039 +
catttgtttcttctctgatctt

SEQ ID NO: 72416 - DNA, 22 bp, Artificial Sequence
  Synthetic oligonucleotide; TTC chr11 5160018 5160039 5160035 5160040 +
atttgtttcttctctgatcttt

SEQ ID NO: 72417 - DNA, 22 bp, Artificial Sequence
  Synthetic oligonucleotide; TTT chr11 5160022 5160043 5160039 5160044 +
gtttcttctctgatctttctta

SEQ ID NO: 72418 - DNA, 22 bp, Artificial Sequence
  Synthetic oligonucleotide; TTG chr11 5160023 5160044 5160040 5160045 +
tttcttctctgatctttcttat

SEQ ID NO: 72419 - DNA, 22 bp, Artificial Sequence
  Synthetic oligonucleotide; TTT chr11 5160026 5160047 5160043 5160048 +
cttctctgatctttcttatttc

SEQ ID NO: 72420 - DNA, 22 bp, Artificial Sequence
  Synthetic oligonucleotide; TTC chr11 5160027 5160048 5160044 5160049 +
ttctctgatctttcttatttct

SEQ ID NO: 72421 - DNA, 22 bp, Artificial Sequence
  Synthetic oligonucleotide; CTT chr11 5160029 5160050 5160046 5160051 +
ctctgatctttcttatttctcc

SEQ ID NO: 72422 - DNA, 22 bp, Artificial Sequence
  Synthetic oligonucleotide; TTC chr11 5160030 5160051 5160047 5160052 +
tctgatctttcttatttctccc

SEQ ID NO: 72423 - DNA, 22 bp, Artificial Sequence
  Synthetic oligonucleotide; CTC chr11 5160032 5160053 5160049 5160054 +
tgatctttcttatttctcccct

SEQ ID NO: 72424 - DNA, 22 bp, Artificial Sequence
  Synthetic oligonucleotide; CTG chr11 5160034 5160055 5160051 5160056 +
atctttcttatttctccccttc

SEQ ID NO: 72425 - DNA, 22 bp, Artificial Sequence
  Synthetic oligonucleotide; CTT chr11 5160039 5160060 5160056 5160061 +
tcttatttctccccttctatta

SEQ ID NO: 72426 - DNA, 22 bp, Artificial Sequence
  Synthetic oligonucleotide; TTT chr11 5160040 5160061 5160057 5160062 +
cttatttctccccttctattaa

SEQ ID NO: 72427 - DNA, 22 bp, Artificial Sequence
  Synthetic oligonucleotide; TTC chr11 5160041 5160062 5160058 5160063 +
ttatttctccccttctattaat

SEQ ID NO: 72428 - DNA, 22 bp, Artificial Sequence
  Synthetic oligonucleotide; CTT chr11 5160043 5160064 5160060 5160065 +
atttctccccttctattaattt

SEQ ID NO: 72429 - DNA, 22 bp, Artificial Sequence
  Synthetic oligonucleotide; TTA chr11 5160044 5160065 5160061 5160066 +
tttctccccttctattaatttt

SEQ ID NO: 72430 - DNA, 22 bp, Artificial Sequence
  Synthetic oligonucleotide; TTT chr11 5160047 5160068 5160064 5160069 +
ctccccttctattaattttgca

SEQ ID NO: 72431 - DNA, 22 bp, Artificial Sequence
  Synthetic oligonucleotide; TTC chr11 5160048 5160069 5160065 5160070 +
tccccttctattaattttgcat

SEQ ID NO: 72432 - DNA, 22 bp, Artificial Sequence
  Synthetic oligonucleotide; CTC chr11 5160050 5160071 5160067 5160072 +
cccttctattaattttgcattt

SEQ ID NO: 72433 - DNA, 22 bp, Artificial Sequence
  Synthetic oligonucleotide; CTT chr11 5160055 5160076 5160072 5160077 +
ctattaattttgcatttggttt

SEQ ID NO: 72434 - DNA, 22 bp, Artificial Sequence
  Synthetic oligonucleotide; TTC chr11 5160056 5160077 5160073 5160078 +
tattaattttgcatttggtttg

SEQ ID NO: 72435 - DNA, 22 bp, Artificial Sequence
  Synthetic oligonucleotide; CTA chr11 5160058 5160079 5160075 5160080 +
ttaattttgcatttggtttgtt

SEQ ID NO: 72436 - DNA, 22 bp, Artificial Sequence
  Synthetic oligonucleotide; TTA chr11 5160061 5160082 5160078 5160083 +
attttgcatttggtttgttctt

SEQ ID NO: 72437 - DNA, 22 bp, Artificial Sequence
  Synthetic oligonucleotide; TTT chr11 5160065 5160086 5160082 5160087 +
tgcatttggtttgttcttgctt

SEQ ID NO: 72438 - DNA, 22 bp, Artificial Sequence
  Synthetic oligonucleotide; TTT chr11 5160066 5160087 5160083 5160088 +
gcatttggtttgttcttgcttt

SEQ ID NO: 72439 - DNA, 22 bp, Artificial Sequence
  Synthetic oligonucleotide; TTG chr11 5160067 5160088 5160084 5160089 +
catttggtttgttcttgctttc

SEQ ID NO: 72440 - DNA, 22 bp, Artificial Sequence
  Synthetic oligonucleotide; TTT chr11 5160072 5160093 5160089 5160094 +
ggtttgttcttgctttcctatt

SEQ ID NO: 72441 - DNA, 22 bp, Artificial Sequence
  Synthetic oligonucleotide; TTG chr11 5160073 5160094 5160090 5160095 +
gtttgttcttgctttcctattt

SEQ ID NO: 72442 - DNA, 22 bp, Artificial Sequence
  Synthetic oligonucleotide; TTT chr11 5160077 5160098 5160094 5160099 +
gttcttgctttcctatttcctt

SEQ ID NO: 72443 - DNA, 22 bp, Artificial Sequence
  Synthetic oligonucleotide; TTG chr11 5160078 5160099 5160095 5160100 +
ttcttgctttcctatttccttg

SEQ ID NO: 72444 - DNA, 22 bp, Artificial Sequence
  Synthetic oligonucleotide; TTC chr11 5160081 5160102 5160098 5160103 +
ttgctttcctatttccttgagg

SEQ ID NO: 72445 - DNA, 22 bp, Artificial Sequence
  Synthetic oligonucleotide; CTT chr11 5160083 5160104 5160100 5160105 +
gctttcctatttccttgaggta

SEQ ID NO: 72446 - DNA, 22 bp, Artificial Sequence
  Synthetic oligonucleotide; TTG chr11 5160084 5160105 5160101 5160106 +
ctttcctatttccttgaggtac

SEQ ID NO: 72447 - DNA, 22 bp, Artificial Sequence
  Synthetic oligonucleotide; CTT chr11 5160087 5160108 5160104 5160109 +
tcctatttccttgaggtacatt

SEQ ID NO: 72448 - DNA, 22 bp, Artificial Sequence
  Synthetic oligonucleotide; TTT chr11 5160088 5160109 5160105 5160110 +
cctatttccttgaggtacattg

SEQ ID NO: 72449 - DNA, 22 bp, Artificial Sequence
  Synthetic oligonucleotide; TTC chr11 5160089 5160110 5160106 5160111 +
ctatttccttgaggtacattgt

SEQ ID NO: 72450 - DNA, 22 bp, Artificial Sequence
  Synthetic oligonucleotide; CTA chr11 5160092 5160113 5160109 5160114 +
tttccttgaggtacattgtttg

SEQ ID NO: 72451 - DNA, 22 bp, Artificial Sequence
  Synthetic oligonucleotide; TTT chr11 5160095 5160116 5160112 5160117 +
ccttgaggtacattgtttggtt

SEQ ID NO: 72452 - DNA, 22 bp, Artificial Sequence
  Synthetic oligonucleotide; TTC chr11 5160096 5160117 5160113 5160118 +
cttgaggtacattgtttggttg

SEQ ID NO: 72453 - DNA, 22 bp, Artificial Sequence
  Synthetic oligonucleotide; CTT chr11 5160099 5160120 5160116 5160121 +
gaggtacattgtttggttgctt

SEQ ID NO: 72454 - DNA, 22 bp, Artificial Sequence
  Synthetic oligonucleotide; TTG chr11 5160100 5160121 5160117 5160122 +
aggtacattgtttggttgctta

SEQ ID NO: 72455 - DNA, 22 bp, Artificial Sequence
  Synthetic oligonucleotide; TTG chr11 5160110 5160131 5160127 5160132 +
tttggttgcttagttgaagcct

SEQ ID NO: 72456 - DNA, 22 bp, Artificial Sequence
  Synthetic oligonucleotide; TTT chr11 5160113 5160134 5160130 5160135 +
ggttgcttagttgaagcctttc

SEQ ID NO: 72457 - DNA, 22 bp, Artificial Sequence
  Synthetic oligonucleotide; TTG chr11 5160114 5160135 5160131 5160136 +
gttgcttagttgaagcctttct

SEQ ID NO: 72458 - DNA, 22 bp, Artificial Sequence
  Synthetic oligonucleotide; TTG chr11 5160118 5160139 5160135 5160140 +
cttagttgaagcctttctactt

SEQ ID NO: 72459 - DNA, 22 bp, Artificial Sequence
  Synthetic oligonucleotide; CTT chr11 5160121 5160142 5160138 5160143 +
agttgaagcctttctacttttt

SEQ ID NO: 72460 - DNA, 22 bp, Artificial Sequence
  Synthetic oligonucleotide; TTA chr11 5160122 5160143 5160139 5160144 +
gttgaagcctttctactttttt

SEQ ID NO: 72461 - DNA, 22 bp, Artificial Sequence
  Synthetic oligonucleotide; TTG chr11 5160126 5160147 5160143 5160148 +
aagcctttctacttttttggat

SEQ ID NO: 72462 - DNA, 22 bp, Artificial Sequence
  Synthetic oligonucleotide; CTT chr11 5160133 5160154 5160150 5160155 +
tctacttttttggatataggtg

SEQ ID NO: 72463 - DNA, 22 bp, Artificial Sequence
  Synthetic oligonucleotide; TTT chr11 5160134 5160155 5160151 5160156 +
ctacttttttggatataggtgt

SEQ ID NO: 72464 - DNA, 22 bp, Artificial Sequence
  Synthetic oligonucleotide; TTC chr11 5160135 5160156 5160152 5160157 +
tacttttttggatataggtgtt

SEQ ID NO: 72465 - DNA, 22 bp, Artificial Sequence
  Synthetic oligonucleotide; CTA chr11 5160137 5160158 5160154 5160159 +
cttttttggatataggtgttta

SEQ ID NO: 72466 - DNA, 22 bp, Artificial Sequence
  Synthetic oligonucleotide; CTT chr11 5160140 5160161 5160157 5160162 +
ttttggatataggtgtttattg

SEQ ID NO: 72467 - DNA, 22 bp, Artificial Sequence
  Synthetic oligonucleotide; TTT chr11 5160141 5160162 5160158 5160163 +
tttggatataggtgtttattgc

SEQ ID NO: 72468 - DNA, 22 bp, Artificial Sequence
  Synthetic oligonucleotide; TTT chr11 5160142 5160163 5160159 5160164 +
ttggatataggtgtttattgct

SEQ ID NO: 72469 - DNA, 22 bp, Artificial Sequence
  Synthetic oligonucleotide; TTT chr11 5160143 5160164 5160160 5160165 +
tggatataggtgtttattgcta

SEQ ID NO: 72470 - DNA, 22 bp, Artificial Sequence
  Synthetic oligonucleotide; TTT chr11 5160144 5160165 5160161 5160166 +
ggatataggtgtttattgctat

SEQ ID NO: 72471 - DNA, 22 bp, Artificial Sequence
  Synthetic oligonucleotide; TTG chr11 5160145 5160166 5160162 5160167 +
gatataggtgtttattgctatg

SEQ ID NO: 72472 - DNA, 22 bp, Artificial Sequence
  Synthetic oligonucleotide; TTT chr11 5160158 5160179 5160175 5160180 +
attgctatgaacttccctctaa

SEQ ID NO: 72473 - DNA, 22 bp, Artificial Sequence
  Synthetic oligonucleotide; TTA chr11 5160159 5160180 5160176 5160181 +
ttgctatgaacttccctctaag

SEQ ID NO: 72474 - DNA, 22 bp, Artificial Sequence
  Synthetic oligonucleotide; TTG chr11 5160162 5160183 5160179 5160184 +
ctatgaacttccctctaagtac

SEQ ID NO: 72475 - DNA, 22 bp, Artificial Sequence
  Synthetic oligonucleotide; CTA chr11 5160165 5160186 5160182 5160187 +
tgaacttccctctaagtactgc

SEQ ID NO: 72476 - DNA, 22 bp, Artificial Sequence
  Synthetic oligonucleotide; CTT chr11 5160172 5160193 5160189 5160194 +
ccctctaagtactgcttttgcc

SEQ ID NO: 72477 - DNA, 22 bp, Artificial Sequence
  Synthetic oligonucleotide; TTC chr11 5160173 5160194 5160190 5160195 +
cctctaagtactgcttttgcca

SEQ ID NO: 72478 - DNA, 22 bp, Artificial Sequence
  Synthetic oligonucleotide; CTC chr11 5160177 5160198 5160194 5160199 +
taagtactgcttttgccatatc

SEQ ID NO: 72479 - DNA, 22 bp, Artificial Sequence
  Synthetic oligonucleotide; CTA chr11 5160179 5160200 5160196 5160201 +
agtactgcttttgccatatcct

SEQ ID NO: 72480 - DNA, 22 bp, Artificial Sequence
  Synthetic oligonucleotide; CTG chr11 5160186 5160207 5160203 5160208 +
cttttgccatatcctgtaggtt

SEQ ID NO: 72481 - DNA, 22 bp, Artificial Sequence
  Synthetic oligonucleotide; CTT chr11 5160189 5160210 5160206 5160211 +
ttgccatatcctgtaggttttg

SEQ ID NO: 72482 - DNA, 22 bp, Artificial Sequence
  Synthetic oligonucleotide; TTT chr11 5160190 5160211 5160207 5160212 +
tgccatatcctgtaggttttgg

SEQ ID NO: 72483 - DNA, 22 bp, Artificial Sequence
  Synthetic oligonucleotide; TTT chr11 5160191 5160212 5160208 5160213 +
gccatatcctgtaggttttggt

SEQ ID NO: 72484 - DNA, 22 bp, Artificial Sequence
  Synthetic oligonucleotide; TTG chr11 5160192 5160213 5160209 5160214 +
ccatatcctgtaggttttggta

SEQ ID NO: 72485 - DNA, 22 bp, Artificial Sequence
  Synthetic oligonucleotide; CTG chr11 5160202 5160223 5160219 5160224 +
taggttttggtatgttgtattt

SEQ ID NO: 72486 - DNA, 22 bp, Artificial Sequence
  Synthetic oligonucleotide; TTT chr11 5160209 5160230 5160226 5160231 +
tggtatgttgtatttccatttt

SEQ ID NO: 72487 - DNA, 22 bp, Artificial Sequence
  Synthetic oligonucleotide; TTT chr11 5160210 5160231 5160227 5160232 +
ggtatgttgtatttccattttc

SEQ ID NO: 72488 - DNA, 22 bp, Artificial Sequence
  Synthetic oligonucleotide; TTG chr11 5160211 5160232 5160228 5160233 +
gtatgttgtatttccattttca

SEQ ID NO: 72489 - DNA, 22 bp, Artificial Sequence
  Synthetic oligonucleotide; TTG chr11 5160219 5160240 5160236 5160241 +
tatttccattttcacttgtttc

SEQ ID NO: 72490 - DNA, 22 bp, Artificial Sequence
  Synthetic oligonucleotide; TTT chr11 5160224 5160245 5160241 5160246 +
ccattttcacttgtttcaagaa

SEQ ID NO: 72491 - DNA, 22 bp, Artificial Sequence
  Synthetic oligonucleotide; TTC chr11 5160225 5160246 5160242 5160247 +
cattttcacttgtttcaagaag

SEQ ID NO: 72492 - DNA, 22 bp, Artificial Sequence
  Synthetic oligonucleotide; TTT chr11 5160230 5160251 5160247 5160252 +
tcacttgtttcaagaagtttta

SEQ ID NO: 72493 - DNA, 22 bp, Artificial Sequence
  Synthetic oligonucleotide; TTT chr11 5160231 5160252 5160248 5160253 +
cacttgtttcaagaagttttaa

SEQ ID NO: 72494 - DNA, 22 bp, Artificial Sequence
  Synthetic oligonucleotide; TTC chr11 5160232 5160253 5160249 5160254 +
acttgtttcaagaagttttaaa

SEQ ID NO: 72495 - DNA, 22 bp, Artificial Sequence
  Synthetic oligonucleotide; CTT chr11 5160236 5160257 5160253 5160258 +
gtttcaagaagttttaaaattt

SEQ ID NO: 72496 - DNA, 22 bp, Artificial Sequence
  Synthetic oligonucleotide; TTG chr11 5160237 5160258 5160254 5160259 +
tttcaagaagttttaaaatttc

SEQ ID NO: 72497 - DNA, 22 bp, Artificial Sequence
  Synthetic oligonucleotide; TTT chr11 5160240 5160261 5160257 5160262 +
caagaagttttaaaatttcctt

SEQ ID NO: 72498 - DNA, 22 bp, Artificial Sequence
  Synthetic oligonucleotide; TTC chr11 5160241 5160262 5160258 5160263 +
aagaagttttaaaatttccttc

SEQ ID NO: 72499 - DNA, 22 bp, Artificial Sequence
  Synthetic oligonucleotide; TTT chr11 5160250 5160271 5160267 5160272 +
taaaatttccttcttaatttct

SEQ ID NO: 72500 - DNA, 22 bp, Artificial Sequence
  Synthetic oligonucleotide; TTT chr11 5160251 5160272 5160268 5160273 +
aaaatttccttcttaatttctt

SEQ ID NO: 72501 - DNA, 22 bp, Artificial Sequence
  Synthetic oligonucleotide; TTA chr11 5160252 5160273 5160269 5160274 +
aaatttccttcttaatttcttt

SEQ ID NO: 72502 - DNA, 22 bp, Artificial Sequence
  Synthetic oligonucleotide; TTT chr11 5160258 5160279 5160275 5160280 +
ccttcttaatttctttagtgac

SEQ ID NO: 72503 - DNA, 22 bp, Artificial Sequence
  Synthetic oligonucleotide; TTC chr11 5160259 5160280 5160276 5160281 +
cttcttaatttctttagtgact

SEQ ID NO: 72504 - DNA, 22 bp, Artificial Sequence
  Synthetic oligonucleotide; CTT chr11 5160262 5160283 5160279 5160284 +
cttaatttctttagtgactcat

SEQ ID NO: 72505 - DNA, 22 bp, Artificial Sequence
  Synthetic oligonucleotide; TTC chr11 5160263 5160284 5160280 5160285 +
ttaatttctttagtgactcatt

SEQ ID NO: 72506 - DNA, 22 bp, Artificial Sequence
  Synthetic oligonucleotide; CTT chr11 5160265 5160286 5160282 5160287 +
aatttctttagtgactcattgg

SEQ ID NO: 72507 - DNA, 22 bp, Artificial Sequence
  Synthetic oligonucleotide; TTA chr11 5160266 5160287 5160283 5160288 +
atttctttagtgactcattggt

SEQ ID NO: 72508 - DNA, 22 bp, Artificial Sequence
  Synthetic oligonucleotide; TTT chr11 5160270 5160291 5160287 5160292 +
ctttagtgactcattggttatt

SEQ ID NO: 72509 - DNA, 22 bp, Artificial Sequence
  Synthetic oligonucleotide; TTC chr11 5160271 5160292 5160288 5160293 +
tttagtgactcattggttattc

SEQ ID NO: 72510 - DNA, 22 bp, Artificial Sequence
  Synthetic oligonucleotide; CTT chr11 5160273 5160294 5160290 5160295 +
tagtgactcattggttattcag

SEQ ID NO: 72511 - DNA, 22 bp, Artificial Sequence
  Synthetic oligonucleotide; TTT chr11 5160274 5160295 5160291 5160296 +
agtgactcattggttattcagt

SEQ ID NO: 72512 - DNA, 22 bp, Artificial Sequence
  Synthetic oligonucleotide; TTA chr11 5160275 5160296 5160292 5160297 +
gtgactcattggttattcagtt

SEQ ID NO: 72513 - DNA, 22 bp, Artificial Sequence
  Synthetic oligonucleotide; CTC chr11 5160282 5160303 5160299 5160304 +
attggttattcagtttcatgcg

SEQ ID NO: 72514 - DNA, 22 bp, Artificial Sequence
  Synthetic oligonucleotide; TTG chr11 5160286 5160307 5160303 5160308 +
gttattcagtttcatgcgcatc

SEQ ID NO: 72515 - DNA, 22 bp, Artificial Sequence
  Synthetic oligonucleotide; TTA chr11 5160290 5160311 5160307 5160312 +
ttcagtttcatgcgcatccctg

SEQ ID NO: 72516 - DNA, 22 bp, Artificial Sequence
  Synthetic oligonucleotide; TTC chr11 5160293 5160314 5160310 5160315 +
agtttcatgcgcatccctgtga

SEQ ID NO: 72517 - DNA, 22 bp, Artificial Sequence
  Synthetic oligonucleotide; TTT chr11 5160298 5160319 5160315 5160320 +
catgcgcatccctgtgaggaga

SEQ ID NO: 72518 - DNA, 22 bp, Artificial Sequence
  Synthetic oligonucleotide; TTC chr11 5160299 5160320 5160316 5160321 +
atgcgcatccctgtgaggagac

SEQ ID NO: 72519 - DNA, 22 bp, Artificial Sequence
  Synthetic oligonucleotide; CTG chr11 5160312 5160333 5160329 5160334 +
tgaggagactaccaaacaggct

SEQ ID NO: 72520 - DNA, 22 bp, Artificial Sequence
  Synthetic oligonucleotide; CTA chr11 5160323 5160344 5160340 5160345 +
ccaaacaggctttgtgtgagca

SEQ ID NO: 72521 - DNA, 22 bp, Artificial Sequence
  Synthetic oligonucleotide; CTT chr11 5160335 5160356 5160352 5160357 +
tgtgtgagcaataaagcttttt

SEQ ID NO: 72522 - DNA, 22 bp, Artificial Sequence
  Synthetic oligonucleotide; TTT chr11 5160336 5160357 5160353 5160358 +
gtgtgagcaataaagcttttta

SEQ ID NO: 72523 - DNA, 22 bp, Artificial Sequence
  Synthetic oligonucleotide; TTG chr11 5160337 5160358 5160354 5160359 +
tgtgagcaataaagctttttat

SEQ ID NO: 72524 - DNA, 22 bp, Artificial Sequence
  Synthetic oligonucleotide; CTT chr11 5160354 5160375 5160371 5160376 +
tttatcacctgggtgcaggcgg

SEQ ID NO: 72525 - DNA, 22 bp, Artificial Sequence
  Synthetic oligonucleotide; TTT chr11 5160355 5160376 5160372 5160377 +
ttatcacctgggtgcaggcggg

SEQ ID NO: 72526 - DNA, 22 bp, Artificial Sequence
  Synthetic oligonucleotide; TTT chr11 5160356 5160377 5160373 5160378 +
tatcacctgggtgcaggcgggc

SEQ ID NO: 72527 - DNA, 22 bp, Artificial Sequence
  Synthetic oligonucleotide; TTT chr11 5160357 5160378 5160374 5160379 +
atcacctgggtgcaggcgggct

SEQ ID NO: 72528 - DNA, 22 bp, Artificial Sequence
  Synthetic oligonucleotide; TTA chr11 5160358 5160379 5160375 5160380 +
tcacctgggtgcaggcgggctg

SEQ ID NO: 72529 - DNA, 22 bp, Artificial Sequence
  Synthetic oligonucleotide; CTG chr11 5160365 5160386 5160382 5160387 +
ggtgcaggcgggctgagtccga

SEQ ID NO: 72530 - DNA, 22 bp, Artificial Sequence
  Synthetic oligonucleotide; CTG chr11 5160380 5160401 5160397 5160402 +
agtccgaaaagagagtcagcaa

SEQ ID NO: 72531 - DNA, 22 bp, Artificial Sequence
  Synthetic oligonucleotide; CTG chr11 5160423 5160444 5160440 5160445 +
ttttataagatttgggtaggta

SEQ ID NO: 72532 - DNA, 22 bp, Artificial Sequence
  Synthetic oligonucleotide; TTT chr11 5160426 5160447 5160443 5160448 +
tataagatttgggtaggtaaag

SEQ ID NO: 72533 - DNA, 22 bp, Artificial Sequence
  Synthetic oligonucleotide; TTT chr11 5160427 5160448 5160444 5160449 +
ataagatttgggtaggtaaagg

SEQ ID NO: 72534 - DNA, 22 bp, Artificial Sequence
  Synthetic oligonucleotide; TTA chr11 5160428 5160449 5160445 5160450 +
taagatttgggtaggtaaagga

SEQ ID NO: 72535 - DNA, 22 bp, Artificial Sequence
  Synthetic oligonucleotide; TTT chr11 5160436 5160457 5160453 5160458 +
gggtaggtaaaggaaaattaca

SEQ ID NO: 72536 - DNA, 22 bp, Artificial Sequence
  Synthetic oligonucleotide; TTG chr11 5160437 5160458 5160454 5160459 +
ggtaggtaaaggaaaattacag

SEQ ID NO: 72537 - DNA, 22 bp, Artificial Sequence
  Synthetic oligonucleotide; TTA chr11 5160456 5160477 5160473 5160478 +
cagtcaaaggggggttgttctc

SEQ ID NO: 72538 - DNA, 22 bp, Artificial Sequence
  Synthetic oligonucleotide; TTG chr11 5160473 5160494 5160490 5160495 +
ttctctggcgggcaggagtggg

SEQ ID NO: 72539 - DNA, 22 bp, Artificial Sequence
  Synthetic oligonucleotide; TTC chr11 5160476 5160497 5160493 5160498 +
tctggcgggcaggagtgggggg

SEQ ID NO: 72540 - DNA, 22 bp, Artificial Sequence
  Synthetic oligonucleotide; CTC chr11 5160478 5160499 5160495 5160500 +
tggcgggcaggagtggggggtc

SEQ ID NO: 72541 - DNA, 22 bp, Artificial Sequence
  Synthetic oligonucleotide; CTG chr11 5160480 5160501 5160497 5160502 +
gcgggcaggagtggggggtcac

SEQ ID NO: 72542 - DNA, 22 bp, Artificial Sequence
  Synthetic oligonucleotide; CTC chr11 5160511 5160532 5160528 5160533 +
agtaggggagcttttgagccag

SEQ ID NO: 72543 - DNA, 22 bp, Artificial Sequence
  Synthetic oligonucleotide; CTT chr11 5160524 5160545 5160541 5160546 +
ttgagccaggatgagccaggag

SEQ ID NO: 72544 - DNA, 22 bp, Artificial Sequence
  Synthetic oligonucleotide; TTT chr11 5160525 5160546 5160542 5160547 +
tgagccaggatgagccaggaga

SEQ ID NO: 72545 - DNA, 22 bp, Artificial Sequence
  Synthetic oligonucleotide; TTT chr11 5160526 5160547 5160543 5160548 +
gagccaggatgagccaggagaa

SEQ ID NO: 72546 - DNA, 22 bp, Artificial Sequence
  Synthetic oligonucleotide; TTG chr11 5160527 5160548 5160544 5160549 +
agccaggatgagccaggagaag

SEQ ID NO: 72547 - DNA, 22 bp, Artificial Sequence
  Synthetic oligonucleotide; CTT chr11 5160554 5160575 5160571 5160576 +
tcacaagacaatgtcatcagtt

SEQ ID NO: 72548 - DNA, 22 bp, Artificial Sequence
  Synthetic oligonucleotide; TTT chr11 5160555 5160576 5160572 5160577 +
cacaagacaatgtcatcagtta

SEQ ID NO: 72549 - DNA, 22 bp, Artificial Sequence
  Synthetic oligonucleotide; TTC chr11 5160556 5160577 5160573 5160578 +
acaagacaatgtcatcagttaa

SEQ ID NO: 72550 - DNA, 22 bp, Artificial Sequence
  Synthetic oligonucleotide; TTA chr11 5160577 5160598 5160594 5160599 +
aggcaggaacaggccattttca

SEQ ID NO: 72551 - DNA, 22 bp, Artificial Sequence
  Synthetic oligonucleotide; TTT chr11 5160596 5160617 5160613 5160618 +
tcacttcttttgtggtggaatg

SEQ ID NO: 72552 - DNA, 22 bp, Artificial Sequence
  Synthetic oligonucleotide; TTT chr11 5160597 5160618 5160614 5160619 +
cacttcttttgtggtggaatgt

SEQ ID NO: 72553 - DNA, 22 bp, Artificial Sequence
  Synthetic oligonucleotide; TTC chr11 5160598 5160619 5160615 5160620 +
acttcttttgtggtggaatgtc

SEQ ID NO: 72554 - DNA, 22 bp, Artificial Sequence
  Synthetic oligonucleotide; CTT chr11 5160602 5160623 5160619 5160624 +
cttttgtggtggaatgtcatca

SEQ ID NO: 72555 - DNA, 22 bp, Artificial Sequence
  Synthetic oligonucleotide; TTC chr11 5160603 5160624 5160620 5160625 +
ttttgtggtggaatgtcatcag

SEQ ID NO: 72556 - DNA, 22 bp, Artificial Sequence
  Synthetic oligonucleotide; CTT chr11 5160605 5160626 5160622 5160627 +
ttgtggtggaatgtcatcagtt

SEQ ID NO: 72557 - DNA, 22 bp, Artificial Sequence
  Synthetic oligonucleotide; TTT chr11 5160606 5160627 5160623 5160628 +
tgtggtggaatgtcatcagtta

SEQ ID NO: 72558 - DNA, 22 bp, Artificial Sequence
  Synthetic oligonucleotide; TTT chr11 5160607 5160628 5160624 5160629 +
gtggtggaatgtcatcagttaa

SEQ ID NO: 72559 - DNA, 22 bp, Artificial Sequence
  Synthetic oligonucleotide; TTG chr11 5160608 5160629 5160625 5160630 +
tggtggaatgtcatcagttaag

SEQ ID NO: 72560 - DNA, 22 bp, Artificial Sequence
  Synthetic oligonucleotide; TTA chr11 5160628 5160649 5160645 5160650 +
aggcaggaactggccatctgta

SEQ ID NO: 72561 - DNA, 22 bp, Artificial Sequence
  Synthetic oligonucleotide; CTG chr11 5160640 5160661 5160657 5160662 +
gccatctgtatgtgtacctgca

SEQ ID NO: 72562 - DNA, 22 bp, Artificial Sequence
  Synthetic oligonucleotide; CTG chr11 5160648 5160669 5160665 5160670 +
tatgtgtacctgcaggtcacag

SEQ ID NO: 72563 - DNA, 22 bp, Artificial Sequence
  Synthetic oligonucleotide; CTG chr11 5160660 5160681 5160677 5160682 +
caggtcacaggggacatgatgg

SEQ ID NO: 72564 - DNA, 22 bp, Artificial Sequence
  Synthetic oligonucleotide; CTT chr11 5160685 5160706 5160702 5160707 +
agcttgggctcagaggcctgac

SEQ ID NO: 72565 - DNA, 22 bp, Artificial Sequence
  Synthetic oligonucleotide; TTA chr11 5160686 5160707 5160703 5160708 +
gcttgggctcagaggcctgaca

SEQ ID NO: 72566 - DNA, 22 bp, Artificial Sequence
  Synthetic oligonucleotide; CTT chr11 5160690 5160711 5160707 5160712 +
gggctcagaggcctgacattcc

SEQ ID NO: 72567 - DNA, 22 bp, Artificial Sequence
  Synthetic oligonucleotide; TTG chr11 5160691 5160712 5160708 5160713 +
ggctcagaggcctgacattcct

SEQ ID NO: 72568 - DNA, 22 bp, Artificial Sequence
  Synthetic oligonucleotide; CTC chr11 5160696 5160717 5160713 5160718 +
agaggcctgacattcctgtctt

SEQ ID NO: 72569 - DNA, 22 bp, Artificial Sequence
  Synthetic oligonucleotide; CTG chr11 5160705 5160726 5160722 5160727 +
acattcctgtcttcttatatta

SEQ ID NO: 72570 - DNA, 22 bp, Artificial Sequence
  Synthetic oligonucleotide; TTC chr11 5160711 5160732 5160728 5160733 +
ctgtcttcttatattaataaga

SEQ ID NO: 72571 - DNA, 22 bp, Artificial Sequence
  Synthetic oligonucleotide; CTG chr11 5160714 5160735 5160731 5160736 +
tcttcttatattaataagaaaa

SEQ ID NO: 72572 - DNA, 22 bp, Artificial Sequence
  Synthetic oligonucleotide; CTT chr11 5160718 5160739 5160735 5160740 +
cttatattaataagaaaaataa

SEQ ID NO: 72573 - DNA, 22 bp, Artificial Sequence
  Synthetic oligonucleotide; TTC chr11 5160719 5160740 5160736 5160741 +
ttatattaataagaaaaataaa

SEQ ID NO: 72574 - DNA, 22 bp, Artificial Sequence
  Synthetic oligonucleotide; CTT chr11 5160721 5160742 5160738 5160743 +
atattaataagaaaaataaaac

SEQ ID NO: 72575 - DNA, 22 bp, Artificial Sequence
  Synthetic oligonucleotide; TTA chr11 5160722 5160743 5160739 5160744 +
tattaataagaaaaataaaaca

SEQ ID NO: 72576 - DNA, 22 bp, Artificial Sequence
  Synthetic oligonucleotide; TTA chr11 5160727 5160748 5160744 5160749 +
ataagaaaaataaaacataata

SEQ ID NO: 72577 - DNA, 22 bp, Artificial Sequence
  Synthetic oligonucleotide; TTG chr11 5160755 5160776 5160772 5160777 +
aagtgttggggcagcgaaaatt

SEQ ID NO: 72578 - DNA, 22 bp, Artificial Sequence
  Synthetic oligonucleotide; TTG chr11 5160763 5160784 5160780 5160785 +
gggcagcgaaaattttggggga

SEQ ID NO: 72579 - DNA, 22 bp, Artificial Sequence
  Synthetic oligonucleotide; TTT chr11 5160778 5160799 5160795 5160800 +
tgggggatggtatggagagata

SEQ ID NO: 72580 - DNA, 22 bp, Artificial Sequence
  Synthetic oligonucleotide; TTT chr11 5160779 5160800 5160796 5160801 +
gggggatggtatggagagataa

SEQ ID NO: 72581 - DNA, 22 bp, Artificial Sequence
  Synthetic oligonucleotide; TTG chr11 5160780 5160801 5160797 5160802 +
ggggatggtatggagagataat

SEQ ID NO: 72582 - DNA, 22 bp, Artificial Sequence
  Synthetic oligonucleotide; TTT chr11 5160813 5160834 5160830 5160835 +
ctcagggctgcttcgagcggga

SEQ ID NO: 72583 - DNA, 22 bp, Artificial Sequence
  Synthetic oligonucleotide; TTC chr11 5160814 5160835 5160831 5160836 +
tcagggctgcttcgagcgggat

SEQ ID NO: 72584 - DNA, 22 bp, Artificial Sequence
  Synthetic oligonucleotide; CTC chr11 5160816 5160837 5160833 5160838 +
agggctgcttcgagcgggatta

SEQ ID NO: 72585 - DNA, 22 bp, Artificial Sequence
  Synthetic oligonucleotide; CTG chr11 5160823 5160844 5160840 5160845 +
cttcgagcgggattaggggcgg

SEQ ID NO: 72586 - DNA, 22 bp, Artificial Sequence
  Synthetic oligonucleotide; CTT chr11 5160826 5160847 5160843 5160848 +
cgagcgggattaggggcggcgt

SEQ ID NO: 72587 - DNA, 22 bp, Artificial Sequence
  Synthetic oligonucleotide; TTC chr11 5160827 5160848 5160844 5160849 +
gagcgggattaggggcggcgtg

SEQ ID NO: 72588 - DNA, 22 bp, Artificial Sequence
  Synthetic oligonucleotide; TTA chr11 5160838 5160859 5160855 5160860 +
ggggcggcgtgggaacctagag

SEQ ID NO: 72589 - DNA, 22 bp, Artificial Sequence
  Synthetic oligonucleotide; CTA chr11 5160857 5160878 5160874 5160879 +
gagtgggagagattaagctgaa

SEQ ID NO: 72590 - DNA, 22 bp, Artificial Sequence
  Synthetic oligonucleotide; TTA chr11 5160872 5160893 5160889 5160894 +
agctgaaggaagattttgtggt

SEQ ID NO: 72591 - DNA, 22 bp, Artificial Sequence
  Synthetic oligonucleotide; CTG chr11 5160877 5160898 5160894 5160899 +
aaggaagattttgtggtaaggg

SEQ ID NO: 72592 - DNA, 22 bp, Artificial Sequence
  Synthetic oligonucleotide; TTT chr11 5160888 5160909 5160905 5160910 +
tgtggtaaggggtgatattgtg

SEQ ID NO: 72593 - DNA, 22 bp, Artificial Sequence
  Synthetic oligonucleotide; TTT chr11 5160889 5160910 5160906 5160911 +
gtggtaaggggtgatattgtgg

SEQ ID NO: 72594 - DNA, 22 bp, Artificial Sequence
  Synthetic oligonucleotide; TTG chr11 5160890 5160911 5160907 5160912 +
tggtaaggggtgatattgtggg

SEQ ID NO: 72595 - DNA, 22 bp, Artificial Sequence
  Synthetic oligonucleotide; TTG chr11 5160908 5160929 5160925 5160930 +
tggggttgttagaagaaacatt

SEQ ID NO: 72596 - DNA, 22 bp, Artificial Sequence
  Synthetic oligonucleotide; TTG chr11 5160916 5160937 5160933 5160938 +
ttagaagaaacatttgtcatgt

SEQ ID NO: 72597 - DNA, 22 bp, Artificial Sequence
  Synthetic oligonucleotide; TTA chr11 5160919 5160940 5160936 5160941 +
gaagaaacatttgtcatgtaga

SEQ ID NO: 72598 - DNA, 22 bp, Artificial Sequence
  Synthetic oligonucleotide; TTT chr11 5160931 5160952 5160948 5160953 +
gtcatgtagaattattggtgat

SEQ ID NO: 72599 - DNA, 22 bp, Artificial Sequence
  Synthetic oligonucleotide; TTG chr11 5160932 5160953 5160949 5160954 +
tcatgtagaattattggtgatg

SEQ ID NO: 72600 - DNA, 22 bp, Artificial Sequence
  Synthetic oligonucleotide; TTA chr11 5160945 5160966 5160962 5160967 +
ttggtgatggcctggatacggt

SEQ ID NO: 72601 - DNA, 22 bp, Artificial Sequence
  Synthetic oligonucleotide; TTG chr11 5160948 5160969 5160965 5160970 +
gtgatggcctggatacggtttt

SEQ ID NO: 72602 - DNA, 22 bp, Artificial Sequence
  Synthetic oligonucleotide; CTG chr11 5160959 5160980 5160976 5160981 +
gatacggttttgtatggattga

SEQ ID NO: 72603 - DNA, 22 bp, Artificial Sequence
  Synthetic oligonucleotide; TTT chr11 5160969 5160990 5160986 5160991 +
tgtatggattgaaaaaccaaat

SEQ ID NO: 72604 - DNA, 22 bp, Artificial Sequence
  Synthetic oligonucleotide; TTT chr11 5160970 5160991 5160987 5160992 +
gtatggattgaaaaaccaaatg

SEQ ID NO: 72605 - DNA, 22 bp, Artificial Sequence
  Synthetic oligonucleotide; TTG chr11 5160971 5160992 5160988 5160993 +
tatggattgaaaaaccaaatgg

SEQ ID NO: 72606 - DNA, 22 bp, Artificial Sequence
  Synthetic oligonucleotide; TTG chr11 5160980 5161001 5160997 5161002 +
aaaaaccaaatggaataagaga

SEQ ID NO: 72607 - DNA, 22 bp, Artificial Sequence
  Synthetic oligonucleotide; TTA chr11 5161021 5161042 5161038 5161043 +
aaggactaagaagtgggaggac

SEQ ID NO: 72608 - DNA, 22 bp, Artificial Sequence
  Synthetic oligonucleotide; CTA chr11 5161029 5161050 5161046 5161051 +
agaagtgggaggacctaggaca

SEQ ID NO: 72609 - DNA, 22 bp, Artificial Sequence
  Synthetic oligonucleotide; CTA chr11 5161046 5161067 5161063 5161068 +
ggacatctgattaaagagtgcc

SEQ ID NO: 72610 - DNA, 22 bp, Artificial Sequence
  Synthetic oligonucleotide; CTG chr11 5161055 5161076 5161072 5161077 +
attaaagagtgcctaaggagat

SEQ ID NO: 72611 - DNA, 22 bp, Artificial Sequence
  Synthetic oligonucleotide; TTA chr11 5161059 5161080 5161076 5161081 +
aagagtgcctaaggagattcaa

SEQ ID NO: 72612 - DNA, 22 bp, Artificial Sequence
  Synthetic oligonucleotide; CTA chr11 5161070 5161091 5161087 5161092 +
aggagattcaacatagtcctgc

SEQ ID NO: 72613 - DNA, 22 bp, Artificial Sequence
  Synthetic oligonucleotide; TTC chr11 5161079 5161100 5161096 5161101 +
aacatagtcctgccagcaaaga

SEQ ID NO: 72614 - DNA, 22 bp, Artificial Sequence
  Synthetic oligonucleotide; CTG chr11 5161091 5161112 5161108 5161113 +
ccagcaaagattatttatttac

SEQ ID NO: 72615 - DNA, 22 bp, Artificial Sequence
  Synthetic oligonucleotide; TTA chr11 5161104 5161125 5161121 5161126 +
tttatttacttcaagagttaag

SEQ ID NO: 72616 - DNA, 22 bp, Artificial Sequence
  Synthetic oligonucleotide; TTT chr11 5161107 5161128 5161124 5161129 +
atttacttcaagagttaagagt

SEQ ID NO: 72617 - DNA, 22 bp, Artificial Sequence
  Synthetic oligonucleotide; TTA chr11 5161108 5161129 5161125 5161130 +
tttacttcaagagttaagagtg

SEQ ID NO: 72618 - DNA, 22 bp, Artificial Sequence
  Synthetic oligonucleotide; TTT chr11 5161111 5161132 5161128 5161133 +
acttcaagagttaagagtggca

SEQ ID NO: 72619 - DNA, 22 bp, Artificial Sequence
  Synthetic oligonucleotide; TTA chr11 5161112 5161133 5161129 5161134 +
cttcaagagttaagagtggcag

SEQ ID NO: 72620 - DNA, 22 bp, Artificial Sequence
  Synthetic oligonucleotide; CTT chr11 5161115 5161136 5161132 5161137 +
caagagttaagagtggcagttt

SEQ ID NO: 72621 - DNA, 22 bp, Artificial Sequence
  Synthetic oligonucleotide; TTC chr11 5161116 5161137 5161133 5161138 +
aagagttaagagtggcagtttg

SEQ ID NO: 72622 - DNA, 22 bp, Artificial Sequence
  Synthetic oligonucleotide; TTA chr11 5161124 5161145 5161141 5161146 +
agagtggcagtttggggatagc

SEQ ID NO: 72623 - DNA, 22 bp, Artificial Sequence
  Synthetic oligonucleotide; TTT chr11 5161137 5161158 5161154 5161159 +
ggggatagcaccaggagatatc

SEQ ID NO: 72624 - DNA, 22 bp, Artificial Sequence
  Synthetic oligonucleotide; TTG chr11 5161138 5161159 5161155 5161160 +
gggatagcaccaggagatatca

SEQ ID NO: 72625 - DNA, 22 bp, Artificial Sequence
  Synthetic oligonucleotide; CTG chr11 5161164 5161185 5161181 5161186 +
tgatggcttggaaaaacagtgt

SEQ ID NO: 72626 - DNA, 22 bp, Artificial Sequence
  Synthetic oligonucleotide; CTT chr11 5161173 5161194 5161190 5161195 +
ggaaaaacagtgtaaaccggca

SEQ ID NO: 72627 - DNA, 22 bp, Artificial Sequence
  Synthetic oligonucleotide; TTG chr11 5161174 5161195 5161191 5161196 +
gaaaaacagtgtaaaccggcag

SEQ ID NO: 72628 - DNA, 22 bp, Artificial Sequence
  Synthetic oligonucleotide; TTG chr11 5161229 5161250 5161246 5161251 +
agaatggtgaataggagtatga

SEQ ID NO: 72629 - DNA, 22 bp, Artificial Sequence
  Synthetic oligonucleotide; CTA chr11 5161254 5161275 5161271 5161276 +
gacagaagatagcagggatgac

SEQ ID NO: 72630 - DNA, 22 bp, Artificial Sequence
  Synthetic oligonucleotide; TTT chr11 5161282 5161303 5161299 5161304 +
ttttggggcacattctaagttg

SEQ ID NO: 72631 - DNA, 22 bp, Artificial Sequence
  Synthetic oligonucleotide; TTT chr11 5161283 5161304 5161300 5161305 +
tttggggcacattctaagttgg

SEQ ID NO: 72632 - DNA, 22 bp, Artificial Sequence
  Synthetic oligonucleotide; TTT chr11 5161284 5161305 5161301 5161306 +
ttggggcacattctaagttggt

SEQ ID NO: 72633 - DNA, 22 bp, Artificial Sequence
  Synthetic oligonucleotide; TTT chr11 5161285 5161306 5161302 5161307 +
tggggcacattctaagttggtc

SEQ ID NO: 72634 - DNA, 22 bp, Artificial Sequence
  Synthetic oligonucleotide; TTT chr11 5161286 5161307 5161303 5161308 +
ggggcacattctaagttggtct

SEQ ID NO: 72635 - DNA, 22 bp, Artificial Sequence
  Synthetic oligonucleotide; TTG chr11 5161287 5161308 5161304 5161309 +
gggcacattctaagttggtctg

SEQ ID NO: 72636 - DNA, 22 bp, Artificial Sequence
  Synthetic oligonucleotide; TTC chr11 5161297 5161318 5161314 5161319 +
taagttggtctggtgtctggaa

SEQ ID NO: 72637 - DNA, 22 bp, Artificial Sequence
  Synthetic oligonucleotide; CTA chr11 5161299 5161320 5161316 5161321 +
agttggtctggtgtctggaatt

SEQ ID NO: 72638 - DNA, 22 bp, Artificial Sequence
  Synthetic oligonucleotide; TTG chr11 5161304 5161325 5161321 5161326 +
gtctggtgtctggaattagact

SEQ ID NO: 72639 - DNA, 22 bp, Artificial Sequence
  Synthetic oligonucleotide; CTG chr11 5161309 5161330 5161326 5161331 +
gtgtctggaattagactggggc

SEQ ID NO: 72640 - DNA, 22 bp, Artificial Sequence
  Synthetic oligonucleotide; CTG chr11 5161316 5161337 5161333 5161338 +
gaattagactggggcctaataa

SEQ ID NO: 72641 - DNA, 22 bp, Artificial Sequence
  Synthetic oligonucleotide; TTA chr11 5161322 5161343 5161339 5161344 +
gactggggcctaataaaaaggc

SEQ ID NO: 72642 - DNA, 22 bp, Artificial Sequence
  Synthetic oligonucleotide; CTG chr11 5161327 5161348 5161344 5161349 +
gggcctaataaaaaggcaaatc

SEQ ID NO: 72643 - DNA, 22 bp, Artificial Sequence
  Synthetic oligonucleotide; CTA chr11 5161334 5161355 5161351 5161356 +
ataaaaaggcaaatctatacag

SEQ ID NO: 72644 - DNA, 22 bp, Artificial Sequence
  Synthetic oligonucleotide; CTA chr11 5161351 5161372 5161368 5161373 +
tacaggagctcaaatgggctgt

SEQ ID NO: 72645 - DNA, 22 bp, Artificial Sequence
  Synthetic oligonucleotide; CTC chr11 5161362 5161383 5161379 5161384 +
aaatgggctgtaccctgtagca

SEQ ID NO: 72646 - DNA, 22 bp, Artificial Sequence
  Synthetic oligonucleotide; CTG chr11 5161372 5161393 5161389 5161394 +
taccctgtagcattctgaggac

SEQ ID NO: 72647 - DNA, 22 bp, Artificial Sequence
  Synthetic oligonucleotide; CTG chr11 5161379 5161400 5161396 5161401 +
tagcattctgaggacaggtctg

SEQ ID NO: 72648 - DNA, 22 bp, Artificial Sequence
  Synthetic oligonucleotide; TTC chr11 5161387 5161408 5161404 5161409 +
tgaggacaggtctgacttctga

SEQ ID NO: 72649 - DNA, 22 bp, Artificial Sequence
  Synthetic oligonucleotide; CTG chr11 5161389 5161410 5161406 5161411 +
aggacaggtctgacttctgaga

SEQ ID NO: 72650 - DNA, 22 bp, Artificial Sequence
  Synthetic oligonucleotide; CTG chr11 5161401 5161422 5161418 5161423 +
acttctgagaaagaaaagtggt

SEQ ID NO: 72651 - DNA, 22 bp, Artificial Sequence
  Synthetic oligonucleotide; CTT chr11 5161405 5161426 5161422 5161427 +
ctgagaaagaaaagtggtaaaa

SEQ ID NO: 72652 - DNA, 22 bp, Artificial Sequence
  Synthetic oligonucleotide; TTC chr11 5161406 5161427 5161423 5161428 +
tgagaaagaaaagtggtaaaag

SEQ ID NO: 72653 - DNA, 22 bp, Artificial Sequence
  Synthetic oligonucleotide; CTG chr11 5161408 5161429 5161425 5161430 +
agaaagaaaagtggtaaaagta

SEQ ID NO: 72654 - DNA, 22 bp, Artificial Sequence
  Synthetic oligonucleotide; TTG chr11 5161433 5161454 5161450 5161455 +
tccagtcctttttaagttggtg

SEQ ID NO: 72655 - DNA, 22 bp, Artificial Sequence
  Synthetic oligonucleotide; CTT chr11 5161443 5161464 5161460 5161465 +
tttaagttggtggctgagcttg

SEQ ID NO: 72656 - DNA, 22 bp, Artificial Sequence
  Synthetic oligonucleotide; TTT chr11 5161444 5161465 5161461 5161466 +
ttaagttggtggctgagcttgg

SEQ ID NO: 72657 - DNA, 22 bp, Artificial Sequence
  Synthetic oligonucleotide; TTT chr11 5161445 5161466 5161462 5161467 +
taagttggtggctgagcttggt

SEQ ID NO: 72658 - DNA, 22 bp, Artificial Sequence
  Synthetic oligonucleotide; TTT chr11 5161446 5161467 5161463 5161468 +
aagttggtggctgagcttggtg

SEQ ID NO: 72659 - DNA, 22 bp, Artificial Sequence
  Synthetic oligonucleotide; TTA chr11 5161447 5161468 5161464 5161469 +
agttggtggctgagcttggtga

SEQ ID NO: 72660 - DNA, 22 bp, Artificial Sequence
  Synthetic oligonucleotide; TTG chr11 5161452 5161473 5161469 5161474 +
gtggctgagcttggtgaggtgt

SEQ ID NO: 72661 - DNA, 22 bp, Artificial Sequence
  Synthetic oligonucleotide; CTG chr11 5161459 5161480 5161476 5161481 +
agcttggtgaggtgtgttttta

SEQ ID NO: 72662 - DNA, 22 bp, Artificial Sequence
  Synthetic oligonucleotide; CTT chr11 5161464 5161485 5161481 5161486 +
ggtgaggtgtgtttttaaaaga

SEQ ID NO: 72663 - DNA, 22 bp, Artificial Sequence
  Synthetic oligonucleotide; TTG chr11 5161465 5161486 5161482 5161487 +
gtgaggtgtgtttttaaaagac

SEQ ID NO: 72664 - DNA, 22 bp, Artificial Sequence
  Synthetic oligonucleotide; TTT chr11 5161478 5161499 5161495 5161500 +
ttaaaagacatttagtccgttc

SEQ ID NO: 72665 - DNA, 22 bp, Artificial Sequence
  Synthetic oligonucleotide; TTT chr11 5161479 5161500 5161496 5161501 +
taaaagacatttagtccgttct

SEQ ID NO: 72666 - DNA, 22 bp, Artificial Sequence
  Synthetic oligonucleotide; TTT chr11 5161480 5161501 5161497 5161502 +
aaaagacatttagtccgttcta

SEQ ID NO: 72667 - DNA, 22 bp, Artificial Sequence
  Synthetic oligonucleotide; TTA chr11 5161481 5161502 5161498 5161503 +
aaagacatttagtccgttctac

SEQ ID NO: 72668 - DNA, 22 bp, Artificial Sequence
  Synthetic oligonucleotide; TTT chr11 5161491 5161512 5161508 5161513 +
agtccgttctacttttcctgaa

SEQ ID NO: 72669 - DNA, 22 bp, Artificial Sequence
  Synthetic oligonucleotide; TTA chr11 5161492 5161513 5161509 5161514 +
gtccgttctacttttcctgaag

SEQ ID NO: 72670 - DNA, 22 bp, Artificial Sequence
  Synthetic oligonucleotide; TTC chr11 5161500 5161521 5161517 5161522 +
tacttttcctgaagacggagga

SEQ ID NO: 72671 - DNA, 22 bp, Artificial Sequence
  Synthetic oligonucleotide; CTA chr11 5161502 5161523 5161519 5161524 +
cttttcctgaagacggaggacc

SEQ ID NO: 72672 - DNA, 22 bp, Artificial Sequence
  Synthetic oligonucleotide; CTT chr11 5161505 5161526 5161522 5161527 +
ttcctgaagacggaggaccgta

SEQ ID NO: 72673 - DNA, 22 bp, Artificial Sequence
  Synthetic oligonucleotide; TTT chr11 5161506 5161527 5161523 5161528 +
tcctgaagacggaggaccgtaa

SEQ ID NO: 72674 - DNA, 22 bp, Artificial Sequence
  Synthetic oligonucleotide; TTT chr11 5161507 5161528 5161524 5161529 +
cctgaagacggaggaccgtaag

SEQ ID NO: 72675 - DNA, 22 bp, Artificial Sequence
  Synthetic oligonucleotide; TTC chr11 5161508 5161529 5161525 5161530 +
ctgaagacggaggaccgtaagg

SEQ ID NO: 72676 - DNA, 22 bp, Artificial Sequence
  Synthetic oligonucleotide; CTG chr11 5161511 5161532 5161528 5161533 +
aagacggaggaccgtaagggat

SEQ ID NO: 72677 - DNA, 22 bp, Artificial Sequence
  Synthetic oligonucleotide; TTT chr11 5161543 5161564 5161560 5161565 +
tactgaatactaagagcctgaa

SEQ ID NO: 72678 - DNA, 22 bp, Artificial Sequence
  Synthetic oligonucleotide; TTT chr11 5161544 5161565 5161561 5161566 +
actgaatactaagagcctgaaa

SEQ ID NO: 72679 - DNA, 22 bp, Artificial Sequence
  Synthetic oligonucleotide; TTA chr11 5161545 5161566 5161562 5161567 +
ctgaatactaagagcctgaaaa

SEQ ID NO: 72680 - DNA, 22 bp, Artificial Sequence
  Synthetic oligonucleotide; CTG chr11 5161548 5161569 5161565 5161570 +
aatactaagagcctgaaaaact

SEQ ID NO: 72681 - DNA, 22 bp, Artificial Sequence
  Synthetic oligonucleotide; CTA chr11 5161555 5161576 5161572 5161577 +
agagcctgaaaaactgcttggc

SEQ ID NO: 72682 - DNA, 22 bp, Artificial Sequence
  Synthetic oligonucleotide; CTG chr11 5161563 5161584 5161580 5161585 +
aaaaactgcttggctgatttga

SEQ ID NO: 72683 - DNA, 22 bp, Artificial Sequence
  Synthetic oligonucleotide; CTG chr11 5161571 5161592 5161588 5161593 +
cttggctgatttgactaataaa

SEQ ID NO: 72684 - DNA, 22 bp, Artificial Sequence
  Synthetic oligonucleotide; CTT chr11 5161574 5161595 5161591 5161596 +
ggctgatttgactaataaaggc

SEQ ID NO: 72685 - DNA, 22 bp, Artificial Sequence
  Synthetic oligonucleotide; TTG chr11 5161575 5161596 5161592 5161597 +
gctgatttgactaataaaggct

SEQ ID NO: 72686 - DNA, 22 bp, Artificial Sequence
  Synthetic oligonucleotide; CTG chr11 5161579 5161600 5161596 5161601 +
atttgactaataaaggctggtc

SEQ ID NO: 72687 - DNA, 22 bp, Artificial Sequence
  Synthetic oligonucleotide; TTT chr11 5161583 5161604 5161600 5161605 +
gactaataaaggctggtctgtt

SEQ ID NO: 72688 - DNA, 22 bp, Artificial Sequence
  Synthetic oligonucleotide; TTG chr11 5161584 5161605 5161601 5161606 +
actaataaaggctggtctgtta

SEQ ID NO: 72689 - DNA, 22 bp, Artificial Sequence
  Synthetic oligonucleotide; CTA chr11 5161588 5161609 5161605 5161610 +
ataaaggctggtctgttatcag

SEQ ID NO: 72690 - DNA, 22 bp, Artificial Sequence
  Synthetic oligonucleotide; CTG chr11 5161598 5161619 5161615 5161620 +
gtctgttatcagactgtataga

SEQ ID NO: 72691 - DNA, 22 bp, Artificial Sequence
  Synthetic oligonucleotide; CTG chr11 5161603 5161624 5161620 5161625 +
ttatcagactgtatagaggtag

SEQ ID NO: 72692 - DNA, 22 bp, Artificial Sequence
  Synthetic oligonucleotide; TTA chr11 5161606 5161627 5161623 5161628 +
tcagactgtatagaggtaggaa

SEQ ID NO: 72693 - DNA, 22 bp, Artificial Sequence
  Synthetic oligonucleotide; CTG chr11 5161614 5161635 5161631 5161636 +
tatagaggtaggaaggctaaac

SEQ ID NO: 72694 - DNA, 22 bp, Artificial Sequence
  Synthetic oligonucleotide; CTA chr11 5161633 5161654 5161650 5161655 +
aactgaggaattatgtctgaca

SEQ ID NO: 72695 - DNA, 22 bp, Artificial Sequence
  Synthetic oligonucleotide; CTG chr11 5161638 5161659 5161655 5161660 +
aggaattatgtctgacagaagg

SEQ ID NO: 72696 - DNA, 22 bp, Artificial Sequence
  Synthetic oligonucleotide; TTA chr11 5161646 5161667 5161663 5161668 +
tgtctgacagaagggaagaaat

SEQ ID NO: 72697 - DNA, 22 bp, Artificial Sequence
  Synthetic oligonucleotide; CTG chr11 5161652 5161673 5161669 5161674 +
acagaagggaagaaatgactgc

SEQ ID NO: 72698 - DNA, 22 bp, Artificial Sequence
  Synthetic oligonucleotide; CTG chr11 5161673 5161694 5161690 5161695 +
cggtggccttctcagaccctgt

SEQ ID NO: 72699 - DNA, 22 bp, Artificial Sequence
  Synthetic oligonucleotide; CTT chr11 5161683 5161704 5161700 5161705 +
ctcagaccctgtaggaaagacc

SEQ ID NO: 72700 - DNA, 22 bp, Artificial Sequence
  Synthetic oligonucleotide; TTC chr11 5161684 5161705 5161701 5161706 +
tcagaccctgtaggaaagacct

SEQ ID NO: 72701 - DNA, 22 bp, Artificial Sequence
  Synthetic oligonucleotide; CTC chr11 5161686 5161707 5161703 5161708 +
agaccctgtaggaaagacctct

SEQ ID NO: 72702 - DNA, 22 bp, Artificial Sequence
  Synthetic oligonucleotide; CTG chr11 5161694 5161715 5161711 5161716 +
taggaaagacctctacttatcc

SEQ ID NO: 72703 - DNA, 22 bp, Artificial Sequence
  Synthetic oligonucleotide; CTC chr11 5161707 5161728 5161724 5161729 +
tacttatccagtgaaagtgtct

SEQ ID NO: 72704 - DNA, 22 bp, Artificial Sequence
  Synthetic oligonucleotide; CTA chr11 5161709 5161730 5161726 5161731 +
cttatccagtgaaagtgtctac

SEQ ID NO: 72705 - DNA, 22 bp, Artificial Sequence
  Synthetic oligonucleotide; CTT chr11 5161712 5161733 5161729 5161734 +
atccagtgaaagtgtctaccta

SEQ ID NO: 72706 - DNA, 22 bp, Artificial Sequence
  Synthetic oligonucleotide; TTA chr11 5161713 5161734 5161730 5161735 +
tccagtgaaagtgtctacctag

SEQ ID NO: 72707 - DNA, 22 bp, Artificial Sequence
  Synthetic oligonucleotide; CTA chr11 5161730 5161751 5161747 5161752 +
cctagactaagaggtattttag

SEQ ID NO: 72708 - DNA, 22 bp, Artificial Sequence
  Synthetic oligonucleotide; CTA chr11 5161734 5161755 5161751 5161756 +
gactaagaggtattttagttat

SEQ ID NO: 72709 - DNA, 22 bp, Artificial Sequence
  Synthetic oligonucleotide; CTA chr11 5161739 5161760 5161756 5161761 +
agaggtattttagttatctgac

SEQ ID NO: 72710 - DNA, 22 bp, Artificial Sequence
  Synthetic oligonucleotide; TTT chr11 5161749 5161770 5161766 5161771 +
tagttatctgactcagggcatg

SEQ ID NO: 72711 - DNA, 22 bp, Artificial Sequence
  Synthetic oligonucleotide; TTT chr11 5161750 5161771 5161767 5161772 +
agttatctgactcagggcatgt

SEQ ID NO: 72712 - DNA, 22 bp, Artificial Sequence
  Synthetic oligonucleotide; TTA chr11 5161751 5161772 5161768 5161773 +
gttatctgactcagggcatgtt

SEQ ID NO: 72713 - DNA, 22 bp, Artificial Sequence
  Synthetic oligonucleotide; TTA chr11 5161755 5161776 5161772 5161777 +
tctgactcagggcatgttgagt

SEQ ID NO: 72714 - DNA, 22 bp, Artificial Sequence
  Synthetic oligonucleotide; CTG chr11 5161759 5161780 5161776 5161781 +
actcagggcatgttgagtaaat

SEQ ID NO: 72715 - DNA, 22 bp, Artificial Sequence
  Synthetic oligonucleotide; CTC chr11 5161763 5161784 5161780 5161785 +
agggcatgttgagtaaatctaa

SEQ ID NO: 72716 - DNA, 22 bp, Artificial Sequence
  Synthetic oligonucleotide; TTG chr11 5161774 5161795 5161791 5161796 +
agtaaatctaatttgccagtcc

SEQ ID NO: 72717 - DNA, 22 bp, Artificial Sequence
  Synthetic oligonucleotide; CTA chr11 5161784 5161805 5161801 5161806 +
atttgccagtcctgggtggggg

SEQ ID NO: 72718 - DNA, 22 bp, Artificial Sequence
  Synthetic oligonucleotide; TTT chr11 5161788 5161809 5161805 5161810 +
gccagtcctgggtgggggcaaa

SEQ ID NO: 72719 - DNA, 22 bp, Artificial Sequence
  Synthetic oligonucleotide; TTG chr11 5161789 5161810 5161806 5161811 +
ccagtcctgggtgggggcaaat

SEQ ID NO: 72720 - DNA, 22 bp, Artificial Sequence
  Synthetic oligonucleotide; CTG chr11 5161798 5161819 5161815 5161820 +
ggtgggggcaaatcctcgagct

SEQ ID NO: 72721 - DNA, 22 bp, Artificial Sequence
  Synthetic oligonucleotide; CTC chr11 5161815 5161836 5161832 5161837 +
gagcttgatgtgtagggaaggg

SEQ ID NO: 72722 - DNA, 22 bp, Artificial Sequence
  Synthetic oligonucleotide; CTT chr11 5161821 5161842 5161838 5161843 +
gatgtgtagggaagggaggggg

SEQ ID NO: 72723 - DNA, 22 bp, Artificial Sequence
  Synthetic oligonucleotide; TTG chr11 5161822 5161843 5161839 5161844 +
atgtgtagggaagggagggggc

SEQ ID NO: 72724 - DNA, 22 bp, Artificial Sequence
  Synthetic oligonucleotide; CTG chr11 5161847 5161868 5161864 5161869 +
aataatccctgaggagtagcag

SEQ ID NO: 72725 - DNA, 22 bp, Artificial Sequence
  Synthetic oligonucleotide; CTG chr11 5161858 5161879 5161875 5161880 +
aggagtagcagaatagcagatg

SEQ ID NO: 72726 - DNA, 22 bp, Artificial Sequence
  Synthetic oligonucleotide; CTG chr11 5161888 5161909 5161905 5161910 +
agaagttatttctttgaggata

SEQ ID NO: 72727 - DNA, 22 bp, Artificial Sequence
  Synthetic oligonucleotide; TTA chr11 5161896 5161917 5161913 5161918 +
tttctttgaggatagatttcta

SEQ ID NO: 72728 - DNA, 22 bp, Artificial Sequence
  Synthetic oligonucleotide; TTT chr11 5161899 5161920 5161916 5161921 +
ctttgaggatagatttctacga

SEQ ID NO: 72729 - DNA, 22 bp, Artificial Sequence
  Synthetic oligonucleotide; TTC chr11 5161900 5161921 5161917 5161922 +
tttgaggatagatttctacgat

SEQ ID NO: 72730 - DNA, 22 bp, Artificial Sequence
  Synthetic oligonucleotide; CTT chr11 5161902 5161923 5161919 5161924 +
tgaggatagatttctacgatgg

SEQ ID NO: 72731 - DNA, 22 bp, Artificial Sequence
  Synthetic oligonucleotide; TTT chr11 5161903 5161924 5161920 5161925 +
gaggatagatttctacgatgga

SEQ ID NO: 72732 - DNA, 22 bp, Artificial Sequence
  Synthetic oligonucleotide; TTG chr11 5161904 5161925 5161921 5161926 +
aggatagatttctacgatggaa

SEQ ID NO: 72733 - DNA, 22 bp, Artificial Sequence
  Synthetic oligonucleotide; TTT chr11 5161915 5161936 5161932 5161937 +
ctacgatggaaaggaaatgaga

SEQ ID NO: 72734 - DNA, 22 bp, Artificial Sequence
  Synthetic oligonucleotide; TTC chr11 5161916 5161937 5161933 5161938 +
tacgatggaaaggaaatgagag

SEQ ID NO: 72735 - DNA, 22 bp, Artificial Sequence
  Synthetic oligonucleotide; CTA chr11 5161918 5161939 5161935 5161940 +
cgatggaaaggaaatgagaggt

SEQ ID NO: 72736 - DNA, 22 bp, Artificial Sequence
  Synthetic oligonucleotide; TTC chr11 5161942 5161963 5161959 5161964 +
gaagaggcaggctagtggtttg

SEQ ID NO: 72737 - DNA, 22 bp, Artificial Sequence
  Synthetic oligonucleotide; CTA chr11 5161956 5161977 5161973 5161978 +
gtggtttgtactatagcatagc

SEQ ID NO: 72738 - DNA, 22 bp, Artificial Sequence
  Synthetic oligonucleotide; TTT chr11 5161963 5161984 5161980 5161985 +
gtactatagcatagcctgcctt

SEQ ID NO: 72739 - DNA, 22 bp, Artificial Sequence
  Synthetic oligonucleotide; TTG chr11 5161964 5161985 5161981 5161986 +
tactatagcatagcctgccttt

SEQ ID NO: 72740 - DNA, 22 bp, Artificial Sequence
  Synthetic oligonucleotide; CTA chr11 5161969 5161990 5161986 5161991 +
tagcatagcctgcctttgctgg

SEQ ID NO: 72741 - DNA, 22 bp, Artificial Sequence
  Synthetic oligonucleotide; CTG chr11 5161981 5162002 5161998 5162003 +
cctttgctggtgtgtggctatt

SEQ ID NO: 72742 - DNA, 22 bp, Artificial Sequence
  Synthetic oligonucleotide; CTT chr11 5161985 5162006 5162002 5162007 +
tgctggtgtgtggctattaggc

SEQ ID NO: 72743 - DNA, 22 bp, Artificial Sequence
  Synthetic oligonucleotide; TTT chr11 5161986 5162007 5162003 5162008 +
gctggtgtgtggctattaggcc

SEQ ID NO: 72744 - DNA, 22 bp, Artificial Sequence
  Synthetic oligonucleotide; TTG chr11 5161987 5162008 5162004 5162009 +
ctggtgtgtggctattaggcct

SEQ ID NO: 72745 - DNA, 22 bp, Artificial Sequence
  Synthetic oligonucleotide; CTG chr11 5161990 5162011 5162007 5162012 +
gtgtgtggctattaggcctggt

SEQ ID NO: 72746 - DNA, 22 bp, Artificial Sequence
  Synthetic oligonucleotide; CTA chr11 5162001 5162022 5162018 5162023 +
ttaggcctggtggaacggccat

SEQ ID NO: 72747 - DNA, 22 bp, Artificial Sequence
  Synthetic oligonucleotide; TTA chr11 5162004 5162025 5162021 5162026 +
ggcctggtggaacggccatcaa

SEQ ID NO: 72748 - DNA, 22 bp, Artificial Sequence
  Synthetic oligonucleotide; CTG chr11 5162010 5162031 5162027 5162032 +
gtggaacggccatcaataaatc

SEQ ID NO: 72749 - DNA, 22 bp, Artificial Sequence
  Synthetic oligonucleotide; TTG chr11 5162168 5162189 5162185 5162190 +
aagtccgggccaggaccaatgg

SEQ ID NO: 72750 - DNA, 22 bp, Artificial Sequence
  Synthetic oligonucleotide; TTG chr11 5162196 5162217 5162213 5162218 +
tgggacttaacaaagagtgagt

SEQ ID NO: 72751 - DNA, 22 bp, Artificial Sequence
  Synthetic oligonucleotide; CTT chr11 5162204 5162225 5162221 5162226 +
aacaaagagtgagtacagctga

SEQ ID NO: 72752 - DNA, 22 bp, Artificial Sequence
  Synthetic oligonucleotide; TTA chr11 5162205 5162226 5162222 5162227 +
acaaagagtgagtacagctgaa

SEQ ID NO: 72753 - DNA, 22 bp, Artificial Sequence
  Synthetic oligonucleotide; CTG chr11 5162225 5162246 5162242 5162247 +
aaggagccggggatcagaaagt

SEQ ID NO: 72754 - DNA, 22 bp, Artificial Sequence
  Synthetic oligonucleotide; TTT chr11 5162280 5162301 5162297 5162302 +
tagaagttatgagaaatgtgaa

SEQ ID NO: 72755 - DNA, 22 bp, Artificial Sequence
  Synthetic oligonucleotide; TTT chr11 5162281 5162302 5162298 5162303 +
agaagttatgagaaatgtgaag

SEQ ID NO: 72756 - DNA, 22 bp, Artificial Sequence
  Synthetic oligonucleotide; TTA chr11 5162282 5162303 5162299 5162304 +
gaagttatgagaaatgtgaaga

SEQ ID NO: 72757 - DNA, 22 bp, Artificial Sequence
  Synthetic oligonucleotide; TTA chr11 5162289 5162310 5162306 5162311 +
tgagaaatgtgaagagtgagct

SEQ ID NO: 72758 - DNA, 22 bp, Artificial Sequence
  Synthetic oligonucleotide; CTA chr11 5162312 5162333 5162329 5162334 +
agcatagtttgtgatttttagg

SEQ ID NO: 72759 - DNA, 22 bp, Artificial Sequence
  Synthetic oligonucleotide; TTT chr11 5162322 5162343 5162339 5162344 +
gtgatttttagggcctctaaaa

SEQ ID NO: 72760 - DNA, 22 bp, Artificial Sequence
  Synthetic oligonucleotide; TTG chr11 5162323 5162344 5162340 5162345 +
tgatttttagggcctctaaaag

SEQ ID NO: 72761 - DNA, 22 bp, Artificial Sequence
  Synthetic oligonucleotide; TTT chr11 5162329 5162350 5162346 5162351 +
ttagggcctctaaaagtattaa

SEQ ID NO: 72762 - DNA, 22 bp, Artificial Sequence
  Synthetic oligonucleotide; TTT chr11 5162330 5162351 5162347 5162352 +
tagggcctctaaaagtattaaa

SEQ ID NO: 72763 - DNA, 22 bp, Artificial Sequence
  Synthetic oligonucleotide; TTT chr11 5162331 5162352 5162348 5162353 +
agggcctctaaaagtattaaag

SEQ ID NO: 72764 - DNA, 22 bp, Artificial Sequence
  Synthetic oligonucleotide; TTA chr11 5162332 5162353 5162349 5162354 +
gggcctctaaaagtattaaagc

SEQ ID NO: 72765 - DNA, 22 bp, Artificial Sequence
  Synthetic oligonucleotide; CTC chr11 5162339 5162360 5162356 5162361 +
taaaagtattaaagcagcggca

SEQ ID NO: 72766 - DNA, 22 bp, Artificial Sequence
  Synthetic oligonucleotide; CTA chr11 5162341 5162362 5162358 5162363 +
aaagtattaaagcagcggcagc

SEQ ID NO: 72767 - DNA, 22 bp, Artificial Sequence
  Synthetic oligonucleotide; TTA chr11 5162350 5162371 5162367 5162372 +
aagcagcggcagccactgcatg

SEQ ID NO: 72768 - DNA, 22 bp, Artificial Sequence
  Synthetic oligonucleotide; CTG chr11 5162368 5162389 5162385 5162390 +
catgcagacctgagggctaggc

SEQ ID NO: 72769 - DNA, 22 bp, Artificial Sequence
  Synthetic oligonucleotide; CTG chr11 5162380 5162401 5162397 5162402 +
agggctaggctaaaacagtaag

SEQ ID NO: 72770 - DNA, 22 bp, Artificial Sequence
  Synthetic oligonucleotide; CTA chr11 5162387 5162408 5162404 5162409 +
ggctaaaacagtaaggtcaagt

SEQ ID NO: 72771 - DNA, 22 bp, Artificial Sequence
  Synthetic oligonucleotide; CTA chr11 5162392 5162413 5162409 5162414 +
aaacagtaaggtcaagttattt

SEQ ID NO: 72772 - DNA, 22 bp, Artificial Sequence
  Synthetic oligonucleotide; TTA chr11 5162411 5162432 5162428 5162433 +
tttggacagaaaggctacaggg

SEQ ID NO: 72773 - DNA, 22 bp, Artificial Sequence
  Synthetic oligonucleotide; TTT chr11 5162414 5162435 5162431 5162436 +
ggacagaaaggctacagggtgc

SEQ ID NO: 72774 - DNA, 22 bp, Artificial Sequence
  Synthetic oligonucleotide; TTG chr11 5162415 5162436 5162432 5162437 +
gacagaaaggctacagggtgca

SEQ ID NO: 72775 - DNA, 22 bp, Artificial Sequence
  Synthetic oligonucleotide; CTA chr11 5162428 5162449 5162445 5162450 +
cagggtgcagtcctggatcttg

SEQ ID NO: 72776 - DNA, 22 bp, Artificial Sequence
  Synthetic oligonucleotide; CTG chr11 5162443 5162464 5162460 5162465 +
gatcttgtgtaagaattctgac

SEQ ID NO: 72777 - DNA, 22 bp, Artificial Sequence
  Synthetic oligonucleotide; CTT chr11 5162449 5162470 5162466 5162471 +
gtgtaagaattctgaccgcact

SEQ ID NO: 72778 - DNA, 22 bp, Artificial Sequence
  Synthetic oligonucleotide; TTG chr11 5162450 5162471 5162467 5162472 +
tgtaagaattctgaccgcacta

SEQ ID NO: 72779 - DNA, 22 bp, Artificial Sequence
  Synthetic oligonucleotide; TTC chr11 5162461 5162482 5162478 5162483 +
tgaccgcactaactatgcctag

SEQ ID NO: 72780 - DNA, 22 bp, Artificial Sequence
  Synthetic oligonucleotide; CTG chr11 5162463 5162484 5162480 5162485 +
accgcactaactatgcctagga

SEQ ID NO: 72781 - DNA, 22 bp, Artificial Sequence
  Synthetic oligonucleotide; CTA chr11 5162472 5162493 5162489 5162494 +
actatgcctaggaaggaaagga

SEQ ID NO: 72782 - DNA, 22 bp, Artificial Sequence
  Synthetic oligonucleotide; CTA chr11 5162476 5162497 5162493 5162498 +
tgcctaggaaggaaaggagttg

SEQ ID NO: 72783 - DNA, 22 bp, Artificial Sequence
  Synthetic oligonucleotide; CTA chr11 5162482 5162503 5162499 5162504 +
ggaaggaaaggagttgttgttt

SEQ ID NO: 72784 - DNA, 22 bp, Artificial Sequence
  Synthetic oligonucleotide; TTG chr11 5162498 5162519 5162515 5162520 +
ttgttttgtagaagggattgag

SEQ ID NO: 72785 - DNA, 22 bp, Artificial Sequence
  Synthetic oligonucleotide; TTG chr11 5162501 5162522 5162518 5162523 +
ttttgtagaagggattgaggtt

SEQ ID NO: 72786 - DNA, 22 bp, Artificial Sequence
  Synthetic oligonucleotide; TTT chr11 5162504 5162525 5162521 5162526 +
tgtagaagggattgaggtttgg

SEQ ID NO: 72787 - DNA, 22 bp, Artificial Sequence
  Synthetic oligonucleotide; TTT chr11 5162505 5162526 5162522 5162527 +
gtagaagggattgaggtttggg

SEQ ID NO: 72788 - DNA, 22 bp, Artificial Sequence
  Synthetic oligonucleotide; TTG chr11 5162506 5162527 5162523 5162528 +
tagaagggattgaggtttggga

SEQ ID NO: 72789 - DNA, 22 bp, Artificial Sequence
  Synthetic oligonucleotide; TTG chr11 5162518 5162539 5162535 5162540 +
aggtttgggagattaatcggac

SEQ ID NO: 72790 - DNA, 22 bp, Artificial Sequence
  Synthetic oligonucleotide; TTT chr11 5162524 5162545 5162541 5162546 +
gggagattaatcggacacaatc

SEQ ID NO: 72791 - DNA, 22 bp, Artificial Sequence
  Synthetic oligonucleotide; TTG chr11 5162525 5162546 5162542 5162547 +
ggagattaatcggacacaatca

SEQ ID NO: 72792 - DNA, 22 bp, Artificial Sequence
  Synthetic oligonucleotide; TTA chr11 5162533 5162554 5162550 5162555 +
atcggacacaatcagcagggag

SEQ ID NO: 72793 - DNA, 22 bp, Artificial Sequence
  Synthetic oligonucleotide; TTT chr11 5162568 5162589 5162585 5162590 +
ttatgagaattatgccgagata

SEQ ID NO: 72794 - DNA, 22 bp, Artificial Sequence
  Synthetic oligonucleotide; TTT chr11 5162569 5162590 5162586 5162591 +
tatgagaattatgccgagatag

SEQ ID NO: 72795 - DNA, 22 bp, Artificial Sequence
  Synthetic oligonucleotide; TTT chr11 5162570 5162591 5162587 5162592 +
atgagaattatgccgagatagg

SEQ ID NO: 72796 - DNA, 22 bp, Artificial Sequence
  Synthetic oligonucleotide; TTA chr11 5162571 5162592 5162588 5162593 +
tgagaattatgccgagataggt

SEQ ID NO: 72797 - DNA, 22 bp, Artificial Sequence
  Synthetic oligonucleotide; TTA chr11 5162580 5162601 5162597 5162602 +
tgccgagataggtaacacatga

SEQ ID NO: 72798 - DNA, 22 bp, Artificial Sequence
  Synthetic oligonucleotide; TTT chr11 5162613 5162634 5162630 5162635 +
gggcttgactgaagtaatgggg

SEQ ID NO: 72799 - DNA, 22 bp, Artificial Sequence
  Synthetic oligonucleotide; TTG chr11 5162614 5162635 5162631 5162636 +
ggcttgactgaagtaatggggt

SEQ ID NO: 72800 - DNA, 22 bp, Artificial Sequence
  Synthetic oligonucleotide; CTT chr11 5162619 5162640 5162636 5162641 +
gactgaagtaatggggtctgtc

SEQ ID NO: 72801 - DNA, 22 bp, Artificial Sequence
  Synthetic oligonucleotide; TTG chr11 5162620 5162641 5162637 5162642 +
actgaagtaatggggtctgtct

SEQ ID NO: 72802 - DNA, 22 bp, Artificial Sequence
  Synthetic oligonucleotide; CTG chr11 5162624 5162645 5162641 5162646 +
aagtaatggggtctgtctgtga

SEQ ID NO: 72803 - DNA, 22 bp, Artificial Sequence
  Synthetic oligonucleotide; CTG chr11 5162639 5162660 5162656 5162661 +
tctgtgaagccttgcagcagta

SEQ ID NO: 72804 - DNA, 22 bp, Artificial Sequence
  Synthetic oligonucleotide; CTG chr11 5162643 5162664 5162660 5162665 +
tgaagccttgcagcagtacagc

SEQ ID NO: 72805 - DNA, 22 bp, Artificial Sequence
  Synthetic oligonucleotide; CTT chr11 5162652 5162673 5162669 5162674 +
gcagcagtacagcccaggtaat

SEQ ID NO: 72806 - DNA, 22 bp, Artificial Sequence
  Synthetic oligonucleotide; TTG chr11 5162653 5162674 5162670 5162675 +
cagcagtacagcccaggtaatt

SEQ ID NO: 72807 - DNA, 22 bp, Artificial Sequence
  Synthetic oligonucleotide; TTT chr11 5162676 5162697 5162693 5162698 +
gctgagcctaatgggtgtcagt

SEQ ID NO: 72808 - DNA, 22 bp, Artificial Sequence
  Synthetic oligonucleotide; TTG chr11 5162677 5162698 5162694 5162699 +
ctgagcctaatgggtgtcagtg

SEQ ID NO: 72809 - DNA, 22 bp, Artificial Sequence
  Synthetic oligonucleotide; CTG chr11 5162680 5162701 5162697 5162702 +
agcctaatgggtgtcagtgtca

SEQ ID NO: 72810 - DNA, 22 bp, Artificial Sequence
  Synthetic oligonucleotide; CTA chr11 5162686 5162707 5162703 5162708 +
atgggtgtcagtgtcagtccaa

SEQ ID NO: 72811 - DNA, 22 bp, Artificial Sequence
  Synthetic oligonucleotide; CTG chr11 5162728 5162749 5162745 5162750 +
gaatgaagggtgcaaaggaata

SEQ ID NO: 72812 - DNA, 22 bp, Artificial Sequence
  Synthetic oligonucleotide; TTT chr11 5162767 5162788 5162784 5162789 +
gagatccagaacagaataatgg

SEQ ID NO: 72813 - DNA, 22 bp, Artificial Sequence
  Synthetic oligonucleotide; TTG chr11 5162768 5162789 5162785 5162790 +
agatccagaacagaataatggg

SEQ ID NO: 72814 - DNA, 22 bp, Artificial Sequence
  Synthetic oligonucleotide; TTA chr11 5162793 5162814 5162810 5162815 +
tagatggaggtattgaggatag

SEQ ID NO: 72815 - DNA, 22 bp, Artificial Sequence
  Synthetic oligonucleotide; TTG chr11 5162808 5162829 5162825 5162830 +
aggataggagagtatatgggtt

SEQ ID NO: 72816 - DNA, 22 bp, Artificial Sequence
  Synthetic oligonucleotide; TTT chr11 5162831 5162852 5162848 5162853 +
ggcaccatggggtggataggca

SEQ ID NO: 72817 - DNA, 22 bp, Artificial Sequence
  Synthetic oligonucleotide; TTG chr11 5162832 5162853 5162849 5162854 +
gcaccatggggtggataggcaa

SEQ ID NO: 72818 - DNA, 22 bp, Artificial Sequence
  Synthetic oligonucleotide; TTT chr11 5162862 5162883 5162879 5162884 +
ggttgataagatgcagattctg

SEQ ID NO: 72819 - DNA, 22 bp, Artificial Sequence
  Synthetic oligonucleotide; TTG chr11 5162863 5162884 5162880 5162885 +
gttgataagatgcagattctga

SEQ ID NO: 72820 - DNA, 22 bp, Artificial Sequence
  Synthetic oligonucleotide; TTG chr11 5162867 5162888 5162884 5162889 +
ataagatgcagattctgaacta

SEQ ID NO: 72821 - DNA, 22 bp, Artificial Sequence
  Synthetic oligonucleotide; TTC chr11 5162882 5162903 5162899 5162904 +
tgaactaacctgtaaggcttgt

SEQ ID NO: 72822 - DNA, 22 bp, Artificial Sequence
  Synthetic oligonucleotide; CTG chr11 5162884 5162905 5162901 5162906 +
aactaacctgtaaggcttgtct

SEQ ID NO: 72823 - DNA, 22 bp, Artificial Sequence
  Synthetic oligonucleotide; CTA chr11 5162889 5162910 5162906 5162911 +
acctgtaaggcttgtctggttt

SEQ ID NO: 72824 - DNA, 22 bp, Artificial Sequence
  Synthetic oligonucleotide; CTG chr11 5162894 5162915 5162911 5162916 +
taaggcttgtctggttttagga

SEQ ID NO: 72825 - DNA, 22 bp, Artificial Sequence
  Synthetic oligonucleotide; CTT chr11 5162902 5162923 5162919 5162924 +
gtctggttttaggacaggtaaa

SEQ ID NO: 72826 - DNA, 22 bp, Artificial Sequence
  Synthetic oligonucleotide; TTG chr11 5162903 5162924 5162920 5162925 +
tctggttttaggacaggtaaaa

SEQ ID NO: 72827 - DNA, 22 bp, Artificial Sequence
  Synthetic oligonucleotide; CTG chr11 5162907 5162928 5162924 5162929 +
gttttaggacaggtaaaatggg

SEQ ID NO: 72828 - DNA, 22 bp, Artificial Sequence
  Synthetic oligonucleotide; TTT chr11 5162911 5162932 5162928 5162933 +
taggacaggtaaaatgggggaa

SEQ ID NO: 72829 - DNA, 22 bp, Artificial Sequence
  Synthetic oligonucleotide; TTT chr11 5162912 5162933 5162929 5162934 +
aggacaggtaaaatgggggaat

SEQ ID NO: 72830 - DNA, 22 bp, Artificial Sequence
  Synthetic oligonucleotide; TTA chr11 5162913 5162934 5162930 5162935 +
ggacaggtaaaatgggggaatg

SEQ ID NO: 72831 - DNA, 22 bp, Artificial Sequence
  Synthetic oligonucleotide; TTT chr11 5162948 5162969 5162965 5162970 +
ataggctttaaaaggccatgct

SEQ ID NO: 72832 - DNA, 22 bp, Artificial Sequence
  Synthetic oligonucleotide; TTA chr11 5162949 5162970 5162966 5162971 +
taggctttaaaaggccatgctg

SEQ ID NO: 72833 - DNA, 22 bp, Artificial Sequence
  Synthetic oligonucleotide; CTT chr11 5162956 5162977 5162973 5162978 +
taaaaggccatgctgtaacagg

SEQ ID NO: 72834 - DNA, 22 bp, Artificial Sequence
  Synthetic oligonucleotide; TTT chr11 5162957 5162978 5162974 5162979 +
aaaaggccatgctgtaacaggc

SEQ ID NO: 72835 - DNA, 22 bp, Artificial Sequence
  Synthetic oligonucleotide; TTA chr11 5162958 5162979 5162975 5162980 +
aaaggccatgctgtaacaggca

SEQ ID NO: 72836 - DNA, 22 bp, Artificial Sequence
  Synthetic oligonucleotide; CTG chr11 5162971 5162992 5162988 5162993 +
taacaggcaagtaataacaggc

SEQ ID NO: 72837 - DNA, 22 bp, Artificial Sequence
  Synthetic oligonucleotide; CTT chr11 5162995 5163016 5163012 5163017 +
taatcctttcaaagcatgctgt

SEQ ID NO: 72838 - DNA, 22 bp, Artificial Sequence
  Synthetic oligonucleotide; TTT chr11 5162996 5163017 5163013 5163018 +
aatcctttcaaagcatgctgtg

SEQ ID NO: 72839 - DNA, 22 bp, Artificial Sequence
  Synthetic oligonucleotide; TTA chr11 5162997 5163018 5163014 5163019 +
atcctttcaaagcatgctgtgg

SEQ ID NO: 72840 - DNA, 22 bp, Artificial Sequence
  Synthetic oligonucleotide; CTT chr11 5163003 5163024 5163020 5163025 +
tcaaagcatgctgtgggatggg

SEQ ID NO: 72841 - DNA, 22 bp, Artificial Sequence
  Synthetic oligonucleotide; TTT chr11 5163004 5163025 5163021 5163026 +
caaagcatgctgtgggatggga

SEQ ID NO: 72842 - DNA, 22 bp, Artificial Sequence
  Synthetic oligonucleotide; TTC chr11 5163005 5163026 5163022 5163027 +
aaagcatgctgtgggatgggat

SEQ ID NO: 72843 - DNA, 22 bp, Artificial Sequence
  Synthetic oligonucleotide; CTG chr11 5163016 5163037 5163033 5163038 +
tgggatgggatactggcattga

SEQ ID NO: 72844 - DNA, 22 bp, Artificial Sequence
  Synthetic oligonucleotide; CTG chr11 5163031 5163052 5163048 5163053 +
gcattgagcggggtaagagtga

SEQ ID NO: 72845 - DNA, 22 bp, Artificial Sequence
  Synthetic oligonucleotide; TTG chr11 5163037 5163058 5163054 5163059 +
agcggggtaagagtgattaggt

SEQ ID NO: 72846 - DNA, 22 bp, Artificial Sequence
  Synthetic oligonucleotide; TTA chr11 5163056 5163077 5163073 5163078 +
ggttttaatgggatggtaaggg

SEQ ID NO: 72847 - DNA, 22 bp, Artificial Sequence
  Synthetic oligonucleotide; TTT chr11 5163061 5163082 5163078 5163083 +
taatgggatggtaaggggcgca

SEQ ID NO: 72848 - DNA, 22 bp, Artificial Sequence
  Synthetic oligonucleotide; TTT chr11 5163062 5163083 5163079 5163084 +
aatgggatggtaaggggcgcat

SEQ ID NO: 72849 - DNA, 22 bp, Artificial Sequence
  Synthetic oligonucleotide; TTA chr11 5163063 5163084 5163080 5163085 +
atgggatggtaaggggcgcatg

SEQ ID NO: 72850 - DNA, 22 bp, Artificial Sequence
  Synthetic oligonucleotide; CTT chr11 5163117 5163138 5163134 5163139 +
atacttgtggattaaggtgggg

SEQ ID NO: 72851 - DNA, 22 bp, Artificial Sequence
  Synthetic oligonucleotide; TTA chr11 5163118 5163139 5163135 5163140 +
tacttgtggattaaggtgggga

SEQ ID NO: 72852 - DNA, 22 bp, Artificial Sequence
  Synthetic oligonucleotide; CTT chr11 5163123 5163144 5163140 5163145 +
gtggattaaggtggggagatac

SEQ ID NO: 72853 - DNA, 22 bp, Artificial Sequence
  Synthetic oligonucleotide; TTG chr11 5163124 5163145 5163141 5163146 +
tggattaaggtggggagataca

SEQ ID NO: 72854 - DNA, 22 bp, Artificial Sequence
  Synthetic oligonucleotide; TTA chr11 5163131 5163152 5163148 5163153 +
aggtggggagatacaaggggag

SEQ ID NO: 72855 - DNA, 22 bp, Artificial Sequence
  Synthetic oligonucleotide; CTT chr11 5163169 5163190 5163186 5163191 +
tgaactgggggaaaacatggca

SEQ ID NO: 72856 - DNA, 22 bp, Artificial Sequence
  Synthetic oligonucleotide; TTT chr11 5163170 5163191 5163187 5163192 +
gaactgggggaaaacatggcaa

SEQ ID NO: 72857 - DNA, 22 bp, Artificial Sequence
  Synthetic oligonucleotide; TTG chr11 5163171 5163192 5163188 5163193 +
aactgggggaaaacatggcaat

SEQ ID NO: 72858 - DNA, 22 bp, Artificial Sequence
  Synthetic oligonucleotide; CTG chr11 5163176 5163197 5163193 5163198 +
ggggaaaacatggcaatgaggt

SEQ ID NO: 72859 - DNA, 22 bp, Artificial Sequence
  Synthetic oligonucleotide; CTG chr11 5163205 5163226 5163222 5163227 +
tagcccaggaatagtcagggaa

SEQ ID NO: 72860 - DNA, 22 bp, Artificial Sequence
  Synthetic oligonucleotide; TTT chr11 5163238 5163259 5163255 5163260 +
agttaaagtgtctcggcctaat

SEQ ID NO: 72861 - DNA, 22 bp, Artificial Sequence
  Synthetic oligonucleotide; TTA chr11 5163239 5163260 5163256 5163261 +
gttaaagtgtctcggcctaata

SEQ ID NO: 72862 - DNA, 22 bp, Artificial Sequence
  Synthetic oligonucleotide; TTA chr11 5163243 5163264 5163260 5163265 +
aagtgtctcggcctaataaggg

SEQ ID NO: 72863 - DNA, 22 bp, Artificial Sequence
  Synthetic oligonucleotide; CTC chr11 5163252 5163273 5163269 5163274 +
ggcctaataagggaactggcag

SEQ ID NO: 72864 - DNA, 22 bp, Artificial Sequence
  Synthetic oligonucleotide; CTA chr11 5163258 5163279 5163275 5163280 +
ataagggaactggcaggtgggg

SEQ ID NO: 72865 - DNA, 22 bp, Artificial Sequence
  Synthetic oligonucleotide; CTG chr11 5163270 5163291 5163287 5163292 +
gcaggtggggataatgaaaaag

SEQ ID NO: 72866 - DNA, 22 bp, Artificial Sequence
  Synthetic oligonucleotide; CTT chr11 5163300 5163321 5163317 5163322 +
aaaagagtatcgtctcggttag

SEQ ID NO: 72867 - DNA, 22 bp, Artificial Sequence
  Synthetic oligonucleotide; TTA chr11 5163301 5163322 5163318 5163323 +
aaagagtatcgtctcggttagc

SEQ ID NO: 72868 - DNA, 22 bp, Artificial Sequence
  Synthetic oligonucleotide; CTC chr11 5163316 5163337 5163333 5163338 +
ggttagcaccagagttggggaa

SEQ ID NO: 72869 - DNA, 22 bp, Artificial Sequence
  Synthetic oligonucleotide; TTA chr11 5163321 5163342 5163338 5163343 +
gcaccagagttggggaatttta

SEQ ID NO: 72870 - DNA, 22 bp, Artificial Sequence
  Synthetic oligonucleotide; TTG chr11 5163333 5163354 5163350 5163355 +
gggaattttaagaggtttagaa

SEQ ID NO: 72871 - DNA, 22 bp, Artificial Sequence
  Synthetic oligonucleotide; TTT chr11 5163341 5163362 5163358 5163363 +
taagaggtttagaagcctggcc

SEQ ID NO: 72872 - DNA, 22 bp, Artificial Sequence
  Synthetic oligonucleotide; TTT chr11 5163342 5163363 5163359 5163364 +
aagaggtttagaagcctggcca

SEQ ID NO: 72873 - DNA, 22 bp, Artificial Sequence
  Synthetic oligonucleotide; TTA chr11 5163343 5163364 5163360 5163365 +
agaggtttagaagcctggccat

SEQ ID NO: 72874 - DNA, 22 bp, Artificial Sequence
  Synthetic oligonucleotide; TTT chr11 5163351 5163372 5163368 5163373 +
agaagcctggccatcaatacct

SEQ ID NO: 72875 - DNA, 22 bp, Artificial Sequence
  Synthetic oligonucleotide; TTA chr11 5163352 5163373 5163369 5163374 +
gaagcctggccatcaataccta

SEQ ID NO: 72876 - DNA, 22 bp, Artificial Sequence
  Synthetic oligonucleotide; CTG chr11 5163360 5163381 5163377 5163382 +
gccatcaatacctacaacagtt

SEQ ID NO: 72877 - DNA, 22 bp, Artificial Sequence
  Synthetic oligonucleotide; CTA chr11 5163374 5163395 5163391 5163396 +
caacagttatggaggcaaggga

SEQ ID NO: 72878 - DNA, 22 bp, Artificial Sequence
  Synthetic oligonucleotide; TTA chr11 5163383 5163404 5163400 5163405 +
tggaggcaagggaaacaggcct

SEQ ID NO: 72879 - DNA, 22 bp, Artificial Sequence
  Synthetic oligonucleotide; CTT chr11 5163406 5163427 5163423 5163428 +
tgaaaagaaggtaatgtggagt

SEQ ID NO: 72880 - DNA, 22 bp, Artificial Sequence
  Synthetic oligonucleotide; TTT chr11 5163407 5163428 5163424 5163429 +
gaaaagaaggtaatgtggagtg

SEQ ID NO: 72881 - DNA, 22 bp, Artificial Sequence
  Synthetic oligonucleotide; TTG chr11 5163408 5163429 5163425 5163430 +
aaaagaaggtaatgtggagtgg

SEQ ID NO: 72882 - DNA, 22 bp, Artificial Sequence
  Synthetic oligonucleotide; CTC chr11 5163438 5163459 5163455 5163460 +
catactgattaagaagggtaca

SEQ ID NO: 72883 - DNA, 22 bp, Artificial Sequence
  Synthetic oligonucleotide; CTG chr11 5163445 5163466 5163462 5163467 +
attaagaagggtacagacttac

SEQ ID NO: 72884 - DNA, 22 bp, Artificial Sequence
  Synthetic oligonucleotide; TTA chr11 5163449 5163470 5163466 5163471 +
agaagggtacagacttaccctc

SEQ ID NO: 72885 - DNA, 22 bp, Artificial Sequence
  Synthetic oligonucleotide; CTT chr11 5163465 5163486 5163482 5163487 +
accctccactgtgagaattacc

SEQ ID NO: 72886 - DNA, 22 bp, Artificial Sequence
  Synthetic oligonucleotide; TTA chr11 5163466 5163487 5163483 5163488 +
ccctccactgtgagaattacct

SEQ ID NO: 72887 - DNA, 22 bp, Artificial Sequence
  Synthetic oligonucleotide; CTC chr11 5163471 5163492 5163488 5163493 +
cactgtgagaattacctaaagc

SEQ ID NO: 72888 - DNA, 22 bp, Artificial Sequence
  Synthetic oligonucleotide; CTG chr11 5163476 5163497 5163493 5163498 +
tgagaattacctaaagctcggt

SEQ ID NO: 72889 - DNA, 22 bp, Artificial Sequence
  Synthetic oligonucleotide; TTA chr11 5163485 5163506 5163502 5163507 +
cctaaagctcggtgtctgtgat

SEQ ID NO: 72890 - DNA, 22 bp, Artificial Sequence
  Synthetic oligonucleotide; CTA chr11 5163489 5163510 5163506 5163511 +
aagctcggtgtctgtgatggtc

SEQ ID NO: 72891 - DNA, 22 bp, Artificial Sequence
  Synthetic oligonucleotide; CTC chr11 5163495 5163516 5163512 5163517 +
ggtgtctgtgatggtctacagg

SEQ ID NO: 72892 - DNA, 22 bp, Artificial Sequence
  Synthetic oligonucleotide; CTG chr11 5163503 5163524 5163520 5163525 +
tgatggtctacagggcttccga

SEQ ID NO: 72893 - DNA, 22 bp, Artificial Sequence
  Synthetic oligonucleotide; CTA chr11 5163513 5163534 5163530 5163535 +
cagggcttccgaggcgatcagg

SEQ ID NO: 72894 - DNA, 22 bp, Artificial Sequence
  Synthetic oligonucleotide; CTT chr11 5163521 5163542 5163538 5163543 +
ccgaggcgatcaggcagtggca

SEQ ID NO: 72895 - DNA, 22 bp, Artificial Sequence
  Synthetic oligonucleotide; TTC chr11 5163522 5163543 5163539 5163544 +
cgaggcgatcaggcagtggcag

SEQ ID NO: 72896 - DNA, 22 bp, Artificial Sequence
  Synthetic oligonucleotide; CTT chr11 5163548 5163569 5163565 5163570 +
cagctgcaaagccgagaagatc

SEQ ID NO: 72897 - DNA, 22 bp, Artificial Sequence
  Synthetic oligonucleotide; TTC chr11 5163549 5163570 5163566 5163571 +
agctgcaaagccgagaagatct

SEQ ID NO: 72898 - DNA, 22 bp, Artificial Sequence
  Synthetic oligonucleotide; CTG chr11 5163554 5163575 5163571 5163576 +
caaagccgagaagatctgggaa

SEQ ID NO: 72899 - DNA, 22 bp, Artificial Sequence
  Synthetic oligonucleotide; CTG chr11 5163572 5163593 5163589 5163594 +
ggaaggagtcagtcagggagcc

SEQ ID NO: 72900 - DNA, 22 bp, Artificial Sequence
  Synthetic oligonucleotide; CTT chr11 5163596 5163617 5163613 5163618 +
gggccagagttccaggggctct

SEQ ID NO: 72901 - DNA, 22 bp, Artificial Sequence
  Synthetic oligonucleotide; TTG chr11 5163597 5163618 5163614 5163619 +
ggccagagttccaggggctcta

SEQ ID NO: 72902 - DNA, 22 bp, Artificial Sequence
  Synthetic oligonucleotide; TTC chr11 5163608 5163629 5163625 5163630 +
caggggctctaggagtggctgc

SEQ ID NO: 72903 - DNA, 22 bp, Artificial Sequence
  Synthetic oligonucleotide; CTC chr11 5163617 5163638 5163634 5163639 +
taggagtggctgccaggtgagt

SEQ ID NO: 72904 - DNA, 22 bp, Artificial Sequence
  Synthetic oligonucleotide; CTA chr11 5163619 5163640 5163636 5163641 +
ggagtggctgccaggtgagttg

SEQ ID NO: 72905 - DNA, 22 bp, Artificial Sequence
  Synthetic oligonucleotide; CTG chr11 5163629 5163650 5163646 5163651 +
ccaggtgagttgaacagtccga

SEQ ID NO: 72906 - DNA, 22 bp, Artificial Sequence
  Synthetic oligonucleotide; TTG chr11 5163641 5163662 5163658 5163663 +
aacagtccgatttctagtgggg

SEQ ID NO: 72907 - DNA, 22 bp, Artificial Sequence
  Synthetic oligonucleotide; TTT chr11 5163654 5163675 5163671 5163676 +
ctagtggggtcctgcacagatg

SEQ ID NO: 72908 - DNA, 22 bp, Artificial Sequence
  Synthetic oligonucleotide; TTC chr11 5163655 5163676 5163672 5163677 +
tagtggggtcctgcacagatgg

SEQ ID NO: 72909 - DNA, 22 bp, Artificial Sequence
  Synthetic oligonucleotide; CTA chr11 5163657 5163678 5163674 5163679 +
gtggggtcctgcacagatggga

SEQ ID NO: 72910 - DNA, 22 bp, Artificial Sequence
  Synthetic oligonucleotide; CTG chr11 5163668 5163689 5163685 5163690 +
cacagatgggacacggcttagg

SEQ ID NO: 72911 - DNA, 22 bp, Artificial Sequence
  Synthetic oligonucleotide; CTT chr11 5163687 5163708 5163704 5163709 +
aggaggaatcctgggctgcggg

SEQ ID NO: 72912 - DNA, 22 bp, Artificial Sequence
  Synthetic oligonucleotide; TTA chr11 5163688 5163709 5163705 5163710 +
ggaggaatcctgggctgcgggc

SEQ ID NO: 72913 - DNA, 22 bp, Artificial Sequence
  Synthetic oligonucleotide; CTG chr11 5163700 5163721 5163717 5163722 +
ggctgcgggcattccttggcct

SEQ ID NO: 72914 - DNA, 22 bp, Artificial Sequence
  Synthetic oligonucleotide; CTG chr11 5163705 5163726 5163722 5163727 +
cgggcattccttggcctggtgg

SEQ ID NO: 72915 - DNA, 22 bp, Artificial Sequence
  Synthetic oligonucleotide; TTC chr11 5163714 5163735 5163731 5163736 +
cttggcctggtggccagatttc

SEQ ID NO: 72916 - DNA, 22 bp, Artificial Sequence
  Synthetic oligonucleotide; CTT chr11 5163717 5163738 5163734 5163739 +
ggcctggtggccagatttctgg

SEQ ID NO: 72917 - DNA, 22 bp, Artificial Sequence
  Synthetic oligonucleotide; TTG chr11 5163718 5163739 5163735 5163740 +
gcctggtggccagatttctggc

SEQ ID NO: 72918 - DNA, 22 bp, Artificial Sequence
  Synthetic oligonucleotide; CTG chr11 5163723 5163744 5163740 5163745 +
gtggccagatttctggcacttg

SEQ ID NO: 72919 - DNA, 22 bp, Artificial Sequence
  Synthetic oligonucleotide; TTT chr11 5163735 5163756 5163752 5163757 +
ctggcacttgtagcaagctcct

SEQ ID NO: 72920 - DNA, 22 bp, Artificial Sequence
  Synthetic oligonucleotide; TTC chr11 5163736 5163757 5163753 5163758 +
tggcacttgtagcaagctcctg

SEQ ID NO: 72921 - DNA, 22 bp, Artificial Sequence
  Synthetic oligonucleotide; CTG chr11 5163738 5163759 5163755 5163760 +
gcacttgtagcaagctcctggg

SEQ ID NO: 72922 - DNA, 22 bp, Artificial Sequence
  Synthetic oligonucleotide; CTT chr11 5163744 5163765 5163761 5163766 +
gtagcaagctcctgggggaggt

SEQ ID NO: 72923 - DNA, 22 bp, Artificial Sequence
  Synthetic oligonucleotide; TTG chr11 5163745 5163766 5163762 5163767 +
tagcaagctcctgggggaggtg

SEQ ID NO: 72924 - DNA, 22 bp, Artificial Sequence
  Synthetic oligonucleotide; CTC chr11 5163755 5163776 5163772 5163777 +
ctgggggaggtggttccggagg

SEQ ID NO: 72925 - DNA, 22 bp, Artificial Sequence
  Synthetic oligonucleotide; CTG chr11 5163758 5163779 5163775 5163780 +
ggggaggtggttccggaggaac

SEQ ID NO: 72926 - DNA, 22 bp, Artificial Sequence
  Synthetic oligonucleotide; TTC chr11 5163771 5163792 5163788 5163793 +
cggaggaacgcctggccactgc

SEQ ID NO: 72927 - DNA, 22 bp, Artificial Sequence
  Synthetic oligonucleotide; CTG chr11 5163785 5163806 5163802 5163807 +
gccactgcggtttaggcatttg

SEQ ID NO: 72928 - DNA, 22 bp, Artificial Sequence
  Synthetic oligonucleotide; CTG chr11 5163792 5163813 5163809 5163814 +
cggtttaggcatttggaagttc

SEQ ID NO: 72929 - DNA, 22 bp, Artificial Sequence
  Synthetic oligonucleotide; TTT chr11 5163798 5163819 5163815 5163820 +
aggcatttggaagttcttgtgt

SEQ ID NO: 72930 - DNA, 22 bp, Artificial Sequence
  Synthetic oligonucleotide; TTA chr11 5163799 5163820 5163816 5163821 +
ggcatttggaagttcttgtgtg

SEQ ID NO: 72931 - DNA, 22 bp, Artificial Sequence
  Synthetic oligonucleotide; TTT chr11 5163806 5163827 5163823 5163828 +
ggaagttcttgtgtgctggaga

SEQ ID NO: 72932 - DNA, 22 bp, Artificial Sequence
  Synthetic oligonucleotide; TTG chr11 5163807 5163828 5163824 5163829 +
gaagttcttgtgtgctggagat

SEQ ID NO: 72933 - DNA, 22 bp, Artificial Sequence
  Synthetic oligonucleotide; TTC chr11 5163814 5163835 5163831 5163836 +
ttgtgtgctggagatgtggctg

SEQ ID NO: 72934 - DNA, 22 bp, Artificial Sequence
  Synthetic oligonucleotide; CTT chr11 5163816 5163837 5163833 5163838 +
gtgtgctggagatgtggctggg

SEQ ID NO: 72935 - DNA, 22 bp, Artificial Sequence
  Synthetic oligonucleotide; TTG chr11 5163817 5163838 5163834 5163839 +
tgtgctggagatgtggctgggg

SEQ ID NO: 72936 - DNA, 22 bp, Artificial Sequence
  Synthetic oligonucleotide; CTG chr11 5163824 5163845 5163841 5163846 +
gagatgtggctggggtttgtct

SEQ ID NO: 72937 - DNA, 22 bp, Artificial Sequence
  Synthetic oligonucleotide; CTG chr11 5163836 5163857 5163853 5163858 +
gggtttgtctcacagtggaggc

SEQ ID NO: 72938 - DNA, 22 bp, Artificial Sequence
  Synthetic oligonucleotide; TTT chr11 5163842 5163863 5163859 5163864 +
gtctcacagtggaggcaaggaa

SEQ ID NO: 72939 - DNA, 22 bp, Artificial Sequence
  Synthetic oligonucleotide; TTG chr11 5163843 5163864 5163860 5163865 +
tctcacagtggaggcaaggaat

SEQ ID NO: 72940 - DNA, 22 bp, Artificial Sequence
  Synthetic oligonucleotide; CTC chr11 5163847 5163868 5163864 5163869 +
acagtggaggcaaggaattgca

SEQ ID NO: 72941 - DNA, 22 bp, Artificial Sequence
  Synthetic oligonucleotide; TTG chr11 5163867 5163888 5163884 5163889 +
caactcaaaaatatgttgctac

SEQ ID NO: 72942 - DNA, 22 bp, Artificial Sequence
  Synthetic oligonucleotide; CTC chr11 5163873 5163894 5163890 5163895 +
aaaaatatgttgctacttggct

SEQ ID NO: 72943 - DNA, 22 bp, Artificial Sequence
  Synthetic oligonucleotide; TTG chr11 5163885 5163906 5163902 5163907 +
ctacttggctgcctctactcta

SEQ ID NO: 72944 - DNA, 22 bp, Artificial Sequence
  Synthetic oligonucleotide; CTA chr11 5163888 5163909 5163905 5163910 +
cttggctgcctctactctatta

SEQ ID NO: 72945 - DNA, 22 bp, Artificial Sequence
  Synthetic oligonucleotide; CTT chr11 5163891 5163912 5163908 5163913 +
ggctgcctctactctattattg

SEQ ID NO: 72946 - DNA, 22 bp, Artificial Sequence
  Synthetic oligonucleotide; TTG chr11 5163892 5163913 5163909 5163914 +
gctgcctctactctattattgt

SEQ ID NO: 72947 - DNA, 22 bp, Artificial Sequence
  Synthetic oligonucleotide; CTG chr11 5163896 5163917 5163913 5163918 +
cctctactctattattgtacac

SEQ ID NO: 72948 - DNA, 22 bp, Artificial Sequence
  Synthetic oligonucleotide; CTC chr11 5163900 5163921 5163917 5163922 +
tactctattattgtacaccttg

SEQ ID NO: 72949 - DNA, 22 bp, Artificial Sequence
  Synthetic oligonucleotide; CTA chr11 5163902 5163923 5163919 5163924 +
ctctattattgtacaccttgaa

SEQ ID NO: 72950 - DNA, 22 bp, Artificial Sequence
  Synthetic oligonucleotide; CTC chr11 5163905 5163926 5163922 5163927 +
tattattgtacaccttgaaggt

SEQ ID NO: 72951 - DNA, 22 bp, Artificial Sequence
  Synthetic oligonucleotide; CTA chr11 5163907 5163928 5163924 5163929 +
ttattgtacaccttgaaggtga

SEQ ID NO: 72952 - DNA, 22 bp, Artificial Sequence
  Synthetic oligonucleotide; TTA chr11 5163910 5163931 5163927 5163932 +
ttgtacaccttgaaggtgaggt

SEQ ID NO: 72953 - DNA, 22 bp, Artificial Sequence
  Synthetic oligonucleotide; TTG chr11 5163913 5163934 5163930 5163935 +
tacaccttgaaggtgaggttaa

SEQ ID NO: 72954 - DNA, 22 bp, Artificial Sequence
  Synthetic oligonucleotide; CTT chr11 5163921 5163942 5163938 5163943 +
gaaggtgaggttaattgagtcc

SEQ ID NO: 72955 - DNA, 22 bp, Artificial Sequence
  Synthetic oligonucleotide; TTG chr11 5163922 5163943 5163939 5163944 +
aaggtgaggttaattgagtcct

SEQ ID NO: 72956 - DNA, 22 bp, Artificial Sequence
  Synthetic oligonucleotide; TTA chr11 5163934 5163955 5163951 5163956 +
attgagtcctgttgtggggttt

SEQ ID NO: 72957 - DNA, 22 bp, Artificial Sequence
  Synthetic oligonucleotide; TTG chr11 5163938 5163959 5163955 5163960 +
agtcctgttgtggggtttgagg

SEQ ID NO: 72958 - DNA, 22 bp, Artificial Sequence
  Synthetic oligonucleotide; CTG chr11 5163945 5163966 5163962 5163967 +
ttgtggggtttgaggtccagaa

SEQ ID NO: 72959 - DNA, 22 bp, Artificial Sequence
  Synthetic oligonucleotide; TTG chr11 5163948 5163969 5163965 5163970 +
tggggtttgaggtccagaattt

SEQ ID NO: 72960 - DNA, 22 bp, Artificial Sequence
  Synthetic oligonucleotide; TTT chr11 5163956 5163977 5163973 5163978 +
gaggtccagaatttaatttttg

SEQ ID NO: 72961 - DNA, 22 bp, Artificial Sequence
  Synthetic oligonucleotide; TTG chr11 5163957 5163978 5163974 5163979 +
aggtccagaatttaatttttgg

SEQ ID NO: 72962 - DNA, 22 bp, Artificial Sequence
  Synthetic oligonucleotide; TTT chr11 5163970 5163991 5163987 5163992 +
aatttttggagttttatttaat

SEQ ID NO: 72963 - DNA, 22 bp, Artificial Sequence
  Synthetic oligonucleotide; TTA chr11 5163971 5163992 5163988 5163993 +
atttttggagttttatttaatg

SEQ ID NO: 72964 - DNA, 22 bp, Artificial Sequence
  Synthetic oligonucleotide; TTT chr11 5163975 5163996 5163992 5163997 +
ttggagttttatttaatgtcag

SEQ ID NO: 72965 - DNA, 22 bp, Artificial Sequence
  Synthetic oligonucleotide; TTT chr11 5163976 5163997 5163993 5163998 +
tggagttttatttaatgtcagg

SEQ ID NO: 72966 - DNA, 22 bp, Artificial Sequence
  Synthetic oligonucleotide; TTT chr11 5163977 5163998 5163994 5163999 +
ggagttttatttaatgtcagga

SEQ ID NO: 72967 - DNA, 22 bp, Artificial Sequence
  Synthetic oligonucleotide; TTG chr11 5163978 5163999 5163995 5164000 +
gagttttatttaatgtcaggag

SEQ ID NO: 72968 - DNA, 22 bp, Artificial Sequence
  Synthetic oligonucleotide; TTT chr11 5163984 5164005 5164001 5164006 +
tatttaatgtcaggagcagatt

SEQ ID NO: 72969 - DNA, 22 bp, Artificial Sequence
  Synthetic oligonucleotide; TTT chr11 5163985 5164006 5164002 5164007 +
atttaatgtcaggagcagattg

SEQ ID NO: 72970 - DNA, 22 bp, Artificial Sequence
  Synthetic oligonucleotide; TTA chr11 5163986 5164007 5164003 5164008 +
tttaatgtcaggagcagattgg

SEQ ID NO: 72971 - DNA, 22 bp, Artificial Sequence
  Synthetic oligonucleotide; TTT chr11 5163989 5164010 5164006 5164011 +
aatgtcaggagcagattgggta

SEQ ID NO: 72972 - DNA, 22 bp, Artificial Sequence
  Synthetic oligonucleotide; TTA chr11 5163990 5164011 5164007 5164012 +
atgtcaggagcagattgggtaa

SEQ ID NO: 72973 - DNA, 22 bp, Artificial Sequence
  Synthetic oligonucleotide; TTG chr11 5164007 5164028 5164024 5164029 +
ggtaataaaatgtatattgaga

SEQ ID NO: 72974 - DNA, 22 bp, Artificial Sequence
  Synthetic oligonucleotide; TTG chr11 5164026 5164047 5164043 5164048 +
agaataaagtggccttttgtcc

SEQ ID NO: 72975 - DNA, 22 bp, Artificial Sequence
  Synthetic oligonucleotide; CTT chr11 5164042 5164063 5164059 5164064 +
ttgtccttttagggtctagggc

SEQ ID NO: 72976 - DNA, 22 bp, Artificial Sequence
  Synthetic oligonucleotide; TTT chr11 5164043 5164064 5164060 5164065 +
tgtccttttagggtctagggct

SEQ ID NO: 72977 - DNA, 22 bp, Artificial Sequence
  Synthetic oligonucleotide; TTT chr11 5164044 5164065 5164061 5164066 +
gtccttttagggtctagggctg

SEQ ID NO: 72978 - DNA, 22 bp, Artificial Sequence
  Synthetic oligonucleotide; TTG chr11 5164045 5164066 5164062 5164067 +
tccttttagggtctagggctgt

SEQ ID NO: 72979 - DNA, 22 bp, Artificial Sequence
  Synthetic oligonucleotide; CTT chr11 5164050 5164071 5164067 5164072 +
ttagggtctagggctgtaaagc

SEQ ID NO: 72980 - DNA, 22 bp, Artificial Sequence
  Synthetic oligonucleotide; TTT chr11 5164051 5164072 5164068 5164073 +
tagggtctagggctgtaaagcg

SEQ ID NO: 72981 - DNA, 22 bp, Artificial Sequence
  Synthetic oligonucleotide; TTT chr11 5164052 5164073 5164069 5164074 +
agggtctagggctgtaaagcgt

SEQ ID NO: 72982 - DNA, 22 bp, Artificial Sequence
  Synthetic oligonucleotide; TTA chr11 5164053 5164074 5164070 5164075 +
gggtctagggctgtaaagcgtc

SEQ ID NO: 72983 - DNA, 22 bp, Artificial Sequence
  Synthetic oligonucleotide; CTA chr11 5164060 5164081 5164077 5164082 +
gggctgtaaagcgtctcagggt

SEQ ID NO: 72984 - DNA, 22 bp, Artificial Sequence
  Synthetic oligonucleotide; CTG chr11 5164066 5164087 5164083 5164088 +
taaagcgtctcagggttgctgc

SEQ ID NO: 72985 - DNA, 22 bp, Artificial Sequence
  Synthetic oligonucleotide; CTC chr11 5164077 5164098 5164094 5164099 +
agggttgctgccgaacgagcca

SEQ ID NO: 72986 - DNA, 22 bp, Artificial Sequence
  Synthetic oligonucleotide; TTG chr11 5164084 5164105 5164101 5164106 +
ctgccgaacgagccatgaactg

SEQ ID NO: 72987 - DNA, 22 bp, Artificial Sequence
  Synthetic oligonucleotide; CTG chr11 5164087 5164108 5164104 5164109 +
ccgaacgagccatgaactgggc

SEQ ID NO: 72988 - DNA, 22 bp, Artificial Sequence
  Synthetic oligonucleotide; CTG chr11 5164106 5164127 5164123 5164128 +
ggctgggtttttcatatttgat

SEQ ID NO: 72989 - DNA, 22 bp, Artificial Sequence
  Synthetic oligonucleotide; CTG chr11 5164111 5164132 5164128 5164133 +
ggtttttcatatttgatgaaag

SEQ ID NO: 72990 - DNA, 22 bp, Artificial Sequence
  Synthetic oligonucleotide; TTT chr11 5164116 5164137 5164133 5164138 +
ttcatatttgatgaaagagcct

SEQ ID NO: 72991 - DNA, 22 bp, Artificial Sequence
  Synthetic oligonucleotide; TTT chr11 5164117 5164138 5164134 5164139 +
tcatatttgatgaaagagccta

SEQ ID NO: 72992 - DNA, 22 bp, Artificial Sequence
  Synthetic oligonucleotide; TTT chr11 5164118 5164139 5164135 5164140 +
catatttgatgaaagagcctaa

SEQ ID NO: 72993 - DNA, 22 bp, Artificial Sequence
  Synthetic oligonucleotide; TTC chr11 5164119 5164140 5164136 5164141 +
atatttgatgaaagagcctaaa

SEQ ID NO: 72994 - DNA, 22 bp, Artificial Sequence
  Synthetic oligonucleotide; TTT chr11 5164125 5164146 5164142 5164147 +
gatgaaagagcctaaacgctct

SEQ ID NO: 72995 - DNA, 22 bp, Artificial Sequence
  Synthetic oligonucleotide; TTG chr11 5164126 5164147 5164143 5164148 +
atgaaagagcctaaacgctctg

SEQ ID NO: 72996 - DNA, 22 bp, Artificial Sequence
  Synthetic oligonucleotide; CTA chr11 5164139 5164160 5164156 5164161 +
aacgctctgattcgggagaggt

SEQ ID NO: 72997 - DNA, 22 bp, Artificial Sequence
  Synthetic oligonucleotide; CTC chr11 5164146 5164167 5164163 5164168 +
tgattcgggagaggtcggataa

SEQ ID NO: 72998 - DNA, 22 bp, Artificial Sequence
  Synthetic oligonucleotide; CTG chr11 5164148 5164169 5164165 5164170 +
attcgggagaggtcggataaag

SEQ ID NO: 72999 - DNA, 22 bp, Artificial Sequence
  Synthetic oligonucleotide; TTC chr11 5164152 5164173 5164169 5164174 +
gggagaggtcggataaagaaaa

SEQ ID NO: 73000 - DNA, 22 bp, Artificial Sequence
  Synthetic oligonucleotide; TTA chr11 5164184 5164205 5164201 5164206 +
accttgactacgcctttagctt

SEQ ID NO: 73001 - DNA, 22 bp, Artificial Sequence
  Synthetic oligonucleotide; CTT chr11 5164189 5164210 5164206 5164211 +
gactacgcctttagcttcagcc

SEQ ID NO: 73002 - DNA, 22 bp, Artificial Sequence
  Synthetic oligonucleotide; TTG chr11 5164190 5164211 5164207 5164212 +
actacgcctttagcttcagcca

SEQ ID NO: 73003 - DNA, 22 bp, Artificial Sequence
  Synthetic oligonucleotide; CTA chr11 5164194 5164215 5164211 5164216 +
cgcctttagcttcagccacctt

SEQ ID NO: 73004 - DNA, 22 bp, Artificial Sequence
  Synthetic oligonucleotide; CTT chr11 5164200 5164221 5164217 5164222 +
tagcttcagccaccttcttaat

SEQ ID NO: 73005 - DNA, 22 bp, Artificial Sequence
  Synthetic oligonucleotide; TTT chr11 5164201 5164222 5164218 5164223 +
agcttcagccaccttcttaata

SEQ ID NO: 73006 - DNA, 22 bp, Artificial Sequence
  Synthetic oligonucleotide; TTA chr11 5164202 5164223 5164219 5164224 +
gcttcagccaccttcttaatag

SEQ ID NO: 73007 - DNA, 22 bp, Artificial Sequence
  Synthetic oligonucleotide; CTT chr11 5164206 5164227 5164223 5164228 +
cagccaccttcttaataggaaa

SEQ ID NO: 73008 - DNA, 22 bp, Artificial Sequence
  Synthetic oligonucleotide; TTC chr11 5164207 5164228 5164224 5164229 +
agccaccttcttaataggaaat

SEQ ID NO: 73009 - DNA, 22 bp, Artificial Sequence
  Synthetic oligonucleotide; CTT chr11 5164216 5164237 5164233 5164238 +
cttaataggaaattgctgggca

SEQ ID NO: 73010 - DNA, 22 bp, Artificial Sequence
  Synthetic oligonucleotide; TTC chr11 5164217 5164238 5164234 5164239 +
ttaataggaaattgctgggcag

SEQ ID NO: 73011 - DNA, 22 bp, Artificial Sequence
  Synthetic oligonucleotide; CTT chr11 5164219 5164240 5164236 5164241 +
aataggaaattgctgggcaggt

SEQ ID NO: 73012 - DNA, 22 bp, Artificial Sequence
  Synthetic oligonucleotide; TTA chr11 5164220 5164241 5164237 5164242 +
ataggaaattgctgggcaggtt

SEQ ID NO: 73013 - DNA, 22 bp, Artificial Sequence
  Synthetic oligonucleotide; TTG chr11 5164231 5164252 5164248 5164253 +
ctgggcaggttggggagggcta

SEQ ID NO: 73014 - DNA, 22 bp, Artificial Sequence
  Synthetic oligonucleotide; CTG chr11 5164234 5164255 5164251 5164256 +
ggcaggttggggagggctagtc

SEQ ID NO: 73015 - DNA, 22 bp, Artificial Sequence
  Synthetic oligonucleotide; TTG chr11 5164243 5164264 5164260 5164265 +
gggagggctagtcacggaatga

SEQ ID NO: 73016 - DNA, 22 bp, Artificial Sequence
  Synthetic oligonucleotide; CTA chr11 5164253 5164274 5164270 5164275 +
gtcacggaatgaaactgtaaac

SEQ ID NO: 73017 - DNA, 22 bp, Artificial Sequence
  Synthetic oligonucleotide; CTG chr11 5164270 5164291 5164287 5164292 +
taaaccggaccgggtgtgagga

SEQ ID NO: 73018 - DNA, 22 bp, Artificial Sequence
  Synthetic oligonucleotide; TTA chr11 5164313 5164334 5164330 5164335 +
cagggtggaggagctgaggctg

SEQ ID NO: 73019 - DNA, 22 bp, Artificial Sequence
  Synthetic oligonucleotide; CTG chr11 5164329 5164350 5164346 5164351 +
aggctgaggaagatttgggacc

SEQ ID NO: 73020 - DNA, 22 bp, Artificial Sequence
  Synthetic oligonucleotide; CTG chr11 5164335 5164356 5164352 5164357 +
aggaagatttgggacctagctc

SEQ ID NO: 73021 - DNA, 22 bp, Artificial Sequence
  Synthetic oligonucleotide; TTT chr11 5164345 5164366 5164362 5164367 +
gggacctagctcggcctggcaa

SEQ ID NO: 73022 - DNA, 22 bp, Artificial Sequence
  Synthetic oligonucleotide; TTG chr11 5164346 5164367 5164363 5164368 +
ggacctagctcggcctggcaag

SEQ ID NO: 73023 - DNA, 22 bp, Artificial Sequence
  Synthetic oligonucleotide; CTA chr11 5164353 5164374 5164370 5164375 +
gctcggcctggcaaggagcagc

SEQ ID NO: 73024 - DNA, 22 bp, Artificial Sequence
  Synthetic oligonucleotide; CTC chr11 5164357 5164378 5164374 5164379 +
ggcctggcaaggagcagcctgg

SEQ ID NO: 73025 - DNA, 22 bp, Artificial Sequence
  Synthetic oligonucleotide; CTG chr11 5164363 5164384 5164380 5164385 +
gcaaggagcagcctggggagga

SEQ ID NO: 73026 - DNA, 22 bp, Artificial Sequence
  Synthetic oligonucleotide; CTG chr11 5164378 5164399 5164395 5164400 +
gggaggaggggagacgtcagat

SEQ ID NO: 73027 - DNA, 22 bp, Artificial Sequence
  Synthetic oligonucleotide; CTG chr11 5164407 5164428 5164424 5164429 +
tagaaaaggaagattagaaaga

SEQ ID NO: 73028 - DNA, 22 bp, Artificial Sequence
  Synthetic oligonucleotide; TTA chr11 5164423 5164444 5164440 5164445 +
gaaagactcagcgacgcttgga

SEQ ID NO: 73029 - DNA, 22 bp, Artificial Sequence
  Synthetic oligonucleotide; CTC chr11 5164432 5164453 5164449 5164454 +
agcgacgcttggagttgggact

SEQ ID NO: 73030 - DNA, 22 bp, Artificial Sequence
  Synthetic oligonucleotide; CTT chr11 5164442 5164463 5164459 5164464 +
ggagttgggactgaggggacag

SEQ ID NO: 73031 - DNA, 22 bp, Artificial Sequence
  Synthetic oligonucleotide; TTG chr11 5164443 5164464 5164460 5164465 +
gagttgggactgaggggacagg

SEQ ID NO: 73032 - DNA, 22 bp, Artificial Sequence
  Synthetic oligonucleotide; TTG chr11 5164449 5164470 5164466 5164471 +
ggactgaggggacaggcgggag

SEQ ID NO: 73033 - DNA, 22 bp, Artificial Sequence
  Synthetic oligonucleotide; CTG chr11 5164455 5164476 5164472 5164477 +
aggggacaggcgggagggaaag

SEQ ID NO: 73034 - DNA, 22 bp, Artificial Sequence
  Synthetic oligonucleotide; TTT chr11 5164488 5164509 5164505 5164510 +
gggacaagttgcattgggaaga

SEQ ID NO: 73035 - DNA, 22 bp, Artificial Sequence
  Synthetic oligonucleotide; TTG chr11 5164489 5164510 5164506 5164511 +
ggacaagttgcattgggaagag

SEQ ID NO: 73036 - DNA, 22 bp, Artificial Sequence
  Synthetic oligonucleotide; TTG chr11 5164499 5164520 5164516 5164521 +
cattgggaagagactagggagg

SEQ ID NO: 73037 - DNA, 22 bp, Artificial Sequence
  Synthetic oligonucleotide; TTG chr11 5164504 5164525 5164521 5164526 +
ggaagagactagggagggacca

SEQ ID NO: 73038 - DNA, 22 bp, Artificial Sequence
  Synthetic oligonucleotide; CTA chr11 5164515 5164536 5164532 5164537 +
gggagggaccaatgtgtaaaag

SEQ ID NO: 73039 - DNA, 22 bp, Artificial Sequence
  Synthetic oligonucleotide; CTG chr11 5164545 5164566 5164562 5164567 +
gacgtcaggcacctcagactgt

SEQ ID NO: 73040 - DNA, 22 bp, Artificial Sequence
  Synthetic oligonucleotide; CTC chr11 5164560 5164581 5164577 5164582 +
agactgtttgcctgttttacga

SEQ ID NO: 73041 - DNA, 22 bp, Artificial Sequence
  Synthetic oligonucleotide; CTG chr11 5164566 5164587 5164583 5164588 +
tttgcctgttttacgacaaaaa

SEQ ID NO: 73042 - DNA, 22 bp, Artificial Sequence
  Synthetic oligonucleotide; TTT chr11 5164569 5164590 5164586 5164591 +
gcctgttttacgacaaaaatta

SEQ ID NO: 73043 - DNA, 22 bp, Artificial Sequence
  Synthetic oligonucleotide; TTG chr11 5164570 5164591 5164587 5164592 +
cctgttttacgacaaaaattat

SEQ ID NO: 73044 - DNA, 22 bp, Artificial Sequence
  Synthetic oligonucleotide; CTG chr11 5164574 5164595 5164591 5164596 +
ttttacgacaaaaattatttag

SEQ ID NO: 73045 - DNA, 22 bp, Artificial Sequence
  Synthetic oligonucleotide; TTT chr11 5164577 5164598 5164594 5164599 +
tacgacaaaaattatttagatc

SEQ ID NO: 73046 - DNA, 22 bp, Artificial Sequence
  Synthetic oligonucleotide; TTT chr11 5164578 5164599 5164595 5164600 +
acgacaaaaattatttagatct

SEQ ID NO: 73047 - DNA, 22 bp, Artificial Sequence
  Synthetic oligonucleotide; TTA chr11 5164579 5164600 5164596 5164601 +
cgacaaaaattatttagatctt

SEQ ID NO: 73048 - DNA, 22 bp, Artificial Sequence
  Synthetic oligonucleotide; TTA chr11 5164591 5164612 5164608 5164613 +
tttagatcttgaagaatggaaa

SEQ ID NO: 73049 - DNA, 22 bp, Artificial Sequence
  Synthetic oligonucleotide; TTT chr11 5164594 5164615 5164611 5164616 +
agatcttgaagaatggaaaaat

SEQ ID NO: 73050 - DNA, 22 bp, Artificial Sequence
  Synthetic oligonucleotide; TTA chr11 5164595 5164616 5164612 5164617 +
gatcttgaagaatggaaaaatt

SEQ ID NO: 73051 - DNA, 22 bp, Artificial Sequence
  Synthetic oligonucleotide; CTT chr11 5164601 5164622 5164618 5164623 +
gaagaatggaaaaattgaaagt

SEQ ID NO: 73052 - DNA, 22 bp, Artificial Sequence
  Synthetic oligonucleotide; TTG chr11 5164602 5164623 5164619 5164624 +
aagaatggaaaaattgaaagtg

SEQ ID NO: 73053 - DNA, 22 bp, Artificial Sequence
  Synthetic oligonucleotide; TTG chr11 5164618 5164639 5164635 5164640 +
aaagtgccattttctggctatt

SEQ ID NO: 73054 - DNA, 22 bp, Artificial Sequence
  Synthetic oligonucleotide; TTT chr11 5164630 5164651 5164647 5164652 +
tctggctatttggaaccactgt

SEQ ID NO: 73055 - DNA, 22 bp, Artificial Sequence
  Synthetic oligonucleotide; TTT chr11 5164631 5164652 5164648 5164653 +
ctggctatttggaaccactgtc

SEQ ID NO: 73056 - DNA, 22 bp, Artificial Sequence
  Synthetic oligonucleotide; TTC chr11 5164632 5164653 5164649 5164654 +
tggctatttggaaccactgtcg

SEQ ID NO: 73057 - DNA, 22 bp, Artificial Sequence
  Synthetic oligonucleotide; CTG chr11 5164634 5164655 5164651 5164656 +
gctatttggaaccactgtcgag

SEQ ID NO: 73058 - DNA, 22 bp, Artificial Sequence
  Synthetic oligonucleotide; CTA chr11 5164638 5164659 5164655 5164660 +
tttggaaccactgtcgagtttg

SEQ ID NO: 73059 - DNA, 22 bp, Artificial Sequence
  Synthetic oligonucleotide; TTT chr11 5164641 5164662 5164658 5164663 +
ggaaccactgtcgagtttgtat

SEQ ID NO: 73060 - DNA, 22 bp, Artificial Sequence
  Synthetic oligonucleotide; TTG chr11 5164642 5164663 5164659 5164664 +
gaaccactgtcgagtttgtatt

SEQ ID NO: 73061 - DNA, 22 bp, Artificial Sequence
  Synthetic oligonucleotide; CTG chr11 5164651 5164672 5164668 5164673 +
tcgagtttgtattggagtcaag

SEQ ID NO: 73062 - DNA, 22 bp, Artificial Sequence
  Synthetic oligonucleotide; TTT chr11 5164659 5164680 5164676 5164681 +
gtattggagtcaagcggccttg

SEQ ID NO: 73063 - DNA, 22 bp, Artificial Sequence
  Synthetic oligonucleotide; TTG chr11 5164660 5164681 5164677 5164682 +
tattggagtcaagcggccttgc

SEQ ID NO: 73064 - DNA, 22 bp, Artificial Sequence
  Synthetic oligonucleotide; TTG chr11 5164665 5164686 5164682 5164687 +
gagtcaagcggccttgcagaag

SEQ ID NO: 73065 - DNA, 22 bp, Artificial Sequence
  Synthetic oligonucleotide; CTT chr11 5164680 5164701 5164697 5164702 +
gcagaagaaaataaggcattta

SEQ ID NO: 73066 - DNA, 22 bp, Artificial Sequence
  Synthetic oligonucleotide; TTG chr11 5164681 5164702 5164698 5164703 +
cagaagaaaataaggcatttag

SEQ ID NO: 73067 - DNA, 22 bp, Artificial Sequence
  Synthetic oligonucleotide; TTT chr11 5164701 5164722 5164718 5164723 +
aggttttaggtcaggtgtgagt

SEQ ID NO: 73068 - DNA, 22 bp, Artificial Sequence
  Synthetic oligonucleotide; TTA chr11 5164702 5164723 5164719 5164724 +
ggttttaggtcaggtgtgagtt

SEQ ID NO: 73069 - DNA, 22 bp, Artificial Sequence
  Synthetic oligonucleotide; TTT chr11 5164707 5164728 5164724 5164729 +
taggtcaggtgtgagttgaaga

SEQ ID NO: 73070 - DNA, 22 bp, Artificial Sequence
  Synthetic oligonucleotide; TTT chr11 5164708 5164729 5164725 5164730 +
aggtcaggtgtgagttgaagag

SEQ ID NO: 73071 - DNA, 22 bp, Artificial Sequence
  Synthetic oligonucleotide; TTA chr11 5164709 5164730 5164726 5164731 +
ggtcaggtgtgagttgaagagg

SEQ ID NO: 73072 - DNA, 22 bp, Artificial Sequence
  Synthetic oligonucleotide; TTG chr11 5164725 5164746 5164742 5164747 +
aagaggttttaagttcttgaga

SEQ ID NO: 73073 - DNA, 22 bp, Artificial Sequence
  Synthetic oligonucleotide; TTT chr11 5164734 5164755 5164751 5164756 +
taagttcttgagagcacaggct

SEQ ID NO: 73074 - DNA, 22 bp, Artificial Sequence
  Synthetic oligonucleotide; TTT chr11 5164735 5164756 5164752 5164757 +
aagttcttgagagcacaggcta

SEQ ID NO: 73075 - DNA, 22 bp, Artificial Sequence
  Synthetic oligonucleotide; TTA chr11 5164736 5164757 5164753 5164758 +
agttcttgagagcacaggctaa

SEQ ID NO: 73076 - DNA, 22 bp, Artificial Sequence
  Synthetic oligonucleotide; TTC chr11 5164741 5164762 5164758 5164763 +
ttgagagcacaggctaagggag

SEQ ID NO: 73077 - DNA, 22 bp, Artificial Sequence
  Synthetic oligonucleotide; CTT chr11 5164743 5164764 5164760 5164765 +
gagagcacaggctaagggagag

SEQ ID NO: 73078 - DNA, 22 bp, Artificial Sequence
  Synthetic oligonucleotide; TTG chr11 5164744 5164765 5164761 5164766 +
agagcacaggctaagggagagg

SEQ ID NO: 73079 - DNA, 22 bp, Artificial Sequence
  Synthetic oligonucleotide; CTA chr11 5164757 5164778 5164774 5164779 +
agggagagggaggaatggaggg

SEQ ID NO: 73080 - DNA, 22 bp, Artificial Sequence
  Synthetic oligonucleotide; TTG chr11 5164789 5164810 5164806 5164811 +
cccctagtgaaggaggcaagcc

SEQ ID NO: 73081 - DNA, 22 bp, Artificial Sequence
  Synthetic oligonucleotide; CTA chr11 5164795 5164816 5164812 5164817 +
gtgaaggaggcaagcccagaga

SEQ ID NO: 73082 - DNA, 22 bp, Artificial Sequence
  Synthetic oligonucleotide; TTC chr11 5164851 5164872 5164868 5164873 +
gggggttcttactcaccagaaa

SEQ ID NO: 73083 - DNA, 22 bp, Artificial Sequence
  Synthetic oligonucleotide; TTC chr11 5164859 5164880 5164876 5164881 +
ttactcaccagaaaaatgggca

SEQ ID NO: 73084 - DNA, 22 bp, Artificial Sequence
  Synthetic oligonucleotide; CTT chr11 5164861 5164882 5164878 5164883 +
actcaccagaaaaatgggcaag

SEQ ID NO: 73085 - DNA, 22 bp, Artificial Sequence
  Synthetic oligonucleotide; TTA chr11 5164862 5164883 5164879 5164884 +
ctcaccagaaaaatgggcaagg

SEQ ID NO: 73086 - DNA, 22 bp, Artificial Sequence
  Synthetic oligonucleotide; CTC chr11 5164865 5164886 5164882 5164887 +
accagaaaaatgggcaaggggt

SEQ ID NO: 73087 - DNA, 22 bp, Artificial Sequence
  Synthetic oligonucleotide; TTG chr11 5164889 5164910 5164906 5164911 +
gggcacggaaataaggggttgg

SEQ ID NO: 73088 - DNA, 22 bp, Artificial Sequence
  Synthetic oligonucleotide; TTG chr11 5164910 5164931 5164927 5164932 +
gggtgcagagataagaggtcag

SEQ ID NO: 73089 - DNA, 22 bp, Artificial Sequence
  Synthetic oligonucleotide; TTG chr11 5164952 5164973 5164969 5164974 +
gggtgcagagataagaggttgg

SEQ ID NO: 73090 - DNA, 22 bp, Artificial Sequence
  Synthetic oligonucleotide; TTG chr11 5164973 5164994 5164990 5164995 +
gggcacagaaataagggatcgg

SEQ ID NO: 73091 - DNA, 22 bp, Artificial Sequence
  Synthetic oligonucleotide; TTG chr11 5165015 5165036 5165032 5165037 +
gggtgcagaaataagggatcag

SEQ ID NO: 73092 - DNA, 22 bp, Artificial Sequence
  Synthetic oligonucleotide; TTG chr11 5165078 5165099 5165095 5165100 +
gggtgcagagataagaggatgg

SEQ ID NO: 73093 - DNA, 22 bp, Artificial Sequence
  Synthetic oligonucleotide; CTG chr11 5165127 5165148 5165144 5165149 +
agataagaggttggggcacaga

SEQ ID NO: 73094 - DNA, 22 bp, Artificial Sequence
  Synthetic oligonucleotide; TTG chr11 5165140 5165161 5165157 5165162 +
gggcacagaaataagggattgg

SEQ ID NO: 73095 - DNA, 22 bp, Artificial Sequence
  Synthetic oligonucleotide; TTG chr11 5165161 5165182 5165178 5165183 +
gggttcttgcccccagaaaagc

SEQ ID NO: 73096 - DNA, 22 bp, Artificial Sequence
  Synthetic oligonucleotide; TTC chr11 5165167 5165188 5165184 5165189 +
ttgcccccagaaaagcagtgaa

SEQ ID NO: 73097 - DNA, 22 bp, Artificial Sequence
  Synthetic oligonucleotide; CTT chr11 5165169 5165190 5165186 5165191 +
gcccccagaaaagcagtgaagg

SEQ ID NO: 73098 - DNA, 22 bp, Artificial Sequence
  Synthetic oligonucleotide; TTG chr11 5165170 5165191 5165187 5165192 +
cccccagaaaagcagtgaaggg

SEQ ID NO: 73099 - DNA, 22 bp, Artificial Sequence
  Synthetic oligonucleotide; TTG chr11 5165217 5165238 5165234 5165239 +
gggtacttacccccctccagaa

SEQ ID NO: 73100 - DNA, 22 bp, Artificial Sequence
  Synthetic oligonucleotide; CTT chr11 5165225 5165246 5165242 5165247 +
acccccctccagaaaagtggga

SEQ ID NO: 73101 - DNA, 22 bp, Artificial Sequence
  Synthetic oligonucleotide; TTA chr11 5165226 5165247 5165243 5165248 +
cccccctccagaaaagtgggat

SEQ ID NO: 73102 - DNA, 22 bp, Artificial Sequence
  Synthetic oligonucleotide; CTC chr11 5165234 5165255 5165251 5165256 +
cagaaaagtgggatttgccgct

SEQ ID NO: 73103 - DNA, 22 bp, Artificial Sequence
  Synthetic oligonucleotide; TTT chr11 5165250 5165271 5165267 5165272 +
gccgctaagggtgaaggaccaa

SEQ ID NO: 73104 - DNA, 22 bp, Artificial Sequence
  Synthetic oligonucleotide; TTG chr11 5165251 5165272 5165268 5165273 +
ccgctaagggtgaaggaccaag

SEQ ID NO: 73105 - DNA, 22 bp, Artificial Sequence
  Synthetic oligonucleotide; CTA chr11 5165257 5165278 5165274 5165279 +
agggtgaaggaccaaggcaggc

SEQ ID NO: 73106 - DNA, 22 bp, Artificial Sequence
  Synthetic oligonucleotide; CTG chr11 5165286 5165307 5165303 5165308 +
cgtggtctgacacctctgaaac

SEQ ID NO: 73107 - DNA, 22 bp, Artificial Sequence
  Synthetic oligonucleotide; CTG chr11 5165295 5165316 5165312 5165317 +
acacctctgaaacatggtttaa

SEQ ID NO: 73108 - DNA, 22 bp, Artificial Sequence
  Synthetic oligonucleotide; CTC chr11 5165302 5165323 5165319 5165324 +
tgaaacatggtttaataatcag

SEQ ID NO: 73109 - DNA, 22 bp, Artificial Sequence
  Synthetic oligonucleotide; CTG chr11 5165304 5165325 5165321 5165326 +
aaacatggtttaataatcagag

SEQ ID NO: 73110 - DNA, 22 bp, Artificial Sequence
  Synthetic oligonucleotide; TTT chr11 5165315 5165336 5165332 5165337 +
aataatcagagaggtgtccctg

SEQ ID NO: 73111 - DNA, 22 bp, Artificial Sequence
  Synthetic oligonucleotide; TTA chr11 5165316 5165337 5165333 5165338 +
ataatcagagaggtgtccctgc

SEQ ID NO: 73112 - DNA, 22 bp, Artificial Sequence
  Synthetic oligonucleotide; CTG chr11 5165337 5165358 5165354 5165359 +
caatgattaaacaccaagggaa

SEQ ID NO: 73113 - DNA, 22 bp, Artificial Sequence
  Synthetic oligonucleotide; TTA chr11 5165346 5165367 5165363 5165368 +
aacaccaagggaaggctgcctt

SEQ ID NO: 73114 - DNA, 22 bp, Artificial Sequence
  Synthetic oligonucleotide; CTG chr11 5165364 5165385 5165381 5165386 +
ccttcccagtccgtgactggca

SEQ ID NO: 73115 - DNA, 22 bp, Artificial Sequence
  Synthetic oligonucleotide; CTT chr11 5165368 5165389 5165385 5165390 +
cccagtccgtgactggcaccgg

SEQ ID NO: 73116 - DNA, 22 bp, Artificial Sequence
  Synthetic oligonucleotide; TTC chr11 5165369 5165390 5165386 5165391 +
ccagtccgtgactggcaccgga

SEQ ID NO: 73117 - DNA, 22 bp, Artificial Sequence
  Synthetic oligonucleotide; CTG chr11 5165383 5165404 5165400 5165405 +
gcaccggagttttgggtccacg

SEQ ID NO: 73118 - DNA, 22 bp, Artificial Sequence
  Synthetic oligonucleotide; TTT chr11 5165395 5165416 5165412 5165417 +
tgggtccacggataaaacatgt

SEQ ID NO: 73119 - DNA, 22 bp, Artificial Sequence
  Synthetic oligonucleotide; TTT chr11 5165396 5165417 5165413 5165418 +
gggtccacggataaaacatgtc

SEQ ID NO: 73120 - DNA, 22 bp, Artificial Sequence
  Synthetic oligonucleotide; TTG chr11 5165397 5165418 5165414 5165419 +
ggtccacggataaaacatgtct

SEQ ID NO: 73121 - DNA, 22 bp, Artificial Sequence
  Synthetic oligonucleotide; CTC chr11 5165420 5165441 5165437 5165442 +
ctttgtctctactggaaaatga

SEQ ID NO: 73122 - DNA, 22 bp, Artificial Sequence
  Synthetic oligonucleotide; CTT chr11 5165423 5165444 5165440 5165445 +
tgtctctactggaaaatgaaag

SEQ ID NO: 73123 - DNA, 22 bp, Artificial Sequence
  Synthetic oligonucleotide; TTT chr11 5165424 5165445 5165441 5165446 +
gtctctactggaaaatgaaagg

SEQ ID NO: 73124 - DNA, 22 bp, Artificial Sequence
  Synthetic oligonucleotide; TTG chr11 5165425 5165446 5165442 5165447 +
tctctactggaaaatgaaagga

SEQ ID NO: 73125 - DNA, 22 bp, Artificial Sequence
  Synthetic oligonucleotide; CTC chr11 5165429 5165450 5165446 5165451 +
tactggaaaatgaaaggaattg

SEQ ID NO: 73126 - DNA, 22 bp, Artificial Sequence
  Synthetic oligonucleotide; CTA chr11 5165431 5165452 5165448 5165453 +
ctggaaaatgaaaggaattgaa

SEQ ID NO: 73127 - DNA, 22 bp, Artificial Sequence
  Synthetic oligonucleotide; CTG chr11 5165434 5165455 5165451 5165456 +
gaaaatgaaaggaattgaaatt

SEQ ID NO: 73128 - DNA, 22 bp, Artificial Sequence
  Synthetic oligonucleotide; TTG chr11 5165451 5165472 5165468 5165473 +
aaattaagagaagggagaaatt

SEQ ID NO: 73129 - DNA, 22 bp, Artificial Sequence
  Synthetic oligonucleotide; TTA chr11 5165457 5165478 5165474 5165479 +
agagaagggagaaattgaagtg

SEQ ID NO: 73130 - DNA, 22 bp, Artificial Sequence
  Synthetic oligonucleotide; TTG chr11 5165474 5165495 5165491 5165496 +
aagtgtggtgccaagattgaaa

SEQ ID NO: 73131 - DNA, 22 bp, Artificial Sequence
  Synthetic oligonucleotide; TTG chr11 5165493 5165514 5165510 5165515 +
aaaggagaaagaagttgaggga

SEQ ID NO: 73132 - DNA, 22 bp, Artificial Sequence
  Synthetic oligonucleotide; TTG chr11 5165510 5165531 5165527 5165532 +
agggatagtgagggaggttgga

SEQ ID NO: 73133 - DNA, 22 bp, Artificial Sequence
  Synthetic oligonucleotide; TTG chr11 5165530 5165551 5165547 5165552 +
gagaagacagtaaaaagaggcc

SEQ ID NO: 73134 - DNA, 22 bp, Artificial Sequence
  Synthetic oligonucleotide; CTT chr11 5165556 5165577 5165573 5165578 +
accggatttgaaattggtgaaa

SEQ ID NO: 73135 - DNA, 22 bp, Artificial Sequence
  Synthetic oligonucleotide; TTA chr11 5165557 5165578 5165574 5165579 +
ccggatttgaaattggtgaaat

SEQ ID NO: 73136 - DNA, 22 bp, Artificial Sequence
  Synthetic oligonucleotide; TTT chr11 5165565 5165586 5165582 5165587 +
gaaattggtgaaatgtttcttg

SEQ ID NO: 73137 - DNA, 22 bp, Artificial Sequence
  Synthetic oligonucleotide; TTG chr11 5165566 5165587 5165583 5165588 +
aaattggtgaaatgtttcttgg

SEQ ID NO: 73138 - DNA, 22 bp, Artificial Sequence
  Synthetic oligonucleotide; TTG chr11 5165572 5165593 5165589 5165594 +
gtgaaatgtttcttgggctggt

SEQ ID NO: 73139 - DNA, 22 bp, Artificial Sequence
  Synthetic oligonucleotide; TTT chr11 5165583 5165604 5165600 5165605 +
cttgggctggtcagtttgagga

SEQ ID NO: 73140 - DNA, 22 bp, Artificial Sequence
  Synthetic oligonucleotide; TTC chr11 5165584 5165605 5165601 5165606 +
ttgggctggtcagtttgaggac

SEQ ID NO: 73141 - DNA, 22 bp, Artificial Sequence
  Synthetic oligonucleotide; CTT chr11 5165586 5165607 5165603 5165608 +
gggctggtcagtttgaggacct

SEQ ID NO: 73142 - DNA, 22 bp, Artificial Sequence
  Synthetic oligonucleotide; TTG chr11 5165587 5165608 5165604 5165609 +
ggctggtcagtttgaggacctg

SEQ ID NO: 73143 - DNA, 22 bp, Artificial Sequence
  Synthetic oligonucleotide; CTG chr11 5165592 5165613 5165609 5165614 +
gtcagtttgaggacctgaggtc

SEQ ID NO: 73144 - DNA, 22 bp, Artificial Sequence
  Synthetic oligonucleotide; TTT chr11 5165600 5165621 5165617 5165622 +
gaggacctgaggtcgtaggtgg

SEQ ID NO: 73145 - DNA, 22 bp, Artificial Sequence
  Synthetic oligonucleotide; TTG chr11 5165601 5165622 5165618 5165623 +
aggacctgaggtcgtaggtgga

SEQ ID NO: 73146 - DNA, 22 bp, Artificial Sequence
  Synthetic oligonucleotide; CTG chr11 5165609 5165630 5165626 5165631 +
aggtcgtaggtggatctttctc

SEQ ID NO: 73147 - DNA, 22 bp, Artificial Sequence
  Synthetic oligonucleotide; CTT chr11 5165627 5165648 5165644 5165649 +
tctcacggagcaaagagcagga

SEQ ID NO: 73148 - DNA, 22 bp, Artificial Sequence
  Synthetic oligonucleotide; TTT chr11 5165628 5165649 5165645 5165650 +
ctcacggagcaaagagcaggag

SEQ ID NO: 73149 - DNA, 22 bp, Artificial Sequence
  Synthetic oligonucleotide; TTC chr11 5165629 5165650 5165646 5165651 +
tcacggagcaaagagcaggagg

SEQ ID NO: 73150 - DNA, 22 bp, Artificial Sequence
  Synthetic oligonucleotide; CTC chr11 5165631 5165652 5165648 5165653 +
acggagcaaagagcaggaggac

SEQ ID NO: 73151 - DNA, 22 bp, Artificial Sequence
  Synthetic oligonucleotide; TTG chr11 5165662 5165683 5165679 5165684 +
atctcccaagggaggtccccca

SEQ ID NO: 73152 - DNA, 22 bp, Artificial Sequence
  Synthetic oligonucleotide; CTC chr11 5165667 5165688 5165684 5165689 +
ccaagggaggtcccccaatctg

SEQ ID NO: 73153 - DNA, 22 bp, Artificial Sequence
  Synthetic oligonucleotide; CTG chr11 5165689 5165710 5165706 5165711 +
agtcacggcaccaaatttcatg

SEQ ID NO: 73154 - DNA, 22 bp, Artificial Sequence
  Synthetic oligonucleotide; TTT chr11 5165707 5165728 5165724 5165729 +
catgcgcgtccatatgaagaga

SEQ ID NO: 73155 - DNA, 22 bp, Artificial Sequence
  Synthetic oligonucleotide; TTC chr11 5165708 5165729 5165725 5165730 +
atgcgcgtccatatgaagagac

SEQ ID NO: 73156 - DNA, 22 bp, Artificial Sequence
  Synthetic oligonucleotide; CTA chr11 5165732 5165753 5165749 5165754 +
ccaaacaggctttgtgtaagca

SEQ ID NO: 73157 - DNA, 22 bp, Artificial Sequence
  Synthetic oligonucleotide; CTT chr11 5165744 5165765 5165761 5165766 +
tgtgtaagcaacaaggctgttt

SEQ ID NO: 73158 - DNA, 22 bp, Artificial Sequence
  Synthetic oligonucleotide; TTT chr11 5165745 5165766 5165762 5165767 +
gtgtaagcaacaaggctgttta

SEQ ID NO: 73159 - DNA, 22 bp, Artificial Sequence
  Synthetic oligonucleotide; TTG chr11 5165746 5165767 5165763 5165768 +
tgtaagcaacaaggctgtttat

SEQ ID NO: 73160 - DNA, 22 bp, Artificial Sequence
  Synthetic oligonucleotide; CTG chr11 5165763 5165784 5165780 5165785 +
tttatttcacctgggtgcaggc

SEQ ID NO: 73161 - DNA, 22 bp, Artificial Sequence
  Synthetic oligonucleotide; TTT chr11 5165766 5165787 5165783 5165788 +
atttcacctgggtgcaggcagg

SEQ ID NO: 73162 - DNA, 22 bp, Artificial Sequence
  Synthetic oligonucleotide; TTA chr11 5165767 5165788 5165784 5165789 +
tttcacctgggtgcaggcaggc

SEQ ID NO: 73163 - DNA, 22 bp, Artificial Sequence
  Synthetic oligonucleotide; TTT chr11 5165770 5165791 5165787 5165792 +
cacctgggtgcaggcaggctga

SEQ ID NO: 73164 - DNA, 22 bp, Artificial Sequence
  Synthetic oligonucleotide; TTC chr11 5165771 5165792 5165788 5165793 +
acctgggtgcaggcaggctgag

SEQ ID NO: 73165 - DNA, 22 bp, Artificial Sequence
  Synthetic oligonucleotide; CTG chr11 5165776 5165797 5165793 5165798 +
ggtgcaggcaggctgagtccaa

SEQ ID NO: 73166 - DNA, 22 bp, Artificial Sequence
  Synthetic oligonucleotide; CTG chr11 5165791 5165812 5165808 5165813 +
agtccaaaaagagagtcagcaa

SEQ ID NO: 73167 - DNA, 22 bp, Artificial Sequence
  Synthetic oligonucleotide; CTG chr11 5165834 5165855 5165851 5165856 +
ttttataagatttgggtaggta

SEQ ID NO: 73168 - DNA, 22 bp, Artificial Sequence
  Synthetic oligonucleotide; TTT chr11 5165837 5165858 5165854 5165859 +
tataagatttgggtaggtaaag

SEQ ID NO: 73169 - DNA, 22 bp, Artificial Sequence
  Synthetic oligonucleotide; TTT chr11 5165838 5165859 5165855 5165860 +
ataagatttgggtaggtaaagg

SEQ ID NO: 73170 - DNA, 22 bp, Artificial Sequence
  Synthetic oligonucleotide; TTA chr11 5165839 5165860 5165856 5165861 +
taagatttgggtaggtaaagga

SEQ ID NO: 73171 - DNA, 22 bp, Artificial Sequence
  Synthetic oligonucleotide; TTT chr11 5165847 5165868 5165864 5165869 +
gggtaggtaaaggaaaattaca

SEQ ID NO: 73172 - DNA, 22 bp, Artificial Sequence
  Synthetic oligonucleotide; TTG chr11 5165848 5165869 5165865 5165870 +
ggtaggtaaaggaaaattacag

SEQ ID NO: 73173 - DNA, 22 bp, Artificial Sequence
  Synthetic oligonucleotide; TTA chr11 5165867 5165888 5165884 5165889 +
cagtcaaaggggggttgttctc

SEQ ID NO: 73174 - DNA, 22 bp, Artificial Sequence
  Synthetic oligonucleotide; TTG chr11 5165884 5165905 5165901 5165906 +
ttctctggcgggcaggagtggg

SEQ ID NO: 73175 - DNA, 22 bp, Artificial Sequence
  Synthetic oligonucleotide; TTC chr11 5165887 5165908 5165904 5165909 +
tctggcgggcaggagtgggggt

SEQ ID NO: 73176 - DNA, 22 bp, Artificial Sequence
  Synthetic oligonucleotide; CTC chr11 5165889 5165910 5165906 5165911 +
tggcgggcaggagtgggggtca

SEQ ID NO: 73177 - DNA, 22 bp, Artificial Sequence
  Synthetic oligonucleotide; CTG chr11 5165891 5165912 5165908 5165913 +
gcgggcaggagtgggggtcaca

SEQ ID NO: 73178 - DNA, 22 bp, Artificial Sequence
  Synthetic oligonucleotide; CTC chr11 5165921 5165942 5165938 5165943 +
agtaggggagcttttgagccag

SEQ ID NO: 73179 - DNA, 22 bp, Artificial Sequence
  Synthetic oligonucleotide; CTT chr11 5165934 5165955 5165951 5165956 +
ttgagccaggatgagccaggag

SEQ ID NO: 73180 - DNA, 22 bp, Artificial Sequence
  Synthetic oligonucleotide; TTT chr11 5165935 5165956 5165952 5165957 +
tgagccaggatgagccaggaga

SEQ ID NO: 73181 - DNA, 22 bp, Artificial Sequence
  Synthetic oligonucleotide; TTT chr11 5165936 5165957 5165953 5165958 +
gagccaggatgagccaggagaa

SEQ ID NO: 73182 - DNA, 22 bp, Artificial Sequence
  Synthetic oligonucleotide; TTG chr11 5165937 5165958 5165954 5165959 +
agccaggatgagccaggagaag

SEQ ID NO: 73183 - DNA, 22 bp, Artificial Sequence
  Synthetic oligonucleotide; TTT chr11 5165965 5165986 5165982 5165987 +
cacaagacaatgtcatcagtta

SEQ ID NO: 73184 - DNA, 22 bp, Artificial Sequence
  Synthetic oligonucleotide; TTC chr11 5165966 5165987 5165983 5165988 +
acaagacaatgtcatcagttaa

SEQ ID NO: 73185 - DNA, 22 bp, Artificial Sequence
  Synthetic oligonucleotide; TTA chr11 5165987 5166008 5166004 5166009 +
aggcaggaacaggccattttca

SEQ ID NO: 73186 - DNA, 22 bp, Artificial Sequence
  Synthetic oligonucleotide; TTT chr11 5166006 5166027 5166023 5166028 +
tcacttcttttgtggtggaatg

SEQ ID NO: 73187 - DNA, 22 bp, Artificial Sequence
  Synthetic oligonucleotide; TTT chr11 5166007 5166028 5166024 5166029 +
cacttcttttgtggtggaatgt

SEQ ID NO: 73188 - DNA, 22 bp, Artificial Sequence
  Synthetic oligonucleotide; TTC chr11 5166008 5166029 5166025 5166030 +
acttcttttgtggtggaatgtc

SEQ ID NO: 73189 - DNA, 22 bp, Artificial Sequence
  Synthetic oligonucleotide; CTT chr11 5166012 5166033 5166029 5166034 +
cttttgtggtggaatgtcatca

SEQ ID NO: 73190 - DNA, 22 bp, Artificial Sequence
  Synthetic oligonucleotide; TTC chr11 5166013 5166034 5166030 5166035 +
ttttgtggtggaatgtcatcag

SEQ ID NO: 73191 - DNA, 22 bp, Artificial Sequence
  Synthetic oligonucleotide; CTT chr11 5166015 5166036 5166032 5166037 +
ttgtggtggaatgtcatcagtt

SEQ ID NO: 73192 - DNA, 22 bp, Artificial Sequence
  Synthetic oligonucleotide; TTT chr11 5166016 5166037 5166033 5166038 +
tgtggtggaatgtcatcagtta

SEQ ID NO: 73193 - DNA, 22 bp, Artificial Sequence
  Synthetic oligonucleotide; TTT chr11 5166017 5166038 5166034 5166039 +
gtggtggaatgtcatcagttaa

SEQ ID NO: 73194 - DNA, 22 bp, Artificial Sequence
  Synthetic oligonucleotide; TTG chr11 5166018 5166039 5166035 5166040 +
tggtggaatgtcatcagttaag

SEQ ID NO: 73195 - DNA, 22 bp, Artificial Sequence
  Synthetic oligonucleotide; TTA chr11 5166038 5166059 5166055 5166060 +
aggcagaaactggccatctgta

SEQ ID NO: 73196 - DNA, 22 bp, Artificial Sequence
  Synthetic oligonucleotide; CTG chr11 5166050 5166071 5166067 5166072 +
gccatctgtatgtgtatatgca

SEQ ID NO: 73197 - DNA, 22 bp, Artificial Sequence
  Synthetic oligonucleotide; CTG chr11 5166058 5166079 5166075 5166080 +
tatgtgtatatgcaggtcacag

SEQ ID NO: 73198 - DNA, 22 bp, Artificial Sequence
  Synthetic oligonucleotide; CTT chr11 5166095 5166116 5166112 5166117 +
agcttgggctcagaggcctgac

SEQ ID NO: 73199 - DNA, 22 bp, Artificial Sequence
  Synthetic oligonucleotide; TTA chr11 5166096 5166117 5166113 5166118 +
gcttgggctcagaggcctgaca

SEQ ID NO: 73200 - DNA, 22 bp, Artificial Sequence
  Synthetic oligonucleotide; CTT chr11 5166100 5166121 5166117 5166122 +
gggctcagaggcctgacattca

SEQ ID NO: 73201 - DNA, 22 bp, Artificial Sequence
  Synthetic oligonucleotide; TTG chr11 5166101 5166122 5166118 5166123 +
ggctcagaggcctgacattcag

SEQ ID NO: 73202 - DNA, 22 bp, Artificial Sequence
  Synthetic oligonucleotide; CTC chr11 5166106 5166127 5166123 5166128 +
agaggcctgacattcaggagca

SEQ ID NO: 73203 - DNA, 22 bp, Artificial Sequence
  Synthetic oligonucleotide; CTG chr11 5166115 5166136 5166132 5166137 +
acattcaggagcatactgtttg

SEQ ID NO: 73204 - DNA, 22 bp, Artificial Sequence
  Synthetic oligonucleotide; TTC chr11 5166121 5166142 5166138 5166143 +
aggagcatactgtttgatttcc

SEQ ID NO: 73205 - DNA, 22 bp, Artificial Sequence
  Synthetic oligonucleotide; CTG chr11 5166133 5166154 5166150 5166155 +
tttgatttccatatgtttctat

SEQ ID NO: 73206 - DNA, 22 bp, Artificial Sequence
  Synthetic oligonucleotide; TTT chr11 5166136 5166157 5166153 5166158 +
gatttccatatgtttctatatt

SEQ ID NO: 73207 - DNA, 22 bp, Artificial Sequence
  Synthetic oligonucleotide; TTG chr11 5166137 5166158 5166154 5166159 +
atttccatatgtttctatattt

SEQ ID NO: 73208 - DNA, 22 bp, Artificial Sequence
  Synthetic oligonucleotide; TTT chr11 5166141 5166162 5166158 5166163 +
ccatatgtttctatattttctg

SEQ ID NO: 73209 - DNA, 22 bp, Artificial Sequence
  Synthetic oligonucleotide; TTC chr11 5166142 5166163 5166159 5166164 +
catatgtttctatattttctga

SEQ ID NO: 73210 - DNA, 22 bp, Artificial Sequence
  Synthetic oligonucleotide; TTT chr11 5166151 5166172 5166168 5166173 +
ctatattttctgatgatcttct

SEQ ID NO: 73211 - DNA, 22 bp, Artificial Sequence
  Synthetic oligonucleotide; TTC chr11 5166152 5166173 5166169 5166174 +
tatattttctgatgatcttctt

SEQ ID NO: 73212 - DNA, 22 bp, Artificial Sequence
  Synthetic oligonucleotide; CTA chr11 5166154 5166175 5166171 5166176 +
tattttctgatgatcttcttgt

SEQ ID NO: 73213 - DNA, 22 bp, Artificial Sequence
  Synthetic oligonucleotide; TTT chr11 5166159 5166180 5166176 5166181 +
tctgatgatcttcttgttattc

SEQ ID NO: 73214 - DNA, 22 bp, Artificial Sequence
  Synthetic oligonucleotide; TTT chr11 5166160 5166181 5166177 5166182 +
ctgatgatcttcttgttattca

SEQ ID NO: 73215 - DNA, 22 bp, Artificial Sequence
  Synthetic oligonucleotide; TTC chr11 5166161 5166182 5166178 5166183 +
tgatgatcttcttgttattcat

SEQ ID NO: 73216 - DNA, 22 bp, Artificial Sequence
  Synthetic oligonucleotide; CTG chr11 5166163 5166184 5166180 5166185 +
atgatcttcttgttattcattt

SEQ ID NO: 73217 - DNA, 22 bp, Artificial Sequence
  Synthetic oligonucleotide; CTT chr11 5166171 5166192 5166188 5166193 +
cttgttattcatttctagtttt

SEQ ID NO: 73218 - DNA, 22 bp, Artificial Sequence
  Synthetic oligonucleotide; TTC chr11 5166172 5166193 5166189 5166194 +
ttgttattcatttctagtttta

SEQ ID NO: 73219 - DNA, 22 bp, Artificial Sequence
  Synthetic oligonucleotide; CTT chr11 5166174 5166195 5166191 5166196 +
gttattcatttctagttttatt

SEQ ID NO: 73220 - DNA, 22 bp, Artificial Sequence
  Synthetic oligonucleotide; TTG chr11 5166175 5166196 5166192 5166197 +
ttattcatttctagttttattc

SEQ ID NO: 73221 - DNA, 22 bp, Artificial Sequence
  Synthetic oligonucleotide; TTA chr11 5166178 5166199 5166195 5166200 +
ttcatttctagttttattccac

SEQ ID NO: 73222 - DNA, 22 bp, Artificial Sequence
  Synthetic oligonucleotide; TTC chr11 5166181 5166202 5166198 5166203 +
atttctagttttattccactgt

SEQ ID NO: 73223 - DNA, 22 bp, Artificial Sequence
  Synthetic oligonucleotide; TTT chr11 5166185 5166206 5166202 5166207 +
ctagttttattccactgtggtc

SEQ ID NO: 73224 - DNA, 22 bp, Artificial Sequence
  Synthetic oligonucleotide; TTC chr11 5166186 5166207 5166203 5166208 +
tagttttattccactgtggtca

SEQ ID NO: 73225 - DNA, 22 bp, Artificial Sequence
  Synthetic oligonucleotide; CTA chr11 5166188 5166209 5166205 5166210 +
gttttattccactgtggtcaga

SEQ ID NO: 73226 - DNA, 22 bp, Artificial Sequence
  Synthetic oligonucleotide; TTT chr11 5166192 5166213 5166209 5166214 +
tattccactgtggtcagaaaat

SEQ ID NO: 73227 - DNA, 22 bp, Artificial Sequence
  Synthetic oligonucleotide; TTT chr11 5166193 5166214 5166210 5166215 +
attccactgtggtcagaaaata

SEQ ID NO: 73228 - DNA, 22 bp, Artificial Sequence
  Synthetic oligonucleotide; TTA chr11 5166194 5166215 5166211 5166216 +
ttccactgtggtcagaaaatat

SEQ ID NO: 73229 - DNA, 22 bp, Artificial Sequence
  Synthetic oligonucleotide; TTC chr11 5166197 5166218 5166214 5166219 +
cactgtggtcagaaaatatact

SEQ ID NO: 73230 - DNA, 22 bp, Artificial Sequence
  Synthetic oligonucleotide; CTG chr11 5166202 5166223 5166219 5166224 +
tggtcagaaaatatacttgata

SEQ ID NO: 73231 - DNA, 22 bp, Artificial Sequence
  Synthetic oligonucleotide; CTT chr11 5166220 5166241 5166237 5166242 +
gataaaatttctacttctgaaa

SEQ ID NO: 73232 - DNA, 22 bp, Artificial Sequence
  Synthetic oligonucleotide; TTG chr11 5166221 5166242 5166238 5166243 +
ataaaatttctacttctgaaaa

SEQ ID NO: 73233 - DNA, 22 bp, Artificial Sequence
  Synthetic oligonucleotide; TTT chr11 5166230 5166251 5166247 5166252 +
ctacttctgaaaaatttgtaca

SEQ ID NO: 73234 - DNA, 22 bp, Artificial Sequence
  Synthetic oligonucleotide; TTC chr11 5166231 5166252 5166248 5166253 +
tacttctgaaaaatttgtacaa

SEQ ID NO: 73235 - DNA, 22 bp, Artificial Sequence
  Synthetic oligonucleotide; CTA chr11 5166233 5166254 5166250 5166255 +
cttctgaaaaatttgtacaaac

SEQ ID NO: 73236 - DNA, 22 bp, Artificial Sequence
  Synthetic oligonucleotide; CTT chr11 5166236 5166257 5166253 5166258 +
ctgaaaaatttgtacaaactta

SEQ ID NO: 73237 - DNA, 22 bp, Artificial Sequence
  Synthetic oligonucleotide; TTC chr11 5166237 5166258 5166254 5166259 +
tgaaaaatttgtacaaacttac

SEQ ID NO: 73238 - DNA, 22 bp, Artificial Sequence
  Synthetic oligonucleotide; CTG chr11 5166239 5166260 5166256 5166261 +
aaaaatttgtacaaacttacct

SEQ ID NO: 73239 - DNA, 22 bp, Artificial Sequence
  Synthetic oligonucleotide; TTT chr11 5166247 5166268 5166264 5166269 +
gtacaaacttaccttgtggcct

SEQ ID NO: 73240 - DNA, 22 bp, Artificial Sequence
  Synthetic oligonucleotide; TTG chr11 5166248 5166269 5166265 5166270 +
tacaaacttaccttgtggccta

SEQ ID NO: 73241 - DNA, 22 bp, Artificial Sequence
  Synthetic oligonucleotide; CTT chr11 5166257 5166278 5166274 5166279 +
accttgtggcctaacatatggc

SEQ ID NO: 73242 - DNA, 22 bp, Artificial Sequence
  Synthetic oligonucleotide; TTA chr11 5166258 5166279 5166275 5166280 +
ccttgtggcctaacatatggcc

SEQ ID NO: 73243 - DNA, 22 bp, Artificial Sequence
  Synthetic oligonucleotide; CTT chr11 5166262 5166283 5166279 5166284 +
gtggcctaacatatggccttat

SEQ ID NO: 73244 - DNA, 22 bp, Artificial Sequence
  Synthetic oligonucleotide; TTG chr11 5166263 5166284 5166280 5166285 +
tggcctaacatatggccttatt

SEQ ID NO: 73245 - DNA, 22 bp, Artificial Sequence
  Synthetic oligonucleotide; CTA chr11 5166270 5166291 5166287 5166292 +
acatatggccttatttaggaaa

SEQ ID NO: 73246 - DNA, 22 bp, Artificial Sequence
  Synthetic oligonucleotide; CTT chr11 5166282 5166303 5166299 5166304 +
atttaggaaaatgttgtacatg

SEQ ID NO: 73247 - DNA, 22 bp, Artificial Sequence
  Synthetic oligonucleotide; TTA chr11 5166283 5166304 5166300 5166305 +
tttaggaaaatgttgtacatgc

SEQ ID NO: 73248 - DNA, 22 bp, Artificial Sequence
  Synthetic oligonucleotide; TTT chr11 5166286 5166307 5166303 5166308 +
aggaaaatgttgtacatgctgc

SEQ ID NO: 73249 - DNA, 22 bp, Artificial Sequence
  Synthetic oligonucleotide; TTA chr11 5166287 5166308 5166304 5166309 +
ggaaaatgttgtacatgctgct

SEQ ID NO: 73250 - DNA, 22 bp, Artificial Sequence
  Synthetic oligonucleotide; TTG chr11 5166298 5166319 5166315 5166320 +
tacatgctgctttaaagaaatg

SEQ ID NO: 73251 - DNA, 22 bp, Artificial Sequence
  Synthetic oligonucleotide; CTG chr11 5166307 5166328 5166324 5166329 +
ctttaaagaaatgtatcttctt

SEQ ID NO: 73252 - DNA, 22 bp, Artificial Sequence
  Synthetic oligonucleotide; CTT chr11 5166310 5166331 5166327 5166332 +
taaagaaatgtatcttcttcag

SEQ ID NO: 73253 - DNA, 22 bp, Artificial Sequence
  Synthetic oligonucleotide; TTT chr11 5166311 5166332 5166328 5166333 +
aaagaaatgtatcttcttcagc

SEQ ID NO: 73254 - DNA, 22 bp, Artificial Sequence
  Synthetic oligonucleotide; TTA chr11 5166312 5166333 5166329 5166334 +
aagaaatgtatcttcttcagca

SEQ ID NO: 73255 - DNA, 22 bp, Artificial Sequence
  Synthetic oligonucleotide; CTT chr11 5166326 5166347 5166343 5166348 +
cttcagcagttgggggacaagt

SEQ ID NO: 73256 - DNA, 22 bp, Artificial Sequence
  Synthetic oligonucleotide; TTC chr11 5166327 5166348 5166344 5166349 +
ttcagcagttgggggacaagtt

SEQ ID NO: 73257 - DNA, 22 bp, Artificial Sequence
  Synthetic oligonucleotide; CTT chr11 5166329 5166350 5166346 5166351 +
cagcagttgggggacaagttct

SEQ ID NO: 73258 - DNA, 22 bp, Artificial Sequence
  Synthetic oligonucleotide; TTC chr11 5166330 5166351 5166347 5166352 +
agcagttgggggacaagttctg

SEQ ID NO: 73259 - DNA, 22 bp, Artificial Sequence
  Synthetic oligonucleotide; TTG chr11 5166338 5166359 5166355 5166360 +
ggggacaagttctgttaatgtc

SEQ ID NO: 73260 - DNA, 22 bp, Artificial Sequence
  Synthetic oligonucleotide; TTC chr11 5166350 5166371 5166367 5166372 +
tgttaatgtcagttgggtctat

SEQ ID NO: 73261 - DNA, 22 bp, Artificial Sequence
  Synthetic oligonucleotide; CTG chr11 5166352 5166373 5166369 5166374 +
ttaatgtcagttgggtctatta

SEQ ID NO: 73262 - DNA, 22 bp, Artificial Sequence
  Synthetic oligonucleotide; TTA chr11 5166355 5166376 5166372 5166377 +
atgtcagttgggtctattagat

SEQ ID NO: 73263 - DNA, 22 bp, Artificial Sequence
  Synthetic oligonucleotide; TTG chr11 5166365 5166386 5166382 5166387 +
ggtctattagatatagtgggta

SEQ ID NO: 73264 - DNA, 22 bp, Artificial Sequence
  Synthetic oligonucleotide; CTA chr11 5166371 5166392 5166388 5166393 +
ttagatatagtgggtacattaa

SEQ ID NO: 73265 - DNA, 22 bp, Artificial Sequence
  Synthetic oligonucleotide; TTA chr11 5166374 5166395 5166391 5166396 +
gatatagtgggtacattaactg

SEQ ID NO: 73266 - DNA, 22 bp, Artificial Sequence
  Synthetic oligonucleotide; TTA chr11 5166392 5166413 5166409 5166414 +
actgtgttgttcatttgttgat

SEQ ID NO: 73267 - DNA, 22 bp, Artificial Sequence
  Synthetic oligonucleotide; CTG chr11 5166396 5166417 5166413 5166418 +
tgttgttcatttgttgattttt

SEQ ID NO: 73268 - DNA, 22 bp, Artificial Sequence
  Synthetic oligonucleotide; TTG chr11 5166401 5166422 5166418 5166423 +
ttcatttgttgatttttagtct

SEQ ID NO: 73269 - DNA, 22 bp, Artificial Sequence
  Synthetic oligonucleotide; TTC chr11 5166404 5166425 5166421 5166426 +
atttgttgatttttagtctggc

SEQ ID NO: 73270 - DNA, 22 bp, Artificial Sequence
  Synthetic oligonucleotide; TTT chr11 5166408 5166429 5166425 5166430 +
gttgatttttagtctggccgat

SEQ ID NO: 73271 - DNA, 22 bp, Artificial Sequence
  Synthetic oligonucleotide; TTG chr11 5166409 5166430 5166426 5166431 +
ttgatttttagtctggccgatc

SEQ ID NO: 73272 - DNA, 22 bp, Artificial Sequence
  Synthetic oligonucleotide; TTG chr11 5166412 5166433 5166429 5166434 +
atttttagtctggccgatctgt

SEQ ID NO: 73273 - DNA, 22 bp, Artificial Sequence
  Synthetic oligonucleotide; TTT chr11 5166416 5166437 5166433 5166438 +
ttagtctggccgatctgttcat

SEQ ID NO: 73274 - DNA, 22 bp, Artificial Sequence
  Synthetic oligonucleotide; TTT chr11 5166417 5166438 5166434 5166439 +
tagtctggccgatctgttcatt

SEQ ID NO: 73275 - DNA, 22 bp, Artificial Sequence
  Synthetic oligonucleotide; TTT chr11 5166418 5166439 5166435 5166440 +
agtctggccgatctgttcatta

SEQ ID NO: 73276 - DNA, 22 bp, Artificial Sequence
  Synthetic oligonucleotide; TTA chr11 5166419 5166440 5166436 5166441 +
gtctggccgatctgttcattac

SEQ ID NO: 73277 - DNA, 22 bp, Artificial Sequence
  Synthetic oligonucleotide; CTG chr11 5166424 5166445 5166441 5166446 +
gccgatctgttcattactgaga

SEQ ID NO: 73278 - DNA, 22 bp, Artificial Sequence
  Synthetic oligonucleotide; CTG chr11 5166433 5166454 5166450 5166455 +
ttcattactgagactgaagtgt

SEQ ID NO: 73279 - DNA, 22 bp, Artificial Sequence
  Synthetic oligonucleotide; TTC chr11 5166436 5166457 5166453 5166458 +
attactgagactgaagtgttta

SEQ ID NO: 73280 - DNA, 22 bp, Artificial Sequence
  Synthetic oligonucleotide; TTA chr11 5166440 5166461 5166457 5166462 +
ctgagactgaagtgtttaaagt

SEQ ID NO: 73281 - DNA, 22 bp, Artificial Sequence
  Synthetic oligonucleotide; CTG chr11 5166443 5166464 5166460 5166465 +
agactgaagtgtttaaagttcc

SEQ ID NO: 73282 - DNA, 22 bp, Artificial Sequence
  Synthetic oligonucleotide; CTG chr11 5166449 5166470 5166466 5166471 +
aagtgtttaaagttccctacta

SEQ ID NO: 73283 - DNA, 22 bp, Artificial Sequence
  Synthetic oligonucleotide; TTT chr11 5166457 5166478 5166474 5166479 +
aaagttccctactattattgta

SEQ ID NO: 73284 - DNA, 22 bp, Artificial Sequence
  Synthetic oligonucleotide; TTA chr11 5166458 5166479 5166475 5166480 +
aagttccctactattattgtat

SEQ ID NO: 73285 - DNA, 22 bp, Artificial Sequence
  Synthetic oligonucleotide; TTC chr11 5166464 5166485 5166481 5166486 +
cctactattattgtattgcagt

SEQ ID NO: 73286 - DNA, 22 bp, Artificial Sequence
  Synthetic oligonucleotide; CTA chr11 5166468 5166489 5166485 5166490 +
ctattattgtattgcagtctgt

SEQ ID NO: 73287 - DNA, 22 bp, Artificial Sequence
  Synthetic oligonucleotide; CTA chr11 5166471 5166492 5166488 5166493 +
ttattgtattgcagtctgtctc

SEQ ID NO: 73288 - DNA, 22 bp, Artificial Sequence
  Synthetic oligonucleotide; TTA chr11 5166474 5166495 5166491 5166496 +
ttgtattgcagtctgtctcgcc

SEQ ID NO: 73289 - DNA, 22 bp, Artificial Sequence
  Synthetic oligonucleotide; TTG chr11 5166477 5166498 5166494 5166499 +
tattgcagtctgtctcgccctt

SEQ ID NO: 73290 - DNA, 22 bp, Artificial Sequence
  Synthetic oligonucleotide; TTG chr11 5166482 5166503 5166499 5166504 +
cagtctgtctcgccctttagga

SEQ ID NO: 73291 - DNA, 22 bp, Artificial Sequence
  Synthetic oligonucleotide; CTG chr11 5166489 5166510 5166506 5166511 +
tctcgccctttaggactattaa

SEQ ID NO: 73292 - DNA, 22 bp, Artificial Sequence
  Synthetic oligonucleotide; CTC chr11 5166493 5166514 5166510 5166515 +
gccctttaggactattaatgtt

SEQ ID NO: 73293 - DNA, 22 bp, Artificial Sequence
  Synthetic oligonucleotide; CTT chr11 5166499 5166520 5166516 5166521 +
taggactattaatgttttcctt

SEQ ID NO: 73294 - DNA, 22 bp, Artificial Sequence
  Synthetic oligonucleotide; TTT chr11 5166500 5166521 5166517 5166522 +
aggactattaatgttttcctta

SEQ ID NO: 73295 - DNA, 22 bp, Artificial Sequence
  Synthetic oligonucleotide; TTA chr11 5166501 5166522 5166518 5166523 +
ggactattaatgttttccttat

SEQ ID NO: 73296 - DNA, 22 bp, Artificial Sequence
  Synthetic oligonucleotide; CTA chr11 5166507 5166528 5166524 5166529 +
ttaatgttttccttatatactt

SEQ ID NO: 73297 - DNA, 22 bp, Artificial Sequence
  Synthetic oligonucleotide; TTA chr11 5166510 5166531 5166527 5166532 +
atgttttccttatatacttggg

SEQ ID NO: 73298 - DNA, 22 bp, Artificial Sequence
  Synthetic oligonucleotide; TTT chr11 5166516 5166537 5166533 5166538 +
tccttatatacttgggaacttt

SEQ ID NO: 73299 - DNA, 22 bp, Artificial Sequence
  Synthetic oligonucleotide; TTT chr11 5166517 5166538 5166534 5166539 +
ccttatatacttgggaactttg

SEQ ID NO: 73300 - DNA, 22 bp, Artificial Sequence
  Synthetic oligonucleotide; TTC chr11 5166518 5166539 5166535 5166540 +
cttatatacttgggaactttga

SEQ ID NO: 73301 - DNA, 22 bp, Artificial Sequence
  Synthetic oligonucleotide; CTT chr11 5166521 5166542 5166538 5166543 +
atatacttgggaactttgatgt

SEQ ID NO: 73302 - DNA, 22 bp, Artificial Sequence
  Synthetic oligonucleotide; TTA chr11 5166522 5166543 5166539 5166544 +
tatacttgggaactttgatgtt

SEQ ID NO: 73303 - DNA, 22 bp, Artificial Sequence
  Synthetic oligonucleotide; CTT chr11 5166529 5166550 5166546 5166551 +
gggaactttgatgttggataca

SEQ ID NO: 73304 - DNA, 22 bp, Artificial Sequence
  Synthetic oligonucleotide; TTG chr11 5166530 5166551 5166547 5166552 +
ggaactttgatgttggatacat

SEQ ID NO: 73305 - DNA, 22 bp, Artificial Sequence
  Synthetic oligonucleotide; CTT chr11 5166537 5166558 5166554 5166559 +
tgatgttggatacatcaatatt

SEQ ID NO: 73306 - DNA, 22 bp, Artificial Sequence
  Synthetic oligonucleotide; TTT chr11 5166538 5166559 5166555 5166560 +
gatgttggatacatcaatattt

SEQ ID NO: 73307 - DNA, 22 bp, Artificial Sequence
  Synthetic oligonucleotide; TTG chr11 5166539 5166560 5166556 5166561 +
atgttggatacatcaatattta

SEQ ID NO: 73308 - DNA, 22 bp, Artificial Sequence
  Synthetic oligonucleotide; TTG chr11 5166545 5166566 5166562 5166567 +
gatacatcaatatttataattg

SEQ ID NO: 73309 - DNA, 22 bp, Artificial Sequence
  Synthetic oligonucleotide; TTT chr11 5166560 5166581 5166577 5166582 +
ataattgtatcctcttgctgaa

SEQ ID NO: 73310 - DNA, 22 bp, Artificial Sequence
  Synthetic oligonucleotide; TTA chr11 5166561 5166582 5166578 5166583 +
taattgtatcctcttgctgaat

SEQ ID NO: 73311 - DNA, 22 bp, Artificial Sequence
  Synthetic oligonucleotide; TTG chr11 5166567 5166588 5166584 5166589 +
tatcctcttgctgaattgaccc

SEQ ID NO: 73312 - DNA, 22 bp, Artificial Sequence
  Synthetic oligonucleotide; CTC chr11 5166574 5166595 5166591 5166596 +
ttgctgaattgacccctttatt

SEQ ID NO: 73313 - DNA, 22 bp, Artificial Sequence
  Synthetic oligonucleotide; CTT chr11 5166576 5166597 5166593 5166598 +
gctgaattgacccctttattat

SEQ ID NO: 73314 - DNA, 22 bp, Artificial Sequence
  Synthetic oligonucleotide; TTG chr11 5166577 5166598 5166594 5166599 +
ctgaattgacccctttattatt

SEQ ID NO: 73315 - DNA, 22 bp, Artificial Sequence
  Synthetic oligonucleotide; CTG chr11 5166580 5166601 5166597 5166602 +
aattgacccctttattattata

SEQ ID NO: 73316 - DNA, 22 bp, Artificial Sequence
  Synthetic oligonucleotide; TTG chr11 5166585 5166606 5166602 5166607 +
acccctttattattatacagtg

SEQ ID NO: 73317 - DNA, 22 bp, Artificial Sequence
  Synthetic oligonucleotide; CTT chr11 5166592 5166613 5166609 5166614 +
tattattatacagtgaccctcc

SEQ ID NO: 73318 - DNA, 22 bp, Artificial Sequence
  Synthetic oligonucleotide; TTT chr11 5166593 5166614 5166610 5166615 +
attattatacagtgaccctcct

SEQ ID NO: 73319 - DNA, 22 bp, Artificial Sequence
  Synthetic oligonucleotide; TTA chr11 5166594 5166615 5166611 5166616 +
ttattatacagtgaccctcctt

SEQ ID NO: 73320 - DNA, 22 bp, Artificial Sequence
  Synthetic oligonucleotide; TTA chr11 5166597 5166618 5166614 5166619 +
ttatacagtgaccctccttatc

SEQ ID NO: 73321 - DNA, 22 bp, Artificial Sequence
  Synthetic oligonucleotide; TTA chr11 5166600 5166621 5166617 5166622 +
tacagtgaccctccttatcttt

SEQ ID NO: 73322 - DNA, 22 bp, Artificial Sequence
  Synthetic oligonucleotide; CTC chr11 5166613 5166634 5166630 5166635 +
cttatcttttcttacagttttt

SEQ ID NO: 73323 - DNA, 22 bp, Artificial Sequence
  Synthetic oligonucleotide; CTT chr11 5166616 5166637 5166633 5166638 +
atcttttcttacagtttttaaa

SEQ ID NO: 73324 - DNA, 22 bp, Artificial Sequence
  Synthetic oligonucleotide; TTA chr11 5166617 5166638 5166634 5166639 +
tcttttcttacagtttttaaat

SEQ ID NO: 73325 - DNA, 22 bp, Artificial Sequence
  Synthetic oligonucleotide; CTT chr11 5166621 5166642 5166638 5166643 +
ttcttacagtttttaaatttgt

SEQ ID NO: 73326 - DNA, 22 bp, Artificial Sequence
  Synthetic oligonucleotide; TTT chr11 5166622 5166643 5166639 5166644 +
tcttacagtttttaaatttgta

SEQ ID NO: 73327 - DNA, 22 bp, Artificial Sequence
  Synthetic oligonucleotide; TTT chr11 5166623 5166644 5166640 5166645 +
cttacagtttttaaatttgtag

SEQ ID NO: 73328 - DNA, 22 bp, Artificial Sequence
  Synthetic oligonucleotide; TTC chr11 5166624 5166645 5166641 5166646 +
ttacagtttttaaatttgtagt

SEQ ID NO: 73329 - DNA, 22 bp, Artificial Sequence
  Synthetic oligonucleotide; CTT chr11 5166626 5166647 5166643 5166648 +
acagtttttaaatttgtagtct

SEQ ID NO: 73330 - DNA, 22 bp, Artificial Sequence
  Synthetic oligonucleotide; TTA chr11 5166627 5166648 5166644 5166649 +
cagtttttaaatttgtagtcta

SEQ ID NO: 73331 - DNA, 22 bp, Artificial Sequence
  Synthetic oligonucleotide; TTT chr11 5166633 5166654 5166650 5166655 +
ttaaatttgtagtctattttat

SEQ ID NO: 73332 - DNA, 22 bp, Artificial Sequence
  Synthetic oligonucleotide; TTT chr11 5166634 5166655 5166651 5166656 +
taaatttgtagtctattttatc

SEQ ID NO: 73333 - DNA, 22 bp, Artificial Sequence
  Synthetic oligonucleotide; TTT chr11 5166635 5166656 5166652 5166657 +
aaatttgtagtctattttatct

SEQ ID NO: 73334 - DNA, 22 bp, Artificial Sequence
  Synthetic oligonucleotide; TTA chr11 5166636 5166657 5166653 5166658 +
aatttgtagtctattttatctg

SEQ ID NO: 73335 - DNA, 22 bp, Artificial Sequence
  Synthetic oligonucleotide; TTT chr11 5166641 5166662 5166658 5166663 +
gtagtctattttatctgattta

SEQ ID NO: 73336 - DNA, 22 bp, Artificial Sequence
  Synthetic oligonucleotide; TTG chr11 5166642 5166663 5166659 5166664 +
tagtctattttatctgatttaa

SEQ ID NO: 73337 - DNA, 22 bp, Artificial Sequence
  Synthetic oligonucleotide; CTA chr11 5166649 5166670 5166666 5166671 +
ttttatctgatttaagtacaat

SEQ ID NO: 73338 - DNA, 22 bp, Artificial Sequence
  Synthetic oligonucleotide; TTT chr11 5166652 5166673 5166669 5166674 +
tatctgatttaagtacaattac

SEQ ID NO: 73339 - DNA, 22 bp, Artificial Sequence
  Synthetic oligonucleotide; TTT chr11 5166653 5166674 5166670 5166675 +
atctgatttaagtacaattact

SEQ ID NO: 73340 - DNA, 22 bp, Artificial Sequence
  Synthetic oligonucleotide; TTA chr11 5166654 5166675 5166671 5166676 +
tctgatttaagtacaattacta

SEQ ID NO: 73341 - DNA, 22 bp, Artificial Sequence
  Synthetic oligonucleotide; CTG chr11 5166658 5166679 5166675 5166680 +
atttaagtacaattactactgc

SEQ ID NO: 73342 - DNA, 22 bp, Artificial Sequence
  Synthetic oligonucleotide; TTT chr11 5166662 5166683 5166679 5166684 +
aagtacaattactactgctctt

SEQ ID NO: 73343 - DNA, 22 bp, Artificial Sequence
  Synthetic oligonucleotide; TTA chr11 5166663 5166684 5166680 5166685 +
agtacaattactactgctcttt

SEQ ID NO: 73344 - DNA, 22 bp, Artificial Sequence
  Synthetic oligonucleotide; TTA chr11 5166673 5166694 5166690 5166695 +
ctactgctctttctggtttcca

SEQ ID NO: 73345 - DNA, 22 bp, Artificial Sequence
  Synthetic oligonucleotide; CTA chr11 5166676 5166697 5166693 5166698 +
ctgctctttctggtttccagtt

SEQ ID NO: 73346 - DNA, 22 bp, Artificial Sequence
  Synthetic oligonucleotide; CTG chr11 5166679 5166700 5166696 5166701 +
ctctttctggtttccagttcat

SEQ ID NO: 73347 - DNA, 22 bp, Artificial Sequence
  Synthetic oligonucleotide; CTC chr11 5166682 5166703 5166699 5166704 +
tttctggtttccagttcatgga

SEQ ID NO: 73348 - DNA, 22 bp, Artificial Sequence
  Synthetic oligonucleotide; CTT chr11 5166684 5166705 5166701 5166706 +
tctggtttccagttcatggaat

SEQ ID NO: 73349 - DNA, 22 bp, Artificial Sequence
  Synthetic oligonucleotide; TTT chr11 5166685 5166706 5166702 5166707 +
ctggtttccagttcatggaatt

SEQ ID NO: 73350 - DNA, 22 bp, Artificial Sequence
  Synthetic oligonucleotide; TTC chr11 5166686 5166707 5166703 5166708 +
tggtttccagttcatggaattt

SEQ ID NO: 73351 - DNA, 22 bp, Artificial Sequence
  Synthetic oligonucleotide; CTG chr11 5166688 5166709 5166705 5166710 +
gtttccagttcatggaattttt

SEQ ID NO: 73352 - DNA, 22 bp, Artificial Sequence
  Synthetic oligonucleotide; TTT chr11 5166692 5166713 5166709 5166714 +
ccagttcatggaatttttttcc

SEQ ID NO: 73353 - DNA, 22 bp, Artificial Sequence
  Synthetic oligonucleotide; TTC chr11 5166693 5166714 5166710 5166715 +
cagttcatggaatttttttcca

SEQ ID NO: 73354 - DNA, 22 bp, Artificial Sequence
  Synthetic oligonucleotide; TTC chr11 5166699 5166720 5166716 5166721 +
atggaatttttttccaaccctt

SEQ ID NO: 73355 - DNA, 22 bp, Artificial Sequence
  Synthetic oligonucleotide; TTT chr11 5166708 5166729 5166725 5166730 +
ttttccaacccttcactttcat

SEQ ID NO: 73356 - DNA, 22 bp, Artificial Sequence
  Synthetic oligonucleotide; TTT chr11 5166709 5166730 5166726 5166731 +
tttccaacccttcactttcatt

SEQ ID NO: 73357 - DNA, 22 bp, Artificial Sequence
  Synthetic oligonucleotide; TTT chr11 5166710 5166731 5166727 5166732 +
ttccaacccttcactttcattt

SEQ ID NO: 73358 - DNA, 22 bp, Artificial Sequence
  Synthetic oligonucleotide; TTT chr11 5166711 5166732 5166728 5166733 +
tccaacccttcactttcattta

SEQ ID NO: 73359 - DNA, 22 bp, Artificial Sequence
  Synthetic oligonucleotide; TTT chr11 5166712 5166733 5166729 5166734 +
ccaacccttcactttcatttat

SEQ ID NO: 73360 - DNA, 22 bp, Artificial Sequence
  Synthetic oligonucleotide; TTC chr11 5166713 5166734 5166730 5166735 +
caacccttcactttcatttatg

SEQ ID NO: 73361 - DNA, 22 bp, Artificial Sequence
  Synthetic oligonucleotide; CTT chr11 5166721 5166742 5166738 5166743 +
cactttcatttatgtgtgcctt

SEQ ID NO: 73362 - DNA, 22 bp, Artificial Sequence
  Synthetic oligonucleotide; TTC chr11 5166722 5166743 5166739 5166744 +
actttcatttatgtgtgccttt

SEQ ID NO: 73363 - DNA, 22 bp, Artificial Sequence
  Synthetic oligonucleotide; CTT chr11 5166726 5166747 5166743 5166748 +
tcatttatgtgtgcctttatag

SEQ ID NO: 73364 - DNA, 22 bp, Artificial Sequence
  Synthetic oligonucleotide; TTT chr11 5166727 5166748 5166744 5166749 +
catttatgtgtgcctttatagg

SEQ ID NO: 73365 - DNA, 22 bp, Artificial Sequence
  Synthetic oligonucleotide; TTC chr11 5166728 5166749 5166745 5166750 +
atttatgtgtgcctttataggt

SEQ ID NO: 73366 - DNA, 22 bp, Artificial Sequence
  Synthetic oligonucleotide; TTT chr11 5166732 5166753 5166749 5166754 +
atgtgtgcctttataggtgaag

SEQ ID NO: 73367 - DNA, 22 bp, Artificial Sequence
  Synthetic oligonucleotide; TTA chr11 5166733 5166754 5166750 5166755 +
tgtgtgcctttataggtgaagt

SEQ ID NO: 73368 - DNA, 22 bp, Artificial Sequence
  Synthetic oligonucleotide; CTT chr11 5166743 5166764 5166760 5166765 +
tataggtgaagtgggtttcttg

SEQ ID NO: 73369 - DNA, 22 bp, Artificial Sequence
  Synthetic oligonucleotide; TTT chr11 5166744 5166765 5166761 5166766 +
ataggtgaagtgggtttcttga

SEQ ID NO: 73370 - DNA, 22 bp, Artificial Sequence
  Synthetic oligonucleotide; TTA chr11 5166745 5166766 5166762 5166767 +
taggtgaagtgggtttcttgaa

SEQ ID NO: 73371 - DNA, 22 bp, Artificial Sequence
  Synthetic oligonucleotide; TTT chr11 5166761 5166782 5166778 5166783 +
cttgaagatcgcataaagttgg

SEQ ID NO: 73372 - DNA, 22 bp, Artificial Sequence
  Synthetic oligonucleotide; TTC chr11 5166762 5166783 5166779 5166784 +
ttgaagatcgcataaagttgga

SEQ ID NO: 73373 - DNA, 22 bp, Artificial Sequence
  Synthetic oligonucleotide; CTT chr11 5166764 5166785 5166781 5166786 +
gaagatcgcataaagttggata

SEQ ID NO: 73374 - DNA, 22 bp, Artificial Sequence
  Synthetic oligonucleotide; TTG chr11 5166765 5166786 5166782 5166787 +
aagatcgcataaagttggatat

SEQ ID NO: 73375 - DNA, 22 bp, Artificial Sequence
  Synthetic oligonucleotide; TTG chr11 5166782 5166803 5166799 5166804 +
gatattgtttctttatccattt

SEQ ID NO: 73376 - DNA, 22 bp, Artificial Sequence
  Synthetic oligonucleotide; TTG chr11 5166789 5166810 5166806 5166811 +
tttctttatccatttaccattc

SEQ ID NO: 73377 - DNA, 22 bp, Artificial Sequence
  Synthetic oligonucleotide; TTT chr11 5166792 5166813 5166809 5166814 +
ctttatccatttaccattctat

SEQ ID NO: 73378 - DNA, 22 bp, Artificial Sequence
  Synthetic oligonucleotide; TTC chr11 5166793 5166814 5166810 5166815 +
tttatccatttaccattctatt

SEQ ID NO: 73379 - DNA, 22 bp, Artificial Sequence
  Synthetic oligonucleotide; CTT chr11 5166795 5166816 5166812 5166817 +
tatccatttaccattctattac

SEQ ID NO: 73380 - DNA, 22 bp, Artificial Sequence
  Synthetic oligonucleotide; TTT chr11 5166796 5166817 5166813 5166818 +
atccatttaccattctattact

SEQ ID NO: 73381 - DNA, 22 bp, Artificial Sequence
  Synthetic oligonucleotide; TTA chr11 5166797 5166818 5166814 5166819 +
tccatttaccattctattactt

SEQ ID NO: 73382 - DNA, 22 bp, Artificial Sequence
  Synthetic oligonucleotide; TTT chr11 5166804 5166825 5166821 5166826 +
accattctattacttttaattg

SEQ ID NO: 73383 - DNA, 22 bp, Artificial Sequence
  Synthetic oligonucleotide; TTA chr11 5166805 5166826 5166822 5166827 +
ccattctattacttttaattgg

SEQ ID NO: 73384 - DNA, 22 bp, Artificial Sequence
  Synthetic oligonucleotide; TTC chr11 5166811 5166832 5166828 5166833 +
tattacttttaattggggaact

SEQ ID NO: 73385 - DNA, 22 bp, Artificial Sequence
  Synthetic oligonucleotide; CTA chr11 5166813 5166834 5166830 5166835 +
ttacttttaattggggaactga

SEQ ID NO: 73386 - DNA, 22 bp, Artificial Sequence
  Synthetic oligonucleotide; TTA chr11 5166816 5166837 5166833 5166838 +
cttttaattggggaactgagac

SEQ ID NO: 73387 - DNA, 22 bp, Artificial Sequence
  Synthetic oligonucleotide; CTT chr11 5166819 5166840 5166836 5166841 +
ttaattggggaactgagactat

SEQ ID NO: 73388 - DNA, 22 bp, Artificial Sequence
  Synthetic oligonucleotide; TTT chr11 5166820 5166841 5166837 5166842 +
taattggggaactgagactatt

SEQ ID NO: 73389 - DNA, 22 bp, Artificial Sequence
  Synthetic oligonucleotide; TTT chr11 5166821 5166842 5166838 5166843 +
aattggggaactgagactattt

SEQ ID NO: 73390 - DNA, 22 bp, Artificial Sequence
  Synthetic oligonucleotide; TTA chr11 5166822 5166843 5166839 5166844 +
attggggaactgagactattta

SEQ ID NO: 73391 - DNA, 22 bp, Artificial Sequence
  Synthetic oligonucleotide; TTG chr11 5166826 5166847 5166843 5166848 +
gggaactgagactatttacact

SEQ ID NO: 73392 - DNA, 22 bp, Artificial Sequence
  Synthetic oligonucleotide; CTG chr11 5166834 5166855 5166851 5166856 +
agactatttacactcagtgtag

SEQ ID NO: 73393 - DNA, 22 bp, Artificial Sequence
  Synthetic oligonucleotide; CTA chr11 5166840 5166861 5166857 5166862 +
tttacactcagtgtagttacta

SEQ ID NO: 73394 - DNA, 22 bp, Artificial Sequence
  Synthetic oligonucleotide; TTT chr11 5166843 5166864 5166860 5166865 +
acactcagtgtagttactaagt

SEQ ID NO: 73395 - DNA, 22 bp, Artificial Sequence
  Synthetic oligonucleotide; TTA chr11 5166844 5166865 5166861 5166866 +
cactcagtgtagttactaagta

SEQ ID NO: 73396 - DNA, 22 bp, Artificial Sequence
  Synthetic oligonucleotide; CTC chr11 5166849 5166870 5166866 5166871 +
agtgtagttactaagtaaggat

SEQ ID NO: 73397 - DNA, 22 bp, Artificial Sequence
  Synthetic oligonucleotide; TTA chr11 5166859 5166880 5166876 5166881 +
ctaagtaaggatttcctttttt

SEQ ID NO: 73398 - DNA, 22 bp, Artificial Sequence
  Synthetic oligonucleotide; CTA chr11 5166862 5166883 5166879 5166884 +
agtaaggatttccttttttttt

SEQ ID NO: 73399 - DNA, 22 bp, Artificial Sequence
  Synthetic oligonucleotide; TTT chr11 5166873 5166894 5166890 5166895 +
cctttttttttttttttttttt

SEQ ID NO: 73400 - DNA, 22 bp, Artificial Sequence
  Synthetic oligonucleotide; TTC chr11 5166874 5166895 5166891 5166896 +
cttttttttttttttttttttt

SEQ ID NO: 73401 - DNA, 22 bp, Artificial Sequence
  Synthetic oligonucleotide; CTT chr11 5166877 5166898 5166894 5166899 +
tttttttttttttttttttttt

SEQ ID NO: 73402 - DNA, 22 bp, Artificial Sequence
  Synthetic oligonucleotide; TTT chr11 5166878 5166899 5166895 5166900 +
tttttttttttttttttttttt

SEQ ID NO: 73403 - DNA, 22 bp, Artificial Sequence
  Synthetic oligonucleotide; TTT chr11 5166879 5166900 5166896 5166901 +
tttttttttttttttttttttg

SEQ ID NO: 73404 - DNA, 22 bp, Artificial Sequence
  Synthetic oligonucleotide; TTT chr11 5166880 5166901 5166897 5166902 +
ttttttttttttttttttttgc

SEQ ID NO: 73405 - DNA, 22 bp, Artificial Sequence
  Synthetic oligonucleotide; TTT chr11 5166881 5166902 5166898 5166903 +
tttttttttttttttttttgct

SEQ ID NO: 73406 - DNA, 22 bp, Artificial Sequence
  Synthetic oligonucleotide; TTT chr11 5166882 5166903 5166899 5166904 +
ttttttttttttttttttgctt

SEQ ID NO: 73407 - DNA, 22 bp, Artificial Sequence
  Synthetic oligonucleotide; TTT chr11 5166883 5166904 5166900 5166905 +
tttttttttttttttttgctta

SEQ ID NO: 73408 - DNA, 22 bp, Artificial Sequence
  Synthetic oligonucleotide; TTT chr11 5166884 5166905 5166901 5166906 +
ttttttttttttttttgcttat

SEQ ID NO: 73409 - DNA, 22 bp, Artificial Sequence
  Synthetic oligonucleotide; TTT chr11 5166885 5166906 5166902 5166907 +
tttttttttttttttgcttatt

SEQ ID NO: 73410 - DNA, 22 bp, Artificial Sequence
  Synthetic oligonucleotide; TTT chr11 5166886 5166907 5166903 5166908 +
ttttttttttttttgcttattt

SEQ ID NO: 73411 - DNA, 22 bp, Artificial Sequence
  Synthetic oligonucleotide; TTT chr11 5166887 5166908 5166904 5166909 +
tttttttttttttgcttatttt

SEQ ID NO: 73412 - DNA, 22 bp, Artificial Sequence
  Synthetic oligonucleotide; TTT chr11 5166888 5166909 5166905 5166910 +
ttttttttttttgcttattttt

SEQ ID NO: 73413 - DNA, 22 bp, Artificial Sequence
  Synthetic oligonucleotide; TTT chr11 5166889 5166910 5166906 5166911 +
tttttttttttgcttatttttg

SEQ ID NO: 73414 - DNA, 22 bp, Artificial Sequence
  Synthetic oligonucleotide; TTT chr11 5166890 5166911 5166907 5166912 +
ttttttttttgcttatttttgg

SEQ ID NO: 73415 - DNA, 22 bp, Artificial Sequence
  Synthetic oligonucleotide; TTT chr11 5166891 5166912 5166908 5166913 +
tttttttttgcttatttttggc

SEQ ID NO: 73416 - DNA, 22 bp, Artificial Sequence
  Synthetic oligonucleotide; TTT chr11 5166892 5166913 5166909 5166914 +
ttttttttgcttatttttggct

SEQ ID NO: 73417 - DNA, 22 bp, Artificial Sequence
  Synthetic oligonucleotide; TTT chr11 5166893 5166914 5166910 5166915 +
tttttttgcttatttttggctg

SEQ ID NO: 73418 - DNA, 22 bp, Artificial Sequence
  Synthetic oligonucleotide; TTT chr11 5166894 5166915 5166911 5166916 +
ttttttgcttatttttggctgt

SEQ ID NO: 73419 - DNA, 22 bp, Artificial Sequence
  Synthetic oligonucleotide; TTT chr11 5166895 5166916 5166912 5166917 +
tttttgcttatttttggctgta

SEQ ID NO: 73420 - DNA, 22 bp, Artificial Sequence
  Synthetic oligonucleotide; TTT chr11 5166896 5166917 5166913 5166918 +
ttttgcttatttttggctgtat

SEQ ID NO: 73421 - DNA, 22 bp, Artificial Sequence
  Synthetic oligonucleotide; TTT chr11 5166897 5166918 5166914 5166919 +
tttgcttatttttggctgtatg

SEQ ID NO: 73422 - DNA, 22 bp, Artificial Sequence
  Synthetic oligonucleotide; TTT chr11 5166898 5166919 5166915 5166920 +
ttgcttatttttggctgtatgg

SEQ ID NO: 73423 - DNA, 22 bp, Artificial Sequence
  Synthetic oligonucleotide; TTT chr11 5166899 5166920 5166916 5166921 +
tgcttatttttggctgtatgga

SEQ ID NO: 73424 - DNA, 22 bp, Artificial Sequence
  Synthetic oligonucleotide; TTT chr11 5166900 5166921 5166917 5166922 +
gcttatttttggctgtatggag

SEQ ID NO: 73425 - DNA, 22 bp, Artificial Sequence
  Synthetic oligonucleotide; TTG chr11 5166901 5166922 5166918 5166923 +
cttatttttggctgtatggaga

SEQ ID NO: 73426 - DNA, 22 bp, Artificial Sequence
  Synthetic oligonucleotide; CTT chr11 5166904 5166925 5166921 5166926 +
atttttggctgtatggagactc

SEQ ID NO: 73427 - DNA, 22 bp, Artificial Sequence
  Synthetic oligonucleotide; TTA chr11 5166905 5166926 5166922 5166927 +
tttttggctgtatggagactcc

SEQ ID NO: 73428 - DNA, 22 bp, Artificial Sequence
  Synthetic oligonucleotide; TTT chr11 5166908 5166929 5166925 5166930 +
ttggctgtatggagactcctct

SEQ ID NO: 73429 - DNA, 22 bp, Artificial Sequence
  Synthetic oligonucleotide; TTT chr11 5166909 5166930 5166926 5166931 +
tggctgtatggagactcctctc

SEQ ID NO: 73430 - DNA, 22 bp, Artificial Sequence
  Synthetic oligonucleotide; TTT chr11 5166910 5166931 5166927 5166932 +
ggctgtatggagactcctctct

SEQ ID NO: 73431 - DNA, 22 bp, Artificial Sequence
  Synthetic oligonucleotide; TTG chr11 5166911 5166932 5166928 5166933 +
gctgtatggagactcctctctt

SEQ ID NO: 73432 - DNA, 22 bp, Artificial Sequence
  Synthetic oligonucleotide; CTG chr11 5166915 5166936 5166932 5166937 +
tatggagactcctctcttcctt

SEQ ID NO: 73433 - DNA, 22 bp, Artificial Sequence
  Synthetic oligonucleotide; CTC chr11 5166926 5166947 5166943 5166948 +
ctctcttccttttttttccttc

SEQ ID NO: 73434 - DNA, 22 bp, Artificial Sequence
  Synthetic oligonucleotide; CTC chr11 5166929 5166950 5166946 5166951 +
tcttccttttttttccttcatg

SEQ ID NO: 73435 - DNA, 22 bp, Artificial Sequence
  Synthetic oligonucleotide; CTC chr11 5166931 5166952 5166948 5166953 +
ttccttttttttccttcatggt

SEQ ID NO: 73436 - DNA, 22 bp, Artificial Sequence
  Synthetic oligonucleotide; CTT chr11 5166933 5166954 5166950 5166955 +
ccttttttttccttcatggtta

SEQ ID NO: 73437 - DNA, 22 bp, Artificial Sequence
  Synthetic oligonucleotide; TTC chr11 5166934 5166955 5166951 5166956 +
cttttttttccttcatggttat

SEQ ID NO: 73438 - DNA, 22 bp, Artificial Sequence
  Synthetic oligonucleotide; CTT chr11 5166937 5166958 5166954 5166959 +
ttttttccttcatggttatgtg

SEQ ID NO: 73439 - DNA, 22 bp, Artificial Sequence
  Synthetic oligonucleotide; TTT chr11 5166938 5166959 5166955 5166960 +
tttttccttcatggttatgtga

SEQ ID NO: 73440 - DNA, 22 bp, Artificial Sequence
  Synthetic oligonucleotide; TTT chr11 5166939 5166960 5166956 5166961 +
ttttccttcatggttatgtgat

SEQ ID NO: 73441 - DNA, 22 bp, Artificial Sequence
  Synthetic oligonucleotide; TTT chr11 5166940 5166961 5166957 5166962 +
tttccttcatggttatgtgatt

SEQ ID NO: 73442 - DNA, 22 bp, Artificial Sequence
  Synthetic oligonucleotide; TTT chr11 5166941 5166962 5166958 5166963 +
ttccttcatggttatgtgatta

SEQ ID NO: 73443 - DNA, 22 bp, Artificial Sequence
  Synthetic oligonucleotide; TTT chr11 5166942 5166963 5166959 5166964 +
tccttcatggttatgtgattat

SEQ ID NO: 73444 - DNA, 22 bp, Artificial Sequence
  Synthetic oligonucleotide; TTT chr11 5166943 5166964 5166960 5166965 +
ccttcatggttatgtgattatc

SEQ ID NO: 73445 - DNA, 22 bp, Artificial Sequence
  Synthetic oligonucleotide; TTC chr11 5166944 5166965 5166961 5166966 +
cttcatggttatgtgattatct

SEQ ID NO: 73446 - DNA, 22 bp, Artificial Sequence
  Synthetic oligonucleotide; CTT chr11 5166947 5166968 5166964 5166969 +
catggttatgtgattatctctg

SEQ ID NO: 73447 - DNA, 22 bp, Artificial Sequence
  Synthetic oligonucleotide; TTC chr11 5166948 5166969 5166965 5166970 +
atggttatgtgattatctctgg

SEQ ID NO: 73448 - DNA, 22 bp, Artificial Sequence
  Synthetic oligonucleotide; TTA chr11 5166955 5166976 5166972 5166977 +
tgtgattatctctggtagcata

SEQ ID NO: 73449 - DNA, 22 bp, Artificial Sequence
  Synthetic oligonucleotide; TTA chr11 5166963 5166984 5166980 5166985 +
tctctggtagcatattttaatt

SEQ ID NO: 73450 - DNA, 22 bp, Artificial Sequence
  Synthetic oligonucleotide; CTC chr11 5166967 5166988 5166984 5166989 +
tggtagcatattttaatttgtt

SEQ ID NO: 73451 - DNA, 22 bp, Artificial Sequence
  Synthetic oligonucleotide; CTG chr11 5166969 5166990 5166986 5166991 +
gtagcatattttaatttgttac

SEQ ID NO: 73452 - DNA, 22 bp, Artificial Sequence
  Synthetic oligonucleotide; TTT chr11 5166980 5167001 5166997 5167002 +
taatttgttactttttattttt

SEQ ID NO: 73453 - DNA, 22 bp, Artificial Sequence
  Synthetic oligonucleotide; TTT chr11 5166981 5167002 5166998 5167003 +
aatttgttactttttattttta

SEQ ID NO: 73454 - DNA, 22 bp, Artificial Sequence
  Synthetic oligonucleotide; TTA chr11 5166982 5167003 5166999 5167004 +
atttgttactttttatttttag

SEQ ID NO: 73455 - DNA, 22 bp, Artificial Sequence
  Synthetic oligonucleotide; TTT chr11 5166986 5167007 5167003 5167008 +
gttactttttatttttagtaaa

SEQ ID NO: 73456 - DNA, 22 bp, Artificial Sequence
  Synthetic oligonucleotide; TTG chr11 5166987 5167008 5167004 5167009 +
ttactttttatttttagtaaat

SEQ ID NO: 73457 - DNA, 22 bp, Artificial Sequence
  Synthetic oligonucleotide; TTA chr11 5166990 5167011 5167007 5167012 +
ctttttatttttagtaaatcta

SEQ ID NO: 73458 - DNA, 22 bp, Artificial Sequence
  Synthetic oligonucleotide; CTT chr11 5166993 5167014 5167010 5167015 +
tttatttttagtaaatctatta

SEQ ID NO: 73459 - DNA, 22 bp, Artificial Sequence
  Synthetic oligonucleotide; TTT chr11 5166994 5167015 5167011 5167016 +
ttatttttagtaaatctattat

SEQ ID NO: 73460 - DNA, 22 bp, Artificial Sequence
  Synthetic oligonucleotide; TTT chr11 5166995 5167016 5167012 5167017 +
tatttttagtaaatctattata

SEQ ID NO: 73461 - DNA, 22 bp, Artificial Sequence
  Synthetic oligonucleotide; TTT chr11 5166996 5167017 5167013 5167018 +
atttttagtaaatctattatag

SEQ ID NO: 73462 - DNA, 22 bp, Artificial Sequence
  Synthetic oligonucleotide; TTA chr11 5166997 5167018 5167014 5167019 +
tttttagtaaatctattataga

SEQ ID NO: 73463 - DNA, 22 bp, Artificial Sequence
  Synthetic oligonucleotide; TTT chr11 5167000 5167021 5167017 5167022 +
ttagtaaatctattatagattt

SEQ ID NO: 73464 - DNA, 22 bp, Artificial Sequence
  Synthetic oligonucleotide; TTT chr11 5167001 5167022 5167018 5167023 +
tagtaaatctattatagatttt

SEQ ID NO: 73465 - DNA, 22 bp, Artificial Sequence
  Synthetic oligonucleotide; TTT chr11 5167002 5167023 5167019 5167024 +
agtaaatctattatagattttt

SEQ ID NO: 73466 - DNA, 22 bp, Artificial Sequence
  Synthetic oligonucleotide; TTA chr11 5167003 5167024 5167020 5167025 +
gtaaatctattatagatttttg

SEQ ID NO: 73467 - DNA, 22 bp, Artificial Sequence
  Synthetic oligonucleotide; CTA chr11 5167012 5167033 5167029 5167034 +
ttatagatttttgtgctgtggt

SEQ ID NO: 73468 - DNA, 22 bp, Artificial Sequence
  Synthetic oligonucleotide; TTA chr11 5167015 5167036 5167032 5167037 +
tagatttttgtgctgtggttac

SEQ ID NO: 73469 - DNA, 22 bp, Artificial Sequence
  Synthetic oligonucleotide; TTT chr11 5167022 5167043 5167039 5167044 +
ttgtgctgtggttaccatgggg

SEQ ID NO: 73470 - DNA, 22 bp, Artificial Sequence
  Synthetic oligonucleotide; TTT chr11 5167023 5167044 5167040 5167045 +
tgtgctgtggttaccatggggc

SEQ ID NO: 73471 - DNA, 22 bp, Artificial Sequence
  Synthetic oligonucleotide; TTT chr11 5167024 5167045 5167041 5167046 +
gtgctgtggttaccatggggct

SEQ ID NO: 73472 - DNA, 22 bp, Artificial Sequence
  Synthetic oligonucleotide; TTG chr11 5167025 5167046 5167042 5167047 +
tgctgtggttaccatggggctt

SEQ ID NO: 73473 - DNA, 22 bp, Artificial Sequence
  Synthetic oligonucleotide; CTG chr11 5167030 5167051 5167047 5167052 +
tggttaccatggggcttacaag

SEQ ID NO: 73474 - DNA, 22 bp, Artificial Sequence
  Synthetic oligonucleotide; TTA chr11 5167036 5167057 5167053 5167058 +
ccatggggcttacaagaaacat

SEQ ID NO: 73475 - DNA, 22 bp, Artificial Sequence
  Synthetic oligonucleotide; CTT chr11 5167047 5167068 5167064 5167069 +
acaagaaacatcttataaatat

SEQ ID NO: 73476 - DNA, 22 bp, Artificial Sequence
  Synthetic oligonucleotide; TTA chr11 5167048 5167069 5167065 5167070 +
caagaaacatcttataaatata

SEQ ID NO: 73477 - DNA, 22 bp, Artificial Sequence
  Synthetic oligonucleotide; CTT chr11 5167061 5167082 5167078 5167083 +
ataaatatagcaagttatttta

SEQ ID NO: 73478 - DNA, 22 bp, Artificial Sequence
  Synthetic oligonucleotide; TTA chr11 5167062 5167083 5167079 5167084 +
taaatatagcaagttattttaa

SEQ ID NO: 73479 - DNA, 22 bp, Artificial Sequence
  Synthetic oligonucleotide; TTA chr11 5167078 5167099 5167095 5167100 +
ttttaaaggatgacgaattatc

SEQ ID NO: 73480 - DNA, 22 bp, Artificial Sequence
  Synthetic oligonucleotide; TTT chr11 5167081 5167102 5167098 5167103 +
taaaggatgacgaattatctta

SEQ ID NO: 73481 - DNA, 22 bp, Artificial Sequence
  Synthetic oligonucleotide; TTT chr11 5167082 5167103 5167099 5167104 +
aaaggatgacgaattatcttag

SEQ ID NO: 73482 - DNA, 22 bp, Artificial Sequence
  Synthetic oligonucleotide; TTA chr11 5167083 5167104 5167100 5167105 +
aaggatgacgaattatcttaga

SEQ ID NO: 73483 - DNA, 22 bp, Artificial Sequence
  Synthetic oligonucleotide; TTA chr11 5167098 5167119 5167115 5167120 +
tcttagatcgcaaataaaggaa

SEQ ID NO: 73484 - DNA, 22 bp, Artificial Sequence
  Synthetic oligonucleotide; CTT chr11 5167102 5167123 5167119 5167124 +
agatcgcaaataaaggaatata

SEQ ID NO: 73485 - DNA, 22 bp, Artificial Sequence
  Synthetic oligonucleotide; TTA chr11 5167103 5167124 5167120 5167125 +
gatcgcaaataaaggaatataa

SEQ ID NO: 73486 - DNA, 22 bp, Artificial Sequence
  Synthetic oligonucleotide; TTC chr11 5167153 5167174 5167170 5167175 +
tacactttaactccactccacc

SEQ ID NO: 73487 - DNA, 22 bp, Artificial Sequence
  Synthetic oligonucleotide; CTA chr11 5167155 5167176 5167172 5167177 +
cactttaactccactccacccc

SEQ ID NO: 73488 - DNA, 22 bp, Artificial Sequence
  Synthetic oligonucleotide; CTT chr11 5167160 5167181 5167177 5167182 +
taactccactccacccccacat

SEQ ID NO: 73489 - DNA, 22 bp, Artificial Sequence
  Synthetic oligonucleotide; TTT chr11 5167161 5167182 5167178 5167183 +
aactccactccacccccacatt

SEQ ID NO: 73490 - DNA, 22 bp, Artificial Sequence
  Synthetic oligonucleotide; TTA chr11 5167162 5167183 5167179 5167184 +
actccactccacccccacattt

SEQ ID NO: 73491 - DNA, 22 bp, Artificial Sequence
  Synthetic oligonucleotide; CTC chr11 5167166 5167187 5167183 5167188 +
cactccacccccacattttgac

SEQ ID NO: 73492 - DNA, 22 bp, Artificial Sequence
  Synthetic oligonucleotide; CTC chr11 5167171 5167192 5167188 5167193 +
cacccccacattttgacttttg

SEQ ID NO: 73493 - DNA, 22 bp, Artificial Sequence
  Synthetic oligonucleotide; TTT chr11 5167184 5167205 5167201 5167206 +
tgacttttgtctcattttacat

SEQ ID NO: 73494 - DNA, 22 bp, Artificial Sequence
  Synthetic oligonucleotide; TTT chr11 5167185 5167206 5167202 5167207 +
gacttttgtctcattttacata

SEQ ID NO: 73495 - DNA, 22 bp, Artificial Sequence
  Synthetic oligonucleotide; TTG chr11 5167186 5167207 5167203 5167208 +
acttttgtctcattttacatat

SEQ ID NO: 73496 - DNA, 22 bp, Artificial Sequence
  Synthetic oligonucleotide; CTT chr11 5167190 5167211 5167207 5167212 +
ttgtctcattttacatatttta

SEQ ID NO: 73497 - DNA, 22 bp, Artificial Sequence
  Synthetic oligonucleotide; TTT chr11 5167191 5167212 5167208 5167213 +
tgtctcattttacatattttat

SEQ ID NO: 73498 - DNA, 22 bp, Artificial Sequence
  Synthetic oligonucleotide; TTT chr11 5167192 5167213 5167209 5167214 +
gtctcattttacatattttata

SEQ ID NO: 73499 - DNA, 22 bp, Artificial Sequence
  Synthetic oligonucleotide; TTG chr11 5167193 5167214 5167210 5167215 +
tctcattttacatattttatat

SEQ ID NO: 73500 - DNA, 22 bp, Artificial Sequence
  Synthetic oligonucleotide; CTC chr11 5167197 5167218 5167214 5167219 +
attttacatattttatattacc

SEQ ID NO: 73501 - DNA, 22 bp, Artificial Sequence
  Synthetic oligonucleotide; TTT chr11 5167201 5167222 5167218 5167223 +
tacatattttatattacctaca

SEQ ID NO: 73502 - DNA, 22 bp, Artificial Sequence
  Synthetic oligonucleotide; TTT chr11 5167202 5167223 5167219 5167224 +
acatattttatattacctacat

SEQ ID NO: 73503 - DNA, 22 bp, Artificial Sequence
  Synthetic oligonucleotide; TTA chr11 5167203 5167224 5167220 5167225 +
catattttatattacctacatc

SEQ ID NO: 73504 - DNA, 22 bp, Artificial Sequence
  Synthetic oligonucleotide; TTT chr11 5167210 5167231 5167227 5167232 +
tatattacctacatcttaaaag

SEQ ID NO: 73505 - DNA, 22 bp, Artificial Sequence
  Synthetic oligonucleotide; TTT chr11 5167211 5167232 5167228 5167233 +
atattacctacatcttaaaagg

SEQ ID NO: 73506 - DNA, 22 bp, Artificial Sequence
  Synthetic oligonucleotide; TTA chr11 5167212 5167233 5167229 5167234 +
tattacctacatcttaaaaggt

SEQ ID NO: 73507 - DNA, 22 bp, Artificial Sequence
  Synthetic oligonucleotide; TTA chr11 5167217 5167238 5167234 5167239 +
cctacatcttaaaaggttgcta

SEQ ID NO: 73508 - DNA, 22 bp, Artificial Sequence
  Synthetic oligonucleotide; CTA chr11 5167221 5167242 5167238 5167243 +
catcttaaaaggttgctatagc

SEQ ID NO: 73509 - DNA, 22 bp, Artificial Sequence
  Synthetic oligonucleotide; CTT chr11 5167227 5167248 5167244 5167249 +
aaaaggttgctatagctattac

SEQ ID NO: 73510 - DNA, 22 bp, Artificial Sequence
  Synthetic oligonucleotide; TTA chr11 5167228 5167249 5167245 5167250 +
aaaggttgctatagctattact

SEQ ID NO: 73511 - DNA, 22 bp, Artificial Sequence
  Synthetic oligonucleotide; TTG chr11 5167236 5167257 5167253 5167258 +
ctatagctattactgtttttga

SEQ ID NO: 73512 - DNA, 22 bp, Artificial Sequence
  Synthetic oligonucleotide; CTA chr11 5167239 5167260 5167256 5167261 +
tagctattactgtttttgaaag

SEQ ID NO: 73513 - DNA, 22 bp, Artificial Sequence
  Synthetic oligonucleotide; CTA chr11 5167245 5167266 5167262 5167267 +
ttactgtttttgaaagatttgt

SEQ ID NO: 73514 - DNA, 22 bp, Artificial Sequence
  Synthetic oligonucleotide; TTA chr11 5167248 5167269 5167265 5167270 +
ctgtttttgaaagatttgtttt

SEQ ID NO: 73515 - DNA, 22 bp, Artificial Sequence
  Synthetic oligonucleotide; CTG chr11 5167251 5167272 5167268 5167273 +
tttttgaaagatttgttttttg

SEQ ID NO: 73516 - DNA, 22 bp, Artificial Sequence
  Synthetic oligonucleotide; TTT chr11 5167254 5167275 5167271 5167276 +
ttgaaagatttgttttttgggt

SEQ ID NO: 73517 - DNA, 22 bp, Artificial Sequence
  Synthetic oligonucleotide; TTT chr11 5167255 5167276 5167272 5167277 +
tgaaagatttgttttttgggtt

SEQ ID NO: 73518 - DNA, 22 bp, Artificial Sequence
  Synthetic oligonucleotide; TTT chr11 5167256 5167277 5167273 5167278 +
gaaagatttgttttttgggttt

SEQ ID NO: 73519 - DNA, 22 bp, Artificial Sequence
  Synthetic oligonucleotide; TTG chr11 5167257 5167278 5167274 5167279 +
aaagatttgttttttgggtttc

SEQ ID NO: 73520 - DNA, 22 bp, Artificial Sequence
  Synthetic oligonucleotide; TTT chr11 5167265 5167286 5167282 5167287 +
gttttttgggtttcatactgga

SEQ ID NO: 73521 - DNA, 22 bp, Artificial Sequence
  Synthetic oligonucleotide; TTG chr11 5167266 5167287 5167283 5167288 +
ttttttgggtttcatactggag

SEQ ID NO: 73522 - DNA, 22 bp, Artificial Sequence
  Synthetic oligonucleotide; TTT chr11 5167269 5167290 5167286 5167291 +
tttgggtttcatactggagttc

SEQ ID NO: 73523 - DNA, 22 bp, Artificial Sequence
  Synthetic oligonucleotide; TTT chr11 5167270 5167291 5167287 5167292 +
ttgggtttcatactggagttct

SEQ ID NO: 73524 - DNA, 22 bp, Artificial Sequence
  Synthetic oligonucleotide; TTT chr11 5167271 5167292 5167288 5167293 +
tgggtttcatactggagttctg

SEQ ID NO: 73525 - DNA, 22 bp, Artificial Sequence
  Synthetic oligonucleotide; TTT chr11 5167272 5167293 5167289 5167294 +
gggtttcatactggagttctgt

SEQ ID NO: 73526 - DNA, 22 bp, Artificial Sequence
  Synthetic oligonucleotide; TTG chr11 5167273 5167294 5167290 5167295 +
ggtttcatactggagttctgtg

SEQ ID NO: 73527 - DNA, 22 bp, Artificial Sequence
  Synthetic oligonucleotide; TTT chr11 5167278 5167299 5167295 5167300 +
catactggagttctgtgtggat

SEQ ID NO: 73528 - DNA, 22 bp, Artificial Sequence
  Synthetic oligonucleotide; TTC chr11 5167279 5167300 5167296 5167301 +
atactggagttctgtgtggatt

SEQ ID NO: 73529 - DNA, 22 bp, Artificial Sequence
  Synthetic oligonucleotide; CTG chr11 5167285 5167306 5167302 5167307 +
gagttctgtgtggattgcacac

SEQ ID NO: 73530 - DNA, 22 bp, Artificial Sequence
  Synthetic oligonucleotide; TTC chr11 5167291 5167312 5167308 5167313 +
tgtgtggattgcacaccaaaaa

SEQ ID NO: 73531 - DNA, 22 bp, Artificial Sequence
  Synthetic oligonucleotide; CTG chr11 5167293 5167314 5167310 5167315 +
tgtggattgcacaccaaaaaat

SEQ ID NO: 73532 - DNA, 22 bp, Artificial Sequence
  Synthetic oligonucleotide; TTG chr11 5167302 5167323 5167319 5167324 +
cacaccaaaaaatacagtaatg

SEQ ID NO: 73533 - DNA, 22 bp, Artificial Sequence
  Synthetic oligonucleotide; TTC chr11 5167332 5167353 5167349 5167354 +
taggtttgtctatgtacttaat

SEQ ID NO: 73534 - DNA, 22 bp, Artificial Sequence
  Synthetic oligonucleotide; CTA chr11 5167334 5167355 5167351 5167356 +
ggtttgtctatgtacttaattt

SEQ ID NO: 73535 - DNA, 22 bp, Artificial Sequence
  Synthetic oligonucleotide; TTT chr11 5167339 5167360 5167356 5167361 +
gtctatgtacttaattttacca

SEQ ID NO: 73536 - DNA, 22 bp, Artificial Sequence
  Synthetic oligonucleotide; TTG chr11 5167340 5167361 5167357 5167362 +
tctatgtacttaattttaccag

SEQ ID NO: 73537 - DNA, 22 bp, Artificial Sequence
  Synthetic oligonucleotide; CTA chr11 5167344 5167365 5167361 5167366 +
tgtacttaattttaccagtggg

SEQ ID NO: 73538 - DNA, 22 bp, Artificial Sequence
  Synthetic oligonucleotide; CTT chr11 5167351 5167372 5167368 5167373 +
aattttaccagtgggtttcata

SEQ ID NO: 73539 - DNA, 22 bp, Artificial Sequence
  Synthetic oligonucleotide; TTA chr11 5167352 5167373 5167369 5167374 +
attttaccagtgggtttcatac

SEQ ID NO: 73540 - DNA, 22 bp, Artificial Sequence
  Synthetic oligonucleotide; TTT chr11 5167356 5167377 5167373 5167378 +
taccagtgggtttcatactttg

SEQ ID NO: 73541 - DNA, 22 bp, Artificial Sequence
  Synthetic oligonucleotide; TTT chr11 5167357 5167378 5167374 5167379 +
accagtgggtttcatactttga

SEQ ID NO: 73542 - DNA, 22 bp, Artificial Sequence
  Synthetic oligonucleotide; TTA chr11 5167358 5167379 5167375 5167380 +
ccagtgggtttcatactttgaa

SEQ ID NO: 73543 - DNA, 22 bp, Artificial Sequence
  Synthetic oligonucleotide; TTT chr11 5167369 5167390 5167386 5167391 +
catactttgaaaagttttcttt

SEQ ID NO: 73544 - DNA, 22 bp, Artificial Sequence
  Synthetic oligonucleotide; TTC chr11 5167370 5167391 5167387 5167392 +
atactttgaaaagttttctttt

SEQ ID NO: 73545 - DNA, 22 bp, Artificial Sequence
  Synthetic oligonucleotide; CTT chr11 5167376 5167397 5167393 5167398 +
tgaaaagttttcttttgcatgt

SEQ ID NO: 73546 - DNA, 22 bp, Artificial Sequence
  Synthetic oligonucleotide; TTT chr11 5167377 5167398 5167394 5167399 +
gaaaagttttcttttgcatgtt

SEQ ID NO: 73547 - DNA, 22 bp, Artificial Sequence
  Synthetic oligonucleotide; TTG chr11 5167378 5167399 5167395 5167400 +
aaaagttttcttttgcatgtta

SEQ ID NO: 73548 - DNA, 22 bp, Artificial Sequence
  Synthetic oligonucleotide; TTT chr11 5167386 5167407 5167403 5167408 +
tcttttgcatgttaatgtcttt

SEQ ID NO: 73549 - DNA, 22 bp, Artificial Sequence
  Synthetic oligonucleotide; TTT chr11 5167387 5167408 5167404 5167409 +
cttttgcatgttaatgtctttt

SEQ ID NO: 73550 - DNA, 22 bp, Artificial Sequence
  Synthetic oligonucleotide; TTC chr11 5167388 5167409 5167405 5167410 +
ttttgcatgttaatgtcttttt

SEQ ID NO: 73551 - DNA, 22 bp, Artificial Sequence
  Synthetic oligonucleotide; CTT chr11 5167390 5167411 5167407 5167412 +
ttgcatgttaatgtcttttttc

SEQ ID NO: 73552 - DNA, 22 bp, Artificial Sequence
  Synthetic oligonucleotide; TTT chr11 5167391 5167412 5167408 5167413 +
tgcatgttaatgtcttttttct

SEQ ID NO: 73553 - DNA, 22 bp, Artificial Sequence
  Synthetic oligonucleotide; TTT chr11 5167392 5167413 5167409 5167414 +
gcatgttaatgtcttttttctt

SEQ ID NO: 73554 - DNA, 22 bp, Artificial Sequence
  Synthetic oligonucleotide; TTG chr11 5167393 5167414 5167410 5167415 +
catgttaatgtcttttttcttt

SEQ ID NO: 73555 - DNA, 22 bp, Artificial Sequence
  Synthetic oligonucleotide; TTA chr11 5167400 5167421 5167417 5167422 +
atgtcttttttctttcagattg

SEQ ID NO: 73556 - DNA, 22 bp, Artificial Sequence
  Synthetic oligonucleotide; CTT chr11 5167407 5167428 5167424 5167429 +
ttttctttcagattgcataact

SEQ ID NO: 73557 - DNA, 22 bp, Artificial Sequence
  Synthetic oligonucleotide; TTT chr11 5167408 5167429 5167425 5167430 +
tttctttcagattgcataactc

SEQ ID NO: 73558 - DNA, 22 bp, Artificial Sequence
  Synthetic oligonucleotide; TTT chr11 5167409 5167430 5167426 5167431 +
ttctttcagattgcataactcc

SEQ ID NO: 73559 - DNA, 22 bp, Artificial Sequence
  Synthetic oligonucleotide; TTT chr11 5167410 5167431 5167427 5167432 +
tctttcagattgcataactccc

SEQ ID NO: 73560 - DNA, 22 bp, Artificial Sequence
  Synthetic oligonucleotide; TTT chr11 5167411 5167432 5167428 5167433 +
ctttcagattgcataactccct

SEQ ID NO: 73561 - DNA, 22 bp, Artificial Sequence
  Synthetic oligonucleotide; TTC chr11 5167412 5167433 5167429 5167434 +
tttcagattgcataactccctt

SEQ ID NO: 73562 - DNA, 22 bp, Artificial Sequence
  Synthetic oligonucleotide; CTT chr11 5167414 5167435 5167431 5167436 +
tcagattgcataactcccttta

SEQ ID NO: 73563 - DNA, 22 bp, Artificial Sequence
  Synthetic oligonucleotide; TTT chr11 5167415 5167436 5167432 5167437 +
cagattgcataactccctttag

SEQ ID NO: 73564 - DNA, 22 bp, Artificial Sequence
  Synthetic oligonucleotide; TTC chr11 5167416 5167437 5167433 5167438 +
agattgcataactccctttagc

SEQ ID NO: 73565 - DNA, 22 bp, Artificial Sequence
  Synthetic oligonucleotide; TTG chr11 5167422 5167443 5167439 5167444 +
cataactccctttagcattttt

SEQ ID NO: 73566 - DNA, 22 bp, Artificial Sequence
  Synthetic oligonucleotide; CTC chr11 5167430 5167451 5167447 5167452 +
cctttagcattttttgcaagat

SEQ ID NO: 73567 - DNA, 22 bp, Artificial Sequence
  Synthetic oligonucleotide; CTT chr11 5167434 5167455 5167451 5167456 +
tagcattttttgcaagatggtc

SEQ ID NO: 73568 - DNA, 22 bp, Artificial Sequence
  Synthetic oligonucleotide; TTT chr11 5167435 5167456 5167452 5167457 +
agcattttttgcaagatggtct

SEQ ID NO: 73569 - DNA, 22 bp, Artificial Sequence
  Synthetic oligonucleotide; TTA chr11 5167436 5167457 5167453 5167458 +
gcattttttgcaagatggtctg

SEQ ID NO: 73570 - DNA, 22 bp, Artificial Sequence
  Synthetic oligonucleotide; TTT chr11 5167442 5167463 5167459 5167464 +
tttgcaagatggtctggtgttg

SEQ ID NO: 73571 - DNA, 22 bp, Artificial Sequence
  Synthetic oligonucleotide; TTT chr11 5167443 5167464 5167460 5167465 +
ttgcaagatggtctggtgttgg

SEQ ID NO: 73572 - DNA, 22 bp, Artificial Sequence
  Synthetic oligonucleotide; TTT chr11 5167444 5167465 5167461 5167466 +
tgcaagatggtctggtgttggt

SEQ ID NO: 73573 - DNA, 22 bp, Artificial Sequence
  Synthetic oligonucleotide; TTT chr11 5167445 5167466 5167462 5167467 +
gcaagatggtctggtgttggtg

SEQ ID NO: 73574 - DNA, 22 bp, Artificial Sequence
  Synthetic oligonucleotide; TTG chr11 5167446 5167467 5167463 5167468 +
caagatggtctggtgttggtga

SEQ ID NO: 73575 - DNA, 22 bp, Artificial Sequence
  Synthetic oligonucleotide; CTG chr11 5167458 5167479 5167475 5167480 +
gtgttggtgaattctctcaact

SEQ ID NO: 73576 - DNA, 22 bp, Artificial Sequence
  Synthetic oligonucleotide; TTG chr11 5167464 5167485 5167481 5167486 +
gtgaattctctcaacttttgtt

SEQ ID NO: 73577 - DNA, 22 bp, Artificial Sequence
  Synthetic oligonucleotide; TTC chr11 5167472 5167493 5167489 5167494 +
tctcaacttttgtttgtctggg

SEQ ID NO: 73578 - DNA, 22 bp, Artificial Sequence
  Synthetic oligonucleotide; CTC chr11 5167474 5167495 5167491 5167496 +
tcaacttttgtttgtctgggaa

SEQ ID NO: 73579 - DNA, 22 bp, Artificial Sequence
  Synthetic oligonucleotide; CTC chr11 5167476 5167497 5167493 5167498 +
aacttttgtttgtctgggaaag

SEQ ID NO: 73580 - DNA, 22 bp, Artificial Sequence
  Synthetic oligonucleotide; CTT chr11 5167481 5167502 5167498 5167503 +
ttgtttgtctgggaaagacttt

SEQ ID NO: 73581 - DNA, 22 bp, Artificial Sequence
  Synthetic oligonucleotide; TTT chr11 5167482 5167503 5167499 5167504 +
tgtttgtctgggaaagacttta

SEQ ID NO: 73582 - DNA, 22 bp, Artificial Sequence
  Synthetic oligonucleotide; TTT chr11 5167483 5167504 5167500 5167505 +
gtttgtctgggaaagactttat

SEQ ID NO: 73583 - DNA, 22 bp, Artificial Sequence
  Synthetic oligonucleotide; TTG chr11 5167484 5167505 5167501 5167506 +
tttgtctgggaaagactttata

SEQ ID NO: 73584 - DNA, 22 bp, Artificial Sequence
  Synthetic oligonucleotide; TTT chr11 5167487 5167508 5167504 5167509 +
gtctgggaaagactttatatat

SEQ ID NO: 73585 - DNA, 22 bp, Artificial Sequence
  Synthetic oligonucleotide; TTG chr11 5167488 5167509 5167505 5167510 +
tctgggaaagactttatatatt

SEQ ID NO: 73586 - DNA, 22 bp, Artificial Sequence
  Synthetic oligonucleotide; CTG chr11 5167492 5167513 5167509 5167514 +
ggaaagactttatatattgctt

SEQ ID NO: 73587 - DNA, 22 bp, Artificial Sequence
  Synthetic oligonucleotide; CTT chr11 5167502 5167523 5167519 5167524 +
tatatattgcttatatttgaat

SEQ ID NO: 73588 - DNA, 22 bp, Artificial Sequence
  Synthetic oligonucleotide; TTT chr11 5167503 5167524 5167520 5167525 +
atatattgcttatatttgaata

SEQ ID NO: 73589 - DNA, 22 bp, Artificial Sequence
  Synthetic oligonucleotide; TTA chr11 5167504 5167525 5167521 5167526 +
tatattgcttatatttgaataa

SEQ ID NO: 73590 - DNA, 22 bp, Artificial Sequence
  Synthetic oligonucleotide; TTG chr11 5167511 5167532 5167528 5167533 +
cttatatttgaataacagtttt

SEQ ID NO: 73591 - DNA, 22 bp, Artificial Sequence
  Synthetic oligonucleotide; CTT chr11 5167514 5167535 5167531 5167536 +
atatttgaataacagttttacc

SEQ ID NO: 73592 - DNA, 22 bp, Artificial Sequence
  Synthetic oligonucleotide; TTA chr11 5167515 5167536 5167532 5167537 +
tatttgaataacagttttaccc

SEQ ID NO: 73593 - DNA, 22 bp, Artificial Sequence
  Synthetic oligonucleotide; TTT chr11 5167520 5167541 5167537 5167542 +
gaataacagttttaccctataa

SEQ ID NO: 73594 - DNA, 22 bp, Artificial Sequence
  Synthetic oligonucleotide; TTG chr11 5167521 5167542 5167538 5167543 +
aataacagttttaccctataaa

SEQ ID NO: 73595 - DNA, 22 bp, Artificial Sequence
  Synthetic oligonucleotide; TTT chr11 5167532 5167553 5167549 5167554 +
taccctataaaatattcttgaa

SEQ ID NO: 73596 - DNA, 22 bp, Artificial Sequence
  Synthetic oligonucleotide; TTT chr11 5167533 5167554 5167550 5167555 +
accctataaaatattcttgaat

SEQ ID NO: 73597 - DNA, 22 bp, Artificial Sequence
  Synthetic oligonucleotide; TTA chr11 5167534 5167555 5167551 5167556 +
ccctataaaatattcttgaata

SEQ ID NO: 73598 - DNA, 22 bp, Artificial Sequence
  Synthetic oligonucleotide; CTA chr11 5167539 5167560 5167556 5167561 +
taaaatattcttgaatatcagt

SEQ ID NO: 73599 - DNA, 22 bp, Artificial Sequence
  Synthetic oligonucleotide; TTC chr11 5167549 5167570 5167566 5167571 +
ttgaatatcagttttcttttat

SEQ ID NO: 73600 - DNA, 22 bp, Artificial Sequence
  Synthetic oligonucleotide; CTT chr11 5167551 5167572 5167568 5167573 +
gaatatcagttttcttttatcc

SEQ ID NO: 73601 - DNA, 22 bp, Artificial Sequence
  Synthetic oligonucleotide; TTG chr11 5167552 5167573 5167569 5167574 +
aatatcagttttcttttatccc

SEQ ID NO: 73602 - DNA, 22 bp, Artificial Sequence
  Synthetic oligonucleotide; TTT chr11 5167563 5167584 5167580 5167585 +
tcttttatccctgagcgctttg

SEQ ID NO: 73603 - DNA, 22 bp, Artificial Sequence
  Synthetic oligonucleotide; TTT chr11 5167564 5167585 5167581 5167586 +
cttttatccctgagcgctttga

SEQ ID NO: 73604 - DNA, 22 bp, Artificial Sequence
  Synthetic oligonucleotide; TTC chr11 5167565 5167586 5167582 5167587 +
ttttatccctgagcgctttgaa

SEQ ID NO: 73605 - DNA, 22 bp, Artificial Sequence
  Synthetic oligonucleotide; CTT chr11 5167567 5167588 5167584 5167589 +
ttatccctgagcgctttgaaaa

SEQ ID NO: 73606 - DNA, 22 bp, Artificial Sequence
  Synthetic oligonucleotide; TTT chr11 5167568 5167589 5167585 5167590 +
tatccctgagcgctttgaaaat

SEQ ID NO: 73607 - DNA, 22 bp, Artificial Sequence
  Synthetic oligonucleotide; TTT chr11 5167569 5167590 5167586 5167591 +
atccctgagcgctttgaaaatt

SEQ ID NO: 73608 - DNA, 22 bp, Artificial Sequence
  Synthetic oligonucleotide; TTA chr11 5167570 5167591 5167587 5167592 +
tccctgagcgctttgaaaattt

SEQ ID NO: 73609 - DNA, 22 bp, Artificial Sequence
  Synthetic oligonucleotide; CTG chr11 5167576 5167597 5167593 5167598 +
agcgctttgaaaatttcattcg

SEQ ID NO: 73610 - DNA, 22 bp, Artificial Sequence
  Synthetic oligonucleotide; CTT chr11 5167583 5167604 5167600 5167605 +
tgaaaatttcattcgactctct

SEQ ID NO: 73611 - DNA, 22 bp, Artificial Sequence
  Synthetic oligonucleotide; TTT chr11 5167584 5167605 5167601 5167606 +
gaaaatttcattcgactctctc

SEQ ID NO: 73612 - DNA, 22 bp, Artificial Sequence
  Synthetic oligonucleotide; TTG chr11 5167585 5167606 5167602 5167607 +
aaaatttcattcgactctctct

SEQ ID NO: 73613 - DNA, 22 bp, Artificial Sequence
  Synthetic oligonucleotide; TTT chr11 5167592 5167613 5167609 5167614 +
cattcgactctctcttggactg

SEQ ID NO: 73614 - DNA, 22 bp, Artificial Sequence
  Synthetic oligonucleotide; TTC chr11 5167593 5167614 5167610 5167615 +
attcgactctctcttggactgt

SEQ ID NO: 73615 - DNA, 22 bp, Artificial Sequence
  Synthetic oligonucleotide; TTC chr11 5167597 5167618 5167614 5167619 +
gactctctcttggactgtgtga

SEQ ID NO: 73616 - DNA, 22 bp, Artificial Sequence
  Synthetic oligonucleotide; CTC chr11 5167602 5167623 5167619 5167624 +
tctcttggactgtgtgatttct

SEQ ID NO: 73617 - DNA, 22 bp, Artificial Sequence
  Synthetic oligonucleotide; CTC chr11 5167604 5167625 5167621 5167626 +
tcttggactgtgtgatttctat

SEQ ID NO: 73618 - DNA, 22 bp, Artificial Sequence
  Synthetic oligonucleotide; CTC chr11 5167606 5167627 5167623 5167628 +
ttggactgtgtgatttctattg

SEQ ID NO: 73619 - DNA, 22 bp, Artificial Sequence
  Synthetic oligonucleotide; CTT chr11 5167608 5167629 5167625 5167630 +
ggactgtgtgatttctattgag

SEQ ID NO: 73620 - DNA, 22 bp, Artificial Sequence
  Synthetic oligonucleotide; TTG chr11 5167609 5167630 5167626 5167631 +
gactgtgtgatttctattgaga

SEQ ID NO: 73621 - DNA, 22 bp, Artificial Sequence
  Synthetic oligonucleotide; CTG chr11 5167614 5167635 5167631 5167636 +
tgtgatttctattgagatgttt

SEQ ID NO: 73622 - DNA, 22 bp, Artificial Sequence
  Synthetic oligonucleotide; TTT chr11 5167622 5167643 5167639 5167644 +
ctattgagatgtttgttgtcac

SEQ ID NO: 73623 - DNA, 22 bp, Artificial Sequence
  Synthetic oligonucleotide; TTC chr11 5167623 5167644 5167640 5167645 +
tattgagatgtttgttgtcaca

SEQ ID NO: 73624 - DNA, 22 bp, Artificial Sequence
  Synthetic oligonucleotide; CTA chr11 5167625 5167646 5167642 5167647 +
ttgagatgtttgttgtcacagg

SEQ ID NO: 73625 - DNA, 22 bp, Artificial Sequence
  Synthetic oligonucleotide; TTG chr11 5167628 5167649 5167645 5167650 +
agatgtttgttgtcacaggatt

SEQ ID NO: 73626 - DNA, 22 bp, Artificial Sequence
  Synthetic oligonucleotide; TTT chr11 5167636 5167657 5167653 5167658 +
gttgtcacaggatttggagctc

SEQ ID NO: 73627 - DNA, 22 bp, Artificial Sequence
  Synthetic oligonucleotide; TTG chr11 5167637 5167658 5167654 5167659 +
ttgtcacaggatttggagctcc

SEQ ID NO: 73628 - DNA, 22 bp, Artificial Sequence
  Synthetic oligonucleotide; TTG chr11 5167640 5167661 5167657 5167662 +
tcacaggatttggagctccttt

SEQ ID NO: 73629 - DNA, 22 bp, Artificial Sequence
  Synthetic oligonucleotide; TTT chr11 5167651 5167672 5167668 5167673 +
ggagctcctttatatgctattt

SEQ ID NO: 73630 - DNA, 22 bp, Artificial Sequence
  Synthetic oligonucleotide; TTG chr11 5167652 5167673 5167669 5167674 +
gagctcctttatatgctatttg

SEQ ID NO: 73631 - DNA, 22 bp, Artificial Sequence
  Synthetic oligonucleotide; CTC chr11 5167658 5167679 5167675 5167680 +
ctttatatgctatttgtttctc

SEQ ID NO: 73632 - DNA, 22 bp, Artificial Sequence
  Synthetic oligonucleotide; CTT chr11 5167661 5167682 5167678 5167683 +
tatatgctatttgtttctcatc

SEQ ID NO: 73633 - DNA, 22 bp, Artificial Sequence
  Synthetic oligonucleotide; TTT chr11 5167662 5167683 5167679 5167684 +
atatgctatttgtttctcatct

SEQ ID NO: 73634 - DNA, 22 bp, Artificial Sequence
  Synthetic oligonucleotide; TTA chr11 5167663 5167684 5167680 5167685 +
tatgctatttgtttctcatctc

SEQ ID NO: 73635 - DNA, 22 bp, Artificial Sequence
  Synthetic oligonucleotide; CTA chr11 5167670 5167691 5167687 5167692 +
tttgtttctcatctcttctgct

SEQ ID NO: 73636 - DNA, 22 bp, Artificial Sequence
  Synthetic oligonucleotide; TTT chr11 5167673 5167694 5167690 5167695 +
gtttctcatctcttctgctttt

SEQ ID NO: 73637 - DNA, 22 bp, Artificial Sequence
  Synthetic oligonucleotide; TTG chr11 5167674 5167695 5167691 5167696 +
tttctcatctcttctgctttta

SEQ ID NO: 73638 - DNA, 22 bp, Artificial Sequence
  Synthetic oligonucleotide; TTT chr11 5167677 5167698 5167694 5167699 +
ctcatctcttctgcttttagga

SEQ ID NO: 73639 - DNA, 22 bp, Artificial Sequence
  Synthetic oligonucleotide; TTC chr11 5167678 5167699 5167695 5167700 +
tcatctcttctgcttttaggat

SEQ ID NO: 73640 - DNA, 22 bp, Artificial Sequence
  Synthetic oligonucleotide; CTC chr11 5167680 5167701 5167697 5167702 +
atctcttctgcttttaggatca

SEQ ID NO: 73641 - DNA, 22 bp, Artificial Sequence
  Synthetic oligonucleotide; CTC chr11 5167685 5167706 5167702 5167707 +
ttctgcttttaggatcatcttt

SEQ ID NO: 73642 - DNA, 22 bp, Artificial Sequence
  Synthetic oligonucleotide; CTT chr11 5167687 5167708 5167704 5167709 +
ctgcttttaggatcatcttttt

SEQ ID NO: 73643 - DNA, 22 bp, Artificial Sequence
  Synthetic oligonucleotide; TTC chr11 5167688 5167709 5167705 5167710 +
tgcttttaggatcatctttttg

SEQ ID NO: 73644 - DNA, 22 bp, Artificial Sequence
  Synthetic oligonucleotide; CTG chr11 5167690 5167711 5167707 5167712 +
cttttaggatcatctttttgtc

SEQ ID NO: 73645 - DNA, 22 bp, Artificial Sequence
  Synthetic oligonucleotide; CTT chr11 5167693 5167714 5167710 5167715 +
ttaggatcatctttttgtcctt

SEQ ID NO: 73646 - DNA, 22 bp, Artificial Sequence
  Synthetic oligonucleotide; TTT chr11 5167694 5167715 5167711 5167716 +
taggatcatctttttgtccttg

SEQ ID NO: 73647 - DNA, 22 bp, Artificial Sequence
  Synthetic oligonucleotide; TTT chr11 5167695 5167716 5167712 5167717 +
aggatcatctttttgtccttga

SEQ ID NO: 73648 - DNA, 22 bp, Artificial Sequence
  Synthetic oligonucleotide; TTA chr11 5167696 5167717 5167713 5167718 +
ggatcatctttttgtccttgac

SEQ ID NO: 73649 - DNA, 22 bp, Artificial Sequence
  Synthetic oligonucleotide; CTT chr11 5167706 5167727 5167723 5167728 +
tttgtccttgacctgatgtctt

SEQ ID NO: 73650 - DNA, 22 bp, Artificial Sequence
  Synthetic oligonucleotide; TTT chr11 5167707 5167728 5167724 5167729 +
ttgtccttgacctgatgtcttg

SEQ ID NO: 73651 - DNA, 22 bp, Artificial Sequence
  Synthetic oligonucleotide; TTT chr11 5167708 5167729 5167725 5167730 +
tgtccttgacctgatgtcttgg

SEQ ID NO: 73652 - DNA, 22 bp, Artificial Sequence
  Synthetic oligonucleotide; TTT chr11 5167709 5167730 5167726 5167731 +
gtccttgacctgatgtcttggc

SEQ ID NO: 73653 - DNA, 22 bp, Artificial Sequence
  Synthetic oligonucleotide; TTG chr11 5167710 5167731 5167727 5167732 +
tccttgacctgatgtcttggcg

SEQ ID NO: 73654 - DNA, 22 bp, Artificial Sequence
  Synthetic oligonucleotide; CTT chr11 5167715 5167736 5167732 5167737 +
gacctgatgtcttggcgtagta

SEQ ID NO: 73655 - DNA, 22 bp, Artificial Sequence
  Synthetic oligonucleotide; TTG chr11 5167716 5167737 5167733 5167738 +
acctgatgtcttggcgtagtac

SEQ ID NO: 73656 - DNA, 22 bp, Artificial Sequence
  Synthetic oligonucleotide; CTG chr11 5167721 5167742 5167738 5167743 +
atgtcttggcgtagtactctac

SEQ ID NO: 73657 - DNA, 22 bp, Artificial Sequence
  Synthetic oligonucleotide; CTT chr11 5167728 5167749 5167745 5167750 +
ggcgtagtactctactatatct

SEQ ID NO: 73658 - DNA, 22 bp, Artificial Sequence
  Synthetic oligonucleotide; TTG chr11 5167729 5167750 5167746 5167751 +
gcgtagtactctactatatcta

SEQ ID NO: 73659 - DNA, 22 bp, Artificial Sequence
  Synthetic oligonucleotide; CTC chr11 5167740 5167761 5167757 5167762 +
tactatatctaggactacactt

SEQ ID NO: 73660 - DNA, 22 bp, Artificial Sequence
  Synthetic oligonucleotide; CTA chr11 5167742 5167763 5167759 5167764 +
ctatatctaggactacacttag

SEQ ID NO: 73661 - DNA, 22 bp, Artificial Sequence
  Synthetic oligonucleotide; CTA chr11 5167745 5167766 5167762 5167767 +
tatctaggactacacttagaat

SEQ ID NO: 73662 - DNA, 22 bp, Artificial Sequence
  Synthetic oligonucleotide; CTA chr11 5167751 5167772 5167768 5167773 +
ggactacacttagaatgaataa

SEQ ID NO: 73663 - DNA, 22 bp, Artificial Sequence
  Synthetic oligonucleotide; CTA chr11 5167757 5167778 5167774 5167779 +
cacttagaatgaataatatgta

SEQ ID NO: 73664 - DNA, 22 bp, Artificial Sequence
  Synthetic oligonucleotide; CTT chr11 5167762 5167783 5167779 5167784 +
agaatgaataatatgtaataaa

SEQ ID NO: 73665 - DNA, 22 bp, Artificial Sequence
  Synthetic oligonucleotide; TTA chr11 5167763 5167784 5167780 5167785 +
gaatgaataatatgtaataaaa

SEQ ID NO: 73666 - DNA, 22 bp, Artificial Sequence
  Synthetic oligonucleotide; TTG chr11 5167807 5167828 5167824 5167829 +
ctggcttaaaaagtatttattt

SEQ ID NO: 73667 - DNA, 22 bp, Artificial Sequence
  Synthetic oligonucleotide; CTG chr11 5167810 5167831 5167827 5167832 +
gcttaaaaagtatttatttatt

SEQ ID NO: 73668 - DNA, 22 bp, Artificial Sequence
  Synthetic oligonucleotide; CTT chr11 5167814 5167835 5167831 5167836 +
aaaaagtatttatttattgtaa

SEQ ID NO: 73669 - DNA, 22 bp, Artificial Sequence
  Synthetic oligonucleotide; TTA chr11 5167815 5167836 5167832 5167837 +
aaaagtatttatttattgtaag

SEQ ID NO: 73670 - DNA, 22 bp, Artificial Sequence
  Synthetic oligonucleotide; TTT chr11 5167825 5167846 5167842 5167847 +
atttattgtaagcataagaaaa

SEQ ID NO: 73671 - DNA, 22 bp, Artificial Sequence
  Synthetic oligonucleotide; TTA chr11 5167826 5167847 5167843 5167848 +
tttattgtaagcataagaaaat

SEQ ID NO: 73672 - DNA, 22 bp, Artificial Sequence
  Synthetic oligonucleotide; TTT chr11 5167829 5167850 5167846 5167851 +
attgtaagcataagaaaatttg

SEQ ID NO: 73673 - DNA, 22 bp, Artificial Sequence
  Synthetic oligonucleotide; TTA chr11 5167830 5167851 5167847 5167852 +
ttgtaagcataagaaaatttga

SEQ ID NO: 73674 - DNA, 22 bp, Artificial Sequence
  Synthetic oligonucleotide; TTG chr11 5167833 5167854 5167850 5167855 +
taagcataagaaaatttgaccg

SEQ ID NO: 73675 - DNA, 22 bp, Artificial Sequence
  Synthetic oligonucleotide; TTT chr11 5167850 5167871 5167867 5167872 +
gaccgatgtaatcttagatgat

SEQ ID NO: 73676 - DNA, 22 bp, Artificial Sequence
  Synthetic oligonucleotide; TTG chr11 5167851 5167872 5167868 5167873 +
accgatgtaatcttagatgata

SEQ ID NO: 73677 - DNA, 22 bp, Artificial Sequence
  Synthetic oligonucleotide; CTT chr11 5167865 5167886 5167882 5167887 +
agatgatagttctaaaagtgtt

SEQ ID NO: 73678 - DNA, 22 bp, Artificial Sequence
  Synthetic oligonucleotide; TTA chr11 5167866 5167887 5167883 5167888 +
gatgatagttctaaaagtgttg

SEQ ID NO: 73679 - DNA, 22 bp, Artificial Sequence
  Synthetic oligonucleotide; TTC chr11 5167877 5167898 5167894 5167899 +
taaaagtgttggttgaggaagt

SEQ ID NO: 73680 - DNA, 22 bp, Artificial Sequence
  Synthetic oligonucleotide; CTA chr11 5167879 5167900 5167896 5167901 +
aaagtgttggttgaggaagtag

SEQ ID NO: 73681 - DNA, 22 bp, Artificial Sequence
  Synthetic oligonucleotide; TTG chr11 5167888 5167909 5167905 5167910 +
gttgaggaagtagaagagaatc

SEQ ID NO: 73682 - DNA, 22 bp, Artificial Sequence
  Synthetic oligonucleotide; TTG chr11 5167892 5167913 5167909 5167914 +
aggaagtagaagagaatcagta

SEQ ID NO: 73683 - DNA, 22 bp, Artificial Sequence
  Synthetic oligonucleotide; CTA chr11 5167918 5167939 5167935 5167940 +
agcagttaaactaatgtgggaa

SEQ ID NO: 73684 - DNA, 22 bp, Artificial Sequence
  Synthetic oligonucleotide; TTA chr11 5167926 5167947 5167943 5167948 +
aactaatgtgggaaggcccctt

SEQ ID NO: 73685 - DNA, 22 bp, Artificial Sequence
  Synthetic oligonucleotide; CTA chr11 5167931 5167952 5167948 5167953 +
atgtgggaaggccccttttata

SEQ ID NO: 73686 - DNA, 22 bp, Artificial Sequence
  Synthetic oligonucleotide; CTT chr11 5167948 5167969 5167965 5167970 +
ttataaagatcctcttgagaaa

SEQ ID NO: 73687 - DNA, 22 bp, Artificial Sequence
  Synthetic oligonucleotide; TTT chr11 5167949 5167970 5167966 5167971 +
tataaagatcctcttgagaaaa

SEQ ID NO: 73688 - DNA, 22 bp, Artificial Sequence
  Synthetic oligonucleotide; TTT chr11 5167950 5167971 5167967 5167972 +
ataaagatcctcttgagaaaac

SEQ ID NO: 73689 - DNA, 22 bp, Artificial Sequence
  Synthetic oligonucleotide; TTA chr11 5167951 5167972 5167968 5167973 +
taaagatcctcttgagaaaacc

SEQ ID NO: 73690 - DNA, 22 bp, Artificial Sequence
  Synthetic oligonucleotide; CTC chr11 5167962 5167983 5167979 5167984 +
ttgagaaaacctttatacatta

SEQ ID NO: 73691 - DNA, 22 bp, Artificial Sequence
  Synthetic oligonucleotide; CTT chr11 5167964 5167985 5167981 5167986 +
gagaaaacctttatacattatt

SEQ ID NO: 73692 - DNA, 22 bp, Artificial Sequence
  Synthetic oligonucleotide; TTG chr11 5167965 5167986 5167982 5167987 +
agaaaacctttatacattatta

SEQ ID NO: 73693 - DNA, 22 bp, Artificial Sequence
  Synthetic oligonucleotide; CTT chr11 5167975 5167996 5167992 5167997 +
tatacattattaatatatgact

SEQ ID NO: 73694 - DNA, 22 bp, Artificial Sequence
  Synthetic oligonucleotide; TTT chr11 5167976 5167997 5167993 5167998 +
atacattattaatatatgacta

SEQ ID NO: 73695 - DNA, 22 bp, Artificial Sequence
  Synthetic oligonucleotide; TTA chr11 5167977 5167998 5167994 5167999 +
tacattattaatatatgactat

SEQ ID NO: 73696 - DNA, 22 bp, Artificial Sequence
  Synthetic oligonucleotide; TTA chr11 5167984 5168005 5168001 5168006 +
ttaatatatgactataattaga

SEQ ID NO: 73697 - DNA, 22 bp, Artificial Sequence
  Synthetic oligonucleotide; TTA chr11 5167987 5168008 5168004 5168009 +
atatatgactataattagagga

SEQ ID NO: 73698 - DNA, 22 bp, Artificial Sequence
  Synthetic oligonucleotide; CTA chr11 5167998 5168019 5168015 5168020 +
taattagaggaaacagaggtga

SEQ ID NO: 73699 - DNA, 22 bp, Artificial Sequence
  Synthetic oligonucleotide; TTA chr11 5168004 5168025 5168021 5168026 +
gaggaaacagaggtgagtgaat

SEQ ID NO: 73700 - DNA, 22 bp, Artificial Sequence
  Synthetic oligonucleotide; TTT chr11 5168028 5168049 5168045 5168050 +
tgtcctcatgaatctcaaagga

SEQ ID NO: 73701 - DNA, 22 bp, Artificial Sequence
  Synthetic oligonucleotide; TTT chr11 5168029 5168050 5168046 5168051 +
gtcctcatgaatctcaaaggag

SEQ ID NO: 73702 - DNA, 22 bp, Artificial Sequence
  Synthetic oligonucleotide; TTG chr11 5168030 5168051 5168047 5168052 +
tcctcatgaatctcaaaggaga

SEQ ID NO: 73703 - DNA, 22 bp, Artificial Sequence
  Synthetic oligonucleotide; CTC chr11 5168035 5168056 5168052 5168057 +
atgaatctcaaaggagaaaatg

SEQ ID NO: 73704 - DNA, 22 bp, Artificial Sequence
  Synthetic oligonucleotide; CTC chr11 5168044 5168065 5168061 5168066 +
aaaggagaaaatggtttacaga

SEQ ID NO: 73705 - DNA, 22 bp, Artificial Sequence
  Synthetic oligonucleotide; TTT chr11 5168061 5168082 5168078 5168083 +
acagaattgcttggtgttcttc

SEQ ID NO: 73706 - DNA, 22 bp, Artificial Sequence
  Synthetic oligonucleotide; TTA chr11 5168062 5168083 5168079 5168084 +
cagaattgcttggtgttcttca

SEQ ID NO: 73707 - DNA, 22 bp, Artificial Sequence
  Synthetic oligonucleotide; TTG chr11 5168070 5168091 5168087 5168092 +
cttggtgttcttcagattccaa

SEQ ID NO: 73708 - DNA, 22 bp, Artificial Sequence
  Synthetic oligonucleotide; CTT chr11 5168073 5168094 5168090 5168095 +
ggtgttcttcagattccaattt

SEQ ID NO: 73709 - DNA, 22 bp, Artificial Sequence
  Synthetic oligonucleotide; TTG chr11 5168074 5168095 5168091 5168096 +
gtgttcttcagattccaatttt

SEQ ID NO: 73710 - DNA, 22 bp, Artificial Sequence
  Synthetic oligonucleotide; TTC chr11 5168080 5168101 5168097 5168102 +
ttcagattccaattttaaagtc

SEQ ID NO: 73711 - DNA, 22 bp, Artificial Sequence
  Synthetic oligonucleotide; CTT chr11 5168082 5168103 5168099 5168104 +
cagattccaattttaaagtcaa

SEQ ID NO: 73712 - DNA, 22 bp, Artificial Sequence
  Synthetic oligonucleotide; TTC chr11 5168083 5168104 5168100 5168105 +
agattccaattttaaagtcaaa

SEQ ID NO: 73713 - DNA, 22 bp, Artificial Sequence
  Synthetic oligonucleotide; TTC chr11 5168089 5168110 5168106 5168111 +
caattttaaagtcaaatctgaa

SEQ ID NO: 73714 - DNA, 22 bp, Artificial Sequence
  Synthetic oligonucleotide; TTT chr11 5168095 5168116 5168112 5168117 +
taaagtcaaatctgaattttaa

SEQ ID NO: 73715 - DNA, 22 bp, Artificial Sequence
  Synthetic oligonucleotide; TTT chr11 5168096 5168117 5168113 5168118 +
aaagtcaaatctgaattttaag

SEQ ID NO: 73716 - DNA, 22 bp, Artificial Sequence
  Synthetic oligonucleotide; TTA chr11 5168097 5168118 5168114 5168119 +
aagtcaaatctgaattttaagt

SEQ ID NO: 73717 - DNA, 22 bp, Artificial Sequence
  Synthetic oligonucleotide; CTG chr11 5168109 5168130 5168126 5168131 +
aattttaagttatgggaccact

SEQ ID NO: 73718 - DNA, 22 bp, Artificial Sequence
  Synthetic oligonucleotide; TTT chr11 5168114 5168135 5168131 5168136 +
taagttatgggaccactgataa

SEQ ID NO: 73719 - DNA, 22 bp, Artificial Sequence
  Synthetic oligonucleotide; TTT chr11 5168115 5168136 5168132 5168137 +
aagttatgggaccactgataat

SEQ ID NO: 73720 - DNA, 22 bp, Artificial Sequence
  Synthetic oligonucleotide; TTA chr11 5168116 5168137 5168133 5168138 +
agttatgggaccactgataata

SEQ ID NO: 73721 - DNA, 22 bp, Artificial Sequence
  Synthetic oligonucleotide; TTA chr11 5168121 5168142 5168138 5168143 +
tgggaccactgataatatggtg

SEQ ID NO: 73722 - DNA, 22 bp, Artificial Sequence
  Synthetic oligonucleotide; CTG chr11 5168132 5168153 5168149 5168154 +
ataatatggtgggctaaagaat

SEQ ID NO: 73723 - DNA, 22 bp, Artificial Sequence
  Synthetic oligonucleotide; CTA chr11 5168148 5168169 5168165 5168170 +
aagaatcaggtttttagttgga

SEQ ID NO: 73724 - DNA, 22 bp, Artificial Sequence
  Synthetic oligonucleotide; TTT chr11 5168161 5168182 5168178 5168183 +
ttagttggattgtctggttttg

SEQ ID NO: 73725 - DNA, 22 bp, Artificial Sequence
  Synthetic oligonucleotide; TTT chr11 5168162 5168183 5168179 5168184 +
tagttggattgtctggttttga

SEQ ID NO: 73726 - DNA, 22 bp, Artificial Sequence
  Synthetic oligonucleotide; TTT chr11 5168163 5168184 5168180 5168185 +
agttggattgtctggttttgag

SEQ ID NO: 73727 - DNA, 22 bp, Artificial Sequence
  Synthetic oligonucleotide; TTA chr11 5168164 5168185 5168181 5168186 +
gttggattgtctggttttgagt

SEQ ID NO: 73728 - DNA, 22 bp, Artificial Sequence
  Synthetic oligonucleotide; TTG chr11 5168168 5168189 5168185 5168190 +
gattgtctggttttgagttgtg

SEQ ID NO: 73729 - DNA, 22 bp, Artificial Sequence
  Synthetic oligonucleotide; TTG chr11 5168173 5168194 5168190 5168195 +
tctggttttgagttgtgattct

SEQ ID NO: 73730 - DNA, 22 bp, Artificial Sequence
  Synthetic oligonucleotide; CTG chr11 5168177 5168198 5168194 5168199 +
gttttgagttgtgattctgcca

SEQ ID NO: 73731 - DNA, 22 bp, Artificial Sequence
  Synthetic oligonucleotide; TTT chr11 5168181 5168202 5168198 5168203 +
tgagttgtgattctgccactta

SEQ ID NO: 73732 - DNA, 22 bp, Artificial Sequence
  Synthetic oligonucleotide; TTT chr11 5168182 5168203 5168199 5168204 +
gagttgtgattctgccacttat

SEQ ID NO: 73733 - DNA, 22 bp, Artificial Sequence
  Synthetic oligonucleotide; TTG chr11 5168183 5168204 5168200 5168205 +
agttgtgattctgccacttatt

SEQ ID NO: 73734 - DNA, 22 bp, Artificial Sequence
  Synthetic oligonucleotide; TTG chr11 5168188 5168209 5168205 5168210 +
tgattctgccacttattaactc

SEQ ID NO: 73735 - DNA, 22 bp, Artificial Sequence
  Synthetic oligonucleotide; TTC chr11 5168194 5168215 5168211 5168216 +
tgccacttattaactctttgac

SEQ ID NO: 73736 - DNA, 22 bp, Artificial Sequence
  Synthetic oligonucleotide; CTG chr11 5168196 5168217 5168213 5168218 +
ccacttattaactctttgactt

SEQ ID NO: 73737 - DNA, 22 bp, Artificial Sequence
  Synthetic oligonucleotide; CTT chr11 5168202 5168223 5168219 5168224 +
attaactctttgacttggggca

SEQ ID NO: 73738 - DNA, 22 bp, Artificial Sequence
  Synthetic oligonucleotide; TTA chr11 5168203 5168224 5168220 5168225 +
ttaactctttgacttggggcat

SEQ ID NO: 73739 - DNA, 22 bp, Artificial Sequence
  Synthetic oligonucleotide; TTA chr11 5168206 5168227 5168223 5168228 +
actctttgacttggggcatgat

SEQ ID NO: 73740 - DNA, 22 bp, Artificial Sequence
  Synthetic oligonucleotide; CTC chr11 5168210 5168231 5168227 5168232 +
tttgacttggggcatgatgact

SEQ ID NO: 73741 - DNA, 22 bp, Artificial Sequence
  Synthetic oligonucleotide; CTT chr11 5168212 5168233 5168229 5168234 +
tgacttggggcatgatgacttg

SEQ ID NO: 73742 - DNA, 22 bp, Artificial Sequence
  Synthetic oligonucleotide; TTT chr11 5168213 5168234 5168230 5168235 +
gacttggggcatgatgacttga

SEQ ID NO: 73743 - DNA, 22 bp, Artificial Sequence
  Synthetic oligonucleotide; TTG chr11 5168214 5168235 5168231 5168236 +
acttggggcatgatgacttgac

SEQ ID NO: 73744 - DNA, 22 bp, Artificial Sequence
  Synthetic oligonucleotide; CTT chr11 5168218 5168239 5168235 5168240 +
ggggcatgatgacttgacttct

SEQ ID NO: 73745 - DNA, 22 bp, Artificial Sequence
  Synthetic oligonucleotide; TTG chr11 5168219 5168240 5168236 5168241 +
gggcatgatgacttgacttctc

SEQ ID NO: 73746 - DNA, 22 bp, Artificial Sequence
  Synthetic oligonucleotide; CTT chr11 5168233 5168254 5168250 5168255 +
gacttctctatgtttctgtttc

SEQ ID NO: 73747 - DNA, 22 bp, Artificial Sequence
  Synthetic oligonucleotide; TTG chr11 5168234 5168255 5168251 5168256 +
acttctctatgtttctgtttct

SEQ ID NO: 73748 - DNA, 22 bp, Artificial Sequence
  Synthetic oligonucleotide; CTT chr11 5168238 5168259 5168255 5168260 +
ctctatgtttctgtttctacat

SEQ ID NO: 73749 - DNA, 22 bp, Artificial Sequence
  Synthetic oligonucleotide; TTC chr11 5168239 5168260 5168256 5168261 +
tctatgtttctgtttctacatt

SEQ ID NO: 73750 - DNA, 22 bp, Artificial Sequence
  Synthetic oligonucleotide; CTC chr11 5168241 5168262 5168258 5168263 +
tatgtttctgtttctacatttg

SEQ ID NO: 73751 - DNA, 22 bp, Artificial Sequence
  Synthetic oligonucleotide; CTA chr11 5168243 5168264 5168260 5168265 +
tgtttctgtttctacatttgta

SEQ ID NO: 73752 - DNA, 22 bp, Artificial Sequence
  Synthetic oligonucleotide; TTT chr11 5168248 5168269 5168265 5168270 +
ctgtttctacatttgtaacatg

SEQ ID NO: 73753 - DNA, 22 bp, Artificial Sequence
  Synthetic oligonucleotide; TTC chr11 5168249 5168270 5168266 5168271 +
tgtttctacatttgtaacatgt

SEQ ID NO: 73754 - DNA, 22 bp, Artificial Sequence
  Synthetic oligonucleotide; CTG chr11 5168251 5168272 5168268 5168273 +
tttctacatttgtaacatgtag

SEQ ID NO: 73755 - DNA, 22 bp, Artificial Sequence
  Synthetic oligonucleotide; TTT chr11 5168254 5168275 5168271 5168276 +
ctacatttgtaacatgtagaca

SEQ ID NO: 73756 - DNA, 22 bp, Artificial Sequence
  Synthetic oligonucleotide; TTC chr11 5168255 5168276 5168272 5168277 +
tacatttgtaacatgtagacaa

SEQ ID NO: 73757 - DNA, 22 bp, Artificial Sequence
  Synthetic oligonucleotide; CTA chr11 5168257 5168278 5168274 5168279 +
catttgtaacatgtagacaaac

SEQ ID NO: 73758 - DNA, 22 bp, Artificial Sequence
  Synthetic oligonucleotide; TTT chr11 5168262 5168283 5168279 5168284 +
gtaacatgtagacaaactgata

SEQ ID NO: 73759 - DNA, 22 bp, Artificial Sequence
  Synthetic oligonucleotide; TTG chr11 5168263 5168284 5168280 5168285 +
taacatgtagacaaactgataa

SEQ ID NO: 73760 - DNA, 22 bp, Artificial Sequence
  Synthetic oligonucleotide; CTG chr11 5168281 5168302 5168298 5168303 +
ataatttcttcatatatttgtt

SEQ ID NO: 73761 - DNA, 22 bp, Artificial Sequence
  Synthetic oligonucleotide; TTT chr11 5168288 5168309 5168305 5168310 +
cttcatatatttgttccgtgga

SEQ ID NO: 73762 - DNA, 22 bp, Artificial Sequence
  Synthetic oligonucleotide; TTC chr11 5168289 5168310 5168306 5168311 +
ttcatatatttgttccgtggat

SEQ ID NO: 73763 - DNA, 22 bp, Artificial Sequence
  Synthetic oligonucleotide; CTT chr11 5168291 5168312 5168308 5168313 +
catatatttgttccgtggatta

SEQ ID NO: 73764 - DNA, 22 bp, Artificial Sequence
  Synthetic oligonucleotide; TTC chr11 5168292 5168313 5168309 5168314 +
atatatttgttccgtggattaa

SEQ ID NO: 73765 - DNA, 22 bp, Artificial Sequence
  Synthetic oligonucleotide; TTT chr11 5168300 5168321 5168317 5168322 +
gttccgtggattaaatgaacta

SEQ ID NO: 73766 - DNA, 22 bp, Artificial Sequence
  Synthetic oligonucleotide; TTG chr11 5168301 5168322 5168318 5168323 +
ttccgtggattaaatgaactaa

SEQ ID NO: 73767 - DNA, 22 bp, Artificial Sequence
  Synthetic oligonucleotide; TTC chr11 5168304 5168325 5168321 5168326 +
cgtggattaaatgaactaatct

SEQ ID NO: 73768 - DNA, 22 bp, Artificial Sequence
  Synthetic oligonucleotide; TTA chr11 5168313 5168334 5168330 5168335 +
aatgaactaatctatataaatc

SEQ ID NO: 73769 - DNA, 22 bp, Artificial Sequence
  Synthetic oligonucleotide; CTA chr11 5168322 5168343 5168339 5168344 +
atctatataaatcacttagtat

SEQ ID NO: 73770 - DNA, 22 bp, Artificial Sequence
  Synthetic oligonucleotide; CTA chr11 5168327 5168348 5168344 5168349 +
tataaatcacttagtatggtac

SEQ ID NO: 73771 - DNA, 22 bp, Artificial Sequence
  Synthetic oligonucleotide; CTT chr11 5168339 5168360 5168356 5168361 +
agtatggtacactatagctcgt

SEQ ID NO: 73772 - DNA, 22 bp, Artificial Sequence
  Synthetic oligonucleotide; TTA chr11 5168340 5168361 5168357 5168362 +
gtatggtacactatagctcgtg

SEQ ID NO: 73773 - DNA, 22 bp, Artificial Sequence
  Synthetic oligonucleotide; CTA chr11 5168353 5168374 5168370 5168375 +
tagctcgtgacagagaaatttg

SEQ ID NO: 73774 - DNA, 22 bp, Artificial Sequence
  Synthetic oligonucleotide; CTC chr11 5168359 5168380 5168376 5168381 +
gtgacagagaaatttgtgactt

SEQ ID NO: 73775 - DNA, 22 bp, Artificial Sequence
  Synthetic oligonucleotide; TTT chr11 5168374 5168395 5168391 5168396 +
gtgactttaatttttatgtact

SEQ ID NO: 73776 - DNA, 22 bp, Artificial Sequence
  Synthetic oligonucleotide; TTG chr11 5168375 5168396 5168392 5168397 +
tgactttaatttttatgtactt

SEQ ID NO: 73777 - DNA, 22 bp, Artificial Sequence
  Synthetic oligonucleotide; CTT chr11 5168381 5168402 5168398 5168403 +
taatttttatgtacttgagttt

SEQ ID NO: 73778 - DNA, 22 bp, Artificial Sequence
  Synthetic oligonucleotide; TTT chr11 5168382 5168403 5168399 5168404 +
aatttttatgtacttgagttta

SEQ ID NO: 73779 - DNA, 22 bp, Artificial Sequence
  Synthetic oligonucleotide; TTA chr11 5168383 5168404 5168400 5168405 +
atttttatgtacttgagtttaa

SEQ ID NO: 73780 - DNA, 22 bp, Artificial Sequence
  Synthetic oligonucleotide; TTT chr11 5168387 5168408 5168404 5168409 +
ttatgtacttgagtttaaaatt

SEQ ID NO: 73781 - DNA, 22 bp, Artificial Sequence
  Synthetic oligonucleotide; TTT chr11 5168388 5168409 5168405 5168410 +
tatgtacttgagtttaaaatta

SEQ ID NO: 73782 - DNA, 22 bp, Artificial Sequence
  Synthetic oligonucleotide; TTT chr11 5168389 5168410 5168406 5168411 +
atgtacttgagtttaaaattag

SEQ ID NO: 73783 - DNA, 22 bp, Artificial Sequence
  Synthetic oligonucleotide; TTA chr11 5168390 5168411 5168407 5168412 +
tgtacttgagtttaaaattagc

SEQ ID NO: 73784 - DNA, 22 bp, Artificial Sequence
  Synthetic oligonucleotide; CTT chr11 5168397 5168418 5168414 5168419 +
gagtttaaaattagcatttaga

SEQ ID NO: 73785 - DNA, 22 bp, Artificial Sequence
  Synthetic oligonucleotide; TTG chr11 5168398 5168419 5168415 5168420 +
agtttaaaattagcatttagag

SEQ ID NO: 73786 - DNA, 22 bp, Artificial Sequence
  Synthetic oligonucleotide; TTT chr11 5168403 5168424 5168420 5168425 +
aaaattagcatttagagagact

SEQ ID NO: 73787 - DNA, 22 bp, Artificial Sequence
  Synthetic oligonucleotide; TTA chr11 5168404 5168425 5168421 5168426 +
aaattagcatttagagagactg

SEQ ID NO: 73788 - DNA, 22 bp, Artificial Sequence
  Synthetic oligonucleotide; TTA chr11 5168410 5168431 5168427 5168432 +
gcatttagagagactgtcagga

SEQ ID NO: 73789 - DNA, 22 bp, Artificial Sequence
  Synthetic oligonucleotide; TTT chr11 5168416 5168437 5168433 5168438 +
agagagactgtcaggaattgtg

SEQ ID NO: 73790 - DNA, 22 bp, Artificial Sequence
  Synthetic oligonucleotide; TTA chr11 5168417 5168438 5168434 5168439 +
gagagactgtcaggaattgtga

SEQ ID NO: 73791 - DNA, 22 bp, Artificial Sequence
  Synthetic oligonucleotide; CTG chr11 5168426 5168447 5168443 5168448 +
tcaggaattgtgaaatttgact

SEQ ID NO: 73792 - DNA, 22 bp, Artificial Sequence
  Synthetic oligonucleotide; TTG chr11 5168436 5168457 5168453 5168458 +
tgaaatttgactgtgtattcac

SEQ ID NO: 73793 - DNA, 22 bp, Artificial Sequence
  Synthetic oligonucleotide; TTT chr11 5168444 5168465 5168461 5168466 +
gactgtgtattcacgtattgta

SEQ ID NO: 73794 - DNA, 22 bp, Artificial Sequence
  Synthetic oligonucleotide; TTG chr11 5168445 5168466 5168462 5168467 +
actgtgtattcacgtattgtag

SEQ ID NO: 73795 - DNA, 22 bp, Artificial Sequence
  Synthetic oligonucleotide; CTG chr11 5168449 5168470 5168466 5168471 +
tgtattcacgtattgtagtcag

SEQ ID NO: 73796 - DNA, 22 bp, Artificial Sequence
  Synthetic oligonucleotide; TTC chr11 5168456 5168477 5168473 5168478 +
acgtattgtagtcagatttggt

SEQ ID NO: 73797 - DNA, 22 bp, Artificial Sequence
  Synthetic oligonucleotide; TTG chr11 5168464 5168485 5168481 5168486 +
tagtcagatttggtgaaaaagt

SEQ ID NO: 73798 - DNA, 22 bp, Artificial Sequence
  Synthetic oligonucleotide; TTT chr11 5168475 5168496 5168492 5168497 +
ggtgaaaaagtaattacttaat

SEQ ID NO: 73799 - DNA, 22 bp, Artificial Sequence
  Synthetic oligonucleotide; TTG chr11 5168476 5168497 5168493 5168498 +
gtgaaaaagtaattacttaata

SEQ ID NO: 73800 - DNA, 22 bp, Artificial Sequence
  Synthetic oligonucleotide; TTA chr11 5168491 5168512 5168508 5168513 +
cttaataaaatataattactta

SEQ ID NO: 73801 - DNA, 22 bp, Artificial Sequence
  Synthetic oligonucleotide; CTT chr11 5168494 5168515 5168511 5168516 +
aataaaatataattacttattg

SEQ ID NO: 73802 - DNA, 22 bp, Artificial Sequence
  Synthetic oligonucleotide; TTA chr11 5168495 5168516 5168512 5168517 +
ataaaatataattacttattga

SEQ ID NO: 73803 - DNA, 22 bp, Artificial Sequence
  Synthetic oligonucleotide; TTA chr11 5168509 5168530 5168526 5168531 +
cttattgagcaaattttactag

SEQ ID NO: 73804 - DNA, 22 bp, Artificial Sequence
  Synthetic oligonucleotide; CTT chr11 5168512 5168533 5168529 5168534 +
attgagcaaattttactaggaa

SEQ ID NO: 73805 - DNA, 22 bp, Artificial Sequence
  Synthetic oligonucleotide; TTA chr11 5168513 5168534 5168530 5168535 +
ttgagcaaattttactaggaac

SEQ ID NO: 73806 - DNA, 22 bp, Artificial Sequence
  Synthetic oligonucleotide; TTG chr11 5168516 5168537 5168533 5168538 +
agcaaattttactaggaacttt

SEQ ID NO: 73807 - DNA, 22 bp, Artificial Sequence
  Synthetic oligonucleotide; TTT chr11 5168525 5168546 5168542 5168547 +
tactaggaactttgctaattgc

SEQ ID NO: 73808 - DNA, 22 bp, Artificial Sequence
  Synthetic oligonucleotide; TTT chr11 5168526 5168547 5168543 5168548 +
actaggaactttgctaattgct

SEQ ID NO: 73809 - DNA, 22 bp, Artificial Sequence
  Synthetic oligonucleotide; TTA chr11 5168527 5168548 5168544 5168549 +
ctaggaactttgctaattgctt

SEQ ID NO: 73810 - DNA, 22 bp, Artificial Sequence
  Synthetic oligonucleotide; CTA chr11 5168530 5168551 5168547 5168552 +
ggaactttgctaattgcttaat

SEQ ID NO: 73811 - DNA, 22 bp, Artificial Sequence
  Synthetic oligonucleotide; CTT chr11 5168537 5168558 5168554 5168559 +
tgctaattgcttaatgtgcacc

SEQ ID NO: 73812 - DNA, 22 bp, Artificial Sequence
  Synthetic oligonucleotide; TTT chr11 5168538 5168559 5168555 5168560 +
gctaattgcttaatgtgcacca

SEQ ID NO: 73813 - DNA, 22 bp, Artificial Sequence
  Synthetic oligonucleotide; TTG chr11 5168539 5168560 5168556 5168561 +
ctaattgcttaatgtgcaccat

SEQ ID NO: 73814 - DNA, 22 bp, Artificial Sequence
  Synthetic oligonucleotide; CTA chr11 5168542 5168563 5168559 5168564 +
attgcttaatgtgcaccatttc

SEQ ID NO: 73815 - DNA, 22 bp, Artificial Sequence
  Synthetic oligonucleotide; TTG chr11 5168546 5168567 5168563 5168568 +
cttaatgtgcaccatttcattt

SEQ ID NO: 73816 - DNA, 22 bp, Artificial Sequence
  Synthetic oligonucleotide; CTT chr11 5168549 5168570 5168566 5168571 +
aatgtgcaccatttcatttaat

SEQ ID NO: 73817 - DNA, 22 bp, Artificial Sequence
  Synthetic oligonucleotide; TTA chr11 5168550 5168571 5168567 5168572 +
atgtgcaccatttcatttaatc

SEQ ID NO: 73818 - DNA, 22 bp, Artificial Sequence
  Synthetic oligonucleotide; TTT chr11 5168563 5168584 5168580 5168585 +
catttaatcttcaagatcataa

SEQ ID NO: 73819 - DNA, 22 bp, Artificial Sequence
  Synthetic oligonucleotide; TTC chr11 5168564 5168585 5168581 5168586 +
atttaatcttcaagatcataaa

SEQ ID NO: 73820 - DNA, 22 bp, Artificial Sequence
  Synthetic oligonucleotide; TTT chr11 5168568 5168589 5168585 5168590 +
aatcttcaagatcataaaagct

SEQ ID NO: 73821 - DNA, 22 bp, Artificial Sequence
  Synthetic oligonucleotide; TTA chr11 5168569 5168590 5168586 5168591 +
atcttcaagatcataaaagctg

SEQ ID NO: 73822 - DNA, 22 bp, Artificial Sequence
  Synthetic oligonucleotide; CTT chr11 5168574 5168595 5168591 5168596 +
caagatcataaaagctggattt

SEQ ID NO: 73823 - DNA, 22 bp, Artificial Sequence
  Synthetic oligonucleotide; TTC chr11 5168575 5168596 5168592 5168597 +
aagatcataaaagctggatttt

SEQ ID NO: 73824 - DNA, 22 bp, Artificial Sequence
  Synthetic oligonucleotide; CTG chr11 5168591 5168612 5168608 5168613 +
gattttattttcttattcattt

SEQ ID NO: 73825 - DNA, 22 bp, Artificial Sequence
  Synthetic oligonucleotide; TTT chr11 5168596 5168617 5168613 5168618 +
tattttcttattcatttataaa

SEQ ID NO: 73826 - DNA, 22 bp, Artificial Sequence
  Synthetic oligonucleotide; TTT chr11 5168597 5168618 5168614 5168619 +
attttcttattcatttataaat

SEQ ID NO: 73827 - DNA, 22 bp, Artificial Sequence
  Synthetic oligonucleotide; TTA chr11 5168598 5168619 5168615 5168620 +
ttttcttattcatttataaatg

SEQ ID NO: 73828 - DNA, 22 bp, Artificial Sequence
  Synthetic oligonucleotide; TTT chr11 5168601 5168622 5168618 5168623 +
tcttattcatttataaatgaat

SEQ ID NO: 73829 - DNA, 22 bp, Artificial Sequence
  Synthetic oligonucleotide; TTT chr11 5168602 5168623 5168619 5168624 +
cttattcatttataaatgaata

SEQ ID NO: 73830 - DNA, 22 bp, Artificial Sequence
  Synthetic oligonucleotide; TTC chr11 5168603 5168624 5168620 5168625 +
ttattcatttataaatgaataa

SEQ ID NO: 73831 - DNA, 22 bp, Artificial Sequence
  Synthetic oligonucleotide; CTT chr11 5168605 5168626 5168622 5168627 +
attcatttataaatgaataaat

SEQ ID NO: 73832 - DNA, 22 bp, Artificial Sequence
  Synthetic oligonucleotide; TTA chr11 5168606 5168627 5168623 5168628 +
ttcatttataaatgaataaatt

SEQ ID NO: 73833 - DNA, 22 bp, Artificial Sequence
  Synthetic oligonucleotide; TTC chr11 5168609 5168630 5168626 5168631 +
atttataaatgaataaattata

SEQ ID NO: 73834 - DNA, 22 bp, Artificial Sequence
  Synthetic oligonucleotide; TTT chr11 5168613 5168634 5168630 5168635 +
ataaatgaataaattatattca

SEQ ID NO: 73835 - DNA, 22 bp, Artificial Sequence
  Synthetic oligonucleotide; TTA chr11 5168614 5168635 5168631 5168636 +
taaatgaataaattatattcaa

SEQ ID NO: 73836 - DNA, 22 bp, Artificial Sequence
  Synthetic oligonucleotide; TTA chr11 5168629 5168650 5168646 5168651 +
tattcaaacaggtcatactact

SEQ ID NO: 73837 - DNA, 22 bp, Artificial Sequence
  Synthetic oligonucleotide; TTC chr11 5168634 5168655 5168651 5168656 +
aaacaggtcatactactagcaa

SEQ ID NO: 73838 - DNA, 22 bp, Artificial Sequence
  Synthetic oligonucleotide; CTA chr11 5168649 5168670 5168666 5168671 +
ctagcaagatcccacaattact

SEQ ID NO: 73839 - DNA, 22 bp, Artificial Sequence
  Synthetic oligonucleotide; CTA chr11 5168652 5168673 5168669 5168674 +
gcaagatcccacaattactaat

SEQ ID NO: 73840 - DNA, 22 bp, Artificial Sequence
  Synthetic oligonucleotide; TTA chr11 5168669 5168690 5168686 5168691 +
ctaatagcaagatagctaagat

SEQ ID NO: 73841 - DNA, 22 bp, Artificial Sequence
  Synthetic oligonucleotide; CTA chr11 5168672 5168693 5168689 5168694 +
atagcaagatagctaagatttc

SEQ ID NO: 73842 - DNA, 22 bp, Artificial Sequence
  Synthetic oligonucleotide; CTA chr11 5168687 5168708 5168704 5168709 +
agatttcaacctaggtacatct

SEQ ID NO: 73843 - DNA, 22 bp, Artificial Sequence
  Synthetic oligonucleotide; TTT chr11 5168693 5168714 5168710 5168715 +
caacctaggtacatctggttca

SEQ ID NO: 73844 - DNA, 22 bp, Artificial Sequence
  Synthetic oligonucleotide; TTC chr11 5168694 5168715 5168711 5168716 +
aacctaggtacatctggttcaa

SEQ ID NO: 73845 - DNA, 22 bp, Artificial Sequence
  Synthetic oligonucleotide; CTA chr11 5168700 5168721 5168717 5168722 +
ggtacatctggttcaagtgtat

SEQ ID NO: 73846 - DNA, 22 bp, Artificial Sequence
  Synthetic oligonucleotide; CTG chr11 5168710 5168731 5168727 5168732 +
gttcaagtgtataacatcacac

SEQ ID NO: 73847 - DNA, 22 bp, Artificial Sequence
  Synthetic oligonucleotide; TTC chr11 5168714 5168735 5168731 5168736 +
aagtgtataacatcacactgag

SEQ ID NO: 73848 - DNA, 22 bp, Artificial Sequence
  Synthetic oligonucleotide; CTG chr11 5168734 5168755 5168751 5168756 +
aggacttggctcttgggtgtac

SEQ ID NO: 73849 - DNA, 22 bp, Artificial Sequence
  Synthetic oligonucleotide; CTT chr11 5168741 5168762 5168758 5168763 +
ggctcttgggtgtacaagtttt

SEQ ID NO: 73850 - DNA, 22 bp, Artificial Sequence
  Synthetic oligonucleotide; TTG chr11 5168742 5168763 5168759 5168764 +
gctcttgggtgtacaagttttc

SEQ ID NO: 73851 - DNA, 22 bp, Artificial Sequence
  Synthetic oligonucleotide; CTC chr11 5168746 5168767 5168763 5168768 +
ttgggtgtacaagttttccatt

SEQ ID NO: 73852 - DNA, 22 bp, Artificial Sequence
  Synthetic oligonucleotide; CTT chr11 5168748 5168769 5168765 5168770 +
gggtgtacaagttttccattgt

SEQ ID NO: 73853 - DNA, 22 bp, Artificial Sequence
  Synthetic oligonucleotide; TTG chr11 5168749 5168770 5168766 5168771 +
ggtgtacaagttttccattgtg

SEQ ID NO: 73854 - DNA, 22 bp, Artificial Sequence
  Synthetic oligonucleotide; TTT chr11 5168762 5168783 5168779 5168784 +
tccattgtgtgaacttgataaa

SEQ ID NO: 73855 - DNA, 22 bp, Artificial Sequence
  Synthetic oligonucleotide; TTT chr11 5168763 5168784 5168780 5168785 +
ccattgtgtgaacttgataaag

SEQ ID NO: 73856 - DNA, 22 bp, Artificial Sequence
  Synthetic oligonucleotide; TTC chr11 5168764 5168785 5168781 5168786 +
cattgtgtgaacttgataaagt

SEQ ID NO: 73857 - DNA, 22 bp, Artificial Sequence
  Synthetic oligonucleotide; TTG chr11 5168769 5168790 5168786 5168791 +
tgtgaacttgataaagttacaa

SEQ ID NO: 73858 - DNA, 22 bp, Artificial Sequence
  Synthetic oligonucleotide; CTT chr11 5168778 5168799 5168795 5168800 +
gataaagttacaaaaattatct

SEQ ID NO: 73859 - DNA, 22 bp, Artificial Sequence
  Synthetic oligonucleotide; TTG chr11 5168779 5168800 5168796 5168801 +
ataaagttacaaaaattatctc

SEQ ID NO: 73860 - DNA, 22 bp, Artificial Sequence
  Synthetic oligonucleotide; TTA chr11 5168788 5168809 5168805 5168810 +
caaaaattatctcttagttttt

SEQ ID NO: 73861 - DNA, 22 bp, Artificial Sequence
  Synthetic oligonucleotide; TTA chr11 5168797 5168818 5168814 5168819 +
tctcttagttttttcatgtata

SEQ ID NO: 73862 - DNA, 22 bp, Artificial Sequence
  Synthetic oligonucleotide; CTC chr11 5168801 5168822 5168818 5168823 +
ttagttttttcatgtataccat

SEQ ID NO: 73863 - DNA, 22 bp, Artificial Sequence
  Synthetic oligonucleotide; CTT chr11 5168803 5168824 5168820 5168825 +
agttttttcatgtataccataa

SEQ ID NO: 73864 - DNA, 22 bp, Artificial Sequence
  Synthetic oligonucleotide; TTA chr11 5168804 5168825 5168821 5168826 +
gttttttcatgtataccataag

SEQ ID NO: 73865 - DNA, 22 bp, Artificial Sequence
  Synthetic oligonucleotide; TTT chr11 5168808 5168829 5168825 5168830 +
tttcatgtataccataagaata

SEQ ID NO: 73866 - DNA, 22 bp, Artificial Sequence
  Synthetic oligonucleotide; TTT chr11 5168809 5168830 5168826 5168831 +
ttcatgtataccataagaatag

SEQ ID NO: 73867 - DNA, 22 bp, Artificial Sequence
  Synthetic oligonucleotide; TTT chr11 5168810 5168831 5168827 5168832 +
tcatgtataccataagaatagt

SEQ ID NO: 73868 - DNA, 22 bp, Artificial Sequence
  Synthetic oligonucleotide; TTT chr11 5168811 5168832 5168828 5168833 +
catgtataccataagaatagta

SEQ ID NO: 73869 - DNA, 22 bp, Artificial Sequence
  Synthetic oligonucleotide; TTC chr11 5168812 5168833 5168829 5168834 +
atgtataccataagaatagtaa

SEQ ID NO: 73870 - DNA, 22 bp, Artificial Sequence
  Synthetic oligonucleotide; CTG chr11 5168844 5168865 5168861 5168866 +
taatggaggttaccaataatta

SEQ ID NO: 73871 - DNA, 22 bp, Artificial Sequence
  Synthetic oligonucleotide; TTA chr11 5168856 5168877 5168873 5168878 +
ccaataattattgttaaggaag

SEQ ID NO: 73872 - DNA, 22 bp, Artificial Sequence
  Synthetic oligonucleotide; TTA chr11 5168866 5168887 5168883 5168888 +
ttgttaaggaagggcttctaaa

SEQ ID NO: 73873 - DNA, 22 bp, Artificial Sequence
  Synthetic oligonucleotide; TTG chr11 5168869 5168890 5168886 5168891 +
ttaaggaagggcttctaaatta

SEQ ID NO: 73874 - DNA, 22 bp, Artificial Sequence
  Synthetic oligonucleotide; TTA chr11 5168872 5168893 5168889 5168894 +
aggaagggcttctaaattactc

SEQ ID NO: 73875 - DNA, 22 bp, Artificial Sequence
  Synthetic oligonucleotide; CTT chr11 5168883 5168904 5168900 5168905 +
ctaaattactctgaaattttga

SEQ ID NO: 73876 - DNA, 22 bp, Artificial Sequence
  Synthetic oligonucleotide; TTC chr11 5168884 5168905 5168901 5168906 +
taaattactctgaaattttgag

SEQ ID NO: 73877 - DNA, 22 bp, Artificial Sequence
  Synthetic oligonucleotide; CTA chr11 5168886 5168907 5168903 5168908 +
aattactctgaaattttgagaa

SEQ ID NO: 73878 - DNA, 22 bp, Artificial Sequence
  Synthetic oligonucleotide; TTA chr11 5168891 5168912 5168908 5168913 +
ctctgaaattttgagaattttt

SEQ ID NO: 73879 - DNA, 22 bp, Artificial Sequence
  Synthetic oligonucleotide; CTC chr11 5168894 5168915 5168911 5168916 +
tgaaattttgagaatttttttt

SEQ ID NO: 73880 - DNA, 22 bp, Artificial Sequence
  Synthetic oligonucleotide; CTG chr11 5168896 5168917 5168913 5168918 +
aaattttgagaattttttttta

SEQ ID NO: 73881 - DNA, 22 bp, Artificial Sequence
  Synthetic oligonucleotide; TTT chr11 5168902 5168923 5168919 5168924 +
tgagaatttttttttaaatccc

SEQ ID NO: 73882 - DNA, 22 bp, Artificial Sequence
  Synthetic oligonucleotide; TTT chr11 5168903 5168924 5168920 5168925 +
gagaatttttttttaaatccca

SEQ ID NO: 73883 - DNA, 22 bp, Artificial Sequence
  Synthetic oligonucleotide; TTG chr11 5168904 5168925 5168921 5168926 +
agaatttttttttaaatcccat

SEQ ID NO: 73884 - DNA, 22 bp, Artificial Sequence
  Synthetic oligonucleotide; TTT chr11 5168911 5168932 5168928 5168933 +
ttttttaaatcccatgttgttt

SEQ ID NO: 73885 - DNA, 22 bp, Artificial Sequence
  Synthetic oligonucleotide; TTT chr11 5168912 5168933 5168929 5168934 +
tttttaaatcccatgttgtttt

SEQ ID NO: 73886 - DNA, 22 bp, Artificial Sequence
  Synthetic oligonucleotide; TTT chr11 5168913 5168934 5168930 5168935 +
ttttaaatcccatgttgttttt

SEQ ID NO: 73887 - DNA, 22 bp, Artificial Sequence
  Synthetic oligonucleotide; TTT chr11 5168914 5168935 5168931 5168936 +
tttaaatcccatgttgttttta

SEQ ID NO: 73888 - DNA, 22 bp, Artificial Sequence
  Synthetic oligonucleotide; TTT chr11 5168915 5168936 5168932 5168937 +
ttaaatcccatgttgtttttat

SEQ ID NO: 73889 - DNA, 22 bp, Artificial Sequence
  Synthetic oligonucleotide; TTT chr11 5168916 5168937 5168933 5168938 +
taaatcccatgttgtttttatg

SEQ ID NO: 73890 - DNA, 22 bp, Artificial Sequence
  Synthetic oligonucleotide; TTT chr11 5168917 5168938 5168934 5168939 +
aaatcccatgttgtttttatga

SEQ ID NO: 73891 - DNA, 22 bp, Artificial Sequence
  Synthetic oligonucleotide; TTA chr11 5168918 5168939 5168935 5168940 +
aatcccatgttgtttttatgac

SEQ ID NO: 73892 - DNA, 22 bp, Artificial Sequence
  Synthetic oligonucleotide; TTG chr11 5168930 5168951 5168947 5168952 +
tttttatgacttcactacattg

SEQ ID NO: 73893 - DNA, 22 bp, Artificial Sequence
  Synthetic oligonucleotide; TTT chr11 5168933 5168954 5168950 5168955 +
ttatgacttcactacattgaac

SEQ ID NO: 73894 - DNA, 22 bp, Artificial Sequence
  Synthetic oligonucleotide; TTT chr11 5168934 5168955 5168951 5168956 +
tatgacttcactacattgaaca

SEQ ID NO: 73895 - DNA, 22 bp, Artificial Sequence
  Synthetic oligonucleotide; TTT chr11 5168935 5168956 5168952 5168957 +
atgacttcactacattgaacac

SEQ ID NO: 73896 - DNA, 22 bp, Artificial Sequence
  Synthetic oligonucleotide; TTA chr11 5168936 5168957 5168953 5168958 +
tgacttcactacattgaacact

SEQ ID NO: 73897 - DNA, 22 bp, Artificial Sequence
  Synthetic oligonucleotide; CTT chr11 5168942 5168963 5168959 5168964 +
cactacattgaacactttcaaa

SEQ ID NO: 73898 - DNA, 22 bp, Artificial Sequence
  Synthetic oligonucleotide; TTC chr11 5168943 5168964 5168960 5168965 +
actacattgaacactttcaaag

SEQ ID NO: 73899 - DNA, 22 bp, Artificial Sequence
  Synthetic oligonucleotide; CTA chr11 5168947 5168968 5168964 5168969 +
cattgaacactttcaaaggtgt

SEQ ID NO: 73900 - DNA, 22 bp, Artificial Sequence
  Synthetic oligonucleotide; TTG chr11 5168952 5168973 5168969 5168974 +
aacactttcaaaggtgtttcat

SEQ ID NO: 73901 - DNA, 22 bp, Artificial Sequence
  Synthetic oligonucleotide; CTT chr11 5168959 5168980 5168976 5168981 +
tcaaaggtgtttcatacattaa

SEQ ID NO: 73902 - DNA, 22 bp, Artificial Sequence
  Synthetic oligonucleotide; TTT chr11 5168960 5168981 5168977 5168982 +
caaaggtgtttcatacattaaa

SEQ ID NO: 73903 - DNA, 22 bp, Artificial Sequence
  Synthetic oligonucleotide; TTC chr11 5168961 5168982 5168978 5168983 +
aaaggtgtttcatacattaaaa

SEQ ID NO: 73904 - DNA, 22 bp, Artificial Sequence
  Synthetic oligonucleotide; TTT chr11 5168971 5168992 5168988 5168993 +
catacattaaaaattttttaag

SEQ ID NO: 73905 - DNA, 22 bp, Artificial Sequence
  Synthetic oligonucleotide; TTC chr11 5168972 5168993 5168989 5168994 +
atacattaaaaattttttaagt

SEQ ID NO: 73906 - DNA, 22 bp, Artificial Sequence
  Synthetic oligonucleotide; TTA chr11 5168980 5169001 5168997 5169002 +
aaaattttttaagtccataaat

SEQ ID NO: 73907 - DNA, 22 bp, Artificial Sequence
  Synthetic oligonucleotide; TTT chr11 5168987 5169008 5169004 5169009 +
tttaagtccataaattaatttc

SEQ ID NO: 73908 - DNA, 22 bp, Artificial Sequence
  Synthetic oligonucleotide; TTT chr11 5168988 5169009 5169005 5169010 +
ttaagtccataaattaatttcg

SEQ ID NO: 73909 - DNA, 22 bp, Artificial Sequence
  Synthetic oligonucleotide; TTT chr11 5168989 5169010 5169006 5169011 +
taagtccataaattaatttcga

SEQ ID NO: 73910 - DNA, 22 bp, Artificial Sequence
  Synthetic oligonucleotide; TTT chr11 5168990 5169011 5169007 5169012 +
aagtccataaattaatttcgag

SEQ ID NO: 73911 - DNA, 22 bp, Artificial Sequence
  Synthetic oligonucleotide; TTA chr11 5168991 5169012 5169008 5169013 +
agtccataaattaatttcgagg

SEQ ID NO: 73912 - DNA, 22 bp, Artificial Sequence
  Synthetic oligonucleotide; TTA chr11 5169004 5169025 5169021 5169026 +
atttcgaggaaaacagaaaaaa

SEQ ID NO: 73913 - DNA, 22 bp, Artificial Sequence
  Synthetic oligonucleotide; TTT chr11 5169008 5169029 5169025 5169030 +
cgaggaaaacagaaaaaaatat

SEQ ID NO: 73914 - DNA, 22 bp, Artificial Sequence
  Synthetic oligonucleotide; TTC chr11 5169009 5169030 5169026 5169031 +
gaggaaaacagaaaaaaatata

SEQ ID NO: 73915 - DNA, 22 bp, Artificial Sequence
  Synthetic oligonucleotide; TTT chr11 5169036 5169057 5169053 5169058 +
tgccactcattacttgatacat

SEQ ID NO: 73916 - DNA, 22 bp, Artificial Sequence
  Synthetic oligonucleotide; TTT chr11 5169037 5169058 5169054 5169059 +
gccactcattacttgatacata

SEQ ID NO: 73917 - DNA, 22 bp, Artificial Sequence
  Synthetic oligonucleotide; TTG chr11 5169038 5169059 5169055 5169060 +
ccactcattacttgatacatat

SEQ ID NO: 73918 - DNA, 22 bp, Artificial Sequence
  Synthetic oligonucleotide; CTC chr11 5169044 5169065 5169061 5169066 +
attacttgatacatatttttat

SEQ ID NO: 73919 - DNA, 22 bp, Artificial Sequence
  Synthetic oligonucleotide; TTA chr11 5169048 5169069 5169065 5169070 +
cttgatacatatttttatttga

SEQ ID NO: 73920 - DNA, 22 bp, Artificial Sequence
  Synthetic oligonucleotide; CTT chr11 5169051 5169072 5169068 5169073 +
gatacatatttttatttgacca

SEQ ID NO: 73921 - DNA, 22 bp, Artificial Sequence
  Synthetic oligonucleotide; TTG chr11 5169052 5169073 5169069 5169074 +
atacatatttttatttgaccaa

SEQ ID NO: 73922 - DNA, 22 bp, Artificial Sequence
  Synthetic oligonucleotide; TTT chr11 5169062 5169083 5169079 5169084 +
ttatttgaccaaaccttctatt

SEQ ID NO: 73923 - DNA, 22 bp, Artificial Sequence
  Synthetic oligonucleotide; TTT chr11 5169063 5169084 5169080 5169085 +
tatttgaccaaaccttctatta

SEQ ID NO: 73924 - DNA, 22 bp, Artificial Sequence
  Synthetic oligonucleotide; TTT chr11 5169064 5169085 5169081 5169086 +
atttgaccaaaccttctattag

SEQ ID NO: 73925 - DNA, 22 bp, Artificial Sequence
  Synthetic oligonucleotide; TTA chr11 5169065 5169086 5169082 5169087 +
tttgaccaaaccttctattagt

SEQ ID NO: 73926 - DNA, 22 bp, Artificial Sequence
  Synthetic oligonucleotide; TTT chr11 5169068 5169089 5169085 5169090 +
gaccaaaccttctattagttac

SEQ ID NO: 73927 - DNA, 22 bp, Artificial Sequence
  Synthetic oligonucleotide; TTG chr11 5169069 5169090 5169086 5169091 +
accaaaccttctattagttact

SEQ ID NO: 73928 - DNA, 22 bp, Artificial Sequence
  Synthetic oligonucleotide; CTT chr11 5169079 5169100 5169096 5169101 +
ctattagttacttggttggctg

SEQ ID NO: 73929 - DNA, 22 bp, Artificial Sequence
  Synthetic oligonucleotide; TTC chr11 5169080 5169101 5169097 5169102 +
tattagttacttggttggctga

SEQ ID NO: 73930 - DNA, 22 bp, Artificial Sequence
  Synthetic oligonucleotide; CTA chr11 5169082 5169103 5169099 5169104 +
ttagttacttggttggctgata

SEQ ID NO: 73931 - DNA, 22 bp, Artificial Sequence
  Synthetic oligonucleotide; TTA chr11 5169085 5169106 5169102 5169107 +
gttacttggttggctgataatc

SEQ ID NO: 73932 - DNA, 22 bp, Artificial Sequence
  Synthetic oligonucleotide; TTA chr11 5169089 5169110 5169106 5169111 +
cttggttggctgataatcactc

SEQ ID NO: 73933 - DNA, 22 bp, Artificial Sequence
  Synthetic oligonucleotide; CTT chr11 5169092 5169113 5169109 5169114 +
ggttggctgataatcactcaag

SEQ ID NO: 73934 - DNA, 22 bp, Artificial Sequence
  Synthetic oligonucleotide; TTG chr11 5169093 5169114 5169110 5169115 +
gttggctgataatcactcaaga

SEQ ID NO: 73935 - DNA, 22 bp, Artificial Sequence
  Synthetic oligonucleotide; TTG chr11 5169097 5169118 5169114 5169119 +
gctgataatcactcaagactgt

SEQ ID NO: 73936 - DNA, 22 bp, Artificial Sequence
  Synthetic oligonucleotide; CTG chr11 5169101 5169122 5169118 5169123 +
ataatcactcaagactgtgtgg

SEQ ID NO: 73937 - DNA, 22 bp, Artificial Sequence
  Synthetic oligonucleotide; CTC chr11 5169111 5169132 5169128 5169133 +
aagactgtgtggtttaatagga

SEQ ID NO: 73938 - DNA, 22 bp, Artificial Sequence
  Synthetic oligonucleotide; CTG chr11 5169118 5169139 5169135 5169140 +
tgtggtttaataggatattcac

SEQ ID NO: 73939 - DNA, 22 bp, Artificial Sequence
  Synthetic oligonucleotide; TTT chr11 5169126 5169147 5169143 5169148 +
aataggatattcactgtggttc

SEQ ID NO: 73940 - DNA, 22 bp, Artificial Sequence
  Synthetic oligonucleotide; TTA chr11 5169127 5169148 5169144 5169149 +
ataggatattcactgtggttca

SEQ ID NO: 73941 - DNA, 22 bp, Artificial Sequence
  Synthetic oligonucleotide; TTC chr11 5169138 5169159 5169155 5169160 +
actgtggttcatggaaattcaa

SEQ ID NO: 73942 - DNA, 22 bp, Artificial Sequence
  Synthetic oligonucleotide; CTG chr11 5169142 5169163 5169159 5169164 +
tggttcatggaaattcaaaatt

SEQ ID NO: 73943 - DNA, 22 bp, Artificial Sequence
  Synthetic oligonucleotide; TTC chr11 5169148 5169169 5169165 5169170 +
atggaaattcaaaattatctga

SEQ ID NO: 73944 - DNA, 22 bp, Artificial Sequence
  Synthetic oligonucleotide; TTC chr11 5169158 5169179 5169175 5169180 +
aaaattatctgaagaaaacaaa

SEQ ID NO: 73945 - DNA, 22 bp, Artificial Sequence
  Synthetic oligonucleotide; TTA chr11 5169165 5169186 5169182 5169187 +
tctgaagaaaacaaaaagttgg

SEQ ID NO: 73946 - DNA, 22 bp, Artificial Sequence
  Synthetic oligonucleotide; CTG chr11 5169169 5169190 5169186 5169191 +
aagaaaacaaaaagttgggctc

SEQ ID NO: 73947 - DNA, 22 bp, Artificial Sequence
  Synthetic oligonucleotide; TTG chr11 5169186 5169207 5169203 5169208 +
ggctctgcaatccctgtctgag

SEQ ID NO: 73948 - DNA, 22 bp, Artificial Sequence
  Synthetic oligonucleotide; CTC chr11 5169191 5169212 5169208 5169213 +
tgcaatccctgtctgagggatt

SEQ ID NO: 73949 - DNA, 22 bp, Artificial Sequence
  Synthetic oligonucleotide; CTG chr11 5169193 5169214 5169210 5169215 +
caatccctgtctgagggatttt

SEQ ID NO: 73950 - DNA, 22 bp, Artificial Sequence
  Synthetic oligonucleotide; CTG chr11 5169202 5169223 5169219 5169224 +
tctgagggattttctagaattc

SEQ ID NO: 73951 - DNA, 22 bp, Artificial Sequence
  Synthetic oligonucleotide; CTG chr11 5169206 5169227 5169223 5169228 +
agggattttctagaattcttct

SEQ ID NO: 73952 - DNA, 22 bp, Artificial Sequence
  Synthetic oligonucleotide; TTT chr11 5169214 5169235 5169231 5169236 +
tctagaattcttctggtcctcc

SEQ ID NO: 73953 - DNA, 22 bp, Artificial Sequence
  Synthetic oligonucleotide; TTT chr11 5169215 5169236 5169232 5169237 +
ctagaattcttctggtcctccc

SEQ ID NO: 73954 - DNA, 22 bp, Artificial Sequence
  Synthetic oligonucleotide; TTC chr11 5169216 5169237 5169233 5169238 +
tagaattcttctggtcctccct

SEQ ID NO: 73955 - DNA, 22 bp, Artificial Sequence
  Synthetic oligonucleotide; CTA chr11 5169218 5169239 5169235 5169240 +
gaattcttctggtcctccctac

SEQ ID NO: 73956 - DNA, 22 bp, Artificial Sequence
  Synthetic oligonucleotide; TTC chr11 5169224 5169245 5169241 5169246 +
ttctggtcctccctaccttttt

SEQ ID NO: 73957 - DNA, 22 bp, Artificial Sequence
  Synthetic oligonucleotide; CTT chr11 5169226 5169247 5169243 5169248 +
ctggtcctccctacctttttgt

SEQ ID NO: 73958 - DNA, 22 bp, Artificial Sequence
  Synthetic oligonucleotide; TTC chr11 5169227 5169248 5169244 5169249 +
tggtcctccctacctttttgtt

SEQ ID NO: 73959 - DNA, 22 bp, Artificial Sequence
  Synthetic oligonucleotide; CTG chr11 5169229 5169250 5169246 5169251 +
gtcctccctacctttttgtttg

SEQ ID NO: 73960 - DNA, 22 bp, Artificial Sequence
  Synthetic oligonucleotide; CTC chr11 5169235 5169256 5169252 5169257 +
cctacctttttgtttgtcagaa

SEQ ID NO: 73961 - DNA, 22 bp, Artificial Sequence
  Synthetic oligonucleotide; CTA chr11 5169239 5169260 5169256 5169261 +
cctttttgtttgtcagaagctt

SEQ ID NO: 73962 - DNA, 22 bp, Artificial Sequence
  Synthetic oligonucleotide; CTT chr11 5169243 5169264 5169260 5169265 +
tttgtttgtcagaagcttgtct

SEQ ID NO: 73963 - DNA, 22 bp, Artificial Sequence
  Synthetic oligonucleotide; TTT chr11 5169244 5169265 5169261 5169266 +
ttgtttgtcagaagcttgtcta

SEQ ID NO: 73964 - DNA, 22 bp, Artificial Sequence
  Synthetic oligonucleotide; TTT chr11 5169245 5169266 5169262 5169267 +
tgtttgtcagaagcttgtctac

SEQ ID NO: 73965 - DNA, 22 bp, Artificial Sequence
  Synthetic oligonucleotide; TTT chr11 5169246 5169267 5169263 5169268 +
gtttgtcagaagcttgtctact

SEQ ID NO: 73966 - DNA, 22 bp, Artificial Sequence
  Synthetic oligonucleotide; TTG chr11 5169247 5169268 5169264 5169269 +
tttgtcagaagcttgtctacta

SEQ ID NO: 73967 - DNA, 22 bp, Artificial Sequence
  Synthetic oligonucleotide; TTT chr11 5169250 5169271 5169267 5169272 +
gtcagaagcttgtctactaccg

SEQ ID NO: 73968 - DNA, 22 bp, Artificial Sequence
  Synthetic oligonucleotide; TTG chr11 5169251 5169272 5169268 5169273 +
tcagaagcttgtctactaccga

SEQ ID NO: 73969 - DNA, 22 bp, Artificial Sequence
  Synthetic oligonucleotide; CTT chr11 5169261 5169282 5169278 5169283 +
gtctactaccgagtgattgatg

SEQ ID NO: 73970 - DNA, 22 bp, Artificial Sequence
  Synthetic oligonucleotide; TTG chr11 5169262 5169283 5169279 5169284 +
tctactaccgagtgattgatgt

SEQ ID NO: 73971 - DNA, 22 bp, Artificial Sequence
  Synthetic oligonucleotide; CTA chr11 5169266 5169287 5169283 5169288 +
ctaccgagtgattgatgtcacc

SEQ ID NO: 73972 - DNA, 22 bp, Artificial Sequence
  Synthetic oligonucleotide; CTA chr11 5169269 5169290 5169286 5169291 +
ccgagtgattgatgtcaccaaa

SEQ ID NO: 73973 - DNA, 22 bp, Artificial Sequence
  Synthetic oligonucleotide; TTG chr11 5169280 5169301 5169297 5169302 +
atgtcaccaaagactattgcag

SEQ ID NO: 73974 - DNA, 22 bp, Artificial Sequence
  Synthetic oligonucleotide; CTA chr11 5169296 5169317 5169313 5169318 +
ttgcaggagtaggccttgcttt

SEQ ID NO: 73975 - DNA, 22 bp, Artificial Sequence
  Synthetic oligonucleotide; TTG chr11 5169299 5169320 5169316 5169321 +
caggagtaggccttgctttttc

SEQ ID NO: 73976 - DNA, 22 bp, Artificial Sequence
  Synthetic oligonucleotide; CTT chr11 5169313 5169334 5169330 5169335 +
gctttttctgttttttagttat

SEQ ID NO: 73977 - DNA, 22 bp, Artificial Sequence
  Synthetic oligonucleotide; TTG chr11 5169314 5169335 5169331 5169336 +
ctttttctgttttttagttatt

SEQ ID NO: 73978 - DNA, 22 bp, Artificial Sequence
  Synthetic oligonucleotide; CTT chr11 5169317 5169338 5169334 5169339 +
tttctgttttttagttattttc

SEQ ID NO: 73979 - DNA, 22 bp, Artificial Sequence
  Synthetic oligonucleotide; TTT chr11 5169318 5169339 5169335 5169340 +
ttctgttttttagttattttct

SEQ ID NO: 73980 - DNA, 22 bp, Artificial Sequence
  Synthetic oligonucleotide; TTT chr11 5169319 5169340 5169336 5169341 +
tctgttttttagttattttctt

SEQ ID NO: 73981 - DNA, 22 bp, Artificial Sequence
  Synthetic oligonucleotide; TTT chr11 5169320 5169341 5169337 5169342 +
ctgttttttagttattttcttc

SEQ ID NO: 73982 - DNA, 22 bp, Artificial Sequence
  Synthetic oligonucleotide; TTC chr11 5169321 5169342 5169338 5169343 +
tgttttttagttattttcttct

SEQ ID NO: 73983 - DNA, 22 bp, Artificial Sequence
  Synthetic oligonucleotide; CTG chr11 5169323 5169344 5169340 5169345 +
ttttttagttattttcttctaa

SEQ ID NO: 73984 - DNA, 22 bp, Artificial Sequence
  Synthetic oligonucleotide; TTT chr11 5169326 5169347 5169343 5169348 +
tttagttattttcttctaaaac

SEQ ID NO: 73985 - DNA, 22 bp, Artificial Sequence
  Synthetic oligonucleotide; TTT chr11 5169327 5169348 5169344 5169349 +
ttagttattttcttctaaaaca

SEQ ID NO: 73986 - DNA, 22 bp, Artificial Sequence
  Synthetic oligonucleotide; TTT chr11 5169328 5169349 5169345 5169350 +
tagttattttcttctaaaacag

SEQ ID NO: 73987 - DNA, 22 bp, Artificial Sequence
  Synthetic oligonucleotide; TTT chr11 5169329 5169350 5169346 5169351 +
agttattttcttctaaaacagt

SEQ ID NO: 73988 - DNA, 22 bp, Artificial Sequence
  Synthetic oligonucleotide; TTA chr11 5169330 5169351 5169347 5169352 +
gttattttcttctaaaacagta

SEQ ID NO: 73989 - DNA, 22 bp, Artificial Sequence
  Synthetic oligonucleotide; TTA chr11 5169334 5169355 5169351 5169356 +
ttttcttctaaaacagtatttt

SEQ ID NO: 73990 - DNA, 22 bp, Artificial Sequence
  Synthetic oligonucleotide; TTT chr11 5169337 5169358 5169354 5169359 +
tcttctaaaacagtattttcaa

SEQ ID NO: 73991 - DNA, 22 bp, Artificial Sequence
  Synthetic oligonucleotide; TTT chr11 5169338 5169359 5169355 5169360 +
cttctaaaacagtattttcaag

SEQ ID NO: 73992 - DNA, 22 bp, Artificial Sequence
  Synthetic oligonucleotide; TTC chr11 5169339 5169360 5169356 5169361 +
ttctaaaacagtattttcaagt

SEQ ID NO: 73993 - DNA, 22 bp, Artificial Sequence
  Synthetic oligonucleotide; CTT chr11 5169341 5169362 5169358 5169363 +
ctaaaacagtattttcaagtag

SEQ ID NO: 73994 - DNA, 22 bp, Artificial Sequence
  Synthetic oligonucleotide; TTC chr11 5169342 5169363 5169359 5169364 +
taaaacagtattttcaagtagt

SEQ ID NO: 73995 - DNA, 22 bp, Artificial Sequence
  Synthetic oligonucleotide; CTA chr11 5169344 5169365 5169361 5169366 +
aaacagtattttcaagtagttg

SEQ ID NO: 73996 - DNA, 22 bp, Artificial Sequence
  Synthetic oligonucleotide; TTT chr11 5169355 5169376 5169372 5169377 +
tcaagtagttgtggtttttttt

SEQ ID NO: 73997 - DNA, 22 bp, Artificial Sequence
  Synthetic oligonucleotide; TTT chr11 5169356 5169377 5169373 5169378 +
caagtagttgtggttttttttc

SEQ ID NO: 73998 - DNA, 22 bp, Artificial Sequence
  Synthetic oligonucleotide; TTC chr11 5169357 5169378 5169374 5169379 +
aagtagttgtggttttttttct

SEQ ID NO: 73999 - DNA, 22 bp, Artificial Sequence
  Synthetic oligonucleotide; TTG chr11 5169366 5169387 5169383 5169388 +
tggttttttttctttctagtat

SEQ ID NO: 74000 - DNA, 22 bp, Artificial Sequence
  Synthetic oligonucleotide; TTT chr11 5169372 5169393 5169389 5169394 +
tttttctttctagtattgaact

SEQ ID NO: 74001 - DNA, 22 bp, Artificial Sequence
  Synthetic oligonucleotide; TTT chr11 5169373 5169394 5169390 5169395 +
ttttctttctagtattgaactc

SEQ ID NO: 74002 - DNA, 22 bp, Artificial Sequence
  Synthetic oligonucleotide; TTT chr11 5169374 5169395 5169391 5169396 +
tttctttctagtattgaactca

SEQ ID NO: 74003 - DNA, 22 bp, Artificial Sequence
  Synthetic oligonucleotide; TTT chr11 5169375 5169396 5169392 5169397 +
ttctttctagtattgaactcat

SEQ ID NO: 74004 - DNA, 22 bp, Artificial Sequence
  Synthetic oligonucleotide; TTT chr11 5169376 5169397 5169393 5169398 +
tctttctagtattgaactcatt

SEQ ID NO: 74005 - DNA, 22 bp, Artificial Sequence
  Synthetic oligonucleotide; TTT chr11 5169377 5169398 5169394 5169399 +
ctttctagtattgaactcatta

SEQ ID NO: 74006 - DNA, 22 bp, Artificial Sequence
  Synthetic oligonucleotide; TTC chr11 5169378 5169399 5169395 5169400 +
tttctagtattgaactcattaa

SEQ ID NO: 74007 - DNA, 22 bp, Artificial Sequence
  Synthetic oligonucleotide; CTT chr11 5169380 5169401 5169397 5169402 +
tctagtattgaactcattaaaa

SEQ ID NO: 74008 - DNA, 22 bp, Artificial Sequence
  Synthetic oligonucleotide; TTT chr11 5169381 5169402 5169398 5169403 +
ctagtattgaactcattaaaaa

SEQ ID NO: 74009 - DNA, 22 bp, Artificial Sequence
  Synthetic oligonucleotide; TTC chr11 5169382 5169403 5169399 5169404 +
tagtattgaactcattaaaaat

SEQ ID NO: 74010 - DNA, 22 bp, Artificial Sequence
  Synthetic oligonucleotide; CTA chr11 5169384 5169405 5169401 5169406 +
gtattgaactcattaaaaataa

SEQ ID NO: 74011 - DNA, 22 bp, Artificial Sequence
  Synthetic oligonucleotide; TTG chr11 5169390 5169411 5169407 5169412 +
aactcattaaaaataaaatagc

SEQ ID NO: 74012 - DNA, 22 bp, Artificial Sequence
  Synthetic oligonucleotide; CTC chr11 5169395 5169416 5169412 5169417 +
attaaaaataaaatagctttct

SEQ ID NO: 74013 - DNA, 22 bp, Artificial Sequence
  Synthetic oligonucleotide; TTA chr11 5169399 5169420 5169416 5169421 +
aaaataaaatagctttctaaag

SEQ ID NO: 74014 - DNA, 22 bp, Artificial Sequence
  Synthetic oligonucleotide; CTT chr11 5169414 5169435 5169431 5169436 +
tctaaagccaaacagtttcctc

SEQ ID NO: 74015 - DNA, 22 bp, Artificial Sequence
  Synthetic oligonucleotide; TTT chr11 5169415 5169436 5169432 5169437 +
ctaaagccaaacagtttcctcc

SEQ ID NO: 74016 - DNA, 22 bp, Artificial Sequence
  Synthetic oligonucleotide; TTC chr11 5169416 5169437 5169433 5169438 +
taaagccaaacagtttcctcct

SEQ ID NO: 74017 - DNA, 22 bp, Artificial Sequence
  Synthetic oligonucleotide; CTA chr11 5169418 5169439 5169435 5169440 +
aagccaaacagtttcctcctga

SEQ ID NO: 74018 - DNA, 22 bp, Artificial Sequence
  Synthetic oligonucleotide; TTT chr11 5169432 5169453 5169449 5169454 +
cctcctgaccagttaaaagtta

SEQ ID NO: 74019 - DNA, 22 bp, Artificial Sequence
  Synthetic oligonucleotide; TTC chr11 5169433 5169454 5169450 5169455 +
ctcctgaccagttaaaagttat

SEQ ID NO: 74020 - DNA, 22 bp, Artificial Sequence
  Synthetic oligonucleotide; CTC chr11 5169436 5169457 5169453 5169458 +
ctgaccagttaaaagttatctc

SEQ ID NO: 74021 - DNA, 22 bp, Artificial Sequence
  Synthetic oligonucleotide; CTG chr11 5169439 5169460 5169456 5169461 +
accagttaaaagttatctctgc

SEQ ID NO: 74022 - DNA, 22 bp, Artificial Sequence
  Synthetic oligonucleotide; TTA chr11 5169447 5169468 5169464 5169469 +
aaagttatctctgcttcatggt

SEQ ID NO: 74023 - DNA, 22 bp, Artificial Sequence
  Synthetic oligonucleotide; TTA chr11 5169454 5169475 5169471 5169476 +
tctctgcttcatggtgcatatt

SEQ ID NO: 74024 - DNA, 22 bp, Artificial Sequence
  Synthetic oligonucleotide; CTC chr11 5169458 5169479 5169475 5169480 +
tgcttcatggtgcatattcaat

SEQ ID NO: 74025 - DNA, 22 bp, Artificial Sequence
  Synthetic oligonucleotide; CTG chr11 5169460 5169481 5169477 5169482 +
cttcatggtgcatattcaatta

SEQ ID NO: 74026 - DNA, 22 bp, Artificial Sequence
  Synthetic oligonucleotide; CTT chr11 5169463 5169484 5169480 5169485 +
catggtgcatattcaattaaga

SEQ ID NO: 74027 - DNA, 22 bp, Artificial Sequence
  Synthetic oligonucleotide; TTC chr11 5169464 5169485 5169481 5169486 +
atggtgcatattcaattaagat

SEQ ID NO: 74028 - DNA, 22 bp, Artificial Sequence
  Synthetic oligonucleotide; TTC chr11 5169477 5169498 5169494 5169499 +
aattaagatttaacattagcac

SEQ ID NO: 74029 - DNA, 22 bp, Artificial Sequence
  Synthetic oligonucleotide; TTA chr11 5169482 5169503 5169499 5169504 +
agatttaacattagcacactga

SEQ ID NO: 74030 - DNA, 22 bp, Artificial Sequence
  Synthetic oligonucleotide; TTT chr11 5169488 5169509 5169505 5169510 +
aacattagcacactgagtataa

SEQ ID NO: 74031 - DNA, 22 bp, Artificial Sequence
  Synthetic oligonucleotide; TTA chr11 5169489 5169510 5169506 5169511 +
acattagcacactgagtataat

SEQ ID NO: 74032 - DNA, 22 bp, Artificial Sequence
  Synthetic oligonucleotide; TTA chr11 5169495 5169516 5169512 5169517 +
gcacactgagtataattttttt

SEQ ID NO: 74033 - DNA, 22 bp, Artificial Sequence
  Synthetic oligonucleotide; CTG chr11 5169503 5169524 5169520 5169525 +
agtataatttttttaagaatct

SEQ ID NO: 74034 - DNA, 22 bp, Artificial Sequence
  Synthetic oligonucleotide; TTT chr11 5169513 5169534 5169530 5169535 +
ttttaagaatctttttattaca

SEQ ID NO: 74035 - DNA, 22 bp, Artificial Sequence
  Synthetic oligonucleotide; TTT chr11 5169514 5169535 5169531 5169536 +
tttaagaatctttttattacag

SEQ ID NO: 74036 - DNA, 22 bp, Artificial Sequence
  Synthetic oligonucleotide; TTT chr11 5169515 5169536 5169532 5169537 +
ttaagaatctttttattacaga

SEQ ID NO: 74037 - DNA, 22 bp, Artificial Sequence
  Synthetic oligonucleotide; TTT chr11 5169516 5169537 5169533 5169538 +
taagaatctttttattacagaa

SEQ ID NO: 74038 - DNA, 22 bp, Artificial Sequence
  Synthetic oligonucleotide; TTT chr11 5169517 5169538 5169534 5169539 +
aagaatctttttattacagaaa

SEQ ID NO: 74039 - DNA, 22 bp, Artificial Sequence
  Synthetic oligonucleotide; TTA chr11 5169518 5169539 5169535 5169540 +
agaatctttttattacagaaat

SEQ ID NO: 74040 - DNA, 22 bp, Artificial Sequence
  Synthetic oligonucleotide; CTT chr11 5169526 5169547 5169543 5169548 +
tttattacagaaattgtaaact

SEQ ID NO: 74041 - DNA, 22 bp, Artificial Sequence
  Synthetic oligonucleotide; TTT chr11 5169527 5169548 5169544 5169549 +
ttattacagaaattgtaaacta

SEQ ID NO: 74042 - DNA, 22 bp, Artificial Sequence
  Synthetic oligonucleotide; TTT chr11 5169528 5169549 5169545 5169550 +
tattacagaaattgtaaactac

SEQ ID NO: 74043 - DNA, 22 bp, Artificial Sequence
  Synthetic oligonucleotide; TTT chr11 5169529 5169550 5169546 5169551 +
attacagaaattgtaaactaca

SEQ ID NO: 74044 - DNA, 22 bp, Artificial Sequence
  Synthetic oligonucleotide; TTA chr11 5169530 5169551 5169547 5169552 +
ttacagaaattgtaaactacac

SEQ ID NO: 74045 - DNA, 22 bp, Artificial Sequence
  Synthetic oligonucleotide; TTA chr11 5169533 5169554 5169550 5169555 +
cagaaattgtaaactacacaaa

SEQ ID NO: 74046 - DNA, 22 bp, Artificial Sequence
  Synthetic oligonucleotide; TTG chr11 5169542 5169563 5169559 5169564 +
taaactacacaaagtaaacaga

SEQ ID NO: 74047 - DNA, 22 bp, Artificial Sequence
  Synthetic oligonucleotide; CTA chr11 5169549 5169570 5169566 5169571 +
cacaaagtaaacagaatattat

SEQ ID NO: 74048 - DNA, 22 bp, Artificial Sequence
  Synthetic oligonucleotide; TTA chr11 5169570 5169591 5169587 5169592 +
taattaatttccaggcacccat

SEQ ID NO: 74049 - DNA, 22 bp, Artificial Sequence
  Synthetic oligonucleotide; TTA chr11 5169576 5169597 5169593 5169598 +
atttccaggcacccatgacaca

SEQ ID NO: 74050 - DNA, 22 bp, Artificial Sequence
  Synthetic oligonucleotide; TTT chr11 5169580 5169601 5169597 5169602 +
ccaggcacccatgacacaactt

SEQ ID NO: 74051 - DNA, 22 bp, Artificial Sequence
  Synthetic oligonucleotide; TTC chr11 5169581 5169602 5169598 5169603 +
caggcacccatgacacaacttc

SEQ ID NO: 74052 - DNA, 22 bp, Artificial Sequence
  Synthetic oligonucleotide; CTT chr11 5169602 5169623 5169619 5169624 +
caacaattatcaacattacacc

SEQ ID NO: 74053 - DNA, 22 bp, Artificial Sequence
  Synthetic oligonucleotide; TTC chr11 5169603 5169624 5169620 5169625 +
aacaattatcaacattacacca

SEQ ID NO: 74054 - DNA, 22 bp, Artificial Sequence
  Synthetic oligonucleotide; TTA chr11 5169611 5169632 5169628 5169633 +
tcaacattacaccattcttgta

SEQ ID NO: 74055 - DNA, 22 bp, Artificial Sequence
  Synthetic oligonucleotide; TTA chr11 5169620 5169641 5169637 5169642 +
caccattcttgtattttccaca

SEQ ID NO: 74056 - DNA, 22 bp, Artificial Sequence
  Synthetic oligonucleotide; TTC chr11 5169628 5169649 5169645 5169650 +
ttgtattttccacacttgtatt

SEQ ID NO: 74057 - DNA, 22 bp, Artificial Sequence
  Synthetic oligonucleotide; CTT chr11 5169630 5169651 5169647 5169652 +
gtattttccacacttgtattca

SEQ ID NO: 74058 - DNA, 22 bp, Artificial Sequence
  Synthetic oligonucleotide; TTG chr11 5169631 5169652 5169648 5169653 +
tattttccacacttgtattcac

SEQ ID NO: 74059 - DNA, 22 bp, Artificial Sequence
  Synthetic oligonucleotide; TTT chr11 5169636 5169657 5169653 5169658 +
tccacacttgtattcactatga

SEQ ID NO: 74060 - DNA, 22 bp, Artificial Sequence
  Synthetic oligonucleotide; TTT chr11 5169637 5169658 5169654 5169659 +
ccacacttgtattcactatgaa

SEQ ID NO: 74061 - DNA, 22 bp, Artificial Sequence
  Synthetic oligonucleotide; TTC chr11 5169638 5169659 5169655 5169660 +
cacacttgtattcactatgaaa

SEQ ID NO: 74062 - DNA, 22 bp, Artificial Sequence
  Synthetic oligonucleotide; CTT chr11 5169645 5169666 5169662 5169667 +
gtattcactatgaaatctaatc

SEQ ID NO: 74063 - DNA, 22 bp, Artificial Sequence
  Synthetic oligonucleotide; TTG chr11 5169646 5169667 5169663 5169668 +
tattcactatgaaatctaatca

SEQ ID NO: 74064 - DNA, 22 bp, Artificial Sequence
  Synthetic oligonucleotide; TTC chr11 5169651 5169672 5169668 5169673 +
actatgaaatctaatcatctgt

SEQ ID NO: 74065 - DNA, 22 bp, Artificial Sequence
  Synthetic oligonucleotide; CTA chr11 5169655 5169676 5169672 5169677 +
tgaaatctaatcatctgtatta

SEQ ID NO: 74066 - DNA, 22 bp, Artificial Sequence
  Synthetic oligonucleotide; CTA chr11 5169664 5169685 5169681 5169686 +
atcatctgtattattattacta

SEQ ID NO: 74067 - DNA, 22 bp, Artificial Sequence
  Synthetic oligonucleotide; CTG chr11 5169672 5169693 5169689 5169694 +
tattattattactattttcctt

SEQ ID NO: 74068 - DNA, 22 bp, Artificial Sequence
  Synthetic oligonucleotide; TTA chr11 5169677 5169698 5169694 5169699 +
ttattactattttcctttttgt

SEQ ID NO: 74069 - DNA, 22 bp, Artificial Sequence
  Synthetic oligonucleotide; TTA chr11 5169680 5169701 5169697 5169702 +
ttactattttcctttttgttat

SEQ ID NO: 74070 - DNA, 22 bp, Artificial Sequence
  Synthetic oligonucleotide; TTA chr11 5169683 5169704 5169700 5169705 +
ctattttcctttttgttattat

SEQ ID NO: 74071 - DNA, 22 bp, Artificial Sequence
  Synthetic oligonucleotide; CTA chr11 5169686 5169707 5169703 5169708 +
ttttcctttttgttattattat

SEQ ID NO: 74072 - DNA, 22 bp, Artificial Sequence
  Synthetic oligonucleotide; TTT chr11 5169689 5169710 5169706 5169711 +
tcctttttgttattattatcat

SEQ ID NO: 74073 - DNA, 22 bp, Artificial Sequence
  Synthetic oligonucleotide; TTT chr11 5169690 5169711 5169707 5169712 +
cctttttgttattattatcatt

SEQ ID NO: 74074 - DNA, 22 bp, Artificial Sequence
  Synthetic oligonucleotide; TTC chr11 5169691 5169712 5169708 5169713 +
ctttttgttattattatcattc

SEQ ID NO: 74075 - DNA, 22 bp, Artificial Sequence
  Synthetic oligonucleotide; CTT chr11 5169694 5169715 5169711 5169716 +
tttgttattattatcattcaga

SEQ ID NO: 74076 - DNA, 22 bp, Artificial Sequence
  Synthetic oligonucleotide; TTT chr11 5169695 5169716 5169712 5169717 +
ttgttattattatcattcagaa

SEQ ID NO: 74077 - DNA, 22 bp, Artificial Sequence
  Synthetic oligonucleotide; TTT chr11 5169696 5169717 5169713 5169718 +
tgttattattatcattcagaag

SEQ ID NO: 74078 - DNA, 22 bp, Artificial Sequence
  Synthetic oligonucleotide; TTT chr11 5169697 5169718 5169714 5169719 +
gttattattatcattcagaagt

SEQ ID NO: 74079 - DNA, 22 bp, Artificial Sequence
  Synthetic oligonucleotide; TTG chr11 5169698 5169719 5169715 5169720 +
ttattattatcattcagaagtt

SEQ ID NO: 74080 - DNA, 22 bp, Artificial Sequence
  Synthetic oligonucleotide; TTA chr11 5169701 5169722 5169718 5169723 +
ttattatcattcagaagttttg

SEQ ID NO: 74081 - DNA, 22 bp, Artificial Sequence
  Synthetic oligonucleotide; TTA chr11 5169704 5169725 5169721 5169726 +
ttatcattcagaagttttgatg

SEQ ID NO: 74082 - DNA, 22 bp, Artificial Sequence
  Synthetic oligonucleotide; TTA chr11 5169707 5169728 5169724 5169729 +
tcattcagaagttttgatgtaa

SEQ ID NO: 74083 - DNA, 22 bp, Artificial Sequence
  Synthetic oligonucleotide; TTC chr11 5169713 5169734 5169730 5169735 +
agaagttttgatgtaaaattga

SEQ ID NO: 74084 - DNA, 22 bp, Artificial Sequence
  Synthetic oligonucleotide; TTT chr11 5169721 5169742 5169738 5169743 +
tgatgtaaaattgatgtaccta

SEQ ID NO: 74085 - DNA, 22 bp, Artificial Sequence
  Synthetic oligonucleotide; TTT chr11 5169722 5169743 5169739 5169744 +
gatgtaaaattgatgtacctag

SEQ ID NO: 74086 - DNA, 22 bp, Artificial Sequence
  Synthetic oligonucleotide; TTG chr11 5169723 5169744 5169740 5169745 +
atgtaaaattgatgtacctaga

SEQ ID NO: 74087 - DNA, 22 bp, Artificial Sequence
  Synthetic oligonucleotide; TTG chr11 5169734 5169755 5169751 5169756 +
atgtacctagaaatgtgcaaat

SEQ ID NO: 74088 - DNA, 22 bp, Artificial Sequence
  Synthetic oligonucleotide; CTA chr11 5169743 5169764 5169760 5169765 +
gaaatgtgcaaatcttagctgt

SEQ ID NO: 74089 - DNA, 22 bp, Artificial Sequence
  Synthetic oligonucleotide; CTT chr11 5169759 5169780 5169776 5169781 +
agctgtaccgttttgacaaatt

SEQ ID NO: 74090 - DNA, 22 bp, Artificial Sequence
  Synthetic oligonucleotide; TTA chr11 5169760 5169781 5169777 5169782 +
gctgtaccgttttgacaaattg

SEQ ID NO: 74091 - DNA, 22 bp, Artificial Sequence
  Synthetic oligonucleotide; CTG chr11 5169764 5169785 5169781 5169786 +
taccgttttgacaaattgacaa

SEQ ID NO: 74092 - DNA, 22 bp, Artificial Sequence
  Synthetic oligonucleotide; TTT chr11 5169772 5169793 5169789 5169794 +
tgacaaattgacaaaacaatgt

SEQ ID NO: 74093 - DNA, 22 bp, Artificial Sequence
  Synthetic oligonucleotide; TTT chr11 5169773 5169794 5169790 5169795 +
gacaaattgacaaaacaatgtc

SEQ ID NO: 74094 - DNA, 22 bp, Artificial Sequence
  Synthetic oligonucleotide; TTG chr11 5169774 5169795 5169791 5169796 +
acaaattgacaaaacaatgtca

SEQ ID NO: 74095 - DNA, 22 bp, Artificial Sequence
  Synthetic oligonucleotide; TTG chr11 5169782 5169803 5169799 5169804 +
acaaaacaatgtcaccacatcc

SEQ ID NO: 74096 - DNA, 22 bp, Artificial Sequence
  Synthetic oligonucleotide; CTA chr11 5169807 5169828 5169824 5169829 +
acacaacaaaatatttccatct

SEQ ID NO: 74097 - DNA, 22 bp, Artificial Sequence
  Synthetic oligonucleotide; TTT chr11 5169823 5169844 5169840 5169845 +
ccatctccccagaaattgcctc

SEQ ID NO: 74098 - DNA, 22 bp, Artificial Sequence
  Synthetic oligonucleotide; TTC chr11 5169824 5169845 5169841 5169846 +
catctccccagaaattgcctca

SEQ ID NO: 74099 - DNA, 22 bp, Artificial Sequence
  Synthetic oligonucleotide; CTC chr11 5169830 5169851 5169847 5169852 +
cccagaaattgcctcatgtctc

SEQ ID NO: 74100 - DNA, 22 bp, Artificial Sequence
  Synthetic oligonucleotide; TTG chr11 5169841 5169862 5169858 5169863 +
cctcatgtctctccccattctt

SEQ ID NO: 74101 - DNA, 22 bp, Artificial Sequence
  Synthetic oligonucleotide; CTC chr11 5169845 5169866 5169862 5169867 +
atgtctctccccattcttccat

SEQ ID NO: 74102 - DNA, 22 bp, Artificial Sequence
  Synthetic oligonucleotide; CTC chr11 5169852 5169873 5169869 5169874 +
tccccattcttccatctttata

SEQ ID NO: 74103 - DNA, 22 bp, Artificial Sequence
  Synthetic oligonucleotide; CTC chr11 5169854 5169875 5169871 5169876 +
cccattcttccatctttatatc

SEQ ID NO: 74104 - DNA, 22 bp, Artificial Sequence
  Synthetic oligonucleotide; TTC chr11 5169861 5169882 5169878 5169883 +
ttccatctttatatccatcaga

SEQ ID NO: 74105 - DNA, 22 bp, Artificial Sequence
  Synthetic oligonucleotide; CTT chr11 5169863 5169884 5169880 5169885 +
ccatctttatatccatcagagg

SEQ ID NO: 74106 - DNA, 22 bp, Artificial Sequence
  Synthetic oligonucleotide; TTC chr11 5169864 5169885 5169881 5169886 +
catctttatatccatcagaggt

SEQ ID NO: 74107 - DNA, 22 bp, Artificial Sequence
  Synthetic oligonucleotide; CTT chr11 5169870 5169891 5169887 5169892 +
tatatccatcagaggtaagcag

SEQ ID NO: 74108 - DNA, 22 bp, Artificial Sequence
  Synthetic oligonucleotide; TTT chr11 5169871 5169892 5169888 5169893 +
atatccatcagaggtaagcagg

SEQ ID NO: 74109 - DNA, 22 bp, Artificial Sequence
  Synthetic oligonucleotide; TTA chr11 5169872 5169893 5169889 5169894 +
tatccatcagaggtaagcaggg

SEQ ID NO: 74110 - DNA, 22 bp, Artificial Sequence
  Synthetic oligonucleotide; TTC chr11 5169897 5169918 5169914 5169919 +
tgattttttgacattaaattag

SEQ ID NO: 74111 - DNA, 22 bp, Artificial Sequence
  Synthetic oligonucleotide; CTG chr11 5169899 5169920 5169916 5169921 +
attttttgacattaaattagat

SEQ ID NO: 74112 - DNA, 22 bp, Artificial Sequence
  Synthetic oligonucleotide; TTT chr11 5169903 5169924 5169920 5169925 +
tttgacattaaattagatgtac

SEQ ID NO: 74113 - DNA, 22 bp, Artificial Sequence
  Synthetic oligonucleotide; TTT chr11 5169904 5169925 5169921 5169926 +
ttgacattaaattagatgtaca

SEQ ID NO: 74114 - DNA, 22 bp, Artificial Sequence
  Synthetic oligonucleotide; TTT chr11 5169905 5169926 5169922 5169927 +
tgacattaaattagatgtacat

SEQ ID NO: 74115 - DNA, 22 bp, Artificial Sequence
  Synthetic oligonucleotide; TTT chr11 5169906 5169927 5169923 5169928 +
gacattaaattagatgtacatg

SEQ ID NO: 74116 - DNA, 22 bp, Artificial Sequence
  Synthetic oligonucleotide; TTG chr11 5169907 5169928 5169924 5169929 +
acattaaattagatgtacatgt

SEQ ID NO: 74117 - DNA, 22 bp, Artificial Sequence
  Synthetic oligonucleotide; TTA chr11 5169913 5169934 5169930 5169935 +
aattagatgtacatgttctgaa

SEQ ID NO: 74118 - DNA, 22 bp, Artificial Sequence
  Synthetic oligonucleotide; TTA chr11 5169918 5169939 5169935 5169940 +
gatgtacatgttctgaaactat

SEQ ID NO: 74119 - DNA, 22 bp, Artificial Sequence
  Synthetic oligonucleotide; TTC chr11 5169931 5169952 5169948 5169953 +
tgaaactatacaaacaaaataa

SEQ ID NO: 74120 - DNA, 22 bp, Artificial Sequence
  Synthetic oligonucleotide; CTG chr11 5169933 5169954 5169950 5169955 +
aaactatacaaacaaaataata

SEQ ID NO: 74121 - DNA, 22 bp, Artificial Sequence
  Synthetic oligonucleotide; CTA chr11 5169939 5169960 5169956 5169961 +
tacaaacaaaataatacaatat

SEQ ID NO: 74122 - DNA, 22 bp, Artificial Sequence
  Synthetic oligonucleotide; CTC chr11 5169967 5169988 5169984 5169989 +
ttttgtgtcctgattattttcc

SEQ ID NO: 74123 - DNA, 22 bp, Artificial Sequence
  Synthetic oligonucleotide; CTT chr11 5169969 5169990 5169986 5169991 +
ttgtgtcctgattattttcctt

SEQ ID NO: 74124 - DNA, 22 bp, Artificial Sequence
  Synthetic oligonucleotide; TTT chr11 5169970 5169991 5169987 5169992 +
tgtgtcctgattattttccttc

SEQ ID NO: 74125 - DNA, 22 bp, Artificial Sequence
  Synthetic oligonucleotide; TTT chr11 5169971 5169992 5169988 5169993 +
gtgtcctgattattttccttca

SEQ ID NO: 74126 - DNA, 22 bp, Artificial Sequence
  Synthetic oligonucleotide; TTG chr11 5169972 5169993 5169989 5169994 +
tgtcctgattattttccttcac

SEQ ID NO: 74127 - DNA, 22 bp, Artificial Sequence
  Synthetic oligonucleotide; CTG chr11 5169979 5170000 5169996 5170001 +
attattttccttcacaagtatg

SEQ ID NO: 74128 - DNA, 22 bp, Artificial Sequence
  Synthetic oligonucleotide; TTA chr11 5169983 5170004 5170000 5170005 +
ttttccttcacaagtatgtatc

SEQ ID NO: 74129 - DNA, 22 bp, Artificial Sequence
  Synthetic oligonucleotide; TTT chr11 5169986 5170007 5170003 5170008 +
tccttcacaagtatgtatcact

SEQ ID NO: 74130 - DNA, 22 bp, Artificial Sequence
  Synthetic oligonucleotide; TTT chr11 5169987 5170008 5170004 5170009 +
ccttcacaagtatgtatcacta

SEQ ID NO: 74131 - DNA, 22 bp, Artificial Sequence
  Synthetic oligonucleotide; TTC chr11 5169988 5170009 5170005 5170010 +
cttcacaagtatgtatcactaa

SEQ ID NO: 74132 - DNA, 22 bp, Artificial Sequence
  Synthetic oligonucleotide; CTT chr11 5169991 5170012 5170008 5170013 +
cacaagtatgtatcactaattt

SEQ ID NO: 74133 - DNA, 22 bp, Artificial Sequence
  Synthetic oligonucleotide; TTC chr11 5169992 5170013 5170009 5170014 +
acaagtatgtatcactaatttt

SEQ ID NO: 74134 - DNA, 22 bp, Artificial Sequence
  Synthetic oligonucleotide; CTA chr11 5170009 5170030 5170026 5170031 +
attttaatataaccagaaactt

SEQ ID NO: 74135 - DNA, 22 bp, Artificial Sequence
  Synthetic oligonucleotide; TTT chr11 5170013 5170034 5170030 5170035 +
taatataaccagaaacttaaac

SEQ ID NO: 74136 - DNA, 22 bp, Artificial Sequence
  Synthetic oligonucleotide; TTT chr11 5170014 5170035 5170031 5170036 +
aatataaccagaaacttaaacc

SEQ ID NO: 74137 - DNA, 22 bp, Artificial Sequence
  Synthetic oligonucleotide; TTA chr11 5170015 5170036 5170032 5170037 +
atataaccagaaacttaaacct

SEQ ID NO: 74138 - DNA, 22 bp, Artificial Sequence
  Synthetic oligonucleotide; CTT chr11 5170031 5170052 5170048 5170053 +
aaacctccccaagactctttct

SEQ ID NO: 74139 - DNA, 22 bp, Artificial Sequence
  Synthetic oligonucleotide; TTA chr11 5170032 5170053 5170049 5170054 +
aacctccccaagactctttcta

SEQ ID NO: 74140 - DNA, 22 bp, Artificial Sequence
  Synthetic oligonucleotide; CTC chr11 5170038 5170059 5170055 5170060 +
cccaagactctttctacatatt

SEQ ID NO: 74141 - DNA, 22 bp, Artificial Sequence
  Synthetic oligonucleotide; CTC chr11 5170048 5170069 5170065 5170070 +
tttctacatattcccagaacca

SEQ ID NO: 74142 - DNA, 22 bp, Artificial Sequence
  Synthetic oligonucleotide; CTT chr11 5170050 5170071 5170067 5170072 +
tctacatattcccagaaccaaa

SEQ ID NO: 74143 - DNA, 22 bp, Artificial Sequence
  Synthetic oligonucleotide; TTT chr11 5170051 5170072 5170068 5170073 +
ctacatattcccagaaccaaat

SEQ ID NO: 74144 - DNA, 22 bp, Artificial Sequence
  Synthetic oligonucleotide; TTC chr11 5170052 5170073 5170069 5170074 +
tacatattcccagaaccaaatg

SEQ ID NO: 74145 - DNA, 22 bp, Artificial Sequence
  Synthetic oligonucleotide; CTA chr11 5170054 5170075 5170071 5170076 +
catattcccagaaccaaatgtc

SEQ ID NO: 74146 - DNA, 22 bp, Artificial Sequence
  Synthetic oligonucleotide; TTC chr11 5170061 5170082 5170078 5170083 +
ccagaaccaaatgtcactgaat

SEQ ID NO: 74147 - DNA, 22 bp, Artificial Sequence
  Synthetic oligonucleotide; CTG chr11 5170080 5170101 5170097 5170102 +
aattgagtattcaaggattcag

SEQ ID NO: 74148 - DNA, 22 bp, Artificial Sequence
  Synthetic oligonucleotide; TTG chr11 5170085 5170106 5170102 5170107 +
agtattcaaggattcagcacac

SEQ ID NO: 74149 - DNA, 22 bp, Artificial Sequence
  Synthetic oligonucleotide; TTC chr11 5170092 5170113 5170109 5170114 +
aaggattcagcacacaaagtgt

SEQ ID NO: 74150 - DNA, 22 bp, Artificial Sequence
  Synthetic oligonucleotide; TTC chr11 5170100 5170121 5170117 5170122 +
agcacacaaagtgtgtcatcac

SEQ ID NO: 74151 - DNA, 22 bp, Artificial Sequence
  Synthetic oligonucleotide; CTG chr11 5170136 5170157 5170153 5170158 +
tgttctatgcctcctcccacaa

SEQ ID NO: 74152 - DNA, 22 bp, Artificial Sequence
  Synthetic oligonucleotide; TTC chr11 5170141 5170162 5170158 5170163 +
tatgcctcctcccacaatttta

SEQ ID NO: 74153 - DNA, 22 bp, Artificial Sequence
  Synthetic oligonucleotide; CTA chr11 5170143 5170164 5170160 5170165 +
tgcctcctcccacaattttatt

SEQ ID NO: 74154 - DNA, 22 bp, Artificial Sequence
  Synthetic oligonucleotide; CTC chr11 5170149 5170170 5170166 5170171 +
ctcccacaattttatttcagag

SEQ ID NO: 74155 - DNA, 22 bp, Artificial Sequence
  Synthetic oligonucleotide; CTC chr11 5170152 5170173 5170169 5170174 +
ccacaattttatttcagagtaa

SEQ ID NO: 74156 - DNA, 22 bp, Artificial Sequence
  Synthetic oligonucleotide; TTT chr11 5170161 5170182 5170178 5170183 +
tatttcagagtaatgccatttc

SEQ ID NO: 74157 - DNA, 22 bp, Artificial Sequence
  Synthetic oligonucleotide; TTT chr11 5170162 5170183 5170179 5170184 +
atttcagagtaatgccatttcc

SEQ ID NO: 74158 - DNA, 22 bp, Artificial Sequence
  Synthetic oligonucleotide; TTA chr11 5170163 5170184 5170180 5170185 +
tttcagagtaatgccatttcct

SEQ ID NO: 74159 - DNA, 22 bp, Artificial Sequence
  Synthetic oligonucleotide; TTT chr11 5170166 5170187 5170183 5170188 +
cagagtaatgccatttcctatt

SEQ ID NO: 74160 - DNA, 22 bp, Artificial Sequence
  Synthetic oligonucleotide; TTC chr11 5170167 5170188 5170184 5170189 +
agagtaatgccatttcctattc

SEQ ID NO: 74161 - DNA, 22 bp, Artificial Sequence
  Synthetic oligonucleotide; TTT chr11 5170182 5170203 5170199 5170204 +
cctattctcagggaaatatata

SEQ ID NO: 74162 - DNA, 22 bp, Artificial Sequence
  Synthetic oligonucleotide; TTC chr11 5170183 5170204 5170200 5170205 +
ctattctcagggaaatatataa

SEQ ID NO: 74163 - DNA, 22 bp, Artificial Sequence
  Synthetic oligonucleotide; CTA chr11 5170186 5170207 5170203 5170208 +
ttctcagggaaatatataaaac

SEQ ID NO: 74164 - DNA, 22 bp, Artificial Sequence
  Synthetic oligonucleotide; TTC chr11 5170189 5170210 5170206 5170211 +
tcagggaaatatataaaactgt

SEQ ID NO: 74165 - DNA, 22 bp, Artificial Sequence
  Synthetic oligonucleotide; CTC chr11 5170191 5170212 5170208 5170213 +
agggaaatatataaaactgttt

SEQ ID NO: 74166 - DNA, 22 bp, Artificial Sequence
  Synthetic oligonucleotide; CTG chr11 5170210 5170231 5170227 5170232 +
ttttttttcttcatctacaaaa

SEQ ID NO: 74167 - DNA, 22 bp, Artificial Sequence
  Synthetic oligonucleotide; TTT chr11 5170213 5170234 5170230 5170235 +
tttttcttcatctacaaaatgt

SEQ ID NO: 74168 - DNA, 22 bp, Artificial Sequence
  Synthetic oligonucleotide; TTT chr11 5170214 5170235 5170231 5170236 +
ttttcttcatctacaaaatgtt

SEQ ID NO: 74169 - DNA, 22 bp, Artificial Sequence
  Synthetic oligonucleotide; TTT chr11 5170215 5170236 5170232 5170237 +
tttcttcatctacaaaatgtta

SEQ ID NO: 74170 - DNA, 22 bp, Artificial Sequence
  Synthetic oligonucleotide; TTT chr11 5170216 5170237 5170233 5170238 +
ttcttcatctacaaaatgttaa

SEQ ID NO: 74171 - DNA, 22 bp, Artificial Sequence
  Synthetic oligonucleotide; TTT chr11 5170217 5170238 5170234 5170239 +
tcttcatctacaaaatgttaaa

SEQ ID NO: 74172 - DNA, 22 bp, Artificial Sequence
  Synthetic oligonucleotide; TTT chr11 5170218 5170239 5170235 5170240 +
cttcatctacaaaatgttaaag

SEQ ID NO: 74173 - DNA, 22 bp, Artificial Sequence
  Synthetic oligonucleotide; TTC chr11 5170219 5170240 5170236 5170241 +
ttcatctacaaaatgttaaagc

SEQ ID NO: 74174 - DNA, 22 bp, Artificial Sequence
  Synthetic oligonucleotide; CTT chr11 5170221 5170242 5170238 5170243 +
catctacaaaatgttaaagctc

SEQ ID NO: 74175 - DNA, 22 bp, Artificial Sequence
  Synthetic oligonucleotide; TTC chr11 5170222 5170243 5170239 5170244 +
atctacaaaatgttaaagctca

SEQ ID NO: 74176 - DNA, 22 bp, Artificial Sequence
  Synthetic oligonucleotide; CTA chr11 5170227 5170248 5170244 5170249 +
caaaatgttaaagctcattaac

SEQ ID NO: 74177 - DNA, 22 bp, Artificial Sequence
  Synthetic oligonucleotide; TTA chr11 5170237 5170258 5170254 5170259 +
aagctcattaacaagcaataat

SEQ ID NO: 74178 - DNA, 22 bp, Artificial Sequence
  Synthetic oligonucleotide; CTC chr11 5170243 5170264 5170260 5170265 +
attaacaagcaataataagcca

SEQ ID NO: 74179 - DNA, 22 bp, Artificial Sequence
  Synthetic oligonucleotide; TTA chr11 5170247 5170268 5170264 5170269 +
acaagcaataataagccatgga

SEQ ID NO: 74180 - DNA, 22 bp, Artificial Sequence
  Synthetic oligonucleotide; TTT chr11 5170273 5170294 5170290 5170295 +
ttcatatttgcaaagctaatat

SEQ ID NO: 74181 - DNA, 22 bp, Artificial Sequence
  Synthetic oligonucleotide; TTT chr11 5170274 5170295 5170291 5170296 +
tcatatttgcaaagctaatatt

SEQ ID NO: 74182 - DNA, 22 bp, Artificial Sequence
  Synthetic oligonucleotide; TTT chr11 5170275 5170296 5170292 5170297 +
catatttgcaaagctaatattc

SEQ ID NO: 74183 - DNA, 22 bp, Artificial Sequence
  Synthetic oligonucleotide; TTC chr11 5170276 5170297 5170293 5170298 +
atatttgcaaagctaatattca

SEQ ID NO: 74184 - DNA, 22 bp, Artificial Sequence
  Synthetic oligonucleotide; TTT chr11 5170282 5170303 5170299 5170304 +
gcaaagctaatattcaggtaat

SEQ ID NO: 74185 - DNA, 22 bp, Artificial Sequence
  Synthetic oligonucleotide; TTG chr11 5170283 5170304 5170300 5170305 +
caaagctaatattcaggtaata

SEQ ID NO: 74186 - DNA, 22 bp, Artificial Sequence
  Synthetic oligonucleotide; CTA chr11 5170291 5170312 5170308 5170313 +
atattcaggtaataaagcctga

SEQ ID NO: 74187 - DNA, 22 bp, Artificial Sequence
  Synthetic oligonucleotide; TTC chr11 5170297 5170318 5170314 5170319 +
aggtaataaagcctgatctaag

SEQ ID NO: 74188 - DNA, 22 bp, Artificial Sequence
  Synthetic oligonucleotide; CTG chr11 5170312 5170333 5170329 5170334 +
atctaagtgcctgtgctgtcag

SEQ ID NO: 74189 - DNA, 22 bp, Artificial Sequence
  Synthetic oligonucleotide; CTA chr11 5170317 5170338 5170334 5170339 +
agtgcctgtgctgtcagggtat

SEQ ID NO: 74190 - DNA, 22 bp, Artificial Sequence
  Synthetic oligonucleotide; CTG chr11 5170325 5170346 5170342 5170347 +
tgctgtcagggtatcttcagtc

SEQ ID NO: 74191 - DNA, 22 bp, Artificial Sequence
  Synthetic oligonucleotide; CTG chr11 5170330 5170351 5170347 5170352 +
tcagggtatcttcagtctccat

SEQ ID NO: 74192 - DNA, 22 bp, Artificial Sequence
  Synthetic oligonucleotide; CTT chr11 5170342 5170363 5170359 5170364 +
cagtctccattagaactcaccc

SEQ ID NO: 74193 - DNA, 22 bp, Artificial Sequence
  Synthetic oligonucleotide; TTC chr11 5170343 5170364 5170360 5170365 +
agtctccattagaactcacccc

SEQ ID NO: 74194 - DNA, 22 bp, Artificial Sequence
  Synthetic oligonucleotide; CTC chr11 5170349 5170370 5170366 5170371 +
cattagaactcacccctcttcc

SEQ ID NO: 74195 - DNA, 22 bp, Artificial Sequence
  Synthetic oligonucleotide; TTA chr11 5170354 5170375 5170371 5170376 +
gaactcacccctcttcctggat

SEQ ID NO: 74196 - DNA, 22 bp, Artificial Sequence
  Synthetic oligonucleotide; CTC chr11 5170360 5170381 5170377 5170382 +
acccctcttcctggatagtgta

SEQ ID NO: 74197 - DNA, 22 bp, Artificial Sequence
  Synthetic oligonucleotide; CTC chr11 5170367 5170388 5170384 5170389 +
ttcctggatagtgtaagaacaa

SEQ ID NO: 74198 - DNA, 22 bp, Artificial Sequence
  Synthetic oligonucleotide; CTT chr11 5170369 5170390 5170386 5170391 +
cctggatagtgtaagaacaacg

SEQ ID NO: 74199 - DNA, 22 bp, Artificial Sequence
  Synthetic oligonucleotide; TTC chr11 5170370 5170391 5170387 5170392 +
ctggatagtgtaagaacaacgc

SEQ ID NO: 74200 - DNA, 22 bp, Artificial Sequence
  Synthetic oligonucleotide; CTG chr11 5170373 5170394 5170390 5170395 +
gatagtgtaagaacaacgctgt

SEQ ID NO: 74201 - DNA, 22 bp, Artificial Sequence
  Synthetic oligonucleotide; CTG chr11 5170394 5170415 5170411 5170416 +
ttgcgaatttctttgattttga

SEQ ID NO: 74202 - DNA, 22 bp, Artificial Sequence
  Synthetic oligonucleotide; TTG chr11 5170397 5170418 5170414 5170419 +
cgaatttctttgattttgatac

SEQ ID NO: 74203 - DNA, 22 bp, Artificial Sequence
  Synthetic oligonucleotide; TTT chr11 5170404 5170425 5170421 5170426 +
ctttgattttgatactatagac

SEQ ID NO: 74204 - DNA, 22 bp, Artificial Sequence
  Synthetic oligonucleotide; TTC chr11 5170405 5170426 5170422 5170427 +
tttgattttgatactatagaca

SEQ ID NO: 74205 - DNA, 22 bp, Artificial Sequence
  Synthetic oligonucleotide; CTT chr11 5170407 5170428 5170424 5170429 +
tgattttgatactatagacaat

SEQ ID NO: 74206 - DNA, 22 bp, Artificial Sequence
  Synthetic oligonucleotide; TTT chr11 5170408 5170429 5170425 5170430 +
gattttgatactatagacaatg

SEQ ID NO: 74207 - DNA, 22 bp, Artificial Sequence
  Synthetic oligonucleotide; TTG chr11 5170409 5170430 5170426 5170431 +
attttgatactatagacaatgg

SEQ ID NO: 74208 - DNA, 22 bp, Artificial Sequence
  Synthetic oligonucleotide; TTT chr11 5170413 5170434 5170430 5170435 +
tgatactatagacaatggggtt

SEQ ID NO: 74209 - DNA, 22 bp, Artificial Sequence
  Synthetic oligonucleotide; TTT chr11 5170414 5170435 5170431 5170436 +
gatactatagacaatggggttg

SEQ ID NO: 74210 - DNA, 22 bp, Artificial Sequence
  Synthetic oligonucleotide; TTG chr11 5170415 5170436 5170432 5170437 +
atactatagacaatggggttga

SEQ ID NO: 74211 - DNA, 22 bp, Artificial Sequence
  Synthetic oligonucleotide; CTA chr11 5170421 5170442 5170438 5170443 +
tagacaatggggttgaccacag

SEQ ID NO: 74212 - DNA, 22 bp, Artificial Sequence
  Synthetic oligonucleotide; TTG chr11 5170436 5170457 5170453 5170458 +
accacaggaggaaaaaagaggt

SEQ ID NO: 74213 - DNA, 22 bp, Artificial Sequence
  Synthetic oligonucleotide; TTG chr11 5170466 5170487 5170483 5170488 +
gccgtgacagtctggaaaagtg

SEQ ID NO: 74214 - DNA, 22 bp, Artificial Sequence
  Synthetic oligonucleotide; CTG chr11 5170480 5170501 5170497 5170502 +
gaaaagtggaggtaaatgccgt

SEQ ID NO: 74215 - DNA, 22 bp, Artificial Sequence
  Synthetic oligonucleotide; CTG chr11 5170529 5170550 5170546 5170551 +
atcatgggcacatagtacacaa

SEQ ID NO: 74216 - DNA, 22 bp, Artificial Sequence
  Synthetic oligonucleotide; TTG chr11 5170583 5170604 5170600 5170605 +
agtgcctgccaccgccctgctc

SEQ ID NO: 74217 - DNA, 22 bp, Artificial Sequence
  Synthetic oligonucleotide; CTG chr11 5170591 5170612 5170608 5170613 +
ccaccgccctgctccagaagct

SEQ ID NO: 74218 - DNA, 22 bp, Artificial Sequence
  Synthetic oligonucleotide; CTG chr11 5170602 5170623 5170619 5170624 +
ctccagaagctatttccagtac

SEQ ID NO: 74219 - DNA, 22 bp, Artificial Sequence
  Synthetic oligonucleotide; CTC chr11 5170605 5170626 5170622 5170627 +
cagaagctatttccagtactgt

SEQ ID NO: 74220 - DNA, 22 bp, Artificial Sequence
  Synthetic oligonucleotide; CTA chr11 5170614 5170635 5170631 5170636 +
tttccagtactgtatgaagaat

SEQ ID NO: 74221 - DNA, 22 bp, Artificial Sequence
  Synthetic oligonucleotide; TTT chr11 5170617 5170638 5170634 5170639 +
ccagtactgtatgaagaatcag

SEQ ID NO: 74222 - DNA, 22 bp, Artificial Sequence
  Synthetic oligonucleotide; TTC chr11 5170618 5170639 5170635 5170640 +
cagtactgtatgaagaatcagc

SEQ ID NO: 74223 - DNA, 22 bp, Artificial Sequence
  Synthetic oligonucleotide; CTG chr11 5170626 5170647 5170643 5170648 +
tatgaagaatcagcacataaga

SEQ ID NO: 74224 - DNA, 22 bp, Artificial Sequence
  Synthetic oligonucleotide; CTA chr11 5170712 5170733 5170729 5170734 +
ttgggacgtgtgtctccacagg

SEQ ID NO: 74225 - DNA, 22 bp, Artificial Sequence
  Synthetic oligonucleotide; TTG chr11 5170715 5170736 5170732 5170737 +
ggacgtgtgtctccacagggca

SEQ ID NO: 74226 - DNA, 22 bp, Artificial Sequence
  Synthetic oligonucleotide; CTC chr11 5170728 5170749 5170745 5170750 +
cacagggcaatttgatcagatc

SEQ ID NO: 74227 - DNA, 22 bp, Artificial Sequence
  Synthetic oligonucleotide; TTT chr11 5170741 5170762 5170758 5170763 +
gatcagatctgagtggaggcaa

SEQ ID NO: 74228 - DNA, 22 bp, Artificial Sequence
  Synthetic oligonucleotide; TTG chr11 5170742 5170763 5170759 5170764 +
atcagatctgagtggaggcaat

SEQ ID NO: 74229 - DNA, 22 bp, Artificial Sequence
  Synthetic oligonucleotide; CTG chr11 5170752 5170773 5170769 5170774 +
agtggaggcaataagagtgtgt

SEQ ID NO: 74230 - DNA, 22 bp, Artificial Sequence
  Synthetic oligonucleotide; TTG chr11 5170784 5170805 5170801 5170806 +
tggccacagaaaggcagacgcc

SEQ ID NO: 74231 - DNA, 22 bp, Artificial Sequence
  Synthetic oligonucleotide; CTC chr11 5170808 5170829 5170825 5170830 +
aggagaaagagcagtgggagca

SEQ ID NO: 74232 - DNA, 22 bp, Artificial Sequence
  Synthetic oligonucleotide; TTA chr11 5170839 5170860 5170856 5170861 +
cactgcgcaaggcaatggcggc

SEQ ID NO: 74233 - DNA, 22 bp, Artificial Sequence
  Synthetic oligonucleotide; CTG chr11 5170844 5170865 5170861 5170866 +
cgcaaggcaatggcggcacccg

SEQ ID NO: 74234 - DNA, 22 bp, Artificial Sequence
  Synthetic oligonucleotide; TTG chr11 5170887 5170908 5170904 5170909 +
tcagaatggttgtgtagcgcag

SEQ ID NO: 74235 - DNA, 22 bp, Artificial Sequence
  Synthetic oligonucleotide; TTG chr11 5170899 5170920 5170916 5170921 +
tgtagcgcagtgggctgtagat

SEQ ID NO: 74236 - DNA, 22 bp, Artificial Sequence
  Synthetic oligonucleotide; CTG chr11 5170916 5170937 5170933 5170938 +
tagatggccacaaagcggtcca

SEQ ID NO: 74237 - DNA, 22 bp, Artificial Sequence
  Synthetic oligonucleotide; CTG chr11 5170941 5170962 5170958 5170963 +
acattgccagaaggacacctga

SEQ ID NO: 74238 - DNA, 22 bp, Artificial Sequence
  Synthetic oligonucleotide; TTG chr11 5170947 5170968 5170964 5170969 +
ccagaaggacacctgactccat

SEQ ID NO: 74239 - DNA, 22 bp, Artificial Sequence
  Synthetic oligonucleotide; CTG chr11 5170962 5170983 5170979 5170984 +
actccataagagtgaaagagtg

SEQ ID NO: 74240 - DNA, 22 bp, Artificial Sequence
  Synthetic oligonucleotide; CTC chr11 5170966 5170987 5170983 5170988 +
cataagagtgaaagagtgcata

SEQ ID NO: 74241 - DNA, 22 bp, Artificial Sequence
  Synthetic oligonucleotide; CTG chr11 5170999 5171020 5171016 5171021 +
gagcaggcaaccaccaaaactg

SEQ ID NO: 74242 - DNA, 22 bp, Artificial Sequence
  Synthetic oligonucleotide; CTG chr11 5171021 5171042 5171038 5171043 +
acatcgttaatgccaaagagga

SEQ ID NO: 74243 - DNA, 22 bp, Artificial Sequence
  Synthetic oligonucleotide; TTA chr11 5171030 5171051 5171047 5171052 +
atgccaaagaggaatatgctta

SEQ ID NO: 74244 - DNA, 22 bp, Artificial Sequence
  Synthetic oligonucleotide; CTT chr11 5171051 5171072 5171068 5171073 +
aacacagtgggcatggtggaag

SEQ ID NO: 74245 - DNA, 22 bp, Artificial Sequence
  Synthetic oligonucleotide; TTA chr11 5171052 5171073 5171069 5171074 +
acacagtgggcatggtggaagc

SEQ ID NO: 74246 - DNA, 22 bp, Artificial Sequence
  Synthetic oligonucleotide; TTC chr11 5171089 5171110 5171106 5171111 +
aacaaaggccggcatggccaga

SEQ ID NO: 74247 - DNA, 22 bp, Artificial Sequence
  Synthetic oligonucleotide; TTG chr11 5171128 5171149 5171145 5171150 +
gtgcaaggaagagtcaattcgg

SEQ ID NO: 74248 - DNA, 22 bp, Artificial Sequence
  Synthetic oligonucleotide; TTC chr11 5171148 5171169 5171165 5171170 +
ggatgatgtgaagaatgatgcc

SEQ ID NO: 74249 - DNA, 22 bp, Artificial Sequence
  Synthetic oligonucleotide; TTT chr11 5171174 5171195 5171191 5171196 +
cccggaaagatgatggtgtata

SEQ ID NO: 74250 - DNA, 22 bp, Artificial Sequence
  Synthetic oligonucleotide; TTC chr11 5171175 5171196 5171192 5171197 +
ccggaaagatgatggtgtatat

SEQ ID NO: 74251 - DNA, 22 bp, Artificial Sequence
  Synthetic oligonucleotide; TTC chr11 5171231 5171252 5171248 5171253 +
tgcctccagtcccgggatgcca

SEQ ID NO: 74252 - DNA, 22 bp, Artificial Sequence
  Synthetic oligonucleotide; CTG chr11 5171233 5171254 5171250 5171255 +
cctccagtcccgggatgccaac

SEQ ID NO: 74253 - DNA, 22 bp, Artificial Sequence
  Synthetic oligonucleotide; CTC chr11 5171237 5171258 5171254 5171259 +
cagtcccgggatgccaacgaga

SEQ ID NO: 74254 - DNA, 22 bp, Artificial Sequence
  Synthetic oligonucleotide; TTG chr11 5171269 5171290 5171286 5171291 +
taggtgtgaatgttatggaacg

SEQ ID NO: 74255 - DNA, 22 bp, Artificial Sequence
  Synthetic oligonucleotide; TTA chr11 5171284 5171305 5171301 5171306 +
tggaacgtttgaaaacgtcatg

SEQ ID NO: 74256 - DNA, 22 bp, Artificial Sequence
  Synthetic oligonucleotide; TTT chr11 5171294 5171315 5171311 5171316 +
gaaaacgtcatggtgatacttc

SEQ ID NO: 74257 - DNA, 22 bp, Artificial Sequence
  Synthetic oligonucleotide; TTG chr11 5171295 5171316 5171312 5171317 +
aaaacgtcatggtgatacttcc

SEQ ID NO: 74258 - DNA, 22 bp, Artificial Sequence
  Synthetic oligonucleotide; CTT chr11 5171315 5171336 5171332 5171337 +
cctctgaagatattgagaagca

SEQ ID NO: 74259 - DNA, 22 bp, Artificial Sequence
  Synthetic oligonucleotide; TTC chr11 5171316 5171337 5171333 5171338 +
ctctgaagatattgagaagcac

SEQ ID NO: 74260 - DNA, 22 bp, Artificial Sequence
  Synthetic oligonucleotide; CTC chr11 5171319 5171340 5171336 5171341 +
tgaagatattgagaagcacatg

SEQ ID NO: 74261 - DNA, 22 bp, Artificial Sequence
  Synthetic oligonucleotide; CTG chr11 5171321 5171342 5171338 5171343 +
aagatattgagaagcacatgga

SEQ ID NO: 74262 - DNA, 22 bp, Artificial Sequence
  Synthetic oligonucleotide; TTG chr11 5171330 5171351 5171347 5171352 +
agaagcacatggagactggaat

SEQ ID NO: 74263 - DNA, 22 bp, Artificial Sequence
  Synthetic oligonucleotide; CTG chr11 5171348 5171369 5171365 5171370 +
gaatatataagtttctactcag

SEQ ID NO: 74264 - DNA, 22 bp, Artificial Sequence
  Synthetic oligonucleotide; TTT chr11 5171362 5171383 5171379 5171384 +
ctactcagttattgcacatcaa

SEQ ID NO: 74265 - DNA, 22 bp, Artificial Sequence
  Synthetic oligonucleotide; TTC chr11 5171363 5171384 5171380 5171385 +
tactcagttattgcacatcaag

SEQ ID NO: 74266 - DNA, 22 bp, Artificial Sequence
  Synthetic oligonucleotide; CTA chr11 5171365 5171386 5171382 5171387 +
ctcagttattgcacatcaagtt

SEQ ID NO: 74267 - DNA, 22 bp, Artificial Sequence
  Synthetic oligonucleotide; CTC chr11 5171368 5171389 5171385 5171390 +
agttattgcacatcaagttctg

SEQ ID NO: 74268 - DNA, 22 bp, Artificial Sequence
  Synthetic oligonucleotide; TTA chr11 5171373 5171394 5171390 5171395 +
ttgcacatcaagttctgagcta

SEQ ID NO: 74269 - DNA, 22 bp, Artificial Sequence
  Synthetic oligonucleotide; TTG chr11 5171376 5171397 5171393 5171398 +
cacatcaagttctgagctaaca

SEQ ID NO: 74270 - DNA, 22 bp, Artificial Sequence
  Synthetic oligonucleotide; TTC chr11 5171388 5171409 5171405 5171410 +
tgagctaacagtcatatctaag

SEQ ID NO: 74271 - DNA, 22 bp, Artificial Sequence
  Synthetic oligonucleotide; CTG chr11 5171390 5171411 5171407 5171412 +
agctaacagtcatatctaagac

SEQ ID NO: 74272 - DNA, 22 bp, Artificial Sequence
  Synthetic oligonucleotide; CTA chr11 5171395 5171416 5171412 5171417 +
acagtcatatctaagacatttc

SEQ ID NO: 74273 - DNA, 22 bp, Artificial Sequence
  Synthetic oligonucleotide; CTA chr11 5171408 5171429 5171425 5171430 +
agacatttcctcagaaaaaggg

SEQ ID NO: 74274 - DNA, 22 bp, Artificial Sequence
  Synthetic oligonucleotide; TTT chr11 5171416 5171437 5171433 5171438 +
cctcagaaaaagggataaaaaa

SEQ ID NO: 74275 - DNA, 22 bp, Artificial Sequence
  Synthetic oligonucleotide; TTC chr11 5171417 5171438 5171434 5171439 +
ctcagaaaaagggataaaaaat

SEQ ID NO: 74276 - DNA, 22 bp, Artificial Sequence
  Synthetic oligonucleotide; CTC chr11 5171420 5171441 5171437 5171442 +
agaaaaagggataaaaaattta

SEQ ID NO: 74277 - DNA, 22 bp, Artificial Sequence
  Synthetic oligonucleotide; TTT chr11 5171441 5171462 5171458 5171463 +
atttctgaaacaagggcacagg

SEQ ID NO: 74278 - DNA, 22 bp, Artificial Sequence
  Synthetic oligonucleotide; TTA chr11 5171442 5171463 5171459 5171464 +
tttctgaaacaagggcacaggt

SEQ ID NO: 74279 - DNA, 22 bp, Artificial Sequence
  Synthetic oligonucleotide; TTT chr11 5171445 5171466 5171462 5171467 +
ctgaaacaagggcacaggtaag

SEQ ID NO: 74280 - DNA, 22 bp, Artificial Sequence
  Synthetic oligonucleotide; TTC chr11 5171446 5171467 5171463 5171468 +
tgaaacaagggcacaggtaagc

SEQ ID NO: 74281 - DNA, 22 bp, Artificial Sequence
  Synthetic oligonucleotide; CTG chr11 5171448 5171469 5171465 5171470 +
aaacaagggcacaggtaagcca

SEQ ID NO: 74282 - DNA, 22 bp, Artificial Sequence
  Synthetic oligonucleotide; CTA chr11 5171492 5171513 5171509 5171514 +
atgggtcatgcagaaaagtatt

SEQ ID NO: 74283 - DNA, 22 bp, Artificial Sequence
  Synthetic oligonucleotide; TTC chr11 5171515 5171536 5171532 5171537 +
caacatagcctatatgccagat

SEQ ID NO: 74284 - DNA, 22 bp, Artificial Sequence
  Synthetic oligonucleotide; CTA chr11 5171527 5171548 5171544 5171549 +
tatgccagataaggcattaata

SEQ ID NO: 74285 - DNA, 22 bp, Artificial Sequence
  Synthetic oligonucleotide; TTA chr11 5171546 5171567 5171563 5171568 +
atagaaatctcaagttgggtca

SEQ ID NO: 74286 - DNA, 22 bp, Artificial Sequence
  Synthetic oligonucleotide; CTC chr11 5171557 5171578 5171574 5171579 +
aagttgggtcatctatggcagt

SEQ ID NO: 74287 - DNA, 22 bp, Artificial Sequence
  Synthetic oligonucleotide; TTG chr11 5171563 5171584 5171580 5171585 +
ggtcatctatggcagtgaaaaa

SEQ ID NO: 74288 - DNA, 22 bp, Artificial Sequence
  Synthetic oligonucleotide; CTA chr11 5171572 5171593 5171589 5171594 +
tggcagtgaaaaacagttaaaa

SEQ ID NO: 74289 - DNA, 22 bp, Artificial Sequence
  Synthetic oligonucleotide; TTA chr11 5171591 5171612 5171608 5171613 +
aaataagcatagagatgacaga

SEQ ID NO: 74290 - DNA, 22 bp, Artificial Sequence
  Synthetic oligonucleotide; TTC chr11 5171616 5171637 5171633 5171638 +
acatggaaattatgactgaaga

SEQ ID NO: 74291 - DNA, 22 bp, Artificial Sequence
  Synthetic oligonucleotide; TTA chr11 5171628 5171649 5171645 5171650 +
tgactgaagaaactgctaactt

SEQ ID NO: 74292 - DNA, 22 bp, Artificial Sequence
  Synthetic oligonucleotide; CTG chr11 5171634 5171655 5171651 5171656 +
aagaaactgctaacttgtagtg

SEQ ID NO: 74293 - DNA, 22 bp, Artificial Sequence
  Synthetic oligonucleotide; CTG chr11 5171643 5171664 5171660 5171665 +
ctaacttgtagtgtttataaag

SEQ ID NO: 74294 - DNA, 22 bp, Artificial Sequence
  Synthetic oligonucleotide; CTA chr11 5171646 5171667 5171663 5171668 +
acttgtagtgtttataaagaga

SEQ ID NO: 74295 - DNA, 22 bp, Artificial Sequence
  Synthetic oligonucleotide; CTT chr11 5171650 5171671 5171667 5171672 +
gtagtgtttataaagagagtag

SEQ ID NO: 74296 - DNA, 22 bp, Artificial Sequence
  Synthetic oligonucleotide; TTG chr11 5171651 5171672 5171668 5171673 +
tagtgtttataaagagagtaga

SEQ ID NO: 74297 - DNA, 22 bp, Artificial Sequence
  Synthetic oligonucleotide; TTT chr11 5171659 5171680 5171676 5171681 +
ataaagagagtagatgaatagc

SEQ ID NO: 74298 - DNA, 22 bp, Artificial Sequence
  Synthetic oligonucleotide; TTA chr11 5171660 5171681 5171677 5171682 +
taaagagagtagatgaatagct

SEQ ID NO: 74299 - DNA, 22 bp, Artificial Sequence
  Synthetic oligonucleotide; CTA chr11 5171683 5171704 5171700 5171705 +
aagtaatataacactaataaag

SEQ ID NO: 74300 - DNA, 22 bp, Artificial Sequence
  Synthetic oligonucleotide; CTA chr11 5171699 5171720 5171716 5171721 +
ataaagagtattgatggttcta

SEQ ID NO: 74301 - DNA, 22 bp, Artificial Sequence
  Synthetic oligonucleotide; TTG chr11 5171712 5171733 5171729 5171734 +
atggttctaacatttaattgac

SEQ ID NO: 74302 - DNA, 22 bp, Artificial Sequence
  Synthetic oligonucleotide; TTC chr11 5171719 5171740 5171736 5171741 +
taacatttaattgacgtgtaat

SEQ ID NO: 74303 - DNA, 22 bp, Artificial Sequence
  Synthetic oligonucleotide; CTA chr11 5171721 5171742 5171738 5171743 +
acatttaattgacgtgtaatct

SEQ ID NO: 74304 - DNA, 22 bp, Artificial Sequence
  Synthetic oligonucleotide; TTT chr11 5171727 5171748 5171744 5171749 +
aattgacgtgtaatcttgggat

SEQ ID NO: 74305 - DNA, 22 bp, Artificial Sequence
  Synthetic oligonucleotide; TTA chr11 5171728 5171749 5171745 5171750 +
attgacgtgtaatcttgggatt

SEQ ID NO: 74306 - DNA, 22 bp, Artificial Sequence
  Synthetic oligonucleotide; TTG chr11 5171732 5171753 5171749 5171754 +
acgtgtaatcttgggattatat

SEQ ID NO: 74307 - DNA, 22 bp, Artificial Sequence
  Synthetic oligonucleotide; CTT chr11 5171744 5171765 5171761 5171766 +
gggattatattaaagttgattt

SEQ ID NO: 74308 - DNA, 22 bp, Artificial Sequence
  Synthetic oligonucleotide; TTG chr11 5171745 5171766 5171762 5171767 +
ggattatattaaagttgattta

SEQ ID NO: 74309 - DNA, 22 bp, Artificial Sequence
  Synthetic oligonucleotide; TTA chr11 5171751 5171772 5171768 5171773 +
tattaaagttgatttatattgc

SEQ ID NO: 74310 - DNA, 22 bp, Artificial Sequence
  Synthetic oligonucleotide; TTA chr11 5171756 5171777 5171773 5171778 +
aagttgatttatattgcaagtt

SEQ ID NO: 74311 - DNA, 22 bp, Artificial Sequence
  Synthetic oligonucleotide; TTG chr11 5171762 5171783 5171779 5171784 +
atttatattgcaagttatctga

SEQ ID NO: 74312 - DNA, 22 bp, Artificial Sequence
  Synthetic oligonucleotide; TTT chr11 5171766 5171787 5171783 5171788 +
atattgcaagttatctgagacc

SEQ ID NO: 74313 - DNA, 22 bp, Artificial Sequence
  Synthetic oligonucleotide; TTA chr11 5171767 5171788 5171784 5171789 +
tattgcaagttatctgagaccc

SEQ ID NO: 74314 - DNA, 22 bp, Artificial Sequence
  Synthetic oligonucleotide; TTG chr11 5171772 5171793 5171789 5171794 +
caagttatctgagacccagata

SEQ ID NO: 74315 - DNA, 22 bp, Artificial Sequence
  Synthetic oligonucleotide; TTA chr11 5171779 5171800 5171796 5171801 +
tctgagacccagatatttgcta

SEQ ID NO: 74316 - DNA, 22 bp, Artificial Sequence
  Synthetic oligonucleotide; CTG chr11 5171783 5171804 5171800 5171805 +
agacccagatatttgctataaa

SEQ ID NO: 74317 - DNA, 22 bp, Artificial Sequence
  Synthetic oligonucleotide; TTT chr11 5171797 5171818 5171814 5171819 +
gctataaagacaataatagtat

SEQ ID NO: 74318 - DNA, 22 bp, Artificial Sequence
  Synthetic oligonucleotide; TTG chr11 5171798 5171819 5171815 5171820 +
ctataaagacaataatagtatt

SEQ ID NO: 74319 - DNA, 22 bp, Artificial Sequence
  Synthetic oligonucleotide; CTA chr11 5171801 5171822 5171818 5171823 +
taaagacaataatagtatttta

SEQ ID NO: 74320 - DNA, 22 bp, Artificial Sequence
  Synthetic oligonucleotide; TTT chr11 5171821 5171842 5171838 5171843 +
taaagtaatatttatatattgt

SEQ ID NO: 74321 - DNA, 22 bp, Artificial Sequence
  Synthetic oligonucleotide; TTT chr11 5171822 5171843 5171839 5171844 +
aaagtaatatttatatattgtt

SEQ ID NO: 74322 - DNA, 22 bp, Artificial Sequence
  Synthetic oligonucleotide; TTA chr11 5171823 5171844 5171840 5171845 +
aagtaatatttatatattgttt

SEQ ID NO: 74323 - DNA, 22 bp, Artificial Sequence
  Synthetic oligonucleotide; TTT chr11 5171834 5171855 5171851 5171856 +
atatattgtttatcattatatg

SEQ ID NO: 74324 - DNA, 22 bp, Artificial Sequence
  Synthetic oligonucleotide; TTA chr11 5171835 5171856 5171852 5171857 +
tatattgtttatcattatatgt

SEQ ID NO: 74325 - DNA, 22 bp, Artificial Sequence
  Synthetic oligonucleotide; TTG chr11 5171842 5171863 5171859 5171864 +
tttatcattatatgtggaatat

SEQ ID NO: 74326 - DNA, 22 bp, Artificial Sequence
  Synthetic oligonucleotide; TTT chr11 5171845 5171866 5171862 5171867 +
atcattatatgtggaatatagt

SEQ ID NO: 74327 - DNA, 22 bp, Artificial Sequence
  Synthetic oligonucleotide; TTA chr11 5171846 5171867 5171863 5171868 +
tcattatatgtggaatatagta

SEQ ID NO: 74328 - DNA, 22 bp, Artificial Sequence
  Synthetic oligonucleotide; TTA chr11 5171852 5171873 5171869 5171874 +
tatgtggaatatagtaaatatt

SEQ ID NO: 74329 - DNA, 22 bp, Artificial Sequence
  Synthetic oligonucleotide; TTA chr11 5171875 5171896 5171892 5171897 +
aatgtatagaataaaaagaaca

SEQ ID NO: 74330 - DNA, 22 bp, Artificial Sequence
  Synthetic oligonucleotide; TTT chr11 5171901 5171922 5171918 5171923 +
aatatattagaacacaaggata

SEQ ID NO: 74331 - DNA, 22 bp, Artificial Sequence
  Synthetic oligonucleotide; TTA chr11 5171902 5171923 5171919 5171924 +
atatattagaacacaaggatag

SEQ ID NO: 74332 - DNA, 22 bp, Artificial Sequence
  Synthetic oligonucleotide; TTA chr11 5171910 5171931 5171927 5171932 +
gaacacaaggatagtttctcct

SEQ ID NO: 74333 - DNA, 22 bp, Artificial Sequence
  Synthetic oligonucleotide; TTT chr11 5171927 5171948 5171944 5171949 +
ctcctagaataaagtattttcc

SEQ ID NO: 74334 - DNA, 22 bp, Artificial Sequence
  Synthetic oligonucleotide; TTC chr11 5171928 5171949 5171945 5171950 +
tcctagaataaagtattttcca

SEQ ID NO: 74335 - DNA, 22 bp, Artificial Sequence
  Synthetic oligonucleotide; CTC chr11 5171930 5171951 5171947 5171952 +
ctagaataaagtattttccatt

SEQ ID NO: 74336 - DNA, 22 bp, Artificial Sequence
  Synthetic oligonucleotide; CTA chr11 5171933 5171954 5171950 5171955 +
gaataaagtattttccattttt

SEQ ID NO: 74337 - DNA, 22 bp, Artificial Sequence
  Synthetic oligonucleotide; TTT chr11 5171946 5171967 5171963 5171968 +
tccatttttttctttaacttac

SEQ ID NO: 74338 - DNA, 22 bp, Artificial Sequence
  Synthetic oligonucleotide; TTT chr11 5171947 5171968 5171964 5171969 +
ccatttttttctttaacttacc

SEQ ID NO: 74339 - DNA, 22 bp, Artificial Sequence
  Synthetic oligonucleotide; TTC chr11 5171948 5171969 5171965 5171970 +
catttttttctttaacttacca

SEQ ID NO: 74340 - DNA, 22 bp, Artificial Sequence
  Synthetic oligonucleotide; TTT chr11 5171953 5171974 5171970 5171975 +
ttttctttaacttaccagttca

SEQ ID NO: 74341 - DNA, 22 bp, Artificial Sequence
  Synthetic oligonucleotide; TTT chr11 5171954 5171975 5171971 5171976 +
tttctttaacttaccagttcac

SEQ ID NO: 74342 - DNA, 22 bp, Artificial Sequence
  Synthetic oligonucleotide; TTT chr11 5171955 5171976 5171972 5171977 +
ttctttaacttaccagttcact

SEQ ID NO: 74343 - DNA, 22 bp, Artificial Sequence
  Synthetic oligonucleotide; TTT chr11 5171956 5171977 5171973 5171978 +
tctttaacttaccagttcactc

SEQ ID NO: 74344 - DNA, 22 bp, Artificial Sequence
  Synthetic oligonucleotide; TTT chr11 5171957 5171978 5171974 5171979 +
ctttaacttaccagttcactct

SEQ ID NO: 74345 - DNA, 22 bp, Artificial Sequence
  Synthetic oligonucleotide; TTC chr11 5171958 5171979 5171975 5171980 +
tttaacttaccagttcactctt

SEQ ID NO: 74346 - DNA, 22 bp, Artificial Sequence
  Synthetic oligonucleotide; CTT chr11 5171960 5171981 5171977 5171982 +
taacttaccagttcactctttc

SEQ ID NO: 74347 - DNA, 22 bp, Artificial Sequence
  Synthetic oligonucleotide; TTT chr11 5171961 5171982 5171978 5171983 +
aacttaccagttcactctttct

SEQ ID NO: 74348 - DNA, 22 bp, Artificial Sequence
  Synthetic oligonucleotide; TTA chr11 5171962 5171983 5171979 5171984 +
acttaccagttcactctttctc

SEQ ID NO: 74349 - DNA, 22 bp, Artificial Sequence
  Synthetic oligonucleotide; CTT chr11 5171966 5171987 5171983 5171988 +
accagttcactctttctccacc

SEQ ID NO: 74350 - DNA, 22 bp, Artificial Sequence
  Synthetic oligonucleotide; TTA chr11 5171967 5171988 5171984 5171989 +
ccagttcactctttctccacct

SEQ ID NO: 74351 - DNA, 22 bp, Artificial Sequence
  Synthetic oligonucleotide; TTC chr11 5171974 5171995 5171991 5171996 +
actctttctccacctgctatcc

SEQ ID NO: 74352 - DNA, 22 bp, Artificial Sequence
  Synthetic oligonucleotide; CTC chr11 5171978 5171999 5171995 5172000 +
tttctccacctgctatccatag

SEQ ID NO: 74353 - DNA, 22 bp, Artificial Sequence
  Synthetic oligonucleotide; CTT chr11 5171980 5172001 5171997 5172002 +
tctccacctgctatccatagat

SEQ ID NO: 74354 - DNA, 22 bp, Artificial Sequence
  Synthetic oligonucleotide; TTT chr11 5171981 5172002 5171998 5172003 +
ctccacctgctatccatagatt

SEQ ID NO: 74355 - DNA, 22 bp, Artificial Sequence
  Synthetic oligonucleotide; TTC chr11 5171982 5172003 5171999 5172004 +
tccacctgctatccatagatta

SEQ ID NO: 74356 - DNA, 22 bp, Artificial Sequence
  Synthetic oligonucleotide; CTC chr11 5171984 5172005 5172001 5172006 +
cacctgctatccatagattaga

SEQ ID NO: 74357 - DNA, 22 bp, Artificial Sequence
  Synthetic oligonucleotide; CTG chr11 5171990 5172011 5172007 5172012 +
ctatccatagattagaaaagct

SEQ ID NO: 74358 - DNA, 22 bp, Artificial Sequence
  Synthetic oligonucleotide; CTA chr11 5171993 5172014 5172010 5172015 +
tccatagattagaaaagctcct

SEQ ID NO: 74359 - DNA, 22 bp, Artificial Sequence
  Synthetic oligonucleotide; TTA chr11 5172004 5172025 5172021 5172026 +
gaaaagctcctctgtattttgc

SEQ ID NO: 74360 - DNA, 22 bp, Artificial Sequence
  Synthetic oligonucleotide; CTC chr11 5172013 5172034 5172030 5172035 +
ctctgtattttgcagaagggtc

SEQ ID NO: 74361 - DNA, 22 bp, Artificial Sequence
  Synthetic oligonucleotide; CTC chr11 5172016 5172037 5172033 5172038 +
tgtattttgcagaagggtcagt

SEQ ID NO: 74362 - DNA, 22 bp, Artificial Sequence
  Synthetic oligonucleotide; CTG chr11 5172018 5172039 5172035 5172040 +
tattttgcagaagggtcagtct

SEQ ID NO: 74363 - DNA, 22 bp, Artificial Sequence
  Synthetic oligonucleotide; TTT chr11 5172023 5172044 5172040 5172045 +
tgcagaagggtcagtcttctgc

SEQ ID NO: 74364 - DNA, 22 bp, Artificial Sequence
  Synthetic oligonucleotide; TTT chr11 5172024 5172045 5172041 5172046 +
gcagaagggtcagtcttctgct

SEQ ID NO: 74365 - DNA, 22 bp, Artificial Sequence
  Synthetic oligonucleotide; TTG chr11 5172025 5172046 5172042 5172047 +
cagaagggtcagtcttctgctg

SEQ ID NO: 74366 - DNA, 22 bp, Artificial Sequence
  Synthetic oligonucleotide; CTT chr11 5172041 5172062 5172058 5172063 +
ctgctggaaccgggtcagggag

SEQ ID NO: 74367 - DNA, 22 bp, Artificial Sequence
  Synthetic oligonucleotide; TTC chr11 5172042 5172063 5172059 5172064 +
tgctggaaccgggtcagggagc

SEQ ID NO: 74368 - DNA, 22 bp, Artificial Sequence
  Synthetic oligonucleotide; CTG chr11 5172044 5172065 5172061 5172066 +
ctggaaccgggtcagggagcaa

SEQ ID NO: 74369 - DNA, 22 bp, Artificial Sequence
  Synthetic oligonucleotide; CTG chr11 5172047 5172068 5172064 5172069 +
gaaccgggtcagggagcaagat

SEQ ID NO: 74370 - DNA, 22 bp, Artificial Sequence
  Synthetic oligonucleotide; CTC chr11 5172087 5172108 5172104 5172109 +
acaagtcacatgtgatggtggg

SEQ ID NO: 74371 - DNA, 22 bp, Artificial Sequence
  Synthetic oligonucleotide; CTA chr11 5172113 5172134 5172130 5172135 +
gggtacaggcttagagatattt

SEQ ID NO: 74372 - DNA, 22 bp, Artificial Sequence
  Synthetic oligonucleotide; CTT chr11 5172125 5172146 5172142 5172147 +
agagatatttatctgggaacaa

SEQ ID NO: 74373 - DNA, 22 bp, Artificial Sequence
  Synthetic oligonucleotide; TTA chr11 5172126 5172147 5172143 5172148 +
gagatatttatctgggaacaag

SEQ ID NO: 74374 - DNA, 22 bp, Artificial Sequence
  Synthetic oligonucleotide; TTT chr11 5172135 5172156 5172152 5172157 +
atctgggaacaagtttattaac

SEQ ID NO: 74375 - DNA, 22 bp, Artificial Sequence
  Synthetic oligonucleotide; TTA chr11 5172136 5172157 5172153 5172158 +
tctgggaacaagtttattaaca

SEQ ID NO: 74376 - DNA, 22 bp, Artificial Sequence
  Synthetic oligonucleotide; CTG chr11 5172140 5172161 5172157 5172162 +
ggaacaagtttattaacactaa

SEQ ID NO: 74377 - DNA, 22 bp, Artificial Sequence
  Synthetic oligonucleotide; TTT chr11 5172151 5172172 5172168 5172173 +
attaacactaaagttccactta

SEQ ID NO: 74378 - DNA, 22 bp, Artificial Sequence
  Synthetic oligonucleotide; TTA chr11 5172152 5172173 5172169 5172174 +
ttaacactaaagttccacttat

SEQ ID NO: 74379 - DNA, 22 bp, Artificial Sequence
  Synthetic oligonucleotide; TTA chr11 5172155 5172176 5172172 5172177 +
acactaaagttccacttatctg

SEQ ID NO: 74380 - DNA, 22 bp, Artificial Sequence
  Synthetic oligonucleotide; CTA chr11 5172161 5172182 5172178 5172183 +
aagttccacttatctgcagcag

SEQ ID NO: 74381 - DNA, 22 bp, Artificial Sequence
  Synthetic oligonucleotide; TTC chr11 5172167 5172188 5172184 5172189 +
cacttatctgcagcagagcctt

SEQ ID NO: 74382 - DNA, 22 bp, Artificial Sequence
  Synthetic oligonucleotide; CTT chr11 5172172 5172193 5172189 5172194 +
atctgcagcagagccttaggta

SEQ ID NO: 74383 - DNA, 22 bp, Artificial Sequence
  Synthetic oligonucleotide; TTA chr11 5172173 5172194 5172190 5172195 +
tctgcagcagagccttaggtat

SEQ ID NO: 74384 - DNA, 22 bp, Artificial Sequence
  Synthetic oligonucleotide; CTG chr11 5172177 5172198 5172194 5172199 +
cagcagagccttaggtattaac

SEQ ID NO: 74385 - DNA, 22 bp, Artificial Sequence
  Synthetic oligonucleotide; CTT chr11 5172189 5172210 5172206 5172211 +
aggtattaacgttggaggccag

SEQ ID NO: 74386 - DNA, 22 bp, Artificial Sequence
  Synthetic oligonucleotide; TTA chr11 5172190 5172211 5172207 5172212 +
ggtattaacgttggaggccaga

SEQ ID NO: 74387 - DNA, 22 bp, Artificial Sequence
  Synthetic oligonucleotide; TTA chr11 5172197 5172218 5172214 5172219 +
acgttggaggccagaaatggaa

SEQ ID NO: 74388 - DNA, 22 bp, Artificial Sequence
  Synthetic oligonucleotide; TTG chr11 5172203 5172224 5172220 5172225 +
gaggccagaaatggaattcagg

SEQ ID NO: 74389 - DNA, 22 bp, Artificial Sequence
  Synthetic oligonucleotide; TTC chr11 5172222 5172243 5172239 5172244 +
aggatggggctcagaaataaga

SEQ ID NO: 74390 - DNA, 22 bp, Artificial Sequence
  Synthetic oligonucleotide; CTC chr11 5172234 5172255 5172251 5172256 +
agaaataagaatgtgaccaagg

SEQ ID NO: 74391 - DNA, 22 bp, Artificial Sequence
  Synthetic oligonucleotide; CTG chr11 5172259 5172280 5172276 5172281 +
aactcttcttcccgtgttgggc

SEQ ID NO: 74392 - DNA, 22 bp, Artificial Sequence
  Synthetic oligonucleotide; CTC chr11 5172264 5172285 5172281 5172286 +
ttcttcccgtgttgggccaggg

SEQ ID NO: 74393 - DNA, 22 bp, Artificial Sequence
  Synthetic oligonucleotide; CTT chr11 5172266 5172287 5172283 5172288 +
cttcccgtgttgggccagggct

SEQ ID NO: 74394 - DNA, 22 bp, Artificial Sequence
  Synthetic oligonucleotide; TTC chr11 5172267 5172288 5172284 5172289 +
ttcccgtgttgggccagggctc

SEQ ID NO: 74395 - DNA, 22 bp, Artificial Sequence
  Synthetic oligonucleotide; CTT chr11 5172269 5172290 5172286 5172291 +
cccgtgttgggccagggctctt

SEQ ID NO: 74396 - DNA, 22 bp, Artificial Sequence
  Synthetic oligonucleotide; TTC chr11 5172270 5172291 5172287 5172292 +
ccgtgttgggccagggctcttc

SEQ ID NO: 74397 - DNA, 22 bp, Artificial Sequence
  Synthetic oligonucleotide; TTG chr11 5172278 5172299 5172295 5172300 +
ggccagggctcttcgttaggca

SEQ ID NO: 74398 - DNA, 22 bp, Artificial Sequence
  Synthetic oligonucleotide; CTC chr11 5172289 5172310 5172306 5172311 +
ttcgttaggcataatcagtggg

SEQ ID NO: 74399 - DNA, 22 bp, Artificial Sequence
  Synthetic oligonucleotide; CTT chr11 5172291 5172312 5172308 5172313 +
cgttaggcataatcagtgggat

SEQ ID NO: 74400 - DNA, 22 bp, Artificial Sequence
  Synthetic oligonucleotide; TTC chr11 5172292 5172313 5172309 5172314 +
gttaggcataatcagtgggata

SEQ ID NO: 74401 - DNA, 22 bp, Artificial Sequence
  Synthetic oligonucleotide; TTA chr11 5172296 5172317 5172313 5172318 +
ggcataatcagtgggatagtaa

SEQ ID NO: 74402 - DNA, 22 bp, Artificial Sequence
  Synthetic oligonucleotide; TTT chr11 5172327 5172348 5172344 5172349 +
ccaaataaaaatgccctgattt

SEQ ID NO: 74403 - DNA, 22 bp, Artificial Sequence
  Synthetic oligonucleotide; TTC chr11 5172328 5172349 5172345 5172350 +
caaataaaaatgccctgatttt

SEQ ID NO: 74404 - DNA, 22 bp, Artificial Sequence
  Synthetic oligonucleotide; CTG chr11 5172345 5172366 5172362 5172367 +
atttttaccagttaccgatttt

SEQ ID NO: 74405 - DNA, 22 bp, Artificial Sequence
  Synthetic oligonucleotide; TTT chr11 5172349 5172370 5172366 5172371 +
ttaccagttaccgattttttgt

SEQ ID NO: 74406 - DNA, 22 bp, Artificial Sequence
  Synthetic oligonucleotide; TTT chr11 5172350 5172371 5172367 5172372 +
taccagttaccgattttttgtg

SEQ ID NO: 74407 - DNA, 22 bp, Artificial Sequence
  Synthetic oligonucleotide; TTT chr11 5172351 5172372 5172368 5172373 +
accagttaccgattttttgtgt

SEQ ID NO: 74408 - DNA, 22 bp, Artificial Sequence
  Synthetic oligonucleotide; TTA chr11 5172352 5172373 5172369 5172374 +
ccagttaccgattttttgtgtt

SEQ ID NO: 74409 - DNA, 22 bp, Artificial Sequence
  Synthetic oligonucleotide; TTA chr11 5172359 5172380 5172376 5172381 +
ccgattttttgtgttttaatga

SEQ ID NO: 74410 - DNA, 22 bp, Artificial Sequence
  Synthetic oligonucleotide; TTT chr11 5172366 5172387 5172383 5172388 +
tttgtgttttaatgactcctac

SEQ ID NO: 74411 - DNA, 22 bp, Artificial Sequence
  Synthetic oligonucleotide; TTT chr11 5172367 5172388 5172384 5172389 +
ttgtgttttaatgactcctacc

SEQ ID NO: 74412 - DNA, 22 bp, Artificial Sequence
  Synthetic oligonucleotide; TTT chr11 5172368 5172389 5172385 5172390 +
tgtgttttaatgactcctacca

SEQ ID NO: 74413 - DNA, 22 bp, Artificial Sequence
  Synthetic oligonucleotide; TTT chr11 5172369 5172390 5172386 5172391 +
gtgttttaatgactcctaccat

SEQ ID NO: 74414 - DNA, 22 bp, Artificial Sequence
  Synthetic oligonucleotide; TTG chr11 5172370 5172391 5172387 5172392 +
tgttttaatgactcctaccatg

SEQ ID NO: 74415 - DNA, 22 bp, Artificial Sequence
  Synthetic oligonucleotide; TTT chr11 5172375 5172396 5172392 5172397 +
taatgactcctaccatgatcaa

SEQ ID NO: 74416 - DNA, 22 bp, Artificial Sequence
  Synthetic oligonucleotide; TTT chr11 5172376 5172397 5172393 5172398 +
aatgactcctaccatgatcaat

SEQ ID NO: 74417 - DNA, 22 bp, Artificial Sequence
  Synthetic oligonucleotide; TTA chr11 5172377 5172398 5172394 5172399 +
atgactcctaccatgatcaatt

SEQ ID NO: 74418 - DNA, 22 bp, Artificial Sequence
  Synthetic oligonucleotide; CTC chr11 5172384 5172405 5172401 5172406 +
ctaccatgatcaatttcagact

SEQ ID NO: 74419 - DNA, 22 bp, Artificial Sequence
  Synthetic oligonucleotide; CTA chr11 5172387 5172408 5172404 5172409 +
ccatgatcaatttcagactacc

SEQ ID NO: 74420 - DNA, 22 bp, Artificial Sequence
  Synthetic oligonucleotide; TTT chr11 5172400 5172421 5172417 5172422 +
cagactaccaaagagatgctat

SEQ ID NO: 74421 - DNA, 22 bp, Artificial Sequence
  Synthetic oligonucleotide; TTC chr11 5172401 5172422 5172418 5172423 +
agactaccaaagagatgctatt

SEQ ID NO: 74422 - DNA, 22 bp, Artificial Sequence
  Synthetic oligonucleotide; CTA chr11 5172407 5172428 5172424 5172429 +
ccaaagagatgctattaaatgc

SEQ ID NO: 74423 - DNA, 22 bp, Artificial Sequence
  Synthetic oligonucleotide; CTA chr11 5172421 5172442 5172438 5172443 +
ttaaatgcagagctgagatgag

SEQ ID NO: 74424 - DNA, 22 bp, Artificial Sequence
  Synthetic oligonucleotide; TTA chr11 5172424 5172445 5172441 5172446 +
aatgcagagctgagatgagcat

SEQ ID NO: 74425 - DNA, 22 bp, Artificial Sequence
  Synthetic oligonucleotide; CTG chr11 5172436 5172457 5172453 5172458 +
agatgagcataatcagctttcc

SEQ ID NO: 74426 - DNA, 22 bp, Artificial Sequence
  Synthetic oligonucleotide; CTT chr11 5172455 5172476 5172472 5172477 +
tcctaagctggtgcaagccagc

SEQ ID NO: 74427 - DNA, 22 bp, Artificial Sequence
  Synthetic oligonucleotide; TTT chr11 5172456 5172477 5172473 5172478 +
cctaagctggtgcaagccagca

SEQ ID NO: 74428 - DNA, 22 bp, Artificial Sequence
  Synthetic oligonucleotide; TTC chr11 5172457 5172478 5172474 5172479 +
ctaagctggtgcaagccagcac

SEQ ID NO: 74429 - DNA, 22 bp, Artificial Sequence
  Synthetic oligonucleotide; CTA chr11 5172460 5172481 5172477 5172482 +
agctggtgcaagccagcacatt

SEQ ID NO: 74430 - DNA, 22 bp, Artificial Sequence
  Synthetic oligonucleotide; CTG chr11 5172465 5172486 5172482 5172487 +
gtgcaagccagcacattatacc

SEQ ID NO: 74431 - DNA, 22 bp, Artificial Sequence
  Synthetic oligonucleotide; TTA chr11 5172483 5172504 5172500 5172505 +
taccattaggcataactatagt

SEQ ID NO: 74432 - DNA, 22 bp, Artificial Sequence
  Synthetic oligonucleotide; TTA chr11 5172491 5172512 5172508 5172513 +
ggcataactatagttgatccta

SEQ ID NO: 74433 - DNA, 22 bp, Artificial Sequence
  Synthetic oligonucleotide; CTA chr11 5172501 5172522 5172518 5172523 +
tagttgatcctagacctcagat

SEQ ID NO: 74434 - DNA, 22 bp, Artificial Sequence
  Synthetic oligonucleotide; TTG chr11 5172507 5172528 5172524 5172529 +
atcctagacctcagatacttac

SEQ ID NO: 74435 - DNA, 22 bp, Artificial Sequence
  Synthetic oligonucleotide; CTA chr11 5172513 5172534 5172530 5172535 +
gacctcagatacttacctaggt

SEQ ID NO: 74436 - DNA, 22 bp, Artificial Sequence
  Synthetic oligonucleotide; CTC chr11 5172519 5172540 5172536 5172541 +
agatacttacctaggtggaact

SEQ ID NO: 74437 - DNA, 22 bp, Artificial Sequence
  Synthetic oligonucleotide; CTT chr11 5172527 5172548 5172544 5172549 +
acctaggtggaactgagagcta

SEQ ID NO: 74438 - DNA, 22 bp, Artificial Sequence
  Synthetic oligonucleotide; TTA chr11 5172528 5172549 5172545 5172550 +
cctaggtggaactgagagctac

SEQ ID NO: 74439 - DNA, 22 bp, Artificial Sequence
  Synthetic oligonucleotide; CTA chr11 5172532 5172553 5172549 5172554 +
ggtggaactgagagctaccaca

SEQ ID NO: 74440 - DNA, 22 bp, Artificial Sequence
  Synthetic oligonucleotide; CTG chr11 5172542 5172563 5172559 5172564 +
agagctaccacatcaatccatg

SEQ ID NO: 74441 - DNA, 22 bp, Artificial Sequence
  Synthetic oligonucleotide; CTA chr11 5172549 5172570 5172566 5172571 +
ccacatcaatccatgcatacta

SEQ ID NO: 74442 - DNA, 22 bp, Artificial Sequence
  Synthetic oligonucleotide; CTA chr11 5172571 5172592 5172588 5172593 +
tttgttactgtttactttcaac

SEQ ID NO: 74443 - DNA, 22 bp, Artificial Sequence
  Synthetic oligonucleotide; TTT chr11 5172574 5172595 5172591 5172596 +
gttactgtttactttcaactgg

SEQ ID NO: 74444 - DNA, 22 bp, Artificial Sequence
  Synthetic oligonucleotide; TTG chr11 5172575 5172596 5172592 5172597 +
ttactgtttactttcaactggg

SEQ ID NO: 74445 - DNA, 22 bp, Artificial Sequence
  Synthetic oligonucleotide; TTA chr11 5172578 5172599 5172595 5172600 +
ctgtttactttcaactgggctg

SEQ ID NO: 74446 - DNA, 22 bp, Artificial Sequence
  Synthetic oligonucleotide; CTG chr11 5172581 5172602 5172598 5172603 +
tttactttcaactgggctgtgg

SEQ ID NO: 74447 - DNA, 22 bp, Artificial Sequence
  Synthetic oligonucleotide; TTT chr11 5172584 5172605 5172601 5172606 +
actttcaactgggctgtggaca

SEQ ID NO: 74448 - DNA, 22 bp, Artificial Sequence
  Synthetic oligonucleotide; TTA chr11 5172585 5172606 5172602 5172607 +
ctttcaactgggctgtggacat

SEQ ID NO: 74449 - DNA, 22 bp, Artificial Sequence
  Synthetic oligonucleotide; CTT chr11 5172588 5172609 5172605 5172610 +
tcaactgggctgtggacatagt

SEQ ID NO: 74450 - DNA, 22 bp, Artificial Sequence
  Synthetic oligonucleotide; TTT chr11 5172589 5172610 5172606 5172611 +
caactgggctgtggacatagtt

SEQ ID NO: 74451 - DNA, 22 bp, Artificial Sequence
  Synthetic oligonucleotide; TTC chr11 5172590 5172611 5172607 5172612 +
aactgggctgtggacatagtta

SEQ ID NO: 74452 - DNA, 22 bp, Artificial Sequence
  Synthetic oligonucleotide; CTG chr11 5172595 5172616 5172612 5172617 +
ggctgtggacatagttactacc

SEQ ID NO: 74453 - DNA, 22 bp, Artificial Sequence
  Synthetic oligonucleotide; CTG chr11 5172600 5172621 5172617 5172622 +
tggacatagttactacctccct

SEQ ID NO: 74454 - DNA, 22 bp, Artificial Sequence
  Synthetic oligonucleotide; TTA chr11 5172612 5172633 5172629 5172634 +
ctacctccctgtatatgtgctt

SEQ ID NO: 74455 - DNA, 22 bp, Artificial Sequence
  Synthetic oligonucleotide; CTA chr11 5172615 5172636 5172632 5172637 +
cctccctgtatatgtgcttagt

SEQ ID NO: 74456 - DNA, 22 bp, Artificial Sequence
  Synthetic oligonucleotide; CTC chr11 5172619 5172640 5172636 5172641 +
cctgtatatgtgcttagttgac

SEQ ID NO: 74457 - DNA, 22 bp, Artificial Sequence
  Synthetic oligonucleotide; CTG chr11 5172623 5172644 5172640 5172645 +
tatatgtgcttagttgactgga

SEQ ID NO: 74458 - DNA, 22 bp, Artificial Sequence
  Synthetic oligonucleotide; CTT chr11 5172634 5172655 5172651 5172656 +
agttgactggaggacatagaga

SEQ ID NO: 74459 - DNA, 22 bp, Artificial Sequence
  Synthetic oligonucleotide; TTA chr11 5172635 5172656 5172652 5172657 +
gttgactggaggacatagagac

SEQ ID NO: 74460 - DNA, 22 bp, Artificial Sequence
  Synthetic oligonucleotide; TTG chr11 5172639 5172660 5172656 5172661 +
actggaggacatagagacagaa

SEQ ID NO: 74461 - DNA, 22 bp, Artificial Sequence
  Synthetic oligonucleotide; CTG chr11 5172643 5172664 5172660 5172665 +
gaggacatagagacagaatgat

SEQ ID NO: 74462 - DNA, 22 bp, Artificial Sequence
  Synthetic oligonucleotide; TTC chr11 5172667 5172688 5172684 5172689 +
agtatccctcaagaagcaatta

SEQ ID NO: 74463 - DNA, 22 bp, Artificial Sequence
  Synthetic oligonucleotide; CTC chr11 5172677 5172698 5172694 5172699 +
aagaagcaattaaccaagaata

SEQ ID NO: 74464 - DNA, 22 bp, Artificial Sequence
  Synthetic oligonucleotide; TTA chr11 5172689 5172710 5172706 5172711 +
accaagaataattattcccaga

SEQ ID NO: 74465 - DNA, 22 bp, Artificial Sequence
  Synthetic oligonucleotide; TTA chr11 5172703 5172724 5172720 5172725 +
ttcccagaaacttcgggtgtat

SEQ ID NO: 74466 - DNA, 22 bp, Artificial Sequence
  Synthetic oligonucleotide; TTC chr11 5172706 5172727 5172723 5172728 +
ccagaaacttcgggtgtattag

SEQ ID NO: 74467 - DNA, 22 bp, Artificial Sequence
  Synthetic oligonucleotide; CTT chr11 5172716 5172737 5172733 5172738 +
cgggtgtattagagagaaaggg

SEQ ID NO: 74468 - DNA, 22 bp, Artificial Sequence
  Synthetic oligonucleotide; TTC chr11 5172717 5172738 5172734 5172739 +
gggtgtattagagagaaagggg

SEQ ID NO: 74469 - DNA, 22 bp, Artificial Sequence
  Synthetic oligonucleotide; TTA chr11 5172727 5172748 5172744 5172749 +
gagagaaaggggggaatagttc

SEQ ID NO: 74470 - DNA, 22 bp, Artificial Sequence
  Synthetic oligonucleotide; TTC chr11 5172749 5172770 5172766 5172771 +
ctgagaagcatgctggagagag

SEQ ID NO: 74471 - DNA, 22 bp, Artificial Sequence
  Synthetic oligonucleotide; CTG chr11 5172752 5172773 5172769 5172774 +
agaagcatgctggagagagtat

SEQ ID NO: 74472 - DNA, 22 bp, Artificial Sequence
  Synthetic oligonucleotide; CTG chr11 5172764 5172785 5172781 5172786 +
gagagagtatacataagaacat

SEQ ID NO: 74473 - DNA, 22 bp, Artificial Sequence
  Synthetic oligonucleotide; TTA chr11 5172827 5172848 5172844 5172849 +
cacaatatcattaattataatt

SEQ ID NO: 74474 - DNA, 22 bp, Artificial Sequence
  Synthetic oligonucleotide; TTA chr11 5172840 5172861 5172857 5172862 +
attataatttaaatataagaca

SEQ ID NO: 74475 - DNA, 22 bp, Artificial Sequence
  Synthetic oligonucleotide; TTA chr11 5172844 5172865 5172861 5172866 +
taatttaaatataagacattgg

SEQ ID NO: 74476 - DNA, 22 bp, Artificial Sequence
  Synthetic oligonucleotide; TTT chr11 5172850 5172871 5172867 5172872 +
aaatataagacattggtttata

SEQ ID NO: 74477 - DNA, 22 bp, Artificial Sequence
  Synthetic oligonucleotide; TTA chr11 5172851 5172872 5172868 5172873 +
aatataagacattggtttatat

SEQ ID NO: 74478 - DNA, 22 bp, Artificial Sequence
  Synthetic oligonucleotide; TTG chr11 5172865 5172886 5172882 5172887 +
gtttatatttcttatatacttc

SEQ ID NO: 74479 - DNA, 22 bp, Artificial Sequence
  Synthetic oligonucleotide; TTT chr11 5172869 5172890 5172886 5172891 +
atatttcttatatacttccccc

SEQ ID NO: 74480 - DNA, 22 bp, Artificial Sequence
  Synthetic oligonucleotide; TTA chr11 5172870 5172891 5172887 5172892 +
tatttcttatatacttcccccg

SEQ ID NO: 74481 - DNA, 22 bp, Artificial Sequence
  Synthetic oligonucleotide; TTT chr11 5172875 5172896 5172892 5172897 +
cttatatacttcccccgcatct

SEQ ID NO: 74482 - DNA, 22 bp, Artificial Sequence
  Synthetic oligonucleotide; TTC chr11 5172876 5172897 5172893 5172898 +
ttatatacttcccccgcatctt

SEQ ID NO: 74483 - DNA, 22 bp, Artificial Sequence
  Synthetic oligonucleotide; CTT chr11 5172878 5172899 5172895 5172900 +
atatacttcccccgcatcttat

SEQ ID NO: 74484 - DNA, 22 bp, Artificial Sequence
  Synthetic oligonucleotide; TTA chr11 5172879 5172900 5172896 5172901 +
tatacttcccccgcatcttatc

SEQ ID NO: 74485 - DNA, 22 bp, Artificial Sequence
  Synthetic oligonucleotide; CTT chr11 5172886 5172907 5172903 5172908 +
cccccgcatcttatcttcatta

SEQ ID NO: 74486 - DNA, 22 bp, Artificial Sequence
  Synthetic oligonucleotide; TTC chr11 5172887 5172908 5172904 5172909 +
ccccgcatcttatcttcattaa

SEQ ID NO: 74487 - DNA, 22 bp, Artificial Sequence
  Synthetic oligonucleotide; CTT chr11 5172898 5172919 5172915 5172920 +
atcttcattaattttttcatac

SEQ ID NO: 74488 - DNA, 22 bp, Artificial Sequence
  Synthetic oligonucleotide; TTA chr11 5172899 5172920 5172916 5172921 +
tcttcattaattttttcataca

SEQ ID NO: 74489 - DNA, 22 bp, Artificial Sequence
  Synthetic oligonucleotide; CTT chr11 5172903 5172924 5172920 5172925 +
cattaattttttcatacacaat

SEQ ID NO: 74490 - DNA, 22 bp, Artificial Sequence
  Synthetic oligonucleotide; TTC chr11 5172904 5172925 5172921 5172926 +
attaattttttcatacacaatc

SEQ ID NO: 74491 - DNA, 22 bp, Artificial Sequence
  Synthetic oligonucleotide; TTA chr11 5172908 5172929 5172925 5172930 +
attttttcatacacaatcattt

SEQ ID NO: 74492 - DNA, 22 bp, Artificial Sequence
  Synthetic oligonucleotide; TTT chr11 5172912 5172933 5172929 5172934 +
tttcatacacaatcatttacaa

SEQ ID NO: 74493 - DNA, 22 bp, Artificial Sequence
  Synthetic oligonucleotide; TTT chr11 5172913 5172934 5172930 5172935 +
ttcatacacaatcatttacaaa

SEQ ID NO: 74494 - DNA, 22 bp, Artificial Sequence
  Synthetic oligonucleotide; TTT chr11 5172914 5172935 5172931 5172936 +
tcatacacaatcatttacaaaa

SEQ ID NO: 74495 - DNA, 22 bp, Artificial Sequence
  Synthetic oligonucleotide; TTT chr11 5172915 5172936 5172932 5172937 +
catacacaatcatttacaaaac

SEQ ID NO: 74496 - DNA, 22 bp, Artificial Sequence
  Synthetic oligonucleotide; TTC chr11 5172916 5172937 5172933 5172938 +
atacacaatcatttacaaaact

SEQ ID NO: 74497 - DNA, 22 bp, Artificial Sequence
  Synthetic oligonucleotide; TTT chr11 5172930 5172951 5172947 5172952 +
acaaaacttttatgtagtcagg

SEQ ID NO: 74498 - DNA, 22 bp, Artificial Sequence
  Synthetic oligonucleotide; TTA chr11 5172931 5172952 5172948 5172953 +
caaaacttttatgtagtcaggt

SEQ ID NO: 74499 - DNA, 22 bp, Artificial Sequence
  Synthetic oligonucleotide; CTT chr11 5172939 5172960 5172956 5172961 +
ttatgtagtcaggttaacatac

SEQ ID NO: 74500 - DNA, 22 bp, Artificial Sequence
  Synthetic oligonucleotide; TTT chr11 5172940 5172961 5172957 5172962 +
tatgtagtcaggttaacataca

SEQ ID NO: 74501 - DNA, 22 bp, Artificial Sequence
  Synthetic oligonucleotide; TTT chr11 5172941 5172962 5172958 5172963 +
atgtagtcaggttaacatacat

SEQ ID NO: 74502 - DNA, 22 bp, Artificial Sequence
  Synthetic oligonucleotide; TTA chr11 5172942 5172963 5172959 5172964 +
tgtagtcaggttaacatacatt

SEQ ID NO: 74503 - DNA, 22 bp, Artificial Sequence
  Synthetic oligonucleotide; TTA chr11 5172955 5172976 5172972 5172977 +
acatacattttattaatattat

SEQ ID NO: 74504 - DNA, 22 bp, Artificial Sequence
  Synthetic oligonucleotide; TTT chr11 5172965 5172986 5172982 5172987 +
tattaatattatatacttttca

SEQ ID NO: 74505 - DNA, 22 bp, Artificial Sequence
  Synthetic oligonucleotide; TTT chr11 5172966 5172987 5172983 5172988 +
attaatattatatacttttcat

SEQ ID NO: 74506 - DNA, 22 bp, Artificial Sequence
  Synthetic oligonucleotide; TTA chr11 5172967 5172988 5172984 5172989 +
ttaatattatatacttttcatt

SEQ ID NO: 74507 - DNA, 22 bp, Artificial Sequence
  Synthetic oligonucleotide; TTA chr11 5172970 5172991 5172987 5172992 +
atattatatacttttcattctt

SEQ ID NO: 74508 - DNA, 22 bp, Artificial Sequence
  Synthetic oligonucleotide; TTA chr11 5172976 5172997 5172993 5172998 +
tatacttttcattcttaagaag

SEQ ID NO: 74509 - DNA, 22 bp, Artificial Sequence
  Synthetic oligonucleotide; CTT chr11 5172983 5173004 5173000 5173005 +
ttcattcttaagaagctattcc

SEQ ID NO: 74510 - DNA, 22 bp, Artificial Sequence
  Synthetic oligonucleotide; TTT chr11 5172984 5173005 5173001 5173006 +
tcattcttaagaagctattcca

SEQ ID NO: 74511 - DNA, 22 bp, Artificial Sequence
  Synthetic oligonucleotide; TTT chr11 5172985 5173006 5173002 5173007 +
cattcttaagaagctattccat

SEQ ID NO: 74512 - DNA, 22 bp, Artificial Sequence
  Synthetic oligonucleotide; TTC chr11 5172986 5173007 5173003 5173008 +
attcttaagaagctattccata

SEQ ID NO: 74513 - DNA, 22 bp, Artificial Sequence
  Synthetic oligonucleotide; TTC chr11 5172990 5173011 5173007 5173012 +
ttaagaagctattccatataca

SEQ ID NO: 74514 - DNA, 22 bp, Artificial Sequence
  Synthetic oligonucleotide; CTT chr11 5172992 5173013 5173009 5173014 +
aagaagctattccatatacaaa

SEQ ID NO: 74515 - DNA, 22 bp, Artificial Sequence
  Synthetic oligonucleotide; TTA chr11 5172993 5173014 5173010 5173015 +
agaagctattccatatacaaag

SEQ ID NO: 74516 - DNA, 22 bp, Artificial Sequence
  Synthetic oligonucleotide; CTA chr11 5173001 5173022 5173018 5173023 +
ttccatatacaaagtaaaaagt

SEQ ID NO: 74517 - DNA, 22 bp, Artificial Sequence
  Synthetic oligonucleotide; TTC chr11 5173004 5173025 5173021 5173026 +
catatacaaagtaaaaagtgga

SEQ ID NO: 74518 - DNA, 22 bp, Artificial Sequence
  Synthetic oligonucleotide; TTG chr11 5173040 5173061 5173057 5173062 +
gatctagagctagagacggaac

SEQ ID NO: 74519 - DNA, 22 bp, Artificial Sequence
  Synthetic oligonucleotide; CTA chr11 5173046 5173067 5173063 5173068 +
gagctagagacggaactgcaga

SEQ ID NO: 74520 - DNA, 22 bp, Artificial Sequence
  Synthetic oligonucleotide; CTA chr11 5173052 5173073 5173069 5173074 +
gagacggaactgcagataggga

SEQ ID NO: 74521 - DNA, 22 bp, Artificial Sequence
  Synthetic oligonucleotide; CTG chr11 5173064 5173085 5173081 5173086 +
cagatagggatagtggtgtaga

SEQ ID NO: 74522 - DNA, 22 bp, Artificial Sequence
  Synthetic oligonucleotide; TTA chr11 5173144 5173165 5173161 5173166 +
gagattcttgattccacctgaa

SEQ ID NO: 74523 - DNA, 22 bp, Artificial Sequence
  Synthetic oligonucleotide; TTC chr11 5173151 5173172 5173168 5173173 +
ttgattccacctgaaatttgtt

SEQ ID NO: 74524 - DNA, 22 bp, Artificial Sequence
  Synthetic oligonucleotide; CTT chr11 5173153 5173174 5173170 5173175 +
gattccacctgaaatttgtttg

SEQ ID NO: 74525 - DNA, 22 bp, Artificial Sequence
  Synthetic oligonucleotide; TTG chr11 5173154 5173175 5173171 5173176 +
attccacctgaaatttgtttgg

SEQ ID NO: 74526 - DNA, 22 bp, Artificial Sequence
  Synthetic oligonucleotide; TTC chr11 5173158 5173179 5173175 5173180 +
cacctgaaatttgtttggggga

SEQ ID NO: 74527 - DNA, 22 bp, Artificial Sequence
  Synthetic oligonucleotide; CTG chr11 5173164 5173185 5173181 5173186 +
aaatttgtttgggggacttggg

SEQ ID NO: 74528 - DNA, 22 bp, Artificial Sequence
  Synthetic oligonucleotide; TTT chr11 5173170 5173191 5173187 5173192 +
gtttgggggacttgggtaatta

SEQ ID NO: 74529 - DNA, 22 bp, Artificial Sequence
  Synthetic oligonucleotide; TTG chr11 5173171 5173192 5173188 5173193 +
tttgggggacttgggtaattag

SEQ ID NO: 74530 - DNA, 22 bp, Artificial Sequence
  Synthetic oligonucleotide; TTT chr11 5173174 5173195 5173191 5173196 +
gggggacttgggtaattagaat

SEQ ID NO: 74531 - DNA, 22 bp, Artificial Sequence
  Synthetic oligonucleotide; TTG chr11 5173175 5173196 5173192 5173197 +
ggggacttgggtaattagaatt

SEQ ID NO: 74532 - DNA, 22 bp, Artificial Sequence
  Synthetic oligonucleotide; CTT chr11 5173183 5173204 5173200 5173205 +
gggtaattagaattttacttaa

SEQ ID NO: 74533 - DNA, 22 bp, Artificial Sequence
  Synthetic oligonucleotide; TTG chr11 5173184 5173205 5173201 5173206 +
ggtaattagaattttacttaag

SEQ ID NO: 74534 - DNA, 22 bp, Artificial Sequence
  Synthetic oligonucleotide; TTA chr11 5173192 5173213 5173209 5173214 +
gaattttacttaagtattctca

SEQ ID NO: 74535 - DNA, 22 bp, Artificial Sequence
  Synthetic oligonucleotide; TTT chr11 5173198 5173219 5173215 5173220 +
tacttaagtattctcaaacata

SEQ ID NO: 74536 - DNA, 22 bp, Artificial Sequence
  Synthetic oligonucleotide; TTT chr11 5173199 5173220 5173216 5173221 +
acttaagtattctcaaacatat

SEQ ID NO: 74537 - DNA, 22 bp, Artificial Sequence
  Synthetic oligonucleotide; TTA chr11 5173200 5173221 5173217 5173222 +
cttaagtattctcaaacatata

SEQ ID NO: 74538 - DNA, 22 bp, Artificial Sequence
  Synthetic oligonucleotide; CTT chr11 5173203 5173224 5173220 5173225 +
aagtattctcaaacatataaac

SEQ ID NO: 74539 - DNA, 22 bp, Artificial Sequence
  Synthetic oligonucleotide; TTA chr11 5173204 5173225 5173221 5173226 +
agtattctcaaacatataaaca

SEQ ID NO: 74540 - DNA, 22 bp, Artificial Sequence
  Synthetic oligonucleotide; TTC chr11 5173211 5173232 5173228 5173233 +
tcaaacatataaacaatttttc

SEQ ID NO: 74541 - DNA, 22 bp, Artificial Sequence
  Synthetic oligonucleotide; CTC chr11 5173213 5173234 5173230 5173235 +
aaacatataaacaatttttcta

SEQ ID NO: 74542 - DNA, 22 bp, Artificial Sequence
  Synthetic oligonucleotide; TTT chr11 5173230 5173251 5173247 5173252 +
ttctaataccaagtataagatc

SEQ ID NO: 74543 - DNA, 22 bp, Artificial Sequence
  Synthetic oligonucleotide; TTT chr11 5173231 5173252 5173248 5173253 +
tctaataccaagtataagatca

SEQ ID NO: 74544 - DNA, 22 bp, Artificial Sequence
  Synthetic oligonucleotide; TTT chr11 5173232 5173253 5173249 5173254 +
ctaataccaagtataagatcaa

SEQ ID NO: 74545 - DNA, 22 bp, Artificial Sequence
  Synthetic oligonucleotide; TTC chr11 5173233 5173254 5173250 5173255 +
taataccaagtataagatcaag

SEQ ID NO: 74546 - DNA, 22 bp, Artificial Sequence
  Synthetic oligonucleotide; CTA chr11 5173235 5173256 5173252 5173257 +
ataccaagtataagatcaaggg

SEQ ID NO: 74547 - DNA, 22 bp, Artificial Sequence
  Synthetic oligonucleotide; TTG chr11 5173260 5173281 5173277 5173282 +
gtctccaagcatgatgagggat

SEQ ID NO: 74548 - DNA, 22 bp, Artificial Sequence
  Synthetic oligonucleotide; CTC chr11 5173265 5173286 5173282 5173287 +
caagcatgatgagggattacat

SEQ ID NO: 74549 - DNA, 22 bp, Artificial Sequence
  Synthetic oligonucleotide; TTA chr11 5173284 5173305 5173301 5173306 +
catacattttattttatatttt

SEQ ID NO: 74550 - DNA, 22 bp, Artificial Sequence
  Synthetic oligonucleotide; TTT chr11 5173293 5173314 5173310 5173315 +
tattttatatttttatataaat

SEQ ID NO: 74551 - DNA, 22 bp, Artificial Sequence
  Synthetic oligonucleotide; TTT chr11 5173294 5173315 5173311 5173316 +
attttatatttttatataaata

SEQ ID NO: 74552 - DNA, 22 bp, Artificial Sequence
  Synthetic oligonucleotide; TTA chr11 5173295 5173316 5173312 5173317 +
ttttatatttttatataaatat

SEQ ID NO: 74553 - DNA, 22 bp, Artificial Sequence
  Synthetic oligonucleotide; TTT chr11 5173298 5173319 5173315 5173320 +
tatatttttatataaatatgga

SEQ ID NO: 74554 - DNA, 22 bp, Artificial Sequence
  Synthetic oligonucleotide; TTT chr11 5173299 5173320 5173316 5173321 +
atatttttatataaatatggat

SEQ ID NO: 74555 - DNA, 22 bp, Artificial Sequence
  Synthetic oligonucleotide; TTA chr11 5173300 5173321 5173317 5173322 +
tatttttatataaatatggatc

SEQ ID NO: 74556 - DNA, 22 bp, Artificial Sequence
  Synthetic oligonucleotide; TTT chr11 5173305 5173326 5173322 5173327 +
ttatataaatatggatctaatt

SEQ ID NO: 74557 - DNA, 22 bp, Artificial Sequence
  Synthetic oligonucleotide; TTT chr11 5173306 5173327 5173323 5173328 +
tatataaatatggatctaattc

SEQ ID NO: 74558 - DNA, 22 bp, Artificial Sequence
  Synthetic oligonucleotide; TTT chr11 5173307 5173328 5173324 5173329 +
atataaatatggatctaattct

SEQ ID NO: 74559 - DNA, 22 bp, Artificial Sequence
  Synthetic oligonucleotide; TTA chr11 5173308 5173329 5173325 5173330 +
tataaatatggatctaattcta

SEQ ID NO: 74560 - DNA, 22 bp, Artificial Sequence
  Synthetic oligonucleotide; CTA chr11 5173324 5173345 5173341 5173346 +
attctagactgttttctgttgt

SEQ ID NO: 74561 - DNA, 22 bp, Artificial Sequence
  Synthetic oligonucleotide; TTC chr11 5173328 5173349 5173345 5173350 +
tagactgttttctgttgtttga

SEQ ID NO: 74562 - DNA, 22 bp, Artificial Sequence
  Synthetic oligonucleotide; CTA chr11 5173330 5173351 5173347 5173352 +
gactgttttctgttgtttgatc

SEQ ID NO: 74563 - DNA, 22 bp, Artificial Sequence
  Synthetic oligonucleotide; CTG chr11 5173335 5173356 5173352 5173357 +
ttttctgttgtttgatctgtgt

SEQ ID NO: 74564 - DNA, 22 bp, Artificial Sequence
  Synthetic oligonucleotide; TTT chr11 5173338 5173359 5173355 5173360 +
tctgttgtttgatctgtgtcct

SEQ ID NO: 74565 - DNA, 22 bp, Artificial Sequence
  Synthetic oligonucleotide; TTT chr11 5173339 5173360 5173356 5173361 +
ctgttgtttgatctgtgtcctt

SEQ ID NO: 74566 - DNA, 22 bp, Artificial Sequence
  Synthetic oligonucleotide; TTC chr11 5173340 5173361 5173357 5173362 +
tgttgtttgatctgtgtccttt

SEQ ID NO: 74567 - DNA, 22 bp, Artificial Sequence
  Synthetic oligonucleotide; CTG chr11 5173342 5173363 5173359 5173364 +
ttgtttgatctgtgtccttttt

SEQ ID NO: 74568 - DNA, 22 bp, Artificial Sequence
  Synthetic oligonucleotide; TTG chr11 5173345 5173366 5173362 5173367 +
tttgatctgtgtcctttttgcc

SEQ ID NO: 74569 - DNA, 22 bp, Artificial Sequence
  Synthetic oligonucleotide; TTT chr11 5173348 5173369 5173365 5173370 +
gatctgtgtcctttttgccaca

SEQ ID NO: 74570 - DNA, 22 bp, Artificial Sequence
  Synthetic oligonucleotide; TTG chr11 5173349 5173370 5173366 5173371 +
atctgtgtcctttttgccacat

SEQ ID NO: 74571 - DNA, 22 bp, Artificial Sequence
  Synthetic oligonucleotide; CTG chr11 5173354 5173375 5173371 5173376 +
tgtcctttttgccacatgcaca

SEQ ID NO: 74572 - DNA, 22 bp, Artificial Sequence
  Synthetic oligonucleotide; CTT chr11 5173361 5173382 5173378 5173383 +
tttgccacatgcacatactgcc

SEQ ID NO: 74573 - DNA, 22 bp, Artificial Sequence
  Synthetic oligonucleotide; TTT chr11 5173362 5173383 5173379 5173384 +
ttgccacatgcacatactgccg

SEQ ID NO: 74574 - DNA, 22 bp, Artificial Sequence
  Synthetic oligonucleotide; TTT chr11 5173363 5173384 5173380 5173385 +
tgccacatgcacatactgccgt

SEQ ID NO: 74575 - DNA, 22 bp, Artificial Sequence
  Synthetic oligonucleotide; TTT chr11 5173364 5173385 5173381 5173386 +
gccacatgcacatactgccgtt

SEQ ID NO: 74576 - DNA, 22 bp, Artificial Sequence
  Synthetic oligonucleotide; TTG chr11 5173365 5173386 5173382 5173387 +
ccacatgcacatactgccgttc

SEQ ID NO: 74577 - DNA, 22 bp, Artificial Sequence
  Synthetic oligonucleotide; CTG chr11 5173381 5173402 5173398 5173403 +
ccgttcttattctgtttttata

SEQ ID NO: 74578 - DNA, 22 bp, Artificial Sequence
  Synthetic oligonucleotide; TTC chr11 5173387 5173408 5173404 5173409 +
ttattctgtttttatatacaac

SEQ ID NO: 74579 - DNA, 22 bp, Artificial Sequence
  Synthetic oligonucleotide; CTT chr11 5173389 5173410 5173406 5173411 +
attctgtttttatatacaactt

SEQ ID NO: 74580 - DNA, 22 bp, Artificial Sequence
  Synthetic oligonucleotide; TTA chr11 5173390 5173411 5173407 5173412 +
ttctgtttttatatacaacttc

SEQ ID NO: 74581 - DNA, 22 bp, Artificial Sequence
  Synthetic oligonucleotide; TTC chr11 5173393 5173414 5173410 5173415 +
tgtttttatatacaacttcata

SEQ ID NO: 74582 - DNA, 22 bp, Artificial Sequence
  Synthetic oligonucleotide; CTG chr11 5173395 5173416 5173412 5173417 +
tttttatatacaacttcatatt

SEQ ID NO: 74583 - DNA, 22 bp, Artificial Sequence
  Synthetic oligonucleotide; TTT chr11 5173398 5173419 5173415 5173420 +
ttatatacaacttcatattcaa

SEQ ID NO: 74584 - DNA, 22 bp, Artificial Sequence
  Synthetic oligonucleotide; TTT chr11 5173399 5173420 5173416 5173421 +
tatatacaacttcatattcaat

SEQ ID NO: 74585 - DNA, 22 bp, Artificial Sequence
  Synthetic oligonucleotide; TTT chr11 5173400 5173421 5173417 5173422 +
atatacaacttcatattcaatt

SEQ ID NO: 74586 - DNA, 22 bp, Artificial Sequence
  Synthetic oligonucleotide; TTA chr11 5173401 5173422 5173418 5173423 +
tatacaacttcatattcaattg

SEQ ID NO: 74587 - DNA, 22 bp, Artificial Sequence
  Synthetic oligonucleotide; CTT chr11 5173411 5173432 5173428 5173433 +
catattcaattggtcaagctat

SEQ ID NO: 74588 - DNA, 22 bp, Artificial Sequence
  Synthetic oligonucleotide; TTC chr11 5173412 5173433 5173429 5173434 +
atattcaattggtcaagctata

SEQ ID NO: 74589 - DNA, 22 bp, Artificial Sequence
  Synthetic oligonucleotide; TTC chr11 5173418 5173439 5173435 5173440 +
aattggtcaagctatatttttg

SEQ ID NO: 74590 - DNA, 22 bp, Artificial Sequence
  Synthetic oligonucleotide; TTG chr11 5173423 5173444 5173440 5173445 +
gtcaagctatatttttgttgtc

SEQ ID NO: 74591 - DNA, 22 bp, Artificial Sequence
  Synthetic oligonucleotide; CTA chr11 5173432 5173453 5173449 5173454 +
tatttttgttgtcatgctaact

SEQ ID NO: 74592 - DNA, 22 bp, Artificial Sequence
  Synthetic oligonucleotide; TTT chr11 5173437 5173458 5173454 5173459 +
ttgttgtcatgctaactttgta

SEQ ID NO: 74593 - DNA, 22 bp, Artificial Sequence
  Synthetic oligonucleotide; TTT chr11 5173438 5173459 5173455 5173460 +
tgttgtcatgctaactttgtat

SEQ ID NO: 74594 - DNA, 22 bp, Artificial Sequence
  Synthetic oligonucleotide; TTT chr11 5173439 5173460 5173456 5173461 +
gttgtcatgctaactttgtatt

SEQ ID NO: 74595 - DNA, 22 bp, Artificial Sequence
  Synthetic oligonucleotide; TTG chr11 5173440 5173461 5173457 5173462 +
ttgtcatgctaactttgtattc

SEQ ID NO: 74596 - DNA, 22 bp, Artificial Sequence
  Synthetic oligonucleotide; TTG chr11 5173443 5173464 5173460 5173465 +
tcatgctaactttgtattcttt

SEQ ID NO: 74597 - DNA, 22 bp, Artificial Sequence
  Synthetic oligonucleotide; CTA chr11 5173451 5173472 5173468 5173473 +
actttgtattctttcaaataag

SEQ ID NO: 74598 - DNA, 22 bp, Artificial Sequence
  Synthetic oligonucleotide; CTT chr11 5173455 5173476 5173472 5173477 +
tgtattctttcaaataaggatt

SEQ ID NO: 74599 - DNA, 22 bp, Artificial Sequence
  Synthetic oligonucleotide; TTT chr11 5173456 5173477 5173473 5173478 +
gtattctttcaaataaggatta

SEQ ID NO: 74600 - DNA, 22 bp, Artificial Sequence
  Synthetic oligonucleotide; TTG chr11 5173457 5173478 5173474 5173479 +
tattctttcaaataaggattaa

SEQ ID NO: 74601 - DNA, 22 bp, Artificial Sequence
  Synthetic oligonucleotide; TTC chr11 5173462 5173483 5173479 5173484 +
tttcaaataaggattaaaagcc

SEQ ID NO: 74602 - DNA, 22 bp, Artificial Sequence
  Synthetic oligonucleotide; CTT chr11 5173464 5173485 5173481 5173486 +
tcaaataaggattaaaagccag

SEQ ID NO: 74603 - DNA, 22 bp, Artificial Sequence
  Synthetic oligonucleotide; TTT chr11 5173465 5173486 5173482 5173487 +
caaataaggattaaaagccagc

SEQ ID NO: 74604 - DNA, 22 bp, Artificial Sequence
  Synthetic oligonucleotide; TTC chr11 5173466 5173487 5173483 5173488 +
aaataaggattaaaagccagca

SEQ ID NO: 74605 - DNA, 22 bp, Artificial Sequence
  Synthetic oligonucleotide; TTA chr11 5173478 5173499 5173495 5173500 +
aaagccagcatgcataaaaatt

SEQ ID NO: 74606 - DNA, 22 bp, Artificial Sequence
  Synthetic oligonucleotide; TTG chr11 5173501 5173522 5173518 5173523 +
tgtaatgacctaaattgaacta

SEQ ID NO: 74607 - DNA, 22 bp, Artificial Sequence
  Synthetic oligonucleotide; CTA chr11 5173513 5173534 5173530 5173535 +
aattgaactaaagccataacac

SEQ ID NO: 74608 - DNA, 22 bp, Artificial Sequence
  Synthetic oligonucleotide; TTG chr11 5173518 5173539 5173535 5173540 +
aactaaagccataacaccctcg

SEQ ID NO: 74609 - DNA, 22 bp, Artificial Sequence
  Synthetic oligonucleotide; CTA chr11 5173523 5173544 5173540 5173545 +
aagccataacaccctcggaagg

SEQ ID NO: 74610 - DNA, 22 bp, Artificial Sequence
  Synthetic oligonucleotide; CTC chr11 5173539 5173560 5173556 5173561 +
ggaaggaagcatgggtaaatct

SEQ ID NO: 74611 - DNA, 22 bp, Artificial Sequence
  Synthetic oligonucleotide; CTT chr11 5173562 5173583 5173579 5173584 +
catgaactttgattttacaata

SEQ ID NO: 74612 - DNA, 22 bp, Artificial Sequence
  Synthetic oligonucleotide; TTC chr11 5173563 5173584 5173580 5173585 +
atgaactttgattttacaatag

SEQ ID NO: 74613 - DNA, 22 bp, Artificial Sequence
  Synthetic oligonucleotide; CTT chr11 5173571 5173592 5173588 5173593 +
tgattttacaatagattcttag

SEQ ID NO: 74614 - DNA, 22 bp, Artificial Sequence
  Synthetic oligonucleotide; TTT chr11 5173572 5173593 5173589 5173594 +
gattttacaatagattcttaga

SEQ ID NO: 74615 - DNA, 22 bp, Artificial Sequence
  Synthetic oligonucleotide; TTG chr11 5173573 5173594 5173590 5173595 +
attttacaatagattcttagat

SEQ ID NO: 74616 - DNA, 22 bp, Artificial Sequence
  Synthetic oligonucleotide; TTT chr11 5173577 5173598 5173594 5173599 +
tacaatagattcttagatatga

SEQ ID NO: 74617 - DNA, 22 bp, Artificial Sequence
  Synthetic oligonucleotide; TTT chr11 5173578 5173599 5173595 5173600 +
acaatagattcttagatatgac

SEQ ID NO: 74618 - DNA, 22 bp, Artificial Sequence
  Synthetic oligonucleotide; TTA chr11 5173579 5173600 5173596 5173601 +
caatagattcttagatatgaca

SEQ ID NO: 74619 - DNA, 22 bp, Artificial Sequence
  Synthetic oligonucleotide; TTC chr11 5173589 5173610 5173606 5173611 +
ttagatatgacacaaaaagtat

SEQ ID NO: 74620 - DNA, 22 bp, Artificial Sequence
  Synthetic oligonucleotide; CTT chr11 5173591 5173612 5173608 5173613 +
agatatgacacaaaaagtatga

SEQ ID NO: 74621 - DNA, 22 bp, Artificial Sequence
  Synthetic oligonucleotide; TTA chr11 5173592 5173613 5173609 5173614 +
gatatgacacaaaaagtatgag

SEQ ID NO: 74622 - DNA, 22 bp, Artificial Sequence
  Synthetic oligonucleotide; TTG chr11 5173639 5173660 5173656 5173661 +
gatttcatttaaaaagttcatg

SEQ ID NO: 74623 - DNA, 22 bp, Artificial Sequence
  Synthetic oligonucleotide; TTT chr11 5173644 5173665 5173661 5173666 +
catttaaaaagttcatgcaaca

SEQ ID NO: 74624 - DNA, 22 bp, Artificial Sequence
  Synthetic oligonucleotide; TTC chr11 5173645 5173666 5173662 5173667 +
atttaaaaagttcatgcaacaa

SEQ ID NO: 74625 - DNA, 22 bp, Artificial Sequence
  Synthetic oligonucleotide; TTT chr11 5173649 5173670 5173666 5173671 +
aaaaagttcatgcaacaaacga

SEQ ID NO: 74626 - DNA, 22 bp, Artificial Sequence
  Synthetic oligonucleotide; TTA chr11 5173650 5173671 5173667 5173672 +
aaaagttcatgcaacaaacgac

SEQ ID NO: 74627 - DNA, 22 bp, Artificial Sequence
  Synthetic oligonucleotide; TTC chr11 5173658 5173679 5173675 5173680 +
atgcaacaaacgactttaagaa

SEQ ID NO: 74628 - DNA, 22 bp, Artificial Sequence
  Synthetic oligonucleotide; CTT chr11 5173674 5173695 5173691 5173696 +
taagaaagtaaaaagacaacct

SEQ ID NO: 74629 - DNA, 22 bp, Artificial Sequence
  Synthetic oligonucleotide; TTT chr11 5173675 5173696 5173692 5173697 +
aagaaagtaaaaagacaaccta

SEQ ID NO: 74630 - DNA, 22 bp, Artificial Sequence
  Synthetic oligonucleotide; TTA chr11 5173676 5173697 5173693 5173698 +
agaaagtaaaaagacaacctat

SEQ ID NO: 74631 - DNA, 22 bp, Artificial Sequence
  Synthetic oligonucleotide; CTA chr11 5173697 5173718 5173714 5173719 +
taagatgagagaacatctttgc

SEQ ID NO: 74632 - DNA, 22 bp, Artificial Sequence
  Synthetic oligonucleotide; CTT chr11 5173716 5173737 5173733 5173738 +
tgcaaattatgtatttcataag

SEQ ID NO: 74633 - DNA, 22 bp, Artificial Sequence
  Synthetic oligonucleotide; TTT chr11 5173717 5173738 5173734 5173739 +
gcaaattatgtatttcataagt

SEQ ID NO: 74634 - DNA, 22 bp, Artificial Sequence
  Synthetic oligonucleotide; TTG chr11 5173718 5173739 5173735 5173740 +
caaattatgtatttcataagtt

SEQ ID NO: 74635 - DNA, 22 bp, Artificial Sequence
  Synthetic oligonucleotide; TTA chr11 5173725 5173746 5173742 5173747 +
tgtatttcataagtttaatatc

SEQ ID NO: 74636 - DNA, 22 bp, Artificial Sequence
  Synthetic oligonucleotide; TTT chr11 5173732 5173753 5173749 5173754 +
cataagtttaatatccagaatg

SEQ ID NO: 74637 - DNA, 22 bp, Artificial Sequence
  Synthetic oligonucleotide; TTC chr11 5173733 5173754 5173750 5173755 +
ataagtttaatatccagaatgt

SEQ ID NO: 74638 - DNA, 22 bp, Artificial Sequence
  Synthetic oligonucleotide; TTT chr11 5173741 5173762 5173758 5173763 +
aatatccagaatgtatgaaaaa

SEQ ID NO: 74639 - DNA, 22 bp, Artificial Sequence
  Synthetic oligonucleotide; TTA chr11 5173742 5173763 5173759 5173764 +
atatccagaatgtatgaaaaag

SEQ ID NO: 74640 - DNA, 22 bp, Artificial Sequence
  Synthetic oligonucleotide; CTA chr11 5173769 5173790 5173786 5173791 +
caactcaaaaacaaaaagacaa

SEQ ID NO: 74641 - DNA, 22 bp, Artificial Sequence
  Synthetic oligonucleotide; CTC chr11 5173775 5173796 5173792 5173797 +
aaaaacaaaaagacaaacaact

SEQ ID NO: 74642 - DNA, 22 bp, Artificial Sequence
  Synthetic oligonucleotide; CTC chr11 5173798 5173819 5173815 5173820 +
aatttaaaaatatgcaaatgat

SEQ ID NO: 74643 - DNA, 22 bp, Artificial Sequence
  Synthetic oligonucleotide; TTT chr11 5173803 5173824 5173820 5173825 +
aaaaatatgcaaatgatgggaa

SEQ ID NO: 74644 - DNA, 22 bp, Artificial Sequence
  Synthetic oligonucleotide; TTA chr11 5173804 5173825 5173821 5173826 +
aaaatatgcaaatgatgggaat

SEQ ID NO: 74645 - DNA, 22 bp, Artificial Sequence
  Synthetic oligonucleotide; TTT chr11 5173835 5173856 5173852 5173857 +
ctagaaagaagatatacaaatg

SEQ ID NO: 74646 - DNA, 22 bp, Artificial Sequence
  Synthetic oligonucleotide; TTC chr11 5173836 5173857 5173853 5173858 +
tagaaagaagatatacaaatga

SEQ ID NO: 74647 - DNA, 22 bp, Artificial Sequence
  Synthetic oligonucleotide; CTA chr11 5173838 5173859 5173855 5173860 +
gaaagaagatatacaaatgaac

SEQ ID NO: 74648 - DNA, 22 bp, Artificial Sequence
  Synthetic oligonucleotide; TTG chr11 5173864 5173885 5173881 5173886 +
gcacataaaatgcaaaccaaaa

SEQ ID NO: 74649 - DNA, 22 bp, Artificial Sequence
  Synthetic oligonucleotide; CTA chr11 5173902 5173923 5173919 5173924 +
cttcaaacttactagaatgtct

SEQ ID NO: 74650 - DNA, 22 bp, Artificial Sequence
  Synthetic oligonucleotide; CTT chr11 5173905 5173926 5173922 5173927 +
caaacttactagaatgtctata

SEQ ID NO: 74651 - DNA, 22 bp, Artificial Sequence
  Synthetic oligonucleotide; TTC chr11 5173906 5173927 5173923 5173928 +
aaacttactagaatgtctatac

SEQ ID NO: 74652 - DNA, 22 bp, Artificial Sequence
  Synthetic oligonucleotide; CTT chr11 5173912 5173933 5173929 5173934 +
actagaatgtctatactttaag

SEQ ID NO: 74653 - DNA, 22 bp, Artificial Sequence
  Synthetic oligonucleotide; TTA chr11 5173913 5173934 5173930 5173935 +
ctagaatgtctatactttaaga

SEQ ID NO: 74654 - DNA, 22 bp, Artificial Sequence
  Synthetic oligonucleotide; CTA chr11 5173916 5173937 5173933 5173938 +
gaatgtctatactttaagagaa

SEQ ID NO: 74655 - DNA, 22 bp, Artificial Sequence
  Synthetic oligonucleotide; CTA chr11 5173925 5173946 5173942 5173947 +
tactttaagagaaacaaaacaa

SEQ ID NO: 74656 - DNA, 22 bp, Artificial Sequence
  Synthetic oligonucleotide; CTT chr11 5173930 5173951 5173947 5173952 +
taagagaaacaaaacaaatgaa

SEQ ID NO: 74657 - DNA, 22 bp, Artificial Sequence
  Synthetic oligonucleotide; TTT chr11 5173931 5173952 5173948 5173953 +
aagagaaacaaaacaaatgaaa

SEQ ID NO: 74658 - DNA, 22 bp, Artificial Sequence
  Synthetic oligonucleotide; TTA chr11 5173932 5173953 5173949 5173954 +
agagaaacaaaacaaatgaaaa

SEQ ID NO: 74659 - DNA, 22 bp, Artificial Sequence
  Synthetic oligonucleotide; TTG chr11 5173967 5173988 5173984 5173989 +
acaaagatataagaaaattgga

SEQ ID NO: 74660 - DNA, 22 bp, Artificial Sequence
  Synthetic oligonucleotide; TTG chr11 5173987 5174008 5174004 5174009 +
gaatcctcatatattgctgcta

SEQ ID NO: 74661 - DNA, 22 bp, Artificial Sequence
  Synthetic oligonucleotide; CTC chr11 5173995 5174016 5174012 5174017 +
atatattgctgctaaaaatgtt

SEQ ID NO: 74662 - DNA, 22 bp, Artificial Sequence
  Synthetic oligonucleotide; TTG chr11 5174003 5174024 5174020 5174025 +
ctgctaaaaatgttaagtggtg

SEQ ID NO: 74663 - DNA, 22 bp, Artificial Sequence
  Synthetic oligonucleotide; CTG chr11 5174006 5174027 5174023 5174028 +
ctaaaaatgttaagtggtgcaa

SEQ ID NO: 74664 - DNA, 22 bp, Artificial Sequence
  Synthetic oligonucleotide; CTA chr11 5174009 5174030 5174026 5174031 +
aaaatgttaagtggtgcaactt

SEQ ID NO: 74665 - DNA, 22 bp, Artificial Sequence
  Synthetic oligonucleotide; TTA chr11 5174018 5174039 5174035 5174040 +
agtggtgcaacttctgtagaaa

SEQ ID NO: 74666 - DNA, 22 bp, Artificial Sequence
  Synthetic oligonucleotide; CTT chr11 5174031 5174052 5174048 5174053 +
ctgtagaaaatattttgacagt

SEQ ID NO: 74667 - DNA, 22 bp, Artificial Sequence
  Synthetic oligonucleotide; TTC chr11 5174032 5174053 5174049 5174054 +
tgtagaaaatattttgacagtt

SEQ ID NO: 74668 - DNA, 22 bp, Artificial Sequence
  Synthetic oligonucleotide; CTG chr11 5174034 5174055 5174051 5174056 +
tagaaaatattttgacagttct

SEQ ID NO: 74669 - DNA, 22 bp, Artificial Sequence
  Synthetic oligonucleotide; TTT chr11 5174046 5174067 5174063 5174068 +
tgacagttcttcaaaaacttag

SEQ ID NO: 74670 - DNA, 22 bp, Artificial Sequence
  Synthetic oligonucleotide; TTT chr11 5174047 5174068 5174064 5174069 +
gacagttcttcaaaaacttagg

SEQ ID NO: 74671 - DNA, 22 bp, Artificial Sequence
  Synthetic oligonucleotide; TTG chr11 5174048 5174069 5174065 5174070 +
acagttcttcaaaaacttaggc

SEQ ID NO: 74672 - DNA, 22 bp, Artificial Sequence
  Synthetic oligonucleotide; TTC chr11 5174055 5174076 5174072 5174077 +
ttcaaaaacttaggcactgaat

SEQ ID NO: 74673 - DNA, 22 bp, Artificial Sequence
  Synthetic oligonucleotide; CTT chr11 5174057 5174078 5174074 5174079 +
caaaaacttaggcactgaataa

SEQ ID NO: 74674 - DNA, 22 bp, Artificial Sequence
  Synthetic oligonucleotide; TTC chr11 5174058 5174079 5174075 5174080 +
aaaaacttaggcactgaataac

SEQ ID NO: 74675 - DNA, 22 bp, Artificial Sequence
  Synthetic oligonucleotide; CTT chr11 5174066 5174087 5174083 5174088 +
aggcactgaataacatatgacc

SEQ ID NO: 74676 - DNA, 22 bp, Artificial Sequence
  Synthetic oligonucleotide; TTA chr11 5174067 5174088 5174084 5174089 +
ggcactgaataacatatgaccc

SEQ ID NO: 74677 - DNA, 22 bp, Artificial Sequence
  Synthetic oligonucleotide; CTG chr11 5174074 5174095 5174091 5174096 +
aataacatatgaccccaaaatt

SEQ ID NO: 74678 - DNA, 22 bp, Artificial Sequence
  Synthetic oligonucleotide; TTC chr11 5174097 5174118 5174114 5174119 +
ctctcctaggtatatattaaaa

SEQ ID NO: 74679 - DNA, 22 bp, Artificial Sequence
  Synthetic oligonucleotide; CTC chr11 5174100 5174121 5174117 5174122 +
tcctaggtatatattaaaaata

SEQ ID NO: 74680 - DNA, 22 bp, Artificial Sequence
  Synthetic oligonucleotide; CTC chr11 5174102 5174123 5174119 5174124 +
ctaggtatatattaaaaatata

SEQ ID NO: 74681 - DNA, 22 bp, Artificial Sequence
  Synthetic oligonucleotide; CTA chr11 5174105 5174126 5174122 5174127 +
ggtatatattaaaaatatatat

SEQ ID NO: 74682 - DNA, 22 bp, Artificial Sequence
  Synthetic oligonucleotide; TTA chr11 5174116 5174137 5174133 5174138 +
aaaatatatataaagatttaaa

SEQ ID NO: 74683 - DNA, 22 bp, Artificial Sequence
  Synthetic oligonucleotide; TTT chr11 5174135 5174156 5174152 5174157 +
aaacaggtacttgtactgaaat

SEQ ID NO: 74684 - DNA, 22 bp, Artificial Sequence
  Synthetic oligonucleotide; TTA chr11 5174136 5174157 5174153 5174158 +
aacaggtacttgtactgaaatg

SEQ ID NO: 74685 - DNA, 22 bp, Artificial Sequence
  Synthetic oligonucleotide; CTT chr11 5174147 5174168 5174164 5174169 +
gtactgaaatgttcattgtagc

SEQ ID NO: 74686 - DNA, 22 bp, Artificial Sequence
  Synthetic oligonucleotide; TTG chr11 5174148 5174169 5174165 5174170 +
tactgaaatgttcattgtagca

SEQ ID NO: 74687 - DNA, 22 bp, Artificial Sequence
  Synthetic oligonucleotide; CTG chr11 5174153 5174174 5174170 5174175 +
aaatgttcattgtagcattatt

SEQ ID NO: 74688 - DNA, 22 bp, Artificial Sequence
  Synthetic oligonucleotide; TTC chr11 5174161 5174182 5174178 5174183 +
attgtagcattattcacaatag

SEQ ID NO: 74689 - DNA, 22 bp, Artificial Sequence
  Synthetic oligonucleotide; TTG chr11 5174165 5174186 5174182 5174187 +
tagcattattcacaatagccaa

SEQ ID NO: 74690 - DNA, 22 bp, Artificial Sequence
  Synthetic oligonucleotide; TTA chr11 5174173 5174194 5174190 5174195 +
ttcacaatagccaaaaggtgga

SEQ ID NO: 74691 - DNA, 22 bp, Artificial Sequence
  Synthetic oligonucleotide; TTC chr11 5174176 5174197 5174193 5174198 +
acaatagccaaaaggtggaaac

SEQ ID NO: 74692 - DNA, 22 bp, Artificial Sequence
  Synthetic oligonucleotide; TTA chr11 5174264 5174285 5174281 5174286 +
tgtagcaataaaaaagaatgaa

SEQ ID NO: 74693 - DNA, 22 bp, Artificial Sequence
  Synthetic oligonucleotide; CTT chr11 5174307 5174328 5174324 5174329 +
atttaatgtcatgaataggttt

SEQ ID NO: 74694 - DNA, 22 bp, Artificial Sequence
  Synthetic oligonucleotide; TTA chr11 5174308 5174329 5174325 5174330 +
tttaatgtcatgaataggtttt

SEQ ID NO: 74695 - DNA, 22 bp, Artificial Sequence
  Synthetic oligonucleotide; TTT chr11 5174311 5174332 5174328 5174333 +
aatgtcatgaataggtttttgg

SEQ ID NO: 74696 - DNA, 22 bp, Artificial Sequence
  Synthetic oligonucleotide; TTA chr11 5174312 5174333 5174329 5174334 +
atgtcatgaataggtttttgga

SEQ ID NO: 74697 - DNA, 22 bp, Artificial Sequence
  Synthetic oligonucleotide; TTT chr11 5174329 5174350 5174346 5174351 +
ttggaaatggcaactttaagtg

SEQ ID NO: 74698 - DNA, 22 bp, Artificial Sequence
  Synthetic oligonucleotide; TTT chr11 5174330 5174351 5174347 5174352 +
tggaaatggcaactttaagtga

SEQ ID NO: 74699 - DNA, 22 bp, Artificial Sequence
  Synthetic oligonucleotide; TTT chr11 5174331 5174352 5174348 5174353 +
ggaaatggcaactttaagtgaa

SEQ ID NO: 74700 - DNA, 22 bp, Artificial Sequence
  Synthetic oligonucleotide; TTG chr11 5174332 5174353 5174349 5174354 +
gaaatggcaactttaagtgaaa

SEQ ID NO: 74701 - DNA, 22 bp, Artificial Sequence
  Synthetic oligonucleotide; CTT chr11 5174345 5174366 5174362 5174367 +
taagtgaaatgatgtaaaacag

SEQ ID NO: 74702 - DNA, 22 bp, Artificial Sequence
  Synthetic oligonucleotide; TTT chr11 5174346 5174367 5174363 5174368 +
aagtgaaatgatgtaaaacaga

SEQ ID NO: 74703 - DNA, 22 bp, Artificial Sequence
  Synthetic oligonucleotide; TTA chr11 5174347 5174368 5174364 5174369 +
agtgaaatgatgtaaaacagat

SEQ ID NO: 74704 - DNA, 22 bp, Artificial Sequence
  Synthetic oligonucleotide; CTC chr11 5174373 5174394 5174390 5174395 +
aaataacactgttttagccaac

SEQ ID NO: 74705 - DNA, 22 bp, Artificial Sequence
  Synthetic oligonucleotide; CTG chr11 5174384 5174405 5174401 5174406 +
ttttagccaacactgttagatg

SEQ ID NO: 74706 - DNA, 22 bp, Artificial Sequence
  Synthetic oligonucleotide; TTT chr11 5174387 5174408 5174404 5174409 +
tagccaacactgttagatgaga

SEQ ID NO: 74707 - DNA, 22 bp, Artificial Sequence
  Synthetic oligonucleotide; TTT chr11 5174388 5174409 5174405 5174410 +
agccaacactgttagatgagaa

SEQ ID NO: 74708 - DNA, 22 bp, Artificial Sequence
  Synthetic oligonucleotide; TTA chr11 5174389 5174410 5174406 5174411 +
gccaacactgttagatgagaaa

SEQ ID NO: 74709 - DNA, 22 bp, Artificial Sequence
  Synthetic oligonucleotide; CTG chr11 5174399 5174420 5174416 5174421 +
ttagatgagaaaaaaaatggat

SEQ ID NO: 74710 - DNA, 22 bp, Artificial Sequence
  Synthetic oligonucleotide; TTA chr11 5174402 5174423 5174419 5174424 +
gatgagaaaaaaaatggatatc

SEQ ID NO: 74711 - DNA, 22 bp, Artificial Sequence
  Synthetic oligonucleotide; TTA chr11 5174428 5174449 5174445 5174450 +
tatgtcacttggcttaaagttt

SEQ ID NO: 74712 - DNA, 22 bp, Artificial Sequence
  Synthetic oligonucleotide; CTT chr11 5174438 5174459 5174455 5174460 +
ggcttaaagtttcagtttccaa

SEQ ID NO: 74713 - DNA, 22 bp, Artificial Sequence
  Synthetic oligonucleotide; TTG chr11 5174439 5174460 5174456 5174461 +
gcttaaagtttcagtttccaag

SEQ ID NO: 74714 - DNA, 22 bp, Artificial Sequence
  Synthetic oligonucleotide; CTT chr11 5174443 5174464 5174460 5174465 +
aaagtttcagtttccaagaatc

SEQ ID NO: 74715 - DNA, 22 bp, Artificial Sequence
  Synthetic oligonucleotide; TTA chr11 5174444 5174465 5174461 5174466 +
aagtttcagtttccaagaatct

SEQ ID NO: 74716 - DNA, 22 bp, Artificial Sequence
  Synthetic oligonucleotide; TTT chr11 5174450 5174471 5174467 5174472 +
cagtttccaagaatctatgaat

SEQ ID NO: 74717 - DNA, 22 bp, Artificial Sequence
  Synthetic oligonucleotide; TTC chr11 5174451 5174472 5174468 5174473 +
agtttccaagaatctatgaatg

SEQ ID NO: 74718 - DNA, 22 bp, Artificial Sequence
  Synthetic oligonucleotide; TTT chr11 5174456 5174477 5174473 5174478 +
ccaagaatctatgaatggacaa

SEQ ID NO: 74719 - DNA, 22 bp, Artificial Sequence
  Synthetic oligonucleotide; TTC chr11 5174457 5174478 5174474 5174479 +
caagaatctatgaatggacaac

SEQ ID NO: 74720 - DNA, 22 bp, Artificial Sequence
  Synthetic oligonucleotide; CTA chr11 5174467 5174488 5174484 5174489 +
tgaatggacaacattaagcaaa

SEQ ID NO: 74721 - DNA, 22 bp, Artificial Sequence
  Synthetic oligonucleotide; TTA chr11 5174483 5174504 5174500 5174505 +
agcaaagacttaccactataca

SEQ ID NO: 74722 - DNA, 22 bp, Artificial Sequence
  Synthetic oligonucleotide; CTT chr11 5174494 5174515 5174511 5174516 +
accactatacatgttatggcat

SEQ ID NO: 74723 - DNA, 22 bp, Artificial Sequence
  Synthetic oligonucleotide; TTA chr11 5174495 5174516 5174512 5174517 +
ccactatacatgttatggcatg

SEQ ID NO: 74724 - DNA, 22 bp, Artificial Sequence
  Synthetic oligonucleotide; CTA chr11 5174501 5174522 5174518 5174523 +
tacatgttatggcatggatgga

SEQ ID NO: 74725 - DNA, 22 bp, Artificial Sequence
  Synthetic oligonucleotide; TTA chr11 5174510 5174531 5174527 5174532 +
tggcatggatggactttgaaac

SEQ ID NO: 74726 - DNA, 22 bp, Artificial Sequence
  Synthetic oligonucleotide; CTT chr11 5174526 5174547 5174543 5174548 +
tgaaaccttatgttgggtaaaa

SEQ ID NO: 74727 - DNA, 22 bp, Artificial Sequence
  Synthetic oligonucleotide; TTT chr11 5174527 5174548 5174544 5174549 +
gaaaccttatgttgggtaaaat

SEQ ID NO: 74728 - DNA, 22 bp, Artificial Sequence
  Synthetic oligonucleotide; TTG chr11 5174528 5174549 5174545 5174550 +
aaaccttatgttgggtaaaata

SEQ ID NO: 74729 - DNA, 22 bp, Artificial Sequence
  Synthetic oligonucleotide; CTT chr11 5174535 5174556 5174552 5174557 +
atgttgggtaaaataagccaga

SEQ ID NO: 74730 - DNA, 22 bp, Artificial Sequence
  Synthetic oligonucleotide; TTA chr11 5174536 5174557 5174553 5174558 +
tgttgggtaaaataagccagac

SEQ ID NO: 74731 - DNA, 22 bp, Artificial Sequence
  Synthetic oligonucleotide; TTG chr11 5174541 5174562 5174558 5174563 +
ggtaaaataagccagacacaaa

SEQ ID NO: 74732 - DNA, 22 bp, Artificial Sequence
  Synthetic oligonucleotide; TTG chr11 5174576 5174597 5174593 5174598 +
tatgaatctatttatatgaatt

SEQ ID NO: 74733 - DNA, 22 bp, Artificial Sequence
  Synthetic oligonucleotide; CTA chr11 5174586 5174607 5174603 5174608 +
tttatatgaattatctaaaata

SEQ ID NO: 74734 - DNA, 22 bp, Artificial Sequence
  Synthetic oligonucleotide; TTT chr11 5174589 5174610 5174606 5174611 +
atatgaattatctaaaatagac

SEQ ID NO: 74735 - DNA, 22 bp, Artificial Sequence
  Synthetic oligonucleotide; TTA chr11 5174590 5174611 5174607 5174612 +
tatgaattatctaaaatagact

SEQ ID NO: 74736 - DNA, 22 bp, Artificial Sequence
  Synthetic oligonucleotide; TTA chr11 5174599 5174620 5174616 5174621 +
tctaaaatagactgatttagag

SEQ ID NO: 74737 - DNA, 22 bp, Artificial Sequence
  Synthetic oligonucleotide; CTA chr11 5174603 5174624 5174620 5174625 +
aaatagactgatttagagaaac

SEQ ID NO: 74738 - DNA, 22 bp, Artificial Sequence
  Synthetic oligonucleotide; CTG chr11 5174613 5174634 5174630 5174635 +
atttagagaaacatatagtaga

SEQ ID NO: 74739 - DNA, 22 bp, Artificial Sequence
  Synthetic oligonucleotide; TTT chr11 5174617 5174638 5174634 5174639 +
agagaaacatatagtagattag

SEQ ID NO: 74740 - DNA, 22 bp, Artificial Sequence
  Synthetic oligonucleotide; TTA chr11 5174618 5174639 5174635 5174640 +
gagaaacatatagtagattaga

SEQ ID NO: 74741 - DNA, 22 bp, Artificial Sequence
  Synthetic oligonucleotide; TTA chr11 5174638 5174659 5174655 5174660 +
gaggttactatgggactgggga

SEQ ID NO: 74742 - DNA, 22 bp, Artificial Sequence
  Synthetic oligonucleotide; TTA chr11 5174645 5174666 5174662 5174667 +
ctatgggactggggagttactg

SEQ ID NO: 74743 - DNA, 22 bp, Artificial Sequence
  Synthetic oligonucleotide; CTA chr11 5174648 5174669 5174665 5174670 +
tgggactggggagttactgcct

SEQ ID NO: 74744 - DNA, 22 bp, Artificial Sequence
  Synthetic oligonucleotide; CTG chr11 5174656 5174677 5174673 5174678 +
gggagttactgcctaacaagta

SEQ ID NO: 74745 - DNA, 22 bp, Artificial Sequence
  Synthetic oligonucleotide; TTA chr11 5174664 5174685 5174681 5174686 +
ctgcctaacaagtatagcattt

SEQ ID NO: 74746 - DNA, 22 bp, Artificial Sequence
  Synthetic oligonucleotide; CTG chr11 5174667 5174688 5174684 5174689 +
cctaacaagtatagcatttctg

SEQ ID NO: 74747 - DNA, 22 bp, Artificial Sequence
  Synthetic oligonucleotide; CTA chr11 5174671 5174692 5174688 5174693 +
acaagtatagcatttctgcttg

SEQ ID NO: 74748 - DNA, 22 bp, Artificial Sequence
  Synthetic oligonucleotide; TTT chr11 5174686 5174707 5174703 5174708 +
ctgcttggatgatgaaaaagtt

SEQ ID NO: 74749 - DNA, 22 bp, Artificial Sequence
  Synthetic oligonucleotide; TTC chr11 5174687 5174708 5174704 5174709 +
tgcttggatgatgaaaaagttt

SEQ ID NO: 74750 - DNA, 22 bp, Artificial Sequence
  Synthetic oligonucleotide; CTG chr11 5174689 5174710 5174706 5174711 +
cttggatgatgaaaaagttttg

SEQ ID NO: 74751 - DNA, 22 bp, Artificial Sequence
  Synthetic oligonucleotide; CTT chr11 5174692 5174713 5174709 5174714 +
ggatgatgaaaaagttttggca

SEQ ID NO: 74752 - DNA, 22 bp, Artificial Sequence
  Synthetic oligonucleotide; TTG chr11 5174693 5174714 5174710 5174715 +
gatgatgaaaaagttttggcat

SEQ ID NO: 74753 - DNA, 22 bp, Artificial Sequence
  Synthetic oligonucleotide; TTT chr11 5174709 5174730 5174726 5174731 +
tggcatgagatcatggtgatag

SEQ ID NO: 74754 - DNA, 22 bp, Artificial Sequence
  Synthetic oligonucleotide; TTT chr11 5174710 5174731 5174727 5174732 +
ggcatgagatcatggtgatagc

SEQ ID NO: 74755 - DNA, 22 bp, Artificial Sequence
  Synthetic oligonucleotide; TTG chr11 5174711 5174732 5174728 5174733 +
gcatgagatcatggtgatagcg

SEQ ID NO: 74756 - DNA, 22 bp, Artificial Sequence
  Synthetic oligonucleotide; TTG chr11 5174744 5174765 5174761 5174766 +
ttaatataattaatgccacata

SEQ ID NO: 74757 - DNA, 22 bp, Artificial Sequence
  Synthetic oligonucleotide; TTA chr11 5174747 5174768 5174764 5174769 +
atataattaatgccacataatt

SEQ ID NO: 74758 - DNA, 22 bp, Artificial Sequence
  Synthetic oligonucleotide; TTA chr11 5174756 5174777 5174773 5174778 +
atgccacataattatacttaaa

SEQ ID NO: 74759 - DNA, 22 bp, Artificial Sequence
  Synthetic oligonucleotide; TTA chr11 5174770 5174791 5174787 5174792 +
tacttaaaaatggttaatatgg

SEQ ID NO: 74760 - DNA, 22 bp, Artificial Sequence
  Synthetic oligonucleotide; CTT chr11 5174775 5174796 5174792 5174797 +
aaaaatggttaatatggtgagc

SEQ ID NO: 74761 - DNA, 22 bp, Artificial Sequence
  Synthetic oligonucleotide; TTA chr11 5174776 5174797 5174793 5174798 +
aaaatggttaatatggtgagct

SEQ ID NO: 74762 - DNA, 22 bp, Artificial Sequence
  Synthetic oligonucleotide; TTA chr11 5174786 5174807 5174803 5174808 +
atatggtgagctttattatata

SEQ ID NO: 74763 - DNA, 22 bp, Artificial Sequence
  Synthetic oligonucleotide; CTT chr11 5174799 5174820 5174816 5174821 +
tattatatatgatatacggtat

SEQ ID NO: 74764 - DNA, 22 bp, Artificial Sequence
  Synthetic oligonucleotide; TTT chr11 5174800 5174821 5174817 5174822 +
attatatatgatatacggtatt

SEQ ID NO: 74765 - DNA, 22 bp, Artificial Sequence
  Synthetic oligonucleotide; TTA chr11 5174801 5174822 5174818 5174823 +
ttatatatgatatacggtatta

SEQ ID NO: 74766 - DNA, 22 bp, Artificial Sequence
  Synthetic oligonucleotide; TTA chr11 5174804 5174825 5174821 5174826 +
tatatgatatacggtattatat

SEQ ID NO: 74767 - DNA, 22 bp, Artificial Sequence
  Synthetic oligonucleotide; TTA chr11 5174823 5174844 5174840 5174845 +
tatgtagcatatttataaactt

SEQ ID NO: 74768 - DNA, 22 bp, Artificial Sequence
  Synthetic oligonucleotide; TTT chr11 5174837 5174858 5174854 5174859 +
ataaactttatcacaataaaaa

SEQ ID NO: 74769 - DNA, 22 bp, Artificial Sequence
  Synthetic oligonucleotide; TTA chr11 5174838 5174859 5174855 5174860 +
taaactttatcacaataaaaat

SEQ ID NO: 74770 - DNA, 22 bp, Artificial Sequence
  Synthetic oligonucleotide; CTT chr11 5174845 5174866 5174862 5174867 +
tatcacaataaaaatggaaaga

SEQ ID NO: 74771 - DNA, 22 bp, Artificial Sequence
  Synthetic oligonucleotide; TTT chr11 5174846 5174867 5174863 5174868 +
atcacaataaaaatggaaagaa

SEQ ID NO: 74772 - DNA, 22 bp, Artificial Sequence
  Synthetic oligonucleotide; TTA chr11 5174847 5174868 5174864 5174869 +
tcacaataaaaatggaaagaaa

SEQ ID NO: 74773 - DNA, 22 bp, Artificial Sequence
  Synthetic oligonucleotide; TTT chr11 5174872 5174893 5174889 5174894 +
aaaacaagacaaatttttattt

SEQ ID NO: 74774 - DNA, 22 bp, Artificial Sequence
  Synthetic oligonucleotide; TTA chr11 5174873 5174894 5174890 5174895 +
aaacaagacaaatttttatttt

SEQ ID NO: 74775 - DNA, 22 bp, Artificial Sequence
  Synthetic oligonucleotide; TTT chr11 5174888 5174909 5174905 5174910 +
ttattttgattagggttgaatt

SEQ ID NO: 74776 - DNA, 22 bp, Artificial Sequence
  Synthetic oligonucleotide; TTT chr11 5174889 5174910 5174906 5174911 +
tattttgattagggttgaattg

SEQ ID NO: 74777 - DNA, 22 bp, Artificial Sequence
  Synthetic oligonucleotide; TTT chr11 5174890 5174911 5174907 5174912 +
attttgattagggttgaattga

SEQ ID NO: 74778 - DNA, 22 bp, Artificial Sequence
  Synthetic oligonucleotide; TTA chr11 5174891 5174912 5174908 5174913 +
ttttgattagggttgaattgaa

SEQ ID NO: 74779 - DNA, 22 bp, Artificial Sequence
  Synthetic oligonucleotide; TTT chr11 5174894 5174915 5174911 5174916 +
tgattagggttgaattgaattt

SEQ ID NO: 74780 - DNA, 22 bp, Artificial Sequence
  Synthetic oligonucleotide; TTT chr11 5174895 5174916 5174912 5174917 +
gattagggttgaattgaattta

SEQ ID NO: 74781 - DNA, 22 bp, Artificial Sequence
  Synthetic oligonucleotide; TTG chr11 5174896 5174917 5174913 5174918 +
attagggttgaattgaatttat

SEQ ID NO: 74782 - DNA, 22 bp, Artificial Sequence
  Synthetic oligonucleotide; TTA chr11 5174900 5174921 5174917 5174922 +
gggttgaattgaatttattatg

SEQ ID NO: 74783 - DNA, 22 bp, Artificial Sequence
  Synthetic oligonucleotide; TTG chr11 5174906 5174927 5174923 5174928 +
aattgaatttattatgagttgt

SEQ ID NO: 74784 - DNA, 22 bp, Artificial Sequence
  Synthetic oligonucleotide; TTG chr11 5174911 5174932 5174928 5174933 +
aatttattatgagttgtttctg

SEQ ID NO: 74785 - DNA, 22 bp, Artificial Sequence
  Synthetic oligonucleotide; TTT chr11 5174916 5174937 5174933 5174938 +
attatgagttgtttctgagaga

SEQ ID NO: 74786 - DNA, 22 bp, Artificial Sequence
  Synthetic oligonucleotide; TTA chr11 5174917 5174938 5174934 5174939 +
ttatgagttgtttctgagagaa

SEQ ID NO: 74787 - DNA, 22 bp, Artificial Sequence
  Synthetic oligonucleotide; TTA chr11 5174920 5174941 5174937 5174942 +
tgagttgtttctgagagaattg

SEQ ID NO: 74788 - DNA, 22 bp, Artificial Sequence
  Synthetic oligonucleotide; TTG chr11 5174927 5174948 5174944 5174949 +
tttctgagagaattgttacaat

SEQ ID NO: 74789 - DNA, 22 bp, Artificial Sequence
  Synthetic oligonucleotide; TTT chr11 5174930 5174951 5174947 5174952 +
ctgagagaattgttacaataaa

SEQ ID NO: 74790 - DNA, 22 bp, Artificial Sequence
  Synthetic oligonucleotide; TTC chr11 5174931 5174952 5174948 5174953 +
tgagagaattgttacaataaac

SEQ ID NO: 74791 - DNA, 22 bp, Artificial Sequence
  Synthetic oligonucleotide; CTG chr11 5174933 5174954 5174950 5174955 +
agagaattgttacaataaacaa

SEQ ID NO: 74792 - DNA, 22 bp, Artificial Sequence
  Synthetic oligonucleotide; TTG chr11 5174942 5174963 5174959 5174964 +
ttacaataaacaatgtataata

SEQ ID NO: 74793 - DNA, 22 bp, Artificial Sequence
  Synthetic oligonucleotide; TTA chr11 5174945 5174966 5174962 5174967 +
caataaacaatgtataataaac

SEQ ID NO: 74794 - DNA, 22 bp, Artificial Sequence
  Synthetic oligonucleotide; TTA chr11 5174972 5174993 5174989 5174994 +
tttcatttattttaggcacata

SEQ ID NO: 74795 - DNA, 22 bp, Artificial Sequence
  Synthetic oligonucleotide; TTT chr11 5174975 5174996 5174992 5174997 +
catttattttaggcacatatac

SEQ ID NO: 74796 - DNA, 22 bp, Artificial Sequence
  Synthetic oligonucleotide; TTC chr11 5174976 5174997 5174993 5174998 +
atttattttaggcacatataca

SEQ ID NO: 74797 - DNA, 22 bp, Artificial Sequence
  Synthetic oligonucleotide; TTT chr11 5174980 5175001 5174997 5175002 +
attttaggcacatatacagttc

SEQ ID NO: 74798 - DNA, 22 bp, Artificial Sequence
  Synthetic oligonucleotide; TTA chr11 5174981 5175002 5174998 5175003 +
ttttaggcacatatacagttct

SEQ ID NO: 74799 - DNA, 22 bp, Artificial Sequence
  Synthetic oligonucleotide; TTT chr11 5174984 5175005 5175001 5175006 +
taggcacatatacagttctatt

SEQ ID NO: 74800 - DNA, 22 bp, Artificial Sequence
  Synthetic oligonucleotide; TTT chr11 5174985 5175006 5175002 5175007 +
aggcacatatacagttctatta

SEQ ID NO: 74801 - DNA, 22 bp, Artificial Sequence
  Synthetic oligonucleotide; TTA chr11 5174986 5175007 5175003 5175008 +
ggcacatatacagttctattat

SEQ ID NO: 74802 - DNA, 22 bp, Artificial Sequence
  Synthetic oligonucleotide; TTC chr11 5175002 5175023 5175019 5175024 +
tattatcattttgggttttatt

SEQ ID NO: 74803 - DNA, 22 bp, Artificial Sequence
  Synthetic oligonucleotide; CTA chr11 5175004 5175025 5175021 5175026 +
ttatcattttgggttttatttt

SEQ ID NO: 74804 - DNA, 22 bp, Artificial Sequence
  Synthetic oligonucleotide; TTA chr11 5175007 5175028 5175024 5175029 +
tcattttgggttttattttttg

SEQ ID NO: 74805 - DNA, 22 bp, Artificial Sequence
  Synthetic oligonucleotide; TTT chr11 5175013 5175034 5175030 5175035 +
tgggttttattttttgtttttc

SEQ ID NO: 74806 - DNA, 22 bp, Artificial Sequence
  Synthetic oligonucleotide; TTT chr11 5175014 5175035 5175031 5175036 +
gggttttattttttgtttttct

SEQ ID NO: 74807 - DNA, 22 bp, Artificial Sequence
  Synthetic oligonucleotide; TTG chr11 5175015 5175036 5175032 5175037 +
ggttttattttttgtttttctt

SEQ ID NO: 74808 - DNA, 22 bp, Artificial Sequence
  Synthetic oligonucleotide; TTT chr11 5175020 5175041 5175037 5175042 +
tattttttgtttttctttttgt

SEQ ID NO: 74809 - DNA, 22 bp, Artificial Sequence
  Synthetic oligonucleotide; TTT chr11 5175021 5175042 5175038 5175043 +
attttttgtttttctttttgtt

SEQ ID NO: 74810 - DNA, 22 bp, Artificial Sequence
  Synthetic oligonucleotide; TTA chr11 5175022 5175043 5175039 5175044 +
ttttttgtttttctttttgttt

SEQ ID NO: 74811 - DNA, 22 bp, Artificial Sequence
  Synthetic oligonucleotide; TTT chr11 5175025 5175046 5175042 5175047 +
tttgtttttctttttgtttttg

SEQ ID NO: 74812 - DNA, 22 bp, Artificial Sequence
  Synthetic oligonucleotide; TTT chr11 5175026 5175047 5175043 5175048 +
ttgtttttctttttgtttttgt

SEQ ID NO: 74813 - DNA, 22 bp, Artificial Sequence
  Synthetic oligonucleotide; TTT chr11 5175027 5175048 5175044 5175049 +
tgtttttctttttgtttttgtt

SEQ ID NO: 74814 - DNA, 22 bp, Artificial Sequence
  Synthetic oligonucleotide; TTT chr11 5175028 5175049 5175045 5175050 +
gtttttctttttgtttttgttt

SEQ ID NO: 74815 - DNA, 22 bp, Artificial Sequence
  Synthetic oligonucleotide; TTG chr11 5175029 5175050 5175046 5175051 +
tttttctttttgtttttgtttt

SEQ ID NO: 74816 - DNA, 22 bp, Artificial Sequence
  Synthetic oligonucleotide; TTT chr11 5175032 5175053 5175049 5175054 +
ttctttttgtttttgttttacg

SEQ ID NO: 74817 - DNA, 22 bp, Artificial Sequence
  Synthetic oligonucleotide; TTT chr11 5175033 5175054 5175050 5175055 +
tctttttgtttttgttttacgt

SEQ ID NO: 74818 - DNA, 22 bp, Artificial Sequence
  Synthetic oligonucleotide; TTT chr11 5175034 5175055 5175051 5175056 +
ctttttgtttttgttttacgta

SEQ ID NO: 74819 - DNA, 22 bp, Artificial Sequence
  Synthetic oligonucleotide; TTC chr11 5175035 5175056 5175052 5175057 +
tttttgtttttgttttacgtat

SEQ ID NO: 74820 - DNA, 22 bp, Artificial Sequence
  Synthetic oligonucleotide; CTT chr11 5175037 5175058 5175054 5175059 +
tttgtttttgttttacgtattt

SEQ ID NO: 74821 - DNA, 22 bp, Artificial Sequence
  Synthetic oligonucleotide; TTT chr11 5175038 5175059 5175055 5175060 +
ttgtttttgttttacgtatttt

SEQ ID NO: 74822 - DNA, 22 bp, Artificial Sequence
  Synthetic oligonucleotide; TTT chr11 5175039 5175060 5175056 5175061 +
tgtttttgttttacgtattttt

SEQ ID NO: 74823 - DNA, 22 bp, Artificial Sequence
  Synthetic oligonucleotide; TTT chr11 5175040 5175061 5175057 5175062 +
gtttttgttttacgtatttttg

SEQ ID NO: 74824 - DNA, 22 bp, Artificial Sequence
  Synthetic oligonucleotide; TTG chr11 5175041 5175062 5175058 5175063 +
tttttgttttacgtatttttgg

SEQ ID NO: 74825 - DNA, 22 bp, Artificial Sequence
  Synthetic oligonucleotide; TTT chr11 5175044 5175065 5175061 5175066 +
ttgttttacgtatttttggttt

SEQ ID NO: 74826 - DNA, 22 bp, Artificial Sequence
  Synthetic oligonucleotide; TTT chr11 5175045 5175066 5175062 5175067 +
tgttttacgtatttttggtttt

SEQ ID NO: 74827 - DNA, 22 bp, Artificial Sequence
  Synthetic oligonucleotide; TTT chr11 5175046 5175067 5175063 5175068 +
gttttacgtatttttggttttt

SEQ ID NO: 74828 - DNA, 22 bp, Artificial Sequence
  Synthetic oligonucleotide; TTG chr11 5175047 5175068 5175064 5175069 +
ttttacgtatttttggtttttt

SEQ ID NO: 74829 - DNA, 22 bp, Artificial Sequence
  Synthetic oligonucleotide; TTT chr11 5175050 5175071 5175067 5175072 +
tacgtatttttggtttttttga

SEQ ID NO: 74830 - DNA, 22 bp, Artificial Sequence
  Synthetic oligonucleotide; TTT chr11 5175051 5175072 5175068 5175073 +
acgtatttttggtttttttgag

SEQ ID NO: 74831 - DNA, 22 bp, Artificial Sequence
  Synthetic oligonucleotide; TTA chr11 5175052 5175073 5175069 5175074 +
cgtatttttggtttttttgaga

SEQ ID NO: 74832 - DNA, 22 bp, Artificial Sequence
  Synthetic oligonucleotide; TTT chr11 5175059 5175080 5175076 5175081 +
ttggtttttttgagatggagtc

SEQ ID NO: 74833 - DNA, 22 bp, Artificial Sequence
  Synthetic oligonucleotide; TTT chr11 5175060 5175081 5175077 5175082 +
tggtttttttgagatggagtct

SEQ ID NO: 74834 - DNA, 22 bp, Artificial Sequence
  Synthetic oligonucleotide; TTT chr11 5175061 5175082 5175078 5175083 +
ggtttttttgagatggagtctc

SEQ ID NO: 74835 - DNA, 22 bp, Artificial Sequence
  Synthetic oligonucleotide; TTG chr11 5175062 5175083 5175079 5175084 +
gtttttttgagatggagtctct

SEQ ID NO: 74836 - DNA, 22 bp, Artificial Sequence
  Synthetic oligonucleotide; TTT chr11 5175066 5175087 5175083 5175088 +
ttttgagatggagtctctctct

SEQ ID NO: 74837 - DNA, 22 bp, Artificial Sequence
  Synthetic oligonucleotide; TTT chr11 5175067 5175088 5175084 5175089 +
tttgagatggagtctctctctg

SEQ ID NO: 74838 - DNA, 22 bp, Artificial Sequence
  Synthetic oligonucleotide; TTT chr11 5175068 5175089 5175085 5175090 +
ttgagatggagtctctctctgt

SEQ ID NO: 74839 - DNA, 22 bp, Artificial Sequence
  Synthetic oligonucleotide; TTT chr11 5175069 5175090 5175086 5175091 +
tgagatggagtctctctctgtg

SEQ ID NO: 74840 - DNA, 22 bp, Artificial Sequence
  Synthetic oligonucleotide; TTT chr11 5175070 5175091 5175087 5175092 +
gagatggagtctctctctgtgg

SEQ ID NO: 74841 - DNA, 22 bp, Artificial Sequence
  Synthetic oligonucleotide; TTG chr11 5175071 5175092 5175088 5175093 +
agatggagtctctctctgtggt

SEQ ID NO: 74842 - DNA, 22 bp, Artificial Sequence
  Synthetic oligonucleotide; CTC chr11 5175083 5175104 5175100 5175105 +
tctctgtggtccaggctagagt

SEQ ID NO: 74843 - DNA, 22 bp, Artificial Sequence
  Synthetic oligonucleotide; CTC chr11 5175085 5175106 5175102 5175107 +
tctgtggtccaggctagagtga

SEQ ID NO: 74844 - DNA, 22 bp, Artificial Sequence
  Synthetic oligonucleotide; CTC chr11 5175087 5175108 5175104 5175109 +
tgtggtccaggctagagtgagg

SEQ ID NO: 74845 - DNA, 22 bp, Artificial Sequence
  Synthetic oligonucleotide; CTG chr11 5175089 5175110 5175106 5175111 +
tggtccaggctagagtgaggtg

SEQ ID NO: 74846 - DNA, 22 bp, Artificial Sequence
  Synthetic oligonucleotide; CTA chr11 5175101 5175122 5175118 5175123 +
gagtgaggtgacgcgatctcgg

SEQ ID NO: 74847 - DNA, 22 bp, Artificial Sequence
  Synthetic oligonucleotide; CTC chr11 5175121 5175142 5175138 5175143 +
ggctcactgcaacctccgcctc

SEQ ID NO: 74848 - DNA, 22 bp, Artificial Sequence
  Synthetic oligonucleotide; CTC chr11 5175126 5175147 5175143 5175148 +
actgcaacctccgcctccagaa

SEQ ID NO: 74849 - DNA, 22 bp, Artificial Sequence
  Synthetic oligonucleotide; CTG chr11 5175130 5175151 5175147 5175152 +
caacctccgcctccagaattca

SEQ ID NO: 74850 - DNA, 22 bp, Artificial Sequence
  Synthetic oligonucleotide; CTC chr11 5175137 5175158 5175154 5175159 +
cgcctccagaattcaaatcatt

SEQ ID NO: 74851 - DNA, 22 bp, Artificial Sequence
  Synthetic oligonucleotide; CTC chr11 5175143 5175164 5175160 5175165 +
cagaattcaaatcattctcctg

SEQ ID NO: 74852 - DNA, 22 bp, Artificial Sequence
  Synthetic oligonucleotide; TTC chr11 5175151 5175172 5175168 5175173 +
aaatcattctcctgcctcagcc

SEQ ID NO: 74853 - DNA, 22 bp, Artificial Sequence
  Synthetic oligonucleotide; TTC chr11 5175160 5175181 5175177 5175182 +
tcctgcctcagcctcccatgta

SEQ ID NO: 74854 - DNA, 22 bp, Artificial Sequence
  Synthetic oligonucleotide; CTC chr11 5175162 5175183 5175179 5175184 +
ctgcctcagcctcccatgtagc

SEQ ID NO: 74855 - DNA, 22 bp, Artificial Sequence
  Synthetic oligonucleotide; CTG chr11 5175165 5175186 5175182 5175187 +
cctcagcctcccatgtagctgg

SEQ ID NO: 74856 - DNA, 22 bp, Artificial Sequence
  Synthetic oligonucleotide; CTC chr11 5175169 5175190 5175186 5175191 +
agcctcccatgtagctgggatt

SEQ ID NO: 74857 - DNA, 22 bp, Artificial Sequence
  Synthetic oligonucleotide; CTC chr11 5175175 5175196 5175192 5175197 +
ccatgtagctgggattacaggt

SEQ ID NO: 74858 - DNA, 22 bp, Artificial Sequence
  Synthetic oligonucleotide; CTG chr11 5175186 5175207 5175203 5175208 +
ggattacaggtgtgcgccacca

SEQ ID NO: 74859 - DNA, 22 bp, Artificial Sequence
  Synthetic oligonucleotide; TTA chr11 5175192 5175213 5175209 5175214 +
caggtgtgcgccaccacgtctg

SEQ ID NO: 74860 - DNA, 22 bp, Artificial Sequence
  Synthetic oligonucleotide; CTG chr11 5175214 5175235 5175231 5175236 +
gcctctatcatcattttgaatg

SEQ ID NO: 74861 - DNA, 22 bp, Artificial Sequence
  Synthetic oligonucleotide; CTC chr11 5175219 5175240 5175236 5175241 +
tatcatcattttgaatgtgaca

SEQ ID NO: 74862 - DNA, 22 bp, Artificial Sequence
  Synthetic oligonucleotide; CTA chr11 5175221 5175242 5175238 5175243 +
tcatcattttgaatgtgacatt

SEQ ID NO: 74863 - DNA, 22 bp, Artificial Sequence
  Synthetic oligonucleotide; TTT chr11 5175230 5175251 5175247 5175252 +
tgaatgtgacatttttcccatt

SEQ ID NO: 74864 - DNA, 22 bp, Artificial Sequence
  Synthetic oligonucleotide; TTT chr11 5175231 5175252 5175248 5175253 +
gaatgtgacatttttcccattc

SEQ ID NO: 74865 - DNA, 22 bp, Artificial Sequence
  Synthetic oligonucleotide; TTG chr11 5175232 5175253 5175249 5175254 +
aatgtgacatttttcccattct

SEQ ID NO: 74866 - DNA, 22 bp, Artificial Sequence
  Synthetic oligonucleotide; TTT chr11 5175244 5175265 5175261 5175266 +
ttcccattctattttcctattg

SEQ ID NO: 74867 - DNA, 22 bp, Artificial Sequence
  Synthetic oligonucleotide; TTT chr11 5175245 5175266 5175262 5175267 +
tcccattctattttcctattgg

SEQ ID NO: 74868 - DNA, 22 bp, Artificial Sequence
  Synthetic oligonucleotide; TTT chr11 5175246 5175267 5175263 5175268 +
cccattctattttcctattggt

SEQ ID NO: 74869 - DNA, 22 bp, Artificial Sequence
  Synthetic oligonucleotide; TTC chr11 5175247 5175268 5175264 5175269 +
ccattctattttcctattggtt

SEQ ID NO: 74870 - DNA, 22 bp, Artificial Sequence
  Synthetic oligonucleotide; TTC chr11 5175253 5175274 5175270 5175275 +
tattttcctattggttcttgca

SEQ ID NO: 74871 - DNA, 22 bp, Artificial Sequence
  Synthetic oligonucleotide; CTA chr11 5175255 5175276 5175272 5175277 +
ttttcctattggttcttgcagt

SEQ ID NO: 74872 - DNA, 22 bp, Artificial Sequence
  Synthetic oligonucleotide; TTT chr11 5175258 5175279 5175275 5175280 +
tcctattggttcttgcagttgc

SEQ ID NO: 74873 - DNA, 22 bp, Artificial Sequence
  Synthetic oligonucleotide; TTT chr11 5175259 5175280 5175276 5175281 +
cctattggttcttgcagttgca

SEQ ID NO: 74874 - DNA, 22 bp, Artificial Sequence
  Synthetic oligonucleotide; TTC chr11 5175260 5175281 5175277 5175282 +
ctattggttcttgcagttgcat

SEQ ID NO: 74875 - DNA, 22 bp, Artificial Sequence
  Synthetic oligonucleotide; CTA chr11 5175263 5175284 5175280 5175285 +
ttggttcttgcagttgcataaa

SEQ ID NO: 74876 - DNA, 22 bp, Artificial Sequence
  Synthetic oligonucleotide; TTG chr11 5175266 5175287 5175283 5175288 +
gttcttgcagttgcataaaaca

SEQ ID NO: 74877 - DNA, 22 bp, Artificial Sequence
  Synthetic oligonucleotide; TTC chr11 5175270 5175291 5175287 5175292 +
ttgcagttgcataaaacattat

SEQ ID NO: 74878 - DNA, 22 bp, Artificial Sequence
  Synthetic oligonucleotide; CTT chr11 5175272 5175293 5175289 5175294 +
gcagttgcataaaacattattg

SEQ ID NO: 74879 - DNA, 22 bp, Artificial Sequence
  Synthetic oligonucleotide; TTG chr11 5175273 5175294 5175290 5175295 +
cagttgcataaaacattattga

SEQ ID NO: 74880 - DNA, 22 bp, Artificial Sequence
  Synthetic oligonucleotide; TTG chr11 5175279 5175300 5175296 5175301 +
cataaaacattattgattttta

SEQ ID NO: 74881 - DNA, 22 bp, Artificial Sequence
  Synthetic oligonucleotide; TTA chr11 5175291 5175312 5175308 5175313 +
ttgatttttatgttgtccttat

SEQ ID NO: 74882 - DNA, 22 bp, Artificial Sequence
  Synthetic oligonucleotide; TTG chr11 5175294 5175315 5175311 5175316 +
atttttatgttgtccttatata

SEQ ID NO: 74883 - DNA, 22 bp, Artificial Sequence
  Synthetic oligonucleotide; TTT chr11 5175298 5175319 5175315 5175320 +
ttatgttgtccttatataactc

SEQ ID NO: 74884 - DNA, 22 bp, Artificial Sequence
  Synthetic oligonucleotide; TTT chr11 5175299 5175320 5175316 5175321 +
tatgttgtccttatataactct

SEQ ID NO: 74885 - DNA, 22 bp, Artificial Sequence
  Synthetic oligonucleotide; TTT chr11 5175300 5175321 5175317 5175322 +
atgttgtccttatataactctt

SEQ ID NO: 74886 - DNA, 22 bp, Artificial Sequence
  Synthetic oligonucleotide; TTA chr11 5175301 5175322 5175318 5175323 +
tgttgtccttatataactcttt

SEQ ID NO: 74887 - DNA, 22 bp, Artificial Sequence
  Synthetic oligonucleotide; TTG chr11 5175306 5175327 5175323 5175328 +
tccttatataactctttttact

SEQ ID NO: 74888 - DNA, 22 bp, Artificial Sequence
  Synthetic oligonucleotide; CTT chr11 5175311 5175332 5175328 5175333 +
atataactctttttactttcag

SEQ ID NO: 74889 - DNA, 22 bp, Artificial Sequence
  Synthetic oligonucleotide; TTA chr11 5175312 5175333 5175329 5175334 +
tataactctttttactttcagg

SEQ ID NO: 74890 - DNA, 22 bp, Artificial Sequence
  Synthetic oligonucleotide; CTC chr11 5175320 5175341 5175337 5175342 +
tttttactttcaggtgacttat

SEQ ID NO: 74891 - DNA, 22 bp, Artificial Sequence
  Synthetic oligonucleotide; CTT chr11 5175322 5175343 5175339 5175344 +
tttactttcaggtgacttatac

SEQ ID NO: 74892 - DNA, 22 bp, Artificial Sequence
  Synthetic oligonucleotide; TTT chr11 5175323 5175344 5175340 5175345 +
ttactttcaggtgacttatact

SEQ ID NO: 74893 - DNA, 22 bp, Artificial Sequence
  Synthetic oligonucleotide; TTT chr11 5175324 5175345 5175341 5175346 +
tactttcaggtgacttatactt

SEQ ID NO: 74894 - DNA, 22 bp, Artificial Sequence
  Synthetic oligonucleotide; TTT chr11 5175325 5175346 5175342 5175347 +
actttcaggtgacttatactta

SEQ ID NO: 74895 - DNA, 22 bp, Artificial Sequence
  Synthetic oligonucleotide; TTA chr11 5175326 5175347 5175343 5175348 +
ctttcaggtgacttatacttaa

SEQ ID NO: 74896 - DNA, 22 bp, Artificial Sequence
  Synthetic oligonucleotide; CTT chr11 5175329 5175350 5175346 5175351 +
tcaggtgacttatacttaaatg

SEQ ID NO: 74897 - DNA, 22 bp, Artificial Sequence
  Synthetic oligonucleotide; TTT chr11 5175330 5175351 5175347 5175352 +
caggtgacttatacttaaatga

SEQ ID NO: 74898 - DNA, 22 bp, Artificial Sequence
  Synthetic oligonucleotide; TTC chr11 5175331 5175352 5175348 5175353 +
aggtgacttatacttaaatgat

SEQ ID NO: 74899 - DNA, 22 bp, Artificial Sequence
  Synthetic oligonucleotide; CTT chr11 5175340 5175361 5175357 5175362 +
atacttaaatgatcatatcata

SEQ ID NO: 74900 - DNA, 22 bp, Artificial Sequence
  Synthetic oligonucleotide; TTA chr11 5175341 5175362 5175358 5175363 +
tacttaaatgatcatatcatat

SEQ ID NO: 74901 - DNA, 22 bp, Artificial Sequence
  Synthetic oligonucleotide; CTT chr11 5175346 5175367 5175363 5175368 +
aaatgatcatatcatatacaaa

SEQ ID NO: 74902 - DNA, 22 bp, Artificial Sequence
  Synthetic oligonucleotide; TTA chr11 5175347 5175368 5175364 5175369 +
aatgatcatatcatatacaaaa

SEQ ID NO: 74903 - DNA, 22 bp, Artificial Sequence
  Synthetic oligonucleotide; TTA chr11 5175377 5175398 5175394 5175399 +
aaaaataaaggcaaagatgtaa

SEQ ID NO: 74904 - DNA, 22 bp, Artificial Sequence
  Synthetic oligonucleotide; TTA chr11 5175422 5175443 5175439 5175444 +
caatttggtcttttttctcccc

SEQ ID NO: 74905 - DNA, 22 bp, Artificial Sequence
  Synthetic oligonucleotide; TTT chr11 5175428 5175449 5175445 5175450 +
ggtcttttttctccccccgaaa

SEQ ID NO: 74906 - DNA, 22 bp, Artificial Sequence
  Synthetic oligonucleotide; TTG chr11 5175429 5175450 5175446 5175451 +
gtcttttttctccccccgaaat

SEQ ID NO: 74907 - DNA, 22 bp, Artificial Sequence
  Synthetic oligonucleotide; CTT chr11 5175434 5175455 5175451 5175456 +
ttttctccccccgaaatcaaaa

SEQ ID NO: 74908 - DNA, 22 bp, Artificial Sequence
  Synthetic oligonucleotide; TTT chr11 5175435 5175456 5175452 5175457 +
tttctccccccgaaatcaaaat

SEQ ID NO: 74909 - DNA, 22 bp, Artificial Sequence
  Synthetic oligonucleotide; TTT chr11 5175436 5175457 5175453 5175458 +
ttctccccccgaaatcaaaatt

SEQ ID NO: 74910 - DNA, 22 bp, Artificial Sequence
  Synthetic oligonucleotide; TTT chr11 5175437 5175458 5175454 5175459 +
tctccccccgaaatcaaaattt

SEQ ID NO: 74911 - DNA, 22 bp, Artificial Sequence
  Synthetic oligonucleotide; TTT chr11 5175438 5175459 5175455 5175460 +
ctccccccgaaatcaaaatttt

SEQ ID NO: 74912 - DNA, 22 bp, Artificial Sequence
  Synthetic oligonucleotide; TTC chr11 5175439 5175460 5175456 5175461 +
tccccccgaaatcaaaattttg

SEQ ID NO: 74913 - DNA, 22 bp, Artificial Sequence
  Synthetic oligonucleotide; CTC chr11 5175441 5175462 5175458 5175463 +
cccccgaaatcaaaattttgct

SEQ ID NO: 74914 - DNA, 22 bp, Artificial Sequence
  Synthetic oligonucleotide; TTT chr11 5175459 5175480 5175476 5175481 +
tgcttgattgatattaactaag

SEQ ID NO: 74915 - DNA, 22 bp, Artificial Sequence
  Synthetic oligonucleotide; TTT chr11 5175460 5175481 5175477 5175482 +
gcttgattgatattaactaaga

SEQ ID NO: 74916 - DNA, 22 bp, Artificial Sequence
  Synthetic oligonucleotide; TTG chr11 5175461 5175482 5175478 5175483 +
cttgattgatattaactaagac

SEQ ID NO: 74917 - DNA, 22 bp, Artificial Sequence
  Synthetic oligonucleotide; CTT chr11 5175464 5175485 5175481 5175486 +
gattgatattaactaagacctc

SEQ ID NO: 74918 - DNA, 22 bp, Artificial Sequence
  Synthetic oligonucleotide; TTG chr11 5175465 5175486 5175482 5175487 +
attgatattaactaagacctca

SEQ ID NO: 74919 - DNA, 22 bp, Artificial Sequence
  Synthetic oligonucleotide; TTG chr11 5175469 5175490 5175486 5175491 +
atattaactaagacctcagtta

SEQ ID NO: 74920 - DNA, 22 bp, Artificial Sequence
  Synthetic oligonucleotide; TTA chr11 5175475 5175496 5175492 5175497 +
actaagacctcagttataaaac

SEQ ID NO: 74921 - DNA, 22 bp, Artificial Sequence
  Synthetic oligonucleotide; CTA chr11 5175479 5175500 5175496 5175501 +
agacctcagttataaaacaata

SEQ ID NO: 74922 - DNA, 22 bp, Artificial Sequence
  Synthetic oligonucleotide; CTC chr11 5175486 5175507 5175503 5175508 +
agttataaaacaatagtctgta

SEQ ID NO: 74923 - DNA, 22 bp, Artificial Sequence
  Synthetic oligonucleotide; TTA chr11 5175491 5175512 5175508 5175513 +
taaaacaatagtctgtagtggt

SEQ ID NO: 74924 - DNA, 22 bp, Artificial Sequence
  Synthetic oligonucleotide; CTG chr11 5175506 5175527 5175523 5175528 +
tagtggtactggtcttggatct

SEQ ID NO: 74925 - DNA, 22 bp, Artificial Sequence
  Synthetic oligonucleotide; CTG chr11 5175517 5175538 5175534 5175539 +
gtcttggatctcttgctcattt

SEQ ID NO: 74926 - DNA, 22 bp, Artificial Sequence
  Synthetic oligonucleotide; CTT chr11 5175522 5175543 5175539 5175544 +
ggatctcttgctcatttgaaat

SEQ ID NO: 74927 - DNA, 22 bp, Artificial Sequence
  Synthetic oligonucleotide; TTG chr11 5175523 5175544 5175540 5175545 +
gatctcttgctcatttgaaata

SEQ ID NO: 74928 - DNA, 22 bp, Artificial Sequence
  Synthetic oligonucleotide; CTC chr11 5175529 5175550 5175546 5175551 +
ttgctcatttgaaatactattc

SEQ ID NO: 74929 - DNA, 22 bp, Artificial Sequence
  Synthetic oligonucleotide; CTT chr11 5175531 5175552 5175548 5175553 +
gctcatttgaaatactattctc

SEQ ID NO: 74930 - DNA, 22 bp, Artificial Sequence
  Synthetic oligonucleotide; TTG chr11 5175532 5175553 5175549 5175554 +
ctcatttgaaatactattctca

SEQ ID NO: 74931 - DNA, 22 bp, Artificial Sequence
  Synthetic oligonucleotide; CTC chr11 5175535 5175556 5175552 5175557 +
atttgaaatactattctcacct

SEQ ID NO: 74932 - DNA, 22 bp, Artificial Sequence
  Synthetic oligonucleotide; TTT chr11 5175539 5175560 5175556 5175561 +
gaaatactattctcaccttatc

SEQ ID NO: 74933 - DNA, 22 bp, Artificial Sequence
  Synthetic oligonucleotide; TTG chr11 5175540 5175561 5175557 5175562 +
aaatactattctcaccttatca

SEQ ID NO: 74934 - DNA, 22 bp, Artificial Sequence
  Synthetic oligonucleotide; CTA chr11 5175548 5175569 5175565 5175570 +
ttctcaccttatcaatcactta

SEQ ID NO: 74935 - DNA, 22 bp, Artificial Sequence
  Synthetic oligonucleotide; TTC chr11 5175551 5175572 5175568 5175573 +
tcaccttatcaatcacttagca

SEQ ID NO: 74936 - DNA, 22 bp, Artificial Sequence
  Synthetic oligonucleotide; CTC chr11 5175553 5175574 5175570 5175575 +
accttatcaatcacttagcacc

SEQ ID NO: 74937 - DNA, 22 bp, Artificial Sequence
  Synthetic oligonucleotide; CTT chr11 5175558 5175579 5175575 5175580 +
atcaatcacttagcaccctgta

SEQ ID NO: 74938 - DNA, 22 bp, Artificial Sequence
  Synthetic oligonucleotide; TTA chr11 5175559 5175580 5175576 5175581 +
tcaatcacttagcaccctgtac

SEQ ID NO: 74939 - DNA, 22 bp, Artificial Sequence
  Synthetic oligonucleotide; CTT chr11 5175569 5175590 5175586 5175591 +
agcaccctgtaccttttgtttt

SEQ ID NO: 74940 - DNA, 22 bp, Artificial Sequence
  Synthetic oligonucleotide; TTA chr11 5175570 5175591 5175587 5175592 +
gcaccctgtaccttttgttttt

SEQ ID NO: 74941 - DNA, 22 bp, Artificial Sequence
  Synthetic oligonucleotide; CTG chr11 5175578 5175599 5175595 5175600 +
taccttttgttttttgtttttg

SEQ ID NO: 74942 - DNA, 22 bp, Artificial Sequence
  Synthetic oligonucleotide; CTT chr11 5175584 5175605 5175601 5175606 +
ttgttttttgtttttgctaatt

SEQ ID NO: 74943 - DNA, 22 bp, Artificial Sequence
  Synthetic oligonucleotide; TTT chr11 5175585 5175606 5175602 5175607 +
tgttttttgtttttgctaattc

SEQ ID NO: 74944 - DNA, 22 bp, Artificial Sequence
  Synthetic oligonucleotide; TTT chr11 5175586 5175607 5175603 5175608 +
gttttttgtttttgctaattct

SEQ ID NO: 74945 - DNA, 22 bp, Artificial Sequence
  Synthetic oligonucleotide; TTG chr11 5175587 5175608 5175604 5175609 +
ttttttgtttttgctaattctg

SEQ ID NO: 74946 - DNA, 22 bp, Artificial Sequence
  Synthetic oligonucleotide; TTT chr11 5175590 5175611 5175607 5175612 +
tttgtttttgctaattctgtct

SEQ ID NO: 74947 - DNA, 22 bp, Artificial Sequence
  Synthetic oligonucleotide; TTT chr11 5175591 5175612 5175608 5175613 +
ttgtttttgctaattctgtcta

SEQ ID NO: 74948 - DNA, 22 bp, Artificial Sequence
  Synthetic oligonucleotide; TTT chr11 5175592 5175613 5175609 5175614 +
tgtttttgctaattctgtctag

SEQ ID NO: 74949 - DNA, 22 bp, Artificial Sequence
  Synthetic oligonucleotide; TTT chr11 5175593 5175614 5175610 5175615 +
gtttttgctaattctgtctaga

SEQ ID NO: 74950 - DNA, 22 bp, Artificial Sequence
  Synthetic oligonucleotide; TTG chr11 5175594 5175615 5175611 5175616 +
tttttgctaattctgtctagaa

SEQ ID NO: 74951 - DNA, 22 bp, Artificial Sequence
  Synthetic oligonucleotide; TTT chr11 5175597 5175618 5175614 5175619 +
ttgctaattctgtctagaacac

SEQ ID NO: 74952 - DNA, 22 bp, Artificial Sequence
  Synthetic oligonucleotide; TTT chr11 5175598 5175619 5175615 5175620 +
tgctaattctgtctagaacacc

SEQ ID NO: 74953 - DNA, 22 bp, Artificial Sequence
  Synthetic oligonucleotide; TTT chr11 5175599 5175620 5175616 5175621 +
gctaattctgtctagaacacca

SEQ ID NO: 74954 - DNA, 22 bp, Artificial Sequence
  Synthetic oligonucleotide; TTG chr11 5175600 5175621 5175617 5175622 +
ctaattctgtctagaacaccat

SEQ ID NO: 74955 - DNA, 22 bp, Artificial Sequence
  Synthetic oligonucleotide; CTA chr11 5175603 5175624 5175620 5175625 +
attctgtctagaacaccatatc

SEQ ID NO: 74956 - DNA, 22 bp, Artificial Sequence
  Synthetic oligonucleotide; TTC chr11 5175607 5175628 5175624 5175629 +
tgtctagaacaccatatcagtt

SEQ ID NO: 74957 - DNA, 22 bp, Artificial Sequence
  Synthetic oligonucleotide; CTG chr11 5175609 5175630 5175626 5175631 +
tctagaacaccatatcagtttt

SEQ ID NO: 74958 - DNA, 22 bp, Artificial Sequence
  Synthetic oligonucleotide; CTA chr11 5175613 5175634 5175630 5175635 +
gaacaccatatcagttttagct

SEQ ID NO: 74959 - DNA, 22 bp, Artificial Sequence
  Synthetic oligonucleotide; TTT chr11 5175630 5175651 5175647 5175652 +
tagctaagtgcttccaaaactc

SEQ ID NO: 74960 - DNA, 22 bp, Artificial Sequence
  Synthetic oligonucleotide; TTT chr11 5175631 5175652 5175648 5175653 +
agctaagtgcttccaaaactcc

SEQ ID NO: 74961 - DNA, 22 bp, Artificial Sequence
  Synthetic oligonucleotide; TTA chr11 5175632 5175653 5175649 5175654 +
gctaagtgcttccaaaactccc

SEQ ID NO: 74962 - DNA, 22 bp, Artificial Sequence
  Synthetic oligonucleotide; CTA chr11 5175636 5175657 5175653 5175658 +
agtgcttccaaaactccctgct

SEQ ID NO: 74963 - DNA, 22 bp, Artificial Sequence
  Synthetic oligonucleotide; CTT chr11 5175643 5175664 5175660 5175665 +
ccaaaactccctgctttaaaat

SEQ ID NO: 74964 - DNA, 22 bp, Artificial Sequence
  Synthetic oligonucleotide; TTC chr11 5175644 5175665 5175661 5175666 +
caaaactccctgctttaaaatt

SEQ ID NO: 74965 - DNA, 22 bp, Artificial Sequence
  Synthetic oligonucleotide; CTC chr11 5175652 5175673 5175669 5175674 +
cctgctttaaaattgtttggtt

SEQ ID NO: 74966 - DNA, 22 bp, Artificial Sequence
  Synthetic oligonucleotide; CTG chr11 5175656 5175677 5175673 5175678 +
ctttaaaattgtttggtttctg

SEQ ID NO: 74967 - DNA, 22 bp, Artificial Sequence
  Synthetic oligonucleotide; CTT chr11 5175659 5175680 5175676 5175681 +
taaaattgtttggtttctgccc

SEQ ID NO: 74968 - DNA, 22 bp, Artificial Sequence
  Synthetic oligonucleotide; TTT chr11 5175660 5175681 5175677 5175682 +
aaaattgtttggtttctgccct

SEQ ID NO: 74969 - DNA, 22 bp, Artificial Sequence
  Synthetic oligonucleotide; TTA chr11 5175661 5175682 5175678 5175683 +
aaattgtttggtttctgccctt

SEQ ID NO: 74970 - DNA, 22 bp, Artificial Sequence
  Synthetic oligonucleotide; TTG chr11 5175667 5175688 5175684 5175689 +
tttggtttctgcccttttttgg

SEQ ID NO: 74971 - DNA, 22 bp, Artificial Sequence
  Synthetic oligonucleotide; TTT chr11 5175670 5175691 5175687 5175692 +
ggtttctgcccttttttggacc

SEQ ID NO: 74972 - DNA, 22 bp, Artificial Sequence
  Synthetic oligonucleotide; TTG chr11 5175671 5175692 5175688 5175693 +
gtttctgcccttttttggacct

SEQ ID NO: 74973 - DNA, 22 bp, Artificial Sequence
  Synthetic oligonucleotide; TTT chr11 5175675 5175696 5175692 5175697 +
ctgcccttttttggacctttcc

SEQ ID NO: 74974 - DNA, 22 bp, Artificial Sequence
  Synthetic oligonucleotide; TTC chr11 5175676 5175697 5175693 5175698 +
tgcccttttttggacctttcct

SEQ ID NO: 74975 - DNA, 22 bp, Artificial Sequence
  Synthetic oligonucleotide; CTG chr11 5175678 5175699 5175695 5175700 +
cccttttttggacctttccttt

SEQ ID NO: 74976 - DNA, 22 bp, Artificial Sequence
  Synthetic oligonucleotide; CTT chr11 5175683 5175704 5175700 5175705 +
ttttggacctttcctttccttt

SEQ ID NO: 74977 - DNA, 22 bp, Artificial Sequence
  Synthetic oligonucleotide; TTT chr11 5175684 5175705 5175701 5175706 +
tttggacctttcctttcctttc

SEQ ID NO: 74978 - DNA, 22 bp, Artificial Sequence
  Synthetic oligonucleotide; TTT chr11 5175685 5175706 5175702 5175707 +
ttggacctttcctttcctttcc

SEQ ID NO: 74979 - DNA, 22 bp, Artificial Sequence
  Synthetic oligonucleotide; TTT chr11 5175686 5175707 5175703 5175708 +
tggacctttcctttcctttcct

SEQ ID NO: 74980 - DNA, 22 bp, Artificial Sequence
  Synthetic oligonucleotide; TTT chr11 5175687 5175708 5175704 5175709 +
ggacctttcctttcctttcctt

SEQ ID NO: 74981 - DNA, 22 bp, Artificial Sequence
  Synthetic oligonucleotide; TTG chr11 5175688 5175709 5175705 5175710 +
gacctttcctttcctttccttt

SEQ ID NO: 74982 - DNA, 22 bp, Artificial Sequence
  Synthetic oligonucleotide; CTT chr11 5175694 5175715 5175711 5175716 +
tcctttcctttcctttcctttc

SEQ ID NO: 74983 - DNA, 22 bp, Artificial Sequence
  Synthetic oligonucleotide; TTT chr11 5175695 5175716 5175712 5175717 +
cctttcctttcctttcctttcc

SEQ ID NO: 74984 - DNA, 22 bp, Artificial Sequence
  Synthetic oligonucleotide; TTC chr11 5175696 5175717 5175713 5175718 +
ctttcctttcctttcctttcct

SEQ ID NO: 74985 - DNA, 22 bp, Artificial Sequence
  Synthetic oligonucleotide; CTT chr11 5175699 5175720 5175716 5175721 +
tcctttcctttcctttcctttc

SEQ ID NO: 74986 - DNA, 22 bp, Artificial Sequence
  Synthetic oligonucleotide; TTT chr11 5175700 5175721 5175717 5175722 +
cctttcctttcctttcctttcc

SEQ ID NO: 74987 - DNA, 22 bp, Artificial Sequence
  Synthetic oligonucleotide; TTC chr11 5175701 5175722 5175718 5175723 +
ctttcctttcctttcctttcct

SEQ ID NO: 74988 - DNA, 22 bp, Artificial Sequence
  Synthetic oligonucleotide; CTT chr11 5175704 5175725 5175721 5175726 +
tcctttcctttcctttcctttc

SEQ ID NO: 74989 - DNA, 22 bp, Artificial Sequence
  Synthetic oligonucleotide; TTT chr11 5175705 5175726 5175722 5175727 +
cctttcctttcctttcctttcc

SEQ ID NO: 74990 - DNA, 22 bp, Artificial Sequence
  Synthetic oligonucleotide; TTC chr11 5175706 5175727 5175723 5175728 +
ctttcctttcctttcctttcct

SEQ ID NO: 74991 - DNA, 22 bp, Artificial Sequence
  Synthetic oligonucleotide; CTT chr11 5175709 5175730 5175726 5175731 +
tcctttcctttcctttcctttc

SEQ ID NO: 74992 - DNA, 22 bp, Artificial Sequence
  Synthetic oligonucleotide; TTT chr11 5175710 5175731 5175727 5175732 +
cctttcctttcctttcctttcc

SEQ ID NO: 74993 - DNA, 22 bp, Artificial Sequence
  Synthetic oligonucleotide; TTC chr11 5175711 5175732 5175728 5175733 +
ctttcctttcctttcctttcct

SEQ ID NO: 74994 - DNA, 22 bp, Artificial Sequence
  Synthetic oligonucleotide; CTT chr11 5175714 5175735 5175731 5175736 +
tcctttcctttcctttcctttt

SEQ ID NO: 74995 - DNA, 22 bp, Artificial Sequence
  Synthetic oligonucleotide; TTT chr11 5175715 5175736 5175732 5175737 +
cctttcctttcctttccttttt

SEQ ID NO: 74996 - DNA, 22 bp, Artificial Sequence
  Synthetic oligonucleotide; TTC chr11 5175716 5175737 5175733 5175738 +
ctttcctttcctttcctttttc

SEQ ID NO: 74997 - DNA, 22 bp, Artificial Sequence
  Synthetic oligonucleotide; CTT chr11 5175719 5175740 5175736 5175741 +
tcctttcctttcctttttcctt

SEQ ID NO: 74998 - DNA, 22 bp, Artificial Sequence
  Synthetic oligonucleotide; TTT chr11 5175720 5175741 5175737 5175742 +
cctttcctttcctttttccttt

SEQ ID NO: 74999 - DNA, 22 bp, Artificial Sequence
  Synthetic oligonucleotide; TTC chr11 5175721 5175742 5175738 5175743 +
ctttcctttcctttttcctttc

SEQ ID NO: 75000 - DNA, 22 bp, Artificial Sequence
  Synthetic oligonucleotide; CTT chr11 5175724 5175745 5175741 5175746 +
tcctttcctttttcctttcctt

SEQ ID NO: 75001 - DNA, 22 bp, Artificial Sequence
  Synthetic oligonucleotide; TTT chr11 5175725 5175746 5175742 5175747 +
cctttcctttttcctttccttt

SEQ ID NO: 75002 - DNA, 22 bp, Artificial Sequence
  Synthetic oligonucleotide; TTC chr11 5175726 5175747 5175743 5175748 +
ctttcctttttcctttcctttc

SEQ ID NO: 75003 - DNA, 22 bp, Artificial Sequence
  Synthetic oligonucleotide; CTT chr11 5175729 5175750 5175746 5175751 +
tcctttttcctttcctttcctt

SEQ ID NO: 75004 - DNA, 22 bp, Artificial Sequence
  Synthetic oligonucleotide; TTT chr11 5175730 5175751 5175747 5175752 +
cctttttcctttcctttccttc

SEQ ID NO: 75005 - DNA, 22 bp, Artificial Sequence
  Synthetic oligonucleotide; TTC chr11 5175731 5175752 5175748 5175753 +
ctttttcctttcctttccttcc

SEQ ID NO: 75006 - DNA, 22 bp, Artificial Sequence
  Synthetic oligonucleotide; CTT chr11 5175734 5175755 5175751 5175756 +
tttcctttcctttccttccctt

SEQ ID NO: 75007 - DNA, 22 bp, Artificial Sequence
  Synthetic oligonucleotide; TTT chr11 5175735 5175756 5175752 5175757 +
ttcctttcctttccttcccttc

SEQ ID NO: 75008 - DNA, 22 bp, Artificial Sequence
  Synthetic oligonucleotide; TTT chr11 5175736 5175757 5175753 5175758 +
tcctttcctttccttcccttcc

SEQ ID NO: 75009 - DNA, 22 bp, Artificial Sequence
  Synthetic oligonucleotide; TTT chr11 5175737 5175758 5175754 5175759 +
cctttcctttccttcccttccc

SEQ ID NO: 75010 - DNA, 22 bp, Artificial Sequence
  Synthetic oligonucleotide; TTC chr11 5175738 5175759 5175755 5175760 +
ctttcctttccttcccttccct

SEQ ID NO: 75011 - DNA, 22 bp, Artificial Sequence
  Synthetic oligonucleotide; CTT chr11 5175741 5175762 5175758 5175763 +
tcctttccttcccttccctttc

SEQ ID NO: 75012 - DNA, 22 bp, Artificial Sequence
  Synthetic oligonucleotide; TTT chr11 5175742 5175763 5175759 5175764 +
cctttccttcccttccctttcc

SEQ ID NO: 75013 - DNA, 22 bp, Artificial Sequence
  Synthetic oligonucleotide; TTC chr11 5175743 5175764 5175760 5175765 +
ctttccttcccttccctttcct

SEQ ID NO: 75014 - DNA, 22 bp, Artificial Sequence
  Synthetic oligonucleotide; CTT chr11 5175746 5175767 5175763 5175768 +
tccttcccttccctttcctttc

SEQ ID NO: 75015 - DNA, 22 bp, Artificial Sequence
  Synthetic oligonucleotide; TTT chr11 5175747 5175768 5175764 5175769 +
ccttcccttccctttcctttcc

SEQ ID NO: 75016 - DNA, 22 bp, Artificial Sequence
  Synthetic oligonucleotide; TTC chr11 5175748 5175769 5175765 5175770 +
cttcccttccctttcctttccc

SEQ ID NO: 75017 - DNA, 22 bp, Artificial Sequence
  Synthetic oligonucleotide; CTT chr11 5175751 5175772 5175768 5175773 +
cccttccctttcctttcccttc

SEQ ID NO: 75018 - DNA, 22 bp, Artificial Sequence
  Synthetic oligonucleotide; TTC chr11 5175752 5175773 5175769 5175774 +
ccttccctttcctttcccttcc

SEQ ID NO: 75019 - DNA, 22 bp, Artificial Sequence
  Synthetic oligonucleotide; CTT chr11 5175756 5175777 5175773 5175778 +
ccctttcctttcccttccctcc

SEQ ID NO: 75020 - DNA, 22 bp, Artificial Sequence
  Synthetic oligonucleotide; TTC chr11 5175757 5175778 5175774 5175779 +
cctttcctttcccttccctccc

SEQ ID NO: 75021 - DNA, 22 bp, Artificial Sequence
  Synthetic oligonucleotide; CTT chr11 5175761 5175782 5175778 5175783 +
tcctttcccttccctccctttc

SEQ ID NO: 75022 - DNA, 22 bp, Artificial Sequence
  Synthetic oligonucleotide; TTT chr11 5175762 5175783 5175779 5175784 +
cctttcccttccctccctttcc

SEQ ID NO: 75023 - DNA, 22 bp, Artificial Sequence
  Synthetic oligonucleotide; TTC chr11 5175763 5175784 5175780 5175785 +
ctttcccttccctccctttccc

SEQ ID NO: 75024 - DNA, 22 bp, Artificial Sequence
  Synthetic oligonucleotide; CTT chr11 5175766 5175787 5175783 5175788 +
tcccttccctccctttcccttt

SEQ ID NO: 75025 - DNA, 22 bp, Artificial Sequence
  Synthetic oligonucleotide; TTT chr11 5175767 5175788 5175784 5175789 +
cccttccctccctttccctttc

SEQ ID NO: 75026 - DNA, 22 bp, Artificial Sequence
  Synthetic oligonucleotide; TTC chr11 5175768 5175789 5175785 5175790 +
ccttccctccctttccctttcc

SEQ ID NO: 75027 - DNA, 22 bp, Artificial Sequence
  Synthetic oligonucleotide; CTT chr11 5175772 5175793 5175789 5175794 +
ccctccctttccctttcccttt

SEQ ID NO: 75028 - DNA, 22 bp, Artificial Sequence
  Synthetic oligonucleotide; TTC chr11 5175773 5175794 5175790 5175795 +
cctccctttccctttccctttc

SEQ ID NO: 75029 - DNA, 22 bp, Artificial Sequence
  Synthetic oligonucleotide; CTC chr11 5175777 5175798 5175794 5175799 +
cctttccctttccctttccctt

SEQ ID NO: 75030 - DNA, 22 bp, Artificial Sequence
  Synthetic oligonucleotide; CTT chr11 5175781 5175802 5175798 5175803 +
tccctttccctttccctttccc

SEQ ID NO: 75031 - DNA, 22 bp, Artificial Sequence
  Synthetic oligonucleotide; TTT chr11 5175782 5175803 5175799 5175804 +
ccctttccctttccctttccct

SEQ ID NO: 75032 - DNA, 22 bp, Artificial Sequence
  Synthetic oligonucleotide; TTC chr11 5175783 5175804 5175800 5175805 +
cctttccctttccctttccctt

SEQ ID NO: 75033 - DNA, 22 bp, Artificial Sequence
  Synthetic oligonucleotide; CTT chr11 5175787 5175808 5175804 5175809 +
tccctttccctttccctttccc

SEQ ID NO: 75034 - DNA, 22 bp, Artificial Sequence
  Synthetic oligonucleotide; TTT chr11 5175788 5175809 5175805 5175810 +
ccctttccctttccctttccct

SEQ ID NO: 75035 - DNA, 22 bp, Artificial Sequence
  Synthetic oligonucleotide; TTC chr11 5175789 5175810 5175806 5175811 +
cctttccctttccctttccctt

SEQ ID NO: 75036 - DNA, 22 bp, Artificial Sequence
  Synthetic oligonucleotide; CTT chr11 5175793 5175814 5175810 5175815 +
tccctttccctttccctttccc

SEQ ID NO: 75037 - DNA, 22 bp, Artificial Sequence
  Synthetic oligonucleotide; TTT chr11 5175794 5175815 5175811 5175816 +
ccctttccctttccctttccct

SEQ ID NO: 75038 - DNA, 22 bp, Artificial Sequence
  Synthetic oligonucleotide; TTC chr11 5175795 5175816 5175812 5175817 +
cctttccctttccctttccctt

SEQ ID NO: 75039 - DNA, 22 bp, Artificial Sequence
  Synthetic oligonucleotide; CTT chr11 5175799 5175820 5175816 5175821 +
tccctttccctttcccttcctg

SEQ ID NO: 75040 - DNA, 22 bp, Artificial Sequence
  Synthetic oligonucleotide; TTT chr11 5175800 5175821 5175817 5175822 +
ccctttccctttcccttcctgc

SEQ ID NO: 75041 - DNA, 22 bp, Artificial Sequence
  Synthetic oligonucleotide; TTC chr11 5175801 5175822 5175818 5175823 +
cctttccctttcccttcctgct

SEQ ID NO: 75042 - DNA, 22 bp, Artificial Sequence
  Synthetic oligonucleotide; CTT chr11 5175805 5175826 5175822 5175827 +
tccctttcccttcctgctgaag

SEQ ID NO: 75043 - DNA, 22 bp, Artificial Sequence
  Synthetic oligonucleotide; TTT chr11 5175806 5175827 5175823 5175828 +
ccctttcccttcctgctgaagg

SEQ ID NO: 75044 - DNA, 22 bp, Artificial Sequence
  Synthetic oligonucleotide; TTC chr11 5175807 5175828 5175824 5175829 +
cctttcccttcctgctgaagga

SEQ ID NO: 75045 - DNA, 22 bp, Artificial Sequence
  Synthetic oligonucleotide; CTT chr11 5175811 5175832 5175828 5175833 +
tcccttcctgctgaaggattac

SEQ ID NO: 75046 - DNA, 22 bp, Artificial Sequence
  Synthetic oligonucleotide; TTT chr11 5175812 5175833 5175829 5175834 +
cccttcctgctgaaggattact

SEQ ID NO: 75047 - DNA, 22 bp, Artificial Sequence
  Synthetic oligonucleotide; TTC chr11 5175813 5175834 5175830 5175835 +
ccttcctgctgaaggattactg

SEQ ID NO: 75048 - DNA, 22 bp, Artificial Sequence
  Synthetic oligonucleotide; CTT chr11 5175817 5175838 5175834 5175839 +
cctgctgaaggattactggtta

SEQ ID NO: 75049 - DNA, 22 bp, Artificial Sequence
  Synthetic oligonucleotide; TTC chr11 5175818 5175839 5175835 5175840 +
ctgctgaaggattactggttaa

SEQ ID NO: 75050 - DNA, 22 bp, Artificial Sequence
  Synthetic oligonucleotide; CTG chr11 5175821 5175842 5175838 5175843 +
ctgaaggattactggttaagga

SEQ ID NO: 75051 - DNA, 22 bp, Artificial Sequence
  Synthetic oligonucleotide; CTG chr11 5175824 5175845 5175841 5175846 +
aaggattactggttaaggagac

SEQ ID NO: 75052 - DNA, 22 bp, Artificial Sequence
  Synthetic oligonucleotide; TTA chr11 5175832 5175853 5175849 5175854 +
ctggttaaggagacagtagaac

SEQ ID NO: 75053 - DNA, 22 bp, Artificial Sequence
  Synthetic oligonucleotide; CTG chr11 5175835 5175856 5175852 5175857 +
gttaaggagacagtagaacatg

SEQ ID NO: 75054 - DNA, 22 bp, Artificial Sequence
  Synthetic oligonucleotide; TTA chr11 5175839 5175860 5175856 5175861 +
aggagacagtagaacatgaaaa

SEQ ID NO: 75055 - DNA, 22 bp, Artificial Sequence
  Synthetic oligonucleotide; CTT chr11 5175864 5175885 5175881 5175886 +
cttctcatgtccagggcaatgg

SEQ ID NO: 75056 - DNA, 22 bp, Artificial Sequence
  Synthetic oligonucleotide; TTC chr11 5175865 5175886 5175882 5175887 +
ttctcatgtccagggcaatggc

SEQ ID NO: 75057 - DNA, 22 bp, Artificial Sequence
  Synthetic oligonucleotide; CTT chr11 5175867 5175888 5175884 5175889 +
ctcatgtccagggcaatggctc

SEQ ID NO: 75058 - DNA, 22 bp, Artificial Sequence
  Synthetic oligonucleotide; TTC chr11 5175868 5175889 5175885 5175890 +
tcatgtccagggcaatggctca

SEQ ID NO: 75059 - DNA, 22 bp, Artificial Sequence
  Synthetic oligonucleotide; CTC chr11 5175870 5175891 5175887 5175892 +
atgtccagggcaatggctcagt

SEQ ID NO: 75060 - DNA, 22 bp, Artificial Sequence
  Synthetic oligonucleotide; CTC chr11 5175889 5175910 5175906 5175911 +
agtaatgttaaattcagcagct

SEQ ID NO: 75061 - DNA, 22 bp, Artificial Sequence
  Synthetic oligonucleotide; TTA chr11 5175899 5175920 5175916 5175921 +
aattcagcagctgcatagcaac

SEQ ID NO: 75062 - DNA, 22 bp, Artificial Sequence
  Synthetic oligonucleotide; TTC chr11 5175904 5175925 5175921 5175926 +
agcagctgcatagcaacagcca

SEQ ID NO: 75063 - DNA, 22 bp, Artificial Sequence
  Synthetic oligonucleotide; CTG chr11 5175912 5175933 5175929 5175934 +
catagcaacagccatttcctaa

SEQ ID NO: 75064 - DNA, 22 bp, Artificial Sequence
  Synthetic oligonucleotide; TTT chr11 5175929 5175950 5175946 5175951 +
cctaaatcctttcagaatctga

SEQ ID NO: 75065 - DNA, 22 bp, Artificial Sequence
  Synthetic oligonucleotide; TTC chr11 5175930 5175951 5175947 5175952 +
ctaaatcctttcagaatctgag

SEQ ID NO: 75066 - DNA, 22 bp, Artificial Sequence
  Synthetic oligonucleotide; CTA chr11 5175933 5175954 5175950 5175955 +
aatcctttcagaatctgagtgc

SEQ ID NO: 75067 - DNA, 22 bp, Artificial Sequence
  Synthetic oligonucleotide; CTT chr11 5175940 5175961 5175957 5175962 +
tcagaatctgagtgctcaactg

SEQ ID NO: 75068 - DNA, 22 bp, Artificial Sequence
  Synthetic oligonucleotide; TTT chr11 5175941 5175962 5175958 5175963 +
cagaatctgagtgctcaactga

SEQ ID NO: 75069 - DNA, 22 bp, Artificial Sequence
  Synthetic oligonucleotide; TTC chr11 5175942 5175963 5175959 5175964 +
agaatctgagtgctcaactgaa

SEQ ID NO: 75070 - DNA, 22 bp, Artificial Sequence
  Synthetic oligonucleotide; CTG chr11 5175950 5175971 5175967 5175972 +
agtgctcaactgaaagtttatt

SEQ ID NO: 75071 - DNA, 22 bp, Artificial Sequence
  Synthetic oligonucleotide; CTC chr11 5175957 5175978 5175974 5175979 +
aactgaaagtttatttagagat

SEQ ID NO: 75072 - DNA, 22 bp, Artificial Sequence
  Synthetic oligonucleotide; CTG chr11 5175962 5175983 5175979 5175984 +
aaagtttatttagagattgtaa

SEQ ID NO: 75073 - DNA, 22 bp, Artificial Sequence
  Synthetic oligonucleotide; TTT chr11 5175969 5175990 5175986 5175991 +
atttagagattgtaaattcaat

SEQ ID NO: 75074 - DNA, 22 bp, Artificial Sequence
  Synthetic oligonucleotide; TTA chr11 5175970 5175991 5175987 5175992 +
tttagagattgtaaattcaatc

SEQ ID NO: 75075 - DNA, 22 bp, Artificial Sequence
  Synthetic oligonucleotide; TTT chr11 5175973 5175994 5175990 5175995 +
agagattgtaaattcaatcatt

SEQ ID NO: 75076 - DNA, 22 bp, Artificial Sequence
  Synthetic oligonucleotide; TTA chr11 5175974 5175995 5175991 5175996 +
gagattgtaaattcaatcattt

SEQ ID NO: 75077 - DNA, 22 bp, Artificial Sequence
  Synthetic oligonucleotide; TTG chr11 5175981 5176002 5175998 5176003 +
taaattcaatcatttttacttc

SEQ ID NO: 75078 - DNA, 22 bp, Artificial Sequence
  Synthetic oligonucleotide; TTC chr11 5175988 5176009 5176005 5176010 +
aatcatttttacttctaccatt

SEQ ID NO: 75079 - DNA, 22 bp, Artificial Sequence
  Synthetic oligonucleotide; TTT chr11 5175996 5176017 5176013 5176018 +
ttacttctaccattttaactgt

SEQ ID NO: 75080 - DNA, 22 bp, Artificial Sequence
  Synthetic oligonucleotide; TTT chr11 5175997 5176018 5176014 5176019 +
tacttctaccattttaactgtc

SEQ ID NO: 75081 - DNA, 22 bp, Artificial Sequence
  Synthetic oligonucleotide; TTT chr11 5175998 5176019 5176015 5176020 +
acttctaccattttaactgtca

SEQ ID NO: 75082 - DNA, 22 bp, Artificial Sequence
  Synthetic oligonucleotide; TTA chr11 5175999 5176020 5176016 5176021 +
cttctaccattttaactgtcaa

SEQ ID NO: 75083 - DNA, 22 bp, Artificial Sequence
  Synthetic oligonucleotide; CTT chr11 5176002 5176023 5176019 5176024 +
ctaccattttaactgtcaaaat

SEQ ID NO: 75084 - DNA, 22 bp, Artificial Sequence
  Synthetic oligonucleotide; TTC chr11 5176003 5176024 5176020 5176025 +
taccattttaactgtcaaaatg

SEQ ID NO: 75085 - DNA, 22 bp, Artificial Sequence
  Synthetic oligonucleotide; CTA chr11 5176005 5176026 5176022 5176027 +
ccattttaactgtcaaaatgac

SEQ ID NO: 75086 - DNA, 22 bp, Artificial Sequence
  Synthetic oligonucleotide; TTT chr11 5176011 5176032 5176028 5176033 +
taactgtcaaaatgacatgtat

SEQ ID NO: 75087 - DNA, 22 bp, Artificial Sequence
  Synthetic oligonucleotide; TTT chr11 5176012 5176033 5176029 5176034 +
aactgtcaaaatgacatgtata

SEQ ID NO: 75088 - DNA, 22 bp, Artificial Sequence
  Synthetic oligonucleotide; TTA chr11 5176013 5176034 5176030 5176035 +
actgtcaaaatgacatgtatat

SEQ ID NO: 75089 - DNA, 22 bp, Artificial Sequence
  Synthetic oligonucleotide; CTG chr11 5176017 5176038 5176034 5176039 +
tcaaaatgacatgtatatgtta

SEQ ID NO: 75090 - DNA, 22 bp, Artificial Sequence
  Synthetic oligonucleotide; TTA chr11 5176039 5176060 5176056 5176061 +
ctgtgtagctatatatgtatat

SEQ ID NO: 75091 - DNA, 22 bp, Artificial Sequence
  Synthetic oligonucleotide; CTG chr11 5176042 5176063 5176059 5176064 +
tgtagctatatatgtatatatg

SEQ ID NO: 75092 - DNA, 22 bp, Artificial Sequence
  Synthetic oligonucleotide; CTA chr11 5176050 5176071 5176067 5176072 +
tatatgtatatatgattatata

SEQ ID NO: 75093 - DNA, 22 bp, Artificial Sequence
  Synthetic oligonucleotide; TTA chr11 5176068 5176089 5176085 5176090 +
tatatattcatatacctattta

SEQ ID NO: 75094 - DNA, 22 bp, Artificial Sequence
  Synthetic oligonucleotide; TTC chr11 5176077 5176098 5176094 5176099 +
atatacctatttaagatatcat

SEQ ID NO: 75095 - DNA, 22 bp, Artificial Sequence
  Synthetic oligonucleotide; CTA chr11 5176086 5176107 5176103 5176108 +
tttaagatatcatgttgcatgc

SEQ ID NO: 75096 - DNA, 22 bp, Artificial Sequence
  Synthetic oligonucleotide; TTT chr11 5176089 5176110 5176106 5176111 +
aagatatcatgttgcatgcatt

SEQ ID NO: 75097 - DNA, 22 bp, Artificial Sequence
  Synthetic oligonucleotide; TTA chr11 5176090 5176111 5176107 5176112 +
agatatcatgttgcatgcattt

SEQ ID NO: 75098 - DNA, 22 bp, Artificial Sequence
  Synthetic oligonucleotide; TTG chr11 5176103 5176124 5176120 5176125 +
catgcattttggatgtgaaatt

SEQ ID NO: 75099 - DNA, 22 bp, Artificial Sequence
  Synthetic oligonucleotide; TTT chr11 5176112 5176133 5176129 5176134 +
tggatgtgaaattggcattttc

SEQ ID NO: 75100 - DNA, 22 bp, Artificial Sequence
  Synthetic oligonucleotide; TTT chr11 5176113 5176134 5176130 5176135 +
ggatgtgaaattggcattttct

SEQ ID NO: 75101 - DNA, 22 bp, Artificial Sequence
  Synthetic oligonucleotide; TTG chr11 5176114 5176135 5176131 5176136 +
gatgtgaaattggcattttctt

SEQ ID NO: 75102 - DNA, 22 bp, Artificial Sequence
  Synthetic oligonucleotide; TTG chr11 5176126 5176147 5176143 5176148 +
gcattttcttagctccccactg

SEQ ID NO: 75103 - DNA, 22 bp, Artificial Sequence
  Synthetic oligonucleotide; TTT chr11 5176132 5176153 5176149 5176154 +
tcttagctccccactgctaaaa

SEQ ID NO: 75104 - DNA, 22 bp, Artificial Sequence
  Synthetic oligonucleotide; TTT chr11 5176133 5176154 5176150 5176155 +
cttagctccccactgctaaaat

SEQ ID NO: 75105 - DNA, 22 bp, Artificial Sequence
  Synthetic oligonucleotide; TTC chr11 5176134 5176155 5176151 5176156 +
ttagctccccactgctaaaatc

SEQ ID NO: 75106 - DNA, 22 bp, Artificial Sequence
  Synthetic oligonucleotide; CTT chr11 5176136 5176157 5176153 5176158 +
agctccccactgctaaaatcaa

SEQ ID NO: 75107 - DNA, 22 bp, Artificial Sequence
  Synthetic oligonucleotide; TTA chr11 5176137 5176158 5176154 5176159 +
gctccccactgctaaaatcaag

SEQ ID NO: 75108 - DNA, 22 bp, Artificial Sequence
  Synthetic oligonucleotide; CTC chr11 5176141 5176162 5176158 5176163 +
cccactgctaaaatcaagtata

SEQ ID NO: 75109 - DNA, 22 bp, Artificial Sequence
  Synthetic oligonucleotide; CTG chr11 5176148 5176169 5176165 5176170 +
ctaaaatcaagtatacaaaatc

SEQ ID NO: 75110 - DNA, 22 bp, Artificial Sequence
  Synthetic oligonucleotide; CTA chr11 5176151 5176172 5176168 5176173 +
aaatcaagtatacaaaatcttc

SEQ ID NO: 75111 - DNA, 22 bp, Artificial Sequence
  Synthetic oligonucleotide; CTT chr11 5176172 5176193 5176189 5176194 +
cctacctttcagtcaaatcctc

SEQ ID NO: 75112 - DNA, 22 bp, Artificial Sequence
  Synthetic oligonucleotide; TTC chr11 5176173 5176194 5176190 5176195 +
ctacctttcagtcaaatcctct

SEQ ID NO: 75113 - DNA, 22 bp, Artificial Sequence
  Synthetic oligonucleotide; CTA chr11 5176176 5176197 5176193 5176198 +
cctttcagtcaaatcctctgtc

SEQ ID NO: 75114 - DNA, 22 bp, Artificial Sequence
  Synthetic oligonucleotide; CTT chr11 5176180 5176201 5176197 5176202 +
tcagtcaaatcctctgtcatca

SEQ ID NO: 75115 - DNA, 22 bp, Artificial Sequence
  Synthetic oligonucleotide; TTT chr11 5176181 5176202 5176198 5176203 +
cagtcaaatcctctgtcatcat

SEQ ID NO: 75116 - DNA, 22 bp, Artificial Sequence
  Synthetic oligonucleotide; TTC chr11 5176182 5176203 5176199 5176204 +
agtcaaatcctctgtcatcata

SEQ ID NO: 75117 - DNA, 22 bp, Artificial Sequence
  Synthetic oligonucleotide; CTC chr11 5176194 5176215 5176211 5176216 +
tgtcatcatactgcaatctatc

SEQ ID NO: 75118 - DNA, 22 bp, Artificial Sequence
  Synthetic oligonucleotide; CTG chr11 5176196 5176217 5176213 5176218 +
tcatcatactgcaatctatcta

SEQ ID NO: 75119 - DNA, 22 bp, Artificial Sequence
  Synthetic oligonucleotide; CTG chr11 5176207 5176228 5176224 5176229 +
caatctatctattccctcattt

SEQ ID NO: 75120 - DNA, 22 bp, Artificial Sequence
  Synthetic oligonucleotide; CTA chr11 5176214 5176235 5176231 5176236 +
tctattccctcattttccatca

SEQ ID NO: 75121 - DNA, 22 bp, Artificial Sequence
  Synthetic oligonucleotide; CTA chr11 5176218 5176239 5176235 5176240 +
ttccctcattttccatcatatt

SEQ ID NO: 75122 - DNA, 22 bp, Artificial Sequence
  Synthetic oligonucleotide; TTC chr11 5176221 5176242 5176238 5176243 +
cctcattttccatcatattatt

SEQ ID NO: 75123 - DNA, 22 bp, Artificial Sequence
  Synthetic oligonucleotide; CTC chr11 5176225 5176246 5176242 5176247 +
attttccatcatattattactt

SEQ ID NO: 75124 - DNA, 22 bp, Artificial Sequence
  Synthetic oligonucleotide; TTT chr11 5176229 5176250 5176246 5176251 +
tccatcatattattacttttat

SEQ ID NO: 75125 - DNA, 22 bp, Artificial Sequence
  Synthetic oligonucleotide; TTT chr11 5176230 5176251 5176247 5176252 +
ccatcatattattacttttatg

SEQ ID NO: 75126 - DNA, 22 bp, Artificial Sequence
  Synthetic oligonucleotide; TTC chr11 5176231 5176252 5176248 5176253 +
catcatattattacttttatgg

SEQ ID NO: 75127 - DNA, 22 bp, Artificial Sequence
  Synthetic oligonucleotide; TTA chr11 5176241 5176262 5176258 5176263 +
ttacttttatggagaaatgcaa

SEQ ID NO: 75128 - DNA, 22 bp, Artificial Sequence
  Synthetic oligonucleotide; TTA chr11 5176244 5176265 5176261 5176266 +
cttttatggagaaatgcaacgc

SEQ ID NO: 75129 - DNA, 22 bp, Artificial Sequence
  Synthetic oligonucleotide; CTT chr11 5176247 5176268 5176264 5176269 +
ttatggagaaatgcaacgctga

SEQ ID NO: 75130 - DNA, 22 bp, Artificial Sequence
  Synthetic oligonucleotide; TTT chr11 5176248 5176269 5176265 5176270 +
tatggagaaatgcaacgctgag

SEQ ID NO: 75131 - DNA, 22 bp, Artificial Sequence
  Synthetic oligonucleotide; TTT chr11 5176249 5176270 5176266 5176271 +
atggagaaatgcaacgctgagt

SEQ ID NO: 75132 - DNA, 22 bp, Artificial Sequence
  Synthetic oligonucleotide; TTA chr11 5176250 5176271 5176267 5176272 +
tggagaaatgcaacgctgagtg

SEQ ID NO: 75133 - DNA, 22 bp, Artificial Sequence
  Synthetic oligonucleotide; CTG chr11 5176268 5176289 5176285 5176290 +
agtgtaaatttcacattagaat

SEQ ID NO: 75134 - DNA, 22 bp, Artificial Sequence
  Synthetic oligonucleotide; TTT chr11 5176279 5176300 5176296 5176301 +
cacattagaatgtccaaaacat

SEQ ID NO: 75135 - DNA, 22 bp, Artificial Sequence
  Synthetic oligonucleotide; TTC chr11 5176280 5176301 5176297 5176302 +
acattagaatgtccaaaacatt

SEQ ID NO: 75136 - DNA, 22 bp, Artificial Sequence
  Synthetic oligonucleotide; TTA chr11 5176286 5176307 5176303 5176308 +
gaatgtccaaaacattgtgtag

SEQ ID NO: 75137 - DNA, 22 bp, Artificial Sequence
  Synthetic oligonucleotide; TTG chr11 5176303 5176324 5176320 5176325 +
tgtagagtagaaaaaaaaacta

SEQ ID NO: 75138 - DNA, 22 bp, Artificial Sequence
  Synthetic oligonucleotide; CTA chr11 5176325 5176346 5176342 5176347 +
tatgaagtttaacagatgtact

SEQ ID NO: 75139 - DNA, 22 bp, Artificial Sequence
  Synthetic oligonucleotide; TTT chr11 5176335 5176356 5176352 5176357 +
aacagatgtactgagaaatgca

SEQ ID NO: 75140 - DNA, 22 bp, Artificial Sequence
  Synthetic oligonucleotide; TTA chr11 5176336 5176357 5176353 5176358 +
acagatgtactgagaaatgcaa

SEQ ID NO: 75141 - DNA, 22 bp, Artificial Sequence
  Synthetic oligonucleotide; CTG chr11 5176348 5176369 5176365 5176370 +
agaaatgcaaatattttgaaga

SEQ ID NO: 75142 - DNA, 22 bp, Artificial Sequence
  Synthetic oligonucleotide; TTT chr11 5176364 5176385 5176381 5176386 +
tgaagacaattcaaaatagcac

SEQ ID NO: 75143 - DNA, 22 bp, Artificial Sequence
  Synthetic oligonucleotide; TTT chr11 5176365 5176386 5176382 5176387 +
gaagacaattcaaaatagcact

SEQ ID NO: 75144 - DNA, 22 bp, Artificial Sequence
  Synthetic oligonucleotide; TTG chr11 5176366 5176387 5176383 5176388 +
aagacaattcaaaatagcactt

SEQ ID NO: 75145 - DNA, 22 bp, Artificial Sequence
  Synthetic oligonucleotide; TTC chr11 5176376 5176397 5176393 5176398 +
aaaatagcacttaaatatttag

SEQ ID NO: 75146 - DNA, 22 bp, Artificial Sequence
  Synthetic oligonucleotide; CTT chr11 5176388 5176409 5176405 5176410 +
aaatatttagtgtagtactagc

SEQ ID NO: 75147 - DNA, 22 bp, Artificial Sequence
  Synthetic oligonucleotide; TTA chr11 5176389 5176410 5176406 5176411 +
aatatttagtgtagtactagca

SEQ ID NO: 75148 - DNA, 22 bp, Artificial Sequence
  Synthetic oligonucleotide; TTT chr11 5176396 5176417 5176413 5176418 +
agtgtagtactagcagaaacaa

SEQ ID NO: 75149 - DNA, 22 bp, Artificial Sequence
  Synthetic oligonucleotide; TTA chr11 5176397 5176418 5176414 5176419 +
gtgtagtactagcagaaacaaa

SEQ ID NO: 75150 - DNA, 22 bp, Artificial Sequence
  Synthetic oligonucleotide; CTA chr11 5176408 5176429 5176425 5176430 +
gcagaaacaaattaattagatt

SEQ ID NO: 75151 - DNA, 22 bp, Artificial Sequence
  Synthetic oligonucleotide; TTA chr11 5176422 5176443 5176439 5176444 +
attagattttttagaatgtttt

SEQ ID NO: 75152 - DNA, 22 bp, Artificial Sequence
  Synthetic oligonucleotide; TTA chr11 5176426 5176447 5176443 5176448 +
gattttttagaatgttttatgt

SEQ ID NO: 75153 - DNA, 22 bp, Artificial Sequence
  Synthetic oligonucleotide; TTT chr11 5176431 5176452 5176448 5176453 +
tttagaatgttttatgtattct

SEQ ID NO: 75154 - DNA, 22 bp, Artificial Sequence
  Synthetic oligonucleotide; TTT chr11 5176432 5176453 5176449 5176454 +
ttagaatgttttatgtattctc

SEQ ID NO: 75155 - DNA, 22 bp, Artificial Sequence
  Synthetic oligonucleotide; TTT chr11 5176433 5176454 5176450 5176455 +
tagaatgttttatgtattctcc

SEQ ID NO: 75156 - DNA, 22 bp, Artificial Sequence
  Synthetic oligonucleotide; TTT chr11 5176434 5176455 5176451 5176456 +
agaatgttttatgtattctccc

SEQ ID NO: 75157 - DNA, 22 bp, Artificial Sequence
  Synthetic oligonucleotide; TTA chr11 5176435 5176456 5176452 5176457 +
gaatgttttatgtattctccct

SEQ ID NO: 75158 - DNA, 22 bp, Artificial Sequence
  Synthetic oligonucleotide; TTT chr11 5176443 5176464 5176460 5176465 +
tatgtattctcccttcccaata

SEQ ID NO: 75159 - DNA, 22 bp, Artificial Sequence
  Synthetic oligonucleotide; TTT chr11 5176444 5176465 5176461 5176466 +
atgtattctcccttcccaataa

SEQ ID NO: 75160 - DNA, 22 bp, Artificial Sequence
  Synthetic oligonucleotide; TTA chr11 5176445 5176466 5176462 5176467 +
tgtattctcccttcccaataat

SEQ ID NO: 75161 - DNA, 22 bp, Artificial Sequence
  Synthetic oligonucleotide; TTC chr11 5176452 5176473 5176469 5176474 +
tcccttcccaataatggaaata

SEQ ID NO: 75162 - DNA, 22 bp, Artificial Sequence
  Synthetic oligonucleotide; CTC chr11 5176454 5176475 5176471 5176476 +
ccttcccaataatggaaatact

SEQ ID NO: 75163 - DNA, 22 bp, Artificial Sequence
  Synthetic oligonucleotide; CTT chr11 5176458 5176479 5176475 5176480 +
cccaataatggaaatactgtag

SEQ ID NO: 75164 - DNA, 22 bp, Artificial Sequence
  Synthetic oligonucleotide; TTC chr11 5176459 5176480 5176476 5176481 +
ccaataatggaaatactgtagg

SEQ ID NO: 75165 - DNA, 22 bp, Artificial Sequence
  Synthetic oligonucleotide; CTG chr11 5176477 5176498 5176494 5176499 +
taggaagtctatttctaacttt

SEQ ID NO: 75166 - DNA, 22 bp, Artificial Sequence
  Synthetic oligonucleotide; CTA chr11 5176488 5176509 5176505 5176510 +
tttctaactttcttattctttg

SEQ ID NO: 75167 - DNA, 22 bp, Artificial Sequence
  Synthetic oligonucleotide; TTT chr11 5176491 5176512 5176508 5176513 +
ctaactttcttattctttggtg

SEQ ID NO: 75168 - DNA, 22 bp, Artificial Sequence
  Synthetic oligonucleotide; TTC chr11 5176492 5176513 5176509 5176514 +
taactttcttattctttggtgc

SEQ ID NO: 75169 - DNA, 22 bp, Artificial Sequence
  Synthetic oligonucleotide; CTA chr11 5176494 5176515 5176511 5176516 +
actttcttattctttggtgcac

SEQ ID NO: 75170 - DNA, 22 bp, Artificial Sequence
  Synthetic oligonucleotide; CTT chr11 5176498 5176519 5176515 5176520 +
tcttattctttggtgcacaaac

SEQ ID NO: 75171 - DNA, 22 bp, Artificial Sequence
  Synthetic oligonucleotide; TTT chr11 5176499 5176520 5176516 5176521 +
cttattctttggtgcacaaacg

SEQ ID NO: 75172 - DNA, 22 bp, Artificial Sequence
  Synthetic oligonucleotide; TTC chr11 5176500 5176521 5176517 5176522 +
ttattctttggtgcacaaacgt

SEQ ID NO: 75173 - DNA, 22 bp, Artificial Sequence
  Synthetic oligonucleotide; CTT chr11 5176502 5176523 5176519 5176524 +
attctttggtgcacaaacgtgt

SEQ ID NO: 75174 - DNA, 22 bp, Artificial Sequence
  Synthetic oligonucleotide; TTA chr11 5176503 5176524 5176520 5176525 +
ttctttggtgcacaaacgtgtg

SEQ ID NO: 75175 - DNA, 22 bp, Artificial Sequence
  Synthetic oligonucleotide; TTC chr11 5176506 5176527 5176523 5176528 +
tttggtgcacaaacgtgtgtgt

SEQ ID NO: 75176 - DNA, 22 bp, Artificial Sequence
  Synthetic oligonucleotide; CTT chr11 5176508 5176529 5176525 5176530 +
tggtgcacaaacgtgtgtgtgt

SEQ ID NO: 75177 - DNA, 22 bp, Artificial Sequence
  Synthetic oligonucleotide; TTT chr11 5176509 5176530 5176526 5176531 +
ggtgcacaaacgtgtgtgtgtg

SEQ ID NO: 75178 - DNA, 22 bp, Artificial Sequence
  Synthetic oligonucleotide; TTG chr11 5176510 5176531 5176527 5176532 +
gtgcacaaacgtgtgtgtgtgt

SEQ ID NO: 75179 - DNA, 22 bp, Artificial Sequence
  Synthetic oligonucleotide; TTA chr11 5176618 5176639 5176635 5176640 +
agtgtgtgtatatgtaaatcta

SEQ ID NO: 75180 - DNA, 22 bp, Artificial Sequence
  Synthetic oligonucleotide; CTA chr11 5176640 5176661 5176657 5176662 +
agtgttaatacatgtataaatt

SEQ ID NO: 75181 - DNA, 22 bp, Artificial Sequence
  Synthetic oligonucleotide; TTA chr11 5176647 5176668 5176664 5176669 +
atacatgtataaatttctataa

SEQ ID NO: 75182 - DNA, 22 bp, Artificial Sequence
  Synthetic oligonucleotide; TTT chr11 5176663 5176684 5176680 5176685 +
ctataaaaatcacagaaaaagc

SEQ ID NO: 75183 - DNA, 22 bp, Artificial Sequence
  Synthetic oligonucleotide; TTC chr11 5176664 5176685 5176681 5176686 +
tataaaaatcacagaaaaagct

SEQ ID NO: 75184 - DNA, 22 bp, Artificial Sequence
  Synthetic oligonucleotide; CTA chr11 5176666 5176687 5176683 5176688 +
taaaaatcacagaaaaagctaa

SEQ ID NO: 75185 - DNA, 22 bp, Artificial Sequence
  Synthetic oligonucleotide; CTA chr11 5176687 5176708 5176704 5176709 +
agcataagccaagcatgagtag

SEQ ID NO: 75186 - DNA, 22 bp, Artificial Sequence
  Synthetic oligonucleotide; TTT chr11 5176713 5176734 5176730 5176735 +
caagtgtttaagatagtacctc

SEQ ID NO: 75187 - DNA, 22 bp, Artificial Sequence
  Synthetic oligonucleotide; TTC chr11 5176714 5176735 5176731 5176736 +
aagtgtttaagatagtacctca

SEQ ID NO: 75188 - DNA, 22 bp, Artificial Sequence
  Synthetic oligonucleotide; TTT chr11 5176722 5176743 5176739 5176744 +
aagatagtacctcagatttctc

SEQ ID NO: 75189 - DNA, 22 bp, Artificial Sequence
  Synthetic oligonucleotide; TTA chr11 5176723 5176744 5176740 5176745 +
agatagtacctcagatttctca

SEQ ID NO: 75190 - DNA, 22 bp, Artificial Sequence
  Synthetic oligonucleotide; CTC chr11 5176735 5176756 5176752 5176757 +
agatttctcaaagttttttttt

SEQ ID NO: 75191 - DNA, 22 bp, Artificial Sequence
  Synthetic oligonucleotide; TTT chr11 5176741 5176762 5176758 5176763 +
ctcaaagttttttttttgtctt

SEQ ID NO: 75192 - DNA, 22 bp, Artificial Sequence
  Synthetic oligonucleotide; TTC chr11 5176742 5176763 5176759 5176764 +
tcaaagttttttttttgtcttt

SEQ ID NO: 75193 - DNA, 22 bp, Artificial Sequence
  Synthetic oligonucleotide; CTC chr11 5176744 5176765 5176761 5176766 +
aaagttttttttttgtctttct

SEQ ID NO: 75194 - DNA, 22 bp, Artificial Sequence
  Synthetic oligonucleotide; TTT chr11 5176751 5176772 5176768 5176773 +
tttttttgtctttctttaggtg

SEQ ID NO: 75195 - DNA, 22 bp, Artificial Sequence
  Synthetic oligonucleotide; TTT chr11 5176752 5176773 5176769 5176774 +
ttttttgtctttctttaggtgt

SEQ ID NO: 75196 - DNA, 22 bp, Artificial Sequence
  Synthetic oligonucleotide; TTT chr11 5176753 5176774 5176770 5176775 +
tttttgtctttctttaggtgta

SEQ ID NO: 75197 - DNA, 22 bp, Artificial Sequence
  Synthetic oligonucleotide; TTT chr11 5176754 5176775 5176771 5176776 +
ttttgtctttctttaggtgtaa

SEQ ID NO: 75198 - DNA, 22 bp, Artificial Sequence
  Synthetic oligonucleotide; TTT chr11 5176755 5176776 5176772 5176777 +
tttgtctttctttaggtgtaaa

SEQ ID NO: 75199 - DNA, 22 bp, Artificial Sequence
  Synthetic oligonucleotide; TTT chr11 5176756 5176777 5176773 5176778 +
ttgtctttctttaggtgtaaat

SEQ ID NO: 75200 - DNA, 22 bp, Artificial Sequence
  Synthetic oligonucleotide; TTT chr11 5176757 5176778 5176774 5176779 +
tgtctttctttaggtgtaaata

SEQ ID NO: 75201 - DNA, 22 bp, Artificial Sequence
  Synthetic oligonucleotide; TTT chr11 5176758 5176779 5176775 5176780 +
gtctttctttaggtgtaaataa

SEQ ID NO: 75202 - DNA, 22 bp, Artificial Sequence
  Synthetic oligonucleotide; TTG chr11 5176759 5176780 5176776 5176781 +
tctttctttaggtgtaaataag

SEQ ID NO: 75203 - DNA, 22 bp, Artificial Sequence
  Synthetic oligonucleotide; CTT chr11 5176763 5176784 5176780 5176785 +
tctttaggtgtaaataaggtca

SEQ ID NO: 75204 - DNA, 22 bp, Artificial Sequence
  Synthetic oligonucleotide; TTT chr11 5176764 5176785 5176781 5176786 +
ctttaggtgtaaataaggtcat

SEQ ID NO: 75205 - DNA, 22 bp, Artificial Sequence
  Synthetic oligonucleotide; TTC chr11 5176765 5176786 5176782 5176787 +
tttaggtgtaaataaggtcatt

SEQ ID NO: 75206 - DNA, 22 bp, Artificial Sequence
  Synthetic oligonucleotide; CTT chr11 5176767 5176788 5176784 5176789 +
taggtgtaaataaggtcatttt

SEQ ID NO: 75207 - DNA, 22 bp, Artificial Sequence
  Synthetic oligonucleotide; TTT chr11 5176768 5176789 5176785 5176790 +
aggtgtaaataaggtcattttt

SEQ ID NO: 75208 - DNA, 22 bp, Artificial Sequence
  Synthetic oligonucleotide; TTA chr11 5176769 5176790 5176786 5176791 +
ggtgtaaataaggtcatttttt

SEQ ID NO: 75209 - DNA, 22 bp, Artificial Sequence
  Synthetic oligonucleotide; TTT chr11 5176788 5176809 5176805 5176810 +
tttaaacattctcatggcattg

SEQ ID NO: 75210 - DNA, 22 bp, Artificial Sequence
  Synthetic oligonucleotide; TTT chr11 5176789 5176810 5176806 5176811 +
ttaaacattctcatggcattgt

SEQ ID NO: 75211 - DNA, 22 bp, Artificial Sequence
  Synthetic oligonucleotide; TTT chr11 5176790 5176811 5176807 5176812 +
taaacattctcatggcattgtt

SEQ ID NO: 75212 - DNA, 22 bp, Artificial Sequence
  Synthetic oligonucleotide; TTT chr11 5176791 5176812 5176808 5176813 +
aaacattctcatggcattgttc

SEQ ID NO: 75213 - DNA, 22 bp, Artificial Sequence
  Synthetic oligonucleotide; TTA chr11 5176792 5176813 5176809 5176814 +
aacattctcatggcattgttct

SEQ ID NO: 75214 - DNA, 22 bp, Artificial Sequence
  Synthetic oligonucleotide; TTC chr11 5176799 5176820 5176816 5176821 +
tcatggcattgttctaggcttt

SEQ ID NO: 75215 - DNA, 22 bp, Artificial Sequence
  Synthetic oligonucleotide; CTC chr11 5176801 5176822 5176818 5176823 +
atggcattgttctaggctttta

SEQ ID NO: 75216 - DNA, 22 bp, Artificial Sequence
  Synthetic oligonucleotide; TTG chr11 5176810 5176831 5176827 5176832 +
ttctaggcttttaagaaggaga

SEQ ID NO: 75217 - DNA, 22 bp, Artificial Sequence
  Synthetic oligonucleotide; TTC chr11 5176813 5176834 5176830 5176835 +
taggcttttaagaaggagagat

SEQ ID NO: 75218 - DNA, 22 bp, Artificial Sequence
  Synthetic oligonucleotide; CTA chr11 5176815 5176836 5176832 5176837 +
ggcttttaagaaggagagattg

SEQ ID NO: 75219 - DNA, 22 bp, Artificial Sequence
  Synthetic oligonucleotide; CTT chr11 5176820 5176841 5176837 5176842 +
ttaagaaggagagattgtaaaa

SEQ ID NO: 75220 - DNA, 22 bp, Artificial Sequence
  Synthetic oligonucleotide; TTT chr11 5176821 5176842 5176838 5176843 +
taagaaggagagattgtaaaaa

SEQ ID NO: 75221 - DNA, 22 bp, Artificial Sequence
  Synthetic oligonucleotide; TTT chr11 5176822 5176843 5176839 5176844 +
aagaaggagagattgtaaaaat

SEQ ID NO: 75222 - DNA, 22 bp, Artificial Sequence
  Synthetic oligonucleotide; TTA chr11 5176823 5176844 5176840 5176845 +
agaaggagagattgtaaaaatt

SEQ ID NO: 75223 - DNA, 22 bp, Artificial Sequence
  Synthetic oligonucleotide; TTG chr11 5176837 5176858 5176854 5176859 +
taaaaatttgtattgatgtgaa

SEQ ID NO: 75224 - DNA, 22 bp, Artificial Sequence
  Synthetic oligonucleotide; TTT chr11 5176846 5176867 5176863 5176868 +
gtattgatgtgaagggattaag

SEQ ID NO: 75225 - DNA, 22 bp, Artificial Sequence
  Synthetic oligonucleotide; TTG chr11 5176847 5176868 5176864 5176869 +
tattgatgtgaagggattaagg

SEQ ID NO: 75226 - DNA, 22 bp, Artificial Sequence
  Synthetic oligonucleotide; TTG chr11 5176852 5176873 5176869 5176874 +
atgtgaagggattaaggtatag

SEQ ID NO: 75227 - DNA, 22 bp, Artificial Sequence
  Synthetic oligonucleotide; TTA chr11 5176866 5176887 5176883 5176888 +
aggtatagtctgtagataatat

SEQ ID NO: 75228 - DNA, 22 bp, Artificial Sequence
  Synthetic oligonucleotide; CTG chr11 5176878 5176899 5176895 5176900 +
tagataatatcatagataatta

SEQ ID NO: 75229 - DNA, 22 bp, Artificial Sequence
  Synthetic oligonucleotide; TTA chr11 5176900 5176921 5176917 5176922 +
cttttgctgggattacattctt

SEQ ID NO: 75230 - DNA, 22 bp, Artificial Sequence
  Synthetic oligonucleotide; CTT chr11 5176903 5176924 5176920 5176925 +
ttgctgggattacattcttttt

SEQ ID NO: 75231 - DNA, 22 bp, Artificial Sequence
  Synthetic oligonucleotide; TTT chr11 5176904 5176925 5176921 5176926 +
tgctgggattacattctttttt

SEQ ID NO: 75232 - DNA, 22 bp, Artificial Sequence
  Synthetic oligonucleotide; TTT chr11 5176905 5176926 5176922 5176927 +
gctgggattacattctttttta

SEQ ID NO: 75233 - DNA, 22 bp, Artificial Sequence
  Synthetic oligonucleotide; TTG chr11 5176906 5176927 5176923 5176928 +
ctgggattacattcttttttat

SEQ ID NO: 75234 - DNA, 22 bp, Artificial Sequence
  Synthetic oligonucleotide; CTG chr11 5176909 5176930 5176926 5176931 +
ggattacattcttttttattta

SEQ ID NO: 75235 - DNA, 22 bp, Artificial Sequence
  Synthetic oligonucleotide; TTA chr11 5176915 5176936 5176932 5176937 +
cattcttttttatttaagtttc

SEQ ID NO: 75236 - DNA, 22 bp, Artificial Sequence
  Synthetic oligonucleotide; TTC chr11 5176920 5176941 5176937 5176942 +
ttttttatttaagtttcttgga

SEQ ID NO: 75237 - DNA, 22 bp, Artificial Sequence
  Synthetic oligonucleotide; CTT chr11 5176922 5176943 5176939 5176944 +
ttttatttaagtttcttggaaa

SEQ ID NO: 75238 - DNA, 22 bp, Artificial Sequence
  Synthetic oligonucleotide; TTT chr11 5176923 5176944 5176940 5176945 +
tttatttaagtttcttggaaaa

SEQ ID NO: 75239 - DNA, 22 bp, Artificial Sequence
  Synthetic oligonucleotide; TTT chr11 5176924 5176945 5176941 5176946 +
ttatttaagtttcttggaaaat

SEQ ID NO: 75240 - DNA, 22 bp, Artificial Sequence
  Synthetic oligonucleotide; TTT chr11 5176925 5176946 5176942 5176947 +
tatttaagtttcttggaaaata

SEQ ID NO: 75241 - DNA, 22 bp, Artificial Sequence
  Synthetic oligonucleotide; TTT chr11 5176926 5176947 5176943 5176948 +
atttaagtttcttggaaaatat

SEQ ID NO: 75242 - DNA, 22 bp, Artificial Sequence
  Synthetic oligonucleotide; TTA chr11 5176927 5176948 5176944 5176949 +
tttaagtttcttggaaaatatt

SEQ ID NO: 75243 - DNA, 22 bp, Artificial Sequence
  Synthetic oligonucleotide; TTT chr11 5176930 5176951 5176947 5176952 +
aagtttcttggaaaatattctc

SEQ ID NO: 75244 - DNA, 22 bp, Artificial Sequence
  Synthetic oligonucleotide; TTA chr11 5176931 5176952 5176948 5176953 +
agtttcttggaaaatattctcc

SEQ ID NO: 75245 - DNA, 22 bp, Artificial Sequence
  Synthetic oligonucleotide; TTT chr11 5176936 5176957 5176953 5176958 +
cttggaaaatattctccttaat

SEQ ID NO: 75246 - DNA, 22 bp, Artificial Sequence
  Synthetic oligonucleotide; TTC chr11 5176937 5176958 5176954 5176959 +
ttggaaaatattctccttaatc

SEQ ID NO: 75247 - DNA, 22 bp, Artificial Sequence
  Synthetic oligonucleotide; CTT chr11 5176939 5176960 5176956 5176961 +
ggaaaatattctccttaatctt

SEQ ID NO: 75248 - DNA, 22 bp, Artificial Sequence
  Synthetic oligonucleotide; TTG chr11 5176940 5176961 5176957 5176962 +
gaaaatattctccttaatcttc

SEQ ID NO: 75249 - DNA, 22 bp, Artificial Sequence
  Synthetic oligonucleotide; TTC chr11 5176950 5176971 5176967 5176972 +
tccttaatcttctctagctttt

SEQ ID NO: 75250 - DNA, 22 bp, Artificial Sequence
  Synthetic oligonucleotide; CTC chr11 5176952 5176973 5176969 5176974 +
cttaatcttctctagcttttta

SEQ ID NO: 75251 - DNA, 22 bp, Artificial Sequence
  Synthetic oligonucleotide; CTT chr11 5176955 5176976 5176972 5176977 +
aatcttctctagctttttaaaa

SEQ ID NO: 75252 - DNA, 22 bp, Artificial Sequence
  Synthetic oligonucleotide; TTA chr11 5176956 5176977 5176973 5176978 +
atcttctctagctttttaaaaa

SEQ ID NO: 75253 - DNA, 22 bp, Artificial Sequence
  Synthetic oligonucleotide; CTT chr11 5176961 5176982 5176978 5176983 +
ctctagctttttaaaaaatgtt

SEQ ID NO: 75254 - DNA, 22 bp, Artificial Sequence
  Synthetic oligonucleotide; TTC chr11 5176962 5176983 5176979 5176984 +
tctagctttttaaaaaatgttt

SEQ ID NO: 75255 - DNA, 22 bp, Artificial Sequence
  Synthetic oligonucleotide; CTC chr11 5176964 5176985 5176981 5176986 +
tagctttttaaaaaatgtttat

SEQ ID NO: 75256 - DNA, 22 bp, Artificial Sequence
  Synthetic oligonucleotide; CTA chr11 5176966 5176987 5176983 5176988 +
gctttttaaaaaatgtttattt

SEQ ID NO: 75257 - DNA, 22 bp, Artificial Sequence
  Synthetic oligonucleotide; CTT chr11 5176970 5176991 5176987 5176992 +
tttaaaaaatgtttattttaaa

SEQ ID NO: 75258 - DNA, 22 bp, Artificial Sequence
  Synthetic oligonucleotide; TTT chr11 5176971 5176992 5176988 5176993 +
ttaaaaaatgtttattttaaaa

SEQ ID NO: 75259 - DNA, 22 bp, Artificial Sequence
  Synthetic oligonucleotide; TTT chr11 5176972 5176993 5176989 5176994 +
taaaaaatgtttattttaaaaa

SEQ ID NO: 75260 - DNA, 22 bp, Artificial Sequence
  Synthetic oligonucleotide; TTT chr11 5176973 5176994 5176990 5176995 +
aaaaaatgtttattttaaaaat

SEQ ID NO: 75261 - DNA, 22 bp, Artificial Sequence
  Synthetic oligonucleotide; TTA chr11 5176974 5176995 5176991 5176996 +
aaaaatgtttattttaaaaatt

SEQ ID NO: 75262 - DNA, 22 bp, Artificial Sequence
  Synthetic oligonucleotide; TTT chr11 5176984 5177005 5177001 5177006 +
attttaaaaatttatttatcac

SEQ ID NO: 75263 - DNA, 22 bp, Artificial Sequence
  Synthetic oligonucleotide; TTA chr11 5176985 5177006 5177002 5177007 +
ttttaaaaatttatttatcacc

SEQ ID NO: 75264 - DNA, 22 bp, Artificial Sequence
  Synthetic oligonucleotide; TTT chr11 5176988 5177009 5177005 5177010 +
taaaaatttatttatcacccag

SEQ ID NO: 75265 - DNA, 22 bp, Artificial Sequence
  Synthetic oligonucleotide; TTT chr11 5176989 5177010 5177006 5177011 +
aaaaatttatttatcacccagg

SEQ ID NO: 75266 - DNA, 22 bp, Artificial Sequence
  Synthetic oligonucleotide; TTA chr11 5176990 5177011 5177007 5177012 +
aaaatttatttatcacccaggt

SEQ ID NO: 75267 - DNA, 22 bp, Artificial Sequence
  Synthetic oligonucleotide; TTT chr11 5176997 5177018 5177014 5177019 +
atttatcacccaggtatagaaa

SEQ ID NO: 75268 - DNA, 22 bp, Artificial Sequence
  Synthetic oligonucleotide; TTA chr11 5176998 5177019 5177015 5177020 +
tttatcacccaggtatagaaat

SEQ ID NO: 75269 - DNA, 22 bp, Artificial Sequence
  Synthetic oligonucleotide; TTT chr11 5177001 5177022 5177018 5177023 +
atcacccaggtatagaaatttt

SEQ ID NO: 75270 - DNA, 22 bp, Artificial Sequence
  Synthetic oligonucleotide; TTA chr11 5177002 5177023 5177019 5177024 +
tcacccaggtatagaaattttc

SEQ ID NO: 75271 - DNA, 22 bp, Artificial Sequence
  Synthetic oligonucleotide; TTT chr11 5177022 5177043 5177039 5177044 +
tcaatcattttacttcttcagt

SEQ ID NO: 75272 - DNA, 22 bp, Artificial Sequence
  Synthetic oligonucleotide; TTT chr11 5177023 5177044 5177040 5177045 +
caatcattttacttcttcagtg

SEQ ID NO: 75273 - DNA, 22 bp, Artificial Sequence
  Synthetic oligonucleotide; TTC chr11 5177024 5177045 5177041 5177046 +
aatcattttacttcttcagtga

SEQ ID NO: 75274 - DNA, 22 bp, Artificial Sequence
  Synthetic oligonucleotide; TTT chr11 5177032 5177053 5177049 5177054 +
tacttcttcagtgatgtttctg

SEQ ID NO: 75275 - DNA, 22 bp, Artificial Sequence
  Synthetic oligonucleotide; TTT chr11 5177033 5177054 5177050 5177055 +
acttcttcagtgatgtttctgt

SEQ ID NO: 75276 - DNA, 22 bp, Artificial Sequence
  Synthetic oligonucleotide; TTA chr11 5177034 5177055 5177051 5177056 +
cttcttcagtgatgtttctgtt

SEQ ID NO: 75277 - DNA, 22 bp, Artificial Sequence
  Synthetic oligonucleotide; CTT chr11 5177037 5177058 5177054 5177059 +
cttcagtgatgtttctgttgat

SEQ ID NO: 75278 - DNA, 22 bp, Artificial Sequence
  Synthetic oligonucleotide; TTC chr11 5177038 5177059 5177055 5177060 +
ttcagtgatgtttctgttgatg

SEQ ID NO: 75279 - DNA, 22 bp, Artificial Sequence
  Synthetic oligonucleotide; CTT chr11 5177040 5177061 5177057 5177062 +
cagtgatgtttctgttgatgcc

SEQ ID NO: 75280 - DNA, 22 bp, Artificial Sequence
  Synthetic oligonucleotide; TTC chr11 5177041 5177062 5177058 5177063 +
agtgatgtttctgttgatgcca

SEQ ID NO: 75281 - DNA, 22 bp, Artificial Sequence
  Synthetic oligonucleotide; TTT chr11 5177051 5177072 5177068 5177073 +
ctgttgatgccatgatgctcca

SEQ ID NO: 75282 - DNA, 22 bp, Artificial Sequence
  Synthetic oligonucleotide; TTC chr11 5177052 5177073 5177069 5177074 +
tgttgatgccatgatgctccat

SEQ ID NO: 75283 - DNA, 22 bp, Artificial Sequence
  Synthetic oligonucleotide; CTG chr11 5177054 5177075 5177071 5177076 +
ttgatgccatgatgctccattg

SEQ ID NO: 75284 - DNA, 22 bp, Artificial Sequence
  Synthetic oligonucleotide; TTG chr11 5177057 5177078 5177074 5177079 +
atgccatgatgctccattgatg

SEQ ID NO: 75285 - DNA, 22 bp, Artificial Sequence
  Synthetic oligonucleotide; CTC chr11 5177071 5177092 5177088 5177093 +
cattgatgacttgggtctaaaa

SEQ ID NO: 75286 - DNA, 22 bp, Artificial Sequence
  Synthetic oligonucleotide; TTG chr11 5177076 5177097 5177093 5177098 +
atgacttgggtctaaaatctcc

SEQ ID NO: 75287 - DNA, 22 bp, Artificial Sequence
  Synthetic oligonucleotide; CTT chr11 5177083 5177104 5177100 5177105 +
gggtctaaaatctccactatag

SEQ ID NO: 75288 - DNA, 22 bp, Artificial Sequence
  Synthetic oligonucleotide; TTG chr11 5177084 5177105 5177101 5177106 +
ggtctaaaatctccactatagg

SEQ ID NO: 75289 - DNA, 22 bp, Artificial Sequence
  Synthetic oligonucleotide; CTA chr11 5177090 5177111 5177107 5177112 +
aaatctccactatagggggaaa

SEQ ID NO: 75290 - DNA, 22 bp, Artificial Sequence
  Synthetic oligonucleotide; CTC chr11 5177097 5177118 5177114 5177119 +
cactatagggggaaatgtgtat

SEQ ID NO: 75291 - DNA, 22 bp, Artificial Sequence
  Synthetic oligonucleotide; CTA chr11 5177102 5177123 5177119 5177124 +
tagggggaaatgtgtatcagat

SEQ ID NO: 75292 - DNA, 22 bp, Artificial Sequence
  Synthetic oligonucleotide; TTT chr11 5177126 5177147 5177143 5177148 +
tacatcatccaggcaatctcat

SEQ ID NO: 75293 - DNA, 22 bp, Artificial Sequence
  Synthetic oligonucleotide; TTT chr11 5177127 5177148 5177144 5177149 +
acatcatccaggcaatctcata

SEQ ID NO: 75294 - DNA, 22 bp, Artificial Sequence
  Synthetic oligonucleotide; TTA chr11 5177128 5177149 5177145 5177150 +
catcatccaggcaatctcatat

SEQ ID NO: 75295 - DNA, 22 bp, Artificial Sequence
  Synthetic oligonucleotide; CTC chr11 5177146 5177167 5177163 5177168 +
atatttgttaatttaatattgg

SEQ ID NO: 75296 - DNA, 22 bp, Artificial Sequence
  Synthetic oligonucleotide; TTT chr11 5177152 5177173 5177169 5177174 +
gttaatttaatattggttatta

SEQ ID NO: 75297 - DNA, 22 bp, Artificial Sequence
  Synthetic oligonucleotide; TTG chr11 5177153 5177174 5177170 5177175 +
ttaatttaatattggttattat

SEQ ID NO: 75298 - DNA, 22 bp, Artificial Sequence
  Synthetic oligonucleotide; TTA chr11 5177156 5177177 5177173 5177178 +
atttaatattggttattatttg

SEQ ID NO: 75299 - DNA, 22 bp, Artificial Sequence
  Synthetic oligonucleotide; TTT chr11 5177160 5177181 5177177 5177182 +
aatattggttattatttgcttt

SEQ ID NO: 75300 - DNA, 22 bp, Artificial Sequence
  Synthetic oligonucleotide; TTA chr11 5177161 5177182 5177178 5177183 +
atattggttattatttgcttta

SEQ ID NO: 75301 - DNA, 22 bp, Artificial Sequence
  Synthetic oligonucleotide; TTG chr11 5177167 5177188 5177184 5177189 +
gttattatttgctttaattcac

SEQ ID NO: 75302 - DNA, 22 bp, Artificial Sequence
  Synthetic oligonucleotide; TTA chr11 5177171 5177192 5177188 5177193 +
ttatttgctttaattcactatt

SEQ ID NO: 75303 - DNA, 22 bp, Artificial Sequence
  Synthetic oligonucleotide; TTA chr11 5177174 5177195 5177191 5177196 +
tttgctttaattcactattatt

SEQ ID NO: 75304 - DNA, 22 bp, Artificial Sequence
  Synthetic oligonucleotide; TTT chr11 5177177 5177198 5177194 5177199 +
gctttaattcactattattcac

SEQ ID NO: 75305 - DNA, 22 bp, Artificial Sequence
  Synthetic oligonucleotide; TTG chr11 5177178 5177199 5177195 5177200 +
ctttaattcactattattcact

SEQ ID NO: 75306 - DNA, 22 bp, Artificial Sequence
  Synthetic oligonucleotide; CTT chr11 5177181 5177202 5177198 5177203 +
taattcactattattcacttgt

SEQ ID NO: 75307 - DNA, 22 bp, Artificial Sequence
  Synthetic oligonucleotide; TTT chr11 5177182 5177203 5177199 5177204 +
aattcactattattcacttgtt

SEQ ID NO: 75308 - DNA, 22 bp, Artificial Sequence
  Synthetic oligonucleotide; TTA chr11 5177183 5177204 5177200 5177205 +
attcactattattcacttgttg

SEQ ID NO: 75309 - DNA, 22 bp, Artificial Sequence
  Synthetic oligonucleotide; TTC chr11 5177187 5177208 5177204 5177209 +
actattattcacttgttgaata

SEQ ID NO: 75310 - DNA, 22 bp, Artificial Sequence
  Synthetic oligonucleotide; CTA chr11 5177191 5177212 5177208 5177213 +
ttattcacttgttgaatacata

SEQ ID NO: 75311 - DNA, 22 bp, Artificial Sequence
  Synthetic oligonucleotide; TTA chr11 5177194 5177215 5177211 5177216 +
ttcacttgttgaatacatatgt

SEQ ID NO: 75312 - DNA, 22 bp, Artificial Sequence
  Synthetic oligonucleotide; TTC chr11 5177197 5177218 5177214 5177219 +
acttgttgaatacatatgtatt

SEQ ID NO: 75313 - DNA, 22 bp, Artificial Sequence
  Synthetic oligonucleotide; CTT chr11 5177201 5177222 5177218 5177223 +
gttgaatacatatgtattatgt

SEQ ID NO: 75314 - DNA, 22 bp, Artificial Sequence
  Synthetic oligonucleotide; TTG chr11 5177202 5177223 5177219 5177224 +
ttgaatacatatgtattatgtg

SEQ ID NO: 75315 - DNA, 22 bp, Artificial Sequence
  Synthetic oligonucleotide; TTG chr11 5177205 5177226 5177222 5177227 +
aatacatatgtattatgtgtct

SEQ ID NO: 75316 - DNA, 22 bp, Artificial Sequence
  Synthetic oligonucleotide; TTA chr11 5177220 5177241 5177237 5177242 +
tgtgtctattccatacaagaga

SEQ ID NO: 75317 - DNA, 22 bp, Artificial Sequence
  Synthetic oligonucleotide; CTA chr11 5177228 5177249 5177245 5177250 +
ttccatacaagagactttgtga

SEQ ID NO: 75318 - DNA, 22 bp, Artificial Sequence
  Synthetic oligonucleotide; TTC chr11 5177231 5177252 5177248 5177253 +
catacaagagactttgtgagat

SEQ ID NO: 75319 - DNA, 22 bp, Artificial Sequence
  Synthetic oligonucleotide; CTT chr11 5177245 5177266 5177262 5177267 +
tgtgagatgtcagtgagttaga

SEQ ID NO: 75320 - DNA, 22 bp, Artificial Sequence
  Synthetic oligonucleotide; TTT chr11 5177246 5177267 5177263 5177268 +
gtgagatgtcagtgagttagaa

SEQ ID NO: 75321 - DNA, 22 bp, Artificial Sequence
  Synthetic oligonucleotide; TTG chr11 5177247 5177268 5177264 5177269 +
tgagatgtcagtgagttagaaa

SEQ ID NO: 75322 - DNA, 22 bp, Artificial Sequence
  Synthetic oligonucleotide; TTA chr11 5177265 5177286 5177282 5177287 +
gaaaatattctagggataacat

SEQ ID NO: 75323 - DNA, 22 bp, Artificial Sequence
  Synthetic oligonucleotide; TTC chr11 5177275 5177296 5177292 5177297 +
tagggataacattttaacttaa

SEQ ID NO: 75324 - DNA, 22 bp, Artificial Sequence
  Synthetic oligonucleotide; CTA chr11 5177277 5177298 5177294 5177299 +
gggataacattttaacttaagt

SEQ ID NO: 75325 - DNA, 22 bp, Artificial Sequence
  Synthetic oligonucleotide; TTT chr11 5177289 5177310 5177306 5177311 +
taacttaagtaacaggtgttga

SEQ ID NO: 75326 - DNA, 22 bp, Artificial Sequence
  Synthetic oligonucleotide; TTT chr11 5177290 5177311 5177307 5177312 +
aacttaagtaacaggtgttgac

SEQ ID NO: 75327 - DNA, 22 bp, Artificial Sequence
  Synthetic oligonucleotide; TTA chr11 5177291 5177312 5177308 5177313 +
acttaagtaacaggtgttgaca

SEQ ID NO: 75328 - DNA, 22 bp, Artificial Sequence
  Synthetic oligonucleotide; CTT chr11 5177295 5177316 5177312 5177317 +
aagtaacaggtgttgacaaaaa

SEQ ID NO: 75329 - DNA, 22 bp, Artificial Sequence
  Synthetic oligonucleotide; TTA chr11 5177296 5177317 5177313 5177318 +
agtaacaggtgttgacaaaaat

SEQ ID NO: 75330 - DNA, 22 bp, Artificial Sequence
  Synthetic oligonucleotide; TTG chr11 5177310 5177331 5177327 5177332 +
acaaaaataatattatggcttc

SEQ ID NO: 75331 - DNA, 22 bp, Artificial Sequence
  Synthetic oligonucleotide; TTA chr11 5177325 5177346 5177342 5177347 +
tggcttcatgttattggttcaa

SEQ ID NO: 75332 - DNA, 22 bp, Artificial Sequence
  Synthetic oligonucleotide; CTT chr11 5177331 5177352 5177348 5177353 +
catgttattggttcaagtctct

SEQ ID NO: 75333 - DNA, 22 bp, Artificial Sequence
  Synthetic oligonucleotide; TTC chr11 5177332 5177353 5177349 5177354 +
atgttattggttcaagtctctg

SEQ ID NO: 75334 - DNA, 22 bp, Artificial Sequence
  Synthetic oligonucleotide; TTA chr11 5177338 5177359 5177355 5177360 +
ttggttcaagtctctgcagagt

SEQ ID NO: 75335 - DNA, 22 bp, Artificial Sequence
  Synthetic oligonucleotide; TTG chr11 5177341 5177362 5177358 5177363 +
gttcaagtctctgcagagtaca

SEQ ID NO: 75336 - DNA, 22 bp, Artificial Sequence
  Synthetic oligonucleotide; TTC chr11 5177345 5177366 5177362 5177367 +
aagtctctgcagagtacagcgg

SEQ ID NO: 75337 - DNA, 22 bp, Artificial Sequence
  Synthetic oligonucleotide; CTC chr11 5177352 5177373 5177369 5177374 +
tgcagagtacagcgggagtgtt

SEQ ID NO: 75338 - DNA, 22 bp, Artificial Sequence
  Synthetic oligonucleotide; CTG chr11 5177354 5177375 5177371 5177376 +
cagagtacagcgggagtgttgt

SEQ ID NO: 75339 - DNA, 22 bp, Artificial Sequence
  Synthetic oligonucleotide; TTG chr11 5177375 5177396 5177392 5177397 +
tacatttcagcagaatttcaga

SEQ ID NO: 75340 - DNA, 22 bp, Artificial Sequence
  Synthetic oligonucleotide; TTT chr11 5177382 5177403 5177399 5177404 +
cagcagaatttcagactgacta

SEQ ID NO: 75341 - DNA, 22 bp, Artificial Sequence
  Synthetic oligonucleotide; TTC chr11 5177383 5177404 5177400 5177405 +
agcagaatttcagactgactat

SEQ ID NO: 75342 - DNA, 22 bp, Artificial Sequence
  Synthetic oligonucleotide; TTT chr11 5177393 5177414 5177410 5177415 +
cagactgactataaaaagccca

SEQ ID NO: 75343 - DNA, 22 bp, Artificial Sequence
  Synthetic oligonucleotide; TTC chr11 5177394 5177415 5177411 5177416 +
agactgactataaaaagcccag

SEQ ID NO: 75344 - DNA, 22 bp, Artificial Sequence
  Synthetic oligonucleotide; CTG chr11 5177400 5177421 5177417 5177422 +
actataaaaagcccagtgactg

SEQ ID NO: 75345 - DNA, 22 bp, Artificial Sequence
  Synthetic oligonucleotide; CTA chr11 5177404 5177425 5177421 5177426 +
taaaaagcccagtgactgactc

SEQ ID NO: 75346 - DNA, 22 bp, Artificial Sequence
  Synthetic oligonucleotide; CTG chr11 5177422 5177443 5177439 5177444 +
actcaaaaccccacttcctagc

SEQ ID NO: 75347 - DNA, 22 bp, Artificial Sequence
  Synthetic oligonucleotide; CTC chr11 5177426 5177447 5177443 5177448 +
aaaaccccacttcctagctcta

SEQ ID NO: 75348 - DNA, 22 bp, Artificial Sequence
  Synthetic oligonucleotide; CTT chr11 5177438 5177459 5177455 5177460 +
cctagctctacgtaggaaaagt

SEQ ID NO: 75349 - DNA, 22 bp, Artificial Sequence
  Synthetic oligonucleotide; TTC chr11 5177439 5177460 5177456 5177461 +
ctagctctacgtaggaaaagtc

SEQ ID NO: 75350 - DNA, 22 bp, Artificial Sequence
  Synthetic oligonucleotide; CTA chr11 5177442 5177463 5177459 5177464 +
gctctacgtaggaaaagtcaat

SEQ ID NO: 75351 - DNA, 22 bp, Artificial Sequence
  Synthetic oligonucleotide; CTC chr11 5177446 5177467 5177463 5177468 +
tacgtaggaaaagtcaatctgg

SEQ ID NO: 75352 - DNA, 22 bp, Artificial Sequence
  Synthetic oligonucleotide; CTA chr11 5177448 5177469 5177465 5177470 +
cgtaggaaaagtcaatctggat

SEQ ID NO: 75353 - DNA, 22 bp, Artificial Sequence
  Synthetic oligonucleotide; CTG chr11 5177467 5177488 5177484 5177489 +
gattaaaccctaaaatatattt

SEQ ID NO: 75354 - DNA, 22 bp, Artificial Sequence
  Synthetic oligonucleotide; TTA chr11 5177472 5177493 5177489 5177494 +
aaccctaaaatatatttctctt

SEQ ID NO: 75355 - DNA, 22 bp, Artificial Sequence
  Synthetic oligonucleotide; CTA chr11 5177479 5177500 5177496 5177501 +
aaatatatttctcttttctcga

SEQ ID NO: 75356 - DNA, 22 bp, Artificial Sequence
  Synthetic oligonucleotide; TTT chr11 5177489 5177510 5177506 5177511 +
ctcttttctcgattatctttat

SEQ ID NO: 75357 - DNA, 22 bp, Artificial Sequence
  Synthetic oligonucleotide; TTC chr11 5177490 5177511 5177507 5177512 +
tcttttctcgattatctttata

SEQ ID NO: 75358 - DNA, 22 bp, Artificial Sequence
  Synthetic oligonucleotide; CTC chr11 5177492 5177513 5177509 5177514 +
ttttctcgattatctttatata

SEQ ID NO: 75359 - DNA, 22 bp, Artificial Sequence
  Synthetic oligonucleotide; CTT chr11 5177494 5177515 5177511 5177516 +
ttctcgattatctttatatatt

SEQ ID NO: 75360 - DNA, 22 bp, Artificial Sequence
  Synthetic oligonucleotide; TTT chr11 5177495 5177516 5177512 5177517 +
tctcgattatctttatatattt

SEQ ID NO: 75361 - DNA, 22 bp, Artificial Sequence
  Synthetic oligonucleotide; TTT chr11 5177496 5177517 5177513 5177518 +
ctcgattatctttatatatttt

SEQ ID NO: 75362 - DNA, 22 bp, Artificial Sequence
  Synthetic oligonucleotide; TTC chr11 5177497 5177518 5177514 5177519 +
tcgattatctttatatattttt

SEQ ID NO: 75363 - DNA, 22 bp, Artificial Sequence
  Synthetic oligonucleotide; CTC chr11 5177499 5177520 5177516 5177521 +
gattatctttatatatttttaa

SEQ ID NO: 75364 - DNA, 22 bp, Artificial Sequence
  Synthetic oligonucleotide; TTA chr11 5177504 5177525 5177521 5177526 +
tctttatatatttttaagttaa

SEQ ID NO: 75365 - DNA, 22 bp, Artificial Sequence
  Synthetic oligonucleotide; CTT chr11 5177508 5177529 5177525 5177530 +
tatatatttttaagttaaaatt

SEQ ID NO: 75366 - DNA, 22 bp, Artificial Sequence
  Synthetic oligonucleotide; TTT chr11 5177509 5177530 5177526 5177531 +
atatatttttaagttaaaattc

SEQ ID NO: 75367 - DNA, 22 bp, Artificial Sequence
  Synthetic oligonucleotide; TTA chr11 5177510 5177531 5177527 5177532 +
tatatttttaagttaaaattca

SEQ ID NO: 75368 - DNA, 22 bp, Artificial Sequence
  Synthetic oligonucleotide; TTT chr11 5177517 5177538 5177534 5177539 +
ttaagttaaaattcatgaaaat

SEQ ID NO: 75369 - DNA, 22 bp, Artificial Sequence
  Synthetic oligonucleotide; TTT chr11 5177518 5177539 5177535 5177540 +
taagttaaaattcatgaaaata

SEQ ID NO: 75370 - DNA, 22 bp, Artificial Sequence
  Synthetic oligonucleotide; TTT chr11 5177519 5177540 5177536 5177541 +
aagttaaaattcatgaaaatag

SEQ ID NO: 75371 - DNA, 22 bp, Artificial Sequence
  Synthetic oligonucleotide; TTA chr11 5177520 5177541 5177537 5177542 +
agttaaaattcatgaaaatagt

SEQ ID NO: 75372 - DNA, 22 bp, Artificial Sequence
  Synthetic oligonucleotide; TTA chr11 5177525 5177546 5177542 5177547 +
aaattcatgaaaatagtatttc

SEQ ID NO: 75373 - DNA, 22 bp, Artificial Sequence
  Synthetic oligonucleotide; TTC chr11 5177531 5177552 5177548 5177553 +
atgaaaatagtatttctgaaaa

SEQ ID NO: 75374 - DNA, 22 bp, Artificial Sequence
  Synthetic oligonucleotide; TTT chr11 5177546 5177567 5177563 5177568 +
ctgaaaaaatggagaatttcat

SEQ ID NO: 75375 - DNA, 22 bp, Artificial Sequence
  Synthetic oligonucleotide; TTC chr11 5177547 5177568 5177564 5177569 +
tgaaaaaatggagaatttcatt

SEQ ID NO: 75376 - DNA, 22 bp, Artificial Sequence
  Synthetic oligonucleotide; CTG chr11 5177549 5177570 5177566 5177571 +
aaaaaatggagaatttcattaa

SEQ ID NO: 75377 - DNA, 22 bp, Artificial Sequence
  Synthetic oligonucleotide; TTT chr11 5177565 5177586 5177582 5177587 +
cattaaagtattttttttttca

SEQ ID NO: 75378 - DNA, 22 bp, Artificial Sequence
  Synthetic oligonucleotide; TTC chr11 5177566 5177587 5177583 5177588 +
attaaagtattttttttttcaa

SEQ ID NO: 75379 - DNA, 22 bp, Artificial Sequence
  Synthetic oligonucleotide; TTA chr11 5177570 5177591 5177587 5177592 +
aagtattttttttttcaaaacc

SEQ ID NO: 75380 - DNA, 22 bp, Artificial Sequence
  Synthetic oligonucleotide; TTT chr11 5177578 5177599 5177595 5177600 +
tttttttcaaaacctttgatct

SEQ ID NO: 75381 - DNA, 22 bp, Artificial Sequence
  Synthetic oligonucleotide; TTT chr11 5177579 5177600 5177596 5177601 +
ttttttcaaaacctttgatctt

SEQ ID NO: 75382 - DNA, 22 bp, Artificial Sequence
  Synthetic oligonucleotide; TTT chr11 5177580 5177601 5177597 5177602 +
tttttcaaaacctttgatcttt

SEQ ID NO: 75383 - DNA, 22 bp, Artificial Sequence
  Synthetic oligonucleotide; TTT chr11 5177581 5177602 5177598 5177603 +
ttttcaaaacctttgatctttg

SEQ ID NO: 75384 - DNA, 22 bp, Artificial Sequence
  Synthetic oligonucleotide; TTT chr11 5177582 5177603 5177599 5177604 +
tttcaaaacctttgatctttga

SEQ ID NO: 75385 - DNA, 22 bp, Artificial Sequence
  Synthetic oligonucleotide; TTT chr11 5177583 5177604 5177600 5177605 +
ttcaaaacctttgatctttgag

SEQ ID NO: 75386 - DNA, 22 bp, Artificial Sequence
  Synthetic oligonucleotide; TTT chr11 5177584 5177605 5177601 5177606 +
tcaaaacctttgatctttgagt

SEQ ID NO: 75387 - DNA, 22 bp, Artificial Sequence
  Synthetic oligonucleotide; TTT chr11 5177585 5177606 5177602 5177607 +
caaaacctttgatctttgagtg

SEQ ID NO: 75388 - DNA, 22 bp, Artificial Sequence
  Synthetic oligonucleotide; TTC chr11 5177586 5177607 5177603 5177608 +
aaaacctttgatctttgagtgc

SEQ ID NO: 75389 - DNA, 22 bp, Artificial Sequence
  Synthetic oligonucleotide; CTT chr11 5177594 5177615 5177611 5177616 +
tgatctttgagtgccttagcaa

SEQ ID NO: 75390 - DNA, 22 bp, Artificial Sequence
  Synthetic oligonucleotide; TTT chr11 5177595 5177616 5177612 5177617 +
gatctttgagtgccttagcaaa

SEQ ID NO: 75391 - DNA, 22 bp, Artificial Sequence
  Synthetic oligonucleotide; TTG chr11 5177596 5177617 5177613 5177618 +
atctttgagtgccttagcaaaa

SEQ ID NO: 75392 - DNA, 22 bp, Artificial Sequence
  Synthetic oligonucleotide; CTT chr11 5177601 5177622 5177618 5177623 +
tgagtgccttagcaaaattccg

SEQ ID NO: 75393 - DNA, 22 bp, Artificial Sequence
  Synthetic oligonucleotide; TTT chr11 5177602 5177623 5177619 5177624 +
gagtgccttagcaaaattccgt

SEQ ID NO: 75394 - DNA, 22 bp, Artificial Sequence
  Synthetic oligonucleotide; TTG chr11 5177603 5177624 5177620 5177625 +
agtgccttagcaaaattccgtg

SEQ ID NO: 75395 - DNA, 22 bp, Artificial Sequence
  Synthetic oligonucleotide; CTT chr11 5177611 5177632 5177628 5177633 +
agcaaaattccgtggacacttt

SEQ ID NO: 75396 - DNA, 22 bp, Artificial Sequence
  Synthetic oligonucleotide; TTA chr11 5177612 5177633 5177629 5177634 +
gcaaaattccgtggacactttg

SEQ ID NO: 75397 - DNA, 22 bp, Artificial Sequence
  Synthetic oligonucleotide; TTC chr11 5177621 5177642 5177638 5177643 +
cgtggacactttgatagacacc

SEQ ID NO: 75398 - DNA, 22 bp, Artificial Sequence
  Synthetic oligonucleotide; CTT chr11 5177632 5177653 5177649 5177654 +
tgatagacaccatcattttaag

SEQ ID NO: 75399 - DNA, 22 bp, Artificial Sequence
  Synthetic oligonucleotide; TTT chr11 5177633 5177654 5177650 5177655 +
gatagacaccatcattttaagt

SEQ ID NO: 75400 - DNA, 22 bp, Artificial Sequence
  Synthetic oligonucleotide; TTG chr11 5177634 5177655 5177651 5177656 +
atagacaccatcattttaagtg

SEQ ID NO: 75401 - DNA, 22 bp, Artificial Sequence
  Synthetic oligonucleotide; TTT chr11 5177650 5177671 5177667 5177672 +
taagtgtgtttgaggatttcta

SEQ ID NO: 75402 - DNA, 22 bp, Artificial Sequence
  Synthetic oligonucleotide; TTT chr11 5177651 5177672 5177668 5177673 +
aagtgtgtttgaggatttctat

SEQ ID NO: 75403 - DNA, 22 bp, Artificial Sequence
  Synthetic oligonucleotide; TTA chr11 5177652 5177673 5177669 5177674 +
agtgtgtttgaggatttctatg

SEQ ID NO: 75404 - DNA, 22 bp, Artificial Sequence
  Synthetic oligonucleotide; TTT chr11 5177661 5177682 5177678 5177683 +
gaggatttctatggattgtatt

SEQ ID NO: 75405 - DNA, 22 bp, Artificial Sequence
  Synthetic oligonucleotide; TTG chr11 5177662 5177683 5177679 5177684 +
aggatttctatggattgtattt

SEQ ID NO: 75406 - DNA, 22 bp, Artificial Sequence
  Synthetic oligonucleotide; TTT chr11 5177669 5177690 5177686 5177691 +
ctatggattgtatttattctat

SEQ ID NO: 75407 - DNA, 22 bp, Artificial Sequence
  Synthetic oligonucleotide; TTC chr11 5177670 5177691 5177687 5177692 +
tatggattgtatttattctatt

SEQ ID NO: 75408 - DNA, 22 bp, Artificial Sequence
  Synthetic oligonucleotide; CTA chr11 5177672 5177693 5177689 5177694 +
tggattgtatttattctattcc

SEQ ID NO: 75409 - DNA, 22 bp, Artificial Sequence
  Synthetic oligonucleotide; TTG chr11 5177679 5177700 5177696 5177701 +
tatttattctattccctaaaac

SEQ ID NO: 75410 - DNA, 22 bp, Artificial Sequence
  Synthetic oligonucleotide; TTT chr11 5177684 5177705 5177701 5177706 +
attctattccctaaaacagact

SEQ ID NO: 75411 - DNA, 22 bp, Artificial Sequence
  Synthetic oligonucleotide; TTA chr11 5177685 5177706 5177702 5177707 +
ttctattccctaaaacagactt

SEQ ID NO: 75412 - DNA, 22 bp, Artificial Sequence
  Synthetic oligonucleotide; TTC chr11 5177688 5177709 5177705 5177710 +
tattccctaaaacagacttttt

SEQ ID NO: 75413 - DNA, 22 bp, Artificial Sequence
  Synthetic oligonucleotide; CTA chr11 5177690 5177711 5177707 5177712 +
ttccctaaaacagactttttaa

SEQ ID NO: 75414 - DNA, 22 bp, Artificial Sequence
  Synthetic oligonucleotide; TTC chr11 5177693 5177714 5177710 5177715 +
cctaaaacagactttttaatct

SEQ ID NO: 75415 - DNA, 22 bp, Artificial Sequence
  Synthetic oligonucleotide; CTA chr11 5177697 5177718 5177714 5177719 +
aaacagactttttaatcttaac

SEQ ID NO: 75416 - DNA, 22 bp, Artificial Sequence
  Synthetic oligonucleotide; CTT chr11 5177707 5177728 5177724 5177729 +
tttaatcttaacagcatacact

SEQ ID NO: 75417 - DNA, 22 bp, Artificial Sequence
  Synthetic oligonucleotide; TTT chr11 5177708 5177729 5177725 5177730 +
ttaatcttaacagcatacactg

SEQ ID NO: 75418 - DNA, 22 bp, Artificial Sequence
  Synthetic oligonucleotide; TTT chr11 5177709 5177730 5177726 5177731 +
taatcttaacagcatacactga

SEQ ID NO: 75419 - DNA, 22 bp, Artificial Sequence
  Synthetic oligonucleotide; TTT chr11 5177710 5177731 5177727 5177732 +
aatcttaacagcatacactgat

SEQ ID NO: 75420 - DNA, 22 bp, Artificial Sequence
  Synthetic oligonucleotide; TTA chr11 5177711 5177732 5177728 5177733 +
atcttaacagcatacactgata

SEQ ID NO: 75421 - DNA, 22 bp, Artificial Sequence
  Synthetic oligonucleotide; CTT chr11 5177716 5177737 5177733 5177738 +
aacagcatacactgataggaga

SEQ ID NO: 75422 - DNA, 22 bp, Artificial Sequence
  Synthetic oligonucleotide; TTA chr11 5177717 5177738 5177734 5177739 +
acagcatacactgataggagag

SEQ ID NO: 75423 - DNA, 22 bp, Artificial Sequence
  Synthetic oligonucleotide; CTG chr11 5177730 5177751 5177747 5177752 +
ataggagagaaaagcaaaatca

SEQ ID NO: 75424 - DNA, 22 bp, Artificial Sequence
  Synthetic oligonucleotide; CTC chr11 5177755 5177776 5177772 5177777 +
gatctttaatttgtttggtctt

SEQ ID NO: 75425 - DNA, 22 bp, Artificial Sequence
  Synthetic oligonucleotide; CTT chr11 5177761 5177782 5177778 5177783 +
taatttgtttggtcttcacccc

SEQ ID NO: 75426 - DNA, 22 bp, Artificial Sequence
  Synthetic oligonucleotide; TTT chr11 5177762 5177783 5177779 5177784 +
aatttgtttggtcttcacccca

SEQ ID NO: 75427 - DNA, 22 bp, Artificial Sequence
  Synthetic oligonucleotide; TTA chr11 5177763 5177784 5177780 5177785 +
atttgtttggtcttcaccccat

SEQ ID NO: 75428 - DNA, 22 bp, Artificial Sequence
  Synthetic oligonucleotide; TTT chr11 5177767 5177788 5177784 5177789 +
gtttggtcttcaccccataaat

SEQ ID NO: 75429 - DNA, 22 bp, Artificial Sequence
  Synthetic oligonucleotide; TTG chr11 5177768 5177789 5177785 5177790 +
tttggtcttcaccccataaatg

SEQ ID NO: 75430 - DNA, 22 bp, Artificial Sequence
  Synthetic oligonucleotide; TTT chr11 5177771 5177792 5177788 5177793 +
ggtcttcaccccataaatgatg

SEQ ID NO: 75431 - DNA, 22 bp, Artificial Sequence
  Synthetic oligonucleotide; TTG chr11 5177772 5177793 5177789 5177794 +
gtcttcaccccataaatgatgg

SEQ ID NO: 75432 - DNA, 22 bp, Artificial Sequence
  Synthetic oligonucleotide; CTT chr11 5177777 5177798 5177794 5177799 +
caccccataaatgatggggttt

SEQ ID NO: 75433 - DNA, 22 bp, Artificial Sequence
  Synthetic oligonucleotide; TTC chr11 5177778 5177799 5177795 5177800 +
accccataaatgatggggttta

SEQ ID NO: 75434 - DNA, 22 bp, Artificial Sequence
  Synthetic oligonucleotide; TTT chr11 5177799 5177820 5177816 5177821 +
agcatagggggcactaacacat

SEQ ID NO: 75435 - DNA, 22 bp, Artificial Sequence
  Synthetic oligonucleotide; TTA chr11 5177800 5177821 5177817 5177822 +
gcatagggggcactaacacata

SEQ ID NO: 75436 - DNA, 22 bp, Artificial Sequence
  Synthetic oligonucleotide; CTA chr11 5177815 5177836 5177832 5177837 +
acacatagagactgcccactag

SEQ ID NO: 75437 - DNA, 22 bp, Artificial Sequence
  Synthetic oligonucleotide; CTG chr11 5177829 5177850 5177846 5177851 +
cccactaggatgtgaatgtggt

SEQ ID NO: 75438 - DNA, 22 bp, Artificial Sequence
  Synthetic oligonucleotide; CTA chr11 5177836 5177857 5177853 5177858 +
ggatgtgaatgtggtgagggat

SEQ ID NO: 75439 - DNA, 22 bp, Artificial Sequence
  Synthetic oligonucleotide; TTT chr11 5177863 5177884 5177880 5177885 +
tacctccaaagcgatgggcaag

SEQ ID NO: 75440 - DNA, 22 bp, Artificial Sequence
  Synthetic oligonucleotide; TTT chr11 5177864 5177885 5177881 5177886 +
acctccaaagcgatgggcaaga

SEQ ID NO: 75441 - DNA, 22 bp, Artificial Sequence
  Synthetic oligonucleotide; TTA chr11 5177865 5177886 5177882 5177887 +
cctccaaagcgatgggcaagaa

SEQ ID NO: 75442 - DNA, 22 bp, Artificial Sequence
  Synthetic oligonucleotide; CTC chr11 5177869 5177890 5177886 5177891 +
caaagcgatgggcaagaaatga

SEQ ID NO: 75443 - DNA, 22 bp, Artificial Sequence
  Synthetic oligonucleotide; CTG chr11 5177902 5177923 5177919 5177924 +
gggtatagaacataaatatgac

SEQ ID NO: 75444 - DNA, 22 bp, Artificial Sequence
  Synthetic oligonucleotide; CTA chr11 5177949 5177970 5177966 5177971 +
agggccttgaacctggcagccc

SEQ ID NO: 75445 - DNA, 22 bp, Artificial Sequence
  Synthetic oligonucleotide; CTT chr11 5177957 5177978 5177974 5177979 +
gaacctggcagcccaggaagat

SEQ ID NO: 75446 - DNA, 22 bp, Artificial Sequence
  Synthetic oligonucleotide; TTG chr11 5177958 5177979 5177975 5177980 +
aacctggcagcccaggaagata

SEQ ID NO: 75447 - DNA, 22 bp, Artificial Sequence
  Synthetic oligonucleotide; CTG chr11 5177964 5177985 5177981 5177986 +
gcagcccaggaagatatctgaa

SEQ ID NO: 75448 - DNA, 22 bp, Artificial Sequence
  Synthetic oligonucleotide; CTG chr11 5177984 5178005 5178001 5178006 +
aaacactgagtgaaggatcatt

SEQ ID NO: 75449 - DNA, 22 bp, Artificial Sequence
  Synthetic oligonucleotide; CTG chr11 5177992 5178013 5178009 5178014 +
agtgaaggatcattgtgtagga

SEQ ID NO: 75450 - DNA, 22 bp, Artificial Sequence
  Synthetic oligonucleotide; TTG chr11 5178007 5178028 5178024 5178029 +
tgtaggatataatgataagcac

SEQ ID NO: 75451 - DNA, 22 bp, Artificial Sequence
  Synthetic oligonucleotide; CTA chr11 5178031 5178052 5178048 5178053 +
tatccagtcctgtagagagtag

SEQ ID NO: 75452 - DNA, 22 bp, Artificial Sequence
  Synthetic oligonucleotide; CTG chr11 5178043 5178064 5178060 5178065 +
tagagagtagggccacagtgag

SEQ ID NO: 75453 - DNA, 22 bp, Artificial Sequence
  Synthetic oligonucleotide; TTG chr11 5178081 5178102 5178098 5178103 +
acattgatattgccacaagcca

SEQ ID NO: 75454 - DNA, 22 bp, Artificial Sequence
  Synthetic oligonucleotide; TTG chr11 5178087 5178108 5178104 5178109 +
atattgccacaagccaatctgg

SEQ ID NO: 75455 - DNA, 22 bp, Artificial Sequence
  Synthetic oligonucleotide; TTG chr11 5178093 5178114 5178110 5178115 +
ccacaagccaatctggcaatgt

SEQ ID NO: 75456 - DNA, 22 bp, Artificial Sequence
  Synthetic oligonucleotide; CTG chr11 5178108 5178129 5178125 5178130 +
gcaatgtgctcacagtaggaat

SEQ ID NO: 75457 - DNA, 22 bp, Artificial Sequence
  Synthetic oligonucleotide; CTC chr11 5178119 5178140 5178136 5178141 +
acagtaggaatgaggaatgatg

SEQ ID NO: 75458 - DNA, 22 bp, Artificial Sequence
  Synthetic oligonucleotide; TTT chr11 5178144 5178165 5178161 5178166 +
ctcccacaatatgtaagtcggt

SEQ ID NO: 75459 - DNA, 22 bp, Artificial Sequence
  Synthetic oligonucleotide; TTC chr11 5178145 5178166 5178162 5178167 +
tcccacaatatgtaagtcggta

SEQ ID NO: 75460 - DNA, 22 bp, Artificial Sequence
  Synthetic oligonucleotide; CTC chr11 5178147 5178168 5178164 5178169 +
ccacaatatgtaagtcggtata

SEQ ID NO: 75461 - DNA, 22 bp, Artificial Sequence
  Synthetic oligonucleotide; CTC chr11 5178204 5178225 5178221 5178226 +
ctgaccacagctgctatgccaa

SEQ ID NO: 75462 - DNA, 22 bp, Artificial Sequence
  Synthetic oligonucleotide; CTG chr11 5178207 5178228 5178224 5178229 +
accacagctgctatgccaatct

SEQ ID NO: 75463 - DNA, 22 bp, Artificial Sequence
  Synthetic oligonucleotide; CTG chr11 5178217 5178238 5178234 5178239 +
ctatgccaatcttcctgacggc

SEQ ID NO: 75464 - DNA, 22 bp, Artificial Sequence
  Synthetic oligonucleotide; CTA chr11 5178220 5178241 5178237 5178242 +
tgccaatcttcctgacggctga

SEQ ID NO: 75465 - DNA, 22 bp, Artificial Sequence
  Synthetic oligonucleotide; CTT chr11 5178230 5178251 5178247 5178252 +
cctgacggctgatgaggttaaa

SEQ ID NO: 75466 - DNA, 22 bp, Artificial Sequence
  Synthetic oligonucleotide; TTC chr11 5178231 5178252 5178248 5178253 +
ctgacggctgatgaggttaaaa

SEQ ID NO: 75467 - DNA, 22 bp, Artificial Sequence
  Synthetic oligonucleotide; CTG chr11 5178234 5178255 5178251 5178256 +
acggctgatgaggttaaaatgg

SEQ ID NO: 75468 - DNA, 22 bp, Artificial Sequence
  Synthetic oligonucleotide; CTG chr11 5178241 5178262 5178258 5178263 +
atgaggttaaaatggtgtatct

SEQ ID NO: 75469 - DNA, 22 bp, Artificial Sequence
  Synthetic oligonucleotide; TTA chr11 5178250 5178271 5178267 5178272 +
aaatggtgtatctcagtgggta

SEQ ID NO: 75470 - DNA, 22 bp, Artificial Sequence
  Synthetic oligonucleotide; CTC chr11 5178264 5178285 5178281 5178286 +
agtgggtaacagatggccacat

SEQ ID NO: 75471 - DNA, 22 bp, Artificial Sequence
  Synthetic oligonucleotide; TTG chr11 5178304 5178325 5178321 5178326 +
ccaggagaatagcagattctgc

SEQ ID NO: 75472 - DNA, 22 bp, Artificial Sequence
  Synthetic oligonucleotide; TTC chr11 5178323 5178344 5178340 5178345 +
tgccacaaagatgaaatgtatg

SEQ ID NO: 75473 - DNA, 22 bp, Artificial Sequence
  Synthetic oligonucleotide; CTG chr11 5178325 5178346 5178342 5178347 +
ccacaaagatgaaatgtatgaa

SEQ ID NO: 75474 - DNA, 22 bp, Artificial Sequence
  Synthetic oligonucleotide; CTG chr11 5178356 5178377 5178373 5178378 +
agacacacaactaccaaaggat

SEQ ID NO: 75475 - DNA, 22 bp, Artificial Sequence
  Synthetic oligonucleotide; CTA chr11 5178369 5178390 5178386 5178391 +
ccaaaggatatgtccatggagt

SEQ ID NO: 75476 - DNA, 22 bp, Artificial Sequence
  Synthetic oligonucleotide; CTT chr11 5178416 5178437 5178433 5178438 +
aggggctgcagcagtggcgagc

SEQ ID NO: 75477 - DNA, 22 bp, Artificial Sequence
  Synthetic oligonucleotide; TTA chr11 5178417 5178438 5178434 5178439 +
ggggctgcagcagtggcgagca

SEQ ID NO: 75478 - DNA, 22 bp, Artificial Sequence
  Synthetic oligonucleotide; CTG chr11 5178424 5178445 5178441 5178446 +
cagcagtggcgagcaggaagtc

SEQ ID NO: 75479 - DNA, 22 bp, Artificial Sequence
  Synthetic oligonucleotide; CTG chr11 5178451 5178472 5178468 5178473 +
aggccagcatggataggaagag

SEQ ID NO: 75480 - DNA, 22 bp, Artificial Sequence
  Synthetic oligonucleotide; CTC chr11 5178485 5178506 5178502 5178507 +
atggagactgcgctcagtcatg

SEQ ID NO: 75481 - DNA, 22 bp, Artificial Sequence
  Synthetic oligonucleotide; CTG chr11 5178495 5178516 5178512 5178517 +
cgctcagtcatgatcaggaaga

SEQ ID NO: 75482 - DNA, 22 bp, Artificial Sequence
  Synthetic oligonucleotide; CTC chr11 5178500 5178521 5178517 5178522 +
agtcatgatcaggaagatcaag

SEQ ID NO: 75483 - DNA, 22 bp, Artificial Sequence
  Synthetic oligonucleotide; TTG chr11 5178531 5178552 5178548 5178553 +
cctgcaacagccacaatgtaca

SEQ ID NO: 75484 - DNA, 22 bp, Artificial Sequence
  Synthetic oligonucleotide; CTG chr11 5178535 5178556 5178552 5178557 +
caacagccacaatgtacataaa

SEQ ID NO: 75485 - DNA, 22 bp, Artificial Sequence
  Synthetic oligonucleotide; CTT chr11 5178592 5178613 5178609 5178614 +
ccagccctgggattcccatcag

SEQ ID NO: 75486 - DNA, 22 bp, Artificial Sequence
  Synthetic oligonucleotide; TTC chr11 5178593 5178614 5178610 5178615 +
cagccctgggattcccatcagg

SEQ ID NO: 75487 - DNA, 22 bp, Artificial Sequence
  Synthetic oligonucleotide; CTG chr11 5178601 5178622 5178618 5178623 +
ggattcccatcaggacatacca

SEQ ID NO: 75488 - DNA, 22 bp, Artificial Sequence
  Synthetic oligonucleotide; TTC chr11 5178607 5178628 5178624 5178629 +
ccatcaggacataccacacatc

SEQ ID NO: 75489 - DNA, 22 bp, Artificial Sequence
  Synthetic oligonucleotide; CTG chr11 5178632 5178653 5178649 5178654 +
ggaattagtgtgattgcgaaag

SEQ ID NO: 75490 - DNA, 22 bp, Artificial Sequence
  Synthetic oligonucleotide; TTA chr11 5178639 5178660 5178656 5178661 +
gtgtgattgcgaaagaaaggag

SEQ ID NO: 75491 - DNA, 22 bp, Artificial Sequence
  Synthetic oligonucleotide; TTG chr11 5178648 5178669 5178665 5178670 +
cgaaagaaaggagccgtatgta

SEQ ID NO: 75492 - DNA, 22 bp, Artificial Sequence
  Synthetic oligonucleotide; TTT chr11 5178676 5178697 5178693 5178698 +
attccaggcctagtgccattag

SEQ ID NO: 75493 - DNA, 22 bp, Artificial Sequence
  Synthetic oligonucleotide; TTA chr11 5178677 5178698 5178694 5178699 +
ttccaggcctagtgccattagt

SEQ ID NO: 75494 - DNA, 22 bp, Artificial Sequence
  Synthetic oligonucleotide; TTC chr11 5178680 5178701 5178697 5178702 +
caggcctagtgccattagtgaa

SEQ ID NO: 75495 - DNA, 22 bp, Artificial Sequence
  Synthetic oligonucleotide; CTA chr11 5178688 5178709 5178705 5178710 +
gtgccattagtgaaagactaca

SEQ ID NO: 75496 - DNA, 22 bp, Artificial Sequence
  Synthetic oligonucleotide; TTA chr11 5178697 5178718 5178714 5178719 +
gtgaaagactacaaagttgagg

SEQ ID NO: 75497 - DNA, 22 bp, Artificial Sequence
  Synthetic oligonucleotide; CTA chr11 5178708 5178729 5178725 5178730 +
caaagttgaggatttagaaaca

SEQ ID NO: 75498 - DNA, 22 bp, Artificial Sequence
  Synthetic oligonucleotide; TTG chr11 5178716 5178737 5178733 5178738 +
aggatttagaaacactacctta

SEQ ID NO: 75499 - DNA, 22 bp, Artificial Sequence
  Synthetic oligonucleotide; TTT chr11 5178723 5178744 5178740 5178745 +
agaaacactaccttaggctgaa

SEQ ID NO: 75500 - DNA, 22 bp, Artificial Sequence
  Synthetic oligonucleotide; TTA chr11 5178724 5178745 5178741 5178746 +
gaaacactaccttaggctgaat

SEQ ID NO: 75501 - DNA, 22 bp, Artificial Sequence
  Synthetic oligonucleotide; CTA chr11 5178733 5178754 5178750 5178755 +
ccttaggctgaatgaggtctca

SEQ ID NO: 75502 - DNA, 22 bp, Artificial Sequence
  Synthetic oligonucleotide; CTT chr11 5178737 5178758 5178754 5178759 +
aggctgaatgaggtctcatcag

SEQ ID NO: 75503 - DNA, 22 bp, Artificial Sequence
  Synthetic oligonucleotide; TTA chr11 5178738 5178759 5178755 5178760 +
ggctgaatgaggtctcatcaga

SEQ ID NO: 75504 - DNA, 22 bp, Artificial Sequence
  Synthetic oligonucleotide; CTG chr11 5178743 5178764 5178760 5178765 +
aatgaggtctcatcagatttgt

SEQ ID NO: 75505 - DNA, 22 bp, Artificial Sequence
  Synthetic oligonucleotide; CTC chr11 5178754 5178775 5178771 5178776 +
atcagatttgttttctttccaa

SEQ ID NO: 75506 - DNA, 22 bp, Artificial Sequence
  Synthetic oligonucleotide; TTT chr11 5178763 5178784 5178780 5178785 +
gttttctttccaatgttttctt

SEQ ID NO: 75507 - DNA, 22 bp, Artificial Sequence
  Synthetic oligonucleotide; TTG chr11 5178764 5178785 5178781 5178786 +
ttttctttccaatgttttcttc

SEQ ID NO: 75508 - DNA, 22 bp, Artificial Sequence
  Synthetic oligonucleotide; TTT chr11 5178767 5178788 5178784 5178789 +
tctttccaatgttttcttctct

SEQ ID NO: 75509 - DNA, 22 bp, Artificial Sequence
  Synthetic oligonucleotide; TTT chr11 5178768 5178789 5178785 5178790 +
ctttccaatgttttcttctctg

SEQ ID NO: 75510 - DNA, 22 bp, Artificial Sequence
  Synthetic oligonucleotide; TTC chr11 5178769 5178790 5178786 5178791 +
tttccaatgttttcttctctgg

SEQ ID NO: 75511 - DNA, 22 bp, Artificial Sequence
  Synthetic oligonucleotide; CTT chr11 5178771 5178792 5178788 5178793 +
tccaatgttttcttctctggga

SEQ ID NO: 75512 - DNA, 22 bp, Artificial Sequence
  Synthetic oligonucleotide; TTT chr11 5178772 5178793 5178789 5178794 +
ccaatgttttcttctctgggaa

SEQ ID NO: 75513 - DNA, 22 bp, Artificial Sequence
  Synthetic oligonucleotide; TTC chr11 5178773 5178794 5178790 5178795 +
caatgttttcttctctgggaaa

SEQ ID NO: 75514 - DNA, 22 bp, Artificial Sequence
  Synthetic oligonucleotide; TTT chr11 5178781 5178802 5178798 5178803 +
tcttctctgggaaaggagagta

SEQ ID NO: 75515 - DNA, 22 bp, Artificial Sequence
  Synthetic oligonucleotide; TTT chr11 5178782 5178803 5178799 5178804 +
cttctctgggaaaggagagtaa

SEQ ID NO: 75516 - DNA, 22 bp, Artificial Sequence
  Synthetic oligonucleotide; TTC chr11 5178783 5178804 5178800 5178805 +
ttctctgggaaaggagagtaaa

SEQ ID NO: 75517 - DNA, 22 bp, Artificial Sequence
  Synthetic oligonucleotide; CTT chr11 5178785 5178806 5178802 5178807 +
ctctgggaaaggagagtaaaat

SEQ ID NO: 75518 - DNA, 22 bp, Artificial Sequence
  Synthetic oligonucleotide; TTC chr11 5178786 5178807 5178803 5178808 +
tctgggaaaggagagtaaaatg

SEQ ID NO: 75519 - DNA, 22 bp, Artificial Sequence
  Synthetic oligonucleotide; CTC chr11 5178788 5178809 5178805 5178810 +
tgggaaaggagagtaaaatggg

SEQ ID NO: 75520 - DNA, 22 bp, Artificial Sequence
  Synthetic oligonucleotide; CTG chr11 5178790 5178811 5178807 5178812 +
ggaaaggagagtaaaatgggtt

SEQ ID NO: 75521 - DNA, 22 bp, Artificial Sequence
  Synthetic oligonucleotide; TTA chr11 5178813 5178834 5178830 5178835 +
atagaccgaatatataagtcct

SEQ ID NO: 75522 - DNA, 22 bp, Artificial Sequence
  Synthetic oligonucleotide; CTA chr11 5178836 5178857 5178853 5178858 +
ccaaataattaattttttgtac

SEQ ID NO: 75523 - DNA, 22 bp, Artificial Sequence
  Synthetic oligonucleotide; TTA chr11 5178847 5178868 5178864 5178869 +
attttttgtaccttaaaaaatt

SEQ ID NO: 75524 - DNA, 22 bp, Artificial Sequence
  Synthetic oligonucleotide; TTT chr11 5178851 5178872 5178868 5178873 +
tttgtaccttaaaaaattagta

SEQ ID NO: 75525 - DNA, 22 bp, Artificial Sequence
  Synthetic oligonucleotide; TTT chr11 5178852 5178873 5178869 5178874 +
ttgtaccttaaaaaattagtag

SEQ ID NO: 75526 - DNA, 22 bp, Artificial Sequence
  Synthetic oligonucleotide; TTT chr11 5178853 5178874 5178870 5178875 +
tgtaccttaaaaaattagtaga

SEQ ID NO: 75527 - DNA, 22 bp, Artificial Sequence
  Synthetic oligonucleotide; TTT chr11 5178854 5178875 5178871 5178876 +
gtaccttaaaaaattagtagat

SEQ ID NO: 75528 - DNA, 22 bp, Artificial Sequence
  Synthetic oligonucleotide; TTG chr11 5178855 5178876 5178872 5178877 +
taccttaaaaaattagtagata

SEQ ID NO: 75529 - DNA, 22 bp, Artificial Sequence
  Synthetic oligonucleotide; CTT chr11 5178861 5178882 5178878 5178883 +
aaaaaattagtagatattattt

SEQ ID NO: 75530 - DNA, 22 bp, Artificial Sequence
  Synthetic oligonucleotide; TTA chr11 5178862 5178883 5178879 5178884 +
aaaaattagtagatattattta

SEQ ID NO: 75531 - DNA, 22 bp, Artificial Sequence
  Synthetic oligonucleotide; TTA chr11 5178870 5178891 5178887 5178892 +
gtagatattatttaataactgc

SEQ ID NO: 75532 - DNA, 22 bp, Artificial Sequence
  Synthetic oligonucleotide; TTA chr11 5178880 5178901 5178897 5178902 +
tttaataactgcttaatatgtg

SEQ ID NO: 75533 - DNA, 22 bp, Artificial Sequence
  Synthetic oligonucleotide; TTT chr11 5178883 5178904 5178900 5178905 +
aataactgcttaatatgtgtca

SEQ ID NO: 75534 - DNA, 22 bp, Artificial Sequence
  Synthetic oligonucleotide; TTA chr11 5178884 5178905 5178901 5178906 +
ataactgcttaatatgtgtcat

SEQ ID NO: 75535 - DNA, 22 bp, Artificial Sequence
  Synthetic oligonucleotide; CTG chr11 5178891 5178912 5178908 5178913 +
cttaatatgtgtcatactactt

SEQ ID NO: 75536 - DNA, 22 bp, Artificial Sequence
  Synthetic oligonucleotide; CTT chr11 5178894 5178915 5178911 5178916 +
aatatgtgtcatactactttac

SEQ ID NO: 75537 - DNA, 22 bp, Artificial Sequence
  Synthetic oligonucleotide; TTA chr11 5178895 5178916 5178912 5178917 +
atatgtgtcatactactttaca

SEQ ID NO: 75538 - DNA, 22 bp, Artificial Sequence
  Synthetic oligonucleotide; CTA chr11 5178910 5178931 5178927 5178932 +
ctttacaaatattaacttatta

SEQ ID NO: 75539 - DNA, 22 bp, Artificial Sequence
  Synthetic oligonucleotide; CTT chr11 5178913 5178934 5178930 5178935 +
tacaaatattaacttattaaat

SEQ ID NO: 75540 - DNA, 22 bp, Artificial Sequence
  Synthetic oligonucleotide; TTT chr11 5178914 5178935 5178931 5178936 +
acaaatattaacttattaaatc

SEQ ID NO: 75541 - DNA, 22 bp, Artificial Sequence
  Synthetic oligonucleotide; TTA chr11 5178915 5178936 5178932 5178937 +
caaatattaacttattaaatct

SEQ ID NO: 75542 - DNA, 22 bp, Artificial Sequence
  Synthetic oligonucleotide; TTA chr11 5178924 5178945 5178941 5178946 +
acttattaaatcttcacaataa

SEQ ID NO: 75543 - DNA, 22 bp, Artificial Sequence
  Synthetic oligonucleotide; CTT chr11 5178928 5178949 5178945 5178950 +
attaaatcttcacaataaccta

SEQ ID NO: 75544 - DNA, 22 bp, Artificial Sequence
  Synthetic oligonucleotide; TTA chr11 5178929 5178950 5178946 5178951 +
ttaaatcttcacaataacctat

SEQ ID NO: 75545 - DNA, 22 bp, Artificial Sequence
  Synthetic oligonucleotide; TTA chr11 5178932 5178953 5178949 5178954 +
aatcttcacaataacctattga

SEQ ID NO: 75546 - DNA, 22 bp, Artificial Sequence
  Synthetic oligonucleotide; CTT chr11 5178938 5178959 5178955 5178960 +
cacaataacctattgaaaagcc

SEQ ID NO: 75547 - DNA, 22 bp, Artificial Sequence
  Synthetic oligonucleotide; TTC chr11 5178939 5178960 5178956 5178961 +
acaataacctattgaaaagccc

SEQ ID NO: 75548 - DNA, 22 bp, Artificial Sequence
  Synthetic oligonucleotide; CTA chr11 5178950 5178971 5178967 5178972 +
ttgaaaagccctttaaataacc

SEQ ID NO: 75549 - DNA, 22 bp, Artificial Sequence
  Synthetic oligonucleotide; TTG chr11 5178953 5178974 5178970 5178975 +
aaaagccctttaaataaccatt

SEQ ID NO: 75550 - DNA, 22 bp, Artificial Sequence
  Synthetic oligonucleotide; CTT chr11 5178963 5178984 5178980 5178985 +
taaataaccattatataaatac

SEQ ID NO: 75551 - DNA, 22 bp, Artificial Sequence
  Synthetic oligonucleotide; TTT chr11 5178964 5178985 5178981 5178986 +
aaataaccattatataaatact

SEQ ID NO: 75552 - DNA, 22 bp, Artificial Sequence
  Synthetic oligonucleotide; TTA chr11 5178965 5178986 5178982 5178987 +
aataaccattatataaatacta

SEQ ID NO: 75553 - DNA, 22 bp, Artificial Sequence
  Synthetic oligonucleotide; TTA chr11 5178976 5178997 5178993 5178998 +
tataaatactattatttctaca

SEQ ID NO: 75554 - DNA, 22 bp, Artificial Sequence
  Synthetic oligonucleotide; CTA chr11 5178987 5179008 5179004 5179009 +
ttatttctacagatgtaaaaaa

SEQ ID NO: 75555 - DNA, 22 bp, Artificial Sequence
  Synthetic oligonucleotide; TTA chr11 5178990 5179011 5179007 5179012 +
tttctacagatgtaaaaaaaac

SEQ ID NO: 75556 - DNA, 22 bp, Artificial Sequence
  Synthetic oligonucleotide; TTT chr11 5178993 5179014 5179010 5179015 +
ctacagatgtaaaaaaaaccca

SEQ ID NO: 75557 - DNA, 22 bp, Artificial Sequence
  Synthetic oligonucleotide; TTC chr11 5178994 5179015 5179011 5179016 +
tacagatgtaaaaaaaacccac

SEQ ID NO: 75558 - DNA, 22 bp, Artificial Sequence
  Synthetic oligonucleotide; CTA chr11 5178996 5179017 5179013 5179018 +
cagatgtaaaaaaaacccacag

SEQ ID NO: 75559 - DNA, 22 bp, Artificial Sequence
  Synthetic oligonucleotide; CTT chr11 5179022 5179043 5179039 5179044 +
tcagcctcttaccctaggccct

SEQ ID NO: 75560 - DNA, 22 bp, Artificial Sequence
  Synthetic oligonucleotide; TTT chr11 5179023 5179044 5179040 5179045 +
cagcctcttaccctaggcccta

SEQ ID NO: 75561 - DNA, 22 bp, Artificial Sequence
  Synthetic oligonucleotide; TTC chr11 5179024 5179045 5179041 5179046 +
agcctcttaccctaggccctac

SEQ ID NO: 75562 - DNA, 22 bp, Artificial Sequence
  Synthetic oligonucleotide; CTC chr11 5179030 5179051 5179047 5179052 +
ttaccctaggccctactggatt

SEQ ID NO: 75563 - DNA, 22 bp, Artificial Sequence
  Synthetic oligonucleotide; CTT chr11 5179032 5179053 5179049 5179054 +
accctaggccctactggattta

SEQ ID NO: 75564 - DNA, 22 bp, Artificial Sequence
  Synthetic oligonucleotide; TTA chr11 5179033 5179054 5179050 5179055 +
ccctaggccctactggatttaa

SEQ ID NO: 75565 - DNA, 22 bp, Artificial Sequence
  Synthetic oligonucleotide; CTA chr11 5179038 5179059 5179055 5179060 +
ggccctactggatttaaagtaa

SEQ ID NO: 75566 - DNA, 22 bp, Artificial Sequence
  Synthetic oligonucleotide; CTA chr11 5179045 5179066 5179062 5179067 +
ctggatttaaagtaaggcagga

SEQ ID NO: 75567 - DNA, 22 bp, Artificial Sequence
  Synthetic oligonucleotide; CTG chr11 5179048 5179069 5179065 5179070 +
gatttaaagtaaggcaggataa

SEQ ID NO: 75568 - DNA, 22 bp, Artificial Sequence
  Synthetic oligonucleotide; TTT chr11 5179053 5179074 5179070 5179075 +
aaagtaaggcaggataaatctg

SEQ ID NO: 75569 - DNA, 22 bp, Artificial Sequence
  Synthetic oligonucleotide; TTA chr11 5179054 5179075 5179071 5179076 +
aagtaaggcaggataaatctga

SEQ ID NO: 75570 - DNA, 22 bp, Artificial Sequence
  Synthetic oligonucleotide; CTG chr11 5179075 5179096 5179092 5179097 +
aaagctttgatctttactacca

SEQ ID NO: 75571 - DNA, 22 bp, Artificial Sequence
  Synthetic oligonucleotide; CTT chr11 5179082 5179103 5179099 5179104 +
tgatctttactaccatccaatg

SEQ ID NO: 75572 - DNA, 22 bp, Artificial Sequence
  Synthetic oligonucleotide; TTT chr11 5179083 5179104 5179100 5179105 +
gatctttactaccatccaatgc

SEQ ID NO: 75573 - DNA, 22 bp, Artificial Sequence
  Synthetic oligonucleotide; TTG chr11 5179084 5179105 5179101 5179106 +
atctttactaccatccaatgct

SEQ ID NO: 75574 - DNA, 22 bp, Artificial Sequence
  Synthetic oligonucleotide; CTT chr11 5179089 5179110 5179106 5179111 +
tactaccatccaatgctgccta

SEQ ID NO: 75575 - DNA, 22 bp, Artificial Sequence
  Synthetic oligonucleotide; TTT chr11 5179090 5179111 5179107 5179112 +
actaccatccaatgctgcctat

SEQ ID NO: 75576 - DNA, 22 bp, Artificial Sequence
  Synthetic oligonucleotide; TTA chr11 5179091 5179112 5179108 5179113 +
ctaccatccaatgctgcctatc

SEQ ID NO: 75577 - DNA, 22 bp, Artificial Sequence
  Synthetic oligonucleotide; CTA chr11 5179094 5179115 5179111 5179116 +
ccatccaatgctgcctatcaag

SEQ ID NO: 75578 - DNA, 22 bp, Artificial Sequence
  Synthetic oligonucleotide; CTG chr11 5179107 5179128 5179124 5179129 +
cctatcaaggtaaaactagata

SEQ ID NO: 75579 - DNA, 22 bp, Artificial Sequence
  Synthetic oligonucleotide; CTA chr11 5179111 5179132 5179128 5179133 +
tcaaggtaaaactagatataaa

SEQ ID NO: 75580 - DNA, 22 bp, Artificial Sequence
  Synthetic oligonucleotide; CTA chr11 5179125 5179146 5179142 5179147 +
gatataaaacgcagcatcaaat

SEQ ID NO: 75581 - DNA, 22 bp, Artificial Sequence
  Synthetic oligonucleotide; TTT chr11 5179149 5179170 5179166 5179171 +
tttactgatcatatccctaagg

SEQ ID NO: 75582 - DNA, 22 bp, Artificial Sequence
  Synthetic oligonucleotide; TTT chr11 5179150 5179171 5179167 5179172 +
ttactgatcatatccctaagga

SEQ ID NO: 75583 - DNA, 22 bp, Artificial Sequence
  Synthetic oligonucleotide; TTT chr11 5179151 5179172 5179168 5179173 +
tactgatcatatccctaaggaa

SEQ ID NO: 75584 - DNA, 22 bp, Artificial Sequence
  Synthetic oligonucleotide; TTT chr11 5179152 5179173 5179169 5179174 +
actgatcatatccctaaggaaa

SEQ ID NO: 75585 - DNA, 22 bp, Artificial Sequence
  Synthetic oligonucleotide; TTA chr11 5179153 5179174 5179170 5179175 +
ctgatcatatccctaaggaaaa

SEQ ID NO: 75586 - DNA, 22 bp, Artificial Sequence
  Synthetic oligonucleotide; CTG chr11 5179156 5179177 5179173 5179178 +
atcatatccctaaggaaaatag

SEQ ID NO: 75587 - DNA, 22 bp, Artificial Sequence
  Synthetic oligonucleotide; CTA chr11 5179168 5179189 5179185 5179190 +
aggaaaatagagagttatgaaa

SEQ ID NO: 75588 - DNA, 22 bp, Artificial Sequence
  Synthetic oligonucleotide; TTA chr11 5179185 5179206 5179202 5179207 +
tgaaatttagttgtgctgctta

SEQ ID NO: 75589 - DNA, 22 bp, Artificial Sequence
  Synthetic oligonucleotide; TTT chr11 5179193 5179214 5179210 5179215 +
agttgtgctgcttacagaaatg

SEQ ID NO: 75590 - DNA, 22 bp, Artificial Sequence
  Synthetic oligonucleotide; TTA chr11 5179194 5179215 5179211 5179216 +
gttgtgctgcttacagaaatgg

SEQ ID NO: 75591 - DNA, 22 bp, Artificial Sequence
  Synthetic oligonucleotide; TTG chr11 5179198 5179219 5179215 5179220 +
tgctgcttacagaaatgggagg

SEQ ID NO: 75592 - DNA, 22 bp, Artificial Sequence
  Synthetic oligonucleotide; CTG chr11 5179203 5179224 5179220 5179225 +
cttacagaaatgggagggaatt

SEQ ID NO: 75593 - DNA, 22 bp, Artificial Sequence
  Synthetic oligonucleotide; CTT chr11 5179206 5179227 5179223 5179228 +
acagaaatgggagggaattaag

SEQ ID NO: 75594 - DNA, 22 bp, Artificial Sequence
  Synthetic oligonucleotide; TTA chr11 5179207 5179228 5179224 5179229 +
cagaaatgggagggaattaagt

SEQ ID NO: 75595 - DNA, 22 bp, Artificial Sequence
  Synthetic oligonucleotide; TTA chr11 5179226 5179247 5179243 5179248 +
agtctgacaaaatagatttcaa

SEQ ID NO: 75596 - DNA, 22 bp, Artificial Sequence
  Synthetic oligonucleotide; CTG chr11 5179232 5179253 5179249 5179254 +
acaaaatagatttcaagcaata

SEQ ID NO: 75597 - DNA, 22 bp, Artificial Sequence
  Synthetic oligonucleotide; TTT chr11 5179245 5179266 5179262 5179267 +
caagcaatatagcatgtatgcc

SEQ ID NO: 75598 - DNA, 22 bp, Artificial Sequence
  Synthetic oligonucleotide; TTC chr11 5179246 5179267 5179263 5179268 +
aagcaatatagcatgtatgcct

SEQ ID NO: 75599 - DNA, 22 bp, Artificial Sequence
  Synthetic oligonucleotide; CTT chr11 5179269 5179290 5179286 5179291 +
cttccacattgattggccttaa

SEQ ID NO: 75600 - DNA, 22 bp, Artificial Sequence
  Synthetic oligonucleotide; TTC chr11 5179270 5179291 5179287 5179292 +
ttccacattgattggccttaac

SEQ ID NO: 75601 - DNA, 22 bp, Artificial Sequence
  Synthetic oligonucleotide; CTT chr11 5179272 5179293 5179289 5179294 +
ccacattgattggccttaactt

SEQ ID NO: 75602 - DNA, 22 bp, Artificial Sequence
  Synthetic oligonucleotide; TTC chr11 5179273 5179294 5179290 5179295 +
cacattgattggccttaactta

SEQ ID NO: 75603 - DNA, 22 bp, Artificial Sequence
  Synthetic oligonucleotide; TTG chr11 5179280 5179301 5179297 5179302 +
attggccttaacttattgttaa

SEQ ID NO: 75604 - DNA, 22 bp, Artificial Sequence
  Synthetic oligonucleotide; TTG chr11 5179284 5179305 5179301 5179306 +
gccttaacttattgttaagcca

SEQ ID NO: 75605 - DNA, 22 bp, Artificial Sequence
  Synthetic oligonucleotide; CTT chr11 5179289 5179310 5179306 5179311 +
aacttattgttaagccatatgc

SEQ ID NO: 75606 - DNA, 22 bp, Artificial Sequence
  Synthetic oligonucleotide; TTA chr11 5179290 5179311 5179307 5179312 +
acttattgttaagccatatgct

SEQ ID NO: 75607 - DNA, 22 bp, Artificial Sequence
  Synthetic oligonucleotide; CTT chr11 5179294 5179315 5179311 5179316 +
attgttaagccatatgctagcc

SEQ ID NO: 75608 - DNA, 22 bp, Artificial Sequence
  Synthetic oligonucleotide; TTA chr11 5179295 5179316 5179312 5179317 +
ttgttaagccatatgctagcca

SEQ ID NO: 75609 - DNA, 22 bp, Artificial Sequence
  Synthetic oligonucleotide; TTG chr11 5179298 5179319 5179315 5179320 +
ttaagccatatgctagccattg

SEQ ID NO: 75610 - DNA, 22 bp, Artificial Sequence
  Synthetic oligonucleotide; TTA chr11 5179301 5179322 5179318 5179323 +
agccatatgctagccattgaag

SEQ ID NO: 75611 - DNA, 22 bp, Artificial Sequence
  Synthetic oligonucleotide; CTA chr11 5179313 5179334 5179330 5179335 +
gccattgaagacatacagcaaa

SEQ ID NO: 75612 - DNA, 22 bp, Artificial Sequence
  Synthetic oligonucleotide; TTG chr11 5179320 5179341 5179337 5179342 +
aagacatacagcaaattaaatt

SEQ ID NO: 75613 - DNA, 22 bp, Artificial Sequence
  Synthetic oligonucleotide; TTA chr11 5179338 5179359 5179355 5179360 +
aattgttctgccaattaatcta

SEQ ID NO: 75614 - DNA, 22 bp, Artificial Sequence
  Synthetic oligonucleotide; TTG chr11 5179343 5179364 5179360 5179365 +
ttctgccaattaatctatttct

SEQ ID NO: 75615 - DNA, 22 bp, Artificial Sequence
  Synthetic oligonucleotide; TTC chr11 5179346 5179367 5179363 5179368 +
tgccaattaatctatttctcaa

SEQ ID NO: 75616 - DNA, 22 bp, Artificial Sequence
  Synthetic oligonucleotide; CTG chr11 5179348 5179369 5179365 5179370 +
ccaattaatctatttctcaaaa

SEQ ID NO: 75617 - DNA, 22 bp, Artificial Sequence
  Synthetic oligonucleotide; TTA chr11 5179355 5179376 5179372 5179377 +
atctatttctcaaaaatatagg

SEQ ID NO: 75618 - DNA, 22 bp, Artificial Sequence
  Synthetic oligonucleotide; CTA chr11 5179360 5179381 5179377 5179382 +
tttctcaaaaatataggataaa

SEQ ID NO: 75619 - DNA, 22 bp, Artificial Sequence
  Synthetic oligonucleotide; TTT chr11 5179363 5179384 5179380 5179385 +
ctcaaaaatataggataaaaca

SEQ ID NO: 75620 - DNA, 22 bp, Artificial Sequence
  Synthetic oligonucleotide; TTC chr11 5179364 5179385 5179381 5179386 +
tcaaaaatataggataaaacat

SEQ ID NO: 75621 - DNA, 22 bp, Artificial Sequence
  Synthetic oligonucleotide; CTC chr11 5179366 5179387 5179383 5179388 +
aaaaatataggataaaacatta

SEQ ID NO: 75622 - DNA, 22 bp, Artificial Sequence
  Synthetic oligonucleotide; TTA chr11 5179388 5179409 5179405 5179410 +
taaactttagatatttgcaatg

SEQ ID NO: 75623 - DNA, 22 bp, Artificial Sequence
  Synthetic oligonucleotide; CTT chr11 5179395 5179416 5179412 5179417 +
tagatatttgcaatggcagacg

SEQ ID NO: 75624 - DNA, 22 bp, Artificial Sequence
  Synthetic oligonucleotide; TTT chr11 5179396 5179417 5179413 5179418 +
agatatttgcaatggcagacgg

SEQ ID NO: 75625 - DNA, 22 bp, Artificial Sequence
  Synthetic oligonucleotide; TTA chr11 5179397 5179418 5179414 5179419 +
gatatttgcaatggcagacgga

SEQ ID NO: 75626 - DNA, 22 bp, Artificial Sequence
  Synthetic oligonucleotide; TTT chr11 5179404 5179425 5179421 5179426 +
gcaatggcagacggagctgggt

SEQ ID NO: 75627 - DNA, 22 bp, Artificial Sequence
  Synthetic oligonucleotide; TTG chr11 5179405 5179426 5179422 5179427 +
caatggcagacggagctgggtt

SEQ ID NO: 75628 - DNA, 22 bp, Artificial Sequence
  Synthetic oligonucleotide; CTG chr11 5179423 5179444 5179440 5179445 +
ggtttttaaatctatatgccag

SEQ ID NO: 75629 - DNA, 22 bp, Artificial Sequence
  Synthetic oligonucleotide; TTT chr11 5179428 5179449 5179445 5179450 +
ttaaatctatatgccagcctgg

SEQ ID NO: 75630 - DNA, 22 bp, Artificial Sequence
  Synthetic oligonucleotide; TTT chr11 5179429 5179450 5179446 5179451 +
taaatctatatgccagcctggc

SEQ ID NO: 75631 - DNA, 22 bp, Artificial Sequence
  Synthetic oligonucleotide; TTT chr11 5179430 5179451 5179447 5179452 +
aaatctatatgccagcctggca

SEQ ID NO: 75632 - DNA, 22 bp, Artificial Sequence
  Synthetic oligonucleotide; TTA chr11 5179431 5179452 5179448 5179453 +
aatctatatgccagcctggcac

SEQ ID NO: 75633 - DNA, 22 bp, Artificial Sequence
  Synthetic oligonucleotide; CTA chr11 5179437 5179458 5179454 5179459 +
tatgccagcctggcacggtggc

SEQ ID NO: 75634 - DNA, 22 bp, Artificial Sequence
  Synthetic oligonucleotide; CTG chr11 5179449 5179470 5179466 5179471 +
gcacggtggctcacacctgtaa

SEQ ID NO: 75635 - DNA, 22 bp, Artificial Sequence
  Synthetic oligonucleotide; CTC chr11 5179461 5179482 5179478 5179483 +
acacctgtaatcccagcacttt

SEQ ID NO: 75636 - DNA, 22 bp, Artificial Sequence
  Synthetic oligonucleotide; CTG chr11 5179468 5179489 5179485 5179490 +
taatcccagcactttgagaggc

SEQ ID NO: 75637 - DNA, 22 bp, Artificial Sequence
  Synthetic oligonucleotide; CTT chr11 5179482 5179503 5179499 5179504 +
tgagaggctgaggcgggtagat

SEQ ID NO: 75638 - DNA, 22 bp, Artificial Sequence
  Synthetic oligonucleotide; TTT chr11 5179483 5179504 5179500 5179505 +
gagaggctgaggcgggtagatc

SEQ ID NO: 75639 - DNA, 22 bp, Artificial Sequence
  Synthetic oligonucleotide; TTG chr11 5179484 5179505 5179501 5179506 +
agaggctgaggcgggtagatca

SEQ ID NO: 75640 - DNA, 22 bp, Artificial Sequence
  Synthetic oligonucleotide; CTG chr11 5179492 5179513 5179509 5179514 +
aggcgggtagatcacaaggtca

SEQ ID NO: 75641 - DNA, 22 bp, Artificial Sequence
  Synthetic oligonucleotide; TTC chr11 5179521 5179542 5179538 5179543 +
cagaccagcttgaccaaaacaa

SEQ ID NO: 75642 - DNA, 22 bp, Artificial Sequence
  Synthetic oligonucleotide; CTT chr11 5179532 5179553 5179549 5179554 +
gaccaaaacaatgaaaccccgt

SEQ ID NO: 75643 - DNA, 22 bp, Artificial Sequence
  Synthetic oligonucleotide; TTG chr11 5179533 5179554 5179550 5179555 +
accaaaacaatgaaaccccgtc

SEQ ID NO: 75644 - DNA, 22 bp, Artificial Sequence
  Synthetic oligonucleotide; CTC chr11 5179557 5179578 5179574 5179579 +
tactaaaaatacaaaaattagc

SEQ ID NO: 75645 - DNA, 22 bp, Artificial Sequence
  Synthetic oligonucleotide; CTA chr11 5179559 5179580 5179576 5179581 +
ctaaaaatacaaaaattagctg

SEQ ID NO: 75646 - DNA, 22 bp, Artificial Sequence
  Synthetic oligonucleotide; CTA chr11 5179562 5179583 5179579 5179584 +
aaaatacaaaaattagctgggc

SEQ ID NO: 75647 - DNA, 22 bp, Artificial Sequence
  Synthetic oligonucleotide; TTA chr11 5179577 5179598 5179594 5179599 +
gctgggcatagtggtgtgcacc

SEQ ID NO: 75648 - DNA, 22 bp, Artificial Sequence
  Synthetic oligonucleotide; CTG chr11 5179581 5179602 5179598 5179603 +
ggcatagtggtgtgcaccttta

SEQ ID NO: 75649 - DNA, 22 bp, Artificial Sequence
  Synthetic oligonucleotide; CTT chr11 5179601 5179622 5179618 5179623 +
taatcccagctactcaagaggc

SEQ ID NO: 75650 - DNA, 22 bp, Artificial Sequence
  Synthetic oligonucleotide; TTT chr11 5179602 5179623 5179619 5179624 +
aatcccagctactcaagaggct

SEQ ID NO: 75651 - DNA, 22 bp, Artificial Sequence
  Synthetic oligonucleotide; TTA chr11 5179603 5179624 5179620 5179625 +
atcccagctactcaagaggctg

SEQ ID NO: 75652 - DNA, 22 bp, Artificial Sequence
  Synthetic oligonucleotide; CTA chr11 5179613 5179634 5179630 5179635 +
ctcaagaggctgaggcaggaga

SEQ ID NO: 75653 - DNA, 22 bp, Artificial Sequence
  Synthetic oligonucleotide; CTC chr11 5179616 5179637 5179633 5179638 +
aagaggctgaggcaggagaatc

SEQ ID NO: 75654 - DNA, 22 bp, Artificial Sequence
  Synthetic oligonucleotide; CTG chr11 5179625 5179646 5179642 5179647 +
aggcaggagaatcgcttgaacc

SEQ ID NO: 75655 - DNA, 22 bp, Artificial Sequence
  Synthetic oligonucleotide; CTT chr11 5179642 5179663 5179659 5179664 +
gaacctgggaggcagaagtttc

SEQ ID NO: 75656 - DNA, 22 bp, Artificial Sequence
  Synthetic oligonucleotide; TTG chr11 5179643 5179664 5179660 5179665 +
aacctgggaggcagaagtttca

SEQ ID NO: 75657 - DNA, 22 bp, Artificial Sequence
  Synthetic oligonucleotide; CTG chr11 5179649 5179670 5179666 5179671 +
ggaggcagaagtttcagtgagc

SEQ ID NO: 75658 - DNA, 22 bp, Artificial Sequence
  Synthetic oligonucleotide; TTT chr11 5179663 5179684 5179680 5179685 +
cagtgagcagagatcgcgcaac

SEQ ID NO: 75659 - DNA, 22 bp, Artificial Sequence
  Synthetic oligonucleotide; TTC chr11 5179664 5179685 5179681 5179686 +
agtgagcagagatcgcgcaact

SEQ ID NO: 75660 - DNA, 22 bp, Artificial Sequence
  Synthetic oligonucleotide; CTG chr11 5179687 5179708 5179704 5179709 +
cactccagcctaggtgacagag

SEQ ID NO: 75661 - DNA, 22 bp, Artificial Sequence
  Synthetic oligonucleotide; CTC chr11 5179692 5179713 5179709 5179714 +
cagcctaggtgacagagcgaga

SEQ ID NO: 75662 - DNA, 22 bp, Artificial Sequence
  Synthetic oligonucleotide; CTA chr11 5179699 5179720 5179716 5179721 +
ggtgacagagcgagactccctc

SEQ ID NO: 75663 - DNA, 22 bp, Artificial Sequence
  Synthetic oligonucleotide; CTC chr11 5179717 5179738 5179734 5179739 +
cctctcaaaaaaaaaagtatat

SEQ ID NO: 75664 - DNA, 22 bp, Artificial Sequence
  Synthetic oligonucleotide; CTC chr11 5179721 5179742 5179738 5179743 +
tcaaaaaaaaaagtatatgcct

SEQ ID NO: 75665 - DNA, 22 bp, Artificial Sequence
  Synthetic oligonucleotide; CTC chr11 5179723 5179744 5179740 5179745 +
aaaaaaaaaagtatatgcctca

SEQ ID NO: 75666 - DNA, 22 bp, Artificial Sequence
  Synthetic oligonucleotide; CTC chr11 5179744 5179765 5179761 5179766 +
ataggtggtaaagaataaaata

SEQ ID NO: 75667 - DNA, 22 bp, Artificial Sequence
  Synthetic oligonucleotide; TTT chr11 5179769 5179790 5179786 5179791 +
tgtttctttccacttcagtcac

SEQ ID NO: 75668 - DNA, 22 bp, Artificial Sequence
  Synthetic oligonucleotide; TTT chr11 5179770 5179791 5179787 5179792 +
gtttctttccacttcagtcact

SEQ ID NO: 75669 - DNA, 22 bp, Artificial Sequence
  Synthetic oligonucleotide; TTG chr11 5179771 5179792 5179788 5179793 +
tttctttccacttcagtcactg

SEQ ID NO: 75670 - DNA, 22 bp, Artificial Sequence
  Synthetic oligonucleotide; TTT chr11 5179774 5179795 5179791 5179796 +
ctttccacttcagtcactgatt

SEQ ID NO: 75671 - DNA, 22 bp, Artificial Sequence
  Synthetic oligonucleotide; TTC chr11 5179775 5179796 5179792 5179797 +
tttccacttcagtcactgattg

SEQ ID NO: 75672 - DNA, 22 bp, Artificial Sequence
  Synthetic oligonucleotide; CTT chr11 5179777 5179798 5179794 5179799 +
tccacttcagtcactgattgaa

SEQ ID NO: 75673 - DNA, 22 bp, Artificial Sequence
  Synthetic oligonucleotide; TTT chr11 5179778 5179799 5179795 5179800 +
ccacttcagtcactgattgaaa

SEQ ID NO: 75674 - DNA, 22 bp, Artificial Sequence
  Synthetic oligonucleotide; TTC chr11 5179779 5179800 5179796 5179801 +
cacttcagtcactgattgaaaa

SEQ ID NO: 75675 - DNA, 22 bp, Artificial Sequence
  Synthetic oligonucleotide; CTT chr11 5179784 5179805 5179801 5179806 +
cagtcactgattgaaaatgaga

SEQ ID NO: 75676 - DNA, 22 bp, Artificial Sequence
  Synthetic oligonucleotide; TTC chr11 5179785 5179806 5179802 5179807 +
agtcactgattgaaaatgagac

SEQ ID NO: 75677 - DNA, 22 bp, Artificial Sequence
  Synthetic oligonucleotide; CTG chr11 5179793 5179814 5179810 5179815 +
attgaaaatgagacaatacaca

SEQ ID NO: 75678 - DNA, 22 bp, Artificial Sequence
  Synthetic oligonucleotide; TTG chr11 5179797 5179818 5179814 5179819 +
aaaatgagacaatacacattgt

SEQ ID NO: 75679 - DNA, 22 bp, Artificial Sequence
  Synthetic oligonucleotide; TTG chr11 5179818 5179839 5179835 5179840 +
tatatatatatatatgtttatt

SEQ ID NO: 75680 - DNA, 22 bp, Artificial Sequence
  Synthetic oligonucleotide; TTT chr11 5179837 5179858 5179854 5179859 +
attatactttaagttctagggt

SEQ ID NO: 75681 - DNA, 22 bp, Artificial Sequence
  Synthetic oligonucleotide; TTA chr11 5179838 5179859 5179855 5179860 +
ttatactttaagttctagggta

SEQ ID NO: 75682 - DNA, 22 bp, Artificial Sequence
  Synthetic oligonucleotide; TTA chr11 5179841 5179862 5179858 5179863 +
tactttaagttctagggtacat

SEQ ID NO: 75683 - DNA, 22 bp, Artificial Sequence
  Synthetic oligonucleotide; CTT chr11 5179846 5179867 5179863 5179868 +
taagttctagggtacatgtgca

SEQ ID NO: 75684 - DNA, 22 bp, Artificial Sequence
  Synthetic oligonucleotide; TTT chr11 5179847 5179868 5179864 5179869 +
aagttctagggtacatgtgcac

SEQ ID NO: 75685 - DNA, 22 bp, Artificial Sequence
  Synthetic oligonucleotide; TTA chr11 5179848 5179869 5179865 5179870 +
agttctagggtacatgtgcaca

SEQ ID NO: 75686 - DNA, 22 bp, Artificial Sequence
  Synthetic oligonucleotide; TTC chr11 5179853 5179874 5179870 5179875 +
tagggtacatgtgcacaacatg

SEQ ID NO: 75687 - DNA, 22 bp, Artificial Sequence
  Synthetic oligonucleotide; CTA chr11 5179855 5179876 5179872 5179877 +
gggtacatgtgcacaacatgca

SEQ ID NO: 75688 - DNA, 22 bp, Artificial Sequence
  Synthetic oligonucleotide; TTT chr11 5179882 5179903 5179899 5179904 +
gttacatatgtatacatgtgcc

SEQ ID NO: 75689 - DNA, 22 bp, Artificial Sequence
  Synthetic oligonucleotide; TTG chr11 5179883 5179904 5179900 5179905 +
ttacatatgtatacatgtgcca

SEQ ID NO: 75690 - DNA, 22 bp, Artificial Sequence
  Synthetic oligonucleotide; TTA chr11 5179886 5179907 5179903 5179908 +
catatgtatacatgtgccatgt

SEQ ID NO: 75691 - DNA, 22 bp, Artificial Sequence
  Synthetic oligonucleotide; TTG chr11 5179910 5179931 5179927 5179932 +
gtgtgctgcacccattaactcg

SEQ ID NO: 75692 - DNA, 22 bp, Artificial Sequence
  Synthetic oligonucleotide; CTG chr11 5179918 5179939 5179935 5179940 +
cacccattaactcgtcatttac

SEQ ID NO: 75693 - DNA, 22 bp, Artificial Sequence
  Synthetic oligonucleotide; TTA chr11 5179927 5179948 5179944 5179949 +
actcgtcatttacattaggtat

SEQ ID NO: 75694 - DNA, 22 bp, Artificial Sequence
  Synthetic oligonucleotide; CTC chr11 5179931 5179952 5179948 5179953 +
gtcatttacattaggtatatct

SEQ ID NO: 75695 - DNA, 22 bp, Artificial Sequence
  Synthetic oligonucleotide; TTT chr11 5179938 5179959 5179955 5179960 +
acattaggtatatctcctaatg

SEQ ID NO: 75696 - DNA, 22 bp, Artificial Sequence
  Synthetic oligonucleotide; TTA chr11 5179939 5179960 5179956 5179961 +
cattaggtatatctcctaatgc

SEQ ID NO: 75697 - DNA, 22 bp, Artificial Sequence
  Synthetic oligonucleotide; TTA chr11 5179944 5179965 5179961 5179966 +
ggtatatctcctaatgctatcc

SEQ ID NO: 75698 - DNA, 22 bp, Artificial Sequence
  Synthetic oligonucleotide; CTC chr11 5179954 5179975 5179971 5179976 +
ctaatgctatccctccccccgg

SEQ ID NO: 75699 - DNA, 22 bp, Artificial Sequence
  Synthetic oligonucleotide; CTA chr11 5179957 5179978 5179974 5179979 +
atgctatccctccccccggccc

SEQ ID NO: 75700 - DNA, 22 bp, Artificial Sequence
  Synthetic oligonucleotide; CTA chr11 5179963 5179984 5179980 5179985 +
tccctccccccggcccccaccc

SEQ ID NO: 75701 - DNA, 22 bp, Artificial Sequence
  Synthetic oligonucleotide; CTC chr11 5179969 5179990 5179986 5179991 +
cccccggcccccaccccacaac

SEQ ID NO: 75702 - DNA, 22 bp, Artificial Sequence
  Synthetic oligonucleotide; TTC chr11 5180012 5180033 5180029 5180034 +
ccctcactgtgtccaaatgttc

SEQ ID NO: 75703 - DNA, 22 bp, Artificial Sequence
  Synthetic oligonucleotide; CTC chr11 5180017 5180038 5180034 5180039 +
actgtgtccaaatgttctcatt

SEQ ID NO: 75704 - DNA, 22 bp, Artificial Sequence
  Synthetic oligonucleotide; CTG chr11 5180021 5180042 5180038 5180043 +
tgtccaaatgttctcattgttc

SEQ ID NO: 75705 - DNA, 22 bp, Artificial Sequence
  Synthetic oligonucleotide; TTC chr11 5180034 5180055 5180051 5180056 +
tcattgttcaactcccacctat

SEQ ID NO: 75706 - DNA, 22 bp, Artificial Sequence
  Synthetic oligonucleotide; CTC chr11 5180036 5180057 5180053 5180058 +
attgttcaactcccacctatga

SEQ ID NO: 75707 - DNA, 22 bp, Artificial Sequence
  Synthetic oligonucleotide; TTG chr11 5180040 5180061 5180057 5180062 +
ttcaactcccacctatgagtga

SEQ ID NO: 75708 - DNA, 22 bp, Artificial Sequence
  Synthetic oligonucleotide; TTC chr11 5180043 5180064 5180060 5180065 +
aactcccacctatgagtgagaa

SEQ ID NO: 75709 - DNA, 22 bp, Artificial Sequence
  Synthetic oligonucleotide; CTC chr11 5180048 5180069 5180065 5180070 +
ccacctatgagtgagaatatgt

SEQ ID NO: 75710 - DNA, 22 bp, Artificial Sequence
  Synthetic oligonucleotide; CTA chr11 5180055 5180076 5180072 5180077 +
tgagtgagaatatgtggtgttt

SEQ ID NO: 75711 - DNA, 22 bp, Artificial Sequence
  Synthetic oligonucleotide; TTT chr11 5180077 5180098 5180094 5180099 +
ggtttttcgtccttgcgatact

SEQ ID NO: 75712 - DNA, 22 bp, Artificial Sequence
  Synthetic oligonucleotide; TTG chr11 5180078 5180099 5180095 5180100 +
gtttttcgtccttgcgatactt

SEQ ID NO: 75713 - DNA, 22 bp, Artificial Sequence
  Synthetic oligonucleotide; TTT chr11 5180082 5180103 5180099 5180104 +
ttcgtccttgcgatactttgct

SEQ ID NO: 75714 - DNA, 22 bp, Artificial Sequence
  Synthetic oligonucleotide; TTT chr11 5180083 5180104 5180100 5180105 +
tcgtccttgcgatactttgctc

SEQ ID NO: 75715 - DNA, 22 bp, Artificial Sequence
  Synthetic oligonucleotide; TTT chr11 5180084 5180105 5180101 5180106 +
cgtccttgcgatactttgctca

SEQ ID NO: 75716 - DNA, 22 bp, Artificial Sequence
  Synthetic oligonucleotide; TTC chr11 5180085 5180106 5180102 5180107 +
gtccttgcgatactttgctcag

SEQ ID NO: 75717 - DNA, 22 bp, Artificial Sequence
  Synthetic oligonucleotide; CTT chr11 5180091 5180112 5180108 5180113 +
gcgatactttgctcagaatgat

SEQ ID NO: 75718 - DNA, 22 bp, Artificial Sequence
  Synthetic oligonucleotide; TTG chr11 5180092 5180113 5180109 5180114 +
cgatactttgctcagaatgatg

SEQ ID NO: 75719 - DNA, 22 bp, Artificial Sequence
  Synthetic oligonucleotide; CTT chr11 5180100 5180121 5180117 5180122 +
tgctcagaatgatggtttccag

SEQ ID NO: 75720 - DNA, 22 bp, Artificial Sequence
  Synthetic oligonucleotide; TTT chr11 5180101 5180122 5180118 5180123 +
gctcagaatgatggtttccagt

SEQ ID NO: 75721 - DNA, 22 bp, Artificial Sequence
  Synthetic oligonucleotide; TTG chr11 5180102 5180123 5180119 5180124 +
ctcagaatgatggtttccagtt

SEQ ID NO: 75722 - DNA, 22 bp, Artificial Sequence
  Synthetic oligonucleotide; CTC chr11 5180105 5180126 5180122 5180127 +
agaatgatggtttccagtttca

SEQ ID NO: 75723 - DNA, 22 bp, Artificial Sequence
  Synthetic oligonucleotide; TTT chr11 5180118 5180139 5180135 5180140 +
ccagtttcatccatgtccctac

SEQ ID NO: 75724 - DNA, 22 bp, Artificial Sequence
  Synthetic oligonucleotide; TTC chr11 5180119 5180140 5180136 5180141 +
cagtttcatccatgtccctaca

SEQ ID NO: 75725 - DNA, 22 bp, Artificial Sequence
  Synthetic oligonucleotide; TTT chr11 5180125 5180146 5180142 5180147 +
catccatgtccctacaaaggac

SEQ ID NO: 75726 - DNA, 22 bp, Artificial Sequence
  Synthetic oligonucleotide; TTC chr11 5180126 5180147 5180143 5180148 +
atccatgtccctacaaaggaca

SEQ ID NO: 75727 - DNA, 22 bp, Artificial Sequence
  Synthetic oligonucleotide; CTA chr11 5180139 5180160 5180156 5180161 +
caaaggacatgaactcatcatt

SEQ ID NO: 75728 - DNA, 22 bp, Artificial Sequence
  Synthetic oligonucleotide; CTC chr11 5180155 5180176 5180172 5180177 +
atcattttttatggctgcatag

SEQ ID NO: 75729 - DNA, 22 bp, Artificial Sequence
  Synthetic oligonucleotide; TTT chr11 5180162 5180183 5180179 5180184 +
tttatggctgcatagtattcca

SEQ ID NO: 75730 - DNA, 22 bp, Artificial Sequence
  Synthetic oligonucleotide; TTT chr11 5180163 5180184 5180180 5180185 +
ttatggctgcatagtattccat

SEQ ID NO: 75731 - DNA, 22 bp, Artificial Sequence
  Synthetic oligonucleotide; TTT chr11 5180164 5180185 5180181 5180186 +
tatggctgcatagtattccatg

SEQ ID NO: 75732 - DNA, 22 bp, Artificial Sequence
  Synthetic oligonucleotide; TTT chr11 5180165 5180186 5180182 5180187 +
atggctgcatagtattccatga

SEQ ID NO: 75733 - DNA, 22 bp, Artificial Sequence
  Synthetic oligonucleotide; TTA chr11 5180166 5180187 5180183 5180188 +
tggctgcatagtattccatgat

SEQ ID NO: 75734 - DNA, 22 bp, Artificial Sequence
  Synthetic oligonucleotide; CTG chr11 5180172 5180193 5180189 5180194 +
catagtattccatgatgtatat

SEQ ID NO: 75735 - DNA, 22 bp, Artificial Sequence
  Synthetic oligonucleotide; TTC chr11 5180182 5180203 5180199 5180204 +
catgatgtatatgtgccacatt

SEQ ID NO: 75736 - DNA, 22 bp, Artificial Sequence
  Synthetic oligonucleotide; TTT chr11 5180205 5180226 5180222 5180227 +
tcttaatccagtctatcattgt

SEQ ID NO: 75737 - DNA, 22 bp, Artificial Sequence
  Synthetic oligonucleotide; TTT chr11 5180206 5180227 5180223 5180228 +
cttaatccagtctatcattgtt

SEQ ID NO: 75738 - DNA, 22 bp, Artificial Sequence
  Synthetic oligonucleotide; TTC chr11 5180207 5180228 5180224 5180229 +
ttaatccagtctatcattgttg

SEQ ID NO: 75739 - DNA, 22 bp, Artificial Sequence
  Synthetic oligonucleotide; CTT chr11 5180209 5180230 5180226 5180231 +
aatccagtctatcattgttgga

SEQ ID NO: 75740 - DNA, 22 bp, Artificial Sequence
  Synthetic oligonucleotide; TTA chr11 5180210 5180231 5180227 5180232 +
atccagtctatcattgttggac

SEQ ID NO: 75741 - DNA, 22 bp, Artificial Sequence
  Synthetic oligonucleotide; CTA chr11 5180220 5180241 5180237 5180242 +
tcattgttggacatttgggttg

SEQ ID NO: 75742 - DNA, 22 bp, Artificial Sequence
  Synthetic oligonucleotide; TTG chr11 5180226 5180247 5180243 5180248 +
ttggacatttgggttggttcca

SEQ ID NO: 75743 - DNA, 22 bp, Artificial Sequence
  Synthetic oligonucleotide; TTG chr11 5180229 5180250 5180246 5180251 +
gacatttgggttggttccaagt

SEQ ID NO: 75744 - DNA, 22 bp, Artificial Sequence
  Synthetic oligonucleotide; TTT chr11 5180236 5180257 5180253 5180258 +
gggttggttccaagtctttgct

SEQ ID NO: 75745 - DNA, 22 bp, Artificial Sequence
  Synthetic oligonucleotide; TTG chr11 5180237 5180258 5180254 5180259 +
ggttggttccaagtctttgcta

SEQ ID NO: 75746 - DNA, 22 bp, Artificial Sequence
  Synthetic oligonucleotide; TTG chr11 5180242 5180263 5180259 5180264 +
gttccaagtctttgctattgtg

SEQ ID NO: 75747 - DNA, 22 bp, Artificial Sequence
  Synthetic oligonucleotide; TTC chr11 5180246 5180267 5180263 5180268 +
caagtctttgctattgtgaata

SEQ ID NO: 75748 - DNA, 22 bp, Artificial Sequence
  Synthetic oligonucleotide; CTT chr11 5180254 5180275 5180271 5180276 +
tgctattgtgaatagtgccaca

SEQ ID NO: 75749 - DNA, 22 bp, Artificial Sequence
  Synthetic oligonucleotide; TTT chr11 5180255 5180276 5180272 5180277 +
gctattgtgaatagtgccacaa

SEQ ID NO: 75750 - DNA, 22 bp, Artificial Sequence
  Synthetic oligonucleotide; TTG chr11 5180256 5180277 5180273 5180278 +
ctattgtgaatagtgccacaat

SEQ ID NO: 75751 - DNA, 22 bp, Artificial Sequence
  Synthetic oligonucleotide; CTA chr11 5180259 5180280 5180276 5180281 +
ttgtgaatagtgccacaataaa

SEQ ID NO: 75752 - DNA, 22 bp, Artificial Sequence
  Synthetic oligonucleotide; TTG chr11 5180262 5180283 5180279 5180284 +
tgaatagtgccacaataaacat

SEQ ID NO: 75753 - DNA, 22 bp, Artificial Sequence
  Synthetic oligonucleotide; CTT chr11 5180301 5180322 5180318 5180323 +
tatagcagcatgatttacattc

SEQ ID NO: 75754 - DNA, 22 bp, Artificial Sequence
  Synthetic oligonucleotide; TTT chr11 5180302 5180323 5180319 5180324 +
atagcagcatgatttacattcc

SEQ ID NO: 75755 - DNA, 22 bp, Artificial Sequence
  Synthetic oligonucleotide; TTA chr11 5180303 5180324 5180320 5180325 +
tagcagcatgatttacattcct

SEQ ID NO: 75756 - DNA, 22 bp, Artificial Sequence
  Synthetic oligonucleotide; TTT chr11 5180317 5180338 5180334 5180339 +
acattcctttgggtatataccc

SEQ ID NO: 75757 - DNA, 22 bp, Artificial Sequence
  Synthetic oligonucleotide; TTA chr11 5180318 5180339 5180335 5180340 +
cattcctttgggtatataccca

SEQ ID NO: 75758 - DNA, 22 bp, Artificial Sequence
  Synthetic oligonucleotide; TTC chr11 5180323 5180344 5180340 5180345 +
ctttgggtatatacccagtaat

SEQ ID NO: 75759 - DNA, 22 bp, Artificial Sequence
  Synthetic oligonucleotide; CTT chr11 5180326 5180347 5180343 5180348 +
tgggtatatacccagtaatagg

SEQ ID NO: 75760 - DNA, 22 bp, Artificial Sequence
  Synthetic oligonucleotide; TTT chr11 5180327 5180348 5180344 5180349 +
gggtatatacccagtaatagga

SEQ ID NO: 75761 - DNA, 22 bp, Artificial Sequence
  Synthetic oligonucleotide; TTG chr11 5180328 5180349 5180345 5180350 +
ggtatatacccagtaataggat

SEQ ID NO: 75762 - DNA, 22 bp, Artificial Sequence
  Synthetic oligonucleotide; CTG chr11 5180355 5180376 5180372 5180377 +
ggtcaaatggtatttctagttc

SEQ ID NO: 75763 - DNA, 22 bp, Artificial Sequence
  Synthetic oligonucleotide; TTT chr11 5180370 5180391 5180387 5180392 +
ctagttctagatccctgaggaa

SEQ ID NO: 75764 - DNA, 22 bp, Artificial Sequence
  Synthetic oligonucleotide; TTC chr11 5180371 5180392 5180388 5180393 +
tagttctagatccctgaggaat

SEQ ID NO: 75765 - DNA, 22 bp, Artificial Sequence
  Synthetic oligonucleotide; CTA chr11 5180373 5180394 5180390 5180395 +
gttctagatccctgaggaattg

SEQ ID NO: 75766 - DNA, 22 bp, Artificial Sequence
  Synthetic oligonucleotide; TTC chr11 5180377 5180398 5180394 5180399 +
tagatccctgaggaattgccac

SEQ ID NO: 75767 - DNA, 22 bp, Artificial Sequence
  Synthetic oligonucleotide; CTA chr11 5180379 5180400 5180396 5180401 +
gatccctgaggaattgccacac

SEQ ID NO: 75768 - DNA, 22 bp, Artificial Sequence
  Synthetic oligonucleotide; CTG chr11 5180387 5180408 5180404 5180409 +
aggaattgccacactgacttcc

SEQ ID NO: 75769 - DNA, 22 bp, Artificial Sequence
  Synthetic oligonucleotide; TTG chr11 5180395 5180416 5180412 5180417 +
ccacactgacttccacaatggt

SEQ ID NO: 75770 - DNA, 22 bp, Artificial Sequence
  Synthetic oligonucleotide; CTG chr11 5180403 5180424 5180420 5180425 +
acttccacaatggttgaactag

SEQ ID NO: 75771 - DNA, 22 bp, Artificial Sequence
  Synthetic oligonucleotide; CTT chr11 5180407 5180428 5180424 5180429 +
ccacaatggttgaactagttta

SEQ ID NO: 75772 - DNA, 22 bp, Artificial Sequence
  Synthetic oligonucleotide; TTC chr11 5180408 5180429 5180425 5180430 +
cacaatggttgaactagtttat

SEQ ID NO: 75773 - DNA, 22 bp, Artificial Sequence
  Synthetic oligonucleotide; TTG chr11 5180419 5180440 5180436 5180441 +
aactagtttatagtcccaccaa

SEQ ID NO: 75774 - DNA, 22 bp, Artificial Sequence
  Synthetic oligonucleotide; CTA chr11 5180424 5180445 5180441 5180446 +
gtttatagtcccaccaacagtg

SEQ ID NO: 75775 - DNA, 22 bp, Artificial Sequence
  Synthetic oligonucleotide; TTT chr11 5180428 5180449 5180445 5180450 +
atagtcccaccaacagtgtaaa

SEQ ID NO: 75776 - DNA, 22 bp, Artificial Sequence
  Synthetic oligonucleotide; TTA chr11 5180429 5180450 5180446 5180451 +
tagtcccaccaacagtgtaaaa

SEQ ID NO: 75777 - DNA, 22 bp, Artificial Sequence
  Synthetic oligonucleotide; TTC chr11 5180457 5180478 5180474 5180479 +
ctatttctccacatcctctcca

SEQ ID NO: 75778 - DNA, 22 bp, Artificial Sequence
  Synthetic oligonucleotide; CTA chr11 5180460 5180481 5180477 5180482 +
tttctccacatcctctccagca

SEQ ID NO: 75779 - DNA, 22 bp, Artificial Sequence
  Synthetic oligonucleotide; TTT chr11 5180463 5180484 5180480 5180485 +
ctccacatcctctccagcacct

SEQ ID NO: 75780 - DNA, 22 bp, Artificial Sequence
  Synthetic oligonucleotide; TTC chr11 5180464 5180485 5180481 5180486 +
tccacatcctctccagcacctg

SEQ ID NO: 75781 - DNA, 22 bp, Artificial Sequence
  Synthetic oligonucleotide; CTC chr11 5180466 5180487 5180483 5180488 +
cacatcctctccagcacctgtg

SEQ ID NO: 75782 - DNA, 22 bp, Artificial Sequence
  Synthetic oligonucleotide; CTC chr11 5180475 5180496 5180492 5180497 +
tccagcacctgtggtttcctga

SEQ ID NO: 75783 - DNA, 22 bp, Artificial Sequence
  Synthetic oligonucleotide; CTC chr11 5180477 5180498 5180494 5180499 +
cagcacctgtggtttcctgact

SEQ ID NO: 75784 - DNA, 22 bp, Artificial Sequence
  Synthetic oligonucleotide; CTG chr11 5180486 5180507 5180503 5180508 +
tggtttcctgactttttaatga

SEQ ID NO: 75785 - DNA, 22 bp, Artificial Sequence
  Synthetic oligonucleotide; TTT chr11 5180492 5180513 5180509 5180514 +
cctgactttttaatgatcacca

SEQ ID NO: 75786 - DNA, 22 bp, Artificial Sequence
  Synthetic oligonucleotide; TTC chr11 5180493 5180514 5180510 5180515 +
ctgactttttaatgatcaccat

SEQ ID NO: 75787 - DNA, 22 bp, Artificial Sequence
  Synthetic oligonucleotide; CTG chr11 5180496 5180517 5180513 5180518 +
actttttaatgatcaccattct

SEQ ID NO: 75788 - DNA, 22 bp, Artificial Sequence
  Synthetic oligonucleotide; CTT chr11 5180500 5180521 5180517 5180522 +
tttaatgatcaccattctaact

SEQ ID NO: 75789 - DNA, 22 bp, Artificial Sequence
  Synthetic oligonucleotide; TTT chr11 5180501 5180522 5180518 5180523 +
ttaatgatcaccattctaactg

SEQ ID NO: 75790 - DNA, 22 bp, Artificial Sequence
  Synthetic oligonucleotide; TTT chr11 5180502 5180523 5180519 5180524 +
taatgatcaccattctaactgg

SEQ ID NO: 75791 - DNA, 22 bp, Artificial Sequence
  Synthetic oligonucleotide; TTT chr11 5180503 5180524 5180520 5180525 +
aatgatcaccattctaactggt

SEQ ID NO: 75792 - DNA, 22 bp, Artificial Sequence
  Synthetic oligonucleotide; TTA chr11 5180504 5180525 5180521 5180526 +
atgatcaccattctaactggtg

SEQ ID NO: 75793 - DNA, 22 bp, Artificial Sequence
  Synthetic oligonucleotide; TTC chr11 5180517 5180538 5180534 5180539 +
taactggtgtgagatgatatct

SEQ ID NO: 75794 - DNA, 22 bp, Artificial Sequence
  Synthetic oligonucleotide; CTA chr11 5180519 5180540 5180536 5180541 +
actggtgtgagatgatatctca

SEQ ID NO: 75795 - DNA, 22 bp, Artificial Sequence
  Synthetic oligonucleotide; CTG chr11 5180523 5180544 5180540 5180545 +
gtgtgagatgatatctcattgt

SEQ ID NO: 75796 - DNA, 22 bp, Artificial Sequence
  Synthetic oligonucleotide; CTC chr11 5180540 5180561 5180557 5180562 +
attgtggttttgatttgcattt

SEQ ID NO: 75797 - DNA, 22 bp, Artificial Sequence
  Synthetic oligonucleotide; TTG chr11 5180544 5180565 5180561 5180566 +
tggttttgatttgcatttctct

SEQ ID NO: 75798 - DNA, 22 bp, Artificial Sequence
  Synthetic oligonucleotide; TTT chr11 5180550 5180571 5180567 5180572 +
tgatttgcatttctctgatggc

SEQ ID NO: 75799 - DNA, 22 bp, Artificial Sequence
  Synthetic oligonucleotide; TTT chr11 5180551 5180572 5180568 5180573 +
gatttgcatttctctgatggcc

SEQ ID NO: 75800 - DNA, 22 bp, Artificial Sequence
  Synthetic oligonucleotide; TTG chr11 5180552 5180573 5180569 5180574 +
atttgcatttctctgatggcca

SEQ ID NO: 75801 - DNA, 22 bp, Artificial Sequence
  Synthetic oligonucleotide; TTT chr11 5180556 5180577 5180573 5180578 +
gcatttctctgatggccagtga

SEQ ID NO: 75802 - DNA, 22 bp, Artificial Sequence
  Synthetic oligonucleotide; TTG chr11 5180557 5180578 5180574 5180579 +
catttctctgatggccagtgat

SEQ ID NO: 75803 - DNA, 22 bp, Artificial Sequence
  Synthetic oligonucleotide; TTT chr11 5180562 5180583 5180579 5180584 +
ctctgatggccagtgatgatga

SEQ ID NO: 75804 - DNA, 22 bp, Artificial Sequence
  Synthetic oligonucleotide; TTC chr11 5180563 5180584 5180580 5180585 +
tctgatggccagtgatgatgag

SEQ ID NO: 75805 - DNA, 22 bp, Artificial Sequence
  Synthetic oligonucleotide; CTC chr11 5180565 5180586 5180582 5180587 +
tgatggccagtgatgatgagca

SEQ ID NO: 75806 - DNA, 22 bp, Artificial Sequence
  Synthetic oligonucleotide; CTG chr11 5180567 5180588 5180584 5180589 +
atggccagtgatgatgagcatt

SEQ ID NO: 75807 - DNA, 22 bp, Artificial Sequence
  Synthetic oligonucleotide; TTT chr11 5180590 5180611 5180607 5180612 +
tttcatgtgttttttggctgca

SEQ ID NO: 75808 - DNA, 22 bp, Artificial Sequence
  Synthetic oligonucleotide; TTT chr11 5180591 5180612 5180608 5180613 +
ttcatgtgttttttggctgcat

SEQ ID NO: 75809 - DNA, 22 bp, Artificial Sequence
  Synthetic oligonucleotide; TTT chr11 5180592 5180613 5180609 5180614 +
tcatgtgttttttggctgcata

SEQ ID NO: 75810 - DNA, 22 bp, Artificial Sequence
  Synthetic oligonucleotide; TTT chr11 5180593 5180614 5180610 5180615 +
catgtgttttttggctgcataa

SEQ ID NO: 75811 - DNA, 22 bp, Artificial Sequence
  Synthetic oligonucleotide; TTC chr11 5180594 5180615 5180611 5180616 +
atgtgttttttggctgcataaa

SEQ ID NO: 75812 - DNA, 22 bp, Artificial Sequence
  Synthetic oligonucleotide; TTT chr11 5180602 5180623 5180619 5180624 +
tttggctgcataaatgtcttct

SEQ ID NO: 75813 - DNA, 22 bp, Artificial Sequence
  Synthetic oligonucleotide; TTT chr11 5180603 5180624 5180620 5180625 +
ttggctgcataaatgtcttctt

SEQ ID NO: 75814 - DNA, 22 bp, Artificial Sequence
  Synthetic oligonucleotide; TTT chr11 5180604 5180625 5180621 5180626 +
tggctgcataaatgtcttcttt

SEQ ID NO: 75815 - DNA, 22 bp, Artificial Sequence
  Synthetic oligonucleotide; TTT chr11 5180605 5180626 5180622 5180627 +
ggctgcataaatgtcttctttt

SEQ ID NO: 75816 - DNA, 22 bp, Artificial Sequence
  Synthetic oligonucleotide; TTG chr11 5180606 5180627 5180623 5180628 +
gctgcataaatgtcttcttttg

SEQ ID NO: 75817 - DNA, 22 bp, Artificial Sequence
  Synthetic oligonucleotide; CTG chr11 5180610 5180631 5180627 5180632 +
cataaatgtcttcttttgagaa

SEQ ID NO: 75818 - DNA, 22 bp, Artificial Sequence
  Synthetic oligonucleotide; CTT chr11 5180622 5180643 5180639 5180644 +
cttttgagaagtgtctgttcat

SEQ ID NO: 75819 - DNA, 22 bp, Artificial Sequence
  Synthetic oligonucleotide; TTC chr11 5180623 5180644 5180640 5180645 +
ttttgagaagtgtctgttcata

SEQ ID NO: 75820 - DNA, 22 bp, Artificial Sequence
  Synthetic oligonucleotide; CTT chr11 5180625 5180646 5180642 5180647 +
ttgagaagtgtctgttcatatc

SEQ ID NO: 75821 - DNA, 22 bp, Artificial Sequence
  Synthetic oligonucleotide; TTT chr11 5180626 5180647 5180643 5180648 +
tgagaagtgtctgttcatatcc

SEQ ID NO: 75822 - DNA, 22 bp, Artificial Sequence
  Synthetic oligonucleotide; TTT chr11 5180627 5180648 5180644 5180649 +
gagaagtgtctgttcatatcct

SEQ ID NO: 75823 - DNA, 22 bp, Artificial Sequence
  Synthetic oligonucleotide; TTG chr11 5180628 5180649 5180645 5180650 +
agaagtgtctgttcatatcctt

SEQ ID NO: 75824 - DNA, 22 bp, Artificial Sequence
  Synthetic oligonucleotide; CTG chr11 5180639 5180660 5180656 5180661 +
ttcatatccttcacccccttgt

SEQ ID NO: 75825 - DNA, 22 bp, Artificial Sequence
  Synthetic oligonucleotide; TTC chr11 5180642 5180663 5180659 5180664 +
atatccttcacccccttgttga

SEQ ID NO: 75826 - DNA, 22 bp, Artificial Sequence
  Synthetic oligonucleotide; CTT chr11 5180650 5180671 5180667 5180672 +
cacccccttgttgatgcagttg

SEQ ID NO: 75827 - DNA, 22 bp, Artificial Sequence
  Synthetic oligonucleotide; TTC chr11 5180651 5180672 5180668 5180673 +
acccccttgttgatgcagttgt

SEQ ID NO: 75828 - DNA, 22 bp, Artificial Sequence
  Synthetic oligonucleotide; CTT chr11 5180659 5180680 5180676 5180681 +
gttgatgcagttgtttgttttt

SEQ ID NO: 75829 - DNA, 22 bp, Artificial Sequence
  Synthetic oligonucleotide; TTG chr11 5180660 5180681 5180677 5180682 +
ttgatgcagttgtttgtttttt

SEQ ID NO: 75830 - DNA, 22 bp, Artificial Sequence
  Synthetic oligonucleotide; TTG chr11 5180663 5180684 5180680 5180685 +
atgcagttgtttgtttttttct

SEQ ID NO: 75831 - DNA, 22 bp, Artificial Sequence
  Synthetic oligonucleotide; TTG chr11 5180672 5180693 5180689 5180694 +
tttgtttttttcttgtaaattt

SEQ ID NO: 75832 - DNA, 22 bp, Artificial Sequence
  Synthetic oligonucleotide; TTT chr11 5180675 5180696 5180692 5180697 +
gtttttttcttgtaaatttgtt

SEQ ID NO: 75833 - DNA, 22 bp, Artificial Sequence
  Synthetic oligonucleotide; TTG chr11 5180676 5180697 5180693 5180698 +
tttttttcttgtaaatttgttt

SEQ ID NO: 75834 - DNA, 22 bp, Artificial Sequence
  Synthetic oligonucleotide; TTT chr11 5180679 5180700 5180696 5180701 +
ttttcttgtaaatttgtttgag

SEQ ID NO: 75835 - DNA, 22 bp, Artificial Sequence
  Synthetic oligonucleotide; TTT chr11 5180680 5180701 5180697 5180702 +
tttcttgtaaatttgtttgagt

SEQ ID NO: 75836 - DNA, 22 bp, Artificial Sequence
  Synthetic oligonucleotide; TTT chr11 5180681 5180702 5180698 5180703 +
ttcttgtaaatttgtttgagtt

SEQ ID NO: 75837 - DNA, 22 bp, Artificial Sequence
  Synthetic oligonucleotide; TTT chr11 5180682 5180703 5180699 5180704 +
tcttgtaaatttgtttgagttc

SEQ ID NO: 75838 - DNA, 22 bp, Artificial Sequence
  Synthetic oligonucleotide; TTT chr11 5180683 5180704 5180700 5180705 +
cttgtaaatttgtttgagttca

SEQ ID NO: 75839 - DNA, 22 bp, Artificial Sequence
  Synthetic oligonucleotide; TTC chr11 5180684 5180705 5180701 5180706 +
ttgtaaatttgtttgagttcat

SEQ ID NO: 75840 - DNA, 22 bp, Artificial Sequence
  Synthetic oligonucleotide; CTT chr11 5180686 5180707 5180703 5180708 +
gtaaatttgtttgagttcattg

SEQ ID NO: 75841 - DNA, 22 bp, Artificial Sequence
  Synthetic oligonucleotide; TTG chr11 5180687 5180708 5180704 5180709 +
taaatttgtttgagttcattgt

SEQ ID NO: 75842 - DNA, 22 bp, Artificial Sequence
  Synthetic oligonucleotide; TTT chr11 5180694 5180715 5180711 5180716 +
gtttgagttcattgtagattct

SEQ ID NO: 75843 - DNA, 22 bp, Artificial Sequence
  Synthetic oligonucleotide; TTG chr11 5180695 5180716 5180712 5180717 +
tttgagttcattgtagattctg

SEQ ID NO: 75844 - DNA, 22 bp, Artificial Sequence
  Synthetic oligonucleotide; TTT chr11 5180698 5180719 5180715 5180720 +
gagttcattgtagattctggat

SEQ ID NO: 75845 - DNA, 22 bp, Artificial Sequence
  Synthetic oligonucleotide; TTG chr11 5180699 5180720 5180716 5180721 +
agttcattgtagattctggata

SEQ ID NO: 75846 - DNA, 22 bp, Artificial Sequence
  Synthetic oligonucleotide; TTC chr11 5180704 5180725 5180721 5180726 +
attgtagattctggatattagc

SEQ ID NO: 75847 - DNA, 22 bp, Artificial Sequence
  Synthetic oligonucleotide; TTG chr11 5180708 5180729 5180725 5180730 +
tagattctggatattagccctt

SEQ ID NO: 75848 - DNA, 22 bp, Artificial Sequence
  Synthetic oligonucleotide; TTC chr11 5180715 5180736 5180732 5180737 +
tggatattagccctttgtcaga

SEQ ID NO: 75849 - DNA, 22 bp, Artificial Sequence
  Synthetic oligonucleotide; CTG chr11 5180717 5180738 5180734 5180739 +
gatattagccctttgtcagatg

SEQ ID NO: 75850 - DNA, 22 bp, Artificial Sequence
  Synthetic oligonucleotide; TTA chr11 5180724 5180745 5180741 5180746 +
gccctttgtcagatgagtagat

SEQ ID NO: 75851 - DNA, 22 bp, Artificial Sequence
  Synthetic oligonucleotide; CTT chr11 5180730 5180751 5180747 5180752 +
tgtcagatgagtagattgcaaa

SEQ ID NO: 75852 - DNA, 22 bp, Artificial Sequence
  Synthetic oligonucleotide; TTT chr11 5180731 5180752 5180748 5180753 +
gtcagatgagtagattgcaaaa

SEQ ID NO: 75853 - DNA, 22 bp, Artificial Sequence
  Synthetic oligonucleotide; TTG chr11 5180732 5180753 5180749 5180754 +
tcagatgagtagattgcaaaaa

SEQ ID NO: 75854 - DNA, 22 bp, Artificial Sequence
  Synthetic oligonucleotide; TTG chr11 5180748 5180769 5180765 5180770 +
caaaaattttctcccattgtgt

SEQ ID NO: 75855 - DNA, 22 bp, Artificial Sequence
  Synthetic oligonucleotide; TTT chr11 5180757 5180778 5180774 5180779 +
tctcccattgtgtaggttgcct

SEQ ID NO: 75856 - DNA, 22 bp, Artificial Sequence
  Synthetic oligonucleotide; TTT chr11 5180758 5180779 5180775 5180780 +
ctcccattgtgtaggttgcctg

SEQ ID NO: 75857 - DNA, 22 bp, Artificial Sequence
  Synthetic oligonucleotide; TTC chr11 5180759 5180780 5180776 5180781 +
tcccattgtgtaggttgcctgt

SEQ ID NO: 75858 - DNA, 22 bp, Artificial Sequence
  Synthetic oligonucleotide; CTC chr11 5180761 5180782 5180778 5180783 +
ccattgtgtaggttgcctgttc

SEQ ID NO: 75859 - DNA, 22 bp, Artificial Sequence
  Synthetic oligonucleotide; TTG chr11 5180767 5180788 5180784 5180789 +
tgtaggttgcctgttcactctg

SEQ ID NO: 75860 - DNA, 22 bp, Artificial Sequence
  Synthetic oligonucleotide; TTG chr11 5180776 5180797 5180793 5180798 +
cctgttcactctgatggtagtt

SEQ ID NO: 75861 - DNA, 22 bp, Artificial Sequence
  Synthetic oligonucleotide; CTG chr11 5180780 5180801 5180797 5180802 +
ttcactctgatggtagtttctt

SEQ ID NO: 75862 - DNA, 22 bp, Artificial Sequence
  Synthetic oligonucleotide; TTC chr11 5180783 5180804 5180800 5180805 +
actctgatggtagtttcttttg

SEQ ID NO: 75863 - DNA, 22 bp, Artificial Sequence
  Synthetic oligonucleotide; CTC chr11 5180787 5180808 5180804 5180809 +
tgatggtagtttcttttgctgt

SEQ ID NO: 75864 - DNA, 22 bp, Artificial Sequence
  Synthetic oligonucleotide; CTG chr11 5180789 5180810 5180806 5180811 +
atggtagtttcttttgctgtgc

SEQ ID NO: 75865 - DNA, 22 bp, Artificial Sequence
  Synthetic oligonucleotide; TTT chr11 5180799 5180820 5180816 5180821 +
cttttgctgtgcagaagctctt

SEQ ID NO: 75866 - DNA, 22 bp, Artificial Sequence
  Synthetic oligonucleotide; TTC chr11 5180800 5180821 5180817 5180822 +
ttttgctgtgcagaagctcttt

SEQ ID NO: 75867 - DNA, 22 bp, Artificial Sequence
  Synthetic oligonucleotide; CTT chr11 5180802 5180823 5180819 5180824 +
ttgctgtgcagaagctctttag

SEQ ID NO: 75868 - DNA, 22 bp, Artificial Sequence
  Synthetic oligonucleotide; TTT chr11 5180803 5180824 5180820 5180825 +
tgctgtgcagaagctctttagt

SEQ ID NO: 75869 - DNA, 22 bp, Artificial Sequence
  Synthetic oligonucleotide; TTT chr11 5180804 5180825 5180821 5180826 +
gctgtgcagaagctctttagtt

SEQ ID NO: 75870 - DNA, 22 bp, Artificial Sequence
  Synthetic oligonucleotide; TTG chr11 5180805 5180826 5180822 5180827 +
ctgtgcagaagctctttagttt

SEQ ID NO: 75871 - DNA, 22 bp, Artificial Sequence
  Synthetic oligonucleotide; CTG chr11 5180808 5180829 5180825 5180830 +
tgcagaagctctttagtttaat

SEQ ID NO: 75872 - DNA, 22 bp, Artificial Sequence
  Synthetic oligonucleotide; CTC chr11 5180819 5180840 5180836 5180841 +
tttagtttaattagatcccatt

SEQ ID NO: 75873 - DNA, 22 bp, Artificial Sequence
  Synthetic oligonucleotide; CTT chr11 5180821 5180842 5180838 5180843 +
tagtttaattagatcccatttg

SEQ ID NO: 75874 - DNA, 22 bp, Artificial Sequence
  Synthetic oligonucleotide; TTT chr11 5180822 5180843 5180839 5180844 +
agtttaattagatcccatttgt

SEQ ID NO: 75875 - DNA, 22 bp, Artificial Sequence
  Synthetic oligonucleotide; TTA chr11 5180823 5180844 5180840 5180845 +
gtttaattagatcccatttgtc

SEQ ID NO: 75876 - DNA, 22 bp, Artificial Sequence
  Synthetic oligonucleotide; TTT chr11 5180827 5180848 5180844 5180849 +
aattagatcccatttgtccatt

SEQ ID NO: 75877 - DNA, 22 bp, Artificial Sequence
  Synthetic oligonucleotide; TTA chr11 5180828 5180849 5180845 5180850 +
attagatcccatttgtccattt

SEQ ID NO: 75878 - DNA, 22 bp, Artificial Sequence
  Synthetic oligonucleotide; TTA chr11 5180832 5180853 5180849 5180854 +
gatcccatttgtccattttgtc

SEQ ID NO: 75879 - DNA, 22 bp, Artificial Sequence
  Synthetic oligonucleotide; TTT chr11 5180842 5180863 5180859 5180864 +
gtccattttgtcttttgttgcc

SEQ ID NO: 75880 - DNA, 22 bp, Artificial Sequence
  Synthetic oligonucleotide; TTG chr11 5180843 5180864 5180860 5180865 +
tccattttgtcttttgttgcca

SEQ ID NO: 75881 - DNA, 22 bp, Artificial Sequence
  Synthetic oligonucleotide; TTT chr11 5180850 5180871 5180867 5180872 +
tgtcttttgttgccattgcttt

SEQ ID NO: 75882 - DNA, 22 bp, Artificial Sequence
  Synthetic oligonucleotide; TTT chr11 5180851 5180872 5180868 5180873 +
gtcttttgttgccattgctttt

SEQ ID NO: 75883 - DNA, 22 bp, Artificial Sequence
  Synthetic oligonucleotide; TTG chr11 5180852 5180873 5180869 5180874 +
tcttttgttgccattgcttttg

SEQ ID NO: 75884 - DNA, 22 bp, Artificial Sequence
  Synthetic oligonucleotide; CTT chr11 5180856 5180877 5180873 5180878 +
ttgttgccattgcttttggtgt

SEQ ID NO: 75885 - DNA, 22 bp, Artificial Sequence
  Synthetic oligonucleotide; TTT chr11 5180857 5180878 5180874 5180879 +
tgttgccattgcttttggtgtt

SEQ ID NO: 75886 - DNA, 22 bp, Artificial Sequence
  Synthetic oligonucleotide; TTT chr11 5180858 5180879 5180875 5180880 +
gttgccattgcttttggtgttt

SEQ ID NO: 75887 - DNA, 22 bp, Artificial Sequence
  Synthetic oligonucleotide; TTG chr11 5180859 5180880 5180876 5180881 +
ttgccattgcttttggtgtttt

SEQ ID NO: 75888 - DNA, 22 bp, Artificial Sequence
  Synthetic oligonucleotide; TTG chr11 5180862 5180883 5180879 5180884 +
ccattgcttttggtgttttaga

SEQ ID NO: 75889 - DNA, 22 bp, Artificial Sequence
  Synthetic oligonucleotide; TTG chr11 5180868 5180889 5180885 5180890 +
cttttggtgttttagacatgaa

SEQ ID NO: 75890 - DNA, 22 bp, Artificial Sequence
  Synthetic oligonucleotide; CTT chr11 5180871 5180892 5180888 5180893 +
ttggtgttttagacatgaagtc

SEQ ID NO: 75891 - DNA, 22 bp, Artificial Sequence
  Synthetic oligonucleotide; TTT chr11 5180872 5180893 5180889 5180894 +
tggtgttttagacatgaagtcc

SEQ ID NO: 75892 - DNA, 22 bp, Artificial Sequence
  Synthetic oligonucleotide; TTT chr11 5180873 5180894 5180890 5180895 +
ggtgttttagacatgaagtcct

SEQ ID NO: 75893 - DNA, 22 bp, Artificial Sequence
  Synthetic oligonucleotide; TTG chr11 5180874 5180895 5180891 5180896 +
gtgttttagacatgaagtcctt

SEQ ID NO: 75894 - DNA, 22 bp, Artificial Sequence
  Synthetic oligonucleotide; TTT chr11 5180880 5180901 5180897 5180902 +
tagacatgaagtccttgcccat

SEQ ID NO: 75895 - DNA, 22 bp, Artificial Sequence
  Synthetic oligonucleotide; TTT chr11 5180881 5180902 5180898 5180903 +
agacatgaagtccttgcccatg

SEQ ID NO: 75896 - DNA, 22 bp, Artificial Sequence
  Synthetic oligonucleotide; TTA chr11 5180882 5180903 5180899 5180904 +
gacatgaagtccttgcccatgc

SEQ ID NO: 75897 - DNA, 22 bp, Artificial Sequence
  Synthetic oligonucleotide; CTT chr11 5180896 5180917 5180913 5180918 +
gcccatgcctatgtcctgaatg

SEQ ID NO: 75898 - DNA, 22 bp, Artificial Sequence
  Synthetic oligonucleotide; TTG chr11 5180897 5180918 5180914 5180919 +
cccatgcctatgtcctgaatgg

SEQ ID NO: 75899 - DNA, 22 bp, Artificial Sequence
  Synthetic oligonucleotide; CTA chr11 5180907 5180928 5180924 5180929 +
tgtcctgaatggtattgcttag

SEQ ID NO: 75900 - DNA, 22 bp, Artificial Sequence
  Synthetic oligonucleotide; CTG chr11 5180914 5180935 5180931 5180936 +
aatggtattgcttaggttttct

SEQ ID NO: 75901 - DNA, 22 bp, Artificial Sequence
  Synthetic oligonucleotide; TTG chr11 5180924 5180945 5180941 5180946 +
cttaggttttcttctaaggttt

SEQ ID NO: 75902 - DNA, 22 bp, Artificial Sequence
  Synthetic oligonucleotide; CTT chr11 5180927 5180948 5180944 5180949 +
aggttttcttctaaggttttta

SEQ ID NO: 75903 - DNA, 22 bp, Artificial Sequence
  Synthetic oligonucleotide; TTA chr11 5180928 5180949 5180945 5180950 +
ggttttcttctaaggtttttat

SEQ ID NO: 75904 - DNA, 22 bp, Artificial Sequence
  Synthetic oligonucleotide; TTT chr11 5180933 5180954 5180950 5180955 +
tcttctaaggtttttatggttt

SEQ ID NO: 75905 - DNA, 22 bp, Artificial Sequence
  Synthetic oligonucleotide; TTT chr11 5180934 5180955 5180951 5180956 +
cttctaaggtttttatggtttt

SEQ ID NO: 75906 - DNA, 22 bp, Artificial Sequence
  Synthetic oligonucleotide; TTC chr11 5180935 5180956 5180952 5180957 +
ttctaaggtttttatggtttta

SEQ ID NO: 75907 - DNA, 22 bp, Artificial Sequence
  Synthetic oligonucleotide; CTT chr11 5180937 5180958 5180954 5180959 +
ctaaggtttttatggttttagg

SEQ ID NO: 75908 - DNA, 22 bp, Artificial Sequence
  Synthetic oligonucleotide; TTC chr11 5180938 5180959 5180955 5180960 +
taaggtttttatggttttaggt

SEQ ID NO: 75909 - DNA, 22 bp, Artificial Sequence
  Synthetic oligonucleotide; CTA chr11 5180940 5180961 5180957 5180962 +
aggtttttatggttttaggtct

SEQ ID NO: 75910 - DNA, 22 bp, Artificial Sequence
  Synthetic oligonucleotide; TTT chr11 5180946 5180967 5180963 5180968 +
ttatggttttaggtctaacatg

SEQ ID NO: 75911 - DNA, 22 bp, Artificial Sequence
  Synthetic oligonucleotide; TTT chr11 5180947 5180968 5180964 5180969 +
tatggttttaggtctaacatgt

SEQ ID NO: 75912 - DNA, 22 bp, Artificial Sequence
  Synthetic oligonucleotide; TTT chr11 5180948 5180969 5180965 5180970 +
atggttttaggtctaacatgta

SEQ ID NO: 75913 - DNA, 22 bp, Artificial Sequence
  Synthetic oligonucleotide; TTA chr11 5180949 5180970 5180966 5180971 +
tggttttaggtctaacatgtaa

SEQ ID NO: 75914 - DNA, 22 bp, Artificial Sequence
  Synthetic oligonucleotide; TTT chr11 5180955 5180976 5180972 5180977 +
taggtctaacatgtaagtcttt

SEQ ID NO: 75915 - DNA, 22 bp, Artificial Sequence
  Synthetic oligonucleotide; TTT chr11 5180956 5180977 5180973 5180978 +
aggtctaacatgtaagtcttta

SEQ ID NO: 75916 - DNA, 22 bp, Artificial Sequence
  Synthetic oligonucleotide; TTA chr11 5180957 5180978 5180974 5180979 +
ggtctaacatgtaagtctttaa

SEQ ID NO: 75917 - DNA, 22 bp, Artificial Sequence
  Synthetic oligonucleotide; CTA chr11 5180963 5180984 5180980 5180985 +
acatgtaagtctttaatccatc

SEQ ID NO: 75918 - DNA, 22 bp, Artificial Sequence
  Synthetic oligonucleotide; CTT chr11 5180976 5180997 5180993 5180998 +
taatccatcttgaaataatttt

SEQ ID NO: 75919 - DNA, 22 bp, Artificial Sequence
  Synthetic oligonucleotide; TTT chr11 5180977 5180998 5180994 5180999 +
aatccatcttgaaataattttt

SEQ ID NO: 75920 - DNA, 22 bp, Artificial Sequence
  Synthetic oligonucleotide; TTA chr11 5180978 5180999 5180995 5181000 +
atccatcttgaaataatttttg

SEQ ID NO: 75921 - DNA, 22 bp, Artificial Sequence
  Synthetic oligonucleotide; CTT chr11 5180987 5181008 5181004 5181009 +
gaaataatttttgtataaggtg

SEQ ID NO: 75922 - DNA, 22 bp, Artificial Sequence
  Synthetic oligonucleotide; TTG chr11 5180988 5181009 5181005 5181010 +
aaataatttttgtataaggtgt

SEQ ID NO: 75923 - DNA, 22 bp, Artificial Sequence
  Synthetic oligonucleotide; TTT chr11 5180997 5181018 5181014 5181019 +
ttgtataaggtgtaaggaaggg

SEQ ID NO: 75924 - DNA, 22 bp, Artificial Sequence
  Synthetic oligonucleotide; TTT chr11 5180998 5181019 5181015 5181020 +
tgtataaggtgtaaggaaggga

SEQ ID NO: 75925 - DNA, 22 bp, Artificial Sequence
  Synthetic oligonucleotide; TTT chr11 5180999 5181020 5181016 5181021 +
gtataaggtgtaaggaagggat

SEQ ID NO: 75926 - DNA, 22 bp, Artificial Sequence
  Synthetic oligonucleotide; TTG chr11 5181000 5181021 5181017 5181022 +
tataaggtgtaaggaagggatc

SEQ ID NO: 75927 - DNA, 22 bp, Artificial Sequence
  Synthetic oligonucleotide; TTT chr11 5181028 5181049 5181045 5181050 +
cagctttctacatatggctagc

SEQ ID NO: 75928 - DNA, 22 bp, Artificial Sequence
  Synthetic oligonucleotide; TTC chr11 5181029 5181050 5181046 5181051 +
agctttctacatatggctagcc

SEQ ID NO: 75929 - DNA, 22 bp, Artificial Sequence
  Synthetic oligonucleotide; CTT chr11 5181034 5181055 5181051 5181056 +
tctacatatggctagccagttt

SEQ ID NO: 75930 - DNA, 22 bp, Artificial Sequence
  Synthetic oligonucleotide; TTT chr11 5181035 5181056 5181052 5181057 +
ctacatatggctagccagtttt

SEQ ID NO: 75931 - DNA, 22 bp, Artificial Sequence
  Synthetic oligonucleotide; TTC chr11 5181036 5181057 5181053 5181058 +
tacatatggctagccagttttc

SEQ ID NO: 75932 - DNA, 22 bp, Artificial Sequence
  Synthetic oligonucleotide; CTA chr11 5181038 5181059 5181055 5181060 +
catatggctagccagttttccc

SEQ ID NO: 75933 - DNA, 22 bp, Artificial Sequence
  Synthetic oligonucleotide; CTA chr11 5181048 5181069 5181065 5181070 +
gccagttttcccagcatcattt

SEQ ID NO: 75934 - DNA, 22 bp, Artificial Sequence
  Synthetic oligonucleotide; TTT chr11 5181056 5181077 5181073 5181078 +
tcccagcatcatttattaaata

SEQ ID NO: 75935 - DNA, 22 bp, Artificial Sequence
  Synthetic oligonucleotide; TTT chr11 5181057 5181078 5181074 5181079 +
cccagcatcatttattaaatag

SEQ ID NO: 75936 - DNA, 22 bp, Artificial Sequence
  Synthetic oligonucleotide; TTC chr11 5181058 5181079 5181075 5181080 +
ccagcatcatttattaaatagg

SEQ ID NO: 75937 - DNA, 22 bp, Artificial Sequence
  Synthetic oligonucleotide; TTT chr11 5181070 5181091 5181087 5181092 +
attaaatagggaatcctttccc

SEQ ID NO: 75938 - DNA, 22 bp, Artificial Sequence
  Synthetic oligonucleotide; TTA chr11 5181071 5181092 5181088 5181093 +
ttaaatagggaatcctttcccc

SEQ ID NO: 75939 - DNA, 22 bp, Artificial Sequence
  Synthetic oligonucleotide; TTA chr11 5181074 5181095 5181091 5181096 +
aatagggaatcctttccccatt

SEQ ID NO: 75940 - DNA, 22 bp, Artificial Sequence
  Synthetic oligonucleotide; CTT chr11 5181088 5181109 5181105 5181110 +
tccccattgcttgtttttgtca

SEQ ID NO: 75941 - DNA, 22 bp, Artificial Sequence
  Synthetic oligonucleotide; TTT chr11 5181089 5181110 5181106 5181111 +
ccccattgcttgtttttgtcag

SEQ ID NO: 75942 - DNA, 22 bp, Artificial Sequence
  Synthetic oligonucleotide; TTC chr11 5181090 5181111 5181107 5181112 +
cccattgcttgtttttgtcagg

SEQ ID NO: 75943 - DNA, 22 bp, Artificial Sequence
  Synthetic oligonucleotide; TTG chr11 5181097 5181118 5181114 5181119 +
cttgtttttgtcaggtttgtca

SEQ ID NO: 75944 - DNA, 22 bp, Artificial Sequence
  Synthetic oligonucleotide; CTT chr11 5181100 5181121 5181117 5181122 +
gtttttgtcaggtttgtcaaag

SEQ ID NO: 75945 - DNA, 22 bp, Artificial Sequence
  Synthetic oligonucleotide; TTG chr11 5181101 5181122 5181118 5181123 +
tttttgtcaggtttgtcaaaga

SEQ ID NO: 75946 - DNA, 22 bp, Artificial Sequence
  Synthetic oligonucleotide; TTT chr11 5181104 5181125 5181121 5181126 +
ttgtcaggtttgtcaaagatca

SEQ ID NO: 75947 - DNA, 22 bp, Artificial Sequence
  Synthetic oligonucleotide; TTT chr11 5181105 5181126 5181122 5181127 +
tgtcaggtttgtcaaagatcag

SEQ ID NO: 75948 - DNA, 22 bp, Artificial Sequence
  Synthetic oligonucleotide; TTT chr11 5181106 5181127 5181123 5181128 +
gtcaggtttgtcaaagatcaga

SEQ ID NO: 75949 - DNA, 22 bp, Artificial Sequence
  Synthetic oligonucleotide; TTG chr11 5181107 5181128 5181124 5181129 +
tcaggtttgtcaaagatcagat

SEQ ID NO: 75950 - DNA, 22 bp, Artificial Sequence
  Synthetic oligonucleotide; TTT chr11 5181115 5181136 5181132 5181137 +
gtcaaagatcagatagttgtgg

SEQ ID NO: 75951 - DNA, 22 bp, Artificial Sequence
  Synthetic oligonucleotide; TTG chr11 5181116 5181137 5181133 5181138 +
tcaaagatcagatagttgtgga

SEQ ID NO: 75952 - DNA, 22 bp, Artificial Sequence
  Synthetic oligonucleotide; TTG chr11 5181134 5181155 5181151 5181156 +
tggatgtgtggtattatttctg

SEQ ID NO: 75953 - DNA, 22 bp, Artificial Sequence
  Synthetic oligonucleotide; TTA chr11 5181150 5181171 5181167 5181172 +
tttctgagagctctgttctgct

SEQ ID NO: 75954 - DNA, 22 bp, Artificial Sequence
  Synthetic oligonucleotide; TTT chr11 5181153 5181174 5181170 5181175 +
ctgagagctctgttctgctcca

SEQ ID NO: 75955 - DNA, 22 bp, Artificial Sequence
  Synthetic oligonucleotide; TTC chr11 5181154 5181175 5181171 5181176 +
tgagagctctgttctgctccat

SEQ ID NO: 75956 - DNA, 22 bp, Artificial Sequence
  Synthetic oligonucleotide; CTG chr11 5181156 5181177 5181173 5181178 +
agagctctgttctgctccattg

SEQ ID NO: 75957 - DNA, 22 bp, Artificial Sequence
  Synthetic oligonucleotide; CTC chr11 5181163 5181184 5181180 5181185 +
tgttctgctccattggtctaca

SEQ ID NO: 75958 - DNA, 22 bp, Artificial Sequence
  Synthetic oligonucleotide; CTG chr11 5181165 5181186 5181182 5181187 +
ttctgctccattggtctacatc

SEQ ID NO: 75959 - DNA, 22 bp, Artificial Sequence
  Synthetic oligonucleotide; TTC chr11 5181168 5181189 5181185 5181190 +
tgctccattggtctacatctct

SEQ ID NO: 75960 - DNA, 22 bp, Artificial Sequence
  Synthetic oligonucleotide; CTG chr11 5181170 5181191 5181187 5181192 +
ctccattggtctacatctctgt

SEQ ID NO: 75961 - DNA, 22 bp, Artificial Sequence
  Synthetic oligonucleotide; CTC chr11 5181173 5181194 5181190 5181195 +
cattggtctacatctctgtttt

SEQ ID NO: 75962 - DNA, 22 bp, Artificial Sequence
  Synthetic oligonucleotide; TTG chr11 5181178 5181199 5181195 5181200 +
gtctacatctctgttttggtac

SEQ ID NO: 75963 - DNA, 22 bp, Artificial Sequence
  Synthetic oligonucleotide; CTA chr11 5181183 5181204 5181200 5181205 +
catctctgttttggtaccagta

SEQ ID NO: 75964 - DNA, 22 bp, Artificial Sequence
  Synthetic oligonucleotide; CTC chr11 5181189 5181210 5181206 5181211 +
tgttttggtaccagtaccatgt

SEQ ID NO: 75965 - DNA, 22 bp, Artificial Sequence
  Synthetic oligonucleotide; CTG chr11 5181191 5181212 5181208 5181213 +
ttttggtaccagtaccatgttg

SEQ ID NO: 75966 - DNA, 22 bp, Artificial Sequence
  Synthetic oligonucleotide; TTT chr11 5181194 5181215 5181211 5181216 +
tggtaccagtaccatgttgttt

SEQ ID NO: 75967 - DNA, 22 bp, Artificial Sequence
  Synthetic oligonucleotide; TTT chr11 5181195 5181216 5181212 5181217 +
ggtaccagtaccatgttgtttt

SEQ ID NO: 75968 - DNA, 22 bp, Artificial Sequence
  Synthetic oligonucleotide; TTG chr11 5181196 5181217 5181213 5181218 +
gtaccagtaccatgttgttttg

SEQ ID NO: 75969 - DNA, 22 bp, Artificial Sequence
  Synthetic oligonucleotide; TTG chr11 5181213 5181234 5181230 5181235 +
ttttggttactgtaccttgtag

SEQ ID NO: 75970 - DNA, 22 bp, Artificial Sequence
  Synthetic oligonucleotide; TTT chr11 5181216 5181237 5181233 5181238 +
tggttactgtaccttgtagtat

SEQ ID NO: 75971 - DNA, 22 bp, Artificial Sequence
  Synthetic oligonucleotide; TTT chr11 5181217 5181238 5181234 5181239 +
ggttactgtaccttgtagtata

SEQ ID NO: 75972 - DNA, 22 bp, Artificial Sequence
  Synthetic oligonucleotide; TTG chr11 5181218 5181239 5181235 5181240 +
gttactgtaccttgtagtatag

SEQ ID NO: 75973 - DNA, 22 bp, Artificial Sequence
  Synthetic oligonucleotide; TTA chr11 5181222 5181243 5181239 5181244 +
ctgtaccttgtagtatagtttg

SEQ ID NO: 75974 - DNA, 22 bp, Artificial Sequence
  Synthetic oligonucleotide; CTG chr11 5181225 5181246 5181242 5181247 +
taccttgtagtatagtttgaag

SEQ ID NO: 75975 - DNA, 22 bp, Artificial Sequence
  Synthetic oligonucleotide; CTT chr11 5181231 5181252 5181248 5181253 +
gtagtatagtttgaagtcaggt

SEQ ID NO: 75976 - DNA, 22 bp, Artificial Sequence
  Synthetic oligonucleotide; TTG chr11 5181232 5181253 5181249 5181254 +
tagtatagtttgaagtcaggta

SEQ ID NO: 75977 - DNA, 22 bp, Artificial Sequence
  Synthetic oligonucleotide; TTT chr11 5181243 5181264 5181260 5181265 +
gaagtcaggtagcatgatgcct

SEQ ID NO: 75978 - DNA, 22 bp, Artificial Sequence
  Synthetic oligonucleotide; TTG chr11 5181244 5181265 5181261 5181266 +
aagtcaggtagcatgatgcctc

SEQ ID NO: 75979 - DNA, 22 bp, Artificial Sequence
  Synthetic oligonucleotide; CTC chr11 5181266 5181287 5181283 5181288 +
tagctttgttcttttggcttag

SEQ ID NO: 75980 - DNA, 22 bp, Artificial Sequence
  Synthetic oligonucleotide; CTA chr11 5181268 5181289 5181285 5181290 +
gctttgttcttttggcttagga

SEQ ID NO: 75981 - DNA, 22 bp, Artificial Sequence
  Synthetic oligonucleotide; CTT chr11 5181272 5181293 5181289 5181294 +
tgttcttttggcttaggattga

SEQ ID NO: 75982 - DNA, 22 bp, Artificial Sequence
  Synthetic oligonucleotide; TTT chr11 5181273 5181294 5181290 5181295 +
gttcttttggcttaggattgac

SEQ ID NO: 75983 - DNA, 22 bp, Artificial Sequence
  Synthetic oligonucleotide; TTG chr11 5181274 5181295 5181291 5181296 +
ttcttttggcttaggattgact

SEQ ID NO: 75984 - DNA, 22 bp, Artificial Sequence
  Synthetic oligonucleotide; TTC chr11 5181277 5181298 5181294 5181299 +
ttttggcttaggattgacttgt

SEQ ID NO: 75985 - DNA, 22 bp, Artificial Sequence
  Synthetic oligonucleotide; CTT chr11 5181279 5181300 5181296 5181301 +
ttggcttaggattgacttgtca

SEQ ID NO: 75986 - DNA, 22 bp, Artificial Sequence
  Synthetic oligonucleotide; TTT chr11 5181280 5181301 5181297 5181302 +
tggcttaggattgacttgtcaa

SEQ ID NO: 75987 - DNA, 22 bp, Artificial Sequence
  Synthetic oligonucleotide; TTT chr11 5181281 5181302 5181298 5181303 +
ggcttaggattgacttgtcaat

SEQ ID NO: 75988 - DNA, 22 bp, Artificial Sequence
  Synthetic oligonucleotide; TTG chr11 5181282 5181303 5181299 5181304 +
gcttaggattgacttgtcaatg

SEQ ID NO: 75989 - DNA, 22 bp, Artificial Sequence
  Synthetic oligonucleotide; CTT chr11 5181286 5181307 5181303 5181308 +
aggattgacttgtcaatgcggg

SEQ ID NO: 75990 - DNA, 22 bp, Artificial Sequence
  Synthetic oligonucleotide; TTA chr11 5181287 5181308 5181304 5181309 +
ggattgacttgtcaatgcgggc

SEQ ID NO: 75991 - DNA, 22 bp, Artificial Sequence
  Synthetic oligonucleotide; TTG chr11 5181293 5181314 5181310 5181315 +
acttgtcaatgcgggctctttt

SEQ ID NO: 75992 - DNA, 22 bp, Artificial Sequence
  Synthetic oligonucleotide; CTT chr11 5181297 5181318 5181314 5181319 +
gtcaatgcgggctcttttttgg

SEQ ID NO: 75993 - DNA, 22 bp, Artificial Sequence
  Synthetic oligonucleotide; TTG chr11 5181298 5181319 5181315 5181320 +
tcaatgcgggctcttttttggt

SEQ ID NO: 75994 - DNA, 22 bp, Artificial Sequence
  Synthetic oligonucleotide; CTC chr11 5181311 5181332 5181328 5181333 +
ttttttggttccatatgaactt

SEQ ID NO: 75995 - DNA, 22 bp, Artificial Sequence
  Synthetic oligonucleotide; CTT chr11 5181313 5181334 5181330 5181335 +
ttttggttccatatgaacttta

SEQ ID NO: 75996 - DNA, 22 bp, Artificial Sequence
  Synthetic oligonucleotide; TTT chr11 5181314 5181335 5181331 5181336 +
tttggttccatatgaactttaa

SEQ ID NO: 75997 - DNA, 22 bp, Artificial Sequence
  Synthetic oligonucleotide; TTT chr11 5181315 5181336 5181332 5181337 +
ttggttccatatgaactttaaa

SEQ ID NO: 75998 - DNA, 22 bp, Artificial Sequence
  Synthetic oligonucleotide; TTT chr11 5181316 5181337 5181333 5181338 +
tggttccatatgaactttaaag

SEQ ID NO: 75999 - DNA, 22 bp, Artificial Sequence
  Synthetic oligonucleotide; TTT chr11 5181317 5181338 5181334 5181339 +
ggttccatatgaactttaaagt

SEQ ID NO: 76000 - DNA, 22 bp, Artificial Sequence
  Synthetic oligonucleotide; TTG chr11 5181318 5181339 5181335 5181340 +
gttccatatgaactttaaagta

SEQ ID NO: 76001 - DNA, 22 bp, Artificial Sequence
  Synthetic oligonucleotide; TTC chr11 5181322 5181343 5181339 5181344 +
catatgaactttaaagtagttt

SEQ ID NO: 76002 - DNA, 22 bp, Artificial Sequence
  Synthetic oligonucleotide; CTT chr11 5181333 5181354 5181350 5181355 +
taaagtagttttttccaattct

SEQ ID NO: 76003 - DNA, 22 bp, Artificial Sequence
  Synthetic oligonucleotide; TTT chr11 5181334 5181355 5181351 5181356 +
aaagtagttttttccaattctg

SEQ ID NO: 76004 - DNA, 22 bp, Artificial Sequence
  Synthetic oligonucleotide; TTA chr11 5181335 5181356 5181352 5181357 +
aagtagttttttccaattctgt

SEQ ID NO: 76005 - DNA, 22 bp, Artificial Sequence
  Synthetic oligonucleotide; TTT chr11 5181344 5181365 5181361 5181366 +
tttccaattctgtgaagaaagt

SEQ ID NO: 76006 - DNA, 22 bp, Artificial Sequence
  Synthetic oligonucleotide; TTT chr11 5181345 5181366 5181362 5181367 +
ttccaattctgtgaagaaagtc

SEQ ID NO: 76007 - DNA, 22 bp, Artificial Sequence
  Synthetic oligonucleotide; TTT chr11 5181346 5181367 5181363 5181368 +
tccaattctgtgaagaaagtca

SEQ ID NO: 76008 - DNA, 22 bp, Artificial Sequence
  Synthetic oligonucleotide; TTT chr11 5181347 5181368 5181364 5181369 +
ccaattctgtgaagaaagtcat

SEQ ID NO: 76009 - DNA, 22 bp, Artificial Sequence
  Synthetic oligonucleotide; TTC chr11 5181348 5181369 5181365 5181370 +
caattctgtgaagaaagtcatt

SEQ ID NO: 76010 - DNA, 22 bp, Artificial Sequence
  Synthetic oligonucleotide; TTC chr11 5181354 5181375 5181371 5181376 +
tgtgaagaaagtcattggtagc

SEQ ID NO: 76011 - DNA, 22 bp, Artificial Sequence
  Synthetic oligonucleotide; CTG chr11 5181356 5181377 5181373 5181378 +
tgaagaaagtcattggtagctt

SEQ ID NO: 76012 - DNA, 22 bp, Artificial Sequence
  Synthetic oligonucleotide; TTG chr11 5181371 5181392 5181388 5181393 +
gtagcttgatggggatggcatt

SEQ ID NO: 76013 - DNA, 22 bp, Artificial Sequence
  Synthetic oligonucleotide; CTT chr11 5181378 5181399 5181395 5181400 +
gatggggatggcattgaatcta

SEQ ID NO: 76014 - DNA, 22 bp, Artificial Sequence
  Synthetic oligonucleotide; TTG chr11 5181379 5181400 5181396 5181401 +
atggggatggcattgaatctat

SEQ ID NO: 76015 - DNA, 22 bp, Artificial Sequence
  Synthetic oligonucleotide; TTG chr11 5181394 5181415 5181411 5181416 +
aatctataaattaccttgggca

SEQ ID NO: 76016 - DNA, 22 bp, Artificial Sequence
  Synthetic oligonucleotide; CTA chr11 5181400 5181421 5181417 5181422 +
taaattaccttgggcagtaagg

SEQ ID NO: 76017 - DNA, 22 bp, Artificial Sequence
  Synthetic oligonucleotide; TTA chr11 5181407 5181428 5181424 5181429 +
ccttgggcagtaaggccatttt

SEQ ID NO: 76018 - DNA, 22 bp, Artificial Sequence
  Synthetic oligonucleotide; CTT chr11 5181411 5181432 5181428 5181433 +
gggcagtaaggccattttcacg

SEQ ID NO: 76019 - DNA, 22 bp, Artificial Sequence
  Synthetic oligonucleotide; TTG chr11 5181412 5181433 5181429 5181434 +
ggcagtaaggccattttcacga

SEQ ID NO: 76020 - DNA, 22 bp, Artificial Sequence
  Synthetic oligonucleotide; TTT chr11 5181428 5181449 5181445 5181450 +
tcacgatattgattcttcctat

SEQ ID NO: 76021 - DNA, 22 bp, Artificial Sequence
  Synthetic oligonucleotide; TTT chr11 5181429 5181450 5181446 5181451 +
cacgatattgattcttcctatc

SEQ ID NO: 76022 - DNA, 22 bp, Artificial Sequence
  Synthetic oligonucleotide; TTC chr11 5181430 5181451 5181447 5181452 +
acgatattgattcttcctatcc

SEQ ID NO: 76023 - DNA, 22 bp, Artificial Sequence
  Synthetic oligonucleotide; TTG chr11 5181439 5181460 5181456 5181461 +
attcttcctatccatgagcatg

SEQ ID NO: 76024 - DNA, 22 bp, Artificial Sequence
  Synthetic oligonucleotide; TTC chr11 5181443 5181464 5181460 5181465 +
ttcctatccatgagcatggaat

SEQ ID NO: 76025 - DNA, 22 bp, Artificial Sequence
  Synthetic oligonucleotide; CTT chr11 5181445 5181466 5181462 5181467 +
cctatccatgagcatggaatgt

SEQ ID NO: 76026 - DNA, 22 bp, Artificial Sequence
  Synthetic oligonucleotide; TTC chr11 5181446 5181467 5181463 5181468 +
ctatccatgagcatggaatgtt

SEQ ID NO: 76027 - DNA, 22 bp, Artificial Sequence
  Synthetic oligonucleotide; CTA chr11 5181449 5181470 5181466 5181471 +
tccatgagcatggaatgttctt

SEQ ID NO: 76028 - DNA, 22 bp, Artificial Sequence
  Synthetic oligonucleotide; TTC chr11 5181469 5181490 5181486 5181491 +
ttccatttgtttgtatcctctt

SEQ ID NO: 76029 - DNA, 22 bp, Artificial Sequence
  Synthetic oligonucleotide; CTT chr11 5181471 5181492 5181488 5181493 +
ccatttgtttgtatcctctttt

SEQ ID NO: 76030 - DNA, 22 bp, Artificial Sequence
  Synthetic oligonucleotide; TTC chr11 5181472 5181493 5181489 5181494 +
catttgtttgtatcctctttta

SEQ ID NO: 76031 - DNA, 22 bp, Artificial Sequence
  Synthetic oligonucleotide; TTT chr11 5181477 5181498 5181494 5181499 +
gtttgtatcctcttttatttcg

SEQ ID NO: 76032 - DNA, 22 bp, Artificial Sequence
  Synthetic oligonucleotide; TTG chr11 5181478 5181499 5181495 5181500 +
tttgtatcctcttttatttcgt

SEQ ID NO: 76033 - DNA, 22 bp, Artificial Sequence
  Synthetic oligonucleotide; TTT chr11 5181481 5181502 5181498 5181503 +
gtatcctcttttatttcgttga

SEQ ID NO: 76034 - DNA, 22 bp, Artificial Sequence
  Synthetic oligonucleotide; TTG chr11 5181482 5181503 5181499 5181504 +
tatcctcttttatttcgttgag

SEQ ID NO: 76035 - DNA, 22 bp, Artificial Sequence
  Synthetic oligonucleotide; CTC chr11 5181489 5181510 5181506 5181511 +
ttttatttcgttgagcagtgtt

SEQ ID NO: 76036 - DNA, 22 bp, Artificial Sequence
  Synthetic oligonucleotide; CTT chr11 5181491 5181512 5181508 5181513 +
ttatttcgttgagcagtgtttt

SEQ ID NO: 76037 - DNA, 22 bp, Artificial Sequence
  Synthetic oligonucleotide; TTT chr11 5181492 5181513 5181509 5181514 +
tatttcgttgagcagtgttttg

SEQ ID NO: 76038 - DNA, 22 bp, Artificial Sequence
  Synthetic oligonucleotide; TTT chr11 5181493 5181514 5181510 5181515 +
atttcgttgagcagtgttttgt

SEQ ID NO: 76039 - DNA, 22 bp, Artificial Sequence
  Synthetic oligonucleotide; TTA chr11 5181494 5181515 5181511 5181516 +
tttcgttgagcagtgttttgtt

SEQ ID NO: 76040 - DNA, 22 bp, Artificial Sequence
  Synthetic oligonucleotide; TTT chr11 5181497 5181518 5181514 5181519 +
cgttgagcagtgttttgttgtt

SEQ ID NO: 76041 - DNA, 22 bp, Artificial Sequence
  Synthetic oligonucleotide; TTC chr11 5181498 5181519 5181515 5181520 +
gttgagcagtgttttgttgttc

SEQ ID NO: 76042 - DNA, 22 bp, Artificial Sequence
  Synthetic oligonucleotide; TTG chr11 5181502 5181523 5181519 5181524 +
agcagtgttttgttgttctcct

SEQ ID NO: 76043 - DNA, 22 bp, Artificial Sequence
  Synthetic oligonucleotide; TTT chr11 5181512 5181533 5181529 5181534 +
tgttgttctccttgaagaggtc

SEQ ID NO: 76044 - DNA, 22 bp, Artificial Sequence
  Synthetic oligonucleotide; TTT chr11 5181513 5181534 5181530 5181535 +
gttgttctccttgaagaggtcc

SEQ ID NO: 76045 - DNA, 22 bp, Artificial Sequence
  Synthetic oligonucleotide; TTG chr11 5181514 5181535 5181531 5181536 +
ttgttctccttgaagaggtcct

SEQ ID NO: 76046 - DNA, 22 bp, Artificial Sequence
  Synthetic oligonucleotide; TTG chr11 5181517 5181538 5181534 5181539 +
ttctccttgaagaggtccttca

SEQ ID NO: 76047 - DNA, 22 bp, Artificial Sequence
  Synthetic oligonucleotide; TTC chr11 5181520 5181541 5181537 5181542 +
tccttgaagaggtccttcacat

SEQ ID NO: 76048 - DNA, 22 bp, Artificial Sequence
  Synthetic oligonucleotide; CTC chr11 5181522 5181543 5181539 5181544 +
cttgaagaggtccttcacatcc

SEQ ID NO: 76049 - DNA, 22 bp, Artificial Sequence
  Synthetic oligonucleotide; CTT chr11 5181525 5181546 5181542 5181547 +
gaagaggtccttcacatccctt

SEQ ID NO: 76050 - DNA, 22 bp, Artificial Sequence
  Synthetic oligonucleotide; TTG chr11 5181526 5181547 5181543 5181548 +
aagaggtccttcacatcccttg

SEQ ID NO: 76051 - DNA, 22 bp, Artificial Sequence
  Synthetic oligonucleotide; CTT chr11 5181537 5181558 5181554 5181559 +
cacatcccttgtaagttggatt

SEQ ID NO: 76052 - DNA, 22 bp, Artificial Sequence
  Synthetic oligonucleotide; TTC chr11 5181538 5181559 5181555 5181560 +
acatcccttgtaagttggattc

SEQ ID NO: 76053 - DNA, 22 bp, Artificial Sequence
  Synthetic oligonucleotide; CTT chr11 5181547 5181568 5181564 5181569 +
gtaagttggattcctaggtatt

SEQ ID NO: 76054 - DNA, 22 bp, Artificial Sequence
  Synthetic oligonucleotide; TTG chr11 5181548 5181569 5181565 5181570 +
taagttggattcctaggtattt

SEQ ID NO: 76055 - DNA, 22 bp, Artificial Sequence
  Synthetic oligonucleotide; TTG chr11 5181555 5181576 5181572 5181577 +
gattcctaggtattttattctc

SEQ ID NO: 76056 - DNA, 22 bp, Artificial Sequence
  Synthetic oligonucleotide; TTC chr11 5181560 5181581 5181577 5181582 +
ctaggtattttattctctttga

SEQ ID NO: 76057 - DNA, 22 bp, Artificial Sequence
  Synthetic oligonucleotide; CTA chr11 5181563 5181584 5181580 5181585 +
ggtattttattctctttgaggc

SEQ ID NO: 76058 - DNA, 22 bp, Artificial Sequence
  Synthetic oligonucleotide; TTT chr11 5181570 5181591 5181587 5181592 +
tattctctttgaggcaattgtg

SEQ ID NO: 76059 - DNA, 22 bp, Artificial Sequence
  Synthetic oligonucleotide; TTT chr11 5181571 5181592 5181588 5181593 +
attctctttgaggcaattgtga

SEQ ID NO: 76060 - DNA, 22 bp, Artificial Sequence
  Synthetic oligonucleotide; TTA chr11 5181572 5181593 5181589 5181594 +
ttctctttgaggcaattgtgaa

SEQ ID NO: 76061 - DNA, 22 bp, Artificial Sequence
  Synthetic oligonucleotide; TTC chr11 5181575 5181596 5181592 5181597 +
tctttgaggcaattgtgaatgg

SEQ ID NO: 76062 - DNA, 22 bp, Artificial Sequence
  Synthetic oligonucleotide; CTC chr11 5181577 5181598 5181594 5181599 +
tttgaggcaattgtgaatggga

SEQ ID NO: 76063 - DNA, 22 bp, Artificial Sequence
  Synthetic oligonucleotide; CTT chr11 5181579 5181600 5181596 5181601 +
tgaggcaattgtgaatgggagt

SEQ ID NO: 76064 - DNA, 22 bp, Artificial Sequence
  Synthetic oligonucleotide; TTT chr11 5181580 5181601 5181597 5181602 +
gaggcaattgtgaatgggagtt

SEQ ID NO: 76065 - DNA, 22 bp, Artificial Sequence
  Synthetic oligonucleotide; TTG chr11 5181581 5181602 5181598 5181603 +
aggcaattgtgaatgggagttc

SEQ ID NO: 76066 - DNA, 22 bp, Artificial Sequence
  Synthetic oligonucleotide; TTG chr11 5181590 5181611 5181607 5181612 +
tgaatgggagttcactcatgat

SEQ ID NO: 76067 - DNA, 22 bp, Artificial Sequence
  Synthetic oligonucleotide; TTC chr11 5181603 5181624 5181620 5181625 +
actcatgatttggctctctgtt

SEQ ID NO: 76068 - DNA, 22 bp, Artificial Sequence
  Synthetic oligonucleotide; CTC chr11 5181607 5181628 5181624 5181629 +
atgatttggctctctgtttgtc

SEQ ID NO: 76069 - DNA, 22 bp, Artificial Sequence
  Synthetic oligonucleotide; TTT chr11 5181614 5181635 5181631 5181636 +
ggctctctgtttgtctgttatt

SEQ ID NO: 76070 - DNA, 22 bp, Artificial Sequence
  Synthetic oligonucleotide; TTG chr11 5181615 5181636 5181632 5181637 +
gctctctgtttgtctgttattg

SEQ ID NO: 76071 - DNA, 22 bp, Artificial Sequence
  Synthetic oligonucleotide; CTC chr11 5181619 5181640 5181636 5181641 +
tctgtttgtctgttattggtgt

SEQ ID NO: 76072 - DNA, 22 bp, Artificial Sequence
  Synthetic oligonucleotide; CTC chr11 5181621 5181642 5181638 5181643 +
tgtttgtctgttattggtgtat

SEQ ID NO: 76073 - DNA, 22 bp, Artificial Sequence
  Synthetic oligonucleotide; CTG chr11 5181623 5181644 5181640 5181645 +
tttgtctgttattggtgtatag

SEQ ID NO: 76074 - DNA, 22 bp, Artificial Sequence
  Synthetic oligonucleotide; TTT chr11 5181626 5181647 5181643 5181648 +
gtctgttattggtgtataggaa

SEQ ID NO: 76075 - DNA, 22 bp, Artificial Sequence
  Synthetic oligonucleotide; TTG chr11 5181627 5181648 5181644 5181649 +
tctgttattggtgtataggaat

SEQ ID NO: 76076 - DNA, 22 bp, Artificial Sequence
  Synthetic oligonucleotide; CTG chr11 5181631 5181652 5181648 5181653 +
ttattggtgtataggaatgctt

SEQ ID NO: 76077 - DNA, 22 bp, Artificial Sequence
  Synthetic oligonucleotide; TTA chr11 5181634 5181655 5181651 5181656 +
ttggtgtataggaatgcttgtg

SEQ ID NO: 76078 - DNA, 22 bp, Artificial Sequence
  Synthetic oligonucleotide; TTG chr11 5181637 5181658 5181654 5181659 +
gtgtataggaatgcttgtgatt

SEQ ID NO: 76079 - DNA, 22 bp, Artificial Sequence
  Synthetic oligonucleotide; CTT chr11 5181653 5181674 5181670 5181675 +
gtgatttttgcacattgatttt

SEQ ID NO: 76080 - DNA, 22 bp, Artificial Sequence
  Synthetic oligonucleotide; TTG chr11 5181654 5181675 5181671 5181676 +
tgatttttgcacattgattttg

SEQ ID NO: 76081 - DNA, 22 bp, Artificial Sequence
  Synthetic oligonucleotide; TTT chr11 5181660 5181681 5181677 5181682 +
ttgcacattgattttgtatgct

SEQ ID NO: 76082 - DNA, 22 bp, Artificial Sequence
  Synthetic oligonucleotide; TTT chr11 5181661 5181682 5181678 5181683 +
tgcacattgattttgtatgctg

SEQ ID NO: 76083 - DNA, 22 bp, Artificial Sequence
  Synthetic oligonucleotide; TTT chr11 5181662 5181683 5181679 5181684 +
gcacattgattttgtatgctga

SEQ ID NO: 76084 - DNA, 22 bp, Artificial Sequence
  Synthetic oligonucleotide; TTG chr11 5181663 5181684 5181680 5181685 +
cacattgattttgtatgctgag

SEQ ID NO: 76085 - DNA, 22 bp, Artificial Sequence
  Synthetic oligonucleotide; TTG chr11 5181670 5181691 5181687 5181692 +
attttgtatgctgagacttttc

SEQ ID NO: 76086 - DNA, 22 bp, Artificial Sequence
  Synthetic oligonucleotide; TTT chr11 5181674 5181695 5181691 5181696 +
tgtatgctgagacttttctgaa

SEQ ID NO: 76087 - DNA, 22 bp, Artificial Sequence
  Synthetic oligonucleotide; TTT chr11 5181675 5181696 5181692 5181697 +
gtatgctgagacttttctgaag

SEQ ID NO: 76088 - DNA, 22 bp, Artificial Sequence
  Synthetic oligonucleotide; TTG chr11 5181676 5181697 5181693 5181698 +
tatgctgagacttttctgaagt

SEQ ID NO: 76089 - DNA, 22 bp, Artificial Sequence
  Synthetic oligonucleotide; CTG chr11 5181683 5181704 5181700 5181705 +
agacttttctgaagttgcttat

SEQ ID NO: 76090 - DNA, 22 bp, Artificial Sequence
  Synthetic oligonucleotide; CTT chr11 5181689 5181710 5181706 5181711 +
ttctgaagttgcttatcagctt

SEQ ID NO: 76091 - DNA, 22 bp, Artificial Sequence
  Synthetic oligonucleotide; TTT chr11 5181690 5181711 5181707 5181712 +
tctgaagttgcttatcagctta

SEQ ID NO: 76092 - DNA, 22 bp, Artificial Sequence
  Synthetic oligonucleotide; TTT chr11 5181691 5181712 5181708 5181713 +
ctgaagttgcttatcagcttaa

SEQ ID NO: 76093 - DNA, 22 bp, Artificial Sequence
  Synthetic oligonucleotide; TTC chr11 5181692 5181713 5181709 5181714 +
tgaagttgcttatcagcttaag

SEQ ID NO: 76094 - DNA, 22 bp, Artificial Sequence
  Synthetic oligonucleotide; CTG chr11 5181694 5181715 5181711 5181716 +
aagttgcttatcagcttaagga

SEQ ID NO: 76095 - DNA, 22 bp, Artificial Sequence
  Synthetic oligonucleotide; TTG chr11 5181700 5181721 5181717 5181722 +
cttatcagcttaaggagatttt

SEQ ID NO: 76096 - DNA, 22 bp, Artificial Sequence
  Synthetic oligonucleotide; CTT chr11 5181703 5181724 5181720 5181725 +
atcagcttaaggagattttggg

SEQ ID NO: 76097 - DNA, 22 bp, Artificial Sequence
  Synthetic oligonucleotide; TTA chr11 5181704 5181725 5181721 5181726 +
tcagcttaaggagattttgggc

SEQ ID NO: 76098 - DNA, 22 bp, Artificial Sequence
  Synthetic oligonucleotide; CTT chr11 5181711 5181732 5181728 5181733 +
aaggagattttgggctgagacg

SEQ ID NO: 76099 - DNA, 22 bp, Artificial Sequence
  Synthetic oligonucleotide; TTA chr11 5181712 5181733 5181729 5181734 +
aggagattttgggctgagacga

SEQ ID NO: 76100 - DNA, 22 bp, Artificial Sequence
  Synthetic oligonucleotide; TTT chr11 5181721 5181742 5181738 5181743 +
tgggctgagacgatggggtttt

SEQ ID NO: 76101 - DNA, 22 bp, Artificial Sequence
  Synthetic oligonucleotide; TTT chr11 5181722 5181743 5181739 5181744 +
gggctgagacgatggggttttc

SEQ ID NO: 76102 - DNA, 22 bp, Artificial Sequence
  Synthetic oligonucleotide; TTG chr11 5181723 5181744 5181740 5181745 +
ggctgagacgatggggttttct

SEQ ID NO: 76103 - DNA, 22 bp, Artificial Sequence
  Synthetic oligonucleotide; CTG chr11 5181728 5181749 5181745 5181750 +
agacgatggggttttctagata

SEQ ID NO: 76104 - DNA, 22 bp, Artificial Sequence
  Synthetic oligonucleotide; TTT chr11 5181742 5181763 5181759 5181764 +
tctagatatacaatcacgtcat

SEQ ID NO: 76105 - DNA, 22 bp, Artificial Sequence
  Synthetic oligonucleotide; TTT chr11 5181743 5181764 5181760 5181765 +
ctagatatacaatcacgtcatc

SEQ ID NO: 76106 - DNA, 22 bp, Artificial Sequence
  Synthetic oligonucleotide; TTC chr11 5181744 5181765 5181761 5181766 +
tagatatacaatcacgtcatct

SEQ ID NO: 76107 - DNA, 22 bp, Artificial Sequence
  Synthetic oligonucleotide; CTA chr11 5181746 5181767 5181763 5181768 +
gatatacaatcacgtcatctgc

SEQ ID NO: 76108 - DNA, 22 bp, Artificial Sequence
  Synthetic oligonucleotide; CTG chr11 5181767 5181788 5181784 5181789 +
caaacagggacaatttcacttc

SEQ ID NO: 76109 - DNA, 22 bp, Artificial Sequence
  Synthetic oligonucleotide; TTT chr11 5181783 5181804 5181800 5181805 +
cacttcctcttttcctaattga

SEQ ID NO: 76110 - DNA, 22 bp, Artificial Sequence
  Synthetic oligonucleotide; TTC chr11 5181784 5181805 5181801 5181806 +
acttcctcttttcctaattgaa

SEQ ID NO: 76111 - DNA, 22 bp, Artificial Sequence
  Synthetic oligonucleotide; CTT chr11 5181788 5181809 5181805 5181810 +
cctcttttcctaattgaatgcc

SEQ ID NO: 76112 - DNA, 22 bp, Artificial Sequence
  Synthetic oligonucleotide; TTC chr11 5181789 5181810 5181806 5181811 +
ctcttttcctaattgaatgccc

SEQ ID NO: 76113 - DNA, 22 bp, Artificial Sequence
  Synthetic oligonucleotide; CTC chr11 5181792 5181813 5181809 5181814 +
ttttcctaattgaatgcccttt

SEQ ID NO: 76114 - DNA, 22 bp, Artificial Sequence
  Synthetic oligonucleotide; CTT chr11 5181794 5181815 5181811 5181816 +
ttcctaattgaatgccctttat

SEQ ID NO: 76115 - DNA, 22 bp, Artificial Sequence
  Synthetic oligonucleotide; TTT chr11 5181795 5181816 5181812 5181817 +
tcctaattgaatgccctttatt

SEQ ID NO: 76116 - DNA, 22 bp, Artificial Sequence
  Synthetic oligonucleotide; TTT chr11 5181796 5181817 5181813 5181818 +
cctaattgaatgccctttattt

SEQ ID NO: 76117 - DNA, 22 bp, Artificial Sequence
  Synthetic oligonucleotide; TTC chr11 5181797 5181818 5181814 5181819 +
ctaattgaatgccctttatttc

SEQ ID NO: 76118 - DNA, 22 bp, Artificial Sequence
  Synthetic oligonucleotide; CTA chr11 5181800 5181821 5181817 5181822 +
attgaatgccctttatttcttt

SEQ ID NO: 76119 - DNA, 22 bp, Artificial Sequence
  Synthetic oligonucleotide; TTG chr11 5181804 5181825 5181821 5181826 +
aatgccctttatttctttctct

SEQ ID NO: 76120 - DNA, 22 bp, Artificial Sequence
  Synthetic oligonucleotide; CTT chr11 5181813 5181834 5181830 5181835 +
tatttctttctcttgcctgatt

SEQ ID NO: 76121 - DNA, 22 bp, Artificial Sequence
  Synthetic oligonucleotide; TTT chr11 5181814 5181835 5181831 5181836 +
atttctttctcttgcctgattg

SEQ ID NO: 76122 - DNA, 22 bp, Artificial Sequence
  Synthetic oligonucleotide; TTA chr11 5181815 5181836 5181832 5181837 +
tttctttctcttgcctgattgc

SEQ ID NO: 76123 - DNA, 22 bp, Artificial Sequence
  Synthetic oligonucleotide; TTT chr11 5181818 5181839 5181835 5181840 +
ctttctcttgcctgattgccct

SEQ ID NO: 76124 - DNA, 22 bp, Artificial Sequence
  Synthetic oligonucleotide; TTC chr11 5181819 5181840 5181836 5181841 +
tttctcttgcctgattgccctg

SEQ ID NO: 76125 - DNA, 22 bp, Artificial Sequence
  Synthetic oligonucleotide; CTT chr11 5181821 5181842 5181838 5181843 +
tctcttgcctgattgccctggc

SEQ ID NO: 76126 - DNA, 22 bp, Artificial Sequence
  Synthetic oligonucleotide; TTT chr11 5181822 5181843 5181839 5181844 +
ctcttgcctgattgccctggcc

SEQ ID NO: 76127 - DNA, 22 bp, Artificial Sequence
  Synthetic oligonucleotide; TTC chr11 5181823 5181844 5181840 5181845 +
tcttgcctgattgccctggcca

SEQ ID NO: 76128 - DNA, 22 bp, Artificial Sequence
  Synthetic oligonucleotide; CTC chr11 5181825 5181846 5181842 5181847 +
ttgcctgattgccctggccaga

SEQ ID NO: 76129 - DNA, 22 bp, Artificial Sequence
  Synthetic oligonucleotide; CTT chr11 5181827 5181848 5181844 5181849 +
gcctgattgccctggccagaac

SEQ ID NO: 76130 - DNA, 22 bp, Artificial Sequence
  Synthetic oligonucleotide; TTG chr11 5181828 5181849 5181845 5181850 +
cctgattgccctggccagaact

SEQ ID NO: 76131 - DNA, 22 bp, Artificial Sequence
  Synthetic oligonucleotide; CTG chr11 5181832 5181853 5181849 5181854 +
attgccctggccagaacttcca

SEQ ID NO: 76132 - DNA, 22 bp, Artificial Sequence
  Synthetic oligonucleotide; TTG chr11 5181836 5181857 5181853 5181858 +
ccctggccagaacttccaacac

SEQ ID NO: 76133 - DNA, 22 bp, Artificial Sequence
  Synthetic oligonucleotide; CTG chr11 5181841 5181862 5181858 5181863 +
gccagaacttccaacactatgt

SEQ ID NO: 76134 - DNA, 22 bp, Artificial Sequence
  Synthetic oligonucleotide; CTT chr11 5181851 5181872 5181868 5181873 +
ccaacactatgttgaataggag

SEQ ID NO: 76135 - DNA, 22 bp, Artificial Sequence
  Synthetic oligonucleotide; TTC chr11 5181852 5181873 5181869 5181874 +
caacactatgttgaataggagt

SEQ ID NO: 76136 - DNA, 22 bp, Artificial Sequence
  Synthetic oligonucleotide; CTA chr11 5181860 5181881 5181877 5181882 +
tgttgaataggagtggtgagag

SEQ ID NO: 76137 - DNA, 22 bp, Artificial Sequence
  Synthetic oligonucleotide; TTG chr11 5181865 5181886 5181882 5181887 +
aataggagtggtgagagagggc

SEQ ID NO: 76138 - DNA, 22 bp, Artificial Sequence
  Synthetic oligonucleotide; CTG chr11 5181894 5181915 5181911 5181916 +
tcttgtgccagttttcaaaggg

SEQ ID NO: 76139 - DNA, 22 bp, Artificial Sequence
  Synthetic oligonucleotide; CTT chr11 5181898 5181919 5181915 5181920 +
gtgccagttttcaaagggaatg

SEQ ID NO: 76140 - DNA, 22 bp, Artificial Sequence
  Synthetic oligonucleotide; TTG chr11 5181899 5181920 5181916 5181921 +
tgccagttttcaaagggaatgc

SEQ ID NO: 76141 - DNA, 22 bp, Artificial Sequence
  Synthetic oligonucleotide; TTT chr11 5181908 5181929 5181925 5181930 +
tcaaagggaatgcttccagttt

SEQ ID NO: 76142 - DNA, 22 bp, Artificial Sequence
  Synthetic oligonucleotide; TTT chr11 5181909 5181930 5181926 5181931 +
caaagggaatgcttccagtttt

SEQ ID NO: 76143 - DNA, 22 bp, Artificial Sequence
  Synthetic oligonucleotide; TTC chr11 5181910 5181931 5181927 5181932 +
aaagggaatgcttccagttttt

SEQ ID NO: 76144 - DNA, 22 bp, Artificial Sequence
  Synthetic oligonucleotide; CTT chr11 5181923 5181944 5181940 5181945 +
ccagtttttgtccattcagtat

SEQ ID NO: 76145 - DNA, 22 bp, Artificial Sequence
  Synthetic oligonucleotide; TTC chr11 5181924 5181945 5181941 5181946 +
cagtttttgtccattcagtatg

SEQ ID NO: 76146 - DNA, 22 bp, Artificial Sequence
  Synthetic oligonucleotide; TTT chr11 5181930 5181951 5181947 5181952 +
ttgtccattcagtatgatattg

SEQ ID NO: 76147 - DNA, 22 bp, Artificial Sequence
  Synthetic oligonucleotide; TTT chr11 5181931 5181952 5181948 5181953 +
tgtccattcagtatgatattgg

SEQ ID NO: 76148 - DNA, 22 bp, Artificial Sequence
  Synthetic oligonucleotide; TTT chr11 5181932 5181953 5181949 5181954 +
gtccattcagtatgatattggc

SEQ ID NO: 76149 - DNA, 22 bp, Artificial Sequence
  Synthetic oligonucleotide; TTG chr11 5181933 5181954 5181950 5181955 +
tccattcagtatgatattggct

SEQ ID NO: 76150 - DNA, 22 bp, Artificial Sequence
  Synthetic oligonucleotide; TTC chr11 5181940 5181961 5181957 5181962 +
agtatgatattggctgtgggtt

SEQ ID NO: 76151 - DNA, 22 bp, Artificial Sequence
  Synthetic oligonucleotide; TTG chr11 5181952 5181973 5181969 5181974 +
gctgtgggtttgtcatagatag

SEQ ID NO: 76152 - DNA, 22 bp, Artificial Sequence
  Synthetic oligonucleotide; CTG chr11 5181956 5181977 5181973 5181978 +
tgggtttgtcatagatagctct

SEQ ID NO: 76153 - DNA, 22 bp, Artificial Sequence
  Synthetic oligonucleotide; TTT chr11 5181963 5181984 5181980 5181985 +
gtcatagatagctcttattatt

SEQ ID NO: 76154 - DNA, 22 bp, Artificial Sequence
  Synthetic oligonucleotide; TTG chr11 5181964 5181985 5181981 5181986 +
tcatagatagctcttattattt

SEQ ID NO: 76155 - DNA, 22 bp, Artificial Sequence
  Synthetic oligonucleotide; CTC chr11 5181977 5181998 5181994 5181999 +
ttattattttgagatatgtccc

SEQ ID NO: 76156 - DNA, 22 bp, Artificial Sequence
  Synthetic oligonucleotide; CTT chr11 5181979 5182000 5181996 5182001 +
attattttgagatatgtcccat

SEQ ID NO: 76157 - DNA, 22 bp, Artificial Sequence
  Synthetic oligonucleotide; TTA chr11 5181980 5182001 5181997 5182002 +
ttattttgagatatgtcccatc

SEQ ID NO: 76158 - DNA, 22 bp, Artificial Sequence
  Synthetic oligonucleotide; TTA chr11 5181983 5182004 5182000 5182005 +
ttttgagatatgtcccatcgat

SEQ ID NO: 76159 - DNA, 22 bp, Artificial Sequence
  Synthetic oligonucleotide; TTT chr11 5181986 5182007 5182003 5182008 +
tgagatatgtcccatcgatacc

SEQ ID NO: 76160 - DNA, 22 bp, Artificial Sequence
  Synthetic oligonucleotide; TTT chr11 5181987 5182008 5182004 5182009 +
gagatatgtcccatcgatacct

SEQ ID NO: 76161 - DNA, 22 bp, Artificial Sequence
  Synthetic oligonucleotide; TTG chr11 5181988 5182009 5182005 5182010 +
agatatgtcccatcgataccta

SEQ ID NO: 76162 - DNA, 22 bp, Artificial Sequence
  Synthetic oligonucleotide; CTA chr11 5182010 5182031 5182027 5182032 +
atttattgagagtttttagtat

SEQ ID NO: 76163 - DNA, 22 bp, Artificial Sequence
  Synthetic oligonucleotide; TTT chr11 5182014 5182035 5182031 5182036 +
attgagagtttttagtatgaag

SEQ ID NO: 76164 - DNA, 22 bp, Artificial Sequence
  Synthetic oligonucleotide; TTA chr11 5182015 5182036 5182032 5182037 +
ttgagagtttttagtatgaagc

SEQ ID NO: 76165 - DNA, 22 bp, Artificial Sequence
  Synthetic oligonucleotide; TTG chr11 5182018 5182039 5182035 5182040 +
agagtttttagtatgaagcatt

SEQ ID NO: 76166 - DNA, 22 bp, Artificial Sequence
  Synthetic oligonucleotide; TTT chr11 5182025 5182046 5182042 5182047 +
ttagtatgaagcattgttgaat

SEQ ID NO: 76167 - DNA, 22 bp, Artificial Sequence
  Synthetic oligonucleotide; TTT chr11 5182026 5182047 5182043 5182048 +
tagtatgaagcattgttgaatt

SEQ ID NO: 76168 - DNA, 22 bp, Artificial Sequence
  Synthetic oligonucleotide; TTT chr11 5182027 5182048 5182044 5182049 +
agtatgaagcattgttgaattt

SEQ ID NO: 76169 - DNA, 22 bp, Artificial Sequence
  Synthetic oligonucleotide; TTA chr11 5182028 5182049 5182045 5182050 +
gtatgaagcattgttgaatttt

SEQ ID NO: 76170 - DNA, 22 bp, Artificial Sequence
  Synthetic oligonucleotide; TTG chr11 5182041 5182062 5182058 5182063 +
ttgaattttgtcaaaggccttt

SEQ ID NO: 76171 - DNA, 22 bp, Artificial Sequence
  Synthetic oligonucleotide; TTG chr11 5182044 5182065 5182061 5182066 +
aattttgtcaaaggccttttct

SEQ ID NO: 76172 - DNA, 22 bp, Artificial Sequence
  Synthetic oligonucleotide; TTT chr11 5182049 5182070 5182066 5182071 +
tgtcaaaggccttttctgcatc

SEQ ID NO: 76173 - DNA, 22 bp, Artificial Sequence
  Synthetic oligonucleotide; TTT chr11 5182050 5182071 5182067 5182072 +
gtcaaaggccttttctgcatct

SEQ ID NO: 76174 - DNA, 22 bp, Artificial Sequence
  Synthetic oligonucleotide; TTG chr11 5182051 5182072 5182068 5182073 +
tcaaaggccttttctgcatcta

SEQ ID NO: 76175 - DNA, 22 bp, Artificial Sequence
  Synthetic oligonucleotide; CTT chr11 5182062 5182083 5182079 5182084 +
ttctgcatctattgagataatc

SEQ ID NO: 76176 - DNA, 22 bp, Artificial Sequence
  Synthetic oligonucleotide; TTT chr11 5182063 5182084 5182080 5182085 +
tctgcatctattgagataatca

SEQ ID NO: 76177 - DNA, 22 bp, Artificial Sequence
  Synthetic oligonucleotide; TTT chr11 5182064 5182085 5182081 5182086 +
ctgcatctattgagataatcat

SEQ ID NO: 76178 - DNA, 22 bp, Artificial Sequence
  Synthetic oligonucleotide; TTC chr11 5182065 5182086 5182082 5182087 +
tgcatctattgagataatcatg

SEQ ID NO: 76179 - DNA, 22 bp, Artificial Sequence
  Synthetic oligonucleotide; CTG chr11 5182067 5182088 5182084 5182089 +
catctattgagataatcatgtg

SEQ ID NO: 76180 - DNA, 22 bp, Artificial Sequence
  Synthetic oligonucleotide; CTA chr11 5182073 5182094 5182090 5182095 +
ttgagataatcatgtggtttgt

SEQ ID NO: 76181 - DNA, 22 bp, Artificial Sequence
  Synthetic oligonucleotide; TTG chr11 5182076 5182097 5182093 5182098 +
agataatcatgtggtttgtgtc

SEQ ID NO: 76182 - DNA, 22 bp, Artificial Sequence
  Synthetic oligonucleotide; TTT chr11 5182093 5182114 5182110 5182115 +
gtgtctttggttctgtttatat

SEQ ID NO: 76183 - DNA, 22 bp, Artificial Sequence
  Synthetic oligonucleotide; TTG chr11 5182094 5182115 5182111 5182116 +
tgtctttggttctgtttatatg

SEQ ID NO: 76184 - DNA, 22 bp, Artificial Sequence
  Synthetic oligonucleotide; CTT chr11 5182100 5182121 5182117 5182122 +
tggttctgtttatatgctggat

SEQ ID NO: 76185 - DNA, 22 bp, Artificial Sequence
  Synthetic oligonucleotide; TTT chr11 5182101 5182122 5182118 5182123 +
ggttctgtttatatgctggatt

SEQ ID NO: 76186 - DNA, 22 bp, Artificial Sequence
  Synthetic oligonucleotide; TTG chr11 5182102 5182123 5182119 5182124 +
gttctgtttatatgctggatta

SEQ ID NO: 76187 - DNA, 22 bp, Artificial Sequence
  Synthetic oligonucleotide; TTC chr11 5182106 5182127 5182123 5182128 +
tgtttatatgctggattatgtt

SEQ ID NO: 76188 - DNA, 22 bp, Artificial Sequence
  Synthetic oligonucleotide; CTG chr11 5182108 5182129 5182125 5182130 +
tttatatgctggattatgttta

SEQ ID NO: 76189 - DNA, 22 bp, Artificial Sequence
  Synthetic oligonucleotide; TTT chr11 5182111 5182132 5182128 5182133 +
atatgctggattatgtttattg

SEQ ID NO: 76190 - DNA, 22 bp, Artificial Sequence
  Synthetic oligonucleotide; TTA chr11 5182112 5182133 5182129 5182134 +
tatgctggattatgtttattga

SEQ ID NO: 76191 - DNA, 22 bp, Artificial Sequence
  Synthetic oligonucleotide; CTG chr11 5182119 5182140 5182136 5182141 +
gattatgtttattgatttgcat

SEQ ID NO: 76192 - DNA, 22 bp, Artificial Sequence
  Synthetic oligonucleotide; TTA chr11 5182124 5182145 5182141 5182146 +
tgtttattgatttgcatatgtt

SEQ ID NO: 76193 - DNA, 22 bp, Artificial Sequence
  Synthetic oligonucleotide; TTT chr11 5182129 5182150 5182146 5182151 +
attgatttgcatatgttgaacc

SEQ ID NO: 76194 - DNA, 22 bp, Artificial Sequence
  Synthetic oligonucleotide; TTA chr11 5182130 5182151 5182147 5182152 +
ttgatttgcatatgttgaacca

SEQ ID NO: 76195 - DNA, 22 bp, Artificial Sequence
  Synthetic oligonucleotide; TTG chr11 5182133 5182154 5182150 5182155 +
atttgcatatgttgaaccagcc

SEQ ID NO: 76196 - DNA, 22 bp, Artificial Sequence
  Synthetic oligonucleotide; TTT chr11 5182137 5182158 5182154 5182159 +
gcatatgttgaaccagccctgc

SEQ ID NO: 76197 - DNA, 22 bp, Artificial Sequence
  Synthetic oligonucleotide; TTG chr11 5182138 5182159 5182155 5182160 +
catatgttgaaccagccctgca

SEQ ID NO: 76198 - DNA, 22 bp, Artificial Sequence
  Synthetic oligonucleotide; TTG chr11 5182147 5182168 5182164 5182169 +
aaccagccctgcatcccaggga

SEQ ID NO: 76199 - DNA, 22 bp, Artificial Sequence
  Synthetic oligonucleotide; CTG chr11 5182158 5182179 5182175 5182180 +
catcccagggatgaagcccact

SEQ ID NO: 76200 - DNA, 22 bp, Artificial Sequence
  Synthetic oligonucleotide; CTT chr11 5182181 5182202 5182198 5182203 +
gatcatggtggataagcttttt

SEQ ID NO: 76201 - DNA, 22 bp, Artificial Sequence
  Synthetic oligonucleotide; TTG chr11 5182182 5182203 5182199 5182204 +
atcatggtggataagctttttg

SEQ ID NO: 76202 - DNA, 22 bp, Artificial Sequence
  Synthetic oligonucleotide; CTT chr11 5182200 5182221 5182217 5182222 +
tttgatgtgctcctggatttgg

SEQ ID NO: 76203 - DNA, 22 bp, Artificial Sequence
  Synthetic oligonucleotide; TTT chr11 5182201 5182222 5182218 5182223 +
ttgatgtgctcctggatttggt

SEQ ID NO: 76204 - DNA, 22 bp, Artificial Sequence
  Synthetic oligonucleotide; TTT chr11 5182202 5182223 5182219 5182224 +
tgatgtgctcctggatttggtt

SEQ ID NO: 76205 - DNA, 22 bp, Artificial Sequence
  Synthetic oligonucleotide; TTT chr11 5182203 5182224 5182220 5182225 +
gatgtgctcctggatttggttt

SEQ ID NO: 76206 - DNA, 22 bp, Artificial Sequence
  Synthetic oligonucleotide; TTG chr11 5182204 5182225 5182221 5182226 +
atgtgctcctggatttggtttg

SEQ ID NO: 76207 - DNA, 22 bp, Artificial Sequence
  Synthetic oligonucleotide; CTC chr11 5182212 5182233 5182229 5182234 +
ctggatttggtttgccagtatt

SEQ ID NO: 76208 - DNA, 22 bp, Artificial Sequence
  Synthetic oligonucleotide; CTG chr11 5182215 5182236 5182232 5182237 +
gatttggtttgccagtatttta

SEQ ID NO: 76209 - DNA, 22 bp, Artificial Sequence
  Synthetic oligonucleotide; TTT chr11 5182220 5182241 5182237 5182242 +
ggtttgccagtattttactgag

SEQ ID NO: 76210 - DNA, 22 bp, Artificial Sequence
  Synthetic oligonucleotide; TTG chr11 5182221 5182242 5182238 5182243 +
gtttgccagtattttactgagg

SEQ ID NO: 76211 - DNA, 22 bp, Artificial Sequence
  Synthetic oligonucleotide; TTT chr11 5182225 5182246 5182242 5182247 +
gccagtattttactgaggattt

SEQ ID NO: 76212 - DNA, 22 bp, Artificial Sequence
  Synthetic oligonucleotide; TTG chr11 5182226 5182247 5182243 5182248 +
ccagtattttactgaggatttt

SEQ ID NO: 76213 - DNA, 22 bp, Artificial Sequence
  Synthetic oligonucleotide; TTT chr11 5182235 5182256 5182252 5182257 +
tactgaggatttttgcatcgat

SEQ ID NO: 76214 - DNA, 22 bp, Artificial Sequence
  Synthetic oligonucleotide; TTT chr11 5182236 5182257 5182253 5182258 +
actgaggatttttgcatcgatg

SEQ ID NO: 76215 - DNA, 22 bp, Artificial Sequence
  Synthetic oligonucleotide; TTA chr11 5182237 5182258 5182254 5182259 +
ctgaggatttttgcatcgatgt

SEQ ID NO: 76216 - DNA, 22 bp, Artificial Sequence
  Synthetic oligonucleotide; CTG chr11 5182240 5182261 5182257 5182262 +
aggatttttgcatcgatgttca

SEQ ID NO: 76217 - DNA, 22 bp, Artificial Sequence
  Synthetic oligonucleotide; TTT chr11 5182247 5182268 5182264 5182269 +
ttgcatcgatgttcatcaggga

SEQ ID NO: 76218 - DNA, 22 bp, Artificial Sequence
  Synthetic oligonucleotide; TTT chr11 5182248 5182269 5182265 5182270 +
tgcatcgatgttcatcagggat

SEQ ID NO: 76219 - DNA, 22 bp, Artificial Sequence
  Synthetic oligonucleotide; TTT chr11 5182249 5182270 5182266 5182271 +
gcatcgatgttcatcagggata

SEQ ID NO: 76220 - DNA, 22 bp, Artificial Sequence
  Synthetic oligonucleotide; TTG chr11 5182250 5182271 5182267 5182272 +
catcgatgttcatcagggatat

SEQ ID NO: 76221 - DNA, 22 bp, Artificial Sequence
  Synthetic oligonucleotide; TTC chr11 5182261 5182282 5182278 5182283 +
atcagggatattggtgtaaaat

SEQ ID NO: 76222 - DNA, 22 bp, Artificial Sequence
  Synthetic oligonucleotide; TTG chr11 5182274 5182295 5182291 5182296 +
gtgtaaaattctctttttttgt

SEQ ID NO: 76223 - DNA, 22 bp, Artificial Sequence
  Synthetic oligonucleotide; TTC chr11 5182285 5182306 5182302 5182307 +
tctttttttgttgtgtgtctgc

SEQ ID NO: 76224 - DNA, 22 bp, Artificial Sequence
  Synthetic oligonucleotide; CTC chr11 5182287 5182308 5182304 5182309 +
tttttttgttgtgtgtctgcta

SEQ ID NO: 76225 - DNA, 22 bp, Artificial Sequence
  Synthetic oligonucleotide; CTT chr11 5182289 5182310 5182306 5182311 +
tttttgttgtgtgtctgctagg

SEQ ID NO: 76226 - DNA, 22 bp, Artificial Sequence
  Synthetic oligonucleotide; TTT chr11 5182290 5182311 5182307 5182312 +
ttttgttgtgtgtctgctaggc

SEQ ID NO: 76227 - DNA, 22 bp, Artificial Sequence
  Synthetic oligonucleotide; TTT chr11 5182291 5182312 5182308 5182313 +
tttgttgtgtgtctgctaggct

SEQ ID NO: 76228 - DNA, 22 bp, Artificial Sequence
  Synthetic oligonucleotide; TTT chr11 5182292 5182313 5182309 5182314 +
ttgttgtgtgtctgctaggctt

SEQ ID NO: 76229 - DNA, 22 bp, Artificial Sequence
  Synthetic oligonucleotide; TTT chr11 5182293 5182314 5182310 5182315 +
tgttgtgtgtctgctaggcttt

SEQ ID NO: 76230 - DNA, 22 bp, Artificial Sequence
  Synthetic oligonucleotide; TTT chr11 5182294 5182315 5182311 5182316 +
gttgtgtgtctgctaggctttg

SEQ ID NO: 76231 - DNA, 22 bp, Artificial Sequence
  Synthetic oligonucleotide; TTG chr11 5182295 5182316 5182312 5182317 +
ttgtgtgtctgctaggctttgg

SEQ ID NO: 76232 - DNA, 22 bp, Artificial Sequence
  Synthetic oligonucleotide; TTG chr11 5182298 5182319 5182315 5182320 +
tgtgtctgctaggctttggtat

SEQ ID NO: 76233 - DNA, 22 bp, Artificial Sequence
  Synthetic oligonucleotide; CTG chr11 5182306 5182327 5182323 5182328 +
ctaggctttggtatcaagatga

SEQ ID NO: 76234 - DNA, 22 bp, Artificial Sequence
  Synthetic oligonucleotide; CTA chr11 5182309 5182330 5182326 5182331 +
ggctttggtatcaagatgatgc

SEQ ID NO: 76235 - DNA, 22 bp, Artificial Sequence
  Synthetic oligonucleotide; CTT chr11 5182314 5182335 5182331 5182336 +
tggtatcaagatgatgctggcc

SEQ ID NO: 76236 - DNA, 22 bp, Artificial Sequence
  Synthetic oligonucleotide; TTT chr11 5182315 5182336 5182332 5182337 +
ggtatcaagatgatgctggcct

SEQ ID NO: 76237 - DNA, 22 bp, Artificial Sequence
  Synthetic oligonucleotide; TTG chr11 5182316 5182337 5182333 5182338 +
gtatcaagatgatgctggcctc

SEQ ID NO: 76238 - DNA, 22 bp, Artificial Sequence
  Synthetic oligonucleotide; CTG chr11 5182333 5182354 5182350 5182355 +
gcctcataaaatgagttaggga

SEQ ID NO: 76239 - DNA, 22 bp, Artificial Sequence
  Synthetic oligonucleotide; CTC chr11 5182338 5182359 5182355 5182360 +
ataaaatgagttagggaggatt

SEQ ID NO: 76240 - DNA, 22 bp, Artificial Sequence
  Synthetic oligonucleotide; TTA chr11 5182351 5182372 5182368 5182373 +
gggaggattccctctttttcta

SEQ ID NO: 76241 - DNA, 22 bp, Artificial Sequence
  Synthetic oligonucleotide; TTC chr11 5182361 5182382 5182378 5182383 +
cctctttttctattgattggaa

SEQ ID NO: 76242 - DNA, 22 bp, Artificial Sequence
  Synthetic oligonucleotide; CTC chr11 5182365 5182386 5182382 5182387 +
tttttctattgattggaatagt

SEQ ID NO: 76243 - DNA, 22 bp, Artificial Sequence
  Synthetic oligonucleotide; CTT chr11 5182367 5182388 5182384 5182389 +
tttctattgattggaatagttt

SEQ ID NO: 76244 - DNA, 22 bp, Artificial Sequence
  Synthetic oligonucleotide; TTT chr11 5182368 5182389 5182385 5182390 +
ttctattgattggaatagtttc

SEQ ID NO: 76245 - DNA, 22 bp, Artificial Sequence
  Synthetic oligonucleotide; TTT chr11 5182369 5182390 5182386 5182391 +
tctattgattggaatagtttca

SEQ ID NO: 76246 - DNA, 22 bp, Artificial Sequence
  Synthetic oligonucleotide; TTT chr11 5182370 5182391 5182387 5182392 +
ctattgattggaatagtttcag

SEQ ID NO: 76247 - DNA, 22 bp, Artificial Sequence
  Synthetic oligonucleotide; TTC chr11 5182371 5182392 5182388 5182393 +
tattgattggaatagtttcaga

SEQ ID NO: 76248 - DNA, 22 bp, Artificial Sequence
  Synthetic oligonucleotide; CTA chr11 5182373 5182394 5182390 5182395 +
ttgattggaatagtttcagaag

SEQ ID NO: 76249 - DNA, 22 bp, Artificial Sequence
  Synthetic oligonucleotide; TTG chr11 5182376 5182397 5182393 5182398 +
attggaatagtttcagaaggaa

SEQ ID NO: 76250 - DNA, 22 bp, Artificial Sequence
  Synthetic oligonucleotide; TTG chr11 5182380 5182401 5182397 5182402 +
gaatagtttcagaaggaatggt

SEQ ID NO: 76251 - DNA, 22 bp, Artificial Sequence
  Synthetic oligonucleotide; TTT chr11 5182389 5182410 5182406 5182411 +
cagaaggaatggtaccagctcc

SEQ ID NO: 76252 - DNA, 22 bp, Artificial Sequence
  Synthetic oligonucleotide; TTC chr11 5182390 5182411 5182407 5182412 +
agaaggaatggtaccagctcct

SEQ ID NO: 76253 - DNA, 22 bp, Artificial Sequence
  Synthetic oligonucleotide; CTC chr11 5182410 5182431 5182427 5182432 +
ctccttgtacctctggtagaat

SEQ ID NO: 76254 - DNA, 22 bp, Artificial Sequence
  Synthetic oligonucleotide; CTC chr11 5182413 5182434 5182430 5182435 +
cttgtacctctggtagaattcg

SEQ ID NO: 76255 - DNA, 22 bp, Artificial Sequence
  Synthetic oligonucleotide; CTT chr11 5182416 5182437 5182433 5182438 +
gtacctctggtagaattcggct

SEQ ID NO: 76256 - DNA, 22 bp, Artificial Sequence
  Synthetic oligonucleotide; TTG chr11 5182417 5182438 5182434 5182439 +
tacctctggtagaattcggctg

SEQ ID NO: 76257 - DNA, 22 bp, Artificial Sequence
  Synthetic oligonucleotide; CTC chr11 5182423 5182444 5182440 5182445 +
tggtagaattcggctgtgaatc

SEQ ID NO: 76258 - DNA, 22 bp, Artificial Sequence
  Synthetic oligonucleotide; CTG chr11 5182425 5182446 5182442 5182447 +
gtagaattcggctgtgaatcca

SEQ ID NO: 76259 - DNA, 22 bp, Artificial Sequence
  Synthetic oligonucleotide; TTC chr11 5182434 5182455 5182451 5182456 +
ggctgtgaatccatctggtcct

SEQ ID NO: 76260 - DNA, 22 bp, Artificial Sequence
  Synthetic oligonucleotide; CTG chr11 5182439 5182460 5182456 5182461 +
tgaatccatctggtcctggact

SEQ ID NO: 76261 - DNA, 22 bp, Artificial Sequence
  Synthetic oligonucleotide; CTG chr11 5182451 5182472 5182468 5182473 +
gtcctggactttttttggttgg

SEQ ID NO: 76262 - DNA, 22 bp, Artificial Sequence
  Synthetic oligonucleotide; CTG chr11 5182457 5182478 5182474 5182479 +
gactttttttggttggtaagct

SEQ ID NO: 76263 - DNA, 22 bp, Artificial Sequence
  Synthetic oligonucleotide; CTT chr11 5182462 5182483 5182479 5182484 +
tttttggttggtaagcttcata

SEQ ID NO: 76264 - DNA, 22 bp, Artificial Sequence
  Synthetic oligonucleotide; TTT chr11 5182463 5182484 5182480 5182485 +
ttttggttggtaagcttcataa

SEQ ID NO: 76265 - DNA, 22 bp, Artificial Sequence
  Synthetic oligonucleotide; TTT chr11 5182464 5182485 5182481 5182486 +
tttggttggtaagcttcataag

SEQ ID NO: 76266 - DNA, 22 bp, Artificial Sequence
  Synthetic oligonucleotide; TTT chr11 5182465 5182486 5182482 5182487 +
ttggttggtaagcttcataagt

SEQ ID NO: 76267 - DNA, 22 bp, Artificial Sequence
  Synthetic oligonucleotide; TTT chr11 5182466 5182487 5182483 5182488 +
tggttggtaagcttcataagtg

SEQ ID NO: 76268 - DNA, 22 bp, Artificial Sequence
  Synthetic oligonucleotide; TTT chr11 5182467 5182488 5182484 5182489 +
ggttggtaagcttcataagtga

SEQ ID NO: 76269 - DNA, 22 bp, Artificial Sequence
  Synthetic oligonucleotide; TTG chr11 5182468 5182489 5182485 5182490 +
gttggtaagcttcataagtgaa

SEQ ID NO: 76270 - DNA, 22 bp, Artificial Sequence
  Synthetic oligonucleotide; TTG chr11 5182472 5182493 5182489 5182494 +
gtaagcttcataagtgaaggag

SEQ ID NO: 76271 - DNA, 22 bp, Artificial Sequence
  Synthetic oligonucleotide; CTT chr11 5182480 5182501 5182497 5182502 +
cataagtgaaggagaaataaaa

SEQ ID NO: 76272 - DNA, 22 bp, Artificial Sequence
  Synthetic oligonucleotide; TTC chr11 5182481 5182502 5182498 5182503 +
ataagtgaaggagaaataaaat

SEQ ID NO: 76273 - DNA, 22 bp, Artificial Sequence
  Synthetic oligonucleotide; CTT chr11 5182507 5182528 5182524 5182529 +
tacagacaagcaattgctgatt

SEQ ID NO: 76274 - DNA, 22 bp, Artificial Sequence
  Synthetic oligonucleotide; TTT chr11 5182508 5182529 5182525 5182530 +
acagacaagcaattgctgattt

SEQ ID NO: 76275 - DNA, 22 bp, Artificial Sequence
  Synthetic oligonucleotide; TTA chr11 5182509 5182530 5182526 5182531 +
cagacaagcaattgctgatttt

SEQ ID NO: 76276 - DNA, 22 bp, Artificial Sequence
  Synthetic oligonucleotide; TTG chr11 5182523 5182544 5182540 5182545 +
ctgattttgtcaccaccaggcc

SEQ ID NO: 76277 - DNA, 22 bp, Artificial Sequence
  Synthetic oligonucleotide; CTG chr11 5182526 5182547 5182543 5182548 +
attttgtcaccaccaggcctgc

SEQ ID NO: 76278 - DNA, 22 bp, Artificial Sequence
  Synthetic oligonucleotide; TTT chr11 5182530 5182551 5182547 5182552 +
tgtcaccaccaggcctgcccta

SEQ ID NO: 76279 - DNA, 22 bp, Artificial Sequence
  Synthetic oligonucleotide; TTT chr11 5182531 5182552 5182548 5182553 +
gtcaccaccaggcctgccctaa

SEQ ID NO: 76280 - DNA, 22 bp, Artificial Sequence
  Synthetic oligonucleotide; TTG chr11 5182532 5182553 5182549 5182554 +
tcaccaccaggcctgccctaaa

SEQ ID NO: 76281 - DNA, 22 bp, Artificial Sequence
  Synthetic oligonucleotide; CTG chr11 5182547 5182568 5182564 5182569 +
ccctaaaagagctcctgaagga

SEQ ID NO: 76282 - DNA, 22 bp, Artificial Sequence
  Synthetic oligonucleotide; CTA chr11 5182552 5182573 5182569 5182574 +
aaagagctcctgaaggaagcag

SEQ ID NO: 76283 - DNA, 22 bp, Artificial Sequence
  Synthetic oligonucleotide; CTC chr11 5182561 5182582 5182578 5182583 +
ctgaaggaagcagtaaacatgg

SEQ ID NO: 76284 - DNA, 22 bp, Artificial Sequence
  Synthetic oligonucleotide; CTG chr11 5182564 5182585 5182581 5182586 +
aaggaagcagtaaacatggaaa

SEQ ID NO: 76285 - DNA, 22 bp, Artificial Sequence
  Synthetic oligonucleotide; CTG chr11 5182609 5182630 5182626 5182631 +
caaaaacatgccaaattgtaaa

SEQ ID NO: 76286 - DNA, 22 bp, Artificial Sequence
  Synthetic oligonucleotide; TTG chr11 5182627 5182648 5182644 5182649 +
taaagaccatcaaggctaggga

SEQ ID NO: 76287 - DNA, 22 bp, Artificial Sequence
  Synthetic oligonucleotide; CTA chr11 5182645 5182666 5182662 5182667 +
gggagaaactgcatcaactagc

SEQ ID NO: 76288 - DNA, 22 bp, Artificial Sequence
  Synthetic oligonucleotide; CTG chr11 5182656 5182677 5182673 5182678 +
catcaactagcaagcaaaataa

SEQ ID NO: 76289 - DNA, 22 bp, Artificial Sequence
  Synthetic oligonucleotide; CTA chr11 5182665 5182686 5182682 5182687 +
gcaagcaaaataaccagctaac

SEQ ID NO: 76290 - DNA, 22 bp, Artificial Sequence
  Synthetic oligonucleotide; CTA chr11 5182685 5182706 5182702 5182707 +
acatcataatgacaggatcaaa

SEQ ID NO: 76291 - DNA, 22 bp, Artificial Sequence
  Synthetic oligonucleotide; TTC chr11 5182710 5182731 5182727 5182732 +
tcacataacaatattaacctta

SEQ ID NO: 76292 - DNA, 22 bp, Artificial Sequence
  Synthetic oligonucleotide; CTC chr11 5182712 5182733 5182729 5182734 +
acataacaatattaaccttaaa

SEQ ID NO: 76293 - DNA, 22 bp, Artificial Sequence
  Synthetic oligonucleotide; TTA chr11 5182726 5182747 5182743 5182748 +
accttaaatgtaaatgagctaa

SEQ ID NO: 76294 - DNA, 22 bp, Artificial Sequence
  Synthetic oligonucleotide; CTT chr11 5182731 5182752 5182748 5182753 +
aaatgtaaatgagctaaatgct

SEQ ID NO: 76295 - DNA, 22 bp, Artificial Sequence
  Synthetic oligonucleotide; TTA chr11 5182732 5182753 5182749 5182754 +
aatgtaaatgagctaaatgctc

SEQ ID NO: 76296 - DNA, 22 bp, Artificial Sequence
  Synthetic oligonucleotide; CTA chr11 5182747 5182768 5182764 5182769 +
aatgctccaattaaaagacaca

SEQ ID NO: 76297 - DNA, 22 bp, Artificial Sequence
  Synthetic oligonucleotide; CTC chr11 5182754 5182775 5182771 5182776 +
caattaaaagacacagactggc

SEQ ID NO: 76298 - DNA, 22 bp, Artificial Sequence
  Synthetic oligonucleotide; TTA chr11 5182760 5182781 5182777 5182782 +
aaagacacagactggcaaattg

SEQ ID NO: 76299 - DNA, 22 bp, Artificial Sequence
  Synthetic oligonucleotide; CTG chr11 5182774 5182795 5182791 5182796 +
gcaaattggataaagagtcaag

SEQ ID NO: 76300 - DNA, 22 bp, Artificial Sequence
  Synthetic oligonucleotide; TTG chr11 5182782 5182803 5182799 5182804 +
gataaagagtcaagacctatca

SEQ ID NO: 76301 - DNA, 22 bp, Artificial Sequence
  Synthetic oligonucleotide; CTA chr11 5182801 5182822 5182818 5182823 +
tcagtgtgctgtattcaggaaa

SEQ ID NO: 76302 - DNA, 22 bp, Artificial Sequence
  Synthetic oligonucleotide; CTG chr11 5182812 5182833 5182829 5182834 +
tattcaggaaaccaatctcatg

SEQ ID NO: 76303 - DNA, 22 bp, Artificial Sequence
  Synthetic oligonucleotide; TTC chr11 5182817 5182838 5182834 5182839 +
aggaaaccaatctcatgtggag

SEQ ID NO: 76304 - DNA, 22 bp, Artificial Sequence
  Synthetic oligonucleotide; CTC chr11 5182831 5182852 5182848 5182853 +
atgtggagagacacacataggc

SEQ ID NO: 76305 - DNA, 22 bp, Artificial Sequence
  Synthetic oligonucleotide; CTC chr11 5182855 5182876 5182872 5182877 +
aaaataaagggatggaggaaga

SEQ ID NO: 76306 - DNA, 22 bp, Artificial Sequence
  Synthetic oligonucleotide; CTA chr11 5182881 5182902 5182898 5182903 +
ccaagcaaatggaaaacaaaaa

SEQ ID NO: 76307 - DNA, 22 bp, Artificial Sequence
  Synthetic oligonucleotide; TTT chr11 5182916 5182937 5182933 5182938 +
gcaatcttagtctctgataaaa

SEQ ID NO: 76308 - DNA, 22 bp, Artificial Sequence
  Synthetic oligonucleotide; TTG chr11 5182917 5182938 5182934 5182939 +
caatcttagtctctgataaaac

SEQ ID NO: 76309 - DNA, 22 bp, Artificial Sequence
  Synthetic oligonucleotide; CTT chr11 5182924 5182945 5182941 5182946 +
agtctctgataaaacagacttt

SEQ ID NO: 76310 - DNA, 22 bp, Artificial Sequence
  Synthetic oligonucleotide; TTA chr11 5182925 5182946 5182942 5182947 +
gtctctgataaaacagacttta

SEQ ID NO: 76311 - DNA, 22 bp, Artificial Sequence
  Synthetic oligonucleotide; CTC chr11 5182930 5182951 5182947 5182952 +
tgataaaacagactttaaacca

SEQ ID NO: 76312 - DNA, 22 bp, Artificial Sequence
  Synthetic oligonucleotide; CTG chr11 5182932 5182953 5182949 5182954 +
ataaaacagactttaaaccaac

SEQ ID NO: 76313 - DNA, 22 bp, Artificial Sequence
  Synthetic oligonucleotide; CTT chr11 5182945 5182966 5182962 5182967 +
taaaccaacaaagatcaaaaga

SEQ ID NO: 76314 - DNA, 22 bp, Artificial Sequence
  Synthetic oligonucleotide; TTT chr11 5182946 5182967 5182963 5182968 +
aaaccaacaaagatcaaaagag

SEQ ID NO: 76315 - DNA, 22 bp, Artificial Sequence
  Synthetic oligonucleotide; TTA chr11 5182947 5182968 5182964 5182969 +
aaccaacaaagatcaaaagaga

SEQ ID NO: 76316 - DNA, 22 bp, Artificial Sequence
  Synthetic oligonucleotide; TTA chr11 5182984 5183005 5183001 5183006 +
catactggtaaagggatcaatt

SEQ ID NO: 76317 - DNA, 22 bp, Artificial Sequence
  Synthetic oligonucleotide; CTG chr11 5182991 5183012 5183008 5183013 +
gtaaagggatcaattcaacaag

SEQ ID NO: 76318 - DNA, 22 bp, Artificial Sequence
  Synthetic oligonucleotide; TTC chr11 5183007 5183028 5183024 5183029 +
aacaagaagagctaactatcct

SEQ ID NO: 76319 - DNA, 22 bp, Artificial Sequence
  Synthetic oligonucleotide; CTA chr11 5183021 5183042 5183038 5183043 +
actatcctaaatatatatgcac

SEQ ID NO: 76320 - DNA, 22 bp, Artificial Sequence
  Synthetic oligonucleotide; CTA chr11 5183025 5183046 5183042 5183047 +
tcctaaatatatatgcacccaa

SEQ ID NO: 76321 - DNA, 22 bp, Artificial Sequence
  Synthetic oligonucleotide; CTA chr11 5183030 5183051 5183047 5183052 +
aatatatatgcacccaatacag

SEQ ID NO: 76322 - DNA, 22 bp, Artificial Sequence
  Synthetic oligonucleotide; TTC chr11 5183066 5183087 5183083 5183088 +
ataaagcaagtccttagagacc

SEQ ID NO: 76323 - DNA, 22 bp, Artificial Sequence
  Synthetic oligonucleotide; CTT chr11 5183081 5183102 5183098 5183103 +
agagacctacaaagagacttag

SEQ ID NO: 76324 - DNA, 22 bp, Artificial Sequence
  Synthetic oligonucleotide; TTA chr11 5183082 5183103 5183099 5183104 +
gagacctacaaagagacttaga

SEQ ID NO: 76325 - DNA, 22 bp, Artificial Sequence
  Synthetic oligonucleotide; CTA chr11 5183090 5183111 5183107 5183112 +
caaagagacttagactcccaca

SEQ ID NO: 76326 - DNA, 22 bp, Artificial Sequence
  Synthetic oligonucleotide; CTT chr11 5183101 5183122 5183118 5183123 +
agactcccacacaataataatg

SEQ ID NO: 76327 - DNA, 22 bp, Artificial Sequence
  Synthetic oligonucleotide; TTA chr11 5183102 5183123 5183119 5183124 +
gactcccacacaataataatgg

SEQ ID NO: 76328 - DNA, 22 bp, Artificial Sequence
  Synthetic oligonucleotide; CTC chr11 5183107 5183128 5183124 5183129 +
ccacacaataataatgggagac

SEQ ID NO: 76329 - DNA, 22 bp, Artificial Sequence
  Synthetic oligonucleotide; CTT chr11 5183131 5183152 5183148 5183153 +
taacaccccactgtcaacatta

SEQ ID NO: 76330 - DNA, 22 bp, Artificial Sequence
  Synthetic oligonucleotide; TTT chr11 5183132 5183153 5183149 5183154 +
aacaccccactgtcaacattag

SEQ ID NO: 76331 - DNA, 22 bp, Artificial Sequence
  Synthetic oligonucleotide; TTA chr11 5183133 5183154 5183150 5183155 +
acaccccactgtcaacattaga

SEQ ID NO: 76332 - DNA, 22 bp, Artificial Sequence
  Synthetic oligonucleotide; CTG chr11 5183144 5183165 5183161 5183166 +
tcaacattagacagatcaacga

SEQ ID NO: 76333 - DNA, 22 bp, Artificial Sequence
  Synthetic oligonucleotide; TTA chr11 5183153 5183174 5183170 5183175 +
gacagatcaacgagacagaaag

SEQ ID NO: 76334 - DNA, 22 bp, Artificial Sequence
  Synthetic oligonucleotide; TTA chr11 5183178 5183199 5183195 5183200 +
acaaggatatccaggaattgaa

SEQ ID NO: 76335 - DNA, 22 bp, Artificial Sequence
  Synthetic oligonucleotide; TTG chr11 5183198 5183219 5183215 5183220 +
aattcagctctgcaccaagcag

SEQ ID NO: 76336 - DNA, 22 bp, Artificial Sequence
  Synthetic oligonucleotide; TTC chr11 5183203 5183224 5183220 5183225 +
agctctgcaccaagcagaccta

SEQ ID NO: 76337 - DNA, 22 bp, Artificial Sequence
  Synthetic oligonucleotide; CTC chr11 5183208 5183229 5183225 5183230 +
tgcaccaagcagacctaataga

SEQ ID NO: 76338 - DNA, 22 bp, Artificial Sequence
  Synthetic oligonucleotide; CTG chr11 5183210 5183231 5183227 5183232 +
caccaagcagacctaatagaca

SEQ ID NO: 76339 - DNA, 22 bp, Artificial Sequence
  Synthetic oligonucleotide; CTA chr11 5183225 5183246 5183242 5183247 +
atagacatctacagaactctcc

SEQ ID NO: 76340 - DNA, 22 bp, Artificial Sequence
  Synthetic oligonucleotide; CTA chr11 5183236 5183257 5183253 5183258 +
cagaactctccatcccaaatca

SEQ ID NO: 76341 - DNA, 22 bp, Artificial Sequence
  Synthetic oligonucleotide; CTC chr11 5183244 5183265 5183261 5183266 +
tccatcccaaatcaatagaata

SEQ ID NO: 76342 - DNA, 22 bp, Artificial Sequence
  Synthetic oligonucleotide; CTC chr11 5183246 5183267 5183263 5183268 +
catcccaaatcaatagaatata

SEQ ID NO: 76343 - DNA, 22 bp, Artificial Sequence
  Synthetic oligonucleotide; TTC chr11 5183273 5183294 5183290 5183295 +
ttctcagcaccacaccacacct

SEQ ID NO: 76344 - DNA, 22 bp, Artificial Sequence
  Synthetic oligonucleotide; CTT chr11 5183275 5183296 5183292 5183297 +
ctcagcaccacaccacacctat

SEQ ID NO: 76345 - DNA, 22 bp, Artificial Sequence
  Synthetic oligonucleotide; TTC chr11 5183276 5183297 5183293 5183298 +
tcagcaccacaccacacctatt

SEQ ID NO: 76346 - DNA, 22 bp, Artificial Sequence
  Synthetic oligonucleotide; CTC chr11 5183278 5183299 5183295 5183300 +
agcaccacaccacacctattcc

SEQ ID NO: 76347 - DNA, 22 bp, Artificial Sequence
  Synthetic oligonucleotide; CTA chr11 5183296 5183317 5183313 5183318 +
ttccagttgaccacatagttgg

SEQ ID NO: 76348 - DNA, 22 bp, Artificial Sequence
  Synthetic oligonucleotide; TTC chr11 5183299 5183320 5183316 5183321 +
cagttgaccacatagttggaag

SEQ ID NO: 76349 - DNA, 22 bp, Artificial Sequence
  Synthetic oligonucleotide; TTG chr11 5183305 5183326 5183322 5183327 +
accacatagttggaagtgaagc

SEQ ID NO: 76350 - DNA, 22 bp, Artificial Sequence
  Synthetic oligonucleotide; TTG chr11 5183317 5183338 5183334 5183339 +
gaagtgaagcactcctcagcaa

SEQ ID NO: 76351 - DNA, 22 bp, Artificial Sequence
  Synthetic oligonucleotide; CTC chr11 5183331 5183352 5183348 5183353 +
ctcagcaaacgtaaaagaacag

SEQ ID NO: 76352 - DNA, 22 bp, Artificial Sequence
  Synthetic oligonucleotide; CTC chr11 5183334 5183355 5183351 5183356 +
agcaaacgtaaaagaacagaaa

SEQ ID NO: 76353 - DNA, 22 bp, Artificial Sequence
  Synthetic oligonucleotide; CTG chr11 5183369 5183390 5183386 5183391 +
tctctcagaccacagtgcaatc

SEQ ID NO: 76354 - DNA, 22 bp, Artificial Sequence
  Synthetic oligonucleotide; CTC chr11 5183373 5183394 5183390 5183395 +
tcagaccacagtgcaatcaaac

SEQ ID NO: 76355 - DNA, 22 bp, Artificial Sequence
  Synthetic oligonucleotide; CTC chr11 5183375 5183396 5183392 5183397 +
agaccacagtgcaatcaaacta

SEQ ID NO: 76356 - DNA, 22 bp, Artificial Sequence
  Synthetic oligonucleotide; CTA chr11 5183397 5183418 5183414 5183419 +
gaactcaggattaagaaactca

SEQ ID NO: 76357 - DNA, 22 bp, Artificial Sequence
  Synthetic oligonucleotide; CTC chr11 5183403 5183424 5183420 5183425 +
aggattaagaaactcactcaaa

SEQ ID NO: 76358 - DNA, 22 bp, Artificial Sequence
  Synthetic oligonucleotide; TTA chr11 5183410 5183431 5183427 5183432 +
agaaactcactcaaaaccactc

SEQ ID NO: 76359 - DNA, 22 bp, Artificial Sequence
  Synthetic oligonucleotide; CTC chr11 5183418 5183439 5183435 5183440 +
actcaaaaccactcaactacat

SEQ ID NO: 76360 - DNA, 22 bp, Artificial Sequence
  Synthetic oligonucleotide; CTC chr11 5183422 5183443 5183439 5183444 +
aaaaccactcaactacatggaa

SEQ ID NO: 76361 - DNA, 22 bp, Artificial Sequence
  Synthetic oligonucleotide; CTC chr11 5183432 5183453 5183449 5183454 +
aactacatggaaactgaacagc

SEQ ID NO: 76362 - DNA, 22 bp, Artificial Sequence
  Synthetic oligonucleotide; CTA chr11 5183437 5183458 5183454 5183459 +
catggaaactgaacagcctgct

SEQ ID NO: 76363 - DNA, 22 bp, Artificial Sequence
  Synthetic oligonucleotide; CTG chr11 5183448 5183469 5183465 5183470 +
aacagcctgctcctgaatgact

SEQ ID NO: 76364 - DNA, 22 bp, Artificial Sequence
  Synthetic oligonucleotide; CTG chr11 5183457 5183478 5183474 5183479 +
ctcctgaatgactactgggtac

SEQ ID NO: 76365 - DNA, 22 bp, Artificial Sequence
  Synthetic oligonucleotide; CTC chr11 5183460 5183481 5183477 5183482 +
ctgaatgactactgggtacata

SEQ ID NO: 76366 - DNA, 22 bp, Artificial Sequence
  Synthetic oligonucleotide; CTG chr11 5183463 5183484 5183480 5183485 +
aatgactactgggtacataaca

SEQ ID NO: 76367 - DNA, 22 bp, Artificial Sequence
  Synthetic oligonucleotide; CTA chr11 5183471 5183492 5183488 5183493 +
ctgggtacataacaaaatgaag

SEQ ID NO: 76368 - DNA, 22 bp, Artificial Sequence
  Synthetic oligonucleotide; CTG chr11 5183474 5183495 5183491 5183496 +
ggtacataacaaaatgaaggca

SEQ ID NO: 76369 - DNA, 22 bp, Artificial Sequence
  Synthetic oligonucleotide; TTC chr11 5183511 5183532 5183528 5183533 +
tttgaaaccaacgagaataaag

SEQ ID NO: 76370 - DNA, 22 bp, Artificial Sequence
  Synthetic oligonucleotide; CTT chr11 5183513 5183534 5183530 5183535 +
tgaaaccaacgagaataaagat

SEQ ID NO: 76371 - DNA, 22 bp, Artificial Sequence
  Synthetic oligonucleotide; TTT chr11 5183514 5183535 5183531 5183536 +
gaaaccaacgagaataaagata

SEQ ID NO: 76372 - DNA, 22 bp, Artificial Sequence
  Synthetic oligonucleotide; TTG chr11 5183515 5183536 5183532 5183537 +
aaaccaacgagaataaagatac

SEQ ID NO: 76373 - DNA, 22 bp, Artificial Sequence
  Synthetic oligonucleotide; CTC chr11 5183553 5183574 5183570 5183575 +
tgggacacatttaaagcagtgt

SEQ ID NO: 76374 - DNA, 22 bp, Artificial Sequence
  Synthetic oligonucleotide; CTG chr11 5183555 5183576 5183572 5183577 +
ggacacatttaaagcagtgtgt

SEQ ID NO: 76375 - DNA, 22 bp, Artificial Sequence
  Synthetic oligonucleotide; TTT chr11 5183565 5183586 5183582 5183587 +
aaagcagtgtgtagagggaaat

SEQ ID NO: 76376 - DNA, 22 bp, Artificial Sequence
  Synthetic oligonucleotide; TTA chr11 5183566 5183587 5183583 5183588 +
aagcagtgtgtagagggaaatt

SEQ ID NO: 76377 - DNA, 22 bp, Artificial Sequence
  Synthetic oligonucleotide; TTT chr11 5183589 5183610 5183606 5183611 +
atagcactaaatgcccacaaaa

SEQ ID NO: 76378 - DNA, 22 bp, Artificial Sequence
  Synthetic oligonucleotide; TTA chr11 5183590 5183611 5183607 5183612 +
tagcactaaatgcccacaaaag

SEQ ID NO: 76379 - DNA, 22 bp, Artificial Sequence
  Synthetic oligonucleotide; CTA chr11 5183598 5183619 5183615 5183620 +
aatgcccacaaaagaaagcagg

SEQ ID NO: 76380 - DNA, 22 bp, Artificial Sequence
  Synthetic oligonucleotide; CTA chr11 5183629 5183650 5183646 5183651 +
aaattgacaccctaacatcaca

SEQ ID NO: 76381 - DNA, 22 bp, Artificial Sequence
  Synthetic oligonucleotide; TTG chr11 5183635 5183656 5183652 5183657 +
acaccctaacatcacaattaaa

SEQ ID NO: 76382 - DNA, 22 bp, Artificial Sequence
  Synthetic oligonucleotide; CTA chr11 5183643 5183664 5183660 5183665 +
acatcacaattaaaagaactag

SEQ ID NO: 76383 - DNA, 22 bp, Artificial Sequence
  Synthetic oligonucleotide; TTA chr11 5183655 5183676 5183672 5183677 +
aaagaactagagaagcaagagc

SEQ ID NO: 76384 - DNA, 22 bp, Artificial Sequence
  Synthetic oligonucleotide; CTA chr11 5183664 5183685 5183681 5183686 +
gagaagcaagagcaaacacttt

SEQ ID NO: 76385 - DNA, 22 bp, Artificial Sequence
  Synthetic oligonucleotide; CTT chr11 5183685 5183706 5183702 5183707 +
tcaaaagctagcggaaggcaag

SEQ ID NO: 76386 - DNA, 22 bp, Artificial Sequence
  Synthetic oligonucleotide; TTT chr11 5183686 5183707 5183703 5183708 +
caaaagctagcggaaggcaaga

SEQ ID NO: 76387 - DNA, 22 bp, Artificial Sequence
  Synthetic oligonucleotide; TTC chr11 5183687 5183708 5183704 5183709 +
aaaagctagcggaaggcaagaa

SEQ ID NO: 76388 - DNA, 22 bp, Artificial Sequence
  Synthetic oligonucleotide; CTA chr11 5183695 5183716 5183712 5183717 +
gcggaaggcaagaaataagtaa

SEQ ID NO: 76389 - DNA, 22 bp, Artificial Sequence
  Synthetic oligonucleotide; TTG chr11 5183743 5183764 5183760 5183765 +
agacacaaaaaacccttaaaaa

SEQ ID NO: 76390 - DNA, 22 bp, Artificial Sequence
  Synthetic oligonucleotide; CTT chr11 5183760 5183781 5183777 5183782 +
aaaaaaatcaatgaatccagga

SEQ ID NO: 76391 - DNA, 22 bp, Artificial Sequence
  Synthetic oligonucleotide; TTA chr11 5183761 5183782 5183778 5183783 +
aaaaaatcaatgaatccaggag

SEQ ID NO: 76392 - DNA, 22 bp, Artificial Sequence
  Synthetic oligonucleotide; CTG chr11 5183786 5183807 5183803 5183808 +
gttttttgaaaagatcaacaaa

SEQ ID NO: 76393 - DNA, 22 bp, Artificial Sequence
  Synthetic oligonucleotide; TTT chr11 5183790 5183811 5183807 5183812 +
tttgaaaagatcaacaaaattg

SEQ ID NO: 76394 - DNA, 22 bp, Artificial Sequence
  Synthetic oligonucleotide; TTT chr11 5183791 5183812 5183808 5183813 +
ttgaaaagatcaacaaaattga

SEQ ID NO: 76395 - DNA, 22 bp, Artificial Sequence
  Synthetic oligonucleotide; TTT chr11 5183792 5183813 5183809 5183814 +
tgaaaagatcaacaaaattgat

SEQ ID NO: 76396 - DNA, 22 bp, Artificial Sequence
  Synthetic oligonucleotide; TTT chr11 5183793 5183814 5183810 5183815 +
gaaaagatcaacaaaattgata

SEQ ID NO: 76397 - DNA, 22 bp, Artificial Sequence
  Synthetic oligonucleotide; TTG chr11 5183794 5183815 5183811 5183816 +
aaaagatcaacaaaattgatag

SEQ ID NO: 76398 - DNA, 22 bp, Artificial Sequence
  Synthetic oligonucleotide; TTG chr11 5183812 5183833 5183829 5183834 +
atagactgctagcaagactaat

SEQ ID NO: 76399 - DNA, 22 bp, Artificial Sequence
  Synthetic oligonucleotide; CTG chr11 5183820 5183841 5183837 5183842 +
ctagcaagactaataaagaaga

SEQ ID NO: 76400 - DNA, 22 bp, Artificial Sequence
  Synthetic oligonucleotide; CTA chr11 5183823 5183844 5183840 5183845 +
gcaagactaataaagaagaaaa

SEQ ID NO: 76401 - DNA, 22 bp, Artificial Sequence
  Synthetic oligonucleotide; CTA chr11 5183832 5183853 5183849 5183854 +
ataaagaagaaaagagagaaga

SEQ ID NO: 76402 - DNA, 22 bp, Artificial Sequence
  Synthetic oligonucleotide; CTC chr11 5183857 5183878 5183874 5183879 +
aaatagatgcaataagaaatga

SEQ ID NO: 76403 - DNA, 22 bp, Artificial Sequence
  Synthetic oligonucleotide; CTA chr11 5183920 5183941 5183937 5183942 +
ccatcagagaatactataaaca

SEQ ID NO: 76404 - DNA, 22 bp, Artificial Sequence
  Synthetic oligonucleotide; CTA chr11 5183936 5183957 5183953 5183958 +
taaacacctctacgcaaataaa

SEQ ID NO: 76405 - DNA, 22 bp, Artificial Sequence
  Synthetic oligonucleotide; CTC chr11 5183946 5183967 5183963 5183968 +
tacgcaaataaactagaaaatc

SEQ ID NO: 76406 - DNA, 22 bp, Artificial Sequence
  Synthetic oligonucleotide; CTA chr11 5183948 5183969 5183965 5183970 +
cgcaaataaactagaaaatcta

SEQ ID NO: 76407 - DNA, 22 bp, Artificial Sequence
  Synthetic oligonucleotide; CTA chr11 5183961 5183982 5183978 5183983 +
gaaaatctagtagaaatggata

SEQ ID NO: 76408 - DNA, 22 bp, Artificial Sequence
  Synthetic oligonucleotide; CTA chr11 5183970 5183991 5183987 5183992 +
gtagaaatggataaattcctcg

SEQ ID NO: 76409 - DNA, 22 bp, Artificial Sequence
  Synthetic oligonucleotide; TTC chr11 5183988 5184009 5184005 5184010 +
ctcgacacatacaccctcccaa

SEQ ID NO: 76410 - DNA, 22 bp, Artificial Sequence
  Synthetic oligonucleotide; CTC chr11 5183991 5184012 5184008 5184013 +
gacacatacaccctcccaagac

SEQ ID NO: 76411 - DNA, 22 bp, Artificial Sequence
  Synthetic oligonucleotide; CTC chr11 5184006 5184027 5184023 5184028 +
ccaagactaaaccagggagaaa

SEQ ID NO: 76412 - DNA, 22 bp, Artificial Sequence
  Synthetic oligonucleotide; CTA chr11 5184015 5184036 5184032 5184037 +
aaccagggagaaattgaatctc

SEQ ID NO: 76413 - DNA, 22 bp, Artificial Sequence
  Synthetic oligonucleotide; TTG chr11 5184031 5184052 5184048 5184053 +
aatctcttaatagacaaataat

SEQ ID NO: 76414 - DNA, 22 bp, Artificial Sequence
  Synthetic oligonucleotide; CTC chr11 5184037 5184058 5184054 5184059 +
ttaatagacaaataataggctc

SEQ ID NO: 76415 - DNA, 22 bp, Artificial Sequence
  Synthetic oligonucleotide; CTT chr11 5184039 5184060 5184056 5184061 +
aatagacaaataataggctctg

SEQ ID NO: 76416 - DNA, 22 bp, Artificial Sequence
  Synthetic oligonucleotide; TTA chr11 5184040 5184061 5184057 5184062 +
atagacaaataataggctctga

SEQ ID NO: 76417 - DNA, 22 bp, Artificial Sequence
  Synthetic oligonucleotide; CTC chr11 5184059 5184080 5184076 5184081 +
tgaaattgagacaataattaat

SEQ ID NO: 76418 - DNA, 22 bp, Artificial Sequence
  Synthetic oligonucleotide; CTG chr11 5184061 5184082 5184078 5184083 +
aaattgagacaataattaatag

SEQ ID NO: 76419 - DNA, 22 bp, Artificial Sequence
  Synthetic oligonucleotide; TTG chr11 5184067 5184088 5184084 5184089 +
agacaataattaatagtttaca

SEQ ID NO: 76420 - DNA, 22 bp, Artificial Sequence
  Synthetic oligonucleotide; TTA chr11 5184079 5184100 5184096 5184101 +
atagtttacacattgtatatct

SEQ ID NO: 76421 - DNA, 22 bp, Artificial Sequence
  Synthetic oligonucleotide; TTT chr11 5184086 5184107 5184103 5184108 +
acacattgtatatctaagtacc

SEQ ID NO: 76422 - DNA, 22 bp, Artificial Sequence
  Synthetic oligonucleotide; TTA chr11 5184087 5184108 5184104 5184109 +
cacattgtatatctaagtacca

SEQ ID NO: 76423 - DNA, 22 bp, Artificial Sequence
  Synthetic oligonucleotide; TTG chr11 5184094 5184115 5184111 5184116 +
tatatctaagtaccaccacagc

SEQ ID NO: 76424 - DNA, 22 bp, Artificial Sequence
  Synthetic oligonucleotide; CTA chr11 5184102 5184123 5184119 5184124 +
agtaccaccacagcagcaagta

SEQ ID NO: 76425 - DNA, 22 bp, Artificial Sequence
  Synthetic oligonucleotide; TTT chr11 5184128 5184149 5184145 5184150 +
aatgttttcacattataaaaca

SEQ ID NO: 76426 - DNA, 22 bp, Artificial Sequence
  Synthetic oligonucleotide; TTA chr11 5184129 5184150 5184146 5184151 +
atgttttcacattataaaacag

SEQ ID NO: 76427 - DNA, 22 bp, Artificial Sequence
  Synthetic oligonucleotide; TTT chr11 5184135 5184156 5184152 5184157 +
tcacattataaaacaggagtct

SEQ ID NO: 76428 - DNA, 22 bp, Artificial Sequence
  Synthetic oligonucleotide; TTT chr11 5184136 5184157 5184153 5184158 +
cacattataaaacaggagtcta

SEQ ID NO: 76429 - DNA, 22 bp, Artificial Sequence
  Synthetic oligonucleotide; TTC chr11 5184137 5184158 5184154 5184159 +
acattataaaacaggagtctat

SEQ ID NO: 76430 - DNA, 22 bp, Artificial Sequence
  Synthetic oligonucleotide; TTA chr11 5184143 5184164 5184160 5184165 +
taaaacaggagtctatattact

SEQ ID NO: 76431 - DNA, 22 bp, Artificial Sequence
  Synthetic oligonucleotide; CTA chr11 5184158 5184179 5184175 5184180 +
tattacttcaatatattacttg

SEQ ID NO: 76432 - DNA, 22 bp, Artificial Sequence
  Synthetic oligonucleotide; TTA chr11 5184163 5184184 5184180 5184185 +
cttcaatatattacttgttatt

SEQ ID NO: 76433 - DNA, 22 bp, Artificial Sequence
  Synthetic oligonucleotide; CTT chr11 5184166 5184187 5184183 5184188 +
caatatattacttgttattact

SEQ ID NO: 76434 - DNA, 22 bp, Artificial Sequence
  Synthetic oligonucleotide; TTC chr11 5184167 5184188 5184184 5184189 +
aatatattacttgttattacta

SEQ ID NO: 76435 - DNA, 22 bp, Artificial Sequence
  Synthetic oligonucleotide; TTA chr11 5184176 5184197 5184193 5184198 +
cttgttattactaattactagt

SEQ ID NO: 76436 - DNA, 22 bp, Artificial Sequence
  Synthetic oligonucleotide; CTT chr11 5184179 5184200 5184196 5184201 +
gttattactaattactagttct

SEQ ID NO: 76437 - DNA, 22 bp, Artificial Sequence
  Synthetic oligonucleotide; TTG chr11 5184180 5184201 5184197 5184202 +
ttattactaattactagttcta

SEQ ID NO: 76438 - DNA, 22 bp, Artificial Sequence
  Synthetic oligonucleotide; TTA chr11 5184183 5184204 5184200 5184205 +
ttactaattactagttctaaaa

SEQ ID NO: 76439 - DNA, 22 bp, Artificial Sequence
  Synthetic oligonucleotide; TTA chr11 5184186 5184207 5184203 5184208 +
ctaattactagttctaaaaaat

SEQ ID NO: 76440 - DNA, 22 bp, Artificial Sequence
  Synthetic oligonucleotide; CTA chr11 5184189 5184210 5184206 5184211 +
attactagttctaaaaaatgtg

SEQ ID NO: 76441 - DNA, 22 bp, Artificial Sequence
  Synthetic oligonucleotide; TTA chr11 5184193 5184214 5184210 5184215 +
ctagttctaaaaaatgtggata

SEQ ID NO: 76442 - DNA, 22 bp, Artificial Sequence
  Synthetic oligonucleotide; CTA chr11 5184196 5184217 5184213 5184218 +
gttctaaaaaatgtggatagaa

SEQ ID NO: 76443 - DNA, 22 bp, Artificial Sequence
  Synthetic oligonucleotide; TTC chr11 5184200 5184221 5184217 5184222 +
taaaaaatgtggatagaagcaa

SEQ ID NO: 76444 - DNA, 22 bp, Artificial Sequence
  Synthetic oligonucleotide; CTA chr11 5184202 5184223 5184219 5184224 +
aaaaatgtggatagaagcaagt

SEQ ID NO: 76445 - DNA, 22 bp, Artificial Sequence
  Synthetic oligonucleotide; TTT chr11 5184226 5184247 5184243 5184248 +
aatattgagtggaaaataagat

SEQ ID NO: 76446 - DNA, 22 bp, Artificial Sequence
  Synthetic oligonucleotide; TTA chr11 5184227 5184248 5184244 5184249 +
atattgagtggaaaataagatt

SEQ ID NO: 76447 - DNA, 22 bp, Artificial Sequence
  Synthetic oligonucleotide; TTG chr11 5184233 5184254 5184250 5184255 +
agtggaaaataagattaggaga

SEQ ID NO: 76448 - DNA, 22 bp, Artificial Sequence
  Synthetic oligonucleotide; TTA chr11 5184250 5184271 5184267 5184272 +
ggagatgcaacaccagggtagg

SEQ ID NO: 76449 - DNA, 22 bp, Artificial Sequence
  Synthetic oligonucleotide; TTA chr11 5184294 5184315 5184311 5184316 +
gataggtagatagctagctagc

SEQ ID NO: 76450 - DNA, 22 bp, Artificial Sequence
  Synthetic oligonucleotide; CTA chr11 5184310 5184331 5184327 5184332 +
gctagctagctagctagctagc

SEQ ID NO: 76451 - DNA, 22 bp, Artificial Sequence
  Synthetic oligonucleotide; CTA chr11 5184314 5184335 5184331 5184336 +
gctagctagctagctagctaga

SEQ ID NO: 76452 - DNA, 22 bp, Artificial Sequence
  Synthetic oligonucleotide; CTA chr11 5184318 5184339 5184335 5184340 +
gctagctagctagctagaaaga

SEQ ID NO: 76453 - DNA, 22 bp, Artificial Sequence
  Synthetic oligonucleotide; CTA chr11 5184322 5184343 5184339 5184344 +
gctagctagctagaaagataga

SEQ ID NO: 76454 - DNA, 22 bp, Artificial Sequence
  Synthetic oligonucleotide; CTA chr11 5184326 5184347 5184343 5184348 +
gctagctagaaagatagataga

SEQ ID NO: 76455 - DNA, 22 bp, Artificial Sequence
  Synthetic oligonucleotide; CTA chr11 5184330 5184351 5184347 5184352 +
gctagaaagatagatagataga

SEQ ID NO: 76456 - DNA, 22 bp, Artificial Sequence
  Synthetic oligonucleotide; CTA chr11 5184334 5184355 5184351 5184356 +
gaaagatagatagatagataga

SEQ ID NO: 76457 - DNA, 22 bp, Artificial Sequence
  Synthetic oligonucleotide; CTT chr11 5184435 5184456 5184452 5184457 +
ctatactctctaagttcccttt

SEQ ID NO: 76458 - DNA, 22 bp, Artificial Sequence
  Synthetic oligonucleotide; TTC chr11 5184436 5184457 5184453 5184458 +
tatactctctaagttccctttc

SEQ ID NO: 76459 - DNA, 22 bp, Artificial Sequence
  Synthetic oligonucleotide; CTA chr11 5184438 5184459 5184455 5184460 +
tactctctaagttccctttctc

SEQ ID NO: 76460 - DNA, 22 bp, Artificial Sequence
  Synthetic oligonucleotide; CTC chr11 5184443 5184464 5184460 5184465 +
tctaagttccctttctcaagta

SEQ ID NO: 76461 - DNA, 22 bp, Artificial Sequence
  Synthetic oligonucleotide; CTC chr11 5184445 5184466 5184462 5184467 +
taagttccctttctcaagtaaa

SEQ ID NO: 76462 - DNA, 22 bp, Artificial Sequence
  Synthetic oligonucleotide; CTA chr11 5184447 5184468 5184464 5184469 +
agttccctttctcaagtaaaag

SEQ ID NO: 76463 - DNA, 22 bp, Artificial Sequence
  Synthetic oligonucleotide; TTC chr11 5184452 5184473 5184469 5184474 +
cctttctcaagtaaaagctggc

SEQ ID NO: 76464 - DNA, 22 bp, Artificial Sequence
  Synthetic oligonucleotide; CTT chr11 5184456 5184477 5184473 5184478 +
tctcaagtaaaagctggctaaa

SEQ ID NO: 76465 - DNA, 22 bp, Artificial Sequence
  Synthetic oligonucleotide; TTT chr11 5184457 5184478 5184474 5184479 +
ctcaagtaaaagctggctaaag

SEQ ID NO: 76466 - DNA, 22 bp, Artificial Sequence
  Synthetic oligonucleotide; TTC chr11 5184458 5184479 5184475 5184480 +
tcaagtaaaagctggctaaagt

SEQ ID NO: 76467 - DNA, 22 bp, Artificial Sequence
  Synthetic oligonucleotide; CTC chr11 5184460 5184481 5184477 5184482 +
aagtaaaagctggctaaagttc

SEQ ID NO: 76468 - DNA, 22 bp, Artificial Sequence
  Synthetic oligonucleotide; CTG chr11 5184472 5184493 5184489 5184494 +
gctaaagttcttgttttttgag

SEQ ID NO: 76469 - DNA, 22 bp, Artificial Sequence
  Synthetic oligonucleotide; CTA chr11 5184476 5184497 5184493 5184498 +
aagttcttgttttttgaggtgg

SEQ ID NO: 76470 - DNA, 22 bp, Artificial Sequence
  Synthetic oligonucleotide; TTC chr11 5184482 5184503 5184499 5184504 +
ttgttttttgaggtggcacagg

SEQ ID NO: 76471 - DNA, 22 bp, Artificial Sequence
  Synthetic oligonucleotide; CTT chr11 5184484 5184505 5184501 5184506 +
gttttttgaggtggcacagggg

SEQ ID NO: 76472 - DNA, 22 bp, Artificial Sequence
  Synthetic oligonucleotide; TTG chr11 5184485 5184506 5184502 5184507 +
ttttttgaggtggcacaggggc

SEQ ID NO: 76473 - DNA, 22 bp, Artificial Sequence
  Synthetic oligonucleotide; TTT chr11 5184488 5184509 5184505 5184510 +
tttgaggtggcacaggggctta

SEQ ID NO: 76474 - DNA, 22 bp, Artificial Sequence
  Synthetic oligonucleotide; TTT chr11 5184489 5184510 5184506 5184511 +
ttgaggtggcacaggggcttaa

SEQ ID NO: 76475 - DNA, 22 bp, Artificial Sequence
  Synthetic oligonucleotide; TTT chr11 5184490 5184511 5184507 5184512 +
tgaggtggcacaggggcttaag

SEQ ID NO: 76476 - DNA, 22 bp, Artificial Sequence
  Synthetic oligonucleotide; TTT chr11 5184491 5184512 5184508 5184513 +
gaggtggcacaggggcttaaga

SEQ ID NO: 76477 - DNA, 22 bp, Artificial Sequence
  Synthetic oligonucleotide; TTG chr11 5184492 5184513 5184509 5184514 +
aggtggcacaggggcttaagaa

SEQ ID NO: 76478 - DNA, 22 bp, Artificial Sequence
  Synthetic oligonucleotide; CTT chr11 5184509 5184530 5184526 5184531 +
aagaaatgactgctcccccatc

SEQ ID NO: 76479 - DNA, 22 bp, Artificial Sequence
  Synthetic oligonucleotide; TTA chr11 5184510 5184531 5184527 5184532 +
agaaatgactgctcccccatct

SEQ ID NO: 76480 - DNA, 22 bp, Artificial Sequence
  Synthetic oligonucleotide; CTG chr11 5184521 5184542 5184538 5184543 +
ctcccccatctcttgattccat

SEQ ID NO: 76481 - DNA, 22 bp, Artificial Sequence
  Synthetic oligonucleotide; CTC chr11 5184524 5184545 5184541 5184546 +
ccccatctcttgattccattac

SEQ ID NO: 76482 - DNA, 22 bp, Artificial Sequence
  Synthetic oligonucleotide; CTC chr11 5184533 5184554 5184550 5184555 +
ttgattccattacagttcaata

SEQ ID NO: 76483 - DNA, 22 bp, Artificial Sequence
  Synthetic oligonucleotide; CTT chr11 5184535 5184556 5184552 5184557 +
gattccattacagttcaatata

SEQ ID NO: 76484 - DNA, 22 bp, Artificial Sequence
  Synthetic oligonucleotide; TTG chr11 5184536 5184557 5184553 5184558 +
attccattacagttcaatatac

SEQ ID NO: 76485 - DNA, 22 bp, Artificial Sequence
  Synthetic oligonucleotide; TTC chr11 5184540 5184561 5184557 5184562 +
cattacagttcaatatactgat

SEQ ID NO: 76486 - DNA, 22 bp, Artificial Sequence
  Synthetic oligonucleotide; TTA chr11 5184545 5184566 5184562 5184567 +
cagttcaatatactgatcattg

SEQ ID NO: 76487 - DNA, 22 bp, Artificial Sequence
  Synthetic oligonucleotide; TTC chr11 5184551 5184572 5184568 5184573 +
aatatactgatcattgtatagc

SEQ ID NO: 76488 - DNA, 22 bp, Artificial Sequence
  Synthetic oligonucleotide; CTG chr11 5184560 5184581 5184577 5184582 +
atcattgtatagcatagtctgc

SEQ ID NO: 76489 - DNA, 22 bp, Artificial Sequence
  Synthetic oligonucleotide; TTG chr11 5184567 5184588 5184584 5184589 +
tatagcatagtctgctaccttt

SEQ ID NO: 76490 - DNA, 22 bp, Artificial Sequence
  Synthetic oligonucleotide; CTG chr11 5184581 5184602 5184598 5184603 +
ctacctttacttttgtttttgc

SEQ ID NO: 76491 - DNA, 22 bp, Artificial Sequence
  Synthetic oligonucleotide; CTA chr11 5184584 5184605 5184601 5184606 +
cctttacttttgtttttgctaa

SEQ ID NO: 76492 - DNA, 22 bp, Artificial Sequence
  Synthetic oligonucleotide; CTT chr11 5184588 5184609 5184605 5184610 +
tacttttgtttttgctaagtgc

SEQ ID NO: 76493 - DNA, 22 bp, Artificial Sequence
  Synthetic oligonucleotide; TTT chr11 5184589 5184610 5184606 5184611 +
acttttgtttttgctaagtgct

SEQ ID NO: 76494 - DNA, 22 bp, Artificial Sequence
  Synthetic oligonucleotide; TTA chr11 5184590 5184611 5184607 5184612 +
cttttgtttttgctaagtgcta

SEQ ID NO: 76495 - DNA, 22 bp, Artificial Sequence
  Synthetic oligonucleotide; CTT chr11 5184593 5184614 5184610 5184615 +
ttgtttttgctaagtgctaaat

SEQ ID NO: 76496 - DNA, 22 bp, Artificial Sequence
  Synthetic oligonucleotide; TTT chr11 5184594 5184615 5184611 5184616 +
tgtttttgctaagtgctaaata

SEQ ID NO: 76497 - DNA, 22 bp, Artificial Sequence
  Synthetic oligonucleotide; TTT chr11 5184595 5184616 5184612 5184617 +
gtttttgctaagtgctaaatat

SEQ ID NO: 76498 - DNA, 22 bp, Artificial Sequence
  Synthetic oligonucleotide; TTG chr11 5184596 5184617 5184613 5184618 +
tttttgctaagtgctaaatatt

SEQ ID NO: 76499 - DNA, 22 bp, Artificial Sequence
  Synthetic oligonucleotide; TTT chr11 5184599 5184620 5184616 5184621 +
ttgctaagtgctaaatattctg

SEQ ID NO: 76500 - DNA, 22 bp, Artificial Sequence
  Synthetic oligonucleotide; TTT chr11 5184600 5184621 5184617 5184622 +
tgctaagtgctaaatattctgg

SEQ ID NO: 76501 - DNA, 22 bp, Artificial Sequence
  Synthetic oligonucleotide; TTT chr11 5184601 5184622 5184618 5184623 +
gctaagtgctaaatattctggt

SEQ ID NO: 76502 - DNA, 22 bp, Artificial Sequence
  Synthetic oligonucleotide; TTG chr11 5184602 5184623 5184619 5184624 +
ctaagtgctaaatattctggtc

SEQ ID NO: 76503 - DNA, 22 bp, Artificial Sequence
  Synthetic oligonucleotide; CTA chr11 5184605 5184626 5184622 5184627 +
agtgctaaatattctggtctca

SEQ ID NO: 76504 - DNA, 22 bp, Artificial Sequence
  Synthetic oligonucleotide; CTA chr11 5184612 5184633 5184629 5184634 +
aatattctggtctcaaatttta

SEQ ID NO: 76505 - DNA, 22 bp, Artificial Sequence
  Synthetic oligonucleotide; TTC chr11 5184619 5184640 5184636 5184641 +
tggtctcaaattttatatgatg

SEQ ID NO: 76506 - DNA, 22 bp, Artificial Sequence
  Synthetic oligonucleotide; CTG chr11 5184621 5184642 5184638 5184643 +
gtctcaaattttatatgatgga

SEQ ID NO: 76507 - DNA, 22 bp, Artificial Sequence
  Synthetic oligonucleotide; CTC chr11 5184626 5184647 5184643 5184648 +
aaattttatatgatggaaatgt

SEQ ID NO: 76508 - DNA, 22 bp, Artificial Sequence
  Synthetic oligonucleotide; TTT chr11 5184632 5184653 5184649 5184654 +
tatatgatggaaatgtttgggt

SEQ ID NO: 76509 - DNA, 22 bp, Artificial Sequence
  Synthetic oligonucleotide; TTT chr11 5184633 5184654 5184650 5184655 +
atatgatggaaatgtttgggtc

SEQ ID NO: 76510 - DNA, 22 bp, Artificial Sequence
  Synthetic oligonucleotide; TTA chr11 5184634 5184655 5184651 5184656 +
tatgatggaaatgtttgggtcc

SEQ ID NO: 76511 - DNA, 22 bp, Artificial Sequence
  Synthetic oligonucleotide; TTT chr11 5184650 5184671 5184667 5184672 +
gggtcccattttttgagttaca

SEQ ID NO: 76512 - DNA, 22 bp, Artificial Sequence
  Synthetic oligonucleotide; TTG chr11 5184651 5184672 5184668 5184673 +
ggtcccattttttgagttacag

SEQ ID NO: 76513 - DNA, 22 bp, Artificial Sequence
  Synthetic oligonucleotide; TTT chr11 5184661 5184682 5184678 5184683 +
tttgagttacagtttagaattt

SEQ ID NO: 76514 - DNA, 22 bp, Artificial Sequence
  Synthetic oligonucleotide; TTT chr11 5184662 5184683 5184679 5184684 +
ttgagttacagtttagaattta

SEQ ID NO: 76515 - DNA, 22 bp, Artificial Sequence
  Synthetic oligonucleotide; TTT chr11 5184663 5184684 5184680 5184685 +
tgagttacagtttagaatttaa

SEQ ID NO: 76516 - DNA, 22 bp, Artificial Sequence
  Synthetic oligonucleotide; TTT chr11 5184664 5184685 5184681 5184686 +
gagttacagtttagaatttaaa

SEQ ID NO: 76517 - DNA, 22 bp, Artificial Sequence
  Synthetic oligonucleotide; TTG chr11 5184665 5184686 5184682 5184687 +
agttacagtttagaatttaaaa

SEQ ID NO: 76518 - DNA, 22 bp, Artificial Sequence
  Synthetic oligonucleotide; TTA chr11 5184670 5184691 5184687 5184692 +
cagtttagaatttaaaataccc

SEQ ID NO: 76519 - DNA, 22 bp, Artificial Sequence
  Synthetic oligonucleotide; TTT chr11 5184676 5184697 5184693 5184698 +
agaatttaaaatacccacacag

SEQ ID NO: 76520 - DNA, 22 bp, Artificial Sequence
  Synthetic oligonucleotide; TTA chr11 5184677 5184698 5184694 5184699 +
gaatttaaaatacccacacagc

SEQ ID NO: 76521 - DNA, 22 bp, Artificial Sequence
  Synthetic oligonucleotide; TTT chr11 5184683 5184704 5184700 5184705 +
aaaatacccacacagctgagca

SEQ ID NO: 76522 - DNA, 22 bp, Artificial Sequence
  Synthetic oligonucleotide; TTA chr11 5184684 5184705 5184701 5184706 +
aaatacccacacagctgagcaa

SEQ ID NO: 76523 - DNA, 22 bp, Artificial Sequence
  Synthetic oligonucleotide; CTG chr11 5184701 5184722 5184718 5184723 +
agcaatttacccttgctttaag

SEQ ID NO: 76524 - DNA, 22 bp, Artificial Sequence
  Synthetic oligonucleotide; TTT chr11 5184709 5184730 5184726 5184731 +
acccttgctttaagttggaatg

SEQ ID NO: 76525 - DNA, 22 bp, Artificial Sequence
  Synthetic oligonucleotide; TTA chr11 5184710 5184731 5184727 5184732 +
cccttgctttaagttggaatga

SEQ ID NO: 76526 - DNA, 22 bp, Artificial Sequence
  Synthetic oligonucleotide; CTT chr11 5184715 5184736 5184732 5184737 +
gctttaagttggaatgaggttc

SEQ ID NO: 76527 - DNA, 22 bp, Artificial Sequence
  Synthetic oligonucleotide; TTG chr11 5184716 5184737 5184733 5184738 +
ctttaagttggaatgaggttct

SEQ ID NO: 76528 - DNA, 22 bp, Artificial Sequence
  Synthetic oligonucleotide; CTT chr11 5184719 5184740 5184736 5184741 +
taagttggaatgaggttcttta

SEQ ID NO: 76529 - DNA, 22 bp, Artificial Sequence
  Synthetic oligonucleotide; TTT chr11 5184720 5184741 5184737 5184742 +
aagttggaatgaggttctttaa

SEQ ID NO: 76530 - DNA, 22 bp, Artificial Sequence
  Synthetic oligonucleotide; TTA chr11 5184721 5184742 5184738 5184743 +
agttggaatgaggttctttaaa

SEQ ID NO: 76531 - DNA, 22 bp, Artificial Sequence
  Synthetic oligonucleotide; TTG chr11 5184726 5184747 5184743 5184748 +
gaatgaggttctttaaaaatat

SEQ ID NO: 76532 - DNA, 22 bp, Artificial Sequence
  Synthetic oligonucleotide; TTC chr11 5184737 5184758 5184754 5184759 +
tttaaaaatattaagataaaat

SEQ ID NO: 76533 - DNA, 22 bp, Artificial Sequence
  Synthetic oligonucleotide; CTT chr11 5184739 5184760 5184756 5184761 +
taaaaatattaagataaaattt

SEQ ID NO: 76534 - DNA, 22 bp, Artificial Sequence
  Synthetic oligonucleotide; TTT chr11 5184740 5184761 5184757 5184762 +
aaaaatattaagataaaatttg

SEQ ID NO: 76535 - DNA, 22 bp, Artificial Sequence
  Synthetic oligonucleotide; TTA chr11 5184741 5184762 5184758 5184763 +
aaaatattaagataaaatttga

SEQ ID NO: 76536 - DNA, 22 bp, Artificial Sequence
  Synthetic oligonucleotide; TTA chr11 5184750 5184771 5184767 5184772 +
agataaaatttgaagttattta

SEQ ID NO: 76537 - DNA, 22 bp, Artificial Sequence
  Synthetic oligonucleotide; TTT chr11 5184761 5184782 5184778 5184783 +
gaagttatttaactctgtggat

SEQ ID NO: 76538 - DNA, 22 bp, Artificial Sequence
  Synthetic oligonucleotide; TTG chr11 5184762 5184783 5184779 5184784 +
aagttatttaactctgtggatc

SEQ ID NO: 76539 - DNA, 22 bp, Artificial Sequence
  Synthetic oligonucleotide; TTA chr11 5184768 5184789 5184785 5184790 +
tttaactctgtggatctacttt

SEQ ID NO: 76540 - DNA, 22 bp, Artificial Sequence
  Synthetic oligonucleotide; TTT chr11 5184771 5184792 5184788 5184793 +
aactctgtggatctactttatt

SEQ ID NO: 76541 - DNA, 22 bp, Artificial Sequence
  Synthetic oligonucleotide; TTA chr11 5184772 5184793 5184789 5184794 +
actctgtggatctactttattt

SEQ ID NO: 76542 - DNA, 22 bp, Artificial Sequence
  Synthetic oligonucleotide; CTC chr11 5184776 5184797 5184793 5184798 +
tgtggatctactttatttacat

SEQ ID NO: 76543 - DNA, 22 bp, Artificial Sequence
  Synthetic oligonucleotide; CTG chr11 5184778 5184799 5184795 5184800 +
tggatctactttatttacataa

SEQ ID NO: 76544 - DNA, 22 bp, Artificial Sequence
  Synthetic oligonucleotide; CTA chr11 5184786 5184807 5184803 5184808 +
ctttatttacataaactaattg

SEQ ID NO: 76545 - DNA, 22 bp, Artificial Sequence
  Synthetic oligonucleotide; CTT chr11 5184789 5184810 5184806 5184811 +
tatttacataaactaattgttt

SEQ ID NO: 76546 - DNA, 22 bp, Artificial Sequence
  Synthetic oligonucleotide; TTT chr11 5184790 5184811 5184807 5184812 +
atttacataaactaattgtttt

SEQ ID NO: 76547 - DNA, 22 bp, Artificial Sequence
  Synthetic oligonucleotide; TTA chr11 5184791 5184812 5184808 5184813 +
tttacataaactaattgtttta

SEQ ID NO: 76548 - DNA, 22 bp, Artificial Sequence
  Synthetic oligonucleotide; TTT chr11 5184794 5184815 5184811 5184816 +
acataaactaattgttttacta

SEQ ID NO: 76549 - DNA, 22 bp, Artificial Sequence
  Synthetic oligonucleotide; TTA chr11 5184795 5184816 5184812 5184817 +
cataaactaattgttttactat

SEQ ID NO: 76550 - DNA, 22 bp, Artificial Sequence
  Synthetic oligonucleotide; CTA chr11 5184804 5184825 5184821 5184826 +
attgttttactatttaatatat

SEQ ID NO: 76551 - DNA, 22 bp, Artificial Sequence
  Synthetic oligonucleotide; TTG chr11 5184808 5184829 5184825 5184830 +
ttttactatttaatatatatct

SEQ ID NO: 76552 - DNA, 22 bp, Artificial Sequence
  Synthetic oligonucleotide; TTT chr11 5184811 5184832 5184828 5184833 +
tactatttaatatatatctcac

SEQ ID NO: 76553 - DNA, 22 bp, Artificial Sequence
  Synthetic oligonucleotide; TTT chr11 5184812 5184833 5184829 5184834 +
actatttaatatatatctcaca

SEQ ID NO: 76554 - DNA, 22 bp, Artificial Sequence
  Synthetic oligonucleotide; TTA chr11 5184813 5184834 5184830 5184835 +
ctatttaatatatatctcacat

SEQ ID NO: 76555 - DNA, 22 bp, Artificial Sequence
  Synthetic oligonucleotide; CTA chr11 5184816 5184837 5184833 5184838 +
tttaatatatatctcacattgt

SEQ ID NO: 76556 - DNA, 22 bp, Artificial Sequence
  Synthetic oligonucleotide; TTT chr11 5184819 5184840 5184836 5184841 +
aatatatatctcacattgttag

SEQ ID NO: 76557 - DNA, 22 bp, Artificial Sequence
  Synthetic oligonucleotide; TTA chr11 5184820 5184841 5184837 5184842 +
atatatatctcacattgttaga

SEQ ID NO: 76558 - DNA, 22 bp, Artificial Sequence
  Synthetic oligonucleotide; CTC chr11 5184831 5184852 5184848 5184853 +
acattgttagaatattttaagt

SEQ ID NO: 76559 - DNA, 22 bp, Artificial Sequence
  Synthetic oligonucleotide; TTG chr11 5184837 5184858 5184854 5184859 +
ttagaatattttaagtaaactg

SEQ ID NO: 76560 - DNA, 22 bp, Artificial Sequence
  Synthetic oligonucleotide; TTA chr11 5184840 5184861 5184857 5184862 +
gaatattttaagtaaactgttg

SEQ ID NO: 76561 - DNA, 22 bp, Artificial Sequence
  Synthetic oligonucleotide; TTT chr11 5184848 5184869 5184865 5184870 +
taagtaaactgttgatgtttca

SEQ ID NO: 76562 - DNA, 22 bp, Artificial Sequence
  Synthetic oligonucleotide; TTT chr11 5184849 5184870 5184866 5184871 +
aagtaaactgttgatgtttcag

SEQ ID NO: 76563 - DNA, 22 bp, Artificial Sequence
  Synthetic oligonucleotide; TTA chr11 5184850 5184871 5184867 5184872 +
agtaaactgttgatgtttcaga

SEQ ID NO: 76564 - DNA, 22 bp, Artificial Sequence
  Synthetic oligonucleotide; CTG chr11 5184859 5184880 5184876 5184881 +
ttgatgtttcagagaaaggaaa

SEQ ID NO: 76565 - DNA, 22 bp, Artificial Sequence
  Synthetic oligonucleotide; TTG chr11 5184862 5184883 5184879 5184884 +
atgtttcagagaaaggaaagaa

SEQ ID NO: 76566 - DNA, 22 bp, Artificial Sequence
  Synthetic oligonucleotide; TTT chr11 5184868 5184889 5184885 5184890 +
cagagaaaggaaagaataattt

SEQ ID NO: 76567 - DNA, 22 bp, Artificial Sequence
  Synthetic oligonucleotide; TTC chr11 5184869 5184890 5184886 5184891 +
agagaaaggaaagaataatttt

SEQ ID NO: 76568 - DNA, 22 bp, Artificial Sequence
  Synthetic oligonucleotide; TTT chr11 5184890 5184911 5184907 5184912 +
tgaagcattcctgacacagttc

SEQ ID NO: 76569 - DNA, 22 bp, Artificial Sequence
  Synthetic oligonucleotide; TTT chr11 5184891 5184912 5184908 5184913 +
gaagcattcctgacacagttct

SEQ ID NO: 76570 - DNA, 22 bp, Artificial Sequence
  Synthetic oligonucleotide; TTG chr11 5184892 5184913 5184909 5184914 +
aagcattcctgacacagttcta

SEQ ID NO: 76571 - DNA, 22 bp, Artificial Sequence
  Synthetic oligonucleotide; TTC chr11 5184900 5184921 5184917 5184922 +
ctgacacagttctaggccagag

SEQ ID NO: 76572 - DNA, 22 bp, Artificial Sequence
  Synthetic oligonucleotide; CTG chr11 5184903 5184924 5184920 5184925 +
acacagttctaggccagagcca

SEQ ID NO: 76573 - DNA, 22 bp, Artificial Sequence
  Synthetic oligonucleotide; TTC chr11 5184912 5184933 5184929 5184934 +
taggccagagccatgcatgtga

SEQ ID NO: 76574 - DNA, 22 bp, Artificial Sequence
  Synthetic oligonucleotide; CTA chr11 5184914 5184935 5184931 5184936 +
ggccagagccatgcatgtgagt

SEQ ID NO: 76575 - DNA, 22 bp, Artificial Sequence
  Synthetic oligonucleotide; TTA chr11 5184948 5184969 5184965 5184970 +
tagaagtgagggttacagtgac

SEQ ID NO: 76576 - DNA, 22 bp, Artificial Sequence
  Synthetic oligonucleotide; TTA chr11 5184963 5184984 5184980 5184985 +
cagtgactggggcttcatcagg

SEQ ID NO: 76577 - DNA, 22 bp, Artificial Sequence
  Synthetic oligonucleotide; CTG chr11 5184972 5184993 5184989 5184994 +
gggcttcatcaggacattaggg

SEQ ID NO: 76578 - DNA, 22 bp, Artificial Sequence
  Synthetic oligonucleotide; CTT chr11 5184978 5184999 5184995 5185000 +
catcaggacattagggatggga

SEQ ID NO: 76579 - DNA, 22 bp, Artificial Sequence
  Synthetic oligonucleotide; TTC chr11 5184979 5185000 5184996 5185001 +
atcaggacattagggatgggag

SEQ ID NO: 76580 - DNA, 22 bp, Artificial Sequence
  Synthetic oligonucleotide; TTA chr11 5184991 5185012 5185008 5185013 +
gggatgggagagaagaatctaa

SEQ ID NO: 76581 - DNA, 22 bp, Artificial Sequence
  Synthetic oligonucleotide; CTA chr11 5185012 5185033 5185029 5185034 +
agtgaaaaaaaaatacaggaat

SEQ ID NO: 76582 - DNA, 22 bp, Artificial Sequence
  Synthetic oligonucleotide; TTT chr11 5185062 5185083 5185079 5185084 +
tctggcctttaaattttttctg

SEQ ID NO: 76583 - DNA, 22 bp, Artificial Sequence
  Synthetic oligonucleotide; TTT chr11 5185063 5185084 5185080 5185085 +
ctggcctttaaattttttctgg

SEQ ID NO: 76584 - DNA, 22 bp, Artificial Sequence
  Synthetic oligonucleotide; TTC chr11 5185064 5185085 5185081 5185086 +
tggcctttaaattttttctggt

SEQ ID NO: 76585 - DNA, 22 bp, Artificial Sequence
  Synthetic oligonucleotide; CTG chr11 5185066 5185087 5185083 5185088 +
gcctttaaattttttctggtga

SEQ ID NO: 76586 - DNA, 22 bp, Artificial Sequence
  Synthetic oligonucleotide; CTT chr11 5185071 5185092 5185088 5185093 +
taaattttttctggtgatcttt

SEQ ID NO: 76587 - DNA, 22 bp, Artificial Sequence
  Synthetic oligonucleotide; TTT chr11 5185072 5185093 5185089 5185094 +
aaattttttctggtgatctttt

SEQ ID NO: 76588 - DNA, 22 bp, Artificial Sequence
  Synthetic oligonucleotide; TTA chr11 5185073 5185094 5185090 5185095 +
aattttttctggtgatcttttg

SEQ ID NO: 76589 - DNA, 22 bp, Artificial Sequence
  Synthetic oligonucleotide; TTT chr11 5185078 5185099 5185095 5185100 +
tttctggtgatcttttgtgata

SEQ ID NO: 76590 - DNA, 22 bp, Artificial Sequence
  Synthetic oligonucleotide; TTT chr11 5185079 5185100 5185096 5185101 +
ttctggtgatcttttgtgatac

SEQ ID NO: 76591 - DNA, 22 bp, Artificial Sequence
  Synthetic oligonucleotide; TTT chr11 5185080 5185101 5185097 5185102 +
tctggtgatcttttgtgatacc

SEQ ID NO: 76592 - DNA, 22 bp, Artificial Sequence
  Synthetic oligonucleotide; TTT chr11 5185081 5185102 5185098 5185103 +
ctggtgatcttttgtgatacct

SEQ ID NO: 76593 - DNA, 22 bp, Artificial Sequence
  Synthetic oligonucleotide; TTC chr11 5185082 5185103 5185099 5185104 +
tggtgatcttttgtgataccta

SEQ ID NO: 76594 - DNA, 22 bp, Artificial Sequence
  Synthetic oligonucleotide; CTG chr11 5185084 5185105 5185101 5185106 +
gtgatcttttgtgatacctatg

SEQ ID NO: 76595 - DNA, 22 bp, Artificial Sequence
  Synthetic oligonucleotide; CTT chr11 5185092 5185113 5185109 5185114 +
ttgtgatacctatggtttttaa

SEQ ID NO: 76596 - DNA, 22 bp, Artificial Sequence
  Synthetic oligonucleotide; TTT chr11 5185093 5185114 5185110 5185115 +
tgtgatacctatggtttttaaa

SEQ ID NO: 76597 - DNA, 22 bp, Artificial Sequence
  Synthetic oligonucleotide; TTT chr11 5185094 5185115 5185111 5185116 +
gtgatacctatggtttttaaat

SEQ ID NO: 76598 - DNA, 22 bp, Artificial Sequence
  Synthetic oligonucleotide; TTG chr11 5185095 5185116 5185112 5185117 +
tgatacctatggtttttaaata

SEQ ID NO: 76599 - DNA, 22 bp, Artificial Sequence
  Synthetic oligonucleotide; CTA chr11 5185104 5185125 5185121 5185126 +
tggtttttaaatatttgtttgt

SEQ ID NO: 76600 - DNA, 22 bp, Artificial Sequence
  Synthetic oligonucleotide; TTT chr11 5185110 5185131 5185127 5185132 +
ttaaatatttgtttgttttttt

SEQ ID NO: 76601 - DNA, 22 bp, Artificial Sequence
  Synthetic oligonucleotide; TTT chr11 5185111 5185132 5185128 5185133 +
taaatatttgtttgtttttttg

SEQ ID NO: 76602 - DNA, 22 bp, Artificial Sequence
  Synthetic oligonucleotide; TTT chr11 5185112 5185133 5185129 5185134 +
aaatatttgtttgtttttttgt

SEQ ID NO: 76603 - DNA, 22 bp, Artificial Sequence
  Synthetic oligonucleotide; TTA chr11 5185113 5185134 5185130 5185135 +
aatatttgtttgtttttttgtt

SEQ ID NO: 76604 - DNA, 22 bp, Artificial Sequence
  Synthetic oligonucleotide; TTT chr11 5185120 5185141 5185137 5185142 +
gtttgtttttttgtttttccta

SEQ ID NO: 76605 - DNA, 22 bp, Artificial Sequence
  Synthetic oligonucleotide; TTG chr11 5185121 5185142 5185138 5185143 +
tttgtttttttgtttttcctaa

SEQ ID NO: 76606 - DNA, 22 bp, Artificial Sequence
  Synthetic oligonucleotide; TTT chr11 5185124 5185145 5185141 5185146 +
gtttttttgtttttcctaaaac

SEQ ID NO: 76607 - DNA, 22 bp, Artificial Sequence
  Synthetic oligonucleotide; TTG chr11 5185125 5185146 5185142 5185147 +
tttttttgtttttcctaaaaca

SEQ ID NO: 76608 - DNA, 22 bp, Artificial Sequence
  Synthetic oligonucleotide; TTT chr11 5185128 5185149 5185145 5185150 +
ttttgtttttcctaaaacattg

SEQ ID NO: 76609 - DNA, 22 bp, Artificial Sequence
  Synthetic oligonucleotide; TTT chr11 5185129 5185150 5185146 5185151 +
tttgtttttcctaaaacattgt

SEQ ID NO: 76610 - DNA, 22 bp, Artificial Sequence
  Synthetic oligonucleotide; TTT chr11 5185130 5185151 5185147 5185152 +
ttgtttttcctaaaacattgtc

SEQ ID NO: 76611 - DNA, 22 bp, Artificial Sequence
  Synthetic oligonucleotide; TTT chr11 5185131 5185152 5185148 5185153 +
tgtttttcctaaaacattgtca

SEQ ID NO: 76612 - DNA, 22 bp, Artificial Sequence
  Synthetic oligonucleotide; TTT chr11 5185132 5185153 5185149 5185154 +
gtttttcctaaaacattgtcat

SEQ ID NO: 76613 - DNA, 22 bp, Artificial Sequence
  Synthetic oligonucleotide; TTG chr11 5185133 5185154 5185150 5185155 +
tttttcctaaaacattgtcata

SEQ ID NO: 76614 - DNA, 22 bp, Artificial Sequence
  Synthetic oligonucleotide; TTT chr11 5185136 5185157 5185153 5185158 +
ttcctaaaacattgtcatatgt

SEQ ID NO: 76615 - DNA, 22 bp, Artificial Sequence
  Synthetic oligonucleotide; TTT chr11 5185137 5185158 5185154 5185159 +
tcctaaaacattgtcatatgtg

SEQ ID NO: 76616 - DNA, 22 bp, Artificial Sequence
  Synthetic oligonucleotide; TTT chr11 5185138 5185159 5185155 5185160 +
cctaaaacattgtcatatgtga

SEQ ID NO: 76617 - DNA, 22 bp, Artificial Sequence
  Synthetic oligonucleotide; TTC chr11 5185139 5185160 5185156 5185161 +
ctaaaacattgtcatatgtgat

SEQ ID NO: 76618 - DNA, 22 bp, Artificial Sequence
  Synthetic oligonucleotide; CTA chr11 5185142 5185163 5185159 5185164 +
aaacattgtcatatgtgatgac

SEQ ID NO: 76619 - DNA, 22 bp, Artificial Sequence
  Synthetic oligonucleotide; TTG chr11 5185150 5185171 5185167 5185172 +
tcatatgtgatgacccaaatta

SEQ ID NO: 76620 - DNA, 22 bp, Artificial Sequence
  Synthetic oligonucleotide; TTA chr11 5185172 5185193 5185189 5185194 +
taggcctgggttccttgtagca

SEQ ID NO: 76621 - DNA, 22 bp, Artificial Sequence
  Synthetic oligonucleotide; CTG chr11 5185180 5185201 5185197 5185202 +
ggttccttgtagcattattcta

SEQ ID NO: 76622 - DNA, 22 bp, Artificial Sequence
  Synthetic oligonucleotide; TTC chr11 5185185 5185206 5185202 5185207 +
cttgtagcattattctaggata

SEQ ID NO: 76623 - DNA, 22 bp, Artificial Sequence
  Synthetic oligonucleotide; CTT chr11 5185188 5185209 5185205 5185210 +
gtagcattattctaggatattt

SEQ ID NO: 76624 - DNA, 22 bp, Artificial Sequence
  Synthetic oligonucleotide; TTG chr11 5185189 5185210 5185206 5185211 +
tagcattattctaggatatttc

SEQ ID NO: 76625 - DNA, 22 bp, Artificial Sequence
  Synthetic oligonucleotide; TTA chr11 5185197 5185218 5185214 5185219 +
ttctaggatatttctgacagca

SEQ ID NO: 76626 - DNA, 22 bp, Artificial Sequence
  Synthetic oligonucleotide; TTC chr11 5185200 5185221 5185217 5185222 +
taggatatttctgacagcatat

SEQ ID NO: 76627 - DNA, 22 bp, Artificial Sequence
  Synthetic oligonucleotide; CTA chr11 5185202 5185223 5185219 5185224 +
ggatatttctgacagcatattc

SEQ ID NO: 76628 - DNA, 22 bp, Artificial Sequence
  Synthetic oligonucleotide; TTT chr11 5185210 5185231 5185227 5185232 +
ctgacagcatattctgactgaa

SEQ ID NO: 76629 - DNA, 22 bp, Artificial Sequence
  Synthetic oligonucleotide; TTC chr11 5185211 5185232 5185228 5185233 +
tgacagcatattctgactgaat

SEQ ID NO: 76630 - DNA, 22 bp, Artificial Sequence
  Synthetic oligonucleotide; CTG chr11 5185213 5185234 5185230 5185235 +
acagcatattctgactgaatca

SEQ ID NO: 76631 - DNA, 22 bp, Artificial Sequence
  Synthetic oligonucleotide; TTC chr11 5185224 5185245 5185241 5185246 +
tgactgaatcatgaatgtatcc

SEQ ID NO: 76632 - DNA, 22 bp, Artificial Sequence
  Synthetic oligonucleotide; CTG chr11 5185226 5185247 5185243 5185248 +
actgaatcatgaatgtatccac

SEQ ID NO: 76633 - DNA, 22 bp, Artificial Sequence
  Synthetic oligonucleotide; CTG chr11 5185230 5185251 5185247 5185252 +
aatcatgaatgtatccacggag

SEQ ID NO: 76634 - DNA, 22 bp, Artificial Sequence
  Synthetic oligonucleotide; CTC chr11 5185288 5185309 5185305 5185310 +
taaggacatatatagttgtatt

SEQ ID NO: 76635 - DNA, 22 bp, Artificial Sequence
  Synthetic oligonucleotide; CTA chr11 5185290 5185311 5185307 5185312 +
aggacatatatagttgtattta

SEQ ID NO: 76636 - DNA, 22 bp, Artificial Sequence
  Synthetic oligonucleotide; TTG chr11 5185306 5185327 5185323 5185328 +
tatttaaatactggctaaatct

SEQ ID NO: 76637 - DNA, 22 bp, Artificial Sequence
  Synthetic oligonucleotide; TTT chr11 5185311 5185332 5185328 5185333 +
aaatactggctaaatcttattc

SEQ ID NO: 76638 - DNA, 22 bp, Artificial Sequence
  Synthetic oligonucleotide; TTA chr11 5185312 5185333 5185329 5185334 +
aatactggctaaatcttattct

SEQ ID NO: 76639 - DNA, 22 bp, Artificial Sequence
  Synthetic oligonucleotide; CTG chr11 5185319 5185340 5185336 5185341 +
gctaaatcttattctgactcta

SEQ ID NO: 76640 - DNA, 22 bp, Artificial Sequence
  Synthetic oligonucleotide; CTA chr11 5185323 5185344 5185340 5185345 +
aatcttattctgactctatgac

SEQ ID NO: 76641 - DNA, 22 bp, Artificial Sequence
  Synthetic oligonucleotide; CTT chr11 5185329 5185350 5185346 5185351 +
attctgactctatgaccctgga

SEQ ID NO: 76642 - DNA, 22 bp, Artificial Sequence
  Synthetic oligonucleotide; TTA chr11 5185330 5185351 5185347 5185352 +
ttctgactctatgaccctggac

SEQ ID NO: 76643 - DNA, 22 bp, Artificial Sequence
  Synthetic oligonucleotide; TTC chr11 5185333 5185354 5185350 5185355 +
tgactctatgaccctggacacg

SEQ ID NO: 76644 - DNA, 22 bp, Artificial Sequence
  Synthetic oligonucleotide; CTG chr11 5185335 5185356 5185352 5185357 +
actctatgaccctggacacgtc

SEQ ID NO: 76645 - DNA, 22 bp, Artificial Sequence
  Synthetic oligonucleotide; CTC chr11 5185339 5185360 5185356 5185361 +
tatgaccctggacacgtcattt

SEQ ID NO: 76646 - DNA, 22 bp, Artificial Sequence
  Synthetic oligonucleotide; CTA chr11 5185341 5185362 5185358 5185363 +
tgaccctggacacgtcatttaa

SEQ ID NO: 76647 - DNA, 22 bp, Artificial Sequence
  Synthetic oligonucleotide; CTG chr11 5185349 5185370 5185366 5185371 +
gacacgtcatttaatttaaact

SEQ ID NO: 76648 - DNA, 22 bp, Artificial Sequence
  Synthetic oligonucleotide; TTT chr11 5185361 5185382 5185378 5185383 +
aatttaaactttagttctcttg

SEQ ID NO: 76649 - DNA, 22 bp, Artificial Sequence
  Synthetic oligonucleotide; TTA chr11 5185362 5185383 5185379 5185384 +
atttaaactttagttctcttgc

SEQ ID NO: 76650 - DNA, 22 bp, Artificial Sequence
  Synthetic oligonucleotide; TTT chr11 5185366 5185387 5185383 5185388 +
aaactttagttctcttgcttgt

SEQ ID NO: 76651 - DNA, 22 bp, Artificial Sequence
  Synthetic oligonucleotide; TTA chr11 5185367 5185388 5185384 5185389 +
aactttagttctcttgcttgta

SEQ ID NO: 76652 - DNA, 22 bp, Artificial Sequence
  Synthetic oligonucleotide; CTT chr11 5185372 5185393 5185389 5185394 +
tagttctcttgcttgtaaaata

SEQ ID NO: 76653 - DNA, 22 bp, Artificial Sequence
  Synthetic oligonucleotide; TTT chr11 5185373 5185394 5185390 5185395 +
agttctcttgcttgtaaaatac

SEQ ID NO: 76654 - DNA, 22 bp, Artificial Sequence
  Synthetic oligonucleotide; TTA chr11 5185374 5185395 5185391 5185396 +
gttctcttgcttgtaaaatacc

SEQ ID NO: 76655 - DNA, 22 bp, Artificial Sequence
  Synthetic oligonucleotide; TTC chr11 5185378 5185399 5185395 5185400 +
tcttgcttgtaaaatacctaac

SEQ ID NO: 76656 - DNA, 22 bp, Artificial Sequence
  Synthetic oligonucleotide; CTC chr11 5185380 5185401 5185397 5185402 +
ttgcttgtaaaatacctaacaa

SEQ ID NO: 76657 - DNA, 22 bp, Artificial Sequence
  Synthetic oligonucleotide; CTT chr11 5185382 5185403 5185399 5185404 +
gcttgtaaaatacctaacaata

SEQ ID NO: 76658 - DNA, 22 bp, Artificial Sequence
  Synthetic oligonucleotide; TTG chr11 5185383 5185404 5185400 5185405 +
cttgtaaaatacctaacaataa

SEQ ID NO: 76659 - DNA, 22 bp, Artificial Sequence
  Synthetic oligonucleotide; CTT chr11 5185386 5185407 5185403 5185408 +
gtaaaatacctaacaataagca

SEQ ID NO: 76660 - DNA, 22 bp, Artificial Sequence
  Synthetic oligonucleotide; TTG chr11 5185387 5185408 5185404 5185409 +
taaaatacctaacaataagcat

SEQ ID NO: 76661 - DNA, 22 bp, Artificial Sequence
  Synthetic oligonucleotide; CTA chr11 5185398 5185419 5185415 5185420 +
acaataagcataaatttaaaat

SEQ ID NO: 76662 - DNA, 22 bp, Artificial Sequence
  Synthetic oligonucleotide; TTT chr11 5185415 5185436 5185432 5185437 +
aaaatgtgagtcttttctgaag

SEQ ID NO: 76663 - DNA, 22 bp, Artificial Sequence
  Synthetic oligonucleotide; TTA chr11 5185416 5185437 5185433 5185438 +
aaatgtgagtcttttctgaagt

SEQ ID NO: 76664 - DNA, 22 bp, Artificial Sequence
  Synthetic oligonucleotide; CTT chr11 5185429 5185450 5185446 5185451 +
ttctgaagtcagtgtcttagga

SEQ ID NO: 76665 - DNA, 22 bp, Artificial Sequence
  Synthetic oligonucleotide; TTT chr11 5185430 5185451 5185447 5185452 +
tctgaagtcagtgtcttaggaa

SEQ ID NO: 76666 - DNA, 22 bp, Artificial Sequence
  Synthetic oligonucleotide; TTT chr11 5185431 5185452 5185448 5185453 +
ctgaagtcagtgtcttaggaag

SEQ ID NO: 76667 - DNA, 22 bp, Artificial Sequence
  Synthetic oligonucleotide; TTC chr11 5185432 5185453 5185449 5185454 +
tgaagtcagtgtcttaggaagg

SEQ ID NO: 76668 - DNA, 22 bp, Artificial Sequence
  Synthetic oligonucleotide; CTG chr11 5185434 5185455 5185451 5185456 +
aagtcagtgtcttaggaaggta

SEQ ID NO: 76669 - DNA, 22 bp, Artificial Sequence
  Synthetic oligonucleotide; CTT chr11 5185447 5185468 5185464 5185469 +
aggaaggtagctacataagtca

SEQ ID NO: 76670 - DNA, 22 bp, Artificial Sequence
  Synthetic oligonucleotide; TTA chr11 5185448 5185469 5185465 5185470 +
ggaaggtagctacataagtcat

SEQ ID NO: 76671 - DNA, 22 bp, Artificial Sequence
  Synthetic oligonucleotide; CTA chr11 5185460 5185481 5185477 5185482 +
cataagtcatttatatctctat

SEQ ID NO: 76672 - DNA, 22 bp, Artificial Sequence
  Synthetic oligonucleotide; TTT chr11 5185472 5185493 5185489 5185494 +
atatctctatcccaacaataga

SEQ ID NO: 76673 - DNA, 22 bp, Artificial Sequence
  Synthetic oligonucleotide; TTA chr11 5185473 5185494 5185490 5185495 +
tatctctatcccaacaatagat

SEQ ID NO: 76674 - DNA, 22 bp, Artificial Sequence
  Synthetic oligonucleotide; CTC chr11 5185479 5185500 5185496 5185501 +
tatcccaacaatagatgacatc

SEQ ID NO: 76675 - DNA, 22 bp, Artificial Sequence
  Synthetic oligonucleotide; CTA chr11 5185481 5185502 5185498 5185503 +
tcccaacaatagatgacatcag

SEQ ID NO: 76676 - DNA, 22 bp, Artificial Sequence
  Synthetic oligonucleotide; CTA chr11 5185510 5185531 5185527 5185532 +
acaaaattgtagcaattaagac

SEQ ID NO: 76677 - DNA, 22 bp, Artificial Sequence
  Synthetic oligonucleotide; TTG chr11 5185519 5185540 5185536 5185541 +
tagcaattaagaccaaaattat

SEQ ID NO: 76678 - DNA, 22 bp, Artificial Sequence
  Synthetic oligonucleotide; TTA chr11 5185528 5185549 5185545 5185550 +
agaccaaaattattgtcaactg

SEQ ID NO: 76679 - DNA, 22 bp, Artificial Sequence
  Synthetic oligonucleotide; TTA chr11 5185540 5185561 5185557 5185562 +
ttgtcaactggaataagtttaa

SEQ ID NO: 76680 - DNA, 22 bp, Artificial Sequence
  Synthetic oligonucleotide; TTG chr11 5185543 5185564 5185560 5185565 +
tcaactggaataagtttaactt

SEQ ID NO: 76681 - DNA, 22 bp, Artificial Sequence
  Synthetic oligonucleotide; CTG chr11 5185550 5185571 5185567 5185572 +
gaataagtttaactttcaggac

SEQ ID NO: 76682 - DNA, 22 bp, Artificial Sequence
  Synthetic oligonucleotide; TTT chr11 5185560 5185581 5185577 5185582 +
aactttcaggacttcaggctta

SEQ ID NO: 76683 - DNA, 22 bp, Artificial Sequence
  Synthetic oligonucleotide; TTA chr11 5185561 5185582 5185578 5185583 +
actttcaggacttcaggcttat

SEQ ID NO: 76684 - DNA, 22 bp, Artificial Sequence
  Synthetic oligonucleotide; CTT chr11 5185565 5185586 5185582 5185587 +
tcaggacttcaggcttattatc

SEQ ID NO: 76685 - DNA, 22 bp, Artificial Sequence
  Synthetic oligonucleotide; TTT chr11 5185566 5185587 5185583 5185588 +
caggacttcaggcttattatcc

SEQ ID NO: 76686 - DNA, 22 bp, Artificial Sequence
  Synthetic oligonucleotide; TTC chr11 5185567 5185588 5185584 5185589 +
aggacttcaggcttattatcca

SEQ ID NO: 76687 - DNA, 22 bp, Artificial Sequence
  Synthetic oligonucleotide; CTT chr11 5185574 5185595 5185591 5185596 +
caggcttattatccatcaaact

SEQ ID NO: 76688 - DNA, 22 bp, Artificial Sequence
  Synthetic oligonucleotide; TTC chr11 5185575 5185596 5185592 5185597 +
aggcttattatccatcaaactg

SEQ ID NO: 76689 - DNA, 22 bp, Artificial Sequence
  Synthetic oligonucleotide; CTT chr11 5185581 5185602 5185598 5185603 +
attatccatcaaactgagattg

SEQ ID NO: 76690 - DNA, 22 bp, Artificial Sequence
  Synthetic oligonucleotide; TTA chr11 5185582 5185603 5185599 5185604 +
ttatccatcaaactgagattga

SEQ ID NO: 76691 - DNA, 22 bp, Artificial Sequence
  Synthetic oligonucleotide; TTA chr11 5185585 5185606 5185602 5185607 +
tccatcaaactgagattgaatt

SEQ ID NO: 76692 - DNA, 22 bp, Artificial Sequence
  Synthetic oligonucleotide; CTG chr11 5185597 5185618 5185614 5185619 +
agattgaattgatttagagtat

SEQ ID NO: 76693 - DNA, 22 bp, Artificial Sequence
  Synthetic oligonucleotide; TTG chr11 5185603 5185624 5185620 5185625 +
aattgatttagagtatccataa

SEQ ID NO: 76694 - DNA, 22 bp, Artificial Sequence
  Synthetic oligonucleotide; TTG chr11 5185608 5185629 5185625 5185630 +
atttagagtatccataaatact

SEQ ID NO: 76695 - DNA, 22 bp, Artificial Sequence
  Synthetic oligonucleotide; TTT chr11 5185612 5185633 5185629 5185634 +
agagtatccataaatactagga

SEQ ID NO: 76696 - DNA, 22 bp, Artificial Sequence
  Synthetic oligonucleotide; TTA chr11 5185613 5185634 5185630 5185635 +
gagtatccataaatactaggaa

SEQ ID NO: 76697 - DNA, 22 bp, Artificial Sequence
  Synthetic oligonucleotide; CTA chr11 5185631 5185652 5185648 5185653 +
ggaataaatttttttttaataa

SEQ ID NO: 76698 - DNA, 22 bp, Artificial Sequence
  Synthetic oligonucleotide; TTT chr11 5185642 5185663 5185659 5185664 +
ttttttaataaatttcttatac

SEQ ID NO: 76699 - DNA, 22 bp, Artificial Sequence
  Synthetic oligonucleotide; TTT chr11 5185643 5185664 5185660 5185665 +
tttttaataaatttcttatact

SEQ ID NO: 76700 - DNA, 22 bp, Artificial Sequence
  Synthetic oligonucleotide; TTT chr11 5185644 5185665 5185661 5185666 +
ttttaataaatttcttatactg

SEQ ID NO: 76701 - DNA, 22 bp, Artificial Sequence
  Synthetic oligonucleotide; TTT chr11 5185645 5185666 5185662 5185667 +
tttaataaatttcttatactgg

SEQ ID NO: 76702 - DNA, 22 bp, Artificial Sequence
  Synthetic oligonucleotide; TTT chr11 5185646 5185667 5185663 5185668 +
ttaataaatttcttatactggg

SEQ ID NO: 76703 - DNA, 22 bp, Artificial Sequence
  Synthetic oligonucleotide; TTT chr11 5185647 5185668 5185664 5185669 +
taataaatttcttatactgggc

SEQ ID NO: 76704 - DNA, 22 bp, Artificial Sequence
  Synthetic oligonucleotide; TTT chr11 5185648 5185669 5185665 5185670 +
aataaatttcttatactgggca

SEQ ID NO: 76705 - DNA, 22 bp, Artificial Sequence
  Synthetic oligonucleotide; TTA chr11 5185649 5185670 5185666 5185671 +
ataaatttcttatactgggcac

SEQ ID NO: 76706 - DNA, 22 bp, Artificial Sequence
  Synthetic oligonucleotide; TTT chr11 5185657 5185678 5185674 5185679 +
cttatactgggcacatggtatc

SEQ ID NO: 76707 - DNA, 22 bp, Artificial Sequence
  Synthetic oligonucleotide; TTC chr11 5185658 5185679 5185675 5185680 +
ttatactgggcacatggtatca

SEQ ID NO: 76708 - DNA, 22 bp, Artificial Sequence
  Synthetic oligonucleotide; CTT chr11 5185660 5185681 5185677 5185682 +
atactgggcacatggtatcaat

SEQ ID NO: 76709 - DNA, 22 bp, Artificial Sequence
  Synthetic oligonucleotide; TTA chr11 5185661 5185682 5185678 5185683 +
tactgggcacatggtatcaatt

SEQ ID NO: 76710 - DNA, 22 bp, Artificial Sequence
  Synthetic oligonucleotide; CTG chr11 5185666 5185687 5185683 5185688 +
ggcacatggtatcaattggtaa

SEQ ID NO: 76711 - DNA, 22 bp, Artificial Sequence
  Synthetic oligonucleotide; TTG chr11 5185684 5185705 5185701 5185706 +
gtaatcttcaccctgtatctgt

SEQ ID NO: 76712 - DNA, 22 bp, Artificial Sequence
  Synthetic oligonucleotide; CTT chr11 5185692 5185713 5185709 5185714 +
caccctgtatctgtcatttact

SEQ ID NO: 76713 - DNA, 22 bp, Artificial Sequence
  Synthetic oligonucleotide; TTC chr11 5185693 5185714 5185710 5185715 +
accctgtatctgtcatttactt

SEQ ID NO: 76714 - DNA, 22 bp, Artificial Sequence
  Synthetic oligonucleotide; CTG chr11 5185699 5185720 5185716 5185721 +
tatctgtcatttacttttataa

SEQ ID NO: 76715 - DNA, 22 bp, Artificial Sequence
  Synthetic oligonucleotide; CTG chr11 5185705 5185726 5185722 5185727 +
tcatttacttttataaggtgca

SEQ ID NO: 76716 - DNA, 22 bp, Artificial Sequence
  Synthetic oligonucleotide; TTT chr11 5185711 5185732 5185728 5185733 +
acttttataaggtgcaaatagt

SEQ ID NO: 76717 - DNA, 22 bp, Artificial Sequence
  Synthetic oligonucleotide; TTA chr11 5185712 5185733 5185729 5185734 +
cttttataaggtgcaaatagtt

SEQ ID NO: 76718 - DNA, 22 bp, Artificial Sequence
  Synthetic oligonucleotide; CTT chr11 5185715 5185736 5185732 5185737 +
ttataaggtgcaaatagttcag

SEQ ID NO: 76719 - DNA, 22 bp, Artificial Sequence
  Synthetic oligonucleotide; TTT chr11 5185716 5185737 5185733 5185738 +
tataaggtgcaaatagttcagc

SEQ ID NO: 76720 - DNA, 22 bp, Artificial Sequence
  Synthetic oligonucleotide; TTT chr11 5185717 5185738 5185734 5185739 +
ataaggtgcaaatagttcagca

SEQ ID NO: 76721 - DNA, 22 bp, Artificial Sequence
  Synthetic oligonucleotide; TTA chr11 5185718 5185739 5185735 5185740 +
taaggtgcaaatagttcagcat

SEQ ID NO: 76722 - DNA, 22 bp, Artificial Sequence
  Synthetic oligonucleotide; TTC chr11 5185735 5185756 5185752 5185757 +
agcatggtgacagacacatgaa

SEQ ID NO: 76723 - DNA, 22 bp, Artificial Sequence
  Synthetic oligonucleotide; TTT chr11 5185760 5185781 5185777 5185782 +
tgaaatggagttttatttttgc

SEQ ID NO: 76724 - DNA, 22 bp, Artificial Sequence
  Synthetic oligonucleotide; TTT chr11 5185761 5185782 5185778 5185783 +
gaaatggagttttatttttgcc

SEQ ID NO: 76725 - DNA, 22 bp, Artificial Sequence
  Synthetic oligonucleotide; TTG chr11 5185762 5185783 5185779 5185784 +
aaatggagttttatttttgccc

SEQ ID NO: 76726 - DNA, 22 bp, Artificial Sequence
  Synthetic oligonucleotide; TTT chr11 5185773 5185794 5185790 5185795 +
tatttttgccccatcaccagta

SEQ ID NO: 76727 - DNA, 22 bp, Artificial Sequence
  Synthetic oligonucleotide; TTT chr11 5185774 5185795 5185791 5185796 +
atttttgccccatcaccagtat

SEQ ID NO: 76728 - DNA, 22 bp, Artificial Sequence
  Synthetic oligonucleotide; TTA chr11 5185775 5185796 5185792 5185797 +
tttttgccccatcaccagtata

SEQ ID NO: 76729 - DNA, 22 bp, Artificial Sequence
  Synthetic oligonucleotide; TTT chr11 5185778 5185799 5185795 5185800 +
ttgccccatcaccagtataata

SEQ ID NO: 76730 - DNA, 22 bp, Artificial Sequence
  Synthetic oligonucleotide; TTT chr11 5185779 5185800 5185796 5185801 +
tgccccatcaccagtataatat

SEQ ID NO: 76731 - DNA, 22 bp, Artificial Sequence
  Synthetic oligonucleotide; TTT chr11 5185780 5185801 5185797 5185802 +
gccccatcaccagtataatatc

SEQ ID NO: 76732 - DNA, 22 bp, Artificial Sequence
  Synthetic oligonucleotide; TTG chr11 5185781 5185802 5185798 5185803 +
ccccatcaccagtataatatct

SEQ ID NO: 76733 - DNA, 22 bp, Artificial Sequence
  Synthetic oligonucleotide; CTT chr11 5185804 5185825 5185821 5185826 +
tgttacatagggaagagagtta

SEQ ID NO: 76734 - DNA, 22 bp, Artificial Sequence
  Synthetic oligonucleotide; TTT chr11 5185805 5185826 5185822 5185827 +
gttacatagggaagagagttaa

SEQ ID NO: 76735 - DNA, 22 bp, Artificial Sequence
  Synthetic oligonucleotide; TTG chr11 5185806 5185827 5185823 5185828 +
ttacatagggaagagagttaaa

SEQ ID NO: 76736 - DNA, 22 bp, Artificial Sequence
  Synthetic oligonucleotide; TTA chr11 5185809 5185830 5185826 5185831 +
catagggaagagagttaaaaat

SEQ ID NO: 76737 - DNA, 22 bp, Artificial Sequence
  Synthetic oligonucleotide; TTA chr11 5185826 5185847 5185843 5185848 +
aaaattttggagtgccagcttc

SEQ ID NO: 76738 - DNA, 22 bp, Artificial Sequence
  Synthetic oligonucleotide; TTT chr11 5185833 5185854 5185850 5185855 +
tggagtgccagcttcttaatct

SEQ ID NO: 76739 - DNA, 22 bp, Artificial Sequence
  Synthetic oligonucleotide; TTT chr11 5185834 5185855 5185851 5185856 +
ggagtgccagcttcttaatctg

SEQ ID NO: 76740 - DNA, 22 bp, Artificial Sequence
  Synthetic oligonucleotide; TTG chr11 5185835 5185856 5185852 5185857 +
gagtgccagcttcttaatctgt

SEQ ID NO: 76741 - DNA, 22 bp, Artificial Sequence
  Synthetic oligonucleotide; CTT chr11 5185847 5185868 5185864 5185869 +
cttaatctgtgcctagactatt

SEQ ID NO: 76742 - DNA, 22 bp, Artificial Sequence
  Synthetic oligonucleotide; TTC chr11 5185848 5185869 5185865 5185870 +
ttaatctgtgcctagactatta

SEQ ID NO: 76743 - DNA, 22 bp, Artificial Sequence
  Synthetic oligonucleotide; CTT chr11 5185850 5185871 5185867 5185872 +
aatctgtgcctagactattacc

SEQ ID NO: 76744 - DNA, 22 bp, Artificial Sequence
  Synthetic oligonucleotide; TTA chr11 5185851 5185872 5185868 5185873 +
atctgtgcctagactattacct

SEQ ID NO: 76745 - DNA, 22 bp, Artificial Sequence
  Synthetic oligonucleotide; CTG chr11 5185856 5185877 5185873 5185878 +
tgcctagactattacctgatga

SEQ ID NO: 76746 - DNA, 22 bp, Artificial Sequence
  Synthetic oligonucleotide; CTA chr11 5185862 5185883 5185879 5185884 +
gactattacctgatgagtaata

SEQ ID NO: 76747 - DNA, 22 bp, Artificial Sequence
  Synthetic oligonucleotide; CTA chr11 5185867 5185888 5185884 5185889 +
ttacctgatgagtaatagtcaa

SEQ ID NO: 76748 - DNA, 22 bp, Artificial Sequence
  Synthetic oligonucleotide; TTA chr11 5185870 5185891 5185887 5185892 +
cctgatgagtaatagtcaataa

SEQ ID NO: 76749 - DNA, 22 bp, Artificial Sequence
  Synthetic oligonucleotide; CTG chr11 5185874 5185895 5185891 5185896 +
atgagtaatagtcaataaacta

SEQ ID NO: 76750 - DNA, 22 bp, Artificial Sequence
  Synthetic oligonucleotide; CTA chr11 5185896 5185917 5185913 5185918 +
cagaacgatgcacacacacaca

SEQ ID NO: 76751 - DNA, 22 bp, Artificial Sequence
  Synthetic oligonucleotide; TTA chr11 5185925 5185946 5185942 5185947 +
aactactaaaattttttattac

SEQ ID NO: 76752 - DNA, 22 bp, Artificial Sequence
  Synthetic oligonucleotide; CTA chr11 5185930 5185951 5185947 5185952 +
ctaaaattttttattactgagc

SEQ ID NO: 76753 - DNA, 22 bp, Artificial Sequence
  Synthetic oligonucleotide; CTA chr11 5185933 5185954 5185950 5185955 +
aaattttttattactgagcctt

SEQ ID NO: 76754 - DNA, 22 bp, Artificial Sequence
  Synthetic oligonucleotide; TTT chr11 5185939 5185960 5185956 5185961 +
tttattactgagccttgtttta

SEQ ID NO: 76755 - DNA, 22 bp, Artificial Sequence
  Synthetic oligonucleotide; TTT chr11 5185940 5185961 5185957 5185962 +
ttattactgagccttgttttaa

SEQ ID NO: 76756 - DNA, 22 bp, Artificial Sequence
  Synthetic oligonucleotide; TTT chr11 5185941 5185962 5185958 5185963 +
tattactgagccttgttttaac

SEQ ID NO: 76757 - DNA, 22 bp, Artificial Sequence
  Synthetic oligonucleotide; TTT chr11 5185942 5185963 5185959 5185964 +
attactgagccttgttttaact

SEQ ID NO: 76758 - DNA, 22 bp, Artificial Sequence
  Synthetic oligonucleotide; TTA chr11 5185943 5185964 5185960 5185965 +
ttactgagccttgttttaacta

SEQ ID NO: 76759 - DNA, 22 bp, Artificial Sequence
  Synthetic oligonucleotide; TTA chr11 5185946 5185967 5185963 5185968 +
ctgagccttgttttaactacta

SEQ ID NO: 76760 - DNA, 22 bp, Artificial Sequence
  Synthetic oligonucleotide; CTG chr11 5185949 5185970 5185966 5185971 +
agccttgttttaactactagaa

SEQ ID NO: 76761 - DNA, 22 bp, Artificial Sequence
  Synthetic oligonucleotide; CTT chr11 5185955 5185976 5185972 5185977 +
gttttaactactagaatataaa

SEQ ID NO: 76762 - DNA, 22 bp, Artificial Sequence
  Synthetic oligonucleotide; TTG chr11 5185956 5185977 5185973 5185978 +
ttttaactactagaatataaat

SEQ ID NO: 76763 - DNA, 22 bp, Artificial Sequence
  Synthetic oligonucleotide; TTT chr11 5185959 5185980 5185976 5185981 +
taactactagaatataaattca

SEQ ID NO: 76764 - DNA, 22 bp, Artificial Sequence
  Synthetic oligonucleotide; TTT chr11 5185960 5185981 5185977 5185982 +
aactactagaatataaattcat

SEQ ID NO: 76765 - DNA, 22 bp, Artificial Sequence
  Synthetic oligonucleotide; TTA chr11 5185961 5185982 5185978 5185983 +
actactagaatataaattcatt

SEQ ID NO: 76766 - DNA, 22 bp, Artificial Sequence
  Synthetic oligonucleotide; CTA chr11 5185965 5185986 5185982 5185987 +
ctagaatataaattcattgaat

SEQ ID NO: 76767 - DNA, 22 bp, Artificial Sequence
  Synthetic oligonucleotide; CTA chr11 5185968 5185989 5185985 5185990 +
gaatataaattcattgaatctt

SEQ ID NO: 76768 - DNA, 22 bp, Artificial Sequence
  Synthetic oligonucleotide; TTC chr11 5185980 5186001 5185997 5186002 +
attgaatctttgtacaacattc

SEQ ID NO: 76769 - DNA, 22 bp, Artificial Sequence
  Synthetic oligonucleotide; TTG chr11 5185984 5186005 5186001 5186006 +
aatctttgtacaacattcaaat

SEQ ID NO: 76770 - DNA, 22 bp, Artificial Sequence
  Synthetic oligonucleotide; CTT chr11 5185990 5186011 5186007 5186012 +
tgtacaacattcaaatctgcat

SEQ ID NO: 76771 - DNA, 22 bp, Artificial Sequence
  Synthetic oligonucleotide; TTT chr11 5185991 5186012 5186008 5186013 +
gtacaacattcaaatctgcata

SEQ ID NO: 76772 - DNA, 22 bp, Artificial Sequence
  Synthetic oligonucleotide; TTG chr11 5185992 5186013 5186009 5186014 +
tacaacattcaaatctgcatat

SEQ ID NO: 76773 - DNA, 22 bp, Artificial Sequence
  Synthetic oligonucleotide; TTC chr11 5186002 5186023 5186019 5186024 +
aaatctgcatatcaaagaaaat

SEQ ID NO: 76774 - DNA, 22 bp, Artificial Sequence
  Synthetic oligonucleotide; CTG chr11 5186009 5186030 5186026 5186031 +
catatcaaagaaaatgagcatt

SEQ ID NO: 76775 - DNA, 22 bp, Artificial Sequence
  Synthetic oligonucleotide; TTA chr11 5186032 5186053 5186049 5186054 +
tttaaacatattctaagagaaa

SEQ ID NO: 76776 - DNA, 22 bp, Artificial Sequence
  Synthetic oligonucleotide; TTT chr11 5186035 5186056 5186052 5186057 +
aaacatattctaagagaaaact

SEQ ID NO: 76777 - DNA, 22 bp, Artificial Sequence
  Synthetic oligonucleotide; TTA chr11 5186036 5186057 5186053 5186058 +
aacatattctaagagaaaacta

SEQ ID NO: 76778 - DNA, 22 bp, Artificial Sequence
  Synthetic oligonucleotide; TTC chr11 5186045 5186066 5186062 5186067 +
taagagaaaactaaaatattct

SEQ ID NO: 76779 - DNA, 22 bp, Artificial Sequence
  Synthetic oligonucleotide; CTA chr11 5186047 5186068 5186064 5186069 +
agagaaaactaaaatattcttt

SEQ ID NO: 76780 - DNA, 22 bp, Artificial Sequence
  Synthetic oligonucleotide; CTA chr11 5186058 5186079 5186075 5186080 +
aaatattctttttgaaaatgac

SEQ ID NO: 76781 - DNA, 22 bp, Artificial Sequence
  Synthetic oligonucleotide; TTC chr11 5186066 5186087 5186083 5186088 +
tttttgaaaatgacttacttaa

SEQ ID NO: 76782 - DNA, 22 bp, Artificial Sequence
  Synthetic oligonucleotide; CTT chr11 5186068 5186089 5186085 5186090 +
tttgaaaatgacttacttaata

SEQ ID NO: 76783 - DNA, 22 bp, Artificial Sequence
  Synthetic oligonucleotide; TTT chr11 5186069 5186090 5186086 5186091 +
ttgaaaatgacttacttaatac

SEQ ID NO: 76784 - DNA, 22 bp, Artificial Sequence
  Synthetic oligonucleotide; TTT chr11 5186070 5186091 5186087 5186092 +
tgaaaatgacttacttaataca

SEQ ID NO: 76785 - DNA, 22 bp, Artificial Sequence
  Synthetic oligonucleotide; TTT chr11 5186071 5186092 5186088 5186093 +
gaaaatgacttacttaatacaa

SEQ ID NO: 76786 - DNA, 22 bp, Artificial Sequence
  Synthetic oligonucleotide; TTG chr11 5186072 5186093 5186089 5186094 +
aaaatgacttacttaatacaag

SEQ ID NO: 76787 - DNA, 22 bp, Artificial Sequence
  Synthetic oligonucleotide; CTT chr11 5186082 5186103 5186099 5186104 +
acttaatacaagaacacaaaaa

SEQ ID NO: 76788 - DNA, 22 bp, Artificial Sequence
  Synthetic oligonucleotide; TTA chr11 5186083 5186104 5186100 5186105 +
cttaatacaagaacacaaaaaa

SEQ ID NO: 76789 - DNA, 22 bp, Artificial Sequence
  Synthetic oligonucleotide; CTT chr11 5186086 5186107 5186103 5186108 +
aatacaagaacacaaaaaatac

SEQ ID NO: 76790 - DNA, 22 bp, Artificial Sequence
  Synthetic oligonucleotide; TTA chr11 5186087 5186108 5186104 5186109 +
atacaagaacacaaaaaatact

SEQ ID NO: 76791 - DNA, 22 bp, Artificial Sequence
  Synthetic oligonucleotide; CTA chr11 5186110 5186131 5186127 5186132 +
caattgcaaatcaactccagct

SEQ ID NO: 76792 - DNA, 22 bp, Artificial Sequence
  Synthetic oligonucleotide; TTG chr11 5186116 5186137 5186133 5186138 +
caaatcaactccagctaaagcc

SEQ ID NO: 76793 - DNA, 22 bp, Artificial Sequence
  Synthetic oligonucleotide; CTC chr11 5186127 5186148 5186144 5186149 +
cagctaaagccaagtctagtat

SEQ ID NO: 76794 - DNA, 22 bp, Artificial Sequence
  Synthetic oligonucleotide; CTA chr11 5186133 5186154 5186150 5186155 +
aagccaagtctagtattccatg

SEQ ID NO: 76795 - DNA, 22 bp, Artificial Sequence
  Synthetic oligonucleotide; CTA chr11 5186145 5186166 5186162 5186167 +
gtattccatgggtcaaaaatca

SEQ ID NO: 76796 - DNA, 22 bp, Artificial Sequence
  Synthetic oligonucleotide; TTC chr11 5186151 5186172 5186168 5186173 +
catgggtcaaaaatcaaggaaa

SEQ ID NO: 76797 - DNA, 22 bp, Artificial Sequence
  Synthetic oligonucleotide; TTA chr11 5186179 5186200 5186196 5186201 +
gatgattaagttatcggaagaa

SEQ ID NO: 76798 - DNA, 22 bp, Artificial Sequence
  Synthetic oligonucleotide; TTA chr11 5186187 5186208 5186204 5186209 +
agttatcggaagaatgagctgc

SEQ ID NO: 76799 - DNA, 22 bp, Artificial Sequence
  Synthetic oligonucleotide; TTA chr11 5186192 5186213 5186209 5186214 +
tcggaagaatgagctgcttctg

SEQ ID NO: 76800 - DNA, 22 bp, Artificial Sequence
  Synthetic oligonucleotide; CTG chr11 5186208 5186229 5186225 5186230 +
cttctgcagtttcttgcctttt

SEQ ID NO: 76801 - DNA, 22 bp, Artificial Sequence
  Synthetic oligonucleotide; CTT chr11 5186211 5186232 5186228 5186233 +
ctgcagtttcttgccttttttt

SEQ ID NO: 76802 - DNA, 22 bp, Artificial Sequence
  Synthetic oligonucleotide; TTC chr11 5186212 5186233 5186229 5186234 +
tgcagtttcttgcctttttttt

SEQ ID NO: 76803 - DNA, 22 bp, Artificial Sequence
  Synthetic oligonucleotide; CTG chr11 5186214 5186235 5186231 5186236 +
cagtttcttgcctttttttttt

SEQ ID NO: 76804 - DNA, 22 bp, Artificial Sequence
  Synthetic oligonucleotide; TTT chr11 5186220 5186241 5186237 5186242 +
cttgccttttttttttctggtg

SEQ ID NO: 76805 - DNA, 22 bp, Artificial Sequence
  Synthetic oligonucleotide; TTC chr11 5186221 5186242 5186238 5186243 +
ttgccttttttttttctggtgt

SEQ ID NO: 76806 - DNA, 22 bp, Artificial Sequence
  Synthetic oligonucleotide; CTT chr11 5186223 5186244 5186240 5186245 +
gccttttttttttctggtgtta

SEQ ID NO: 76807 - DNA, 22 bp, Artificial Sequence
  Synthetic oligonucleotide; TTG chr11 5186224 5186245 5186241 5186246 +
ccttttttttttctggtgttat

SEQ ID NO: 76808 - DNA, 22 bp, Artificial Sequence
  Synthetic oligonucleotide; CTT chr11 5186228 5186249 5186245 5186250 +
ttttttttctggtgttattttc

SEQ ID NO: 76809 - DNA, 22 bp, Artificial Sequence
  Synthetic oligonucleotide; TTT chr11 5186229 5186250 5186246 5186251 +
tttttttctggtgttattttct

SEQ ID NO: 76810 - DNA, 22 bp, Artificial Sequence
  Synthetic oligonucleotide; TTT chr11 5186230 5186251 5186247 5186252 +
ttttttctggtgttattttcta

SEQ ID NO: 76811 - DNA, 22 bp, Artificial Sequence
  Synthetic oligonucleotide; TTT chr11 5186231 5186252 5186248 5186253 +
tttttctggtgttattttctac

SEQ ID NO: 76812 - DNA, 22 bp, Artificial Sequence
  Synthetic oligonucleotide; TTT chr11 5186232 5186253 5186249 5186254 +
ttttctggtgttattttctaca

SEQ ID NO: 76813 - DNA, 22 bp, Artificial Sequence
  Synthetic oligonucleotide; TTT chr11 5186233 5186254 5186250 5186255 +
tttctggtgttattttctacaa

SEQ ID NO: 76814 - DNA, 22 bp, Artificial Sequence
  Synthetic oligonucleotide; TTT chr11 5186234 5186255 5186251 5186256 +
ttctggtgttattttctacaag

SEQ ID NO: 76815 - DNA, 22 bp, Artificial Sequence
  Synthetic oligonucleotide; TTT chr11 5186235 5186256 5186252 5186257 +
tctggtgttattttctacaagt

SEQ ID NO: 76816 - DNA, 22 bp, Artificial Sequence
  Synthetic oligonucleotide; TTT chr11 5186236 5186257 5186253 5186258 +
ctggtgttattttctacaagtt

SEQ ID NO: 76817 - DNA, 22 bp, Artificial Sequence
  Synthetic oligonucleotide; TTC chr11 5186237 5186258 5186254 5186259 +
tggtgttattttctacaagttt

SEQ ID NO: 76818 - DNA, 22 bp, Artificial Sequence
  Synthetic oligonucleotide; CTG chr11 5186239 5186260 5186256 5186261 +
gtgttattttctacaagttttc

SEQ ID NO: 76819 - DNA, 22 bp, Artificial Sequence
  Synthetic oligonucleotide; TTA chr11 5186245 5186266 5186262 5186267 +
ttttctacaagttttcattgag

SEQ ID NO: 76820 - DNA, 22 bp, Artificial Sequence
  Synthetic oligonucleotide; TTT chr11 5186248 5186269 5186265 5186270 +
tctacaagttttcattgagcat

SEQ ID NO: 76821 - DNA, 22 bp, Artificial Sequence
  Synthetic oligonucleotide; TTT chr11 5186249 5186270 5186266 5186271 +
ctacaagttttcattgagcata

SEQ ID NO: 76822 - DNA, 22 bp, Artificial Sequence
  Synthetic oligonucleotide; TTC chr11 5186250 5186271 5186267 5186272 +
tacaagttttcattgagcataa

SEQ ID NO: 76823 - DNA, 22 bp, Artificial Sequence
  Synthetic oligonucleotide; CTA chr11 5186252 5186273 5186269 5186274 +
caagttttcattgagcataact

SEQ ID NO: 76824 - DNA, 22 bp, Artificial Sequence
  Synthetic oligonucleotide; TTT chr11 5186259 5186280 5186276 5186281 +
tcattgagcataactcagttta

SEQ ID NO: 76825 - DNA, 22 bp, Artificial Sequence
  Synthetic oligonucleotide; TTT chr11 5186260 5186281 5186277 5186282 +
cattgagcataactcagtttac

SEQ ID NO: 76826 - DNA, 22 bp, Artificial Sequence
  Synthetic oligonucleotide; TTC chr11 5186261 5186282 5186278 5186283 +
attgagcataactcagtttact

SEQ ID NO: 76827 - DNA, 22 bp, Artificial Sequence
  Synthetic oligonucleotide; TTG chr11 5186265 5186286 5186282 5186287 +
agcataactcagtttacttact

SEQ ID NO: 76828 - DNA, 22 bp, Artificial Sequence
  Synthetic oligonucleotide; CTC chr11 5186275 5186296 5186292 5186297 +
agtttacttacttgcattttct

SEQ ID NO: 76829 - DNA, 22 bp, Artificial Sequence
  Synthetic oligonucleotide; TTT chr11 5186280 5186301 5186297 5186302 +
acttacttgcattttctagaat

SEQ ID NO: 76830 - DNA, 22 bp, Artificial Sequence
  Synthetic oligonucleotide; TTA chr11 5186281 5186302 5186298 5186303 +
cttacttgcattttctagaatc

SEQ ID NO: 76831 - DNA, 22 bp, Artificial Sequence
  Synthetic oligonucleotide; CTT chr11 5186284 5186305 5186301 5186306 +
acttgcattttctagaatcctg

SEQ ID NO: 76832 - DNA, 22 bp, Artificial Sequence
  Synthetic oligonucleotide; TTA chr11 5186285 5186306 5186302 5186307 +
cttgcattttctagaatcctga

SEQ ID NO: 76833 - DNA, 22 bp, Artificial Sequence
  Synthetic oligonucleotide; CTT chr11 5186288 5186309 5186305 5186310 +
gcattttctagaatcctgaaga

SEQ ID NO: 76834 - DNA, 22 bp, Artificial Sequence
  Synthetic oligonucleotide; TTG chr11 5186289 5186310 5186306 5186311 +
cattttctagaatcctgaagat

SEQ ID NO: 76835 - DNA, 22 bp, Artificial Sequence
  Synthetic oligonucleotide; TTT chr11 5186294 5186315 5186311 5186316 +
tctagaatcctgaagatattta

SEQ ID NO: 76836 - DNA, 22 bp, Artificial Sequence
  Synthetic oligonucleotide; TTT chr11 5186295 5186316 5186312 5186317 +
ctagaatcctgaagatatttag

SEQ ID NO: 76837 - DNA, 22 bp, Artificial Sequence
  Synthetic oligonucleotide; TTC chr11 5186296 5186317 5186313 5186318 +
tagaatcctgaagatatttagc

SEQ ID NO: 76838 - DNA, 22 bp, Artificial Sequence
  Synthetic oligonucleotide; CTA chr11 5186298 5186319 5186315 5186320 +
gaatcctgaagatatttagcag

SEQ ID NO: 76839 - DNA, 22 bp, Artificial Sequence
  Synthetic oligonucleotide; CTG chr11 5186306 5186327 5186323 5186328 +
aagatatttagcaggttgagag

SEQ ID NO: 76840 - DNA, 22 bp, Artificial Sequence
  Synthetic oligonucleotide; TTT chr11 5186315 5186336 5186332 5186337 +
agcaggttgagaggagacaaaa

SEQ ID NO: 76841 - DNA, 22 bp, Artificial Sequence
  Synthetic oligonucleotide; TTA chr11 5186316 5186337 5186333 5186338 +
gcaggttgagaggagacaaaat

SEQ ID NO: 76842 - DNA, 22 bp, Artificial Sequence
  Synthetic oligonucleotide; TTG chr11 5186324 5186345 5186341 5186346 +
agaggagacaaaataaatgcaa

SEQ ID NO: 76843 - DNA, 22 bp, Artificial Sequence
  Synthetic oligonucleotide; TTA chr11 5186354 5186375 5186371 5186376 +
ggaaatctggaactatttatac

SEQ ID NO: 76844 - DNA, 22 bp, Artificial Sequence
  Synthetic oligonucleotide; CTG chr11 5186363 5186384 5186380 5186385 +
gaactatttatacttcttttaa

SEQ ID NO: 76845 - DNA, 22 bp, Artificial Sequence
  Synthetic oligonucleotide; CTA chr11 5186369 5186390 5186386 5186391 +
tttatacttcttttaaagcatg

SEQ ID NO: 76846 - DNA, 22 bp, Artificial Sequence
  Synthetic oligonucleotide; TTT chr11 5186372 5186393 5186389 5186394 +
atacttcttttaaagcatgtct

SEQ ID NO: 76847 - DNA, 22 bp, Artificial Sequence
  Synthetic oligonucleotide; TTA chr11 5186373 5186394 5186390 5186395 +
tacttcttttaaagcatgtctt

SEQ ID NO: 76848 - DNA, 22 bp, Artificial Sequence
  Synthetic oligonucleotide; CTT chr11 5186378 5186399 5186395 5186400 +
cttttaaagcatgtcttgggcc

SEQ ID NO: 76849 - DNA, 22 bp, Artificial Sequence
  Synthetic oligonucleotide; TTC chr11 5186379 5186400 5186396 5186401 +
ttttaaagcatgtcttgggccc

SEQ ID NO: 76850 - DNA, 22 bp, Artificial Sequence
  Synthetic oligonucleotide; CTT chr11 5186381 5186402 5186398 5186403 +
ttaaagcatgtcttgggcccaa

SEQ ID NO: 76851 - DNA, 22 bp, Artificial Sequence
  Synthetic oligonucleotide; TTT chr11 5186382 5186403 5186399 5186404 +
taaagcatgtcttgggcccaag

SEQ ID NO: 76852 - DNA, 22 bp, Artificial Sequence
  Synthetic oligonucleotide; TTT chr11 5186383 5186404 5186400 5186405 +
aaagcatgtcttgggcccaagg

SEQ ID NO: 76853 - DNA, 22 bp, Artificial Sequence
  Synthetic oligonucleotide; TTA chr11 5186384 5186405 5186401 5186406 +
aagcatgtcttgggcccaaggt

SEQ ID NO: 76854 - DNA, 22 bp, Artificial Sequence
  Synthetic oligonucleotide; CTT chr11 5186395 5186416 5186412 5186417 +
gggcccaaggttttcagcttaa

SEQ ID NO: 76855 - DNA, 22 bp, Artificial Sequence
  Synthetic oligonucleotide; TTG chr11 5186396 5186417 5186413 5186418 +
ggcccaaggttttcagcttaag

SEQ ID NO: 76856 - DNA, 22 bp, Artificial Sequence
  Synthetic oligonucleotide; TTT chr11 5186408 5186429 5186425 5186430 +
tcagcttaagaggacgaatttt

SEQ ID NO: 76857 - DNA, 22 bp, Artificial Sequence
  Synthetic oligonucleotide; TTT chr11 5186409 5186430 5186426 5186431 +
cagcttaagaggacgaatttta

SEQ ID NO: 76858 - DNA, 22 bp, Artificial Sequence
  Synthetic oligonucleotide; TTC chr11 5186410 5186431 5186427 5186432 +
agcttaagaggacgaattttac

SEQ ID NO: 76859 - DNA, 22 bp, Artificial Sequence
  Synthetic oligonucleotide; CTT chr11 5186415 5186436 5186432 5186437 +
aagaggacgaattttactcctc

SEQ ID NO: 76860 - DNA, 22 bp, Artificial Sequence
  Synthetic oligonucleotide; TTA chr11 5186416 5186437 5186433 5186438 +
agaggacgaattttactcctcc

SEQ ID NO: 76861 - DNA, 22 bp, Artificial Sequence
  Synthetic oligonucleotide; TTT chr11 5186429 5186450 5186446 5186451 +
tactcctcccatggaaggagat

SEQ ID NO: 76862 - DNA, 22 bp, Artificial Sequence
  Synthetic oligonucleotide; TTT chr11 5186430 5186451 5186447 5186452 +
actcctcccatggaaggagatg

SEQ ID NO: 76863 - DNA, 22 bp, Artificial Sequence
  Synthetic oligonucleotide; TTA chr11 5186431 5186452 5186448 5186453 +
ctcctcccatggaaggagatga

SEQ ID NO: 76864 - DNA, 22 bp, Artificial Sequence
  Synthetic oligonucleotide; CTC chr11 5186434 5186455 5186451 5186456 +
ctcccatggaaggagatgacac

SEQ ID NO: 76865 - DNA, 22 bp, Artificial Sequence
  Synthetic oligonucleotide; CTC chr11 5186437 5186458 5186454 5186459 +
ccatggaaggagatgacacaga

SEQ ID NO: 76866 - DNA, 22 bp, Artificial Sequence
  Synthetic oligonucleotide; CTG chr11 5186463 5186484 5186480 5186485 +
cttctggtacatagtccacagg

SEQ ID NO: 76867 - DNA, 22 bp, Artificial Sequence
  Synthetic oligonucleotide; CTT chr11 5186466 5186487 5186483 5186488 +
ctggtacatagtccacagggag

SEQ ID NO: 76868 - DNA, 22 bp, Artificial Sequence
  Synthetic oligonucleotide; TTC chr11 5186467 5186488 5186484 5186489 +
tggtacatagtccacagggaga

SEQ ID NO: 76869 - DNA, 22 bp, Artificial Sequence
  Synthetic oligonucleotide; CTG chr11 5186469 5186490 5186486 5186491 +
gtacatagtccacagggagaaa

SEQ ID NO: 76870 - DNA, 22 bp, Artificial Sequence
  Synthetic oligonucleotide; CTG chr11 5186498 5186519 5186515 5186520 +
cattctctttcattataatttg

SEQ ID NO: 76871 - DNA, 22 bp, Artificial Sequence
  Synthetic oligonucleotide; TTC chr11 5186503 5186524 5186520 5186525 +
tctttcattataatttgtgcat

SEQ ID NO: 76872 - DNA, 22 bp, Artificial Sequence
  Synthetic oligonucleotide; CTC chr11 5186505 5186526 5186522 5186527 +
tttcattataatttgtgcattt

SEQ ID NO: 76873 - DNA, 22 bp, Artificial Sequence
  Synthetic oligonucleotide; CTT chr11 5186507 5186528 5186524 5186529 +
tcattataatttgtgcattttt

SEQ ID NO: 76874 - DNA, 22 bp, Artificial Sequence
  Synthetic oligonucleotide; TTT chr11 5186508 5186529 5186525 5186530 +
cattataatttgtgcatttttt

SEQ ID NO: 76875 - DNA, 22 bp, Artificial Sequence
  Synthetic oligonucleotide; TTC chr11 5186509 5186530 5186526 5186531 +
attataatttgtgcattttttt

SEQ ID NO: 76876 - DNA, 22 bp, Artificial Sequence
  Synthetic oligonucleotide; TTA chr11 5186513 5186534 5186530 5186535 +
taatttgtgcattttttttctt

SEQ ID NO: 76877 - DNA, 22 bp, Artificial Sequence
  Synthetic oligonucleotide; TTT chr11 5186519 5186540 5186536 5186541 +
gtgcattttttttcttcagcca

SEQ ID NO: 76878 - DNA, 22 bp, Artificial Sequence
  Synthetic oligonucleotide; TTG chr11 5186520 5186541 5186537 5186542 +
tgcattttttttcttcagccac

SEQ ID NO: 76879 - DNA, 22 bp, Artificial Sequence
  Synthetic oligonucleotide; TTT chr11 5186527 5186548 5186544 5186549 +
tttttcttcagccaccactctc

SEQ ID NO: 76880 - DNA, 22 bp, Artificial Sequence
  Synthetic oligonucleotide; TTT chr11 5186528 5186549 5186545 5186550 +
ttttcttcagccaccactctct

SEQ ID NO: 76881 - DNA, 22 bp, Artificial Sequence
  Synthetic oligonucleotide; TTT chr11 5186529 5186550 5186546 5186551 +
tttcttcagccaccactctctg

SEQ ID NO: 76882 - DNA, 22 bp, Artificial Sequence
  Synthetic oligonucleotide; TTT chr11 5186530 5186551 5186547 5186552 +
ttcttcagccaccactctctga

SEQ ID NO: 76883 - DNA, 22 bp, Artificial Sequence
  Synthetic oligonucleotide; TTT chr11 5186531 5186552 5186548 5186553 +
tcttcagccaccactctctgac

SEQ ID NO: 76884 - DNA, 22 bp, Artificial Sequence
  Synthetic oligonucleotide; TTT chr11 5186532 5186553 5186549 5186554 +
cttcagccaccactctctgaca

SEQ ID NO: 76885 - DNA, 22 bp, Artificial Sequence
  Synthetic oligonucleotide; TTC chr11 5186533 5186554 5186550 5186555 +
ttcagccaccactctctgacac

SEQ ID NO: 76886 - DNA, 22 bp, Artificial Sequence
  Synthetic oligonucleotide; CTT chr11 5186535 5186556 5186552 5186557 +
cagccaccactctctgacacct

SEQ ID NO: 76887 - DNA, 22 bp, Artificial Sequence
  Synthetic oligonucleotide; TTC chr11 5186536 5186557 5186553 5186558 +
agccaccactctctgacaccta

SEQ ID NO: 76888 - DNA, 22 bp, Artificial Sequence
  Synthetic oligonucleotide; CTC chr11 5186547 5186568 5186564 5186569 +
tctgacacctaagttaatacat

SEQ ID NO: 76889 - DNA, 22 bp, Artificial Sequence
  Synthetic oligonucleotide; CTC chr11 5186549 5186570 5186566 5186571 +
tgacacctaagttaatacatac

SEQ ID NO: 76890 - DNA, 22 bp, Artificial Sequence
  Synthetic oligonucleotide; CTG chr11 5186551 5186572 5186568 5186573 +
acacctaagttaatacatacat

SEQ ID NO: 76891 - DNA, 22 bp, Artificial Sequence
  Synthetic oligonucleotide; CTA chr11 5186558 5186579 5186575 5186580 +
agttaatacatacatctacatg

SEQ ID NO: 76892 - DNA, 22 bp, Artificial Sequence
  Synthetic oligonucleotide; TTA chr11 5186563 5186584 5186580 5186585 +
atacatacatctacatgtccag

SEQ ID NO: 76893 - DNA, 22 bp, Artificial Sequence
  Synthetic oligonucleotide; CTA chr11 5186576 5186597 5186593 5186598 +
catgtccaggtcttttgtccct

SEQ ID NO: 76894 - DNA, 22 bp, Artificial Sequence
  Synthetic oligonucleotide; CTT chr11 5186590 5186611 5186607 5186612 +
ttgtccctgtcatatattgttt

SEQ ID NO: 76895 - DNA, 22 bp, Artificial Sequence
  Synthetic oligonucleotide; TTT chr11 5186591 5186612 5186608 5186613 +
tgtccctgtcatatattgtttc

SEQ ID NO: 76896 - DNA, 22 bp, Artificial Sequence
  Synthetic oligonucleotide; TTT chr11 5186592 5186613 5186609 5186614 +
gtccctgtcatatattgtttcc

SEQ ID NO: 76897 - DNA, 22 bp, Artificial Sequence
  Synthetic oligonucleotide; TTG chr11 5186593 5186614 5186610 5186615 +
tccctgtcatatattgtttcca

SEQ ID NO: 76898 - DNA, 22 bp, Artificial Sequence
  Synthetic oligonucleotide; CTG chr11 5186599 5186620 5186616 5186621 +
tcatatattgtttccaatgagc

SEQ ID NO: 76899 - DNA, 22 bp, Artificial Sequence
  Synthetic oligonucleotide; TTG chr11 5186609 5186630 5186626 5186631 +
tttccaatgagccattggcaaa

SEQ ID NO: 76900 - DNA, 22 bp, Artificial Sequence
  Synthetic oligonucleotide; TTT chr11 5186612 5186633 5186629 5186634 +
ccaatgagccattggcaaatat

SEQ ID NO: 76901 - DNA, 22 bp, Artificial Sequence
  Synthetic oligonucleotide; TTC chr11 5186613 5186634 5186630 5186635 +
caatgagccattggcaaatata

SEQ ID NO: 76902 - DNA, 22 bp, Artificial Sequence
  Synthetic oligonucleotide; TTG chr11 5186626 5186647 5186643 5186648 +
gcaaatataggttgcaaaggag

SEQ ID NO: 76903 - DNA, 22 bp, Artificial Sequence
  Synthetic oligonucleotide; TTG chr11 5186640 5186661 5186657 5186662 +
caaaggagacatgtgggagaag

SEQ ID NO: 76904 - DNA, 22 bp, Artificial Sequence
  Synthetic oligonucleotide; CTT chr11 5186667 5186688 5186684 5186689 +
tacacatcttagatggcaccta

SEQ ID NO: 76905 - DNA, 22 bp, Artificial Sequence
  Synthetic oligonucleotide; TTT chr11 5186668 5186689 5186685 5186690 +
acacatcttagatggcacctaa

SEQ ID NO: 76906 - DNA, 22 bp, Artificial Sequence
  Synthetic oligonucleotide; TTA chr11 5186669 5186690 5186686 5186691 +
cacatcttagatggcacctaaa

SEQ ID NO: 76907 - DNA, 22 bp, Artificial Sequence
  Synthetic oligonucleotide; CTT chr11 5186677 5186698 5186694 5186699 +
agatggcacctaaaagttaatt

SEQ ID NO: 76908 - DNA, 22 bp, Artificial Sequence
  Synthetic oligonucleotide; TTA chr11 5186678 5186699 5186695 5186700 +
gatggcacctaaaagttaattc

SEQ ID NO: 76909 - DNA, 22 bp, Artificial Sequence
  Synthetic oligonucleotide; CTA chr11 5186689 5186710 5186706 5186711 +
aaagttaattctctcattttat

SEQ ID NO: 76910 - DNA, 22 bp, Artificial Sequence
  Synthetic oligonucleotide; TTA chr11 5186696 5186717 5186713 5186718 +
attctctcattttatttccctt

SEQ ID NO: 76911 - DNA, 22 bp, Artificial Sequence
  Synthetic oligonucleotide; TTC chr11 5186700 5186721 5186717 5186722 +
tctcattttatttccctttaat

SEQ ID NO: 76912 - DNA, 22 bp, Artificial Sequence
  Synthetic oligonucleotide; CTC chr11 5186702 5186723 5186719 5186724 +
tcattttatttccctttaattt

SEQ ID NO: 76913 - DNA, 22 bp, Artificial Sequence
  Synthetic oligonucleotide; CTC chr11 5186704 5186725 5186721 5186726 +
attttatttccctttaattttt

SEQ ID NO: 76914 - DNA, 22 bp, Artificial Sequence
  Synthetic oligonucleotide; TTT chr11 5186708 5186729 5186725 5186730 +
tatttccctttaatttttaagg

SEQ ID NO: 76915 - DNA, 22 bp, Artificial Sequence
  Synthetic oligonucleotide; TTT chr11 5186709 5186730 5186726 5186731 +
atttccctttaatttttaaggt

SEQ ID NO: 76916 - DNA, 22 bp, Artificial Sequence
  Synthetic oligonucleotide; TTA chr11 5186710 5186731 5186727 5186732 +
tttccctttaatttttaaggtt

SEQ ID NO: 76917 - DNA, 22 bp, Artificial Sequence
  Synthetic oligonucleotide; TTT chr11 5186713 5186734 5186730 5186735 +
ccctttaatttttaaggttcta

SEQ ID NO: 76918 - DNA, 22 bp, Artificial Sequence
  Synthetic oligonucleotide; TTC chr11 5186714 5186735 5186731 5186736 +
cctttaatttttaaggttctat

SEQ ID NO: 76919 - DNA, 22 bp, Artificial Sequence
  Synthetic oligonucleotide; CTT chr11 5186718 5186739 5186735 5186740 +
taatttttaaggttctattgct

SEQ ID NO: 76920 - DNA, 22 bp, Artificial Sequence
  Synthetic oligonucleotide; TTT chr11 5186719 5186740 5186736 5186741 +
aatttttaaggttctattgctt

SEQ ID NO: 76921 - DNA, 22 bp, Artificial Sequence
  Synthetic oligonucleotide; TTA chr11 5186720 5186741 5186737 5186742 +
atttttaaggttctattgcttt

SEQ ID NO: 76922 - DNA, 22 bp, Artificial Sequence
  Synthetic oligonucleotide; TTT chr11 5186724 5186745 5186741 5186746 +
ttaaggttctattgctttccct

SEQ ID NO: 76923 - DNA, 22 bp, Artificial Sequence
  Synthetic oligonucleotide; TTT chr11 5186725 5186746 5186742 5186747 +
taaggttctattgctttccctg

SEQ ID NO: 76924 - DNA, 22 bp, Artificial Sequence
  Synthetic oligonucleotide; TTT chr11 5186726 5186747 5186743 5186748 +
aaggttctattgctttccctgc

SEQ ID NO: 76925 - DNA, 22 bp, Artificial Sequence
  Synthetic oligonucleotide; TTA chr11 5186727 5186748 5186744 5186749 +
aggttctattgctttccctgct

SEQ ID NO: 76926 - DNA, 22 bp, Artificial Sequence
  Synthetic oligonucleotide; TTC chr11 5186733 5186754 5186750 5186755 +
tattgctttccctgctttttct

SEQ ID NO: 76927 - DNA, 22 bp, Artificial Sequence
  Synthetic oligonucleotide; CTA chr11 5186735 5186756 5186752 5186757 +
ttgctttccctgctttttcttg

SEQ ID NO: 76928 - DNA, 22 bp, Artificial Sequence
  Synthetic oligonucleotide; TTG chr11 5186738 5186759 5186755 5186760 +
ctttccctgctttttcttggtc

SEQ ID NO: 76929 - DNA, 22 bp, Artificial Sequence
  Synthetic oligonucleotide; CTT chr11 5186741 5186762 5186758 5186763 +
tccctgctttttcttggtcaca

SEQ ID NO: 76930 - DNA, 22 bp, Artificial Sequence
  Synthetic oligonucleotide; TTT chr11 5186742 5186763 5186759 5186764 +
ccctgctttttcttggtcacat

SEQ ID NO: 76931 - DNA, 22 bp, Artificial Sequence
  Synthetic oligonucleotide; TTC chr11 5186743 5186764 5186760 5186765 +
cctgctttttcttggtcacatg

SEQ ID NO: 76932 - DNA, 22 bp, Artificial Sequence
  Synthetic oligonucleotide; CTG chr11 5186747 5186768 5186764 5186769 +
ctttttcttggtcacatggtaa

SEQ ID NO: 76933 - DNA, 22 bp, Artificial Sequence
  Synthetic oligonucleotide; CTT chr11 5186750 5186771 5186767 5186772 +
tttcttggtcacatggtaaatg

SEQ ID NO: 76934 - DNA, 22 bp, Artificial Sequence
  Synthetic oligonucleotide; TTT chr11 5186751 5186772 5186768 5186773 +
ttcttggtcacatggtaaatgg

SEQ ID NO: 76935 - DNA, 22 bp, Artificial Sequence
  Synthetic oligonucleotide; TTT chr11 5186752 5186773 5186769 5186774 +
tcttggtcacatggtaaatggg

SEQ ID NO: 76936 - DNA, 22 bp, Artificial Sequence
  Synthetic oligonucleotide; TTT chr11 5186753 5186774 5186770 5186775 +
cttggtcacatggtaaatgggt

SEQ ID NO: 76937 - DNA, 22 bp, Artificial Sequence
  Synthetic oligonucleotide; TTC chr11 5186754 5186775 5186771 5186776 +
ttggtcacatggtaaatgggtc

SEQ ID NO: 76938 - DNA, 22 bp, Artificial Sequence
  Synthetic oligonucleotide; CTT chr11 5186756 5186777 5186773 5186778 +
ggtcacatggtaaatgggtcag

SEQ ID NO: 76939 - DNA, 22 bp, Artificial Sequence
  Synthetic oligonucleotide; TTG chr11 5186757 5186778 5186774 5186779 +
gtcacatggtaaatgggtcaga

SEQ ID NO: 76940 - DNA, 22 bp, Artificial Sequence
  Synthetic oligonucleotide; CTG chr11 5186784 5186805 5186801 5186806 +
aagggccaagaaattatattag

SEQ ID NO: 76941 - DNA, 22 bp, Artificial Sequence
  Synthetic oligonucleotide; TTA chr11 5186800 5186821 5186817 5186822 +
tattagctactgtagatatccc

SEQ ID NO: 76942 - DNA, 22 bp, Artificial Sequence
  Synthetic oligonucleotide; TTA chr11 5186805 5186826 5186822 5186827 +
gctactgtagatatcccattct

SEQ ID NO: 76943 - DNA, 22 bp, Artificial Sequence
  Synthetic oligonucleotide; CTA chr11 5186809 5186830 5186826 5186831 +
ctgtagatatcccattctcttg

SEQ ID NO: 76944 - DNA, 22 bp, Artificial Sequence
  Synthetic oligonucleotide; CTG chr11 5186812 5186833 5186829 5186834 +
tagatatcccattctcttgaag

SEQ ID NO: 76945 - DNA, 22 bp, Artificial Sequence
  Synthetic oligonucleotide; TTC chr11 5186826 5186847 5186843 5186848 +
tcttgaaggatactttaatgag

SEQ ID NO: 76946 - DNA, 22 bp, Artificial Sequence
  Synthetic oligonucleotide; CTC chr11 5186828 5186849 5186845 5186850 +
ttgaaggatactttaatgagga

SEQ ID NO: 76947 - DNA, 22 bp, Artificial Sequence
  Synthetic oligonucleotide; CTT chr11 5186830 5186851 5186847 5186852 +
gaaggatactttaatgaggaat

SEQ ID NO: 76948 - DNA, 22 bp, Artificial Sequence
  Synthetic oligonucleotide; TTG chr11 5186831 5186852 5186848 5186853 +
aaggatactttaatgaggaata

SEQ ID NO: 76949 - DNA, 22 bp, Artificial Sequence
  Synthetic oligonucleotide; CTT chr11 5186841 5186862 5186858 5186863 +
taatgaggaatacagatgaaga

SEQ ID NO: 76950 - DNA, 22 bp, Artificial Sequence
  Synthetic oligonucleotide; TTT chr11 5186842 5186863 5186859 5186864 +
aatgaggaatacagatgaagat

SEQ ID NO: 76951 - DNA, 22 bp, Artificial Sequence
  Synthetic oligonucleotide; TTA chr11 5186843 5186864 5186860 5186865 +
atgaggaatacagatgaagata

SEQ ID NO: 76952 - DNA, 22 bp, Artificial Sequence
  Synthetic oligonucleotide; TTC chr11 5186894 5186915 5186911 5186916 +
atggaattaaaaactggcttca

SEQ ID NO: 76953 - DNA, 22 bp, Artificial Sequence
  Synthetic oligonucleotide; TTA chr11 5186903 5186924 5186920 5186925 +
aaaactggcttcacactgataa

SEQ ID NO: 76954 - DNA, 22 bp, Artificial Sequence
  Synthetic oligonucleotide; CTG chr11 5186910 5186931 5186927 5186932 +
gcttcacactgataagccagat

SEQ ID NO: 76955 - DNA, 22 bp, Artificial Sequence
  Synthetic oligonucleotide; CTT chr11 5186914 5186935 5186931 5186936 +
cacactgataagccagatttat

SEQ ID NO: 76956 - DNA, 22 bp, Artificial Sequence
  Synthetic oligonucleotide; TTC chr11 5186915 5186936 5186932 5186937 +
acactgataagccagatttatg

SEQ ID NO: 76957 - DNA, 22 bp, Artificial Sequence
  Synthetic oligonucleotide; CTG chr11 5186921 5186942 5186938 5186943 +
ataagccagatttatggagaga

SEQ ID NO: 76958 - DNA, 22 bp, Artificial Sequence
  Synthetic oligonucleotide; TTT chr11 5186934 5186955 5186951 5186956 +
atggagagagatgtttccttat

SEQ ID NO: 76959 - DNA, 22 bp, Artificial Sequence
  Synthetic oligonucleotide; TTA chr11 5186935 5186956 5186952 5186957 +
tggagagagatgtttccttatt

SEQ ID NO: 76960 - DNA, 22 bp, Artificial Sequence
  Synthetic oligonucleotide; TTT chr11 5186950 5186971 5186967 5186972 +
ccttattctctcaagtggagcc

SEQ ID NO: 76961 - DNA, 22 bp, Artificial Sequence
  Synthetic oligonucleotide; TTC chr11 5186951 5186972 5186968 5186973 +
cttattctctcaagtggagcct

SEQ ID NO: 76962 - DNA, 22 bp, Artificial Sequence
  Synthetic oligonucleotide; CTT chr11 5186954 5186975 5186971 5186976 +
attctctcaagtggagccttcc

SEQ ID NO: 76963 - DNA, 22 bp, Artificial Sequence
  Synthetic oligonucleotide; TTA chr11 5186955 5186976 5186972 5186977 +
ttctctcaagtggagccttcca

SEQ ID NO: 76964 - DNA, 22 bp, Artificial Sequence
  Synthetic oligonucleotide; TTC chr11 5186958 5186979 5186975 5186980 +
tctcaagtggagccttccatat

SEQ ID NO: 76965 - DNA, 22 bp, Artificial Sequence
  Synthetic oligonucleotide; CTC chr11 5186960 5186981 5186977 5186982 +
tcaagtggagccttccatatat

SEQ ID NO: 76966 - DNA, 22 bp, Artificial Sequence
  Synthetic oligonucleotide; CTC chr11 5186962 5186983 5186979 5186984 +
aagtggagccttccatatatct

SEQ ID NO: 76967 - DNA, 22 bp, Artificial Sequence
  Synthetic oligonucleotide; CTT chr11 5186974 5186995 5186991 5186996 +
ccatatatctgtgattttctga

SEQ ID NO: 76968 - DNA, 22 bp, Artificial Sequence
  Synthetic oligonucleotide; TTC chr11 5186975 5186996 5186992 5186997 +
catatatctgtgattttctgat

SEQ ID NO: 76969 - DNA, 22 bp, Artificial Sequence
  Synthetic oligonucleotide; CTG chr11 5186985 5187006 5187002 5187007 +
tgattttctgatatttttcaaa

SEQ ID NO: 76970 - DNA, 22 bp, Artificial Sequence
  Synthetic oligonucleotide; TTT chr11 5186991 5187012 5187008 5187013 +
tctgatatttttcaaagaatcc

SEQ ID NO: 76971 - DNA, 22 bp, Artificial Sequence
  Synthetic oligonucleotide; TTT chr11 5186992 5187013 5187009 5187014 +
ctgatatttttcaaagaatccc

SEQ ID NO: 76972 - DNA, 22 bp, Artificial Sequence
  Synthetic oligonucleotide; TTC chr11 5186993 5187014 5187010 5187015 +
tgatatttttcaaagaatccct

SEQ ID NO: 76973 - DNA, 22 bp, Artificial Sequence
  Synthetic oligonucleotide; CTG chr11 5186995 5187016 5187012 5187017 +
atatttttcaaagaatccctag

SEQ ID NO: 76974 - DNA, 22 bp, Artificial Sequence
  Synthetic oligonucleotide; TTT chr11 5187001 5187022 5187018 5187023 +
ttcaaagaatccctagaagctt

SEQ ID NO: 76975 - DNA, 22 bp, Artificial Sequence
  Synthetic oligonucleotide; TTT chr11 5187002 5187023 5187019 5187024 +
tcaaagaatccctagaagcttt

SEQ ID NO: 76976 - DNA, 22 bp, Artificial Sequence
  Synthetic oligonucleotide; TTT chr11 5187003 5187024 5187020 5187025 +
caaagaatccctagaagctttt

SEQ ID NO: 76977 - DNA, 22 bp, Artificial Sequence
  Synthetic oligonucleotide; TTC chr11 5187004 5187025 5187021 5187026 +
aaagaatccctagaagcttttt

SEQ ID NO: 76978 - DNA, 22 bp, Artificial Sequence
  Synthetic oligonucleotide; CTA chr11 5187016 5187037 5187033 5187038 +
gaagcttttttcacctatagta

SEQ ID NO: 76979 - DNA, 22 bp, Artificial Sequence
  Synthetic oligonucleotide; CTT chr11 5187023 5187044 5187040 5187045 +
ttttcacctatagtagtaaaac

SEQ ID NO: 76980 - DNA, 22 bp, Artificial Sequence
  Synthetic oligonucleotide; TTT chr11 5187024 5187045 5187041 5187046 +
tttcacctatagtagtaaaact

SEQ ID NO: 76981 - DNA, 22 bp, Artificial Sequence
  Synthetic oligonucleotide; TTT chr11 5187025 5187046 5187042 5187047 +
ttcacctatagtagtaaaactt

SEQ ID NO: 76982 - DNA, 22 bp, Artificial Sequence
  Synthetic oligonucleotide; TTT chr11 5187026 5187047 5187043 5187048 +
tcacctatagtagtaaaactta

SEQ ID NO: 76983 - DNA, 22 bp, Artificial Sequence
  Synthetic oligonucleotide; TTT chr11 5187027 5187048 5187044 5187049 +
cacctatagtagtaaaacttag

SEQ ID NO: 76984 - DNA, 22 bp, Artificial Sequence
  Synthetic oligonucleotide; TTC chr11 5187028 5187049 5187045 5187050 +
acctatagtagtaaaacttagt

SEQ ID NO: 76985 - DNA, 22 bp, Artificial Sequence
  Synthetic oligonucleotide; CTA chr11 5187033 5187054 5187050 5187055 +
tagtagtaaaacttagtaaaaa

SEQ ID NO: 76986 - DNA, 22 bp, Artificial Sequence
  Synthetic oligonucleotide; CTT chr11 5187047 5187068 5187064 5187069 +
agtaaaaaaaaatagtaaaact

SEQ ID NO: 76987 - DNA, 22 bp, Artificial Sequence
  Synthetic oligonucleotide; TTA chr11 5187048 5187069 5187065 5187070 +
gtaaaaaaaaatagtaaaactt

SEQ ID NO: 76988 - DNA, 22 bp, Artificial Sequence
  Synthetic oligonucleotide; CTT chr11 5187070 5187091 5187087 5187092 +
ccctataaatatgatgtttgac

SEQ ID NO: 76989 - DNA, 22 bp, Artificial Sequence
  Synthetic oligonucleotide; TTC chr11 5187071 5187092 5187088 5187093 +
cctataaatatgatgtttgaca

SEQ ID NO: 76990 - DNA, 22 bp, Artificial Sequence
  Synthetic oligonucleotide; CTA chr11 5187075 5187096 5187092 5187097 +
taaatatgatgtttgacatcag

SEQ ID NO: 76991 - DNA, 22 bp, Artificial Sequence
  Synthetic oligonucleotide; TTT chr11 5187089 5187110 5187106 5187111 +
gacatcagctgaccctgactgg

SEQ ID NO: 76992 - DNA, 22 bp, Artificial Sequence
  Synthetic oligonucleotide; TTG chr11 5187090 5187111 5187107 5187112 +
acatcagctgaccctgactgga

SEQ ID NO: 76993 - DNA, 22 bp, Artificial Sequence
  Synthetic oligonucleotide; CTG chr11 5187100 5187121 5187117 5187122 +
accctgactggatgatcttgat

SEQ ID NO: 76994 - DNA, 22 bp, Artificial Sequence
  Synthetic oligonucleotide; CTG chr11 5187106 5187127 5187123 5187128 +
actggatgatcttgattggatg

SEQ ID NO: 76995 - DNA, 22 bp, Artificial Sequence
  Synthetic oligonucleotide; CTG chr11 5187110 5187131 5187127 5187132 +
gatgatcttgattggatgctag

SEQ ID NO: 76996 - DNA, 22 bp, Artificial Sequence
  Synthetic oligonucleotide; CTT chr11 5187119 5187140 5187136 5187141 +
gattggatgctaggcaagtgcc

SEQ ID NO: 76997 - DNA, 22 bp, Artificial Sequence
  Synthetic oligonucleotide; TTG chr11 5187120 5187141 5187137 5187142 +
attggatgctaggcaagtgccc

SEQ ID NO: 76998 - DNA, 22 bp, Artificial Sequence
  Synthetic oligonucleotide; TTG chr11 5187124 5187145 5187141 5187146 +
gatgctaggcaagtgcccaggt

SEQ ID NO: 76999 - DNA, 22 bp, Artificial Sequence
  Synthetic oligonucleotide; CTA chr11 5187131 5187152 5187148 5187153 +
ggcaagtgcccaggtcctccaa

SEQ ID NO: 77000 - DNA, 22 bp, Artificial Sequence
  Synthetic oligonucleotide; CTC chr11 5187150 5187171 5187167 5187172 +
caatcagtcatctaggcatctt

SEQ ID NO: 77001 - DNA, 22 bp, Artificial Sequence
  Synthetic oligonucleotide; CTA chr11 5187164 5187185 5187181 5187186 +
ggcatcttagttctcactggct

SEQ ID NO: 77002 - DNA, 22 bp, Artificial Sequence
  Synthetic oligonucleotide; CTT chr11 5187172 5187193 5187189 5187194 +
agttctcactggctaagagagg

SEQ ID NO: 77003 - DNA, 22 bp, Artificial Sequence
  Synthetic oligonucleotide; TTA chr11 5187173 5187194 5187190 5187195 +
gttctcactggctaagagaggt

SEQ ID NO: 77004 - DNA, 22 bp, Artificial Sequence
  Synthetic oligonucleotide; TTC chr11 5187177 5187198 5187194 5187199 +
tcactggctaagagaggtcata

SEQ ID NO: 77005 - DNA, 22 bp, Artificial Sequence
  Synthetic oligonucleotide; CTC chr11 5187179 5187200 5187196 5187201 +
actggctaagagaggtcatatt

SEQ ID NO: 77006 - DNA, 22 bp, Artificial Sequence
  Synthetic oligonucleotide; CTG chr11 5187183 5187204 5187200 5187205 +
gctaagagaggtcatattttat

SEQ ID NO: 77007 - DNA, 22 bp, Artificial Sequence
  Synthetic oligonucleotide; CTA chr11 5187187 5187208 5187204 5187209 +
agagaggtcatattttattacg

SEQ ID NO: 77008 - DNA, 22 bp, Artificial Sequence
  Synthetic oligonucleotide; TTT chr11 5187202 5187223 5187219 5187224 +
tattacgtaagtgtgagtgcta

SEQ ID NO: 77009 - DNA, 22 bp, Artificial Sequence
  Synthetic oligonucleotide; TTT chr11 5187203 5187224 5187220 5187225 +
attacgtaagtgtgagtgctat

SEQ ID NO: 77010 - DNA, 22 bp, Artificial Sequence
  Synthetic oligonucleotide; TTA chr11 5187204 5187225 5187221 5187226 +
ttacgtaagtgtgagtgctata

SEQ ID NO: 77011 - DNA, 22 bp, Artificial Sequence
  Synthetic oligonucleotide; TTA chr11 5187207 5187228 5187224 5187229 +
cgtaagtgtgagtgctatatgg

SEQ ID NO: 77012 - DNA, 22 bp, Artificial Sequence
  Synthetic oligonucleotide; CTA chr11 5187224 5187245 5187241 5187246 +
tatggtgggagatataagaatt

SEQ ID NO: 77013 - DNA, 22 bp, Artificial Sequence
  Synthetic oligonucleotide; TTA chr11 5187247 5187268 5187264 5187269 +
tcacatgcatttcaagtgcttt

SEQ ID NO: 77014 - DNA, 22 bp, Artificial Sequence
  Synthetic oligonucleotide; TTT chr11 5187259 5187280 5187276 5187281 +
caagtgctttccattcaaaggt

SEQ ID NO: 77015 - DNA, 22 bp, Artificial Sequence
  Synthetic oligonucleotide; TTC chr11 5187260 5187281 5187277 5187282 +
aagtgctttccattcaaaggtc

SEQ ID NO: 77016 - DNA, 22 bp, Artificial Sequence
  Synthetic oligonucleotide; CTT chr11 5187268 5187289 5187285 5187290 +
tccattcaaaggtcttgaaacc

SEQ ID NO: 77017 - DNA, 22 bp, Artificial Sequence
  Synthetic oligonucleotide; TTT chr11 5187269 5187290 5187286 5187291 +
ccattcaaaggtcttgaaacca

SEQ ID NO: 77018 - DNA, 22 bp, Artificial Sequence
  Synthetic oligonucleotide; TTC chr11 5187270 5187291 5187287 5187292 +
cattcaaaggtcttgaaaccat

SEQ ID NO: 77019 - DNA, 22 bp, Artificial Sequence
  Synthetic oligonucleotide; TTC chr11 5187275 5187296 5187292 5187297 +
aaaggtcttgaaaccatagtga

SEQ ID NO: 77020 - DNA, 22 bp, Artificial Sequence
  Synthetic oligonucleotide; CTT chr11 5187284 5187305 5187301 5187306 +
gaaaccatagtgagggtaaatt

SEQ ID NO: 77021 - DNA, 22 bp, Artificial Sequence
  Synthetic oligonucleotide; TTG chr11 5187285 5187306 5187302 5187307 +
aaaccatagtgagggtaaattg

SEQ ID NO: 77022 - DNA, 22 bp, Artificial Sequence
  Synthetic oligonucleotide; TTG chr11 5187307 5187328 5187324 5187329 +
gatggcttcaccttgctttttt

SEQ ID NO: 77023 - DNA, 22 bp, Artificial Sequence
  Synthetic oligonucleotide; CTT chr11 5187315 5187336 5187332 5187337 +
caccttgcttttttagacatta

SEQ ID NO: 77024 - DNA, 22 bp, Artificial Sequence
  Synthetic oligonucleotide; TTC chr11 5187316 5187337 5187333 5187338 +
accttgcttttttagacattaa

SEQ ID NO: 77025 - DNA, 22 bp, Artificial Sequence
  Synthetic oligonucleotide; CTT chr11 5187321 5187342 5187338 5187343 +
gcttttttagacattaaagaaa

SEQ ID NO: 77026 - DNA, 22 bp, Artificial Sequence
  Synthetic oligonucleotide; TTG chr11 5187322 5187343 5187339 5187344 +
cttttttagacattaaagaaag

SEQ ID NO: 77027 - DNA, 22 bp, Artificial Sequence
  Synthetic oligonucleotide; CTT chr11 5187325 5187346 5187342 5187347 +
ttttagacattaaagaaaggac

SEQ ID NO: 77028 - DNA, 22 bp, Artificial Sequence
  Synthetic oligonucleotide; TTT chr11 5187326 5187347 5187343 5187348 +
tttagacattaaagaaaggaca

SEQ ID NO: 77029 - DNA, 22 bp, Artificial Sequence
  Synthetic oligonucleotide; TTT chr11 5187327 5187348 5187344 5187349 +
ttagacattaaagaaaggacag

SEQ ID NO: 77030 - DNA, 22 bp, Artificial Sequence
  Synthetic oligonucleotide; TTT chr11 5187328 5187349 5187345 5187350 +
tagacattaaagaaaggacagt

SEQ ID NO: 77031 - DNA, 22 bp, Artificial Sequence
  Synthetic oligonucleotide; TTT chr11 5187329 5187350 5187346 5187351 +
agacattaaagaaaggacagta

SEQ ID NO: 77032 - DNA, 22 bp, Artificial Sequence
  Synthetic oligonucleotide; TTA chr11 5187330 5187351 5187347 5187352 +
gacattaaagaaaggacagtac

SEQ ID NO: 77033 - DNA, 22 bp, Artificial Sequence
  Synthetic oligonucleotide; TTA chr11 5187337 5187358 5187354 5187359 +
aagaaaggacagtacttatctt

SEQ ID NO: 77034 - DNA, 22 bp, Artificial Sequence
  Synthetic oligonucleotide; CTT chr11 5187354 5187375 5187371 5187376 +
atcttcccacctatccttggaa

SEQ ID NO: 77035 - DNA, 22 bp, Artificial Sequence
  Synthetic oligonucleotide; TTA chr11 5187355 5187376 5187372 5187377 +
tcttcccacctatccttggaaa

SEQ ID NO: 77036 - DNA, 22 bp, Artificial Sequence
  Synthetic oligonucleotide; CTT chr11 5187359 5187380 5187376 5187381 +
cccacctatccttggaaaagaa

SEQ ID NO: 77037 - DNA, 22 bp, Artificial Sequence
  Synthetic oligonucleotide; TTC chr11 5187360 5187381 5187377 5187382 +
ccacctatccttggaaaagaaa

SEQ ID NO: 77038 - DNA, 22 bp, Artificial Sequence
  Synthetic oligonucleotide; CTA chr11 5187367 5187388 5187384 5187389 +
tccttggaaaagaaattaaagg

SEQ ID NO: 77039 - DNA, 22 bp, Artificial Sequence
  Synthetic oligonucleotide; CTT chr11 5187372 5187393 5187389 5187394 +
ggaaaagaaattaaaggaatca

SEQ ID NO: 77040 - DNA, 22 bp, Artificial Sequence
  Synthetic oligonucleotide; TTG chr11 5187373 5187394 5187390 5187395 +
gaaaagaaattaaaggaatcaa

SEQ ID NO: 77041 - DNA, 22 bp, Artificial Sequence
  Synthetic oligonucleotide; TTA chr11 5187385 5187406 5187402 5187407 +
aaggaatcaaaggatattatag

SEQ ID NO: 77042 - DNA, 22 bp, Artificial Sequence
  Synthetic oligonucleotide; TTA chr11 5187404 5187425 5187421 5187426 +
tagaaaaagagatggagaaagg

SEQ ID NO: 77043 - DNA, 22 bp, Artificial Sequence
  Synthetic oligonucleotide; TTT chr11 5187439 5187460 5187456 5187461 +
aggggacaacagaaattgatgt

SEQ ID NO: 77044 - DNA, 22 bp, Artificial Sequence
  Synthetic oligonucleotide; TTA chr11 5187440 5187461 5187457 5187462 +
ggggacaacagaaattgatgtc

SEQ ID NO: 77045 - DNA, 22 bp, Artificial Sequence
  Synthetic oligonucleotide; TTG chr11 5187457 5187478 5187474 5187479 +
atgtctgcatctgactacctga

SEQ ID NO: 77046 - DNA, 22 bp, Artificial Sequence
  Synthetic oligonucleotide; CTG chr11 5187464 5187485 5187481 5187486 +
catctgactacctgatagtgac

SEQ ID NO: 77047 - DNA, 22 bp, Artificial Sequence
  Synthetic oligonucleotide; CTG chr11 5187470 5187491 5187487 5187492 +
actacctgatagtgacaggaag

SEQ ID NO: 77048 - DNA, 22 bp, Artificial Sequence
  Synthetic oligonucleotide; CTA chr11 5187474 5187495 5187491 5187496 +
cctgatagtgacaggaagaaca

SEQ ID NO: 77049 - DNA, 22 bp, Artificial Sequence
  Synthetic oligonucleotide; CTG chr11 5187478 5187499 5187495 5187500 +
atagtgacaggaagaacaaaga

SEQ ID NO: 77050 - DNA, 22 bp, Artificial Sequence
  Synthetic oligonucleotide; CTC chr11 5187522 5187543 5187539 5187544 +
tgctgataacttattataatgt

SEQ ID NO: 77051 - DNA, 22 bp, Artificial Sequence
  Synthetic oligonucleotide; CTG chr11 5187524 5187545 5187541 5187546 +
ctgataacttattataatgttt

SEQ ID NO: 77052 - DNA, 22 bp, Artificial Sequence
  Synthetic oligonucleotide; CTG chr11 5187527 5187548 5187544 5187549 +
ataacttattataatgttttta

SEQ ID NO: 77053 - DNA, 22 bp, Artificial Sequence
  Synthetic oligonucleotide; CTT chr11 5187534 5187555 5187551 5187556 +
attataatgtttttaaatctgg

SEQ ID NO: 77054 - DNA, 22 bp, Artificial Sequence
  Synthetic oligonucleotide; TTA chr11 5187535 5187556 5187552 5187557 +
ttataatgtttttaaatctggg

SEQ ID NO: 77055 - DNA, 22 bp, Artificial Sequence
  Synthetic oligonucleotide; TTA chr11 5187538 5187559 5187555 5187560 +
taatgtttttaaatctggggac

SEQ ID NO: 77056 - DNA, 22 bp, Artificial Sequence
  Synthetic oligonucleotide; TTT chr11 5187546 5187567 5187563 5187568 +
ttaaatctggggactctaaaac

SEQ ID NO: 77057 - DNA, 22 bp, Artificial Sequence
  Synthetic oligonucleotide; TTT chr11 5187547 5187568 5187564 5187569 +
taaatctggggactctaaaact

SEQ ID NO: 77058 - DNA, 22 bp, Artificial Sequence
  Synthetic oligonucleotide; TTT chr11 5187548 5187569 5187565 5187570 +
aaatctggggactctaaaactt

SEQ ID NO: 77059 - DNA, 22 bp, Artificial Sequence
  Synthetic oligonucleotide; TTA chr11 5187549 5187570 5187566 5187571 +
aatctggggactctaaaacttg

SEQ ID NO: 77060 - DNA, 22 bp, Artificial Sequence
  Synthetic oligonucleotide; CTG chr11 5187555 5187576 5187572 5187577 +
gggactctaaaacttgaagaat

SEQ ID NO: 77061 - DNA, 22 bp, Artificial Sequence
  Synthetic oligonucleotide; CTC chr11 5187562 5187583 5187579 5187584 +
taaaacttgaagaatttttttt

SEQ ID NO: 77062 - DNA, 22 bp, Artificial Sequence
  Synthetic oligonucleotide; CTA chr11 5187564 5187585 5187581 5187586 +
aaacttgaagaatttttttttg

SEQ ID NO: 77063 - DNA, 22 bp, Artificial Sequence
  Synthetic oligonucleotide; CTT chr11 5187570 5187591 5187587 5187592 +
gaagaatttttttttgagcaaa

SEQ ID NO: 77064 - DNA, 22 bp, Artificial Sequence
  Synthetic oligonucleotide; TTG chr11 5187571 5187592 5187588 5187593 +
aagaatttttttttgagcaaat

SEQ ID NO: 77065 - DNA, 22 bp, Artificial Sequence
  Synthetic oligonucleotide; TTT chr11 5187579 5187600 5187596 5187601 +
ttttttgagcaaatgttttcag

SEQ ID NO: 77066 - DNA, 22 bp, Artificial Sequence
  Synthetic oligonucleotide; TTT chr11 5187580 5187601 5187597 5187602 +
tttttgagcaaatgttttcagt

SEQ ID NO: 77067 - DNA, 22 bp, Artificial Sequence
  Synthetic oligonucleotide; TTT chr11 5187581 5187602 5187598 5187603 +
ttttgagcaaatgttttcagta

SEQ ID NO: 77068 - DNA, 22 bp, Artificial Sequence
  Synthetic oligonucleotide; TTT chr11 5187582 5187603 5187599 5187604 +
tttgagcaaatgttttcagtaa

SEQ ID NO: 77069 - DNA, 22 bp, Artificial Sequence
  Synthetic oligonucleotide; TTT chr11 5187583 5187604 5187600 5187605 +
ttgagcaaatgttttcagtaaa

SEQ ID NO: 77070 - DNA, 22 bp, Artificial Sequence
  Synthetic oligonucleotide; TTT chr11 5187584 5187605 5187601 5187606 +
tgagcaaatgttttcagtaaat

SEQ ID NO: 77071 - DNA, 22 bp, Artificial Sequence
  Synthetic oligonucleotide; TTT chr11 5187585 5187606 5187602 5187607 +
gagcaaatgttttcagtaaata

SEQ ID NO: 77072 - DNA, 22 bp, Artificial Sequence
  Synthetic oligonucleotide; TTG chr11 5187586 5187607 5187603 5187608 +
agcaaatgttttcagtaaataa

SEQ ID NO: 77073 - DNA, 22 bp, Artificial Sequence
  Synthetic oligonucleotide; TTT chr11 5187597 5187618 5187614 5187619 +
tcagtaaataatgatttctgat

SEQ ID NO: 77074 - DNA, 22 bp, Artificial Sequence
  Synthetic oligonucleotide; TTT chr11 5187598 5187619 5187615 5187620 +
cagtaaataatgatttctgata

SEQ ID NO: 77075 - DNA, 22 bp, Artificial Sequence
  Synthetic oligonucleotide; TTC chr11 5187599 5187620 5187616 5187621 +
agtaaataatgatttctgataa

SEQ ID NO: 77076 - DNA, 22 bp, Artificial Sequence
  Synthetic oligonucleotide; TTT chr11 5187614 5187635 5187631 5187636 +
ctgataaatataatatgcaaga

SEQ ID NO: 77077 - DNA, 22 bp, Artificial Sequence
  Synthetic oligonucleotide; TTC chr11 5187615 5187636 5187632 5187637 +
tgataaatataatatgcaagag

SEQ ID NO: 77078 - DNA, 22 bp, Artificial Sequence
  Synthetic oligonucleotide; CTG chr11 5187617 5187638 5187634 5187639 +
ataaatataatatgcaagaggg

SEQ ID NO: 77079 - DNA, 22 bp, Artificial Sequence
  Synthetic oligonucleotide; CTA chr11 5187654 5187675 5187671 5187676 +
cggctgctgtgatacaagtacc

SEQ ID NO: 77080 - DNA, 22 bp, Artificial Sequence
  Synthetic oligonucleotide; CTG chr11 5187660 5187681 5187677 5187682 +
ctgtgatacaagtaccatgtta

SEQ ID NO: 77081 - DNA, 22 bp, Artificial Sequence
  Synthetic oligonucleotide; CTG chr11 5187663 5187684 5187680 5187685 +
tgatacaagtaccatgttacta

SEQ ID NO: 77082 - DNA, 22 bp, Artificial Sequence
  Synthetic oligonucleotide; TTA chr11 5187682 5187703 5187699 5187704 +
ctactttaaaacacaccttcag

SEQ ID NO: 77083 - DNA, 22 bp, Artificial Sequence
  Synthetic oligonucleotide; CTA chr11 5187685 5187706 5187702 5187707 +
ctttaaaacacaccttcagcaa

SEQ ID NO: 77084 - DNA, 22 bp, Artificial Sequence
  Synthetic oligonucleotide; CTT chr11 5187688 5187709 5187705 5187710 +
taaaacacaccttcagcaatat

SEQ ID NO: 77085 - DNA, 22 bp, Artificial Sequence
  Synthetic oligonucleotide; TTT chr11 5187689 5187710 5187706 5187711 +
aaaacacaccttcagcaatatt

SEQ ID NO: 77086 - DNA, 22 bp, Artificial Sequence
  Synthetic oligonucleotide; TTA chr11 5187690 5187711 5187707 5187712 +
aaacacaccttcagcaatattc

SEQ ID NO: 77087 - DNA, 22 bp, Artificial Sequence
  Synthetic oligonucleotide; CTT chr11 5187701 5187722 5187718 5187723 +
cagcaatattctatgcagatga

SEQ ID NO: 77088 - DNA, 22 bp, Artificial Sequence
  Synthetic oligonucleotide; TTC chr11 5187702 5187723 5187719 5187724 +
agcaatattctatgcagatgaa

SEQ ID NO: 77089 - DNA, 22 bp, Artificial Sequence
  Synthetic oligonucleotide; TTC chr11 5187712 5187733 5187729 5187734 +
tatgcagatgaaataatagtta

SEQ ID NO: 77090 - DNA, 22 bp, Artificial Sequence
  Synthetic oligonucleotide; CTA chr11 5187714 5187735 5187731 5187736 +
tgcagatgaaataatagttatt

SEQ ID NO: 77091 - DNA, 22 bp, Artificial Sequence
  Synthetic oligonucleotide; TTA chr11 5187734 5187755 5187751 5187756 +
ttgatatgtttaatttaatatg

SEQ ID NO: 77092 - DNA, 22 bp, Artificial Sequence
  Synthetic oligonucleotide; TTG chr11 5187737 5187758 5187754 5187759 +
atatgtttaatttaatatgttt

SEQ ID NO: 77093 - DNA, 22 bp, Artificial Sequence
  Synthetic oligonucleotide; TTT chr11 5187745 5187766 5187762 5187767 +
aatttaatatgtttagttttct

SEQ ID NO: 77094 - DNA, 22 bp, Artificial Sequence
  Synthetic oligonucleotide; TTA chr11 5187746 5187767 5187763 5187768 +
atttaatatgtttagttttctt

SEQ ID NO: 77095 - DNA, 22 bp, Artificial Sequence
  Synthetic oligonucleotide; TTT chr11 5187750 5187771 5187767 5187772 +
aatatgtttagttttcttatag

SEQ ID NO: 77096 - DNA, 22 bp, Artificial Sequence
  Synthetic oligonucleotide; TTA chr11 5187751 5187772 5187768 5187773 +
atatgtttagttttcttataga

SEQ ID NO: 77097 - DNA, 22 bp, Artificial Sequence
  Synthetic oligonucleotide; TTT chr11 5187759 5187780 5187776 5187781 +
agttttcttatagaagtctaca

SEQ ID NO: 77098 - DNA, 22 bp, Artificial Sequence
  Synthetic oligonucleotide; TTA chr11 5187760 5187781 5187777 5187782 +
gttttcttatagaagtctacag

SEQ ID NO: 77099 - DNA, 22 bp, Artificial Sequence
  Synthetic oligonucleotide; TTT chr11 5187764 5187785 5187781 5187786 +
tcttatagaagtctacagtctt

SEQ ID NO: 77100 - DNA, 22 bp, Artificial Sequence
  Synthetic oligonucleotide; TTT chr11 5187765 5187786 5187782 5187787 +
cttatagaagtctacagtcttt

SEQ ID NO: 77101 - DNA, 22 bp, Artificial Sequence
  Synthetic oligonucleotide; TTC chr11 5187766 5187787 5187783 5187788 +
ttatagaagtctacagtctttg

SEQ ID NO: 77102 - DNA, 22 bp, Artificial Sequence
  Synthetic oligonucleotide; CTT chr11 5187768 5187789 5187785 5187790 +
atagaagtctacagtctttgag

SEQ ID NO: 77103 - DNA, 22 bp, Artificial Sequence
  Synthetic oligonucleotide; TTA chr11 5187769 5187790 5187786 5187791 +
tagaagtctacagtctttgagc

SEQ ID NO: 77104 - DNA, 22 bp, Artificial Sequence
  Synthetic oligonucleotide; CTA chr11 5187779 5187800 5187796 5187801 +
cagtctttgagccacatgcttt

SEQ ID NO: 77105 - DNA, 22 bp, Artificial Sequence
  Synthetic oligonucleotide; CTT chr11 5187786 5187807 5187803 5187808 +
tgagccacatgctttagaaaaa

SEQ ID NO: 77106 - DNA, 22 bp, Artificial Sequence
  Synthetic oligonucleotide; TTT chr11 5187787 5187808 5187804 5187809 +
gagccacatgctttagaaaaat

SEQ ID NO: 77107 - DNA, 22 bp, Artificial Sequence
  Synthetic oligonucleotide; TTG chr11 5187788 5187809 5187805 5187810 +
agccacatgctttagaaaaata

SEQ ID NO: 77108 - DNA, 22 bp, Artificial Sequence
  Synthetic oligonucleotide; CTT chr11 5187800 5187821 5187817 5187822 +
tagaaaaataattttccaattt

SEQ ID NO: 77109 - DNA, 22 bp, Artificial Sequence
  Synthetic oligonucleotide; TTT chr11 5187801 5187822 5187818 5187823 +
agaaaaataattttccaatttt

SEQ ID NO: 77110 - DNA, 22 bp, Artificial Sequence
  Synthetic oligonucleotide; TTA chr11 5187802 5187823 5187819 5187824 +
gaaaaataattttccaattttt

SEQ ID NO: 77111 - DNA, 22 bp, Artificial Sequence
  Synthetic oligonucleotide; TTT chr11 5187814 5187835 5187831 5187836 +
tccaatttttatgaatgttata

SEQ ID NO: 77112 - DNA, 22 bp, Artificial Sequence
  Synthetic oligonucleotide; TTT chr11 5187815 5187836 5187832 5187837 +
ccaatttttatgaatgttatat

SEQ ID NO: 77113 - DNA, 22 bp, Artificial Sequence
  Synthetic oligonucleotide; TTC chr11 5187816 5187837 5187833 5187838 +
caatttttatgaatgttatata

SEQ ID NO: 77114 - DNA, 22 bp, Artificial Sequence
  Synthetic oligonucleotide; TTT chr11 5187822 5187843 5187839 5187844 +
ttatgaatgttatataatatta

SEQ ID NO: 77115 - DNA, 22 bp, Artificial Sequence
  Synthetic oligonucleotide; TTT chr11 5187823 5187844 5187840 5187845 +
tatgaatgttatataatattat

SEQ ID NO: 77116 - DNA, 22 bp, Artificial Sequence
  Synthetic oligonucleotide; TTT chr11 5187824 5187845 5187841 5187846 +
atgaatgttatataatattatt

SEQ ID NO: 77117 - DNA, 22 bp, Artificial Sequence
  Synthetic oligonucleotide; TTA chr11 5187825 5187846 5187842 5187847 +
tgaatgttatataatattattg

SEQ ID NO: 77118 - DNA, 22 bp, Artificial Sequence
  Synthetic oligonucleotide; TTA chr11 5187834 5187855 5187851 5187856 +
tataatattattgacatcaagt

SEQ ID NO: 77119 - DNA, 22 bp, Artificial Sequence
  Synthetic oligonucleotide; TTA chr11 5187844 5187865 5187861 5187866 +
ttgacatcaagtaacaatatca

SEQ ID NO: 77120 - DNA, 22 bp, Artificial Sequence
  Synthetic oligonucleotide; TTG chr11 5187847 5187868 5187864 5187869 +
acatcaagtaacaatatcattg

SEQ ID NO: 77121 - DNA, 22 bp, Artificial Sequence
  Synthetic oligonucleotide; TTG chr11 5187869 5187890 5187886 5187891 +
gaatctcggtatgcccttaata

SEQ ID NO: 77122 - DNA, 22 bp, Artificial Sequence
  Synthetic oligonucleotide; CTC chr11 5187876 5187897 5187893 5187898 +
ggtatgcccttaataatcatat

SEQ ID NO: 77123 - DNA, 22 bp, Artificial Sequence
  Synthetic oligonucleotide; CTT chr11 5187887 5187908 5187904 5187909 +
aataatcatatatctatatgat

SEQ ID NO: 77124 - DNA, 22 bp, Artificial Sequence
  Synthetic oligonucleotide; TTA chr11 5187888 5187909 5187905 5187910 +
ataatcatatatctatatgatt

SEQ ID NO: 77125 - DNA, 22 bp, Artificial Sequence
  Synthetic oligonucleotide; CTA chr11 5187903 5187924 5187920 5187925 +
tatgattatctaatatacctag

SEQ ID NO: 77126 - DNA, 22 bp, Artificial Sequence
  Synthetic oligonucleotide; TTA chr11 5187911 5187932 5187928 5187933 +
tctaatatacctagatattttt

SEQ ID NO: 77127 - DNA, 22 bp, Artificial Sequence
  Synthetic oligonucleotide; CTA chr11 5187915 5187936 5187932 5187937 +
atatacctagatatttttgcag

SEQ ID NO: 77128 - DNA, 22 bp, Artificial Sequence
  Synthetic oligonucleotide; CTA chr11 5187924 5187945 5187941 5187946 +
gatatttttgcagggaacatgt

SEQ ID NO: 77129 - DNA, 22 bp, Artificial Sequence
  Synthetic oligonucleotide; TTT chr11 5187931 5187952 5187948 5187953 +
ttgcagggaacatgtaagtatt

SEQ ID NO: 77130 - DNA, 22 bp, Artificial Sequence
  Synthetic oligonucleotide; TTT chr11 5187932 5187953 5187949 5187954 +
tgcagggaacatgtaagtatta

SEQ ID NO: 77131 - DNA, 22 bp, Artificial Sequence
  Synthetic oligonucleotide; TTT chr11 5187933 5187954 5187950 5187955 +
gcagggaacatgtaagtattat

SEQ ID NO: 77132 - DNA, 22 bp, Artificial Sequence
  Synthetic oligonucleotide; TTG chr11 5187934 5187955 5187951 5187956 +
cagggaacatgtaagtattatg

SEQ ID NO: 77133 - DNA, 22 bp, Artificial Sequence
  Synthetic oligonucleotide; TTA chr11 5187954 5187975 5187971 5187976 +
tgtagaataaataaagattata

SEQ ID NO: 77134 - DNA, 22 bp, Artificial Sequence
  Synthetic oligonucleotide; TTA chr11 5187974 5187995 5187991 5187996 +
taaaaattctcacataagttca

SEQ ID NO: 77135 - DNA, 22 bp, Artificial Sequence
  Synthetic oligonucleotide; TTC chr11 5187983 5188004 5188000 5188005 +
tcacataagttcatgtcagaaa

SEQ ID NO: 77136 - DNA, 22 bp, Artificial Sequence
  Synthetic oligonucleotide; CTC chr11 5187985 5188006 5188002 5188007 +
acataagttcatgtcagaaatt

SEQ ID NO: 77137 - DNA, 22 bp, Artificial Sequence
  Synthetic oligonucleotide; TTC chr11 5187995 5188016 5188012 5188017 +
atgtcagaaattgccatcactt

SEQ ID NO: 77138 - DNA, 22 bp, Artificial Sequence
  Synthetic oligonucleotide; TTG chr11 5188008 5188029 5188025 5188030 +
ccatcactttagagcagattgt

SEQ ID NO: 77139 - DNA, 22 bp, Artificial Sequence
  Synthetic oligonucleotide; CTT chr11 5188017 5188038 5188034 5188039 +
tagagcagattgtgctgttaaa

SEQ ID NO: 77140 - DNA, 22 bp, Artificial Sequence
  Synthetic oligonucleotide; TTT chr11 5188018 5188039 5188035 5188040 +
agagcagattgtgctgttaaaa

SEQ ID NO: 77141 - DNA, 22 bp, Artificial Sequence
  Synthetic oligonucleotide; TTA chr11 5188019 5188040 5188036 5188041 +
gagcagattgtgctgttaaaag

SEQ ID NO: 77142 - DNA, 22 bp, Artificial Sequence
  Synthetic oligonucleotide; TTG chr11 5188029 5188050 5188046 5188051 +
tgctgttaaaagactcagtttt

SEQ ID NO: 77143 - DNA, 22 bp, Artificial Sequence
  Synthetic oligonucleotide; CTG chr11 5188034 5188055 5188051 5188056 +
ttaaaagactcagtttttaaat

SEQ ID NO: 77144 - DNA, 22 bp, Artificial Sequence
  Synthetic oligonucleotide; TTA chr11 5188037 5188058 5188054 5188059 +
aaagactcagtttttaaatttc

SEQ ID NO: 77145 - DNA, 22 bp, Artificial Sequence
  Synthetic oligonucleotide; CTC chr11 5188045 5188066 5188062 5188067 +
agtttttaaatttctatggatt

SEQ ID NO: 77146 - DNA, 22 bp, Artificial Sequence
  Synthetic oligonucleotide; TTT chr11 5188050 5188071 5188067 5188072 +
ttaaatttctatggatttcaag

SEQ ID NO: 77147 - DNA, 22 bp, Artificial Sequence
  Synthetic oligonucleotide; TTT chr11 5188051 5188072 5188068 5188073 +
taaatttctatggatttcaagg

SEQ ID NO: 77148 - DNA, 22 bp, Artificial Sequence
  Synthetic oligonucleotide; TTT chr11 5188052 5188073 5188069 5188074 +
aaatttctatggatttcaagga

SEQ ID NO: 77149 - DNA, 22 bp, Artificial Sequence
  Synthetic oligonucleotide; TTA chr11 5188053 5188074 5188070 5188075 +
aatttctatggatttcaaggaa

SEQ ID NO: 77150 - DNA, 22 bp, Artificial Sequence
  Synthetic oligonucleotide; TTT chr11 5188058 5188079 5188075 5188080 +
ctatggatttcaaggaaatgga

SEQ ID NO: 77151 - DNA, 22 bp, Artificial Sequence
  Synthetic oligonucleotide; TTC chr11 5188059 5188080 5188076 5188081 +
tatggatttcaaggaaatggat

SEQ ID NO: 77152 - DNA, 22 bp, Artificial Sequence
  Synthetic oligonucleotide; CTA chr11 5188061 5188082 5188078 5188083 +
tggatttcaaggaaatggataa

SEQ ID NO: 77153 - DNA, 22 bp, Artificial Sequence
  Synthetic oligonucleotide; TTT chr11 5188068 5188089 5188085 5188090 +
caaggaaatggataaatgattg

SEQ ID NO: 77154 - DNA, 22 bp, Artificial Sequence
  Synthetic oligonucleotide; TTC chr11 5188069 5188090 5188086 5188091 +
aaggaaatggataaatgattgt

SEQ ID NO: 77155 - DNA, 22 bp, Artificial Sequence
  Synthetic oligonucleotide; TTG chr11 5188090 5188111 5188107 5188112 +
tggccctgttaaccaaaatagc

SEQ ID NO: 77156 - DNA, 22 bp, Artificial Sequence
  Synthetic oligonucleotide; CTG chr11 5188098 5188119 5188115 5188120 +
ttaaccaaaatagcagtaaaaa

SEQ ID NO: 77157 - DNA, 22 bp, Artificial Sequence
  Synthetic oligonucleotide; TTA chr11 5188101 5188122 5188118 5188123 +
accaaaatagcagtaaaaatgg

SEQ ID NO: 77158 - DNA, 22 bp, Artificial Sequence
  Synthetic oligonucleotide; CTT chr11 5188126 5188147 5188143 5188148 +
tggctactgatttagtatctgt

SEQ ID NO: 77159 - DNA, 22 bp, Artificial Sequence
  Synthetic oligonucleotide; TTT chr11 5188127 5188148 5188144 5188149 +
ggctactgatttagtatctgta

SEQ ID NO: 77160 - DNA, 22 bp, Artificial Sequence
  Synthetic oligonucleotide; TTG chr11 5188128 5188149 5188145 5188150 +
gctactgatttagtatctgtaa

SEQ ID NO: 77161 - DNA, 22 bp, Artificial Sequence
  Synthetic oligonucleotide; CTA chr11 5188132 5188153 5188149 5188154 +
ctgatttagtatctgtaaatta

SEQ ID NO: 77162 - DNA, 22 bp, Artificial Sequence
  Synthetic oligonucleotide; CTG chr11 5188135 5188156 5188152 5188157 +
atttagtatctgtaaattaagg

SEQ ID NO: 77163 - DNA, 22 bp, Artificial Sequence
  Synthetic oligonucleotide; TTT chr11 5188139 5188160 5188156 5188161 +
agtatctgtaaattaaggatgt

SEQ ID NO: 77164 - DNA, 22 bp, Artificial Sequence
  Synthetic oligonucleotide; TTA chr11 5188140 5188161 5188157 5188162 +
gtatctgtaaattaaggatgtt

SEQ ID NO: 77165 - DNA, 22 bp, Artificial Sequence
  Synthetic oligonucleotide; CTG chr11 5188147 5188168 5188164 5188169 +
taaattaaggatgttggattgc

SEQ ID NO: 77166 - DNA, 22 bp, Artificial Sequence
  Synthetic oligonucleotide; TTA chr11 5188154 5188175 5188171 5188176 +
aggatgttggattgcttgagat

SEQ ID NO: 77167 - DNA, 22 bp, Artificial Sequence
  Synthetic oligonucleotide; TTG chr11 5188163 5188184 5188180 5188185 +
gattgcttgagattttagctct

SEQ ID NO: 77168 - DNA, 22 bp, Artificial Sequence
  Synthetic oligonucleotide; TTG chr11 5188168 5188189 5188185 5188190 +
cttgagattttagctctaactc

SEQ ID NO: 77169 - DNA, 22 bp, Artificial Sequence
  Synthetic oligonucleotide; CTT chr11 5188171 5188192 5188188 5188193 +
gagattttagctctaactctgc

SEQ ID NO: 77170 - DNA, 22 bp, Artificial Sequence
  Synthetic oligonucleotide; TTG chr11 5188172 5188193 5188189 5188194 +
agattttagctctaactctgct

SEQ ID NO: 77171 - DNA, 22 bp, Artificial Sequence
  Synthetic oligonucleotide; TTT chr11 5188178 5188199 5188195 5188200 +
tagctctaactctgcttcaata

SEQ ID NO: 77172 - DNA, 22 bp, Artificial Sequence
  Synthetic oligonucleotide; TTT chr11 5188179 5188200 5188196 5188201 +
agctctaactctgcttcaatat

SEQ ID NO: 77173 - DNA, 22 bp, Artificial Sequence
  Synthetic oligonucleotide; TTA chr11 5188180 5188201 5188197 5188202 +
gctctaactctgcttcaatatg

SEQ ID NO: 77174 - DNA, 22 bp, Artificial Sequence
  Synthetic oligonucleotide; CTC chr11 5188184 5188205 5188201 5188206 +
taactctgcttcaatatgtaag

SEQ ID NO: 77175 - DNA, 22 bp, Artificial Sequence
  Synthetic oligonucleotide; CTA chr11 5188186 5188207 5188203 5188208 +
actctgcttcaatatgtaagat

SEQ ID NO: 77176 - DNA, 22 bp, Artificial Sequence
  Synthetic oligonucleotide; CTC chr11 5188190 5188211 5188207 5188212 +
tgcttcaatatgtaagatactt

SEQ ID NO: 77177 - DNA, 22 bp, Artificial Sequence
  Synthetic oligonucleotide; CTG chr11 5188192 5188213 5188209 5188214 +
cttcaatatgtaagatacttct

SEQ ID NO: 77178 - DNA, 22 bp, Artificial Sequence
  Synthetic oligonucleotide; CTT chr11 5188195 5188216 5188212 5188217 +
caatatgtaagatacttctaat

SEQ ID NO: 77179 - DNA, 22 bp, Artificial Sequence
  Synthetic oligonucleotide; TTC chr11 5188196 5188217 5188213 5188218 +
aatatgtaagatacttctaatt

SEQ ID NO: 77180 - DNA, 22 bp, Artificial Sequence
  Synthetic oligonucleotide; CTT chr11 5188212 5188233 5188229 5188234 +
ctaattgagtctagataattgt

SEQ ID NO: 77181 - DNA, 22 bp, Artificial Sequence
  Synthetic oligonucleotide; TTC chr11 5188213 5188234 5188230 5188235 +
taattgagtctagataattgtt

SEQ ID NO: 77182 - DNA, 22 bp, Artificial Sequence
  Synthetic oligonucleotide; CTA chr11 5188215 5188236 5188232 5188237 +
attgagtctagataattgttct

SEQ ID NO: 77183 - DNA, 22 bp, Artificial Sequence
  Synthetic oligonucleotide; TTG chr11 5188219 5188240 5188236 5188241 +
agtctagataattgttctatag

SEQ ID NO: 77184 - DNA, 22 bp, Artificial Sequence
  Synthetic oligonucleotide; CTA chr11 5188225 5188246 5188242 5188247 +
gataattgttctataggtaaat

SEQ ID NO: 77185 - DNA, 22 bp, Artificial Sequence
  Synthetic oligonucleotide; TTG chr11 5188233 5188254 5188250 5188255 +
ttctataggtaaattagtgtcc

SEQ ID NO: 77186 - DNA, 22 bp, Artificial Sequence
  Synthetic oligonucleotide; TTC chr11 5188236 5188257 5188253 5188258 +
tataggtaaattagtgtcctgg

SEQ ID NO: 77187 - DNA, 22 bp, Artificial Sequence
  Synthetic oligonucleotide; CTA chr11 5188238 5188259 5188255 5188260 +
taggtaaattagtgtcctggat

SEQ ID NO: 77188 - DNA, 22 bp, Artificial Sequence
  Synthetic oligonucleotide; TTA chr11 5188249 5188270 5188266 5188271 +
gtgtcctggatgctagtgcttc

SEQ ID NO: 77189 - DNA, 22 bp, Artificial Sequence
  Synthetic oligonucleotide; CTG chr11 5188257 5188278 5188274 5188279 +
gatgctagtgcttcagccaaaa

SEQ ID NO: 77190 - DNA, 22 bp, Artificial Sequence
  Synthetic oligonucleotide; CTA chr11 5188264 5188285 5188281 5188286 +
gtgcttcagccaaaaaatgaaa

SEQ ID NO: 77191 - DNA, 22 bp, Artificial Sequence
  Synthetic oligonucleotide; CTT chr11 5188270 5188291 5188287 5188292 +
cagccaaaaaatgaaaaagata

SEQ ID NO: 77192 - DNA, 22 bp, Artificial Sequence
  Synthetic oligonucleotide; TTC chr11 5188271 5188292 5188288 5188293 +
agccaaaaaatgaaaaagatac

SEQ ID NO: 77193 - DNA, 22 bp, Artificial Sequence
  Synthetic oligonucleotide; TTA chr11 5188298 5188319 5188315 5188320 +
aatgaaagcctttatcttacta

SEQ ID NO: 77194 - DNA, 22 bp, Artificial Sequence
  Synthetic oligonucleotide; CTT chr11 5188310 5188331 5188327 5188332 +
tatcttactatgggacttgagt

SEQ ID NO: 77195 - DNA, 22 bp, Artificial Sequence
  Synthetic oligonucleotide; TTT chr11 5188311 5188332 5188328 5188333 +
atcttactatgggacttgagtg

SEQ ID NO: 77196 - DNA, 22 bp, Artificial Sequence
  Synthetic oligonucleotide; TTA chr11 5188312 5188333 5188329 5188334 +
tcttactatgggacttgagtgg

SEQ ID NO: 77197 - DNA, 22 bp, Artificial Sequence
  Synthetic oligonucleotide; CTT chr11 5188316 5188337 5188333 5188338 +
actatgggacttgagtggagga

SEQ ID NO: 77198 - DNA, 22 bp, Artificial Sequence
  Synthetic oligonucleotide; TTA chr11 5188317 5188338 5188334 5188339 +
ctatgggacttgagtggaggaa

SEQ ID NO: 77199 - DNA, 22 bp, Artificial Sequence
  Synthetic oligonucleotide; CTA chr11 5188320 5188341 5188337 5188342 +
tgggacttgagtggaggaaatc

SEQ ID NO: 77200 - DNA, 22 bp, Artificial Sequence
  Synthetic oligonucleotide; CTT chr11 5188328 5188349 5188345 5188350 +
gagtggaggaaatccaagaaaa

SEQ ID NO: 77201 - DNA, 22 bp, Artificial Sequence
  Synthetic oligonucleotide; TTG chr11 5188329 5188350 5188346 5188351 +
agtggaggaaatccaagaaaag

SEQ ID NO: 77202 - DNA, 22 bp, Artificial Sequence
  Synthetic oligonucleotide; TTC chr11 5188356 5188377 5188373 5188378 +
cagatgatcctttcttcgaaca

SEQ ID NO: 77203 - DNA, 22 bp, Artificial Sequence
  Synthetic oligonucleotide; CTT chr11 5188368 5188389 5188385 5188390 +
tcttcgaacaagtaatttggca

SEQ ID NO: 77204 - DNA, 22 bp, Artificial Sequence
  Synthetic oligonucleotide; TTT chr11 5188369 5188390 5188386 5188391 +
cttcgaacaagtaatttggcat

SEQ ID NO: 77205 - DNA, 22 bp, Artificial Sequence
  Synthetic oligonucleotide; TTC chr11 5188370 5188391 5188387 5188392 +
ttcgaacaagtaatttggcata

SEQ ID NO: 77206 - DNA, 22 bp, Artificial Sequence
  Synthetic oligonucleotide; CTT chr11 5188372 5188393 5188389 5188394 +
cgaacaagtaatttggcataat

SEQ ID NO: 77207 - DNA, 22 bp, Artificial Sequence
  Synthetic oligonucleotide; TTC chr11 5188373 5188394 5188390 5188395 +
gaacaagtaatttggcataatt

SEQ ID NO: 77208 - DNA, 22 bp, Artificial Sequence
  Synthetic oligonucleotide; TTT chr11 5188386 5188407 5188403 5188408 +
ggcataattggacacctggttt

SEQ ID NO: 77209 - DNA, 22 bp, Artificial Sequence
  Synthetic oligonucleotide; TTG chr11 5188387 5188408 5188404 5188409 +
gcataattggacacctggtttc

SEQ ID NO: 77210 - DNA, 22 bp, Artificial Sequence
  Synthetic oligonucleotide; TTG chr11 5188396 5188417 5188413 5188418 +
gacacctggtttcttctcattt

SEQ ID NO: 77211 - DNA, 22 bp, Artificial Sequence
  Synthetic oligonucleotide; CTG chr11 5188404 5188425 5188421 5188426 +
gtttcttctcatttgtaagtta

SEQ ID NO: 77212 - DNA, 22 bp, Artificial Sequence
  Synthetic oligonucleotide; TTT chr11 5188408 5188429 5188425 5188430 +
cttctcatttgtaagttagtaa

SEQ ID NO: 77213 - DNA, 22 bp, Artificial Sequence
  Synthetic oligonucleotide; TTC chr11 5188409 5188430 5188426 5188431 +
ttctcatttgtaagttagtaaa

SEQ ID NO: 77214 - DNA, 22 bp, Artificial Sequence
  Synthetic oligonucleotide; CTT chr11 5188411 5188432 5188428 5188433 +
ctcatttgtaagttagtaaagc

SEQ ID NO: 77215 - DNA, 22 bp, Artificial Sequence
  Synthetic oligonucleotide; TTC chr11 5188412 5188433 5188429 5188434 +
tcatttgtaagttagtaaagct

SEQ ID NO: 77216 - DNA, 22 bp, Artificial Sequence
  Synthetic oligonucleotide; CTC chr11 5188414 5188435 5188431 5188436 +
atttgtaagttagtaaagctgg

SEQ ID NO: 77217 - DNA, 22 bp, Artificial Sequence
  Synthetic oligonucleotide; TTT chr11 5188418 5188439 5188435 5188440 +
gtaagttagtaaagctgggagt

SEQ ID NO: 77218 - DNA, 22 bp, Artificial Sequence
  Synthetic oligonucleotide; TTG chr11 5188419 5188440 5188436 5188441 +
taagttagtaaagctgggagtt

SEQ ID NO: 77219 - DNA, 22 bp, Artificial Sequence
  Synthetic oligonucleotide; TTA chr11 5188426 5188447 5188443 5188448 +
gtaaagctgggagttggtgcta

SEQ ID NO: 77220 - DNA, 22 bp, Artificial Sequence
  Synthetic oligonucleotide; CTG chr11 5188435 5188456 5188452 5188457 +
ggagttggtgctagtaaagctg

SEQ ID NO: 77221 - DNA, 22 bp, Artificial Sequence
  Synthetic oligonucleotide; TTG chr11 5188442 5188463 5188459 5188464 +
gtgctagtaaagctgggagttg

SEQ ID NO: 77222 - DNA, 22 bp, Artificial Sequence
  Synthetic oligonucleotide; CTA chr11 5188448 5188469 5188465 5188470 +
gtaaagctgggagttggtgcca

SEQ ID NO: 77223 - DNA, 22 bp, Artificial Sequence
  Synthetic oligonucleotide; CTG chr11 5188457 5188478 5188474 5188479 +
ggagttggtgccagaaaagaga

SEQ ID NO: 77224 - DNA, 22 bp, Artificial Sequence
  Synthetic oligonucleotide; TTG chr11 5188464 5188485 5188481 5188486 +
gtgccagaaaagagaacagaaa

SEQ ID NO: 77225 - DNA, 22 bp, Artificial Sequence
  Synthetic oligonucleotide; TTA chr11 5188491 5188512 5188508 5188513 +
atttatttcttccttgtttgta

SEQ ID NO: 77226 - DNA, 22 bp, Artificial Sequence
  Synthetic oligonucleotide; TTT chr11 5188495 5188516 5188512 5188517 +
atttcttccttgtttgtaggct

SEQ ID NO: 77227 - DNA, 22 bp, Artificial Sequence
  Synthetic oligonucleotide; TTA chr11 5188496 5188517 5188513 5188518 +
tttcttccttgtttgtaggctg

SEQ ID NO: 77228 - DNA, 22 bp, Artificial Sequence
  Synthetic oligonucleotide; TTT chr11 5188499 5188520 5188516 5188521 +
cttccttgtttgtaggctgtag

SEQ ID NO: 77229 - DNA, 22 bp, Artificial Sequence
  Synthetic oligonucleotide; TTC chr11 5188500 5188521 5188517 5188522 +
ttccttgtttgtaggctgtaga

SEQ ID NO: 77230 - DNA, 22 bp, Artificial Sequence
  Synthetic oligonucleotide; CTT chr11 5188502 5188523 5188519 5188524 +
ccttgtttgtaggctgtagagc

SEQ ID NO: 77231 - DNA, 22 bp, Artificial Sequence
  Synthetic oligonucleotide; TTC chr11 5188503 5188524 5188520 5188525 +
cttgtttgtaggctgtagagca

SEQ ID NO: 77232 - DNA, 22 bp, Artificial Sequence
  Synthetic oligonucleotide; CTT chr11 5188506 5188527 5188523 5188528 +
gtttgtaggctgtagagcaagc

SEQ ID NO: 77233 - DNA, 22 bp, Artificial Sequence
  Synthetic oligonucleotide; TTG chr11 5188507 5188528 5188524 5188529 +
tttgtaggctgtagagcaagct

SEQ ID NO: 77234 - DNA, 22 bp, Artificial Sequence
  Synthetic oligonucleotide; TTT chr11 5188510 5188531 5188527 5188532 +
gtaggctgtagagcaagcttgt

SEQ ID NO: 77235 - DNA, 22 bp, Artificial Sequence
  Synthetic oligonucleotide; TTG chr11 5188511 5188532 5188528 5188533 +
taggctgtagagcaagcttgtc

SEQ ID NO: 77236 - DNA, 22 bp, Artificial Sequence
  Synthetic oligonucleotide; CTG chr11 5188518 5188539 5188535 5188540 +
tagagcaagcttgtccaacctg

SEQ ID NO: 77237 - DNA, 22 bp, Artificial Sequence
  Synthetic oligonucleotide; CTT chr11 5188530 5188551 5188547 5188552 +
gtccaacctgtggcccgtgggc

SEQ ID NO: 77238 - DNA, 22 bp, Artificial Sequence
  Synthetic oligonucleotide; TTG chr11 5188531 5188552 5188548 5188553 +
tccaacctgtggcccgtgggct

SEQ ID NO: 77239 - DNA, 22 bp, Artificial Sequence
  Synthetic oligonucleotide; CTG chr11 5188540 5188561 5188557 5188562 +
tggcccgtgggctgcatgcatc

SEQ ID NO: 77240 - DNA, 22 bp, Artificial Sequence
  Synthetic oligonucleotide; CTG chr11 5188554 5188575 5188571 5188576 +
catgcatcccaagatggctttg

SEQ ID NO: 77241 - DNA, 22 bp, Artificial Sequence
  Synthetic oligonucleotide; CTT chr11 5188574 5188595 5188591 5188596 +
tgaatgctatccaacacaactt

SEQ ID NO: 77242 - DNA, 22 bp, Artificial Sequence
  Synthetic oligonucleotide; TTT chr11 5188575 5188596 5188592 5188597 +
gaatgctatccaacacaacttt

SEQ ID NO: 77243 - DNA, 22 bp, Artificial Sequence
  Synthetic oligonucleotide; TTG chr11 5188576 5188597 5188593 5188598 +
aatgctatccaacacaactttc

SEQ ID NO: 77244 - DNA, 22 bp, Artificial Sequence
  Synthetic oligonucleotide; CTA chr11 5188583 5188604 5188600 5188605 +
tccaacacaactttcttaaaac

SEQ ID NO: 77245 - DNA, 22 bp, Artificial Sequence
  Synthetic oligonucleotide; CTT chr11 5188596 5188617 5188613 5188618 +
tcttaaaacattatgagatttt

SEQ ID NO: 77246 - DNA, 22 bp, Artificial Sequence
  Synthetic oligonucleotide; TTT chr11 5188597 5188618 5188614 5188619 +
cttaaaacattatgagatttta

SEQ ID NO: 77247 - DNA, 22 bp, Artificial Sequence
  Synthetic oligonucleotide; TTC chr11 5188598 5188619 5188615 5188620 +
ttaaaacattatgagattttat

SEQ ID NO: 77248 - DNA, 22 bp, Artificial Sequence
  Synthetic oligonucleotide; CTT chr11 5188600 5188621 5188617 5188622 +
aaaacattatgagattttatgg

SEQ ID NO: 77249 - DNA, 22 bp, Artificial Sequence
  Synthetic oligonucleotide; TTA chr11 5188601 5188622 5188618 5188623 +
aaacattatgagattttatggg

SEQ ID NO: 77250 - DNA, 22 bp, Artificial Sequence
  Synthetic oligonucleotide; TTA chr11 5188609 5188630 5188626 5188631 +
tgagattttatgggacattttg

SEQ ID NO: 77251 - DNA, 22 bp, Artificial Sequence
  Synthetic oligonucleotide; TTT chr11 5188617 5188638 5188634 5188639 +
tatgggacattttgtgattttt

SEQ ID NO: 77252 - DNA, 22 bp, Artificial Sequence
  Synthetic oligonucleotide; TTT chr11 5188618 5188639 5188635 5188640 +
atgggacattttgtgatttttt

SEQ ID NO: 77253 - DNA, 22 bp, Artificial Sequence
  Synthetic oligonucleotide; TTA chr11 5188619 5188640 5188636 5188641 +
tgggacattttgtgattttttt

SEQ ID NO: 77254 - DNA, 22 bp, Artificial Sequence
  Synthetic oligonucleotide; TTT chr11 5188629 5188650 5188646 5188651 +
tgtgatttttttttttttttgg

SEQ ID NO: 77255 - DNA, 22 bp, Artificial Sequence
  Synthetic oligonucleotide; TTT chr11 5188630 5188651 5188647 5188652 +
gtgatttttttttttttttggc

SEQ ID NO: 77256 - DNA, 22 bp, Artificial Sequence
  Synthetic oligonucleotide; TTG chr11 5188631 5188652 5188648 5188653 +
tgatttttttttttttttggct

SEQ ID NO: 77257 - DNA, 22 bp, Artificial Sequence
  Synthetic oligonucleotide; TTT chr11 5188637 5188658 5188654 5188659 +
ttttttttttttggctcatgag

SEQ ID NO: 77258 - DNA, 22 bp, Artificial Sequence
  Synthetic oligonucleotide; TTT chr11 5188638 5188659 5188655 5188660 +
tttttttttttggctcatgagc

SEQ ID NO: 77259 - DNA, 22 bp, Artificial Sequence
  Synthetic oligonucleotide; TTT chr11 5188639 5188660 5188656 5188661 +
ttttttttttggctcatgagct

SEQ ID NO: 77260 - DNA, 22 bp, Artificial Sequence
  Synthetic oligonucleotide; TTT chr11 5188640 5188661 5188657 5188662 +
tttttttttggctcatgagctg

SEQ ID NO: 77261 - DNA, 22 bp, Artificial Sequence
  Synthetic oligonucleotide; TTT chr11 5188641 5188662 5188658 5188663 +
ttttttttggctcatgagctgt

SEQ ID NO: 77262 - DNA, 22 bp, Artificial Sequence
  Synthetic oligonucleotide; TTT chr11 5188642 5188663 5188659 5188664 +
tttttttggctcatgagctgtc

SEQ ID NO: 77263 - DNA, 22 bp, Artificial Sequence
  Synthetic oligonucleotide; TTT chr11 5188643 5188664 5188660 5188665 +
ttttttggctcatgagctgtca

SEQ ID NO: 77264 - DNA, 22 bp, Artificial Sequence
  Synthetic oligonucleotide; TTT chr11 5188644 5188665 5188661 5188666 +
tttttggctcatgagctgtcat

SEQ ID NO: 77265 - DNA, 22 bp, Artificial Sequence
  Synthetic oligonucleotide; TTT chr11 5188645 5188666 5188662 5188667 +
ttttggctcatgagctgtcatt

SEQ ID NO: 77266 - DNA, 22 bp, Artificial Sequence
  Synthetic oligonucleotide; TTT chr11 5188646 5188667 5188663 5188668 +
tttggctcatgagctgtcatta

SEQ ID NO: 77267 - DNA, 22 bp, Artificial Sequence
  Synthetic oligonucleotide; TTT chr11 5188647 5188668 5188664 5188669 +
ttggctcatgagctgtcattag

SEQ ID NO: 77268 - DNA, 22 bp, Artificial Sequence
  Synthetic oligonucleotide; TTT chr11 5188648 5188669 5188665 5188670 +
tggctcatgagctgtcattagt

SEQ ID NO: 77269 - DNA, 22 bp, Artificial Sequence
  Synthetic oligonucleotide; TTT chr11 5188649 5188670 5188666 5188671 +
ggctcatgagctgtcattagtg

SEQ ID NO: 77270 - DNA, 22 bp, Artificial Sequence
  Synthetic oligonucleotide; TTG chr11 5188650 5188671 5188667 5188672 +
gctcatgagctgtcattagtgt

SEQ ID NO: 77271 - DNA, 22 bp, Artificial Sequence
  Synthetic oligonucleotide; CTC chr11 5188654 5188675 5188671 5188676 +
atgagctgtcattagtgttagt

SEQ ID NO: 77272 - DNA, 22 bp, Artificial Sequence
  Synthetic oligonucleotide; CTG chr11 5188662 5188683 5188679 5188684 +
tcattagtgttagtatatttta

SEQ ID NO: 77273 - DNA, 22 bp, Artificial Sequence
  Synthetic oligonucleotide; TTA chr11 5188668 5188689 5188685 5188690 +
gtgttagtatattttatgtgtg

SEQ ID NO: 77274 - DNA, 22 bp, Artificial Sequence
  Synthetic oligonucleotide; TTA chr11 5188674 5188695 5188691 5188696 +
gtatattttatgtgtggcccag

SEQ ID NO: 77275 - DNA, 22 bp, Artificial Sequence
  Synthetic oligonucleotide; TTT chr11 5188682 5188703 5188699 5188704 +
tatgtgtggcccagggaagcca

SEQ ID NO: 77276 - DNA, 22 bp, Artificial Sequence
  Synthetic oligonucleotide; TTT chr11 5188683 5188704 5188700 5188705 +
atgtgtggcccagggaagccaa

SEQ ID NO: 77277 - DNA, 22 bp, Artificial Sequence
  Synthetic oligonucleotide; TTA chr11 5188684 5188705 5188701 5188706 +
tgtgtggcccagggaagccaaa

SEQ ID NO: 77278 - DNA, 22 bp, Artificial Sequence
  Synthetic oligonucleotide; TTG chr11 5188712 5188733 5188729 5188734 +
gacatccctgctgtagagtttc

SEQ ID NO: 77279 - DNA, 22 bp, Artificial Sequence
  Synthetic oligonucleotide; CTG chr11 5188722 5188743 5188739 5188744 +
ctgtagagtttctcagtggttg

SEQ ID NO: 77280 - DNA, 22 bp, Artificial Sequence
  Synthetic oligonucleotide; CTG chr11 5188725 5188746 5188742 5188747 +
tagagtttctcagtggttggaa

SEQ ID NO: 77281 - DNA, 22 bp, Artificial Sequence
  Synthetic oligonucleotide; TTT chr11 5188733 5188754 5188750 5188755 +
ctcagtggttggaatcaatatt

SEQ ID NO: 77282 - DNA, 22 bp, Artificial Sequence
  Synthetic oligonucleotide; TTC chr11 5188734 5188755 5188751 5188756 +
tcagtggttggaatcaatattt

SEQ ID NO: 77283 - DNA, 22 bp, Artificial Sequence
  Synthetic oligonucleotide; CTC chr11 5188736 5188757 5188753 5188758 +
agtggttggaatcaatatttgc

SEQ ID NO: 77284 - DNA, 22 bp, Artificial Sequence
  Synthetic oligonucleotide; TTG chr11 5188744 5188765 5188761 5188766 +
gaatcaatatttgcagagtctt

SEQ ID NO: 77285 - DNA, 22 bp, Artificial Sequence
  Synthetic oligonucleotide; TTT chr11 5188756 5188777 5188773 5188778 +
gcagagtcttgtagctttttca

SEQ ID NO: 77286 - DNA, 22 bp, Artificial Sequence
  Synthetic oligonucleotide; TTG chr11 5188757 5188778 5188774 5188779 +
cagagtcttgtagctttttcaa

SEQ ID NO: 77287 - DNA, 22 bp, Artificial Sequence
  Synthetic oligonucleotide; CTT chr11 5188766 5188787 5188783 5188788 +
gtagctttttcaaagatttttc

SEQ ID NO: 77288 - DNA, 22 bp, Artificial Sequence
  Synthetic oligonucleotide; TTG chr11 5188767 5188788 5188784 5188789 +
tagctttttcaaagatttttcc

SEQ ID NO: 77289 - DNA, 22 bp, Artificial Sequence
  Synthetic oligonucleotide; CTT chr11 5188773 5188794 5188790 5188795 +
tttcaaagatttttcccctgcc

SEQ ID NO: 77290 - DNA, 22 bp, Artificial Sequence
  Synthetic oligonucleotide; TTT chr11 5188774 5188795 5188791 5188796 +
ttcaaagatttttcccctgcca

SEQ ID NO: 77291 - DNA, 22 bp, Artificial Sequence
  Synthetic oligonucleotide; TTT chr11 5188775 5188796 5188792 5188797 +
tcaaagatttttcccctgccac

SEQ ID NO: 77292 - DNA, 22 bp, Artificial Sequence
  Synthetic oligonucleotide; TTT chr11 5188776 5188797 5188793 5188798 +
caaagatttttcccctgccaca

SEQ ID NO: 77293 - DNA, 22 bp, Artificial Sequence
  Synthetic oligonucleotide; TTC chr11 5188777 5188798 5188794 5188799 +
aaagatttttcccctgccacat

SEQ ID NO: 77294 - DNA, 22 bp, Artificial Sequence
  Synthetic oligonucleotide; TTT chr11 5188785 5188806 5188802 5188807 +
ttcccctgccacattgaagaat

SEQ ID NO: 77295 - DNA, 22 bp, Artificial Sequence
  Synthetic oligonucleotide; TTT chr11 5188786 5188807 5188803 5188808 +
tcccctgccacattgaagaata

SEQ ID NO: 77296 - DNA, 22 bp, Artificial Sequence
  Synthetic oligonucleotide; TTT chr11 5188787 5188808 5188804 5188809 +
cccctgccacattgaagaatag

SEQ ID NO: 77297 - DNA, 22 bp, Artificial Sequence
  Synthetic oligonucleotide; TTC chr11 5188788 5188809 5188805 5188810 +
ccctgccacattgaagaatagc

SEQ ID NO: 77298 - DNA, 22 bp, Artificial Sequence
  Synthetic oligonucleotide; CTG chr11 5188793 5188814 5188810 5188815 +
ccacattgaagaatagcttgag

SEQ ID NO: 77299 - DNA, 22 bp, Artificial Sequence
  Synthetic oligonucleotide; TTG chr11 5188801 5188822 5188818 5188823 +
aagaatagcttgagcaatagcc

SEQ ID NO: 77300 - DNA, 22 bp, Artificial Sequence
  Synthetic oligonucleotide; CTT chr11 5188812 5188833 5188829 5188834 +
gagcaatagccactcttctttc

SEQ ID NO: 77301 - DNA, 22 bp, Artificial Sequence
  Synthetic oligonucleotide; TTG chr11 5188813 5188834 5188830 5188835 +
agcaatagccactcttctttcc

SEQ ID NO: 77302 - DNA, 22 bp, Artificial Sequence
  Synthetic oligonucleotide; CTC chr11 5188827 5188848 5188844 5188849 +
ttctttccaggtggagtttgtg

SEQ ID NO: 77303 - DNA, 22 bp, Artificial Sequence
  Synthetic oligonucleotide; CTT chr11 5188829 5188850 5188846 5188851 +
ctttccaggtggagtttgtgaa

SEQ ID NO: 77304 - DNA, 22 bp, Artificial Sequence
  Synthetic oligonucleotide; TTC chr11 5188830 5188851 5188847 5188852 +
tttccaggtggagtttgtgaat

SEQ ID NO: 77305 - DNA, 22 bp, Artificial Sequence
  Synthetic oligonucleotide; CTT chr11 5188832 5188853 5188849 5188854 +
tccaggtggagtttgtgaatta

SEQ ID NO: 77306 - DNA, 22 bp, Artificial Sequence
  Synthetic oligonucleotide; TTT chr11 5188833 5188854 5188850 5188855 +
ccaggtggagtttgtgaattac

SEQ ID NO: 77307 - DNA, 22 bp, Artificial Sequence
  Synthetic oligonucleotide; TTC chr11 5188834 5188855 5188851 5188856 +
caggtggagtttgtgaattact

SEQ ID NO: 77308 - DNA, 22 bp, Artificial Sequence
  Synthetic oligonucleotide; TTT chr11 5188846 5188867 5188863 5188868 +
gtgaattactttagagatgatc

SEQ ID NO: 77309 - DNA, 22 bp, Artificial Sequence
  Synthetic oligonucleotide; TTG chr11 5188847 5188868 5188864 5188869 +
tgaattactttagagatgatct

SEQ ID NO: 77310 - DNA, 22 bp, Artificial Sequence
  Synthetic oligonucleotide; TTA chr11 5188854 5188875 5188871 5188876 +
ctttagagatgatctttatctg

SEQ ID NO: 77311 - DNA, 22 bp, Artificial Sequence
  Synthetic oligonucleotide; CTT chr11 5188857 5188878 5188874 5188879 +
tagagatgatctttatctggga

SEQ ID NO: 77312 - DNA, 22 bp, Artificial Sequence
  Synthetic oligonucleotide; TTT chr11 5188858 5188879 5188875 5188880 +
agagatgatctttatctgggaa

SEQ ID NO: 77313 - DNA, 22 bp, Artificial Sequence
  Synthetic oligonucleotide; TTA chr11 5188859 5188880 5188876 5188881 +
gagatgatctttatctgggaag

SEQ ID NO: 77314 - DNA, 22 bp, Artificial Sequence
  Synthetic oligonucleotide; CTT chr11 5188870 5188891 5188887 5188892 +
tatctgggaagaattactaata

SEQ ID NO: 77315 - DNA, 22 bp, Artificial Sequence
  Synthetic oligonucleotide; TTT chr11 5188871 5188892 5188888 5188893 +
atctgggaagaattactaatat

SEQ ID NO: 77316 - DNA, 22 bp, Artificial Sequence
  Synthetic oligonucleotide; TTA chr11 5188872 5188893 5188889 5188894 +
tctgggaagaattactaatata

SEQ ID NO: 77317 - DNA, 22 bp, Artificial Sequence
  Synthetic oligonucleotide; CTG chr11 5188876 5188897 5188893 5188898 +
ggaagaattactaatatattat

SEQ ID NO: 77318 - DNA, 22 bp, Artificial Sequence
  Synthetic oligonucleotide; TTA chr11 5188886 5188907 5188903 5188908 +
ctaatatattatctcttcgttt

SEQ ID NO: 77319 - DNA, 22 bp, Artificial Sequence
  Synthetic oligonucleotide; CTA chr11 5188889 5188910 5188906 5188911 +
atatattatctcttcgtttagc

SEQ ID NO: 77320 - DNA, 22 bp, Artificial Sequence
  Synthetic oligonucleotide; TTA chr11 5188897 5188918 5188914 5188919 +
tctcttcgtttagctaacgtaa

SEQ ID NO: 77321 - DNA, 22 bp, Artificial Sequence
  Synthetic oligonucleotide; CTC chr11 5188901 5188922 5188918 5188923 +
ttcgtttagctaacgtaaggtt

SEQ ID NO: 77322 - DNA, 22 bp, Artificial Sequence
  Synthetic oligonucleotide; CTT chr11 5188903 5188924 5188920 5188925 +
cgtttagctaacgtaaggttat

SEQ ID NO: 77323 - DNA, 22 bp, Artificial Sequence
  Synthetic oligonucleotide; TTC chr11 5188904 5188925 5188921 5188926 +
gtttagctaacgtaaggttatt

SEQ ID NO: 77324 - DNA, 22 bp, Artificial Sequence
  Synthetic oligonucleotide; TTT chr11 5188908 5188929 5188925 5188930 +
agctaacgtaaggttattagat

SEQ ID NO: 77325 - DNA, 22 bp, Artificial Sequence
  Synthetic oligonucleotide; TTA chr11 5188909 5188930 5188926 5188931 +
gctaacgtaaggttattagata

SEQ ID NO: 77326 - DNA, 22 bp, Artificial Sequence
  Synthetic oligonucleotide; CTA chr11 5188913 5188934 5188930 5188935 +
acgtaaggttattagatacttt

SEQ ID NO: 77327 - DNA, 22 bp, Artificial Sequence
  Synthetic oligonucleotide; TTA chr11 5188924 5188945 5188941 5188946 +
ttagatacttttctttaaggaa

SEQ ID NO: 77328 - DNA, 22 bp, Artificial Sequence
  Synthetic oligonucleotide; TTA chr11 5188927 5188948 5188944 5188949 +
gatacttttctttaaggaagga

SEQ ID NO: 77329 - DNA, 22 bp, Artificial Sequence
  Synthetic oligonucleotide; CTT chr11 5188934 5188955 5188951 5188956 +
ttctttaaggaaggatacacca

SEQ ID NO: 77330 - DNA, 22 bp, Artificial Sequence
  Synthetic oligonucleotide; TTT chr11 5188935 5188956 5188952 5188957 +
tctttaaggaaggatacaccag

SEQ ID NO: 77331 - DNA, 22 bp, Artificial Sequence
  Synthetic oligonucleotide; TTT chr11 5188936 5188957 5188953 5188958 +
ctttaaggaaggatacaccagg

SEQ ID NO: 77332 - DNA, 22 bp, Artificial Sequence
  Synthetic oligonucleotide; TTC chr11 5188937 5188958 5188954 5188959 +
tttaaggaaggatacaccagga

SEQ ID NO: 77333 - DNA, 22 bp, Artificial Sequence
  Synthetic oligonucleotide; CTT chr11 5188939 5188960 5188956 5188961 +
taaggaaggatacaccaggacc

SEQ ID NO: 77334 - DNA, 22 bp, Artificial Sequence
  Synthetic oligonucleotide; TTT chr11 5188940 5188961 5188957 5188962 +
aaggaaggatacaccaggacct

SEQ ID NO: 77335 - DNA, 22 bp, Artificial Sequence
  Synthetic oligonucleotide; TTA chr11 5188941 5188962 5188958 5188963 +
aggaaggatacaccaggacctg

SEQ ID NO: 77336 - DNA, 22 bp, Artificial Sequence
  Synthetic oligonucleotide; CTG chr11 5188963 5188984 5188980 5188985 +
ccttaataaggcttgatgacat

SEQ ID NO: 77337 - DNA, 22 bp, Artificial Sequence
  Synthetic oligonucleotide; CTT chr11 5188967 5188988 5188984 5188989 +
aataaggcttgatgacatttat

SEQ ID NO: 77338 - DNA, 22 bp, Artificial Sequence
  Synthetic oligonucleotide; TTA chr11 5188968 5188989 5188985 5188990 +
ataaggcttgatgacatttatc

SEQ ID NO: 77339 - DNA, 22 bp, Artificial Sequence
  Synthetic oligonucleotide; CTT chr11 5188977 5188998 5188994 5188999 +
gatgacatttatcttccttcta

SEQ ID NO: 77340 - DNA, 22 bp, Artificial Sequence
  Synthetic oligonucleotide; TTG chr11 5188978 5188999 5188995 5189000 +
atgacatttatcttccttctaa

SEQ ID NO: 77341 - DNA, 22 bp, Artificial Sequence
  Synthetic oligonucleotide; TTT chr11 5188987 5189008 5189004 5189009 +
atcttccttctaatacatcata

SEQ ID NO: 77342 - DNA, 22 bp, Artificial Sequence
  Synthetic oligonucleotide; TTA chr11 5188988 5189009 5189005 5189010 +
tcttccttctaatacatcataa

SEQ ID NO: 77343 - DNA, 22 bp, Artificial Sequence
  Synthetic oligonucleotide; CTT chr11 5188992 5189013 5189009 5189014 +
ccttctaatacatcataatatg

SEQ ID NO: 77344 - DNA, 22 bp, Artificial Sequence
  Synthetic oligonucleotide; TTC chr11 5188993 5189014 5189010 5189015 +
cttctaatacatcataatatgt

SEQ ID NO: 77345 - DNA, 22 bp, Artificial Sequence
  Synthetic oligonucleotide; CTT chr11 5188996 5189017 5189013 5189018 +
ctaatacatcataatatgtgtg

SEQ ID NO: 77346 - DNA, 22 bp, Artificial Sequence
  Synthetic oligonucleotide; TTC chr11 5188997 5189018 5189014 5189019 +
taatacatcataatatgtgtgt

SEQ ID NO: 77347 - DNA, 22 bp, Artificial Sequence
  Synthetic oligonucleotide; CTA chr11 5188999 5189020 5189016 5189021 +
atacatcataatatgtgtgtcg

SEQ ID NO: 77348 - DNA, 22 bp, Artificial Sequence
  Synthetic oligonucleotide; CTT chr11 5189036 5189057 5189053 5189058 +
gtatagaagccaatacgactgc

SEQ ID NO: 77349 - DNA, 22 bp, Artificial Sequence
  Synthetic oligonucleotide; TTG chr11 5189037 5189058 5189054 5189059 +
tatagaagccaatacgactgct

SEQ ID NO: 77350 - DNA, 22 bp, Artificial Sequence
  Synthetic oligonucleotide; CTG chr11 5189057 5189078 5189074 5189079 +
cttgtattaaagaaacaaagtt

SEQ ID NO: 77351 - DNA, 22 bp, Artificial Sequence
  Synthetic oligonucleotide; CTT chr11 5189060 5189081 5189077 5189082 +
gtattaaagaaacaaagtttaa

SEQ ID NO: 77352 - DNA, 22 bp, Artificial Sequence
  Synthetic oligonucleotide; TTG chr11 5189061 5189082 5189078 5189083 +
tattaaagaaacaaagtttaat

SEQ ID NO: 77353 - DNA, 22 bp, Artificial Sequence
  Synthetic oligonucleotide; TTA chr11 5189066 5189087 5189083 5189088 +
aagaaacaaagtttaattcatc

SEQ ID NO: 77354 - DNA, 22 bp, Artificial Sequence
  Synthetic oligonucleotide; TTT chr11 5189080 5189101 5189097 5189102 +
aattcatcgttttgttgttgtg

SEQ ID NO: 77355 - DNA, 22 bp, Artificial Sequence
  Synthetic oligonucleotide; TTA chr11 5189081 5189102 5189098 5189103 +
attcatcgttttgttgttgtgt

SEQ ID NO: 77356 - DNA, 22 bp, Artificial Sequence
  Synthetic oligonucleotide; TTC chr11 5189085 5189106 5189102 5189107 +
atcgttttgttgttgtgttttg

SEQ ID NO: 77357 - DNA, 22 bp, Artificial Sequence
  Synthetic oligonucleotide; TTT chr11 5189092 5189113 5189109 5189114 +
tgttgttgtgttttgcttacat

SEQ ID NO: 77358 - DNA, 22 bp, Artificial Sequence
  Synthetic oligonucleotide; TTT chr11 5189093 5189114 5189110 5189115 +
gttgttgtgttttgcttacatt

SEQ ID NO: 77359 - DNA, 22 bp, Artificial Sequence
  Synthetic oligonucleotide; TTG chr11 5189094 5189115 5189111 5189116 +
ttgttgtgttttgcttacattt

SEQ ID NO: 77360 - DNA, 22 bp, Artificial Sequence
  Synthetic oligonucleotide; TTG chr11 5189097 5189118 5189114 5189119 +
ttgtgttttgcttacattttat

SEQ ID NO: 77361 - DNA, 22 bp, Artificial Sequence
  Synthetic oligonucleotide; TTG chr11 5189100 5189121 5189117 5189122 +
tgttttgcttacattttatgta

SEQ ID NO: 77362 - DNA, 22 bp, Artificial Sequence
  Synthetic oligonucleotide; TTT chr11 5189105 5189126 5189122 5189127 +
tgcttacattttatgtattttg

SEQ ID NO: 77363 - DNA, 22 bp, Artificial Sequence
  Synthetic oligonucleotide; TTT chr11 5189106 5189127 5189123 5189128 +
gcttacattttatgtattttgt

SEQ ID NO: 77364 - DNA, 22 bp, Artificial Sequence
  Synthetic oligonucleotide; TTG chr11 5189107 5189128 5189124 5189129 +
cttacattttatgtattttgtt

SEQ ID NO: 77365 - DNA, 22 bp, Artificial Sequence
  Synthetic oligonucleotide; CTT chr11 5189110 5189131 5189127 5189132 +
acattttatgtattttgttgaa

SEQ ID NO: 77366 - DNA, 22 bp, Artificial Sequence
  Synthetic oligonucleotide; TTA chr11 5189111 5189132 5189128 5189133 +
cattttatgtattttgttgaat

SEQ ID NO: 77367 - DNA, 22 bp, Artificial Sequence
  Synthetic oligonucleotide; TTT chr11 5189116 5189137 5189133 5189138 +
tatgtattttgttgaattgtgt

SEQ ID NO: 77368 - DNA, 22 bp, Artificial Sequence
  Synthetic oligonucleotide; TTT chr11 5189117 5189138 5189134 5189139 +
atgtattttgttgaattgtgtt

SEQ ID NO: 77369 - DNA, 22 bp, Artificial Sequence
  Synthetic oligonucleotide; TTA chr11 5189118 5189139 5189135 5189140 +
tgtattttgttgaattgtgttt

SEQ ID NO: 77370 - DNA, 22 bp, Artificial Sequence
  Synthetic oligonucleotide; TTT chr11 5189125 5189146 5189142 5189147 +
tgttgaattgtgtttaatcaca

SEQ ID NO: 77371 - DNA, 22 bp, Artificial Sequence
  Synthetic oligonucleotide; TTT chr11 5189126 5189147 5189143 5189148 +
gttgaattgtgtttaatcacaa

SEQ ID NO: 77372 - DNA, 22 bp, Artificial Sequence
  Synthetic oligonucleotide; TTG chr11 5189127 5189148 5189144 5189149 +
ttgaattgtgtttaatcacaag

SEQ ID NO: 77373 - DNA, 22 bp, Artificial Sequence
  Synthetic oligonucleotide; TTG chr11 5189130 5189151 5189147 5189152 +
aattgtgtttaatcacaagagt

SEQ ID NO: 77374 - DNA, 22 bp, Artificial Sequence
  Synthetic oligonucleotide; TTG chr11 5189135 5189156 5189152 5189157 +
tgtttaatcacaagagtaatgc

SEQ ID NO: 77375 - DNA, 22 bp, Artificial Sequence
  Synthetic oligonucleotide; TTT chr11 5189140 5189161 5189157 5189162 +
aatcacaagagtaatgcatgcc

SEQ ID NO: 77376 - DNA, 22 bp, Artificial Sequence
  Synthetic oligonucleotide; TTA chr11 5189141 5189162 5189158 5189163 +
atcacaagagtaatgcatgcct

SEQ ID NO: 77377 - DNA, 22 bp, Artificial Sequence
  Synthetic oligonucleotide; CTG chr11 5189164 5189185 5189181 5189186 +
atatggtttggatctgtgtctc

SEQ ID NO: 77378 - DNA, 22 bp, Artificial Sequence
  Synthetic oligonucleotide; TTT chr11 5189173 5189194 5189190 5189195 +
ggatctgtgtctccaccctaat

SEQ ID NO: 77379 - DNA, 22 bp, Artificial Sequence
  Synthetic oligonucleotide; TTG chr11 5189174 5189195 5189191 5189196 +
gatctgtgtctccaccctaatc

SEQ ID NO: 77380 - DNA, 22 bp, Artificial Sequence
  Synthetic oligonucleotide; CTG chr11 5189180 5189201 5189197 5189202 +
tgtctccaccctaatctcatgt

SEQ ID NO: 77381 - DNA, 22 bp, Artificial Sequence
  Synthetic oligonucleotide; CTC chr11 5189186 5189207 5189203 5189208 +
caccctaatctcatgttcagct

SEQ ID NO: 77382 - DNA, 22 bp, Artificial Sequence
  Synthetic oligonucleotide; CTA chr11 5189193 5189214 5189210 5189215 +
atctcatgttcagctgtaatcc

SEQ ID NO: 77383 - DNA, 22 bp, Artificial Sequence
  Synthetic oligonucleotide; CTC chr11 5189198 5189219 5189215 5189220 +
atgttcagctgtaatccccagt

SEQ ID NO: 77384 - DNA, 22 bp, Artificial Sequence
  Synthetic oligonucleotide; TTC chr11 5189204 5189225 5189221 5189226 +
agctgtaatccccagtgttgaa

SEQ ID NO: 77385 - DNA, 22 bp, Artificial Sequence
  Synthetic oligonucleotide; CTG chr11 5189209 5189230 5189226 5189231 +
taatccccagtgttgaagatgg

SEQ ID NO: 77386 - DNA, 22 bp, Artificial Sequence
  Synthetic oligonucleotide; TTG chr11 5189224 5189245 5189241 5189246 +
aagatggggcctggtgggaagt

SEQ ID NO: 77387 - DNA, 22 bp, Artificial Sequence
  Synthetic oligonucleotide; CTG chr11 5189237 5189258 5189254 5189259 +
gtgggaagtgattggatcatag

SEQ ID NO: 77388 - DNA, 22 bp, Artificial Sequence
  Synthetic oligonucleotide; TTG chr11 5189251 5189272 5189268 5189273 +
gatcataggagcagagttatca

SEQ ID NO: 77389 - DNA, 22 bp, Artificial Sequence
  Synthetic oligonucleotide; TTA chr11 5189270 5189291 5189287 5189292 +
tcataaatagcttaatatcagt

SEQ ID NO: 77390 - DNA, 22 bp, Artificial Sequence
  Synthetic oligonucleotide; CTT chr11 5189283 5189304 5189300 5189305 +
aatatcagtcccttttggtacg

SEQ ID NO: 77391 - DNA, 22 bp, Artificial Sequence
  Synthetic oligonucleotide; TTA chr11 5189284 5189305 5189301 5189306 +
atatcagtcccttttggtacgt

SEQ ID NO: 77392 - DNA, 22 bp, Artificial Sequence
  Synthetic oligonucleotide; CTT chr11 5189297 5189318 5189314 5189319 +
ttggtacgtatagtgggtgagt

SEQ ID NO: 77393 - DNA, 22 bp, Artificial Sequence
  Synthetic oligonucleotide; TTT chr11 5189298 5189319 5189315 5189320 +
tggtacgtatagtgggtgagtt

SEQ ID NO: 77394 - DNA, 22 bp, Artificial Sequence
  Synthetic oligonucleotide; TTT chr11 5189299 5189320 5189316 5189321 +
ggtacgtatagtgggtgagttc

SEQ ID NO: 77395 - DNA, 22 bp, Artificial Sequence
  Synthetic oligonucleotide; TTG chr11 5189300 5189321 5189317 5189322 +
gtacgtatagtgggtgagttct

SEQ ID NO: 77396 - DNA, 22 bp, Artificial Sequence
  Synthetic oligonucleotide; TTC chr11 5189321 5189342 5189338 5189343 +
tcatgagatatggttgtttact

SEQ ID NO: 77397 - DNA, 22 bp, Artificial Sequence
  Synthetic oligonucleotide; CTC chr11 5189323 5189344 5189340 5189345 +
atgagatatggttgtttactac

SEQ ID NO: 77398 - DNA, 22 bp, Artificial Sequence
  Synthetic oligonucleotide; TTG chr11 5189337 5189358 5189354 5189359 +
tttactacctccctgcctcttc

SEQ ID NO: 77399 - DNA, 22 bp, Artificial Sequence
  Synthetic oligonucleotide; TTT chr11 5189340 5189361 5189357 5189362 +
actacctccctgcctcttcttc

SEQ ID NO: 77400 - DNA, 22 bp, Artificial Sequence
  Synthetic oligonucleotide; TTA chr11 5189341 5189362 5189358 5189363 +
ctacctccctgcctcttcttcc

SEQ ID NO: 77401 - DNA, 22 bp, Artificial Sequence
  Synthetic oligonucleotide; CTA chr11 5189344 5189365 5189361 5189366 +
cctccctgcctcttcttcctgc

SEQ ID NO: 77402 - DNA, 22 bp, Artificial Sequence
  Synthetic oligonucleotide; CTC chr11 5189348 5189369 5189365 5189370 +
cctgcctcttcttcctgctcca

SEQ ID NO: 77403 - DNA, 22 bp, Artificial Sequence
  Synthetic oligonucleotide; CTG chr11 5189352 5189373 5189369 5189374 +
cctcttcttcctgctccagcca

SEQ ID NO: 77404 - DNA, 22 bp, Artificial Sequence
  Synthetic oligonucleotide; CTC chr11 5189356 5189377 5189373 5189378 +
ttcttcctgctccagccatgtg

SEQ ID NO: 77405 - DNA, 22 bp, Artificial Sequence
  Synthetic oligonucleotide; CTT chr11 5189358 5189379 5189375 5189380 +
cttcctgctccagccatgtgaa

SEQ ID NO: 77406 - DNA, 22 bp, Artificial Sequence
  Synthetic oligonucleotide; TTC chr11 5189359 5189380 5189376 5189381 +
ttcctgctccagccatgtgaag

SEQ ID NO: 77407 - DNA, 22 bp, Artificial Sequence
  Synthetic oligonucleotide; CTT chr11 5189361 5189382 5189378 5189383 +
cctgctccagccatgtgaagac

SEQ ID NO: 77408 - DNA, 22 bp, Artificial Sequence
  Synthetic oligonucleotide; TTC chr11 5189362 5189383 5189379 5189384 +
ctgctccagccatgtgaagaca

SEQ ID NO: 77409 - DNA, 22 bp, Artificial Sequence
  Synthetic oligonucleotide; CTG chr11 5189365 5189386 5189382 5189387 +
ctccagccatgtgaagacacat

SEQ ID NO: 77410 - DNA, 22 bp, Artificial Sequence
  Synthetic oligonucleotide; CTC chr11 5189368 5189389 5189385 5189390 +
cagccatgtgaagacacatgct

SEQ ID NO: 77411 - DNA, 22 bp, Artificial Sequence
  Synthetic oligonucleotide; CTC chr11 5189391 5189412 5189408 5189413 +
ctgtttttctctctgccatgat

SEQ ID NO: 77412 - DNA, 22 bp, Artificial Sequence
  Synthetic oligonucleotide; CTG chr11 5189394 5189415 5189411 5189416 +
tttttctctctgccatgattat

SEQ ID NO: 77413 - DNA, 22 bp, Artificial Sequence
  Synthetic oligonucleotide; TTT chr11 5189397 5189418 5189414 5189419 +
ttctctctgccatgattataag

SEQ ID NO: 77414 - DNA, 22 bp, Artificial Sequence
  Synthetic oligonucleotide; TTT chr11 5189398 5189419 5189415 5189420 +
tctctctgccatgattataagt

SEQ ID NO: 77415 - DNA, 22 bp, Artificial Sequence
  Synthetic oligonucleotide; TTT chr11 5189399 5189420 5189416 5189421 +
ctctctgccatgattataagtt

SEQ ID NO: 77416 - DNA, 22 bp, Artificial Sequence
  Synthetic oligonucleotide; TTC chr11 5189400 5189421 5189417 5189422 +
tctctgccatgattataagttt

SEQ ID NO: 77417 - DNA, 22 bp, Artificial Sequence
  Synthetic oligonucleotide; CTC chr11 5189402 5189423 5189419 5189424 +
tctgccatgattataagtttcc

SEQ ID NO: 77418 - DNA, 22 bp, Artificial Sequence
  Synthetic oligonucleotide; CTC chr11 5189404 5189425 5189421 5189426 +
tgccatgattataagtttcctg

SEQ ID NO: 77419 - DNA, 22 bp, Artificial Sequence
  Synthetic oligonucleotide; CTG chr11 5189406 5189427 5189423 5189428 +
ccatgattataagtttcctgaa

SEQ ID NO: 77420 - DNA, 22 bp, Artificial Sequence
  Synthetic oligonucleotide; TTA chr11 5189415 5189436 5189432 5189437 +
taagtttcctgaaacctcccta

SEQ ID NO: 77421 - DNA, 22 bp, Artificial Sequence
  Synthetic oligonucleotide; TTT chr11 5189422 5189443 5189439 5189444 +
cctgaaacctccctagaagctg

SEQ ID NO: 77422 - DNA, 22 bp, Artificial Sequence
  Synthetic oligonucleotide; TTC chr11 5189423 5189444 5189440 5189445 +
ctgaaacctccctagaagctga

SEQ ID NO: 77423 - DNA, 22 bp, Artificial Sequence
  Synthetic oligonucleotide; CTG chr11 5189426 5189447 5189443 5189448 +
aaacctccctagaagctgagca

SEQ ID NO: 77424 - DNA, 22 bp, Artificial Sequence
  Synthetic oligonucleotide; CTC chr11 5189433 5189454 5189450 5189455 +
cctagaagctgagcagacgttg

SEQ ID NO: 77425 - DNA, 22 bp, Artificial Sequence
  Synthetic oligonucleotide; CTA chr11 5189437 5189458 5189454 5189459 +
gaagctgagcagacgttgccat

SEQ ID NO: 77426 - DNA, 22 bp, Artificial Sequence
  Synthetic oligonucleotide; CTG chr11 5189444 5189465 5189461 5189466 +
agcagacgttgccatgcttcct

SEQ ID NO: 77427 - DNA, 22 bp, Artificial Sequence
  Synthetic oligonucleotide; TTG chr11 5189455 5189476 5189472 5189477 +
ccatgcttcctgtacagccttt

SEQ ID NO: 77428 - DNA, 22 bp, Artificial Sequence
  Synthetic oligonucleotide; CTT chr11 5189463 5189484 5189480 5189485 +
cctgtacagcctttagaactgt

SEQ ID NO: 77429 - DNA, 22 bp, Artificial Sequence
  Synthetic oligonucleotide; TTC chr11 5189464 5189485 5189481 5189486 +
ctgtacagcctttagaactgtg

SEQ ID NO: 77430 - DNA, 22 bp, Artificial Sequence
  Synthetic oligonucleotide; CTG chr11 5189467 5189488 5189484 5189489 +
tacagcctttagaactgtgagc

SEQ ID NO: 77431 - DNA, 22 bp, Artificial Sequence
  Synthetic oligonucleotide; CTT chr11 5189476 5189497 5189493 5189498 +
tagaactgtgagccaattaaat

SEQ ID NO: 77432 - DNA, 22 bp, Artificial Sequence
  Synthetic oligonucleotide; TTT chr11 5189477 5189498 5189494 5189499 +
agaactgtgagccaattaaatc

SEQ ID NO: 77433 - DNA, 22 bp, Artificial Sequence
  Synthetic oligonucleotide; TTA chr11 5189478 5189499 5189495 5189500 +
gaactgtgagccaattaaatct

SEQ ID NO: 77434 - DNA, 22 bp, Artificial Sequence
  Synthetic oligonucleotide; CTG chr11 5189484 5189505 5189501 5189506 +
tgagccaattaaatctctgttc

SEQ ID NO: 77435 - DNA, 22 bp, Artificial Sequence
  Synthetic oligonucleotide; TTA chr11 5189495 5189516 5189512 5189517 +
aatctctgttcttcaccattta

SEQ ID NO: 77436 - DNA, 22 bp, Artificial Sequence
  Synthetic oligonucleotide; CTC chr11 5189501 5189522 5189518 5189523 +
tgttcttcaccatttacccagt

SEQ ID NO: 77437 - DNA, 22 bp, Artificial Sequence
  Synthetic oligonucleotide; CTG chr11 5189503 5189524 5189520 5189525 +
ttcttcaccatttacccagtct

SEQ ID NO: 77438 - DNA, 22 bp, Artificial Sequence
  Synthetic oligonucleotide; TTC chr11 5189506 5189527 5189523 5189528 +
ttcaccatttacccagtctcag

SEQ ID NO: 77439 - DNA, 22 bp, Artificial Sequence
  Synthetic oligonucleotide; CTT chr11 5189508 5189529 5189525 5189530 +
caccatttacccagtctcaggt

SEQ ID NO: 77440 - DNA, 22 bp, Artificial Sequence
  Synthetic oligonucleotide; TTC chr11 5189509 5189530 5189526 5189531 +
accatttacccagtctcaggta

SEQ ID NO: 77441 - DNA, 22 bp, Artificial Sequence
  Synthetic oligonucleotide; TTT chr11 5189516 5189537 5189533 5189538 +
acccagtctcaggtatttcctt

SEQ ID NO: 77442 - DNA, 22 bp, Artificial Sequence
  Synthetic oligonucleotide; TTA chr11 5189517 5189538 5189534 5189539 +
cccagtctcaggtatttcctta

SEQ ID NO: 77443 - DNA, 22 bp, Artificial Sequence
  Synthetic oligonucleotide; CTC chr11 5189526 5189547 5189543 5189548 +
aggtatttccttatagcaagat

SEQ ID NO: 77444 - DNA, 22 bp, Artificial Sequence
  Synthetic oligonucleotide; TTT chr11 5189534 5189555 5189551 5189556 +
ccttatagcaagatgagaatgg

SEQ ID NO: 77445 - DNA, 22 bp, Artificial Sequence
  Synthetic oligonucleotide; TTC chr11 5189535 5189556 5189552 5189557 +
cttatagcaagatgagaatgga

SEQ ID NO: 77446 - DNA, 22 bp, Artificial Sequence
  Synthetic oligonucleotide; CTT chr11 5189538 5189559 5189555 5189560 +
atagcaagatgagaatggacca

SEQ ID NO: 77447 - DNA, 22 bp, Artificial Sequence
  Synthetic oligonucleotide; TTA chr11 5189539 5189560 5189556 5189561 +
tagcaagatgagaatggaccag

SEQ ID NO: 77448 - DNA, 22 bp, Artificial Sequence
  Synthetic oligonucleotide; TTG chr11 5189573 5189594 5189590 5189595 +
gtaccaaaagtggggtactgct

SEQ ID NO: 77449 - DNA, 22 bp, Artificial Sequence
  Synthetic oligonucleotide; CTG chr11 5189593 5189614 5189610 5189615 +
ctataaagatacatgaaaatgt

SEQ ID NO: 77450 - DNA, 22 bp, Artificial Sequence
  Synthetic oligonucleotide; CTA chr11 5189596 5189617 5189613 5189618 +
taaagatacatgaaaatgtgga

SEQ ID NO: 77451 - DNA, 22 bp, Artificial Sequence
  Synthetic oligonucleotide; CTT chr11 5189626 5189647 5189643 5189648 +
tggcattggataacaggcagaa

SEQ ID NO: 77452 - DNA, 22 bp, Artificial Sequence
  Synthetic oligonucleotide; TTT chr11 5189627 5189648 5189644 5189649 +
ggcattggataacaggcagaag

SEQ ID NO: 77453 - DNA, 22 bp, Artificial Sequence
  Synthetic oligonucleotide; TTG chr11 5189628 5189649 5189645 5189650 +
gcattggataacaggcagaagt

SEQ ID NO: 77454 - DNA, 22 bp, Artificial Sequence
  Synthetic oligonucleotide; TTG chr11 5189634 5189655 5189651 5189656 +
gataacaggcagaagttggaag

SEQ ID NO: 77455 - DNA, 22 bp, Artificial Sequence
  Synthetic oligonucleotide; TTG chr11 5189652 5189673 5189669 5189674 +
gaagagtgtggacggctcagaa

SEQ ID NO: 77456 - DNA, 22 bp, Artificial Sequence
  Synthetic oligonucleotide; CTC chr11 5189670 5189691 5189687 5189692 +
agaagaagacagggagatgagg

SEQ ID NO: 77457 - DNA, 22 bp, Artificial Sequence
  Synthetic oligonucleotide; TTT chr11 5189700 5189721 5189717 5189722 +
ggaactttctagagacttgtgg

SEQ ID NO: 77458 - DNA, 22 bp, Artificial Sequence
  Synthetic oligonucleotide; TTG chr11 5189701 5189722 5189718 5189723 +
gaactttctagagacttgtgga

SEQ ID NO: 77459 - DNA, 22 bp, Artificial Sequence
  Synthetic oligonucleotide; CTT chr11 5189707 5189728 5189724 5189729 +
tctagagacttgtggaatggtt

SEQ ID NO: 77460 - DNA, 22 bp, Artificial Sequence
  Synthetic oligonucleotide; TTT chr11 5189708 5189729 5189725 5189730 +
ctagagacttgtggaatggttg

SEQ ID NO: 77461 - DNA, 22 bp, Artificial Sequence
  Synthetic oligonucleotide; TTC chr11 5189709 5189730 5189726 5189731 +
tagagacttgtggaatggttgt

SEQ ID NO: 77462 - DNA, 22 bp, Artificial Sequence
  Synthetic oligonucleotide; CTA chr11 5189711 5189732 5189728 5189733 +
gagacttgtggaatggttgtga

SEQ ID NO: 77463 - DNA, 22 bp, Artificial Sequence
  Synthetic oligonucleotide; CTT chr11 5189718 5189739 5189735 5189740 +
gtggaatggttgtgaccaaaat

SEQ ID NO: 77464 - DNA, 22 bp, Artificial Sequence
  Synthetic oligonucleotide; TTG chr11 5189719 5189740 5189736 5189741 +
tggaatggttgtgaccaaaatt

SEQ ID NO: 77465 - DNA, 22 bp, Artificial Sequence
  Synthetic oligonucleotide; TTG chr11 5189730 5189751 5189747 5189752 +
tgaccaaaattctgatagtgat

SEQ ID NO: 77466 - DNA, 22 bp, Artificial Sequence
  Synthetic oligonucleotide; TTC chr11 5189742 5189763 5189759 5189764 +
tgatagtgatatggacaatgaa

SEQ ID NO: 77467 - DNA, 22 bp, Artificial Sequence
  Synthetic oligonucleotide; CTG chr11 5189744 5189765 5189761 5189766 +
atagtgatatggacaatgaagt

SEQ ID NO: 77468 - DNA, 22 bp, Artificial Sequence
  Synthetic oligonucleotide; CTG chr11 5189774 5189795 5189791 5189796 +
aggtggtctcagatggaaatga

SEQ ID NO: 77469 - DNA, 22 bp, Artificial Sequence
  Synthetic oligonucleotide; CTC chr11 5189784 5189805 5189801 5189806 +
agatggaaatgaatttattgga

SEQ ID NO: 77470 - DNA, 22 bp, Artificial Sequence
  Synthetic oligonucleotide; TTT chr11 5189800 5189821 5189817 5189822 +
attggaaactggagcaaaggtc

SEQ ID NO: 77471 - DNA, 22 bp, Artificial Sequence
  Synthetic oligonucleotide; TTA chr11 5189801 5189822 5189818 5189823 +
ttggaaactggagcaaaggtca

SEQ ID NO: 77472 - DNA, 22 bp, Artificial Sequence
  Synthetic oligonucleotide; TTG chr11 5189804 5189825 5189821 5189826 +
gaaactggagcaaaggtcactt

SEQ ID NO: 77473 - DNA, 22 bp, Artificial Sequence
  Synthetic oligonucleotide; CTG chr11 5189811 5189832 5189828 5189833 +
gagcaaaggtcacttttgttat

SEQ ID NO: 77474 - DNA, 22 bp, Artificial Sequence
  Synthetic oligonucleotide; CTT chr11 5189826 5189847 5189843 5189848 +
ttgttatacattagcaaagagg

SEQ ID NO: 77475 - DNA, 22 bp, Artificial Sequence
  Synthetic oligonucleotide; TTT chr11 5189827 5189848 5189844 5189849 +
tgttatacattagcaaagaggt

SEQ ID NO: 77476 - DNA, 22 bp, Artificial Sequence
  Synthetic oligonucleotide; TTT chr11 5189828 5189849 5189845 5189850 +
gttatacattagcaaagaggtt

SEQ ID NO: 77477 - DNA, 22 bp, Artificial Sequence
  Synthetic oligonucleotide; TTG chr11 5189829 5189850 5189846 5189851 +
ttatacattagcaaagaggttg

SEQ ID NO: 77478 - DNA, 22 bp, Artificial Sequence
  Synthetic oligonucleotide; TTA chr11 5189832 5189853 5189849 5189854 +
tacattagcaaagaggttgact

SEQ ID NO: 77479 - DNA, 22 bp, Artificial Sequence
  Synthetic oligonucleotide; TTA chr11 5189839 5189860 5189856 5189861 +
gcaaagaggttgactgcactgt

SEQ ID NO: 77480 - DNA, 22 bp, Artificial Sequence
  Synthetic oligonucleotide; TTG chr11 5189851 5189872 5189868 5189873 +
actgcactgtgcctctacctta

SEQ ID NO: 77481 - DNA, 22 bp, Artificial Sequence
  Synthetic oligonucleotide; CTG chr11 5189855 5189876 5189872 5189877 +
cactgtgcctctaccttagaga

SEQ ID NO: 77482 - DNA, 22 bp, Artificial Sequence
  Synthetic oligonucleotide; CTG chr11 5189860 5189881 5189877 5189882 +
tgcctctaccttagagaatctg

SEQ ID NO: 77483 - DNA, 22 bp, Artificial Sequence
  Synthetic oligonucleotide; CTC chr11 5189866 5189887 5189883 5189888 +
taccttagagaatctgtggaaa

SEQ ID NO: 77484 - DNA, 22 bp, Artificial Sequence
  Synthetic oligonucleotide; CTA chr11 5189868 5189889 5189885 5189890 +
ccttagagaatctgtggaaatt

SEQ ID NO: 77485 - DNA, 22 bp, Artificial Sequence
  Synthetic oligonucleotide; CTT chr11 5189872 5189893 5189889 5189894 +
agagaatctgtggaaattcgaa

SEQ ID NO: 77486 - DNA, 22 bp, Artificial Sequence
  Synthetic oligonucleotide; TTA chr11 5189873 5189894 5189890 5189895 +
gagaatctgtggaaattcgaag

SEQ ID NO: 77487 - DNA, 22 bp, Artificial Sequence
  Synthetic oligonucleotide; CTG chr11 5189882 5189903 5189899 5189904 +
tggaaattcgaagttgataata

SEQ ID NO: 77488 - DNA, 22 bp, Artificial Sequence
  Synthetic oligonucleotide; TTC chr11 5189891 5189912 5189908 5189913 +
gaagttgataatattatttaag

SEQ ID NO: 77489 - DNA, 22 bp, Artificial Sequence
  Synthetic oligonucleotide; TTG chr11 5189898 5189919 5189915 5189920 +
ataatattatttaagttatgtg

SEQ ID NO: 77490 - DNA, 22 bp, Artificial Sequence
  Synthetic oligonucleotide; TTA chr11 5189907 5189928 5189924 5189929 +
tttaagttatgtgacagaagtt

SEQ ID NO: 77491 - DNA, 22 bp, Artificial Sequence
  Synthetic oligonucleotide; TTT chr11 5189910 5189931 5189927 5189932 +
aagttatgtgacagaagtttct

SEQ ID NO: 77492 - DNA, 22 bp, Artificial Sequence
  Synthetic oligonucleotide; TTA chr11 5189911 5189932 5189928 5189933 +
agttatgtgacagaagtttcta

SEQ ID NO: 77493 - DNA, 22 bp, Artificial Sequence
  Synthetic oligonucleotide; TTA chr11 5189916 5189937 5189933 5189938 +
tgtgacagaagtttctaagcag

SEQ ID NO: 77494 - DNA, 22 bp, Artificial Sequence
  Synthetic oligonucleotide; TTT chr11 5189930 5189951 5189947 5189952 +
ctaagcagcaaggtgttcaaga

SEQ ID NO: 77495 - DNA, 22 bp, Artificial Sequence
  Synthetic oligonucleotide; TTC chr11 5189931 5189952 5189948 5189953 +
taagcagcaaggtgttcaagat

SEQ ID NO: 77496 - DNA, 22 bp, Artificial Sequence
  Synthetic oligonucleotide; CTA chr11 5189933 5189954 5189950 5189955 +
agcagcaaggtgttcaagatgt

SEQ ID NO: 77497 - DNA, 22 bp, Artificial Sequence
  Synthetic oligonucleotide; TTC chr11 5189948 5189969 5189965 5189970 +
aagatgtgtcctggctgcttct

SEQ ID NO: 77498 - DNA, 22 bp, Artificial Sequence
  Synthetic oligonucleotide; CTG chr11 5189961 5189982 5189978 5189983 +
gctgcttctaacaacctatgct

SEQ ID NO: 77499 - DNA, 22 bp, Artificial Sequence
  Synthetic oligonucleotide; CTG chr11 5189965 5189986 5189982 5189987 +
cttctaacaacctatgctcata

SEQ ID NO: 77500 - DNA, 22 bp, Artificial Sequence
  Synthetic oligonucleotide; CTT chr11 5189968 5189989 5189985 5189990 +
ctaacaacctatgctcatatgt

SEQ ID NO: 77501 - DNA, 22 bp, Artificial Sequence
  Synthetic oligonucleotide; TTC chr11 5189969 5189990 5189986 5189991 +
taacaacctatgctcatatgtg

SEQ ID NO: 77502 - DNA, 22 bp, Artificial Sequence
  Synthetic oligonucleotide; CTA chr11 5189971 5189992 5189988 5189993 +
acaacctatgctcatatgtgtg

SEQ ID NO: 77503 - DNA, 22 bp, Artificial Sequence
  Synthetic oligonucleotide; CTA chr11 5189979 5190000 5189996 5190001 +
tgctcatatgtgtgagcaaaga

SEQ ID NO: 77504 - DNA, 22 bp, Artificial Sequence
  Synthetic oligonucleotide; CTC chr11 5189984 5190005 5190001 5190006 +
atatgtgtgagcaaagaaataa

SEQ ID NO: 77505 - DNA, 22 bp, Artificial Sequence
  Synthetic oligonucleotide; CTT chr11 5190022 5190043 5190039 5190044 +
atatttaaaagggaagcagagc

SEQ ID NO: 77506 - DNA, 22 bp, Artificial Sequence
  Synthetic oligonucleotide; TTA chr11 5190023 5190044 5190040 5190045 +
tatttaaaagggaagcagagca

SEQ ID NO: 77507 - DNA, 22 bp, Artificial Sequence
  Synthetic oligonucleotide; TTT chr11 5190028 5190049 5190045 5190050 +
aaaagggaagcagagcataaaa

SEQ ID NO: 77508 - DNA, 22 bp, Artificial Sequence
  Synthetic oligonucleotide; TTA chr11 5190029 5190050 5190046 5190051 +
aaagggaagcagagcataaaag

SEQ ID NO: 77509 - DNA, 22 bp, Artificial Sequence
  Synthetic oligonucleotide; TTT chr11 5190054 5190075 5190071 5190076 +
ggaaaattatctgctcggccat

SEQ ID NO: 77510 - DNA, 22 bp, Artificial Sequence
  Synthetic oligonucleotide; TTG chr11 5190055 5190076 5190072 5190077 +
gaaaattatctgctcggccatg

SEQ ID NO: 77511 - DNA, 22 bp, Artificial Sequence
  Synthetic oligonucleotide; TTA chr11 5190063 5190084 5190080 5190085 +
tctgctcggccatgtggtagaa

SEQ ID NO: 77512 - DNA, 22 bp, Artificial Sequence
  Synthetic oligonucleotide; CTG chr11 5190067 5190088 5190084 5190089 +
ctcggccatgtggtagaaaaca

SEQ ID NO: 77513 - DNA, 22 bp, Artificial Sequence
  Synthetic oligonucleotide; CTC chr11 5190070 5190091 5190087 5190092 +
ggccatgtggtagaaaacagaa

SEQ ID NO: 77514 - DNA, 22 bp, Artificial Sequence
  Synthetic oligonucleotide; CTC chr11 5190096 5190117 5190113 5190118 +
attttcaaaggagcaattcaag

SEQ ID NO: 77515 - DNA, 22 bp, Artificial Sequence
  Synthetic oligonucleotide; TTT chr11 5190100 5190121 5190117 5190122 +
tcaaaggagcaattcaagcagg

SEQ ID NO: 77516 - DNA, 22 bp, Artificial Sequence
  Synthetic oligonucleotide; TTT chr11 5190101 5190122 5190118 5190123 +
caaaggagcaattcaagcaggc

SEQ ID NO: 77517 - DNA, 22 bp, Artificial Sequence
  Synthetic oligonucleotide; TTC chr11 5190102 5190123 5190119 5190124 +
aaaggagcaattcaagcaggct

SEQ ID NO: 77518 - DNA, 22 bp, Artificial Sequence
  Synthetic oligonucleotide; TTC chr11 5190115 5190136 5190132 5190137 +
aagcaggctgtagaaatttgca

SEQ ID NO: 77519 - DNA, 22 bp, Artificial Sequence
  Synthetic oligonucleotide; CTG chr11 5190125 5190146 5190142 5190147 +
tagaaatttgcataaatgaaga

SEQ ID NO: 77520 - DNA, 22 bp, Artificial Sequence
  Synthetic oligonucleotide; TTT chr11 5190134 5190155 5190151 5190156 +
gcataaatgaagaggagccgag

SEQ ID NO: 77521 - DNA, 22 bp, Artificial Sequence
  Synthetic oligonucleotide; TTG chr11 5190135 5190156 5190152 5190157 +
cataaatgaagaggagccgagt

SEQ ID NO: 77522 - DNA, 22 bp, Artificial Sequence
  Synthetic oligonucleotide; TTC chr11 5190159 5190180 5190176 5190181 +
taatagccaaaataaaggggag

SEQ ID NO: 77523 - DNA, 22 bp, Artificial Sequence
  Synthetic oligonucleotide; CTA chr11 5190161 5190182 5190178 5190183 +
atagccaaaataaaggggagaa

SEQ ID NO: 77524 - DNA, 22 bp, Artificial Sequence
  Synthetic oligonucleotide; CTC chr11 5190189 5190210 5190206 5190211 +
aaagacatttcagagacccttg

SEQ ID NO: 77525 - DNA, 22 bp, Artificial Sequence
  Synthetic oligonucleotide; TTT chr11 5190199 5190220 5190216 5190221 +
cagagacccttgtagcagcccc

SEQ ID NO: 77526 - DNA, 22 bp, Artificial Sequence
  Synthetic oligonucleotide; TTC chr11 5190200 5190221 5190217 5190222 +
agagacccttgtagcagcccct

SEQ ID NO: 77527 - DNA, 22 bp, Artificial Sequence
  Synthetic oligonucleotide; CTT chr11 5190210 5190231 5190227 5190232 +
gtagcagcccctcacatcacag

SEQ ID NO: 77528 - DNA, 22 bp, Artificial Sequence
  Synthetic oligonucleotide; TTG chr11 5190211 5190232 5190228 5190233 +
tagcagcccctcacatcacagg

SEQ ID NO: 77529 - DNA, 22 bp, Artificial Sequence
  Synthetic oligonucleotide; CTC chr11 5190223 5190244 5190240 5190245 +
acatcacaggcctggtggccta

SEQ ID NO: 77530 - DNA, 22 bp, Artificial Sequence
  Synthetic oligonucleotide; CTG chr11 5190237 5190258 5190254 5190259 +
gtggcctaggagtactgaatga

SEQ ID NO: 77531 - DNA, 22 bp, Artificial Sequence
  Synthetic oligonucleotide; CTA chr11 5190245 5190266 5190262 5190267 +
ggagtactgaatgattttgtgg

SEQ ID NO: 77532 - DNA, 22 bp, Artificial Sequence
  Synthetic oligonucleotide; CTG chr11 5190254 5190275 5190271 5190276 +
aatgattttgtgggtgagattc

SEQ ID NO: 77533 - DNA, 22 bp, Artificial Sequence
  Synthetic oligonucleotide; TTT chr11 5190262 5190283 5190279 5190284 +
tgtgggtgagattcaggaccct

SEQ ID NO: 77534 - DNA, 22 bp, Artificial Sequence
  Synthetic oligonucleotide; TTT chr11 5190263 5190284 5190280 5190285 +
gtgggtgagattcaggaccctg

SEQ ID NO: 77535 - DNA, 22 bp, Artificial Sequence
  Synthetic oligonucleotide; TTG chr11 5190264 5190285 5190281 5190286 +
tgggtgagattcaggaccctgc

SEQ ID NO: 77536 - DNA, 22 bp, Artificial Sequence
  Synthetic oligonucleotide; TTC chr11 5190276 5190297 5190293 5190298 +
aggaccctgctgccttgagcag

SEQ ID NO: 77537 - DNA, 22 bp, Artificial Sequence
  Synthetic oligonucleotide; CTG chr11 5190285 5190306 5190302 5190307 +
ctgccttgagcagcttcaggac

SEQ ID NO: 77538 - DNA, 22 bp, Artificial Sequence
  Synthetic oligonucleotide; CTG chr11 5190288 5190309 5190305 5190310 +
ccttgagcagcttcaggacact

SEQ ID NO: 77539 - DNA, 22 bp, Artificial Sequence
  Synthetic oligonucleotide; CTT chr11 5190292 5190313 5190309 5190314 +
gagcagcttcaggacactgttc

SEQ ID NO: 77540 - DNA, 22 bp, Artificial Sequence
  Synthetic oligonucleotide; TTG chr11 5190293 5190314 5190310 5190315 +
agcagcttcaggacactgttcc

SEQ ID NO: 77541 - DNA, 22 bp, Artificial Sequence
  Synthetic oligonucleotide; CTT chr11 5190301 5190322 5190318 5190323 +
caggacactgttccttgcatcc

SEQ ID NO: 77542 - DNA, 22 bp, Artificial Sequence
  Synthetic oligonucleotide; TTC chr11 5190302 5190323 5190319 5190324 +
aggacactgttccttgcatcct

SEQ ID NO: 77543 - DNA, 22 bp, Artificial Sequence
  Synthetic oligonucleotide; CTG chr11 5190311 5190332 5190328 5190333 +
ttccttgcatcctggctgctcc

SEQ ID NO: 77544 - DNA, 22 bp, Artificial Sequence
  Synthetic oligonucleotide; TTC chr11 5190314 5190335 5190331 5190336 +
cttgcatcctggctgctccagc

SEQ ID NO: 77545 - DNA, 22 bp, Artificial Sequence
  Synthetic oligonucleotide; CTT chr11 5190317 5190338 5190334 5190339 +
gcatcctggctgctccagcacc

SEQ ID NO: 77546 - DNA, 22 bp, Artificial Sequence
  Synthetic oligonucleotide; TTG chr11 5190318 5190339 5190335 5190340 +
catcctggctgctccagcacca

SEQ ID NO: 77547 - DNA, 22 bp, Artificial Sequence
  Synthetic oligonucleotide; CTG chr11 5190325 5190346 5190342 5190347 +
gctgctccagcaccagctgtgg

SEQ ID NO: 77548 - DNA, 22 bp, Artificial Sequence
  Synthetic oligonucleotide; CTG chr11 5190329 5190350 5190346 5190351 +
ctccagcaccagctgtggctca

SEQ ID NO: 77549 - DNA, 22 bp, Artificial Sequence
  Synthetic oligonucleotide; CTC chr11 5190332 5190353 5190349 5190354 +
cagcaccagctgtggctcaaag

SEQ ID NO: 77550 - DNA, 22 bp, Artificial Sequence
  Synthetic oligonucleotide; CTG chr11 5190344 5190365 5190361 5190366 +
tggctcaaaggggcccaagaac

SEQ ID NO: 77551 - DNA, 22 bp, Artificial Sequence
  Synthetic oligonucleotide; CTC chr11 5190350 5190371 5190367 5190372 +
aaaggggcccaagaacagctaa

SEQ ID NO: 77552 - DNA, 22 bp, Artificial Sequence
  Synthetic oligonucleotide; CTA chr11 5190371 5190392 5190388 5190393 +
aggccactgcttcagagggtgc

SEQ ID NO: 77553 - DNA, 22 bp, Artificial Sequence
  Synthetic oligonucleotide; CTG chr11 5190380 5190401 5190397 5190402 +
cttcagagggtgcaagacataa

SEQ ID NO: 77554 - DNA, 22 bp, Artificial Sequence
  Synthetic oligonucleotide; CTT chr11 5190383 5190404 5190400 5190405 +
cagagggtgcaagacataagcc

SEQ ID NO: 77555 - DNA, 22 bp, Artificial Sequence
  Synthetic oligonucleotide; TTC chr11 5190384 5190405 5190401 5190406 +
agagggtgcaagacataagcct

SEQ ID NO: 77556 - DNA, 22 bp, Artificial Sequence
  Synthetic oligonucleotide; CTT chr11 5190407 5190428 5190424 5190429 +
ggaggcttccacatggtgataa

SEQ ID NO: 77557 - DNA, 22 bp, Artificial Sequence
  Synthetic oligonucleotide; TTG chr11 5190408 5190429 5190425 5190430 +
gaggcttccacatggtgataaa

SEQ ID NO: 77558 - DNA, 22 bp, Artificial Sequence
  Synthetic oligonucleotide; CTT chr11 5190415 5190436 5190432 5190437 +
ccacatggtgataaatctggga

SEQ ID NO: 77559 - DNA, 22 bp, Artificial Sequence
  Synthetic oligonucleotide; TTC chr11 5190416 5190437 5190433 5190438 +
cacatggtgataaatctgggag

SEQ ID NO: 77560 - DNA, 22 bp, Artificial Sequence
  Synthetic oligonucleotide; CTG chr11 5190434 5190455 5190451 5190456 +
ggagtgtgcaaaggtcaaaaag

SEQ ID NO: 77561 - DNA, 22 bp, Artificial Sequence
  Synthetic oligonucleotide; TTG chr11 5190459 5190480 5190476 5190481 +
aggcttgtaagcctccacctag

SEQ ID NO: 77562 - DNA, 22 bp, Artificial Sequence
  Synthetic oligonucleotide; CTT chr11 5190465 5190486 5190482 5190487 +
gtaagcctccacctagatttca

SEQ ID NO: 77563 - DNA, 22 bp, Artificial Sequence
  Synthetic oligonucleotide; TTG chr11 5190466 5190487 5190483 5190488 +
taagcctccacctagatttcag

SEQ ID NO: 77564 - DNA, 22 bp, Artificial Sequence
  Synthetic oligonucleotide; CTC chr11 5190474 5190495 5190491 5190496 +
cacctagatttcagaggatgtg

SEQ ID NO: 77565 - DNA, 22 bp, Artificial Sequence
  Synthetic oligonucleotide; CTA chr11 5190480 5190501 5190497 5190502 +
gatttcagaggatgtgtagaaa

SEQ ID NO: 77566 - DNA, 22 bp, Artificial Sequence
  Synthetic oligonucleotide; TTT chr11 5190485 5190506 5190502 5190507 +
cagaggatgtgtagaaaagcct

SEQ ID NO: 77567 - DNA, 22 bp, Artificial Sequence
  Synthetic oligonucleotide; TTC chr11 5190486 5190507 5190503 5190508 +
agaggatgtgtagaaaagcctg

SEQ ID NO: 77568 - DNA, 22 bp, Artificial Sequence
  Synthetic oligonucleotide; CTG chr11 5190508 5190529 5190525 5190530 +
agtgttcaggcagaagcctcct

SEQ ID NO: 77569 - DNA, 22 bp, Artificial Sequence
  Synthetic oligonucleotide; TTC chr11 5190515 5190536 5190532 5190537 +
aggcagaagcctcctgcagggg

SEQ ID NO: 77570 - DNA, 22 bp, Artificial Sequence
  Synthetic oligonucleotide; CTC chr11 5190528 5190549 5190545 5190550 +
ctgcaggggcagaaccctcatg

SEQ ID NO: 77571 - DNA, 22 bp, Artificial Sequence
  Synthetic oligonucleotide; CTG chr11 5190531 5190552 5190548 5190553 +
caggggcagaaccctcatgaag

SEQ ID NO: 77572 - DNA, 22 bp, Artificial Sequence
  Synthetic oligonucleotide; CTC chr11 5190547 5190568 5190564 5190569 +
atgaagaacctctaatagggca

SEQ ID NO: 77573 - DNA, 22 bp, Artificial Sequence
  Synthetic oligonucleotide; CTC chr11 5190559 5190580 5190576 5190581 +
taatagggcaatgtggaggaaa

SEQ ID NO: 77574 - DNA, 22 bp, Artificial Sequence
  Synthetic oligonucleotide; CTA chr11 5190561 5190582 5190578 5190583 +
atagggcaatgtggaggaaaaa

SEQ ID NO: 77575 - DNA, 22 bp, Artificial Sequence
  Synthetic oligonucleotide; TTG chr11 5190593 5190614 5190610 5190615 +
gaaccccctcacagagtctcca

SEQ ID NO: 77576 - DNA, 22 bp, Artificial Sequence
  Synthetic oligonucleotide; CTC chr11 5190603 5190624 5190620 5190625 +
acagagtctccactggggcact

SEQ ID NO: 77577 - DNA, 22 bp, Artificial Sequence
  Synthetic oligonucleotide; CTC chr11 5190613 5190634 5190630 5190635 +
cactggggcactgcctagcaga

SEQ ID NO: 77578 - DNA, 22 bp, Artificial Sequence
  Synthetic oligonucleotide; CTG chr11 5190618 5190639 5190635 5190640 +
gggcactgcctagcagagctat

SEQ ID NO: 77579 - DNA, 22 bp, Artificial Sequence
  Synthetic oligonucleotide; CTG chr11 5190626 5190647 5190643 5190648 +
cctagcagagctatgagaaaag

SEQ ID NO: 77580 - DNA, 22 bp, Artificial Sequence
  Synthetic oligonucleotide; CTA chr11 5190630 5190651 5190647 5190652 +
gcagagctatgagaaaagggcc

SEQ ID NO: 77581 - DNA, 22 bp, Artificial Sequence
  Synthetic oligonucleotide; CTA chr11 5190639 5190660 5190656 5190661 +
tgagaaaagggccaccgtcctc

SEQ ID NO: 77582 - DNA, 22 bp, Artificial Sequence
  Synthetic oligonucleotide; CTC chr11 5190661 5190682 5190678 5190683 +
cagaccccagaatggtagatcc

SEQ ID NO: 77583 - DNA, 22 bp, Artificial Sequence
  Synthetic oligonucleotide; CTG chr11 5190687 5190708 5190704 5190709 +
acagtttgcaccgtgcacctag

SEQ ID NO: 77584 - DNA, 22 bp, Artificial Sequence
  Synthetic oligonucleotide; TTT chr11 5190694 5190715 5190711 5190716 +
gcaccgtgcacctagaaaagct

SEQ ID NO: 77585 - DNA, 22 bp, Artificial Sequence
  Synthetic oligonucleotide; TTG chr11 5190695 5190716 5190712 5190717 +
caccgtgcacctagaaaagctg

SEQ ID NO: 77586 - DNA, 22 bp, Artificial Sequence
  Synthetic oligonucleotide; CTA chr11 5190708 5190729 5190725 5190730 +
gaaaagctgcaaacactcaata

SEQ ID NO: 77587 - DNA, 22 bp, Artificial Sequence
  Synthetic oligonucleotide; CTG chr11 5190717 5190738 5190734 5190739 +
caaacactcaatacaatctctt

SEQ ID NO: 77588 - DNA, 22 bp, Artificial Sequence
  Synthetic oligonucleotide; CTC chr11 5190726 5190747 5190743 5190748 +
aatacaatctcttaagagcagc

SEQ ID NO: 77589 - DNA, 22 bp, Artificial Sequence
  Synthetic oligonucleotide; CTC chr11 5190737 5190758 5190754 5190759 +
ttaagagcagcagcaggggcta

SEQ ID NO: 77590 - DNA, 22 bp, Artificial Sequence
  Synthetic oligonucleotide; CTT chr11 5190739 5190760 5190756 5190761 +
aagagcagcagcaggggctaaa

SEQ ID NO: 77591 - DNA, 22 bp, Artificial Sequence
  Synthetic oligonucleotide; TTA chr11 5190740 5190761 5190757 5190762 +
agagcagcagcaggggctaaac

SEQ ID NO: 77592 - DNA, 22 bp, Artificial Sequence
  Synthetic oligonucleotide; CTA chr11 5190759 5190780 5190776 5190781 +
aactgtgcaaagcaataggggt

SEQ ID NO: 77593 - DNA, 22 bp, Artificial Sequence
  Synthetic oligonucleotide; CTG chr11 5190764 5190785 5190781 5190786 +
tgcaaagcaataggggtggaac

SEQ ID NO: 77594 - DNA, 22 bp, Artificial Sequence
  Synthetic oligonucleotide; CTG chr11 5190788 5190809 5190805 5190810 +
cccaaggccttgggagcccacc

SEQ ID NO: 77595 - DNA, 22 bp, Artificial Sequence
  Synthetic oligonucleotide; CTT chr11 5190799 5190820 5190816 5190821 +
gggagcccacctcttgcatcag

SEQ ID NO: 77596 - DNA, 22 bp, Artificial Sequence
  Synthetic oligonucleotide; TTG chr11 5190800 5190821 5190817 5190822 +
ggagcccacctcttgcatcagt

SEQ ID NO: 77597 - DNA, 22 bp, Artificial Sequence
  Synthetic oligonucleotide; CTC chr11 5190812 5190833 5190829 5190834 +
ttgcatcagtgtgtccctgata

SEQ ID NO: 77598 - DNA, 22 bp, Artificial Sequence
  Synthetic oligonucleotide; CTT chr11 5190814 5190835 5190831 5190836 +
gcatcagtgtgtccctgatatg

SEQ ID NO: 77599 - DNA, 22 bp, Artificial Sequence
  Synthetic oligonucleotide; TTG chr11 5190815 5190836 5190832 5190837 +
catcagtgtgtccctgatatga

SEQ ID NO: 77600 - DNA, 22 bp, Artificial Sequence
  Synthetic oligonucleotide; CTG chr11 5190831 5190852 5190848 5190853 +
atatgagacatggggtcaaagg

SEQ ID NO: 77601 - DNA, 22 bp, Artificial Sequence
  Synthetic oligonucleotide; TTA chr11 5190859 5190880 5190876 5190881 +
ttttggagtgttaaggtgtgta

SEQ ID NO: 77602 - DNA, 22 bp, Artificial Sequence
  Synthetic oligonucleotide; TTT chr11 5190862 5190883 5190879 5190884 +
tggagtgttaaggtgtgtattt

SEQ ID NO: 77603 - DNA, 22 bp, Artificial Sequence
  Synthetic oligonucleotide; TTT chr11 5190863 5190884 5190880 5190885 +
ggagtgttaaggtgtgtatttg

SEQ ID NO: 77604 - DNA, 22 bp, Artificial Sequence
  Synthetic oligonucleotide; TTG chr11 5190864 5190885 5190881 5190886 +
gagtgttaaggtgtgtatttgt

SEQ ID NO: 77605 - DNA, 22 bp, Artificial Sequence
  Synthetic oligonucleotide; TTA chr11 5190872 5190893 5190889 5190894 +
aggtgtgtatttgtccgtttta

SEQ ID NO: 77606 - DNA, 22 bp, Artificial Sequence
  Synthetic oligonucleotide; TTT chr11 5190884 5190905 5190901 5190906 +
gtccgttttaaactgctatgaa

SEQ ID NO: 77607 - DNA, 22 bp, Artificial Sequence
  Synthetic oligonucleotide; TTG chr11 5190885 5190906 5190902 5190907 +
tccgttttaaactgctatgaag

SEQ ID NO: 77608 - DNA, 22 bp, Artificial Sequence
  Synthetic oligonucleotide; TTT chr11 5190892 5190913 5190909 5190914 +
taaactgctatgaagaaatacc

SEQ ID NO: 77609 - DNA, 22 bp, Artificial Sequence
  Synthetic oligonucleotide; TTT chr11 5190893 5190914 5190910 5190915 +
aaactgctatgaagaaataccc

SEQ ID NO: 77610 - DNA, 22 bp, Artificial Sequence
  Synthetic oligonucleotide; TTA chr11 5190894 5190915 5190911 5190916 +
aactgctatgaagaaatacccg

SEQ ID NO: 77611 - DNA, 22 bp, Artificial Sequence
  Synthetic oligonucleotide; CTG chr11 5190899 5190920 5190916 5190921 +
ctatgaagaaatacccgagact

SEQ ID NO: 77612 - DNA, 22 bp, Artificial Sequence
  Synthetic oligonucleotide; CTA chr11 5190902 5190923 5190919 5190924 +
tgaagaaatacccgagactggg

SEQ ID NO: 77613 - DNA, 22 bp, Artificial Sequence
  Synthetic oligonucleotide; CTG chr11 5190922 5190943 5190939 5190944 +
ggtaatttataaagaaaaagag

SEQ ID NO: 77614 - DNA, 22 bp, Artificial Sequence
  Synthetic oligonucleotide; TTT chr11 5190930 5190951 5190947 5190952 +
ataaagaaaaagagatttaatg

SEQ ID NO: 77615 - DNA, 22 bp, Artificial Sequence
  Synthetic oligonucleotide; TTA chr11 5190931 5190952 5190948 5190953 +
taaagaaaaagagatttaatgg

SEQ ID NO: 77616 - DNA, 22 bp, Artificial Sequence
  Synthetic oligonucleotide; TTT chr11 5190948 5190969 5190965 5190970 +
aatggactcatagatccacatt

SEQ ID NO: 77617 - DNA, 22 bp, Artificial Sequence
  Synthetic oligonucleotide; TTA chr11 5190949 5190970 5190966 5190971 +
atggactcatagatccacattg

SEQ ID NO: 77618 - DNA, 22 bp, Artificial Sequence
  Synthetic oligonucleotide; CTC chr11 5190957 5190978 5190974 5190979 +
atagatccacattgctggggag

SEQ ID NO: 77619 - DNA, 22 bp, Artificial Sequence
  Synthetic oligonucleotide; TTG chr11 5190971 5190992 5190988 5190993 +
ctggggaggccttacaatcatg

SEQ ID NO: 77620 - DNA, 22 bp, Artificial Sequence
  Synthetic oligonucleotide; CTG chr11 5190974 5190995 5190991 5190996 +
gggaggccttacaatcatggtg

SEQ ID NO: 77621 - DNA, 22 bp, Artificial Sequence
  Synthetic oligonucleotide; CTT chr11 5190984 5191005 5191001 5191006 +
acaatcatggtggaaggtgaag

SEQ ID NO: 77622 - DNA, 22 bp, Artificial Sequence
  Synthetic oligonucleotide; TTA chr11 5190985 5191006 5191002 5191007 +
caatcatggtggaaggtgaagg

SEQ ID NO: 77623 - DNA, 22 bp, Artificial Sequence
  Synthetic oligonucleotide; CTG chr11 5191026 5191047 5191043 5191048 +
acatggtggcaggcaagagagc

SEQ ID NO: 77624 - DNA, 22 bp, Artificial Sequence
  Synthetic oligonucleotide; CTT chr11 5191069 5191090 5191086 5191091 +
tataaaaccatcagatcttgtg

SEQ ID NO: 77625 - DNA, 22 bp, Artificial Sequence
  Synthetic oligonucleotide; TTT chr11 5191070 5191091 5191087 5191092 +
ataaaaccatcagatcttgtga

SEQ ID NO: 77626 - DNA, 22 bp, Artificial Sequence
  Synthetic oligonucleotide; TTA chr11 5191071 5191092 5191088 5191093 +
taaaaccatcagatcttgtgag

SEQ ID NO: 77627 - DNA, 22 bp, Artificial Sequence
  Synthetic oligonucleotide; CTT chr11 5191088 5191109 5191105 5191110 +
gtgagacttactcactatcatg

SEQ ID NO: 77628 - DNA, 22 bp, Artificial Sequence
  Synthetic oligonucleotide; TTG chr11 5191089 5191110 5191106 5191111 +
tgagacttactcactatcatga

SEQ ID NO: 77629 - DNA, 22 bp, Artificial Sequence
  Synthetic oligonucleotide; CTT chr11 5191097 5191118 5191114 5191119 +
actcactatcatgagaacagca

SEQ ID NO: 77630 - DNA, 22 bp, Artificial Sequence
  Synthetic oligonucleotide; TTA chr11 5191098 5191119 5191115 5191120 +
ctcactatcatgagaacagcat

SEQ ID NO: 77631 - DNA, 22 bp, Artificial Sequence
  Synthetic oligonucleotide; CTC chr11 5191101 5191122 5191118 5191123 +
actatcatgagaacagcatgtg

SEQ ID NO: 77632 - DNA, 22 bp, Artificial Sequence
  Synthetic oligonucleotide; CTA chr11 5191105 5191126 5191122 5191127 +
tcatgagaacagcatgtgaaaa

SEQ ID NO: 77633 - DNA, 22 bp, Artificial Sequence
  Synthetic oligonucleotide; CTA chr11 5191132 5191153 5191149 5191154 +
cccccatgattcaattacatcc

SEQ ID NO: 77634 - DNA, 22 bp, Artificial Sequence
  Synthetic oligonucleotide; TTC chr11 5191144 5191165 5191161 5191166 +
aattacatcccagtgtgttcct

SEQ ID NO: 77635 - DNA, 22 bp, Artificial Sequence
  Synthetic oligonucleotide; TTA chr11 5191149 5191170 5191166 5191171 +
catcccagtgtgttccttccat

SEQ ID NO: 77636 - DNA, 22 bp, Artificial Sequence
  Synthetic oligonucleotide; TTC chr11 5191164 5191185 5191181 5191186 +
cttccatgacaggcagggatta

SEQ ID NO: 77637 - DNA, 22 bp, Artificial Sequence
  Synthetic oligonucleotide; CTT chr11 5191167 5191188 5191184 5191189 +
ccatgacaggcagggattatgg

SEQ ID NO: 77638 - DNA, 22 bp, Artificial Sequence
  Synthetic oligonucleotide; TTC chr11 5191168 5191189 5191185 5191190 +
catgacaggcagggattatggg

SEQ ID NO: 77639 - DNA, 22 bp, Artificial Sequence
  Synthetic oligonucleotide; TTA chr11 5191186 5191207 5191203 5191208 +
tgggacctactattcaagaaga

SEQ ID NO: 77640 - DNA, 22 bp, Artificial Sequence
  Synthetic oligonucleotide; CTA chr11 5191195 5191216 5191212 5191217 +
ctattcaagaagaaatttgggt

SEQ ID NO: 77641 - DNA, 22 bp, Artificial Sequence
  Synthetic oligonucleotide; CTA chr11 5191198 5191219 5191215 5191220 +
ttcaagaagaaatttgggtggg

SEQ ID NO: 77642 - DNA, 22 bp, Artificial Sequence
  Synthetic oligonucleotide; TTC chr11 5191201 5191222 5191218 5191223 +
aagaagaaatttgggtgggaaa

SEQ ID NO: 77643 - DNA, 22 bp, Artificial Sequence
  Synthetic oligonucleotide; TTT chr11 5191213 5191234 5191230 5191235 +
gggtgggaaaactgccaaacca

SEQ ID NO: 77644 - DNA, 22 bp, Artificial Sequence
  Synthetic oligonucleotide; TTG chr11 5191214 5191235 5191231 5191236 +
ggtgggaaaactgccaaaccat

SEQ ID NO: 77645 - DNA, 22 bp, Artificial Sequence
  Synthetic oligonucleotide; CTG chr11 5191227 5191248 5191244 5191249 +
ccaaaccatatcaaggtgtaat

SEQ ID NO: 77646 - DNA, 22 bp, Artificial Sequence
  Synthetic oligonucleotide; CTG chr11 5191254 5191275 5191271 5191276 +
ccctgctgggttttctactcgt

SEQ ID NO: 77647 - DNA, 22 bp, Artificial Sequence
  Synthetic oligonucleotide; CTG chr11 5191259 5191280 5191276 5191281 +
ctgggttttctactcgtgtggg

SEQ ID NO: 77648 - DNA, 22 bp, Artificial Sequence
  Synthetic oligonucleotide; CTG chr11 5191262 5191283 5191279 5191284 +
ggttttctactcgtgtgggatc

SEQ ID NO: 77649 - DNA, 22 bp, Artificial Sequence
  Synthetic oligonucleotide; TTT chr11 5191267 5191288 5191284 5191289 +
tctactcgtgtgggatctttag

SEQ ID NO: 77650 - DNA, 22 bp, Artificial Sequence
  Synthetic oligonucleotide; TTT chr11 5191268 5191289 5191285 5191290 +
ctactcgtgtgggatctttagc

SEQ ID NO: 77651 - DNA, 22 bp, Artificial Sequence
  Synthetic oligonucleotide; TTC chr11 5191269 5191290 5191286 5191291 +
tactcgtgtgggatctttagcc

SEQ ID NO: 77652 - DNA, 22 bp, Artificial Sequence
  Synthetic oligonucleotide; CTA chr11 5191271 5191292 5191288 5191293 +
ctcgtgtgggatctttagcccc

SEQ ID NO: 77653 - DNA, 22 bp, Artificial Sequence
  Synthetic oligonucleotide; CTC chr11 5191274 5191295 5191291 5191296 +
gtgtgggatctttagccccttt

SEQ ID NO: 77654 - DNA, 22 bp, Artificial Sequence
  Synthetic oligonucleotide; CTT chr11 5191286 5191307 5191303 5191308 +
tagcccctttcttttggtgcat

SEQ ID NO: 77655 - DNA, 22 bp, Artificial Sequence
  Synthetic oligonucleotide; TTT chr11 5191287 5191308 5191304 5191309 +
agcccctttcttttggtgcatt

SEQ ID NO: 77656 - DNA, 22 bp, Artificial Sequence
  Synthetic oligonucleotide; TTA chr11 5191288 5191309 5191305 5191310 +
gcccctttcttttggtgcattt

SEQ ID NO: 77657 - DNA, 22 bp, Artificial Sequence
  Synthetic oligonucleotide; CTT chr11 5191295 5191316 5191312 5191317 +
tcttttggtgcatttctctctt

SEQ ID NO: 77658 - DNA, 22 bp, Artificial Sequence
  Synthetic oligonucleotide; TTT chr11 5191296 5191317 5191313 5191318 +
cttttggtgcatttctctcttt

SEQ ID NO: 77659 - DNA, 22 bp, Artificial Sequence
  Synthetic oligonucleotide; TTC chr11 5191297 5191318 5191314 5191319 +
ttttggtgcatttctctctttt

SEQ ID NO: 77660 - DNA, 22 bp, Artificial Sequence
  Synthetic oligonucleotide; CTT chr11 5191299 5191320 5191316 5191321 +
ttggtgcatttctctcttttgg

SEQ ID NO: 77661 - DNA, 22 bp, Artificial Sequence
  Synthetic oligonucleotide; TTT chr11 5191300 5191321 5191317 5191322 +
tggtgcatttctctcttttgga

SEQ ID NO: 77662 - DNA, 22 bp, Artificial Sequence
  Synthetic oligonucleotide; TTT chr11 5191301 5191322 5191318 5191323 +
ggtgcatttctctcttttggaa

SEQ ID NO: 77663 - DNA, 22 bp, Artificial Sequence
  Synthetic oligonucleotide; TTG chr11 5191302 5191323 5191319 5191324 +
gtgcatttctctcttttggaat

SEQ ID NO: 77664 - DNA, 22 bp, Artificial Sequence
  Synthetic oligonucleotide; TTT chr11 5191310 5191331 5191327 5191332 +
ctctcttttggaatgggaattt

SEQ ID NO: 77665 - DNA, 22 bp, Artificial Sequence
  Synthetic oligonucleotide; TTC chr11 5191311 5191332 5191328 5191333 +
tctcttttggaatgggaatttg

SEQ ID NO: 77666 - DNA, 22 bp, Artificial Sequence
  Synthetic oligonucleotide; CTC chr11 5191313 5191334 5191330 5191335 +
tcttttggaatgggaatttgta

SEQ ID NO: 77667 - DNA, 22 bp, Artificial Sequence
  Synthetic oligonucleotide; CTC chr11 5191315 5191336 5191332 5191337 +
ttttggaatgggaatttgtacc

SEQ ID NO: 77668 - DNA, 22 bp, Artificial Sequence
  Synthetic oligonucleotide; CTT chr11 5191317 5191338 5191334 5191339 +
ttggaatgggaatttgtaccca

SEQ ID NO: 77669 - DNA, 22 bp, Artificial Sequence
  Synthetic oligonucleotide; TTT chr11 5191318 5191339 5191335 5191340 +
tggaatgggaatttgtacccaa

SEQ ID NO: 77670 - DNA, 22 bp, Artificial Sequence
  Synthetic oligonucleotide; TTT chr11 5191319 5191340 5191336 5191341 +
ggaatgggaatttgtacccaat

SEQ ID NO: 77671 - DNA, 22 bp, Artificial Sequence
  Synthetic oligonucleotide; TTG chr11 5191320 5191341 5191337 5191342 +
gaatgggaatttgtacccaatg

SEQ ID NO: 77672 - DNA, 22 bp, Artificial Sequence
  Synthetic oligonucleotide; TTT chr11 5191332 5191353 5191349 5191354 +
gtacccaatgccagtacctcca

SEQ ID NO: 77673 - DNA, 22 bp, Artificial Sequence
  Synthetic oligonucleotide; TTG chr11 5191333 5191354 5191350 5191355 +
tacccaatgccagtacctccat

SEQ ID NO: 77674 - DNA, 22 bp, Artificial Sequence
  Synthetic oligonucleotide; CTC chr11 5191352 5191373 5191369 5191374 +
cattatgtcttggaagtaacta

SEQ ID NO: 77675 - DNA, 22 bp, Artificial Sequence
  Synthetic oligonucleotide; TTA chr11 5191357 5191378 5191374 5191379 +
tgtcttggaagtaactaacttg

SEQ ID NO: 77676 - DNA, 22 bp, Artificial Sequence
  Synthetic oligonucleotide; CTT chr11 5191363 5191384 5191380 5191385 +
ggaagtaactaacttgtttttg

SEQ ID NO: 77677 - DNA, 22 bp, Artificial Sequence
  Synthetic oligonucleotide; TTG chr11 5191364 5191385 5191381 5191386 +
gaagtaactaacttgtttttga

SEQ ID NO: 77678 - DNA, 22 bp, Artificial Sequence
  Synthetic oligonucleotide; CTA chr11 5191374 5191395 5191391 5191396 +
acttgtttttgattttacaggc

SEQ ID NO: 77679 - DNA, 22 bp, Artificial Sequence
  Synthetic oligonucleotide; CTT chr11 5191378 5191399 5191395 5191400 +
gtttttgattttacaggctcat

SEQ ID NO: 77680 - DNA, 22 bp, Artificial Sequence
  Synthetic oligonucleotide; TTG chr11 5191379 5191400 5191396 5191401 +
tttttgattttacaggctcata

SEQ ID NO: 77681 - DNA, 22 bp, Artificial Sequence
  Synthetic oligonucleotide; TTT chr11 5191382 5191403 5191399 5191404 +
ttgattttacaggctcataggt

SEQ ID NO: 77682 - DNA, 22 bp, Artificial Sequence
  Synthetic oligonucleotide; TTT chr11 5191383 5191404 5191400 5191405 +
tgattttacaggctcataggtt

SEQ ID NO: 77683 - DNA, 22 bp, Artificial Sequence
  Synthetic oligonucleotide; TTT chr11 5191384 5191405 5191401 5191406 +
gattttacaggctcataggttg

SEQ ID NO: 77684 - DNA, 22 bp, Artificial Sequence
  Synthetic oligonucleotide; TTG chr11 5191385 5191406 5191402 5191407 +
attttacaggctcataggttga

SEQ ID NO: 77685 - DNA, 22 bp, Artificial Sequence
  Synthetic oligonucleotide; TTT chr11 5191389 5191410 5191406 5191411 +
tacaggctcataggttgaaggg

SEQ ID NO: 77686 - DNA, 22 bp, Artificial Sequence
  Synthetic oligonucleotide; TTT chr11 5191390 5191411 5191407 5191412 +
acaggctcataggttgaaggga

SEQ ID NO: 77687 - DNA, 22 bp, Artificial Sequence
  Synthetic oligonucleotide; TTA chr11 5191391 5191412 5191408 5191413 +
caggctcataggttgaagggac

SEQ ID NO: 77688 - DNA, 22 bp, Artificial Sequence
  Synthetic oligonucleotide; CTC chr11 5191398 5191419 5191415 5191420 +
ataggttgaagggacttgcctt

SEQ ID NO: 77689 - DNA, 22 bp, Artificial Sequence
  Synthetic oligonucleotide; TTG chr11 5191406 5191427 5191423 5191428 +
aagggacttgccttgtcttgga

SEQ ID NO: 77690 - DNA, 22 bp, Artificial Sequence
  Synthetic oligonucleotide; CTT chr11 5191415 5191436 5191432 5191437 +
gccttgtcttggataagacttt

SEQ ID NO: 77691 - DNA, 22 bp, Artificial Sequence
  Synthetic oligonucleotide; TTG chr11 5191416 5191437 5191433 5191438 +
ccttgtcttggataagactttg

SEQ ID NO: 77692 - DNA, 22 bp, Artificial Sequence
  Synthetic oligonucleotide; CTT chr11 5191420 5191441 5191437 5191442 +
gtcttggataagactttggact

SEQ ID NO: 77693 - DNA, 22 bp, Artificial Sequence
  Synthetic oligonucleotide; TTG chr11 5191421 5191442 5191438 5191443 +
tcttggataagactttggactt

SEQ ID NO: 77694 - DNA, 22 bp, Artificial Sequence
  Synthetic oligonucleotide; CTT chr11 5191425 5191446 5191442 5191447 +
ggataagactttggactttgga

SEQ ID NO: 77695 - DNA, 22 bp, Artificial Sequence
  Synthetic oligonucleotide; TTG chr11 5191426 5191447 5191443 5191448 +
gataagactttggactttggac

SEQ ID NO: 77696 - DNA, 22 bp, Artificial Sequence
  Synthetic oligonucleotide; CTT chr11 5191436 5191457 5191453 5191458 +
tggactttggacttttgagtta

SEQ ID NO: 77697 - DNA, 22 bp, Artificial Sequence
  Synthetic oligonucleotide; TTT chr11 5191437 5191458 5191454 5191459 +
ggactttggacttttgagttaa

SEQ ID NO: 77698 - DNA, 22 bp, Artificial Sequence
  Synthetic oligonucleotide; TTG chr11 5191438 5191459 5191455 5191460 +
gactttggacttttgagttaat

SEQ ID NO: 77699 - DNA, 22 bp, Artificial Sequence
  Synthetic oligonucleotide; CTT chr11 5191443 5191464 5191460 5191465 +
tggacttttgagttaatgctgg

SEQ ID NO: 77700 - DNA, 22 bp, Artificial Sequence
  Synthetic oligonucleotide; TTT chr11 5191444 5191465 5191461 5191466 +
ggacttttgagttaatgctgga

SEQ ID NO: 77701 - DNA, 22 bp, Artificial Sequence
  Synthetic oligonucleotide; TTG chr11 5191445 5191466 5191462 5191467 +
gacttttgagttaatgctggaa

SEQ ID NO: 77702 - DNA, 22 bp, Artificial Sequence
  Synthetic oligonucleotide; CTT chr11 5191450 5191471 5191467 5191472 +
ttgagttaatgctggaatgagt

SEQ ID NO: 77703 - DNA, 22 bp, Artificial Sequence
  Synthetic oligonucleotide; TTT chr11 5191451 5191472 5191468 5191473 +
tgagttaatgctggaatgagtt

SEQ ID NO: 77704 - DNA, 22 bp, Artificial Sequence
  Synthetic oligonucleotide; TTT chr11 5191452 5191473 5191469 5191474 +
gagttaatgctggaatgagtta

SEQ ID NO: 77705 - DNA, 22 bp, Artificial Sequence
  Synthetic oligonucleotide; TTG chr11 5191453 5191474 5191470 5191475 +
agttaatgctggaatgagttaa

SEQ ID NO: 77706 - DNA, 22 bp, Artificial Sequence
  Synthetic oligonucleotide; TTA chr11 5191458 5191479 5191475 5191480 +
atgctggaatgagttaagactt

SEQ ID NO: 77707 - DNA, 22 bp, Artificial Sequence
  Synthetic oligonucleotide; CTG chr11 5191464 5191485 5191481 5191486 +
gaatgagttaagactttgtagg

SEQ ID NO: 77708 - DNA, 22 bp, Artificial Sequence
  Synthetic oligonucleotide; TTA chr11 5191474 5191495 5191491 5191496 +
agactttgtaggactgttggga

SEQ ID NO: 77709 - DNA, 22 bp, Artificial Sequence
  Synthetic oligonucleotide; CTT chr11 5191480 5191501 5191497 5191502 +
tgtaggactgttgggaagtaat

SEQ ID NO: 77710 - DNA, 22 bp, Artificial Sequence
  Synthetic oligonucleotide; TTT chr11 5191481 5191502 5191498 5191503 +
gtaggactgttgggaagtaatg

SEQ ID NO: 77711 - DNA, 22 bp, Artificial Sequence
  Synthetic oligonucleotide; TTG chr11 5191482 5191503 5191499 5191504 +
taggactgttgggaagtaatga

SEQ ID NO: 77712 - DNA, 22 bp, Artificial Sequence
  Synthetic oligonucleotide; CTG chr11 5191490 5191511 5191507 5191512 +
ttgggaagtaatgattgtattt

SEQ ID NO: 77713 - DNA, 22 bp, Artificial Sequence
  Synthetic oligonucleotide; TTG chr11 5191493 5191514 5191510 5191515 +
ggaagtaatgattgtattttgt

SEQ ID NO: 77714 - DNA, 22 bp, Artificial Sequence
  Synthetic oligonucleotide; TTG chr11 5191507 5191528 5191524 5191529 +
tattttgtgatgtgagaagaac

SEQ ID NO: 77715 - DNA, 22 bp, Artificial Sequence
  Synthetic oligonucleotide; TTT chr11 5191512 5191533 5191529 5191534 +
tgtgatgtgagaagaacatgag

SEQ ID NO: 77716 - DNA, 22 bp, Artificial Sequence
  Synthetic oligonucleotide; TTT chr11 5191513 5191534 5191530 5191535 +
gtgatgtgagaagaacatgaga

SEQ ID NO: 77717 - DNA, 22 bp, Artificial Sequence
  Synthetic oligonucleotide; TTG chr11 5191514 5191535 5191531 5191536 +
tgatgtgagaagaacatgagat

SEQ ID NO: 77718 - DNA, 22 bp, Artificial Sequence
  Synthetic oligonucleotide; TTT chr11 5191538 5191559 5191555 5191560 +
ggaaggggccagaggtggaagg

SEQ ID NO: 77719 - DNA, 22 bp, Artificial Sequence
  Synthetic oligonucleotide; TTG chr11 5191539 5191560 5191556 5191561 +
gaaggggccagaggtggaagga

SEQ ID NO: 77720 - DNA, 22 bp, Artificial Sequence
  Synthetic oligonucleotide; TTT chr11 5191569 5191590 5191586 5191591 +
ggatctgtgtcaccacccaaat

SEQ ID NO: 77721 - DNA, 22 bp, Artificial Sequence
  Synthetic oligonucleotide; TTG chr11 5191570 5191591 5191587 5191592 +
gatctgtgtcaccacccaaata

SEQ ID NO: 77722 - DNA, 22 bp, Artificial Sequence
  Synthetic oligonucleotide; CTG chr11 5191576 5191597 5191593 5191598 +
tgtcaccacccaaatatcatgt

SEQ ID NO: 77723 - DNA, 22 bp, Artificial Sequence
  Synthetic oligonucleotide; TTA chr11 5191600 5191621 5191617 5191622 +
aattataatcaccagcgttgga

SEQ ID NO: 77724 - DNA, 22 bp, Artificial Sequence
  Synthetic oligonucleotide; TTA chr11 5191605 5191626 5191622 5191627 +
taatcaccagcgttggaggtgg

SEQ ID NO: 77725 - DNA, 22 bp, Artificial Sequence
  Synthetic oligonucleotide; TTG chr11 5191620 5191641 5191637 5191642 +
gaggtggggccttgtgggaggt

SEQ ID NO: 77726 - DNA, 22 bp, Artificial Sequence
  Synthetic oligonucleotide; CTT chr11 5191633 5191654 5191650 5191655 +
gtgggaggtaattcaatcatgg

SEQ ID NO: 77727 - DNA, 22 bp, Artificial Sequence
  Synthetic oligonucleotide; TTG chr11 5191634 5191655 5191651 5191656 +
tgggaggtaattcaatcatggt

SEQ ID NO: 77728 - DNA, 22 bp, Artificial Sequence
  Synthetic oligonucleotide; TTC chr11 5191647 5191668 5191664 5191669 +
aatcatggtggcagagttctca

SEQ ID NO: 77729 - DNA, 22 bp, Artificial Sequence
  Synthetic oligonucleotide; TTC chr11 5191666 5191687 5191683 5191688 +
tcatcagcgatttagtaccatc

SEQ ID NO: 77730 - DNA, 22 bp, Artificial Sequence
  Synthetic oligonucleotide; CTC chr11 5191668 5191689 5191685 5191690 +
atcagcgatttagtaccatccc

SEQ ID NO: 77731 - DNA, 22 bp, Artificial Sequence
  Synthetic oligonucleotide; TTT chr11 5191679 5191700 5191696 5191701 +
agtaccatcccccttggtactg

SEQ ID NO: 77732 - DNA, 22 bp, Artificial Sequence
  Synthetic oligonucleotide; TTA chr11 5191680 5191701 5191697 5191702 +
gtaccatcccccttggtactgt

SEQ ID NO: 77733 - DNA, 22 bp, Artificial Sequence
  Synthetic oligonucleotide; CTT chr11 5191694 5191715 5191711 5191716 +
ggtactgtatagtgagttctca

SEQ ID NO: 77734 - DNA, 22 bp, Artificial Sequence
  Synthetic oligonucleotide; TTG chr11 5191695 5191716 5191712 5191717 +
gtactgtatagtgagttctcaa

SEQ ID NO: 77735 - DNA, 22 bp, Artificial Sequence
  Synthetic oligonucleotide; CTG chr11 5191701 5191722 5191718 5191723 +
tatagtgagttctcaagaggct

SEQ ID NO: 77736 - DNA, 22 bp, Artificial Sequence
  Synthetic oligonucleotide; TTC chr11 5191713 5191734 5191730 5191735 +
tcaagaggctggttgtttgaaa

SEQ ID NO: 77737 - DNA, 22 bp, Artificial Sequence
  Synthetic oligonucleotide; CTC chr11 5191715 5191736 5191732 5191737 +
aagaggctggttgtttgaaagt

SEQ ID NO: 77738 - DNA, 22 bp, Artificial Sequence
  Synthetic oligonucleotide; CTG chr11 5191724 5191745 5191741 5191746 +
gttgtttgaaagtgtgtagcac

SEQ ID NO: 77739 - DNA, 22 bp, Artificial Sequence
  Synthetic oligonucleotide; TTG chr11 5191728 5191749 5191745 5191750 +
tttgaaagtgtgtagcacctcc

SEQ ID NO: 77740 - DNA, 22 bp, Artificial Sequence
  Synthetic oligonucleotide; TTT chr11 5191731 5191752 5191748 5191753 +
gaaagtgtgtagcacctcctac

SEQ ID NO: 77741 - DNA, 22 bp, Artificial Sequence
  Synthetic oligonucleotide; TTG chr11 5191732 5191753 5191749 5191754 +
aaagtgtgtagcacctcctacc

SEQ ID NO: 77742 - DNA, 22 bp, Artificial Sequence
  Synthetic oligonucleotide; CTC chr11 5191749 5191770 5191766 5191771 +
ctaccctgcttctccctgtcct

SEQ ID NO: 77743 - DNA, 22 bp, Artificial Sequence
  Synthetic oligonucleotide; CTA chr11 5191752 5191773 5191769 5191774 +
ccctgcttctccctgtcctggc

SEQ ID NO: 77744 - DNA, 22 bp, Artificial Sequence
  Synthetic oligonucleotide; CTG chr11 5191757 5191778 5191774 5191779 +
cttctccctgtcctggccatgt

SEQ ID NO: 77745 - DNA, 22 bp, Artificial Sequence
  Synthetic oligonucleotide; CTT chr11 5191760 5191781 5191777 5191782 +
ctccctgtcctggccatgtgaa

SEQ ID NO: 77746 - DNA, 22 bp, Artificial Sequence
  Synthetic oligonucleotide; TTC chr11 5191761 5191782 5191778 5191783 +
tccctgtcctggccatgtgaag

SEQ ID NO: 77747 - DNA, 22 bp, Artificial Sequence
  Synthetic oligonucleotide; CTC chr11 5191763 5191784 5191780 5191785 +
cctgtcctggccatgtgaagat

SEQ ID NO: 77748 - DNA, 22 bp, Artificial Sequence
  Synthetic oligonucleotide; CTG chr11 5191767 5191788 5191784 5191789 +
tcctggccatgtgaagatactt

SEQ ID NO: 77749 - DNA, 22 bp, Artificial Sequence
  Synthetic oligonucleotide; CTG chr11 5191772 5191793 5191789 5191794 +
gccatgtgaagatacttgctcc

SEQ ID NO: 77750 - DNA, 22 bp, Artificial Sequence
  Synthetic oligonucleotide; CTT chr11 5191789 5191810 5191806 5191811 +
gctcctgctttgtcttctgcca

SEQ ID NO: 77751 - DNA, 22 bp, Artificial Sequence
  Synthetic oligonucleotide; TTG chr11 5191790 5191811 5191807 5191812 +
ctcctgctttgtcttctgccat

SEQ ID NO: 77752 - DNA, 22 bp, Artificial Sequence
  Synthetic oligonucleotide; CTC chr11 5191793 5191814 5191810 5191815 +
ctgctttgtcttctgccatgat

SEQ ID NO: 77753 - DNA, 22 bp, Artificial Sequence
  Synthetic oligonucleotide; CTG chr11 5191796 5191817 5191813 5191818 +
ctttgtcttctgccatgattgt

SEQ ID NO: 77754 - DNA, 22 bp, Artificial Sequence
  Synthetic oligonucleotide; CTT chr11 5191799 5191820 5191816 5191821 +
tgtcttctgccatgattgtaag

SEQ ID NO: 77755 - DNA, 22 bp, Artificial Sequence
  Synthetic oligonucleotide; TTT chr11 5191800 5191821 5191817 5191822 +
gtcttctgccatgattgtaagt

SEQ ID NO: 77756 - DNA, 22 bp, Artificial Sequence
  Synthetic oligonucleotide; TTG chr11 5191801 5191822 5191818 5191823 +
tcttctgccatgattgtaagtt

SEQ ID NO: 77757 - DNA, 22 bp, Artificial Sequence
  Synthetic oligonucleotide; CTT chr11 5191805 5191826 5191822 5191827 +
ctgccatgattgtaagtttctt

SEQ ID NO: 77758 - DNA, 22 bp, Artificial Sequence
  Synthetic oligonucleotide; TTC chr11 5191806 5191827 5191823 5191828 +
tgccatgattgtaagtttcttg

SEQ ID NO: 77759 - DNA, 22 bp, Artificial Sequence
  Synthetic oligonucleotide; CTG chr11 5191808 5191829 5191825 5191830 +
ccatgattgtaagtttcttgag

SEQ ID NO: 77760 - DNA, 22 bp, Artificial Sequence
  Synthetic oligonucleotide; TTG chr11 5191817 5191838 5191834 5191839 +
taagtttcttgaggtctcccta

SEQ ID NO: 77761 - DNA, 22 bp, Artificial Sequence
  Synthetic oligonucleotide; TTT chr11 5191824 5191845 5191841 5191846 +
cttgaggtctccctagaagctg

SEQ ID NO: 77762 - DNA, 22 bp, Artificial Sequence
  Synthetic oligonucleotide; TTC chr11 5191825 5191846 5191842 5191847 +
ttgaggtctccctagaagctga

SEQ ID NO: 77763 - DNA, 22 bp, Artificial Sequence
  Synthetic oligonucleotide; CTT chr11 5191827 5191848 5191844 5191849 +
gaggtctccctagaagctgagc

SEQ ID NO: 77764 - DNA, 22 bp, Artificial Sequence
  Synthetic oligonucleotide; TTG chr11 5191828 5191849 5191845 5191850 +
aggtctccctagaagctgagca

SEQ ID NO: 77765 - DNA, 22 bp, Artificial Sequence
  Synthetic oligonucleotide; CTC chr11 5191835 5191856 5191852 5191857 +
cctagaagctgagcagatgctg

SEQ ID NO: 77766 - DNA, 22 bp, Artificial Sequence
  Synthetic oligonucleotide; CTA chr11 5191839 5191860 5191856 5191861 +
gaagctgagcagatgctgccat

SEQ ID NO: 77767 - DNA, 22 bp, Artificial Sequence
  Synthetic oligonucleotide; CTG chr11 5191846 5191867 5191863 5191868 +
agcagatgctgccatgcttctt

SEQ ID NO: 77768 - DNA, 22 bp, Artificial Sequence
  Synthetic oligonucleotide; CTG chr11 5191857 5191878 5191874 5191879 +
ccatgcttcttgtacagcctga

SEQ ID NO: 77769 - DNA, 22 bp, Artificial Sequence
  Synthetic oligonucleotide; CTT chr11 5191865 5191886 5191882 5191887 +
cttgtacagcctgaagaacttt

SEQ ID NO: 77770 - DNA, 22 bp, Artificial Sequence
  Synthetic oligonucleotide; TTC chr11 5191866 5191887 5191883 5191888 +
ttgtacagcctgaagaactttg

SEQ ID NO: 77771 - DNA, 22 bp, Artificial Sequence
  Synthetic oligonucleotide; CTT chr11 5191868 5191889 5191885 5191890 +
gtacagcctgaagaactttgag

SEQ ID NO: 77772 - DNA, 22 bp, Artificial Sequence
  Synthetic oligonucleotide; TTG chr11 5191869 5191890 5191886 5191891 +
tacagcctgaagaactttgagc

SEQ ID NO: 77773 - DNA, 22 bp, Artificial Sequence
  Synthetic oligonucleotide; CTG chr11 5191878 5191899 5191895 5191900 +
aagaactttgagccaattaaac

SEQ ID NO: 77774 - DNA, 22 bp, Artificial Sequence
  Synthetic oligonucleotide; CTT chr11 5191886 5191907 5191903 5191908 +
tgagccaattaaacctctgttc

SEQ ID NO: 77775 - DNA, 22 bp, Artificial Sequence
  Synthetic oligonucleotide; TTT chr11 5191887 5191908 5191904 5191909 +
gagccaattaaacctctgttct

SEQ ID NO: 77776 - DNA, 22 bp, Artificial Sequence
  Synthetic oligonucleotide; TTG chr11 5191888 5191909 5191905 5191910 +
agccaattaaacctctgttctt

SEQ ID NO: 77777 - DNA, 22 bp, Artificial Sequence
  Synthetic oligonucleotide; TTA chr11 5191897 5191918 5191914 5191919 +
aacctctgttctttataaatta

SEQ ID NO: 77778 - DNA, 22 bp, Artificial Sequence
  Synthetic oligonucleotide; CTC chr11 5191903 5191924 5191920 5191925 +
tgttctttataaattacccagt

SEQ ID NO: 77779 - DNA, 22 bp, Artificial Sequence
  Synthetic oligonucleotide; CTG chr11 5191905 5191926 5191922 5191927 +
ttctttataaattacccagtct

SEQ ID NO: 77780 - DNA, 22 bp, Artificial Sequence
  Synthetic oligonucleotide; TTC chr11 5191908 5191929 5191925 5191930 +
tttataaattacccagtctcag

SEQ ID NO: 77781 - DNA, 22 bp, Artificial Sequence
  Synthetic oligonucleotide; CTT chr11 5191910 5191931 5191927 5191932 +
tataaattacccagtctcaggt

SEQ ID NO: 77782 - DNA, 22 bp, Artificial Sequence
  Synthetic oligonucleotide; TTT chr11 5191911 5191932 5191928 5191933 +
ataaattacccagtctcaggta

SEQ ID NO: 77783 - DNA, 22 bp, Artificial Sequence
  Synthetic oligonucleotide; TTA chr11 5191912 5191933 5191929 5191934 +
taaattacccagtctcaggtat

SEQ ID NO: 77784 - DNA, 22 bp, Artificial Sequence
  Synthetic oligonucleotide; TTA chr11 5191919 5191940 5191936 5191941 +
cccagtctcaggtattttttta

SEQ ID NO: 77785 - DNA, 22 bp, Artificial Sequence
  Synthetic oligonucleotide; CTC chr11 5191928 5191949 5191945 5191950 +
aggtatttttttacagcagtgt

SEQ ID NO: 77786 - DNA, 22 bp, Artificial Sequence
  Synthetic oligonucleotide; TTT chr11 5191936 5191957 5191953 5191958 +
ttttacagcagtgtgaaaacat

SEQ ID NO: 77787 - DNA, 22 bp, Artificial Sequence
  Synthetic oligonucleotide; TTT chr11 5191937 5191958 5191954 5191959 +
tttacagcagtgtgaaaacatg

SEQ ID NO: 77788 - DNA, 22 bp, Artificial Sequence
  Synthetic oligonucleotide; TTT chr11 5191938 5191959 5191955 5191960 +
ttacagcagtgtgaaaacatgc

SEQ ID NO: 77789 - DNA, 22 bp, Artificial Sequence
  Synthetic oligonucleotide; TTT chr11 5191939 5191960 5191956 5191961 +
tacagcagtgtgaaaacatgcc

SEQ ID NO: 77790 - DNA, 22 bp, Artificial Sequence
  Synthetic oligonucleotide; TTT chr11 5191940 5191961 5191957 5191962 +
acagcagtgtgaaaacatgcca

SEQ ID NO: 77791 - DNA, 22 bp, Artificial Sequence
  Synthetic oligonucleotide; TTA chr11 5191941 5191962 5191958 5191963 +
cagcagtgtgaaaacatgccaa

SEQ ID NO: 77792 - DNA, 22 bp, Artificial Sequence
  Synthetic oligonucleotide; TTT chr11 5192001 5192022 5192018 5192023 +
aatgccaccattaataattttt

SEQ ID NO: 77793 - DNA, 22 bp, Artificial Sequence
  Synthetic oligonucleotide; TTA chr11 5192002 5192023 5192019 5192024 +
atgccaccattaataatttttt

SEQ ID NO: 77794 - DNA, 22 bp, Artificial Sequence
  Synthetic oligonucleotide; TTA chr11 5192014 5192035 5192031 5192036 +
ataattttttcttcttccttcc

SEQ ID NO: 77795 - DNA, 22 bp, Artificial Sequence
  Synthetic oligonucleotide; TTT chr11 5192021 5192042 5192038 5192043 +
tttcttcttccttcctttgata

SEQ ID NO: 77796 - DNA, 22 bp, Artificial Sequence
  Synthetic oligonucleotide; TTT chr11 5192022 5192043 5192039 5192044 +
ttcttcttccttcctttgatac

SEQ ID NO: 77797 - DNA, 22 bp, Artificial Sequence
  Synthetic oligonucleotide; TTT chr11 5192023 5192044 5192040 5192045 +
tcttcttccttcctttgatact

SEQ ID NO: 77798 - DNA, 22 bp, Artificial Sequence
  Synthetic oligonucleotide; TTT chr11 5192024 5192045 5192041 5192046 +
cttcttccttcctttgatactc

SEQ ID NO: 77799 - DNA, 22 bp, Artificial Sequence
  Synthetic oligonucleotide; TTC chr11 5192025 5192046 5192042 5192047 +
ttcttccttcctttgatactca

SEQ ID NO: 77800 - DNA, 22 bp, Artificial Sequence
  Synthetic oligonucleotide; CTT chr11 5192027 5192048 5192044 5192049 +
cttccttcctttgatactcaat

SEQ ID NO: 77801 - DNA, 22 bp, Artificial Sequence
  Synthetic oligonucleotide; TTC chr11 5192028 5192049 5192045 5192050 +
ttccttcctttgatactcaatg

SEQ ID NO: 77802 - DNA, 22 bp, Artificial Sequence
  Synthetic oligonucleotide; CTT chr11 5192030 5192051 5192047 5192052 +
ccttcctttgatactcaatgtg

SEQ ID NO: 77803 - DNA, 22 bp, Artificial Sequence
  Synthetic oligonucleotide; TTC chr11 5192031 5192052 5192048 5192053 +
cttcctttgatactcaatgtga

SEQ ID NO: 77804 - DNA, 22 bp, Artificial Sequence
  Synthetic oligonucleotide; CTT chr11 5192034 5192055 5192051 5192056 +
cctttgatactcaatgtgatca

SEQ ID NO: 77805 - DNA, 22 bp, Artificial Sequence
  Synthetic oligonucleotide; TTC chr11 5192035 5192056 5192052 5192057 +
ctttgatactcaatgtgatcaa

SEQ ID NO: 77806 - DNA, 22 bp, Artificial Sequence
  Synthetic oligonucleotide; CTT chr11 5192038 5192059 5192055 5192060 +
tgatactcaatgtgatcaagat

SEQ ID NO: 77807 - DNA, 22 bp, Artificial Sequence
  Synthetic oligonucleotide; TTT chr11 5192039 5192060 5192056 5192061 +
gatactcaatgtgatcaagatt

SEQ ID NO: 77808 - DNA, 22 bp, Artificial Sequence
  Synthetic oligonucleotide; TTG chr11 5192040 5192061 5192057 5192062 +
atactcaatgtgatcaagattt

SEQ ID NO: 77809 - DNA, 22 bp, Artificial Sequence
  Synthetic oligonucleotide; CTC chr11 5192046 5192067 5192063 5192068 +
aatgtgatcaagatttgggagt

SEQ ID NO: 77810 - DNA, 22 bp, Artificial Sequence
  Synthetic oligonucleotide; TTT chr11 5192062 5192083 5192079 5192084 +
gggagttaatcattttactcct

SEQ ID NO: 77811 - DNA, 22 bp, Artificial Sequence
  Synthetic oligonucleotide; TTG chr11 5192063 5192084 5192080 5192085 +
ggagttaatcattttactcctc

SEQ ID NO: 77812 - DNA, 22 bp, Artificial Sequence
  Synthetic oligonucleotide; TTA chr11 5192070 5192091 5192087 5192092 +
atcattttactcctctttactc

SEQ ID NO: 77813 - DNA, 22 bp, Artificial Sequence
  Synthetic oligonucleotide; TTT chr11 5192077 5192098 5192094 5192099 +
tactcctctttactcatgtcca

SEQ ID NO: 77814 - DNA, 22 bp, Artificial Sequence
  Synthetic oligonucleotide; TTT chr11 5192078 5192099 5192095 5192100 +
actcctctttactcatgtccaa

SEQ ID NO: 77815 - DNA, 22 bp, Artificial Sequence
  Synthetic oligonucleotide; TTA chr11 5192079 5192100 5192096 5192101 +
ctcctctttactcatgtccaaa

SEQ ID NO: 77816 - DNA, 22 bp, Artificial Sequence
  Synthetic oligonucleotide; CTC chr11 5192082 5192103 5192099 5192104 +
ctctttactcatgtccaaagtg

SEQ ID NO: 77817 - DNA, 22 bp, Artificial Sequence
  Synthetic oligonucleotide; CTC chr11 5192085 5192106 5192102 5192107 +
tttactcatgtccaaagtgaca

SEQ ID NO: 77818 - DNA, 22 bp, Artificial Sequence
  Synthetic oligonucleotide; CTT chr11 5192087 5192108 5192104 5192109 +
tactcatgtccaaagtgacatg

SEQ ID NO: 77819 - DNA, 22 bp, Artificial Sequence
  Synthetic oligonucleotide; TTT chr11 5192088 5192109 5192105 5192110 +
actcatgtccaaagtgacatga

SEQ ID NO: 77820 - DNA, 22 bp, Artificial Sequence
  Synthetic oligonucleotide; TTA chr11 5192089 5192110 5192106 5192111 +
ctcatgtccaaagtgacatgaa

SEQ ID NO: 77821 - DNA, 22 bp, Artificial Sequence
  Synthetic oligonucleotide; CTC chr11 5192092 5192113 5192109 5192114 +
atgtccaaagtgacatgaaacc

SEQ ID NO: 77822 - DNA, 22 bp, Artificial Sequence
  Synthetic oligonucleotide; CTG chr11 5192116 5192137 5192133 5192138 +
tatctaagtgtgttatctccat

SEQ ID NO: 77823 - DNA, 22 bp, Artificial Sequence
  Synthetic oligonucleotide; CTA chr11 5192122 5192143 5192139 5192144 +
agtgtgttatctccatgggaag

SEQ ID NO: 77824 - DNA, 22 bp, Artificial Sequence
  Synthetic oligonucleotide; TTA chr11 5192131 5192152 5192148 5192153 +
tctccatgggaagatactaaat

SEQ ID NO: 77825 - DNA, 22 bp, Artificial Sequence
  Synthetic oligonucleotide; CTC chr11 5192135 5192156 5192152 5192157 +
catgggaagatactaaatcttt

SEQ ID NO: 77826 - DNA, 22 bp, Artificial Sequence
  Synthetic oligonucleotide; CTA chr11 5192150 5192171 5192167 5192172 +
aatcttttatttatcatcttat

SEQ ID NO: 77827 - DNA, 22 bp, Artificial Sequence
  Synthetic oligonucleotide; CTT chr11 5192156 5192177 5192173 5192178 +
ttatttatcatcttatttttaa

SEQ ID NO: 77828 - DNA, 22 bp, Artificial Sequence
  Synthetic oligonucleotide; TTT chr11 5192157 5192178 5192174 5192179 +
tatttatcatcttatttttaat

SEQ ID NO: 77829 - DNA, 22 bp, Artificial Sequence
  Synthetic oligonucleotide; TTT chr11 5192158 5192179 5192175 5192180 +
atttatcatcttatttttaata

SEQ ID NO: 77830 - DNA, 22 bp, Artificial Sequence
  Synthetic oligonucleotide; TTA chr11 5192159 5192180 5192176 5192181 +
tttatcatcttatttttaataa

SEQ ID NO: 77831 - DNA, 22 bp, Artificial Sequence
  Synthetic oligonucleotide; TTT chr11 5192162 5192183 5192179 5192184 +
atcatcttatttttaataaatc

SEQ ID NO: 77832 - DNA, 22 bp, Artificial Sequence
  Synthetic oligonucleotide; TTA chr11 5192163 5192184 5192180 5192185 +
tcatcttatttttaataaatca

SEQ ID NO: 77833 - DNA, 22 bp, Artificial Sequence
  Synthetic oligonucleotide; CTT chr11 5192170 5192191 5192187 5192192 +
atttttaataaatcataacatt

SEQ ID NO: 77834 - DNA, 22 bp, Artificial Sequence
  Synthetic oligonucleotide; TTA chr11 5192171 5192192 5192188 5192193 +
tttttaataaatcataacatta

SEQ ID NO: 77835 - DNA, 22 bp, Artificial Sequence
  Synthetic oligonucleotide; TTT chr11 5192174 5192195 5192191 5192196 +
ttaataaatcataacattacct

SEQ ID NO: 77836 - DNA, 22 bp, Artificial Sequence
  Synthetic oligonucleotide; TTT chr11 5192175 5192196 5192192 5192197 +
taataaatcataacattacctg

SEQ ID NO: 77837 - DNA, 22 bp, Artificial Sequence
  Synthetic oligonucleotide; TTT chr11 5192176 5192197 5192193 5192198 +
aataaatcataacattacctgt

SEQ ID NO: 77838 - DNA, 22 bp, Artificial Sequence
  Synthetic oligonucleotide; TTA chr11 5192177 5192198 5192194 5192199 +
ataaatcataacattacctgtt

SEQ ID NO: 77839 - DNA, 22 bp, Artificial Sequence
  Synthetic oligonucleotide; TTA chr11 5192193 5192214 5192210 5192215 +
cctgttattaaatattaatcta

SEQ ID NO: 77840 - DNA, 22 bp, Artificial Sequence
  Synthetic oligonucleotide; CTG chr11 5192197 5192218 5192214 5192219 +
ttattaaatattaatctatttc

SEQ ID NO: 77841 - DNA, 22 bp, Artificial Sequence
  Synthetic oligonucleotide; TTA chr11 5192200 5192221 5192217 5192222 +
ttaaatattaatctatttcatt

SEQ ID NO: 77842 - DNA, 22 bp, Artificial Sequence
  Synthetic oligonucleotide; TTA chr11 5192203 5192224 5192220 5192225 +
aatattaatctatttcattcta

SEQ ID NO: 77843 - DNA, 22 bp, Artificial Sequence
  Synthetic oligonucleotide; TTA chr11 5192210 5192231 5192227 5192232 +
atctatttcattctatgcaata

SEQ ID NO: 77844 - DNA, 22 bp, Artificial Sequence
  Synthetic oligonucleotide; CTA chr11 5192215 5192236 5192232 5192237 +
tttcattctatgcaatagctgt

SEQ ID NO: 77845 - DNA, 22 bp, Artificial Sequence
  Synthetic oligonucleotide; TTT chr11 5192218 5192239 5192235 5192240 +
cattctatgcaatagctgtctg

SEQ ID NO: 77846 - DNA, 22 bp, Artificial Sequence
  Synthetic oligonucleotide; TTC chr11 5192219 5192240 5192236 5192241 +
attctatgcaatagctgtctga

SEQ ID NO: 77847 - DNA, 22 bp, Artificial Sequence
  Synthetic oligonucleotide; TTC chr11 5192223 5192244 5192240 5192245 +
tatgcaatagctgtctgaaact

SEQ ID NO: 77848 - DNA, 22 bp, Artificial Sequence
  Synthetic oligonucleotide; CTA chr11 5192225 5192246 5192242 5192247 +
tgcaatagctgtctgaaactaa

SEQ ID NO: 77849 - DNA, 22 bp, Artificial Sequence
  Synthetic oligonucleotide; CTG chr11 5192236 5192257 5192253 5192258 +
tctgaaactaagtcaaagaatg

SEQ ID NO: 77850 - DNA, 22 bp, Artificial Sequence
  Synthetic oligonucleotide; CTG chr11 5192240 5192261 5192257 5192262 +
aaactaagtcaaagaatgtacc

SEQ ID NO: 77851 - DNA, 22 bp, Artificial Sequence
  Synthetic oligonucleotide; CTA chr11 5192246 5192267 5192263 5192268 +
agtcaaagaatgtaccatactt

SEQ ID NO: 77852 - DNA, 22 bp, Artificial Sequence
  Synthetic oligonucleotide; CTT chr11 5192268 5192289 5192285 5192290 +
tattcactatttgtctattatt

SEQ ID NO: 77853 - DNA, 22 bp, Artificial Sequence
  Synthetic oligonucleotide; TTT chr11 5192269 5192290 5192286 5192291 +
attcactatttgtctattattg

SEQ ID NO: 77854 - DNA, 22 bp, Artificial Sequence
  Synthetic oligonucleotide; TTA chr11 5192270 5192291 5192287 5192292 +
ttcactatttgtctattattga

SEQ ID NO: 77855 - DNA, 22 bp, Artificial Sequence
  Synthetic oligonucleotide; TTC chr11 5192273 5192294 5192290 5192295 +
actatttgtctattattgaata

SEQ ID NO: 77856 - DNA, 22 bp, Artificial Sequence
  Synthetic oligonucleotide; CTA chr11 5192277 5192298 5192294 5192299 +
tttgtctattattgaatatcta

SEQ ID NO: 77857 - DNA, 22 bp, Artificial Sequence
  Synthetic oligonucleotide; TTT chr11 5192280 5192301 5192297 5192302 +
gtctattattgaatatctatat

SEQ ID NO: 77858 - DNA, 22 bp, Artificial Sequence
  Synthetic oligonucleotide; TTG chr11 5192281 5192302 5192298 5192303 +
tctattattgaatatctatatt

SEQ ID NO: 77859 - DNA, 22 bp, Artificial Sequence
  Synthetic oligonucleotide; CTA chr11 5192285 5192306 5192302 5192307 +
ttattgaatatctatatttgtt

SEQ ID NO: 77860 - DNA, 22 bp, Artificial Sequence
  Synthetic oligonucleotide; TTA chr11 5192288 5192309 5192305 5192310 +
ttgaatatctatatttgtttga

SEQ ID NO: 77861 - DNA, 22 bp, Artificial Sequence
  Synthetic oligonucleotide; TTG chr11 5192291 5192312 5192308 5192313 +
aatatctatatttgtttgagga

SEQ ID NO: 77862 - DNA, 22 bp, Artificial Sequence
  Synthetic oligonucleotide; CTA chr11 5192299 5192320 5192316 5192321 +
tatttgtttgaggaataataat

SEQ ID NO: 77863 - DNA, 22 bp, Artificial Sequence
  Synthetic oligonucleotide; TTT chr11 5192304 5192325 5192321 5192326 +
gtttgaggaataataatcagaa

SEQ ID NO: 77864 - DNA, 22 bp, Artificial Sequence
  Synthetic oligonucleotide; TTG chr11 5192305 5192326 5192322 5192327 +
tttgaggaataataatcagaac

SEQ ID NO: 77865 - DNA, 22 bp, Artificial Sequence
  Synthetic oligonucleotide; TTT chr11 5192308 5192329 5192325 5192330 +
gaggaataataatcagaacaga

SEQ ID NO: 77866 - DNA, 22 bp, Artificial Sequence
  Synthetic oligonucleotide; TTG chr11 5192309 5192330 5192326 5192331 +
aggaataataatcagaacagaa

SEQ ID NO: 77867 - DNA, 22 bp, Artificial Sequence
  Synthetic oligonucleotide; CTA chr11 5192346 5192367 5192363 5192368 +
taggaatggaagtttctcaaca

SEQ ID NO: 77868 - DNA, 22 bp, Artificial Sequence
  Synthetic oligonucleotide; TTT chr11 5192361 5192382 5192378 5192383 +
ctcaacagcaagataaaatagg

SEQ ID NO: 77869 - DNA, 22 bp, Artificial Sequence
  Synthetic oligonucleotide; TTC chr11 5192362 5192383 5192379 5192384 +
tcaacagcaagataaaataggt

SEQ ID NO: 77870 - DNA, 22 bp, Artificial Sequence
  Synthetic oligonucleotide; CTC chr11 5192364 5192385 5192381 5192386 +
aacagcaagataaaataggtta

SEQ ID NO: 77871 - DNA, 22 bp, Artificial Sequence
  Synthetic oligonucleotide; TTA chr11 5192386 5192407 5192403 5192408 +
atggagtaatatgtagagaatg

SEQ ID NO: 77872 - DNA, 22 bp, Artificial Sequence
  Synthetic oligonucleotide; CTA chr11 5192415 5192436 5192432 5192437 +
taattaaagaaaatgaattaag

SEQ ID NO: 77873 - DNA, 22 bp, Artificial Sequence
  Synthetic oligonucleotide; TTA chr11 5192421 5192442 5192438 5192443 +
aagaaaatgaattaagcaatat

SEQ ID NO: 77874 - DNA, 22 bp, Artificial Sequence
  Synthetic oligonucleotide; TTA chr11 5192435 5192456 5192452 5192457 +
agcaatatacaattaaagctct

SEQ ID NO: 77875 - DNA, 22 bp, Artificial Sequence
  Synthetic oligonucleotide; TTA chr11 5192450 5192471 5192467 5192472 +
aagctctttatgtcttttcaca

SEQ ID NO: 77876 - DNA, 22 bp, Artificial Sequence
  Synthetic oligonucleotide; CTC chr11 5192456 5192477 5192473 5192478 +
tttatgtcttttcacagcttga

SEQ ID NO: 77877 - DNA, 22 bp, Artificial Sequence
  Synthetic oligonucleotide; CTT chr11 5192458 5192479 5192475 5192480 +
tatgtcttttcacagcttgata

SEQ ID NO: 77878 - DNA, 22 bp, Artificial Sequence
  Synthetic oligonucleotide; TTT chr11 5192459 5192480 5192476 5192481 +
atgtcttttcacagcttgatag

SEQ ID NO: 77879 - DNA, 22 bp, Artificial Sequence
  Synthetic oligonucleotide; TTA chr11 5192460 5192481 5192477 5192482 +
tgtcttttcacagcttgataga

SEQ ID NO: 77880 - DNA, 22 bp, Artificial Sequence
  Synthetic oligonucleotide; CTT chr11 5192466 5192487 5192483 5192488 +
ttcacagcttgatagaccttta

SEQ ID NO: 77881 - DNA, 22 bp, Artificial Sequence
  Synthetic oligonucleotide; TTT chr11 5192467 5192488 5192484 5192489 +
tcacagcttgatagacctttat

SEQ ID NO: 77882 - DNA, 22 bp, Artificial Sequence
  Synthetic oligonucleotide; TTT chr11 5192468 5192489 5192485 5192490 +
cacagcttgatagacctttatt

SEQ ID NO: 77883 - DNA, 22 bp, Artificial Sequence
  Synthetic oligonucleotide; TTC chr11 5192469 5192490 5192486 5192491 +
acagcttgatagacctttattt

SEQ ID NO: 77884 - DNA, 22 bp, Artificial Sequence
  Synthetic oligonucleotide; CTT chr11 5192476 5192497 5192493 5192498 +
gatagacctttatttatatcac

SEQ ID NO: 77885 - DNA, 22 bp, Artificial Sequence
  Synthetic oligonucleotide; TTG chr11 5192477 5192498 5192494 5192499 +
atagacctttatttatatcact

SEQ ID NO: 77886 - DNA, 22 bp, Artificial Sequence
  Synthetic oligonucleotide; CTT chr11 5192486 5192507 5192503 5192508 +
tatttatatcactgaataatat

SEQ ID NO: 77887 - DNA, 22 bp, Artificial Sequence
  Synthetic oligonucleotide; TTT chr11 5192487 5192508 5192504 5192509 +
atttatatcactgaataatatt

SEQ ID NO: 77888 - DNA, 22 bp, Artificial Sequence
  Synthetic oligonucleotide; TTA chr11 5192488 5192509 5192505 5192510 +
tttatatcactgaataatattc

SEQ ID NO: 77889 - DNA, 22 bp, Artificial Sequence
  Synthetic oligonucleotide; TTT chr11 5192491 5192512 5192508 5192513 +
atatcactgaataatattctat

SEQ ID NO: 77890 - DNA, 22 bp, Artificial Sequence
  Synthetic oligonucleotide; TTA chr11 5192492 5192513 5192509 5192514 +
tatcactgaataatattctatc

SEQ ID NO: 77891 - DNA, 22 bp, Artificial Sequence
  Synthetic oligonucleotide; CTG chr11 5192500 5192521 5192517 5192522 +
aataatattctatcctatggat

SEQ ID NO: 77892 - DNA, 22 bp, Artificial Sequence
  Synthetic oligonucleotide; TTC chr11 5192510 5192531 5192527 5192532 +
tatcctatggatgttccacagt

SEQ ID NO: 77893 - DNA, 22 bp, Artificial Sequence
  Synthetic oligonucleotide; CTA chr11 5192512 5192533 5192529 5192534 +
tcctatggatgttccacagttt

SEQ ID NO: 77894 - DNA, 22 bp, Artificial Sequence
  Synthetic oligonucleotide; CTA chr11 5192517 5192538 5192534 5192539 +
tggatgttccacagtttatcca

SEQ ID NO: 77895 - DNA, 22 bp, Artificial Sequence
  Synthetic oligonucleotide; TTC chr11 5192526 5192547 5192543 5192548 +
cacagtttatccattcatcttg

SEQ ID NO: 77896 - DNA, 22 bp, Artificial Sequence
  Synthetic oligonucleotide; TTT chr11 5192534 5192555 5192551 5192556 +
atccattcatcttggttacttt

SEQ ID NO: 77897 - DNA, 22 bp, Artificial Sequence
  Synthetic oligonucleotide; TTA chr11 5192535 5192556 5192552 5192557 +
tccattcatcttggttactttc

SEQ ID NO: 77898 - DNA, 22 bp, Artificial Sequence
  Synthetic oligonucleotide; TTC chr11 5192542 5192563 5192559 5192564 +
atcttggttactttcaactttt

SEQ ID NO: 77899 - DNA, 22 bp, Artificial Sequence
  Synthetic oligonucleotide; CTT chr11 5192547 5192568 5192564 5192569 +
ggttactttcaacttttggcaa

SEQ ID NO: 77900 - DNA, 22 bp, Artificial Sequence
  Synthetic oligonucleotide; TTG chr11 5192548 5192569 5192565 5192570 +
gttactttcaacttttggcaat

SEQ ID NO: 77901 - DNA, 22 bp, Artificial Sequence
  Synthetic oligonucleotide; TTA chr11 5192552 5192573 5192569 5192574 +
ctttcaacttttggcaattatg

SEQ ID NO: 77902 - DNA, 22 bp, Artificial Sequence
  Synthetic oligonucleotide; CTT chr11 5192555 5192576 5192572 5192577 +
tcaacttttggcaattatgagt

SEQ ID NO: 77903 - DNA, 22 bp, Artificial Sequence
  Synthetic oligonucleotide; TTT chr11 5192556 5192577 5192573 5192578 +
caacttttggcaattatgagta

SEQ ID NO: 77904 - DNA, 22 bp, Artificial Sequence
  Synthetic oligonucleotide; TTC chr11 5192557 5192578 5192574 5192579 +
aacttttggcaattatgagtaa

SEQ ID NO: 77905 - DNA, 22 bp, Artificial Sequence
  Synthetic oligonucleotide; CTT chr11 5192562 5192583 5192579 5192584 +
ttggcaattatgagtaaagttc

SEQ ID NO: 77906 - DNA, 22 bp, Artificial Sequence
  Synthetic oligonucleotide; TTT chr11 5192563 5192584 5192580 5192585 +
tggcaattatgagtaaagttcc

SEQ ID NO: 77907 - DNA, 22 bp, Artificial Sequence
  Synthetic oligonucleotide; TTT chr11 5192564 5192585 5192581 5192586 +
ggcaattatgagtaaagttcct

SEQ ID NO: 77908 - DNA, 22 bp, Artificial Sequence
  Synthetic oligonucleotide; TTG chr11 5192565 5192586 5192582 5192587 +
gcaattatgagtaaagttccta

SEQ ID NO: 77909 - DNA, 22 bp, Artificial Sequence
  Synthetic oligonucleotide; TTA chr11 5192572 5192593 5192589 5192594 +
tgagtaaagttcctataaacct

SEQ ID NO: 77910 - DNA, 22 bp, Artificial Sequence
  Synthetic oligonucleotide; TTC chr11 5192584 5192605 5192601 5192606 +
ctataaaccttggttagttcat

SEQ ID NO: 77911 - DNA, 22 bp, Artificial Sequence
  Synthetic oligonucleotide; CTA chr11 5192587 5192608 5192604 5192609 +
taaaccttggttagttcatgtc

SEQ ID NO: 77912 - DNA, 22 bp, Artificial Sequence
  Synthetic oligonucleotide; CTT chr11 5192595 5192616 5192612 5192617 +
ggttagttcatgtctgtgtgtg

SEQ ID NO: 77913 - DNA, 22 bp, Artificial Sequence
  Synthetic oligonucleotide; TTG chr11 5192596 5192617 5192613 5192618 +
gttagttcatgtctgtgtgtgg

SEQ ID NO: 77914 - DNA, 22 bp, Artificial Sequence
  Synthetic oligonucleotide; TTA chr11 5192600 5192621 5192617 5192622 +
gttcatgtctgtgtgtggacat

SEQ ID NO: 77915 - DNA, 22 bp, Artificial Sequence
  Synthetic oligonucleotide; TTC chr11 5192604 5192625 5192621 5192626 +
atgtctgtgtgtggacataaat

SEQ ID NO: 77916 - DNA, 22 bp, Artificial Sequence
  Synthetic oligonucleotide; CTG chr11 5192611 5192632 5192628 5192633 +
tgtgtggacataaatttttgac

SEQ ID NO: 77917 - DNA, 22 bp, Artificial Sequence
  Synthetic oligonucleotide; TTT chr11 5192628 5192649 5192645 5192650 +
ttgactcatttgggtaaataca

SEQ ID NO: 77918 - DNA, 22 bp, Artificial Sequence
  Synthetic oligonucleotide; TTT chr11 5192629 5192650 5192646 5192651 +
tgactcatttgggtaaatacat

SEQ ID NO: 77919 - DNA, 22 bp, Artificial Sequence
  Synthetic oligonucleotide; TTT chr11 5192630 5192651 5192647 5192652 +
gactcatttgggtaaatacata

SEQ ID NO: 77920 - DNA, 22 bp, Artificial Sequence
  Synthetic oligonucleotide; TTG chr11 5192631 5192652 5192648 5192653 +
actcatttgggtaaatacatag

SEQ ID NO: 77921 - DNA, 22 bp, Artificial Sequence
  Synthetic oligonucleotide; CTC chr11 5192635 5192656 5192652 5192657 +
atttgggtaaatacataggagt

SEQ ID NO: 77922 - DNA, 22 bp, Artificial Sequence
  Synthetic oligonucleotide; TTT chr11 5192639 5192660 5192656 5192661 +
gggtaaatacataggagtgtga

SEQ ID NO: 77923 - DNA, 22 bp, Artificial Sequence
  Synthetic oligonucleotide; TTG chr11 5192640 5192661 5192657 5192662 +
ggtaaatacataggagtgtgat

SEQ ID NO: 77924 - DNA, 22 bp, Artificial Sequence
  Synthetic oligonucleotide; TTG chr11 5192664 5192685 5192681 5192686 +
ttgggtcacatgaaaagactag

SEQ ID NO: 77925 - DNA, 22 bp, Artificial Sequence
  Synthetic oligonucleotide; TTG chr11 5192667 5192688 5192684 5192689 +
ggtcacatgaaaagactagttt

SEQ ID NO: 77926 - DNA, 22 bp, Artificial Sequence
  Synthetic oligonucleotide; CTA chr11 5192685 5192706 5192702 5192707 +
gttttgtaagaaactgtaaact

SEQ ID NO: 77927 - DNA, 22 bp, Artificial Sequence
  Synthetic oligonucleotide; TTT chr11 5192689 5192710 5192706 5192711 +
tgtaagaaactgtaaactgtct

SEQ ID NO: 77928 - DNA, 22 bp, Artificial Sequence
  Synthetic oligonucleotide; TTT chr11 5192690 5192711 5192707 5192712 +
gtaagaaactgtaaactgtctt

SEQ ID NO: 77929 - DNA, 22 bp, Artificial Sequence
  Synthetic oligonucleotide; TTG chr11 5192691 5192712 5192708 5192713 +
taagaaactgtaaactgtcttc

SEQ ID NO: 77930 - DNA, 22 bp, Artificial Sequence
  Synthetic oligonucleotide; CTG chr11 5192701 5192722 5192718 5192723 +
taaactgtcttccaatttggct

SEQ ID NO: 77931 - DNA, 22 bp, Artificial Sequence
  Synthetic oligonucleotide; CTG chr11 5192708 5192729 5192725 5192730 +
tcttccaatttggctgcactat

SEQ ID NO: 77932 - DNA, 22 bp, Artificial Sequence
  Synthetic oligonucleotide; CTT chr11 5192712 5192733 5192729 5192734 +
ccaatttggctgcactatttct

SEQ ID NO: 77933 - DNA, 22 bp, Artificial Sequence
  Synthetic oligonucleotide; TTC chr11 5192713 5192734 5192730 5192735 +
caatttggctgcactatttctc

SEQ ID NO: 77934 - DNA, 22 bp, Artificial Sequence
  Synthetic oligonucleotide; TTT chr11 5192719 5192740 5192736 5192741 +
ggctgcactatttctcatccct

SEQ ID NO: 77935 - DNA, 22 bp, Artificial Sequence
  Synthetic oligonucleotide; TTG chr11 5192720 5192741 5192737 5192742 +
gctgcactatttctcatcccta

SEQ ID NO: 77936 - DNA, 22 bp, Artificial Sequence
  Synthetic oligonucleotide; CTG chr11 5192724 5192745 5192741 5192746 +
cactatttctcatccctacaag

SEQ ID NO: 77937 - DNA, 22 bp, Artificial Sequence
  Synthetic oligonucleotide; CTA chr11 5192729 5192750 5192746 5192751 +
tttctcatccctacaagcaata

SEQ ID NO: 77938 - DNA, 22 bp, Artificial Sequence
  Synthetic oligonucleotide; TTT chr11 5192732 5192753 5192749 5192754 +
ctcatccctacaagcaataagt

SEQ ID NO: 77939 - DNA, 22 bp, Artificial Sequence
  Synthetic oligonucleotide; TTC chr11 5192733 5192754 5192750 5192755 +
tcatccctacaagcaataagtg

SEQ ID NO: 77940 - DNA, 22 bp, Artificial Sequence
  Synthetic oligonucleotide; CTC chr11 5192735 5192756 5192752 5192757 +
atccctacaagcaataagtgag

SEQ ID NO: 77941 - DNA, 22 bp, Artificial Sequence
  Synthetic oligonucleotide; CTA chr11 5192742 5192763 5192759 5192764 +
caagcaataagtgagagttact

SEQ ID NO: 77942 - DNA, 22 bp, Artificial Sequence
  Synthetic oligonucleotide; TTA chr11 5192762 5192783 5192779 5192784 +
ctgttgctccacttcgttgcca

SEQ ID NO: 77943 - DNA, 22 bp, Artificial Sequence
  Synthetic oligonucleotide; CTG chr11 5192765 5192786 5192782 5192787 +
ttgctccacttcgttgccagtg

SEQ ID NO: 77944 - DNA, 22 bp, Artificial Sequence
  Synthetic oligonucleotide; TTG chr11 5192768 5192789 5192785 5192790 +
ctccacttcgttgccagtgttt

SEQ ID NO: 77945 - DNA, 22 bp, Artificial Sequence
  Synthetic oligonucleotide; CTC chr11 5192771 5192792 5192788 5192793 +
cacttcgttgccagtgtttggt

SEQ ID NO: 77946 - DNA, 22 bp, Artificial Sequence
  Synthetic oligonucleotide; CTT chr11 5192776 5192797 5192793 5192798 +
cgttgccagtgtttggtggatg

SEQ ID NO: 77947 - DNA, 22 bp, Artificial Sequence
  Synthetic oligonucleotide; TTC chr11 5192777 5192798 5192794 5192799 +
gttgccagtgtttggtggatgt

SEQ ID NO: 77948 - DNA, 22 bp, Artificial Sequence
  Synthetic oligonucleotide; TTG chr11 5192781 5192802 5192798 5192803 +
ccagtgtttggtggatgtcagt

SEQ ID NO: 77949 - DNA, 22 bp, Artificial Sequence
  Synthetic oligonucleotide; TTT chr11 5192790 5192811 5192807 5192812 +
ggtggatgtcagtattttggaa

SEQ ID NO: 77950 - DNA, 22 bp, Artificial Sequence
  Synthetic oligonucleotide; TTG chr11 5192791 5192812 5192808 5192813 +
gtggatgtcagtattttggaat

SEQ ID NO: 77951 - DNA, 22 bp, Artificial Sequence
  Synthetic oligonucleotide; TTT chr11 5192807 5192828 5192824 5192829 +
tggaatttggccttctaatatg

SEQ ID NO: 77952 - DNA, 22 bp, Artificial Sequence
  Synthetic oligonucleotide; TTT chr11 5192808 5192829 5192825 5192830 +
ggaatttggccttctaatatgt

SEQ ID NO: 77953 - DNA, 22 bp, Artificial Sequence
  Synthetic oligonucleotide; TTG chr11 5192809 5192830 5192826 5192831 +
gaatttggccttctaatatgtg

SEQ ID NO: 77954 - DNA, 22 bp, Artificial Sequence
  Synthetic oligonucleotide; TTT chr11 5192815 5192836 5192832 5192837 +
ggccttctaatatgtgtgtagt

SEQ ID NO: 77955 - DNA, 22 bp, Artificial Sequence
  Synthetic oligonucleotide; TTG chr11 5192816 5192837 5192833 5192838 +
gccttctaatatgtgtgtagtg

SEQ ID NO: 77956 - DNA, 22 bp, Artificial Sequence
  Synthetic oligonucleotide; CTT chr11 5192821 5192842 5192838 5192843 +
ctaatatgtgtgtagtggttgg

SEQ ID NO: 77957 - DNA, 22 bp, Artificial Sequence
  Synthetic oligonucleotide; TTC chr11 5192822 5192843 5192839 5192844 +
taatatgtgtgtagtggttggt

SEQ ID NO: 77958 - DNA, 22 bp, Artificial Sequence
  Synthetic oligonucleotide; CTA chr11 5192824 5192845 5192841 5192846 +
atatgtgtgtagtggttggtat

SEQ ID NO: 77959 - DNA, 22 bp, Artificial Sequence
  Synthetic oligonucleotide; TTG chr11 5192842 5192863 5192859 5192864 +
gtatcttcttgttttaatgtgc

SEQ ID NO: 77960 - DNA, 22 bp, Artificial Sequence
  Synthetic oligonucleotide; CTT chr11 5192849 5192870 5192866 5192871 +
cttgttttaatgtgcagtttct

SEQ ID NO: 77961 - DNA, 22 bp, Artificial Sequence
  Synthetic oligonucleotide; TTC chr11 5192850 5192871 5192867 5192872 +
ttgttttaatgtgcagtttctt

SEQ ID NO: 77962 - DNA, 22 bp, Artificial Sequence
  Synthetic oligonucleotide; CTT chr11 5192852 5192873 5192869 5192874 +
gttttaatgtgcagtttcttaa

SEQ ID NO: 77963 - DNA, 22 bp, Artificial Sequence
  Synthetic oligonucleotide; TTG chr11 5192853 5192874 5192870 5192875 +
ttttaatgtgcagtttcttaat

SEQ ID NO: 77964 - DNA, 22 bp, Artificial Sequence
  Synthetic oligonucleotide; TTT chr11 5192856 5192877 5192873 5192878 +
taatgtgcagtttcttaatgac

SEQ ID NO: 77965 - DNA, 22 bp, Artificial Sequence
  Synthetic oligonucleotide; TTT chr11 5192857 5192878 5192874 5192879 +
aatgtgcagtttcttaatgaca

SEQ ID NO: 77966 - DNA, 22 bp, Artificial Sequence
  Synthetic oligonucleotide; TTA chr11 5192858 5192879 5192875 5192880 +
atgtgcagtttcttaatgacat

SEQ ID NO: 77967 - DNA, 22 bp, Artificial Sequence
  Synthetic oligonucleotide; TTT chr11 5192869 5192890 5192886 5192891 +
cttaatgacatgtgttactgag

SEQ ID NO: 77968 - DNA, 22 bp, Artificial Sequence
  Synthetic oligonucleotide; TTC chr11 5192870 5192891 5192887 5192892 +
ttaatgacatgtgttactgagt

SEQ ID NO: 77969 - DNA, 22 bp, Artificial Sequence
  Synthetic oligonucleotide; CTT chr11 5192872 5192893 5192889 5192894 +
aatgacatgtgttactgagtat

SEQ ID NO: 77970 - DNA, 22 bp, Artificial Sequence
  Synthetic oligonucleotide; TTA chr11 5192873 5192894 5192890 5192895 +
atgacatgtgttactgagtata

SEQ ID NO: 77971 - DNA, 22 bp, Artificial Sequence
  Synthetic oligonucleotide; TTA chr11 5192886 5192907 5192903 5192908 +
ctgagtatattttcatgtgctt

SEQ ID NO: 77972 - DNA, 22 bp, Artificial Sequence
  Synthetic oligonucleotide; CTG chr11 5192889 5192910 5192906 5192911 +
agtatattttcatgtgcttatt

SEQ ID NO: 77973 - DNA, 22 bp, Artificial Sequence
  Synthetic oligonucleotide; TTT chr11 5192898 5192919 5192915 5192920 +
tcatgtgcttattgcaatctat

SEQ ID NO: 77974 - DNA, 22 bp, Artificial Sequence
  Synthetic oligonucleotide; TTT chr11 5192899 5192920 5192916 5192921 +
catgtgcttattgcaatctata

SEQ ID NO: 77975 - DNA, 22 bp, Artificial Sequence
  Synthetic oligonucleotide; TTC chr11 5192900 5192921 5192917 5192922 +
atgtgcttattgcaatctatat

SEQ ID NO: 77976 - DNA, 22 bp, Artificial Sequence
  Synthetic oligonucleotide; CTT chr11 5192908 5192929 5192925 5192930 +
attgcaatctatatatcttctt

SEQ ID NO: 77977 - DNA, 22 bp, Artificial Sequence
  Synthetic oligonucleotide; TTA chr11 5192909 5192930 5192926 5192931 +
ttgcaatctatatatcttcttt

SEQ ID NO: 77978 - DNA, 22 bp, Artificial Sequence
  Synthetic oligonucleotide; TTG chr11 5192912 5192933 5192929 5192934 +
caatctatatatcttctttggt

SEQ ID NO: 77979 - DNA, 22 bp, Artificial Sequence
  Synthetic oligonucleotide; CTA chr11 5192919 5192940 5192936 5192941 +
tatatcttctttggtaaagtgt

SEQ ID NO: 77980 - DNA, 22 bp, Artificial Sequence
  Synthetic oligonucleotide; CTT chr11 5192927 5192948 5192944 5192949 +
ctttggtaaagtgtctgttcag

SEQ ID NO: 77981 - DNA, 22 bp, Artificial Sequence
  Synthetic oligonucleotide; TTC chr11 5192928 5192949 5192945 5192950 +
tttggtaaagtgtctgttcaga

SEQ ID NO: 77982 - DNA, 22 bp, Artificial Sequence
  Synthetic oligonucleotide; CTT chr11 5192930 5192951 5192947 5192952 +
tggtaaagtgtctgttcagatc

SEQ ID NO: 77983 - DNA, 22 bp, Artificial Sequence
  Synthetic oligonucleotide; TTT chr11 5192931 5192952 5192948 5192953 +
ggtaaagtgtctgttcagatct

SEQ ID NO: 77984 - DNA, 22 bp, Artificial Sequence
  Synthetic oligonucleotide; TTG chr11 5192932 5192953 5192949 5192954 +
gtaaagtgtctgttcagatctt

SEQ ID NO: 77985 - DNA, 22 bp, Artificial Sequence
  Synthetic oligonucleotide; CTG chr11 5192944 5192965 5192961 5192966 +
ttcagatcttttgcccactttg

SEQ ID NO: 77986 - DNA, 22 bp, Artificial Sequence
  Synthetic oligonucleotide; TTC chr11 5192947 5192968 5192964 5192969 +
agatcttttgcccactttgcaa

SEQ ID NO: 77987 - DNA, 22 bp, Artificial Sequence
  Synthetic oligonucleotide; CTT chr11 5192954 5192975 5192971 5192976 +
ttgcccactttgcaattggatt

SEQ ID NO: 77988 - DNA, 22 bp, Artificial Sequence
  Synthetic oligonucleotide; TTT chr11 5192955 5192976 5192972 5192977 +
tgcccactttgcaattggattg

SEQ ID NO: 77989 - DNA, 22 bp, Artificial Sequence
  Synthetic oligonucleotide; TTT chr11 5192956 5192977 5192973 5192978 +
gcccactttgcaattggattgt

SEQ ID NO: 77990 - DNA, 22 bp, Artificial Sequence
  Synthetic oligonucleotide; TTG chr11 5192957 5192978 5192974 5192979 +
cccactttgcaattggattgtt

SEQ ID NO: 77991 - DNA, 22 bp, Artificial Sequence
  Synthetic oligonucleotide; CTT chr11 5192964 5192985 5192981 5192986 +
tgcaattggattgtttgttttt

SEQ ID NO: 77992 - DNA, 22 bp, Artificial Sequence
  Synthetic oligonucleotide; TTT chr11 5192965 5192986 5192982 5192987 +
gcaattggattgtttgtttttt

SEQ ID NO: 77993 - DNA, 22 bp, Artificial Sequence
  Synthetic oligonucleotide; TTG chr11 5192966 5192987 5192983 5192988 +
caattggattgtttgtttttta

SEQ ID NO: 77994 - DNA, 22 bp, Artificial Sequence
  Synthetic oligonucleotide; TTG chr11 5192972 5192993 5192989 5192994 +
gattgtttgttttttattgtag

SEQ ID NO: 77995 - DNA, 22 bp, Artificial Sequence
  Synthetic oligonucleotide; TTG chr11 5192977 5192998 5192994 5192999 +
tttgttttttattgtagaattt

SEQ ID NO: 77996 - DNA, 22 bp, Artificial Sequence
  Synthetic oligonucleotide; TTT chr11 5192980 5193001 5192997 5193002 +
gttttttattgtagaattttaa

SEQ ID NO: 77997 - DNA, 22 bp, Artificial Sequence
  Synthetic oligonucleotide; TTG chr11 5192981 5193002 5192998 5193003 +
ttttttattgtagaattttaaa

SEQ ID NO: 77998 - DNA, 22 bp, Artificial Sequence
  Synthetic oligonucleotide; TTT chr11 5192984 5193005 5193001 5193006 +
tttattgtagaattttaaaagt

SEQ ID NO: 77999 - DNA, 22 bp, Artificial Sequence
  Synthetic oligonucleotide; TTT chr11 5192985 5193006 5193002 5193007 +
ttattgtagaattttaaaagtt

SEQ ID NO: 78000 - DNA, 22 bp, Artificial Sequence
  Synthetic oligonucleotide; TTT chr11 5192986 5193007 5193003 5193008 +
tattgtagaattttaaaagttc

SEQ ID NO: 78001 - DNA, 22 bp, Artificial Sequence
  Synthetic oligonucleotide; TTT chr11 5192987 5193008 5193004 5193009 +
attgtagaattttaaaagttct

SEQ ID NO: 78002 - DNA, 22 bp, Artificial Sequence
  Synthetic oligonucleotide; TTA chr11 5192988 5193009 5193005 5193010 +
ttgtagaattttaaaagttctt

SEQ ID NO: 78003 - DNA, 22 bp, Artificial Sequence
  Synthetic oligonucleotide; TTG chr11 5192991 5193012 5193008 5193013 +
tagaattttaaaagttctttgt

SEQ ID NO: 78004 - DNA, 22 bp, Artificial Sequence
  Synthetic oligonucleotide; TTT chr11 5192999 5193020 5193016 5193021 +
taaaagttctttgtataatatg

SEQ ID NO: 78005 - DNA, 22 bp, Artificial Sequence
  Synthetic oligonucleotide; TTT chr11 5193000 5193021 5193017 5193022 +
aaaagttctttgtataatatgt

SEQ ID NO: 78006 - DNA, 22 bp, Artificial Sequence
  Synthetic oligonucleotide; TTA chr11 5193001 5193022 5193018 5193023 +
aaagttctttgtataatatgta

SEQ ID NO: 78007 - DNA, 22 bp, Artificial Sequence
  Synthetic oligonucleotide; TTC chr11 5193008 5193029 5193025 5193030 +
tttgtataatatgtatacaagt

SEQ ID NO: 78008 - DNA, 22 bp, Artificial Sequence
  Synthetic oligonucleotide; CTT chr11 5193010 5193031 5193027 5193032 +
tgtataatatgtatacaagtcc

SEQ ID NO: 78009 - DNA, 22 bp, Artificial Sequence
  Synthetic oligonucleotide; TTT chr11 5193011 5193032 5193028 5193033 +
gtataatatgtatacaagtcct

SEQ ID NO: 78010 - DNA, 22 bp, Artificial Sequence
  Synthetic oligonucleotide; TTG chr11 5193012 5193033 5193029 5193034 +
tataatatgtatacaagtcctt

SEQ ID NO: 78011 - DNA, 22 bp, Artificial Sequence
  Synthetic oligonucleotide; CTT chr11 5193034 5193055 5193051 5193056 +
tatcagataatatgttttgcaa

SEQ ID NO: 78012 - DNA, 22 bp, Artificial Sequence
  Synthetic oligonucleotide; TTT chr11 5193035 5193056 5193052 5193057 +
atcagataatatgttttgcaaa

SEQ ID NO: 78013 - DNA, 22 bp, Artificial Sequence
  Synthetic oligonucleotide; TTA chr11 5193036 5193057 5193053 5193058 +
tcagataatatgttttgcaaat

SEQ ID NO: 78014 - DNA, 22 bp, Artificial Sequence
  Synthetic oligonucleotide; TTT chr11 5193051 5193072 5193068 5193073 +
tgcaaatatgttctctgtggct

SEQ ID NO: 78015 - DNA, 22 bp, Artificial Sequence
  Synthetic oligonucleotide; TTT chr11 5193052 5193073 5193069 5193074 +
gcaaatatgttctctgtggctt

SEQ ID NO: 78016 - DNA, 22 bp, Artificial Sequence
  Synthetic oligonucleotide; TTG chr11 5193053 5193074 5193070 5193075 +
caaatatgttctctgtggcttg

SEQ ID NO: 78017 - DNA, 22 bp, Artificial Sequence
  Synthetic oligonucleotide; TTC chr11 5193064 5193085 5193081 5193086 +
tctgtggcttgtttttttcatt

SEQ ID NO: 78018 - DNA, 22 bp, Artificial Sequence
  Synthetic oligonucleotide; CTC chr11 5193066 5193087 5193083 5193088 +
tgtggcttgtttttttcattct

SEQ ID NO: 78019 - DNA, 22 bp, Artificial Sequence
  Synthetic oligonucleotide; CTG chr11 5193068 5193089 5193085 5193090 +
tggcttgtttttttcattctct

SEQ ID NO: 78020 - DNA, 22 bp, Artificial Sequence
  Synthetic oligonucleotide; CTT chr11 5193074 5193095 5193091 5193096 +
gtttttttcattctcttaactt

SEQ ID NO: 78021 - DNA, 22 bp, Artificial Sequence
  Synthetic oligonucleotide; TTG chr11 5193075 5193096 5193092 5193097 +
tttttttcattctcttaactta

SEQ ID NO: 78022 - DNA, 22 bp, Artificial Sequence
  Synthetic oligonucleotide; TTT chr11 5193078 5193099 5193095 5193100 +
ttttcattctcttaacttacca

SEQ ID NO: 78023 - DNA, 22 bp, Artificial Sequence
  Synthetic oligonucleotide; TTT chr11 5193079 5193100 5193096 5193101 +
tttcattctcttaacttaccat

SEQ ID NO: 78024 - DNA, 22 bp, Artificial Sequence
  Synthetic oligonucleotide; TTT chr11 5193080 5193101 5193097 5193102 +
ttcattctcttaacttaccatg

SEQ ID NO: 78025 - DNA, 22 bp, Artificial Sequence
  Synthetic oligonucleotide; TTT chr11 5193081 5193102 5193098 5193103 +
tcattctcttaacttaccatga

SEQ ID NO: 78026 - DNA, 22 bp, Artificial Sequence
  Synthetic oligonucleotide; TTT chr11 5193082 5193103 5193099 5193104 +
cattctcttaacttaccatgaa

SEQ ID NO: 78027 - DNA, 22 bp, Artificial Sequence
  Synthetic oligonucleotide; TTC chr11 5193083 5193104 5193100 5193105 +
attctcttaacttaccatgaat

SEQ ID NO: 78028 - DNA, 22 bp, Artificial Sequence
  Synthetic oligonucleotide; TTC chr11 5193087 5193108 5193104 5193109 +
tcttaacttaccatgaattttt

SEQ ID NO: 78029 - DNA, 22 bp, Artificial Sequence
  Synthetic oligonucleotide; CTC chr11 5193089 5193110 5193106 5193111 +
ttaacttaccatgaatttttat

SEQ ID NO: 78030 - DNA, 22 bp, Artificial Sequence
  Synthetic oligonucleotide; CTT chr11 5193091 5193112 5193108 5193113 +
aacttaccatgaatttttattt

SEQ ID NO: 78031 - DNA, 22 bp, Artificial Sequence
  Synthetic oligonucleotide; TTA chr11 5193092 5193113 5193109 5193114 +
acttaccatgaatttttatttt

SEQ ID NO: 78032 - DNA, 22 bp, Artificial Sequence
  Synthetic oligonucleotide; CTT chr11 5193096 5193117 5193113 5193118 +
accatgaatttttattttattt

SEQ ID NO: 78033 - DNA, 22 bp, Artificial Sequence
  Synthetic oligonucleotide; TTA chr11 5193097 5193118 5193114 5193119 +
ccatgaatttttattttatttt

SEQ ID NO: 78034 - DNA, 22 bp, Artificial Sequence
  Synthetic oligonucleotide; TTT chr11 5193107 5193128 5193124 5193129 +
ttattttattttattttgttct

SEQ ID NO: 78035 - DNA, 22 bp, Artificial Sequence
  Synthetic oligonucleotide; TTT chr11 5193108 5193129 5193125 5193130 +
tattttattttattttgttctg

SEQ ID NO: 78036 - DNA, 22 bp, Artificial Sequence
  Synthetic oligonucleotide; TTT chr11 5193109 5193130 5193126 5193131 +
attttattttattttgttctgg

SEQ ID NO: 78037 - DNA, 22 bp, Artificial Sequence
  Synthetic oligonucleotide; TTA chr11 5193110 5193131 5193127 5193132 +
ttttattttattttgttctggg

SEQ ID NO: 78038 - DNA, 22 bp, Artificial Sequence
  Synthetic oligonucleotide; TTT chr11 5193113 5193134 5193130 5193135 +
tattttattttgttctgggtat

SEQ ID NO: 78039 - DNA, 22 bp, Artificial Sequence
  Synthetic oligonucleotide; TTT chr11 5193114 5193135 5193131 5193136 +
attttattttgttctgggtatt

SEQ ID NO: 78040 - DNA, 22 bp, Artificial Sequence
  Synthetic oligonucleotide; TTA chr11 5193115 5193136 5193132 5193137 +
ttttattttgttctgggtattt

SEQ ID NO: 78041 - DNA, 22 bp, Artificial Sequence
  Synthetic oligonucleotide; TTT chr11 5193118 5193139 5193135 5193140 +
tattttgttctgggtattttgt

SEQ ID NO: 78042 - DNA, 22 bp, Artificial Sequence
  Synthetic oligonucleotide; TTT chr11 5193119 5193140 5193136 5193141 +
attttgttctgggtattttgtg

SEQ ID NO: 78043 - DNA, 22 bp, Artificial Sequence
  Synthetic oligonucleotide; TTA chr11 5193120 5193141 5193137 5193142 +
ttttgttctgggtattttgtgg

SEQ ID NO: 78044 - DNA, 22 bp, Artificial Sequence
  Synthetic oligonucleotide; TTT chr11 5193123 5193144 5193140 5193145 +
tgttctgggtattttgtggata

SEQ ID NO: 78045 - DNA, 22 bp, Artificial Sequence
  Synthetic oligonucleotide; TTT chr11 5193124 5193145 5193141 5193146 +
gttctgggtattttgtggatac

SEQ ID NO: 78046 - DNA, 22 bp, Artificial Sequence
  Synthetic oligonucleotide; TTG chr11 5193125 5193146 5193142 5193147 +
ttctgggtattttgtggatact

SEQ ID NO: 78047 - DNA, 22 bp, Artificial Sequence
  Synthetic oligonucleotide; TTC chr11 5193128 5193149 5193145 5193150 +
tgggtattttgtggatactctc

SEQ ID NO: 78048 - DNA, 22 bp, Artificial Sequence
  Synthetic oligonucleotide; CTG chr11 5193130 5193151 5193147 5193152 +
ggtattttgtggatactctcaa

SEQ ID NO: 78049 - DNA, 22 bp, Artificial Sequence
  Synthetic oligonucleotide; TTT chr11 5193137 5193158 5193154 5193159 +
tgtggatactctcaatttcaac

SEQ ID NO: 78050 - DNA, 22 bp, Artificial Sequence
  Synthetic oligonucleotide; TTT chr11 5193138 5193159 5193155 5193160 +
gtggatactctcaatttcaact

SEQ ID NO: 78051 - DNA, 22 bp, Artificial Sequence
  Synthetic oligonucleotide; TTG chr11 5193139 5193160 5193156 5193161 +
tggatactctcaatttcaactg

SEQ ID NO: 78052 - DNA, 22 bp, Artificial Sequence
  Synthetic oligonucleotide; CTC chr11 5193148 5193169 5193165 5193170 +
tcaatttcaactgctgtgttct

SEQ ID NO: 78053 - DNA, 22 bp, Artificial Sequence
  Synthetic oligonucleotide; CTC chr11 5193150 5193171 5193167 5193172 +
aatttcaactgctgtgttcttt

SEQ ID NO: 78054 - DNA, 22 bp, Artificial Sequence
  Synthetic oligonucleotide; TTT chr11 5193155 5193176 5193172 5193177 +
caactgctgtgttcttttgttc

SEQ ID NO: 78055 - DNA, 22 bp, Artificial Sequence
  Synthetic oligonucleotide; TTC chr11 5193156 5193177 5193173 5193178 +
aactgctgtgttcttttgttca

SEQ ID NO: 78056 - DNA, 22 bp, Artificial Sequence
  Synthetic oligonucleotide; CTG chr11 5193161 5193182 5193178 5193183 +
ctgtgttcttttgttcagaaaa

SEQ ID NO: 78057 - DNA, 22 bp, Artificial Sequence
  Synthetic oligonucleotide; CTG chr11 5193164 5193185 5193181 5193186 +
tgttcttttgttcagaaaattg

SEQ ID NO: 78058 - DNA, 22 bp, Artificial Sequence
  Synthetic oligonucleotide; TTC chr11 5193169 5193190 5193186 5193191 +
ttttgttcagaaaattgtcttg

SEQ ID NO: 78059 - DNA, 22 bp, Artificial Sequence
  Synthetic oligonucleotide; CTT chr11 5193171 5193192 5193188 5193193 +
ttgttcagaaaattgtcttgta

SEQ ID NO: 78060 - DNA, 22 bp, Artificial Sequence
  Synthetic oligonucleotide; TTT chr11 5193172 5193193 5193189 5193194 +
tgttcagaaaattgtcttgtat

SEQ ID NO: 78061 - DNA, 22 bp, Artificial Sequence
  Synthetic oligonucleotide; TTT chr11 5193173 5193194 5193190 5193195 +
gttcagaaaattgtcttgtatt

SEQ ID NO: 78062 - DNA, 22 bp, Artificial Sequence
  Synthetic oligonucleotide; TTG chr11 5193174 5193195 5193191 5193196 +
ttcagaaaattgtcttgtattg

SEQ ID NO: 78063 - DNA, 22 bp, Artificial Sequence
  Synthetic oligonucleotide; TTC chr11 5193177 5193198 5193194 5193199 +
agaaaattgtcttgtattgatc

SEQ ID NO: 78064 - DNA, 22 bp, Artificial Sequence
  Synthetic oligonucleotide; TTG chr11 5193186 5193207 5193203 5193208 +
tcttgtattgatctctagtaag

SEQ ID NO: 78065 - DNA, 22 bp, Artificial Sequence
  Synthetic oligonucleotide; CTT chr11 5193190 5193211 5193207 5193212 +
gtattgatctctagtaagttcc

SEQ ID NO: 78066 - DNA, 22 bp, Artificial Sequence
  Synthetic oligonucleotide; TTG chr11 5193191 5193212 5193208 5193213 +
tattgatctctagtaagttcct

SEQ ID NO: 78067 - DNA, 22 bp, Artificial Sequence
  Synthetic oligonucleotide; TTG chr11 5193196 5193217 5193213 5193218 +
atctctagtaagttccttctac

SEQ ID NO: 78068 - DNA, 22 bp, Artificial Sequence
  Synthetic oligonucleotide; CTC chr11 5193201 5193222 5193218 5193223 +
tagtaagttccttctacatgtt

SEQ ID NO: 78069 - DNA, 22 bp, Artificial Sequence
  Synthetic oligonucleotide; CTA chr11 5193203 5193224 5193220 5193225 +
gtaagttccttctacatgttct

SEQ ID NO: 78070 - DNA, 22 bp, Artificial Sequence
  Synthetic oligonucleotide; TTC chr11 5193211 5193232 5193228 5193233 +
cttctacatgttctattttcac

SEQ ID NO: 78071 - DNA, 22 bp, Artificial Sequence
  Synthetic oligonucleotide; CTT chr11 5193214 5193235 5193231 5193236 +
ctacatgttctattttcactct

SEQ ID NO: 78072 - DNA, 22 bp, Artificial Sequence
  Synthetic oligonucleotide; TTC chr11 5193215 5193236 5193232 5193237 +
tacatgttctattttcactctc

SEQ ID NO: 78073 - DNA, 22 bp, Artificial Sequence
  Synthetic oligonucleotide; CTA chr11 5193217 5193238 5193234 5193239 +
catgttctattttcactctctc

SEQ ID NO: 78074 - DNA, 22 bp, Artificial Sequence
  Synthetic oligonucleotide; TTC chr11 5193224 5193245 5193241 5193246 +
tattttcactctctcctgaact

SEQ ID NO: 78075 - DNA, 22 bp, Artificial Sequence
  Synthetic oligonucleotide; CTA chr11 5193226 5193247 5193243 5193248 +
ttttcactctctcctgaactcc

SEQ ID NO: 78076 - DNA, 22 bp, Artificial Sequence
  Synthetic oligonucleotide; TTT chr11 5193229 5193250 5193246 5193251 +
tcactctctcctgaactccagt

SEQ ID NO: 78077 - DNA, 22 bp, Artificial Sequence
  Synthetic oligonucleotide; TTT chr11 5193230 5193251 5193247 5193252 +
cactctctcctgaactccagtt

SEQ ID NO: 78078 - DNA, 22 bp, Artificial Sequence
  Synthetic oligonucleotide; TTC chr11 5193231 5193252 5193248 5193253 +
actctctcctgaactccagtta

SEQ ID NO: 78079 - DNA, 22 bp, Artificial Sequence
  Synthetic oligonucleotide; CTC chr11 5193235 5193256 5193252 5193257 +
tctcctgaactccagttaagat

SEQ ID NO: 78080 - DNA, 22 bp, Artificial Sequence
  Synthetic oligonucleotide; CTC chr11 5193237 5193258 5193254 5193259 +
tcctgaactccagttaagattt

SEQ ID NO: 78081 - DNA, 22 bp, Artificial Sequence
  Synthetic oligonucleotide; CTC chr11 5193239 5193260 5193256 5193261 +
ctgaactccagttaagattttg

SEQ ID NO: 78082 - DNA, 22 bp, Artificial Sequence
  Synthetic oligonucleotide; CTG chr11 5193242 5193263 5193259 5193264 +
aactccagttaagattttggag

SEQ ID NO: 78083 - DNA, 22 bp, Artificial Sequence
  Synthetic oligonucleotide; CTC chr11 5193247 5193268 5193264 5193269 +
cagttaagattttggagttcct

SEQ ID NO: 78084 - DNA, 22 bp, Artificial Sequence
  Synthetic oligonucleotide; TTA chr11 5193253 5193274 5193270 5193275 +
agattttggagttcctgacttc

SEQ ID NO: 78085 - DNA, 22 bp, Artificial Sequence
  Synthetic oligonucleotide; TTT chr11 5193259 5193280 5193276 5193281 +
tggagttcctgacttcacccta

SEQ ID NO: 78086 - DNA, 22 bp, Artificial Sequence
  Synthetic oligonucleotide; TTT chr11 5193260 5193281 5193277 5193282 +
ggagttcctgacttcaccctat

SEQ ID NO: 78087 - DNA, 22 bp, Artificial Sequence
  Synthetic oligonucleotide; TTG chr11 5193261 5193282 5193278 5193283 +
gagttcctgacttcaccctatt

SEQ ID NO: 78088 - DNA, 22 bp, Artificial Sequence
  Synthetic oligonucleotide; TTC chr11 5193267 5193288 5193284 5193289 +
ctgacttcaccctattttttcc

SEQ ID NO: 78089 - DNA, 22 bp, Artificial Sequence
  Synthetic oligonucleotide; CTG chr11 5193270 5193291 5193287 5193292 +
acttcaccctattttttcctcc

SEQ ID NO: 78090 - DNA, 22 bp, Artificial Sequence
  Synthetic oligonucleotide; CTT chr11 5193274 5193295 5193291 5193296 +
caccctattttttcctccatgc

SEQ ID NO: 78091 - DNA, 22 bp, Artificial Sequence
  Synthetic oligonucleotide; TTC chr11 5193275 5193296 5193292 5193297 +
accctattttttcctccatgcc

SEQ ID NO: 78092 - DNA, 22 bp, Artificial Sequence
  Synthetic oligonucleotide; CTA chr11 5193281 5193302 5193298 5193303 +
ttttttcctccatgccccccat

SEQ ID NO: 78093 - DNA, 22 bp, Artificial Sequence
  Synthetic oligonucleotide; TTT chr11 5193284 5193305 5193301 5193306 +
tttcctccatgccccccatatt

SEQ ID NO: 78094 - DNA, 22 bp, Artificial Sequence
  Synthetic oligonucleotide; TTT chr11 5193285 5193306 5193302 5193307 +
ttcctccatgccccccatattt

SEQ ID NO: 78095 - DNA, 22 bp, Artificial Sequence
  Synthetic oligonucleotide; TTT chr11 5193286 5193307 5193303 5193308 +
tcctccatgccccccatattta

SEQ ID NO: 78096 - DNA, 22 bp, Artificial Sequence
  Synthetic oligonucleotide; TTT chr11 5193287 5193308 5193304 5193309 +
cctccatgccccccatatttat

SEQ ID NO: 78097 - DNA, 22 bp, Artificial Sequence
  Synthetic oligonucleotide; TTC chr11 5193288 5193309 5193305 5193310 +
ctccatgccccccatatttatt

SEQ ID NO: 78098 - DNA, 22 bp, Artificial Sequence
  Synthetic oligonucleotide; CTC chr11 5193291 5193312 5193308 5193313 +
catgccccccatatttattcct

SEQ ID NO: 78099 - DNA, 22 bp, Artificial Sequence
  Synthetic oligonucleotide; TTT chr11 5193307 5193328 5193324 5193329 +
attcctttgtcctttttttctg

SEQ ID NO: 78100 - DNA, 22 bp, Artificial Sequence
  Synthetic oligonucleotide; TTA chr11 5193308 5193329 5193325 5193330 +
ttcctttgtcctttttttctgc

SEQ ID NO: 78101 - DNA, 22 bp, Artificial Sequence
  Synthetic oligonucleotide; TTC chr11 5193311 5193332 5193328 5193333 +
ctttgtcctttttttctgcact

SEQ ID NO: 78102 - DNA, 22 bp, Artificial Sequence
  Synthetic oligonucleotide; CTT chr11 5193314 5193335 5193331 5193336 +
tgtcctttttttctgcactctt

SEQ ID NO: 78103 - DNA, 22 bp, Artificial Sequence
  Synthetic oligonucleotide; TTT chr11 5193315 5193336 5193332 5193337 +
gtcctttttttctgcactctta

SEQ ID NO: 78104 - DNA, 22 bp, Artificial Sequence
  Synthetic oligonucleotide; TTG chr11 5193316 5193337 5193333 5193338 +
tcctttttttctgcactcttaa

SEQ ID NO: 78105 - DNA, 22 bp, Artificial Sequence
  Synthetic oligonucleotide; CTT chr11 5193321 5193342 5193338 5193343 +
tttttctgcactcttaaatcta

SEQ ID NO: 78106 - DNA, 22 bp, Artificial Sequence
  Synthetic oligonucleotide; TTT chr11 5193322 5193343 5193339 5193344 +
ttttctgcactcttaaatctac

SEQ ID NO: 78107 - DNA, 22 bp, Artificial Sequence
  Synthetic oligonucleotide; TTT chr11 5193323 5193344 5193340 5193345 +
tttctgcactcttaaatctact

SEQ ID NO: 78108 - DNA, 22 bp, Artificial Sequence
  Synthetic oligonucleotide; TTT chr11 5193324 5193345 5193341 5193346 +
ttctgcactcttaaatctactt

SEQ ID NO: 78109 - DNA, 22 bp, Artificial Sequence
  Synthetic oligonucleotide; TTT chr11 5193325 5193346 5193342 5193347 +
tctgcactcttaaatctacttc

SEQ ID NO: 78110 - DNA, 22 bp, Artificial Sequence
  Synthetic oligonucleotide; TTT chr11 5193326 5193347 5193343 5193348 +
ctgcactcttaaatctacttcc

SEQ ID NO: 78111 - DNA, 22 bp, Artificial Sequence
  Synthetic oligonucleotide; TTC chr11 5193327 5193348 5193344 5193349 +
tgcactcttaaatctacttcct

SEQ ID NO: 78112 - DNA, 22 bp, Artificial Sequence
  Synthetic oligonucleotide; CTG chr11 5193329 5193350 5193346 5193351 +
cactcttaaatctacttcctgt

SEQ ID NO: 78113 - DNA, 22 bp, Artificial Sequence
  Synthetic oligonucleotide; CTC chr11 5193334 5193355 5193351 5193356 +
ttaaatctacttcctgtccccc

SEQ ID NO: 78114 - DNA, 22 bp, Artificial Sequence
  Synthetic oligonucleotide; CTT chr11 5193336 5193357 5193353 5193358 +
aaatctacttcctgtccccctt

SEQ ID NO: 78115 - DNA, 22 bp, Artificial Sequence
  Synthetic oligonucleotide; TTA chr11 5193337 5193358 5193354 5193359 +
aatctacttcctgtccccctta

SEQ ID NO: 78116 - DNA, 22 bp, Artificial Sequence
  Synthetic oligonucleotide; CTA chr11 5193343 5193364 5193360 5193365 +
cttcctgtcccccttattggct

SEQ ID NO: 78117 - DNA, 22 bp, Artificial Sequence
  Synthetic oligonucleotide; CTT chr11 5193346 5193367 5193363 5193368 +
cctgtcccccttattggctact

SEQ ID NO: 78118 - DNA, 22 bp, Artificial Sequence
  Synthetic oligonucleotide; TTC chr11 5193347 5193368 5193364 5193369 +
ctgtcccccttattggctactt

SEQ ID NO: 78119 - DNA, 22 bp, Artificial Sequence
  Synthetic oligonucleotide; CTG chr11 5193350 5193371 5193367 5193372 +
tcccccttattggctacttcat

SEQ ID NO: 78120 - DNA, 22 bp, Artificial Sequence
  Synthetic oligonucleotide; CTT chr11 5193358 5193379 5193375 5193380 +
attggctacttcatctcatctc

SEQ ID NO: 78121 - DNA, 22 bp, Artificial Sequence
  Synthetic oligonucleotide; TTA chr11 5193359 5193380 5193376 5193381 +
ttggctacttcatctcatctct

SEQ ID NO: 78122 - DNA, 22 bp, Artificial Sequence
  Synthetic oligonucleotide; TTG chr11 5193362 5193383 5193379 5193384 +
gctacttcatctcatctctcat

SEQ ID NO: 78123 - DNA, 22 bp, Artificial Sequence
  Synthetic oligonucleotide; CTA chr11 5193366 5193387 5193383 5193388 +
cttcatctcatctctcatattt

SEQ ID NO: 78124 - DNA, 22 bp, Artificial Sequence
  Synthetic oligonucleotide; CTT chr11 5193369 5193390 5193386 5193391 +
catctcatctctcatatttttg

SEQ ID NO: 78125 - DNA, 22 bp, Artificial Sequence
  Synthetic oligonucleotide; TTC chr11 5193370 5193391 5193387 5193392 +
atctcatctctcatatttttgc

SEQ ID NO: 78126 - DNA, 22 bp, Artificial Sequence
  Synthetic oligonucleotide; CTC chr11 5193375 5193396 5193392 5193397 +
atctctcatatttttgctttat

SEQ ID NO: 78127 - DNA, 22 bp, Artificial Sequence
  Synthetic oligonucleotide; CTC chr11 5193380 5193401 5193397 5193402 +
tcatatttttgctttatttact

SEQ ID NO: 78128 - DNA, 22 bp, Artificial Sequence
  Synthetic oligonucleotide; CTC chr11 5193382 5193403 5193399 5193404 +
atatttttgctttatttactat

SEQ ID NO: 78129 - DNA, 22 bp, Artificial Sequence
  Synthetic oligonucleotide; TTT chr11 5193388 5193409 5193405 5193410 +
ttgctttatttactatttatca

SEQ ID NO: 78130 - DNA, 22 bp, Artificial Sequence
  Synthetic oligonucleotide; TTT chr11 5193389 5193410 5193406 5193411 +
tgctttatttactatttatcat

SEQ ID NO: 78131 - DNA, 22 bp, Artificial Sequence
  Synthetic oligonucleotide; TTT chr11 5193390 5193411 5193407 5193412 +
gctttatttactatttatcatg

SEQ ID NO: 78132 - DNA, 22 bp, Artificial Sequence
  Synthetic oligonucleotide; TTG chr11 5193391 5193412 5193408 5193413 +
ctttatttactatttatcatgc

SEQ ID NO: 78133 - DNA, 22 bp, Artificial Sequence
  Synthetic oligonucleotide; CTT chr11 5193394 5193415 5193411 5193416 +
tatttactatttatcatgccct

SEQ ID NO: 78134 - DNA, 22 bp, Artificial Sequence
  Synthetic oligonucleotide; TTT chr11 5193395 5193416 5193412 5193417 +
atttactatttatcatgccctc

SEQ ID NO: 78135 - DNA, 22 bp, Artificial Sequence
  Synthetic oligonucleotide; TTA chr11 5193396 5193417 5193413 5193418 +
tttactatttatcatgccctct

SEQ ID NO: 78136 - DNA, 22 bp, Artificial Sequence
  Synthetic oligonucleotide; TTT chr11 5193399 5193420 5193416 5193421 +
actatttatcatgccctctatt

SEQ ID NO: 78137 - DNA, 22 bp, Artificial Sequence
  Synthetic oligonucleotide; TTA chr11 5193400 5193421 5193417 5193422 +
ctatttatcatgccctctattt

SEQ ID NO: 78138 - DNA, 22 bp, Artificial Sequence
  Synthetic oligonucleotide; CTA chr11 5193403 5193424 5193420 5193425 +
tttatcatgccctctatttttt

SEQ ID NO: 78139 - DNA, 22 bp, Artificial Sequence
  Synthetic oligonucleotide; TTT chr11 5193406 5193427 5193423 5193428 +
atcatgccctctattttttata

SEQ ID NO: 78140 - DNA, 22 bp, Artificial Sequence
  Synthetic oligonucleotide; TTA chr11 5193407 5193428 5193424 5193429 +
tcatgccctctattttttatac

SEQ ID NO: 78141 - DNA, 22 bp, Artificial Sequence
  Synthetic oligonucleotide; CTC chr11 5193417 5193438 5193434 5193439 +
tattttttatactattctgttc

SEQ ID NO: 78142 - DNA, 22 bp, Artificial Sequence
  Synthetic oligonucleotide; CTA chr11 5193419 5193440 5193436 5193441 +
ttttttatactattctgttcaa

SEQ ID NO: 78143 - DNA, 22 bp, Artificial Sequence
  Synthetic oligonucleotide; TTT chr11 5193422 5193443 5193439 5193444 +
tttatactattctgttcaaata

SEQ ID NO: 78144 - DNA, 22 bp, Artificial Sequence
  Synthetic oligonucleotide; TTT chr11 5193423 5193444 5193440 5193445 +
ttatactattctgttcaaatat

SEQ ID NO: 78145 - DNA, 22 bp, Artificial Sequence
  Synthetic oligonucleotide; TTT chr11 5193424 5193445 5193441 5193446 +
tatactattctgttcaaatatc

SEQ ID NO: 78146 - DNA, 22 bp, Artificial Sequence
  Synthetic oligonucleotide; TTT chr11 5193425 5193446 5193442 5193447 +
atactattctgttcaaatatca

SEQ ID NO: 78147 - DNA, 22 bp, Artificial Sequence
  Synthetic oligonucleotide; TTA chr11 5193426 5193447 5193443 5193448 +
tactattctgttcaaatatcaa

SEQ ID NO: 78148 - DNA, 22 bp, Artificial Sequence
  Synthetic oligonucleotide; CTA chr11 5193431 5193452 5193448 5193453 +
ttctgttcaaatatcaaggatc

SEQ ID NO: 78149 - DNA, 22 bp, Artificial Sequence
  Synthetic oligonucleotide; TTC chr11 5193434 5193455 5193451 5193456 +
tgttcaaatatcaaggatctaa

SEQ ID NO: 78150 - DNA, 22 bp, Artificial Sequence
  Synthetic oligonucleotide; CTG chr11 5193436 5193457 5193453 5193458 +
ttcaaatatcaaggatctaaaa

SEQ ID NO: 78151 - DNA, 22 bp, Artificial Sequence
  Synthetic oligonucleotide; TTC chr11 5193439 5193460 5193456 5193461 +
aaatatcaaggatctaaaatga

SEQ ID NO: 78152 - DNA, 22 bp, Artificial Sequence
  Synthetic oligonucleotide; CTA chr11 5193455 5193476 5193472 5193477 +
aaatgagtggttatttaattaa

SEQ ID NO: 78153 - DNA, 22 bp, Artificial Sequence
  Synthetic oligonucleotide; TTA chr11 5193468 5193489 5193485 5193490 +
tttaattaagaatatttattat

SEQ ID NO: 78154 - DNA, 22 bp, Artificial Sequence
  Synthetic oligonucleotide; TTT chr11 5193471 5193492 5193488 5193493 +
aattaagaatatttattatgca

SEQ ID NO: 78155 - DNA, 22 bp, Artificial Sequence
  Synthetic oligonucleotide; TTA chr11 5193472 5193493 5193489 5193494 +
attaagaatatttattatgcac

SEQ ID NO: 78156 - DNA, 22 bp, Artificial Sequence
  Synthetic oligonucleotide; TTA chr11 5193476 5193497 5193493 5193498 +
agaatatttattatgcacctct

SEQ ID NO: 78157 - DNA, 22 bp, Artificial Sequence
  Synthetic oligonucleotide; TTT chr11 5193485 5193506 5193502 5193507 +
attatgcacctcttttattatt

SEQ ID NO: 78158 - DNA, 22 bp, Artificial Sequence
  Synthetic oligonucleotide; TTA chr11 5193486 5193507 5193503 5193508 +
ttatgcacctcttttattatta

SEQ ID NO: 78159 - DNA, 22 bp, Artificial Sequence
  Synthetic oligonucleotide; TTA chr11 5193489 5193510 5193506 5193511 +
tgcacctcttttattattagct

SEQ ID NO: 78160 - DNA, 22 bp, Artificial Sequence
  Synthetic oligonucleotide; CTC chr11 5193497 5193518 5193514 5193519 +
ttttattattagcttttatttt

SEQ ID NO: 78161 - DNA, 22 bp, Artificial Sequence
  Synthetic oligonucleotide; CTT chr11 5193499 5193520 5193516 5193521 +
ttattattagcttttattttct

SEQ ID NO: 78162 - DNA, 22 bp, Artificial Sequence
  Synthetic oligonucleotide; TTT chr11 5193500 5193521 5193517 5193522 +
tattattagcttttattttctg

SEQ ID NO: 78163 - DNA, 22 bp, Artificial Sequence
  Synthetic oligonucleotide; TTT chr11 5193501 5193522 5193518 5193523 +
attattagcttttattttctgc

SEQ ID NO: 78164 - DNA, 22 bp, Artificial Sequence
  Synthetic oligonucleotide; TTA chr11 5193502 5193523 5193519 5193524 +
ttattagcttttattttctgcc

SEQ ID NO: 78165 - DNA, 22 bp, Artificial Sequence
  Synthetic oligonucleotide; TTA chr11 5193505 5193526 5193522 5193527 +
ttagcttttattttctgccctg

SEQ ID NO: 78166 - DNA, 22 bp, Artificial Sequence
  Synthetic oligonucleotide; TTA chr11 5193508 5193529 5193525 5193530 +
gcttttattttctgccctgaat

SEQ ID NO: 78167 - DNA, 22 bp, Artificial Sequence
  Synthetic oligonucleotide; CTT chr11 5193512 5193533 5193529 5193534 +
ttattttctgccctgaataagc

SEQ ID NO: 78168 - DNA, 22 bp, Artificial Sequence
  Synthetic oligonucleotide; TTT chr11 5193513 5193534 5193530 5193535 +
tattttctgccctgaataagct

SEQ ID NO: 78169 - DNA, 22 bp, Artificial Sequence
  Synthetic oligonucleotide; TTT chr11 5193514 5193535 5193531 5193536 +
attttctgccctgaataagctg

SEQ ID NO: 78170 - DNA, 22 bp, Artificial Sequence
  Synthetic oligonucleotide; TTA chr11 5193515 5193536 5193532 5193537 +
ttttctgccctgaataagctgt

SEQ ID NO: 78171 - DNA, 22 bp, Artificial Sequence
  Synthetic oligonucleotide; TTT chr11 5193518 5193539 5193535 5193540 +
tctgccctgaataagctgtgct

SEQ ID NO: 78172 - DNA, 22 bp, Artificial Sequence
  Synthetic oligonucleotide; TTT chr11 5193519 5193540 5193536 5193541 +
ctgccctgaataagctgtgctc

SEQ ID NO: 78173 - DNA, 22 bp, Artificial Sequence
  Synthetic oligonucleotide; TTC chr11 5193520 5193541 5193537 5193542 +
tgccctgaataagctgtgctcc

SEQ ID NO: 78174 - DNA, 22 bp, Artificial Sequence
  Synthetic oligonucleotide; CTG chr11 5193522 5193543 5193539 5193544 +
ccctgaataagctgtgctccaa

SEQ ID NO: 78175 - DNA, 22 bp, Artificial Sequence
  Synthetic oligonucleotide; CTG chr11 5193527 5193548 5193544 5193549 +
aataagctgtgctccaaataag

SEQ ID NO: 78176 - DNA, 22 bp, Artificial Sequence
  Synthetic oligonucleotide; CTG chr11 5193536 5193557 5193553 5193558 +
tgctccaaataagttttcttta

SEQ ID NO: 78177 - DNA, 22 bp, Artificial Sequence
  Synthetic oligonucleotide; CTC chr11 5193541 5193562 5193558 5193563 +
caaataagttttctttattaaa

SEQ ID NO: 78178 - DNA, 22 bp, Artificial Sequence
  Synthetic oligonucleotide; TTT chr11 5193552 5193573 5193569 5193574 +
tctttattaaaattgattctag

SEQ ID NO: 78179 - DNA, 22 bp, Artificial Sequence
  Synthetic oligonucleotide; TTT chr11 5193553 5193574 5193570 5193575 +
ctttattaaaattgattctagg

SEQ ID NO: 78180 - DNA, 22 bp, Artificial Sequence
  Synthetic oligonucleotide; TTC chr11 5193554 5193575 5193571 5193576 +
tttattaaaattgattctaggt

SEQ ID NO: 78181 - DNA, 22 bp, Artificial Sequence
  Synthetic oligonucleotide; CTT chr11 5193556 5193577 5193573 5193578 +
tattaaaattgattctaggtat

SEQ ID NO: 78182 - DNA, 22 bp, Artificial Sequence
  Synthetic oligonucleotide; TTT chr11 5193557 5193578 5193574 5193579 +
attaaaattgattctaggtatg

SEQ ID NO: 78183 - DNA, 22 bp, Artificial Sequence
  Synthetic oligonucleotide; TTA chr11 5193558 5193579 5193575 5193580 +
ttaaaattgattctaggtatgt

SEQ ID NO: 78184 - DNA, 22 bp, Artificial Sequence
  Synthetic oligonucleotide; TTA chr11 5193561 5193582 5193578 5193583 +
aaattgattctaggtatgtaat

SEQ ID NO: 78185 - DNA, 22 bp, Artificial Sequence
  Synthetic oligonucleotide; TTG chr11 5193567 5193588 5193584 5193589 +
attctaggtatgtaatttttgt

SEQ ID NO: 78186 - DNA, 22 bp, Artificial Sequence
  Synthetic oligonucleotide; TTC chr11 5193571 5193592 5193588 5193593 +
taggtatgtaatttttgtgttg

SEQ ID NO: 78187 - DNA, 22 bp, Artificial Sequence
  Synthetic oligonucleotide; CTA chr11 5193573 5193594 5193590 5193595 +
ggtatgtaatttttgtgttggt

SEQ ID NO: 78188 - DNA, 22 bp, Artificial Sequence
  Synthetic oligonucleotide; TTT chr11 5193585 5193606 5193602 5193607 +
ttgtgttggtggacttaattgc

SEQ ID NO: 78189 - DNA, 22 bp, Artificial Sequence
  Synthetic oligonucleotide; TTT chr11 5193586 5193607 5193603 5193608 +
tgtgttggtggacttaattgca

SEQ ID NO: 78190 - DNA, 22 bp, Artificial Sequence
  Synthetic oligonucleotide; TTT chr11 5193587 5193608 5193604 5193609 +
gtgttggtggacttaattgcat

SEQ ID NO: 78191 - DNA, 22 bp, Artificial Sequence
  Synthetic oligonucleotide; TTG chr11 5193588 5193609 5193605 5193610 +
tgttggtggacttaattgcatt

SEQ ID NO: 78192 - DNA, 22 bp, Artificial Sequence
  Synthetic oligonucleotide; TTG chr11 5193593 5193614 5193610 5193615 +
gtggacttaattgcattcctga

SEQ ID NO: 78193 - DNA, 22 bp, Artificial Sequence
  Synthetic oligonucleotide; CTT chr11 5193601 5193622 5193618 5193623 +
aattgcattcctgataatcttt

SEQ ID NO: 78194 - DNA, 22 bp, Artificial Sequence
  Synthetic oligonucleotide; TTA chr11 5193602 5193623 5193619 5193624 +
attgcattcctgataatctttg

SEQ ID NO: 78195 - DNA, 22 bp, Artificial Sequence
  Synthetic oligonucleotide; TTG chr11 5193606 5193627 5193623 5193628 +
cattcctgataatctttgtcca

SEQ ID NO: 78196 - DNA, 22 bp, Artificial Sequence
  Synthetic oligonucleotide; TTC chr11 5193611 5193632 5193628 5193633 +
ctgataatctttgtccatcctt

SEQ ID NO: 78197 - DNA, 22 bp, Artificial Sequence
  Synthetic oligonucleotide; CTG chr11 5193614 5193635 5193631 5193636 +
ataatctttgtccatccttctg

SEQ ID NO: 78198 - DNA, 22 bp, Artificial Sequence
  Synthetic oligonucleotide; CTT chr11 5193622 5193643 5193639 5193644 +
tgtccatccttctgtgtccgga

SEQ ID NO: 78199 - DNA, 22 bp, Artificial Sequence
  Synthetic oligonucleotide; TTT chr11 5193623 5193644 5193640 5193645 +
gtccatccttctgtgtccggaa

SEQ ID NO: 78200 - DNA, 22 bp, Artificial Sequence
  Synthetic oligonucleotide; TTG chr11 5193624 5193645 5193641 5193646 +
tccatccttctgtgtccggaat

SEQ ID NO: 78201 - DNA, 22 bp, Artificial Sequence
  Synthetic oligonucleotide; CTT chr11 5193633 5193654 5193650 5193655 +
ctgtgtccggaattggtgggtt

SEQ ID NO: 78202 - DNA, 22 bp, Artificial Sequence
  Synthetic oligonucleotide; TTC chr11 5193634 5193655 5193651 5193656 +
tgtgtccggaattggtgggttc

SEQ ID NO: 78203 - DNA, 22 bp, Artificial Sequence
  Synthetic oligonucleotide; CTG chr11 5193636 5193657 5193653 5193658 +
tgtccggaattggtgggttctt

SEQ ID NO: 78204 - DNA, 22 bp, Artificial Sequence
  Synthetic oligonucleotide; TTG chr11 5193648 5193669 5193665 5193670 +
gtgggttcttggtctcgctgac

SEQ ID NO: 78205 - DNA, 22 bp, Artificial Sequence
  Synthetic oligonucleotide; TTC chr11 5193656 5193677 5193673 5193678 +
ttggtctcgctgacttaaagaa

SEQ ID NO: 78206 - DNA, 22 bp, Artificial Sequence
  Synthetic oligonucleotide; CTT chr11 5193658 5193679 5193675 5193680 +
ggtctcgctgacttaaagaatg

SEQ ID NO: 78207 - DNA, 22 bp, Artificial Sequence
  Synthetic oligonucleotide; TTG chr11 5193659 5193680 5193676 5193681 +
gtctcgctgacttaaagaatga

SEQ ID NO: 78208 - DNA, 22 bp, Artificial Sequence
  Synthetic oligonucleotide; CTC chr11 5193664 5193685 5193681 5193686 +
gctgacttaaagaatgaagccg

SEQ ID NO: 78209 - DNA, 22 bp, Artificial Sequence
  Synthetic oligonucleotide; CTG chr11 5193668 5193689 5193685 5193690 +
acttaaagaatgaagccgcgaa

SEQ ID NO: 78210 - DNA, 22 bp, Artificial Sequence
  Synthetic oligonucleotide; CTT chr11 5193672 5193693 5193689 5193694 +
aaagaatgaagccgcgaaccct

SEQ ID NO: 78211 - DNA, 22 bp, Artificial Sequence
  Synthetic oligonucleotide; TTA chr11 5193673 5193694 5193690 5193695 +
aagaatgaagccgcgaaccctc

SEQ ID NO: 78212 - DNA, 22 bp, Artificial Sequence
  Synthetic oligonucleotide; CTC chr11 5193695 5193716 5193712 5193717 +
gtggtgagtgttacaattctta

SEQ ID NO: 78213 - DNA, 22 bp, Artificial Sequence
  Synthetic oligonucleotide; TTA chr11 5193708 5193729 5193725 5193730 +
caattcttaaagatggtgtgtt

SEQ ID NO: 78214 - DNA, 22 bp, Artificial Sequence
  Synthetic oligonucleotide; TTC chr11 5193714 5193735 5193731 5193736 +
ttaaagatggtgtgttcaaagg

SEQ ID NO: 78215 - DNA, 22 bp, Artificial Sequence
  Synthetic oligonucleotide; CTT chr11 5193716 5193737 5193733 5193738 +
aaagatggtgtgttcaaaggat

SEQ ID NO: 78216 - DNA, 22 bp, Artificial Sequence
  Synthetic oligonucleotide; TTA chr11 5193717 5193738 5193734 5193739 +
aagatggtgtgttcaaaggatg

SEQ ID NO: 78217 - DNA, 22 bp, Artificial Sequence
  Synthetic oligonucleotide; TTC chr11 5193731 5193752 5193748 5193753 +
aaaggatggtgtgtccaaagtt

SEQ ID NO: 78218 - DNA, 22 bp, Artificial Sequence
  Synthetic oligonucleotide; TTT chr11 5193754 5193775 5193771 5193776 +
gttacttcagatgtgtccagag

SEQ ID NO: 78219 - DNA, 22 bp, Artificial Sequence
  Synthetic oligonucleotide; TTG chr11 5193755 5193776 5193772 5193777 +
ttacttcagatgtgtccagagt

SEQ ID NO: 78220 - DNA, 22 bp, Artificial Sequence
  Synthetic oligonucleotide; TTA chr11 5193758 5193779 5193775 5193780 +
cttcagatgtgtccagagtttc

SEQ ID NO: 78221 - DNA, 22 bp, Artificial Sequence
  Synthetic oligonucleotide; CTT chr11 5193761 5193782 5193778 5193783 +
cagatgtgtccagagtttcttc

SEQ ID NO: 78222 - DNA, 22 bp, Artificial Sequence
  Synthetic oligonucleotide; TTC chr11 5193762 5193783 5193779 5193784 +
agatgtgtccagagtttcttcc

SEQ ID NO: 78223 - DNA, 22 bp, Artificial Sequence
  Synthetic oligonucleotide; TTT chr11 5193779 5193800 5193796 5193801 +
cttccttctggtgtgttcacgg

SEQ ID NO: 78224 - DNA, 22 bp, Artificial Sequence
  Synthetic oligonucleotide; TTC chr11 5193780 5193801 5193797 5193802 +
ttccttctggtgtgttcacggt

SEQ ID NO: 78225 - DNA, 22 bp, Artificial Sequence
  Synthetic oligonucleotide; CTT chr11 5193782 5193803 5193799 5193804 +
ccttctggtgtgttcacggtct

SEQ ID NO: 78226 - DNA, 22 bp, Artificial Sequence
  Synthetic oligonucleotide; TTC chr11 5193783 5193804 5193800 5193805 +
cttctggtgtgttcacggtctt

SEQ ID NO: 78227 - DNA, 22 bp, Artificial Sequence
  Synthetic oligonucleotide; CTT chr11 5193786 5193807 5193803 5193808 +
ctggtgtgttcacggtcttgct

SEQ ID NO: 78228 - DNA, 22 bp, Artificial Sequence
  Synthetic oligonucleotide; TTC chr11 5193787 5193808 5193804 5193809 +
tggtgtgttcacggtcttgctg

SEQ ID NO: 78229 - DNA, 22 bp, Artificial Sequence
  Synthetic oligonucleotide; CTG chr11 5193789 5193810 5193806 5193811 +
gtgtgttcacggtcttgctggc

SEQ ID NO: 78230 - DNA, 22 bp, Artificial Sequence
  Synthetic oligonucleotide; TTC chr11 5193797 5193818 5193814 5193819 +
acggtcttgctggctccaggag

SEQ ID NO: 78231 - DNA, 22 bp, Artificial Sequence
  Synthetic oligonucleotide; CTT chr11 5193805 5193826 5193822 5193827 +
gctggctccaggagtgaagctg

SEQ ID NO: 78232 - DNA, 22 bp, Artificial Sequence
  Synthetic oligonucleotide; TTG chr11 5193806 5193827 5193823 5193828 +
ctggctccaggagtgaagctgc

SEQ ID NO: 78233 - DNA, 22 bp, Artificial Sequence
  Synthetic oligonucleotide; CTG chr11 5193809 5193830 5193826 5193831 +
gctccaggagtgaagctgcaga

SEQ ID NO: 78234 - DNA, 22 bp, Artificial Sequence
  Synthetic oligonucleotide; CTC chr11 5193813 5193834 5193830 5193835 +
caggagtgaagctgcagacccc

SEQ ID NO: 78235 - DNA, 22 bp, Artificial Sequence
  Synthetic oligonucleotide; CTG chr11 5193827 5193848 5193844 5193849 +
cagacccccacggggagtgtta

SEQ ID NO: 78236 - DNA, 22 bp, Artificial Sequence
  Synthetic oligonucleotide; TTA chr11 5193849 5193870 5193866 5193871 +
cagctcttaaaggcggagcgta

SEQ ID NO: 78237 - DNA, 22 bp, Artificial Sequence
  Synthetic oligonucleotide; CTC chr11 5193855 5193876 5193872 5193877 +
ttaaaggcggagcgtatggagt

SEQ ID NO: 78238 - DNA, 22 bp, Artificial Sequence
  Synthetic oligonucleotide; CTT chr11 5193857 5193878 5193874 5193879 +
aaaggcggagcgtatggagttg

SEQ ID NO: 78239 - DNA, 22 bp, Artificial Sequence
  Synthetic oligonucleotide; TTA chr11 5193858 5193879 5193875 5193880 +
aaggcggagcgtatggagttgc

SEQ ID NO: 78240 - DNA, 22 bp, Artificial Sequence
  Synthetic oligonucleotide; TTG chr11 5193879 5193900 5193896 5193901 +
ctcattcctcctgtcttgggtt

SEQ ID NO: 78241 - DNA, 22 bp, Artificial Sequence
  Synthetic oligonucleotide; CTC chr11 5193882 5193903 5193899 5193904 +
attcctcctgtcttgggttgtt

SEQ ID NO: 78242 - DNA, 22 bp, Artificial Sequence
  Synthetic oligonucleotide; TTC chr11 5193886 5193907 5193903 5193908 +
ctcctgtcttgggttgttcatc

SEQ ID NO: 78243 - DNA, 22 bp, Artificial Sequence
  Synthetic oligonucleotide; CTC chr11 5193889 5193910 5193906 5193911 +
ctgtcttgggttgttcatcccc

SEQ ID NO: 78244 - DNA, 22 bp, Artificial Sequence
  Synthetic oligonucleotide; CTG chr11 5193892 5193913 5193909 5193914 +
tcttgggttgttcatcccccat

SEQ ID NO: 78245 - DNA, 22 bp, Artificial Sequence
  Synthetic oligonucleotide; CTT chr11 5193896 5193917 5193913 5193918 +
gggttgttcatcccccatgctg

SEQ ID NO: 78246 - DNA, 22 bp, Artificial Sequence
  Synthetic oligonucleotide; TTG chr11 5193897 5193918 5193914 5193919 +
ggttgttcatcccccatgctgg

SEQ ID NO: 78247 - DNA, 22 bp, Artificial Sequence
  Synthetic oligonucleotide; TTG chr11 5193902 5193923 5193919 5193924 +
ttcatcccccatgctgggttcg

SEQ ID NO: 78248 - DNA, 22 bp, Artificial Sequence
  Synthetic oligonucleotide; TTC chr11 5193905 5193926 5193922 5193927 +
atcccccatgctgggttcgtgg

SEQ ID NO: 78249 - DNA, 22 bp, Artificial Sequence
  Synthetic oligonucleotide; CTG chr11 5193918 5193939 5193935 5193940 +
ggttcgtggtcttgctggcttc

SEQ ID NO: 78250 - DNA, 22 bp, Artificial Sequence
  Synthetic oligonucleotide; TTC chr11 5193923 5193944 5193940 5193945 +
gtggtcttgctggcttcagaag

SEQ ID NO: 78251 - DNA, 22 bp, Artificial Sequence
  Synthetic oligonucleotide; CTT chr11 5193931 5193952 5193948 5193953 +
gctggcttcagaagtgaagccg

SEQ ID NO: 78252 - DNA, 22 bp, Artificial Sequence
  Synthetic oligonucleotide; TTG chr11 5193932 5193953 5193949 5193954 +
ctggcttcagaagtgaagccgc

SEQ ID NO: 78253 - DNA, 22 bp, Artificial Sequence
  Synthetic oligonucleotide; CTG chr11 5193935 5193956 5193952 5193957 +
gcttcagaagtgaagccgcaga

SEQ ID NO: 78254 - DNA, 22 bp, Artificial Sequence
  Synthetic oligonucleotide; CTT chr11 5193939 5193960 5193956 5193961 +
cagaagtgaagccgcagacctt

SEQ ID NO: 78255 - DNA, 22 bp, Artificial Sequence
  Synthetic oligonucleotide; TTC chr11 5193940 5193961 5193957 5193962 +
agaagtgaagccgcagaccttc

SEQ ID NO: 78256 - DNA, 22 bp, Artificial Sequence
  Synthetic oligonucleotide; CTT chr11 5193961 5193982 5193978 5193983 +
cgcagtgagtgttacagctcat

SEQ ID NO: 78257 - DNA, 22 bp, Artificial Sequence
  Synthetic oligonucleotide; TTC chr11 5193962 5193983 5193979 5193984 +
gcagtgagtgttacagctcata

SEQ ID NO: 78258 - DNA, 22 bp, Artificial Sequence
  Synthetic oligonucleotide; TTA chr11 5193975 5193996 5193992 5193997 +
cagctcataaaggcagcgcgga

SEQ ID NO: 78259 - DNA, 22 bp, Artificial Sequence
  Synthetic oligonucleotide; CTC chr11 5193981 5194002 5193998 5194003 +
ataaaggcagcgcggatccaaa

SEQ ID NO: 78260 - DNA, 22 bp, Artificial Sequence
  Synthetic oligonucleotide; TTT chr11 5194024 5194045 5194041 5194046 +
attgtgaagaataaaagaacaa

SEQ ID NO: 78261 - DNA, 22 bp, Artificial Sequence
  Synthetic oligonucleotide; TTA chr11 5194025 5194046 5194042 5194047 +
ttgtgaagaataaaagaacaaa

SEQ ID NO: 78262 - DNA, 22 bp, Artificial Sequence
  Synthetic oligonucleotide; TTG chr11 5194028 5194049 5194045 5194050 +
tgaagaataaaagaacaaagct

SEQ ID NO: 78263 - DNA, 22 bp, Artificial Sequence
  Synthetic oligonucleotide; CTT chr11 5194051 5194072 5194068 5194073 +
ccacagcatggtagggaaccca

SEQ ID NO: 78264 - DNA, 22 bp, Artificial Sequence
  Synthetic oligonucleotide; TTC chr11 5194052 5194073 5194069 5194074 +
cacagcatggtagggaacccaa

SEQ ID NO: 78265 - DNA, 22 bp, Artificial Sequence
  Synthetic oligonucleotide; TTG chr11 5194082 5194103 5194099 5194104 +
tcacagctggctccggcagcct

SEQ ID NO: 78266 - DNA, 22 bp, Artificial Sequence
  Synthetic oligonucleotide; CTG chr11 5194091 5194112 5194108 5194113 +
gctccggcagcctgcctttatt

SEQ ID NO: 78267 - DNA, 22 bp, Artificial Sequence
  Synthetic oligonucleotide; CTC chr11 5194095 5194116 5194112 5194117 +
cggcagcctgcctttatttcct

SEQ ID NO: 78268 - DNA, 22 bp, Artificial Sequence
  Synthetic oligonucleotide; CTG chr11 5194105 5194126 5194122 5194127 +
cctttatttccttatctgaccc

SEQ ID NO: 78269 - DNA, 22 bp, Artificial Sequence
  Synthetic oligonucleotide; CTT chr11 5194109 5194130 5194126 5194131 +
tatttccttatctgaccccacc

SEQ ID NO: 78270 - DNA, 22 bp, Artificial Sequence
  Synthetic oligonucleotide; TTT chr11 5194110 5194131 5194127 5194132 +
atttccttatctgaccccaccc

SEQ ID NO: 78271 - DNA, 22 bp, Artificial Sequence
  Synthetic oligonucleotide; TTA chr11 5194111 5194132 5194128 5194133 +
tttccttatctgaccccaccca

SEQ ID NO: 78272 - DNA, 22 bp, Artificial Sequence
  Synthetic oligonucleotide; TTT chr11 5194114 5194135 5194131 5194136 +
ccttatctgaccccacccacat

SEQ ID NO: 78273 - DNA, 22 bp, Artificial Sequence
  Synthetic oligonucleotide; TTC chr11 5194115 5194136 5194132 5194137 +
cttatctgaccccacccacatc

SEQ ID NO: 78274 - DNA, 22 bp, Artificial Sequence
  Synthetic oligonucleotide; CTT chr11 5194118 5194139 5194135 5194140 +
atctgaccccacccacatcctg

SEQ ID NO: 78275 - DNA, 22 bp, Artificial Sequence
  Synthetic oligonucleotide; TTA chr11 5194119 5194140 5194136 5194141 +
tctgaccccacccacatcctgc

SEQ ID NO: 78276 - DNA, 22 bp, Artificial Sequence
  Synthetic oligonucleotide; CTG chr11 5194123 5194144 5194140 5194145 +
accccacccacatcctgctgat

SEQ ID NO: 78277 - DNA, 22 bp, Artificial Sequence
  Synthetic oligonucleotide; CTG chr11 5194140 5194161 5194157 5194162 +
ctgattggtccattttacagag

SEQ ID NO: 78278 - DNA, 22 bp, Artificial Sequence
  Synthetic oligonucleotide; CTG chr11 5194143 5194164 5194160 5194165 +
attggtccattttacagagagc

SEQ ID NO: 78279 - DNA, 22 bp, Artificial Sequence
  Synthetic oligonucleotide; TTG chr11 5194147 5194168 5194164 5194169 +
gtccattttacagagagctgat

SEQ ID NO: 78280 - DNA, 22 bp, Artificial Sequence
  Synthetic oligonucleotide; TTT chr11 5194155 5194176 5194172 5194177 +
tacagagagctgattggcccat

SEQ ID NO: 78281 - DNA, 22 bp, Artificial Sequence
  Synthetic oligonucleotide; TTT chr11 5194156 5194177 5194173 5194178 +
acagagagctgattggcccatt

SEQ ID NO: 78282 - DNA, 22 bp, Artificial Sequence
  Synthetic oligonucleotide; TTA chr11 5194157 5194178 5194174 5194179 +
cagagagctgattggcccattt

SEQ ID NO: 78283 - DNA, 22 bp, Artificial Sequence
  Synthetic oligonucleotide; CTG chr11 5194167 5194188 5194184 5194189 +
attggcccattttacagagagc

SEQ ID NO: 78284 - DNA, 22 bp, Artificial Sequence
  Synthetic oligonucleotide; TTG chr11 5194171 5194192 5194188 5194193 +
gcccattttacagagagctggt

SEQ ID NO: 78285 - DNA, 22 bp, Artificial Sequence
  Synthetic oligonucleotide; TTT chr11 5194179 5194200 5194196 5194201 +
tacagagagctggttggtccgt

SEQ ID NO: 78286 - DNA, 22 bp, Artificial Sequence
  Synthetic oligonucleotide; TTT chr11 5194180 5194201 5194197 5194202 +
acagagagctggttggtccgtt

SEQ ID NO: 78287 - DNA, 22 bp, Artificial Sequence
  Synthetic oligonucleotide; TTA chr11 5194181 5194202 5194198 5194203 +
cagagagctggttggtccgttt

SEQ ID NO: 78288 - DNA, 22 bp, Artificial Sequence
  Synthetic oligonucleotide; CTG chr11 5194191 5194212 5194208 5194213 +
gttggtccgttttggcagagtg

SEQ ID NO: 78289 - DNA, 22 bp, Artificial Sequence
  Synthetic oligonucleotide; TTG chr11 5194195 5194216 5194212 5194217 +
gtccgttttggcagagtgctga

SEQ ID NO: 78290 - DNA, 22 bp, Artificial Sequence
  Synthetic oligonucleotide; TTT chr11 5194203 5194224 5194220 5194225 +
tggcagagtgctgattggtgca

SEQ ID NO: 78291 - DNA, 22 bp, Artificial Sequence
  Synthetic oligonucleotide; TTT chr11 5194204 5194225 5194221 5194226 +
ggcagagtgctgattggtgcat

SEQ ID NO: 78292 - DNA, 22 bp, Artificial Sequence
  Synthetic oligonucleotide; TTG chr11 5194205 5194226 5194222 5194227 +
gcagagtgctgattggtgcatt

SEQ ID NO: 78293 - DNA, 22 bp, Artificial Sequence
  Synthetic oligonucleotide; CTG chr11 5194216 5194237 5194233 5194238 +
attggtgcatttacaaaccttg

SEQ ID NO: 78294 - DNA, 22 bp, Artificial Sequence
  Synthetic oligonucleotide; TTG chr11 5194220 5194241 5194237 5194242 +
gtgcatttacaaaccttgagct

SEQ ID NO: 78295 - DNA, 22 bp, Artificial Sequence
  Synthetic oligonucleotide; TTT chr11 5194228 5194249 5194245 5194250 +
acaaaccttgagctagacacag

SEQ ID NO: 78296 - DNA, 22 bp, Artificial Sequence
  Synthetic oligonucleotide; TTA chr11 5194229 5194250 5194246 5194251 +
caaaccttgagctagacacaga

SEQ ID NO: 78297 - DNA, 22 bp, Artificial Sequence
  Synthetic oligonucleotide; CTT chr11 5194237 5194258 5194254 5194259 +
gagctagacacagagtgctgat

SEQ ID NO: 78298 - DNA, 22 bp, Artificial Sequence
  Synthetic oligonucleotide; TTG chr11 5194238 5194259 5194255 5194260 +
agctagacacagagtgctgatt

SEQ ID NO: 78299 - DNA, 22 bp, Artificial Sequence
  Synthetic oligonucleotide; CTA chr11 5194243 5194264 5194260 5194265 +
gacacagagtgctgattagtgc

SEQ ID NO: 78300 - DNA, 22 bp, Artificial Sequence
  Synthetic oligonucleotide; CTG chr11 5194257 5194278 5194274 5194279 +
attagtgcatttacaatccttt

SEQ ID NO: 78301 - DNA, 22 bp, Artificial Sequence
  Synthetic oligonucleotide; TTA chr11 5194261 5194282 5194278 5194283 +
gtgcatttacaatcctttagct

SEQ ID NO: 78302 - DNA, 22 bp, Artificial Sequence
  Synthetic oligonucleotide; TTT chr11 5194269 5194290 5194286 5194291 +
acaatcctttagctagacacaa

SEQ ID NO: 78303 - DNA, 22 bp, Artificial Sequence
  Synthetic oligonucleotide; TTA chr11 5194270 5194291 5194287 5194292 +
caatcctttagctagacacaaa

SEQ ID NO: 78304 - DNA, 22 bp, Artificial Sequence
  Synthetic oligonucleotide; CTT chr11 5194278 5194299 5194295 5194300 +
tagctagacacaaaagttctcc

SEQ ID NO: 78305 - DNA, 22 bp, Artificial Sequence
  Synthetic oligonucleotide; TTT chr11 5194279 5194300 5194296 5194301 +
agctagacacaaaagttctcca

SEQ ID NO: 78306 - DNA, 22 bp, Artificial Sequence
  Synthetic oligonucleotide; TTA chr11 5194280 5194301 5194297 5194302 +
gctagacacaaaagttctccaa

SEQ ID NO: 78307 - DNA, 22 bp, Artificial Sequence
  Synthetic oligonucleotide; CTA chr11 5194284 5194305 5194301 5194306 +
gacacaaaagttctccaagtcc

SEQ ID NO: 78308 - DNA, 22 bp, Artificial Sequence
  Synthetic oligonucleotide; TTC chr11 5194297 5194318 5194314 5194319 +
tccaagtccccactagattagc

SEQ ID NO: 78309 - DNA, 22 bp, Artificial Sequence
  Synthetic oligonucleotide; CTC chr11 5194299 5194320 5194316 5194321 +
caagtccccactagattagcta

SEQ ID NO: 78310 - DNA, 22 bp, Artificial Sequence
  Synthetic oligonucleotide; CTA chr11 5194312 5194333 5194329 5194334 +
gattagctagacacagagcact

SEQ ID NO: 78311 - DNA, 22 bp, Artificial Sequence
  Synthetic oligonucleotide; TTA chr11 5194317 5194338 5194334 5194339 +
gctagacacagagcactgattg

SEQ ID NO: 78312 - DNA, 22 bp, Artificial Sequence
  Synthetic oligonucleotide; CTA chr11 5194321 5194342 5194338 5194343 +
gacacagagcactgattggtgc

SEQ ID NO: 78313 - DNA, 22 bp, Artificial Sequence
  Synthetic oligonucleotide; CTG chr11 5194335 5194356 5194352 5194357 +
attggtgcatttacaaaccttg

SEQ ID NO: 78314 - DNA, 22 bp, Artificial Sequence
  Synthetic oligonucleotide; TTG chr11 5194339 5194360 5194356 5194361 +
gtgcatttacaaaccttgagtt

SEQ ID NO: 78315 - DNA, 22 bp, Artificial Sequence
  Synthetic oligonucleotide; TTT chr11 5194347 5194368 5194364 5194369 +
acaaaccttgagttagacacag

SEQ ID NO: 78316 - DNA, 22 bp, Artificial Sequence
  Synthetic oligonucleotide; TTA chr11 5194348 5194369 5194365 5194370 +
caaaccttgagttagacacaga

SEQ ID NO: 78317 - DNA, 22 bp, Artificial Sequence
  Synthetic oligonucleotide; CTT chr11 5194356 5194377 5194373 5194378 +
gagttagacacagattgctgat

SEQ ID NO: 78318 - DNA, 22 bp, Artificial Sequence
  Synthetic oligonucleotide; TTG chr11 5194357 5194378 5194374 5194379 +
agttagacacagattgctgatt

SEQ ID NO: 78319 - DNA, 22 bp, Artificial Sequence
  Synthetic oligonucleotide; TTA chr11 5194362 5194383 5194379 5194384 +
gacacagattgctgattggtgc

SEQ ID NO: 78320 - DNA, 22 bp, Artificial Sequence
  Synthetic oligonucleotide; TTG chr11 5194373 5194394 5194390 5194395 +
ctgattggtgcatttacaaacc

SEQ ID NO: 78321 - DNA, 22 bp, Artificial Sequence
  Synthetic oligonucleotide; CTG chr11 5194376 5194397 5194393 5194398 +
attggtgcatttacaaaccttt

SEQ ID NO: 78322 - DNA, 22 bp, Artificial Sequence
  Synthetic oligonucleotide; TTG chr11 5194380 5194401 5194397 5194402 +
gtgcatttacaaacctttagct

SEQ ID NO: 78323 - DNA, 22 bp, Artificial Sequence
  Synthetic oligonucleotide; TTT chr11 5194388 5194409 5194405 5194410 +
acaaacctttagctagacatga

SEQ ID NO: 78324 - DNA, 22 bp, Artificial Sequence
  Synthetic oligonucleotide; TTA chr11 5194389 5194410 5194406 5194411 +
caaacctttagctagacatgaa

SEQ ID NO: 78325 - DNA, 22 bp, Artificial Sequence
  Synthetic oligonucleotide; CTT chr11 5194397 5194418 5194414 5194419 +
tagctagacatgaaagttctcc

SEQ ID NO: 78326 - DNA, 22 bp, Artificial Sequence
  Synthetic oligonucleotide; TTT chr11 5194398 5194419 5194415 5194420 +
agctagacatgaaagttctcca

SEQ ID NO: 78327 - DNA, 22 bp, Artificial Sequence
  Synthetic oligonucleotide; TTA chr11 5194399 5194420 5194416 5194421 +
gctagacatgaaagttctccag

SEQ ID NO: 78328 - DNA, 22 bp, Artificial Sequence
  Synthetic oligonucleotide; CTA chr11 5194403 5194424 5194420 5194425 +
gacatgaaagttctccagttcc

SEQ ID NO: 78329 - DNA, 22 bp, Artificial Sequence
  Synthetic oligonucleotide; TTC chr11 5194416 5194437 5194433 5194438 +
tccagttccatatttcatggtg

SEQ ID NO: 78330 - DNA, 22 bp, Artificial Sequence
  Synthetic oligonucleotide; CTC chr11 5194418 5194439 5194435 5194440 +
cagttccatatttcatggtgag

SEQ ID NO: 78331 - DNA, 22 bp, Artificial Sequence
  Synthetic oligonucleotide; TTC chr11 5194424 5194445 5194441 5194446 +
catatttcatggtgaggaacaa

SEQ ID NO: 78332 - DNA, 22 bp, Artificial Sequence
  Synthetic oligonucleotide; TTT chr11 5194431 5194452 5194448 5194453 +
catggtgaggaacaaagaatat

SEQ ID NO: 78333 - DNA, 22 bp, Artificial Sequence
  Synthetic oligonucleotide; TTC chr11 5194432 5194453 5194449 5194454 +
atggtgaggaacaaagaatata

SEQ ID NO: 78334 - DNA, 22 bp, Artificial Sequence
  Synthetic oligonucleotide; TTC chr11 5194475 5194496 5194492 5194497 +
tttgttcctcaccatgaaatat

SEQ ID NO: 78335 - DNA, 22 bp, Artificial Sequence
  Synthetic oligonucleotide; CTT chr11 5194477 5194498 5194494 5194499 +
tgttcctcaccatgaaatatgg

SEQ ID NO: 78336 - DNA, 22 bp, Artificial Sequence
  Synthetic oligonucleotide; TTT chr11 5194478 5194499 5194495 5194500 +
gttcctcaccatgaaatatgga

SEQ ID NO: 78337 - DNA, 22 bp, Artificial Sequence
  Synthetic oligonucleotide; TTG chr11 5194479 5194500 5194496 5194501 +
ttcctcaccatgaaatatggaa

SEQ ID NO: 78338 - DNA, 22 bp, Artificial Sequence
  Synthetic oligonucleotide; TTC chr11 5194482 5194503 5194499 5194504 +
ctcaccatgaaatatggaactg

SEQ ID NO: 78339 - DNA, 22 bp, Artificial Sequence
  Synthetic oligonucleotide; CTC chr11 5194485 5194506 5194502 5194507 +
accatgaaatatggaactggag

SEQ ID NO: 78340 - DNA, 22 bp, Artificial Sequence
  Synthetic oligonucleotide; CTG chr11 5194504 5194525 5194521 5194526 +
gagaactttcatgtctagctaa

SEQ ID NO: 78341 - DNA, 22 bp, Artificial Sequence
  Synthetic oligonucleotide; CTT chr11 5194512 5194533 5194529 5194534 +
tcatgtctagctaaaggtttgt

SEQ ID NO: 78342 - DNA, 22 bp, Artificial Sequence
  Synthetic oligonucleotide; TTT chr11 5194513 5194534 5194530 5194535 +
catgtctagctaaaggtttgta

SEQ ID NO: 78343 - DNA, 22 bp, Artificial Sequence
  Synthetic oligonucleotide; TTC chr11 5194514 5194535 5194531 5194536 +
atgtctagctaaaggtttgtaa

SEQ ID NO: 78344 - DNA, 22 bp, Artificial Sequence
  Synthetic oligonucleotide; CTA chr11 5194521 5194542 5194538 5194543 +
gctaaaggtttgtaaatgcaat

SEQ ID NO: 78345 - DNA, 22 bp, Artificial Sequence
  Synthetic oligonucleotide; CTA chr11 5194525 5194546 5194542 5194547 +
aaggtttgtaaatgcaatttat

SEQ ID NO: 78346 - DNA, 22 bp, Artificial Sequence
  Synthetic oligonucleotide; TTT chr11 5194532 5194553 5194549 5194554 +
gtaaatgcaatttattgcggca

SEQ ID NO: 78347 - DNA, 22 bp, Artificial Sequence
  Synthetic oligonucleotide; TTG chr11 5194533 5194554 5194550 5194555 +
taaatgcaatttattgcggcac

SEQ ID NO: 78348 - DNA, 22 bp, Artificial Sequence
  Synthetic oligonucleotide; TTT chr11 5194545 5194566 5194562 5194567 +
attgcggcactattcacaatag

SEQ ID NO: 78349 - DNA, 22 bp, Artificial Sequence
  Synthetic oligonucleotide; TTA chr11 5194546 5194567 5194563 5194568 +
ttgcggcactattcacaatagc

SEQ ID NO: 78350 - DNA, 22 bp, Artificial Sequence
  Synthetic oligonucleotide; TTG chr11 5194549 5194570 5194566 5194571 +
cggcactattcacaatagcaaa

SEQ ID NO: 78351 - DNA, 22 bp, Artificial Sequence
  Synthetic oligonucleotide; CTA chr11 5194557 5194578 5194574 5194579 +
ttcacaatagcaaagacttgga

SEQ ID NO: 78352 - DNA, 22 bp, Artificial Sequence
  Synthetic oligonucleotide; TTC chr11 5194560 5194581 5194577 5194582 +
acaatagcaaagacttggaacc

SEQ ID NO: 78353 - DNA, 22 bp, Artificial Sequence
  Synthetic oligonucleotide; CTT chr11 5194576 5194597 5194593 5194598 +
ggaaccaacccaaatgtccaac

SEQ ID NO: 78354 - DNA, 22 bp, Artificial Sequence
  Synthetic oligonucleotide; TTG chr11 5194577 5194598 5194594 5194599 +
gaaccaacccaaatgtccaaca

SEQ ID NO: 78355 - DNA, 22 bp, Artificial Sequence
  Synthetic oligonucleotide; CTG chr11 5194610 5194631 5194627 5194632 +
gattaagaaaatgtggcacata

SEQ ID NO: 78356 - DNA, 22 bp, Artificial Sequence
  Synthetic oligonucleotide; TTA chr11 5194615 5194636 5194632 5194637 +
agaaaatgtggcacatacacac

SEQ ID NO: 78357 - DNA, 22 bp, Artificial Sequence
  Synthetic oligonucleotide; CTA chr11 5194649 5194670 5194666 5194671 +
tgcagccataaaaaaggatgag

SEQ ID NO: 78358 - DNA, 22 bp, Artificial Sequence
  Synthetic oligonucleotide; TTC chr11 5194674 5194695 5194691 5194696 +
atgtcctttgtagggacatgga

SEQ ID NO: 78359 - DNA, 22 bp, Artificial Sequence
  Synthetic oligonucleotide; CTT chr11 5194682 5194703 5194699 5194704 +
tgtagggacatggatgaaattg

SEQ ID NO: 78360 - DNA, 22 bp, Artificial Sequence
  Synthetic oligonucleotide; TTT chr11 5194683 5194704 5194700 5194705 +
gtagggacatggatgaaattgg

SEQ ID NO: 78361 - DNA, 22 bp, Artificial Sequence
  Synthetic oligonucleotide; TTG chr11 5194684 5194705 5194701 5194706 +
tagggacatggatgaaattgga

SEQ ID NO: 78362 - DNA, 22 bp, Artificial Sequence
  Synthetic oligonucleotide; TTG chr11 5194704 5194725 5194721 5194726 +
gaaatcatcattctcagtaaac

SEQ ID NO: 78363 - DNA, 22 bp, Artificial Sequence
  Synthetic oligonucleotide; TTC chr11 5194717 5194738 5194734 5194739 +
tcagtaaactatcgcaaggacg

SEQ ID NO: 78364 - DNA, 22 bp, Artificial Sequence
  Synthetic oligonucleotide; CTC chr11 5194719 5194740 5194736 5194741 +
agtaaactatcgcaaggacgaa

SEQ ID NO: 78365 - DNA, 22 bp, Artificial Sequence
  Synthetic oligonucleotide; CTA chr11 5194728 5194749 5194745 5194750 +
tcgcaaggacgaaaaaccaaac

SEQ ID NO: 78366 - DNA, 22 bp, Artificial Sequence
  Synthetic oligonucleotide; CTG chr11 5194754 5194775 5194771 5194776 +
catgttctcactcataggtggg

SEQ ID NO: 78367 - DNA, 22 bp, Artificial Sequence
  Synthetic oligonucleotide; TTC chr11 5194761 5194782 5194778 5194783 +
tcactcataggtgggaattgaa

SEQ ID NO: 78368 - DNA, 22 bp, Artificial Sequence
  Synthetic oligonucleotide; CTC chr11 5194763 5194784 5194780 5194785 +
actcataggtgggaattgaaca

SEQ ID NO: 78369 - DNA, 22 bp, Artificial Sequence
  Synthetic oligonucleotide; CTC chr11 5194767 5194788 5194784 5194789 +
ataggtgggaattgaacaatga

SEQ ID NO: 78370 - DNA, 22 bp, Artificial Sequence
  Synthetic oligonucleotide; TTG chr11 5194781 5194802 5194798 5194803 +
aacaatgagaacacatggacac

SEQ ID NO: 78371 - DNA, 22 bp, Artificial Sequence
  Synthetic oligonucleotide; CTC chr11 5194824 5194845 5194841 5194846 +
tggggactgttgtggggtgggg

SEQ ID NO: 78372 - DNA, 22 bp, Artificial Sequence
  Synthetic oligonucleotide; CTG chr11 5194826 5194847 5194843 5194848 +
gggactgttgtggggtgggggg

SEQ ID NO: 78373 - DNA, 22 bp, Artificial Sequence
  Synthetic oligonucleotide; CTG chr11 5194833 5194854 5194850 5194855 +
ttgtggggtggggggagggagg

SEQ ID NO: 78374 - DNA, 22 bp, Artificial Sequence
  Synthetic oligonucleotide; TTG chr11 5194836 5194857 5194853 5194858 +
tggggtggggggagggaggagg

SEQ ID NO: 78375 - DNA, 22 bp, Artificial Sequence
  Synthetic oligonucleotide; TTA chr11 5194868 5194889 5194885 5194890 +
ggagatatacctaatgctaaat

SEQ ID NO: 78376 - DNA, 22 bp, Artificial Sequence
  Synthetic oligonucleotide; CTA chr11 5194881 5194902 5194898 5194903 +
atgctaaatgatgagttaatgg

SEQ ID NO: 78377 - DNA, 22 bp, Artificial Sequence
  Synthetic oligonucleotide; CTA chr11 5194887 5194908 5194904 5194909 +
aatgatgagttaatgggtgaag

SEQ ID NO: 78378 - DNA, 22 bp, Artificial Sequence
  Synthetic oligonucleotide; TTA chr11 5194899 5194920 5194916 5194921 +
atgggtgaagcacaccagcatg

SEQ ID NO: 78379 - DNA, 22 bp, Artificial Sequence
  Synthetic oligonucleotide; CTA chr11 5194944 5194965 5194961 5194966 +
acctgcacattgtgcacatgta

SEQ ID NO: 78380 - DNA, 22 bp, Artificial Sequence
  Synthetic oligonucleotide; CTG chr11 5194949 5194970 5194966 5194971 +
cacattgtgcacatgtacccta

SEQ ID NO: 78381 - DNA, 22 bp, Artificial Sequence
  Synthetic oligonucleotide; TTG chr11 5194956 5194977 5194973 5194978 +
tgcacatgtaccctaaaactta

SEQ ID NO: 78382 - DNA, 22 bp, Artificial Sequence
  Synthetic oligonucleotide; CTA chr11 5194971 5194992 5194988 5194993 +
aaacttaaagtataataataat

SEQ ID NO: 78383 - DNA, 22 bp, Artificial Sequence
  Synthetic oligonucleotide; CTT chr11 5194977 5194998 5194994 5194999 +
aaagtataataataataaaata

SEQ ID NO: 78384 - DNA, 22 bp, Artificial Sequence
  Synthetic oligonucleotide; TTA chr11 5194978 5194999 5194995 5195000 +
aagtataataataataaaataa

SEQ ID NO: 78385 - DNA, 22 bp, Artificial Sequence
  Synthetic oligonucleotide; TTT chr11 5195008 5195029 5195025 5195030 +
taaaaagagtatagtggggatt

SEQ ID NO: 78386 - DNA, 22 bp, Artificial Sequence
  Synthetic oligonucleotide; TTT chr11 5195009 5195030 5195026 5195031 +
aaaaagagtatagtggggattt

SEQ ID NO: 78387 - DNA, 22 bp, Artificial Sequence
  Synthetic oligonucleotide; TTA chr11 5195010 5195031 5195027 5195032 +
aaaagagtatagtggggatttc

SEQ ID NO: 78388 - DNA, 22 bp, Artificial Sequence
  Synthetic oligonucleotide; TTT chr11 5195031 5195052 5195048 5195053 +
ctatgaacacggtacaattagt

SEQ ID NO: 78389 - DNA, 22 bp, Artificial Sequence
  Synthetic oligonucleotide; TTC chr11 5195032 5195053 5195049 5195054 +
tatgaacacggtacaattagtt

SEQ ID NO: 78390 - DNA, 22 bp, Artificial Sequence
  Synthetic oligonucleotide; CTA chr11 5195034 5195055 5195051 5195056 +
tgaacacggtacaattagttat

SEQ ID NO: 78391 - DNA, 22 bp, Artificial Sequence
  Synthetic oligonucleotide; TTA chr11 5195051 5195072 5195068 5195073 +
gttatctggccagttactttga

SEQ ID NO: 78392 - DNA, 22 bp, Artificial Sequence
  Synthetic oligonucleotide; TTA chr11 5195055 5195076 5195072 5195077 +
tctggccagttactttgaaggc

SEQ ID NO: 78393 - DNA, 22 bp, Artificial Sequence
  Synthetic oligonucleotide; CTG chr11 5195059 5195080 5195076 5195081 +
gccagttactttgaaggctgat

SEQ ID NO: 78394 - DNA, 22 bp, Artificial Sequence
  Synthetic oligonucleotide; TTA chr11 5195067 5195088 5195084 5195089 +
ctttgaaggctgatcagaaaga

SEQ ID NO: 78395 - DNA, 22 bp, Artificial Sequence
  Synthetic oligonucleotide; CTT chr11 5195070 5195091 5195087 5195092 +
tgaaggctgatcagaaagaagc

SEQ ID NO: 78396 - DNA, 22 bp, Artificial Sequence
  Synthetic oligonucleotide; TTT chr11 5195071 5195092 5195088 5195093 +
gaaggctgatcagaaagaagcc

SEQ ID NO: 78397 - DNA, 22 bp, Artificial Sequence
  Synthetic oligonucleotide; TTG chr11 5195072 5195093 5195089 5195094 +
aaggctgatcagaaagaagcct

SEQ ID NO: 78398 - DNA, 22 bp, Artificial Sequence
  Synthetic oligonucleotide; CTG chr11 5195079 5195100 5195096 5195101 +
atcagaaagaagcctagctaat

SEQ ID NO: 78399 - DNA, 22 bp, Artificial Sequence
  Synthetic oligonucleotide; CTA chr11 5195095 5195116 5195112 5195117 +
gctaatccagtaagcgaatact

SEQ ID NO: 78400 - DNA, 22 bp, Artificial Sequence
  Synthetic oligonucleotide; CTA chr11 5195099 5195120 5195116 5195121 +
atccagtaagcgaatactcaaa

SEQ ID NO: 78401 - DNA, 22 bp, Artificial Sequence
  Synthetic oligonucleotide; CTC chr11 5195118 5195139 5195135 5195140 +
aaatgccaatatctattagtcc

SEQ ID NO: 78402 - DNA, 22 bp, Artificial Sequence
  Synthetic oligonucleotide; CTA chr11 5195133 5195154 5195150 5195155 +
ttagtcctttctcttgagacag

SEQ ID NO: 78403 - DNA, 22 bp, Artificial Sequence
  Synthetic oligonucleotide; TTA chr11 5195136 5195157 5195153 5195158 +
gtcctttctcttgagacagttt

SEQ ID NO: 78404 - DNA, 22 bp, Artificial Sequence
  Synthetic oligonucleotide; CTT chr11 5195142 5195163 5195159 5195164 +
tctcttgagacagtttatcatc

SEQ ID NO: 78405 - DNA, 22 bp, Artificial Sequence
  Synthetic oligonucleotide; TTT chr11 5195143 5195164 5195160 5195165 +
ctcttgagacagtttatcatca

SEQ ID NO: 78406 - DNA, 22 bp, Artificial Sequence
  Synthetic oligonucleotide; TTC chr11 5195144 5195165 5195161 5195166 +
tcttgagacagtttatcatcat

SEQ ID NO: 78407 - DNA, 22 bp, Artificial Sequence
  Synthetic oligonucleotide; CTC chr11 5195146 5195167 5195163 5195168 +
ttgagacagtttatcatcattc

SEQ ID NO: 78408 - DNA, 22 bp, Artificial Sequence
  Synthetic oligonucleotide; CTT chr11 5195148 5195169 5195165 5195170 +
gagacagtttatcatcattcaa

SEQ ID NO: 78409 - DNA, 22 bp, Artificial Sequence
  Synthetic oligonucleotide; TTG chr11 5195149 5195170 5195166 5195171 +
agacagtttatcatcattcaat

SEQ ID NO: 78410 - DNA, 22 bp, Artificial Sequence
  Synthetic oligonucleotide; TTT chr11 5195158 5195179 5195175 5195180 +
atcatcattcaatatgtattct

SEQ ID NO: 78411 - DNA, 22 bp, Artificial Sequence
  Synthetic oligonucleotide; TTA chr11 5195159 5195180 5195176 5195181 +
tcatcattcaatatgtattctt

SEQ ID NO: 78412 - DNA, 22 bp, Artificial Sequence
  Synthetic oligonucleotide; TTC chr11 5195168 5195189 5195185 5195190 +
aatatgtattcttttgcataat

SEQ ID NO: 78413 - DNA, 22 bp, Artificial Sequence
  Synthetic oligonucleotide; TTC chr11 5195179 5195200 5195196 5195201 +
ttttgcataatctctctgtttc

SEQ ID NO: 78414 - DNA, 22 bp, Artificial Sequence
  Synthetic oligonucleotide; CTT chr11 5195181 5195202 5195198 5195203 +
ttgcataatctctctgtttcat

SEQ ID NO: 78415 - DNA, 22 bp, Artificial Sequence
  Synthetic oligonucleotide; TTT chr11 5195182 5195203 5195199 5195204 +
tgcataatctctctgtttcata

SEQ ID NO: 78416 - DNA, 22 bp, Artificial Sequence
  Synthetic oligonucleotide; TTT chr11 5195183 5195204 5195200 5195205 +
gcataatctctctgtttcatat

SEQ ID NO: 78417 - DNA, 22 bp, Artificial Sequence
  Synthetic oligonucleotide; TTG chr11 5195184 5195205 5195201 5195206 +
cataatctctctgtttcatata

SEQ ID NO: 78418 - DNA, 22 bp, Artificial Sequence
  Synthetic oligonucleotide; CTC chr11 5195193 5195214 5195210 5195215 +
tctgtttcatatattacacctt

SEQ ID NO: 78419 - DNA, 22 bp, Artificial Sequence
  Synthetic oligonucleotide; CTC chr11 5195195 5195216 5195212 5195217 +
tgtttcatatattacaccttag

SEQ ID NO: 78420 - DNA, 22 bp, Artificial Sequence
  Synthetic oligonucleotide; CTG chr11 5195197 5195218 5195214 5195219 +
tttcatatattacaccttagtc

SEQ ID NO: 78421 - DNA, 22 bp, Artificial Sequence
  Synthetic oligonucleotide; TTT chr11 5195200 5195221 5195217 5195222 +
catatattacaccttagtcctg

SEQ ID NO: 78422 - DNA, 22 bp, Artificial Sequence
  Synthetic oligonucleotide; TTC chr11 5195201 5195222 5195218 5195223 +
atatattacaccttagtcctgg

SEQ ID NO: 78423 - DNA, 22 bp, Artificial Sequence
  Synthetic oligonucleotide; TTA chr11 5195209 5195230 5195226 5195231 +
caccttagtcctggcatccttt

SEQ ID NO: 78424 - DNA, 22 bp, Artificial Sequence
  Synthetic oligonucleotide; CTT chr11 5195215 5195236 5195232 5195237 +
agtcctggcatcctttgcactg

SEQ ID NO: 78425 - DNA, 22 bp, Artificial Sequence
  Synthetic oligonucleotide; TTA chr11 5195216 5195237 5195233 5195238 +
gtcctggcatcctttgcactga

SEQ ID NO: 78426 - DNA, 22 bp, Artificial Sequence
  Synthetic oligonucleotide; CTG chr11 5195222 5195243 5195239 5195244 +
gcatcctttgcactgaatttcc

SEQ ID NO: 78427 - DNA, 22 bp, Artificial Sequence
  Synthetic oligonucleotide; CTT chr11 5195230 5195251 5195247 5195252 +
tgcactgaatttcccagtgtct

SEQ ID NO: 78428 - DNA, 22 bp, Artificial Sequence
  Synthetic oligonucleotide; TTT chr11 5195231 5195252 5195248 5195253 +
gcactgaatttcccagtgtctg

SEQ ID NO: 78429 - DNA, 22 bp, Artificial Sequence
  Synthetic oligonucleotide; TTG chr11 5195232 5195253 5195249 5195254 +
cactgaatttcccagtgtctgg

SEQ ID NO: 78430 - DNA, 22 bp, Artificial Sequence
  Synthetic oligonucleotide; CTG chr11 5195237 5195258 5195254 5195259 +
aatttcccagtgtctggatcat

SEQ ID NO: 78431 - DNA, 22 bp, Artificial Sequence
  Synthetic oligonucleotide; TTT chr11 5195242 5195263 5195259 5195264 +
cccagtgtctggatcatcattg

SEQ ID NO: 78432 - DNA, 22 bp, Artificial Sequence
  Synthetic oligonucleotide; TTC chr11 5195243 5195264 5195260 5195265 +
ccagtgtctggatcatcattga

SEQ ID NO: 78433 - DNA, 22 bp, Artificial Sequence
  Synthetic oligonucleotide; CTG chr11 5195253 5195274 5195270 5195275 +
gatcatcattgatttggttact

SEQ ID NO: 78434 - DNA, 22 bp, Artificial Sequence
  Synthetic oligonucleotide; TTG chr11 5195264 5195285 5195281 5195286 +
atttggttactacagacactaa

SEQ ID NO: 78435 - DNA, 22 bp, Artificial Sequence
  Synthetic oligonucleotide; TTT chr11 5195268 5195289 5195285 5195290 +
ggttactacagacactaatcat

SEQ ID NO: 78436 - DNA, 22 bp, Artificial Sequence
  Synthetic oligonucleotide; TTG chr11 5195269 5195290 5195286 5195291 +
gttactacagacactaatcatt

SEQ ID NO: 78437 - DNA, 22 bp, Artificial Sequence
  Synthetic oligonucleotide; TTA chr11 5195273 5195294 5195290 5195295 +
ctacagacactaatcattttgc

SEQ ID NO: 78438 - DNA, 22 bp, Artificial Sequence
  Synthetic oligonucleotide; CTA chr11 5195276 5195297 5195293 5195298 +
cagacactaatcattttgccag

SEQ ID NO: 78439 - DNA, 22 bp, Artificial Sequence
  Synthetic oligonucleotide; CTA chr11 5195285 5195306 5195302 5195307 +
atcattttgccagaactaaaga

SEQ ID NO: 78440 - DNA, 22 bp, Artificial Sequence
  Synthetic oligonucleotide; TTT chr11 5195292 5195313 5195309 5195314 +
tgccagaactaaagagaaatga

SEQ ID NO: 78441 - DNA, 22 bp, Artificial Sequence
  Synthetic oligonucleotide; TTT chr11 5195293 5195314 5195310 5195315 +
gccagaactaaagagaaatgag

SEQ ID NO: 78442 - DNA, 22 bp, Artificial Sequence
  Synthetic oligonucleotide; TTG chr11 5195294 5195315 5195311 5195316 +
ccagaactaaagagaaatgagt

SEQ ID NO: 78443 - DNA, 22 bp, Artificial Sequence
  Synthetic oligonucleotide; CTA chr11 5195303 5195324 5195320 5195325 +
aagagaaatgagtacctggcta

SEQ ID NO: 78444 - DNA, 22 bp, Artificial Sequence
  Synthetic oligonucleotide; CTG chr11 5195321 5195342 5195338 5195343 +
gctatcttttaggcaaccttaa

SEQ ID NO: 78445 - DNA, 22 bp, Artificial Sequence
  Synthetic oligonucleotide; CTA chr11 5195325 5195346 5195342 5195347 +
tcttttaggcaaccttaaacag

SEQ ID NO: 78446 - DNA, 22 bp, Artificial Sequence
  Synthetic oligonucleotide; CTT chr11 5195329 5195350 5195346 5195351 +
ttaggcaaccttaaacaggtat

SEQ ID NO: 78447 - DNA, 22 bp, Artificial Sequence
  Synthetic oligonucleotide; TTT chr11 5195330 5195351 5195347 5195352 +
taggcaaccttaaacaggtatt

SEQ ID NO: 78448 - DNA, 22 bp, Artificial Sequence
  Synthetic oligonucleotide; TTT chr11 5195331 5195352 5195348 5195353 +
aggcaaccttaaacaggtattc

SEQ ID NO: 78449 - DNA, 22 bp, Artificial Sequence
  Synthetic oligonucleotide; TTA chr11 5195332 5195353 5195349 5195354 +
ggcaaccttaaacaggtattca

SEQ ID NO: 78450 - DNA, 22 bp, Artificial Sequence
  Synthetic oligonucleotide; CTT chr11 5195341 5195362 5195358 5195363 +
aaacaggtattcaccttttcta

SEQ ID NO: 78451 - DNA, 22 bp, Artificial Sequence
  Synthetic oligonucleotide; TTA chr11 5195342 5195363 5195359 5195364 +
aacaggtattcaccttttctac

SEQ ID NO: 78452 - DNA, 22 bp, Artificial Sequence
  Synthetic oligonucleotide; TTC chr11 5195353 5195374 5195370 5195375 +
accttttctaccatttttagcc

SEQ ID NO: 78453 - DNA, 22 bp, Artificial Sequence
  Synthetic oligonucleotide; CTT chr11 5195358 5195379 5195375 5195380 +
ttctaccatttttagccctacc

SEQ ID NO: 78454 - DNA, 22 bp, Artificial Sequence
  Synthetic oligonucleotide; TTT chr11 5195359 5195380 5195376 5195381 +
tctaccatttttagccctaccc

SEQ ID NO: 78455 - DNA, 22 bp, Artificial Sequence
  Synthetic oligonucleotide; TTT chr11 5195360 5195381 5195377 5195382 +
ctaccatttttagccctacccc

SEQ ID NO: 78456 - DNA, 22 bp, Artificial Sequence
  Synthetic oligonucleotide; TTC chr11 5195361 5195382 5195378 5195383 +
taccatttttagccctacccct

SEQ ID NO: 78457 - DNA, 22 bp, Artificial Sequence
  Synthetic oligonucleotide; CTA chr11 5195363 5195384 5195380 5195385 +
ccatttttagccctacccctca

SEQ ID NO: 78458 - DNA, 22 bp, Artificial Sequence
  Synthetic oligonucleotide; TTT chr11 5195369 5195390 5195386 5195391 +
ttagccctacccctcacgaatg

SEQ ID NO: 78459 - DNA, 22 bp, Artificial Sequence
  Synthetic oligonucleotide; TTT chr11 5195370 5195391 5195387 5195392 +
tagccctacccctcacgaatgc

SEQ ID NO: 78460 - DNA, 22 bp, Artificial Sequence
  Synthetic oligonucleotide; TTT chr11 5195371 5195392 5195388 5195393 +
agccctacccctcacgaatgct

SEQ ID NO: 78461 - DNA, 22 bp, Artificial Sequence
  Synthetic oligonucleotide; TTA chr11 5195372 5195393 5195389 5195394 +
gccctacccctcacgaatgctt

SEQ ID NO: 78462 - DNA, 22 bp, Artificial Sequence
  Synthetic oligonucleotide; CTA chr11 5195378 5195399 5195395 5195400 +
cccctcacgaatgctttataag

SEQ ID NO: 78463 - DNA, 22 bp, Artificial Sequence
  Synthetic oligonucleotide; CTC chr11 5195384 5195405 5195401 5195406 +
acgaatgctttataagtaattt

SEQ ID NO: 78464 - DNA, 22 bp, Artificial Sequence
  Synthetic oligonucleotide; CTT chr11 5195394 5195415 5195411 5195416 +
tataagtaatttctgtgttttt

SEQ ID NO: 78465 - DNA, 22 bp, Artificial Sequence
  Synthetic oligonucleotide; TTT chr11 5195395 5195416 5195412 5195417 +
ataagtaatttctgtgtttttc

SEQ ID NO: 78466 - DNA, 22 bp, Artificial Sequence
  Synthetic oligonucleotide; TTA chr11 5195396 5195417 5195413 5195418 +
taagtaatttctgtgtttttcc

SEQ ID NO: 78467 - DNA, 22 bp, Artificial Sequence
  Synthetic oligonucleotide; TTT chr11 5195406 5195427 5195423 5195428 +
ctgtgtttttccagaaaatgct

SEQ ID NO: 78468 - DNA, 22 bp, Artificial Sequence
  Synthetic oligonucleotide; TTC chr11 5195407 5195428 5195424 5195429 +
tgtgtttttccagaaaatgctc

SEQ ID NO: 78469 - DNA, 22 bp, Artificial Sequence
  Synthetic oligonucleotide; CTG chr11 5195409 5195430 5195426 5195431 +
tgtttttccagaaaatgctctt

SEQ ID NO: 78470 - DNA, 22 bp, Artificial Sequence
  Synthetic oligonucleotide; TTT chr11 5195414 5195435 5195431 5195436 +
ttccagaaaatgctctttgcag

SEQ ID NO: 78471 - DNA, 22 bp, Artificial Sequence
  Synthetic oligonucleotide; TTT chr11 5195415 5195436 5195432 5195437 +
tccagaaaatgctctttgcaga

SEQ ID NO: 78472 - DNA, 22 bp, Artificial Sequence
  Synthetic oligonucleotide; TTT chr11 5195416 5195437 5195433 5195438 +
ccagaaaatgctctttgcagat

SEQ ID NO: 78473 - DNA, 22 bp, Artificial Sequence
  Synthetic oligonucleotide; TTC chr11 5195417 5195438 5195434 5195439 +
cagaaaatgctctttgcagata

SEQ ID NO: 78474 - DNA, 22 bp, Artificial Sequence
  Synthetic oligonucleotide; CTC chr11 5195429 5195450 5195446 5195451 +
tttgcagataacgttttttctc

SEQ ID NO: 78475 - DNA, 22 bp, Artificial Sequence
  Synthetic oligonucleotide; CTT chr11 5195431 5195452 5195448 5195453 +
tgcagataacgttttttctcat

SEQ ID NO: 78476 - DNA, 22 bp, Artificial Sequence
  Synthetic oligonucleotide; TTT chr11 5195432 5195453 5195449 5195454 +
gcagataacgttttttctcatt

SEQ ID NO: 78477 - DNA, 22 bp, Artificial Sequence
  Synthetic oligonucleotide; TTG chr11 5195433 5195454 5195450 5195455 +
cagataacgttttttctcattg

SEQ ID NO: 78478 - DNA, 22 bp, Artificial Sequence
  Synthetic oligonucleotide; TTT chr11 5195445 5195466 5195462 5195467 +
tttctcattggtatccttttct

SEQ ID NO: 78479 - DNA, 22 bp, Artificial Sequence
  Synthetic oligonucleotide; TTT chr11 5195446 5195467 5195463 5195468 +
ttctcattggtatccttttctg

SEQ ID NO: 78480 - DNA, 22 bp, Artificial Sequence
  Synthetic oligonucleotide; TTT chr11 5195447 5195468 5195464 5195469 +
tctcattggtatccttttctgt

SEQ ID NO: 78481 - DNA, 22 bp, Artificial Sequence
  Synthetic oligonucleotide; TTT chr11 5195448 5195469 5195465 5195470 +
ctcattggtatccttttctgta

SEQ ID NO: 78482 - DNA, 22 bp, Artificial Sequence
  Synthetic oligonucleotide; TTC chr11 5195449 5195470 5195466 5195471 +
tcattggtatccttttctgtag

SEQ ID NO: 78483 - DNA, 22 bp, Artificial Sequence
  Synthetic oligonucleotide; CTC chr11 5195451 5195472 5195468 5195473 +
attggtatccttttctgtagac

SEQ ID NO: 78484 - DNA, 22 bp, Artificial Sequence
  Synthetic oligonucleotide; TTG chr11 5195455 5195476 5195472 5195477 +
gtatccttttctgtagacatat

SEQ ID NO: 78485 - DNA, 22 bp, Artificial Sequence
  Synthetic oligonucleotide; CTT chr11 5195463 5195484 5195480 5195485 +
ttctgtagacatatagatttca

SEQ ID NO: 78486 - DNA, 22 bp, Artificial Sequence
  Synthetic oligonucleotide; TTT chr11 5195464 5195485 5195481 5195486 +
tctgtagacatatagatttcag

SEQ ID NO: 78487 - DNA, 22 bp, Artificial Sequence
  Synthetic oligonucleotide; TTT chr11 5195465 5195486 5195482 5195487 +
ctgtagacatatagatttcaga

SEQ ID NO: 78488 - DNA, 22 bp, Artificial Sequence
  Synthetic oligonucleotide; TTC chr11 5195466 5195487 5195483 5195488 +
tgtagacatatagatttcagat

SEQ ID NO: 78489 - DNA, 22 bp, Artificial Sequence
  Synthetic oligonucleotide; CTG chr11 5195468 5195489 5195485 5195490 +
tagacatatagatttcagatta

SEQ ID NO: 78490 - DNA, 22 bp, Artificial Sequence
  Synthetic oligonucleotide; TTT chr11 5195483 5195504 5195500 5195505 +
cagattatcctgttctgttttt

SEQ ID NO: 78491 - DNA, 22 bp, Artificial Sequence
  Synthetic oligonucleotide; TTC chr11 5195484 5195505 5195501 5195506 +
agattatcctgttctgtttttt

SEQ ID NO: 78492 - DNA, 22 bp, Artificial Sequence
  Synthetic oligonucleotide; TTA chr11 5195490 5195511 5195507 5195512 +
tcctgttctgttttttaaaaaa

SEQ ID NO: 78493 - DNA, 22 bp, Artificial Sequence
  Synthetic oligonucleotide; CTG chr11 5195495 5195516 5195512 5195517 +
ttctgttttttaaaaaatcata

SEQ ID NO: 78494 - DNA, 22 bp, Artificial Sequence
  Synthetic oligonucleotide; TTC chr11 5195498 5195519 5195515 5195520 +
tgttttttaaaaaatcatattt

SEQ ID NO: 78495 - DNA, 22 bp, Artificial Sequence
  Synthetic oligonucleotide; CTG chr11 5195500 5195521 5195517 5195522 +
ttttttaaaaaatcatatttaa

SEQ ID NO: 78496 - DNA, 22 bp, Artificial Sequence
  Synthetic oligonucleotide; TTT chr11 5195503 5195524 5195520 5195525 +
tttaaaaaatcatatttaaatg

SEQ ID NO: 78497 - DNA, 22 bp, Artificial Sequence
  Synthetic oligonucleotide; TTT chr11 5195504 5195525 5195521 5195526 +
ttaaaaaatcatatttaaatgt

SEQ ID NO: 78498 - DNA, 22 bp, Artificial Sequence
  Synthetic oligonucleotide; TTT chr11 5195505 5195526 5195522 5195527 +
taaaaaatcatatttaaatgta

SEQ ID NO: 78499 - DNA, 22 bp, Artificial Sequence
  Synthetic oligonucleotide; TTT chr11 5195506 5195527 5195523 5195528 +
aaaaaatcatatttaaatgtat

SEQ ID NO: 78500 - DNA, 22 bp, Artificial Sequence
  Synthetic oligonucleotide; TTA chr11 5195507 5195528 5195524 5195529 +
aaaaatcatatttaaatgtata

SEQ ID NO: 78501 - DNA, 22 bp, Artificial Sequence
  Synthetic oligonucleotide; TTT chr11 5195520 5195541 5195537 5195542 +
aaatgtatatacttatcaattt

SEQ ID NO: 78502 - DNA, 22 bp, Artificial Sequence
  Synthetic oligonucleotide; TTA chr11 5195521 5195542 5195538 5195543 +
aatgtatatacttatcaatttg

SEQ ID NO: 78503 - DNA, 22 bp, Artificial Sequence
  Synthetic oligonucleotide; CTT chr11 5195534 5195555 5195551 5195556 +
atcaatttgttcatacatattg

SEQ ID NO: 78504 - DNA, 22 bp, Artificial Sequence
  Synthetic oligonucleotide; TTA chr11 5195535 5195556 5195552 5195557 +
tcaatttgttcatacatattgt

SEQ ID NO: 78505 - DNA, 22 bp, Artificial Sequence
  Synthetic oligonucleotide; TTT chr11 5195542 5195563 5195559 5195564 +
gttcatacatattgtgctattt

SEQ ID NO: 78506 - DNA, 22 bp, Artificial Sequence
  Synthetic oligonucleotide; TTG chr11 5195543 5195564 5195560 5195565 +
ttcatacatattgtgctatttt

SEQ ID NO: 78507 - DNA, 22 bp, Artificial Sequence
  Synthetic oligonucleotide; TTC chr11 5195546 5195567 5195563 5195568 +
atacatattgtgctattttctt

SEQ ID NO: 78508 - DNA, 22 bp, Artificial Sequence
  Synthetic oligonucleotide; TTG chr11 5195556 5195577 5195573 5195578 +
tgctattttcttcacagtgtct

SEQ ID NO: 78509 - DNA, 22 bp, Artificial Sequence
  Synthetic oligonucleotide; CTA chr11 5195561 5195582 5195578 5195583 +
ttttcttcacagtgtctctgtg

SEQ ID NO: 78510 - DNA, 22 bp, Artificial Sequence
  Synthetic oligonucleotide; TTT chr11 5195564 5195585 5195581 5195586 +
tcttcacagtgtctctgtgtac

SEQ ID NO: 78511 - DNA, 22 bp, Artificial Sequence
  Synthetic oligonucleotide; TTT chr11 5195565 5195586 5195582 5195587 +
cttcacagtgtctctgtgtaca

SEQ ID NO: 78512 - DNA, 22 bp, Artificial Sequence
  Synthetic oligonucleotide; TTC chr11 5195566 5195587 5195583 5195588 +
ttcacagtgtctctgtgtacat

SEQ ID NO: 78513 - DNA, 22 bp, Artificial Sequence
  Synthetic oligonucleotide; CTT chr11 5195568 5195589 5195585 5195590 +
cacagtgtctctgtgtacatct

SEQ ID NO: 78514 - DNA, 22 bp, Artificial Sequence
  Synthetic oligonucleotide; TTC chr11 5195569 5195590 5195586 5195591 +
acagtgtctctgtgtacatcta

SEQ ID NO: 78515 - DNA, 22 bp, Artificial Sequence
  Synthetic oligonucleotide; CTC chr11 5195579 5195600 5195596 5195601 +
tgtgtacatctatagctttagt

SEQ ID NO: 78516 - DNA, 22 bp, Artificial Sequence
  Synthetic oligonucleotide; CTG chr11 5195581 5195602 5195598 5195603 +
tgtacatctatagctttagtgg

SEQ ID NO: 78517 - DNA, 22 bp, Artificial Sequence
  Synthetic oligonucleotide; CTA chr11 5195591 5195612 5195608 5195613 +
tagctttagtggattagagaaa

SEQ ID NO: 78518 - DNA, 22 bp, Artificial Sequence
  Synthetic oligonucleotide; CTT chr11 5195597 5195618 5195614 5195619 +
tagtggattagagaaagtagca

SEQ ID NO: 78519 - DNA, 22 bp, Artificial Sequence
  Synthetic oligonucleotide; TTT chr11 5195598 5195619 5195615 5195620 +
agtggattagagaaagtagcag

SEQ ID NO: 78520 - DNA, 22 bp, Artificial Sequence
  Synthetic oligonucleotide; TTA chr11 5195599 5195620 5195616 5195621 +
gtggattagagaaagtagcaga

SEQ ID NO: 78521 - DNA, 22 bp, Artificial Sequence
  Synthetic oligonucleotide; TTA chr11 5195607 5195628 5195624 5195629 +
gagaaagtagcagaaatgaaca

SEQ ID NO: 78522 - DNA, 22 bp, Artificial Sequence
  Synthetic oligonucleotide; TTC chr11 5195636 5195657 5195653 5195658 +
agtctgccaggtttatatgtaa

SEQ ID NO: 78523 - DNA, 22 bp, Artificial Sequence
  Synthetic oligonucleotide; CTG chr11 5195642 5195663 5195659 5195664 +
ccaggtttatatgtaaattgac

SEQ ID NO: 78524 - DNA, 22 bp, Artificial Sequence
  Synthetic oligonucleotide; TTT chr11 5195650 5195671 5195667 5195672 +
atatgtaaattgacactttcac

SEQ ID NO: 78525 - DNA, 22 bp, Artificial Sequence
  Synthetic oligonucleotide; TTA chr11 5195651 5195672 5195668 5195673 +
tatgtaaattgacactttcact

SEQ ID NO: 78526 - DNA, 22 bp, Artificial Sequence
  Synthetic oligonucleotide; TTG chr11 5195662 5195683 5195679 5195684 +
acactttcactcatatttctta

SEQ ID NO: 78527 - DNA, 22 bp, Artificial Sequence
  Synthetic oligonucleotide; CTT chr11 5195668 5195689 5195685 5195690 +
tcactcatatttcttaaattta

SEQ ID NO: 78528 - DNA, 22 bp, Artificial Sequence
  Synthetic oligonucleotide; TTT chr11 5195669 5195690 5195686 5195691 +
cactcatatttcttaaatttat

SEQ ID NO: 78529 - DNA, 22 bp, Artificial Sequence
  Synthetic oligonucleotide; TTC chr11 5195670 5195691 5195687 5195692 +
actcatatttcttaaatttata

SEQ ID NO: 78530 - DNA, 22 bp, Artificial Sequence
  Synthetic oligonucleotide; CTC chr11 5195674 5195695 5195691 5195696 +
atatttcttaaatttatatttt

SEQ ID NO: 78531 - DNA, 22 bp, Artificial Sequence
  Synthetic oligonucleotide; TTT chr11 5195680 5195701 5195697 5195702 +
cttaaatttatattttattatt

SEQ ID NO: 78532 - DNA, 22 bp, Artificial Sequence
  Synthetic oligonucleotide; TTC chr11 5195681 5195702 5195698 5195703 +
ttaaatttatattttattattc

SEQ ID NO: 78533 - DNA, 22 bp, Artificial Sequence
  Synthetic oligonucleotide; CTT chr11 5195683 5195704 5195700 5195705 +
aaatttatattttattattcag

SEQ ID NO: 78534 - DNA, 22 bp, Artificial Sequence
  Synthetic oligonucleotide; TTA chr11 5195684 5195705 5195701 5195706 +
aatttatattttattattcagt

SEQ ID NO: 78535 - DNA, 22 bp, Artificial Sequence
  Synthetic oligonucleotide; TTT chr11 5195689 5195710 5195706 5195711 +
atattttattattcagtacaga

SEQ ID NO: 78536 - DNA, 22 bp, Artificial Sequence
  Synthetic oligonucleotide; TTA chr11 5195690 5195711 5195707 5195712 +
tattttattattcagtacagaa

SEQ ID NO: 78537 - DNA, 22 bp, Artificial Sequence
  Synthetic oligonucleotide; TTT chr11 5195695 5195716 5195712 5195717 +
tattattcagtacagaaaaata

SEQ ID NO: 78538 - DNA, 22 bp, Artificial Sequence
  Synthetic oligonucleotide; TTT chr11 5195696 5195717 5195713 5195718 +
attattcagtacagaaaaatac

SEQ ID NO: 78539 - DNA, 22 bp, Artificial Sequence
  Synthetic oligonucleotide; TTA chr11 5195697 5195718 5195714 5195719 +
ttattcagtacagaaaaataca

SEQ ID NO: 78540 - DNA, 22 bp, Artificial Sequence
  Synthetic oligonucleotide; TTA chr11 5195700 5195721 5195717 5195722 +
ttcagtacagaaaaatacataa

SEQ ID NO: 78541 - DNA, 22 bp, Artificial Sequence
  Synthetic oligonucleotide; TTC chr11 5195703 5195724 5195720 5195725 +
agtacagaaaaatacataaata

SEQ ID NO: 78542 - DNA, 22 bp, Artificial Sequence
  Synthetic oligonucleotide; TTT chr11 5195737 5195758 5195754 5195759 +
gttaaattgacacaaaattagc

SEQ ID NO: 78543 - DNA, 22 bp, Artificial Sequence
  Synthetic oligonucleotide; TTG chr11 5195738 5195759 5195755 5195760 +
ttaaattgacacaaaattagca

SEQ ID NO: 78544 - DNA, 22 bp, Artificial Sequence
  Synthetic oligonucleotide; TTA chr11 5195741 5195762 5195758 5195763 +
aattgacacaaaattagcaaaa

SEQ ID NO: 78545 - DNA, 22 bp, Artificial Sequence
  Synthetic oligonucleotide; TTG chr11 5195746 5195767 5195763 5195768 +
acacaaaattagcaaaagcttt

SEQ ID NO: 78546 - DNA, 22 bp, Artificial Sequence
  Synthetic oligonucleotide; TTA chr11 5195757 5195778 5195774 5195779 +
gcaaaagcttttaacaaacact

SEQ ID NO: 78547 - DNA, 22 bp, Artificial Sequence
  Synthetic oligonucleotide; CTT chr11 5195767 5195788 5195784 5195789 +
ttaacaaacactcagaccaaga

SEQ ID NO: 78548 - DNA, 22 bp, Artificial Sequence
  Synthetic oligonucleotide; TTT chr11 5195768 5195789 5195785 5195790 +
taacaaacactcagaccaagaa

SEQ ID NO: 78549 - DNA, 22 bp, Artificial Sequence
  Synthetic oligonucleotide; TTT chr11 5195769 5195790 5195786 5195791 +
aacaaacactcagaccaagaaa

SEQ ID NO: 78550 - DNA, 22 bp, Artificial Sequence
  Synthetic oligonucleotide; TTA chr11 5195770 5195791 5195787 5195792 +
acaaacactcagaccaagaaag

SEQ ID NO: 78551 - DNA, 22 bp, Artificial Sequence
  Synthetic oligonucleotide; CTC chr11 5195780 5195801 5195797 5195802 +
agaccaagaaagagaacattac

SEQ ID NO: 78552 - DNA, 22 bp, Artificial Sequence
  Synthetic oligonucleotide; TTA chr11 5195801 5195822 5195818 5195823 +
ccagcatctcaaaagctaaaca

SEQ ID NO: 78553 - DNA, 22 bp, Artificial Sequence
  Synthetic oligonucleotide; CTC chr11 5195811 5195832 5195828 5195833 +
aaaagctaaacaccgattgatt

SEQ ID NO: 78554 - DNA, 22 bp, Artificial Sequence
  Synthetic oligonucleotide; CTA chr11 5195819 5195840 5195836 5195841 +
aacaccgattgattcctcagtt

SEQ ID NO: 78555 - DNA, 22 bp, Artificial Sequence
  Synthetic oligonucleotide; TTG chr11 5195830 5195851 5195847 5195852 +
attcctcagttctggctgcaac

SEQ ID NO: 78556 - DNA, 22 bp, Artificial Sequence
  Synthetic oligonucleotide; TTC chr11 5195834 5195855 5195851 5195856 +
ctcagttctggctgcaacctga

SEQ ID NO: 78557 - DNA, 22 bp, Artificial Sequence
  Synthetic oligonucleotide; CTC chr11 5195837 5195858 5195854 5195859 +
agttctggctgcaacctgaaag

SEQ ID NO: 78558 - DNA, 22 bp, Artificial Sequence
  Synthetic oligonucleotide; TTC chr11 5195842 5195863 5195859 5195864 +
tggctgcaacctgaaagcctgc

SEQ ID NO: 78559 - DNA, 22 bp, Artificial Sequence
  Synthetic oligonucleotide; CTG chr11 5195844 5195865 5195861 5195866 +
gctgcaacctgaaagcctgcat

SEQ ID NO: 78560 - DNA, 22 bp, Artificial Sequence
  Synthetic oligonucleotide; CTG chr11 5195848 5195869 5195865 5195870 +
caacctgaaagcctgcattttc

SEQ ID NO: 78561 - DNA, 22 bp, Artificial Sequence
  Synthetic oligonucleotide; CTG chr11 5195855 5195876 5195872 5195877 +
aaagcctgcattttctatgtgc

SEQ ID NO: 78562 - DNA, 22 bp, Artificial Sequence
  Synthetic oligonucleotide; CTG chr11 5195863 5195884 5195880 5195885 +
cattttctatgtgccattacat

SEQ ID NO: 78563 - DNA, 22 bp, Artificial Sequence
  Synthetic oligonucleotide; TTT chr11 5195868 5195889 5195885 5195890 +
tctatgtgccattacatggtgc

SEQ ID NO: 78564 - DNA, 22 bp, Artificial Sequence
  Synthetic oligonucleotide; TTT chr11 5195869 5195890 5195886 5195891 +
ctatgtgccattacatggtgcc

SEQ ID NO: 78565 - DNA, 22 bp, Artificial Sequence
  Synthetic oligonucleotide; TTC chr11 5195870 5195891 5195887 5195892 +
tatgtgccattacatggtgcca

SEQ ID NO: 78566 - DNA, 22 bp, Artificial Sequence
  Synthetic oligonucleotide; CTA chr11 5195872 5195893 5195889 5195894 +
tgtgccattacatggtgccaag

SEQ ID NO: 78567 - DNA, 22 bp, Artificial Sequence
  Synthetic oligonucleotide; TTA chr11 5195882 5195903 5195899 5195904 +
catggtgccaagactgcagggg

SEQ ID NO: 78568 - DNA, 22 bp, Artificial Sequence
  Synthetic oligonucleotide; CTG chr11 5195898 5195919 5195915 5195920 +
caggggcagaaaccacactttt

SEQ ID NO: 78569 - DNA, 22 bp, Artificial Sequence
  Synthetic oligonucleotide; CTT chr11 5195918 5195939 5195935 5195940 +
ttactggaaaagctttaggaca

SEQ ID NO: 78570 - DNA, 22 bp, Artificial Sequence
  Synthetic oligonucleotide; TTT chr11 5195919 5195940 5195936 5195941 +
tactggaaaagctttaggacat

SEQ ID NO: 78571 - DNA, 22 bp, Artificial Sequence
  Synthetic oligonucleotide; TTT chr11 5195920 5195941 5195937 5195942 +
actggaaaagctttaggacatc

SEQ ID NO: 78572 - DNA, 22 bp, Artificial Sequence
  Synthetic oligonucleotide; TTA chr11 5195921 5195942 5195938 5195943 +
ctggaaaagctttaggacatcg

SEQ ID NO: 78573 - DNA, 22 bp, Artificial Sequence
  Synthetic oligonucleotide; CTG chr11 5195924 5195945 5195941 5195946 +
gaaaagctttaggacatcgact

SEQ ID NO: 78574 - DNA, 22 bp, Artificial Sequence
  Synthetic oligonucleotide; CTT chr11 5195933 5195954 5195950 5195955 +
taggacatcgactcctactgca

SEQ ID NO: 78575 - DNA, 22 bp, Artificial Sequence
  Synthetic oligonucleotide; TTT chr11 5195934 5195955 5195951 5195956 +
aggacatcgactcctactgcag

SEQ ID NO: 78576 - DNA, 22 bp, Artificial Sequence
  Synthetic oligonucleotide; TTA chr11 5195935 5195956 5195952 5195957 +
ggacatcgactcctactgcagg

SEQ ID NO: 78577 - DNA, 22 bp, Artificial Sequence
  Synthetic oligonucleotide; CTC chr11 5195947 5195968 5195964 5195969 +
ctactgcaggggtgttcttggc

SEQ ID NO: 78578 - DNA, 22 bp, Artificial Sequence
  Synthetic oligonucleotide; CTA chr11 5195950 5195971 5195967 5195972 +
ctgcaggggtgttcttggctag

SEQ ID NO: 78579 - DNA, 22 bp, Artificial Sequence
  Synthetic oligonucleotide; CTG chr11 5195953 5195974 5195970 5195975 +
caggggtgttcttggctaggtt

SEQ ID NO: 78580 - DNA, 22 bp, Artificial Sequence
  Synthetic oligonucleotide; TTC chr11 5195964 5195985 5195981 5195986 +
ttggctaggttggcattaattt

SEQ ID NO: 78581 - DNA, 22 bp, Artificial Sequence
  Synthetic oligonucleotide; CTT chr11 5195966 5195987 5195983 5195988 +
ggctaggttggcattaattttt

SEQ ID NO: 78582 - DNA, 22 bp, Artificial Sequence
  Synthetic oligonucleotide; TTG chr11 5195967 5195988 5195984 5195989 +
gctaggttggcattaattttta

SEQ ID NO: 78583 - DNA, 22 bp, Artificial Sequence
  Synthetic oligonucleotide; CTA chr11 5195971 5195992 5195988 5195993 +
ggttggcattaatttttaagtt

SEQ ID NO: 78584 - DNA, 22 bp, Artificial Sequence
  Synthetic oligonucleotide; TTG chr11 5195976 5195997 5195993 5195998 +
gcattaatttttaagtttctgc

SEQ ID NO: 78585 - DNA, 22 bp, Artificial Sequence
  Synthetic oligonucleotide; TTA chr11 5195982 5196003 5195999 5196004 +
atttttaagtttctgcaagaga

SEQ ID NO: 78586 - DNA, 22 bp, Artificial Sequence
  Synthetic oligonucleotide; TTT chr11 5195986 5196007 5196003 5196008 +
ttaagtttctgcaagagacttc

SEQ ID NO: 78587 - DNA, 22 bp, Artificial Sequence
  Synthetic oligonucleotide; TTT chr11 5195987 5196008 5196004 5196009 +
taagtttctgcaagagacttct

SEQ ID NO: 78588 - DNA, 22 bp, Artificial Sequence
  Synthetic oligonucleotide; TTT chr11 5195988 5196009 5196005 5196010 +
aagtttctgcaagagacttctg

SEQ ID NO: 78589 - DNA, 22 bp, Artificial Sequence
  Synthetic oligonucleotide; TTA chr11 5195989 5196010 5196006 5196011 +
agtttctgcaagagacttctgg

SEQ ID NO: 78590 - DNA, 22 bp, Artificial Sequence
  Synthetic oligonucleotide; TTT chr11 5195994 5196015 5196011 5196016 +
ctgcaagagacttctgggaaaa

SEQ ID NO: 78591 - DNA, 22 bp, Artificial Sequence
  Synthetic oligonucleotide; TTC chr11 5195995 5196016 5196012 5196017 +
tgcaagagacttctgggaaaat

SEQ ID NO: 78592 - DNA, 22 bp, Artificial Sequence
  Synthetic oligonucleotide; CTG chr11 5195997 5196018 5196014 5196019 +
caagagacttctgggaaaatgg

SEQ ID NO: 78593 - DNA, 22 bp, Artificial Sequence
  Synthetic oligonucleotide; CTT chr11 5196007 5196028 5196024 5196029 +
ctgggaaaatggactattttta

SEQ ID NO: 78594 - DNA, 22 bp, Artificial Sequence
  Synthetic oligonucleotide; TTC chr11 5196008 5196029 5196025 5196030 +
tgggaaaatggactatttttat

SEQ ID NO: 78595 - DNA, 22 bp, Artificial Sequence
  Synthetic oligonucleotide; CTG chr11 5196010 5196031 5196027 5196032 +
ggaaaatggactatttttattt

SEQ ID NO: 78596 - DNA, 22 bp, Artificial Sequence
  Synthetic oligonucleotide; CTA chr11 5196023 5196044 5196040 5196045 +
tttttatttccttcatctggag

SEQ ID NO: 78597 - DNA, 22 bp, Artificial Sequence
  Synthetic oligonucleotide; TTT chr11 5196026 5196047 5196043 5196048 +
ttatttccttcatctggaggcc

SEQ ID NO: 78598 - DNA, 22 bp, Artificial Sequence
  Synthetic oligonucleotide; TTT chr11 5196027 5196048 5196044 5196049 +
tatttccttcatctggaggcct

SEQ ID NO: 78599 - DNA, 22 bp, Artificial Sequence
  Synthetic oligonucleotide; TTT chr11 5196028 5196049 5196045 5196050 +
atttccttcatctggaggcctc

SEQ ID NO: 78600 - DNA, 22 bp, Artificial Sequence
  Synthetic oligonucleotide; TTA chr11 5196029 5196050 5196046 5196051 +
tttccttcatctggaggcctct

SEQ ID NO: 78601 - DNA, 22 bp, Artificial Sequence
  Synthetic oligonucleotide; TTT chr11 5196032 5196053 5196049 5196054 +
ccttcatctggaggcctctatt

SEQ ID NO: 78602 - DNA, 22 bp, Artificial Sequence
  Synthetic oligonucleotide; TTC chr11 5196033 5196054 5196050 5196055 +
cttcatctggaggcctctattc

SEQ ID NO: 78603 - DNA, 22 bp, Artificial Sequence
  Synthetic oligonucleotide; CTT chr11 5196036 5196057 5196053 5196058 +
catctggaggcctctattcact

SEQ ID NO: 78604 - DNA, 22 bp, Artificial Sequence
  Synthetic oligonucleotide; TTC chr11 5196037 5196058 5196054 5196059 +
atctggaggcctctattcacta

SEQ ID NO: 78605 - DNA, 22 bp, Artificial Sequence
  Synthetic oligonucleotide; CTG chr11 5196042 5196063 5196059 5196064 +
gaggcctctattcactactcta

SEQ ID NO: 78606 - DNA, 22 bp, Artificial Sequence
  Synthetic oligonucleotide; CTC chr11 5196050 5196071 5196067 5196072 +
tattcactactctagcaattat

SEQ ID NO: 78607 - DNA, 22 bp, Artificial Sequence
  Synthetic oligonucleotide; CTA chr11 5196052 5196073 5196069 5196074 +
ttcactactctagcaattatct

SEQ ID NO: 78608 - DNA, 22 bp, Artificial Sequence
  Synthetic oligonucleotide; TTC chr11 5196055 5196076 5196072 5196077 +
actactctagcaattatcttct

SEQ ID NO: 78609 - DNA, 22 bp, Artificial Sequence
  Synthetic oligonucleotide; CTA chr11 5196059 5196080 5196076 5196081 +
ctctagcaattatcttctgcaa

SEQ ID NO: 78610 - DNA, 22 bp, Artificial Sequence
  Synthetic oligonucleotide; CTC chr11 5196062 5196083 5196079 5196084 +
tagcaattatcttctgcaagta

SEQ ID NO: 78611 - DNA, 22 bp, Artificial Sequence
  Synthetic oligonucleotide; CTA chr11 5196064 5196085 5196081 5196086 +
gcaattatcttctgcaagtaat

SEQ ID NO: 78612 - DNA, 22 bp, Artificial Sequence
  Synthetic oligonucleotide; TTA chr11 5196071 5196092 5196088 5196093 +
tcttctgcaagtaatggtaaca

SEQ ID NO: 78613 - DNA, 22 bp, Artificial Sequence
  Synthetic oligonucleotide; CTT chr11 5196075 5196096 5196092 5196097 +
ctgcaagtaatggtaacaaata

SEQ ID NO: 78614 - DNA, 22 bp, Artificial Sequence
  Synthetic oligonucleotide; TTC chr11 5196076 5196097 5196093 5196098 +
tgcaagtaatggtaacaaatat

SEQ ID NO: 78615 - DNA, 22 bp, Artificial Sequence
  Synthetic oligonucleotide; CTG chr11 5196078 5196099 5196095 5196100 +
caagtaatggtaacaaatatcc

SEQ ID NO: 78616 - DNA, 22 bp, Artificial Sequence
  Synthetic oligonucleotide; CTA chr11 5196102 5196123 5196119 5196124 +
gggaatggagacacaacctcaa

SEQ ID NO: 78617 - DNA, 22 bp, Artificial Sequence
  Synthetic oligonucleotide; CTC chr11 5196122 5196143 5196139 5196144 +
aagtagaacatctcttaagtct

SEQ ID NO: 78618 - DNA, 22 bp, Artificial Sequence
  Synthetic oligonucleotide; CTC chr11 5196136 5196157 5196153 5196158 +
ttaagtctgtttaacaatacga

SEQ ID NO: 78619 - DNA, 22 bp, Artificial Sequence
  Synthetic oligonucleotide; CTT chr11 5196138 5196159 5196155 5196160 +
aagtctgtttaacaatacgatt

SEQ ID NO: 78620 - DNA, 22 bp, Artificial Sequence
  Synthetic oligonucleotide; TTA chr11 5196139 5196160 5196156 5196161 +
agtctgtttaacaatacgattt

SEQ ID NO: 78621 - DNA, 22 bp, Artificial Sequence
  Synthetic oligonucleotide; CTG chr11 5196145 5196166 5196162 5196167 +
tttaacaatacgattttgataa

SEQ ID NO: 78622 - DNA, 22 bp, Artificial Sequence
  Synthetic oligonucleotide; TTT chr11 5196148 5196169 5196165 5196170 +
aacaatacgattttgataagcc

SEQ ID NO: 78623 - DNA, 22 bp, Artificial Sequence
  Synthetic oligonucleotide; TTA chr11 5196149 5196170 5196166 5196171 +
acaatacgattttgataagcct

SEQ ID NO: 78624 - DNA, 22 bp, Artificial Sequence
  Synthetic oligonucleotide; TTT chr11 5196161 5196182 5196178 5196183 +
tgataagcctaggaaaataggg

SEQ ID NO: 78625 - DNA, 22 bp, Artificial Sequence
  Synthetic oligonucleotide; TTT chr11 5196162 5196183 5196179 5196184 +
gataagcctaggaaaataggga

SEQ ID NO: 78626 - DNA, 22 bp, Artificial Sequence
  Synthetic oligonucleotide; TTG chr11 5196163 5196184 5196180 5196185 +
ataagcctaggaaaatagggag

SEQ ID NO: 78627 - DNA, 22 bp, Artificial Sequence
  Synthetic oligonucleotide; CTA chr11 5196172 5196193 5196189 5196194 +
ggaaaatagggaggtatagtgt

SEQ ID NO: 78628 - DNA, 22 bp, Artificial Sequence
  Synthetic oligonucleotide; CTG chr11 5196206 5196227 5196223 5196228 +
gccacttaccagtactggtccg

SEQ ID NO: 78629 - DNA, 22 bp, Artificial Sequence
  Synthetic oligonucleotide; CTT chr11 5196213 5196234 5196230 5196235 +
accagtactggtccgtggcctg

SEQ ID NO: 78630 - DNA, 22 bp, Artificial Sequence
  Synthetic oligonucleotide; TTA chr11 5196214 5196235 5196231 5196236 +
ccagtactggtccgtggcctgc

SEQ ID NO: 78631 - DNA, 22 bp, Artificial Sequence
  Synthetic oligonucleotide; CTG chr11 5196223 5196244 5196240 5196245 +
gtccgtggcctgctaggaacct

SEQ ID NO: 78632 - DNA, 22 bp, Artificial Sequence
  Synthetic oligonucleotide; CTG chr11 5196235 5196256 5196252 5196257 +
ctaggaacctggtctcacagca

SEQ ID NO: 78633 - DNA, 22 bp, Artificial Sequence
  Synthetic oligonucleotide; CTA chr11 5196238 5196259 5196255 5196260 +
ggaacctggtctcacagcaggg

SEQ ID NO: 78634 - DNA, 22 bp, Artificial Sequence
  Synthetic oligonucleotide; CTG chr11 5196246 5196267 5196263 5196268 +
gtctcacagcagggggatgagc

SEQ ID NO: 78635 - DNA, 22 bp, Artificial Sequence
  Synthetic oligonucleotide; CTC chr11 5196251 5196272 5196268 5196273 +
acagcagggggatgagcaagca

SEQ ID NO: 78636 - DNA, 22 bp, Artificial Sequence
  Synthetic oligonucleotide; TTA chr11 5196276 5196297 5196293 5196298 +
ctgcctgagctcctcctcctgt

SEQ ID NO: 78637 - DNA, 22 bp, Artificial Sequence
  Synthetic oligonucleotide; CTG chr11 5196279 5196300 5196296 5196301 +
cctgagctcctcctcctgtcac

SEQ ID NO: 78638 - DNA, 22 bp, Artificial Sequence
  Synthetic oligonucleotide; CTG chr11 5196283 5196304 5196300 5196305 +
agctcctcctcctgtcacatcg

SEQ ID NO: 78639 - DNA, 22 bp, Artificial Sequence
  Synthetic oligonucleotide; CTC chr11 5196288 5196309 5196305 5196310 +
ctcctcctgtcacatcggcagt

SEQ ID NO: 78640 - DNA, 22 bp, Artificial Sequence
  Synthetic oligonucleotide; CTC chr11 5196291 5196312 5196308 5196313 +
ctcctgtcacatcggcagtggc

SEQ ID NO: 78641 - DNA, 22 bp, Artificial Sequence
  Synthetic oligonucleotide; CTC chr11 5196294 5196315 5196311 5196316 +
ctgtcacatcggcagtggcggc

SEQ ID NO: 78642 - DNA, 22 bp, Artificial Sequence
  Synthetic oligonucleotide; CTG chr11 5196297 5196318 5196314 5196319 +
tcacatcggcagtggcggcatt

SEQ ID NO: 78643 - DNA, 22 bp, Artificial Sequence
  Synthetic oligonucleotide; TTA chr11 5196320 5196341 5196337 5196342 +
gattctcatagaggcatgcaag

SEQ ID NO: 78644 - DNA, 22 bp, Artificial Sequence
  Synthetic oligonucleotide; TTC chr11 5196325 5196346 5196342 5196347 +
tcatagaggcatgcaagggatc

SEQ ID NO: 78645 - DNA, 22 bp, Artificial Sequence
  Synthetic oligonucleotide; CTC chr11 5196327 5196348 5196344 5196349 +
atagaggcatgcaagggatcta

SEQ ID NO: 78646 - DNA, 22 bp, Artificial Sequence
  Synthetic oligonucleotide; CTA chr11 5196349 5196370 5196366 5196371 +
ggttgcggcttcttatgagaat

SEQ ID NO: 78647 - DNA, 22 bp, Artificial Sequence
  Synthetic oligonucleotide; TTG chr11 5196354 5196375 5196371 5196376 +
cggcttcttatgagaatctaat

SEQ ID NO: 78648 - DNA, 22 bp, Artificial Sequence
  Synthetic oligonucleotide; CTT chr11 5196360 5196381 5196377 5196382 +
cttatgagaatctaatgcctaa

SEQ ID NO: 78649 - DNA, 22 bp, Artificial Sequence
  Synthetic oligonucleotide; TTC chr11 5196361 5196382 5196378 5196383 +
ttatgagaatctaatgcctaat

SEQ ID NO: 78650 - DNA, 22 bp, Artificial Sequence
  Synthetic oligonucleotide; CTT chr11 5196363 5196384 5196380 5196385 +
atgagaatctaatgcctaatgc

SEQ ID NO: 78651 - DNA, 22 bp, Artificial Sequence
  Synthetic oligonucleotide; TTA chr11 5196364 5196385 5196381 5196386 +
tgagaatctaatgcctaatgct

SEQ ID NO: 78652 - DNA, 22 bp, Artificial Sequence
  Synthetic oligonucleotide; CTA chr11 5196374 5196395 5196391 5196396 +
atgcctaatgctctgaggtgga

SEQ ID NO: 78653 - DNA, 22 bp, Artificial Sequence
  Synthetic oligonucleotide; CTA chr11 5196381 5196402 5196398 5196403 +
atgctctgaggtggaacagttt

SEQ ID NO: 78654 - DNA, 22 bp, Artificial Sequence
  Synthetic oligonucleotide; CTC chr11 5196387 5196408 5196404 5196409 +
tgaggtggaacagtttcatcct

SEQ ID NO: 78655 - DNA, 22 bp, Artificial Sequence
  Synthetic oligonucleotide; CTG chr11 5196389 5196410 5196406 5196411 +
aggtggaacagtttcatcctga

SEQ ID NO: 78656 - DNA, 22 bp, Artificial Sequence
  Synthetic oligonucleotide; TTT chr11 5196403 5196424 5196420 5196425 +
catcctgaaaccatgccctcct

SEQ ID NO: 78657 - DNA, 22 bp, Artificial Sequence
  Synthetic oligonucleotide; TTC chr11 5196404 5196425 5196421 5196426 +
atcctgaaaccatgccctcctg

SEQ ID NO: 78658 - DNA, 22 bp, Artificial Sequence
  Synthetic oligonucleotide; CTG chr11 5196410 5196431 5196427 5196432 +
aaaccatgccctcctgcacctt

SEQ ID NO: 78659 - DNA, 22 bp, Artificial Sequence
  Synthetic oligonucleotide; CTC chr11 5196423 5196444 5196440 5196445 +
ctgcaccttgtcttccacaaaa

SEQ ID NO: 78660 - DNA, 22 bp, Artificial Sequence
  Synthetic oligonucleotide; CTG chr11 5196426 5196447 5196443 5196448 +
caccttgtcttccacaaaagca

SEQ ID NO: 78661 - DNA, 22 bp, Artificial Sequence
  Synthetic oligonucleotide; CTT chr11 5196432 5196453 5196449 5196454 +
gtcttccacaaaagcagtccct

SEQ ID NO: 78662 - DNA, 22 bp, Artificial Sequence
  Synthetic oligonucleotide; TTG chr11 5196433 5196454 5196450 5196455 +
tcttccacaaaagcagtccctg

SEQ ID NO: 78663 - DNA, 22 bp, Artificial Sequence
  Synthetic oligonucleotide; CTT chr11 5196437 5196458 5196454 5196459 +
ccacaaaagcagtccctggtac

SEQ ID NO: 78664 - DNA, 22 bp, Artificial Sequence
  Synthetic oligonucleotide; TTC chr11 5196438 5196459 5196455 5196460 +
cacaaaagcagtccctggtacc

SEQ ID NO: 78665 - DNA, 22 bp, Artificial Sequence
  Synthetic oligonucleotide; CTG chr11 5196455 5196476 5196472 5196477 +
gtaccaaaaacattgaagactg

SEQ ID NO: 78666 - DNA, 22 bp, Artificial Sequence
  Synthetic oligonucleotide; TTG chr11 5196470 5196491 5196487 5196492 +
aagactgctggtgtacagtgaa

SEQ ID NO: 78667 - DNA, 22 bp, Artificial Sequence
  Synthetic oligonucleotide; CTG chr11 5196477 5196498 5196494 5196499 +
ctggtgtacagtgaacatctgc

SEQ ID NO: 78668 - DNA, 22 bp, Artificial Sequence
  Synthetic oligonucleotide; CTG chr11 5196480 5196501 5196497 5196502 +
gtgtacagtgaacatctgcctg

SEQ ID NO: 78669 - DNA, 22 bp, Artificial Sequence
  Synthetic oligonucleotide; CTG chr11 5196498 5196519 5196515 5196520 +
cctgtggatttattattagcag

SEQ ID NO: 78670 - DNA, 22 bp, Artificial Sequence
  Synthetic oligonucleotide; CTG chr11 5196502 5196523 5196519 5196524 +
tggatttattattagcagatca

SEQ ID NO: 78671 - DNA, 22 bp, Artificial Sequence
  Synthetic oligonucleotide; TTT chr11 5196509 5196530 5196526 5196531 +
attattagcagatcatttttac

SEQ ID NO: 78672 - DNA, 22 bp, Artificial Sequence
  Synthetic oligonucleotide; TTA chr11 5196510 5196531 5196527 5196532 +
ttattagcagatcatttttact

SEQ ID NO: 78673 - DNA, 22 bp, Artificial Sequence
  Synthetic oligonucleotide; TTA chr11 5196513 5196534 5196530 5196535 +
ttagcagatcatttttactaaa

SEQ ID NO: 78674 - DNA, 22 bp, Artificial Sequence
  Synthetic oligonucleotide; TTA chr11 5196516 5196537 5196533 5196538 +
gcagatcatttttactaaaaac

SEQ ID NO: 78675 - DNA, 22 bp, Artificial Sequence
  Synthetic oligonucleotide; TTT chr11 5196527 5196548 5196544 5196549 +
ttactaaaaacacatttctaat

SEQ ID NO: 78676 - DNA, 22 bp, Artificial Sequence
  Synthetic oligonucleotide; TTT chr11 5196528 5196549 5196545 5196550 +
tactaaaaacacatttctaatc

SEQ ID NO: 78677 - DNA, 22 bp, Artificial Sequence
  Synthetic oligonucleotide; TTT chr11 5196529 5196550 5196546 5196551 +
actaaaaacacatttctaatcc

SEQ ID NO: 78678 - DNA, 22 bp, Artificial Sequence
  Synthetic oligonucleotide; TTA chr11 5196530 5196551 5196547 5196552 +
ctaaaaacacatttctaatcct

SEQ ID NO: 78679 - DNA, 22 bp, Artificial Sequence
  Synthetic oligonucleotide; CTA chr11 5196533 5196554 5196550 5196555 +
aaaacacatttctaatcctgaa

SEQ ID NO: 78680 - DNA, 22 bp, Artificial Sequence
  Synthetic oligonucleotide; TTT chr11 5196544 5196565 5196561 5196566 +
ctaatcctgaatcatgtcctct

SEQ ID NO: 78681 - DNA, 22 bp, Artificial Sequence
  Synthetic oligonucleotide; TTC chr11 5196545 5196566 5196562 5196567 +
taatcctgaatcatgtcctctc

SEQ ID NO: 78682 - DNA, 22 bp, Artificial Sequence
  Synthetic oligonucleotide; CTA chr11 5196547 5196568 5196564 5196569 +
atcctgaatcatgtcctctcac

SEQ ID NO: 78683 - DNA, 22 bp, Artificial Sequence
  Synthetic oligonucleotide; CTG chr11 5196553 5196574 5196570 5196575 +
aatcatgtcctctcacttctaa

SEQ ID NO: 78684 - DNA, 22 bp, Artificial Sequence
  Synthetic oligonucleotide; CTC chr11 5196565 5196586 5196582 5196587 +
tcacttctaagaatcactgatt

SEQ ID NO: 78685 - DNA, 22 bp, Artificial Sequence
  Synthetic oligonucleotide; CTC chr11 5196567 5196588 5196584 5196589 +
acttctaagaatcactgatttc

SEQ ID NO: 78686 - DNA, 22 bp, Artificial Sequence
  Synthetic oligonucleotide; CTT chr11 5196571 5196592 5196588 5196593 +
ctaagaatcactgatttctccc

SEQ ID NO: 78687 - DNA, 22 bp, Artificial Sequence
  Synthetic oligonucleotide; TTC chr11 5196572 5196593 5196589 5196594 +
taagaatcactgatttctccca

SEQ ID NO: 78688 - DNA, 22 bp, Artificial Sequence
  Synthetic oligonucleotide; CTA chr11 5196574 5196595 5196591 5196596 +
agaatcactgatttctcccact

SEQ ID NO: 78689 - DNA, 22 bp, Artificial Sequence
  Synthetic oligonucleotide; CTG chr11 5196584 5196605 5196601 5196606 +
atttctcccactggaccttagc

SEQ ID NO: 78690 - DNA, 22 bp, Artificial Sequence
  Synthetic oligonucleotide; TTT chr11 5196588 5196609 5196605 5196610 +
ctcccactggaccttagctttt

SEQ ID NO: 78691 - DNA, 22 bp, Artificial Sequence
  Synthetic oligonucleotide; TTC chr11 5196589 5196610 5196606 5196611 +
tcccactggaccttagcttttc

SEQ ID NO: 78692 - DNA, 22 bp, Artificial Sequence
  Synthetic oligonucleotide; CTC chr11 5196591 5196612 5196608 5196613 +
ccactggaccttagcttttcgg

SEQ ID NO: 78693 - DNA, 22 bp, Artificial Sequence
  Synthetic oligonucleotide; CTG chr11 5196597 5196618 5196614 5196619 +
gaccttagcttttcggtgtaag

SEQ ID NO: 78694 - DNA, 22 bp, Artificial Sequence
  Synthetic oligonucleotide; CTT chr11 5196603 5196624 5196620 5196625 +
agcttttcggtgtaagagttaa

SEQ ID NO: 78695 - DNA, 22 bp, Artificial Sequence
  Synthetic oligonucleotide; TTA chr11 5196604 5196625 5196621 5196626 +
gcttttcggtgtaagagttaaa

SEQ ID NO: 78696 - DNA, 22 bp, Artificial Sequence
  Synthetic oligonucleotide; CTT chr11 5196608 5196629 5196625 5196630 +
ttcggtgtaagagttaaatgaa

SEQ ID NO: 78697 - DNA, 22 bp, Artificial Sequence
  Synthetic oligonucleotide; TTT chr11 5196609 5196630 5196626 5196631 +
tcggtgtaagagttaaatgaat

SEQ ID NO: 78698 - DNA, 22 bp, Artificial Sequence
  Synthetic oligonucleotide; TTT chr11 5196610 5196631 5196627 5196632 +
cggtgtaagagttaaatgaata

SEQ ID NO: 78699 - DNA, 22 bp, Artificial Sequence
  Synthetic oligonucleotide; TTC chr11 5196611 5196632 5196628 5196633 +
ggtgtaagagttaaatgaatag

SEQ ID NO: 78700 - DNA, 22 bp, Artificial Sequence
  Synthetic oligonucleotide; TTA chr11 5196624 5196645 5196641 5196646 +
aatgaatagcaattgaatggac

SEQ ID NO: 78701 - DNA, 22 bp, Artificial Sequence
  Synthetic oligonucleotide; TTG chr11 5196639 5196660 5196656 5196661 +
aatggactagactttctgattt

SEQ ID NO: 78702 - DNA, 22 bp, Artificial Sequence
  Synthetic oligonucleotide; CTA chr11 5196648 5196669 5196665 5196670 +
gactttctgattttctgaatct

SEQ ID NO: 78703 - DNA, 22 bp, Artificial Sequence
  Synthetic oligonucleotide; CTT chr11 5196653 5196674 5196670 5196675 +
tctgattttctgaatcttactt

SEQ ID NO: 78704 - DNA, 22 bp, Artificial Sequence
  Synthetic oligonucleotide; TTT chr11 5196654 5196675 5196671 5196676 +
ctgattttctgaatcttacttt

SEQ ID NO: 78705 - DNA, 22 bp, Artificial Sequence
  Synthetic oligonucleotide; TTC chr11 5196655 5196676 5196672 5196677 +
tgattttctgaatcttactttt

SEQ ID NO: 78706 - DNA, 22 bp, Artificial Sequence
  Synthetic oligonucleotide; CTG chr11 5196657 5196678 5196674 5196679 +
attttctgaatcttacttttgt

SEQ ID NO: 78707 - DNA, 22 bp, Artificial Sequence
  Synthetic oligonucleotide; TTT chr11 5196661 5196682 5196678 5196683 +
tctgaatcttacttttgtcacc

SEQ ID NO: 78708 - DNA, 22 bp, Artificial Sequence
  Synthetic oligonucleotide; TTT chr11 5196662 5196683 5196679 5196684 +
ctgaatcttacttttgtcacct

SEQ ID NO: 78709 - DNA, 22 bp, Artificial Sequence
  Synthetic oligonucleotide; TTC chr11 5196663 5196684 5196680 5196685 +
tgaatcttacttttgtcacctt

SEQ ID NO: 78710 - DNA, 22 bp, Artificial Sequence
  Synthetic oligonucleotide; CTG chr11 5196665 5196686 5196682 5196687 +
aatcttacttttgtcaccttgt

SEQ ID NO: 78711 - DNA, 22 bp, Artificial Sequence
  Synthetic oligonucleotide; CTT chr11 5196671 5196692 5196688 5196693 +
acttttgtcaccttgttctcgg

SEQ ID NO: 78712 - DNA, 22 bp, Artificial Sequence
  Synthetic oligonucleotide; TTA chr11 5196672 5196693 5196689 5196694 +
cttttgtcaccttgttctcggc

SEQ ID NO: 78713 - DNA, 22 bp, Artificial Sequence
  Synthetic oligonucleotide; CTT chr11 5196675 5196696 5196692 5196697 +
ttgtcaccttgttctcggcaat

SEQ ID NO: 78714 - DNA, 22 bp, Artificial Sequence
  Synthetic oligonucleotide; TTT chr11 5196676 5196697 5196693 5196698 +
tgtcaccttgttctcggcaata

SEQ ID NO: 78715 - DNA, 22 bp, Artificial Sequence
  Synthetic oligonucleotide; TTT chr11 5196677 5196698 5196694 5196699 +
gtcaccttgttctcggcaatat

SEQ ID NO: 78716 - DNA, 22 bp, Artificial Sequence
  Synthetic oligonucleotide; TTG chr11 5196678 5196699 5196695 5196700 +
tcaccttgttctcggcaatatt

SEQ ID NO: 78717 - DNA, 22 bp, Artificial Sequence
  Synthetic oligonucleotide; CTT chr11 5196685 5196706 5196702 5196707 +
gttctcggcaatatttttgttt

SEQ ID NO: 78718 - DNA, 22 bp, Artificial Sequence
  Synthetic oligonucleotide; TTG chr11 5196686 5196707 5196703 5196708 +
ttctcggcaatatttttgtttt

SEQ ID NO: 78719 - DNA, 22 bp, Artificial Sequence
  Synthetic oligonucleotide; TTC chr11 5196689 5196710 5196706 5196711 +
tcggcaatatttttgttttctc

SEQ ID NO: 78720 - DNA, 22 bp, Artificial Sequence
  Synthetic oligonucleotide; CTC chr11 5196691 5196712 5196708 5196713 +
ggcaatatttttgttttctcct

SEQ ID NO: 78721 - DNA, 22 bp, Artificial Sequence
  Synthetic oligonucleotide; TTT chr11 5196701 5196722 5196718 5196723 +
ttgttttctccttattataata

SEQ ID NO: 78722 - DNA, 22 bp, Artificial Sequence
  Synthetic oligonucleotide; TTT chr11 5196702 5196723 5196719 5196724 +
tgttttctccttattataataa

SEQ ID NO: 78723 - DNA, 22 bp, Artificial Sequence
  Synthetic oligonucleotide; TTT chr11 5196703 5196724 5196720 5196725 +
gttttctccttattataataac

SEQ ID NO: 78724 - DNA, 22 bp, Artificial Sequence
  Synthetic oligonucleotide; TTG chr11 5196704 5196725 5196721 5196726 +
ttttctccttattataataacc

SEQ ID NO: 78725 - DNA, 22 bp, Artificial Sequence
  Synthetic oligonucleotide; TTT chr11 5196707 5196728 5196724 5196729 +
tctccttattataataaccgtg

SEQ ID NO: 78726 - DNA, 22 bp, Artificial Sequence
  Synthetic oligonucleotide; TTT chr11 5196708 5196729 5196725 5196730 +
ctccttattataataaccgtga

SEQ ID NO: 78727 - DNA, 22 bp, Artificial Sequence
  Synthetic oligonucleotide; TTC chr11 5196709 5196730 5196726 5196731 +
tccttattataataaccgtgac

SEQ ID NO: 78728 - DNA, 22 bp, Artificial Sequence
  Synthetic oligonucleotide; CTC chr11 5196711 5196732 5196728 5196733 +
cttattataataaccgtgactt

SEQ ID NO: 78729 - DNA, 22 bp, Artificial Sequence
  Synthetic oligonucleotide; CTT chr11 5196714 5196735 5196731 5196736 +
attataataaccgtgacttcat

SEQ ID NO: 78730 - DNA, 22 bp, Artificial Sequence
  Synthetic oligonucleotide; TTA chr11 5196715 5196736 5196732 5196737 +
ttataataaccgtgacttcatt

SEQ ID NO: 78731 - DNA, 22 bp, Artificial Sequence
  Synthetic oligonucleotide; TTA chr11 5196718 5196739 5196735 5196740 +
taataaccgtgacttcatttaa

SEQ ID NO: 78732 - DNA, 22 bp, Artificial Sequence
  Synthetic oligonucleotide; CTT chr11 5196733 5196754 5196750 5196755 +
catttaaggcagcagttacaat

SEQ ID NO: 78733 - DNA, 22 bp, Artificial Sequence
  Synthetic oligonucleotide; TTC chr11 5196734 5196755 5196751 5196756 +
atttaaggcagcagttacaatg

SEQ ID NO: 78734 - DNA, 22 bp, Artificial Sequence
  Synthetic oligonucleotide; TTT chr11 5196738 5196759 5196755 5196760 +
aaggcagcagttacaatgatat

SEQ ID NO: 78735 - DNA, 22 bp, Artificial Sequence
  Synthetic oligonucleotide; TTA chr11 5196739 5196760 5196756 5196761 +
aggcagcagttacaatgatatg

SEQ ID NO: 78736 - DNA, 22 bp, Artificial Sequence
  Synthetic oligonucleotide; TTA chr11 5196751 5196772 5196768 5196773 +
caatgatatgacagtctaccta

SEQ ID NO: 78737 - DNA, 22 bp, Artificial Sequence
  Synthetic oligonucleotide; CTA chr11 5196769 5196790 5196786 5196791 +
cctattaaaaaaaaaaaggcaa

SEQ ID NO: 78738 - DNA, 22 bp, Artificial Sequence
  Synthetic oligonucleotide; CTA chr11 5196773 5196794 5196790 5196795 +
ttaaaaaaaaaaaggcaaaaga

SEQ ID NO: 78739 - DNA, 22 bp, Artificial Sequence
  Synthetic oligonucleotide; TTA chr11 5196776 5196797 5196793 5196798 +
aaaaaaaaaaggcaaaagagaa

SEQ ID NO: 78740 - DNA, 22 bp, Artificial Sequence
  Synthetic oligonucleotide; CTG chr11 5196801 5196822 5196818 5196823 +
tgtttccctaacatcactgtgg

SEQ ID NO: 78741 - DNA, 22 bp, Artificial Sequence
  Synthetic oligonucleotide; TTT chr11 5196806 5196827 5196823 5196828 +
ccctaacatcactgtggctgtt

SEQ ID NO: 78742 - DNA, 22 bp, Artificial Sequence
  Synthetic oligonucleotide; TTC chr11 5196807 5196828 5196824 5196829 +
cctaacatcactgtggctgttt

SEQ ID NO: 78743 - DNA, 22 bp, Artificial Sequence
  Synthetic oligonucleotide; CTA chr11 5196811 5196832 5196828 5196833 +
acatcactgtggctgttttcgt

SEQ ID NO: 78744 - DNA, 22 bp, Artificial Sequence
  Synthetic oligonucleotide; CTG chr11 5196820 5196841 5196837 5196842 +
tggctgttttcgtaacgtttct

SEQ ID NO: 78745 - DNA, 22 bp, Artificial Sequence
  Synthetic oligonucleotide; CTG chr11 5196826 5196847 5196843 5196848 +
ttttcgtaacgtttctcagtga

SEQ ID NO: 78746 - DNA, 22 bp, Artificial Sequence
  Synthetic oligonucleotide; TTT chr11 5196829 5196850 5196846 5196851 +
tcgtaacgtttctcagtgacgc

SEQ ID NO: 78747 - DNA, 22 bp, Artificial Sequence
  Synthetic oligonucleotide; TTT chr11 5196830 5196851 5196847 5196852 +
cgtaacgtttctcagtgacgct

SEQ ID NO: 78748 - DNA, 22 bp, Artificial Sequence
  Synthetic oligonucleotide; TTC chr11 5196831 5196852 5196848 5196853 +
gtaacgtttctcagtgacgctg

SEQ ID NO: 78749 - DNA, 22 bp, Artificial Sequence
  Synthetic oligonucleotide; TTT chr11 5196840 5196861 5196857 5196862 +
ctcagtgacgctggatagtagc

SEQ ID NO: 78750 - DNA, 22 bp, Artificial Sequence
  Synthetic oligonucleotide; TTC chr11 5196841 5196862 5196858 5196863 +
tcagtgacgctggatagtagcc

SEQ ID NO: 78751 - DNA, 22 bp, Artificial Sequence
  Synthetic oligonucleotide; CTC chr11 5196843 5196864 5196860 5196865 +
agtgacgctggatagtagcctt

SEQ ID NO: 78752 - DNA, 22 bp, Artificial Sequence
  Synthetic oligonucleotide; CTG chr11 5196853 5196874 5196870 5196875 +
gatagtagccttgcaggcctta

SEQ ID NO: 78753 - DNA, 22 bp, Artificial Sequence
  Synthetic oligonucleotide; CTT chr11 5196865 5196886 5196882 5196887 +
gcaggccttacaaaggaatctg

SEQ ID NO: 78754 - DNA, 22 bp, Artificial Sequence
  Synthetic oligonucleotide; TTG chr11 5196866 5196887 5196883 5196888 +
caggccttacaaaggaatctga

SEQ ID NO: 78755 - DNA, 22 bp, Artificial Sequence
  Synthetic oligonucleotide; CTT chr11 5196874 5196895 5196891 5196896 +
acaaaggaatctgataactgct

SEQ ID NO: 78756 - DNA, 22 bp, Artificial Sequence
  Synthetic oligonucleotide; TTA chr11 5196875 5196896 5196892 5196897 +
caaaggaatctgataactgctt

SEQ ID NO: 78757 - DNA, 22 bp, Artificial Sequence
  Synthetic oligonucleotide; CTG chr11 5196887 5196908 5196904 5196909 +
ataactgcttctcactggctct

SEQ ID NO: 78758 - DNA, 22 bp, Artificial Sequence
  Synthetic oligonucleotide; CTG chr11 5196894 5196915 5196911 5196916 +
cttctcactggctctgcaggct

SEQ ID NO: 78759 - DNA, 22 bp, Artificial Sequence
  Synthetic oligonucleotide; CTT chr11 5196897 5196918 5196914 5196919 +
ctcactggctctgcaggctacc

SEQ ID NO: 78760 - DNA, 22 bp, Artificial Sequence
  Synthetic oligonucleotide; TTC chr11 5196898 5196919 5196915 5196920 +
tcactggctctgcaggctacca

SEQ ID NO: 78761 - DNA, 22 bp, Artificial Sequence
  Synthetic oligonucleotide; CTC chr11 5196900 5196921 5196917 5196922 +
actggctctgcaggctaccaca

SEQ ID NO: 78762 - DNA, 22 bp, Artificial Sequence
  Synthetic oligonucleotide; CTG chr11 5196904 5196925 5196921 5196926 +
gctctgcaggctaccacatcaa

SEQ ID NO: 78763 - DNA, 22 bp, Artificial Sequence
  Synthetic oligonucleotide; CTC chr11 5196908 5196929 5196925 5196930 +
tgcaggctaccacatcaacaac

SEQ ID NO: 78764 - DNA, 22 bp, Artificial Sequence
  Synthetic oligonucleotide; CTG chr11 5196910 5196931 5196927 5196932 +
caggctaccacatcaacaacag

SEQ ID NO: 78765 - DNA, 22 bp, Artificial Sequence
  Synthetic oligonucleotide; CTA chr11 5196917 5196938 5196934 5196939 +
ccacatcaacaacagtttcagc

SEQ ID NO: 78766 - DNA, 22 bp, Artificial Sequence
  Synthetic oligonucleotide; TTT chr11 5196935 5196956 5196952 5196957 +
cagctgttgttgcctaattcat

SEQ ID NO: 78767 - DNA, 22 bp, Artificial Sequence
  Synthetic oligonucleotide; TTC chr11 5196936 5196957 5196953 5196958 +
agctgttgttgcctaattcatg

SEQ ID NO: 78768 - DNA, 22 bp, Artificial Sequence
  Synthetic oligonucleotide; CTG chr11 5196941 5196962 5196958 5196963 +
ttgttgcctaattcatggaaaa

SEQ ID NO: 78769 - DNA, 22 bp, Artificial Sequence
  Synthetic oligonucleotide; TTG chr11 5196944 5196965 5196961 5196966 +
ttgcctaattcatggaaaacaa

SEQ ID NO: 78770 - DNA, 22 bp, Artificial Sequence
  Synthetic oligonucleotide; TTG chr11 5196947 5196968 5196964 5196969 +
cctaattcatggaaaacaagtt

SEQ ID NO: 78771 - DNA, 22 bp, Artificial Sequence
  Synthetic oligonucleotide; CTA chr11 5196951 5196972 5196968 5196973 +
attcatggaaaacaagtttcct

SEQ ID NO: 78772 - DNA, 22 bp, Artificial Sequence
  Synthetic oligonucleotide; TTC chr11 5196955 5196976 5196972 5196977 +
atggaaaacaagtttccttaga

SEQ ID NO: 78773 - DNA, 22 bp, Artificial Sequence
  Synthetic oligonucleotide; TTT chr11 5196970 5196991 5196987 5196992 +
ccttagaagctggctttttgag

SEQ ID NO: 78774 - DNA, 22 bp, Artificial Sequence
  Synthetic oligonucleotide; TTC chr11 5196971 5196992 5196988 5196993 +
cttagaagctggctttttgaga

SEQ ID NO: 78775 - DNA, 22 bp, Artificial Sequence
  Synthetic oligonucleotide; CTT chr11 5196974 5196995 5196991 5196996 +
agaagctggctttttgagatat

SEQ ID NO: 78776 - DNA, 22 bp, Artificial Sequence
  Synthetic oligonucleotide; TTA chr11 5196975 5196996 5196992 5196997 +
gaagctggctttttgagatata

SEQ ID NO: 78777 - DNA, 22 bp, Artificial Sequence
  Synthetic oligonucleotide; CTG chr11 5196982 5197003 5196999 5197004 +
gctttttgagatatatggaaaa

SEQ ID NO: 78778 - DNA, 22 bp, Artificial Sequence
  Synthetic oligonucleotide; CTT chr11 5196986 5197007 5197003 5197008 +
tttgagatatatggaaaaatgt

SEQ ID NO: 78779 - DNA, 22 bp, Artificial Sequence
  Synthetic oligonucleotide; TTT chr11 5196987 5197008 5197004 5197009 +
ttgagatatatggaaaaatgtc

SEQ ID NO: 78780 - DNA, 22 bp, Artificial Sequence
  Synthetic oligonucleotide; TTT chr11 5196988 5197009 5197005 5197010 +
tgagatatatggaaaaatgtct

SEQ ID NO: 78781 - DNA, 22 bp, Artificial Sequence
  Synthetic oligonucleotide; TTT chr11 5196989 5197010 5197006 5197011 +
gagatatatggaaaaatgtctc

SEQ ID NO: 78782 - DNA, 22 bp, Artificial Sequence
  Synthetic oligonucleotide; TTG chr11 5196990 5197011 5197007 5197012 +
agatatatggaaaaatgtctcc

SEQ ID NO: 78783 - DNA, 22 bp, Artificial Sequence
  Synthetic oligonucleotide; CTC chr11 5197011 5197032 5197028 5197033 +
cacctggctactatgtagcttt

SEQ ID NO: 78784 - DNA, 22 bp, Artificial Sequence
  Synthetic oligonucleotide; CTG chr11 5197017 5197038 5197034 5197039 +
gctactatgtagcttttcaaaa

SEQ ID NO: 78785 - DNA, 22 bp, Artificial Sequence
  Synthetic oligonucleotide; CTA chr11 5197021 5197042 5197038 5197043 +
ctatgtagcttttcaaaacaga

SEQ ID NO: 78786 - DNA, 22 bp, Artificial Sequence
  Synthetic oligonucleotide; CTA chr11 5197024 5197045 5197041 5197046 +
tgtagcttttcaaaacagacag

SEQ ID NO: 78787 - DNA, 22 bp, Artificial Sequence
  Synthetic oligonucleotide; CTT chr11 5197032 5197053 5197049 5197054 +
ttcaaaacagacagtgttttaa

SEQ ID NO: 78788 - DNA, 22 bp, Artificial Sequence
  Synthetic oligonucleotide; TTT chr11 5197033 5197054 5197050 5197055 +
tcaaaacagacagtgttttaaa

SEQ ID NO: 78789 - DNA, 22 bp, Artificial Sequence
  Synthetic oligonucleotide; TTT chr11 5197034 5197055 5197051 5197056 +
caaaacagacagtgttttaaac

SEQ ID NO: 78790 - DNA, 22 bp, Artificial Sequence
  Synthetic oligonucleotide; TTC chr11 5197035 5197056 5197052 5197057 +
aaaacagacagtgttttaaaca

SEQ ID NO: 78791 - DNA, 22 bp, Artificial Sequence
  Synthetic oligonucleotide; TTT chr11 5197051 5197072 5197068 5197073 +
taaacacctgtgatgtctccat

SEQ ID NO: 78792 - DNA, 22 bp, Artificial Sequence
  Synthetic oligonucleotide; TTT chr11 5197052 5197073 5197069 5197074 +
aaacacctgtgatgtctccatc

SEQ ID NO: 78793 - DNA, 22 bp, Artificial Sequence
  Synthetic oligonucleotide; TTA chr11 5197053 5197074 5197070 5197075 +
aacacctgtgatgtctccatct

SEQ ID NO: 78794 - DNA, 22 bp, Artificial Sequence
  Synthetic oligonucleotide; CTG chr11 5197061 5197082 5197078 5197083 +
tgatgtctccatctgctcttcc

SEQ ID NO: 78795 - DNA, 22 bp, Artificial Sequence
  Synthetic oligonucleotide; CTC chr11 5197070 5197091 5197087 5197092 +
catctgctcttcctttcaggac

SEQ ID NO: 78796 - DNA, 22 bp, Artificial Sequence
  Synthetic oligonucleotide; CTG chr11 5197076 5197097 5197093 5197098 +
ctcttcctttcaggacctgggc

SEQ ID NO: 78797 - DNA, 22 bp, Artificial Sequence
  Synthetic oligonucleotide; CTC chr11 5197079 5197100 5197096 5197101 +
ttcctttcaggacctgggctga

SEQ ID NO: 78798 - DNA, 22 bp, Artificial Sequence
  Synthetic oligonucleotide; CTT chr11 5197081 5197102 5197098 5197103 +
cctttcaggacctgggctgatg

SEQ ID NO: 78799 - DNA, 22 bp, Artificial Sequence
  Synthetic oligonucleotide; TTC chr11 5197082 5197103 5197099 5197104 +
ctttcaggacctgggctgatgt

SEQ ID NO: 78800 - DNA, 22 bp, Artificial Sequence
  Synthetic oligonucleotide; CTT chr11 5197085 5197106 5197102 5197107 +
tcaggacctgggctgatgtctc

SEQ ID NO: 78801 - DNA, 22 bp, Artificial Sequence
  Synthetic oligonucleotide; TTT chr11 5197086 5197107 5197103 5197108 +
caggacctgggctgatgtctct

SEQ ID NO: 78802 - DNA, 22 bp, Artificial Sequence
  Synthetic oligonucleotide; TTC chr11 5197087 5197108 5197104 5197109 +
aggacctgggctgatgtctctg

SEQ ID NO: 78803 - DNA, 22 bp, Artificial Sequence
  Synthetic oligonucleotide; CTG chr11 5197095 5197116 5197112 5197117 +
ggctgatgtctctgaaattgcc

SEQ ID NO: 78804 - DNA, 22 bp, Artificial Sequence
  Synthetic oligonucleotide; CTG chr11 5197100 5197121 5197117 5197122 +
atgtctctgaaattgccttttc

SEQ ID NO: 78805 - DNA, 22 bp, Artificial Sequence
  Synthetic oligonucleotide; CTC chr11 5197107 5197128 5197124 5197129 +
tgaaattgccttttcttcctca

SEQ ID NO: 78806 - DNA, 22 bp, Artificial Sequence
  Synthetic oligonucleotide; CTG chr11 5197109 5197130 5197126 5197131 +
aaattgccttttcttcctcagg

SEQ ID NO: 78807 - DNA, 22 bp, Artificial Sequence
  Synthetic oligonucleotide; TTG chr11 5197115 5197136 5197132 5197137 +
ccttttcttcctcaggagaggt

SEQ ID NO: 78808 - DNA, 22 bp, Artificial Sequence
  Synthetic oligonucleotide; CTT chr11 5197119 5197140 5197136 5197141 +
ttcttcctcaggagaggtttag

SEQ ID NO: 78809 - DNA, 22 bp, Artificial Sequence
  Synthetic oligonucleotide; TTT chr11 5197120 5197141 5197137 5197142 +
tcttcctcaggagaggtttagt

SEQ ID NO: 78810 - DNA, 22 bp, Artificial Sequence
  Synthetic oligonucleotide; TTT chr11 5197121 5197142 5197138 5197143 +
cttcctcaggagaggtttagtt

SEQ ID NO: 78811 - DNA, 22 bp, Artificial Sequence
  Synthetic oligonucleotide; TTC chr11 5197122 5197143 5197139 5197144 +
ttcctcaggagaggtttagtta

SEQ ID NO: 78812 - DNA, 22 bp, Artificial Sequence
  Synthetic oligonucleotide; CTT chr11 5197124 5197145 5197141 5197146 +
cctcaggagaggtttagttatt

SEQ ID NO: 78813 - DNA, 22 bp, Artificial Sequence
  Synthetic oligonucleotide; TTC chr11 5197125 5197146 5197142 5197147 +
ctcaggagaggtttagttattt

SEQ ID NO: 78814 - DNA, 22 bp, Artificial Sequence
  Synthetic oligonucleotide; CTC chr11 5197128 5197149 5197145 5197150 +
aggagaggtttagttatttttt

SEQ ID NO: 78815 - DNA, 22 bp, Artificial Sequence
  Synthetic oligonucleotide; TTT chr11 5197139 5197160 5197156 5197161 +
agttatttttttaagtaattgc

SEQ ID NO: 78816 - DNA, 22 bp, Artificial Sequence
  Synthetic oligonucleotide; TTA chr11 5197140 5197161 5197157 5197162 +
gttatttttttaagtaattgct

SEQ ID NO: 78817 - DNA, 22 bp, Artificial Sequence
  Synthetic oligonucleotide; TTA chr11 5197144 5197165 5197161 5197166 +
tttttttaagtaattgcttcca

SEQ ID NO: 78818 - DNA, 22 bp, Artificial Sequence
  Synthetic oligonucleotide; TTT chr11 5197147 5197168 5197164 5197169 +
ttttaagtaattgcttccagat

SEQ ID NO: 78819 - DNA, 22 bp, Artificial Sequence
  Synthetic oligonucleotide; TTT chr11 5197148 5197169 5197165 5197170 +
tttaagtaattgcttccagata

SEQ ID NO: 78820 - DNA, 22 bp, Artificial Sequence
  Synthetic oligonucleotide; TTT chr11 5197149 5197170 5197166 5197171 +
ttaagtaattgcttccagatag

SEQ ID NO: 78821 - DNA, 22 bp, Artificial Sequence
  Synthetic oligonucleotide; TTT chr11 5197150 5197171 5197167 5197172 +
taagtaattgcttccagataga

SEQ ID NO: 78822 - DNA, 22 bp, Artificial Sequence
  Synthetic oligonucleotide; TTT chr11 5197151 5197172 5197168 5197173 +
aagtaattgcttccagatagag

SEQ ID NO: 78823 - DNA, 22 bp, Artificial Sequence
  Synthetic oligonucleotide; TTA chr11 5197152 5197173 5197169 5197174 +
agtaattgcttccagatagagg

SEQ ID NO: 78824 - DNA, 22 bp, Artificial Sequence
  Synthetic oligonucleotide; TTG chr11 5197160 5197181 5197177 5197182 +
cttccagatagaggcctttgca

SEQ ID NO: 78825 - DNA, 22 bp, Artificial Sequence
  Synthetic oligonucleotide; CTT chr11 5197163 5197184 5197180 5197185 +
ccagatagaggcctttgcaaaa

SEQ ID NO: 78826 - DNA, 22 bp, Artificial Sequence
  Synthetic oligonucleotide; TTC chr11 5197164 5197185 5197181 5197186 +
cagatagaggcctttgcaaaac

SEQ ID NO: 78827 - DNA, 22 bp, Artificial Sequence
  Synthetic oligonucleotide; CTT chr11 5197178 5197199 5197195 5197200 +
tgcaaaacaaacaatctaaact

SEQ ID NO: 78828 - DNA, 22 bp, Artificial Sequence
  Synthetic oligonucleotide; TTT chr11 5197179 5197200 5197196 5197201 +
gcaaaacaaacaatctaaacta

SEQ ID NO: 78829 - DNA, 22 bp, Artificial Sequence
  Synthetic oligonucleotide; TTG chr11 5197180 5197201 5197197 5197202 +
caaaacaaacaatctaaactac

SEQ ID NO: 78830 - DNA, 22 bp, Artificial Sequence
  Synthetic oligonucleotide; CTA chr11 5197196 5197217 5197213 5197218 +
aactactaatgttctaaacctg

SEQ ID NO: 78831 - DNA, 22 bp, Artificial Sequence
  Synthetic oligonucleotide; CTA chr11 5197201 5197222 5197218 5197223 +
ctaatgttctaaacctgtttct

SEQ ID NO: 78832 - DNA, 22 bp, Artificial Sequence
  Synthetic oligonucleotide; CTA chr11 5197204 5197225 5197221 5197226 +
atgttctaaacctgtttctttc

SEQ ID NO: 78833 - DNA, 22 bp, Artificial Sequence
  Synthetic oligonucleotide; TTC chr11 5197210 5197231 5197227 5197232 +
taaacctgtttctttctgtata

SEQ ID NO: 78834 - DNA, 22 bp, Artificial Sequence
  Synthetic oligonucleotide; CTA chr11 5197212 5197233 5197229 5197234 +
aacctgtttctttctgtataaa

SEQ ID NO: 78835 - DNA, 22 bp, Artificial Sequence
  Synthetic oligonucleotide; CTG chr11 5197218 5197239 5197235 5197240 +
tttctttctgtataaagcccag

SEQ ID NO: 78836 - DNA, 22 bp, Artificial Sequence
  Synthetic oligonucleotide; TTT chr11 5197221 5197242 5197238 5197243 +
ctttctgtataaagcccagtaa

SEQ ID NO: 78837 - DNA, 22 bp, Artificial Sequence
  Synthetic oligonucleotide; TTC chr11 5197222 5197243 5197239 5197244 +
tttctgtataaagcccagtaat

SEQ ID NO: 78838 - DNA, 22 bp, Artificial Sequence
  Synthetic oligonucleotide; CTT chr11 5197224 5197245 5197241 5197246 +
tctgtataaagcccagtaatca

SEQ ID NO: 78839 - DNA, 22 bp, Artificial Sequence
  Synthetic oligonucleotide; TTT chr11 5197225 5197246 5197242 5197247 +
ctgtataaagcccagtaatcat

SEQ ID NO: 78840 - DNA, 22 bp, Artificial Sequence
  Synthetic oligonucleotide; TTC chr11 5197226 5197247 5197243 5197248 +
tgtataaagcccagtaatcata

SEQ ID NO: 78841 - DNA, 22 bp, Artificial Sequence
  Synthetic oligonucleotide; CTG chr11 5197228 5197249 5197245 5197250 +
tataaagcccagtaatcatata

SEQ ID NO: 78842 - DNA, 22 bp, Artificial Sequence
  Synthetic oligonucleotide; TTT chr11 5197256 5197277 5197273 5197278 +
actttcattggctttttttttt

SEQ ID NO: 78843 - DNA, 22 bp, Artificial Sequence
  Synthetic oligonucleotide; TTA chr11 5197257 5197278 5197274 5197279 +
ctttcattggcttttttttttt

SEQ ID NO: 78844 - DNA, 22 bp, Artificial Sequence
  Synthetic oligonucleotide; CTT chr11 5197260 5197281 5197277 5197282 +
tcattggctttttttttttttt

SEQ ID NO: 78845 - DNA, 22 bp, Artificial Sequence
  Synthetic oligonucleotide; TTT chr11 5197261 5197282 5197278 5197283 +
cattggcttttttttttttttt

SEQ ID NO: 78846 - DNA, 22 bp, Artificial Sequence
  Synthetic oligonucleotide; TTC chr11 5197262 5197283 5197279 5197284 +
attggctttttttttttttttt

SEQ ID NO: 78847 - DNA, 22 bp, Artificial Sequence
  Synthetic oligonucleotide; TTG chr11 5197266 5197287 5197283 5197288 +
gctttttttttttttttttact

SEQ ID NO: 78848 - DNA, 22 bp, Artificial Sequence
  Synthetic oligonucleotide; CTT chr11 5197270 5197291 5197287 5197292 +
tttttttttttttttactgatt

SEQ ID NO: 78849 - DNA, 22 bp, Artificial Sequence
  Synthetic oligonucleotide; TTT chr11 5197271 5197292 5197288 5197293 +
ttttttttttttttactgattt

SEQ ID NO: 78850 - DNA, 22 bp, Artificial Sequence
  Synthetic oligonucleotide; TTT chr11 5197272 5197293 5197289 5197294 +
tttttttttttttactgatttt

SEQ ID NO: 78851 - DNA, 22 bp, Artificial Sequence
  Synthetic oligonucleotide; TTT chr11 5197273 5197294 5197290 5197295 +
ttttttttttttactgattttc

SEQ ID NO: 78852 - DNA, 22 bp, Artificial Sequence
  Synthetic oligonucleotide; TTT chr11 5197274 5197295 5197291 5197296 +
tttttttttttactgattttcc

SEQ ID NO: 78853 - DNA, 22 bp, Artificial Sequence
  Synthetic oligonucleotide; TTT chr11 5197275 5197296 5197292 5197297 +
ttttttttttactgattttcct

SEQ ID NO: 78854 - DNA, 22 bp, Artificial Sequence
  Synthetic oligonucleotide; TTT chr11 5197276 5197297 5197293 5197298 +
tttttttttactgattttcctc

SEQ ID NO: 78855 - DNA, 22 bp, Artificial Sequence
  Synthetic oligonucleotide; TTT chr11 5197277 5197298 5197294 5197299 +
ttttttttactgattttcctcc

SEQ ID NO: 78856 - DNA, 22 bp, Artificial Sequence
  Synthetic oligonucleotide; TTT chr11 5197278 5197299 5197295 5197300 +
tttttttactgattttcctccc

SEQ ID NO: 78857 - DNA, 22 bp, Artificial Sequence
  Synthetic oligonucleotide; TTT chr11 5197279 5197300 5197296 5197301 +
ttttttactgattttcctccct

SEQ ID NO: 78858 - DNA, 22 bp, Artificial Sequence
  Synthetic oligonucleotide; TTT chr11 5197280 5197301 5197297 5197302 +
tttttactgattttcctccctt

SEQ ID NO: 78859 - DNA, 22 bp, Artificial Sequence
  Synthetic oligonucleotide; TTT chr11 5197281 5197302 5197298 5197303 +
ttttactgattttcctcccttt

SEQ ID NO: 78860 - DNA, 22 bp, Artificial Sequence
  Synthetic oligonucleotide; TTT chr11 5197282 5197303 5197299 5197304 +
tttactgattttcctccctttg

SEQ ID NO: 78861 - DNA, 22 bp, Artificial Sequence
  Synthetic oligonucleotide; TTT chr11 5197283 5197304 5197300 5197305 +
ttactgattttcctccctttgg

SEQ ID NO: 78862 - DNA, 22 bp, Artificial Sequence
  Synthetic oligonucleotide; TTT chr11 5197284 5197305 5197301 5197306 +
tactgattttcctccctttggc

SEQ ID NO: 78863 - DNA, 22 bp, Artificial Sequence
  Synthetic oligonucleotide; TTT chr11 5197285 5197306 5197302 5197307 +
actgattttcctccctttggct

SEQ ID NO: 78864 - DNA, 22 bp, Artificial Sequence
  Synthetic oligonucleotide; TTA chr11 5197286 5197307 5197303 5197308 +
ctgattttcctccctttggctg

SEQ ID NO: 78865 - DNA, 22 bp, Artificial Sequence
  Synthetic oligonucleotide; CTG chr11 5197289 5197310 5197306 5197311 +
attttcctccctttggctgaat

SEQ ID NO: 78866 - DNA, 22 bp, Artificial Sequence
  Synthetic oligonucleotide; TTT chr11 5197293 5197314 5197310 5197315 +
tcctccctttggctgaattgta

SEQ ID NO: 78867 - DNA, 22 bp, Artificial Sequence
  Synthetic oligonucleotide; TTT chr11 5197294 5197315 5197311 5197316 +
cctccctttggctgaattgtaa

SEQ ID NO: 78868 - DNA, 22 bp, Artificial Sequence
  Synthetic oligonucleotide; TTC chr11 5197295 5197316 5197312 5197317 +
ctccctttggctgaattgtaaa

SEQ ID NO: 78869 - DNA, 22 bp, Artificial Sequence
  Synthetic oligonucleotide; CTC chr11 5197298 5197319 5197315 5197320 +
cctttggctgaattgtaaagat

SEQ ID NO: 78870 - DNA, 22 bp, Artificial Sequence
  Synthetic oligonucleotide; CTT chr11 5197302 5197323 5197319 5197324 +
tggctgaattgtaaagattctg

SEQ ID NO: 78871 - DNA, 22 bp, Artificial Sequence
  Synthetic oligonucleotide; TTT chr11 5197303 5197324 5197320 5197325 +
ggctgaattgtaaagattctga

SEQ ID NO: 78872 - DNA, 22 bp, Artificial Sequence
  Synthetic oligonucleotide; TTG chr11 5197304 5197325 5197321 5197326 +
gctgaattgtaaagattctgaa

SEQ ID NO: 78873 - DNA, 22 bp, Artificial Sequence
  Synthetic oligonucleotide; CTG chr11 5197308 5197329 5197325 5197330 +
aattgtaaagattctgaagttc

SEQ ID NO: 78874 - DNA, 22 bp, Artificial Sequence
  Synthetic oligonucleotide; TTG chr11 5197313 5197334 5197330 5197335 +
taaagattctgaagttcttcat

SEQ ID NO: 78875 - DNA, 22 bp, Artificial Sequence
  Synthetic oligonucleotide; TTC chr11 5197322 5197343 5197339 5197344 +
tgaagttcttcataaatcttat

SEQ ID NO: 78876 - DNA, 22 bp, Artificial Sequence
  Synthetic oligonucleotide; CTG chr11 5197324 5197345 5197341 5197346 +
aagttcttcataaatcttatca

SEQ ID NO: 78877 - DNA, 22 bp, Artificial Sequence
  Synthetic oligonucleotide; TTC chr11 5197330 5197351 5197347 5197352 +
ttcataaatcttatcatcatag

SEQ ID NO: 78878 - DNA, 22 bp, Artificial Sequence
  Synthetic oligonucleotide; CTT chr11 5197332 5197353 5197349 5197354 +
cataaatcttatcatcatagta

SEQ ID NO: 78879 - DNA, 22 bp, Artificial Sequence
  Synthetic oligonucleotide; TTC chr11 5197333 5197354 5197350 5197355 +
ataaatcttatcatcatagtac

SEQ ID NO: 78880 - DNA, 22 bp, Artificial Sequence
  Synthetic oligonucleotide; CTT chr11 5197342 5197363 5197359 5197364 +
atcatcatagtacaattatata

SEQ ID NO: 78881 - DNA, 22 bp, Artificial Sequence
  Synthetic oligonucleotide; TTA chr11 5197343 5197364 5197360 5197365 +
tcatcatagtacaattatatag

SEQ ID NO: 78882 - DNA, 22 bp, Artificial Sequence
  Synthetic oligonucleotide; TTA chr11 5197360 5197381 5197377 5197382 +
tatagctctaaaataagcaatg

SEQ ID NO: 78883 - DNA, 22 bp, Artificial Sequence
  Synthetic oligonucleotide; CTC chr11 5197368 5197389 5197385 5197390 +
taaaataagcaatgatttctga

SEQ ID NO: 78884 - DNA, 22 bp, Artificial Sequence
  Synthetic oligonucleotide; CTA chr11 5197370 5197391 5197387 5197392 +
aaataagcaatgatttctgagg

SEQ ID NO: 78885 - DNA, 22 bp, Artificial Sequence
  Synthetic oligonucleotide; TTT chr11 5197386 5197407 5197403 5197408 +
ctgaggatactcttaggtattt

SEQ ID NO: 78886 - DNA, 22 bp, Artificial Sequence
  Synthetic oligonucleotide; TTC chr11 5197387 5197408 5197404 5197409 +
tgaggatactcttaggtatttt

SEQ ID NO: 78887 - DNA, 22 bp, Artificial Sequence
  Synthetic oligonucleotide; CTG chr11 5197389 5197410 5197406 5197411 +
aggatactcttaggtatttttt

SEQ ID NO: 78888 - DNA, 22 bp, Artificial Sequence
  Synthetic oligonucleotide; CTC chr11 5197398 5197419 5197415 5197420 +
ttaggtattttttattaactgt

SEQ ID NO: 78889 - DNA, 22 bp, Artificial Sequence
  Synthetic oligonucleotide; CTT chr11 5197400 5197421 5197417 5197422 +
aggtattttttattaactgttt

SEQ ID NO: 78890 - DNA, 22 bp, Artificial Sequence
  Synthetic oligonucleotide; TTA chr11 5197401 5197422 5197418 5197423 +
ggtattttttattaactgtttt

SEQ ID NO: 78891 - DNA, 22 bp, Artificial Sequence
  Synthetic oligonucleotide; TTT chr11 5197408 5197429 5197425 5197430 +
tttattaactgttttgtcacgg

SEQ ID NO: 78892 - DNA, 22 bp, Artificial Sequence
  Synthetic oligonucleotide; TTT chr11 5197409 5197430 5197426 5197431 +
ttattaactgttttgtcacggc

SEQ ID NO: 78893 - DNA, 22 bp, Artificial Sequence
  Synthetic oligonucleotide; TTT chr11 5197410 5197431 5197427 5197432 +
tattaactgttttgtcacggcc

SEQ ID NO: 78894 - DNA, 22 bp, Artificial Sequence
  Synthetic oligonucleotide; TTT chr11 5197411 5197432 5197428 5197433 +
attaactgttttgtcacggcca

SEQ ID NO: 78895 - DNA, 22 bp, Artificial Sequence
  Synthetic oligonucleotide; TTA chr11 5197412 5197433 5197429 5197434 +
ttaactgttttgtcacggccat

SEQ ID NO: 78896 - DNA, 22 bp, Artificial Sequence
  Synthetic oligonucleotide; TTA chr11 5197415 5197436 5197432 5197437 +
actgttttgtcacggccattat

SEQ ID NO: 78897 - DNA, 22 bp, Artificial Sequence
  Synthetic oligonucleotide; CTG chr11 5197419 5197440 5197436 5197441 +
ttttgtcacggccattatttca

SEQ ID NO: 78898 - DNA, 22 bp, Artificial Sequence
  Synthetic oligonucleotide; TTT chr11 5197422 5197443 5197439 5197444 +
tgtcacggccattatttcaaac

SEQ ID NO: 78899 - DNA, 22 bp, Artificial Sequence
  Synthetic oligonucleotide; TTT chr11 5197423 5197444 5197440 5197445 +
gtcacggccattatttcaaact

SEQ ID NO: 78900 - DNA, 22 bp, Artificial Sequence
  Synthetic oligonucleotide; TTG chr11 5197424 5197445 5197441 5197446 +
tcacggccattatttcaaacta

SEQ ID NO: 78901 - DNA, 22 bp, Artificial Sequence
  Synthetic oligonucleotide; TTA chr11 5197436 5197457 5197453 5197458 +
tttcaaactattttggttcaca

SEQ ID NO: 78902 - DNA, 22 bp, Artificial Sequence
  Synthetic oligonucleotide; TTT chr11 5197439 5197460 5197456 5197461 +
caaactattttggttcacattc

SEQ ID NO: 78903 - DNA, 22 bp, Artificial Sequence
  Synthetic oligonucleotide; TTC chr11 5197440 5197461 5197457 5197462 +
aaactattttggttcacattct

SEQ ID NO: 78904 - DNA, 22 bp, Artificial Sequence
  Synthetic oligonucleotide; CTA chr11 5197446 5197467 5197463 5197468 +
ttttggttcacattctataggt

SEQ ID NO: 78905 - DNA, 22 bp, Artificial Sequence
  Synthetic oligonucleotide; TTT chr11 5197449 5197470 5197466 5197471 +
tggttcacattctataggttgc

SEQ ID NO: 78906 - DNA, 22 bp, Artificial Sequence
  Synthetic oligonucleotide; TTT chr11 5197450 5197471 5197467 5197472 +
ggttcacattctataggttgcc

SEQ ID NO: 78907 - DNA, 22 bp, Artificial Sequence
  Synthetic oligonucleotide; TTG chr11 5197451 5197472 5197468 5197473 +
gttcacattctataggttgcct

SEQ ID NO: 78908 - DNA, 22 bp, Artificial Sequence
  Synthetic oligonucleotide; TTC chr11 5197455 5197476 5197472 5197477 +
acattctataggttgcctaatc

SEQ ID NO: 78909 - DNA, 22 bp, Artificial Sequence
  Synthetic oligonucleotide; TTC chr11 5197461 5197482 5197478 5197483 +
tataggttgcctaatctgaagc

SEQ ID NO: 78910 - DNA, 22 bp, Artificial Sequence
  Synthetic oligonucleotide; CTA chr11 5197463 5197484 5197480 5197485 +
taggttgcctaatctgaagcac

SEQ ID NO: 78911 - DNA, 22 bp, Artificial Sequence
  Synthetic oligonucleotide; TTG chr11 5197470 5197491 5197487 5197492 +
cctaatctgaagcacaaacact

SEQ ID NO: 78912 - DNA, 22 bp, Artificial Sequence
  Synthetic oligonucleotide; CTA chr11 5197474 5197495 5197491 5197496 +
atctgaagcacaaacactcata

SEQ ID NO: 78913 - DNA, 22 bp, Artificial Sequence
  Synthetic oligonucleotide; CTG chr11 5197479 5197500 5197496 5197501 +
aagcacaaacactcatagtatg

SEQ ID NO: 78914 - DNA, 22 bp, Artificial Sequence
  Synthetic oligonucleotide; CTC chr11 5197493 5197514 5197510 5197515 +
atagtatgaagtcttcagatga

SEQ ID NO: 78915 - DNA, 22 bp, Artificial Sequence
  Synthetic oligonucleotide; CTT chr11 5197508 5197529 5197525 5197530 +
cagatgagccttcctactctcc

SEQ ID NO: 78916 - DNA, 22 bp, Artificial Sequence
  Synthetic oligonucleotide; TTC chr11 5197509 5197530 5197526 5197531 +
agatgagccttcctactctccc

SEQ ID NO: 78917 - DNA, 22 bp, Artificial Sequence
  Synthetic oligonucleotide; CTT chr11 5197520 5197541 5197537 5197542 +
cctactctccctgttaaacata

SEQ ID NO: 78918 - DNA, 22 bp, Artificial Sequence
  Synthetic oligonucleotide; TTC chr11 5197521 5197542 5197538 5197543 +
ctactctccctgttaaacataa

SEQ ID NO: 78919 - DNA, 22 bp, Artificial Sequence
  Synthetic oligonucleotide; CTA chr11 5197524 5197545 5197541 5197546 +
ctctccctgttaaacataactc

SEQ ID NO: 78920 - DNA, 22 bp, Artificial Sequence
  Synthetic oligonucleotide; CTC chr11 5197527 5197548 5197544 5197549 +
tccctgttaaacataactctca

SEQ ID NO: 78921 - DNA, 22 bp, Artificial Sequence
  Synthetic oligonucleotide; CTC chr11 5197529 5197550 5197546 5197551 +
cctgttaaacataactctcaaa

SEQ ID NO: 78922 - DNA, 22 bp, Artificial Sequence
  Synthetic oligonucleotide; CTG chr11 5197533 5197554 5197550 5197555 +
ttaaacataactctcaaaccaa

SEQ ID NO: 78923 - DNA, 22 bp, Artificial Sequence
  Synthetic oligonucleotide; TTA chr11 5197536 5197557 5197553 5197558 +
aacataactctcaaaccaacaa

SEQ ID NO: 78924 - DNA, 22 bp, Artificial Sequence
  Synthetic oligonucleotide; CTC chr11 5197546 5197567 5197563 5197568 +
tcaaaccaacaactcagttgtg

SEQ ID NO: 78925 - DNA, 22 bp, Artificial Sequence
  Synthetic oligonucleotide; CTC chr11 5197548 5197569 5197565 5197570 +
aaaccaacaactcagttgtgtc

SEQ ID NO: 78926 - DNA, 22 bp, Artificial Sequence
  Synthetic oligonucleotide; CTC chr11 5197561 5197582 5197578 5197583 +
agttgtgtcagacatgtaatat

SEQ ID NO: 78927 - DNA, 22 bp, Artificial Sequence
  Synthetic oligonucleotide; TTG chr11 5197566 5197587 5197583 5197588 +
tgtcagacatgtaatattgttc

SEQ ID NO: 78928 - DNA, 22 bp, Artificial Sequence
  Synthetic oligonucleotide; TTG chr11 5197585 5197606 5197602 5197607 +
ttcaaataataaatataaattc

SEQ ID NO: 78929 - DNA, 22 bp, Artificial Sequence
  Synthetic oligonucleotide; TTC chr11 5197588 5197609 5197605 5197610 +
aaataataaatataaattcatt

SEQ ID NO: 78930 - DNA, 22 bp, Artificial Sequence
  Synthetic oligonucleotide; TTC chr11 5197607 5197628 5197624 5197629 +
attctgatgcttccctatgagt

SEQ ID NO: 78931 - DNA, 22 bp, Artificial Sequence
  Synthetic oligonucleotide; TTC chr11 5197611 5197632 5197628 5197633 +
tgatgcttccctatgagtggct

SEQ ID NO: 78932 - DNA, 22 bp, Artificial Sequence
  Synthetic oligonucleotide; CTG chr11 5197613 5197634 5197630 5197635 +
atgcttccctatgagtggctgg

SEQ ID NO: 78933 - DNA, 22 bp, Artificial Sequence
  Synthetic oligonucleotide; CTT chr11 5197619 5197640 5197636 5197641 +
ccctatgagtggctggtggaaa

SEQ ID NO: 78934 - DNA, 22 bp, Artificial Sequence
  Synthetic oligonucleotide; TTC chr11 5197620 5197641 5197637 5197642 +
cctatgagtggctggtggaaaa

SEQ ID NO: 78935 - DNA, 22 bp, Artificial Sequence
  Synthetic oligonucleotide; CTA chr11 5197624 5197645 5197641 5197646 +
tgagtggctggtggaaaacata

SEQ ID NO: 78936 - DNA, 22 bp, Artificial Sequence
  Synthetic oligonucleotide; CTG chr11 5197634 5197655 5197651 5197656 +
gtggaaaacatattgtcagttg

SEQ ID NO: 78937 - DNA, 22 bp, Artificial Sequence
  Synthetic oligonucleotide; TTG chr11 5197649 5197670 5197666 5197671 +
tcagttgttgaagaattctctg

SEQ ID NO: 78938 - DNA, 22 bp, Artificial Sequence
  Synthetic oligonucleotide; TTG chr11 5197656 5197677 5197673 5197678 +
ttgaagaattctctgcttcccc

SEQ ID NO: 78939 - DNA, 22 bp, Artificial Sequence
  Synthetic oligonucleotide; TTG chr11 5197659 5197680 5197676 5197681 +
aagaattctctgcttccccagt

SEQ ID NO: 78940 - DNA, 22 bp, Artificial Sequence
  Synthetic oligonucleotide; TTC chr11 5197667 5197688 5197684 5197689 +
tctgcttccccagtgttgtgtc

SEQ ID NO: 78941 - DNA, 22 bp, Artificial Sequence
  Synthetic oligonucleotide; CTC chr11 5197669 5197690 5197686 5197691 +
tgcttccccagtgttgtgtcag

SEQ ID NO: 78942 - DNA, 22 bp, Artificial Sequence
  Synthetic oligonucleotide; CTG chr11 5197671 5197692 5197688 5197693 +
cttccccagtgttgtgtcagct

SEQ ID NO: 78943 - DNA, 22 bp, Artificial Sequence
  Synthetic oligonucleotide; CTT chr11 5197674 5197695 5197691 5197696 +
ccccagtgttgtgtcagctctc

SEQ ID NO: 78944 - DNA, 22 bp, Artificial Sequence
  Synthetic oligonucleotide; TTC chr11 5197675 5197696 5197692 5197697 +
cccagtgttgtgtcagctctcc

SEQ ID NO: 78945 - DNA, 22 bp, Artificial Sequence
  Synthetic oligonucleotide; TTG chr11 5197685 5197706 5197702 5197707 +
tgtcagctctccggcgtatggg

SEQ ID NO: 78946 - DNA, 22 bp, Artificial Sequence
  Synthetic oligonucleotide; CTC chr11 5197694 5197715 5197711 5197716 +
tccggcgtatgggagggtggat

SEQ ID NO: 78947 - DNA, 22 bp, Artificial Sequence
  Synthetic oligonucleotide; CTC chr11 5197696 5197717 5197713 5197718 +
cggcgtatgggagggtggatgc

SEQ ID NO: 78948 - DNA, 22 bp, Artificial Sequence
  Synthetic oligonucleotide; CTT chr11 5197720 5197741 5197737 5197742 +
attcactttcaaagcattagaa

SEQ ID NO: 78949 - DNA, 22 bp, Artificial Sequence
  Synthetic oligonucleotide; TTA chr11 5197721 5197742 5197738 5197743 +
ttcactttcaaagcattagaag

SEQ ID NO: 78950 - DNA, 22 bp, Artificial Sequence
  Synthetic oligonucleotide; TTC chr11 5197724 5197745 5197741 5197746 +
actttcaaagcattagaaggaa

SEQ ID NO: 78951 - DNA, 22 bp, Artificial Sequence
  Synthetic oligonucleotide; CTT chr11 5197728 5197749 5197745 5197750 +
tcaaagcattagaaggaagctt

SEQ ID NO: 78952 - DNA, 22 bp, Artificial Sequence
  Synthetic oligonucleotide; TTT chr11 5197729 5197750 5197746 5197751 +
caaagcattagaaggaagcttc

SEQ ID NO: 78953 - DNA, 22 bp, Artificial Sequence
  Synthetic oligonucleotide; TTC chr11 5197730 5197751 5197747 5197752 +
aaagcattagaaggaagcttct

SEQ ID NO: 78954 - DNA, 22 bp, Artificial Sequence
  Synthetic oligonucleotide; TTA chr11 5197739 5197760 5197756 5197761 +
gaaggaagcttctttggccatt

SEQ ID NO: 78955 - DNA, 22 bp, Artificial Sequence
  Synthetic oligonucleotide; CTT chr11 5197750 5197771 5197767 5197772 +
ctttggccattgagaaatctat

SEQ ID NO: 78956 - DNA, 22 bp, Artificial Sequence
  Synthetic oligonucleotide; TTC chr11 5197751 5197772 5197768 5197773 +
tttggccattgagaaatctatg

SEQ ID NO: 78957 - DNA, 22 bp, Artificial Sequence
  Synthetic oligonucleotide; CTT chr11 5197753 5197774 5197770 5197775 +
tggccattgagaaatctatgag

SEQ ID NO: 78958 - DNA, 22 bp, Artificial Sequence
  Synthetic oligonucleotide; TTT chr11 5197754 5197775 5197771 5197776 +
ggccattgagaaatctatgaga

SEQ ID NO: 78959 - DNA, 22 bp, Artificial Sequence
  Synthetic oligonucleotide; TTG chr11 5197755 5197776 5197772 5197777 +
gccattgagaaatctatgagac

SEQ ID NO: 78960 - DNA, 22 bp, Artificial Sequence
  Synthetic oligonucleotide; TTG chr11 5197762 5197783 5197779 5197784 +
agaaatctatgagacattcaca

SEQ ID NO: 78961 - DNA, 22 bp, Artificial Sequence
  Synthetic oligonucleotide; CTA chr11 5197771 5197792 5197788 5197793 +
tgagacattcacatgacctcta

SEQ ID NO: 78962 - DNA, 22 bp, Artificial Sequence
  Synthetic oligonucleotide; TTC chr11 5197781 5197802 5197798 5197803 +
acatgacctctacagattcagc

SEQ ID NO: 78963 - DNA, 22 bp, Artificial Sequence
  Synthetic oligonucleotide; CTC chr11 5197791 5197812 5197808 5197813 +
tacagattcagcagctaacttc

SEQ ID NO: 78964 - DNA, 22 bp, Artificial Sequence
  Synthetic oligonucleotide; CTA chr11 5197793 5197814 5197810 5197815 +
cagattcagcagctaacttctc

SEQ ID NO: 78965 - DNA, 22 bp, Artificial Sequence
  Synthetic oligonucleotide; TTC chr11 5197800 5197821 5197817 5197822 +
agcagctaacttctcttttcat

SEQ ID NO: 78966 - DNA, 22 bp, Artificial Sequence
  Synthetic oligonucleotide; CTA chr11 5197808 5197829 5197825 5197830 +
acttctcttttcattataaaac

SEQ ID NO: 78967 - DNA, 22 bp, Artificial Sequence
  Synthetic oligonucleotide; CTT chr11 5197812 5197833 5197829 5197834 +
ctcttttcattataaaactggg

SEQ ID NO: 78968 - DNA, 22 bp, Artificial Sequence
  Synthetic oligonucleotide; TTC chr11 5197813 5197834 5197830 5197835 +
tcttttcattataaaactgggg

SEQ ID NO: 78969 - DNA, 22 bp, Artificial Sequence
  Synthetic oligonucleotide; CTC chr11 5197815 5197836 5197832 5197837 +
ttttcattataaaactggggca

SEQ ID NO: 78970 - DNA, 22 bp, Artificial Sequence
  Synthetic oligonucleotide; CTT chr11 5197817 5197838 5197834 5197839 +
ttcattataaaactggggcata

SEQ ID NO: 78971 - DNA, 22 bp, Artificial Sequence
  Synthetic oligonucleotide; TTT chr11 5197818 5197839 5197835 5197840 +
tcattataaaactggggcatag

SEQ ID NO: 78972 - DNA, 22 bp, Artificial Sequence
  Synthetic oligonucleotide; TTT chr11 5197819 5197840 5197836 5197841 +
cattataaaactggggcatagg

SEQ ID NO: 78973 - DNA, 22 bp, Artificial Sequence
  Synthetic oligonucleotide; TTC chr11 5197820 5197841 5197837 5197842 +
attataaaactggggcatagga

SEQ ID NO: 78974 - DNA, 22 bp, Artificial Sequence
  Synthetic oligonucleotide; TTA chr11 5197824 5197845 5197841 5197846 +
taaaactggggcataggaatct

SEQ ID NO: 78975 - DNA, 22 bp, Artificial Sequence
  Synthetic oligonucleotide; CTG chr11 5197832 5197853 5197849 5197854 +
gggcataggaatcttgtcagat

SEQ ID NO: 78976 - DNA, 22 bp, Artificial Sequence
  Synthetic oligonucleotide; CTT chr11 5197847 5197868 5197864 5197869 +
gtcagattggccacattccagt

SEQ ID NO: 78977 - DNA, 22 bp, Artificial Sequence
  Synthetic oligonucleotide; TTG chr11 5197848 5197869 5197865 5197870 +
tcagattggccacattccagtc

SEQ ID NO: 78978 - DNA, 22 bp, Artificial Sequence
  Synthetic oligonucleotide; TTG chr11 5197856 5197877 5197873 5197878 +
gccacattccagtcggccagga

SEQ ID NO: 78979 - DNA, 22 bp, Artificial Sequence
  Synthetic oligonucleotide; TTC chr11 5197865 5197886 5197882 5197887 +
cagtcggccaggagggaccatg

SEQ ID NO: 78980 - DNA, 22 bp, Artificial Sequence
  Synthetic oligonucleotide; TTT chr11 5197896 5197917 5197913 5197918 +
attatcattagggaacctggag

SEQ ID NO: 78981 - DNA, 22 bp, Artificial Sequence
  Synthetic oligonucleotide; TTA chr11 5197897 5197918 5197914 5197919 +
ttatcattagggaacctggagc

SEQ ID NO: 78982 - DNA, 22 bp, Artificial Sequence
  Synthetic oligonucleotide; TTA chr11 5197900 5197921 5197917 5197922 +
tcattagggaacctggagcagt

SEQ ID NO: 78983 - DNA, 22 bp, Artificial Sequence
  Synthetic oligonucleotide; TTA chr11 5197906 5197927 5197923 5197928 +
gggaacctggagcagtactacc

SEQ ID NO: 78984 - DNA, 22 bp, Artificial Sequence
  Synthetic oligonucleotide; CTG chr11 5197915 5197936 5197932 5197937 +
gagcagtactaccacctgacat

SEQ ID NO: 78985 - DNA, 22 bp, Artificial Sequence
  Synthetic oligonucleotide; CTA chr11 5197926 5197947 5197943 5197948 +
ccacctgacattcatatcaact

SEQ ID NO: 78986 - DNA, 22 bp, Artificial Sequence
  Synthetic oligonucleotide; CTG chr11 5197933 5197954 5197950 5197955 +
acattcatatcaacttttcttt

SEQ ID NO: 78987 - DNA, 22 bp, Artificial Sequence
  Synthetic oligonucleotide; TTC chr11 5197939 5197960 5197956 5197961 +
atatcaacttttcttttttttt

SEQ ID NO: 78988 - DNA, 22 bp, Artificial Sequence
  Synthetic oligonucleotide; CTT chr11 5197949 5197970 5197966 5197971 +
ttctttttttttctcttttttt

SEQ ID NO: 78989 - DNA, 22 bp, Artificial Sequence
  Synthetic oligonucleotide; TTT chr11 5197950 5197971 5197967 5197972 +
tctttttttttctctttttttt

SEQ ID NO: 78990 - DNA, 22 bp, Artificial Sequence
  Synthetic oligonucleotide; TTT chr11 5197951 5197972 5197968 5197973 +
ctttttttttctcttttttttt

SEQ ID NO: 78991 - DNA, 22 bp, Artificial Sequence
  Synthetic oligonucleotide; TTC chr11 5197952 5197973 5197969 5197974 +
tttttttttctctttttttttt

SEQ ID NO: 78992 - DNA, 22 bp, Artificial Sequence
  Synthetic oligonucleotide; CTT chr11 5197954 5197975 5197971 5197976 +
tttttttctctttttttttttt

SEQ ID NO: 78993 - DNA, 22 bp, Artificial Sequence
  Synthetic oligonucleotide; TTT chr11 5197955 5197976 5197972 5197977 +
ttttttctcttttttttttttt

SEQ ID NO: 78994 - DNA, 22 bp, Artificial Sequence
  Synthetic oligonucleotide; TTT chr11 5197956 5197977 5197973 5197978 +
tttttctctttttttttttttt

SEQ ID NO: 78995 - DNA, 22 bp, Artificial Sequence
  Synthetic oligonucleotide; TTT chr11 5197957 5197978 5197974 5197979 +
ttttctcttttttttttttttt

SEQ ID NO: 78996 - DNA, 22 bp, Artificial Sequence
  Synthetic oligonucleotide; TTT chr11 5197958 5197979 5197975 5197980 +
tttctctttttttttttttttt

SEQ ID NO: 78997 - DNA, 22 bp, Artificial Sequence
  Synthetic oligonucleotide; TTT chr11 5197959 5197980 5197976 5197981 +
ttctcttttttttttttttttt

SEQ ID NO: 78998 - DNA, 22 bp, Artificial Sequence
  Synthetic oligonucleotide; TTT chr11 5197960 5197981 5197977 5197982 +
tctctttttttttttttttttg

SEQ ID NO: 78999 - DNA, 22 bp, Artificial Sequence
  Synthetic oligonucleotide; TTT chr11 5197961 5197982 5197978 5197983 +
ctctttttttttttttttttga

SEQ ID NO: 79000 - DNA, 22 bp, Artificial Sequence
  Synthetic oligonucleotide; TTC chr11 5197962 5197983 5197979 5197984 +
tctttttttttttttttttgag

SEQ ID NO: 79001 - DNA, 22 bp, Artificial Sequence
  Synthetic oligonucleotide; CTC chr11 5197964 5197985 5197981 5197986 +
tttttttttttttttttgagac

SEQ ID NO: 79002 - DNA, 22 bp, Artificial Sequence
  Synthetic oligonucleotide; CTT chr11 5197966 5197987 5197983 5197988 +
tttttttttttttttgagacag

SEQ ID NO: 79003 - DNA, 22 bp, Artificial Sequence
  Synthetic oligonucleotide; TTT chr11 5197967 5197988 5197984 5197989 +
ttttttttttttttgagacaga

SEQ ID NO: 79004 - DNA, 22 bp, Artificial Sequence
  Synthetic oligonucleotide; TTT chr11 5197968 5197989 5197985 5197990 +
tttttttttttttgagacagag

SEQ ID NO: 79005 - DNA, 22 bp, Artificial Sequence
  Synthetic oligonucleotide; TTT chr11 5197969 5197990 5197986 5197991 +
ttttttttttttgagacagagt

SEQ ID NO: 79006 - DNA, 22 bp, Artificial Sequence
  Synthetic oligonucleotide; TTT chr11 5197970 5197991 5197987 5197992 +
tttttttttttgagacagagtc

SEQ ID NO: 79007 - DNA, 22 bp, Artificial Sequence
  Synthetic oligonucleotide; TTT chr11 5197971 5197992 5197988 5197993 +
ttttttttttgagacagagtct

SEQ ID NO: 79008 - DNA, 22 bp, Artificial Sequence
  Synthetic oligonucleotide; TTT chr11 5197972 5197993 5197989 5197994 +
tttttttttgagacagagtctc

SEQ ID NO: 79009 - DNA, 22 bp, Artificial Sequence
  Synthetic oligonucleotide; TTT chr11 5197973 5197994 5197990 5197995 +
ttttttttgagacagagtctct

SEQ ID NO: 79010 - DNA, 22 bp, Artificial Sequence
  Synthetic oligonucleotide; TTT chr11 5197974 5197995 5197991 5197996 +
tttttttgagacagagtctctc

SEQ ID NO: 79011 - DNA, 22 bp, Artificial Sequence
  Synthetic oligonucleotide; TTT chr11 5197975 5197996 5197992 5197997 +
ttttttgagacagagtctctct

SEQ ID NO: 79012 - DNA, 22 bp, Artificial Sequence
  Synthetic oligonucleotide; TTT chr11 5197976 5197997 5197993 5197998 +
tttttgagacagagtctctctc

SEQ ID NO: 79013 - DNA, 22 bp, Artificial Sequence
  Synthetic oligonucleotide; TTT chr11 5197977 5197998 5197994 5197999 +
ttttgagacagagtctctctct

SEQ ID NO: 79014 - DNA, 22 bp, Artificial Sequence
  Synthetic oligonucleotide; TTT chr11 5197978 5197999 5197995 5198000 +
tttgagacagagtctctctctg

SEQ ID NO: 79015 - DNA, 22 bp, Artificial Sequence
  Synthetic oligonucleotide; TTT chr11 5197979 5198000 5197996 5198001 +
ttgagacagagtctctctctgt

SEQ ID NO: 79016 - DNA, 22 bp, Artificial Sequence
  Synthetic oligonucleotide; TTT chr11 5197980 5198001 5197997 5198002 +
tgagacagagtctctctctgtc

SEQ ID NO: 79017 - DNA, 22 bp, Artificial Sequence
  Synthetic oligonucleotide; TTT chr11 5197981 5198002 5197998 5198003 +
gagacagagtctctctctgtcg

SEQ ID NO: 79018 - DNA, 22 bp, Artificial Sequence
  Synthetic oligonucleotide; TTG chr11 5197982 5198003 5197999 5198004 +
agacagagtctctctctgtcgc

SEQ ID NO: 79019 - DNA, 22 bp, Artificial Sequence
  Synthetic oligonucleotide; CTC chr11 5197994 5198015 5198011 5198016 +
tctctgtcgcccaggctggagt

SEQ ID NO: 79020 - DNA, 22 bp, Artificial Sequence
  Synthetic oligonucleotide; CTC chr11 5197996 5198017 5198013 5198018 +
tctgtcgcccaggctggagtgc

SEQ ID NO: 79021 - DNA, 22 bp, Artificial Sequence
  Synthetic oligonucleotide; CTC chr11 5197998 5198019 5198015 5198020 +
tgtcgcccaggctggagtgcag

SEQ ID NO: 79022 - DNA, 22 bp, Artificial Sequence
  Synthetic oligonucleotide; CTG chr11 5198000 5198021 5198017 5198022 +
tcgcccaggctggagtgcagtg

SEQ ID NO: 79023 - DNA, 22 bp, Artificial Sequence
  Synthetic oligonucleotide; CTG chr11 5198012 5198033 5198029 5198034 +
gagtgcagtggcgtgatctcga

SEQ ID NO: 79024 - DNA, 22 bp, Artificial Sequence
  Synthetic oligonucleotide; CTC chr11 5198032 5198053 5198049 5198054 +
gactcactgcaagctccacctc

SEQ ID NO: 79025 - DNA, 22 bp, Artificial Sequence
  Synthetic oligonucleotide; CTC chr11 5198037 5198058 5198054 5198059 +
actgcaagctccacctcccggg

SEQ ID NO: 79026 - DNA, 22 bp, Artificial Sequence
  Synthetic oligonucleotide; CTG chr11 5198041 5198062 5198058 5198063 +
caagctccacctcccgggttca

SEQ ID NO: 79027 - DNA, 22 bp, Artificial Sequence
  Synthetic oligonucleotide; CTC chr11 5198048 5198069 5198065 5198070 +
cacctcccgggttcacgccatt

SEQ ID NO: 79028 - DNA, 22 bp, Artificial Sequence
  Synthetic oligonucleotide; CTC chr11 5198054 5198075 5198071 5198076 +
ccgggttcacgccattctcctg

SEQ ID NO: 79029 - DNA, 22 bp, Artificial Sequence
  Synthetic oligonucleotide; TTC chr11 5198062 5198083 5198079 5198084 +
acgccattctcctgtctcagcc

SEQ ID NO: 79030 - DNA, 22 bp, Artificial Sequence
  Synthetic oligonucleotide; TTC chr11 5198071 5198092 5198088 5198093 +
tcctgtctcagcctcccgagta

SEQ ID NO: 79031 - DNA, 22 bp, Artificial Sequence
  Synthetic oligonucleotide; CTC chr11 5198073 5198094 5198090 5198095 +
ctgtctcagcctcccgagtacc

SEQ ID NO: 79032 - DNA, 22 bp, Artificial Sequence
  Synthetic oligonucleotide; CTG chr11 5198076 5198097 5198093 5198098 +
tctcagcctcccgagtacctgg

SEQ ID NO: 79033 - DNA, 22 bp, Artificial Sequence
  Synthetic oligonucleotide; CTC chr11 5198080 5198101 5198097 5198102 +
agcctcccgagtacctgggact

SEQ ID NO: 79034 - DNA, 22 bp, Artificial Sequence
  Synthetic oligonucleotide; CTC chr11 5198086 5198107 5198103 5198108 +
ccgagtacctgggactacaggt

SEQ ID NO: 79035 - DNA, 22 bp, Artificial Sequence
  Synthetic oligonucleotide; CTG chr11 5198097 5198118 5198114 5198119 +
ggactacaggtgcccgccacca

SEQ ID NO: 79036 - DNA, 22 bp, Artificial Sequence
  Synthetic oligonucleotide; CTA chr11 5198103 5198124 5198120 5198125 +
caggtgcccgccaccacgcctg

SEQ ID NO: 79037 - DNA, 22 bp, Artificial Sequence
  Synthetic oligonucleotide; CTG chr11 5198125 5198146 5198142 5198147 +
gatactttcttgtgttttttta

SEQ ID NO: 79038 - DNA, 22 bp, Artificial Sequence
  Synthetic oligonucleotide; CTT chr11 5198132 5198153 5198149 5198154 +
tcttgtgtttttttagtagaga

SEQ ID NO: 79039 - DNA, 22 bp, Artificial Sequence
  Synthetic oligonucleotide; TTT chr11 5198133 5198154 5198150 5198155 +
cttgtgtttttttagtagagac

SEQ ID NO: 79040 - DNA, 22 bp, Artificial Sequence
  Synthetic oligonucleotide; TTC chr11 5198134 5198155 5198151 5198156 +
ttgtgtttttttagtagagacg

SEQ ID NO: 79041 - DNA, 22 bp, Artificial Sequence
  Synthetic oligonucleotide; CTT chr11 5198136 5198157 5198153 5198158 +
gtgtttttttagtagagacggg

SEQ ID NO: 79042 - DNA, 22 bp, Artificial Sequence
  Synthetic oligonucleotide; TTG chr11 5198137 5198158 5198154 5198159 +
tgtttttttagtagagacgggg

SEQ ID NO: 79043 - DNA, 22 bp, Artificial Sequence
  Synthetic oligonucleotide; TTT chr11 5198142 5198163 5198159 5198164 +
ttttagtagagacggggtttca

SEQ ID NO: 79044 - DNA, 22 bp, Artificial Sequence
  Synthetic oligonucleotide; TTT chr11 5198143 5198164 5198160 5198165 +
tttagtagagacggggtttcac

SEQ ID NO: 79045 - DNA, 22 bp, Artificial Sequence
  Synthetic oligonucleotide; TTT chr11 5198144 5198165 5198161 5198166 +
ttagtagagacggggtttcacc

SEQ ID NO: 79046 - DNA, 22 bp, Artificial Sequence
  Synthetic oligonucleotide; TTT chr11 5198145 5198166 5198162 5198167 +
tagtagagacggggtttcacca

SEQ ID NO: 79047 - DNA, 22 bp, Artificial Sequence
  Synthetic oligonucleotide; TTT chr11 5198146 5198167 5198163 5198168 +
agtagagacggggtttcaccat

SEQ ID NO: 79048 - DNA, 22 bp, Artificial Sequence
  Synthetic oligonucleotide; TTA chr11 5198147 5198168 5198164 5198169 +
gtagagacggggtttcaccatt

SEQ ID NO: 79049 - DNA, 22 bp, Artificial Sequence
  Synthetic oligonucleotide; TTT chr11 5198162 5198183 5198179 5198184 +
caccattgctggccaggatggt

SEQ ID NO: 79050 - DNA, 22 bp, Artificial Sequence
  Synthetic oligonucleotide; TTC chr11 5198163 5198184 5198180 5198185 +
accattgctggccaggatggtc

SEQ ID NO: 79051 - DNA, 22 bp, Artificial Sequence
  Synthetic oligonucleotide; TTG chr11 5198170 5198191 5198187 5198192 +
ctggccaggatggtctcgatct

SEQ ID NO: 79052 - DNA, 22 bp, Artificial Sequence
  Synthetic oligonucleotide; CTG chr11 5198173 5198194 5198190 5198195 +
gccaggatggtctcgatctcct

SEQ ID NO: 79053 - DNA, 22 bp, Artificial Sequence
  Synthetic oligonucleotide; CTC chr11 5198187 5198208 5198204 5198209 +
gatctcctgacctcatgatccg

SEQ ID NO: 79054 - DNA, 22 bp, Artificial Sequence
  Synthetic oligonucleotide; CTC chr11 5198193 5198214 5198210 5198215 +
ctgacctcatgatccgcccgcc

SEQ ID NO: 79055 - DNA, 22 bp, Artificial Sequence
  Synthetic oligonucleotide; CTG chr11 5198196 5198217 5198213 5198218 +
acctcatgatccgcccgcctcg

SEQ ID NO: 79056 - DNA, 22 bp, Artificial Sequence
  Synthetic oligonucleotide; CTC chr11 5198201 5198222 5198218 5198223 +
atgatccgcccgcctcggcagc

SEQ ID NO: 79057 - DNA, 22 bp, Artificial Sequence
  Synthetic oligonucleotide; CTC chr11 5198217 5198238 5198234 5198239 +
ggcagctactatgattatatag

SEQ ID NO: 79058 - DNA, 22 bp, Artificial Sequence
  Synthetic oligonucleotide; CTA chr11 5198225 5198246 5198242 5198247 +
ctatgattatatagtaaaaaat

SEQ ID NO: 79059 - DNA, 22 bp, Artificial Sequence
  Synthetic oligonucleotide; CTA chr11 5198228 5198249 5198245 5198250 +
tgattatatagtaaaaaatata

SEQ ID NO: 79060 - DNA, 22 bp, Artificial Sequence
  Synthetic oligonucleotide; TTA chr11 5198234 5198255 5198251 5198256 +
tatagtaaaaaatatatatatt

SEQ ID NO: 79061 - DNA, 22 bp, Artificial Sequence
  Synthetic oligonucleotide; TTG chr11 5198257 5198278 5198274 5198279 +
acattttcccctctagaaccta

SEQ ID NO: 79062 - DNA, 22 bp, Artificial Sequence
  Synthetic oligonucleotide; TTT chr11 5198263 5198284 5198280 5198285 +
tcccctctagaacctacctcac

SEQ ID NO: 79063 - DNA, 22 bp, Artificial Sequence
  Synthetic oligonucleotide; TTT chr11 5198264 5198285 5198281 5198286 +
cccctctagaacctacctcaca

SEQ ID NO: 79064 - DNA, 22 bp, Artificial Sequence
  Synthetic oligonucleotide; TTC chr11 5198265 5198286 5198282 5198287 +
ccctctagaacctacctcacag

SEQ ID NO: 79065 - DNA, 22 bp, Artificial Sequence
  Synthetic oligonucleotide; CTC chr11 5198270 5198291 5198287 5198292 +
tagaacctacctcacagttttc

SEQ ID NO: 79066 - DNA, 22 bp, Artificial Sequence
  Synthetic oligonucleotide; CTA chr11 5198272 5198293 5198289 5198294 +
gaacctacctcacagttttcac

SEQ ID NO: 79067 - DNA, 22 bp, Artificial Sequence
  Synthetic oligonucleotide; CTA chr11 5198279 5198300 5198296 5198301 +
cctcacagttttcacttctgat

SEQ ID NO: 79068 - DNA, 22 bp, Artificial Sequence
  Synthetic oligonucleotide; CTC chr11 5198283 5198304 5198300 5198305 +
acagttttcacttctgatagct

SEQ ID NO: 79069 - DNA, 22 bp, Artificial Sequence
  Synthetic oligonucleotide; TTT chr11 5198290 5198311 5198307 5198312 +
tcacttctgatagctataccag

SEQ ID NO: 79070 - DNA, 22 bp, Artificial Sequence
  Synthetic oligonucleotide; TTT chr11 5198291 5198312 5198308 5198313 +
cacttctgatagctataccaga

SEQ ID NO: 79071 - DNA, 22 bp, Artificial Sequence
  Synthetic oligonucleotide; TTC chr11 5198292 5198313 5198309 5198314 +
acttctgatagctataccagaa

SEQ ID NO: 79072 - DNA, 22 bp, Artificial Sequence
  Synthetic oligonucleotide; CTT chr11 5198296 5198317 5198313 5198318 +
ctgatagctataccagaagatg

SEQ ID NO: 79073 - DNA, 22 bp, Artificial Sequence
  Synthetic oligonucleotide; TTC chr11 5198297 5198318 5198314 5198319 +
tgatagctataccagaagatgc

SEQ ID NO: 79074 - DNA, 22 bp, Artificial Sequence
  Synthetic oligonucleotide; CTG chr11 5198299 5198320 5198316 5198321 +
atagctataccagaagatgcac

SEQ ID NO: 79075 - DNA, 22 bp, Artificial Sequence
  Synthetic oligonucleotide; CTA chr11 5198306 5198327 5198323 5198328 +
taccagaagatgcactagatcc

SEQ ID NO: 79076 - DNA, 22 bp, Artificial Sequence
  Synthetic oligonucleotide; CTA chr11 5198323 5198344 5198340 5198345 +
gatcctctttgacatcaggaaa

SEQ ID NO: 79077 - DNA, 22 bp, Artificial Sequence
  Synthetic oligonucleotide; CTC chr11 5198330 5198351 5198347 5198352 +
tttgacatcaggaaattcactc

SEQ ID NO: 79078 - DNA, 22 bp, Artificial Sequence
  Synthetic oligonucleotide; CTT chr11 5198332 5198353 5198349 5198354 +
tgacatcaggaaattcactcct

SEQ ID NO: 79079 - DNA, 22 bp, Artificial Sequence
  Synthetic oligonucleotide; TTT chr11 5198333 5198354 5198350 5198355 +
gacatcaggaaattcactcctt

SEQ ID NO: 79080 - DNA, 22 bp, Artificial Sequence
  Synthetic oligonucleotide; TTG chr11 5198334 5198355 5198351 5198356 +
acatcaggaaattcactccttt

SEQ ID NO: 79081 - DNA, 22 bp, Artificial Sequence
  Synthetic oligonucleotide; TTC chr11 5198348 5198369 5198365 5198370 +
actcctttatccttcaaattaa

SEQ ID NO: 79082 - DNA, 22 bp, Artificial Sequence
  Synthetic oligonucleotide; CTC chr11 5198352 5198373 5198369 5198374 +
ctttatccttcaaattaacctt

SEQ ID NO: 79083 - DNA, 22 bp, Artificial Sequence
  Synthetic oligonucleotide; CTT chr11 5198355 5198376 5198372 5198377 +
tatccttcaaattaaccttata

SEQ ID NO: 79084 - DNA, 22 bp, Artificial Sequence
  Synthetic oligonucleotide; TTT chr11 5198356 5198377 5198373 5198378 +
atccttcaaattaaccttatac

SEQ ID NO: 79085 - DNA, 22 bp, Artificial Sequence
  Synthetic oligonucleotide; TTA chr11 5198357 5198378 5198374 5198379 +
tccttcaaattaaccttatact

SEQ ID NO: 79086 - DNA, 22 bp, Artificial Sequence
  Synthetic oligonucleotide; CTT chr11 5198362 5198383 5198379 5198384 +
caaattaaccttatactgtaac

SEQ ID NO: 79087 - DNA, 22 bp, Artificial Sequence
  Synthetic oligonucleotide; TTC chr11 5198363 5198384 5198380 5198385 +
aaattaaccttatactgtaacc

SEQ ID NO: 79088 - DNA, 22 bp, Artificial Sequence
  Synthetic oligonucleotide; TTA chr11 5198369 5198390 5198386 5198391 +
accttatactgtaacccagaag

SEQ ID NO: 79089 - DNA, 22 bp, Artificial Sequence
  Synthetic oligonucleotide; CTT chr11 5198374 5198395 5198391 5198396 +
atactgtaacccagaagaccta

SEQ ID NO: 79090 - DNA, 22 bp, Artificial Sequence
  Synthetic oligonucleotide; TTA chr11 5198375 5198396 5198392 5198397 +
tactgtaacccagaagacctaa

SEQ ID NO: 79091 - DNA, 22 bp, Artificial Sequence
  Synthetic oligonucleotide; CTG chr11 5198380 5198401 5198397 5198402 +
taacccagaagacctaatttat

SEQ ID NO: 79092 - DNA, 22 bp, Artificial Sequence
  Synthetic oligonucleotide; CTA chr11 5198396 5198417 5198413 5198418 +
atttattgttctaggaataatt

SEQ ID NO: 79093 - DNA, 22 bp, Artificial Sequence
  Synthetic oligonucleotide; TTT chr11 5198400 5198421 5198417 5198422 +
attgttctaggaataattttac

SEQ ID NO: 79094 - DNA, 22 bp, Artificial Sequence
  Synthetic oligonucleotide; TTA chr11 5198401 5198422 5198418 5198423 +
ttgttctaggaataattttaca

SEQ ID NO: 79095 - DNA, 22 bp, Artificial Sequence
  Synthetic oligonucleotide; TTG chr11 5198404 5198425 5198421 5198426 +
ttctaggaataattttacactt

SEQ ID NO: 79096 - DNA, 22 bp, Artificial Sequence
  Synthetic oligonucleotide; TTC chr11 5198407 5198428 5198424 5198429 +
taggaataattttacacttatc

SEQ ID NO: 79097 - DNA, 22 bp, Artificial Sequence
  Synthetic oligonucleotide; CTA chr11 5198409 5198430 5198426 5198431 +
ggaataattttacacttatctt

SEQ ID NO: 79098 - DNA, 22 bp, Artificial Sequence
  Synthetic oligonucleotide; TTT chr11 5198419 5198440 5198436 5198441 +
tacacttatctttctaaccaga

SEQ ID NO: 79099 - DNA, 22 bp, Artificial Sequence
  Synthetic oligonucleotide; TTT chr11 5198420 5198441 5198437 5198442 +
acacttatctttctaaccagat

SEQ ID NO: 79100 - DNA, 22 bp, Artificial Sequence
  Synthetic oligonucleotide; TTA chr11 5198421 5198442 5198438 5198443 +
cacttatctttctaaccagata

SEQ ID NO: 79101 - DNA, 22 bp, Artificial Sequence
  Synthetic oligonucleotide; CTT chr11 5198426 5198447 5198443 5198448 +
atctttctaaccagatacttta

SEQ ID NO: 79102 - DNA, 22 bp, Artificial Sequence
  Synthetic oligonucleotide; TTA chr11 5198427 5198448 5198444 5198449 +
tctttctaaccagatactttac

SEQ ID NO: 79103 - DNA, 22 bp, Artificial Sequence
  Synthetic oligonucleotide; CTT chr11 5198431 5198452 5198448 5198453 +
tctaaccagatactttactctg

SEQ ID NO: 79104 - DNA, 22 bp, Artificial Sequence
  Synthetic oligonucleotide; TTT chr11 5198432 5198453 5198449 5198454 +
ctaaccagatactttactctgt

SEQ ID NO: 79105 - DNA, 22 bp, Artificial Sequence
  Synthetic oligonucleotide; TTC chr11 5198433 5198454 5198450 5198455 +
taaccagatactttactctgtc

SEQ ID NO: 79106 - DNA, 22 bp, Artificial Sequence
  Synthetic oligonucleotide; CTA chr11 5198435 5198456 5198452 5198457 +
accagatactttactctgtcca

SEQ ID NO: 79107 - DNA, 22 bp, Artificial Sequence
  Synthetic oligonucleotide; CTT chr11 5198446 5198467 5198463 5198468 +
tactctgtccagaaacaatttc

SEQ ID NO: 79108 - DNA, 22 bp, Artificial Sequence
  Synthetic oligonucleotide; TTT chr11 5198447 5198468 5198464 5198469 +
actctgtccagaaacaatttcc

SEQ ID NO: 79109 - DNA, 22 bp, Artificial Sequence
  Synthetic oligonucleotide; TTA chr11 5198448 5198469 5198465 5198470 +
ctctgtccagaaacaatttcct

SEQ ID NO: 79110 - DNA, 22 bp, Artificial Sequence
  Synthetic oligonucleotide; CTC chr11 5198451 5198472 5198468 5198473 +
tgtccagaaacaatttcctcac

SEQ ID NO: 79111 - DNA, 22 bp, Artificial Sequence
  Synthetic oligonucleotide; CTG chr11 5198453 5198474 5198470 5198475 +
tccagaaacaatttcctcactt

SEQ ID NO: 79112 - DNA, 22 bp, Artificial Sequence
  Synthetic oligonucleotide; TTT chr11 5198467 5198488 5198484 5198489 +
cctcactttgaggcttaagcta

SEQ ID NO: 79113 - DNA, 22 bp, Artificial Sequence
  Synthetic oligonucleotide; TTC chr11 5198468 5198489 5198485 5198490 +
ctcactttgaggcttaagctat

SEQ ID NO: 79114 - DNA, 22 bp, Artificial Sequence
  Synthetic oligonucleotide; CTC chr11 5198471 5198492 5198488 5198493 +
actttgaggcttaagctattag

SEQ ID NO: 79115 - DNA, 22 bp, Artificial Sequence
  Synthetic oligonucleotide; CTT chr11 5198475 5198496 5198492 5198497 +
tgaggcttaagctattagaaac

SEQ ID NO: 79116 - DNA, 22 bp, Artificial Sequence
  Synthetic oligonucleotide; TTT chr11 5198476 5198497 5198493 5198498 +
gaggcttaagctattagaaacc

SEQ ID NO: 79117 - DNA, 22 bp, Artificial Sequence
  Synthetic oligonucleotide; TTG chr11 5198477 5198498 5198494 5198499 +
aggcttaagctattagaaacca

SEQ ID NO: 79118 - DNA, 22 bp, Artificial Sequence
  Synthetic oligonucleotide; CTT chr11 5198483 5198504 5198500 5198505 +
aagctattagaaaccaaagcct

SEQ ID NO: 79119 - DNA, 22 bp, Artificial Sequence
  Synthetic oligonucleotide; TTA chr11 5198484 5198505 5198501 5198506 +
agctattagaaaccaaagcctg

SEQ ID NO: 79120 - DNA, 22 bp, Artificial Sequence
  Synthetic oligonucleotide; CTA chr11 5198489 5198510 5198506 5198511 +
ttagaaaccaaagcctgtattt

SEQ ID NO: 79121 - DNA, 22 bp, Artificial Sequence
  Synthetic oligonucleotide; TTA chr11 5198492 5198513 5198509 5198514 +
gaaaccaaagcctgtatttttg

SEQ ID NO: 79122 - DNA, 22 bp, Artificial Sequence
  Synthetic oligonucleotide; CTG chr11 5198506 5198527 5198523 5198528 +
tatttttgtttccctctgagtc

SEQ ID NO: 79123 - DNA, 22 bp, Artificial Sequence
  Synthetic oligonucleotide; TTT chr11 5198511 5198532 5198528 5198533 +
ttgtttccctctgagtcaaata

SEQ ID NO: 79124 - DNA, 22 bp, Artificial Sequence
  Synthetic oligonucleotide; TTT chr11 5198512 5198533 5198529 5198534 +
tgtttccctctgagtcaaataa

SEQ ID NO: 79125 - DNA, 22 bp, Artificial Sequence
  Synthetic oligonucleotide; TTT chr11 5198513 5198534 5198530 5198535 +
gtttccctctgagtcaaataag

SEQ ID NO: 79126 - DNA, 22 bp, Artificial Sequence
  Synthetic oligonucleotide; TTG chr11 5198514 5198535 5198531 5198536 +
tttccctctgagtcaaataagt

SEQ ID NO: 79127 - DNA, 22 bp, Artificial Sequence
  Synthetic oligonucleotide; TTT chr11 5198517 5198538 5198534 5198539 +
ccctctgagtcaaataagtaga

SEQ ID NO: 79128 - DNA, 22 bp, Artificial Sequence
  Synthetic oligonucleotide; TTC chr11 5198518 5198539 5198535 5198540 +
cctctgagtcaaataagtagac

SEQ ID NO: 79129 - DNA, 22 bp, Artificial Sequence
  Synthetic oligonucleotide; CTC chr11 5198522 5198543 5198539 5198544 +
tgagtcaaataagtagacagag

SEQ ID NO: 79130 - DNA, 22 bp, Artificial Sequence
  Synthetic oligonucleotide; CTG chr11 5198524 5198545 5198541 5198546 +
agtcaaataagtagacagaggc

SEQ ID NO: 79131 - DNA, 22 bp, Artificial Sequence
  Synthetic oligonucleotide; CTA chr11 5198548 5198569 5198565 5198570 +
tgttattgaatgaagtccaaag

SEQ ID NO: 79132 - DNA, 22 bp, Artificial Sequence
  Synthetic oligonucleotide; TTA chr11 5198553 5198574 5198570 5198575 +
ttgaatgaagtccaaagtgaaa

SEQ ID NO: 79133 - DNA, 22 bp, Artificial Sequence
  Synthetic oligonucleotide; TTG chr11 5198556 5198577 5198573 5198578 +
aatgaagtccaaagtgaaagga

SEQ ID NO: 79134 - DNA, 22 bp, Artificial Sequence
  Synthetic oligonucleotide; TTA chr11 5198594 5198615 5198611 5198616 +
caggaagacaaatctggttgtt

SEQ ID NO: 79135 - DNA, 22 bp, Artificial Sequence
  Synthetic oligonucleotide; CTG chr11 5198610 5198631 5198627 5198632 +
gttgttttagttgatatctaaa

SEQ ID NO: 79136 - DNA, 22 bp, Artificial Sequence
  Synthetic oligonucleotide; TTG chr11 5198614 5198635 5198631 5198636 +
ttttagttgatatctaaaaata

SEQ ID NO: 79137 - DNA, 22 bp, Artificial Sequence
  Synthetic oligonucleotide; TTT chr11 5198617 5198638 5198634 5198639 +
tagttgatatctaaaaataaaa

SEQ ID NO: 79138 - DNA, 22 bp, Artificial Sequence
  Synthetic oligonucleotide; TTT chr11 5198618 5198639 5198635 5198640 +
agttgatatctaaaaataaaaa

SEQ ID NO: 79139 - DNA, 22 bp, Artificial Sequence
  Synthetic oligonucleotide; TTA chr11 5198619 5198640 5198636 5198641 +
gttgatatctaaaaataaaaat

SEQ ID NO: 79140 - DNA, 22 bp, Artificial Sequence
  Synthetic oligonucleotide; TTG chr11 5198623 5198644 5198640 5198645 +
atatctaaaaataaaaataaat

SEQ ID NO: 79141 - DNA, 22 bp, Artificial Sequence
  Synthetic oligonucleotide; CTA chr11 5198630 5198651 5198647 5198652 +
aaaataaaaataaatatttgct

SEQ ID NO: 79142 - DNA, 22 bp, Artificial Sequence
  Synthetic oligonucleotide; TTT chr11 5198649 5198670 5198666 5198671 +
gctttttggtgtaaaatgactc

SEQ ID NO: 79143 - DNA, 22 bp, Artificial Sequence
  Synthetic oligonucleotide; TTG chr11 5198650 5198671 5198667 5198672 +
ctttttggtgtaaaatgactct

SEQ ID NO: 79144 - DNA, 22 bp, Artificial Sequence
  Synthetic oligonucleotide; CTT chr11 5198653 5198674 5198670 5198675 +
tttggtgtaaaatgactcttat

SEQ ID NO: 79145 - DNA, 22 bp, Artificial Sequence
  Synthetic oligonucleotide; TTT chr11 5198654 5198675 5198671 5198676 +
ttggtgtaaaatgactcttatg

SEQ ID NO: 79146 - DNA, 22 bp, Artificial Sequence
  Synthetic oligonucleotide; TTT chr11 5198655 5198676 5198672 5198677 +
tggtgtaaaatgactcttatgc

SEQ ID NO: 79147 - DNA, 22 bp, Artificial Sequence
  Synthetic oligonucleotide; TTT chr11 5198656 5198677 5198673 5198678 +
ggtgtaaaatgactcttatgca

SEQ ID NO: 79148 - DNA, 22 bp, Artificial Sequence
  Synthetic oligonucleotide; TTG chr11 5198657 5198678 5198674 5198679 +
gtgtaaaatgactcttatgcat

SEQ ID NO: 79149 - DNA, 22 bp, Artificial Sequence
  Synthetic oligonucleotide; CTC chr11 5198671 5198692 5198688 5198693 +
ttatgcattaatttgtccaatt

SEQ ID NO: 79150 - DNA, 22 bp, Artificial Sequence
  Synthetic oligonucleotide; CTT chr11 5198673 5198694 5198690 5198695 +
atgcattaatttgtccaatttt

SEQ ID NO: 79151 - DNA, 22 bp, Artificial Sequence
  Synthetic oligonucleotide; TTA chr11 5198674 5198695 5198691 5198696 +
tgcattaatttgtccaatttta

SEQ ID NO: 79152 - DNA, 22 bp, Artificial Sequence
  Synthetic oligonucleotide; TTA chr11 5198681 5198702 5198698 5198703 +
atttgtccaattttaacactta

SEQ ID NO: 79153 - DNA, 22 bp, Artificial Sequence
  Synthetic oligonucleotide; TTT chr11 5198685 5198706 5198702 5198707 +
gtccaattttaacacttacctt

SEQ ID NO: 79154 - DNA, 22 bp, Artificial Sequence
  Synthetic oligonucleotide; TTG chr11 5198686 5198707 5198703 5198708 +
tccaattttaacacttaccttc

SEQ ID NO: 79155 - DNA, 22 bp, Artificial Sequence
  Synthetic oligonucleotide; TTT chr11 5198694 5198715 5198711 5198716 +
taacacttaccttcttagatac

SEQ ID NO: 79156 - DNA, 22 bp, Artificial Sequence
  Synthetic oligonucleotide; TTT chr11 5198695 5198716 5198712 5198717 +
aacacttaccttcttagatacc

SEQ ID NO: 79157 - DNA, 22 bp, Artificial Sequence
  Synthetic oligonucleotide; TTA chr11 5198696 5198717 5198713 5198718 +
acacttaccttcttagatacct

SEQ ID NO: 79158 - DNA, 22 bp, Artificial Sequence
  Synthetic oligonucleotide; CTT chr11 5198702 5198723 5198719 5198724 +
accttcttagatacctaataga

SEQ ID NO: 79159 - DNA, 22 bp, Artificial Sequence
  Synthetic oligonucleotide; TTA chr11 5198703 5198724 5198720 5198725 +
ccttcttagatacctaatagaa

SEQ ID NO: 79160 - DNA, 22 bp, Artificial Sequence
  Synthetic oligonucleotide; CTT chr11 5198707 5198728 5198724 5198729 +
cttagatacctaatagaatata

SEQ ID NO: 79161 - DNA, 22 bp, Artificial Sequence
  Synthetic oligonucleotide; TTC chr11 5198708 5198729 5198725 5198730 +
ttagatacctaatagaatatag

SEQ ID NO: 79162 - DNA, 22 bp, Artificial Sequence
  Synthetic oligonucleotide; CTT chr11 5198710 5198731 5198727 5198732 +
agatacctaatagaatatagga

SEQ ID NO: 79163 - DNA, 22 bp, Artificial Sequence
  Synthetic oligonucleotide; TTA chr11 5198711 5198732 5198728 5198733 +
gatacctaatagaatataggaa

SEQ ID NO: 79164 - DNA, 22 bp, Artificial Sequence
  Synthetic oligonucleotide; CTA chr11 5198719 5198740 5198736 5198741 +
atagaatataggaagattaaaa

SEQ ID NO: 79165 - DNA, 22 bp, Artificial Sequence
  Synthetic oligonucleotide; TTA chr11 5198738 5198759 5198755 5198760 +
aaacaattattttcttgttatc

SEQ ID NO: 79166 - DNA, 22 bp, Artificial Sequence
  Synthetic oligonucleotide; TTA chr11 5198747 5198768 5198764 5198769 +
ttttcttgttatccatgcatag

SEQ ID NO: 79167 - DNA, 22 bp, Artificial Sequence
  Synthetic oligonucleotide; TTT chr11 5198750 5198771 5198767 5198772 +
tcttgttatccatgcatagttt

SEQ ID NO: 79168 - DNA, 22 bp, Artificial Sequence
  Synthetic oligonucleotide; TTT chr11 5198751 5198772 5198768 5198773 +
cttgttatccatgcatagtttt

SEQ ID NO: 79169 - DNA, 22 bp, Artificial Sequence
  Synthetic oligonucleotide; TTC chr11 5198752 5198773 5198769 5198774 +
ttgttatccatgcatagttttg

SEQ ID NO: 79170 - DNA, 22 bp, Artificial Sequence
  Synthetic oligonucleotide; CTT chr11 5198754 5198775 5198771 5198776 +
gttatccatgcatagttttgta

SEQ ID NO: 79171 - DNA, 22 bp, Artificial Sequence
  Synthetic oligonucleotide; TTG chr11 5198755 5198776 5198772 5198777 +
ttatccatgcatagttttgtac

SEQ ID NO: 79172 - DNA, 22 bp, Artificial Sequence
  Synthetic oligonucleotide; TTA chr11 5198758 5198779 5198775 5198780 +
tccatgcatagttttgtacctg

SEQ ID NO: 79173 - DNA, 22 bp, Artificial Sequence
  Synthetic oligonucleotide; TTT chr11 5198772 5198793 5198789 5198794 +
tgtacctgatttccttcctttc

SEQ ID NO: 79174 - DNA, 22 bp, Artificial Sequence
  Synthetic oligonucleotide; TTT chr11 5198773 5198794 5198790 5198795 +
gtacctgatttccttcctttct

SEQ ID NO: 79175 - DNA, 22 bp, Artificial Sequence
  Synthetic oligonucleotide; TTG chr11 5198774 5198795 5198791 5198796 +
tacctgatttccttcctttctt

SEQ ID NO: 79176 - DNA, 22 bp, Artificial Sequence
  Synthetic oligonucleotide; CTG chr11 5198780 5198801 5198797 5198802 +
atttccttcctttctttccttc

SEQ ID NO: 79177 - DNA, 22 bp, Artificial Sequence
  Synthetic oligonucleotide; TTT chr11 5198784 5198805 5198801 5198806 +
ccttcctttctttccttctttg

SEQ ID NO: 79178 - DNA, 22 bp, Artificial Sequence
  Synthetic oligonucleotide; TTC chr11 5198785 5198806 5198802 5198807 +
cttcctttctttccttctttgg

SEQ ID NO: 79179 - DNA, 22 bp, Artificial Sequence
  Synthetic oligonucleotide; CTT chr11 5198788 5198809 5198805 5198810 +
cctttctttccttctttggaaa

SEQ ID NO: 79180 - DNA, 22 bp, Artificial Sequence
  Synthetic oligonucleotide; TTC chr11 5198789 5198810 5198806 5198811 +
ctttctttccttctttggaaag

SEQ ID NO: 79181 - DNA, 22 bp, Artificial Sequence
  Synthetic oligonucleotide; CTT chr11 5198792 5198813 5198809 5198814 +
tctttccttctttggaaagctg

SEQ ID NO: 79182 - DNA, 22 bp, Artificial Sequence
  Synthetic oligonucleotide; TTT chr11 5198793 5198814 5198810 5198815 +
ctttccttctttggaaagctgc

SEQ ID NO: 79183 - DNA, 22 bp, Artificial Sequence
  Synthetic oligonucleotide; TTC chr11 5198794 5198815 5198811 5198816 +
tttccttctttggaaagctgca

SEQ ID NO: 79184 - DNA, 22 bp, Artificial Sequence
  Synthetic oligonucleotide; CTT chr11 5198796 5198817 5198813 5198818 +
tccttctttggaaagctgcact

SEQ ID NO: 79185 - DNA, 22 bp, Artificial Sequence
  Synthetic oligonucleotide; TTT chr11 5198797 5198818 5198814 5198819 +
ccttctttggaaagctgcacta

SEQ ID NO: 79186 - DNA, 22 bp, Artificial Sequence
  Synthetic oligonucleotide; TTC chr11 5198798 5198819 5198815 5198820 +
cttctttggaaagctgcactag

SEQ ID NO: 79187 - DNA, 22 bp, Artificial Sequence
  Synthetic oligonucleotide; CTT chr11 5198801 5198822 5198818 5198823 +
ctttggaaagctgcactagctt

SEQ ID NO: 79188 - DNA, 22 bp, Artificial Sequence
  Synthetic oligonucleotide; TTC chr11 5198802 5198823 5198819 5198824 +
tttggaaagctgcactagctta

SEQ ID NO: 79189 - DNA, 22 bp, Artificial Sequence
  Synthetic oligonucleotide; CTT chr11 5198804 5198825 5198821 5198826 +
tggaaagctgcactagcttact

SEQ ID NO: 79190 - DNA, 22 bp, Artificial Sequence
  Synthetic oligonucleotide; TTT chr11 5198805 5198826 5198822 5198827 +
ggaaagctgcactagcttactt

SEQ ID NO: 79191 - DNA, 22 bp, Artificial Sequence
  Synthetic oligonucleotide; TTG chr11 5198806 5198827 5198823 5198828 +
gaaagctgcactagcttactta

SEQ ID NO: 79192 - DNA, 22 bp, Artificial Sequence
  Synthetic oligonucleotide; CTG chr11 5198814 5198835 5198831 5198836 +
cactagcttacttagaaaagaa

SEQ ID NO: 79193 - DNA, 22 bp, Artificial Sequence
  Synthetic oligonucleotide; CTA chr11 5198819 5198840 5198836 5198841 +
gcttacttagaaaagaaccgct

SEQ ID NO: 79194 - DNA, 22 bp, Artificial Sequence
  Synthetic oligonucleotide; CTT chr11 5198823 5198844 5198840 5198845 +
acttagaaaagaaccgctttat

SEQ ID NO: 79195 - DNA, 22 bp, Artificial Sequence
  Synthetic oligonucleotide; TTA chr11 5198824 5198845 5198841 5198846 +
cttagaaaagaaccgctttatg

SEQ ID NO: 79196 - DNA, 22 bp, Artificial Sequence
  Synthetic oligonucleotide; CTT chr11 5198827 5198848 5198844 5198849 +
agaaaagaaccgctttatgttc

SEQ ID NO: 79197 - DNA, 22 bp, Artificial Sequence
  Synthetic oligonucleotide; TTA chr11 5198828 5198849 5198845 5198850 +
gaaaagaaccgctttatgttct

SEQ ID NO: 79198 - DNA, 22 bp, Artificial Sequence
  Synthetic oligonucleotide; CTT chr11 5198842 5198863 5198859 5198864 +
tatgttcttttatcttttttct

SEQ ID NO: 79199 - DNA, 22 bp, Artificial Sequence
  Synthetic oligonucleotide; TTT chr11 5198843 5198864 5198860 5198865 +
atgttcttttatcttttttctt

SEQ ID NO: 79200 - DNA, 22 bp, Artificial Sequence
  Synthetic oligonucleotide; TTA chr11 5198844 5198865 5198861 5198866 +
tgttcttttatcttttttcttt

SEQ ID NO: 79201 - DNA, 22 bp, Artificial Sequence
  Synthetic oligonucleotide; TTC chr11 5198849 5198870 5198866 5198871 +
ttttatcttttttcttttaaac

SEQ ID NO: 79202 - DNA, 22 bp, Artificial Sequence
  Synthetic oligonucleotide; CTT chr11 5198851 5198872 5198868 5198873 +
ttatcttttttcttttaaactc

SEQ ID NO: 79203 - DNA, 22 bp, Artificial Sequence
  Synthetic oligonucleotide; TTT chr11 5198852 5198873 5198869 5198874 +
tatcttttttcttttaaactca

SEQ ID NO: 79204 - DNA, 22 bp, Artificial Sequence
  Synthetic oligonucleotide; TTT chr11 5198853 5198874 5198870 5198875 +
atcttttttcttttaaactcag

SEQ ID NO: 79205 - DNA, 22 bp, Artificial Sequence
  Synthetic oligonucleotide; TTA chr11 5198854 5198875 5198871 5198876 +
tcttttttcttttaaactcaga

SEQ ID NO: 79206 - DNA, 22 bp, Artificial Sequence
  Synthetic oligonucleotide; CTT chr11 5198858 5198879 5198875 5198880 +
ttttcttttaaactcagaataa

SEQ ID NO: 79207 - DNA, 22 bp, Artificial Sequence
  Synthetic oligonucleotide; TTT chr11 5198859 5198880 5198876 5198881 +
tttcttttaaactcagaataag

SEQ ID NO: 79208 - DNA, 22 bp, Artificial Sequence
  Synthetic oligonucleotide; TTT chr11 5198860 5198881 5198877 5198882 +
ttcttttaaactcagaataagt

SEQ ID NO: 79209 - DNA, 22 bp, Artificial Sequence
  Synthetic oligonucleotide; TTT chr11 5198861 5198882 5198878 5198883 +
tcttttaaactcagaataagtc

SEQ ID NO: 79210 - DNA, 22 bp, Artificial Sequence
  Synthetic oligonucleotide; TTT chr11 5198862 5198883 5198879 5198884 +
cttttaaactcagaataagtcg

SEQ ID NO: 79211 - DNA, 22 bp, Artificial Sequence
  Synthetic oligonucleotide; TTC chr11 5198863 5198884 5198880 5198885 +
ttttaaactcagaataagtcgg

SEQ ID NO: 79212 - DNA, 22 bp, Artificial Sequence
  Synthetic oligonucleotide; CTT chr11 5198865 5198886 5198882 5198887 +
ttaaactcagaataagtcggta

SEQ ID NO: 79213 - DNA, 22 bp, Artificial Sequence
  Synthetic oligonucleotide; TTT chr11 5198866 5198887 5198883 5198888 +
taaactcagaataagtcggtag

SEQ ID NO: 79214 - DNA, 22 bp, Artificial Sequence
  Synthetic oligonucleotide; TTT chr11 5198867 5198888 5198884 5198889 +
aaactcagaataagtcggtagc

SEQ ID NO: 79215 - DNA, 22 bp, Artificial Sequence
  Synthetic oligonucleotide; TTA chr11 5198868 5198889 5198885 5198890 +
aactcagaataagtcggtagcg

SEQ ID NO: 79216 - DNA, 22 bp, Artificial Sequence
  Synthetic oligonucleotide; CTC chr11 5198873 5198894 5198890 5198895 +
agaataagtcggtagcggacag

SEQ ID NO: 79217 - DNA, 22 bp, Artificial Sequence
  Synthetic oligonucleotide; CTC chr11 5198899 5198920 5198916 5198921 +
atctgttcagaagatcccccac

SEQ ID NO: 79218 - DNA, 22 bp, Artificial Sequence
  Synthetic oligonucleotide; CTG chr11 5198904 5198925 5198921 5198926 +
ttcagaagatcccccacttaga

SEQ ID NO: 79219 - DNA, 22 bp, Artificial Sequence
  Synthetic oligonucleotide; TTC chr11 5198907 5198928 5198924 5198929 +
agaagatcccccacttagatat

SEQ ID NO: 79220 - DNA, 22 bp, Artificial Sequence
  Synthetic oligonucleotide; CTT chr11 5198923 5198944 5198940 5198945 +
agatataaaagcaaaagatcta

SEQ ID NO: 79221 - DNA, 22 bp, Artificial Sequence
  Synthetic oligonucleotide; TTA chr11 5198924 5198945 5198941 5198946 +
gatataaaagcaaaagatctag

SEQ ID NO: 79222 - DNA, 22 bp, Artificial Sequence
  Synthetic oligonucleotide; CTA chr11 5198945 5198966 5198962 5198967 +
gagcaaaatctgcttccagcct

SEQ ID NO: 79223 - DNA, 22 bp, Artificial Sequence
  Synthetic oligonucleotide; CTG chr11 5198957 5198978 5198974 5198979 +
cttccagccttgtagcagtgga

SEQ ID NO: 79224 - DNA, 22 bp, Artificial Sequence
  Synthetic oligonucleotide; CTT chr11 5198960 5198981 5198977 5198982 +
ccagccttgtagcagtggagtc

SEQ ID NO: 79225 - DNA, 22 bp, Artificial Sequence
  Synthetic oligonucleotide; TTC chr11 5198961 5198982 5198978 5198983 +
cagccttgtagcagtggagtcc

SEQ ID NO: 79226 - DNA, 22 bp, Artificial Sequence
  Synthetic oligonucleotide; CTT chr11 5198968 5198989 5198985 5198990 +
gtagcagtggagtccacatata

SEQ ID NO: 79227 - DNA, 22 bp, Artificial Sequence
  Synthetic oligonucleotide; TTG chr11 5198969 5198990 5198986 5198991 +
tagcagtggagtccacatataa

SEQ ID NO: 79228 - DNA, 22 bp, Artificial Sequence
  Synthetic oligonucleotide; CTA chr11 5198997 5199018 5199014 5199019 +
aaaaataaggattctaatttaa

SEQ ID NO: 79229 - DNA, 22 bp, Artificial Sequence
  Synthetic oligonucleotide; TTC chr11 5199011 5199032 5199028 5199033 +
taatttaaattagacatggtag

SEQ ID NO: 79230 - DNA, 22 bp, Artificial Sequence
  Synthetic oligonucleotide; CTA chr11 5199013 5199034 5199030 5199035 +
atttaaattagacatggtagaa

SEQ ID NO: 79231 - DNA, 22 bp, Artificial Sequence
  Synthetic oligonucleotide; TTT chr11 5199017 5199038 5199034 5199039 +
aaattagacatggtagaagttg

SEQ ID NO: 79232 - DNA, 22 bp, Artificial Sequence
  Synthetic oligonucleotide; TTA chr11 5199018 5199039 5199035 5199040 +
aattagacatggtagaagttga

SEQ ID NO: 79233 - DNA, 22 bp, Artificial Sequence
  Synthetic oligonucleotide; TTA chr11 5199023 5199044 5199040 5199045 +
gacatggtagaagttgaatcca

SEQ ID NO: 79234 - DNA, 22 bp, Artificial Sequence
  Synthetic oligonucleotide; TTG chr11 5199039 5199060 5199056 5199061 +
aatccaaagtcatatttctttg

SEQ ID NO: 79235 - DNA, 22 bp, Artificial Sequence
  Synthetic oligonucleotide; TTT chr11 5199056 5199077 5199073 5199078 +
ctttgtgtcctctttatgaact

SEQ ID NO: 79236 - DNA, 22 bp, Artificial Sequence
  Synthetic oligonucleotide; TTC chr11 5199057 5199078 5199074 5199079 +
tttgtgtcctctttatgaactg

SEQ ID NO: 79237 - DNA, 22 bp, Artificial Sequence
  Synthetic oligonucleotide; CTT chr11 5199059 5199080 5199076 5199081 +
tgtgtcctctttatgaactgta

SEQ ID NO: 79238 - DNA, 22 bp, Artificial Sequence
  Synthetic oligonucleotide; TTT chr11 5199060 5199081 5199077 5199082 +
gtgtcctctttatgaactgtag

SEQ ID NO: 79239 - DNA, 22 bp, Artificial Sequence
  Synthetic oligonucleotide; TTG chr11 5199061 5199082 5199078 5199083 +
tgtcctctttatgaactgtagc

SEQ ID NO: 79240 - DNA, 22 bp, Artificial Sequence
  Synthetic oligonucleotide; CTC chr11 5199068 5199089 5199085 5199090 +
tttatgaactgtagcttccctg

SEQ ID NO: 79241 - DNA, 22 bp, Artificial Sequence
  Synthetic oligonucleotide; CTT chr11 5199070 5199091 5199087 5199092 +
tatgaactgtagcttccctgtc

SEQ ID NO: 79242 - DNA, 22 bp, Artificial Sequence
  Synthetic oligonucleotide; TTT chr11 5199071 5199092 5199088 5199093 +
atgaactgtagcttccctgtcc

SEQ ID NO: 79243 - DNA, 22 bp, Artificial Sequence
  Synthetic oligonucleotide; TTA chr11 5199072 5199093 5199089 5199094 +
tgaactgtagcttccctgtcca

SEQ ID NO: 79244 - DNA, 22 bp, Artificial Sequence
  Synthetic oligonucleotide; CTG chr11 5199079 5199100 5199096 5199101 +
tagcttccctgtccaatatagt

SEQ ID NO: 79245 - DNA, 22 bp, Artificial Sequence
  Synthetic oligonucleotide; CTT chr11 5199085 5199106 5199102 5199107 +
ccctgtccaatatagtggctgc

SEQ ID NO: 79246 - DNA, 22 bp, Artificial Sequence
  Synthetic oligonucleotide; TTC chr11 5199086 5199107 5199103 5199108 +
cctgtccaatatagtggctgct

SEQ ID NO: 79247 - DNA, 22 bp, Artificial Sequence
  Synthetic oligonucleotide; CTG chr11 5199090 5199111 5199107 5199112 +
tccaatatagtggctgctgaac

SEQ ID NO: 79248 - DNA, 22 bp, Artificial Sequence
  Synthetic oligonucleotide; CTG chr11 5199106 5199127 5199123 5199128 +
ctgaactgaactgtccaataca

SEQ ID NO: 79249 - DNA, 22 bp, Artificial Sequence
  Synthetic oligonucleotide; CTG chr11 5199109 5199130 5199126 5199131 +
aactgaactgtccaatacaagg

SEQ ID NO: 79250 - DNA, 22 bp, Artificial Sequence
  Synthetic oligonucleotide; CTG chr11 5199114 5199135 5199131 5199136 +
aactgtccaatacaaggacatt

SEQ ID NO: 79251 - DNA, 22 bp, Artificial Sequence
  Synthetic oligonucleotide; CTG chr11 5199119 5199140 5199136 5199141 +
tccaatacaaggacattaaaca

SEQ ID NO: 79252 - DNA, 22 bp, Artificial Sequence
  Synthetic oligonucleotide; TTA chr11 5199137 5199158 5199154 5199159 +
aacatttaaatataaattaact

SEQ ID NO: 79253 - DNA, 22 bp, Artificial Sequence
  Synthetic oligonucleotide; TTT chr11 5199144 5199165 5199161 5199166 +
aaatataaattaacttaaagta

SEQ ID NO: 79254 - DNA, 22 bp, Artificial Sequence
  Synthetic oligonucleotide; TTA chr11 5199145 5199166 5199162 5199167 +
aatataaattaacttaaagtaa

SEQ ID NO: 79255 - DNA, 22 bp, Artificial Sequence
  Synthetic oligonucleotide; TTA chr11 5199156 5199177 5199173 5199178 +
acttaaagtaactgaaattgta

SEQ ID NO: 79256 - DNA, 22 bp, Artificial Sequence
  Synthetic oligonucleotide; CTT chr11 5199160 5199181 5199177 5199182 +
aaagtaactgaaattgtaaatg

SEQ ID NO: 79257 - DNA, 22 bp, Artificial Sequence
  Synthetic oligonucleotide; TTA chr11 5199161 5199182 5199178 5199183 +
aagtaactgaaattgtaaatgc

SEQ ID NO: 79258 - DNA, 22 bp, Artificial Sequence
  Synthetic oligonucleotide; CTG chr11 5199170 5199191 5199187 5199192 +
aaattgtaaatgcagttgttca

SEQ ID NO: 79259 - DNA, 22 bp, Artificial Sequence
  Synthetic oligonucleotide; TTG chr11 5199176 5199197 5199193 5199198 +
taaatgcagttgttcaattaca

SEQ ID NO: 79260 - DNA, 22 bp, Artificial Sequence
  Synthetic oligonucleotide; TTG chr11 5199188 5199209 5199205 5199210 +
ttcaattacactaccatcattt

SEQ ID NO: 79261 - DNA, 22 bp, Artificial Sequence
  Synthetic oligonucleotide; TTC chr11 5199191 5199212 5199208 5199213 +
aattacactaccatcatttcaa

SEQ ID NO: 79262 - DNA, 22 bp, Artificial Sequence
  Synthetic oligonucleotide; TTA chr11 5199196 5199217 5199213 5199218 +
cactaccatcatttcaagcgca

SEQ ID NO: 79263 - DNA, 22 bp, Artificial Sequence
  Synthetic oligonucleotide; CTA chr11 5199201 5199222 5199218 5199223 +
ccatcatttcaagcgcacagga

SEQ ID NO: 79264 - DNA, 22 bp, Artificial Sequence
  Synthetic oligonucleotide; TTT chr11 5199210 5199231 5199227 5199232 +
caagcgcacaggagccatatat

SEQ ID NO: 79265 - DNA, 22 bp, Artificial Sequence
  Synthetic oligonucleotide; TTC chr11 5199211 5199232 5199228 5199233 +
aagcgcacaggagccatatatt

SEQ ID NO: 79266 - DNA, 22 bp, Artificial Sequence
  Synthetic oligonucleotide; TTC chr11 5199234 5199255 5199251 5199256 +
cactttagccattttatggtat

SEQ ID NO: 79267 - DNA, 22 bp, Artificial Sequence
  Synthetic oligonucleotide; CTT chr11 5199239 5199260 5199256 5199261 +
tagccattttatggtattttat

SEQ ID NO: 79268 - DNA, 22 bp, Artificial Sequence
  Synthetic oligonucleotide; TTT chr11 5199240 5199261 5199257 5199262 +
agccattttatggtattttata

SEQ ID NO: 79269 - DNA, 22 bp, Artificial Sequence
  Synthetic oligonucleotide; TTA chr11 5199241 5199262 5199258 5199263 +
gccattttatggtattttatag

SEQ ID NO: 79270 - DNA, 22 bp, Artificial Sequence
  Synthetic oligonucleotide; TTT chr11 5199248 5199269 5199265 5199270 +
tatggtattttatagaacatcg

SEQ ID NO: 79271 - DNA, 22 bp, Artificial Sequence
  Synthetic oligonucleotide; TTT chr11 5199249 5199270 5199266 5199271 +
atggtattttatagaacatcgc

SEQ ID NO: 79272 - DNA, 22 bp, Artificial Sequence
  Synthetic oligonucleotide; TTA chr11 5199250 5199271 5199267 5199272 +
tggtattttatagaacatcgcc

SEQ ID NO: 79273 - DNA, 22 bp, Artificial Sequence
  Synthetic oligonucleotide; TTT chr11 5199258 5199279 5199275 5199280 +
tatagaacatcgccatcagttt

SEQ ID NO: 79274 - DNA, 22 bp, Artificial Sequence
  Synthetic oligonucleotide; TTT chr11 5199259 5199280 5199276 5199281 +
atagaacatcgccatcagttta

SEQ ID NO: 79275 - DNA, 22 bp, Artificial Sequence
  Synthetic oligonucleotide; TTA chr11 5199260 5199281 5199277 5199282 +
tagaacatcgccatcagtttag

SEQ ID NO: 79276 - DNA, 22 bp, Artificial Sequence
  Synthetic oligonucleotide; TTT chr11 5199280 5199301 5199297 5199302 +
agaaaagttcccttggacaatt

SEQ ID NO: 79277 - DNA, 22 bp, Artificial Sequence
  Synthetic oligonucleotide; TTA chr11 5199281 5199302 5199298 5199303 +
gaaaagttcccttggacaattc

SEQ ID NO: 79278 - DNA, 22 bp, Artificial Sequence
  Synthetic oligonucleotide; TTC chr11 5199290 5199311 5199307 5199312 +
ccttggacaattctggtccata

SEQ ID NO: 79279 - DNA, 22 bp, Artificial Sequence
  Synthetic oligonucleotide; CTT chr11 5199294 5199315 5199311 5199316 +
ggacaattctggtccatacaga

SEQ ID NO: 79280 - DNA, 22 bp, Artificial Sequence
  Synthetic oligonucleotide; TTG chr11 5199295 5199316 5199312 5199317 +
gacaattctggtccatacagat

SEQ ID NO: 79281 - DNA, 22 bp, Artificial Sequence
  Synthetic oligonucleotide; TTC chr11 5199303 5199324 5199320 5199325 +
tggtccatacagatatcacaac

SEQ ID NO: 79282 - DNA, 22 bp, Artificial Sequence
  Synthetic oligonucleotide; CTG chr11 5199305 5199326 5199322 5199327 +
gtccatacagatatcacaacat

SEQ ID NO: 79283 - DNA, 22 bp, Artificial Sequence
  Synthetic oligonucleotide; TTC chr11 5199329 5199350 5199346 5199351 +
ctgtgagttggctatagtctcc

SEQ ID NO: 79284 - DNA, 22 bp, Artificial Sequence
  Synthetic oligonucleotide; CTG chr11 5199332 5199353 5199349 5199354 +
tgagttggctatagtctccatt

SEQ ID NO: 79285 - DNA, 22 bp, Artificial Sequence
  Synthetic oligonucleotide; TTG chr11 5199339 5199360 5199356 5199361 +
gctatagtctccattttgaagg

SEQ ID NO: 79286 - DNA, 22 bp, Artificial Sequence
  Synthetic oligonucleotide; CTA chr11 5199343 5199364 5199360 5199365 +
tagtctccattttgaaggttaa

SEQ ID NO: 79287 - DNA, 22 bp, Artificial Sequence
  Synthetic oligonucleotide; CTC chr11 5199350 5199371 5199367 5199372 +
cattttgaaggttaattaagta

SEQ ID NO: 79288 - DNA, 22 bp, Artificial Sequence
  Synthetic oligonucleotide; TTT chr11 5199355 5199376 5199372 5199377 +
tgaaggttaattaagtaaacct

SEQ ID NO: 79289 - DNA, 22 bp, Artificial Sequence
  Synthetic oligonucleotide; TTT chr11 5199356 5199377 5199373 5199378 +
gaaggttaattaagtaaacctc

SEQ ID NO: 79290 - DNA, 22 bp, Artificial Sequence
  Synthetic oligonucleotide; TTG chr11 5199357 5199378 5199374 5199379 +
aaggttaattaagtaaacctca

SEQ ID NO: 79291 - DNA, 22 bp, Artificial Sequence
  Synthetic oligonucleotide; TTA chr11 5199364 5199385 5199381 5199386 +
attaagtaaacctcagagaatg

SEQ ID NO: 79292 - DNA, 22 bp, Artificial Sequence
  Synthetic oligonucleotide; TTA chr11 5199368 5199389 5199385 5199390 +
agtaaacctcagagaatgaaag

SEQ ID NO: 79293 - DNA, 22 bp, Artificial Sequence
  Synthetic oligonucleotide; CTC chr11 5199378 5199399 5199395 5199400 +
agagaatgaaagaaacttcaag

SEQ ID NO: 79294 - DNA, 22 bp, Artificial Sequence
  Synthetic oligonucleotide; CTT chr11 5199396 5199417 5199413 5199418 +
caagttttctactttgaaactt

SEQ ID NO: 79295 - DNA, 22 bp, Artificial Sequence
  Synthetic oligonucleotide; TTC chr11 5199397 5199418 5199414 5199419 +
aagttttctactttgaaacttg

SEQ ID NO: 79296 - DNA, 22 bp, Artificial Sequence
  Synthetic oligonucleotide; TTT chr11 5199403 5199424 5199420 5199425 +
tctactttgaaacttgaaaacc

SEQ ID NO: 79297 - DNA, 22 bp, Artificial Sequence
  Synthetic oligonucleotide; TTT chr11 5199404 5199425 5199421 5199426 +
ctactttgaaacttgaaaacct

SEQ ID NO: 79298 - DNA, 22 bp, Artificial Sequence
  Synthetic oligonucleotide; TTC chr11 5199405 5199426 5199422 5199427 +
tactttgaaacttgaaaaccta

SEQ ID NO: 79299 - DNA, 22 bp, Artificial Sequence
  Synthetic oligonucleotide; CTA chr11 5199407 5199428 5199424 5199429 +
ctttgaaacttgaaaacctagg

SEQ ID NO: 79300 - DNA, 22 bp, Artificial Sequence
  Synthetic oligonucleotide; CTT chr11 5199410 5199431 5199427 5199432 +
tgaaacttgaaaacctaggttt

SEQ ID NO: 79301 - DNA, 22 bp, Artificial Sequence
  Synthetic oligonucleotide; TTT chr11 5199411 5199432 5199428 5199433 +
gaaacttgaaaacctaggtttt

SEQ ID NO: 79302 - DNA, 22 bp, Artificial Sequence
  Synthetic oligonucleotide; TTG chr11 5199412 5199433 5199429 5199434 +
aaacttgaaaacctaggttttt

SEQ ID NO: 79303 - DNA, 22 bp, Artificial Sequence
  Synthetic oligonucleotide; CTT chr11 5199418 5199439 5199435 5199440 +
gaaaacctaggtttttaatcca

SEQ ID NO: 79304 - DNA, 22 bp, Artificial Sequence
  Synthetic oligonucleotide; TTG chr11 5199419 5199440 5199436 5199441 +
aaaacctaggtttttaatccag

SEQ ID NO: 79305 - DNA, 22 bp, Artificial Sequence
  Synthetic oligonucleotide; CTA chr11 5199427 5199448 5199444 5199449 +
ggtttttaatccagctttgttt

SEQ ID NO: 79306 - DNA, 22 bp, Artificial Sequence
  Synthetic oligonucleotide; TTT chr11 5199432 5199453 5199449 5199454 +
ttaatccagctttgttttacag

SEQ ID NO: 79307 - DNA, 22 bp, Artificial Sequence
  Synthetic oligonucleotide; TTT chr11 5199433 5199454 5199450 5199455 +
taatccagctttgttttacagc

SEQ ID NO: 79308 - DNA, 22 bp, Artificial Sequence
  Synthetic oligonucleotide; TTT chr11 5199434 5199455 5199451 5199456 +
aatccagctttgttttacagca

SEQ ID NO: 79309 - DNA, 22 bp, Artificial Sequence
  Synthetic oligonucleotide; TTA chr11 5199435 5199456 5199452 5199457 +
atccagctttgttttacagcaa

SEQ ID NO: 79310 - DNA, 22 bp, Artificial Sequence
  Synthetic oligonucleotide; CTT chr11 5199444 5199465 5199461 5199466 +
tgttttacagcaaaggaaatgc

SEQ ID NO: 79311 - DNA, 22 bp, Artificial Sequence
  Synthetic oligonucleotide; TTT chr11 5199445 5199466 5199462 5199467 +
gttttacagcaaaggaaatgct

SEQ ID NO: 79312 - DNA, 22 bp, Artificial Sequence
  Synthetic oligonucleotide; TTG chr11 5199446 5199467 5199463 5199468 +
ttttacagcaaaggaaatgctc

SEQ ID NO: 79313 - DNA, 22 bp, Artificial Sequence
  Synthetic oligonucleotide; TTT chr11 5199449 5199470 5199466 5199471 +
tacagcaaaggaaatgctcaaa

SEQ ID NO: 79314 - DNA, 22 bp, Artificial Sequence
  Synthetic oligonucleotide; TTT chr11 5199450 5199471 5199467 5199472 +
acagcaaaggaaatgctcaaaa

SEQ ID NO: 79315 - DNA, 22 bp, Artificial Sequence
  Synthetic oligonucleotide; TTA chr11 5199451 5199472 5199468 5199473 +
cagcaaaggaaatgctcaaaag

SEQ ID NO: 79316 - DNA, 22 bp, Artificial Sequence
  Synthetic oligonucleotide; CTC chr11 5199468 5199489 5199485 5199490 +
aaaagtacatttcaggcaaata

SEQ ID NO: 79317 - DNA, 22 bp, Artificial Sequence
  Synthetic oligonucleotide; TTT chr11 5199480 5199501 5199497 5199502 +
caggcaaataaacaattttttc

SEQ ID NO: 79318 - DNA, 22 bp, Artificial Sequence
  Synthetic oligonucleotide; TTC chr11 5199481 5199502 5199498 5199503 +
aggcaaataaacaattttttcc

SEQ ID NO: 79319 - DNA, 22 bp, Artificial Sequence
  Synthetic oligonucleotide; TTT chr11 5199498 5199519 5199515 5199520 +
tttcctctttcttaaatatggt

SEQ ID NO: 79320 - DNA, 22 bp, Artificial Sequence
  Synthetic oligonucleotide; TTT chr11 5199499 5199520 5199516 5199521 +
ttcctctttcttaaatatggtc

SEQ ID NO: 79321 - DNA, 22 bp, Artificial Sequence
  Synthetic oligonucleotide; TTT chr11 5199500 5199521 5199517 5199522 +
tcctctttcttaaatatggtca

SEQ ID NO: 79322 - DNA, 22 bp, Artificial Sequence
  Synthetic oligonucleotide; TTT chr11 5199501 5199522 5199518 5199523 +
cctctttcttaaatatggtcag

SEQ ID NO: 79323 - DNA, 22 bp, Artificial Sequence
  Synthetic oligonucleotide; TTC chr11 5199502 5199523 5199519 5199524 +
ctctttcttaaatatggtcaga

SEQ ID NO: 79324 - DNA, 22 bp, Artificial Sequence
  Synthetic oligonucleotide; CTC chr11 5199505 5199526 5199522 5199527 +
tttcttaaatatggtcagactg

SEQ ID NO: 79325 - DNA, 22 bp, Artificial Sequence
  Synthetic oligonucleotide; CTT chr11 5199507 5199528 5199524 5199529 +
tcttaaatatggtcagactgat

SEQ ID NO: 79326 - DNA, 22 bp, Artificial Sequence
  Synthetic oligonucleotide; TTT chr11 5199508 5199529 5199525 5199530 +
cttaaatatggtcagactgata

SEQ ID NO: 79327 - DNA, 22 bp, Artificial Sequence
  Synthetic oligonucleotide; TTC chr11 5199509 5199530 5199526 5199531 +
ttaaatatggtcagactgatag

SEQ ID NO: 79328 - DNA, 22 bp, Artificial Sequence
  Synthetic oligonucleotide; CTT chr11 5199511 5199532 5199528 5199533 +
aaatatggtcagactgatagag

SEQ ID NO: 79329 - DNA, 22 bp, Artificial Sequence
  Synthetic oligonucleotide; TTA chr11 5199512 5199533 5199529 5199534 +
aatatggtcagactgatagagt

SEQ ID NO: 79330 - DNA, 22 bp, Artificial Sequence
  Synthetic oligonucleotide; CTG chr11 5199527 5199548 5199544 5199549 +
atagagtgacctacatgtgtcc

SEQ ID NO: 79331 - DNA, 22 bp, Artificial Sequence
  Synthetic oligonucleotide; CTA chr11 5199540 5199561 5199557 5199562 +
catgtgtccaggctgacacaat

SEQ ID NO: 79332 - DNA, 22 bp, Artificial Sequence
  Synthetic oligonucleotide; CTG chr11 5199555 5199576 5199572 5199577 +
acacaatggaacttgtttgttg

SEQ ID NO: 79333 - DNA, 22 bp, Artificial Sequence
  Synthetic oligonucleotide; CTT chr11 5199569 5199590 5199586 5199591 +
gtttgttgattctctgactata

SEQ ID NO: 79334 - DNA, 22 bp, Artificial Sequence
  Synthetic oligonucleotide; TTG chr11 5199570 5199591 5199587 5199592 +
tttgttgattctctgactatat

SEQ ID NO: 79335 - DNA, 22 bp, Artificial Sequence
  Synthetic oligonucleotide; TTT chr11 5199573 5199594 5199590 5199595 +
gttgattctctgactatattta

SEQ ID NO: 79336 - DNA, 22 bp, Artificial Sequence
  Synthetic oligonucleotide; TTG chr11 5199574 5199595 5199591 5199596 +
ttgattctctgactatatttaa

SEQ ID NO: 79337 - DNA, 22 bp, Artificial Sequence
  Synthetic oligonucleotide; TTG chr11 5199577 5199598 5199594 5199599 +
attctctgactatatttaaata

SEQ ID NO: 79338 - DNA, 22 bp, Artificial Sequence
  Synthetic oligonucleotide; TTC chr11 5199581 5199602 5199598 5199603 +
tctgactatatttaaatatttt

SEQ ID NO: 79339 - DNA, 22 bp, Artificial Sequence
  Synthetic oligonucleotide; CTC chr11 5199583 5199604 5199600 5199605 +
tgactatatttaaatatttttt

SEQ ID NO: 79340 - DNA, 22 bp, Artificial Sequence
  Synthetic oligonucleotide; CTG chr11 5199585 5199606 5199602 5199607 +
actatatttaaatattttttaa

SEQ ID NO: 79341 - DNA, 22 bp, Artificial Sequence
  Synthetic oligonucleotide; CTA chr11 5199589 5199610 5199606 5199611 +
tatttaaatattttttaaggtc

SEQ ID NO: 79342 - DNA, 22 bp, Artificial Sequence
  Synthetic oligonucleotide; TTT chr11 5199594 5199615 5199611 5199616 +
aaatattttttaaggtcatttg

SEQ ID NO: 79343 - DNA, 22 bp, Artificial Sequence
  Synthetic oligonucleotide; TTA chr11 5199595 5199616 5199612 5199617 +
aatattttttaaggtcatttgt

SEQ ID NO: 79344 - DNA, 22 bp, Artificial Sequence
  Synthetic oligonucleotide; TTT chr11 5199602 5199623 5199619 5199624 +
tttaaggtcatttgtcatggac

SEQ ID NO: 79345 - DNA, 22 bp, Artificial Sequence
  Synthetic oligonucleotide; TTT chr11 5199603 5199624 5199620 5199625 +
ttaaggtcatttgtcatggact

SEQ ID NO: 79346 - DNA, 22 bp, Artificial Sequence
  Synthetic oligonucleotide; TTT chr11 5199604 5199625 5199621 5199626 +
taaggtcatttgtcatggactc

SEQ ID NO: 79347 - DNA, 22 bp, Artificial Sequence
  Synthetic oligonucleotide; TTT chr11 5199605 5199626 5199622 5199627 +
aaggtcatttgtcatggactca

SEQ ID NO: 79348 - DNA, 22 bp, Artificial Sequence
  Synthetic oligonucleotide; TTA chr11 5199606 5199627 5199623 5199628 +
aggtcatttgtcatggactcag

SEQ ID NO: 79349 - DNA, 22 bp, Artificial Sequence
  Synthetic oligonucleotide; TTT chr11 5199615 5199636 5199632 5199637 +
gtcatggactcagagtaaatct

SEQ ID NO: 79350 - DNA, 22 bp, Artificial Sequence
  Synthetic oligonucleotide; TTG chr11 5199616 5199637 5199633 5199638 +
tcatggactcagagtaaatcta

SEQ ID NO: 79351 - DNA, 22 bp, Artificial Sequence
  Synthetic oligonucleotide; CTC chr11 5199626 5199647 5199643 5199648 +
agagtaaatctacaattttaat

SEQ ID NO: 79352 - DNA, 22 bp, Artificial Sequence
  Synthetic oligonucleotide; CTA chr11 5199638 5199659 5199655 5199660 +
caattttaataattttttcttt

SEQ ID NO: 79353 - DNA, 22 bp, Artificial Sequence
  Synthetic oligonucleotide; TTT chr11 5199644 5199665 5199661 5199666 +
taataattttttcttttttatg

SEQ ID NO: 79354 - DNA, 22 bp, Artificial Sequence
  Synthetic oligonucleotide; TTT chr11 5199645 5199666 5199662 5199667 +
aataattttttcttttttatgg

SEQ ID NO: 79355 - DNA, 22 bp, Artificial Sequence
  Synthetic oligonucleotide; TTA chr11 5199646 5199667 5199663 5199668 +
ataattttttcttttttatggc

SEQ ID NO: 79356 - DNA, 22 bp, Artificial Sequence
  Synthetic oligonucleotide; TTT chr11 5199653 5199674 5199670 5199675 +
tttcttttttatggcactgatt

SEQ ID NO: 79357 - DNA, 22 bp, Artificial Sequence
  Synthetic oligonucleotide; TTT chr11 5199654 5199675 5199671 5199676 +
ttcttttttatggcactgattt

SEQ ID NO: 79358 - DNA, 22 bp, Artificial Sequence
  Synthetic oligonucleotide; TTT chr11 5199655 5199676 5199672 5199677 +
tcttttttatggcactgatttt

SEQ ID NO: 79359 - DNA, 22 bp, Artificial Sequence
  Synthetic oligonucleotide; TTT chr11 5199656 5199677 5199673 5199678 +
cttttttatggcactgattttt

SEQ ID NO: 79360 - DNA, 22 bp, Artificial Sequence
  Synthetic oligonucleotide; TTC chr11 5199657 5199678 5199674 5199679 +
ttttttatggcactgatttttg

SEQ ID NO: 79361 - DNA, 22 bp, Artificial Sequence
  Synthetic oligonucleotide; CTT chr11 5199659 5199680 5199676 5199681 +
ttttatggcactgatttttgtt

SEQ ID NO: 79362 - DNA, 22 bp, Artificial Sequence
  Synthetic oligonucleotide; TTT chr11 5199660 5199681 5199677 5199682 +
tttatggcactgatttttgttt

SEQ ID NO: 79363 - DNA, 22 bp, Artificial Sequence
  Synthetic oligonucleotide; TTT chr11 5199661 5199682 5199678 5199683 +
ttatggcactgatttttgttta

SEQ ID NO: 79364 - DNA, 22 bp, Artificial Sequence
  Synthetic oligonucleotide; TTT chr11 5199662 5199683 5199679 5199684 +
tatggcactgatttttgtttat

SEQ ID NO: 79365 - DNA, 22 bp, Artificial Sequence
  Synthetic oligonucleotide; TTT chr11 5199663 5199684 5199680 5199685 +
atggcactgatttttgtttatt

SEQ ID NO: 79366 - DNA, 22 bp, Artificial Sequence
  Synthetic oligonucleotide; TTA chr11 5199664 5199685 5199681 5199686 +
tggcactgatttttgtttatta

SEQ ID NO: 79367 - DNA, 22 bp, Artificial Sequence
  Synthetic oligonucleotide; CTG chr11 5199672 5199693 5199689 5199694 +
atttttgtttattattgttgct

SEQ ID NO: 79368 - DNA, 22 bp, Artificial Sequence
  Synthetic oligonucleotide; TTT chr11 5199676 5199697 5199693 5199698 +
ttgtttattattgttgctgctt

SEQ ID NO: 79369 - DNA, 22 bp, Artificial Sequence
  Synthetic oligonucleotide; TTT chr11 5199677 5199698 5199694 5199699 +
tgtttattattgttgctgcttt

SEQ ID NO: 79370 - DNA, 22 bp, Artificial Sequence
  Synthetic oligonucleotide; TTT chr11 5199678 5199699 5199695 5199700 +
gtttattattgttgctgctttt

SEQ ID NO: 79371 - DNA, 22 bp, Artificial Sequence
  Synthetic oligonucleotide; TTG chr11 5199679 5199700 5199696 5199701 +
tttattattgttgctgcttttc

SEQ ID NO: 79372 - DNA, 22 bp, Artificial Sequence
  Synthetic oligonucleotide; TTT chr11 5199682 5199703 5199699 5199704 +
attattgttgctgcttttcttt

SEQ ID NO: 79373 - DNA, 22 bp, Artificial Sequence
  Synthetic oligonucleotide; TTA chr11 5199683 5199704 5199700 5199705 +
ttattgttgctgcttttctttc

SEQ ID NO: 79374 - DNA, 22 bp, Artificial Sequence
  Synthetic oligonucleotide; TTA chr11 5199686 5199707 5199703 5199708 +
ttgttgctgcttttctttcttt

SEQ ID NO: 79375 - DNA, 22 bp, Artificial Sequence
  Synthetic oligonucleotide; TTG chr11 5199689 5199710 5199706 5199711 +
ttgctgcttttctttctttttt

SEQ ID NO: 79376 - DNA, 22 bp, Artificial Sequence
  Synthetic oligonucleotide; TTG chr11 5199692 5199713 5199709 5199714 +
ctgcttttctttctttttttta

SEQ ID NO: 79377 - DNA, 22 bp, Artificial Sequence
  Synthetic oligonucleotide; CTG chr11 5199695 5199716 5199712 5199717 +
cttttctttcttttttttaggc

SEQ ID NO: 79378 - DNA, 22 bp, Artificial Sequence
  Synthetic oligonucleotide; CTT chr11 5199698 5199719 5199715 5199720 +
ttctttcttttttttaggcaat

SEQ ID NO: 79379 - DNA, 22 bp, Artificial Sequence
  Synthetic oligonucleotide; TTT chr11 5199699 5199720 5199716 5199721 +
tctttcttttttttaggcaata

SEQ ID NO: 79380 - DNA, 22 bp, Artificial Sequence
  Synthetic oligonucleotide; TTT chr11 5199700 5199721 5199717 5199722 +
ctttcttttttttaggcaatac

SEQ ID NO: 79381 - DNA, 22 bp, Artificial Sequence
  Synthetic oligonucleotide; TTC chr11 5199701 5199722 5199718 5199723 +
tttcttttttttaggcaataca

SEQ ID NO: 79382 - DNA, 22 bp, Artificial Sequence
  Synthetic oligonucleotide; CTT chr11 5199703 5199724 5199720 5199725 +
tcttttttttaggcaatacatc

SEQ ID NO: 79383 - DNA, 22 bp, Artificial Sequence
  Synthetic oligonucleotide; TTT chr11 5199704 5199725 5199721 5199726 +
cttttttttaggcaatacatct

SEQ ID NO: 79384 - DNA, 22 bp, Artificial Sequence
  Synthetic oligonucleotide; TTC chr11 5199705 5199726 5199722 5199727 +
ttttttttaggcaatacatctc

SEQ ID NO: 79385 - DNA, 22 bp, Artificial Sequence
  Synthetic oligonucleotide; CTT chr11 5199707 5199728 5199724 5199729 +
ttttttaggcaatacatctcaa

SEQ ID NO: 79386 - DNA, 22 bp, Artificial Sequence
  Synthetic oligonucleotide; TTT chr11 5199708 5199729 5199725 5199730 +
tttttaggcaatacatctcaat

SEQ ID NO: 79387 - DNA, 22 bp, Artificial Sequence
  Synthetic oligonucleotide; TTT chr11 5199709 5199730 5199726 5199731 +
ttttaggcaatacatctcaata

SEQ ID NO: 79388 - DNA, 22 bp, Artificial Sequence
  Synthetic oligonucleotide; TTT chr11 5199710 5199731 5199727 5199732 +
tttaggcaatacatctcaatat

SEQ ID NO: 79389 - DNA, 22 bp, Artificial Sequence
  Synthetic oligonucleotide; TTT chr11 5199711 5199732 5199728 5199733 +
ttaggcaatacatctcaatatc

SEQ ID NO: 79390 - DNA, 22 bp, Artificial Sequence
  Synthetic oligonucleotide; TTT chr11 5199712 5199733 5199729 5199734 +
taggcaatacatctcaatatct

SEQ ID NO: 79391 - DNA, 22 bp, Artificial Sequence
  Synthetic oligonucleotide; TTT chr11 5199713 5199734 5199730 5199735 +
aggcaatacatctcaatatctc

SEQ ID NO: 79392 - DNA, 22 bp, Artificial Sequence
  Synthetic oligonucleotide; TTA chr11 5199714 5199735 5199731 5199736 +
ggcaatacatctcaatatctct

SEQ ID NO: 79393 - DNA, 22 bp, Artificial Sequence
  Synthetic oligonucleotide; CTC chr11 5199727 5199748 5199744 5199749 +
aatatctctcaatatcttttca

SEQ ID NO: 79394 - DNA, 22 bp, Artificial Sequence
  Synthetic oligonucleotide; CTC chr11 5199735 5199756 5199752 5199757 +
tcaatatcttttcagagaaaag

SEQ ID NO: 79395 - DNA, 22 bp, Artificial Sequence
  Synthetic oligonucleotide; CTC chr11 5199737 5199758 5199754 5199759 +
aatatcttttcagagaaaagag

SEQ ID NO: 79396 - DNA, 22 bp, Artificial Sequence
  Synthetic oligonucleotide; CTT chr11 5199745 5199766 5199762 5199767 +
ttcagagaaaagagtctaagca

SEQ ID NO: 79397 - DNA, 22 bp, Artificial Sequence
  Synthetic oligonucleotide; TTT chr11 5199746 5199767 5199763 5199768 +
tcagagaaaagagtctaagcat

SEQ ID NO: 79398 - DNA, 22 bp, Artificial Sequence
  Synthetic oligonucleotide; TTT chr11 5199747 5199768 5199764 5199769 +
cagagaaaagagtctaagcatt

SEQ ID NO: 79399 - DNA, 22 bp, Artificial Sequence
  Synthetic oligonucleotide; TTC chr11 5199748 5199769 5199765 5199770 +
agagaaaagagtctaagcattc

SEQ ID NO: 79400 - DNA, 22 bp, Artificial Sequence
  Synthetic oligonucleotide; CTA chr11 5199763 5199784 5199780 5199785 +
agcattctggtatgaatctgtt

SEQ ID NO: 79401 - DNA, 22 bp, Artificial Sequence
  Synthetic oligonucleotide; TTC chr11 5199770 5199791 5199787 5199792 +
tggtatgaatctgttgggtctt

SEQ ID NO: 79402 - DNA, 22 bp, Artificial Sequence
  Synthetic oligonucleotide; CTG chr11 5199772 5199793 5199789 5199794 +
gtatgaatctgttgggtcttga

SEQ ID NO: 79403 - DNA, 22 bp, Artificial Sequence
  Synthetic oligonucleotide; CTG chr11 5199783 5199804 5199800 5199805 +
ttgggtcttgacactgtagatg

SEQ ID NO: 79404 - DNA, 22 bp, Artificial Sequence
  Synthetic oligonucleotide; TTG chr11 5199786 5199807 5199803 5199808 +
ggtcttgacactgtagatgatg

SEQ ID NO: 79405 - DNA, 22 bp, Artificial Sequence
  Synthetic oligonucleotide; CTT chr11 5199792 5199813 5199809 5199814 +
gacactgtagatgatgggattc

SEQ ID NO: 79406 - DNA, 22 bp, Artificial Sequence
  Synthetic oligonucleotide; TTG chr11 5199793 5199814 5199810 5199815 +
acactgtagatgatgggattca

SEQ ID NO: 79407 - DNA, 22 bp, Artificial Sequence
  Synthetic oligonucleotide; CTG chr11 5199799 5199820 5199816 5199821 +
tagatgatgggattcattaaag

SEQ ID NO: 79408 - DNA, 22 bp, Artificial Sequence
  Synthetic oligonucleotide; TTC chr11 5199814 5199835 5199831 5199836 +
attaaaggtgggaaaaggatgt

SEQ ID NO: 79409 - DNA, 22 bp, Artificial Sequence
  Synthetic oligonucleotide; TTA chr11 5199818 5199839 5199835 5199840 +
aaggtgggaaaaggatgtagat

SEQ ID NO: 79410 - DNA, 22 bp, Artificial Sequence
  Synthetic oligonucleotide; TTG chr11 5199844 5199865 5199861 5199866 +
ccaatgagaacgtgggccacgg

SEQ ID NO: 79411 - DNA, 22 bp, Artificial Sequence
  Synthetic oligonucleotide; CTT chr11 5199879 5199900 5199896 5199901 +
gccaaaacggtgcaccattgtg

SEQ ID NO: 79412 - DNA, 22 bp, Artificial Sequence
  Synthetic oligonucleotide; TTG chr11 5199880 5199901 5199897 5199902 +
ccaaaacggtgcaccattgtga

SEQ ID NO: 79413 - DNA, 22 bp, Artificial Sequence
  Synthetic oligonucleotide; TTG chr11 5199899 5199920 5199916 5199921 +
tgaggctaatgatagggatgta

SEQ ID NO: 79414 - DNA, 22 bp, Artificial Sequence
  Synthetic oligonucleotide; CTA chr11 5199907 5199928 5199924 5199929 +
atgatagggatgtagaacacaa

SEQ ID NO: 79415 - DNA, 22 bp, Artificial Sequence
  Synthetic oligonucleotide; CTG chr11 5199960 5199981 5199977 5199982 +
aaataatttatgcctctcttcc

SEQ ID NO: 79416 - DNA, 22 bp, Artificial Sequence
  Synthetic oligonucleotide; TTT chr11 5199969 5199990 5199986 5199991 +
atgcctctcttcctgagaggca

SEQ ID NO: 79417 - DNA, 22 bp, Artificial Sequence
  Synthetic oligonucleotide; TTA chr11 5199970 5199991 5199987 5199992 +
tgcctctcttcctgagaggcaa

SEQ ID NO: 79418 - DNA, 22 bp, Artificial Sequence
  Synthetic oligonucleotide; CTC chr11 5199976 5199997 5199993 5199998 +
tcttcctgagaggcaactgcca

SEQ ID NO: 79419 - DNA, 22 bp, Artificial Sequence
  Synthetic oligonucleotide; CTC chr11 5199978 5199999 5199995 5200000 +
ttcctgagaggcaactgccagg

SEQ ID NO: 79420 - DNA, 22 bp, Artificial Sequence
  Synthetic oligonucleotide; CTT chr11 5199980 5200001 5199997 5200002 +
cctgagaggcaactgccaggac

SEQ ID NO: 79421 - DNA, 22 bp, Artificial Sequence
  Synthetic oligonucleotide; TTC chr11 5199981 5200002 5199998 5200003 +
ctgagaggcaactgccaggact

SEQ ID NO: 79422 - DNA, 22 bp, Artificial Sequence
  Synthetic oligonucleotide; CTG chr11 5199984 5200005 5200001 5200006 +
agaggcaactgccaggactgac

SEQ ID NO: 79423 - DNA, 22 bp, Artificial Sequence
  Synthetic oligonucleotide; CTG chr11 5199995 5200016 5200012 5200017 +
ccaggactgacttaagaatcag

SEQ ID NO: 79424 - DNA, 22 bp, Artificial Sequence
  Synthetic oligonucleotide; CTG chr11 5200004 5200025 5200021 5200026 +
acttaagaatcaggatgtagga

SEQ ID NO: 79425 - DNA, 22 bp, Artificial Sequence
  Synthetic oligonucleotide; CTT chr11 5200008 5200029 5200025 5200030 +
aagaatcaggatgtaggagaaa

SEQ ID NO: 79426 - DNA, 22 bp, Artificial Sequence
  Synthetic oligonucleotide; TTA chr11 5200009 5200030 5200026 5200031 +
agaatcaggatgtaggagaaaa

SEQ ID NO: 79427 - DNA, 22 bp, Artificial Sequence
  Synthetic oligonucleotide; CTA chr11 5200090 5200111 5200107 5200112 +
ttgaatcggatgtctgaacagg

SEQ ID NO: 79428 - DNA, 22 bp, Artificial Sequence
  Synthetic oligonucleotide; TTG chr11 5200093 5200114 5200110 5200115 +
aatcggatgtctgaacaggcta

SEQ ID NO: 79429 - DNA, 22 bp, Artificial Sequence
  Synthetic oligonucleotide; CTG chr11 5200106 5200127 5200123 5200128 +
aacaggctaagcggagaagatc

SEQ ID NO: 79430 - DNA, 22 bp, Artificial Sequence
  Synthetic oligonucleotide; CTA chr11 5200115 5200136 5200132 5200137 +
agcggagaagatcctggtgcag

SEQ ID NO: 79431 - DNA, 22 bp, Artificial Sequence
  Synthetic oligonucleotide; CTG chr11 5200131 5200152 5200148 5200153 +
gtgcaggcagaaagagtgagaa

SEQ ID NO: 79432 - DNA, 22 bp, Artificial Sequence
  Synthetic oligonucleotide; TTA chr11 5200177 5200198 5200194 5200199 +
aaaaatttcagacagatgatgg

SEQ ID NO: 79433 - DNA, 22 bp, Artificial Sequence
  Synthetic oligonucleotide; TTT chr11 5200185 5200206 5200202 5200207 +
cagacagatgatggggggtgta

SEQ ID NO: 79434 - DNA, 22 bp, Artificial Sequence
  Synthetic oligonucleotide; TTC chr11 5200186 5200207 5200203 5200208 +
agacagatgatggggggtgtaa

SEQ ID NO: 79435 - DNA, 22 bp, Artificial Sequence
  Synthetic oligonucleotide; CTC chr11 5200222 5200243 5200239 5200244 +
ctacctattatagtgagcccaa

SEQ ID NO: 79436 - DNA, 22 bp, Artificial Sequence
  Synthetic oligonucleotide; CTA chr11 5200225 5200246 5200242 5200247 +
cctattatagtgagcccaattt

SEQ ID NO: 79437 - DNA, 22 bp, Artificial Sequence
  Synthetic oligonucleotide; CTA chr11 5200229 5200250 5200246 5200251 +
ttatagtgagcccaattttgat

SEQ ID NO: 79438 - DNA, 22 bp, Artificial Sequence
  Synthetic oligonucleotide; TTA chr11 5200232 5200253 5200249 5200254 +
tagtgagcccaattttgataat

SEQ ID NO: 79439 - DNA, 22 bp, Artificial Sequence
  Synthetic oligonucleotide; TTT chr11 5200247 5200268 5200264 5200269 +
tgataattctggaattagtcag

SEQ ID NO: 79440 - DNA, 22 bp, Artificial Sequence
  Synthetic oligonucleotide; TTT chr11 5200248 5200269 5200265 5200270 +
gataattctggaattagtcagg

SEQ ID NO: 79441 - DNA, 22 bp, Artificial Sequence
  Synthetic oligonucleotide; TTG chr11 5200249 5200270 5200266 5200271 +
ataattctggaattagtcagga

SEQ ID NO: 79442 - DNA, 22 bp, Artificial Sequence
  Synthetic oligonucleotide; TTC chr11 5200256 5200277 5200273 5200278 +
tggaattagtcaggatggagga

SEQ ID NO: 79443 - DNA, 22 bp, Artificial Sequence
  Synthetic oligonucleotide; CTG chr11 5200258 5200279 5200275 5200280 +
gaattagtcaggatggaggaat

SEQ ID NO: 79444 - DNA, 22 bp, Artificial Sequence
  Synthetic oligonucleotide; TTA chr11 5200264 5200285 5200281 5200286 +
gtcaggatggaggaataacgta

SEQ ID NO: 79445 - DNA, 22 bp, Artificial Sequence
  Synthetic oligonucleotide; TTG chr11 5200294 5200315 5200311 5200316 +
caaattgcaatgtaccggtcaa

SEQ ID NO: 79446 - DNA, 22 bp, Artificial Sequence
  Synthetic oligonucleotide; TTG chr11 5200301 5200322 5200318 5200323 +
caatgtaccggtcaaaggccat

SEQ ID NO: 79447 - DNA, 22 bp, Artificial Sequence
  Synthetic oligonucleotide; CTC chr11 5200344 5200365 5200361 5200366 +
catgaaggacagaccatggatg

SEQ ID NO: 79448 - DNA, 22 bp, Artificial Sequence
  Synthetic oligonucleotide; CTG chr11 5200377 5200398 5200394 5200399 +
ggcaatgcaggaatccaagctg

SEQ ID NO: 79449 - DNA, 22 bp, Artificial Sequence
  Synthetic oligonucleotide; CTG chr11 5200399 5200420 5200416 5200421 +
atctctcgaatgatcccccaca

SEQ ID NO: 79450 - DNA, 22 bp, Artificial Sequence
  Synthetic oligonucleotide; CTC chr11 5200404 5200425 5200421 5200426 +
tcgaatgatcccccacaggatc

SEQ ID NO: 79451 - DNA, 22 bp, Artificial Sequence
  Synthetic oligonucleotide; CTC chr11 5200406 5200427 5200423 5200428 +
gaatgatcccccacaggatccc

SEQ ID NO: 79452 - DNA, 22 bp, Artificial Sequence
  Synthetic oligonucleotide; CTG chr11 5200436 5200457 5200453 5200458 +
tgtacacagtggacagccccat

SEQ ID NO: 79453 - DNA, 22 bp, Artificial Sequence
  Synthetic oligonucleotide; CTG chr11 5200506 5200527 5200523 5200528 +
gtgcaggcttggctcagtccat

SEQ ID NO: 79454 - DNA, 22 bp, Artificial Sequence
  Synthetic oligonucleotide; CTT chr11 5200516 5200537 5200533 5200538 +
ggctcagtccatatcacatgga

SEQ ID NO: 79455 - DNA, 22 bp, Artificial Sequence
  Synthetic oligonucleotide; TTG chr11 5200517 5200538 5200534 5200539 +
gctcagtccatatcacatggag

SEQ ID NO: 79456 - DNA, 22 bp, Artificial Sequence
  Synthetic oligonucleotide; CTC chr11 5200521 5200542 5200538 5200543 +
agtccatatcacatggagaacc

SEQ ID NO: 79457 - DNA, 22 bp, Artificial Sequence
  Synthetic oligonucleotide; TTG chr11 5200552 5200573 5200569 5200574 +
cccaaaagcaccatggcataga

SEQ ID NO: 79458 - DNA, 22 bp, Artificial Sequence
  Synthetic oligonucleotide; TTG chr11 5200577 5200598 5200594 5200599 +
aggagaaggggatggaaagcca

SEQ ID NO: 79459 - DNA, 22 bp, Artificial Sequence
  Synthetic oligonucleotide; TTG chr11 5200608 5200629 5200625 5200630 +
ctgctccatgccagaaaatcca

SEQ ID NO: 79460 - DNA, 22 bp, Artificial Sequence
  Synthetic oligonucleotide; CTG chr11 5200611 5200632 5200628 5200633 +
ctccatgccagaaaatccagtg

SEQ ID NO: 79461 - DNA, 22 bp, Artificial Sequence
  Synthetic oligonucleotide; CTC chr11 5200614 5200635 5200631 5200636 +
catgccagaaaatccagtgaga

SEQ ID NO: 79462 - DNA, 22 bp, Artificial Sequence
  Synthetic oligonucleotide; TTC chr11 5200651 5200672 5200668 5200673 +
gtgctggtgctagggcttactg

SEQ ID NO: 79463 - DNA, 22 bp, Artificial Sequence
  Synthetic oligonucleotide; CTG chr11 5200657 5200678 5200674 5200679 +
gtgctagggcttactgaagtaa

SEQ ID NO: 79464 - DNA, 22 bp, Artificial Sequence
  Synthetic oligonucleotide; CTA chr11 5200663 5200684 5200680 5200685 +
gggcttactgaagtaatcattc

SEQ ID NO: 79465 - DNA, 22 bp, Artificial Sequence
  Synthetic oligonucleotide; CTT chr11 5200669 5200690 5200686 5200691 +
actgaagtaatcattctggaac

SEQ ID NO: 79466 - DNA, 22 bp, Artificial Sequence
  Synthetic oligonucleotide; TTA chr11 5200670 5200691 5200687 5200692 +
ctgaagtaatcattctggaact

SEQ ID NO: 79467 - DNA, 22 bp, Artificial Sequence
  Synthetic oligonucleotide; CTG chr11 5200673 5200694 5200690 5200695 +
aagtaatcattctggaactgag

SEQ ID NO: 79468 - DNA, 22 bp, Artificial Sequence
  Synthetic oligonucleotide; TTC chr11 5200685 5200706 5200702 5200707 +
tggaactgagaaacatgtgaga

SEQ ID NO: 79469 - DNA, 22 bp, Artificial Sequence
  Synthetic oligonucleotide; CTG chr11 5200687 5200708 5200704 5200709 +
gaactgagaaacatgtgagagt

SEQ ID NO: 79470 - DNA, 22 bp, Artificial Sequence
  Synthetic oligonucleotide; CTG chr11 5200693 5200714 5200710 5200715 +
agaaacatgtgagagtattttt

SEQ ID NO: 79471 - DNA, 22 bp, Artificial Sequence
  Synthetic oligonucleotide; TTT chr11 5200713 5200734 5200730 5200735 +
tttcaaaggaaatgtttcaatt

SEQ ID NO: 79472 - DNA, 22 bp, Artificial Sequence
  Synthetic oligonucleotide; TTT chr11 5200714 5200735 5200731 5200736 +
ttcaaaggaaatgtttcaattt

SEQ ID NO: 79473 - DNA, 22 bp, Artificial Sequence
  Synthetic oligonucleotide; TTT chr11 5200715 5200736 5200732 5200737 +
tcaaaggaaatgtttcaatttc

SEQ ID NO: 79474 - DNA, 22 bp, Artificial Sequence
  Synthetic oligonucleotide; TTT chr11 5200716 5200737 5200733 5200738 +
caaaggaaatgtttcaatttca

SEQ ID NO: 79475 - DNA, 22 bp, Artificial Sequence
  Synthetic oligonucleotide; TTC chr11 5200717 5200738 5200734 5200739 +
aaaggaaatgtttcaatttcac

SEQ ID NO: 79476 - DNA, 22 bp, Artificial Sequence
  Synthetic oligonucleotide; TTT chr11 5200730 5200751 5200747 5200752 +
caatttcacctgaatacaatga

SEQ ID NO: 79477 - DNA, 22 bp, Artificial Sequence
  Synthetic oligonucleotide; TTC chr11 5200731 5200752 5200748 5200753 +
aatttcacctgaatacaatgaa

SEQ ID NO: 79478 - DNA, 22 bp, Artificial Sequence
  Synthetic oligonucleotide; TTT chr11 5200736 5200757 5200753 5200758 +
cacctgaatacaatgaaatttc

SEQ ID NO: 79479 - DNA, 22 bp, Artificial Sequence
  Synthetic oligonucleotide; TTC chr11 5200737 5200758 5200754 5200759 +
acctgaatacaatgaaatttct

SEQ ID NO: 79480 - DNA, 22 bp, Artificial Sequence
  Synthetic oligonucleotide; CTG chr11 5200742 5200763 5200759 5200764 +
aatacaatgaaatttctaagta

SEQ ID NO: 79481 - DNA, 22 bp, Artificial Sequence
  Synthetic oligonucleotide; TTT chr11 5200757 5200778 5200774 5200779 +
ctaagtaaatgaaataccctaa

SEQ ID NO: 79482 - DNA, 22 bp, Artificial Sequence
  Synthetic oligonucleotide; TTC chr11 5200758 5200779 5200775 5200780 +
taagtaaatgaaataccctaaa

SEQ ID NO: 79483 - DNA, 22 bp, Artificial Sequence
  Synthetic oligonucleotide; CTA chr11 5200760 5200781 5200777 5200782 +
agtaaatgaaataccctaaaac

SEQ ID NO: 79484 - DNA, 22 bp, Artificial Sequence
  Synthetic oligonucleotide; CTA chr11 5200778 5200799 5200795 5200800 +
aaacttactgacttaaaaaaaa

SEQ ID NO: 79485 - DNA, 22 bp, Artificial Sequence
  Synthetic oligonucleotide; CTT chr11 5200784 5200805 5200801 5200806 +
actgacttaaaaaaaacagctg

SEQ ID NO: 79486 - DNA, 22 bp, Artificial Sequence
  Synthetic oligonucleotide; TTA chr11 5200785 5200806 5200802 5200807 +
ctgacttaaaaaaaacagctga

SEQ ID NO: 79487 - DNA, 22 bp, Artificial Sequence
  Synthetic oligonucleotide; CTG chr11 5200788 5200809 5200805 5200810 +
acttaaaaaaaacagctgagaa

SEQ ID NO: 79488 - DNA, 22 bp, Artificial Sequence
  Synthetic oligonucleotide; CTT chr11 5200792 5200813 5200809 5200814 +
aaaaaaaacagctgagaaattc

SEQ ID NO: 79489 - DNA, 22 bp, Artificial Sequence
  Synthetic oligonucleotide; TTA chr11 5200793 5200814 5200810 5200815 +
aaaaaaacagctgagaaattct

SEQ ID NO: 79490 - DNA, 22 bp, Artificial Sequence
  Synthetic oligonucleotide; CTG chr11 5200806 5200827 5200823 5200828 +
agaaattctgtttctttgagac

SEQ ID NO: 79491 - DNA, 22 bp, Artificial Sequence
  Synthetic oligonucleotide; TTC chr11 5200814 5200835 5200831 5200836 +
tgtttctttgagacatagtatc

SEQ ID NO: 79492 - DNA, 22 bp, Artificial Sequence
  Synthetic oligonucleotide; CTG chr11 5200816 5200837 5200833 5200838 +
tttctttgagacatagtatcca

SEQ ID NO: 79493 - DNA, 22 bp, Artificial Sequence
  Synthetic oligonucleotide; TTT chr11 5200819 5200840 5200836 5200841 +
ctttgagacatagtatccattg

SEQ ID NO: 79494 - DNA, 22 bp, Artificial Sequence
  Synthetic oligonucleotide; TTC chr11 5200820 5200841 5200837 5200842 +
tttgagacatagtatccattgc

SEQ ID NO: 79495 - DNA, 22 bp, Artificial Sequence
  Synthetic oligonucleotide; CTT chr11 5200822 5200843 5200839 5200844 +
tgagacatagtatccattgcct

SEQ ID NO: 79496 - DNA, 22 bp, Artificial Sequence
  Synthetic oligonucleotide; TTT chr11 5200823 5200844 5200840 5200845 +
gagacatagtatccattgcctt

SEQ ID NO: 79497 - DNA, 22 bp, Artificial Sequence
  Synthetic oligonucleotide; TTG chr11 5200824 5200845 5200841 5200846 +
agacatagtatccattgccttt

SEQ ID NO: 79498 - DNA, 22 bp, Artificial Sequence
  Synthetic oligonucleotide; TTG chr11 5200841 5200862 5200858 5200863 +
cctttgagaaaatggtcttctt

SEQ ID NO: 79499 - DNA, 22 bp, Artificial Sequence
  Synthetic oligonucleotide; CTT chr11 5200845 5200866 5200862 5200867 +
tgagaaaatggtcttcttttga

SEQ ID NO: 79500 - DNA, 22 bp, Artificial Sequence
  Synthetic oligonucleotide; TTT chr11 5200846 5200867 5200863 5200868 +
gagaaaatggtcttcttttgat

SEQ ID NO: 79501 - DNA, 22 bp, Artificial Sequence
  Synthetic oligonucleotide; TTG chr11 5200847 5200868 5200864 5200869 +
agaaaatggtcttcttttgatg

SEQ ID NO: 79502 - DNA, 22 bp, Artificial Sequence
  Synthetic oligonucleotide; CTT chr11 5200860 5200881 5200877 5200882 +
cttttgatgtcatttaaaagtc

SEQ ID NO: 79503 - DNA, 22 bp, Artificial Sequence
  Synthetic oligonucleotide; TTC chr11 5200861 5200882 5200878 5200883 +
ttttgatgtcatttaaaagtca

SEQ ID NO: 79504 - DNA, 22 bp, Artificial Sequence
  Synthetic oligonucleotide; CTT chr11 5200863 5200884 5200880 5200885 +
ttgatgtcatttaaaagtcatt

SEQ ID NO: 79505 - DNA, 22 bp, Artificial Sequence
  Synthetic oligonucleotide; TTT chr11 5200864 5200885 5200881 5200886 +
tgatgtcatttaaaagtcatta

SEQ ID NO: 79506 - DNA, 22 bp, Artificial Sequence
  Synthetic oligonucleotide; TTT chr11 5200865 5200886 5200882 5200887 +
gatgtcatttaaaagtcattat

SEQ ID NO: 79507 - DNA, 22 bp, Artificial Sequence
  Synthetic oligonucleotide; TTG chr11 5200866 5200887 5200883 5200888 +
atgtcatttaaaagtcattatt

SEQ ID NO: 79508 - DNA, 22 bp, Artificial Sequence
  Synthetic oligonucleotide; TTT chr11 5200875 5200896 5200892 5200897 +
aaaagtcattattttttcactg

SEQ ID NO: 79509 - DNA, 22 bp, Artificial Sequence
  Synthetic oligonucleotide; TTA chr11 5200876 5200897 5200893 5200898 +
aaagtcattattttttcactgt

SEQ ID NO: 79510 - DNA, 22 bp, Artificial Sequence
  Synthetic oligonucleotide; TTA chr11 5200886 5200907 5200903 5200908 +
ttttttcactgtctggatgtga

SEQ ID NO: 79511 - DNA, 22 bp, Artificial Sequence
  Synthetic oligonucleotide; TTT chr11 5200889 5200910 5200906 5200911 +
tttcactgtctggatgtgaaca

SEQ ID NO: 79512 - DNA, 22 bp, Artificial Sequence
  Synthetic oligonucleotide; TTT chr11 5200890 5200911 5200907 5200912 +
ttcactgtctggatgtgaacat

SEQ ID NO: 79513 - DNA, 22 bp, Artificial Sequence
  Synthetic oligonucleotide; TTT chr11 5200891 5200912 5200908 5200913 +
tcactgtctggatgtgaacata

SEQ ID NO: 79514 - DNA, 22 bp, Artificial Sequence
  Synthetic oligonucleotide; TTT chr11 5200892 5200913 5200909 5200914 +
cactgtctggatgtgaacatat

SEQ ID NO: 79515 - DNA, 22 bp, Artificial Sequence
  Synthetic oligonucleotide; TTC chr11 5200893 5200914 5200910 5200915 +
actgtctggatgtgaacatatc

SEQ ID NO: 79516 - DNA, 22 bp, Artificial Sequence
  Synthetic oligonucleotide; CTG chr11 5200897 5200918 5200914 5200919 +
tctggatgtgaacatatcctta

SEQ ID NO: 79517 - DNA, 22 bp, Artificial Sequence
  Synthetic oligonucleotide; CTG chr11 5200901 5200922 5200918 5200923 +
gatgtgaacatatccttagaag

SEQ ID NO: 79518 - DNA, 22 bp, Artificial Sequence
  Synthetic oligonucleotide; CTT chr11 5200918 5200939 5200935 5200940 +
agaagccataagcaaaaacaaa

SEQ ID NO: 79519 - DNA, 22 bp, Artificial Sequence
  Synthetic oligonucleotide; TTA chr11 5200919 5200940 5200936 5200941 +
gaagccataagcaaaaacaaat

SEQ ID NO: 79520 - DNA, 22 bp, Artificial Sequence
  Synthetic oligonucleotide; TTA chr11 5200954 5200975 5200971 5200976 +
gtaaaaggagaaggctagtttt

SEQ ID NO: 79521 - DNA, 22 bp, Artificial Sequence
  Synthetic oligonucleotide; CTA chr11 5200971 5200992 5200988 5200993 +
gttttaaaaaaatacgttgctt

SEQ ID NO: 79522 - DNA, 22 bp, Artificial Sequence
  Synthetic oligonucleotide; TTT chr11 5200975 5200996 5200992 5200997 +
taaaaaaatacgttgcttagac

SEQ ID NO: 79523 - DNA, 22 bp, Artificial Sequence
  Synthetic oligonucleotide; TTT chr11 5200976 5200997 5200993 5200998 +
aaaaaaatacgttgcttagaca

SEQ ID NO: 79524 - DNA, 22 bp, Artificial Sequence
  Synthetic oligonucleotide; TTA chr11 5200977 5200998 5200994 5200999 +
aaaaaatacgttgcttagacat

SEQ ID NO: 79525 - DNA, 22 bp, Artificial Sequence
  Synthetic oligonucleotide; TTG chr11 5200990 5201011 5201007 5201012 +
cttagacattttcccaaggata

SEQ ID NO: 79526 - DNA, 22 bp, Artificial Sequence
  Synthetic oligonucleotide; CTT chr11 5200993 5201014 5201010 5201015 +
agacattttcccaaggatagtg

SEQ ID NO: 79527 - DNA, 22 bp, Artificial Sequence
  Synthetic oligonucleotide; TTA chr11 5200994 5201015 5201011 5201016 +
gacattttcccaaggatagtgg

SEQ ID NO: 79528 - DNA, 22 bp, Artificial Sequence
  Synthetic oligonucleotide; TTT chr11 5201001 5201022 5201018 5201023 +
tcccaaggatagtggtaaaaat

SEQ ID NO: 79529 - DNA, 22 bp, Artificial Sequence
  Synthetic oligonucleotide; TTT chr11 5201002 5201023 5201019 5201024 +
cccaaggatagtggtaaaaatt

SEQ ID NO: 79530 - DNA, 22 bp, Artificial Sequence
  Synthetic oligonucleotide; TTC chr11 5201003 5201024 5201020 5201025 +
ccaaggatagtggtaaaaattt

SEQ ID NO: 79531 - DNA, 22 bp, Artificial Sequence
  Synthetic oligonucleotide; TTT chr11 5201025 5201046 5201042 5201047 +
tataccagtaaagagccgaggt

SEQ ID NO: 79532 - DNA, 22 bp, Artificial Sequence
  Synthetic oligonucleotide; TTT chr11 5201026 5201047 5201043 5201048 +
ataccagtaaagagccgaggtt

SEQ ID NO: 79533 - DNA, 22 bp, Artificial Sequence
  Synthetic oligonucleotide; TTA chr11 5201027 5201048 5201044 5201049 +
taccagtaaagagccgaggttc

SEQ ID NO: 79534 - DNA, 22 bp, Artificial Sequence
  Synthetic oligonucleotide; TTC chr11 5201049 5201070 5201066 5201071 +
ttgaaaaattattttcttctct

SEQ ID NO: 79535 - DNA, 22 bp, Artificial Sequence
  Synthetic oligonucleotide; CTT chr11 5201051 5201072 5201068 5201073 +
gaaaaattattttcttctctcc

SEQ ID NO: 79536 - DNA, 22 bp, Artificial Sequence
  Synthetic oligonucleotide; TTG chr11 5201052 5201073 5201069 5201074 +
aaaaattattttcttctctcca

SEQ ID NO: 79537 - DNA, 22 bp, Artificial Sequence
  Synthetic oligonucleotide; TTA chr11 5201060 5201081 5201077 5201082 +
ttttcttctctccaattcatta

SEQ ID NO: 79538 - DNA, 22 bp, Artificial Sequence
  Synthetic oligonucleotide; TTT chr11 5201063 5201084 5201080 5201085 +
tcttctctccaattcattaaac

SEQ ID NO: 79539 - DNA, 22 bp, Artificial Sequence
  Synthetic oligonucleotide; TTT chr11 5201064 5201085 5201081 5201086 +
cttctctccaattcattaaaca

SEQ ID NO: 79540 - DNA, 22 bp, Artificial Sequence
  Synthetic oligonucleotide; TTC chr11 5201065 5201086 5201082 5201087 +
ttctctccaattcattaaacat

SEQ ID NO: 79541 - DNA, 22 bp, Artificial Sequence
  Synthetic oligonucleotide; CTT chr11 5201067 5201088 5201084 5201089 +
ctctccaattcattaaacattc

SEQ ID NO: 79542 - DNA, 22 bp, Artificial Sequence
  Synthetic oligonucleotide; TTC chr11 5201068 5201089 5201085 5201090 +
tctccaattcattaaacattcg

SEQ ID NO: 79543 - DNA, 22 bp, Artificial Sequence
  Synthetic oligonucleotide; CTC chr11 5201070 5201091 5201087 5201092 +
tccaattcattaaacattcgaa

SEQ ID NO: 79544 - DNA, 22 bp, Artificial Sequence
  Synthetic oligonucleotide; CTC chr11 5201072 5201093 5201089 5201094 +
caattcattaaacattcgaagt

SEQ ID NO: 79545 - DNA, 22 bp, Artificial Sequence
  Synthetic oligonucleotide; TTC chr11 5201078 5201099 5201095 5201100 +
attaaacattcgaagtgaagag

SEQ ID NO: 79546 - DNA, 22 bp, Artificial Sequence
  Synthetic oligonucleotide; TTA chr11 5201082 5201103 5201099 5201104 +
aacattcgaagtgaagagtaat

SEQ ID NO: 79547 - DNA, 22 bp, Artificial Sequence
  Synthetic oligonucleotide; TTC chr11 5201089 5201110 5201106 5201111 +
gaagtgaagagtaatctttggg

SEQ ID NO: 79548 - DNA, 22 bp, Artificial Sequence
  Synthetic oligonucleotide; CTT chr11 5201107 5201128 5201124 5201129 +
tgggctttaaatatcataagtc

SEQ ID NO: 79549 - DNA, 22 bp, Artificial Sequence
  Synthetic oligonucleotide; TTT chr11 5201108 5201129 5201125 5201130 +
gggctttaaatatcataagtct

SEQ ID NO: 79550 - DNA, 22 bp, Artificial Sequence
  Synthetic oligonucleotide; TTG chr11 5201109 5201130 5201126 5201131 +
ggctttaaatatcataagtcta

SEQ ID NO: 79551 - DNA, 22 bp, Artificial Sequence
  Synthetic oligonucleotide; CTT chr11 5201114 5201135 5201131 5201136 +
taaatatcataagtctattaaa

SEQ ID NO: 79552 - DNA, 22 bp, Artificial Sequence
  Synthetic oligonucleotide; TTT chr11 5201115 5201136 5201132 5201137 +
aaatatcataagtctattaaat

SEQ ID NO: 79553 - DNA, 22 bp, Artificial Sequence
  Synthetic oligonucleotide; TTA chr11 5201116 5201137 5201133 5201138 +
aatatcataagtctattaaata

SEQ ID NO: 79554 - DNA, 22 bp, Artificial Sequence
  Synthetic oligonucleotide; CTA chr11 5201131 5201152 5201148 5201153 +
ttaaatagtcacttttccgtca

SEQ ID NO: 79555 - DNA, 22 bp, Artificial Sequence
  Synthetic oligonucleotide; TTA chr11 5201134 5201155 5201151 5201156 +
aatagtcacttttccgtcattt

SEQ ID NO: 79556 - DNA, 22 bp, Artificial Sequence
  Synthetic oligonucleotide; CTT chr11 5201145 5201166 5201162 5201167 +
ttccgtcattttccattttgtg

SEQ ID NO: 79557 - DNA, 22 bp, Artificial Sequence
  Synthetic oligonucleotide; TTT chr11 5201146 5201167 5201163 5201168 +
tccgtcattttccattttgtgc

SEQ ID NO: 79558 - DNA, 22 bp, Artificial Sequence
  Synthetic oligonucleotide; TTT chr11 5201147 5201168 5201164 5201169 +
ccgtcattttccattttgtgcc

SEQ ID NO: 79559 - DNA, 22 bp, Artificial Sequence
  Synthetic oligonucleotide; TTC chr11 5201148 5201169 5201165 5201170 +
cgtcattttccattttgtgccg

SEQ ID NO: 79560 - DNA, 22 bp, Artificial Sequence
  Synthetic oligonucleotide; TTT chr11 5201156 5201177 5201173 5201178 +
tccattttgtgccgtctccaag

SEQ ID NO: 79561 - DNA, 22 bp, Artificial Sequence
  Synthetic oligonucleotide; TTT chr11 5201157 5201178 5201174 5201179 +
ccattttgtgccgtctccaagt

SEQ ID NO: 79562 - DNA, 22 bp, Artificial Sequence
  Synthetic oligonucleotide; TTC chr11 5201158 5201179 5201175 5201180 +
cattttgtgccgtctccaagta

SEQ ID NO: 79563 - DNA, 22 bp, Artificial Sequence
  Synthetic oligonucleotide; TTT chr11 5201163 5201184 5201180 5201185 +
tgtgccgtctccaagtatattt

SEQ ID NO: 79564 - DNA, 22 bp, Artificial Sequence
  Synthetic oligonucleotide; TTT chr11 5201164 5201185 5201181 5201186 +
gtgccgtctccaagtatatttt

SEQ ID NO: 79565 - DNA, 22 bp, Artificial Sequence
  Synthetic oligonucleotide; TTG chr11 5201165 5201186 5201182 5201187 +
tgccgtctccaagtatattttt

SEQ ID NO: 79566 - DNA, 22 bp, Artificial Sequence
  Synthetic oligonucleotide; CTC chr11 5201174 5201195 5201191 5201196 +
caagtatattttttctccaaat

SEQ ID NO: 79567 - DNA, 22 bp, Artificial Sequence
  Synthetic oligonucleotide; TTT chr11 5201185 5201206 5201202 5201207 +
tttctccaaatactatttaatg

SEQ ID NO: 79568 - DNA, 22 bp, Artificial Sequence
  Synthetic oligonucleotide; TTT chr11 5201186 5201207 5201203 5201208 +
ttctccaaatactatttaatga

SEQ ID NO: 79569 - DNA, 22 bp, Artificial Sequence
  Synthetic oligonucleotide; TTT chr11 5201187 5201208 5201204 5201209 +
tctccaaatactatttaatgaa

SEQ ID NO: 79570 - DNA, 22 bp, Artificial Sequence
  Synthetic oligonucleotide; TTT chr11 5201188 5201209 5201205 5201210 +
ctccaaatactatttaatgaag

SEQ ID NO: 79571 - DNA, 22 bp, Artificial Sequence
  Synthetic oligonucleotide; TTC chr11 5201189 5201210 5201206 5201211 +
tccaaatactatttaatgaaga

SEQ ID NO: 79572 - DNA, 22 bp, Artificial Sequence
  Synthetic oligonucleotide; CTC chr11 5201191 5201212 5201208 5201213 +
caaatactatttaatgaagata

SEQ ID NO: 79573 - DNA, 22 bp, Artificial Sequence
  Synthetic oligonucleotide; CTA chr11 5201200 5201221 5201217 5201222 +
tttaatgaagatactcctgttt

SEQ ID NO: 79574 - DNA, 22 bp, Artificial Sequence
  Synthetic oligonucleotide; TTT chr11 5201203 5201224 5201220 5201225 +
aatgaagatactcctgttttct

SEQ ID NO: 79575 - DNA, 22 bp, Artificial Sequence
  Synthetic oligonucleotide; TTA chr11 5201204 5201225 5201221 5201226 +
atgaagatactcctgttttctc

SEQ ID NO: 79576 - DNA, 22 bp, Artificial Sequence
  Synthetic oligonucleotide; CTC chr11 5201216 5201237 5201233 5201238 +
ctgttttctccccctccagatg

SEQ ID NO: 79577 - DNA, 22 bp, Artificial Sequence
  Synthetic oligonucleotide; CTG chr11 5201219 5201240 5201236 5201241 +
ttttctccccctccagatgacg

SEQ ID NO: 79578 - DNA, 22 bp, Artificial Sequence
  Synthetic oligonucleotide; TTT chr11 5201222 5201243 5201239 5201244 +
tctccccctccagatgacgtag

SEQ ID NO: 79579 - DNA, 22 bp, Artificial Sequence
  Synthetic oligonucleotide; TTT chr11 5201223 5201244 5201240 5201245 +
ctccccctccagatgacgtagc

SEQ ID NO: 79580 - DNA, 22 bp, Artificial Sequence
  Synthetic oligonucleotide; TTC chr11 5201224 5201245 5201241 5201246 +
tccccctccagatgacgtagcc

SEQ ID NO: 79581 - DNA, 22 bp, Artificial Sequence
  Synthetic oligonucleotide; CTC chr11 5201226 5201247 5201243 5201248 +
cccctccagatgacgtagccag

SEQ ID NO: 79582 - DNA, 22 bp, Artificial Sequence
  Synthetic oligonucleotide; CTC chr11 5201232 5201253 5201249 5201254 +
cagatgacgtagccagcaatta

SEQ ID NO: 79583 - DNA, 22 bp, Artificial Sequence
  Synthetic oligonucleotide; TTA chr11 5201254 5201275 5201271 5201276 +
ctttttcttcattggtgataag

SEQ ID NO: 79584 - DNA, 22 bp, Artificial Sequence
  Synthetic oligonucleotide; CTT chr11 5201257 5201278 5201274 5201279 +
tttcttcattggtgataagcag

SEQ ID NO: 79585 - DNA, 22 bp, Artificial Sequence
  Synthetic oligonucleotide; TTT chr11 5201258 5201279 5201275 5201280 +
ttcttcattggtgataagcaga

SEQ ID NO: 79586 - DNA, 22 bp, Artificial Sequence
  Synthetic oligonucleotide; TTT chr11 5201259 5201280 5201276 5201281 +
tcttcattggtgataagcagac

SEQ ID NO: 79587 - DNA, 22 bp, Artificial Sequence
  Synthetic oligonucleotide; TTT chr11 5201260 5201281 5201277 5201282 +
cttcattggtgataagcagaca

SEQ ID NO: 79588 - DNA, 22 bp, Artificial Sequence
  Synthetic oligonucleotide; TTC chr11 5201261 5201282 5201278 5201283 +
ttcattggtgataagcagacag

SEQ ID NO: 79589 - DNA, 22 bp, Artificial Sequence
  Synthetic oligonucleotide; CTT chr11 5201263 5201284 5201280 5201285 +
cattggtgataagcagacagga

SEQ ID NO: 79590 - DNA, 22 bp, Artificial Sequence
  Synthetic oligonucleotide; TTC chr11 5201264 5201285 5201281 5201286 +
attggtgataagcagacaggaa

SEQ ID NO: 79591 - DNA, 22 bp, Artificial Sequence
  Synthetic oligonucleotide; TTG chr11 5201268 5201289 5201285 5201290 +
gtgataagcagacaggaatatt

SEQ ID NO: 79592 - DNA, 22 bp, Artificial Sequence
  Synthetic oligonucleotide; TTT chr11 5201291 5201312 5201308 5201313 +
atgcatgagaccttgggtaaat

SEQ ID NO: 79593 - DNA, 22 bp, Artificial Sequence
  Synthetic oligonucleotide; TTA chr11 5201292 5201313 5201309 5201314 +
tgcatgagaccttgggtaaatg

SEQ ID NO: 79594 - DNA, 22 bp, Artificial Sequence
  Synthetic oligonucleotide; CTT chr11 5201305 5201326 5201322 5201327 +
gggtaaatgatttctcactgga

SEQ ID NO: 79595 - DNA, 22 bp, Artificial Sequence
  Synthetic oligonucleotide; TTG chr11 5201306 5201327 5201323 5201328 +
ggtaaatgatttctcactggag

SEQ ID NO: 79596 - DNA, 22 bp, Artificial Sequence
  Synthetic oligonucleotide; TTT chr11 5201318 5201339 5201335 5201340 +
ctcactggagctctggcctctt

SEQ ID NO: 79597 - DNA, 22 bp, Artificial Sequence
  Synthetic oligonucleotide; TTC chr11 5201319 5201340 5201336 5201341 +
tcactggagctctggcctcttg

SEQ ID NO: 79598 - DNA, 22 bp, Artificial Sequence
  Synthetic oligonucleotide; CTC chr11 5201321 5201342 5201338 5201343 +
actggagctctggcctcttgag

SEQ ID NO: 79599 - DNA, 22 bp, Artificial Sequence
  Synthetic oligonucleotide; CTG chr11 5201325 5201346 5201342 5201347 +
gagctctggcctcttgagatgt

SEQ ID NO: 79600 - DNA, 22 bp, Artificial Sequence
  Synthetic oligonucleotide; CTC chr11 5201331 5201352 5201348 5201353 +
tggcctcttgagatgttcaact

SEQ ID NO: 79601 - DNA, 22 bp, Artificial Sequence
  Synthetic oligonucleotide; CTG chr11 5201333 5201354 5201350 5201355 +
gcctcttgagatgttcaactca

SEQ ID NO: 79602 - DNA, 22 bp, Artificial Sequence
  Synthetic oligonucleotide; CTC chr11 5201338 5201359 5201355 5201360 +
ttgagatgttcaactcatttgt

SEQ ID NO: 79603 - DNA, 22 bp, Artificial Sequence
  Synthetic oligonucleotide; CTT chr11 5201340 5201361 5201357 5201362 +
gagatgttcaactcatttgtgc

SEQ ID NO: 79604 - DNA, 22 bp, Artificial Sequence
  Synthetic oligonucleotide; TTG chr11 5201341 5201362 5201358 5201363 +
agatgttcaactcatttgtgcc

SEQ ID NO: 79605 - DNA, 22 bp, Artificial Sequence
  Synthetic oligonucleotide; TTC chr11 5201349 5201370 5201366 5201371 +
aactcatttgtgcctttgtgat

SEQ ID NO: 79606 - DNA, 22 bp, Artificial Sequence
  Synthetic oligonucleotide; CTC chr11 5201354 5201375 5201371 5201376 +
atttgtgcctttgtgatgtaga

SEQ ID NO: 79607 - DNA, 22 bp, Artificial Sequence
  Synthetic oligonucleotide; TTT chr11 5201358 5201379 5201375 5201380 +
gtgcctttgtgatgtagagaat

SEQ ID NO: 79608 - DNA, 22 bp, Artificial Sequence
  Synthetic oligonucleotide; TTG chr11 5201359 5201380 5201376 5201381 +
tgcctttgtgatgtagagaatt

SEQ ID NO: 79609 - DNA, 22 bp, Artificial Sequence
  Synthetic oligonucleotide; CTT chr11 5201365 5201386 5201382 5201387 +
tgtgatgtagagaattagattg

SEQ ID NO: 79610 - DNA, 22 bp, Artificial Sequence
  Synthetic oligonucleotide; TTT chr11 5201366 5201387 5201383 5201388 +
gtgatgtagagaattagattga

SEQ ID NO: 79611 - DNA, 22 bp, Artificial Sequence
  Synthetic oligonucleotide; TTG chr11 5201367 5201388 5201384 5201389 +
tgatgtagagaattagattgaa

SEQ ID NO: 79612 - DNA, 22 bp, Artificial Sequence
  Synthetic oligonucleotide; TTA chr11 5201382 5201403 5201399 5201404 +
gattgaagacactgagcctttg

SEQ ID NO: 79613 - DNA, 22 bp, Artificial Sequence
  Synthetic oligonucleotide; TTG chr11 5201387 5201408 5201404 5201409 +
aagacactgagcctttgatagc

SEQ ID NO: 79614 - DNA, 22 bp, Artificial Sequence
  Synthetic oligonucleotide; CTG chr11 5201396 5201417 5201413 5201418 +
agcctttgatagcagctcagtg

SEQ ID NO: 79615 - DNA, 22 bp, Artificial Sequence
  Synthetic oligonucleotide; CTT chr11 5201402 5201423 5201419 5201424 +
tgatagcagctcagtgcttccc

SEQ ID NO: 79616 - DNA, 22 bp, Artificial Sequence
  Synthetic oligonucleotide; TTT chr11 5201403 5201424 5201420 5201425 +
gatagcagctcagtgcttccca

SEQ ID NO: 79617 - DNA, 22 bp, Artificial Sequence
  Synthetic oligonucleotide; TTG chr11 5201404 5201425 5201421 5201426 +
atagcagctcagtgcttcccat

SEQ ID NO: 79618 - DNA, 22 bp, Artificial Sequence
  Synthetic oligonucleotide; CTC chr11 5201414 5201435 5201431 5201436 +
agtgcttcccattcctttattt

SEQ ID NO: 79619 - DNA, 22 bp, Artificial Sequence
  Synthetic oligonucleotide; CTT chr11 5201421 5201442 5201438 5201443 +
cccattcctttatttattcagt

SEQ ID NO: 79620 - DNA, 22 bp, Artificial Sequence
  Synthetic oligonucleotide; TTC chr11 5201422 5201443 5201439 5201444 +
ccattcctttatttattcagtt

SEQ ID NO: 79621 - DNA, 22 bp, Artificial Sequence
  Synthetic oligonucleotide; TTC chr11 5201428 5201449 5201445 5201450 +
ctttatttattcagttaatgag

SEQ ID NO: 79622 - DNA, 22 bp, Artificial Sequence
  Synthetic oligonucleotide; CTT chr11 5201431 5201452 5201448 5201453 +
tatttattcagttaatgagctg

SEQ ID NO: 79623 - DNA, 22 bp, Artificial Sequence
  Synthetic oligonucleotide; TTT chr11 5201432 5201453 5201449 5201454 +
atttattcagttaatgagctga

SEQ ID NO: 79624 - DNA, 22 bp, Artificial Sequence
  Synthetic oligonucleotide; TTA chr11 5201433 5201454 5201450 5201455 +
tttattcagttaatgagctgat

SEQ ID NO: 79625 - DNA, 22 bp, Artificial Sequence
  Synthetic oligonucleotide; TTT chr11 5201436 5201457 5201453 5201458 +
attcagttaatgagctgattaa

SEQ ID NO: 79626 - DNA, 22 bp, Artificial Sequence
  Synthetic oligonucleotide; TTA chr11 5201437 5201458 5201454 5201459 +
ttcagttaatgagctgattaac

SEQ ID NO: 79627 - DNA, 22 bp, Artificial Sequence
  Synthetic oligonucleotide; TTC chr11 5201440 5201461 5201457 5201462 +
agttaatgagctgattaactat

SEQ ID NO: 79628 - DNA, 22 bp, Artificial Sequence
  Synthetic oligonucleotide; TTA chr11 5201445 5201466 5201462 5201467 +
atgagctgattaactatttatt

SEQ ID NO: 79629 - DNA, 22 bp, Artificial Sequence
  Synthetic oligonucleotide; CTG chr11 5201453 5201474 5201470 5201475 +
attaactatttattcaatatac

SEQ ID NO: 79630 - DNA, 22 bp, Artificial Sequence
  Synthetic oligonucleotide; TTA chr11 5201457 5201478 5201474 5201479 +
actatttattcaatatacattt

SEQ ID NO: 79631 - DNA, 22 bp, Artificial Sequence
  Synthetic oligonucleotide; CTA chr11 5201461 5201482 5201478 5201483 +
tttattcaatatacatttattc

SEQ ID NO: 79632 - DNA, 22 bp, Artificial Sequence
  Synthetic oligonucleotide; TTT chr11 5201464 5201485 5201481 5201486 +
attcaatatacatttattcaat

SEQ ID NO: 79633 - DNA, 22 bp, Artificial Sequence
  Synthetic oligonucleotide; TTA chr11 5201465 5201486 5201482 5201487 +
ttcaatatacatttattcaatg

SEQ ID NO: 79634 - DNA, 22 bp, Artificial Sequence
  Synthetic oligonucleotide; TTC chr11 5201468 5201489 5201485 5201490 +
aatatacatttattcaatgtat

SEQ ID NO: 79635 - DNA, 22 bp, Artificial Sequence
  Synthetic oligonucleotide; TTT chr11 5201479 5201500 5201496 5201501 +
attcaatgtattggccaattgt

SEQ ID NO: 79636 - DNA, 22 bp, Artificial Sequence
  Synthetic oligonucleotide; TTA chr11 5201480 5201501 5201497 5201502 +
ttcaatgtattggccaattgtg

SEQ ID NO: 79637 - DNA, 22 bp, Artificial Sequence
  Synthetic oligonucleotide; TTC chr11 5201483 5201504 5201500 5201505 +
aatgtattggccaattgtgttt

SEQ ID NO: 79638 - DNA, 22 bp, Artificial Sequence
  Synthetic oligonucleotide; TTG chr11 5201492 5201513 5201509 5201514 +
gccaattgtgttttctttctta

SEQ ID NO: 79639 - DNA, 22 bp, Artificial Sequence
  Synthetic oligonucleotide; TTG chr11 5201500 5201521 5201517 5201522 +
tgttttctttcttagaacctgc

SEQ ID NO: 79640 - DNA, 22 bp, Artificial Sequence
  Synthetic oligonucleotide; TTT chr11 5201505 5201526 5201522 5201527 +
tctttcttagaacctgcagttc

SEQ ID NO: 79641 - DNA, 22 bp, Artificial Sequence
  Synthetic oligonucleotide; TTT chr11 5201506 5201527 5201523 5201528 +
ctttcttagaacctgcagttct

SEQ ID NO: 79642 - DNA, 22 bp, Artificial Sequence
  Synthetic oligonucleotide; TTC chr11 5201507 5201528 5201524 5201529 +
tttcttagaacctgcagttcta

SEQ ID NO: 79643 - DNA, 22 bp, Artificial Sequence
  Synthetic oligonucleotide; CTT chr11 5201509 5201530 5201526 5201531 +
tcttagaacctgcagttctaca

SEQ ID NO: 79644 - DNA, 22 bp, Artificial Sequence
  Synthetic oligonucleotide; TTT chr11 5201510 5201531 5201527 5201532 +
cttagaacctgcagttctacag

SEQ ID NO: 79645 - DNA, 22 bp, Artificial Sequence
  Synthetic oligonucleotide; TTC chr11 5201511 5201532 5201528 5201533 +
ttagaacctgcagttctacaga

SEQ ID NO: 79646 - DNA, 22 bp, Artificial Sequence
  Synthetic oligonucleotide; CTT chr11 5201513 5201534 5201530 5201535 +
agaacctgcagttctacagatc

SEQ ID NO: 79647 - DNA, 22 bp, Artificial Sequence
  Synthetic oligonucleotide; TTA chr11 5201514 5201535 5201531 5201536 +
gaacctgcagttctacagatca

SEQ ID NO: 79648 - DNA, 22 bp, Artificial Sequence
  Synthetic oligonucleotide; CTG chr11 5201521 5201542 5201538 5201543 +
cagttctacagatcacaaagcc

SEQ ID NO: 79649 - DNA, 22 bp, Artificial Sequence
  Synthetic oligonucleotide; TTC chr11 5201527 5201548 5201544 5201549 +
tacagatcacaaagccaggctc

SEQ ID NO: 79650 - DNA, 22 bp, Artificial Sequence
  Synthetic oligonucleotide; CTA chr11 5201529 5201550 5201546 5201551 +
cagatcacaaagccaggctcaa

SEQ ID NO: 79651 - DNA, 22 bp, Artificial Sequence
  Synthetic oligonucleotide; CTC chr11 5201549 5201570 5201566 5201571 +
aaacaagcaagcttataatttc

SEQ ID NO: 79652 - DNA, 22 bp, Artificial Sequence
  Synthetic oligonucleotide; CTT chr11 5201563 5201584 5201580 5201585 +
ataatttcaaaagcctcatggt

SEQ ID NO: 79653 - DNA, 22 bp, Artificial Sequence
  Synthetic oligonucleotide; TTA chr11 5201564 5201585 5201581 5201586 +
taatttcaaaagcctcatggta

SEQ ID NO: 79654 - DNA, 22 bp, Artificial Sequence
  Synthetic oligonucleotide; TTT chr11 5201570 5201591 5201587 5201592 +
caaaagcctcatggtagcagaa

SEQ ID NO: 79655 - DNA, 22 bp, Artificial Sequence
  Synthetic oligonucleotide; TTC chr11 5201571 5201592 5201588 5201593 +
aaaagcctcatggtagcagaat

SEQ ID NO: 79656 - DNA, 22 bp, Artificial Sequence
  Synthetic oligonucleotide; CTC chr11 5201580 5201601 5201597 5201602 +
atggtagcagaatcaattggct

SEQ ID NO: 79657 - DNA, 22 bp, Artificial Sequence
  Synthetic oligonucleotide; TTG chr11 5201599 5201620 5201616 5201621 +
gcttcttctttacattgtttgc

SEQ ID NO: 79658 - DNA, 22 bp, Artificial Sequence
  Synthetic oligonucleotide; CTT chr11 5201603 5201624 5201620 5201625 +
cttctttacattgtttgcctgc

SEQ ID NO: 79659 - DNA, 22 bp, Artificial Sequence
  Synthetic oligonucleotide; TTC chr11 5201604 5201625 5201621 5201626 +
ttctttacattgtttgcctgct

SEQ ID NO: 79660 - DNA, 22 bp, Artificial Sequence
  Synthetic oligonucleotide; CTT chr11 5201606 5201627 5201623 5201628 +
ctttacattgtttgcctgcttt

SEQ ID NO: 79661 - DNA, 22 bp, Artificial Sequence
  Synthetic oligonucleotide; TTC chr11 5201607 5201628 5201624 5201629 +
tttacattgtttgcctgcttta

SEQ ID NO: 79662 - DNA, 22 bp, Artificial Sequence
  Synthetic oligonucleotide; CTT chr11 5201609 5201630 5201626 5201631 +
tacattgtttgcctgctttaag

SEQ ID NO: 79663 - DNA, 22 bp, Artificial Sequence
  Synthetic oligonucleotide; TTT chr11 5201610 5201631 5201627 5201632 +
acattgtttgcctgctttaagt

SEQ ID NO: 79664 - DNA, 22 bp, Artificial Sequence
  Synthetic oligonucleotide; TTA chr11 5201611 5201632 5201628 5201633 +
cattgtttgcctgctttaagtt

SEQ ID NO: 79665 - DNA, 22 bp, Artificial Sequence
  Synthetic oligonucleotide; TTG chr11 5201616 5201637 5201633 5201638 +
tttgcctgctttaagttccaga

SEQ ID NO: 79666 - DNA, 22 bp, Artificial Sequence
  Synthetic oligonucleotide; TTT chr11 5201619 5201640 5201636 5201641 +
gcctgctttaagttccagacct

SEQ ID NO: 79667 - DNA, 22 bp, Artificial Sequence
  Synthetic oligonucleotide; TTG chr11 5201620 5201641 5201637 5201642 +
cctgctttaagttccagacctg

SEQ ID NO: 79668 - DNA, 22 bp, Artificial Sequence
  Synthetic oligonucleotide; CTG chr11 5201624 5201645 5201641 5201646 +
ctttaagttccagacctgagaa

SEQ ID NO: 79669 - DNA, 22 bp, Artificial Sequence
  Synthetic oligonucleotide; CTT chr11 5201627 5201648 5201644 5201649 +
taagttccagacctgagaatca

SEQ ID NO: 79670 - DNA, 22 bp, Artificial Sequence
  Synthetic oligonucleotide; TTT chr11 5201628 5201649 5201645 5201650 +
aagttccagacctgagaatcat

SEQ ID NO: 79671 - DNA, 22 bp, Artificial Sequence
  Synthetic oligonucleotide; TTA chr11 5201629 5201650 5201646 5201651 +
agttccagacctgagaatcatc

SEQ ID NO: 79672 - DNA, 22 bp, Artificial Sequence
  Synthetic oligonucleotide; TTC chr11 5201634 5201655 5201651 5201656 +
cagacctgagaatcatcataag

SEQ ID NO: 79673 - DNA, 22 bp, Artificial Sequence
  Synthetic oligonucleotide; CTG chr11 5201642 5201663 5201659 5201664 +
agaatcatcataagttttttta

SEQ ID NO: 79674 - DNA, 22 bp, Artificial Sequence
  Synthetic oligonucleotide; TTT chr11 5201659 5201680 5201676 5201681 +
ttttaaagctctaataatgtaa

SEQ ID NO: 79675 - DNA, 22 bp, Artificial Sequence
  Synthetic oligonucleotide; TTT chr11 5201660 5201681 5201677 5201682 +
tttaaagctctaataatgtaaa

SEQ ID NO: 79676 - DNA, 22 bp, Artificial Sequence
  Synthetic oligonucleotide; TTT chr11 5201661 5201682 5201678 5201683 +
ttaaagctctaataatgtaaac

SEQ ID NO: 79677 - DNA, 22 bp, Artificial Sequence
  Synthetic oligonucleotide; TTT chr11 5201662 5201683 5201679 5201684 +
taaagctctaataatgtaaaca

SEQ ID NO: 79678 - DNA, 22 bp, Artificial Sequence
  Synthetic oligonucleotide; TTT chr11 5201663 5201684 5201680 5201685 +
aaagctctaataatgtaaacag

SEQ ID NO: 79679 - DNA, 22 bp, Artificial Sequence
  Synthetic oligonucleotide; TTA chr11 5201664 5201685 5201681 5201686 +
aagctctaataatgtaaacaga

SEQ ID NO: 79680 - DNA, 22 bp, Artificial Sequence
  Synthetic oligonucleotide; CTC chr11 5201670 5201691 5201687 5201692 +
taataatgtaaacagatgttca

SEQ ID NO: 79681 - DNA, 22 bp, Artificial Sequence
  Synthetic oligonucleotide; CTA chr11 5201672 5201693 5201689 5201694 +
ataatgtaaacagatgttcaaa

SEQ ID NO: 79682 - DNA, 22 bp, Artificial Sequence
  Synthetic oligonucleotide; TTC chr11 5201691 5201712 5201708 5201713 +
aaaagtccatactttcatgttt

SEQ ID NO: 79683 - DNA, 22 bp, Artificial Sequence
  Synthetic oligonucleotide; CTT chr11 5201705 5201726 5201722 5201727 +
tcatgtttgattgagtaacttc

SEQ ID NO: 79684 - DNA, 22 bp, Artificial Sequence
  Synthetic oligonucleotide; TTT chr11 5201706 5201727 5201723 5201728 +
catgtttgattgagtaacttcg

SEQ ID NO: 79685 - DNA, 22 bp, Artificial Sequence
  Synthetic oligonucleotide; TTC chr11 5201707 5201728 5201724 5201729 +
atgtttgattgagtaacttcga

SEQ ID NO: 79686 - DNA, 22 bp, Artificial Sequence
  Synthetic oligonucleotide; TTT chr11 5201713 5201734 5201730 5201735 +
gattgagtaacttcgagatgtt

SEQ ID NO: 79687 - DNA, 22 bp, Artificial Sequence
  Synthetic oligonucleotide; TTG chr11 5201714 5201735 5201731 5201736 +
attgagtaacttcgagatgtta

SEQ ID NO: 79688 - DNA, 22 bp, Artificial Sequence
  Synthetic oligonucleotide; TTG chr11 5201718 5201739 5201735 5201740 +
agtaacttcgagatgttaaagt

SEQ ID NO: 79689 - DNA, 22 bp, Artificial Sequence
  Synthetic oligonucleotide; CTT chr11 5201726 5201747 5201743 5201748 +
cgagatgttaaagtaacttcag

SEQ ID NO: 79690 - DNA, 22 bp, Artificial Sequence
  Synthetic oligonucleotide; TTC chr11 5201727 5201748 5201744 5201749 +
gagatgttaaagtaacttcaga

SEQ ID NO: 79691 - DNA, 22 bp, Artificial Sequence
  Synthetic oligonucleotide; TTA chr11 5201736 5201757 5201753 5201758 +
aagtaacttcagatttgggctg

SEQ ID NO: 79692 - DNA, 22 bp, Artificial Sequence
  Synthetic oligonucleotide; CTT chr11 5201745 5201766 5201762 5201767 +
cagatttgggctgccctttatg

SEQ ID NO: 79693 - DNA, 22 bp, Artificial Sequence
  Synthetic oligonucleotide; TTC chr11 5201746 5201767 5201763 5201768 +
agatttgggctgccctttatgt

SEQ ID NO: 79694 - DNA, 22 bp, Artificial Sequence
  Synthetic oligonucleotide; TTT chr11 5201752 5201773 5201769 5201774 +
gggctgccctttatgtcctact

SEQ ID NO: 79695 - DNA, 22 bp, Artificial Sequence
  Synthetic oligonucleotide; TTG chr11 5201753 5201774 5201770 5201775 +
ggctgccctttatgtcctactt

SEQ ID NO: 79696 - DNA, 22 bp, Artificial Sequence
  Synthetic oligonucleotide; CTG chr11 5201758 5201779 5201775 5201780 +
ccctttatgtcctacttttcag

SEQ ID NO: 79697 - DNA, 22 bp, Artificial Sequence
  Synthetic oligonucleotide; CTT chr11 5201763 5201784 5201780 5201785 +
tatgtcctacttttcagctttg

SEQ ID NO: 79698 - DNA, 22 bp, Artificial Sequence
  Synthetic oligonucleotide; TTT chr11 5201764 5201785 5201781 5201786 +
atgtcctacttttcagctttgt

SEQ ID NO: 79699 - DNA, 22 bp, Artificial Sequence
  Synthetic oligonucleotide; TTA chr11 5201765 5201786 5201782 5201787 +
tgtcctacttttcagctttgtc

SEQ ID NO: 79700 - DNA, 22 bp, Artificial Sequence
  Synthetic oligonucleotide; CTA chr11 5201772 5201793 5201789 5201794 +
cttttcagctttgtcttattag

SEQ ID NO: 79701 - DNA, 22 bp, Artificial Sequence
  Synthetic oligonucleotide; CTT chr11 5201775 5201796 5201792 5201797 +
ttcagctttgtcttattagcct

SEQ ID NO: 79702 - DNA, 22 bp, Artificial Sequence
  Synthetic oligonucleotide; TTT chr11 5201776 5201797 5201793 5201798 +
tcagctttgtcttattagcctc

SEQ ID NO: 79703 - DNA, 22 bp, Artificial Sequence
  Synthetic oligonucleotide; TTT chr11 5201777 5201798 5201794 5201799 +
cagctttgtcttattagcctca

SEQ ID NO: 79704 - DNA, 22 bp, Artificial Sequence
  Synthetic oligonucleotide; TTC chr11 5201778 5201799 5201795 5201800 +
agctttgtcttattagcctcac

SEQ ID NO: 79705 - DNA, 22 bp, Artificial Sequence
  Synthetic oligonucleotide; CTT chr11 5201783 5201804 5201800 5201805 +
tgtcttattagcctcacaacac

SEQ ID NO: 79706 - DNA, 22 bp, Artificial Sequence
  Synthetic oligonucleotide; TTT chr11 5201784 5201805 5201801 5201806 +
gtcttattagcctcacaacaca

SEQ ID NO: 79707 - DNA, 22 bp, Artificial Sequence
  Synthetic oligonucleotide; TTG chr11 5201785 5201806 5201802 5201807 +
tcttattagcctcacaacacag

SEQ ID NO: 79708 - DNA, 22 bp, Artificial Sequence
  Synthetic oligonucleotide; CTT chr11 5201789 5201810 5201806 5201811 +
attagcctcacaacacagttcc

SEQ ID NO: 79709 - DNA, 22 bp, Artificial Sequence
  Synthetic oligonucleotide; TTA chr11 5201790 5201811 5201807 5201812 +
ttagcctcacaacacagttcca

SEQ ID NO: 79710 - DNA, 22 bp, Artificial Sequence
  Synthetic oligonucleotide; TTA chr11 5201793 5201814 5201810 5201815 +
gcctcacaacacagttccacag

SEQ ID NO: 79711 - DNA, 22 bp, Artificial Sequence
  Synthetic oligonucleotide; CTC chr11 5201798 5201819 5201815 5201820 +
acaacacagttccacagacttt

SEQ ID NO: 79712 - DNA, 22 bp, Artificial Sequence
  Synthetic oligonucleotide; TTC chr11 5201810 5201831 5201827 5201832 +
cacagactttcttctcaatgta

SEQ ID NO: 79713 - DNA, 22 bp, Artificial Sequence
  Synthetic oligonucleotide; CTT chr11 5201819 5201840 5201836 5201841 +
tcttctcaatgtactctctata

SEQ ID NO: 79714 - DNA, 22 bp, Artificial Sequence
  Synthetic oligonucleotide; TTT chr11 5201820 5201841 5201837 5201842 +
cttctcaatgtactctctatac

SEQ ID NO: 79715 - DNA, 22 bp, Artificial Sequence
  Synthetic oligonucleotide; TTC chr11 5201821 5201842 5201838 5201843 +
ttctcaatgtactctctatact

SEQ ID NO: 79716 - DNA, 22 bp, Artificial Sequence
  Synthetic oligonucleotide; CTT chr11 5201823 5201844 5201840 5201845 +
ctcaatgtactctctatactac

SEQ ID NO: 79717 - DNA, 22 bp, Artificial Sequence
  Synthetic oligonucleotide; TTC chr11 5201824 5201845 5201841 5201846 +
tcaatgtactctctatactaca

SEQ ID NO: 79718 - DNA, 22 bp, Artificial Sequence
  Synthetic oligonucleotide; CTC chr11 5201826 5201847 5201843 5201848 +
aatgtactctctatactacact

SEQ ID NO: 79719 - DNA, 22 bp, Artificial Sequence
  Synthetic oligonucleotide; CTC chr11 5201835 5201856 5201852 5201857 +
tctatactacactgacgtcttc

SEQ ID NO: 79720 - DNA, 22 bp, Artificial Sequence
  Synthetic oligonucleotide; CTC chr11 5201837 5201858 5201854 5201859 +
tatactacactgacgtcttcta

SEQ ID NO: 79721 - DNA, 22 bp, Artificial Sequence
  Synthetic oligonucleotide; CTA chr11 5201839 5201860 5201856 5201861 +
tactacactgacgtcttctagc

SEQ ID NO: 79722 - DNA, 22 bp, Artificial Sequence
  Synthetic oligonucleotide; CTA chr11 5201844 5201865 5201861 5201866 +
cactgacgtcttctagcagtct

SEQ ID NO: 79723 - DNA, 22 bp, Artificial Sequence
  Synthetic oligonucleotide; CTG chr11 5201849 5201870 5201866 5201871 +
acgtcttctagcagtctaacca

SEQ ID NO: 79724 - DNA, 22 bp, Artificial Sequence
  Synthetic oligonucleotide; CTT chr11 5201856 5201877 5201873 5201878 +
ctagcagtctaaccattgtttt

SEQ ID NO: 79725 - DNA, 22 bp, Artificial Sequence
  Synthetic oligonucleotide; TTC chr11 5201857 5201878 5201874 5201879 +
tagcagtctaaccattgttttt

SEQ ID NO: 79726 - DNA, 22 bp, Artificial Sequence
  Synthetic oligonucleotide; CTA chr11 5201859 5201880 5201876 5201881 +
gcagtctaaccattgtttttct

SEQ ID NO: 79727 - DNA, 22 bp, Artificial Sequence
  Synthetic oligonucleotide; CTA chr11 5201867 5201888 5201884 5201889 +
accattgtttttcttgccctga

SEQ ID NO: 79728 - DNA, 22 bp, Artificial Sequence
  Synthetic oligonucleotide; TTG chr11 5201874 5201895 5201891 5201896 +
tttttcttgccctgactccttc

SEQ ID NO: 79729 - DNA, 22 bp, Artificial Sequence
  Synthetic oligonucleotide; TTT chr11 5201877 5201898 5201894 5201899 +
ttcttgccctgactccttctca

SEQ ID NO: 79730 - DNA, 22 bp, Artificial Sequence
  Synthetic oligonucleotide; TTT chr11 5201878 5201899 5201895 5201900 +
tcttgccctgactccttctcag

SEQ ID NO: 79731 - DNA, 22 bp, Artificial Sequence
  Synthetic oligonucleotide; TTT chr11 5201879 5201900 5201896 5201901 +
cttgccctgactccttctcagc

SEQ ID NO: 79732 - DNA, 22 bp, Artificial Sequence
  Synthetic oligonucleotide; TTC chr11 5201880 5201901 5201897 5201902 +
ttgccctgactccttctcagca

SEQ ID NO: 79733 - DNA, 22 bp, Artificial Sequence
  Synthetic oligonucleotide; CTT chr11 5201882 5201903 5201899 5201904 +
gccctgactccttctcagcatt

SEQ ID NO: 79734 - DNA, 22 bp, Artificial Sequence
  Synthetic oligonucleotide; TTG chr11 5201883 5201904 5201900 5201905 +
ccctgactccttctcagcattg

SEQ ID NO: 79735 - DNA, 22 bp, Artificial Sequence
  Synthetic oligonucleotide; CTG chr11 5201888 5201909 5201905 5201910 +
actccttctcagcattgaataa

SEQ ID NO: 79736 - DNA, 22 bp, Artificial Sequence
  Synthetic oligonucleotide; CTC chr11 5201892 5201913 5201909 5201914 +
cttctcagcattgaataactta

SEQ ID NO: 79737 - DNA, 22 bp, Artificial Sequence
  Synthetic oligonucleotide; CTT chr11 5201895 5201916 5201912 5201917 +
ctcagcattgaataacttagct

SEQ ID NO: 79738 - DNA, 22 bp, Artificial Sequence
  Synthetic oligonucleotide; TTC chr11 5201896 5201917 5201913 5201918 +
tcagcattgaataacttagctc

SEQ ID NO: 79739 - DNA, 22 bp, Artificial Sequence
  Synthetic oligonucleotide; CTC chr11 5201898 5201919 5201915 5201920 +
agcattgaataacttagctcac

SEQ ID NO: 79740 - DNA, 22 bp, Artificial Sequence
  Synthetic oligonucleotide; TTG chr11 5201905 5201926 5201922 5201927 +
aataacttagctcactattttt

SEQ ID NO: 79741 - DNA, 22 bp, Artificial Sequence
  Synthetic oligonucleotide; CTT chr11 5201913 5201934 5201930 5201935 +
agctcactatttttaatacttt

SEQ ID NO: 79742 - DNA, 22 bp, Artificial Sequence
  Synthetic oligonucleotide; TTA chr11 5201914 5201935 5201931 5201936 +
gctcactatttttaatactttt

SEQ ID NO: 79743 - DNA, 22 bp, Artificial Sequence
  Synthetic oligonucleotide; CTC chr11 5201918 5201939 5201935 5201940 +
actatttttaatacttttttct

SEQ ID NO: 79744 - DNA, 22 bp, Artificial Sequence
  Synthetic oligonucleotide; CTA chr11 5201922 5201943 5201939 5201944 +
tttttaatacttttttctccat

SEQ ID NO: 79745 - DNA, 22 bp, Artificial Sequence
  Synthetic oligonucleotide; TTT chr11 5201925 5201946 5201942 5201947 +
ttaatacttttttctccataga

SEQ ID NO: 79746 - DNA, 22 bp, Artificial Sequence
  Synthetic oligonucleotide; TTT chr11 5201926 5201947 5201943 5201948 +
taatacttttttctccatagaa

SEQ ID NO: 79747 - DNA, 22 bp, Artificial Sequence
  Synthetic oligonucleotide; TTT chr11 5201927 5201948 5201944 5201949 +
aatacttttttctccatagaat

SEQ ID NO: 79748 - DNA, 22 bp, Artificial Sequence
  Synthetic oligonucleotide; TTA chr11 5201928 5201949 5201945 5201950 +
atacttttttctccatagaatg

SEQ ID NO: 79749 - DNA, 22 bp, Artificial Sequence
  Synthetic oligonucleotide; CTT chr11 5201934 5201955 5201951 5201956 +
ttttctccatagaatgcttgaa

SEQ ID NO: 79750 - DNA, 22 bp, Artificial Sequence
  Synthetic oligonucleotide; TTT chr11 5201935 5201956 5201952 5201957 +
tttctccatagaatgcttgaag

SEQ ID NO: 79751 - DNA, 22 bp, Artificial Sequence
  Synthetic oligonucleotide; TTT chr11 5201936 5201957 5201953 5201958 +
ttctccatagaatgcttgaagt

SEQ ID NO: 79752 - DNA, 22 bp, Artificial Sequence
  Synthetic oligonucleotide; TTT chr11 5201937 5201958 5201954 5201959 +
tctccatagaatgcttgaagtt

SEQ ID NO: 79753 - DNA, 22 bp, Artificial Sequence
  Synthetic oligonucleotide; TTT chr11 5201938 5201959 5201955 5201960 +
ctccatagaatgcttgaagttt

SEQ ID NO: 79754 - DNA, 22 bp, Artificial Sequence
  Synthetic oligonucleotide; TTC chr11 5201939 5201960 5201956 5201961 +
tccatagaatgcttgaagtttc

SEQ ID NO: 79755 - DNA, 22 bp, Artificial Sequence
  Synthetic oligonucleotide; CTC chr11 5201941 5201962 5201958 5201963 +
catagaatgcttgaagtttctt

SEQ ID NO: 79756 - DNA, 22 bp, Artificial Sequence
  Synthetic oligonucleotide; CTT chr11 5201953 5201974 5201970 5201975 +
gaagtttcttcgtttcttgcag

SEQ ID NO: 79757 - DNA, 22 bp, Artificial Sequence
  Synthetic oligonucleotide; TTG chr11 5201954 5201975 5201971 5201976 +
aagtttcttcgtttcttgcaga

SEQ ID NO: 79758 - DNA, 22 bp, Artificial Sequence
  Synthetic oligonucleotide; TTT chr11 5201960 5201981 5201977 5201982 +
cttcgtttcttgcagaggattt

SEQ ID NO: 79759 - DNA, 22 bp, Artificial Sequence
  Synthetic oligonucleotide; TTC chr11 5201961 5201982 5201978 5201983 +
ttcgtttcttgcagaggatttt

SEQ ID NO: 79760 - DNA, 22 bp, Artificial Sequence
  Synthetic oligonucleotide; CTT chr11 5201963 5201984 5201980 5201985 +
cgtttcttgcagaggatttttc

SEQ ID NO: 79761 - DNA, 22 bp, Artificial Sequence
  Synthetic oligonucleotide; TTC chr11 5201964 5201985 5201981 5201986 +
gtttcttgcagaggatttttca

SEQ ID NO: 79762 - DNA, 22 bp, Artificial Sequence
  Synthetic oligonucleotide; TTT chr11 5201968 5201989 5201985 5201990 +
cttgcagaggatttttcagtct

SEQ ID NO: 79763 - DNA, 22 bp, Artificial Sequence
  Synthetic oligonucleotide; TTC chr11 5201969 5201990 5201986 5201991 +
ttgcagaggatttttcagtctt

SEQ ID NO: 79764 - DNA, 22 bp, Artificial Sequence
  Synthetic oligonucleotide; CTT chr11 5201971 5201992 5201988 5201993 +
gcagaggatttttcagtctttt

SEQ ID NO: 79765 - DNA, 22 bp, Artificial Sequence
  Synthetic oligonucleotide; TTG chr11 5201972 5201993 5201989 5201994 +
cagaggatttttcagtcttttg

SEQ ID NO: 79766 - DNA, 22 bp, Artificial Sequence
  Synthetic oligonucleotide; TTT chr11 5201982 5202003 5201999 5202004 +
ttcagtcttttgaatacgtatc

SEQ ID NO: 79767 - DNA, 22 bp, Artificial Sequence
  Synthetic oligonucleotide; TTT chr11 5201983 5202004 5202000 5202005 +
tcagtcttttgaatacgtatct

SEQ ID NO: 79768 - DNA, 22 bp, Artificial Sequence
  Synthetic oligonucleotide; TTT chr11 5201984 5202005 5202001 5202006 +
cagtcttttgaatacgtatctt

SEQ ID NO: 79769 - DNA, 22 bp, Artificial Sequence
  Synthetic oligonucleotide; TTC chr11 5201985 5202006 5202002 5202007 +
agtcttttgaatacgtatcttc

SEQ ID NO: 79770 - DNA, 22 bp, Artificial Sequence
  Synthetic oligonucleotide; CTT chr11 5201991 5202012 5202008 5202013 +
ttgaatacgtatcttctttcat

SEQ ID NO: 79771 - DNA, 22 bp, Artificial Sequence
  Synthetic oligonucleotide; TTT chr11 5201992 5202013 5202009 5202014 +
tgaatacgtatcttctttcatt

SEQ ID NO: 79772 - DNA, 22 bp, Artificial Sequence
  Synthetic oligonucleotide; TTT chr11 5201993 5202014 5202010 5202015 +
gaatacgtatcttctttcattt

SEQ ID NO: 79773 - DNA, 22 bp, Artificial Sequence
  Synthetic oligonucleotide; TTG chr11 5201994 5202015 5202011 5202016 +
aatacgtatcttctttcatttc

SEQ ID NO: 79774 - DNA, 22 bp, Artificial Sequence
  Synthetic oligonucleotide; CTT chr11 5202006 5202027 5202023 5202028 +
ctttcatttctctaaatcgaat

SEQ ID NO: 79775 - DNA, 22 bp, Artificial Sequence
  Synthetic oligonucleotide; TTC chr11 5202007 5202028 5202024 5202029 +
tttcatttctctaaatcgaatt

SEQ ID NO: 79776 - DNA, 22 bp, Artificial Sequence
  Synthetic oligonucleotide; CTT chr11 5202009 5202030 5202026 5202031 +
tcatttctctaaatcgaatttc

SEQ ID NO: 79777 - DNA, 22 bp, Artificial Sequence
  Synthetic oligonucleotide; TTT chr11 5202010 5202031 5202027 5202032 +
catttctctaaatcgaatttct

SEQ ID NO: 79778 - DNA, 22 bp, Artificial Sequence
  Synthetic oligonucleotide; TTC chr11 5202011 5202032 5202028 5202033 +
atttctctaaatcgaatttctc

SEQ ID NO: 79779 - DNA, 22 bp, Artificial Sequence
  Synthetic oligonucleotide; TTT chr11 5202015 5202036 5202032 5202037 +
ctctaaatcgaatttctcttct

SEQ ID NO: 79780 - DNA, 22 bp, Artificial Sequence
  Synthetic oligonucleotide; TTC chr11 5202016 5202037 5202033 5202038 +
tctaaatcgaatttctcttctt

SEQ ID NO: 79781 - DNA, 22 bp, Artificial Sequence
  Synthetic oligonucleotide; CTC chr11 5202018 5202039 5202035 5202040 +
taaatcgaatttctcttctttc

SEQ ID NO: 79782 - DNA, 22 bp, Artificial Sequence
  Synthetic oligonucleotide; CTA chr11 5202020 5202041 5202037 5202042 +
aatcgaatttctcttctttcgt

SEQ ID NO: 79783 - DNA, 22 bp, Artificial Sequence
  Synthetic oligonucleotide; TTT chr11 5202030 5202051 5202047 5202052 +
ctcttctttcgtaaaatttttc

SEQ ID NO: 79784 - DNA, 22 bp, Artificial Sequence
  Synthetic oligonucleotide; TTC chr11 5202031 5202052 5202048 5202053 +
tcttctttcgtaaaatttttct

SEQ ID NO: 79785 - DNA, 22 bp, Artificial Sequence
  Synthetic oligonucleotide; CTC chr11 5202033 5202054 5202050 5202055 +
ttctttcgtaaaatttttctcg

SEQ ID NO: 79786 - DNA, 22 bp, Artificial Sequence
  Synthetic oligonucleotide; CTT chr11 5202035 5202056 5202052 5202057 +
ctttcgtaaaatttttctcgaa

SEQ ID NO: 79787 - DNA, 22 bp, Artificial Sequence
  Synthetic oligonucleotide; TTC chr11 5202036 5202057 5202053 5202058 +
tttcgtaaaatttttctcgaaa

SEQ ID NO: 79788 - DNA, 22 bp, Artificial Sequence
  Synthetic oligonucleotide; CTT chr11 5202038 5202059 5202055 5202060 +
tcgtaaaatttttctcgaaatg

SEQ ID NO: 79789 - DNA, 22 bp, Artificial Sequence
  Synthetic oligonucleotide; TTT chr11 5202039 5202060 5202056 5202061 +
cgtaaaatttttctcgaaatgt

SEQ ID NO: 79790 - DNA, 22 bp, Artificial Sequence
  Synthetic oligonucleotide; TTC chr11 5202040 5202061 5202057 5202062 +
gtaaaatttttctcgaaatgtt

SEQ ID NO: 79791 - DNA, 22 bp, Artificial Sequence
  Synthetic oligonucleotide; TTT chr11 5202049 5202070 5202066 5202071 +
ttctcgaaatgttctatctgcc

SEQ ID NO: 79792 - DNA, 22 bp, Artificial Sequence
  Synthetic oligonucleotide; TTT chr11 5202050 5202071 5202067 5202072 +
tctcgaaatgttctatctgcct

SEQ ID NO: 79793 - DNA, 22 bp, Artificial Sequence
  Synthetic oligonucleotide; TTT chr11 5202051 5202072 5202068 5202073 +
ctcgaaatgttctatctgccta

SEQ ID NO: 79794 - DNA, 22 bp, Artificial Sequence
  Synthetic oligonucleotide; TTC chr11 5202052 5202073 5202069 5202074 +
tcgaaatgttctatctgcctaa

SEQ ID NO: 79795 - DNA, 22 bp, Artificial Sequence
  Synthetic oligonucleotide; CTC chr11 5202054 5202075 5202071 5202076 +
gaaatgttctatctgcctaaat

SEQ ID NO: 79796 - DNA, 22 bp, Artificial Sequence
  Synthetic oligonucleotide; TTC chr11 5202063 5202084 5202080 5202085 +
tatctgcctaaattattcatca

SEQ ID NO: 79797 - DNA, 22 bp, Artificial Sequence
  Synthetic oligonucleotide; CTA chr11 5202065 5202086 5202082 5202087 +
tctgcctaaattattcatcatc

SEQ ID NO: 79798 - DNA, 22 bp, Artificial Sequence
  Synthetic oligonucleotide; CTG chr11 5202069 5202090 5202086 5202091 +
cctaaattattcatcatctttt

SEQ ID NO: 79799 - DNA, 22 bp, Artificial Sequence
  Synthetic oligonucleotide; CTA chr11 5202073 5202094 5202090 5202095 +
aattattcatcatcttttcctc

SEQ ID NO: 79800 - DNA, 22 bp, Artificial Sequence
  Synthetic oligonucleotide; TTA chr11 5202078 5202099 5202095 5202100 +
ttcatcatcttttcctcaattt

SEQ ID NO: 79801 - DNA, 22 bp, Artificial Sequence
  Synthetic oligonucleotide; TTC chr11 5202081 5202102 5202098 5202103 +
atcatcttttcctcaatttctt

SEQ ID NO: 79802 - DNA, 22 bp, Artificial Sequence
  Synthetic oligonucleotide; CTT chr11 5202089 5202110 5202106 5202111 +
ttcctcaatttcttcctaccct

SEQ ID NO: 79803 - DNA, 22 bp, Artificial Sequence
  Synthetic oligonucleotide; TTT chr11 5202090 5202111 5202107 5202112 +
tcctcaatttcttcctaccctt

SEQ ID NO: 79804 - DNA, 22 bp, Artificial Sequence
  Synthetic oligonucleotide; TTT chr11 5202091 5202112 5202108 5202113 +
cctcaatttcttcctacccttt

SEQ ID NO: 79805 - DNA, 22 bp, Artificial Sequence
  Synthetic oligonucleotide; TTC chr11 5202092 5202113 5202109 5202114 +
ctcaatttcttcctaccctttt

SEQ ID NO: 79806 - DNA, 22 bp, Artificial Sequence
  Synthetic oligonucleotide; CTC chr11 5202095 5202116 5202112 5202117 +
aatttcttcctaccctttttaa

SEQ ID NO: 79807 - DNA, 22 bp, Artificial Sequence
  Synthetic oligonucleotide; TTT chr11 5202100 5202121 5202117 5202122 +
cttcctaccctttttaaaacga

SEQ ID NO: 79808 - DNA, 22 bp, Artificial Sequence
  Synthetic oligonucleotide; TTC chr11 5202101 5202122 5202118 5202123 +
ttcctaccctttttaaaacgat

SEQ ID NO: 79809 - DNA, 22 bp, Artificial Sequence
  Synthetic oligonucleotide; CTT chr11 5202103 5202124 5202120 5202125 +
cctaccctttttaaaacgatct

SEQ ID NO: 79810 - DNA, 22 bp, Artificial Sequence
  Synthetic oligonucleotide; TTC chr11 5202104 5202125 5202121 5202126 +
ctaccctttttaaaacgatctt

SEQ ID NO: 79811 - DNA, 22 bp, Artificial Sequence
  Synthetic oligonucleotide; CTA chr11 5202107 5202128 5202124 5202129 +
ccctttttaaaacgatcttgca

SEQ ID NO: 79812 - DNA, 22 bp, Artificial Sequence
  Synthetic oligonucleotide; CTT chr11 5202112 5202133 5202129 5202134 +
tttaaaacgatcttgcaactca

SEQ ID NO: 79813 - DNA, 22 bp, Artificial Sequence
  Synthetic oligonucleotide; TTT chr11 5202113 5202134 5202130 5202135 +
ttaaaacgatcttgcaactcaa

SEQ ID NO: 79814 - DNA, 22 bp, Artificial Sequence
  Synthetic oligonucleotide; TTT chr11 5202114 5202135 5202131 5202136 +
taaaacgatcttgcaactcaac

SEQ ID NO: 79815 - DNA, 22 bp, Artificial Sequence
  Synthetic oligonucleotide; TTT chr11 5202115 5202136 5202132 5202137 +
aaaacgatcttgcaactcaaca

SEQ ID NO: 79816 - DNA, 22 bp, Artificial Sequence
  Synthetic oligonucleotide; TTA chr11 5202116 5202137 5202133 5202138 +
aaacgatcttgcaactcaacaa

SEQ ID NO: 79817 - DNA, 22 bp, Artificial Sequence
  Synthetic oligonucleotide; CTT chr11 5202126 5202147 5202143 5202148 +
gcaactcaacaatcacttttca

SEQ ID NO: 79818 - DNA, 22 bp, Artificial Sequence
  Synthetic oligonucleotide; TTG chr11 5202127 5202148 5202144 5202149 +
caactcaacaatcacttttcaa

SEQ ID NO: 79819 - DNA, 22 bp, Artificial Sequence
  Synthetic oligonucleotide; CTC chr11 5202133 5202154 5202150 5202155 +
aacaatcacttttcaagaagtt

SEQ ID NO: 79820 - DNA, 22 bp, Artificial Sequence
  Synthetic oligonucleotide; CTT chr11 5202144 5202165 5202161 5202166 +
ttcaagaagtttcttaagacaa

SEQ ID NO: 79821 - DNA, 22 bp, Artificial Sequence
  Synthetic oligonucleotide; TTT chr11 5202145 5202166 5202162 5202167 +
tcaagaagtttcttaagacaaa

SEQ ID NO: 79822 - DNA, 22 bp, Artificial Sequence
  Synthetic oligonucleotide; TTT chr11 5202146 5202167 5202163 5202168 +
caagaagtttcttaagacaaat

SEQ ID NO: 79823 - DNA, 22 bp, Artificial Sequence
  Synthetic oligonucleotide; TTC chr11 5202147 5202168 5202164 5202169 +
aagaagtttcttaagacaaatt

SEQ ID NO: 79824 - DNA, 22 bp, Artificial Sequence
  Synthetic oligonucleotide; TTT chr11 5202156 5202177 5202173 5202178 +
cttaagacaaatttatccatat

SEQ ID NO: 79825 - DNA, 22 bp, Artificial Sequence
  Synthetic oligonucleotide; TTC chr11 5202157 5202178 5202174 5202179 +
ttaagacaaatttatccatata

SEQ ID NO: 79826 - DNA, 22 bp, Artificial Sequence
  Synthetic oligonucleotide; CTT chr11 5202159 5202180 5202176 5202181 +
aagacaaatttatccatatatc

SEQ ID NO: 79827 - DNA, 22 bp, Artificial Sequence
  Synthetic oligonucleotide; TTA chr11 5202160 5202181 5202177 5202182 +
agacaaatttatccatatatct

SEQ ID NO: 79828 - DNA, 22 bp, Artificial Sequence
  Synthetic oligonucleotide; TTT chr11 5202170 5202191 5202187 5202192 +
atccatatatctattattttgg

SEQ ID NO: 79829 - DNA, 22 bp, Artificial Sequence
  Synthetic oligonucleotide; TTA chr11 5202171 5202192 5202188 5202193 +
tccatatatctattattttggt

SEQ ID NO: 79830 - DNA, 22 bp, Artificial Sequence
  Synthetic oligonucleotide; CTA chr11 5202183 5202204 5202200 5202205 +
ttattttggtatcatgtttcaa

SEQ ID NO: 79831 - DNA, 22 bp, Artificial Sequence
  Synthetic oligonucleotide; TTA chr11 5202186 5202207 5202203 5202208 +
ttttggtatcatgtttcaattt

SEQ ID NO: 79832 - DNA, 22 bp, Artificial Sequence
  Synthetic oligonucleotide; TTT chr11 5202189 5202210 5202206 5202211 +
tggtatcatgtttcaattttaa

SEQ ID NO: 79833 - DNA, 22 bp, Artificial Sequence
  Synthetic oligonucleotide; TTT chr11 5202190 5202211 5202207 5202212 +
ggtatcatgtttcaattttaaa

SEQ ID NO: 79834 - DNA, 22 bp, Artificial Sequence
  Synthetic oligonucleotide; TTG chr11 5202191 5202212 5202208 5202213 +
gtatcatgtttcaattttaaat

SEQ ID NO: 79835 - DNA, 22 bp, Artificial Sequence
  Synthetic oligonucleotide; TTT chr11 5202202 5202223 5202219 5202224 +
caattttaaataaaacttataa

SEQ ID NO: 79836 - DNA, 22 bp, Artificial Sequence
  Synthetic oligonucleotide; TTC chr11 5202203 5202224 5202220 5202225 +
aattttaaataaaacttataat

SEQ ID NO: 79837 - DNA, 22 bp, Artificial Sequence
  Synthetic oligonucleotide; TTT chr11 5202208 5202229 5202225 5202230 +
taaataaaacttataattttgt

SEQ ID NO: 79838 - DNA, 22 bp, Artificial Sequence
  Synthetic oligonucleotide; TTT chr11 5202209 5202230 5202226 5202231 +
aaataaaacttataattttgta

SEQ ID NO: 79839 - DNA, 22 bp, Artificial Sequence
  Synthetic oligonucleotide; TTA chr11 5202210 5202231 5202227 5202232 +
aataaaacttataattttgtat

SEQ ID NO: 79840 - DNA, 22 bp, Artificial Sequence
  Synthetic oligonucleotide; CTT chr11 5202220 5202241 5202237 5202242 +
ataattttgtatttattagcta

SEQ ID NO: 79841 - DNA, 22 bp, Artificial Sequence
  Synthetic oligonucleotide; TTA chr11 5202221 5202242 5202238 5202243 +
taattttgtatttattagctaa

SEQ ID NO: 79842 - DNA, 22 bp, Artificial Sequence
  Synthetic oligonucleotide; TTT chr11 5202227 5202248 5202244 5202249 +
tgtatttattagctaaatattt

SEQ ID NO: 79843 - DNA, 22 bp, Artificial Sequence
  Synthetic oligonucleotide; TTT chr11 5202228 5202249 5202245 5202250 +
gtatttattagctaaatattta

SEQ ID NO: 79844 - DNA, 22 bp, Artificial Sequence
  Synthetic oligonucleotide; TTG chr11 5202229 5202250 5202246 5202251 +
tatttattagctaaatatttaa

SEQ ID NO: 79845 - DNA, 22 bp, Artificial Sequence
  Synthetic oligonucleotide; TTT chr11 5202234 5202255 5202251 5202256 +
attagctaaatatttaactaat

SEQ ID NO: 79846 - DNA, 22 bp, Artificial Sequence
  Synthetic oligonucleotide; TTA chr11 5202235 5202256 5202252 5202257 +
ttagctaaatatttaactaata

SEQ ID NO: 79847 - DNA, 22 bp, Artificial Sequence
  Synthetic oligonucleotide; TTA chr11 5202238 5202259 5202255 5202260 +
gctaaatatttaactaatattt

SEQ ID NO: 79848 - DNA, 22 bp, Artificial Sequence
  Synthetic oligonucleotide; CTA chr11 5202242 5202263 5202259 5202264 +
aatatttaactaatatttaaac

SEQ ID NO: 79849 - DNA, 22 bp, Artificial Sequence
  Synthetic oligonucleotide; TTT chr11 5202249 5202270 5202266 5202271 +
aactaatatttaaactaaatat

SEQ ID NO: 79850 - DNA, 22 bp, Artificial Sequence
  Synthetic oligonucleotide; TTA chr11 5202250 5202271 5202267 5202272 +
actaatatttaaactaaatatt

SEQ ID NO: 79851 - DNA, 22 bp, Artificial Sequence
  Synthetic oligonucleotide; CTA chr11 5202254 5202275 5202271 5202276 +
atatttaaactaaatatttaac

SEQ ID NO: 79852 - DNA, 22 bp, Artificial Sequence
  Synthetic oligonucleotide; TTT chr11 5202260 5202281 5202277 5202282 +
aaactaaatatttaactaatat

SEQ ID NO: 79853 - DNA, 22 bp, Artificial Sequence
  Synthetic oligonucleotide; TTA chr11 5202261 5202282 5202278 5202283 +
aactaaatatttaactaatatc

SEQ ID NO: 79854 - DNA, 22 bp, Artificial Sequence
  Synthetic oligonucleotide; CTA chr11 5202266 5202287 5202283 5202288 +
aatatttaactaatatctctgt

SEQ ID NO: 79855 - DNA, 22 bp, Artificial Sequence
  Synthetic oligonucleotide; TTT chr11 5202273 5202294 5202290 5202295 +
aactaatatctctgttacaaac

SEQ ID NO: 79856 - DNA, 22 bp, Artificial Sequence
  Synthetic oligonucleotide; TTA chr11 5202274 5202295 5202291 5202296 +
actaatatctctgttacaaact

SEQ ID NO: 79857 - DNA, 22 bp, Artificial Sequence
  Synthetic oligonucleotide; CTA chr11 5202278 5202299 5202295 5202300 +
atatctctgttacaaactaaat

SEQ ID NO: 79858 - DNA, 22 bp, Artificial Sequence
  Synthetic oligonucleotide; CTC chr11 5202285 5202306 5202302 5202307 +
tgttacaaactaaattctcagt

SEQ ID NO: 79859 - DNA, 22 bp, Artificial Sequence
  Synthetic oligonucleotide; CTG chr11 5202287 5202308 5202304 5202309 +
ttacaaactaaattctcagttc

SEQ ID NO: 79860 - DNA, 22 bp, Artificial Sequence
  Synthetic oligonucleotide; TTA chr11 5202290 5202311 5202307 5202312 +
caaactaaattctcagttcctt

SEQ ID NO: 79861 - DNA, 22 bp, Artificial Sequence
  Synthetic oligonucleotide; CTA chr11 5202297 5202318 5202314 5202319 +
aattctcagttccttaatgtgc

SEQ ID NO: 79862 - DNA, 22 bp, Artificial Sequence
  Synthetic oligonucleotide; TTC chr11 5202302 5202323 5202319 5202324 +
tcagttccttaatgtgcagact

SEQ ID NO: 79863 - DNA, 22 bp, Artificial Sequence
  Synthetic oligonucleotide; CTC chr11 5202304 5202325 5202321 5202326 +
agttccttaatgtgcagactat

SEQ ID NO: 79864 - DNA, 22 bp, Artificial Sequence
  Synthetic oligonucleotide; TTC chr11 5202309 5202330 5202326 5202331 +
cttaatgtgcagactatgtcaa

SEQ ID NO: 79865 - DNA, 22 bp, Artificial Sequence
  Synthetic oligonucleotide; CTT chr11 5202312 5202333 5202329 5202334 +
aatgtgcagactatgtcaactt

SEQ ID NO: 79866 - DNA, 22 bp, Artificial Sequence
  Synthetic oligonucleotide; TTA chr11 5202313 5202334 5202330 5202335 +
atgtgcagactatgtcaacttt

SEQ ID NO: 79867 - DNA, 22 bp, Artificial Sequence
  Synthetic oligonucleotide; CTA chr11 5202325 5202346 5202342 5202347 +
tgtcaactttttcttattattt

SEQ ID NO: 79868 - DNA, 22 bp, Artificial Sequence
  Synthetic oligonucleotide; CTT chr11 5202334 5202355 5202351 5202356 +
tttcttattatttgaaactaac

SEQ ID NO: 79869 - DNA, 22 bp, Artificial Sequence
  Synthetic oligonucleotide; TTT chr11 5202335 5202356 5202352 5202357 +
ttcttattatttgaaactaaca

SEQ ID NO: 79870 - DNA, 22 bp, Artificial Sequence
  Synthetic oligonucleotide; TTT chr11 5202336 5202357 5202353 5202358 +
tcttattatttgaaactaacat

SEQ ID NO: 79871 - DNA, 22 bp, Artificial Sequence
  Synthetic oligonucleotide; TTT chr11 5202337 5202358 5202354 5202359 +
cttattatttgaaactaacatt

SEQ ID NO: 79872 - DNA, 22 bp, Artificial Sequence
  Synthetic oligonucleotide; TTC chr11 5202338 5202359 5202355 5202360 +
ttattatttgaaactaacattt

SEQ ID NO: 79873 - DNA, 22 bp, Artificial Sequence
  Synthetic oligonucleotide; CTT chr11 5202340 5202361 5202357 5202362 +
attatttgaaactaacatttgc

SEQ ID NO: 79874 - DNA, 22 bp, Artificial Sequence
  Synthetic oligonucleotide; TTA chr11 5202341 5202362 5202358 5202363 +
ttatttgaaactaacatttgca

SEQ ID NO: 79875 - DNA, 22 bp, Artificial Sequence
  Synthetic oligonucleotide; TTA chr11 5202344 5202365 5202361 5202366 +
tttgaaactaacatttgcacct

SEQ ID NO: 79876 - DNA, 22 bp, Artificial Sequence
  Synthetic oligonucleotide; TTT chr11 5202347 5202368 5202364 5202369 +
gaaactaacatttgcacctctg

SEQ ID NO: 79877 - DNA, 22 bp, Artificial Sequence
  Synthetic oligonucleotide; TTG chr11 5202348 5202369 5202365 5202370 +
aaactaacatttgcacctctga

SEQ ID NO: 79878 - DNA, 22 bp, Artificial Sequence
  Synthetic oligonucleotide; CTA chr11 5202354 5202375 5202371 5202376 +
acatttgcacctctgattcctg

SEQ ID NO: 79879 - DNA, 22 bp, Artificial Sequence
  Synthetic oligonucleotide; TTT chr11 5202360 5202381 5202377 5202382 +
gcacctctgattcctgaccact

SEQ ID NO: 79880 - DNA, 22 bp, Artificial Sequence
  Synthetic oligonucleotide; TTG chr11 5202361 5202382 5202378 5202383 +
cacctctgattcctgaccactc

SEQ ID NO: 79881 - DNA, 22 bp, Artificial Sequence
  Synthetic oligonucleotide; CTC chr11 5202367 5202388 5202384 5202389 +
tgattcctgaccactcctgaga

SEQ ID NO: 79882 - DNA, 22 bp, Artificial Sequence
  Synthetic oligonucleotide; CTG chr11 5202369 5202390 5202386 5202391 +
attcctgaccactcctgagagc

SEQ ID NO: 79883 - DNA, 22 bp, Artificial Sequence
  Synthetic oligonucleotide; TTC chr11 5202373 5202394 5202390 5202395 +
ctgaccactcctgagagctcaa

SEQ ID NO: 79884 - DNA, 22 bp, Artificial Sequence
  Synthetic oligonucleotide; CTG chr11 5202376 5202397 5202393 5202398 +
accactcctgagagctcaaatt

SEQ ID NO: 79885 - DNA, 22 bp, Artificial Sequence
  Synthetic oligonucleotide; CTC chr11 5202383 5202404 5202400 5202405 +
ctgagagctcaaattcatgaat

SEQ ID NO: 79886 - DNA, 22 bp, Artificial Sequence
  Synthetic oligonucleotide; CTG chr11 5202386 5202407 5202403 5202408 +
agagctcaaattcatgaataca

SEQ ID NO: 79887 - DNA, 22 bp, Artificial Sequence
  Synthetic oligonucleotide; CTC chr11 5202393 5202414 5202410 5202415 +
aaattcatgaatacaactggct

SEQ ID NO: 79888 - DNA, 22 bp, Artificial Sequence
  Synthetic oligonucleotide; TTC chr11 5202399 5202420 5202416 5202421 +
atgaatacaactggctatttaa

SEQ ID NO: 79889 - DNA, 22 bp, Artificial Sequence
  Synthetic oligonucleotide; CTG chr11 5202412 5202433 5202429 5202434 +
gctatttaatatattcatctga

SEQ ID NO: 79890 - DNA, 22 bp, Artificial Sequence
  Synthetic oligonucleotide; CTA chr11 5202416 5202437 5202433 5202438 +
tttaatatattcatctgagtgt

SEQ ID NO: 79891 - DNA, 22 bp, Artificial Sequence
  Synthetic oligonucleotide; TTT chr11 5202419 5202440 5202436 5202441 +
aatatattcatctgagtgttta

SEQ ID NO: 79892 - DNA, 22 bp, Artificial Sequence
  Synthetic oligonucleotide; TTA chr11 5202420 5202441 5202437 5202442 +
atatattcatctgagtgtttaa

SEQ ID NO: 79893 - DNA, 22 bp, Artificial Sequence
  Synthetic oligonucleotide; TTC chr11 5202428 5202449 5202445 5202450 +
atctgagtgtttaatcttaaaa

SEQ ID NO: 79894 - DNA, 22 bp, Artificial Sequence
  Synthetic oligonucleotide; CTG chr11 5202433 5202454 5202450 5202455 +
agtgtttaatcttaaaataaga

SEQ ID NO: 79895 - DNA, 22 bp, Artificial Sequence
  Synthetic oligonucleotide; TTT chr11 5202440 5202461 5202457 5202462 +
aatcttaaaataagaatgatgc

SEQ ID NO: 79896 - DNA, 22 bp, Artificial Sequence
  Synthetic oligonucleotide; TTA chr11 5202441 5202462 5202458 5202463 +
atcttaaaataagaatgatgcc

SEQ ID NO: 79897 - DNA, 22 bp, Artificial Sequence
  Synthetic oligonucleotide; CTT chr11 5202446 5202467 5202463 5202468 +
aaaataagaatgatgccaataa

SEQ ID NO: 79898 - DNA, 22 bp, Artificial Sequence
  Synthetic oligonucleotide; TTA chr11 5202447 5202468 5202464 5202469 +
aaataagaatgatgccaataaa

SEQ ID NO: 79899 - DNA, 22 bp, Artificial Sequence
  Synthetic oligonucleotide; CTT chr11 5202475 5202496 5202492 5202497 +
gattttccccccaaaatctatt

SEQ ID NO: 79900 - DNA, 22 bp, Artificial Sequence
  Synthetic oligonucleotide; TTG chr11 5202476 5202497 5202493 5202498 +
attttccccccaaaatctattt

SEQ ID NO: 79901 - DNA, 22 bp, Artificial Sequence
  Synthetic oligonucleotide; TTT chr11 5202480 5202501 5202497 5202502 +
tccccccaaaatctattttctg

SEQ ID NO: 79902 - DNA, 22 bp, Artificial Sequence
  Synthetic oligonucleotide; TTT chr11 5202481 5202502 5202498 5202503 +
ccccccaaaatctattttctgt

SEQ ID NO: 79903 - DNA, 22 bp, Artificial Sequence
  Synthetic oligonucleotide; TTC chr11 5202482 5202503 5202499 5202504 +
cccccaaaatctattttctgtc

SEQ ID NO: 79904 - DNA, 22 bp, Artificial Sequence
  Synthetic oligonucleotide; CTA chr11 5202495 5202516 5202512 5202517 +
ttttctgtcccttttctcctaa

SEQ ID NO: 79905 - DNA, 22 bp, Artificial Sequence
  Synthetic oligonucleotide; TTT chr11 5202498 5202519 5202515 5202520 +
tctgtcccttttctcctaatat

SEQ ID NO: 79906 - DNA, 22 bp, Artificial Sequence
  Synthetic oligonucleotide; TTT chr11 5202499 5202520 5202516 5202521 +
ctgtcccttttctcctaatatt

SEQ ID NO: 79907 - DNA, 22 bp, Artificial Sequence
  Synthetic oligonucleotide; TTC chr11 5202500 5202521 5202517 5202522 +
tgtcccttttctcctaatatta

SEQ ID NO: 79908 - DNA, 22 bp, Artificial Sequence
  Synthetic oligonucleotide; CTG chr11 5202502 5202523 5202519 5202524 +
tcccttttctcctaatattata

SEQ ID NO: 79909 - DNA, 22 bp, Artificial Sequence
  Synthetic oligonucleotide; CTT chr11 5202508 5202529 5202525 5202530 +
ttctcctaatattataaagtga

SEQ ID NO: 79910 - DNA, 22 bp, Artificial Sequence
  Synthetic oligonucleotide; TTT chr11 5202509 5202530 5202526 5202531 +
tctcctaatattataaagtgac

SEQ ID NO: 79911 - DNA, 22 bp, Artificial Sequence
  Synthetic oligonucleotide; TTT chr11 5202510 5202531 5202527 5202532 +
ctcctaatattataaagtgact

SEQ ID NO: 79912 - DNA, 22 bp, Artificial Sequence
  Synthetic oligonucleotide; TTC chr11 5202511 5202532 5202528 5202533 +
tcctaatattataaagtgactc

SEQ ID NO: 79913 - DNA, 22 bp, Artificial Sequence
  Synthetic oligonucleotide; CTC chr11 5202513 5202534 5202530 5202535 +
ctaatattataaagtgactcca

SEQ ID NO: 79914 - DNA, 22 bp, Artificial Sequence
  Synthetic oligonucleotide; CTA chr11 5202516 5202537 5202533 5202538 +
atattataaagtgactccacca

SEQ ID NO: 79915 - DNA, 22 bp, Artificial Sequence
  Synthetic oligonucleotide; TTA chr11 5202522 5202543 5202539 5202544 +
taaagtgactccaccaataaca

SEQ ID NO: 79916 - DNA, 22 bp, Artificial Sequence
  Synthetic oligonucleotide; CTC chr11 5202533 5202554 5202550 5202555 +
caccaataacacaattgcataa

SEQ ID NO: 79917 - DNA, 22 bp, Artificial Sequence
  Synthetic oligonucleotide; TTG chr11 5202550 5202571 5202567 5202572 +
cataagacaagtcttgagtcat

SEQ ID NO: 79918 - DNA, 22 bp, Artificial Sequence
  Synthetic oligonucleotide; CTT chr11 5202565 5202586 5202582 5202587 +
gagtcatttttaaaatttttta

SEQ ID NO: 79919 - DNA, 22 bp, Artificial Sequence
  Synthetic oligonucleotide; TTG chr11 5202566 5202587 5202583 5202588 +
agtcatttttaaaattttttat

SEQ ID NO: 79920 - DNA, 22 bp, Artificial Sequence
  Synthetic oligonucleotide; TTT chr11 5202574 5202595 5202591 5202596 +
ttaaaattttttatttctctct

SEQ ID NO: 79921 - DNA, 22 bp, Artificial Sequence
  Synthetic oligonucleotide; TTT chr11 5202575 5202596 5202592 5202597 +
taaaattttttatttctctctt

SEQ ID NO: 79922 - DNA, 22 bp, Artificial Sequence
  Synthetic oligonucleotide; TTT chr11 5202576 5202597 5202593 5202598 +
aaaattttttatttctctcttt

SEQ ID NO: 79923 - DNA, 22 bp, Artificial Sequence
  Synthetic oligonucleotide; TTA chr11 5202577 5202598 5202594 5202599 +
aaattttttatttctctctttc

SEQ ID NO: 79924 - DNA, 22 bp, Artificial Sequence
  Synthetic oligonucleotide; TTT chr11 5202583 5202604 5202600 5202605 +
tttatttctctctttccttccc

SEQ ID NO: 79925 - DNA, 22 bp, Artificial Sequence
  Synthetic oligonucleotide; TTT chr11 5202584 5202605 5202601 5202606 +
ttatttctctctttccttccct

SEQ ID NO: 79926 - DNA, 22 bp, Artificial Sequence
  Synthetic oligonucleotide; TTT chr11 5202585 5202606 5202602 5202607 +
tatttctctctttccttccctt

SEQ ID NO: 79927 - DNA, 22 bp, Artificial Sequence
  Synthetic oligonucleotide; TTT chr11 5202586 5202607 5202603 5202608 +
atttctctctttccttcccttt

SEQ ID NO: 79928 - DNA, 22 bp, Artificial Sequence
  Synthetic oligonucleotide; TTA chr11 5202587 5202608 5202604 5202609 +
tttctctctttccttccctttc

SEQ ID NO: 79929 - DNA, 22 bp, Artificial Sequence
  Synthetic oligonucleotide; TTT chr11 5202590 5202611 5202607 5202612 +
ctctctttccttccctttcctc

SEQ ID NO: 79930 - DNA, 22 bp, Artificial Sequence
  Synthetic oligonucleotide; TTC chr11 5202591 5202612 5202608 5202613 +
tctctttccttccctttcctct

SEQ ID NO: 79931 - DNA, 22 bp, Artificial Sequence
  Synthetic oligonucleotide; CTC chr11 5202593 5202614 5202610 5202615 +
tctttccttccctttcctctct

SEQ ID NO: 79932 - DNA, 22 bp, Artificial Sequence
  Synthetic oligonucleotide; CTC chr11 5202595 5202616 5202612 5202617 +
tttccttccctttcctctctcc

SEQ ID NO: 79933 - DNA, 22 bp, Artificial Sequence
  Synthetic oligonucleotide; CTT chr11 5202597 5202618 5202614 5202619 +
tccttccctttcctctctccat

SEQ ID NO: 79934 - DNA, 22 bp, Artificial Sequence
  Synthetic oligonucleotide; TTT chr11 5202598 5202619 5202615 5202620 +
ccttccctttcctctctccatc

SEQ ID NO: 79935 - DNA, 22 bp, Artificial Sequence
  Synthetic oligonucleotide; TTC chr11 5202599 5202620 5202616 5202621 +
cttccctttcctctctccatca

SEQ ID NO: 79936 - DNA, 22 bp, Artificial Sequence
  Synthetic oligonucleotide; CTT chr11 5202602 5202623 5202619 5202624 +
ccctttcctctctccatcaaat

SEQ ID NO: 79937 - DNA, 22 bp, Artificial Sequence
  Synthetic oligonucleotide; TTC chr11 5202603 5202624 5202620 5202625 +
cctttcctctctccatcaaatc

SEQ ID NO: 79938 - DNA, 22 bp, Artificial Sequence
  Synthetic oligonucleotide; CTT chr11 5202607 5202628 5202624 5202629 +
tcctctctccatcaaatctttc

SEQ ID NO: 79939 - DNA, 22 bp, Artificial Sequence
  Synthetic oligonucleotide; TTT chr11 5202608 5202629 5202625 5202630 +
cctctctccatcaaatctttca

SEQ ID NO: 79940 - DNA, 22 bp, Artificial Sequence
  Synthetic oligonucleotide; TTC chr11 5202609 5202630 5202626 5202631 +
ctctctccatcaaatctttcat

SEQ ID NO: 79941 - DNA, 22 bp, Artificial Sequence
  Synthetic oligonucleotide; CTC chr11 5202612 5202633 5202629 5202634 +
tctccatcaaatctttcatcaa

SEQ ID NO: 79942 - DNA, 22 bp, Artificial Sequence
  Synthetic oligonucleotide; CTC chr11 5202614 5202635 5202631 5202636 +
tccatcaaatctttcatcaatt

SEQ ID NO: 79943 - DNA, 22 bp, Artificial Sequence
  Synthetic oligonucleotide; CTC chr11 5202616 5202637 5202633 5202638 +
catcaaatctttcatcaatttc

SEQ ID NO: 79944 - DNA, 22 bp, Artificial Sequence
  Synthetic oligonucleotide; CTT chr11 5202627 5202648 5202644 5202649 +
tcatcaatttctaccatttcta

SEQ ID NO: 79945 - DNA, 22 bp, Artificial Sequence
  Synthetic oligonucleotide; TTT chr11 5202628 5202649 5202645 5202650 +
catcaatttctaccatttctac

SEQ ID NO: 79946 - DNA, 22 bp, Artificial Sequence
  Synthetic oligonucleotide; TTC chr11 5202629 5202650 5202646 5202651 +
atcaatttctaccatttctacc

SEQ ID NO: 79947 - DNA, 22 bp, Artificial Sequence
  Synthetic oligonucleotide; TTT chr11 5202637 5202658 5202654 5202659 +
ctaccatttctaccagaaacac

SEQ ID NO: 79948 - DNA, 22 bp, Artificial Sequence
  Synthetic oligonucleotide; TTC chr11 5202638 5202659 5202655 5202660 +
taccatttctaccagaaacaca

SEQ ID NO: 79949 - DNA, 22 bp, Artificial Sequence
  Synthetic oligonucleotide; CTA chr11 5202640 5202661 5202657 5202662 +
ccatttctaccagaaacacatc

SEQ ID NO: 79950 - DNA, 22 bp, Artificial Sequence
  Synthetic oligonucleotide; TTT chr11 5202646 5202667 5202663 5202668 +
ctaccagaaacacatcccagat

SEQ ID NO: 79951 - DNA, 22 bp, Artificial Sequence
  Synthetic oligonucleotide; TTC chr11 5202647 5202668 5202664 5202669 +
taccagaaacacatcccagata

SEQ ID NO: 79952 - DNA, 22 bp, Artificial Sequence
  Synthetic oligonucleotide; CTA chr11 5202649 5202670 5202666 5202671 +
ccagaaacacatcccagatagg

SEQ ID NO: 79953 - DNA, 22 bp, Artificial Sequence
  Synthetic oligonucleotide; CTT chr11 5202678 5202699 5202695 5202700 +
ttacacattgcccgtcttggtt

SEQ ID NO: 79954 - DNA, 22 bp, Artificial Sequence
  Synthetic oligonucleotide; TTT chr11 5202679 5202700 5202696 5202701 +
tacacattgcccgtcttggttt

SEQ ID NO: 79955 - DNA, 22 bp, Artificial Sequence
  Synthetic oligonucleotide; TTT chr11 5202680 5202701 5202697 5202702 +
acacattgcccgtcttggttta

SEQ ID NO: 79956 - DNA, 22 bp, Artificial Sequence
  Synthetic oligonucleotide; TTA chr11 5202681 5202702 5202698 5202703 +
cacattgcccgtcttggtttat

SEQ ID NO: 79957 - DNA, 22 bp, Artificial Sequence
  Synthetic oligonucleotide; TTG chr11 5202688 5202709 5202705 5202710 +
cccgtcttggtttataatatca

SEQ ID NO: 79958 - DNA, 22 bp, Artificial Sequence
  Synthetic oligonucleotide; CTT chr11 5202696 5202717 5202713 5202718 +
ggtttataatatcattgtttcc

SEQ ID NO: 79959 - DNA, 22 bp, Artificial Sequence
  Synthetic oligonucleotide; TTG chr11 5202697 5202718 5202714 5202719 +
gtttataatatcattgtttccc

SEQ ID NO: 79960 - DNA, 22 bp, Artificial Sequence
  Synthetic oligonucleotide; TTT chr11 5202701 5202722 5202718 5202723 +
ataatatcattgtttccctggc

SEQ ID NO: 79961 - DNA, 22 bp, Artificial Sequence
  Synthetic oligonucleotide; TTA chr11 5202702 5202723 5202719 5202724 +
taatatcattgtttccctggct

SEQ ID NO: 79962 - DNA, 22 bp, Artificial Sequence
  Synthetic oligonucleotide; TTG chr11 5202713 5202734 5202730 5202735 +
tttccctggctactatgataat

SEQ ID NO: 79963 - DNA, 22 bp, Artificial Sequence
  Synthetic oligonucleotide; TTT chr11 5202716 5202737 5202733 5202738 +
ccctggctactatgataattta

SEQ ID NO: 79964 - DNA, 22 bp, Artificial Sequence
  Synthetic oligonucleotide; TTC chr11 5202717 5202738 5202734 5202739 +
cctggctactatgataatttat

SEQ ID NO: 79965 - DNA, 22 bp, Artificial Sequence
  Synthetic oligonucleotide; CTG chr11 5202721 5202742 5202738 5202743 +
gctactatgataatttattaaa

SEQ ID NO: 79966 - DNA, 22 bp, Artificial Sequence
  Synthetic oligonucleotide; CTA chr11 5202725 5202746 5202742 5202747 +
ctatgataatttattaaattaa

SEQ ID NO: 79967 - DNA, 22 bp, Artificial Sequence
  Synthetic oligonucleotide; CTA chr11 5202728 5202749 5202745 5202750 +
tgataatttattaaattaataa

SEQ ID NO: 79968 - DNA, 22 bp, Artificial Sequence
  Synthetic oligonucleotide; TTT chr11 5202737 5202758 5202754 5202759 +
attaaattaataataatttaat

SEQ ID NO: 79969 - DNA, 22 bp, Artificial Sequence
  Synthetic oligonucleotide; TTA chr11 5202738 5202759 5202755 5202760 +
ttaaattaataataatttaata

SEQ ID NO: 79970 - DNA, 22 bp, Artificial Sequence
  Synthetic oligonucleotide; TTA chr11 5202741 5202762 5202758 5202763 +
aattaataataatttaatatta

SEQ ID NO: 79971 - DNA, 22 bp, Artificial Sequence
  Synthetic oligonucleotide; TTA chr11 5202746 5202767 5202763 5202768 +
ataataatttaatattattact

SEQ ID NO: 79972 - DNA, 22 bp, Artificial Sequence
  Synthetic oligonucleotide; TTT chr11 5202756 5202777 5202773 5202778 +
aatattattactagctaatatc

SEQ ID NO: 79973 - DNA, 22 bp, Artificial Sequence
  Synthetic oligonucleotide; TTA chr11 5202757 5202778 5202774 5202779 +
atattattactagctaatatca

SEQ ID NO: 79974 - DNA, 22 bp, Artificial Sequence
  Synthetic oligonucleotide; TTA chr11 5202763 5202784 5202780 5202785 +
ttactagctaatatcatgattt

SEQ ID NO: 79975 - DNA, 22 bp, Artificial Sequence
  Synthetic oligonucleotide; TTA chr11 5202766 5202787 5202783 5202788 +
ctagctaatatcatgatttatc

SEQ ID NO: 79976 - DNA, 22 bp, Artificial Sequence
  Synthetic oligonucleotide; CTA chr11 5202769 5202790 5202786 5202791 +
gctaatatcatgatttatctgt

SEQ ID NO: 79977 - DNA, 22 bp, Artificial Sequence
  Synthetic oligonucleotide; CTA chr11 5202773 5202794 5202790 5202795 +
atatcatgatttatctgtttgt

SEQ ID NO: 79978 - DNA, 22 bp, Artificial Sequence
  Synthetic oligonucleotide; TTT chr11 5202785 5202806 5202802 5202807 +
atctgtttgtcctctaaaaaat

SEQ ID NO: 79979 - DNA, 22 bp, Artificial Sequence
  Synthetic oligonucleotide; TTA chr11 5202786 5202807 5202803 5202808 +
tctgtttgtcctctaaaaaatg

SEQ ID NO: 79980 - DNA, 22 bp, Artificial Sequence
  Synthetic oligonucleotide; CTG chr11 5202790 5202811 5202807 5202812 +
tttgtcctctaaaaaatgtatt

SEQ ID NO: 79981 - DNA, 22 bp, Artificial Sequence
  Synthetic oligonucleotide; TTT chr11 5202793 5202814 5202810 5202815 +
gtcctctaaaaaatgtattatc

SEQ ID NO: 79982 - DNA, 22 bp, Artificial Sequence
  Synthetic oligonucleotide; TTG chr11 5202794 5202815 5202811 5202816 +
tcctctaaaaaatgtattatct

SEQ ID NO: 79983 - DNA, 22 bp, Artificial Sequence
  Synthetic oligonucleotide; CTC chr11 5202799 5202820 5202816 5202821 +
taaaaaatgtattatctccagg

SEQ ID NO: 79984 - DNA, 22 bp, Artificial Sequence
  Synthetic oligonucleotide; CTA chr11 5202801 5202822 5202818 5202823 +
aaaaatgtattatctccaggga

SEQ ID NO: 79985 - DNA, 22 bp, Artificial Sequence
  Synthetic oligonucleotide; TTA chr11 5202813 5202834 5202830 5202835 +
tctccagggaaaccaaattgct

SEQ ID NO: 79986 - DNA, 22 bp, Artificial Sequence
  Synthetic oligonucleotide; CTC chr11 5202817 5202838 5202834 5202839 +
cagggaaaccaaattgcttttc

SEQ ID NO: 79987 - DNA, 22 bp, Artificial Sequence
  Synthetic oligonucleotide; TTG chr11 5202833 5202854 5202850 5202855 +
cttttctacaaacatctactaa

SEQ ID NO: 79988 - DNA, 22 bp, Artificial Sequence
  Synthetic oligonucleotide; CTT chr11 5202836 5202857 5202853 5202858 +
ttctacaaacatctactaaatc

SEQ ID NO: 79989 - DNA, 22 bp, Artificial Sequence
  Synthetic oligonucleotide; TTT chr11 5202837 5202858 5202854 5202859 +
tctacaaacatctactaaatca

SEQ ID NO: 79990 - DNA, 22 bp, Artificial Sequence
  Synthetic oligonucleotide; TTT chr11 5202838 5202859 5202855 5202860 +
ctacaaacatctactaaatcac

SEQ ID NO: 79991 - DNA, 22 bp, Artificial Sequence
  Synthetic oligonucleotide; TTC chr11 5202839 5202860 5202856 5202861 +
tacaaacatctactaaatcaca

SEQ ID NO: 79992 - DNA, 22 bp, Artificial Sequence
  Synthetic oligonucleotide; CTA chr11 5202841 5202862 5202858 5202863 +
caaacatctactaaatcacaca

SEQ ID NO: 79993 - DNA, 22 bp, Artificial Sequence
  Synthetic oligonucleotide; CTA chr11 5202851 5202872 5202868 5202873 +
ctaaatcacacaaacctttgtt

SEQ ID NO: 79994 - DNA, 22 bp, Artificial Sequence
  Synthetic oligonucleotide; CTA chr11 5202854 5202875 5202871 5202876 +
aatcacacaaacctttgttgaa

SEQ ID NO: 79995 - DNA, 22 bp, Artificial Sequence
  Synthetic oligonucleotide; CTT chr11 5202869 5202890 5202886 5202891 +
tgttgaaaaaactctttgatgg

SEQ ID NO: 79996 - DNA, 22 bp, Artificial Sequence
  Synthetic oligonucleotide; TTT chr11 5202870 5202891 5202887 5202892 +
gttgaaaaaactctttgatggt

SEQ ID NO: 79997 - DNA, 22 bp, Artificial Sequence
  Synthetic oligonucleotide; TTG chr11 5202871 5202892 5202888 5202893 +
ttgaaaaaactctttgatggtc

SEQ ID NO: 79998 - DNA, 22 bp, Artificial Sequence
  Synthetic oligonucleotide; TTG chr11 5202874 5202895 5202891 5202896 +
aaaaaactctttgatggtcact

SEQ ID NO: 79999 - DNA, 22 bp, Artificial Sequence
  Synthetic oligonucleotide; CTC chr11 5202883 5202904 5202900 5202905 +
tttgatggtcacttacccattg

SEQ ID NO: 80000 - DNA, 22 bp, Artificial Sequence
  Synthetic oligonucleotide; CTT chr11 5202885 5202906 5202902 5202907 +
tgatggtcacttacccattgct

SEQ ID NO: 80001 - DNA, 22 bp, Artificial Sequence
  Synthetic oligonucleotide; TTT chr11 5202886 5202907 5202903 5202908 +
gatggtcacttacccattgctc

SEQ ID NO: 80002 - DNA, 22 bp, Artificial Sequence
  Synthetic oligonucleotide; TTG chr11 5202887 5202908 5202904 5202909 +
atggtcacttacccattgctcg

SEQ ID NO: 80003 - DNA, 22 bp, Artificial Sequence
  Synthetic oligonucleotide; CTT chr11 5202897 5202918 5202914 5202919 +
acccattgctcgtaatgtaaaa

SEQ ID NO: 80004 - DNA, 22 bp, Artificial Sequence
  Synthetic oligonucleotide; TTA chr11 5202898 5202919 5202915 5202920 +
cccattgctcgtaatgtaaaat

SEQ ID NO: 80005 - DNA, 22 bp, Artificial Sequence
  Synthetic oligonucleotide; TTG chr11 5202905 5202926 5202922 5202927 +
ctcgtaatgtaaaatacaaatt

SEQ ID NO: 80006 - DNA, 22 bp, Artificial Sequence
  Synthetic oligonucleotide; CTC chr11 5202908 5202929 5202925 5202930 +
gtaatgtaaaatacaaattctt

SEQ ID NO: 80007 - DNA, 22 bp, Artificial Sequence
  Synthetic oligonucleotide; TTC chr11 5202928 5202949 5202945 5202950 +
tttatcatagtcaaaaagcctt

SEQ ID NO: 80008 - DNA, 22 bp, Artificial Sequence
  Synthetic oligonucleotide; CTT chr11 5202930 5202951 5202947 5202952 +
tatcatagtcaaaaagccttgt

SEQ ID NO: 80009 - DNA, 22 bp, Artificial Sequence
  Synthetic oligonucleotide; TTT chr11 5202931 5202952 5202948 5202953 +
atcatagtcaaaaagccttgta

SEQ ID NO: 80010 - DNA, 22 bp, Artificial Sequence
  Synthetic oligonucleotide; TTA chr11 5202932 5202953 5202949 5202954 +
tcatagtcaaaaagccttgtat

SEQ ID NO: 80011 - DNA, 22 bp, Artificial Sequence
  Synthetic oligonucleotide; CTT chr11 5202950 5202971 5202967 5202972 +
gtataacgtggctcacctgcct

SEQ ID NO: 80012 - DNA, 22 bp, Artificial Sequence
  Synthetic oligonucleotide; TTG chr11 5202951 5202972 5202968 5202973 +
tataacgtggctcacctgcctc

SEQ ID NO: 80013 - DNA, 22 bp, Artificial Sequence
  Synthetic oligonucleotide; CTC chr11 5202964 5202985 5202981 5202986 +
acctgcctcttctattacatct

SEQ ID NO: 80014 - DNA, 22 bp, Artificial Sequence
  Synthetic oligonucleotide; CTG chr11 5202969 5202990 5202986 5202991 +
cctcttctattacatctttaga

SEQ ID NO: 80015 - DNA, 22 bp, Artificial Sequence
  Synthetic oligonucleotide; CTC chr11 5202973 5202994 5202990 5202995 +
ttctattacatctttagaccac

SEQ ID NO: 80016 - DNA, 22 bp, Artificial Sequence
  Synthetic oligonucleotide; CTT chr11 5202975 5202996 5202992 5202997 +
ctattacatctttagaccacta

SEQ ID NO: 80017 - DNA, 22 bp, Artificial Sequence
  Synthetic oligonucleotide; TTC chr11 5202976 5202997 5202993 5202998 +
tattacatctttagaccactac

SEQ ID NO: 80018 - DNA, 22 bp, Artificial Sequence
  Synthetic oligonucleotide; CTA chr11 5202978 5202999 5202995 5203000 +
ttacatctttagaccactactg

SEQ ID NO: 80019 - DNA, 22 bp, Artificial Sequence
  Synthetic oligonucleotide; TTA chr11 5202981 5203002 5202998 5203003 +
catctttagaccactactgcct

SEQ ID NO: 80020 - DNA, 22 bp, Artificial Sequence
  Synthetic oligonucleotide; CTT chr11 5202987 5203008 5203004 5203009 +
tagaccactactgcctacactc

SEQ ID NO: 80021 - DNA, 22 bp, Artificial Sequence
  Synthetic oligonucleotide; TTT chr11 5202988 5203009 5203005 5203010 +
agaccactactgcctacactcc

SEQ ID NO: 80022 - DNA, 22 bp, Artificial Sequence
  Synthetic oligonucleotide; TTA chr11 5202989 5203010 5203006 5203011 +
gaccactactgcctacactcct

SEQ ID NO: 80023 - DNA, 22 bp, Artificial Sequence
  Synthetic oligonucleotide; CTA chr11 5202997 5203018 5203014 5203019 +
ctgcctacactccttaatattt

SEQ ID NO: 80024 - DNA, 22 bp, Artificial Sequence
  Synthetic oligonucleotide; CTG chr11 5203000 5203021 5203017 5203022 +
cctacactccttaatatttagg

SEQ ID NO: 80025 - DNA, 22 bp, Artificial Sequence
  Synthetic oligonucleotide; CTA chr11 5203004 5203025 5203021 5203026 +
cactccttaatatttaggtatc

SEQ ID NO: 80026 - DNA, 22 bp, Artificial Sequence
  Synthetic oligonucleotide; CTC chr11 5203009 5203030 5203026 5203031 +
cttaatatttaggtatctttat

SEQ ID NO: 80027 - DNA, 22 bp, Artificial Sequence
  Synthetic oligonucleotide; CTT chr11 5203012 5203033 5203029 5203034 +
aatatttaggtatctttatctt

SEQ ID NO: 80028 - DNA, 22 bp, Artificial Sequence
  Synthetic oligonucleotide; TTA chr11 5203013 5203034 5203030 5203035 +
atatttaggtatctttatcttc

SEQ ID NO: 80029 - DNA, 22 bp, Artificial Sequence
  Synthetic oligonucleotide; TTT chr11 5203019 5203040 5203036 5203041 +
aggtatctttatcttcctcaaa

SEQ ID NO: 80030 - DNA, 22 bp, Artificial Sequence
  Synthetic oligonucleotide; TTA chr11 5203020 5203041 5203037 5203042 +
ggtatctttatcttcctcaaaa

SEQ ID NO: 80031 - DNA, 22 bp, Artificial Sequence
  Synthetic oligonucleotide; CTT chr11 5203028 5203049 5203045 5203050 +
tatcttcctcaaaacaagctaa

SEQ ID NO: 80032 - DNA, 22 bp, Artificial Sequence
  Synthetic oligonucleotide; TTT chr11 5203029 5203050 5203046 5203051 +
atcttcctcaaaacaagctaag

SEQ ID NO: 80033 - DNA, 22 bp, Artificial Sequence
  Synthetic oligonucleotide; TTA chr11 5203030 5203051 5203047 5203052 +
tcttcctcaaaacaagctaagt

SEQ ID NO: 80034 - DNA, 22 bp, Artificial Sequence
  Synthetic oligonucleotide; CTT chr11 5203034 5203055 5203051 5203056 +
cctcaaaacaagctaagtacat

SEQ ID NO: 80035 - DNA, 22 bp, Artificial Sequence
  Synthetic oligonucleotide; TTC chr11 5203035 5203056 5203052 5203057 +
ctcaaaacaagctaagtacatg

SEQ ID NO: 80036 - DNA, 22 bp, Artificial Sequence
  Synthetic oligonucleotide; CTC chr11 5203038 5203059 5203055 5203060 +
aaaacaagctaagtacatgcat

SEQ ID NO: 80037 - DNA, 22 bp, Artificial Sequence
  Synthetic oligonucleotide; CTA chr11 5203049 5203070 5203066 5203071 +
agtacatgcatgtctcaggatc

SEQ ID NO: 80038 - DNA, 22 bp, Artificial Sequence
  Synthetic oligonucleotide; CTC chr11 5203065 5203086 5203082 5203087 +
aggatctttgcccatggtcttc

SEQ ID NO: 80039 - DNA, 22 bp, Artificial Sequence
  Synthetic oligonucleotide; CTT chr11 5203073 5203094 5203090 5203095 +
tgcccatggtcttctctgtgct

SEQ ID NO: 80040 - DNA, 22 bp, Artificial Sequence
  Synthetic oligonucleotide; TTT chr11 5203074 5203095 5203091 5203096 +
gcccatggtcttctctgtgctc

SEQ ID NO: 80041 - DNA, 22 bp, Artificial Sequence
  Synthetic oligonucleotide; TTG chr11 5203075 5203096 5203092 5203097 +
cccatggtcttctctgtgctcc

SEQ ID NO: 80042 - DNA, 22 bp, Artificial Sequence
  Synthetic oligonucleotide; CTT chr11 5203086 5203107 5203103 5203108 +
ctctgtgctccgaattatctac

SEQ ID NO: 80043 - DNA, 22 bp, Artificial Sequence
  Synthetic oligonucleotide; TTC chr11 5203087 5203108 5203104 5203109 +
tctgtgctccgaattatctacc

SEQ ID NO: 80044 - DNA, 22 bp, Artificial Sequence
  Synthetic oligonucleotide; CTC chr11 5203089 5203110 5203106 5203111 +
tgtgctccgaattatctacccc

SEQ ID NO: 80045 - DNA, 22 bp, Artificial Sequence
  Synthetic oligonucleotide; CTG chr11 5203091 5203112 5203108 5203113 +
tgctccgaattatctaccccaa

SEQ ID NO: 80046 - DNA, 22 bp, Artificial Sequence
  Synthetic oligonucleotide; CTC chr11 5203096 5203117 5203113 5203118 +
cgaattatctaccccaagtatt

SEQ ID NO: 80047 - DNA, 22 bp, Artificial Sequence
  Synthetic oligonucleotide; TTA chr11 5203103 5203124 5203120 5203125 +
tctaccccaagtatttgcacag

SEQ ID NO: 80048 - DNA, 22 bp, Artificial Sequence
  Synthetic oligonucleotide; CTA chr11 5203107 5203128 5203124 5203129 +
ccccaagtatttgcacagcaat

SEQ ID NO: 80049 - DNA, 22 bp, Artificial Sequence
  Synthetic oligonucleotide; TTT chr11 5203119 5203140 5203136 5203141 +
gcacagcaattcctttcaccat

SEQ ID NO: 80050 - DNA, 22 bp, Artificial Sequence
  Synthetic oligonucleotide; TTG chr11 5203120 5203141 5203137 5203142 +
cacagcaattcctttcaccatt

SEQ ID NO: 80051 - DNA, 22 bp, Artificial Sequence
  Synthetic oligonucleotide; TTC chr11 5203131 5203152 5203148 5203153 +
ctttcaccattaacttttgagt

SEQ ID NO: 80052 - DNA, 22 bp, Artificial Sequence
  Synthetic oligonucleotide; CTT chr11 5203134 5203155 5203151 5203156 +
tcaccattaacttttgagttaa

SEQ ID NO: 80053 - DNA, 22 bp, Artificial Sequence
  Synthetic oligonucleotide; TTT chr11 5203135 5203156 5203152 5203157 +
caccattaacttttgagttaaa

SEQ ID NO: 80054 - DNA, 22 bp, Artificial Sequence
  Synthetic oligonucleotide; TTC chr11 5203136 5203157 5203153 5203158 +
accattaacttttgagttaaaa

SEQ ID NO: 80055 - DNA, 22 bp, Artificial Sequence
  Synthetic oligonucleotide; TTA chr11 5203143 5203164 5203160 5203165 +
acttttgagttaaaatgattac

SEQ ID NO: 80056 - DNA, 22 bp, Artificial Sequence
  Synthetic oligonucleotide; CTT chr11 5203147 5203168 5203164 5203169 +
ttgagttaaaatgattacttcc

SEQ ID NO: 80057 - DNA, 22 bp, Artificial Sequence
  Synthetic oligonucleotide; TTT chr11 5203148 5203169 5203165 5203170 +
tgagttaaaatgattacttcct

SEQ ID NO: 80058 - DNA, 22 bp, Artificial Sequence
  Synthetic oligonucleotide; TTT chr11 5203149 5203170 5203166 5203171 +
gagttaaaatgattacttcctc

SEQ ID NO: 80059 - DNA, 22 bp, Artificial Sequence
  Synthetic oligonucleotide; TTG chr11 5203150 5203171 5203167 5203172 +
agttaaaatgattacttcctca

SEQ ID NO: 80060 - DNA, 22 bp, Artificial Sequence
  Synthetic oligonucleotide; TTA chr11 5203155 5203176 5203172 5203177 +
aaatgattacttcctcaggggg

SEQ ID NO: 80061 - DNA, 22 bp, Artificial Sequence
  Synthetic oligonucleotide; TTA chr11 5203164 5203185 5203181 5203186 +
cttcctcagggggatttttcta

SEQ ID NO: 80062 - DNA, 22 bp, Artificial Sequence
  Synthetic oligonucleotide; CTT chr11 5203167 5203188 5203184 5203189 +
cctcagggggatttttctaata

SEQ ID NO: 80063 - DNA, 22 bp, Artificial Sequence
  Synthetic oligonucleotide; TTC chr11 5203168 5203189 5203185 5203190 +
ctcagggggatttttctaatac

SEQ ID NO: 80064 - DNA, 22 bp, Artificial Sequence
  Synthetic oligonucleotide; CTC chr11 5203171 5203192 5203188 5203193 +
agggggatttttctaatactgc

SEQ ID NO: 80065 - DNA, 22 bp, Artificial Sequence
  Synthetic oligonucleotide; TTT chr11 5203181 5203202 5203198 5203203 +
ttctaatactgctccccaccta

SEQ ID NO: 80066 - DNA, 22 bp, Artificial Sequence
  Synthetic oligonucleotide; TTT chr11 5203182 5203203 5203199 5203204 +
tctaatactgctccccacctag

SEQ ID NO: 80067 - DNA, 22 bp, Artificial Sequence
  Synthetic oligonucleotide; TTT chr11 5203183 5203204 5203200 5203205 +
ctaatactgctccccacctaga

SEQ ID NO: 80068 - DNA, 22 bp, Artificial Sequence
  Synthetic oligonucleotide; TTC chr11 5203184 5203205 5203201 5203206 +
taatactgctccccacctagat

SEQ ID NO: 80069 - DNA, 22 bp, Artificial Sequence
  Synthetic oligonucleotide; CTA chr11 5203186 5203207 5203203 5203208 +
atactgctccccacctagatta

SEQ ID NO: 80070 - DNA, 22 bp, Artificial Sequence
  Synthetic oligonucleotide; CTG chr11 5203192 5203213 5203209 5203214 +
ctccccacctagattatctcat

SEQ ID NO: 80071 - DNA, 22 bp, Artificial Sequence
  Synthetic oligonucleotide; CTC chr11 5203195 5203216 5203212 5203217 +
cccacctagattatctcatttc

SEQ ID NO: 80072 - DNA, 22 bp, Artificial Sequence
  Synthetic oligonucleotide; CTA chr11 5203203 5203224 5203220 5203225 +
gattatctcatttcttcaaccc

SEQ ID NO: 80073 - DNA, 22 bp, Artificial Sequence
  Synthetic oligonucleotide; TTA chr11 5203208 5203229 5203225 5203230 +
tctcatttcttcaaccccctta

SEQ ID NO: 80074 - DNA, 22 bp, Artificial Sequence
  Synthetic oligonucleotide; CTC chr11 5203212 5203233 5203229 5203234 +
atttcttcaacccccttaacta

SEQ ID NO: 80075 - DNA, 22 bp, Artificial Sequence
  Synthetic oligonucleotide; TTT chr11 5203216 5203237 5203233 5203238 +
cttcaacccccttaactaactt

SEQ ID NO: 80076 - DNA, 22 bp, Artificial Sequence
  Synthetic oligonucleotide; TTC chr11 5203217 5203238 5203234 5203239 +
ttcaacccccttaactaactta

SEQ ID NO: 80077 - DNA, 22 bp, Artificial Sequence
  Synthetic oligonucleotide; CTT chr11 5203219 5203240 5203236 5203241 +
caacccccttaactaacttact

SEQ ID NO: 80078 - DNA, 22 bp, Artificial Sequence
  Synthetic oligonucleotide; TTC chr11 5203220 5203241 5203237 5203242 +
aacccccttaactaacttactc

SEQ ID NO: 80079 - DNA, 22 bp, Artificial Sequence
  Synthetic oligonucleotide; CTT chr11 5203229 5203250 5203246 5203251 +
aactaacttactctcatcacag

SEQ ID NO: 80080 - DNA, 22 bp, Artificial Sequence
  Synthetic oligonucleotide; TTA chr11 5203230 5203251 5203247 5203252 +
actaacttactctcatcacagt

SEQ ID NO: 80081 - DNA, 22 bp, Artificial Sequence
  Synthetic oligonucleotide; CTA chr11 5203234 5203255 5203251 5203256 +
acttactctcatcacagtatac

SEQ ID NO: 80082 - DNA, 22 bp, Artificial Sequence
  Synthetic oligonucleotide; CTT chr11 5203238 5203259 5203255 5203260 +
actctcatcacagtatactagt

SEQ ID NO: 80083 - DNA, 22 bp, Artificial Sequence
  Synthetic oligonucleotide; TTA chr11 5203239 5203260 5203256 5203261 +
ctctcatcacagtatactagtt

SEQ ID NO: 80084 - DNA, 22 bp, Artificial Sequence
  Synthetic oligonucleotide; CTC chr11 5203242 5203263 5203259 5203264 +
tcatcacagtatactagtttat

SEQ ID NO: 80085 - DNA, 22 bp, Artificial Sequence
  Synthetic oligonucleotide; CTC chr11 5203244 5203265 5203261 5203266 +
atcacagtatactagtttatat

SEQ ID NO: 80086 - DNA, 22 bp, Artificial Sequence
  Synthetic oligonucleotide; CTA chr11 5203258 5203279 5203275 5203280 +
gtttatatttataccacttatt

SEQ ID NO: 80087 - DNA, 22 bp, Artificial Sequence
  Synthetic oligonucleotide; TTT chr11 5203262 5203283 5203279 5203284 +
atatttataccacttattatac

SEQ ID NO: 80088 - DNA, 22 bp, Artificial Sequence
  Synthetic oligonucleotide; TTA chr11 5203263 5203284 5203280 5203285 +
tatttataccacttattataca

SEQ ID NO: 80089 - DNA, 22 bp, Artificial Sequence
  Synthetic oligonucleotide; TTT chr11 5203268 5203289 5203285 5203290 +
ataccacttattatacactgaa

SEQ ID NO: 80090 - DNA, 22 bp, Artificial Sequence
  Synthetic oligonucleotide; TTA chr11 5203269 5203290 5203286 5203291 +
taccacttattatacactgaat

SEQ ID NO: 80091 - DNA, 22 bp, Artificial Sequence
  Synthetic oligonucleotide; CTT chr11 5203277 5203298 5203294 5203299 +
attatacactgaatttccatta

SEQ ID NO: 80092 - DNA, 22 bp, Artificial Sequence
  Synthetic oligonucleotide; TTA chr11 5203278 5203299 5203295 5203300 +
ttatacactgaatttccattag

SEQ ID NO: 80093 - DNA, 22 bp, Artificial Sequence
  Synthetic oligonucleotide; TTA chr11 5203281 5203302 5203298 5203303 +
tacactgaatttccattagatt

SEQ ID NO: 80094 - DNA, 22 bp, Artificial Sequence
  Synthetic oligonucleotide; CTG chr11 5203288 5203309 5203305 5203310 +
aatttccattagattcattaga

SEQ ID NO: 80095 - DNA, 22 bp, Artificial Sequence
  Synthetic oligonucleotide; TTT chr11 5203293 5203314 5203310 5203315 +
ccattagattcattagaggctg

SEQ ID NO: 80096 - DNA, 22 bp, Artificial Sequence
  Synthetic oligonucleotide; TTC chr11 5203294 5203315 5203311 5203316 +
cattagattcattagaggctgt

SEQ ID NO: 80097 - DNA, 22 bp, Artificial Sequence
  Synthetic oligonucleotide; TTA chr11 5203299 5203320 5203316 5203321 +
gattcattagaggctgtagaag

SEQ ID NO: 80098 - DNA, 22 bp, Artificial Sequence
  Synthetic oligonucleotide; TTC chr11 5203304 5203325 5203321 5203326 +
attagaggctgtagaagattag

SEQ ID NO: 80099 - DNA, 22 bp, Artificial Sequence
  Synthetic oligonucleotide; TTA chr11 5203308 5203329 5203325 5203330 +
gaggctgtagaagattaggaac

SEQ ID NO: 80100 - DNA, 22 bp, Artificial Sequence
  Synthetic oligonucleotide; CTG chr11 5203315 5203336 5203332 5203337 +
tagaagattaggaaccatatct

SEQ ID NO: 80101 - DNA, 22 bp, Artificial Sequence
  Synthetic oligonucleotide; TTA chr11 5203325 5203346 5203342 5203347 +
ggaaccatatctgttttttgct

SEQ ID NO: 80102 - DNA, 22 bp, Artificial Sequence
  Synthetic oligonucleotide; CTG chr11 5203338 5203359 5203355 5203360 +
ttttttgctcaagaatatgaaa

SEQ ID NO: 80103 - DNA, 22 bp, Artificial Sequence
  Synthetic oligonucleotide; TTT chr11 5203341 5203362 5203358 5203363 +
tttgctcaagaatatgaaaaat

SEQ ID NO: 80104 - DNA, 22 bp, Artificial Sequence
  Synthetic oligonucleotide; TTT chr11 5203342 5203363 5203359 5203364 +
ttgctcaagaatatgaaaaata

SEQ ID NO: 80105 - DNA, 22 bp, Artificial Sequence
  Synthetic oligonucleotide; TTT chr11 5203343 5203364 5203360 5203365 +
tgctcaagaatatgaaaaataa

SEQ ID NO: 80106 - DNA, 22 bp, Artificial Sequence
  Synthetic oligonucleotide; TTT chr11 5203344 5203365 5203361 5203366 +
gctcaagaatatgaaaaataag

SEQ ID NO: 80107 - DNA, 22 bp, Artificial Sequence
  Synthetic oligonucleotide; TTG chr11 5203345 5203366 5203362 5203367 +
ctcaagaatatgaaaaataagg

SEQ ID NO: 80108 - DNA, 22 bp, Artificial Sequence
  Synthetic oligonucleotide; CTC chr11 5203348 5203369 5203365 5203370 +
aagaatatgaaaaataagggtt

SEQ ID NO: 80109 - DNA, 22 bp, Artificial Sequence
  Synthetic oligonucleotide; TTA chr11 5203371 5203392 5203388 5203393 +
gcatagaatgggcacttatcaa

SEQ ID NO: 80110 - DNA, 22 bp, Artificial Sequence
  Synthetic oligonucleotide; CTT chr11 5203388 5203409 5203405 5203410 +
atcaaataatttttaattaatt

SEQ ID NO: 80111 - DNA, 22 bp, Artificial Sequence
  Synthetic oligonucleotide; TTA chr11 5203389 5203410 5203406 5203411 +
tcaaataatttttaattaatta

SEQ ID NO: 80112 - DNA, 22 bp, Artificial Sequence
  Synthetic oligonucleotide; TTT chr11 5203400 5203421 5203417 5203422 +
ttaattaattattctatgaaat

SEQ ID NO: 80113 - DNA, 22 bp, Artificial Sequence
  Synthetic oligonucleotide; TTT chr11 5203401 5203422 5203418 5203423 +
taattaattattctatgaaata

SEQ ID NO: 80114 - DNA, 22 bp, Artificial Sequence
  Synthetic oligonucleotide; TTT chr11 5203402 5203423 5203419 5203424 +
aattaattattctatgaaataa

SEQ ID NO: 80115 - DNA, 22 bp, Artificial Sequence
  Synthetic oligonucleotide; TTA chr11 5203403 5203424 5203420 5203425 +
attaattattctatgaaataag

SEQ ID NO: 80116 - DNA, 22 bp, Artificial Sequence
  Synthetic oligonucleotide; TTA chr11 5203407 5203428 5203424 5203429 +
attattctatgaaataagagct

SEQ ID NO: 80117 - DNA, 22 bp, Artificial Sequence
  Synthetic oligonucleotide; TTA chr11 5203411 5203432 5203428 5203433 +
ttctatgaaataagagctagac

SEQ ID NO: 80118 - DNA, 22 bp, Artificial Sequence
  Synthetic oligonucleotide; TTC chr11 5203414 5203435 5203431 5203436 +
tatgaaataagagctagacaat

SEQ ID NO: 80119 - DNA, 22 bp, Artificial Sequence
  Synthetic oligonucleotide; CTA chr11 5203416 5203437 5203433 5203438 +
tgaaataagagctagacaatca

SEQ ID NO: 80120 - DNA, 22 bp, Artificial Sequence
  Synthetic oligonucleotide; CTA chr11 5203430 5203451 5203447 5203452 +
gacaatcacagagatataaaga

SEQ ID NO: 80121 - DNA, 22 bp, Artificial Sequence
  Synthetic oligonucleotide; CTC chr11 5203472 5203493 5203489 5203494 +
ctatcaaagtgtgtgtaaaatc

SEQ ID NO: 80122 - DNA, 22 bp, Artificial Sequence
  Synthetic oligonucleotide; CTA chr11 5203475 5203496 5203492 5203497 +
tcaaagtgtgtgtaaaatcatc

SEQ ID NO: 80123 - DNA, 22 bp, Artificial Sequence
  Synthetic oligonucleotide; CTG chr11 5203499 5203520 5203516 5203521 +
tgtacacttagtcttttctgac

SEQ ID NO: 80124 - DNA, 22 bp, Artificial Sequence
  Synthetic oligonucleotide; CTT chr11 5203508 5203529 5203525 5203530 +
agtcttttctgacctttggcca

SEQ ID NO: 80125 - DNA, 22 bp, Artificial Sequence
  Synthetic oligonucleotide; TTA chr11 5203509 5203530 5203526 5203531 +
gtcttttctgacctttggccac

SEQ ID NO: 80126 - DNA, 22 bp, Artificial Sequence
  Synthetic oligonucleotide; CTT chr11 5203514 5203535 5203531 5203536 +
ttctgacctttggccaccaatt

SEQ ID NO: 80127 - DNA, 22 bp, Artificial Sequence
  Synthetic oligonucleotide; TTT chr11 5203515 5203536 5203532 5203537 +
tctgacctttggccaccaattg

SEQ ID NO: 80128 - DNA, 22 bp, Artificial Sequence
  Synthetic oligonucleotide; TTT chr11 5203516 5203537 5203533 5203538 +
ctgacctttggccaccaattga

SEQ ID NO: 80129 - DNA, 22 bp, Artificial Sequence
  Synthetic oligonucleotide; TTC chr11 5203517 5203538 5203534 5203539 +
tgacctttggccaccaattgag

SEQ ID NO: 80130 - DNA, 22 bp, Artificial Sequence
  Synthetic oligonucleotide; CTG chr11 5203519 5203540 5203536 5203541 +
acctttggccaccaattgagtc

SEQ ID NO: 80131 - DNA, 22 bp, Artificial Sequence
  Synthetic oligonucleotide; CTT chr11 5203524 5203545 5203541 5203546 +
tggccaccaattgagtcatcat

SEQ ID NO: 80132 - DNA, 22 bp, Artificial Sequence
  Synthetic oligonucleotide; TTT chr11 5203525 5203546 5203542 5203547 +
ggccaccaattgagtcatcata

SEQ ID NO: 80133 - DNA, 22 bp, Artificial Sequence
  Synthetic oligonucleotide; TTG chr11 5203526 5203547 5203543 5203548 +
gccaccaattgagtcatcatat

SEQ ID NO: 80134 - DNA, 22 bp, Artificial Sequence
  Synthetic oligonucleotide; TTG chr11 5203537 5203558 5203554 5203559 +
agtcatcatataccaagtttga

SEQ ID NO: 80135 - DNA, 22 bp, Artificial Sequence
  Synthetic oligonucleotide; TTT chr11 5203557 5203578 5203574 5203579 +
gaatggtttataaaacagatgc

SEQ ID NO: 80136 - DNA, 22 bp, Artificial Sequence
  Synthetic oligonucleotide; TTG chr11 5203558 5203579 5203575 5203580 +
aatggtttataaaacagatgct

SEQ ID NO: 80137 - DNA, 22 bp, Artificial Sequence
  Synthetic oligonucleotide; TTT chr11 5203566 5203587 5203583 5203588 +
ataaaacagatgctgctccagg

SEQ ID NO: 80138 - DNA, 22 bp, Artificial Sequence
  Synthetic oligonucleotide; TTA chr11 5203567 5203588 5203584 5203589 +
taaaacagatgctgctccaggg

SEQ ID NO: 80139 - DNA, 22 bp, Artificial Sequence
  Synthetic oligonucleotide; CTG chr11 5203581 5203602 5203598 5203603 +
ctccagggatcttgctgacctt

SEQ ID NO: 80140 - DNA, 22 bp, Artificial Sequence
  Synthetic oligonucleotide; CTC chr11 5203584 5203605 5203601 5203606 +
cagggatcttgctgaccttgaa

SEQ ID NO: 80141 - DNA, 22 bp, Artificial Sequence
  Synthetic oligonucleotide; CTT chr11 5203594 5203615 5203611 5203616 +
gctgaccttgaatacaacactc

SEQ ID NO: 80142 - DNA, 22 bp, Artificial Sequence
  Synthetic oligonucleotide; TTG chr11 5203595 5203616 5203612 5203617 +
ctgaccttgaatacaacactcc

SEQ ID NO: 80143 - DNA, 22 bp, Artificial Sequence
  Synthetic oligonucleotide; CTG chr11 5203598 5203619 5203615 5203620 +
accttgaatacaacactccaat

SEQ ID NO: 80144 - DNA, 22 bp, Artificial Sequence
  Synthetic oligonucleotide; CTT chr11 5203603 5203624 5203620 5203625 +
gaatacaacactccaatttcaa

SEQ ID NO: 80145 - DNA, 22 bp, Artificial Sequence
  Synthetic oligonucleotide; TTG chr11 5203604 5203625 5203621 5203626 +
aatacaacactccaatttcaaa

SEQ ID NO: 80146 - DNA, 22 bp, Artificial Sequence
  Synthetic oligonucleotide; CTC chr11 5203616 5203637 5203633 5203638 +
caatttcaaacatgatttctct

SEQ ID NO: 80147 - DNA, 22 bp, Artificial Sequence
  Synthetic oligonucleotide; TTT chr11 5203622 5203643 5203639 5203644 +
caaacatgatttctctcatttc

SEQ ID NO: 80148 - DNA, 22 bp, Artificial Sequence
  Synthetic oligonucleotide; TTC chr11 5203623 5203644 5203640 5203645 +
aaacatgatttctctcatttcc

SEQ ID NO: 80149 - DNA, 22 bp, Artificial Sequence
  Synthetic oligonucleotide; TTT chr11 5203634 5203655 5203651 5203656 +
ctctcatttccagcctgactca

SEQ ID NO: 80150 - DNA, 22 bp, Artificial Sequence
  Synthetic oligonucleotide; TTC chr11 5203635 5203656 5203652 5203657 +
tctcatttccagcctgactcag

SEQ ID NO: 80151 - DNA, 22 bp, Artificial Sequence
  Synthetic oligonucleotide; CTC chr11 5203637 5203658 5203654 5203659 +
tcatttccagcctgactcagac

SEQ ID NO: 80152 - DNA, 22 bp, Artificial Sequence
  Synthetic oligonucleotide; CTC chr11 5203639 5203660 5203656 5203661 +
atttccagcctgactcagacat

SEQ ID NO: 80153 - DNA, 22 bp, Artificial Sequence
  Synthetic oligonucleotide; TTT chr11 5203643 5203664 5203660 5203665 +
ccagcctgactcagacatatcg

SEQ ID NO: 80154 - DNA, 22 bp, Artificial Sequence
  Synthetic oligonucleotide; TTC chr11 5203644 5203665 5203661 5203666 +
cagcctgactcagacatatcgt

SEQ ID NO: 80155 - DNA, 22 bp, Artificial Sequence
  Synthetic oligonucleotide; CTG chr11 5203651 5203672 5203668 5203673 +
actcagacatatcgtcaaggat

SEQ ID NO: 80156 - DNA, 22 bp, Artificial Sequence
  Synthetic oligonucleotide; CTC chr11 5203655 5203676 5203672 5203677 +
agacatatcgtcaaggatctgg

SEQ ID NO: 80157 - DNA, 22 bp, Artificial Sequence
  Synthetic oligonucleotide; CTG chr11 5203676 5203697 5203693 5203698 +
ggattgatcacaaaagatttaa

SEQ ID NO: 80158 - DNA, 22 bp, Artificial Sequence
  Synthetic oligonucleotide; TTG chr11 5203682 5203703 5203699 5203704 +
atcacaaaagatttaatattct

SEQ ID NO: 80159 - DNA, 22 bp, Artificial Sequence
  Synthetic oligonucleotide; TTT chr11 5203696 5203717 5203713 5203718 +
aatattctgtgaatgtaggtat

SEQ ID NO: 80160 - DNA, 22 bp, Artificial Sequence
  Synthetic oligonucleotide; TTA chr11 5203697 5203718 5203714 5203719 +
atattctgtgaatgtaggtatg

SEQ ID NO: 80161 - DNA, 22 bp, Artificial Sequence
  Synthetic oligonucleotide; TTC chr11 5203703 5203724 5203720 5203725 +
tgtgaatgtaggtatgtgttaa

SEQ ID NO: 80162 - DNA, 22 bp, Artificial Sequence
  Synthetic oligonucleotide; CTG chr11 5203705 5203726 5203722 5203727 +
tgaatgtaggtatgtgttaaaa

SEQ ID NO: 80163 - DNA, 22 bp, Artificial Sequence
  Synthetic oligonucleotide; TTA chr11 5203724 5203745 5203741 5203746 +
aaagtatctactttcagccagg

SEQ ID NO: 80164 - DNA, 22 bp, Artificial Sequence
  Synthetic oligonucleotide; CTA chr11 5203734 5203755 5203751 5203756 +
ctttcagccaggcttggtggct

SEQ ID NO: 80165 - DNA, 22 bp, Artificial Sequence
  Synthetic oligonucleotide; CTT chr11 5203737 5203758 5203754 5203759 +
tcagccaggcttggtggctcac

SEQ ID NO: 80166 - DNA, 22 bp, Artificial Sequence
  Synthetic oligonucleotide; TTT chr11 5203738 5203759 5203755 5203760 +
cagccaggcttggtggctcacg

SEQ ID NO: 80167 - DNA, 22 bp, Artificial Sequence
  Synthetic oligonucleotide; TTC chr11 5203739 5203760 5203756 5203761 +
agccaggcttggtggctcacgc

SEQ ID NO: 80168 - DNA, 22 bp, Artificial Sequence
  Synthetic oligonucleotide; CTT chr11 5203749 5203770 5203766 5203771 +
ggtggctcacgcctgtaatcct

SEQ ID NO: 80169 - DNA, 22 bp, Artificial Sequence
  Synthetic oligonucleotide; TTG chr11 5203750 5203771 5203767 5203772 +
gtggctcacgcctgtaatccta

SEQ ID NO: 80170 - DNA, 22 bp, Artificial Sequence
  Synthetic oligonucleotide; CTC chr11 5203757 5203778 5203774 5203779 +
acgcctgtaatcctagcacttt

SEQ ID NO: 80171 - DNA, 22 bp, Artificial Sequence
  Synthetic oligonucleotide; CTG chr11 5203764 5203785 5203781 5203786 +
taatcctagcactttgggaggc

SEQ ID NO: 80172 - DNA, 22 bp, Artificial Sequence
  Synthetic oligonucleotide; CTA chr11 5203772 5203793 5203789 5203794 +
gcactttgggaggccgaggcag

SEQ ID NO: 80173 - DNA, 22 bp, Artificial Sequence
  Synthetic oligonucleotide; CTT chr11 5203778 5203799 5203795 5203800 +
tgggaggccgaggcaggtggat

SEQ ID NO: 80174 - DNA, 22 bp, Artificial Sequence
  Synthetic oligonucleotide; TTT chr11 5203779 5203800 5203796 5203801 +
gggaggccgaggcaggtggatt

SEQ ID NO: 80175 - DNA, 22 bp, Artificial Sequence
  Synthetic oligonucleotide; TTG chr11 5203780 5203801 5203797 5203802 +
ggaggccgaggcaggtggattg

SEQ ID NO: 80176 - DNA, 22 bp, Artificial Sequence
  Synthetic oligonucleotide; TTG chr11 5203802 5203823 5203819 5203824 +
gctgagctcaggagttggagac

SEQ ID NO: 80177 - DNA, 22 bp, Artificial Sequence
  Synthetic oligonucleotide; CTG chr11 5203806 5203827 5203823 5203828 +
agctcaggagttggagaccaac

SEQ ID NO: 80178 - DNA, 22 bp, Artificial Sequence
  Synthetic oligonucleotide; CTC chr11 5203811 5203832 5203828 5203833 +
aggagttggagaccaacctggg

SEQ ID NO: 80179 - DNA, 22 bp, Artificial Sequence
  Synthetic oligonucleotide; TTG chr11 5203819 5203840 5203836 5203841 +
gagaccaacctgggcaaaatgg

SEQ ID NO: 80180 - DNA, 22 bp, Artificial Sequence
  Synthetic oligonucleotide; CTG chr11 5203831 5203852 5203848 5203853 +
ggcaaaatggtgaaaccctgtc

SEQ ID NO: 80181 - DNA, 22 bp, Artificial Sequence
  Synthetic oligonucleotide; CTG chr11 5203851 5203872 5203868 5203873 +
tctctactaaaacacaaaaata

SEQ ID NO: 80182 - DNA, 22 bp, Artificial Sequence
  Synthetic oligonucleotide; CTC chr11 5203855 5203876 5203872 5203877 +
tactaaaacacaaaaataatta

SEQ ID NO: 80183 - DNA, 22 bp, Artificial Sequence
  Synthetic oligonucleotide; CTA chr11 5203857 5203878 5203874 5203879 +
ctaaaacacaaaaataattagc

SEQ ID NO: 80184 - DNA, 22 bp, Artificial Sequence
  Synthetic oligonucleotide; CTA chr11 5203860 5203881 5203877 5203882 +
aaacacaaaaataattagctgg

SEQ ID NO: 80185 - DNA, 22 bp, Artificial Sequence
  Synthetic oligonucleotide; TTA chr11 5203877 5203898 5203894 5203899 +
gctgggcatggcagtgtgctcc

SEQ ID NO: 80186 - DNA, 22 bp, Artificial Sequence
  Synthetic oligonucleotide; CTG chr11 5203881 5203902 5203898 5203903 +
ggcatggcagtgtgctcctgta

SEQ ID NO: 80187 - DNA, 22 bp, Artificial Sequence
  Synthetic oligonucleotide; CTC chr11 5203898 5203919 5203915 5203920 +
ctgtaatcccagttacttggga

SEQ ID NO: 80188 - DNA, 22 bp, Artificial Sequence
  Synthetic oligonucleotide; CTG chr11 5203901 5203922 5203918 5203923 +
taatcccagttacttgggagac

SEQ ID NO: 80189 - DNA, 22 bp, Artificial Sequence
  Synthetic oligonucleotide; TTA chr11 5203913 5203934 5203930 5203935 +
cttgggagactgaggcaggaga

SEQ ID NO: 80190 - DNA, 22 bp, Artificial Sequence
  Synthetic oligonucleotide; CTT chr11 5203916 5203937 5203933 5203938 +
gggagactgaggcaggagaatt

SEQ ID NO: 80191 - DNA, 22 bp, Artificial Sequence
  Synthetic oligonucleotide; TTG chr11 5203917 5203938 5203934 5203939 +
ggagactgaggcaggagaattg

SEQ ID NO: 80192 - DNA, 22 bp, Artificial Sequence
  Synthetic oligonucleotide; CTG chr11 5203925 5203946 5203942 5203947 +
aggcaggagaattgcttgatcc

SEQ ID NO: 80193 - DNA, 22 bp, Artificial Sequence
  Synthetic oligonucleotide; TTG chr11 5203939 5203960 5203956 5203961 +
cttgatcctgggaggtggaagt

SEQ ID NO: 80194 - DNA, 22 bp, Artificial Sequence
  Synthetic oligonucleotide; CTT chr11 5203942 5203963 5203959 5203964 +
gatcctgggaggtggaagttgc

SEQ ID NO: 80195 - DNA, 22 bp, Artificial Sequence
  Synthetic oligonucleotide; TTG chr11 5203943 5203964 5203960 5203965 +
atcctgggaggtggaagttgca

SEQ ID NO: 80196 - DNA, 22 bp, Artificial Sequence
  Synthetic oligonucleotide; CTG chr11 5203949 5203970 5203966 5203971 +
ggaggtggaagttgcagtgagc

SEQ ID NO: 80197 - DNA, 22 bp, Artificial Sequence
  Synthetic oligonucleotide; TTG chr11 5203963 5203984 5203980 5203985 +
cagtgagccgagatcgcgccat

SEQ ID NO: 80198 - DNA, 22 bp, Artificial Sequence
  Synthetic oligonucleotide; TTG chr11 5203987 5204008 5204004 5204009 +
cactccagtctgggcgacagag

SEQ ID NO: 80199 - DNA, 22 bp, Artificial Sequence
  Synthetic oligonucleotide; CTC chr11 5203992 5204013 5204009 5204014 +
cagtctgggcgacagagcaaga

SEQ ID NO: 80200 - DNA, 22 bp, Artificial Sequence
  Synthetic oligonucleotide; CTG chr11 5203999 5204020 5204016 5204021 +
ggcgacagagcaagactctgtc

SEQ ID NO: 80201 - DNA, 22 bp, Artificial Sequence
  Synthetic oligonucleotide; CTC chr11 5204017 5204038 5204034 5204039 +
tgtcccaaaggaaaaaaaaaat

SEQ ID NO: 80202 - DNA, 22 bp, Artificial Sequence
  Synthetic oligonucleotide; CTG chr11 5204019 5204040 5204036 5204041 +
tcccaaaggaaaaaaaaaatct

SEQ ID NO: 80203 - DNA, 22 bp, Artificial Sequence
  Synthetic oligonucleotide; CTA chr11 5204042 5204063 5204059 5204064 +
ttttcatgcaggtttcttcaga

SEQ ID NO: 80204 - DNA, 22 bp, Artificial Sequence
  Synthetic oligonucleotide; TTT chr11 5204045 5204066 5204062 5204067 +
tcatgcaggtttcttcagactg

SEQ ID NO: 80205 - DNA, 22 bp, Artificial Sequence
  Synthetic oligonucleotide; TTT chr11 5204046 5204067 5204063 5204068 +
catgcaggtttcttcagactga

SEQ ID NO: 80206 - DNA, 22 bp, Artificial Sequence
  Synthetic oligonucleotide; TTC chr11 5204047 5204068 5204064 5204069 +
atgcaggtttcttcagactgac

SEQ ID NO: 80207 - DNA, 22 bp, Artificial Sequence
  Synthetic oligonucleotide; TTT chr11 5204057 5204078 5204074 5204079 +
cttcagactgactacaaaggct

SEQ ID NO: 80208 - DNA, 22 bp, Artificial Sequence
  Synthetic oligonucleotide; TTC chr11 5204058 5204079 5204075 5204080 +
ttcagactgactacaaaggctt

SEQ ID NO: 80209 - DNA, 22 bp, Artificial Sequence
  Synthetic oligonucleotide; CTT chr11 5204060 5204081 5204077 5204082 +
cagactgactacaaaggcttca

SEQ ID NO: 80210 - DNA, 22 bp, Artificial Sequence
  Synthetic oligonucleotide; TTC chr11 5204061 5204082 5204078 5204083 +
agactgactacaaaggcttcag

SEQ ID NO: 80211 - DNA, 22 bp, Artificial Sequence
  Synthetic oligonucleotide; CTG chr11 5204067 5204088 5204084 5204089 +
actacaaaggcttcagactagc

SEQ ID NO: 80212 - DNA, 22 bp, Artificial Sequence
  Synthetic oligonucleotide; CTA chr11 5204071 5204092 5204088 5204093 +
caaaggcttcagactagctaca

SEQ ID NO: 80213 - DNA, 22 bp, Artificial Sequence
  Synthetic oligonucleotide; CTT chr11 5204080 5204101 5204097 5204102 +
cagactagctacaaagcttaaa

SEQ ID NO: 80214 - DNA, 22 bp, Artificial Sequence
  Synthetic oligonucleotide; TTC chr11 5204081 5204102 5204098 5204103 +
agactagctacaaagcttaaaa

SEQ ID NO: 80215 - DNA, 22 bp, Artificial Sequence
  Synthetic oligonucleotide; CTA chr11 5204087 5204108 5204104 5204109 +
gctacaaagcttaaaaatctac

SEQ ID NO: 80216 - DNA, 22 bp, Artificial Sequence
  Synthetic oligonucleotide; CTA chr11 5204091 5204112 5204108 5204113 +
caaagcttaaaaatctactttc

SEQ ID NO: 80217 - DNA, 22 bp, Artificial Sequence
  Synthetic oligonucleotide; CTT chr11 5204099 5204120 5204116 5204121 +
aaaaatctactttcattcaggc

SEQ ID NO: 80218 - DNA, 22 bp, Artificial Sequence
  Synthetic oligonucleotide; TTA chr11 5204100 5204121 5204117 5204122 +
aaaatctactttcattcaggct

SEQ ID NO: 80219 - DNA, 22 bp, Artificial Sequence
  Synthetic oligonucleotide; CTA chr11 5204108 5204129 5204125 5204130 +
ctttcattcaggcttcttcaga

SEQ ID NO: 80220 - DNA, 22 bp, Artificial Sequence
  Synthetic oligonucleotide; CTT chr11 5204111 5204132 5204128 5204133 +
tcattcaggcttcttcagacta

SEQ ID NO: 80221 - DNA, 22 bp, Artificial Sequence
  Synthetic oligonucleotide; TTT chr11 5204112 5204133 5204129 5204134 +
cattcaggcttcttcagactag

SEQ ID NO: 80222 - DNA, 22 bp, Artificial Sequence
  Synthetic oligonucleotide; TTC chr11 5204113 5204134 5204130 5204135 +
attcaggcttcttcagactaga

SEQ ID NO: 80223 - DNA, 22 bp, Artificial Sequence
  Synthetic oligonucleotide; TTC chr11 5204117 5204138 5204134 5204139 +
aggcttcttcagactagataca

SEQ ID NO: 80224 - DNA, 22 bp, Artificial Sequence
  Synthetic oligonucleotide; CTT chr11 5204123 5204144 5204140 5204145 +
cttcagactagatacagaagaa

SEQ ID NO: 80225 - DNA, 22 bp, Artificial Sequence
  Synthetic oligonucleotide; TTC chr11 5204124 5204145 5204141 5204146 +
ttcagactagatacagaagaaa

SEQ ID NO: 80226 - DNA, 22 bp, Artificial Sequence
  Synthetic oligonucleotide; CTT chr11 5204126 5204147 5204143 5204148 +
cagactagatacagaagaaatg

SEQ ID NO: 80227 - DNA, 22 bp, Artificial Sequence
  Synthetic oligonucleotide; TTC chr11 5204127 5204148 5204144 5204149 +
agactagatacagaagaaatga

SEQ ID NO: 80228 - DNA, 22 bp, Artificial Sequence
  Synthetic oligonucleotide; CTA chr11 5204133 5204154 5204150 5204155 +
gatacagaagaaatgagaccat

SEQ ID NO: 80229 - DNA, 22 bp, Artificial Sequence
  Synthetic oligonucleotide; CTA chr11 5204158 5204179 5204175 5204180 +
gatggggaacagtattatccat

SEQ ID NO: 80230 - DNA, 22 bp, Artificial Sequence
  Synthetic oligonucleotide; TTA chr11 5204175 5204196 5204192 5204197 +
tccatgttgccaccatagagac

SEQ ID NO: 80231 - DNA, 22 bp, Artificial Sequence
  Synthetic oligonucleotide; TTG chr11 5204184 5204205 5204201 5204206 +
ccaccatagagactatcagcct

SEQ ID NO: 80232 - DNA, 22 bp, Artificial Sequence
  Synthetic oligonucleotide; CTA chr11 5204199 5204220 5204216 5204221 +
tcagccttttgggattaccaga

SEQ ID NO: 80233 - DNA, 22 bp, Artificial Sequence
  Synthetic oligonucleotide; CTT chr11 5204207 5204228 5204224 5204229 +
ttgggattaccagagcaaaata

SEQ ID NO: 80234 - DNA, 22 bp, Artificial Sequence
  Synthetic oligonucleotide; TTT chr11 5204208 5204229 5204225 5204230 +
tgggattaccagagcaaaatac

SEQ ID NO: 80235 - DNA, 22 bp, Artificial Sequence
  Synthetic oligonucleotide; TTT chr11 5204209 5204230 5204226 5204231 +
gggattaccagagcaaaataca

SEQ ID NO: 80236 - DNA, 22 bp, Artificial Sequence
  Synthetic oligonucleotide; TTG chr11 5204210 5204231 5204227 5204232 +
ggattaccagagcaaaatacat

SEQ ID NO: 80237 - DNA, 22 bp, Artificial Sequence
  Synthetic oligonucleotide; TTA chr11 5204216 5204237 5204233 5204238 +
ccagagcaaaatacatgttgga

SEQ ID NO: 80238 - DNA, 22 bp, Artificial Sequence
  Synthetic oligonucleotide; TTG chr11 5204236 5204257 5204253 5204258 +
gaggattttttaaaatatgttt

SEQ ID NO: 80239 - DNA, 22 bp, Artificial Sequence
  Synthetic oligonucleotide; TTT chr11 5204244 5204265 5204261 5204266 +
tttaaaatatgttttgaaaggt

SEQ ID NO: 80240 - DNA, 22 bp, Artificial Sequence
  Synthetic oligonucleotide; TTT chr11 5204245 5204266 5204262 5204267 +
ttaaaatatgttttgaaaggta

SEQ ID NO: 80241 - DNA, 22 bp, Artificial Sequence
  Synthetic oligonucleotide; TTT chr11 5204246 5204267 5204263 5204268 +
taaaatatgttttgaaaggtag

SEQ ID NO: 80242 - DNA, 22 bp, Artificial Sequence
  Synthetic oligonucleotide; TTT chr11 5204247 5204268 5204264 5204269 +
aaaatatgttttgaaaggtagg

SEQ ID NO: 80243 - DNA, 22 bp, Artificial Sequence
  Synthetic oligonucleotide; TTA chr11 5204248 5204269 5204265 5204270 +
aaatatgttttgaaaggtagga

SEQ ID NO: 80244 - DNA, 22 bp, Artificial Sequence
  Synthetic oligonucleotide; TTT chr11 5204258 5204279 5204275 5204280 +
tgaaaggtaggatgaaagagca

SEQ ID NO: 80245 - DNA, 22 bp, Artificial Sequence
  Synthetic oligonucleotide; TTT chr11 5204259 5204280 5204276 5204281 +
gaaaggtaggatgaaagagcat

SEQ ID NO: 80246 - DNA, 22 bp, Artificial Sequence
  Synthetic oligonucleotide; TTG chr11 5204260 5204281 5204277 5204282 +
aaaggtaggatgaaagagcata

SEQ ID NO: 80247 - DNA, 22 bp, Artificial Sequence
  Synthetic oligonucleotide; TTT chr11 5204286 5204307 5204303 5204308 +
tgataaggtaaataaatgaaga

SEQ ID NO: 80248 - DNA, 22 bp, Artificial Sequence
  Synthetic oligonucleotide; TTT chr11 5204287 5204308 5204304 5204309 +
gataaggtaaataaatgaagat

SEQ ID NO: 80249 - DNA, 22 bp, Artificial Sequence
  Synthetic oligonucleotide; TTG chr11 5204288 5204309 5204305 5204310 +
ataaggtaaataaatgaagatt

SEQ ID NO: 80250 - DNA, 22 bp, Artificial Sequence
  Synthetic oligonucleotide; TTT chr11 5204311 5204332 5204328 5204333 +
aaagaaaaacaagatcaatatg

SEQ ID NO: 80251 - DNA, 22 bp, Artificial Sequence
  Synthetic oligonucleotide; TTA chr11 5204312 5204333 5204329 5204334 +
aagaaaaacaagatcaatatgt

SEQ ID NO: 80252 - DNA, 22 bp, Artificial Sequence
  Synthetic oligonucleotide; CTC chr11 5204352 5204373 5204369 5204374 +
cacctgtatttaaaaaacaaaa

SEQ ID NO: 80253 - DNA, 22 bp, Artificial Sequence
  Synthetic oligonucleotide; CTG chr11 5204358 5204379 5204375 5204380 +
tatttaaaaaacaaaaagattt

SEQ ID NO: 80254 - DNA, 22 bp, Artificial Sequence
  Synthetic oligonucleotide; TTT chr11 5204363 5204384 5204380 5204385 +
aaaaaacaaaaagatttacagt

SEQ ID NO: 80255 - DNA, 22 bp, Artificial Sequence
  Synthetic oligonucleotide; TTA chr11 5204364 5204385 5204381 5204386 +
aaaaacaaaaagatttacagtt

SEQ ID NO: 80256 - DNA, 22 bp, Artificial Sequence
  Synthetic oligonucleotide; TTT chr11 5204380 5204401 5204397 5204402 +
acagttttccaagacatcatgt

SEQ ID NO: 80257 - DNA, 22 bp, Artificial Sequence
  Synthetic oligonucleotide; TTA chr11 5204381 5204402 5204398 5204403 +
cagttttccaagacatcatgtt

SEQ ID NO: 80258 - DNA, 22 bp, Artificial Sequence
  Synthetic oligonucleotide; TTT chr11 5204387 5204408 5204404 5204409 +
tccaagacatcatgttgtgtta

SEQ ID NO: 80259 - DNA, 22 bp, Artificial Sequence
  Synthetic oligonucleotide; TTT chr11 5204388 5204409 5204405 5204410 +
ccaagacatcatgttgtgttat

SEQ ID NO: 80260 - DNA, 22 bp, Artificial Sequence
  Synthetic oligonucleotide; TTC chr11 5204389 5204410 5204406 5204411 +
caagacatcatgttgtgttatg

SEQ ID NO: 80261 - DNA, 22 bp, Artificial Sequence
  Synthetic oligonucleotide; TTG chr11 5204404 5204425 5204421 5204426 +
tgttatgctatctgagagtcag

SEQ ID NO: 80262 - DNA, 22 bp, Artificial Sequence
  Synthetic oligonucleotide; TTA chr11 5204409 5204430 5204426 5204431 +
tgctatctgagagtcagtgtat

SEQ ID NO: 80263 - DNA, 22 bp, Artificial Sequence
  Synthetic oligonucleotide; CTA chr11 5204414 5204435 5204431 5204436 +
tctgagagtcagtgtatggtat

SEQ ID NO: 80264 - DNA, 22 bp, Artificial Sequence
  Synthetic oligonucleotide; CTG chr11 5204418 5204439 5204435 5204440 +
agagtcagtgtatggtatctca

SEQ ID NO: 80265 - DNA, 22 bp, Artificial Sequence
  Synthetic oligonucleotide; CTC chr11 5204439 5204460 5204456 5204461 +
agtctgagttcccagcaaccag

SEQ ID NO: 80266 - DNA, 22 bp, Artificial Sequence
  Synthetic oligonucleotide; CTG chr11 5204445 5204466 5204462 5204467 +
agttcccagcaaccagaacaat

SEQ ID NO: 80267 - DNA, 22 bp, Artificial Sequence
  Synthetic oligonucleotide; TTC chr11 5204450 5204471 5204467 5204472 +
ccagcaaccagaacaatgccta

SEQ ID NO: 80268 - DNA, 22 bp, Artificial Sequence
  Synthetic oligonucleotide; CTA chr11 5204472 5204493 5204489 5204494 +
taataaaataaatagagaagac

SEQ ID NO: 80269 - DNA, 22 bp, Artificial Sequence
  Synthetic oligonucleotide; TTT chr11 5204510 5204531 5204527 5204532 +
gagtctggagaaataaaagggt

SEQ ID NO: 80270 - DNA, 22 bp, Artificial Sequence
  Synthetic oligonucleotide; TTG chr11 5204511 5204532 5204528 5204533 +
agtctggagaaataaaagggtt

SEQ ID NO: 80271 - DNA, 22 bp, Artificial Sequence
  Synthetic oligonucleotide; CTG chr11 5204517 5204538 5204534 5204539 +
gagaaataaaagggttttcgta

SEQ ID NO: 80272 - DNA, 22 bp, Artificial Sequence
  Synthetic oligonucleotide; TTT chr11 5204534 5204555 5204551 5204556 +
tcgtatcccctctgagcactgt

SEQ ID NO: 80273 - DNA, 22 bp, Artificial Sequence
  Synthetic oligonucleotide; TTT chr11 5204535 5204556 5204552 5204557 +
cgtatcccctctgagcactgtc

SEQ ID NO: 80274 - DNA, 22 bp, Artificial Sequence
  Synthetic oligonucleotide; TTC chr11 5204536 5204557 5204553 5204558 +
gtatcccctctgagcactgtct

SEQ ID NO: 80275 - DNA, 22 bp, Artificial Sequence
  Synthetic oligonucleotide; CTC chr11 5204546 5204567 5204563 5204568 +
tgagcactgtctggaatgttga

SEQ ID NO: 80276 - DNA, 22 bp, Artificial Sequence
  Synthetic oligonucleotide; CTG chr11 5204548 5204569 5204565 5204570 +
agcactgtctggaatgttgact

SEQ ID NO: 80277 - DNA, 22 bp, Artificial Sequence
  Synthetic oligonucleotide; CTG chr11 5204555 5204576 5204572 5204577 +
tctggaatgttgacttggaaag

SEQ ID NO: 80278 - DNA, 22 bp, Artificial Sequence
  Synthetic oligonucleotide; CTG chr11 5204559 5204580 5204576 5204581 +
gaatgttgacttggaaagcaaa

SEQ ID NO: 80279 - DNA, 22 bp, Artificial Sequence
  Synthetic oligonucleotide; TTG chr11 5204567 5204588 5204584 5204589 +
acttggaaagcaaatctgtgat

SEQ ID NO: 80280 - DNA, 22 bp, Artificial Sequence
  Synthetic oligonucleotide; CTT chr11 5204571 5204592 5204588 5204593 +
ggaaagcaaatctgtgattata

SEQ ID NO: 80281 - DNA, 22 bp, Artificial Sequence
  Synthetic oligonucleotide; TTG chr11 5204572 5204593 5204589 5204594 +
gaaagcaaatctgtgattataa

SEQ ID NO: 80282 - DNA, 22 bp, Artificial Sequence
  Synthetic oligonucleotide; CTG chr11 5204585 5204606 5204602 5204607 +
tgattataataaccaggtcatt

SEQ ID NO: 80283 - DNA, 22 bp, Artificial Sequence
  Synthetic oligonucleotide; TTA chr11 5204591 5204612 5204608 5204613 +
taataaccaggtcattctttca

SEQ ID NO: 80284 - DNA, 22 bp, Artificial Sequence
  Synthetic oligonucleotide; TTC chr11 5204608 5204629 5204625 5204630 +
tttcaggagtcttttctgatgc

SEQ ID NO: 80285 - DNA, 22 bp, Artificial Sequence
  Synthetic oligonucleotide; CTT chr11 5204610 5204631 5204627 5204632 +
tcaggagtcttttctgatgccc

SEQ ID NO: 80286 - DNA, 22 bp, Artificial Sequence
  Synthetic oligonucleotide; TTT chr11 5204611 5204632 5204628 5204633 +
caggagtcttttctgatgccct

SEQ ID NO: 80287 - DNA, 22 bp, Artificial Sequence
  Synthetic oligonucleotide; TTC chr11 5204612 5204633 5204629 5204634 +
aggagtcttttctgatgccctc

SEQ ID NO: 80288 - DNA, 22 bp, Artificial Sequence
  Synthetic oligonucleotide; CTT chr11 5204621 5204642 5204638 5204643 +
ttctgatgccctctgattaaaa

SEQ ID NO: 80289 - DNA, 22 bp, Artificial Sequence
  Synthetic oligonucleotide; TTT chr11 5204622 5204643 5204639 5204644 +
tctgatgccctctgattaaaac

SEQ ID NO: 80290 - DNA, 22 bp, Artificial Sequence
  Synthetic oligonucleotide; TTT chr11 5204623 5204644 5204640 5204645 +
ctgatgccctctgattaaaact

SEQ ID NO: 80291 - DNA, 22 bp, Artificial Sequence
  Synthetic oligonucleotide; TTC chr11 5204624 5204645 5204641 5204646 +
tgatgccctctgattaaaactg

SEQ ID NO: 80292 - DNA, 22 bp, Artificial Sequence
  Synthetic oligonucleotide; CTG chr11 5204626 5204647 5204643 5204648 +
atgccctctgattaaaactgac

SEQ ID NO: 80293 - DNA, 22 bp, Artificial Sequence
  Synthetic oligonucleotide; CTC chr11 5204634 5204655 5204651 5204656 +
tgattaaaactgacctacatat

SEQ ID NO: 80294 - DNA, 22 bp, Artificial Sequence
  Synthetic oligonucleotide; CTG chr11 5204636 5204657 5204653 5204658 +
attaaaactgacctacatatgc

SEQ ID NO: 80295 - DNA, 22 bp, Artificial Sequence
  Synthetic oligonucleotide; TTA chr11 5204640 5204661 5204657 5204662 +
aaactgacctacatatgcagaa

SEQ ID NO: 80296 - DNA, 22 bp, Artificial Sequence
  Synthetic oligonucleotide; CTG chr11 5204646 5204667 5204663 5204668 +
acctacatatgcagaaatctct

SEQ ID NO: 80297 - DNA, 22 bp, Artificial Sequence
  Synthetic oligonucleotide; CTA chr11 5204651 5204672 5204668 5204673 +
catatgcagaaatctcttggtt

SEQ ID NO: 80298 - DNA, 22 bp, Artificial Sequence
  Synthetic oligonucleotide; CTC chr11 5204667 5204688 5204684 5204689 +
ttggttttttttttttttctgt

SEQ ID NO: 80299 - DNA, 22 bp, Artificial Sequence
  Synthetic oligonucleotide; CTT chr11 5204669 5204690 5204686 5204691 +
ggttttttttttttttctgtct

SEQ ID NO: 80300 - DNA, 22 bp, Artificial Sequence
  Synthetic oligonucleotide; TTG chr11 5204670 5204691 5204687 5204692 +
gttttttttttttttctgtctt

SEQ ID NO: 80301 - DNA, 22 bp, Artificial Sequence
  Synthetic oligonucleotide; TTT chr11 5204674 5204695 5204691 5204696 +
tttttttttttctgtcttttca

SEQ ID NO: 80302 - DNA, 22 bp, Artificial Sequence
  Synthetic oligonucleotide; TTT chr11 5204675 5204696 5204692 5204697 +
ttttttttttctgtcttttcag

SEQ ID NO: 80303 - DNA, 22 bp, Artificial Sequence
  Synthetic oligonucleotide; TTT chr11 5204676 5204697 5204693 5204698 +
tttttttttctgtcttttcaga

SEQ ID NO: 80304 - DNA, 22 bp, Artificial Sequence
  Synthetic oligonucleotide; TTT chr11 5204677 5204698 5204694 5204699 +
ttttttttctgtcttttcagaa

SEQ ID NO: 80305 - DNA, 22 bp, Artificial Sequence
  Synthetic oligonucleotide; TTT chr11 5204678 5204699 5204695 5204700 +
tttttttctgtcttttcagaat

SEQ ID NO: 80306 - DNA, 22 bp, Artificial Sequence
  Synthetic oligonucleotide; TTT chr11 5204679 5204700 5204696 5204701 +
ttttttctgtcttttcagaata

SEQ ID NO: 80307 - DNA, 22 bp, Artificial Sequence
  Synthetic oligonucleotide; TTT chr11 5204680 5204701 5204697 5204702 +
tttttctgtcttttcagaataa

SEQ ID NO: 80308 - DNA, 22 bp, Artificial Sequence
  Synthetic oligonucleotide; TTT chr11 5204681 5204702 5204698 5204703 +
ttttctgtcttttcagaataat

SEQ ID NO: 80309 - DNA, 22 bp, Artificial Sequence
  Synthetic oligonucleotide; TTT chr11 5204682 5204703 5204699 5204704 +
tttctgtcttttcagaataatt

SEQ ID NO: 80310 - DNA, 22 bp, Artificial Sequence
  Synthetic oligonucleotide; TTT chr11 5204683 5204704 5204700 5204705 +
ttctgtcttttcagaataattc

SEQ ID NO: 80311 - DNA, 22 bp, Artificial Sequence
  Synthetic oligonucleotide; TTT chr11 5204684 5204705 5204701 5204706 +
tctgtcttttcagaataattcc

SEQ ID NO: 80312 - DNA, 22 bp, Artificial Sequence
  Synthetic oligonucleotide; TTT chr11 5204685 5204706 5204702 5204707 +
ctgtcttttcagaataattccc

SEQ ID NO: 80313 - DNA, 22 bp, Artificial Sequence
  Synthetic oligonucleotide; TTC chr11 5204686 5204707 5204703 5204708 +
tgtcttttcagaataattccct

SEQ ID NO: 80314 - DNA, 22 bp, Artificial Sequence
  Synthetic oligonucleotide; CTG chr11 5204688 5204709 5204705 5204710 +
tcttttcagaataattccctgt

SEQ ID NO: 80315 - DNA, 22 bp, Artificial Sequence
  Synthetic oligonucleotide; CTT chr11 5204692 5204713 5204709 5204714 +
ttcagaataattccctgtgtga

SEQ ID NO: 80316 - DNA, 22 bp, Artificial Sequence
  Synthetic oligonucleotide; TTT chr11 5204693 5204714 5204710 5204715 +
tcagaataattccctgtgtgat

SEQ ID NO: 80317 - DNA, 22 bp, Artificial Sequence
  Synthetic oligonucleotide; TTT chr11 5204694 5204715 5204711 5204716 +
cagaataattccctgtgtgatt

SEQ ID NO: 80318 - DNA, 22 bp, Artificial Sequence
  Synthetic oligonucleotide; TTC chr11 5204695 5204716 5204712 5204717 +
agaataattccctgtgtgatta

SEQ ID NO: 80319 - DNA, 22 bp, Artificial Sequence
  Synthetic oligonucleotide; TTC chr11 5204705 5204726 5204722 5204727 +
cctgtgtgattacttgcttact

SEQ ID NO: 80320 - DNA, 22 bp, Artificial Sequence
  Synthetic oligonucleotide; CTG chr11 5204709 5204730 5204726 5204731 +
tgtgattacttgcttactttaa

SEQ ID NO: 80321 - DNA, 22 bp, Artificial Sequence
  Synthetic oligonucleotide; TTA chr11 5204717 5204738 5204734 5204739 +
cttgcttactttaaaatagggt

SEQ ID NO: 80322 - DNA, 22 bp, Artificial Sequence
  Synthetic oligonucleotide; CTT chr11 5204720 5204741 5204737 5204742 +
gcttactttaaaatagggtaat

SEQ ID NO: 80323 - DNA, 22 bp, Artificial Sequence
  Synthetic oligonucleotide; TTG chr11 5204721 5204742 5204738 5204743 +
cttactttaaaatagggtaatg

SEQ ID NO: 80324 - DNA, 22 bp, Artificial Sequence
  Synthetic oligonucleotide; CTT chr11 5204724 5204745 5204741 5204746 +
actttaaaatagggtaatgacc

SEQ ID NO: 80325 - DNA, 22 bp, Artificial Sequence
  Synthetic oligonucleotide; TTA chr11 5204725 5204746 5204742 5204747 +
ctttaaaatagggtaatgacca

SEQ ID NO: 80326 - DNA, 22 bp, Artificial Sequence
  Synthetic oligonucleotide; CTT chr11 5204728 5204749 5204745 5204750 +
taaaatagggtaatgaccaata

SEQ ID NO: 80327 - DNA, 22 bp, Artificial Sequence
  Synthetic oligonucleotide; TTT chr11 5204729 5204750 5204746 5204751 +
aaaatagggtaatgaccaatag

SEQ ID NO: 80328 - DNA, 22 bp, Artificial Sequence
  Synthetic oligonucleotide; TTA chr11 5204730 5204751 5204747 5204752 +
aaatagggtaatgaccaatagt

SEQ ID NO: 80329 - DNA, 22 bp, Artificial Sequence
  Synthetic oligonucleotide; TTG chr11 5204757 5204778 5204774 5204779 +
ttccaaagacatagagaaagta

SEQ ID NO: 80330 - DNA, 22 bp, Artificial Sequence
  Synthetic oligonucleotide; TTC chr11 5204760 5204781 5204777 5204782 +
caaagacatagagaaagtatat

SEQ ID NO: 80331 - DNA, 22 bp, Artificial Sequence
  Synthetic oligonucleotide; TTG chr11 5204784 5204805 5204801 5204806 +
tgtttaaaagacagcttcttta

SEQ ID NO: 80332 - DNA, 22 bp, Artificial Sequence
  Synthetic oligonucleotide; TTT chr11 5204789 5204810 5204806 5204811 +
aaaagacagcttctttataatt

SEQ ID NO: 80333 - DNA, 22 bp, Artificial Sequence
  Synthetic oligonucleotide; TTA chr11 5204790 5204811 5204807 5204812 +
aaagacagcttctttataattc

SEQ ID NO: 80334 - DNA, 22 bp, Artificial Sequence
  Synthetic oligonucleotide; CTT chr11 5204801 5204822 5204818 5204823 +
ctttataattctatagaactaa

SEQ ID NO: 80335 - DNA, 22 bp, Artificial Sequence
  Synthetic oligonucleotide; TTC chr11 5204802 5204823 5204819 5204824 +
tttataattctatagaactaaa

SEQ ID NO: 80336 - DNA, 22 bp, Artificial Sequence
  Synthetic oligonucleotide; CTT chr11 5204804 5204825 5204821 5204826 +
tataattctatagaactaaaac

SEQ ID NO: 80337 - DNA, 22 bp, Artificial Sequence
  Synthetic oligonucleotide; TTT chr11 5204805 5204826 5204822 5204827 +
ataattctatagaactaaaaca

SEQ ID NO: 80338 - DNA, 22 bp, Artificial Sequence
  Synthetic oligonucleotide; TTA chr11 5204806 5204827 5204823 5204828 +
taattctatagaactaaaacat

SEQ ID NO: 80339 - DNA, 22 bp, Artificial Sequence
  Synthetic oligonucleotide; TTC chr11 5204812 5204833 5204829 5204834 +
tatagaactaaaacattcctat

SEQ ID NO: 80340 - DNA, 22 bp, Artificial Sequence
  Synthetic oligonucleotide; CTA chr11 5204814 5204835 5204831 5204836 +
tagaactaaaacattcctattt

SEQ ID NO: 80341 - DNA, 22 bp, Artificial Sequence
  Synthetic oligonucleotide; CTA chr11 5204822 5204843 5204839 5204844 +
aaacattcctatttgccaaggc

SEQ ID NO: 80342 - DNA, 22 bp, Artificial Sequence
  Synthetic oligonucleotide; TTC chr11 5204830 5204851 5204847 5204852 +
ctatttgccaaggcagtggagt

SEQ ID NO: 80343 - DNA, 22 bp, Artificial Sequence
  Synthetic oligonucleotide; CTA chr11 5204833 5204854 5204850 5204855 +
tttgccaaggcagtggagtttt

SEQ ID NO: 80344 - DNA, 22 bp, Artificial Sequence
  Synthetic oligonucleotide; TTT chr11 5204836 5204857 5204853 5204858 +
gccaaggcagtggagtttttgc

SEQ ID NO: 80345 - DNA, 22 bp, Artificial Sequence
  Synthetic oligonucleotide; TTG chr11 5204837 5204858 5204854 5204859 +
ccaaggcagtggagtttttgct

SEQ ID NO: 80346 - DNA, 22 bp, Artificial Sequence
  Synthetic oligonucleotide; TTT chr11 5204854 5204875 5204871 5204876 +
ttgctgttcttagaacataatt

SEQ ID NO: 80347 - DNA, 22 bp, Artificial Sequence
  Synthetic oligonucleotide; TTT chr11 5204855 5204876 5204872 5204877 +
tgctgttcttagaacataatta

SEQ ID NO: 80348 - DNA, 22 bp, Artificial Sequence
  Synthetic oligonucleotide; TTT chr11 5204856 5204877 5204873 5204878 +
gctgttcttagaacataattac

SEQ ID NO: 80349 - DNA, 22 bp, Artificial Sequence
  Synthetic oligonucleotide; TTG chr11 5204857 5204878 5204874 5204879 +
ctgttcttagaacataattact

SEQ ID NO: 80350 - DNA, 22 bp, Artificial Sequence
  Synthetic oligonucleotide; CTG chr11 5204860 5204881 5204877 5204882 +
ttcttagaacataattactgaa

SEQ ID NO: 80351 - DNA, 22 bp, Artificial Sequence
  Synthetic oligonucleotide; TTC chr11 5204863 5204884 5204880 5204885 +
ttagaacataattactgaaaga

SEQ ID NO: 80352 - DNA, 22 bp, Artificial Sequence
  Synthetic oligonucleotide; CTT chr11 5204865 5204886 5204882 5204887 +
agaacataattactgaaagaca

SEQ ID NO: 80353 - DNA, 22 bp, Artificial Sequence
  Synthetic oligonucleotide; TTA chr11 5204866 5204887 5204883 5204888 +
gaacataattactgaaagacac

SEQ ID NO: 80354 - DNA, 22 bp, Artificial Sequence
  Synthetic oligonucleotide; TTA chr11 5204877 5204898 5204894 5204899 +
ctgaaagacacccacacatgtc

SEQ ID NO: 80355 - DNA, 22 bp, Artificial Sequence
  Synthetic oligonucleotide; CTG chr11 5204880 5204901 5204897 5204902 +
aaagacacccacacatgtcctg

SEQ ID NO: 80356 - DNA, 22 bp, Artificial Sequence
  Synthetic oligonucleotide; CTG chr11 5204902 5204923 5204919 5204924 +
ccttggacaaaaaattgtatgt

SEQ ID NO: 80357 - DNA, 22 bp, Artificial Sequence
  Synthetic oligonucleotide; CTT chr11 5204906 5204927 5204923 5204928 +
ggacaaaaaattgtatgtccat

SEQ ID NO: 80358 - DNA, 22 bp, Artificial Sequence
  Synthetic oligonucleotide; TTG chr11 5204907 5204928 5204924 5204929 +
gacaaaaaattgtatgtccatc

SEQ ID NO: 80359 - DNA, 22 bp, Artificial Sequence
  Synthetic oligonucleotide; TTG chr11 5204919 5204940 5204936 5204941 +
tatgtccatcctttaaaggtca

SEQ ID NO: 80360 - DNA, 22 bp, Artificial Sequence
  Synthetic oligonucleotide; CTT chr11 5204932 5204953 5204949 5204954 +
taaaggtcattcctttaatggt

SEQ ID NO: 80361 - DNA, 22 bp, Artificial Sequence
  Synthetic oligonucleotide; TTT chr11 5204933 5204954 5204950 5204955 +
aaaggtcattcctttaatggtc

SEQ ID NO: 80362 - DNA, 22 bp, Artificial Sequence
  Synthetic oligonucleotide; TTA chr11 5204934 5204955 5204951 5204956 +
aaggtcattcctttaatggtct

SEQ ID NO: 80363 - DNA, 22 bp, Artificial Sequence
  Synthetic oligonucleotide; TTC chr11 5204944 5204965 5204961 5204966 +
ctttaatggtcttttctggaca

SEQ ID NO: 80364 - DNA, 22 bp, Artificial Sequence
  Synthetic oligonucleotide; CTT chr11 5204947 5204968 5204964 5204969 +
taatggtcttttctggacacca

SEQ ID NO: 80365 - DNA, 22 bp, Artificial Sequence
  Synthetic oligonucleotide; TTT chr11 5204948 5204969 5204965 5204970 +
aatggtcttttctggacaccac

SEQ ID NO: 80366 - DNA, 22 bp, Artificial Sequence
  Synthetic oligonucleotide; TTA chr11 5204949 5204970 5204966 5204971 +
atggtcttttctggacaccact

SEQ ID NO: 80367 - DNA, 22 bp, Artificial Sequence
  Synthetic oligonucleotide; CTT chr11 5204957 5204978 5204974 5204979 +
ttctggacaccactaggggtca

SEQ ID NO: 80368 - DNA, 22 bp, Artificial Sequence
  Synthetic oligonucleotide; TTT chr11 5204958 5204979 5204975 5204980 +
tctggacaccactaggggtcag

SEQ ID NO: 80369 - DNA, 22 bp, Artificial Sequence
  Synthetic oligonucleotide; TTT chr11 5204959 5204980 5204976 5204981 +
ctggacaccactaggggtcaga

SEQ ID NO: 80370 - DNA, 22 bp, Artificial Sequence
  Synthetic oligonucleotide; TTC chr11 5204960 5204981 5204977 5204982 +
tggacaccactaggggtcagaa

SEQ ID NO: 80371 - DNA, 22 bp, Artificial Sequence
  Synthetic oligonucleotide; CTG chr11 5204962 5204983 5204979 5204984 +
gacaccactaggggtcagaagt

SEQ ID NO: 80372 - DNA, 22 bp, Artificial Sequence
  Synthetic oligonucleotide; CTA chr11 5204972 5204993 5204989 5204994 +
ggggtcagaagtagttcatcaa

SEQ ID NO: 80373 - DNA, 22 bp, Artificial Sequence
  Synthetic oligonucleotide; TTC chr11 5204989 5205010 5205006 5205011 +
atcaaactttcttccctcccta

SEQ ID NO: 80374 - DNA, 22 bp, Artificial Sequence
  Synthetic oligonucleotide; CTT chr11 5204998 5205019 5205015 5205020 +
tcttccctccctacttcagtga

SEQ ID NO: 80375 - DNA, 22 bp, Artificial Sequence
  Synthetic oligonucleotide; TTT chr11 5204999 5205020 5205016 5205021 +
cttccctccctacttcagtgat

SEQ ID NO: 80376 - DNA, 22 bp, Artificial Sequence
  Synthetic oligonucleotide; TTC chr11 5205000 5205021 5205017 5205022 +
ttccctccctacttcagtgatg

SEQ ID NO: 80377 - DNA, 22 bp, Artificial Sequence
  Synthetic oligonucleotide; CTT chr11 5205002 5205023 5205019 5205024 +
ccctccctacttcagtgatgca

SEQ ID NO: 80378 - DNA, 22 bp, Artificial Sequence
  Synthetic oligonucleotide; TTC chr11 5205003 5205024 5205020 5205025 +
cctccctacttcagtgatgcat

SEQ ID NO: 80379 - DNA, 22 bp, Artificial Sequence
  Synthetic oligonucleotide; CTC chr11 5205007 5205028 5205024 5205029 +
cctacttcagtgatgcataagg

SEQ ID NO: 80380 - DNA, 22 bp, Artificial Sequence
  Synthetic oligonucleotide; CTA chr11 5205011 5205032 5205028 5205033 +
cttcagtgatgcataaggcaga

SEQ ID NO: 80381 - DNA, 22 bp, Artificial Sequence
  Synthetic oligonucleotide; CTT chr11 5205014 5205035 5205031 5205036 +
cagtgatgcataaggcagatct

SEQ ID NO: 80382 - DNA, 22 bp, Artificial Sequence
  Synthetic oligonucleotide; TTC chr11 5205015 5205036 5205032 5205037 +
agtgatgcataaggcagatctg

SEQ ID NO: 80383 - DNA, 22 bp, Artificial Sequence
  Synthetic oligonucleotide; CTG chr11 5205037 5205058 5205054 5205059 +
ctttagtgtaagcgaggtcagg

SEQ ID NO: 80384 - DNA, 22 bp, Artificial Sequence
  Synthetic oligonucleotide; CTT chr11 5205040 5205061 5205057 5205062 +
tagtgtaagcgaggtcaggccc

SEQ ID NO: 80385 - DNA, 22 bp, Artificial Sequence
  Synthetic oligonucleotide; TTT chr11 5205041 5205062 5205058 5205063 +
agtgtaagcgaggtcaggccct

SEQ ID NO: 80386 - DNA, 22 bp, Artificial Sequence
  Synthetic oligonucleotide; TTA chr11 5205042 5205063 5205059 5205064 +
gtgtaagcgaggtcaggccctc

SEQ ID NO: 80387 - DNA, 22 bp, Artificial Sequence
  Synthetic oligonucleotide; CTC chr11 5205064 5205085 5205081 5205086 +
aagagtcttgggatggctgaag

SEQ ID NO: 80388 - DNA, 22 bp, Artificial Sequence
  Synthetic oligonucleotide; CTT chr11 5205073 5205094 5205090 5205095 +
gggatggctgaagaggtaagaa

SEQ ID NO: 80389 - DNA, 22 bp, Artificial Sequence
  Synthetic oligonucleotide; TTG chr11 5205074 5205095 5205091 5205096 +
ggatggctgaagaggtaagaac

SEQ ID NO: 80390 - DNA, 22 bp, Artificial Sequence
  Synthetic oligonucleotide; CTG chr11 5205083 5205104 5205100 5205105 +
aagaggtaagaacattctataa

SEQ ID NO: 80391 - DNA, 22 bp, Artificial Sequence
  Synthetic oligonucleotide; TTC chr11 5205100 5205121 5205117 5205122 +
tataagacttgtccaaagaact

SEQ ID NO: 80392 - DNA, 22 bp, Artificial Sequence
  Synthetic oligonucleotide; CTA chr11 5205102 5205123 5205119 5205124 +
taagacttgtccaaagaactga

SEQ ID NO: 80393 - DNA, 22 bp, Artificial Sequence
  Synthetic oligonucleotide; CTT chr11 5205110 5205131 5205127 5205132 +
gtccaaagaactgactgtttaa

SEQ ID NO: 80394 - DNA, 22 bp, Artificial Sequence
  Synthetic oligonucleotide; TTG chr11 5205111 5205132 5205128 5205133 +
tccaaagaactgactgtttaat

SEQ ID NO: 80395 - DNA, 22 bp, Artificial Sequence
  Synthetic oligonucleotide; CTG chr11 5205123 5205144 5205140 5205145 +
actgtttaatgattctgaatat

SEQ ID NO: 80396 - DNA, 22 bp, Artificial Sequence
  Synthetic oligonucleotide; CTG chr11 5205127 5205148 5205144 5205149 +
tttaatgattctgaatatgcta

SEQ ID NO: 80397 - DNA, 22 bp, Artificial Sequence
  Synthetic oligonucleotide; TTT chr11 5205130 5205151 5205147 5205152 +
aatgattctgaatatgctagtt

SEQ ID NO: 80398 - DNA, 22 bp, Artificial Sequence
  Synthetic oligonucleotide; TTA chr11 5205131 5205152 5205148 5205153 +
atgattctgaatatgctagttc

SEQ ID NO: 80399 - DNA, 22 bp, Artificial Sequence
  Synthetic oligonucleotide; TTC chr11 5205138 5205159 5205155 5205160 +
tgaatatgctagttcagagaga

SEQ ID NO: 80400 - DNA, 22 bp, Artificial Sequence
  Synthetic oligonucleotide; CTG chr11 5205140 5205161 5205157 5205162 +
aatatgctagttcagagagaat

SEQ ID NO: 80401 - DNA, 22 bp, Artificial Sequence
  Synthetic oligonucleotide; CTA chr11 5205149 5205170 5205166 5205171 +
gttcagagagaatctatttacc

SEQ ID NO: 80402 - DNA, 22 bp, Artificial Sequence
  Synthetic oligonucleotide; TTC chr11 5205153 5205174 5205170 5205175 +
agagagaatctatttaccacaa

SEQ ID NO: 80403 - DNA, 22 bp, Artificial Sequence
  Synthetic oligonucleotide; CTA chr11 5205165 5205186 5205182 5205187 +
tttaccacaaacctgaagtagg

SEQ ID NO: 80404 - DNA, 22 bp, Artificial Sequence
  Synthetic oligonucleotide; TTT chr11 5205168 5205189 5205185 5205190 +
accacaaacctgaagtaggctt

SEQ ID NO: 80405 - DNA, 22 bp, Artificial Sequence
  Synthetic oligonucleotide; TTA chr11 5205169 5205190 5205186 5205191 +
ccacaaacctgaagtaggctta

SEQ ID NO: 80406 - DNA, 22 bp, Artificial Sequence
  Synthetic oligonucleotide; CTG chr11 5205180 5205201 5205197 5205202 +
aagtaggcttaaatttccagtt

SEQ ID NO: 80407 - DNA, 22 bp, Artificial Sequence
  Synthetic oligonucleotide; CTT chr11 5205190 5205211 5205207 5205212 +
aaatttccagtttacctgaatg

SEQ ID NO: 80408 - DNA, 22 bp, Artificial Sequence
  Synthetic oligonucleotide; TTA chr11 5205191 5205212 5205208 5205213 +
aatttccagtttacctgaatgg

SEQ ID NO: 80409 - DNA, 22 bp, Artificial Sequence
  Synthetic oligonucleotide; TTT chr11 5205196 5205217 5205213 5205218 +
ccagtttacctgaatggttatg

SEQ ID NO: 80410 - DNA, 22 bp, Artificial Sequence
  Synthetic oligonucleotide; TTC chr11 5205197 5205218 5205214 5205219 +
cagtttacctgaatggttatga

SEQ ID NO: 80411 - DNA, 22 bp, Artificial Sequence
  Synthetic oligonucleotide; TTT chr11 5205203 5205224 5205220 5205225 +
acctgaatggttatgacctaat

SEQ ID NO: 80412 - DNA, 22 bp, Artificial Sequence
  Synthetic oligonucleotide; TTA chr11 5205204 5205225 5205221 5205226 +
cctgaatggttatgacctaatt

SEQ ID NO: 80413 - DNA, 22 bp, Artificial Sequence
  Synthetic oligonucleotide; CTG chr11 5205208 5205229 5205225 5205230 +
aatggttatgacctaattagag

SEQ ID NO: 80414 - DNA, 22 bp, Artificial Sequence
  Synthetic oligonucleotide; TTA chr11 5205216 5205237 5205233 5205238 +
tgacctaattagaggaatgact

SEQ ID NO: 80415 - DNA, 22 bp, Artificial Sequence
  Synthetic oligonucleotide; CTA chr11 5205223 5205244 5205240 5205245 +
attagaggaatgactttataaa

SEQ ID NO: 80416 - DNA, 22 bp, Artificial Sequence
  Synthetic oligonucleotide; TTA chr11 5205227 5205248 5205244 5205249 +
gaggaatgactttataaacata

SEQ ID NO: 80417 - DNA, 22 bp, Artificial Sequence
  Synthetic oligonucleotide; CTT chr11 5205239 5205260 5205256 5205261 +
tataaacatatatagatacaaa

SEQ ID NO: 80418 - DNA, 22 bp, Artificial Sequence
  Synthetic oligonucleotide; TTT chr11 5205240 5205261 5205257 5205262 +
ataaacatatatagatacaaat

SEQ ID NO: 80419 - DNA, 22 bp, Artificial Sequence
  Synthetic oligonucleotide; TTA chr11 5205241 5205262 5205258 5205263 +
taaacatatatagatacaaata

SEQ ID NO: 80420 - DNA, 22 bp, Artificial Sequence
  Synthetic oligonucleotide; TTT chr11 5205277 5205298 5205294 5205299 +
attatatactatatatttatta

SEQ ID NO: 80421 - DNA, 22 bp, Artificial Sequence
  Synthetic oligonucleotide; TTA chr11 5205278 5205299 5205295 5205300 +
ttatatactatatatttattat

SEQ ID NO: 80422 - DNA, 22 bp, Artificial Sequence
  Synthetic oligonucleotide; TTA chr11 5205281 5205302 5205298 5205303 +
tatactatatatttattatata

SEQ ID NO: 80423 - DNA, 22 bp, Artificial Sequence
  Synthetic oligonucleotide; CTA chr11 5205288 5205309 5205305 5205310 +
tatatttattatatattatata

SEQ ID NO: 80424 - DNA, 22 bp, Artificial Sequence
  Synthetic oligonucleotide; TTT chr11 5205295 5205316 5205312 5205317 +
attatatattatataagcataa

SEQ ID NO: 80425 - DNA, 22 bp, Artificial Sequence
  Synthetic oligonucleotide; TTA chr11 5205296 5205317 5205313 5205318 +
ttatatattatataagcataaa

SEQ ID NO: 80426 - DNA, 22 bp, Artificial Sequence
  Synthetic oligonucleotide; TTA chr11 5205299 5205320 5205316 5205321 +
tatattatataagcataaaatg

SEQ ID NO: 80427 - DNA, 22 bp, Artificial Sequence
  Synthetic oligonucleotide; TTA chr11 5205306 5205327 5205323 5205328 +
tataagcataaaatgtaataga

SEQ ID NO: 80428 - DNA, 22 bp, Artificial Sequence
  Synthetic oligonucleotide; TTA chr11 5205331 5205352 5205348 5205353 +
ttgtatatatttaataacatat

SEQ ID NO: 80429 - DNA, 22 bp, Artificial Sequence
  Synthetic oligonucleotide; TTG chr11 5205334 5205355 5205351 5205356 +
tatatatttaataacatattat

SEQ ID NO: 80430 - DNA, 22 bp, Artificial Sequence
  Synthetic oligonucleotide; TTT chr11 5205343 5205364 5205360 5205365 +
aataacatattattacatattt

SEQ ID NO: 80431 - DNA, 22 bp, Artificial Sequence
  Synthetic oligonucleotide; TTA chr11 5205344 5205365 5205361 5205366 +
ataacatattattacatatttt

SEQ ID NO: 80432 - DNA, 22 bp, Artificial Sequence
  Synthetic oligonucleotide; TTA chr11 5205355 5205376 5205372 5205377 +
ttacatattttaatatataata

SEQ ID NO: 80433 - DNA, 22 bp, Artificial Sequence
  Synthetic oligonucleotide; TTA chr11 5205358 5205379 5205375 5205380 +
catattttaatatataatatat

SEQ ID NO: 80434 - DNA, 22 bp, Artificial Sequence
  Synthetic oligonucleotide; TTT chr11 5205365 5205386 5205382 5205387 +
taatatataatatataaaatgt

SEQ ID NO: 80435 - DNA, 22 bp, Artificial Sequence
  Synthetic oligonucleotide; TTT chr11 5205366 5205387 5205383 5205388 +
aatatataatatataaaatgta

SEQ ID NO: 80436 - DNA, 22 bp, Artificial Sequence
  Synthetic oligonucleotide; TTA chr11 5205367 5205388 5205384 5205389 +
atatataatatataaaatgtat

SEQ ID NO: 80437 - DNA, 22 bp, Artificial Sequence
  Synthetic oligonucleotide; TTA chr11 5205391 5205412 5205408 5205413 +
tatttaatatataatgcatgta

SEQ ID NO: 80438 - DNA, 22 bp, Artificial Sequence
  Synthetic oligonucleotide; TTT chr11 5205396 5205417 5205413 5205418 +
aatatataatgcatgtaatata

SEQ ID NO: 80439 - DNA, 22 bp, Artificial Sequence
  Synthetic oligonucleotide; TTA chr11 5205397 5205418 5205414 5205419 +
atatataatgcatgtaatatat

SEQ ID NO: 80440 - DNA, 22 bp, Artificial Sequence
  Synthetic oligonucleotide; TTA chr11 5205431 5205452 5205448 5205453 +
tatattatatattatgtaataa

SEQ ID NO: 80441 - DNA, 22 bp, Artificial Sequence
  Synthetic oligonucleotide; TTA chr11 5205438 5205459 5205455 5205460 +
tatattatgtaataaatatata

SEQ ID NO: 80442 - DNA, 22 bp, Artificial Sequence
  Synthetic oligonucleotide; TTA chr11 5205445 5205466 5205462 5205467 +
tgtaataaatatatattatgta

SEQ ID NO: 80443 - DNA, 22 bp, Artificial Sequence
  Synthetic oligonucleotide; TTA chr11 5205463 5205484 5205480 5205485 +
tgtatatacacatttatctaga

SEQ ID NO: 80444 - DNA, 22 bp, Artificial Sequence
  Synthetic oligonucleotide; TTT chr11 5205478 5205499 5205495 5205500 +
atctagactttattacatattt

SEQ ID NO: 80445 - DNA, 22 bp, Artificial Sequence
  Synthetic oligonucleotide; TTA chr11 5205479 5205500 5205496 5205501 +
tctagactttattacatatttc

SEQ ID NO: 80446 - DNA, 22 bp, Artificial Sequence
  Synthetic oligonucleotide; CTA chr11 5205483 5205504 5205500 5205505 +
gactttattacatatttcatta

SEQ ID NO: 80447 - DNA, 22 bp, Artificial Sequence
  Synthetic oligonucleotide; CTT chr11 5205488 5205509 5205505 5205510 +
tattacatatttcattatatat

SEQ ID NO: 80448 - DNA, 22 bp, Artificial Sequence
  Synthetic oligonucleotide; TTT chr11 5205489 5205510 5205506 5205511 +
attacatatttcattatatatt

SEQ ID NO: 80449 - DNA, 22 bp, Artificial Sequence
  Synthetic oligonucleotide; TTA chr11 5205490 5205511 5205507 5205512 +
ttacatatttcattatatattt

SEQ ID NO: 80450 - DNA, 22 bp, Artificial Sequence
  Synthetic oligonucleotide; TTA chr11 5205493 5205514 5205510 5205515 +
catatttcattatatattttat

SEQ ID NO: 80451 - DNA, 22 bp, Artificial Sequence
  Synthetic oligonucleotide; TTT chr11 5205500 5205521 5205517 5205522 +
cattatatattttataagattt

SEQ ID NO: 80452 - DNA, 22 bp, Artificial Sequence
  Synthetic oligonucleotide; TTC chr11 5205501 5205522 5205518 5205523 +
attatatattttataagatttc

SEQ ID NO: 80453 - DNA, 22 bp, Artificial Sequence
  Synthetic oligonucleotide; TTA chr11 5205505 5205526 5205522 5205527 +
tatattttataagatttctata

SEQ ID NO: 80454 - DNA, 22 bp, Artificial Sequence
  Synthetic oligonucleotide; TTT chr11 5205512 5205533 5205529 5205534 +
tataagatttctataaataata

SEQ ID NO: 80455 - DNA, 22 bp, Artificial Sequence
  Synthetic oligonucleotide; TTT chr11 5205513 5205534 5205530 5205535 +
ataagatttctataaataatat

SEQ ID NO: 80456 - DNA, 22 bp, Artificial Sequence
  Synthetic oligonucleotide; TTA chr11 5205514 5205535 5205531 5205536 +
taagatttctataaataatatt

SEQ ID NO: 80457 - DNA, 22 bp, Artificial Sequence
  Synthetic oligonucleotide; TTT chr11 5205522 5205543 5205539 5205544 +
ctataaataatattcccatcat

SEQ ID NO: 80458 - DNA, 22 bp, Artificial Sequence
  Synthetic oligonucleotide; TTC chr11 5205523 5205544 5205540 5205545 +
tataaataatattcccatcatt

SEQ ID NO: 80459 - DNA, 22 bp, Artificial Sequence
  Synthetic oligonucleotide; CTA chr11 5205525 5205546 5205542 5205547 +
taaataatattcccatcattac

SEQ ID NO: 80460 - DNA, 22 bp, Artificial Sequence
  Synthetic oligonucleotide; TTC chr11 5205537 5205558 5205554 5205559 +
ccatcattactaaaatattttt

SEQ ID NO: 80461 - DNA, 22 bp, Artificial Sequence
  Synthetic oligonucleotide; TTA chr11 5205546 5205567 5205563 5205568 +
ctaaaatattttttaaaaatta

SEQ ID NO: 80462 - DNA, 22 bp, Artificial Sequence
  Synthetic oligonucleotide; CTA chr11 5205549 5205570 5205566 5205571 +
aaatattttttaaaaattagcc

SEQ ID NO: 80463 - DNA, 22 bp, Artificial Sequence
  Synthetic oligonucleotide; TTT chr11 5205557 5205578 5205574 5205579 +
tttaaaaattagccatacctta

SEQ ID NO: 80464 - DNA, 22 bp, Artificial Sequence
  Synthetic oligonucleotide; TTT chr11 5205558 5205579 5205575 5205580 +
ttaaaaattagccataccttag

SEQ ID NO: 80465 - DNA, 22 bp, Artificial Sequence
  Synthetic oligonucleotide; TTT chr11 5205559 5205580 5205576 5205581 +
taaaaattagccataccttaga

SEQ ID NO: 80466 - DNA, 22 bp, Artificial Sequence
  Synthetic oligonucleotide; TTT chr11 5205560 5205581 5205577 5205582 +
aaaaattagccataccttagaa

SEQ ID NO: 80467 - DNA, 22 bp, Artificial Sequence
  Synthetic oligonucleotide; TTA chr11 5205561 5205582 5205578 5205583 +
aaaattagccataccttagaag

SEQ ID NO: 80468 - DNA, 22 bp, Artificial Sequence
  Synthetic oligonucleotide; TTA chr11 5205568 5205589 5205585 5205590 +
gccataccttagaagcattata

SEQ ID NO: 80469 - DNA, 22 bp, Artificial Sequence
  Synthetic oligonucleotide; CTT chr11 5205578 5205599 5205595 5205600 +
agaagcattataaaaaatatat

SEQ ID NO: 80470 - DNA, 22 bp, Artificial Sequence
  Synthetic oligonucleotide; TTA chr11 5205579 5205600 5205596 5205601 +
gaagcattataaaaaatatatg

SEQ ID NO: 80471 - DNA, 22 bp, Artificial Sequence
  Synthetic oligonucleotide; TTA chr11 5205588 5205609 5205605 5205610 +
taaaaaatatatgacatggtcc

SEQ ID NO: 80472 - DNA, 22 bp, Artificial Sequence
  Synthetic oligonucleotide; CTG chr11 5205615 5205636 5205632 5205637 +
ttcaactgtagccatctaacca

SEQ ID NO: 80473 - DNA, 22 bp, Artificial Sequence
  Synthetic oligonucleotide; TTC chr11 5205618 5205639 5205635 5205640 +
aactgtagccatctaaccattt

SEQ ID NO: 80474 - DNA, 22 bp, Artificial Sequence
  Synthetic oligonucleotide; CTG chr11 5205623 5205644 5205640 5205645 +
tagccatctaaccatttgagaa

SEQ ID NO: 80475 - DNA, 22 bp, Artificial Sequence
  Synthetic oligonucleotide; CTA chr11 5205633 5205654 5205650 5205655 +
accatttgagaagtttttataa

SEQ ID NO: 80476 - DNA, 22 bp, Artificial Sequence
  Synthetic oligonucleotide; TTT chr11 5205640 5205661 5205657 5205662 +
gagaagtttttataagatttat

SEQ ID NO: 80477 - DNA, 22 bp, Artificial Sequence
  Synthetic oligonucleotide; TTG chr11 5205641 5205662 5205658 5205663 +
agaagtttttataagatttata

SEQ ID NO: 80478 - DNA, 22 bp, Artificial Sequence
  Synthetic oligonucleotide; TTT chr11 5205649 5205670 5205666 5205671 +
ttataagatttatagcatttga

SEQ ID NO: 80479 - DNA, 22 bp, Artificial Sequence
  Synthetic oligonucleotide; TTT chr11 5205650 5205671 5205667 5205672 +
tataagatttatagcatttgat

SEQ ID NO: 80480 - DNA, 22 bp, Artificial Sequence
  Synthetic oligonucleotide; TTT chr11 5205651 5205672 5205668 5205673 +
ataagatttatagcatttgatt

SEQ ID NO: 80481 - DNA, 22 bp, Artificial Sequence
  Synthetic oligonucleotide; TTA chr11 5205652 5205673 5205669 5205674 +
taagatttatagcatttgattg

SEQ ID NO: 80482 - DNA, 22 bp, Artificial Sequence
  Synthetic oligonucleotide; TTT chr11 5205660 5205681 5205677 5205682 +
atagcatttgattgtaccatga

SEQ ID NO: 80483 - DNA, 22 bp, Artificial Sequence
  Synthetic oligonucleotide; TTA chr11 5205661 5205682 5205678 5205683 +
tagcatttgattgtaccatgac

SEQ ID NO: 80484 - DNA, 22 bp, Artificial Sequence
  Synthetic oligonucleotide; TTT chr11 5205669 5205690 5205686 5205691 +
gattgtaccatgacataaatca

SEQ ID NO: 80485 - DNA, 22 bp, Artificial Sequence
  Synthetic oligonucleotide; TTG chr11 5205670 5205691 5205687 5205692 +
attgtaccatgacataaatcat

SEQ ID NO: 80486 - DNA, 22 bp, Artificial Sequence
  Synthetic oligonucleotide; TTG chr11 5205674 5205695 5205691 5205696 +
taccatgacataaatcatctca

SEQ ID NO: 80487 - DNA, 22 bp, Artificial Sequence
  Synthetic oligonucleotide; CTC chr11 5205695 5205716 5205712 5205717 +
atgcaagatagtgtatttgttt

SEQ ID NO: 80488 - DNA, 22 bp, Artificial Sequence
  Synthetic oligonucleotide; TTT chr11 5205713 5205734 5205730 5205735 +
gttttgttggctttaatatgtt

SEQ ID NO: 80489 - DNA, 22 bp, Artificial Sequence
  Synthetic oligonucleotide; TTG chr11 5205714 5205735 5205731 5205736 +
ttttgttggctttaatatgttc

SEQ ID NO: 80490 - DNA, 22 bp, Artificial Sequence
  Synthetic oligonucleotide; TTT chr11 5205717 5205738 5205734 5205739 +
tgttggctttaatatgttccct

SEQ ID NO: 80491 - DNA, 22 bp, Artificial Sequence
  Synthetic oligonucleotide; TTT chr11 5205718 5205739 5205735 5205740 +
gttggctttaatatgttccctt

SEQ ID NO: 80492 - DNA, 22 bp, Artificial Sequence
  Synthetic oligonucleotide; TTG chr11 5205719 5205740 5205736 5205741 +
ttggctttaatatgttcccttt

SEQ ID NO: 80493 - DNA, 22 bp, Artificial Sequence
  Synthetic oligonucleotide; TTG chr11 5205722 5205743 5205739 5205744 +
gctttaatatgttcccttttct

SEQ ID NO: 80494 - DNA, 22 bp, Artificial Sequence
  Synthetic oligonucleotide; CTT chr11 5205726 5205747 5205743 5205748 +
taatatgttcccttttcttcag

SEQ ID NO: 80495 - DNA, 22 bp, Artificial Sequence
  Synthetic oligonucleotide; TTT chr11 5205727 5205748 5205744 5205749 +
aatatgttcccttttcttcaga

SEQ ID NO: 80496 - DNA, 22 bp, Artificial Sequence
  Synthetic oligonucleotide; TTA chr11 5205728 5205749 5205745 5205750 +
atatgttcccttttcttcagaa

SEQ ID NO: 80497 - DNA, 22 bp, Artificial Sequence
  Synthetic oligonucleotide; TTC chr11 5205736 5205757 5205753 5205758 +
ccttttcttcagaaaatgtgag

SEQ ID NO: 80498 - DNA, 22 bp, Artificial Sequence
  Synthetic oligonucleotide; CTT chr11 5205740 5205761 5205757 5205762 +
ttcttcagaaaatgtgagacag

SEQ ID NO: 80499 - DNA, 22 bp, Artificial Sequence
  Synthetic oligonucleotide; TTT chr11 5205741 5205762 5205758 5205763 +
tcttcagaaaatgtgagacagc

SEQ ID NO: 80500 - DNA, 22 bp, Artificial Sequence
  Synthetic oligonucleotide; TTT chr11 5205742 5205763 5205759 5205764 +
cttcagaaaatgtgagacagct

SEQ ID NO: 80501 - DNA, 22 bp, Artificial Sequence
  Synthetic oligonucleotide; TTC chr11 5205743 5205764 5205760 5205765 +
ttcagaaaatgtgagacagctt

SEQ ID NO: 80502 - DNA, 22 bp, Artificial Sequence
  Synthetic oligonucleotide; CTT chr11 5205745 5205766 5205762 5205767 +
cagaaaatgtgagacagcttaa

SEQ ID NO: 80503 - DNA, 22 bp, Artificial Sequence
  Synthetic oligonucleotide; TTC chr11 5205746 5205767 5205763 5205768 +
agaaaatgtgagacagcttaaa

SEQ ID NO: 80504 - DNA, 22 bp, Artificial Sequence
  Synthetic oligonucleotide; CTT chr11 5205765 5205786 5205782 5205787 +
aaaataaaattaactataagaa

SEQ ID NO: 80505 - DNA, 22 bp, Artificial Sequence
  Synthetic oligonucleotide; TTA chr11 5205766 5205787 5205783 5205788 +
aaataaaattaactataagaaa

SEQ ID NO: 80506 - DNA, 22 bp, Artificial Sequence
  Synthetic oligonucleotide; TTA chr11 5205777 5205798 5205794 5205799 +
actataagaaactggtaaacac

SEQ ID NO: 80507 - DNA, 22 bp, Artificial Sequence
  Synthetic oligonucleotide; CTA chr11 5205781 5205802 5205798 5205803 +
taagaaactggtaaacactgaa

SEQ ID NO: 80508 - DNA, 22 bp, Artificial Sequence
  Synthetic oligonucleotide; CTG chr11 5205791 5205812 5205808 5205813 +
gtaaacactgaatgaaagaaga

SEQ ID NO: 80509 - DNA, 22 bp, Artificial Sequence
  Synthetic oligonucleotide; CTG chr11 5205801 5205822 5205818 5205823 +
aatgaaagaagaaaaccaagca

SEQ ID NO: 80510 - DNA, 22 bp, Artificial Sequence
  Synthetic oligonucleotide; TTA chr11 5205842 5205863 5205859 5205864 +
caaataaatttatattttaaaa

SEQ ID NO: 80511 - DNA, 22 bp, Artificial Sequence
  Synthetic oligonucleotide; TTT chr11 5205853 5205874 5205870 5205875 +
atattttaaaaacattttttat

SEQ ID NO: 80512 - DNA, 22 bp, Artificial Sequence
  Synthetic oligonucleotide; TTA chr11 5205854 5205875 5205871 5205876 +
tattttaaaaacattttttatt

SEQ ID NO: 80513 - DNA, 22 bp, Artificial Sequence
  Synthetic oligonucleotide; TTT chr11 5205859 5205880 5205876 5205881 +
taaaaacattttttatttgcct

SEQ ID NO: 80514 - DNA, 22 bp, Artificial Sequence
  Synthetic oligonucleotide; TTT chr11 5205860 5205881 5205877 5205882 +
aaaaacattttttatttgcctg

SEQ ID NO: 80515 - DNA, 22 bp, Artificial Sequence
  Synthetic oligonucleotide; TTA chr11 5205861 5205882 5205878 5205883 +
aaaacattttttatttgcctgg

SEQ ID NO: 80516 - DNA, 22 bp, Artificial Sequence
  Synthetic oligonucleotide; TTT chr11 5205870 5205891 5205887 5205892 +
tttatttgcctggcaaataata

SEQ ID NO: 80517 - DNA, 22 bp, Artificial Sequence
  Synthetic oligonucleotide; TTT chr11 5205871 5205892 5205888 5205893 +
ttatttgcctggcaaataataa

SEQ ID NO: 80518 - DNA, 22 bp, Artificial Sequence
  Synthetic oligonucleotide; TTT chr11 5205872 5205893 5205889 5205894 +
tatttgcctggcaaataataag

SEQ ID NO: 80519 - DNA, 22 bp, Artificial Sequence
  Synthetic oligonucleotide; TTT chr11 5205873 5205894 5205890 5205895 +
atttgcctggcaaataataagt

SEQ ID NO: 80520 - DNA, 22 bp, Artificial Sequence
  Synthetic oligonucleotide; TTA chr11 5205874 5205895 5205891 5205896 +
tttgcctggcaaataataagtg

SEQ ID NO: 80521 - DNA, 22 bp, Artificial Sequence
  Synthetic oligonucleotide; TTT chr11 5205877 5205898 5205894 5205899 +
gcctggcaaataataagtgcat

SEQ ID NO: 80522 - DNA, 22 bp, Artificial Sequence
  Synthetic oligonucleotide; TTG chr11 5205878 5205899 5205895 5205900 +
cctggcaaataataagtgcata

SEQ ID NO: 80523 - DNA, 22 bp, Artificial Sequence
  Synthetic oligonucleotide; CTG chr11 5205882 5205903 5205899 5205904 +
gcaaataataagtgcatatatt

SEQ ID NO: 80524 - DNA, 22 bp, Artificial Sequence
  Synthetic oligonucleotide; TTA chr11 5205905 5205926 5205922 5205927 +
atggatacaataataatatata

SEQ ID NO: 80525 - DNA, 22 bp, Artificial Sequence
  Synthetic oligonucleotide; TTA chr11 5205957 5205978 5205974 5205979 +
tgggatacaatgtgatgtttga

SEQ ID NO: 80526 - DNA, 22 bp, Artificial Sequence
  Synthetic oligonucleotide; TTT chr11 5205977 5205998 5205994 5205999 +
gatctatatatacattgtagag

SEQ ID NO: 80527 - DNA, 22 bp, Artificial Sequence
  Synthetic oligonucleotide; TTG chr11 5205978 5205999 5205995 5206000 +
atctatatatacattgtagaga

SEQ ID NO: 80528 - DNA, 22 bp, Artificial Sequence
  Synthetic oligonucleotide; CTA chr11 5205983 5206004 5206000 5206005 +
tatatacattgtagagagagtc

SEQ ID NO: 80529 - DNA, 22 bp, Artificial Sequence
  Synthetic oligonucleotide; TTG chr11 5205994 5206015 5206011 5206016 +
tagagagagtctatcaagctaa

SEQ ID NO: 80530 - DNA, 22 bp, Artificial Sequence
  Synthetic oligonucleotide; CTA chr11 5206007 5206028 5206024 5206029 +
tcaagctaattagcatatgaat

SEQ ID NO: 80531 - DNA, 22 bp, Artificial Sequence
  Synthetic oligonucleotide; CTA chr11 5206015 5206036 5206032 5206037 +
attagcatatgaatcaccttcc

SEQ ID NO: 80532 - DNA, 22 bp, Artificial Sequence
  Synthetic oligonucleotide; TTA chr11 5206019 5206040 5206036 5206041 +
gcatatgaatcaccttccaact

SEQ ID NO: 80533 - DNA, 22 bp, Artificial Sequence
  Synthetic oligonucleotide; CTT chr11 5206035 5206056 5206052 5206057 +
ccaactttttttgtggtgagaa

SEQ ID NO: 80534 - DNA, 22 bp, Artificial Sequence
  Synthetic oligonucleotide; TTC chr11 5206036 5206057 5206053 5206058 +
caactttttttgtggtgagaac

SEQ ID NO: 80535 - DNA, 22 bp, Artificial Sequence
  Synthetic oligonucleotide; CTT chr11 5206042 5206063 5206059 5206064 +
tttttgtggtgagaacataaaa

SEQ ID NO: 80536 - DNA, 22 bp, Artificial Sequence
  Synthetic oligonucleotide; TTT chr11 5206043 5206064 5206060 5206065 +
ttttgtggtgagaacataaaat

SEQ ID NO: 80537 - DNA, 22 bp, Artificial Sequence
  Synthetic oligonucleotide; TTT chr11 5206044 5206065 5206061 5206066 +
tttgtggtgagaacataaaata

SEQ ID NO: 80538 - DNA, 22 bp, Artificial Sequence
  Synthetic oligonucleotide; TTT chr11 5206045 5206066 5206062 5206067 +
ttgtggtgagaacataaaatat

SEQ ID NO: 80539 - DNA, 22 bp, Artificial Sequence
  Synthetic oligonucleotide; TTT chr11 5206046 5206067 5206063 5206068 +
tgtggtgagaacataaaatatt

SEQ ID NO: 80540 - DNA, 22 bp, Artificial Sequence
  Synthetic oligonucleotide; TTT chr11 5206047 5206068 5206064 5206069 +
gtggtgagaacataaaatattt

SEQ ID NO: 80541 - DNA, 22 bp, Artificial Sequence
  Synthetic oligonucleotide; TTG chr11 5206048 5206069 5206065 5206070 +
tggtgagaacataaaatattta

SEQ ID NO: 80542 - DNA, 22 bp, Artificial Sequence
  Synthetic oligonucleotide; TTT chr11 5206069 5206090 5206086 5206091 +
attttttagcaatttttaattt

SEQ ID NO: 80543 - DNA, 22 bp, Artificial Sequence
  Synthetic oligonucleotide; TTA chr11 5206070 5206091 5206087 5206092 +
ttttttagcaatttttaattta

SEQ ID NO: 80544 - DNA, 22 bp, Artificial Sequence
  Synthetic oligonucleotide; TTT chr11 5206073 5206094 5206090 5206095 +
tttagcaatttttaatttaaat

SEQ ID NO: 80545 - DNA, 22 bp, Artificial Sequence
  Synthetic oligonucleotide; TTT chr11 5206074 5206095 5206091 5206096 +
ttagcaatttttaatttaaata

SEQ ID NO: 80546 - DNA, 22 bp, Artificial Sequence
  Synthetic oligonucleotide; TTT chr11 5206075 5206096 5206092 5206097 +
tagcaatttttaatttaaatac

SEQ ID NO: 80547 - DNA, 22 bp, Artificial Sequence
  Synthetic oligonucleotide; TTT chr11 5206076 5206097 5206093 5206098 +
agcaatttttaatttaaataca

SEQ ID NO: 80548 - DNA, 22 bp, Artificial Sequence
  Synthetic oligonucleotide; TTA chr11 5206077 5206098 5206094 5206099 +
gcaatttttaatttaaatacat

SEQ ID NO: 80549 - DNA, 22 bp, Artificial Sequence
  Synthetic oligonucleotide; TTT chr11 5206084 5206105 5206101 5206106 +
ttaatttaaatacataatatat

SEQ ID NO: 80550 - DNA, 22 bp, Artificial Sequence
  Synthetic oligonucleotide; TTT chr11 5206085 5206106 5206102 5206107 +
taatttaaatacataatatatt

SEQ ID NO: 80551 - DNA, 22 bp, Artificial Sequence
  Synthetic oligonucleotide; TTT chr11 5206086 5206107 5206103 5206108 +
aatttaaatacataatatatta

SEQ ID NO: 80552 - DNA, 22 bp, Artificial Sequence
  Synthetic oligonucleotide; TTA chr11 5206087 5206108 5206104 5206109 +
atttaaatacataatatattat

SEQ ID NO: 80553 - DNA, 22 bp, Artificial Sequence
  Synthetic oligonucleotide; TTT chr11 5206091 5206112 5206108 5206113 +
aaatacataatatattattaac

SEQ ID NO: 80554 - DNA, 22 bp, Artificial Sequence
  Synthetic oligonucleotide; TTA chr11 5206092 5206113 5206109 5206114 +
aatacataatatattattaact

SEQ ID NO: 80555 - DNA, 22 bp, Artificial Sequence
  Synthetic oligonucleotide; TTA chr11 5206108 5206129 5206125 5206130 +
ttaactgtgttcactatgcagt

SEQ ID NO: 80556 - DNA, 22 bp, Artificial Sequence
  Synthetic oligonucleotide; TTA chr11 5206111 5206132 5206128 5206133 +
actgtgttcactatgcagtgtg

SEQ ID NO: 80557 - DNA, 22 bp, Artificial Sequence
  Synthetic oligonucleotide; CTG chr11 5206115 5206136 5206132 5206137 +
tgttcactatgcagtgtgagag

SEQ ID NO: 80558 - DNA, 22 bp, Artificial Sequence
  Synthetic oligonucleotide; TTC chr11 5206120 5206141 5206137 5206142 +
actatgcagtgtgagagatcac

SEQ ID NO: 80559 - DNA, 22 bp, Artificial Sequence
  Synthetic oligonucleotide; CTA chr11 5206124 5206145 5206141 5206146 +
tgcagtgtgagagatcactaaa

SEQ ID NO: 80560 - DNA, 22 bp, Artificial Sequence
  Synthetic oligonucleotide; CTA chr11 5206144 5206165 5206161 5206166 +
aaacttattcctctagtctaac

SEQ ID NO: 80561 - DNA, 22 bp, Artificial Sequence
  Synthetic oligonucleotide; CTT chr11 5206150 5206171 5206167 5206172 +
attcctctagtctaactgaaga

SEQ ID NO: 80562 - DNA, 22 bp, Artificial Sequence
  Synthetic oligonucleotide; TTA chr11 5206151 5206172 5206168 5206173 +
ttcctctagtctaactgaagat

SEQ ID NO: 80563 - DNA, 22 bp, Artificial Sequence
  Synthetic oligonucleotide; TTC chr11 5206154 5206175 5206171 5206176 +
ctctagtctaactgaagatcaa

SEQ ID NO: 80564 - DNA, 22 bp, Artificial Sequence
  Synthetic oligonucleotide; CTC chr11 5206157 5206178 5206174 5206179 +
tagtctaactgaagatcaactt

SEQ ID NO: 80565 - DNA, 22 bp, Artificial Sequence
  Synthetic oligonucleotide; CTA chr11 5206159 5206180 5206176 5206181 +
gtctaactgaagatcaacttct

SEQ ID NO: 80566 - DNA, 22 bp, Artificial Sequence
  Synthetic oligonucleotide; CTA chr11 5206164 5206185 5206181 5206186 +
actgaagatcaacttctttccc

SEQ ID NO: 80567 - DNA, 22 bp, Artificial Sequence
  Synthetic oligonucleotide; CTG chr11 5206168 5206189 5206185 5206190 +
aagatcaacttctttcccttcc

SEQ ID NO: 80568 - DNA, 22 bp, Artificial Sequence
  Synthetic oligonucleotide; CTT chr11 5206179 5206200 5206196 5206201 +
ctttcccttcccatccctcctc

SEQ ID NO: 80569 - DNA, 22 bp, Artificial Sequence
  Synthetic oligonucleotide; TTC chr11 5206180 5206201 5206197 5206202 +
tttcccttcccatccctcctct

SEQ ID NO: 80570 - DNA, 22 bp, Artificial Sequence
  Synthetic oligonucleotide; CTT chr11 5206182 5206203 5206199 5206204 +
tcccttcccatccctcctctac

SEQ ID NO: 80571 - DNA, 22 bp, Artificial Sequence
  Synthetic oligonucleotide; TTT chr11 5206183 5206204 5206200 5206205 +
cccttcccatccctcctctaca

SEQ ID NO: 80572 - DNA, 22 bp, Artificial Sequence
  Synthetic oligonucleotide; TTC chr11 5206184 5206205 5206201 5206206 +
ccttcccatccctcctctacac

SEQ ID NO: 80573 - DNA, 22 bp, Artificial Sequence
  Synthetic oligonucleotide; CTT chr11 5206188 5206209 5206205 5206210 +
cccatccctcctctacactctc

SEQ ID NO: 80574 - DNA, 22 bp, Artificial Sequence
  Synthetic oligonucleotide; TTC chr11 5206189 5206210 5206206 5206211 +
ccatccctcctctacactctca

SEQ ID NO: 80575 - DNA, 22 bp, Artificial Sequence
  Synthetic oligonucleotide; CTC chr11 5206198 5206219 5206215 5206220 +
ctctacactctcagtcagccta

SEQ ID NO: 80576 - DNA, 22 bp, Artificial Sequence
  Synthetic oligonucleotide; CTC chr11 5206201 5206222 5206218 5206223 +
tacactctcagtcagcctatgg

SEQ ID NO: 80577 - DNA, 22 bp, Artificial Sequence
  Synthetic oligonucleotide; CTA chr11 5206203 5206224 5206220 5206225 +
cactctcagtcagcctatggaa

SEQ ID NO: 80578 - DNA, 22 bp, Artificial Sequence
  Synthetic oligonucleotide; CTC chr11 5206208 5206229 5206225 5206230 +
tcagtcagcctatggaaccatc

SEQ ID NO: 80579 - DNA, 22 bp, Artificial Sequence
  Synthetic oligonucleotide; CTC chr11 5206210 5206231 5206227 5206232 +
agtcagcctatggaaccatctt

SEQ ID NO: 80580 - DNA, 22 bp, Artificial Sequence
  Synthetic oligonucleotide; CTA chr11 5206220 5206241 5206237 5206242 +
tggaaccatctttctattcccg

SEQ ID NO: 80581 - DNA, 22 bp, Artificial Sequence
  Synthetic oligonucleotide; CTT chr11 5206232 5206253 5206249 5206254 +
tctattcccgtttttatgaaat

SEQ ID NO: 80582 - DNA, 22 bp, Artificial Sequence
  Synthetic oligonucleotide; TTT chr11 5206233 5206254 5206250 5206255 +
ctattcccgtttttatgaaatc

SEQ ID NO: 80583 - DNA, 22 bp, Artificial Sequence
  Synthetic oligonucleotide; TTC chr11 5206234 5206255 5206251 5206256 +
tattcccgtttttatgaaatca

SEQ ID NO: 80584 - DNA, 22 bp, Artificial Sequence
  Synthetic oligonucleotide; CTA chr11 5206236 5206257 5206253 5206258 +
ttcccgtttttatgaaatcaac

SEQ ID NO: 80585 - DNA, 22 bp, Artificial Sequence
  Synthetic oligonucleotide; TTC chr11 5206239 5206260 5206256 5206261 +
ccgtttttatgaaatcaacttt

SEQ ID NO: 80586 - DNA, 22 bp, Artificial Sequence
  Synthetic oligonucleotide; TTT chr11 5206245 5206266 5206262 5206267 +
ttatgaaatcaactttttaaaa

SEQ ID NO: 80587 - DNA, 22 bp, Artificial Sequence
  Synthetic oligonucleotide; TTT chr11 5206246 5206267 5206263 5206268 +
tatgaaatcaactttttaaaaa

SEQ ID NO: 80588 - DNA, 22 bp, Artificial Sequence
  Synthetic oligonucleotide; TTT chr11 5206247 5206268 5206264 5206269 +
atgaaatcaactttttaaaaaa

SEQ ID NO: 80589 - DNA, 22 bp, Artificial Sequence
  Synthetic oligonucleotide; TTA chr11 5206248 5206269 5206265 5206270 +
tgaaatcaactttttaaaaaat

SEQ ID NO: 80590 - DNA, 22 bp, Artificial Sequence
  Synthetic oligonucleotide; CTT chr11 5206260 5206281 5206277 5206282 +
tttaaaaaattcatccttaaat

SEQ ID NO: 80591 - DNA, 22 bp, Artificial Sequence
  Synthetic oligonucleotide; TTT chr11 5206261 5206282 5206278 5206283 +
ttaaaaaattcatccttaaata

SEQ ID NO: 80592 - DNA, 22 bp, Artificial Sequence
  Synthetic oligonucleotide; TTT chr11 5206262 5206283 5206279 5206284 +
taaaaaattcatccttaaatat

SEQ ID NO: 80593 - DNA, 22 bp, Artificial Sequence
  Synthetic oligonucleotide; TTT chr11 5206263 5206284 5206280 5206285 +
aaaaaattcatccttaaatata

SEQ ID NO: 80594 - DNA, 22 bp, Artificial Sequence
  Synthetic oligonucleotide; TTA chr11 5206264 5206285 5206281 5206286 +
aaaaattcatccttaaatatat

SEQ ID NO: 80595 - DNA, 22 bp, Artificial Sequence
  Synthetic oligonucleotide; TTC chr11 5206272 5206293 5206289 5206294 +
atccttaaatatattaaaatga

SEQ ID NO: 80596 - DNA, 22 bp, Artificial Sequence
  Synthetic oligonucleotide; CTT chr11 5206278 5206299 5206295 5206300 +
aaatatattaaaatgaacagtt

SEQ ID NO: 80597 - DNA, 22 bp, Artificial Sequence
  Synthetic oligonucleotide; TTA chr11 5206279 5206300 5206296 5206301 +
aatatattaaaatgaacagtta

SEQ ID NO: 80598 - DNA, 22 bp, Artificial Sequence
  Synthetic oligonucleotide; TTA chr11 5206288 5206309 5206305 5206310 +
aaatgaacagttaaatttatga

SEQ ID NO: 80599 - DNA, 22 bp, Artificial Sequence
  Synthetic oligonucleotide; TTA chr11 5206301 5206322 5206318 5206323 +
aatttatgaggataaataatta

SEQ ID NO: 80600 - DNA, 22 bp, Artificial Sequence
  Synthetic oligonucleotide; TTT chr11 5206306 5206327 5206323 5206328 +
atgaggataaataattaaaact

SEQ ID NO: 80601 - DNA, 22 bp, Artificial Sequence
  Synthetic oligonucleotide; TTA chr11 5206307 5206328 5206324 5206329 +
tgaggataaataattaaaacta

SEQ ID NO: 80602 - DNA, 22 bp, Artificial Sequence
  Synthetic oligonucleotide; TTA chr11 5206323 5206344 5206340 5206345 +
aaactattacacatattttaag

SEQ ID NO: 80603 - DNA, 22 bp, Artificial Sequence
  Synthetic oligonucleotide; CTA chr11 5206329 5206350 5206346 5206351 +
ttacacatattttaagttgtcc

SEQ ID NO: 80604 - DNA, 22 bp, Artificial Sequence
  Synthetic oligonucleotide; TTA chr11 5206332 5206353 5206349 5206354 +
cacatattttaagttgtcctct

SEQ ID NO: 80605 - DNA, 22 bp, Artificial Sequence
  Synthetic oligonucleotide; TTT chr11 5206341 5206362 5206358 5206363 +
taagttgtcctctgaaaattct

SEQ ID NO: 80606 - DNA, 22 bp, Artificial Sequence
  Synthetic oligonucleotide; TTT chr11 5206342 5206363 5206359 5206364 +
aagttgtcctctgaaaattcta

SEQ ID NO: 80607 - DNA, 22 bp, Artificial Sequence
  Synthetic oligonucleotide; TTA chr11 5206343 5206364 5206360 5206365 +
agttgtcctctgaaaattctag

SEQ ID NO: 80608 - DNA, 22 bp, Artificial Sequence
  Synthetic oligonucleotide; TTG chr11 5206348 5206369 5206365 5206370 +
tcctctgaaaattctagaattc

SEQ ID NO: 80609 - DNA, 22 bp, Artificial Sequence
  Synthetic oligonucleotide; CTC chr11 5206353 5206374 5206370 5206375 +
tgaaaattctagaattctactt

SEQ ID NO: 80610 - DNA, 22 bp, Artificial Sequence
  Synthetic oligonucleotide; CTG chr11 5206355 5206376 5206372 5206377 +
aaaattctagaattctacttca

SEQ ID NO: 80611 - DNA, 22 bp, Artificial Sequence
  Synthetic oligonucleotide; TTC chr11 5206362 5206383 5206379 5206384 +
tagaattctacttcaataccct

SEQ ID NO: 80612 - DNA, 22 bp, Artificial Sequence
  Synthetic oligonucleotide; CTA chr11 5206364 5206385 5206381 5206386 +
gaattctacttcaataccctta

SEQ ID NO: 80613 - DNA, 22 bp, Artificial Sequence
  Synthetic oligonucleotide; TTC chr11 5206370 5206391 5206387 5206392 +
tacttcaatacccttattttta

SEQ ID NO: 80614 - DNA, 22 bp, Artificial Sequence
  Synthetic oligonucleotide; CTA chr11 5206372 5206393 5206389 5206394 +
cttcaatacccttatttttaag

SEQ ID NO: 80615 - DNA, 22 bp, Artificial Sequence
  Synthetic oligonucleotide; CTT chr11 5206375 5206396 5206392 5206397 +
caatacccttatttttaagata

SEQ ID NO: 80616 - DNA, 22 bp, Artificial Sequence
  Synthetic oligonucleotide; TTC chr11 5206376 5206397 5206393 5206398 +
aatacccttatttttaagataa

SEQ ID NO: 80617 - DNA, 22 bp, Artificial Sequence
  Synthetic oligonucleotide; CTT chr11 5206385 5206406 5206402 5206407 +
atttttaagataaaggaaattg

SEQ ID NO: 80618 - DNA, 22 bp, Artificial Sequence
  Synthetic oligonucleotide; TTA chr11 5206386 5206407 5206403 5206408 +
tttttaagataaaggaaattgt

SEQ ID NO: 80619 - DNA, 22 bp, Artificial Sequence
  Synthetic oligonucleotide; TTT chr11 5206389 5206410 5206406 5206411 +
ttaagataaaggaaattgtaaa

SEQ ID NO: 80620 - DNA, 22 bp, Artificial Sequence
  Synthetic oligonucleotide; TTT chr11 5206390 5206411 5206407 5206412 +
taagataaaggaaattgtaaag

SEQ ID NO: 80621 - DNA, 22 bp, Artificial Sequence
  Synthetic oligonucleotide; TTT chr11 5206391 5206412 5206408 5206413 +
aagataaaggaaattgtaaagg

SEQ ID NO: 80622 - DNA, 22 bp, Artificial Sequence
  Synthetic oligonucleotide; TTA chr11 5206392 5206413 5206409 5206414 +
agataaaggaaattgtaaaggc

SEQ ID NO: 80623 - DNA, 22 bp, Artificial Sequence
  Synthetic oligonucleotide; TTG chr11 5206407 5206428 5206424 5206429 +
taaaggctttctaagaaatcga

SEQ ID NO: 80624 - DNA, 22 bp, Artificial Sequence
  Synthetic oligonucleotide; CTT chr11 5206416 5206437 5206433 5206438 +
tctaagaaatcgagtacccata

SEQ ID NO: 80625 - DNA, 22 bp, Artificial Sequence
  Synthetic oligonucleotide; TTT chr11 5206417 5206438 5206434 5206439 +
ctaagaaatcgagtacccatac

SEQ ID NO: 80626 - DNA, 22 bp, Artificial Sequence
  Synthetic oligonucleotide; TTC chr11 5206418 5206439 5206435 5206440 +
taagaaatcgagtacccatacc

SEQ ID NO: 80627 - DNA, 22 bp, Artificial Sequence
  Synthetic oligonucleotide; CTA chr11 5206420 5206441 5206437 5206442 +
agaaatcgagtacccataccta

SEQ ID NO: 80628 - DNA, 22 bp, Artificial Sequence
  Synthetic oligonucleotide; CTA chr11 5206442 5206463 5206459 5206464 +
ggctgctagactccaggtccaa

SEQ ID NO: 80629 - DNA, 22 bp, Artificial Sequence
  Synthetic oligonucleotide; CTG chr11 5206447 5206468 5206464 5206469 +
ctagactccaggtccaattttt

SEQ ID NO: 80630 - DNA, 22 bp, Artificial Sequence
  Synthetic oligonucleotide; CTA chr11 5206450 5206471 5206467 5206472 +
gactccaggtccaatttttctc

SEQ ID NO: 80631 - DNA, 22 bp, Artificial Sequence
  Synthetic oligonucleotide; CTC chr11 5206455 5206476 5206472 5206477 +
caggtccaatttttctccaggg

SEQ ID NO: 80632 - DNA, 22 bp, Artificial Sequence
  Synthetic oligonucleotide; TTT chr11 5206467 5206488 5206484 5206489 +
ttctccagggggttactatggc

SEQ ID NO: 80633 - DNA, 22 bp, Artificial Sequence
  Synthetic oligonucleotide; TTT chr11 5206468 5206489 5206485 5206490 +
tctccagggggttactatggct

SEQ ID NO: 80634 - DNA, 22 bp, Artificial Sequence
  Synthetic oligonucleotide; TTT chr11 5206469 5206490 5206486 5206491 +
ctccagggggttactatggctt

SEQ ID NO: 80635 - DNA, 22 bp, Artificial Sequence
  Synthetic oligonucleotide; TTC chr11 5206470 5206491 5206487 5206492 +
tccagggggttactatggcttc

SEQ ID NO: 80636 - DNA, 22 bp, Artificial Sequence
  Synthetic oligonucleotide; CTC chr11 5206472 5206493 5206489 5206494 +
cagggggttactatggcttcag

SEQ ID NO: 80637 - DNA, 22 bp, Artificial Sequence
  Synthetic oligonucleotide; TTA chr11 5206482 5206503 5206499 5206504 +
ctatggcttcagggaagctatc

SEQ ID NO: 80638 - DNA, 22 bp, Artificial Sequence
  Synthetic oligonucleotide; CTA chr11 5206485 5206506 5206502 5206507 +
tggcttcagggaagctatctat

SEQ ID NO: 80639 - DNA, 22 bp, Artificial Sequence
  Synthetic oligonucleotide; CTT chr11 5206491 5206512 5206508 5206513 +
cagggaagctatctataatcac

SEQ ID NO: 80640 - DNA, 22 bp, Artificial Sequence
  Synthetic oligonucleotide; TTC chr11 5206492 5206513 5206509 5206514 +
agggaagctatctataatcacc

SEQ ID NO: 80641 - DNA, 22 bp, Artificial Sequence
  Synthetic oligonucleotide; CTA chr11 5206502 5206523 5206519 5206524 +
tctataatcaccatctccagaa

SEQ ID NO: 80642 - DNA, 22 bp, Artificial Sequence
  Synthetic oligonucleotide; CTA chr11 5206506 5206527 5206523 5206528 +
taatcaccatctccagaacatc

SEQ ID NO: 80643 - DNA, 22 bp, Artificial Sequence
  Synthetic oligonucleotide; CTC chr11 5206519 5206540 5206536 5206541 +
cagaacatctctcactttctca

SEQ ID NO: 80644 - DNA, 22 bp, Artificial Sequence
  Synthetic oligonucleotide; CTC chr11 5206530 5206551 5206547 5206552 +
tcactttctcatcaccacacag

SEQ ID NO: 80645 - DNA, 22 bp, Artificial Sequence
  Synthetic oligonucleotide; CTC chr11 5206532 5206553 5206549 5206554 +
actttctcatcaccacacagtg

SEQ ID NO: 80646 - DNA, 22 bp, Artificial Sequence
  Synthetic oligonucleotide; CTT chr11 5206536 5206557 5206553 5206558 +
tctcatcaccacacagtggaat

SEQ ID NO: 80647 - DNA, 22 bp, Artificial Sequence
  Synthetic oligonucleotide; TTT chr11 5206537 5206558 5206554 5206559 +
ctcatcaccacacagtggaata

SEQ ID NO: 80648 - DNA, 22 bp, Artificial Sequence
  Synthetic oligonucleotide; TTC chr11 5206538 5206559 5206555 5206560 +
tcatcaccacacagtggaataa

SEQ ID NO: 80649 - DNA, 22 bp, Artificial Sequence
  Synthetic oligonucleotide; CTC chr11 5206540 5206561 5206557 5206562 +
atcaccacacagtggaataaga

SEQ ID NO: 80650 - DNA, 22 bp, Artificial Sequence
  Synthetic oligonucleotide; TTT chr11 5206569 5206590 5206586 5206591 +
tggcagcaataaaaaagtaatg

SEQ ID NO: 80651 - DNA, 22 bp, Artificial Sequence
  Synthetic oligonucleotide; TTT chr11 5206570 5206591 5206587 5206592 +
ggcagcaataaaaaagtaatgc

SEQ ID NO: 80652 - DNA, 22 bp, Artificial Sequence
  Synthetic oligonucleotide; TTG chr11 5206571 5206592 5206588 5206593 +
gcagcaataaaaaagtaatgcc

SEQ ID NO: 80653 - DNA, 22 bp, Artificial Sequence
  Synthetic oligonucleotide; TTA chr11 5206604 5206625 5206621 5206626 +
gtaaagccttcagaaaaagtat

SEQ ID NO: 80654 - DNA, 22 bp, Artificial Sequence
  Synthetic oligonucleotide; CTT chr11 5206614 5206635 5206631 5206636 +
cagaaaaagtatgaatattaca

SEQ ID NO: 80655 - DNA, 22 bp, Artificial Sequence
  Synthetic oligonucleotide; TTC chr11 5206615 5206636 5206632 5206637 +
agaaaaagtatgaatattacac

SEQ ID NO: 80656 - DNA, 22 bp, Artificial Sequence
  Synthetic oligonucleotide; TTA chr11 5206634 5206655 5206651 5206656 +
cacagttacacttatattagaa

SEQ ID NO: 80657 - DNA, 22 bp, Artificial Sequence
  Synthetic oligonucleotide; TTA chr11 5206642 5206663 5206659 5206664 +
cacttatattagaactaaaatt

SEQ ID NO: 80658 - DNA, 22 bp, Artificial Sequence
  Synthetic oligonucleotide; CTT chr11 5206647 5206668 5206664 5206669 +
atattagaactaaaatttattt

SEQ ID NO: 80659 - DNA, 22 bp, Artificial Sequence
  Synthetic oligonucleotide; TTA chr11 5206648 5206669 5206665 5206670 +
tattagaactaaaatttattta

SEQ ID NO: 80660 - DNA, 22 bp, Artificial Sequence
  Synthetic oligonucleotide; TTA chr11 5206653 5206674 5206670 5206675 +
gaactaaaatttatttattgaa

SEQ ID NO: 80661 - DNA, 22 bp, Artificial Sequence
  Synthetic oligonucleotide; CTA chr11 5206659 5206680 5206676 5206681 +
aaatttatttattgaaattcac

SEQ ID NO: 80662 - DNA, 22 bp, Artificial Sequence
  Synthetic oligonucleotide; TTT chr11 5206665 5206686 5206682 5206687 +
atttattgaaattcacattacc

SEQ ID NO: 80663 - DNA, 22 bp, Artificial Sequence
  Synthetic oligonucleotide; TTA chr11 5206666 5206687 5206683 5206688 +
tttattgaaattcacattacca

SEQ ID NO: 80664 - DNA, 22 bp, Artificial Sequence
  Synthetic oligonucleotide; TTT chr11 5206669 5206690 5206686 5206691 +
attgaaattcacattaccataa

SEQ ID NO: 80665 - DNA, 22 bp, Artificial Sequence
  Synthetic oligonucleotide; TTA chr11 5206670 5206691 5206687 5206692 +
ttgaaattcacattaccataat

SEQ ID NO: 80666 - DNA, 22 bp, Artificial Sequence
  Synthetic oligonucleotide; TTG chr11 5206673 5206694 5206690 5206695 +
aaattcacattaccataattat

SEQ ID NO: 80667 - DNA, 22 bp, Artificial Sequence
  Synthetic oligonucleotide; TTC chr11 5206679 5206700 5206696 5206701 +
acattaccataattatttatgt

SEQ ID NO: 80668 - DNA, 22 bp, Artificial Sequence
  Synthetic oligonucleotide; TTA chr11 5206685 5206706 5206702 5206707 +
ccataattatttatgtctgatt

SEQ ID NO: 80669 - DNA, 22 bp, Artificial Sequence
  Synthetic oligonucleotide; TTA chr11 5206694 5206715 5206711 5206716 +
tttatgtctgattaaatgttat

SEQ ID NO: 80670 - DNA, 22 bp, Artificial Sequence
  Synthetic oligonucleotide; TTT chr11 5206697 5206718 5206714 5206719 +
atgtctgattaaatgttattaa

SEQ ID NO: 80671 - DNA, 22 bp, Artificial Sequence
  Synthetic oligonucleotide; TTA chr11 5206698 5206719 5206715 5206720 +
tgtctgattaaatgttattaaa

SEQ ID NO: 80672 - DNA, 22 bp, Artificial Sequence
  Synthetic oligonucleotide; CTG chr11 5206704 5206725 5206721 5206726 +
attaaatgttattaaagctaaa

SEQ ID NO: 80673 - DNA, 22 bp, Artificial Sequence
  Synthetic oligonucleotide; TTA chr11 5206708 5206729 5206725 5206730 +
aatgttattaaagctaaaattt

SEQ ID NO: 80674 - DNA, 22 bp, Artificial Sequence
  Synthetic oligonucleotide; TTA chr11 5206715 5206736 5206732 5206737 +
ttaaagctaaaattttgaattt

SEQ ID NO: 80675 - DNA, 22 bp, Artificial Sequence
  Synthetic oligonucleotide; TTA chr11 5206718 5206739 5206735 5206740 +
aagctaaaattttgaatttata

SEQ ID NO: 80676 - DNA, 22 bp, Artificial Sequence
  Synthetic oligonucleotide; CTA chr11 5206724 5206745 5206741 5206746 +
aaattttgaatttatatactac

SEQ ID NO: 80677 - DNA, 22 bp, Artificial Sequence
  Synthetic oligonucleotide; TTT chr11 5206730 5206751 5206747 5206752 +
tgaatttatatactactattaa

SEQ ID NO: 80678 - DNA, 22 bp, Artificial Sequence
  Synthetic oligonucleotide; TTT chr11 5206731 5206752 5206748 5206753 +
gaatttatatactactattaat

SEQ ID NO: 80679 - DNA, 22 bp, Artificial Sequence
  Synthetic oligonucleotide; TTG chr11 5206732 5206753 5206749 5206754 +
aatttatatactactattaatt

SEQ ID NO: 80680 - DNA, 22 bp, Artificial Sequence
  Synthetic oligonucleotide; TTT chr11 5206737 5206758 5206754 5206759 +
atatactactattaatttccag

SEQ ID NO: 80681 - DNA, 22 bp, Artificial Sequence
  Synthetic oligonucleotide; TTA chr11 5206738 5206759 5206755 5206760 +
tatactactattaatttccagt

SEQ ID NO: 80682 - DNA, 22 bp, Artificial Sequence
  Synthetic oligonucleotide; CTA chr11 5206745 5206766 5206762 5206767 +
ctattaatttccagttctatct

SEQ ID NO: 80683 - DNA, 22 bp, Artificial Sequence
  Synthetic oligonucleotide; CTA chr11 5206748 5206769 5206765 5206770 +
ttaatttccagttctatctttc

SEQ ID NO: 80684 - DNA, 22 bp, Artificial Sequence
  Synthetic oligonucleotide; TTA chr11 5206751 5206772 5206768 5206773 +
atttccagttctatctttctgt

SEQ ID NO: 80685 - DNA, 22 bp, Artificial Sequence
  Synthetic oligonucleotide; TTT chr11 5206755 5206776 5206772 5206777 +
ccagttctatctttctgttcaa

SEQ ID NO: 80686 - DNA, 22 bp, Artificial Sequence
  Synthetic oligonucleotide; TTC chr11 5206756 5206777 5206773 5206778 +
cagttctatctttctgttcaag

SEQ ID NO: 80687 - DNA, 22 bp, Artificial Sequence
  Synthetic oligonucleotide; TTC chr11 5206762 5206783 5206779 5206784 +
tatctttctgttcaagaaaaga

SEQ ID NO: 80688 - DNA, 22 bp, Artificial Sequence
  Synthetic oligonucleotide; CTA chr11 5206764 5206785 5206781 5206786 +
tctttctgttcaagaaaagaat

SEQ ID NO: 80689 - DNA, 22 bp, Artificial Sequence
  Synthetic oligonucleotide; CTT chr11 5206768 5206789 5206785 5206790 +
tctgttcaagaaaagaatgtga

SEQ ID NO: 80690 - DNA, 22 bp, Artificial Sequence
  Synthetic oligonucleotide; TTT chr11 5206769 5206790 5206786 5206791 +
ctgttcaagaaaagaatgtgag

SEQ ID NO: 80691 - DNA, 22 bp, Artificial Sequence
  Synthetic oligonucleotide; TTC chr11 5206770 5206791 5206787 5206792 +
tgttcaagaaaagaatgtgaga

SEQ ID NO: 80692 - DNA, 22 bp, Artificial Sequence
  Synthetic oligonucleotide; CTG chr11 5206772 5206793 5206789 5206794 +
ttcaagaaaagaatgtgagaag

SEQ ID NO: 80693 - DNA, 22 bp, Artificial Sequence
  Synthetic oligonucleotide; TTC chr11 5206775 5206796 5206792 5206797 +
aagaaaagaatgtgagaagtaa

SEQ ID NO: 80694 - DNA, 22 bp, Artificial Sequence
  Synthetic oligonucleotide; TTA chr11 5206801 5206822 5206818 5206823 +
gtgcctcaaatttgcctacttc

SEQ ID NO: 80695 - DNA, 22 bp, Artificial Sequence
  Synthetic oligonucleotide; CTC chr11 5206808 5206829 5206825 5206830 +
aaatttgcctacttcatcccca

SEQ ID NO: 80696 - DNA, 22 bp, Artificial Sequence
  Synthetic oligonucleotide; TTT chr11 5206814 5206835 5206831 5206836 +
gcctacttcatccccaacagag

SEQ ID NO: 80697 - DNA, 22 bp, Artificial Sequence
  Synthetic oligonucleotide; TTG chr11 5206815 5206836 5206832 5206837 +
cctacttcatccccaacagagg

SEQ ID NO: 80698 - DNA, 22 bp, Artificial Sequence
  Synthetic oligonucleotide; CTA chr11 5206819 5206840 5206836 5206841 +
cttcatccccaacagaggagat

SEQ ID NO: 80699 - DNA, 22 bp, Artificial Sequence
  Synthetic oligonucleotide; CTT chr11 5206822 5206843 5206839 5206844 +
catccccaacagaggagatcat

SEQ ID NO: 80700 - DNA, 22 bp, Artificial Sequence
  Synthetic oligonucleotide; TTC chr11 5206823 5206844 5206840 5206845 +
atccccaacagaggagatcatg

SEQ ID NO: 80701 - DNA, 22 bp, Artificial Sequence
  Synthetic oligonucleotide; CTA chr11 5206849 5206870 5206866 5206871 +
tatcaataatggagcctgggcc

SEQ ID NO: 80702 - DNA, 22 bp, Artificial Sequence
  Synthetic oligonucleotide; CTG chr11 5206867 5206888 5206884 5206889 +
ggcccagacaactggttaagag

SEQ ID NO: 80703 - DNA, 22 bp, Artificial Sequence
  Synthetic oligonucleotide; CTG chr11 5206881 5206902 5206898 5206903 +
gttaagagagaggtcattctga

SEQ ID NO: 80704 - DNA, 22 bp, Artificial Sequence
  Synthetic oligonucleotide; TTA chr11 5206885 5206906 5206902 5206907 +
agagagaggtcattctgacctc

SEQ ID NO: 80705 - DNA, 22 bp, Artificial Sequence
  Synthetic oligonucleotide; TTC chr11 5206900 5206921 5206917 5206922 +
tgacctcagaacataggagaga

SEQ ID NO: 80706 - DNA, 22 bp, Artificial Sequence
  Synthetic oligonucleotide; CTG chr11 5206902 5206923 5206919 5206924 +
acctcagaacataggagagatg

SEQ ID NO: 80707 - DNA, 22 bp, Artificial Sequence
  Synthetic oligonucleotide; CTC chr11 5206907 5206928 5206924 5206929 +
agaacataggagagatggatat

SEQ ID NO: 80708 - DNA, 22 bp, Artificial Sequence
  Synthetic oligonucleotide; TTG chr11 5206931 5206952 5206948 5206953 +
tacaccacagagtccaggatga

SEQ ID NO: 80709 - DNA, 22 bp, Artificial Sequence
  Synthetic oligonucleotide; CTA chr11 5206956 5206977 5206973 5206978 +
gcagtgaaggattcaaatgcct

SEQ ID NO: 80710 - DNA, 22 bp, Artificial Sequence
  Synthetic oligonucleotide; TTC chr11 5206970 5206991 5206987 5206992 +
aaatgcctggcgaaatctccta

SEQ ID NO: 80711 - DNA, 22 bp, Artificial Sequence
  Synthetic oligonucleotide; CTG chr11 5206979 5207000 5206996 5207001 +
gcgaaatctcctatacaaccgg

SEQ ID NO: 80712 - DNA, 22 bp, Artificial Sequence
  Synthetic oligonucleotide; CTC chr11 5206989 5207010 5207006 5207011 +
ctatacaaccggagagacccaa

SEQ ID NO: 80713 - DNA, 22 bp, Artificial Sequence
  Synthetic oligonucleotide; CTA chr11 5206992 5207013 5207009 5207014 +
tacaaccggagagacccaagtc

SEQ ID NO: 80714 - DNA, 22 bp, Artificial Sequence
  Synthetic oligonucleotide; CTC chr11 5207047 5207068 5207064 5207069 +
tgcatgacatgacttgcctatg

SEQ ID NO: 80715 - DNA, 22 bp, Artificial Sequence
  Synthetic oligonucleotide; CTG chr11 5207049 5207070 5207066 5207071 +
catgacatgacttgcctatgag

SEQ ID NO: 80716 - DNA, 22 bp, Artificial Sequence
  Synthetic oligonucleotide; CTT chr11 5207062 5207083 5207079 5207084 +
gcctatgagccctcccattgct

SEQ ID NO: 80717 - DNA, 22 bp, Artificial Sequence
  Synthetic oligonucleotide; TTG chr11 5207063 5207084 5207080 5207085 +
cctatgagccctcccattgcta

SEQ ID NO: 80718 - DNA, 22 bp, Artificial Sequence
  Synthetic oligonucleotide; CTA chr11 5207067 5207088 5207084 5207089 +
tgagccctcccattgctataag

SEQ ID NO: 80719 - DNA, 22 bp, Artificial Sequence
  Synthetic oligonucleotide; CTC chr11 5207076 5207097 5207093 5207098 +
ccattgctataaggatggggat

SEQ ID NO: 80720 - DNA, 22 bp, Artificial Sequence
  Synthetic oligonucleotide; TTG chr11 5207082 5207103 5207099 5207104 +
ctataaggatggggatcttagc

SEQ ID NO: 80721 - DNA, 22 bp, Artificial Sequence
  Synthetic oligonucleotide; CTA chr11 5207085 5207106 5207102 5207107 +
taaggatggggatcttagcaca

SEQ ID NO: 80722 - DNA, 22 bp, Artificial Sequence
  Synthetic oligonucleotide; CTT chr11 5207101 5207122 5207118 5207123 +
agcacagtgccttgtgtgaaca

SEQ ID NO: 80723 - DNA, 22 bp, Artificial Sequence
  Synthetic oligonucleotide; TTA chr11 5207102 5207123 5207119 5207124 +
gcacagtgccttgtgtgaacag

SEQ ID NO: 80724 - DNA, 22 bp, Artificial Sequence
  Synthetic oligonucleotide; CTT chr11 5207114 5207135 5207131 5207136 +
gtgtgaacagtaatgctagcct

SEQ ID NO: 80725 - DNA, 22 bp, Artificial Sequence
  Synthetic oligonucleotide; TTG chr11 5207115 5207136 5207132 5207137 +
tgtgaacagtaatgctagcctt

SEQ ID NO: 80726 - DNA, 22 bp, Artificial Sequence
  Synthetic oligonucleotide; CTA chr11 5207132 5207153 5207149 5207154 +
gccttgattttaccatggcaag

SEQ ID NO: 80727 - DNA, 22 bp, Artificial Sequence
  Synthetic oligonucleotide; CTT chr11 5207137 5207158 5207154 5207159 +
gattttaccatggcaagtttgt

SEQ ID NO: 80728 - DNA, 22 bp, Artificial Sequence
  Synthetic oligonucleotide; TTG chr11 5207138 5207159 5207155 5207160 +
attttaccatggcaagtttgtt

SEQ ID NO: 80729 - DNA, 22 bp, Artificial Sequence
  Synthetic oligonucleotide; TTT chr11 5207142 5207163 5207159 5207164 +
taccatggcaagtttgtttagg

SEQ ID NO: 80730 - DNA, 22 bp, Artificial Sequence
  Synthetic oligonucleotide; TTT chr11 5207143 5207164 5207160 5207165 +
accatggcaagtttgtttaggg

SEQ ID NO: 80731 - DNA, 22 bp, Artificial Sequence
  Synthetic oligonucleotide; TTA chr11 5207144 5207165 5207161 5207166 +
ccatggcaagtttgtttaggga

SEQ ID NO: 80732 - DNA, 22 bp, Artificial Sequence
  Synthetic oligonucleotide; TTT chr11 5207157 5207178 5207174 5207179 +
gtttagggaaaaattcaaccca

SEQ ID NO: 80733 - DNA, 22 bp, Artificial Sequence
  Synthetic oligonucleotide; TTG chr11 5207158 5207179 5207175 5207180 +
tttagggaaaaattcaacccac

SEQ ID NO: 80734 - DNA, 22 bp, Artificial Sequence
  Synthetic oligonucleotide; TTT chr11 5207161 5207182 5207178 5207183 +
agggaaaaattcaacccaccca

SEQ ID NO: 80735 - DNA, 22 bp, Artificial Sequence
  Synthetic oligonucleotide; TTA chr11 5207162 5207183 5207179 5207184 +
gggaaaaattcaacccacccat

SEQ ID NO: 80736 - DNA, 22 bp, Artificial Sequence
  Synthetic oligonucleotide; TTC chr11 5207173 5207194 5207190 5207195 +
aacccacccattgaaattccaa

SEQ ID NO: 80737 - DNA, 22 bp, Artificial Sequence
  Synthetic oligonucleotide; TTG chr11 5207186 5207207 5207203 5207208 +
aaattccaacctcaaccaaatg

SEQ ID NO: 80738 - DNA, 22 bp, Artificial Sequence
  Synthetic oligonucleotide; TTC chr11 5207192 5207213 5207209 5207214 +
caacctcaaccaaatgagggat

SEQ ID NO: 80739 - DNA, 22 bp, Artificial Sequence
  Synthetic oligonucleotide; CTC chr11 5207199 5207220 5207216 5207221 +
aaccaaatgagggatggctggg

SEQ ID NO: 80740 - DNA, 22 bp, Artificial Sequence
  Synthetic oligonucleotide; CTG chr11 5207219 5207240 5207236 5207241 +
gggatgcaaccacaaagatact

SEQ ID NO: 80741 - DNA, 22 bp, Artificial Sequence
  Synthetic oligonucleotide; CTG chr11 5207242 5207263 5207259 5207264 +
tatcttaggaggggagtttttt

SEQ ID NO: 80742 - DNA, 22 bp, Artificial Sequence
  Synthetic oligonucleotide; CTT chr11 5207248 5207269 5207265 5207270 +
aggaggggagtttttttttttt

SEQ ID NO: 80743 - DNA, 22 bp, Artificial Sequence
  Synthetic oligonucleotide; TTA chr11 5207249 5207270 5207266 5207271 +
ggaggggagtttttttttttta

SEQ ID NO: 80744 - DNA, 22 bp, Artificial Sequence
  Synthetic oligonucleotide; TTT chr11 5207261 5207282 5207278 5207283 +
tttttttttatagaaactcgtc

SEQ ID NO: 80745 - DNA, 22 bp, Artificial Sequence
  Synthetic oligonucleotide; TTT chr11 5207262 5207283 5207279 5207284 +
ttttttttatagaaactcgtca

SEQ ID NO: 80746 - DNA, 22 bp, Artificial Sequence
  Synthetic oligonucleotide; TTT chr11 5207263 5207284 5207280 5207285 +
tttttttatagaaactcgtcag

SEQ ID NO: 80747 - DNA, 22 bp, Artificial Sequence
  Synthetic oligonucleotide; TTT chr11 5207264 5207285 5207281 5207286 +
ttttttatagaaactcgtcagg

SEQ ID NO: 80748 - DNA, 22 bp, Artificial Sequence
  Synthetic oligonucleotide; TTT chr11 5207265 5207286 5207282 5207287 +
tttttatagaaactcgtcagga

SEQ ID NO: 80749 - DNA, 22 bp, Artificial Sequence
  Synthetic oligonucleotide; TTT chr11 5207266 5207287 5207283 5207288 +
ttttatagaaactcgtcaggat

SEQ ID NO: 80750 - DNA, 22 bp, Artificial Sequence
  Synthetic oligonucleotide; TTT chr11 5207267 5207288 5207284 5207289 +
tttatagaaactcgtcaggata

SEQ ID NO: 80751 - DNA, 22 bp, Artificial Sequence
  Synthetic oligonucleotide; TTT chr11 5207268 5207289 5207285 5207290 +
ttatagaaactcgtcaggatat

SEQ ID NO: 80752 - DNA, 22 bp, Artificial Sequence
  Synthetic oligonucleotide; TTT chr11 5207269 5207290 5207286 5207291 +
tatagaaactcgtcaggatatt

SEQ ID NO: 80753 - DNA, 22 bp, Artificial Sequence
  Synthetic oligonucleotide; TTT chr11 5207270 5207291 5207287 5207292 +
atagaaactcgtcaggatatta

SEQ ID NO: 80754 - DNA, 22 bp, Artificial Sequence
  Synthetic oligonucleotide; TTA chr11 5207271 5207292 5207288 5207293 +
tagaaactcgtcaggatattat

SEQ ID NO: 80755 - DNA, 22 bp, Artificial Sequence
  Synthetic oligonucleotide; CTC chr11 5207280 5207301 5207297 5207302 +
gtcaggatattattgctaggat

SEQ ID NO: 80756 - DNA, 22 bp, Artificial Sequence
  Synthetic oligonucleotide; TTA chr11 5207292 5207313 5207309 5207314 +
ttgctaggatgtgttgttactg

SEQ ID NO: 80757 - DNA, 22 bp, Artificial Sequence
  Synthetic oligonucleotide; TTG chr11 5207295 5207316 5207312 5207317 +
ctaggatgtgttgttactggga

SEQ ID NO: 80758 - DNA, 22 bp, Artificial Sequence
  Synthetic oligonucleotide; CTA chr11 5207298 5207319 5207315 5207320 +
ggatgtgttgttactgggaaaa

SEQ ID NO: 80759 - DNA, 22 bp, Artificial Sequence
  Synthetic oligonucleotide; TTG chr11 5207308 5207329 5207325 5207330 +
ttactgggaaaaaagctgatgg

SEQ ID NO: 80760 - DNA, 22 bp, Artificial Sequence
  Synthetic oligonucleotide; TTA chr11 5207311 5207332 5207328 5207333 +
ctgggaaaaaagctgatggaat

SEQ ID NO: 80761 - DNA, 22 bp, Artificial Sequence
  Synthetic oligonucleotide; CTG chr11 5207314 5207335 5207331 5207336 +
ggaaaaaagctgatggaataca

SEQ ID NO: 80762 - DNA, 22 bp, Artificial Sequence
  Synthetic oligonucleotide; CTG chr11 5207326 5207347 5207343 5207348 +
atggaatacaaaagagtagaca

SEQ ID NO: 80763 - DNA, 22 bp, Artificial Sequence
  Synthetic oligonucleotide; TTA chr11 5207363 5207384 5207380 5207385 +
tttgaggcaatcagtgactaac

SEQ ID NO: 80764 - DNA, 22 bp, Artificial Sequence
  Synthetic oligonucleotide; TTT chr11 5207366 5207387 5207383 5207388 +
gaggcaatcagtgactaacatg

SEQ ID NO: 80765 - DNA, 22 bp, Artificial Sequence
  Synthetic oligonucleotide; TTG chr11 5207367 5207388 5207384 5207389 +
aggcaatcagtgactaacatga

SEQ ID NO: 80766 - DNA, 22 bp, Artificial Sequence
  Synthetic oligonucleotide; CTA chr11 5207383 5207404 5207400 5207405 +
acatgaccactttgctttctct

SEQ ID NO: 80767 - DNA, 22 bp, Artificial Sequence
  Synthetic oligonucleotide; CTT chr11 5207395 5207416 5207412 5207417 +
tgctttctctatgcaggtgtca

SEQ ID NO: 80768 - DNA, 22 bp, Artificial Sequence
  Synthetic oligonucleotide; TTT chr11 5207396 5207417 5207413 5207418 +
gctttctctatgcaggtgtcat

SEQ ID NO: 80769 - DNA, 22 bp, Artificial Sequence
  Synthetic oligonucleotide; TTG chr11 5207397 5207418 5207414 5207419 +
ctttctctatgcaggtgtcatc

SEQ ID NO: 80770 - DNA, 22 bp, Artificial Sequence
  Synthetic oligonucleotide; CTT chr11 5207400 5207421 5207417 5207422 +
tctctatgcaggtgtcatctat

SEQ ID NO: 80771 - DNA, 22 bp, Artificial Sequence
  Synthetic oligonucleotide; TTT chr11 5207401 5207422 5207418 5207423 +
ctctatgcaggtgtcatctatt

SEQ ID NO: 80772 - DNA, 22 bp, Artificial Sequence
  Synthetic oligonucleotide; TTC chr11 5207402 5207423 5207419 5207424 +
tctatgcaggtgtcatctattg

SEQ ID NO: 80773 - DNA, 22 bp, Artificial Sequence
  Synthetic oligonucleotide; CTC chr11 5207404 5207425 5207421 5207426 +
tatgcaggtgtcatctattgtg

SEQ ID NO: 80774 - DNA, 22 bp, Artificial Sequence
  Synthetic oligonucleotide; CTA chr11 5207406 5207427 5207423 5207428 +
tgcaggtgtcatctattgtgat

SEQ ID NO: 80775 - DNA, 22 bp, Artificial Sequence
  Synthetic oligonucleotide; CTA chr11 5207421 5207442 5207438 5207443 +
ttgtgatatagtgccaggaggt

SEQ ID NO: 80776 - DNA, 22 bp, Artificial Sequence
  Synthetic oligonucleotide; TTG chr11 5207424 5207445 5207441 5207446 +
tgatatagtgccaggaggttgc

SEQ ID NO: 80777 - DNA, 22 bp, Artificial Sequence
  Synthetic oligonucleotide; TTG chr11 5207445 5207466 5207462 5207467 +
cctttgctgtggctttcgaccc

SEQ ID NO: 80778 - DNA, 22 bp, Artificial Sequence
  Synthetic oligonucleotide; CTT chr11 5207449 5207470 5207466 5207471 +
tgctgtggctttcgaccctaga

SEQ ID NO: 80779 - DNA, 22 bp, Artificial Sequence
  Synthetic oligonucleotide; TTT chr11 5207450 5207471 5207467 5207472 +
gctgtggctttcgaccctagat

SEQ ID NO: 80780 - DNA, 22 bp, Artificial Sequence
  Synthetic oligonucleotide; TTG chr11 5207451 5207472 5207468 5207473 +
ctgtggctttcgaccctagatt

SEQ ID NO: 80781 - DNA, 22 bp, Artificial Sequence
  Synthetic oligonucleotide; CTG chr11 5207454 5207475 5207471 5207476 +
tggctttcgaccctagattttt

SEQ ID NO: 80782 - DNA, 22 bp, Artificial Sequence
  Synthetic oligonucleotide; CTT chr11 5207460 5207481 5207477 5207482 +
tcgaccctagatttttaaattg

SEQ ID NO: 80783 - DNA, 22 bp, Artificial Sequence
  Synthetic oligonucleotide; TTT chr11 5207461 5207482 5207478 5207483 +
cgaccctagatttttaaattgt

SEQ ID NO: 80784 - DNA, 22 bp, Artificial Sequence
  Synthetic oligonucleotide; TTC chr11 5207462 5207483 5207479 5207484 +
gaccctagatttttaaattgtg

SEQ ID NO: 80785 - DNA, 22 bp, Artificial Sequence
  Synthetic oligonucleotide; CTA chr11 5207469 5207490 5207486 5207491 +
gatttttaaattgtgtgacaaa

SEQ ID NO: 80786 - DNA, 22 bp, Artificial Sequence
  Synthetic oligonucleotide; TTT chr11 5207474 5207495 5207491 5207496 +
ttaaattgtgtgacaaacccat

SEQ ID NO: 80787 - DNA, 22 bp, Artificial Sequence
  Synthetic oligonucleotide; TTT chr11 5207475 5207496 5207492 5207497 +
taaattgtgtgacaaacccatc

SEQ ID NO: 80788 - DNA, 22 bp, Artificial Sequence
  Synthetic oligonucleotide; TTT chr11 5207476 5207497 5207493 5207498 +
aaattgtgtgacaaacccatct

SEQ ID NO: 80789 - DNA, 22 bp, Artificial Sequence
  Synthetic oligonucleotide; TTA chr11 5207477 5207498 5207494 5207499 +
aattgtgtgacaaacccatctt

SEQ ID NO: 80790 - DNA, 22 bp, Artificial Sequence
  Synthetic oligonucleotide; TTG chr11 5207482 5207503 5207499 5207504 +
tgtgacaaacccatcttttatt

SEQ ID NO: 80791 - DNA, 22 bp, Artificial Sequence
  Synthetic oligonucleotide; CTT chr11 5207499 5207520 5207516 5207521 +
ttatttatgtaaataaaatgtc

SEQ ID NO: 80792 - DNA, 22 bp, Artificial Sequence
  Synthetic oligonucleotide; TTT chr11 5207500 5207521 5207517 5207522 +
tatttatgtaaataaaatgtcc

SEQ ID NO: 80793 - DNA, 22 bp, Artificial Sequence
  Synthetic oligonucleotide; TTT chr11 5207501 5207522 5207518 5207523 +
atttatgtaaataaaatgtccg

SEQ ID NO: 80794 - DNA, 22 bp, Artificial Sequence
  Synthetic oligonucleotide; TTA chr11 5207502 5207523 5207519 5207524 +
tttatgtaaataaaatgtccgt

SEQ ID NO: 80795 - DNA, 22 bp, Artificial Sequence
  Synthetic oligonucleotide; TTT chr11 5207505 5207526 5207522 5207527 +
atgtaaataaaatgtccgtgtt

SEQ ID NO: 80796 - DNA, 22 bp, Artificial Sequence
  Synthetic oligonucleotide; TTA chr11 5207506 5207527 5207523 5207528 +
tgtaaataaaatgtccgtgttt

SEQ ID NO: 80797 - DNA, 22 bp, Artificial Sequence
  Synthetic oligonucleotide; TTT chr11 5207528 5207549 5207545 5207550 +
attggttattgttatattgtga

SEQ ID NO: 80798 - DNA, 22 bp, Artificial Sequence
  Synthetic oligonucleotide; TTA chr11 5207529 5207550 5207546 5207551 +
ttggttattgttatattgtgaa

SEQ ID NO: 80799 - DNA, 22 bp, Artificial Sequence
  Synthetic oligonucleotide; TTG chr11 5207532 5207553 5207549 5207554 +
gttattgttatattgtgaaatt

SEQ ID NO: 80800 - DNA, 22 bp, Artificial Sequence
  Synthetic oligonucleotide; TTA chr11 5207536 5207557 5207553 5207558 +
ttgttatattgtgaaattgtag

SEQ ID NO: 80801 - DNA, 22 bp, Artificial Sequence
  Synthetic oligonucleotide; TTG chr11 5207539 5207560 5207556 5207561 +
ttatattgtgaaattgtagtag

SEQ ID NO: 80802 - DNA, 22 bp, Artificial Sequence
  Synthetic oligonucleotide; TTA chr11 5207542 5207563 5207559 5207564 +
tattgtgaaattgtagtagatc

SEQ ID NO: 80803 - DNA, 22 bp, Artificial Sequence
  Synthetic oligonucleotide; TTG chr11 5207547 5207568 5207564 5207569 +
tgaaattgtagtagatctaaaa

SEQ ID NO: 80804 - DNA, 22 bp, Artificial Sequence
  Synthetic oligonucleotide; TTG chr11 5207555 5207576 5207572 5207577 +
tagtagatctaaaattgtaatt

SEQ ID NO: 80805 - DNA, 22 bp, Artificial Sequence
  Synthetic oligonucleotide; CTA chr11 5207566 5207587 5207583 5207588 +
aaattgtaatttcttggattcc

SEQ ID NO: 80806 - DNA, 22 bp, Artificial Sequence
  Synthetic oligonucleotide; TTG chr11 5207572 5207593 5207589 5207594 +
taatttcttggattcctagaat

SEQ ID NO: 80807 - DNA, 22 bp, Artificial Sequence
  Synthetic oligonucleotide; TTT chr11 5207578 5207599 5207595 5207600 +
cttggattcctagaatttctaa

SEQ ID NO: 80808 - DNA, 22 bp, Artificial Sequence
  Synthetic oligonucleotide; TTC chr11 5207579 5207600 5207596 5207601 +
ttggattcctagaatttctaaa

SEQ ID NO: 80809 - DNA, 22 bp, Artificial Sequence
  Synthetic oligonucleotide; CTT chr11 5207581 5207602 5207598 5207603 +
ggattcctagaatttctaaatc

SEQ ID NO: 80810 - DNA, 22 bp, Artificial Sequence
  Synthetic oligonucleotide; TTG chr11 5207582 5207603 5207599 5207604 +
gattcctagaatttctaaatct

SEQ ID NO: 80811 - DNA, 22 bp, Artificial Sequence
  Synthetic oligonucleotide; TTC chr11 5207587 5207608 5207604 5207609 +
ctagaatttctaaatctgtgga

SEQ ID NO: 80812 - DNA, 22 bp, Artificial Sequence
  Synthetic oligonucleotide; CTA chr11 5207590 5207611 5207607 5207612 +
gaatttctaaatctgtggattt

SEQ ID NO: 80813 - DNA, 22 bp, Artificial Sequence
  Synthetic oligonucleotide; TTT chr11 5207596 5207617 5207613 5207618 +
ctaaatctgtggatttttagaa

SEQ ID NO: 80814 - DNA, 22 bp, Artificial Sequence
  Synthetic oligonucleotide; TTC chr11 5207597 5207618 5207614 5207619 +
taaatctgtggatttttagaat

SEQ ID NO: 80815 - DNA, 22 bp, Artificial Sequence
  Synthetic oligonucleotide; CTA chr11 5207599 5207620 5207616 5207621 +
aatctgtggatttttagaattc

SEQ ID NO: 80816 - DNA, 22 bp, Artificial Sequence
  Synthetic oligonucleotide; CTG chr11 5207605 5207626 5207622 5207627 +
tggatttttagaattctctaga

SEQ ID NO: 80817 - DNA, 22 bp, Artificial Sequence
  Synthetic oligonucleotide; TTT chr11 5207612 5207633 5207629 5207634 +
ttagaattctctagaggtgaca

SEQ ID NO: 80818 - DNA, 22 bp, Artificial Sequence
  Synthetic oligonucleotide; TTT chr11 5207613 5207634 5207630 5207635 +
tagaattctctagaggtgacaa

SEQ ID NO: 80819 - DNA, 22 bp, Artificial Sequence
  Synthetic oligonucleotide; TTT chr11 5207614 5207635 5207631 5207636 +
agaattctctagaggtgacaaa

SEQ ID NO: 80820 - DNA, 22 bp, Artificial Sequence
  Synthetic oligonucleotide; TTA chr11 5207615 5207636 5207632 5207637 +
gaattctctagaggtgacaaag

SEQ ID NO: 80821 - DNA, 22 bp, Artificial Sequence
  Synthetic oligonucleotide; TTC chr11 5207621 5207642 5207638 5207643 +
tctagaggtgacaaaggtttat

SEQ ID NO: 80822 - DNA, 22 bp, Artificial Sequence
  Synthetic oligonucleotide; CTC chr11 5207623 5207644 5207640 5207645 +
tagaggtgacaaaggtttatta

SEQ ID NO: 80823 - DNA, 22 bp, Artificial Sequence
  Synthetic oligonucleotide; CTA chr11 5207625 5207646 5207642 5207647 +
gaggtgacaaaggtttattatc

SEQ ID NO: 80824 - DNA, 22 bp, Artificial Sequence
  Synthetic oligonucleotide; TTT chr11 5207641 5207662 5207658 5207663 +
attatctaagctaccggagcta

SEQ ID NO: 80825 - DNA, 22 bp, Artificial Sequence
  Synthetic oligonucleotide; TTA chr11 5207642 5207663 5207659 5207664 +
ttatctaagctaccggagctat

SEQ ID NO: 80826 - DNA, 22 bp, Artificial Sequence
  Synthetic oligonucleotide; TTA chr11 5207645 5207666 5207662 5207667 +
tctaagctaccggagctatgta

SEQ ID NO: 80827 - DNA, 22 bp, Artificial Sequence
  Synthetic oligonucleotide; CTA chr11 5207649 5207670 5207666 5207671 +
agctaccggagctatgtacttt

SEQ ID NO: 80828 - DNA, 22 bp, Artificial Sequence
  Synthetic oligonucleotide; CTA chr11 5207654 5207675 5207671 5207676 +
ccggagctatgtacttttggat

SEQ ID NO: 80829 - DNA, 22 bp, Artificial Sequence
  Synthetic oligonucleotide; CTA chr11 5207663 5207684 5207680 5207685 +
tgtacttttggatataagagtg

SEQ ID NO: 80830 - DNA, 22 bp, Artificial Sequence
  Synthetic oligonucleotide; CTT chr11 5207670 5207691 5207687 5207692 +
ttggatataagagtgtctccat

SEQ ID NO: 80831 - DNA, 22 bp, Artificial Sequence
  Synthetic oligonucleotide; TTT chr11 5207671 5207692 5207688 5207693 +
tggatataagagtgtctccatc

SEQ ID NO: 80832 - DNA, 22 bp, Artificial Sequence
  Synthetic oligonucleotide; TTT chr11 5207672 5207693 5207689 5207694 +
ggatataagagtgtctccatct

SEQ ID NO: 80833 - DNA, 22 bp, Artificial Sequence
  Synthetic oligonucleotide; TTG chr11 5207673 5207694 5207690 5207695 +
gatataagagtgtctccatctc

SEQ ID NO: 80834 - DNA, 22 bp, Artificial Sequence
  Synthetic oligonucleotide; CTC chr11 5207689 5207710 5207706 5207711 +
catctccattgccttacaaatc

SEQ ID NO: 80835 - DNA, 22 bp, Artificial Sequence
  Synthetic oligonucleotide; CTC chr11 5207695 5207716 5207712 5207717 +
cattgccttacaaatcaggtgt

SEQ ID NO: 80836 - DNA, 22 bp, Artificial Sequence
  Synthetic oligonucleotide; TTG chr11 5207700 5207721 5207717 5207722 +
ccttacaaatcaggtgtgagcc

SEQ ID NO: 80837 - DNA, 22 bp, Artificial Sequence
  Synthetic oligonucleotide; CTT chr11 5207704 5207725 5207721 5207726 +
acaaatcaggtgtgagccaggc

SEQ ID NO: 80838 - DNA, 22 bp, Artificial Sequence
  Synthetic oligonucleotide; TTA chr11 5207705 5207726 5207722 5207727 +
caaatcaggtgtgagccaggca

SEQ ID NO: 80839 - DNA, 22 bp, Artificial Sequence
  Synthetic oligonucleotide; CTC chr11 5207733 5207754 5207750 5207755 +
tcagactggaaaaggtaactaa

SEQ ID NO: 80840 - DNA, 22 bp, Artificial Sequence
  Synthetic oligonucleotide; CTC chr11 5207735 5207756 5207752 5207757 +
agactggaaaaggtaactaatc

SEQ ID NO: 80841 - DNA, 22 bp, Artificial Sequence
  Synthetic oligonucleotide; CTG chr11 5207741 5207762 5207758 5207763 +
gaaaaggtaactaatcagaagg

SEQ ID NO: 80842 - DNA, 22 bp, Artificial Sequence
  Synthetic oligonucleotide; CTA chr11 5207754 5207775 5207771 5207776 +
atcagaaggaaccattgtccta

SEQ ID NO: 80843 - DNA, 22 bp, Artificial Sequence
  Synthetic oligonucleotide; TTG chr11 5207771 5207792 5207788 5207793 +
tcctagaatggggcaagtgtac

SEQ ID NO: 80844 - DNA, 22 bp, Artificial Sequence
  Synthetic oligonucleotide; CTA chr11 5207776 5207797 5207793 5207798 +
gaatggggcaagtgtacaatac

SEQ ID NO: 80845 - DNA, 22 bp, Artificial Sequence
  Synthetic oligonucleotide; CTG chr11 5207813 5207834 5207830 5207835 +
gtgccgtagcatataacatatt

SEQ ID NO: 80846 - DNA, 22 bp, Artificial Sequence
  Synthetic oligonucleotide; TTC chr11 5207836 5207857 5207853 5207858 +
actcaatccttcataccctttg

SEQ ID NO: 80847 - DNA, 22 bp, Artificial Sequence
  Synthetic oligonucleotide; CTC chr11 5207840 5207861 5207857 5207862 +
aatccttcataccctttgtatc

SEQ ID NO: 80848 - DNA, 22 bp, Artificial Sequence
  Synthetic oligonucleotide; CTT chr11 5207847 5207868 5207864 5207869 +
cataccctttgtatcgtttttt

SEQ ID NO: 80849 - DNA, 22 bp, Artificial Sequence
  Synthetic oligonucleotide; TTC chr11 5207848 5207869 5207865 5207870 +
ataccctttgtatcgttttttt

SEQ ID NO: 80850 - DNA, 22 bp, Artificial Sequence
  Synthetic oligonucleotide; CTT chr11 5207856 5207877 5207873 5207878 +
tgtatcgttttttttctgtttt

SEQ ID NO: 80851 - DNA, 22 bp, Artificial Sequence
  Synthetic oligonucleotide; TTT chr11 5207857 5207878 5207874 5207879 +
gtatcgttttttttctgtttta

SEQ ID NO: 80852 - DNA, 22 bp, Artificial Sequence
  Synthetic oligonucleotide; TTG chr11 5207858 5207879 5207875 5207880 +
tatcgttttttttctgttttat

SEQ ID NO: 80853 - DNA, 22 bp, Artificial Sequence
  Synthetic oligonucleotide; TTT chr11 5207866 5207887 5207883 5207888 +
tttttctgttttatttatttta

SEQ ID NO: 80854 - DNA, 22 bp, Artificial Sequence
  Synthetic oligonucleotide; TTT chr11 5207867 5207888 5207884 5207889 +
ttttctgttttatttattttat

SEQ ID NO: 80855 - DNA, 22 bp, Artificial Sequence
  Synthetic oligonucleotide; TTT chr11 5207868 5207889 5207885 5207890 +
tttctgttttatttattttatt

SEQ ID NO: 80856 - DNA, 22 bp, Artificial Sequence
  Synthetic oligonucleotide; TTT chr11 5207869 5207890 5207886 5207891 +
ttctgttttatttattttattt

SEQ ID NO: 80857 - DNA, 22 bp, Artificial Sequence
  Synthetic oligonucleotide; TTT chr11 5207870 5207891 5207887 5207892 +
tctgttttatttattttattta

SEQ ID NO: 80858 - DNA, 22 bp, Artificial Sequence
  Synthetic oligonucleotide; TTT chr11 5207871 5207892 5207888 5207893 +
ctgttttatttattttatttat

SEQ ID NO: 80859 - DNA, 22 bp, Artificial Sequence
  Synthetic oligonucleotide; TTC chr11 5207872 5207893 5207889 5207894 +
tgttttatttattttatttatt

SEQ ID NO: 80860 - DNA, 22 bp, Artificial Sequence
  Synthetic oligonucleotide; CTG chr11 5207874 5207895 5207891 5207896 +
ttttatttattttatttattta

SEQ ID NO: 80861 - DNA, 22 bp, Artificial Sequence
  Synthetic oligonucleotide; TTT chr11 5207877 5207898 5207894 5207899 +
tatttattttatttatttatta

SEQ ID NO: 80862 - DNA, 22 bp, Artificial Sequence
  Synthetic oligonucleotide; TTT chr11 5207878 5207899 5207895 5207900 +
atttattttatttatttattag

SEQ ID NO: 80863 - DNA, 22 bp, Artificial Sequence
  Synthetic oligonucleotide; TTA chr11 5207879 5207900 5207896 5207901 +
tttattttatttatttattaga

SEQ ID NO: 80864 - DNA, 22 bp, Artificial Sequence
  Synthetic oligonucleotide; TTT chr11 5207882 5207903 5207899 5207904 +
attttatttatttattagagat

SEQ ID NO: 80865 - DNA, 22 bp, Artificial Sequence
  Synthetic oligonucleotide; TTA chr11 5207883 5207904 5207900 5207905 +
ttttatttatttattagagatc

SEQ ID NO: 80866 - DNA, 22 bp, Artificial Sequence
  Synthetic oligonucleotide; TTT chr11 5207886 5207907 5207903 5207908 +
tatttatttattagagatcata

SEQ ID NO: 80867 - DNA, 22 bp, Artificial Sequence
  Synthetic oligonucleotide; TTT chr11 5207887 5207908 5207904 5207909 +
atttatttattagagatcatag

SEQ ID NO: 80868 - DNA, 22 bp, Artificial Sequence
  Synthetic oligonucleotide; TTA chr11 5207888 5207909 5207905 5207910 +
tttatttattagagatcatagt

SEQ ID NO: 80869 - DNA, 22 bp, Artificial Sequence
  Synthetic oligonucleotide; TTT chr11 5207891 5207912 5207908 5207913 +
atttattagagatcatagtgtg

SEQ ID NO: 80870 - DNA, 22 bp, Artificial Sequence
  Synthetic oligonucleotide; TTA chr11 5207892 5207913 5207909 5207914 +
tttattagagatcatagtgtgt

SEQ ID NO: 80871 - DNA, 22 bp, Artificial Sequence
  Synthetic oligonucleotide; TTT chr11 5207895 5207916 5207912 5207917 +
attagagatcatagtgtgtgca

SEQ ID NO: 80872 - DNA, 22 bp, Artificial Sequence
  Synthetic oligonucleotide; TTA chr11 5207896 5207917 5207913 5207918 +
ttagagatcatagtgtgtgcaa

SEQ ID NO: 80873 - DNA, 22 bp, Artificial Sequence
  Synthetic oligonucleotide; TTA chr11 5207899 5207920 5207916 5207921 +
gagatcatagtgtgtgcaacac

SEQ ID NO: 80874 - DNA, 22 bp, Artificial Sequence
  Synthetic oligonucleotide; CTA chr11 5207924 5207945 5207941 5207946 +
tgtccaggttctgtggtaaacg

SEQ ID NO: 80875 - DNA, 22 bp, Artificial Sequence
  Synthetic oligonucleotide; TTC chr11 5207935 5207956 5207952 5207957 +
tgtggtaaacgtcagcgtggag

SEQ ID NO: 80876 - DNA, 22 bp, Artificial Sequence
  Synthetic oligonucleotide; CTG chr11 5207937 5207958 5207954 5207959 +
tggtaaacgtcagcgtggagaa

SEQ ID NO: 80877 - DNA, 22 bp, Artificial Sequence
  Synthetic oligonucleotide; TTA chr11 5207963 5207984 5207980 5207985 +
gtagctattagatcataaaaag

SEQ ID NO: 80878 - DNA, 22 bp, Artificial Sequence
  Synthetic oligonucleotide; CTA chr11 5207970 5207991 5207987 5207992 +
ttagatcataaaaaggtgaggc

SEQ ID NO: 80879 - DNA, 22 bp, Artificial Sequence
  Synthetic oligonucleotide; TTA chr11 5207973 5207994 5207990 5207995 +
gatcataaaaaggtgaggcata

SEQ ID NO: 80880 - DNA, 22 bp, Artificial Sequence
  Synthetic oligonucleotide; TTT chr11 5208004 5208025 5208021 5208026 +
gtctttgagaagctgactgtgg

SEQ ID NO: 80881 - DNA, 22 bp, Artificial Sequence
  Synthetic oligonucleotide; TTG chr11 5208005 5208026 5208022 5208027 +
tctttgagaagctgactgtggc

SEQ ID NO: 80882 - DNA, 22 bp, Artificial Sequence
  Synthetic oligonucleotide; CTT chr11 5208009 5208030 5208026 5208031 +
tgagaagctgactgtggctata

SEQ ID NO: 80883 - DNA, 22 bp, Artificial Sequence
  Synthetic oligonucleotide; TTT chr11 5208010 5208031 5208027 5208032 +
gagaagctgactgtggctatag

SEQ ID NO: 80884 - DNA, 22 bp, Artificial Sequence
  Synthetic oligonucleotide; TTG chr11 5208011 5208032 5208028 5208033 +
agaagctgactgtggctatagg

SEQ ID NO: 80885 - DNA, 22 bp, Artificial Sequence
  Synthetic oligonucleotide; CTG chr11 5208019 5208040 5208036 5208041 +
actgtggctataggtgaagaaa

SEQ ID NO: 80886 - DNA, 22 bp, Artificial Sequence
  Synthetic oligonucleotide; CTG chr11 5208023 5208044 5208040 5208045 +
tggctataggtgaagaaaaaaa

SEQ ID NO: 80887 - DNA, 22 bp, Artificial Sequence
  Synthetic oligonucleotide; CTA chr11 5208029 5208050 5208046 5208051 +
taggtgaagaaaaaaattataa

SEQ ID NO: 80888 - DNA, 22 bp, Artificial Sequence
  Synthetic oligonucleotide; TTA chr11 5208048 5208069 5208065 5208070 +
taattttagttttattattaat

SEQ ID NO: 80889 - DNA, 22 bp, Artificial Sequence
  Synthetic oligonucleotide; TTT chr11 5208054 5208075 5208071 5208076 +
tagttttattattaatatcacc

SEQ ID NO: 80890 - DNA, 22 bp, Artificial Sequence
  Synthetic oligonucleotide; TTT chr11 5208055 5208076 5208072 5208077 +
agttttattattaatatcacca

SEQ ID NO: 80891 - DNA, 22 bp, Artificial Sequence
  Synthetic oligonucleotide; TTA chr11 5208056 5208077 5208073 5208078 +
gttttattattaatatcaccat

SEQ ID NO: 80892 - DNA, 22 bp, Artificial Sequence
  Synthetic oligonucleotide; TTT chr11 5208060 5208081 5208077 5208082 +
tattattaatatcaccatgatc

SEQ ID NO: 80893 - DNA, 22 bp, Artificial Sequence
  Synthetic oligonucleotide; TTT chr11 5208061 5208082 5208078 5208083 +
attattaatatcaccatgatca

SEQ ID NO: 80894 - DNA, 22 bp, Artificial Sequence
  Synthetic oligonucleotide; TTA chr11 5208062 5208083 5208079 5208084 +
ttattaatatcaccatgatcat

SEQ ID NO: 80895 - DNA, 22 bp, Artificial Sequence
  Synthetic oligonucleotide; TTA chr11 5208065 5208086 5208082 5208087 +
ttaatatcaccatgatcatcat

SEQ ID NO: 80896 - DNA, 22 bp, Artificial Sequence
  Synthetic oligonucleotide; TTA chr11 5208068 5208089 5208085 5208090 +
atatcaccatgatcatcatgat

SEQ ID NO: 80897 - DNA, 22 bp, Artificial Sequence
  Synthetic oligonucleotide; TTA chr11 5208099 5208120 5208116 5208121 +
atatttactgggaacttatttg

SEQ ID NO: 80898 - DNA, 22 bp, Artificial Sequence
  Synthetic oligonucleotide; TTT chr11 5208105 5208126 5208122 5208127 +
actgggaacttatttggtttgt

SEQ ID NO: 80899 - DNA, 22 bp, Artificial Sequence
  Synthetic oligonucleotide; TTA chr11 5208106 5208127 5208123 5208128 +
ctgggaacttatttggtttgtc

SEQ ID NO: 80900 - DNA, 22 bp, Artificial Sequence
  Synthetic oligonucleotide; CTG chr11 5208109 5208130 5208126 5208131 +
ggaacttatttggtttgtcatt

SEQ ID NO: 80901 - DNA, 22 bp, Artificial Sequence
  Synthetic oligonucleotide; CTT chr11 5208116 5208137 5208133 5208138 +
atttggtttgtcatttttcgaa

SEQ ID NO: 80902 - DNA, 22 bp, Artificial Sequence
  Synthetic oligonucleotide; TTA chr11 5208117 5208138 5208134 5208139 +
tttggtttgtcatttttcgaag

SEQ ID NO: 80903 - DNA, 22 bp, Artificial Sequence
  Synthetic oligonucleotide; TTT chr11 5208120 5208141 5208137 5208142 +
ggtttgtcatttttcgaaggaa

SEQ ID NO: 80904 - DNA, 22 bp, Artificial Sequence
  Synthetic oligonucleotide; TTG chr11 5208121 5208142 5208138 5208143 +
gtttgtcatttttcgaaggaat

SEQ ID NO: 80905 - DNA, 22 bp, Artificial Sequence
  Synthetic oligonucleotide; TTT chr11 5208125 5208146 5208142 5208147 +
gtcatttttcgaaggaatttat

SEQ ID NO: 80906 - DNA, 22 bp, Artificial Sequence
  Synthetic oligonucleotide; TTG chr11 5208126 5208147 5208143 5208148 +
tcatttttcgaaggaatttatg

SEQ ID NO: 80907 - DNA, 22 bp, Artificial Sequence
  Synthetic oligonucleotide; TTT chr11 5208132 5208153 5208149 5208154 +
ttcgaaggaatttatgttaatt

SEQ ID NO: 80908 - DNA, 22 bp, Artificial Sequence
  Synthetic oligonucleotide; TTT chr11 5208133 5208154 5208150 5208155 +
tcgaaggaatttatgttaattt

SEQ ID NO: 80909 - DNA, 22 bp, Artificial Sequence
  Synthetic oligonucleotide; TTT chr11 5208134 5208155 5208151 5208156 +
cgaaggaatttatgttaattta

SEQ ID NO: 80910 - DNA, 22 bp, Artificial Sequence
  Synthetic oligonucleotide; TTC chr11 5208135 5208156 5208152 5208157 +
gaaggaatttatgttaatttac

SEQ ID NO: 80911 - DNA, 22 bp, Artificial Sequence
  Synthetic oligonucleotide; TTT chr11 5208145 5208166 5208162 5208167 +
atgttaatttactcactataag

SEQ ID NO: 80912 - DNA, 22 bp, Artificial Sequence
  Synthetic oligonucleotide; TTA chr11 5208146 5208167 5208163 5208168 +
tgttaatttactcactataaga

SEQ ID NO: 80913 - DNA, 22 bp, Artificial Sequence
  Synthetic oligonucleotide; TTA chr11 5208151 5208172 5208168 5208173 +
atttactcactataagaaattt

SEQ ID NO: 80914 - DNA, 22 bp, Artificial Sequence
  Synthetic oligonucleotide; TTT chr11 5208155 5208176 5208172 5208177 +
actcactataagaaatttataa

SEQ ID NO: 80915 - DNA, 22 bp, Artificial Sequence
  Synthetic oligonucleotide; TTA chr11 5208156 5208177 5208173 5208178 +
ctcactataagaaatttataaa

SEQ ID NO: 80916 - DNA, 22 bp, Artificial Sequence
  Synthetic oligonucleotide; CTC chr11 5208159 5208180 5208176 5208181 +
actataagaaatttataaagta

SEQ ID NO: 80917 - DNA, 22 bp, Artificial Sequence
  Synthetic oligonucleotide; CTA chr11 5208163 5208184 5208180 5208185 +
taagaaatttataaagtagatt

SEQ ID NO: 80918 - DNA, 22 bp, Artificial Sequence
  Synthetic oligonucleotide; TTT chr11 5208173 5208194 5208190 5208195 +
ataaagtagattccattatagc

SEQ ID NO: 80919 - DNA, 22 bp, Artificial Sequence
  Synthetic oligonucleotide; TTA chr11 5208174 5208195 5208191 5208196 +
taaagtagattccattatagct

SEQ ID NO: 80920 - DNA, 22 bp, Artificial Sequence
  Synthetic oligonucleotide; TTC chr11 5208186 5208207 5208203 5208208 +
cattatagctcttaatttatta

SEQ ID NO: 80921 - DNA, 22 bp, Artificial Sequence
  Synthetic oligonucleotide; TTA chr11 5208191 5208212 5208208 5208213 +
tagctcttaatttattattgag

SEQ ID NO: 80922 - DNA, 22 bp, Artificial Sequence
  Synthetic oligonucleotide; CTC chr11 5208197 5208218 5208214 5208219 +
ttaatttattattgaggaatgt

SEQ ID NO: 80923 - DNA, 22 bp, Artificial Sequence
  Synthetic oligonucleotide; CTT chr11 5208199 5208220 5208216 5208221 +
aatttattattgaggaatgtaa

SEQ ID NO: 80924 - DNA, 22 bp, Artificial Sequence
  Synthetic oligonucleotide; TTA chr11 5208200 5208221 5208217 5208222 +
atttattattgaggaatgtaag

SEQ ID NO: 80925 - DNA, 22 bp, Artificial Sequence
  Synthetic oligonucleotide; TTT chr11 5208204 5208225 5208221 5208226 +
attattgaggaatgtaaggcat

SEQ ID NO: 80926 - DNA, 22 bp, Artificial Sequence
  Synthetic oligonucleotide; TTA chr11 5208205 5208226 5208222 5208227 +
ttattgaggaatgtaaggcata

SEQ ID NO: 80927 - DNA, 22 bp, Artificial Sequence
  Synthetic oligonucleotide; TTA chr11 5208208 5208229 5208225 5208230 +
ttgaggaatgtaaggcatagag

SEQ ID NO: 80928 - DNA, 22 bp, Artificial Sequence
  Synthetic oligonucleotide; TTG chr11 5208211 5208232 5208228 5208233 +
aggaatgtaaggcatagagaag

SEQ ID NO: 80929 - DNA, 22 bp, Artificial Sequence
  Synthetic oligonucleotide; CTT chr11 5208239 5208260 5208256 5208261 +
atcctcaaaacaaagctattaa

SEQ ID NO: 80930 - DNA, 22 bp, Artificial Sequence
  Synthetic oligonucleotide; TTA chr11 5208240 5208261 5208257 5208262 +
tcctcaaaacaaagctattaac

SEQ ID NO: 80931 - DNA, 22 bp, Artificial Sequence
  Synthetic oligonucleotide; CTC chr11 5208245 5208266 5208262 5208267 +
aaaacaaagctattaacttatg

SEQ ID NO: 80932 - DNA, 22 bp, Artificial Sequence
  Synthetic oligonucleotide; CTA chr11 5208257 5208278 5208274 5208279 +
ttaacttatggacctgagagta

SEQ ID NO: 80933 - DNA, 22 bp, Artificial Sequence
  Synthetic oligonucleotide; TTA chr11 5208260 5208281 5208277 5208282 +
acttatggacctgagagtagag

SEQ ID NO: 80934 - DNA, 22 bp, Artificial Sequence
  Synthetic oligonucleotide; CTT chr11 5208264 5208285 5208281 5208286 +
atggacctgagagtagagcccg

SEQ ID NO: 80935 - DNA, 22 bp, Artificial Sequence
  Synthetic oligonucleotide; TTA chr11 5208265 5208286 5208282 5208287 +
tggacctgagagtagagcccgg

SEQ ID NO: 80936 - DNA, 22 bp, Artificial Sequence
  Synthetic oligonucleotide; CTG chr11 5208273 5208294 5208290 5208295 +
agagtagagcccgggctgtctc

SEQ ID NO: 80937 - DNA, 22 bp, Artificial Sequence
  Synthetic oligonucleotide; CTG chr11 5208291 5208312 5208308 5208313 +
tctcatgccagaacctattatc

SEQ ID NO: 80938 - DNA, 22 bp, Artificial Sequence
  Synthetic oligonucleotide; CTC chr11 5208295 5208316 5208312 5208317 +
atgccagaacctattatcccat

SEQ ID NO: 80939 - DNA, 22 bp, Artificial Sequence
  Synthetic oligonucleotide; CTA chr11 5208308 5208329 5208325 5208330 +
ttatcccatgttgcaagacaca

SEQ ID NO: 80940 - DNA, 22 bp, Artificial Sequence
  Synthetic oligonucleotide; TTA chr11 5208311 5208332 5208328 5208333 +
tcccatgttgcaagacacaaat

SEQ ID NO: 80941 - DNA, 22 bp, Artificial Sequence
  Synthetic oligonucleotide; TTG chr11 5208321 5208342 5208338 5208343 +
caagacacaaataggaaaatag

SEQ ID NO: 80942 - DNA, 22 bp, Artificial Sequence
  Synthetic oligonucleotide; TTA chr11 5208352 5208373 5208369 5208374 +
gaagttattgaagggcatgaaa

SEQ ID NO: 80943 - DNA, 22 bp, Artificial Sequence
  Synthetic oligonucleotide; TTA chr11 5208359 5208380 5208376 5208381 +
ttgaagggcatgaaataatagt

SEQ ID NO: 80944 - DNA, 22 bp, Artificial Sequence
  Synthetic oligonucleotide; TTG chr11 5208362 5208383 5208379 5208384 +
aagggcatgaaataatagtggt

SEQ ID NO: 80945 - DNA, 22 bp, Artificial Sequence
  Synthetic oligonucleotide; TTT chr11 5208386 5208407 5208403 5208408 +
gaaatttgagtagagtaggacc

SEQ ID NO: 80946 - DNA, 22 bp, Artificial Sequence
  Synthetic oligonucleotide; TTG chr11 5208387 5208408 5208404 5208409 +
aaatttgagtagagtaggacca

SEQ ID NO: 80947 - DNA, 22 bp, Artificial Sequence
  Synthetic oligonucleotide; TTT chr11 5208393 5208414 5208410 5208415 +
gagtagagtaggaccaagaaaa

SEQ ID NO: 80948 - DNA, 22 bp, Artificial Sequence
  Synthetic oligonucleotide; TTG chr11 5208394 5208415 5208411 5208416 +
agtagagtaggaccaagaaaat

SEQ ID NO: 80949 - DNA, 22 bp, Artificial Sequence
  Synthetic oligonucleotide; TTT chr11 5208424 5208445 5208441 5208446 +
cagggaatacctgagaggaaaa

SEQ ID NO: 80950 - DNA, 22 bp, Artificial Sequence
  Synthetic oligonucleotide; TTC chr11 5208425 5208446 5208442 5208447 +
agggaatacctgagaggaaaaa

SEQ ID NO: 80951 - DNA, 22 bp, Artificial Sequence
  Synthetic oligonucleotide; CTG chr11 5208437 5208458 5208454 5208459 +
agaggaaaaaaaaaaactatga

SEQ ID NO: 80952 - DNA, 22 bp, Artificial Sequence
  Synthetic oligonucleotide; CTA chr11 5208456 5208477 5208473 5208478 +
tgaaggaacgcagtaattagct

SEQ ID NO: 80953 - DNA, 22 bp, Artificial Sequence
  Synthetic oligonucleotide; TTA chr11 5208475 5208496 5208492 5208497 +
gctccttagctgaaagaatgat

SEQ ID NO: 80954 - DNA, 22 bp, Artificial Sequence
  Synthetic oligonucleotide; CTC chr11 5208479 5208500 5208496 5208501 +
cttagctgaaagaatgatcttc

SEQ ID NO: 80955 - DNA, 22 bp, Artificial Sequence
  Synthetic oligonucleotide; CTT chr11 5208482 5208503 5208499 5208504 +
agctgaaagaatgatcttctgg

SEQ ID NO: 80956 - DNA, 22 bp, Artificial Sequence
  Synthetic oligonucleotide; TTA chr11 5208483 5208504 5208500 5208505 +
gctgaaagaatgatcttctggt

SEQ ID NO: 80957 - DNA, 22 bp, Artificial Sequence
  Synthetic oligonucleotide; CTG chr11 5208487 5208508 5208504 5208509 +
aaagaatgatcttctggtcagt

SEQ ID NO: 80958 - DNA, 22 bp, Artificial Sequence
  Synthetic oligonucleotide; CTT chr11 5208500 5208521 5208517 5208522 +
ctggtcagtgagaactggtttc

SEQ ID NO: 80959 - DNA, 22 bp, Artificial Sequence
  Synthetic oligonucleotide; TTC chr11 5208501 5208522 5208518 5208523 +
tggtcagtgagaactggtttca

SEQ ID NO: 80960 - DNA, 22 bp, Artificial Sequence
  Synthetic oligonucleotide; CTG chr11 5208503 5208524 5208520 5208525 +
gtcagtgagaactggtttcaaa

SEQ ID NO: 80961 - DNA, 22 bp, Artificial Sequence
  Synthetic oligonucleotide; CTG chr11 5208517 5208538 5208534 5208539 +
gtttcaaatcttggttttgtca

SEQ ID NO: 80962 - DNA, 22 bp, Artificial Sequence
  Synthetic oligonucleotide; TTT chr11 5208521 5208542 5208538 5208543 +
caaatcttggttttgtcatttc

SEQ ID NO: 80963 - DNA, 22 bp, Artificial Sequence
  Synthetic oligonucleotide; TTC chr11 5208522 5208543 5208539 5208544 +
aaatcttggttttgtcatttct

SEQ ID NO: 80964 - DNA, 22 bp, Artificial Sequence
  Synthetic oligonucleotide; CTT chr11 5208529 5208550 5208546 5208551 +
ggttttgtcatttcttaggtat

SEQ ID NO: 80965 - DNA, 22 bp, Artificial Sequence
  Synthetic oligonucleotide; TTG chr11 5208530 5208551 5208547 5208552 +
gttttgtcatttcttaggtata

SEQ ID NO: 80966 - DNA, 22 bp, Artificial Sequence
  Synthetic oligonucleotide; TTT chr11 5208534 5208555 5208551 5208556 +
tgtcatttcttaggtatataat

SEQ ID NO: 80967 - DNA, 22 bp, Artificial Sequence
  Synthetic oligonucleotide; TTT chr11 5208535 5208556 5208552 5208557 +
gtcatttcttaggtatataatt

SEQ ID NO: 80968 - DNA, 22 bp, Artificial Sequence
  Synthetic oligonucleotide; TTG chr11 5208536 5208557 5208553 5208558 +
tcatttcttaggtatataattt

SEQ ID NO: 80969 - DNA, 22 bp, Artificial Sequence
  Synthetic oligonucleotide; TTT chr11 5208542 5208563 5208559 5208564 +
cttaggtatataatttttagct

SEQ ID NO: 80970 - DNA, 22 bp, Artificial Sequence
  Synthetic oligonucleotide; TTC chr11 5208543 5208564 5208560 5208565 +
ttaggtatataatttttagctc

SEQ ID NO: 80971 - DNA, 22 bp, Artificial Sequence
  Synthetic oligonucleotide; CTT chr11 5208545 5208566 5208562 5208567 +
aggtatataatttttagctcaa

SEQ ID NO: 80972 - DNA, 22 bp, Artificial Sequence
  Synthetic oligonucleotide; TTA chr11 5208546 5208567 5208563 5208568 +
ggtatataatttttagctcaac

SEQ ID NO: 80973 - DNA, 22 bp, Artificial Sequence
  Synthetic oligonucleotide; TTT chr11 5208558 5208579 5208575 5208580 +
ttagctcaacacttagctgcac

SEQ ID NO: 80974 - DNA, 22 bp, Artificial Sequence
  Synthetic oligonucleotide; TTT chr11 5208559 5208580 5208576 5208581 +
tagctcaacacttagctgcaca

SEQ ID NO: 80975 - DNA, 22 bp, Artificial Sequence
  Synthetic oligonucleotide; TTT chr11 5208560 5208581 5208577 5208582 +
agctcaacacttagctgcacaa

SEQ ID NO: 80976 - DNA, 22 bp, Artificial Sequence
  Synthetic oligonucleotide; TTA chr11 5208561 5208582 5208578 5208583 +
gctcaacacttagctgcacaat

SEQ ID NO: 80977 - DNA, 22 bp, Artificial Sequence
  Synthetic oligonucleotide; CTC chr11 5208565 5208586 5208582 5208587 +
aacacttagctgcacaattttt

SEQ ID NO: 80978 - DNA, 22 bp, Artificial Sequence
  Synthetic oligonucleotide; CTT chr11 5208572 5208593 5208589 5208594 +
agctgcacaatttttaaaaata

SEQ ID NO: 80979 - DNA, 22 bp, Artificial Sequence
  Synthetic oligonucleotide; TTA chr11 5208573 5208594 5208590 5208595 +
gctgcacaatttttaaaaatat

SEQ ID NO: 80980 - DNA, 22 bp, Artificial Sequence
  Synthetic oligonucleotide; CTG chr11 5208577 5208598 5208594 5208599 +
cacaatttttaaaaatattgtt

SEQ ID NO: 80981 - DNA, 22 bp, Artificial Sequence
  Synthetic oligonucleotide; TTT chr11 5208585 5208606 5208602 5208607 +
ttaaaaatattgttggtatgat

SEQ ID NO: 80982 - DNA, 22 bp, Artificial Sequence
  Synthetic oligonucleotide; TTT chr11 5208586 5208607 5208603 5208608 +
taaaaatattgttggtatgatg

SEQ ID NO: 80983 - DNA, 22 bp, Artificial Sequence
  Synthetic oligonucleotide; TTT chr11 5208587 5208608 5208604 5208609 +
aaaaatattgttggtatgatga

SEQ ID NO: 80984 - DNA, 22 bp, Artificial Sequence
  Synthetic oligonucleotide; TTA chr11 5208588 5208609 5208605 5208610 +
aaaatattgttggtatgatgat

SEQ ID NO: 80985 - DNA, 22 bp, Artificial Sequence
  Synthetic oligonucleotide; TTG chr11 5208597 5208618 5208614 5208619 +
ttggtatgatgataatatataa

SEQ ID NO: 80986 - DNA, 22 bp, Artificial Sequence
  Synthetic oligonucleotide; TTG chr11 5208600 5208621 5208617 5208622 +
gtatgatgataatatataaaaa

SEQ ID NO: 80987 - DNA, 22 bp, Artificial Sequence
  Synthetic oligonucleotide; CTC chr11 5208628 5208649 5208645 5208650 +
attatctgccactcaaaagcta

SEQ ID NO: 80988 - DNA, 22 bp, Artificial Sequence
  Synthetic oligonucleotide; TTA chr11 5208632 5208653 5208649 5208654 +
tctgccactcaaaagctatcag

SEQ ID NO: 80989 - DNA, 22 bp, Artificial Sequence
  Synthetic oligonucleotide; CTG chr11 5208636 5208657 5208653 5208658 +
ccactcaaaagctatcagtatt

SEQ ID NO: 80990 - DNA, 22 bp, Artificial Sequence
  Synthetic oligonucleotide; CTC chr11 5208642 5208663 5208659 5208664 +
aaaagctatcagtatttatgat

SEQ ID NO: 80991 - DNA, 22 bp, Artificial Sequence
  Synthetic oligonucleotide; CTA chr11 5208650 5208671 5208667 5208672 +
tcagtatttatgataataattc

SEQ ID NO: 80992 - DNA, 22 bp, Artificial Sequence
  Synthetic oligonucleotide; TTT chr11 5208659 5208680 5208676 5208681 +
atgataataattctagttgtga

SEQ ID NO: 80993 - DNA, 22 bp, Artificial Sequence
  Synthetic oligonucleotide; TTA chr11 5208660 5208681 5208677 5208682 +
tgataataattctagttgtgag

SEQ ID NO: 80994 - DNA, 22 bp, Artificial Sequence
  Synthetic oligonucleotide; TTC chr11 5208672 5208693 5208689 5208694 +
tagttgtgagaaattgattatt

SEQ ID NO: 80995 - DNA, 22 bp, Artificial Sequence
  Synthetic oligonucleotide; CTA chr11 5208674 5208695 5208691 5208696 +
gttgtgagaaattgattattaa

SEQ ID NO: 80996 - DNA, 22 bp, Artificial Sequence
  Synthetic oligonucleotide; TTG chr11 5208678 5208699 5208695 5208700 +
tgagaaattgattattaaatat

SEQ ID NO: 80997 - DNA, 22 bp, Artificial Sequence
  Synthetic oligonucleotide; TTG chr11 5208688 5208709 5208705 5208710 +
attattaaatatatataaggga

SEQ ID NO: 80998 - DNA, 22 bp, Artificial Sequence
  Synthetic oligonucleotide; TTA chr11 5208692 5208713 5208709 5208714 +
ttaaatatatataagggataga

SEQ ID NO: 80999 - DNA, 22 bp, Artificial Sequence
  Synthetic oligonucleotide; TTA chr11 5208695 5208716 5208712 5208717 +
aatatatataagggatagaaga

SEQ ID NO: 81000 - DNA, 22 bp, Artificial Sequence
  Synthetic oligonucleotide; TTG chr11 5208745 5208766 5208762 5208767 +
acaaaattttgtcttggaaatc

SEQ ID NO: 81001 - DNA, 22 bp, Artificial Sequence
  Synthetic oligonucleotide; TTT chr11 5208754 5208775 5208771 5208776 +
tgtcttggaaatctgagtgaac

SEQ ID NO: 81002 - DNA, 22 bp, Artificial Sequence
  Synthetic oligonucleotide; TTT chr11 5208755 5208776 5208772 5208777 +
gtcttggaaatctgagtgaacc

SEQ ID NO: 81003 - DNA, 22 bp, Artificial Sequence
  Synthetic oligonucleotide; TTG chr11 5208756 5208777 5208773 5208778 +
tcttggaaatctgagtgaacca

SEQ ID NO: 81004 - DNA, 22 bp, Artificial Sequence
  Synthetic oligonucleotide; CTT chr11 5208760 5208781 5208777 5208782 +
ggaaatctgagtgaaccattca

SEQ ID NO: 81005 - DNA, 22 bp, Artificial Sequence
  Synthetic oligonucleotide; TTG chr11 5208761 5208782 5208778 5208783 +
gaaatctgagtgaaccattcat

SEQ ID NO: 81006 - DNA, 22 bp, Artificial Sequence
  Synthetic oligonucleotide; CTG chr11 5208769 5208790 5208786 5208791 +
agtgaaccattcatcaagtttg

SEQ ID NO: 81007 - DNA, 22 bp, Artificial Sequence
  Synthetic oligonucleotide; TTC chr11 5208781 5208802 5208798 5208803 +
atcaagtttggaagcattagag

SEQ ID NO: 81008 - DNA, 22 bp, Artificial Sequence
  Synthetic oligonucleotide; TTT chr11 5208790 5208811 5208807 5208812 +
ggaagcattagaggaaactgaa

SEQ ID NO: 81009 - DNA, 22 bp, Artificial Sequence
  Synthetic oligonucleotide; TTG chr11 5208791 5208812 5208808 5208813 +
gaagcattagaggaaactgaaa

SEQ ID NO: 81010 - DNA, 22 bp, Artificial Sequence
  Synthetic oligonucleotide; TTA chr11 5208800 5208821 5208817 5208822 +
gaggaaactgaaagaagtggag

SEQ ID NO: 81011 - DNA, 22 bp, Artificial Sequence
  Synthetic oligonucleotide; CTG chr11 5208810 5208831 5208827 5208832 +
aaagaagtggaggataatttac

SEQ ID NO: 81012 - DNA, 22 bp, Artificial Sequence
  Synthetic oligonucleotide; TTT chr11 5208830 5208851 5208847 5208852 +
actatcttttcaactcgctgag

SEQ ID NO: 81013 - DNA, 22 bp, Artificial Sequence
  Synthetic oligonucleotide; TTA chr11 5208831 5208852 5208848 5208853 +
ctatcttttcaactcgctgagt

SEQ ID NO: 81014 - DNA, 22 bp, Artificial Sequence
  Synthetic oligonucleotide; CTA chr11 5208834 5208855 5208851 5208856 +
tcttttcaactcgctgagttta

SEQ ID NO: 81015 - DNA, 22 bp, Artificial Sequence
  Synthetic oligonucleotide; CTT chr11 5208838 5208859 5208855 5208860 +
ttcaactcgctgagtttaagag

SEQ ID NO: 81016 - DNA, 22 bp, Artificial Sequence
  Synthetic oligonucleotide; TTT chr11 5208839 5208860 5208856 5208861 +
tcaactcgctgagtttaagagg

SEQ ID NO: 81017 - DNA, 22 bp, Artificial Sequence
  Synthetic oligonucleotide; TTT chr11 5208840 5208861 5208857 5208862 +
caactcgctgagtttaagaggt

SEQ ID NO: 81018 - DNA, 22 bp, Artificial Sequence
  Synthetic oligonucleotide; TTC chr11 5208841 5208862 5208858 5208863 +
aactcgctgagtttaagaggtc

SEQ ID NO: 81019 - DNA, 22 bp, Artificial Sequence
  Synthetic oligonucleotide; CTC chr11 5208846 5208867 5208863 5208868 +
gctgagtttaagaggtccatag

SEQ ID NO: 81020 - DNA, 22 bp, Artificial Sequence
  Synthetic oligonucleotide; CTG chr11 5208850 5208871 5208867 5208872 +
agtttaagaggtccataggtca

SEQ ID NO: 81021 - DNA, 22 bp, Artificial Sequence
  Synthetic oligonucleotide; TTT chr11 5208855 5208876 5208872 5208877 +
aagaggtccataggtcatataa

SEQ ID NO: 81022 - DNA, 22 bp, Artificial Sequence
  Synthetic oligonucleotide; TTA chr11 5208856 5208877 5208873 5208878 +
agaggtccataggtcatataag

SEQ ID NO: 81023 - DNA, 22 bp, Artificial Sequence
  Synthetic oligonucleotide; CTG chr11 5208891 5208912 5208908 5208913 +
taagctattgtaacattttttt

SEQ ID NO: 81024 - DNA, 22 bp, Artificial Sequence
  Synthetic oligonucleotide; CTA chr11 5208898 5208919 5208915 5208920 +
ttgtaacatttttttttcatgt

SEQ ID NO: 81025 - DNA, 22 bp, Artificial Sequence
  Synthetic oligonucleotide; TTG chr11 5208901 5208922 5208918 5208923 +
taacatttttttttcatgtccc

SEQ ID NO: 81026 - DNA, 22 bp, Artificial Sequence
  Synthetic oligonucleotide; TTT chr11 5208909 5208930 5208926 5208931 +
ttttttcatgtcccaaaatgtt

SEQ ID NO: 81027 - DNA, 22 bp, Artificial Sequence
  Synthetic oligonucleotide; TTT chr11 5208910 5208931 5208927 5208932 +
tttttcatgtcccaaaatgtta

SEQ ID NO: 81028 - DNA, 22 bp, Artificial Sequence
  Synthetic oligonucleotide; TTT chr11 5208911 5208932 5208928 5208933 +
ttttcatgtcccaaaatgttaa

SEQ ID NO: 81029 - DNA, 22 bp, Artificial Sequence
  Synthetic oligonucleotide; TTT chr11 5208912 5208933 5208929 5208934 +
tttcatgtcccaaaatgttaat

SEQ ID NO: 81030 - DNA, 22 bp, Artificial Sequence
  Synthetic oligonucleotide; TTT chr11 5208913 5208934 5208930 5208935 +
ttcatgtcccaaaatgttaatg

SEQ ID NO: 81031 - DNA, 22 bp, Artificial Sequence
  Synthetic oligonucleotide; TTT chr11 5208914 5208935 5208931 5208936 +
tcatgtcccaaaatgttaatgt

SEQ ID NO: 81032 - DNA, 22 bp, Artificial Sequence
  Synthetic oligonucleotide; TTT chr11 5208915 5208936 5208932 5208937 +
catgtcccaaaatgttaatgta

SEQ ID NO: 81033 - DNA, 22 bp, Artificial Sequence
  Synthetic oligonucleotide; TTC chr11 5208916 5208937 5208933 5208938 +
atgtcccaaaatgttaatgtat

SEQ ID NO: 81034 - DNA, 22 bp, Artificial Sequence
  Synthetic oligonucleotide; TTA chr11 5208932 5208953 5208949 5208954 +
atgtatccctaacagagagcaa

SEQ ID NO: 81035 - DNA, 22 bp, Artificial Sequence
  Synthetic oligonucleotide; CTA chr11 5208943 5208964 5208960 5208965 +
acagagagcaatgaagttcttt

SEQ ID NO: 81036 - DNA, 22 bp, Artificial Sequence
  Synthetic oligonucleotide; TTC chr11 5208962 5208983 5208979 5208984 +
tttttagtggagtttctctttc

SEQ ID NO: 81037 - DNA, 22 bp, Artificial Sequence
  Synthetic oligonucleotide; CTT chr11 5208964 5208985 5208981 5208986 +
tttagtggagtttctctttctt

SEQ ID NO: 81038 - DNA, 22 bp, Artificial Sequence
  Synthetic oligonucleotide; TTT chr11 5208965 5208986 5208982 5208987 +
ttagtggagtttctctttcttg

SEQ ID NO: 81039 - DNA, 22 bp, Artificial Sequence
  Synthetic oligonucleotide; TTT chr11 5208966 5208987 5208983 5208988 +
tagtggagtttctctttcttga

SEQ ID NO: 81040 - DNA, 22 bp, Artificial Sequence
  Synthetic oligonucleotide; TTT chr11 5208967 5208988 5208984 5208989 +
agtggagtttctctttcttgac

SEQ ID NO: 81041 - DNA, 22 bp, Artificial Sequence
  Synthetic oligonucleotide; TTA chr11 5208968 5208989 5208985 5208990 +
gtggagtttctctttcttgaca

SEQ ID NO: 81042 - DNA, 22 bp, Artificial Sequence
  Synthetic oligonucleotide; TTT chr11 5208977 5208998 5208994 5208999 +
ctctttcttgacatagtaccat

SEQ ID NO: 81043 - DNA, 22 bp, Artificial Sequence
  Synthetic oligonucleotide; TTC chr11 5208978 5208999 5208995 5209000 +
tctttcttgacatagtaccatg

SEQ ID NO: 81044 - DNA, 22 bp, Artificial Sequence
  Synthetic oligonucleotide; CTC chr11 5208980 5209001 5208997 5209002 +
tttcttgacatagtaccatgta

SEQ ID NO: 81045 - DNA, 22 bp, Artificial Sequence
  Synthetic oligonucleotide; CTT chr11 5208982 5209003 5208999 5209004 +
tcttgacatagtaccatgtagt

SEQ ID NO: 81046 - DNA, 22 bp, Artificial Sequence
  Synthetic oligonucleotide; TTT chr11 5208983 5209004 5209000 5209005 +
cttgacatagtaccatgtagtg

SEQ ID NO: 81047 - DNA, 22 bp, Artificial Sequence
  Synthetic oligonucleotide; TTC chr11 5208984 5209005 5209001 5209006 +
ttgacatagtaccatgtagtga

SEQ ID NO: 81048 - DNA, 22 bp, Artificial Sequence
  Synthetic oligonucleotide; CTT chr11 5208986 5209007 5209003 5209008 +
gacatagtaccatgtagtgaag

SEQ ID NO: 81049 - DNA, 22 bp, Artificial Sequence
  Synthetic oligonucleotide; TTG chr11 5208987 5209008 5209004 5209009 +
acatagtaccatgtagtgaaga

SEQ ID NO: 81050 - DNA, 22 bp, Artificial Sequence
  Synthetic oligonucleotide; CTG chr11 5209014 5209035 5209031 5209036 +
ctgactttggaattgaaagaat

SEQ ID NO: 81051 - DNA, 22 bp, Artificial Sequence
  Synthetic oligonucleotide; CTG chr11 5209017 5209038 5209034 5209039 +
actttggaattgaaagaatctt

SEQ ID NO: 81052 - DNA, 22 bp, Artificial Sequence
  Synthetic oligonucleotide; CTT chr11 5209021 5209042 5209038 5209043 +
tggaattgaaagaatcttagct

SEQ ID NO: 81053 - DNA, 22 bp, Artificial Sequence
  Synthetic oligonucleotide; TTT chr11 5209022 5209043 5209039 5209044 +
ggaattgaaagaatcttagctc

SEQ ID NO: 81054 - DNA, 22 bp, Artificial Sequence
  Synthetic oligonucleotide; TTG chr11 5209023 5209044 5209040 5209045 +
gaattgaaagaatcttagctca

SEQ ID NO: 81055 - DNA, 22 bp, Artificial Sequence
  Synthetic oligonucleotide; TTG chr11 5209029 5209050 5209046 5209051 +
aaagaatcttagctcagctact

SEQ ID NO: 81056 - DNA, 22 bp, Artificial Sequence
  Synthetic oligonucleotide; CTT chr11 5209039 5209060 5209056 5209061 +
agctcagctacttactagctga

SEQ ID NO: 81057 - DNA, 22 bp, Artificial Sequence
  Synthetic oligonucleotide; TTA chr11 5209040 5209061 5209057 5209062 +
gctcagctacttactagctgag

SEQ ID NO: 81058 - DNA, 22 bp, Artificial Sequence
  Synthetic oligonucleotide; CTC chr11 5209044 5209065 5209061 5209066 +
agctacttactagctgagtagc

SEQ ID NO: 81059 - DNA, 22 bp, Artificial Sequence
  Synthetic oligonucleotide; CTA chr11 5209049 5209070 5209066 5209071 +
cttactagctgagtagctacaa

SEQ ID NO: 81060 - DNA, 22 bp, Artificial Sequence
  Synthetic oligonucleotide; CTT chr11 5209052 5209073 5209069 5209074 +
actagctgagtagctacaacac

SEQ ID NO: 81061 - DNA, 22 bp, Artificial Sequence
  Synthetic oligonucleotide; TTA chr11 5209053 5209074 5209070 5209075 +
ctagctgagtagctacaacacc

SEQ ID NO: 81062 - DNA, 22 bp, Artificial Sequence
  Synthetic oligonucleotide; CTA chr11 5209056 5209077 5209073 5209078 +
gctgagtagctacaacacctta

SEQ ID NO: 81063 - DNA, 22 bp, Artificial Sequence
  Synthetic oligonucleotide; CTG chr11 5209060 5209081 5209077 5209082 +
agtagctacaacaccttaatgc

SEQ ID NO: 81064 - DNA, 22 bp, Artificial Sequence
  Synthetic oligonucleotide; CTA chr11 5209068 5209089 5209085 5209090 +
caacaccttaatgcccatccca

SEQ ID NO: 81065 - DNA, 22 bp, Artificial Sequence
  Synthetic oligonucleotide; CTT chr11 5209077 5209098 5209094 5209099 +
aatgcccatcccaagacagtgt

SEQ ID NO: 81066 - DNA, 22 bp, Artificial Sequence
  Synthetic oligonucleotide; TTA chr11 5209078 5209099 5209095 5209100 +
atgcccatcccaagacagtgtg

SEQ ID NO: 81067 - DNA, 22 bp, Artificial Sequence
  Synthetic oligonucleotide; CTC chr11 5209125 5209146 5209142 5209147 +
aggaagcacaggatgtaccaga

SEQ ID NO: 81068 - DNA, 22 bp, Artificial Sequence
  Synthetic oligonucleotide; CTT chr11 5209159 5209180 5209176 5209181 +
ttcatgttgctttcctaggctt

SEQ ID NO: 81069 - DNA, 22 bp, Artificial Sequence
  Synthetic oligonucleotide; TTT chr11 5209160 5209181 5209177 5209182 +
tcatgttgctttcctaggcttt

SEQ ID NO: 81070 - DNA, 22 bp, Artificial Sequence
  Synthetic oligonucleotide; TTT chr11 5209161 5209182 5209178 5209183 +
catgttgctttcctaggctttt

SEQ ID NO: 81071 - DNA, 22 bp, Artificial Sequence
  Synthetic oligonucleotide; TTC chr11 5209162 5209183 5209179 5209184 +
atgttgctttcctaggcttttt

SEQ ID NO: 81072 - DNA, 22 bp, Artificial Sequence
  Synthetic oligonucleotide; TTG chr11 5209168 5209189 5209185 5209190 +
ctttcctaggctttttatttcc

SEQ ID NO: 81073 - DNA, 22 bp, Artificial Sequence
  Synthetic oligonucleotide; CTT chr11 5209171 5209192 5209188 5209193 +
tcctaggctttttatttccctc

SEQ ID NO: 81074 - DNA, 22 bp, Artificial Sequence
  Synthetic oligonucleotide; TTT chr11 5209172 5209193 5209189 5209194 +
cctaggctttttatttccctcc

SEQ ID NO: 81075 - DNA, 22 bp, Artificial Sequence
  Synthetic oligonucleotide; TTC chr11 5209173 5209194 5209190 5209195 +
ctaggctttttatttccctcct

SEQ ID NO: 81076 - DNA, 22 bp, Artificial Sequence
  Synthetic oligonucleotide; CTA chr11 5209176 5209197 5209193 5209198 +
ggctttttatttccctcctcta

SEQ ID NO: 81077 - DNA, 22 bp, Artificial Sequence
  Synthetic oligonucleotide; CTT chr11 5209181 5209202 5209198 5209203 +
tttatttccctcctctaggtat

SEQ ID NO: 81078 - DNA, 22 bp, Artificial Sequence
  Synthetic oligonucleotide; TTT chr11 5209182 5209203 5209199 5209204 +
ttatttccctcctctaggtatt

SEQ ID NO: 81079 - DNA, 22 bp, Artificial Sequence
  Synthetic oligonucleotide; TTT chr11 5209183 5209204 5209200 5209205 +
tatttccctcctctaggtattt

SEQ ID NO: 81080 - DNA, 22 bp, Artificial Sequence
  Synthetic oligonucleotide; TTT chr11 5209184 5209205 5209201 5209206 +
atttccctcctctaggtatttc

SEQ ID NO: 81081 - DNA, 22 bp, Artificial Sequence
  Synthetic oligonucleotide; TTA chr11 5209185 5209206 5209202 5209207 +
tttccctcctctaggtatttct

SEQ ID NO: 81082 - DNA, 22 bp, Artificial Sequence
  Synthetic oligonucleotide; TTT chr11 5209188 5209209 5209205 5209210 +
ccctcctctaggtatttctgtt

SEQ ID NO: 81083 - DNA, 22 bp, Artificial Sequence
  Synthetic oligonucleotide; TTC chr11 5209189 5209210 5209206 5209211 +
cctcctctaggtatttctgtta

SEQ ID NO: 81084 - DNA, 22 bp, Artificial Sequence
  Synthetic oligonucleotide; CTC chr11 5209193 5209214 5209210 5209215 +
ctctaggtatttctgttatttt

SEQ ID NO: 81085 - DNA, 22 bp, Artificial Sequence
  Synthetic oligonucleotide; CTC chr11 5209196 5209217 5209213 5209218 +
taggtatttctgttattttcct

SEQ ID NO: 81086 - DNA, 22 bp, Artificial Sequence
  Synthetic oligonucleotide; CTA chr11 5209198 5209219 5209215 5209220 +
ggtatttctgttattttccttt

SEQ ID NO: 81087 - DNA, 22 bp, Artificial Sequence
  Synthetic oligonucleotide; TTT chr11 5209205 5209226 5209222 5209227 +
ctgttattttccttttttcatt

SEQ ID NO: 81088 - DNA, 22 bp, Artificial Sequence
  Synthetic oligonucleotide; TTC chr11 5209206 5209227 5209223 5209228 +
tgttattttccttttttcatta

SEQ ID NO: 81089 - DNA, 22 bp, Artificial Sequence
  Synthetic oligonucleotide; CTG chr11 5209208 5209229 5209225 5209230 +
ttattttccttttttcattatt

SEQ ID NO: 81090 - DNA, 22 bp, Artificial Sequence
  Synthetic oligonucleotide; TTA chr11 5209211 5209232 5209228 5209233 +
ttttccttttttcattatttct

SEQ ID NO: 81091 - DNA, 22 bp, Artificial Sequence
  Synthetic oligonucleotide; TTT chr11 5209214 5209235 5209231 5209236 +
tccttttttcattatttcttcc

SEQ ID NO: 81092 - DNA, 22 bp, Artificial Sequence
  Synthetic oligonucleotide; TTT chr11 5209215 5209236 5209232 5209237 +
ccttttttcattatttcttccc

SEQ ID NO: 81093 - DNA, 22 bp, Artificial Sequence
  Synthetic oligonucleotide; TTC chr11 5209216 5209237 5209233 5209238 +
cttttttcattatttcttccct

SEQ ID NO: 81094 - DNA, 22 bp, Artificial Sequence
  Synthetic oligonucleotide; CTT chr11 5209219 5209240 5209236 5209241 +
ttttcattatttcttccctctt

SEQ ID NO: 81095 - DNA, 22 bp, Artificial Sequence
  Synthetic oligonucleotide; TTT chr11 5209220 5209241 5209237 5209242 +
tttcattatttcttccctcttc

SEQ ID NO: 81096 - DNA, 22 bp, Artificial Sequence
  Synthetic oligonucleotide; TTT chr11 5209221 5209242 5209238 5209243 +
ttcattatttcttccctcttct

SEQ ID NO: 81097 - DNA, 22 bp, Artificial Sequence
  Synthetic oligonucleotide; TTT chr11 5209222 5209243 5209239 5209244 +
tcattatttcttccctcttctt

SEQ ID NO: 81098 - DNA, 22 bp, Artificial Sequence
  Synthetic oligonucleotide; TTT chr11 5209223 5209244 5209240 5209245 +
cattatttcttccctcttcttc

SEQ ID NO: 81099 - DNA, 22 bp, Artificial Sequence
  Synthetic oligonucleotide; TTC chr11 5209224 5209245 5209241 5209246 +
attatttcttccctcttcttca

SEQ ID NO: 81100 - DNA, 22 bp, Artificial Sequence
  Synthetic oligonucleotide; TTA chr11 5209228 5209249 5209245 5209250 +
tttcttccctcttcttcaggaa

SEQ ID NO: 81101 - DNA, 22 bp, Artificial Sequence
  Synthetic oligonucleotide; TTT chr11 5209231 5209252 5209248 5209253 +
cttccctcttcttcaggaagtt

SEQ ID NO: 81102 - DNA, 22 bp, Artificial Sequence
  Synthetic oligonucleotide; TTC chr11 5209232 5209253 5209249 5209254 +
ttccctcttcttcaggaagtta

SEQ ID NO: 81103 - DNA, 22 bp, Artificial Sequence
  Synthetic oligonucleotide; CTT chr11 5209234 5209255 5209251 5209256 +
ccctcttcttcaggaagttaag

SEQ ID NO: 81104 - DNA, 22 bp, Artificial Sequence
  Synthetic oligonucleotide; TTC chr11 5209235 5209256 5209252 5209257 +
cctcttcttcaggaagttaaga

SEQ ID NO: 81105 - DNA, 22 bp, Artificial Sequence
  Synthetic oligonucleotide; CTC chr11 5209239 5209260 5209256 5209261 +
ttcttcaggaagttaagacagt

SEQ ID NO: 81106 - DNA, 22 bp, Artificial Sequence
  Synthetic oligonucleotide; CTT chr11 5209241 5209262 5209258 5209263 +
cttcaggaagttaagacagtct

SEQ ID NO: 81107 - DNA, 22 bp, Artificial Sequence
  Synthetic oligonucleotide; TTC chr11 5209242 5209263 5209259 5209264 +
ttcaggaagttaagacagtcta

SEQ ID NO: 81108 - DNA, 22 bp, Artificial Sequence
  Synthetic oligonucleotide; CTT chr11 5209244 5209265 5209261 5209266 +
caggaagttaagacagtctacc

SEQ ID NO: 81109 - DNA, 22 bp, Artificial Sequence
  Synthetic oligonucleotide; TTC chr11 5209245 5209266 5209262 5209267 +
aggaagttaagacagtctacct

SEQ ID NO: 81110 - DNA, 22 bp, Artificial Sequence
  Synthetic oligonucleotide; TTA chr11 5209254 5209275 5209271 5209276 +
agacagtctacctagatttaga

SEQ ID NO: 81111 - DNA, 22 bp, Artificial Sequence
  Synthetic oligonucleotide; CTA chr11 5209264 5209285 5209281 5209286 +
cctagatttagaagcaaatgtt

SEQ ID NO: 81112 - DNA, 22 bp, Artificial Sequence
  Synthetic oligonucleotide; CTA chr11 5209268 5209289 5209285 5209290 +
gatttagaagcaaatgtttata

SEQ ID NO: 81113 - DNA, 22 bp, Artificial Sequence
  Synthetic oligonucleotide; TTT chr11 5209273 5209294 5209290 5209295 +
agaagcaaatgtttatatagtg

SEQ ID NO: 81114 - DNA, 22 bp, Artificial Sequence
  Synthetic oligonucleotide; TTA chr11 5209274 5209295 5209291 5209296 +
gaagcaaatgtttatatagtgg

SEQ ID NO: 81115 - DNA, 22 bp, Artificial Sequence
  Synthetic oligonucleotide; TTT chr11 5209287 5209308 5209304 5209309 +
atatagtggtgaaatttaaagc

SEQ ID NO: 81116 - DNA, 22 bp, Artificial Sequence
  Synthetic oligonucleotide; TTA chr11 5209288 5209309 5209305 5209310 +
tatagtggtgaaatttaaagcc

SEQ ID NO: 81117 - DNA, 22 bp, Artificial Sequence
  Synthetic oligonucleotide; TTT chr11 5209304 5209325 5209321 5209326 +
aaagcctaattgactaaagcca

SEQ ID NO: 81118 - DNA, 22 bp, Artificial Sequence
  Synthetic oligonucleotide; TTA chr11 5209305 5209326 5209322 5209327 +
aagcctaattgactaaagccat

SEQ ID NO: 81119 - DNA, 22 bp, Artificial Sequence
  Synthetic oligonucleotide; CTA chr11 5209312 5209333 5209329 5209334 +
attgactaaagccatttaagaa

SEQ ID NO: 81120 - DNA, 22 bp, Artificial Sequence
  Synthetic oligonucleotide; TTG chr11 5209316 5209337 5209333 5209338 +
actaaagccatttaagaatgta

SEQ ID NO: 81121 - DNA, 22 bp, Artificial Sequence
  Synthetic oligonucleotide; CTA chr11 5209320 5209341 5209337 5209342 +
aagccatttaagaatgtaatat

SEQ ID NO: 81122 - DNA, 22 bp, Artificial Sequence
  Synthetic oligonucleotide; TTT chr11 5209329 5209350 5209346 5209351 +
aagaatgtaatatctcagttag

SEQ ID NO: 81123 - DNA, 22 bp, Artificial Sequence
  Synthetic oligonucleotide; TTA chr11 5209330 5209351 5209347 5209352 +
agaatgtaatatctcagttagt

SEQ ID NO: 81124 - DNA, 22 bp, Artificial Sequence
  Synthetic oligonucleotide; CTC chr11 5209345 5209366 5209362 5209367 +
agttagtatgcacttcttgaaa

SEQ ID NO: 81125 - DNA, 22 bp, Artificial Sequence
  Synthetic oligonucleotide; TTA chr11 5209350 5209371 5209367 5209372 +
gtatgcacttcttgaaatgcaa

SEQ ID NO: 81126 - DNA, 22 bp, Artificial Sequence
  Synthetic oligonucleotide; CTT chr11 5209360 5209381 5209377 5209382 +
cttgaaatgcaaagaaatggtc

SEQ ID NO: 81127 - DNA, 22 bp, Artificial Sequence
  Synthetic oligonucleotide; TTC chr11 5209361 5209382 5209378 5209383 +
ttgaaatgcaaagaaatggtct

SEQ ID NO: 81128 - DNA, 22 bp, Artificial Sequence
  Synthetic oligonucleotide; CTT chr11 5209363 5209384 5209380 5209385 +
gaaatgcaaagaaatggtctga

SEQ ID NO: 81129 - DNA, 22 bp, Artificial Sequence
  Synthetic oligonucleotide; TTG chr11 5209364 5209385 5209381 5209386 +
aaatgcaaagaaatggtctgac

SEQ ID NO: 81130 - DNA, 22 bp, Artificial Sequence
  Synthetic oligonucleotide; CTG chr11 5209384 5209405 5209401 5209406 +
acttttttccattgtttagttt

SEQ ID NO: 81131 - DNA, 22 bp, Artificial Sequence
  Synthetic oligonucleotide; CTT chr11 5209388 5209409 5209405 5209410 +
ttttccattgtttagtttctaa

SEQ ID NO: 81132 - DNA, 22 bp, Artificial Sequence
  Synthetic oligonucleotide; TTT chr11 5209389 5209410 5209406 5209411 +
tttccattgtttagtttctaaa

SEQ ID NO: 81133 - DNA, 22 bp, Artificial Sequence
  Synthetic oligonucleotide; TTT chr11 5209390 5209411 5209407 5209412 +
ttccattgtttagtttctaaat

SEQ ID NO: 81134 - DNA, 22 bp, Artificial Sequence
  Synthetic oligonucleotide; TTT chr11 5209391 5209412 5209408 5209413 +
tccattgtttagtttctaaatt

SEQ ID NO: 81135 - DNA, 22 bp, Artificial Sequence
  Synthetic oligonucleotide; TTT chr11 5209392 5209413 5209409 5209414 +
ccattgtttagtttctaaattt

SEQ ID NO: 81136 - DNA, 22 bp, Artificial Sequence
  Synthetic oligonucleotide; TTC chr11 5209393 5209414 5209410 5209415 +
cattgtttagtttctaaattta

SEQ ID NO: 81137 - DNA, 22 bp, Artificial Sequence
  Synthetic oligonucleotide; TTG chr11 5209398 5209419 5209415 5209420 +
tttagtttctaaatttagtttt

SEQ ID NO: 81138 - DNA, 22 bp, Artificial Sequence
  Synthetic oligonucleotide; TTT chr11 5209401 5209422 5209418 5209423 +
agtttctaaatttagtttttat

SEQ ID NO: 81139 - DNA, 22 bp, Artificial Sequence
  Synthetic oligonucleotide; TTA chr11 5209402 5209423 5209419 5209424 +
gtttctaaatttagtttttatt

SEQ ID NO: 81140 - DNA, 22 bp, Artificial Sequence
  Synthetic oligonucleotide; TTT chr11 5209406 5209427 5209423 5209428 +
ctaaatttagtttttattttaa

SEQ ID NO: 81141 - DNA, 22 bp, Artificial Sequence
  Synthetic oligonucleotide; TTC chr11 5209407 5209428 5209424 5209429 +
taaatttagtttttattttaat

SEQ ID NO: 81142 - DNA, 22 bp, Artificial Sequence
  Synthetic oligonucleotide; CTA chr11 5209409 5209430 5209426 5209431 +
aatttagtttttattttaatat

SEQ ID NO: 81143 - DNA, 22 bp, Artificial Sequence
  Synthetic oligonucleotide; TTT chr11 5209414 5209435 5209431 5209436 +
agtttttattttaatattttaa

SEQ ID NO: 81144 - DNA, 22 bp, Artificial Sequence
  Synthetic oligonucleotide; TTA chr11 5209415 5209436 5209432 5209437 +
gtttttattttaatattttaag

SEQ ID NO: 81145 - DNA, 22 bp, Artificial Sequence
  Synthetic oligonucleotide; TTT chr11 5209419 5209440 5209436 5209441 +
ttattttaatattttaagtaca

SEQ ID NO: 81146 - DNA, 22 bp, Artificial Sequence
  Synthetic oligonucleotide; TTT chr11 5209420 5209441 5209437 5209442 +
tattttaatattttaagtacag

SEQ ID NO: 81147 - DNA, 22 bp, Artificial Sequence
  Synthetic oligonucleotide; TTT chr11 5209421 5209442 5209438 5209443 +
attttaatattttaagtacagc

SEQ ID NO: 81148 - DNA, 22 bp, Artificial Sequence
  Synthetic oligonucleotide; TTA chr11 5209422 5209443 5209439 5209444 +
ttttaatattttaagtacagca

SEQ ID NO: 81149 - DNA, 22 bp, Artificial Sequence
  Synthetic oligonucleotide; TTT chr11 5209425 5209446 5209442 5209447 +
taatattttaagtacagcatgc

SEQ ID NO: 81150 - DNA, 22 bp, Artificial Sequence
  Synthetic oligonucleotide; TTT chr11 5209426 5209447 5209443 5209448 +
aatattttaagtacagcatgca

SEQ ID NO: 81151 - DNA, 22 bp, Artificial Sequence
  Synthetic oligonucleotide; TTA chr11 5209427 5209448 5209444 5209449 +
atattttaagtacagcatgcat

SEQ ID NO: 81152 - DNA, 22 bp, Artificial Sequence
  Synthetic oligonucleotide; TTT chr11 5209433 5209454 5209450 5209455 +
taagtacagcatgcatatataa

SEQ ID NO: 81153 - DNA, 22 bp, Artificial Sequence
  Synthetic oligonucleotide; TTT chr11 5209434 5209455 5209451 5209456 +
aagtacagcatgcatatataaa

SEQ ID NO: 81154 - DNA, 22 bp, Artificial Sequence
  Synthetic oligonucleotide; TTA chr11 5209435 5209456 5209452 5209457 +
agtacagcatgcatatataaaa

SEQ ID NO: 81155 - DNA, 22 bp, Artificial Sequence
  Synthetic oligonucleotide; TTA chr11 5209469 5209490 5209486 5209491 +
tacatgcacagctgaattaact

SEQ ID NO: 81156 - DNA, 22 bp, Artificial Sequence
  Synthetic oligonucleotide; CTG chr11 5209483 5209504 5209500 5209505 +
aattaacttttggaaggtgaac

SEQ ID NO: 81157 - DNA, 22 bp, Artificial Sequence
  Synthetic oligonucleotide; TTA chr11 5209488 5209509 5209505 5209510 +
acttttggaaggtgaacacacc

SEQ ID NO: 81158 - DNA, 22 bp, Artificial Sequence
  Synthetic oligonucleotide; CTT chr11 5209492 5209513 5209509 5209514 +
ttggaaggtgaacacacccatg

SEQ ID NO: 81159 - DNA, 22 bp, Artificial Sequence
  Synthetic oligonucleotide; TTT chr11 5209493 5209514 5209510 5209515 +
tggaaggtgaacacacccatgt

SEQ ID NO: 81160 - DNA, 22 bp, Artificial Sequence
  Synthetic oligonucleotide; TTT chr11 5209494 5209515 5209511 5209516 +
ggaaggtgaacacacccatgta

SEQ ID NO: 81161 - DNA, 22 bp, Artificial Sequence
  Synthetic oligonucleotide; TTG chr11 5209495 5209516 5209512 5209517 +
gaaggtgaacacacccatgtaa

SEQ ID NO: 81162 - DNA, 22 bp, Artificial Sequence
  Synthetic oligonucleotide; CTA chr11 5209523 5209544 5209540 5209545 +
ataagataggaaattaaagagt

SEQ ID NO: 81163 - DNA, 22 bp, Artificial Sequence
  Synthetic oligonucleotide; TTA chr11 5209539 5209560 5209556 5209561 +
aagagtaaacatatgctcactc

SEQ ID NO: 81164 - DNA, 22 bp, Artificial Sequence
  Synthetic oligonucleotide; CTC chr11 5209557 5209578 5209574 5209579 +
actctttatcattccactaatt

SEQ ID NO: 81165 - DNA, 22 bp, Artificial Sequence
  Synthetic oligonucleotide; CTC chr11 5209561 5209582 5209578 5209583 +
tttatcattccactaattgtct

SEQ ID NO: 81166 - DNA, 22 bp, Artificial Sequence
  Synthetic oligonucleotide; CTT chr11 5209563 5209584 5209580 5209585 +
tatcattccactaattgtctcc

SEQ ID NO: 81167 - DNA, 22 bp, Artificial Sequence
  Synthetic oligonucleotide; TTT chr11 5209564 5209585 5209581 5209586 +
atcattccactaattgtctcca

SEQ ID NO: 81168 - DNA, 22 bp, Artificial Sequence
  Synthetic oligonucleotide; TTA chr11 5209565 5209586 5209582 5209587 +
tcattccactaattgtctccaa

SEQ ID NO: 81169 - DNA, 22 bp, Artificial Sequence
  Synthetic oligonucleotide; TTC chr11 5209571 5209592 5209588 5209593 +
cactaattgtctccaaagttaa

SEQ ID NO: 81170 - DNA, 22 bp, Artificial Sequence
  Synthetic oligonucleotide; CTA chr11 5209576 5209597 5209593 5209598 +
attgtctccaaagttaataatt

SEQ ID NO: 81171 - DNA, 22 bp, Artificial Sequence
  Synthetic oligonucleotide; TTG chr11 5209580 5209601 5209597 5209602 +
tctccaaagttaataattatcc

SEQ ID NO: 81172 - DNA, 22 bp, Artificial Sequence
  Synthetic oligonucleotide; CTC chr11 5209584 5209605 5209601 5209606 +
caaagttaataattatcctgat

SEQ ID NO: 81173 - DNA, 22 bp, Artificial Sequence
  Synthetic oligonucleotide; TTA chr11 5209592 5209613 5209609 5209614 +
ataattatcctgatataattca

SEQ ID NO: 81174 - DNA, 22 bp, Artificial Sequence
  Synthetic oligonucleotide; TTA chr11 5209599 5209620 5209616 5209621 +
tcctgatataattcatttttat

SEQ ID NO: 81175 - DNA, 22 bp, Artificial Sequence
  Synthetic oligonucleotide; CTG chr11 5209604 5209625 5209621 5209626 +
atataattcatttttatcacga

SEQ ID NO: 81176 - DNA, 22 bp, Artificial Sequence
  Synthetic oligonucleotide; TTC chr11 5209613 5209634 5209630 5209635 +
atttttatcacgattgactcat

SEQ ID NO: 81177 - DNA, 22 bp, Artificial Sequence
  Synthetic oligonucleotide; TTT chr11 5209617 5209638 5209634 5209639 +
ttatcacgattgactcatgtcc

SEQ ID NO: 81178 - DNA, 22 bp, Artificial Sequence
  Synthetic oligonucleotide; TTT chr11 5209618 5209639 5209635 5209640 +
tatcacgattgactcatgtccc

SEQ ID NO: 81179 - DNA, 22 bp, Artificial Sequence
  Synthetic oligonucleotide; TTT chr11 5209619 5209640 5209636 5209641 +
atcacgattgactcatgtccct

SEQ ID NO: 81180 - DNA, 22 bp, Artificial Sequence
  Synthetic oligonucleotide; TTA chr11 5209620 5209641 5209637 5209642 +
tcacgattgactcatgtccctt

SEQ ID NO: 81181 - DNA, 22 bp, Artificial Sequence
  Synthetic oligonucleotide; TTG chr11 5209629 5209650 5209646 5209651 +
actcatgtccctttttttaaaa

SEQ ID NO: 81182 - DNA, 22 bp, Artificial Sequence
  Synthetic oligonucleotide; CTC chr11 5209633 5209654 5209650 5209655 +
atgtccctttttttaaaagtgt

SEQ ID NO: 81183 - DNA, 22 bp, Artificial Sequence
  Synthetic oligonucleotide; CTT chr11 5209642 5209663 5209659 5209664 +
tttttaaaagtgtgtatacatt

SEQ ID NO: 81184 - DNA, 22 bp, Artificial Sequence
  Synthetic oligonucleotide; TTT chr11 5209643 5209664 5209660 5209665 +
ttttaaaagtgtgtatacattg

SEQ ID NO: 81185 - DNA, 22 bp, Artificial Sequence
  Synthetic oligonucleotide; TTT chr11 5209644 5209665 5209661 5209666 +
tttaaaagtgtgtatacattga

SEQ ID NO: 81186 - DNA, 22 bp, Artificial Sequence
  Synthetic oligonucleotide; TTT chr11 5209645 5209666 5209662 5209667 +
ttaaaagtgtgtatacattgaa

SEQ ID NO: 81187 - DNA, 22 bp, Artificial Sequence
  Synthetic oligonucleotide; TTT chr11 5209646 5209667 5209663 5209668 +
taaaagtgtgtatacattgaat

SEQ ID NO: 81188 - DNA, 22 bp, Artificial Sequence
  Synthetic oligonucleotide; TTT chr11 5209647 5209668 5209664 5209669 +
aaaagtgtgtatacattgaatt

SEQ ID NO: 81189 - DNA, 22 bp, Artificial Sequence
  Synthetic oligonucleotide; TTA chr11 5209648 5209669 5209665 5209670 +
aaagtgtgtatacattgaatta

SEQ ID NO: 81190 - DNA, 22 bp, Artificial Sequence
  Synthetic oligonucleotide; TTG chr11 5209665 5209686 5209682 5209687 +
aattatactgtgttgcttatgt

SEQ ID NO: 81191 - DNA, 22 bp, Artificial Sequence
  Synthetic oligonucleotide; TTA chr11 5209670 5209691 5209687 5209692 +
tactgtgttgcttatgtctgac

SEQ ID NO: 81192 - DNA, 22 bp, Artificial Sequence
  Synthetic oligonucleotide; CTG chr11 5209675 5209696 5209692 5209697 +
tgttgcttatgtctgactttat

SEQ ID NO: 81193 - DNA, 22 bp, Artificial Sequence
  Synthetic oligonucleotide; TTG chr11 5209680 5209701 5209697 5209702 +
cttatgtctgactttattcaat

SEQ ID NO: 81194 - DNA, 22 bp, Artificial Sequence
  Synthetic oligonucleotide; CTT chr11 5209683 5209704 5209700 5209705 +
atgtctgactttattcaatatt

SEQ ID NO: 81195 - DNA, 22 bp, Artificial Sequence
  Synthetic oligonucleotide; TTA chr11 5209684 5209705 5209701 5209706 +
tgtctgactttattcaatatta

SEQ ID NO: 81196 - DNA, 22 bp, Artificial Sequence
  Synthetic oligonucleotide; CTG chr11 5209690 5209711 5209707 5209712 +
actttattcaatattatgtttg

SEQ ID NO: 81197 - DNA, 22 bp, Artificial Sequence
  Synthetic oligonucleotide; CTT chr11 5209694 5209715 5209711 5209716 +
tattcaatattatgtttgtgaa

SEQ ID NO: 81198 - DNA, 22 bp, Artificial Sequence
  Synthetic oligonucleotide; TTT chr11 5209695 5209716 5209712 5209717 +
attcaatattatgtttgtgaat

SEQ ID NO: 81199 - DNA, 22 bp, Artificial Sequence
  Synthetic oligonucleotide; TTA chr11 5209696 5209717 5209713 5209718 +
ttcaatattatgtttgtgaatt

SEQ ID NO: 81200 - DNA, 22 bp, Artificial Sequence
  Synthetic oligonucleotide; TTC chr11 5209699 5209720 5209716 5209721 +
aatattatgtttgtgaattgca

SEQ ID NO: 81201 - DNA, 22 bp, Artificial Sequence
  Synthetic oligonucleotide; TTA chr11 5209706 5209727 5209723 5209728 +
tgtttgtgaattgcattcatac

SEQ ID NO: 81202 - DNA, 22 bp, Artificial Sequence
  Synthetic oligonucleotide; TTT chr11 5209711 5209732 5209728 5209733 +
gtgaattgcattcatactagtg

SEQ ID NO: 81203 - DNA, 22 bp, Artificial Sequence
  Synthetic oligonucleotide; TTG chr11 5209712 5209733 5209729 5209734 +
tgaattgcattcatactagtgt

SEQ ID NO: 81204 - DNA, 22 bp, Artificial Sequence
  Synthetic oligonucleotide; TTG chr11 5209719 5209740 5209736 5209741 +
cattcatactagtgtatgactg

SEQ ID NO: 81205 - DNA, 22 bp, Artificial Sequence
  Synthetic oligonucleotide; TTC chr11 5209724 5209745 5209741 5209746 +
atactagtgtatgactgtagtt

SEQ ID NO: 81206 - DNA, 22 bp, Artificial Sequence
  Synthetic oligonucleotide; CTA chr11 5209730 5209751 5209747 5209752 +
gtgtatgactgtagttgatttt

SEQ ID NO: 81207 - DNA, 22 bp, Artificial Sequence
  Synthetic oligonucleotide; CTG chr11 5209741 5209762 5209758 5209763 +
tagttgatttttcatttctgaa

SEQ ID NO: 81208 - DNA, 22 bp, Artificial Sequence
  Synthetic oligonucleotide; TTG chr11 5209747 5209768 5209764 5209769 +
atttttcatttctgaatgtcat

SEQ ID NO: 81209 - DNA, 22 bp, Artificial Sequence
  Synthetic oligonucleotide; TTT chr11 5209751 5209772 5209768 5209773 +
ttcatttctgaatgtcattcta

SEQ ID NO: 81210 - DNA, 22 bp, Artificial Sequence
  Synthetic oligonucleotide; TTT chr11 5209752 5209773 5209769 5209774 +
tcatttctgaatgtcattctat

SEQ ID NO: 81211 - DNA, 22 bp, Artificial Sequence
  Synthetic oligonucleotide; TTT chr11 5209753 5209774 5209770 5209775 +
catttctgaatgtcattctatt

SEQ ID NO: 81212 - DNA, 22 bp, Artificial Sequence
  Synthetic oligonucleotide; TTC chr11 5209754 5209775 5209771 5209776 +
atttctgaatgtcattctattt

SEQ ID NO: 81213 - DNA, 22 bp, Artificial Sequence
  Synthetic oligonucleotide; TTT chr11 5209758 5209779 5209775 5209780 +
ctgaatgtcattctattttatg

SEQ ID NO: 81214 - DNA, 22 bp, Artificial Sequence
  Synthetic oligonucleotide; TTC chr11 5209759 5209780 5209776 5209781 +
tgaatgtcattctattttatgt

SEQ ID NO: 81215 - DNA, 22 bp, Artificial Sequence
  Synthetic oligonucleotide; CTG chr11 5209761 5209782 5209778 5209783 +
aatgtcattctattttatgtat

SEQ ID NO: 81216 - DNA, 22 bp, Artificial Sequence
  Synthetic oligonucleotide; TTC chr11 5209771 5209792 5209788 5209793 +
tattttatgtatataccacaat

SEQ ID NO: 81217 - DNA, 22 bp, Artificial Sequence
  Synthetic oligonucleotide; CTA chr11 5209773 5209794 5209790 5209795 +
ttttatgtatataccacaatat

SEQ ID NO: 81218 - DNA, 22 bp, Artificial Sequence
  Synthetic oligonucleotide; TTT chr11 5209776 5209797 5209793 5209798 +
tatgtatataccacaatatatt

SEQ ID NO: 81219 - DNA, 22 bp, Artificial Sequence
  Synthetic oligonucleotide; TTT chr11 5209777 5209798 5209794 5209799 +
atgtatataccacaatatattt

SEQ ID NO: 81220 - DNA, 22 bp, Artificial Sequence
  Synthetic oligonucleotide; TTA chr11 5209778 5209799 5209795 5209800 +
tgtatataccacaatatattta

SEQ ID NO: 81221 - DNA, 22 bp, Artificial Sequence
  Synthetic oligonucleotide; TTT chr11 5209799 5209820 5209816 5209821 +
attgactccacagttgatagat

SEQ ID NO: 81222 - DNA, 22 bp, Artificial Sequence
  Synthetic oligonucleotide; TTA chr11 5209800 5209821 5209817 5209822 +
ttgactccacagttgatagata

SEQ ID NO: 81223 - DNA, 22 bp, Artificial Sequence
  Synthetic oligonucleotide; TTG chr11 5209803 5209824 5209820 5209825 +
actccacagttgatagatattt

SEQ ID NO: 81224 - DNA, 22 bp, Artificial Sequence
  Synthetic oligonucleotide; CTC chr11 5209807 5209828 5209824 5209829 +
cacagttgatagatatttgagt

SEQ ID NO: 81225 - DNA, 22 bp, Artificial Sequence
  Synthetic oligonucleotide; TTG chr11 5209815 5209836 5209832 5209837 +
atagatatttgagtaccttcta

SEQ ID NO: 81226 - DNA, 22 bp, Artificial Sequence
  Synthetic oligonucleotide; TTT chr11 5209825 5209846 5209842 5209847 +
gagtaccttctagcttttggct

SEQ ID NO: 81227 - DNA, 22 bp, Artificial Sequence
  Synthetic oligonucleotide; TTG chr11 5209826 5209847 5209843 5209848 +
agtaccttctagcttttggcta

SEQ ID NO: 81228 - DNA, 22 bp, Artificial Sequence
  Synthetic oligonucleotide; CTT chr11 5209834 5209855 5209851 5209856 +
ctagcttttggctataatataa

SEQ ID NO: 81229 - DNA, 22 bp, Artificial Sequence
  Synthetic oligonucleotide; TTC chr11 5209835 5209856 5209852 5209857 +
tagcttttggctataatataaa

SEQ ID NO: 81230 - DNA, 22 bp, Artificial Sequence
  Synthetic oligonucleotide; CTA chr11 5209837 5209858 5209854 5209859 +
gcttttggctataatataaatt

SEQ ID NO: 81231 - DNA, 22 bp, Artificial Sequence
  Synthetic oligonucleotide; CTT chr11 5209841 5209862 5209858 5209863 +
ttggctataatataaattgctg

SEQ ID NO: 81232 - DNA, 22 bp, Artificial Sequence
  Synthetic oligonucleotide; TTT chr11 5209842 5209863 5209859 5209864 +
tggctataatataaattgctgc

SEQ ID NO: 81233 - DNA, 22 bp, Artificial Sequence
  Synthetic oligonucleotide; TTT chr11 5209843 5209864 5209860 5209865 +
ggctataatataaattgctgct

SEQ ID NO: 81234 - DNA, 22 bp, Artificial Sequence
  Synthetic oligonucleotide; TTG chr11 5209844 5209865 5209861 5209866 +
gctataatataaattgctgcta

SEQ ID NO: 81235 - DNA, 22 bp, Artificial Sequence
  Synthetic oligonucleotide; CTA chr11 5209848 5209869 5209865 5209870 +
taatataaattgctgctatgaa

SEQ ID NO: 81236 - DNA, 22 bp, Artificial Sequence
  Synthetic oligonucleotide; TTG chr11 5209860 5209881 5209877 5209882 +
ctgctatgaagattcttatata

SEQ ID NO: 81237 - DNA, 22 bp, Artificial Sequence
  Synthetic oligonucleotide; CTG chr11 5209863 5209884 5209880 5209885 +
ctatgaagattcttatatattt

SEQ ID NO: 81238 - DNA, 22 bp, Artificial Sequence
  Synthetic oligonucleotide; CTA chr11 5209866 5209887 5209883 5209888 +
tgaagattcttatatatttttg

SEQ ID NO: 81239 - DNA, 22 bp, Artificial Sequence
  Synthetic oligonucleotide; TTC chr11 5209875 5209896 5209892 5209897 +
ttatatatttttgtatatatat

SEQ ID NO: 81240 - DNA, 22 bp, Artificial Sequence
  Synthetic oligonucleotide; CTT chr11 5209877 5209898 5209894 5209899 +
atatatttttgtatatatattc

SEQ ID NO: 81241 - DNA, 22 bp, Artificial Sequence
  Synthetic oligonucleotide; TTA chr11 5209878 5209899 5209895 5209900 +
tatatttttgtatatatattct

SEQ ID NO: 81242 - DNA, 22 bp, Artificial Sequence
  Synthetic oligonucleotide; TTT chr11 5209885 5209906 5209902 5209907 +
ttgtatatatattctgtaaatt

SEQ ID NO: 81243 - DNA, 22 bp, Artificial Sequence
  Synthetic oligonucleotide; TTT chr11 5209886 5209907 5209903 5209908 +
tgtatatatattctgtaaattg

SEQ ID NO: 81244 - DNA, 22 bp, Artificial Sequence
  Synthetic oligonucleotide; TTT chr11 5209887 5209908 5209904 5209909 +
gtatatatattctgtaaattgc

SEQ ID NO: 81245 - DNA, 22 bp, Artificial Sequence
  Synthetic oligonucleotide; TTG chr11 5209888 5209909 5209905 5209910 +
tatatatattctgtaaattgct

SEQ ID NO: 81246 - DNA, 22 bp, Artificial Sequence
  Synthetic oligonucleotide; TTC chr11 5209899 5209920 5209916 5209921 +
tgtaaattgctaggtcataaaa

SEQ ID NO: 81247 - DNA, 22 bp, Artificial Sequence
  Synthetic oligonucleotide; CTG chr11 5209901 5209922 5209918 5209923 +
taaattgctaggtcataaaata

SEQ ID NO: 81248 - DNA, 22 bp, Artificial Sequence
  Synthetic oligonucleotide; TTG chr11 5209908 5209929 5209925 5209930 +
ctaggtcataaaatatgcatat

SEQ ID NO: 81249 - DNA, 22 bp, Artificial Sequence
  Synthetic oligonucleotide; CTA chr11 5209911 5209932 5209928 5209933 +
ggtcataaaatatgcatatgtt

SEQ ID NO: 81250 - DNA, 22 bp, Artificial Sequence
  Synthetic oligonucleotide; TTC chr11 5209934 5209955 5209951 5209956 +
aactttaaaatacactgccaac

SEQ ID NO: 81251 - DNA, 22 bp, Artificial Sequence
  Synthetic oligonucleotide; CTT chr11 5209939 5209960 5209956 5209961 +
taaaatacactgccaacctgtt

SEQ ID NO: 81252 - DNA, 22 bp, Artificial Sequence
  Synthetic oligonucleotide; TTT chr11 5209940 5209961 5209957 5209962 +
aaaatacactgccaacctgttt

SEQ ID NO: 81253 - DNA, 22 bp, Artificial Sequence
  Synthetic oligonucleotide; TTA chr11 5209941 5209962 5209958 5209963 +
aaatacactgccaacctgttta

SEQ ID NO: 81254 - DNA, 22 bp, Artificial Sequence
  Synthetic oligonucleotide; CTG chr11 5209951 5209972 5209968 5209973 +
ccaacctgtttacctccccact

SEQ ID NO: 81255 - DNA, 22 bp, Artificial Sequence
  Synthetic oligonucleotide; CTG chr11 5209959 5209980 5209976 5209981 +
tttacctccccactataattta

SEQ ID NO: 81256 - DNA, 22 bp, Artificial Sequence
  Synthetic oligonucleotide; TTT chr11 5209962 5209983 5209979 5209984 +
acctccccactataatttaatg

SEQ ID NO: 81257 - DNA, 22 bp, Artificial Sequence
  Synthetic oligonucleotide; TTA chr11 5209963 5209984 5209980 5209985 +
cctccccactataatttaatgt

SEQ ID NO: 81258 - DNA, 22 bp, Artificial Sequence
  Synthetic oligonucleotide; CTC chr11 5209967 5209988 5209984 5209989 +
cccactataatttaatgtcatt

SEQ ID NO: 81259 - DNA, 22 bp, Artificial Sequence
  Synthetic oligonucleotide; CTA chr11 5209974 5209995 5209991 5209996 +
taatttaatgtcatttggtcaa

SEQ ID NO: 81260 - DNA, 22 bp, Artificial Sequence
  Synthetic oligonucleotide; TTT chr11 5209980 5210001 5209997 5210002 +
aatgtcatttggtcaacctata

SEQ ID NO: 81261 - DNA, 22 bp, Artificial Sequence
  Synthetic oligonucleotide; TTA chr11 5209981 5210002 5209998 5210003 +
atgtcatttggtcaacctataa

SEQ ID NO: 81262 - DNA, 22 bp, Artificial Sequence
  Synthetic oligonucleotide; TTT chr11 5209990 5210011 5210007 5210012 +
ggtcaacctataatatcataga

SEQ ID NO: 81263 - DNA, 22 bp, Artificial Sequence
  Synthetic oligonucleotide; TTG chr11 5209991 5210012 5210008 5210013 +
gtcaacctataatatcatagat

SEQ ID NO: 81264 - DNA, 22 bp, Artificial Sequence
  Synthetic oligonucleotide; CTA chr11 5210000 5210021 5210017 5210022 +
taatatcatagatgttttctct

SEQ ID NO: 81265 - DNA, 22 bp, Artificial Sequence
  Synthetic oligonucleotide; TTT chr11 5210017 5210038 5210034 5210039 +
tctcttatagcagcctgcatgt

SEQ ID NO: 81266 - DNA, 22 bp, Artificial Sequence
  Synthetic oligonucleotide; TTT chr11 5210018 5210039 5210035 5210040 +
ctcttatagcagcctgcatgtg

SEQ ID NO: 81267 - DNA, 22 bp, Artificial Sequence
  Synthetic oligonucleotide; TTC chr11 5210019 5210040 5210036 5210041 +
tcttatagcagcctgcatgtgc

SEQ ID NO: 81268 - DNA, 22 bp, Artificial Sequence
  Synthetic oligonucleotide; CTC chr11 5210021 5210042 5210038 5210043 +
ttatagcagcctgcatgtgccc

SEQ ID NO: 81269 - DNA, 22 bp, Artificial Sequence
  Synthetic oligonucleotide; CTT chr11 5210023 5210044 5210040 5210045 +
atagcagcctgcatgtgcccag

SEQ ID NO: 81270 - DNA, 22 bp, Artificial Sequence
  Synthetic oligonucleotide; TTA chr11 5210024 5210045 5210041 5210046 +
tagcagcctgcatgtgcccaga

SEQ ID NO: 81271 - DNA, 22 bp, Artificial Sequence
  Synthetic oligonucleotide; CTG chr11 5210034 5210055 5210051 5210056 +
catgtgcccagattttgaattt

SEQ ID NO: 81272 - DNA, 22 bp, Artificial Sequence
  Synthetic oligonucleotide; TTT chr11 5210049 5210070 5210066 5210071 +
tgaatttatcctttgtatattt

SEQ ID NO: 81273 - DNA, 22 bp, Artificial Sequence
  Synthetic oligonucleotide; TTT chr11 5210050 5210071 5210067 5210072 +
gaatttatcctttgtatattta

SEQ ID NO: 81274 - DNA, 22 bp, Artificial Sequence
  Synthetic oligonucleotide; TTG chr11 5210051 5210072 5210068 5210073 +
aatttatcctttgtatatttac

SEQ ID NO: 81275 - DNA, 22 bp, Artificial Sequence
  Synthetic oligonucleotide; TTT chr11 5210056 5210077 5210073 5210078 +
atcctttgtatatttacattta

SEQ ID NO: 81276 - DNA, 22 bp, Artificial Sequence
  Synthetic oligonucleotide; TTA chr11 5210057 5210078 5210074 5210079 +
tcctttgtatatttacatttag

SEQ ID NO: 81277 - DNA, 22 bp, Artificial Sequence
  Synthetic oligonucleotide; CTT chr11 5210062 5210083 5210079 5210084 +
tgtatatttacatttagttctg

SEQ ID NO: 81278 - DNA, 22 bp, Artificial Sequence
  Synthetic oligonucleotide; TTT chr11 5210063 5210084 5210080 5210085 +
gtatatttacatttagttctgt

SEQ ID NO: 81279 - DNA, 22 bp, Artificial Sequence
  Synthetic oligonucleotide; TTG chr11 5210064 5210085 5210081 5210086 +
tatatttacatttagttctgta

SEQ ID NO: 81280 - DNA, 22 bp, Artificial Sequence
  Synthetic oligonucleotide; TTT chr11 5210071 5210092 5210088 5210093 +
acatttagttctgtattattac

SEQ ID NO: 81281 - DNA, 22 bp, Artificial Sequence
  Synthetic oligonucleotide; TTA chr11 5210072 5210093 5210089 5210094 +
catttagttctgtattattaca

SEQ ID NO: 81282 - DNA, 22 bp, Artificial Sequence
  Synthetic oligonucleotide; TTT chr11 5210077 5210098 5210094 5210099 +
agttctgtattattacaattag

SEQ ID NO: 81283 - DNA, 22 bp, Artificial Sequence
  Synthetic oligonucleotide; TTA chr11 5210078 5210099 5210095 5210100 +
gttctgtattattacaattagt

SEQ ID NO: 81284 - DNA, 22 bp, Artificial Sequence
  Synthetic oligonucleotide; TTC chr11 5210082 5210103 5210099 5210104 +
tgtattattacaattagttcgt

SEQ ID NO: 81285 - DNA, 22 bp, Artificial Sequence
  Synthetic oligonucleotide; CTG chr11 5210084 5210105 5210101 5210106 +
tattattacaattagttcgtag

SEQ ID NO: 81286 - DNA, 22 bp, Artificial Sequence
  Synthetic oligonucleotide; TTA chr11 5210089 5210110 5210106 5210111 +
ttacaattagttcgtagacctg

SEQ ID NO: 81287 - DNA, 22 bp, Artificial Sequence
  Synthetic oligonucleotide; TTA chr11 5210092 5210113 5210109 5210114 +
caattagttcgtagacctgtta

SEQ ID NO: 81288 - DNA, 22 bp, Artificial Sequence
  Synthetic oligonucleotide; TTA chr11 5210098 5210119 5210115 5210120 +
gttcgtagacctgttattatta

SEQ ID NO: 81289 - DNA, 22 bp, Artificial Sequence
  Synthetic oligonucleotide; TTC chr11 5210102 5210123 5210119 5210124 +
gtagacctgttattattattct

SEQ ID NO: 81290 - DNA, 22 bp, Artificial Sequence
  Synthetic oligonucleotide; CTG chr11 5210111 5210132 5210128 5210133 +
ttattattattctcatttgtag

SEQ ID NO: 81291 - DNA, 22 bp, Artificial Sequence
  Synthetic oligonucleotide; TTA chr11 5210114 5210135 5210131 5210136 +
ttattattctcatttgtagttg

SEQ ID NO: 81292 - DNA, 22 bp, Artificial Sequence
  Synthetic oligonucleotide; TTA chr11 5210117 5210138 5210134 5210139 +
ttattctcatttgtagttgaag

SEQ ID NO: 81293 - DNA, 22 bp, Artificial Sequence
  Synthetic oligonucleotide; TTA chr11 5210120 5210141 5210137 5210142 +
ttctcatttgtagttgaagaaa

SEQ ID NO: 81294 - DNA, 22 bp, Artificial Sequence
  Synthetic oligonucleotide; TTC chr11 5210123 5210144 5210140 5210145 +
tcatttgtagttgaagaaattg

SEQ ID NO: 81295 - DNA, 22 bp, Artificial Sequence
  Synthetic oligonucleotide; CTC chr11 5210125 5210146 5210142 5210147 +
atttgtagttgaagaaattgca

SEQ ID NO: 81296 - DNA, 22 bp, Artificial Sequence
  Synthetic oligonucleotide; TTT chr11 5210129 5210150 5210146 5210151 +
gtagttgaagaaattgcactcc

SEQ ID NO: 81297 - DNA, 22 bp, Artificial Sequence
  Synthetic oligonucleotide; TTG chr11 5210130 5210151 5210147 5210152 +
tagttgaagaaattgcactcca

SEQ ID NO: 81298 - DNA, 22 bp, Artificial Sequence
  Synthetic oligonucleotide; TTG chr11 5210136 5210157 5210153 5210158 +
aagaaattgcactccagcaagt

SEQ ID NO: 81299 - DNA, 22 bp, Artificial Sequence
  Synthetic oligonucleotide; TTG chr11 5210145 5210166 5210162 5210167 +
cactccagcaagtttaaattgc

SEQ ID NO: 81300 - DNA, 22 bp, Artificial Sequence
  Synthetic oligonucleotide; CTC chr11 5210150 5210171 5210167 5210172 +
cagcaagtttaaattgctcctg

SEQ ID NO: 81301 - DNA, 22 bp, Artificial Sequence
  Synthetic oligonucleotide; TTT chr11 5210160 5210181 5210177 5210182 +
aaattgctcctggctacatccc

SEQ ID NO: 81302 - DNA, 22 bp, Artificial Sequence
  Synthetic oligonucleotide; TTA chr11 5210161 5210182 5210178 5210183 +
aattgctcctggctacatccca

SEQ ID NO: 81303 - DNA, 22 bp, Artificial Sequence
  Synthetic oligonucleotide; TTG chr11 5210166 5210187 5210183 5210188 +
ctcctggctacatcccagaaaa

SEQ ID NO: 81304 - DNA, 22 bp, Artificial Sequence
  Synthetic oligonucleotide; CTC chr11 5210169 5210190 5210186 5210191 +
ctggctacatcccagaaaaaca

SEQ ID NO: 81305 - DNA, 22 bp, Artificial Sequence
  Synthetic oligonucleotide; CTG chr11 5210172 5210193 5210189 5210194 +
gctacatcccagaaaaacaata

SEQ ID NO: 81306 - DNA, 22 bp, Artificial Sequence
  Synthetic oligonucleotide; CTA chr11 5210176 5210197 5210193 5210198 +
catcccagaaaaacaataataa

SEQ ID NO: 81307 - DNA, 22 bp, Artificial Sequence
  Synthetic oligonucleotide; CTT chr11 5210210 5210231 5210227 5210232 +
tttgcccctacttgactaggaa

SEQ ID NO: 81308 - DNA, 22 bp, Artificial Sequence
  Synthetic oligonucleotide; TTT chr11 5210211 5210232 5210228 5210233 +
ttgcccctacttgactaggaat

SEQ ID NO: 81309 - DNA, 22 bp, Artificial Sequence
  Synthetic oligonucleotide; TTT chr11 5210212 5210233 5210229 5210234 +
tgcccctacttgactaggaatt

SEQ ID NO: 81310 - DNA, 22 bp, Artificial Sequence
  Synthetic oligonucleotide; TTT chr11 5210213 5210234 5210230 5210235 +
gcccctacttgactaggaattg

SEQ ID NO: 81311 - DNA, 22 bp, Artificial Sequence
  Synthetic oligonucleotide; TTG chr11 5210214 5210235 5210231 5210236 +
cccctacttgactaggaattgt

SEQ ID NO: 81312 - DNA, 22 bp, Artificial Sequence
  Synthetic oligonucleotide; CTA chr11 5210220 5210241 5210237 5210242 +
cttgactaggaattgtataaag

SEQ ID NO: 81313 - DNA, 22 bp, Artificial Sequence
  Synthetic oligonucleotide; CTT chr11 5210223 5210244 5210240 5210245 +
gactaggaattgtataaagaga

SEQ ID NO: 81314 - DNA, 22 bp, Artificial Sequence
  Synthetic oligonucleotide; TTG chr11 5210224 5210245 5210241 5210246 +
actaggaattgtataaagagaa

SEQ ID NO: 81315 - DNA, 22 bp, Artificial Sequence
  Synthetic oligonucleotide; CTA chr11 5210228 5210249 5210245 5210250 +
ggaattgtataaagagaacagt

SEQ ID NO: 81316 - DNA, 22 bp, Artificial Sequence
  Synthetic oligonucleotide; TTG chr11 5210235 5210256 5210252 5210257 +
tataaagagaacagttattctt

SEQ ID NO: 81317 - DNA, 22 bp, Artificial Sequence
  Synthetic oligonucleotide; TTA chr11 5210252 5210273 5210269 5210274 +
ttcttctagtgggaagcaagct

SEQ ID NO: 81318 - DNA, 22 bp, Artificial Sequence
  Synthetic oligonucleotide; TTC chr11 5210255 5210276 5210272 5210277 +
ttctagtgggaagcaagctggc

SEQ ID NO: 81319 - DNA, 22 bp, Artificial Sequence
  Synthetic oligonucleotide; CTT chr11 5210257 5210278 5210274 5210279 +
ctagtgggaagcaagctggcct

SEQ ID NO: 81320 - DNA, 22 bp, Artificial Sequence
  Synthetic oligonucleotide; TTC chr11 5210258 5210279 5210275 5210280 +
tagtgggaagcaagctggcctc

SEQ ID NO: 81321 - DNA, 22 bp, Artificial Sequence
  Synthetic oligonucleotide; CTA chr11 5210260 5210281 5210277 5210282 +
gtgggaagcaagctggcctcaa

SEQ ID NO: 81322 - DNA, 22 bp, Artificial Sequence
  Synthetic oligonucleotide; CTG chr11 5210275 5210296 5210292 5210297 +
gcctcaactggaacagaatgag

SEQ ID NO: 81323 - DNA, 22 bp, Artificial Sequence
  Synthetic oligonucleotide; CTC chr11 5210280 5210301 5210297 5210302 +
aactggaacagaatgagagaaa

SEQ ID NO: 81324 - DNA, 22 bp, Artificial Sequence
  Synthetic oligonucleotide; CTG chr11 5210285 5210306 5210302 5210307 +
gaacagaatgagagaaatgcaa

SEQ ID NO: 81325 - DNA, 22 bp, Artificial Sequence
  Synthetic oligonucleotide; CTA chr11 5210315 5210336 5210332 5210337 +
ataatccaacagtcccacaccc

SEQ ID NO: 81326 - DNA, 22 bp, Artificial Sequence
  Synthetic oligonucleotide; CTA chr11 5210342 5210363 5210359 5210364 +
aatgtactttttccttttcccc

SEQ ID NO: 81327 - DNA, 22 bp, Artificial Sequence
  Synthetic oligonucleotide; CTT chr11 5210351 5210372 5210368 5210373 +
tttccttttccccatggagtca

SEQ ID NO: 81328 - DNA, 22 bp, Artificial Sequence
  Synthetic oligonucleotide; TTT chr11 5210352 5210373 5210369 5210374 +
ttccttttccccatggagtcaa

SEQ ID NO: 81329 - DNA, 22 bp, Artificial Sequence
  Synthetic oligonucleotide; TTT chr11 5210353 5210374 5210370 5210375 +
tccttttccccatggagtcaag

SEQ ID NO: 81330 - DNA, 22 bp, Artificial Sequence
  Synthetic oligonucleotide; TTT chr11 5210354 5210375 5210371 5210376 +
ccttttccccatggagtcaagg

SEQ ID NO: 81331 - DNA, 22 bp, Artificial Sequence
  Synthetic oligonucleotide; TTC chr11 5210355 5210376 5210372 5210377 +
cttttccccatggagtcaaggc

SEQ ID NO: 81332 - DNA, 22 bp, Artificial Sequence
  Synthetic oligonucleotide; CTT chr11 5210358 5210379 5210375 5210380 +
ttccccatggagtcaaggctat

SEQ ID NO: 81333 - DNA, 22 bp, Artificial Sequence
  Synthetic oligonucleotide; TTT chr11 5210359 5210380 5210376 5210381 +
tccccatggagtcaaggctatc

SEQ ID NO: 81334 - DNA, 22 bp, Artificial Sequence
  Synthetic oligonucleotide; TTT chr11 5210360 5210381 5210377 5210382 +
ccccatggagtcaaggctatct

SEQ ID NO: 81335 - DNA, 22 bp, Artificial Sequence
  Synthetic oligonucleotide; TTC chr11 5210361 5210382 5210378 5210383 +
cccatggagtcaaggctatcta

SEQ ID NO: 81336 - DNA, 22 bp, Artificial Sequence
  Synthetic oligonucleotide; CTA chr11 5210379 5210400 5210396 5210401 +
tctaaacttcctttaagtgcac

SEQ ID NO: 81337 - DNA, 22 bp, Artificial Sequence
  Synthetic oligonucleotide; CTA chr11 5210383 5210404 5210400 5210405 +
aacttcctttaagtgcacaagc

SEQ ID NO: 81338 - DNA, 22 bp, Artificial Sequence
  Synthetic oligonucleotide; CTT chr11 5210388 5210409 5210405 5210410 +
cctttaagtgcacaagctaata

SEQ ID NO: 81339 - DNA, 22 bp, Artificial Sequence
  Synthetic oligonucleotide; TTC chr11 5210389 5210410 5210406 5210411 +
ctttaagtgcacaagctaatat

SEQ ID NO: 81340 - DNA, 22 bp, Artificial Sequence
  Synthetic oligonucleotide; CTT chr11 5210392 5210413 5210409 5210414 +
taagtgcacaagctaatatggt

SEQ ID NO: 81341 - DNA, 22 bp, Artificial Sequence
  Synthetic oligonucleotide; TTT chr11 5210393 5210414 5210410 5210415 +
aagtgcacaagctaatatggta

SEQ ID NO: 81342 - DNA, 22 bp, Artificial Sequence
  Synthetic oligonucleotide; TTA chr11 5210394 5210415 5210411 5210416 +
agtgcacaagctaatatggtag

SEQ ID NO: 81343 - DNA, 22 bp, Artificial Sequence
  Synthetic oligonucleotide; CTA chr11 5210407 5210428 5210424 5210429 +
atatggtagggaaatataaagc

SEQ ID NO: 81344 - DNA, 22 bp, Artificial Sequence
  Synthetic oligonucleotide; CTA chr11 5210432 5210453 5210449 5210454 +
atcctgccatccagaatgagca

SEQ ID NO: 81345 - DNA, 22 bp, Artificial Sequence
  Synthetic oligonucleotide; CTG chr11 5210438 5210459 5210455 5210460 +
ccatccagaatgagcaagtgga

SEQ ID NO: 81346 - DNA, 22 bp, Artificial Sequence
  Synthetic oligonucleotide; CTG chr11 5210495 5210516 5210512 5210517 +
ccaagtctgacctaatgccctc

SEQ ID NO: 81347 - DNA, 22 bp, Artificial Sequence
  Synthetic oligonucleotide; CTG chr11 5210504 5210525 5210521 5210526 +
acctaatgccctctgtttctcc

SEQ ID NO: 81348 - DNA, 22 bp, Artificial Sequence
  Synthetic oligonucleotide; CTA chr11 5210509 5210530 5210526 5210531 +
atgccctctgtttctcccactt

SEQ ID NO: 81349 - DNA, 22 bp, Artificial Sequence
  Synthetic oligonucleotide; CTC chr11 5210517 5210538 5210534 5210539 +
tgtttctcccacttgctctgca

SEQ ID NO: 81350 - DNA, 22 bp, Artificial Sequence
  Synthetic oligonucleotide; CTG chr11 5210519 5210540 5210536 5210541 +
tttctcccacttgctctgcagg

SEQ ID NO: 81351 - DNA, 22 bp, Artificial Sequence
  Synthetic oligonucleotide; TTT chr11 5210522 5210543 5210539 5210544 +
ctcccacttgctctgcaggatg

SEQ ID NO: 81352 - DNA, 22 bp, Artificial Sequence
  Synthetic oligonucleotide; TTC chr11 5210523 5210544 5210540 5210545 +
tcccacttgctctgcaggatgg

SEQ ID NO: 81353 - DNA, 22 bp, Artificial Sequence
  Synthetic oligonucleotide; CTC chr11 5210525 5210546 5210542 5210547 +
ccacttgctctgcaggatggct

SEQ ID NO: 81354 - DNA, 22 bp, Artificial Sequence
  Synthetic oligonucleotide; CTT chr11 5210531 5210552 5210548 5210553 +
gctctgcaggatggcttagcag

SEQ ID NO: 81355 - DNA, 22 bp, Artificial Sequence
  Synthetic oligonucleotide; TTG chr11 5210532 5210553 5210549 5210554 +
ctctgcaggatggcttagcagc

SEQ ID NO: 81356 - DNA, 22 bp, Artificial Sequence
  Synthetic oligonucleotide; CTC chr11 5210535 5210556 5210552 5210557 +
tgcaggatggcttagcagctcc

SEQ ID NO: 81357 - DNA, 22 bp, Artificial Sequence
  Synthetic oligonucleotide; CTG chr11 5210537 5210558 5210554 5210559 +
caggatggcttagcagctccca

SEQ ID NO: 81358 - DNA, 22 bp, Artificial Sequence
  Synthetic oligonucleotide; CTT chr11 5210548 5210569 5210565 5210570 +
agcagctcccagctcagggcct

SEQ ID NO: 81359 - DNA, 22 bp, Artificial Sequence
  Synthetic oligonucleotide; TTA chr11 5210549 5210570 5210566 5210571 +
gcagctcccagctcagggccta

SEQ ID NO: 81360 - DNA, 22 bp, Artificial Sequence
  Synthetic oligonucleotide; CTC chr11 5210556 5210577 5210573 5210578 +
ccagctcagggcctatcagagg

SEQ ID NO: 81361 - DNA, 22 bp, Artificial Sequence
  Synthetic oligonucleotide; CTC chr11 5210563 5210584 5210580 5210585 +
agggcctatcagaggctgagaa

SEQ ID NO: 81362 - DNA, 22 bp, Artificial Sequence
  Synthetic oligonucleotide; CTA chr11 5210571 5210592 5210588 5210593 +
tcagaggctgagaaggtcggcc

SEQ ID NO: 81363 - DNA, 22 bp, Artificial Sequence
  Synthetic oligonucleotide; CTG chr11 5210581 5210602 5210598 5210603 +
agaaggtcggccctctgatgca

SEQ ID NO: 81364 - DNA, 22 bp, Artificial Sequence
  Synthetic oligonucleotide; CTC chr11 5210596 5210617 5210613 5210618 +
tgatgcattttattccttcact

SEQ ID NO: 81365 - DNA, 22 bp, Artificial Sequence
  Synthetic oligonucleotide; CTG chr11 5210598 5210619 5210615 5210620 +
atgcattttattccttcactaa

SEQ ID NO: 81366 - DNA, 22 bp, Artificial Sequence
  Synthetic oligonucleotide; TTT chr11 5210606 5210627 5210623 5210628 +
tattccttcactaacaaagcaa

SEQ ID NO: 81367 - DNA, 22 bp, Artificial Sequence
  Synthetic oligonucleotide; TTT chr11 5210607 5210628 5210624 5210629 +
attccttcactaacaaagcaaa

SEQ ID NO: 81368 - DNA, 22 bp, Artificial Sequence
  Synthetic oligonucleotide; TTA chr11 5210608 5210629 5210625 5210630 +
ttccttcactaacaaagcaaac

SEQ ID NO: 81369 - DNA, 22 bp, Artificial Sequence
  Synthetic oligonucleotide; TTC chr11 5210611 5210632 5210628 5210633 +
cttcactaacaaagcaaaccca

SEQ ID NO: 81370 - DNA, 22 bp, Artificial Sequence
  Synthetic oligonucleotide; CTT chr11 5210614 5210635 5210631 5210636 +
cactaacaaagcaaacccagct

SEQ ID NO: 81371 - DNA, 22 bp, Artificial Sequence
  Synthetic oligonucleotide; TTC chr11 5210615 5210636 5210632 5210637 +
actaacaaagcaaacccagctt

SEQ ID NO: 81372 - DNA, 22 bp, Artificial Sequence
  Synthetic oligonucleotide; CTA chr11 5210619 5210640 5210636 5210641 +
acaaagcaaacccagctttact

SEQ ID NO: 81373 - DNA, 22 bp, Artificial Sequence
  Synthetic oligonucleotide; CTT chr11 5210637 5210658 5210654 5210659 +
tacttctaccctctcctctatg

SEQ ID NO: 81374 - DNA, 22 bp, Artificial Sequence
  Synthetic oligonucleotide; TTT chr11 5210638 5210659 5210655 5210660 +
acttctaccctctcctctatgc

SEQ ID NO: 81375 - DNA, 22 bp, Artificial Sequence
  Synthetic oligonucleotide; TTA chr11 5210639 5210660 5210656 5210661 +
cttctaccctctcctctatgca

SEQ ID NO: 81376 - DNA, 22 bp, Artificial Sequence
  Synthetic oligonucleotide; CTT chr11 5210642 5210663 5210659 5210664 +
ctaccctctcctctatgcactc

SEQ ID NO: 81377 - DNA, 22 bp, Artificial Sequence
  Synthetic oligonucleotide; TTC chr11 5210643 5210664 5210660 5210665 +
taccctctcctctatgcactct

SEQ ID NO: 81378 - DNA, 22 bp, Artificial Sequence
  Synthetic oligonucleotide; CTA chr11 5210645 5210666 5210662 5210667 +
ccctctcctctatgcactctct

SEQ ID NO: 81379 - DNA, 22 bp, Artificial Sequence
  Synthetic oligonucleotide; CTC chr11 5210650 5210671 5210667 5210672 +
tcctctatgcactctctcgggg

SEQ ID NO: 81380 - DNA, 22 bp, Artificial Sequence
  Synthetic oligonucleotide; CTC chr11 5210652 5210673 5210669 5210674 +
ctctatgcactctctcggggca

SEQ ID NO: 81381 - DNA, 22 bp, Artificial Sequence
  Synthetic oligonucleotide; CTC chr11 5210655 5210676 5210672 5210677 +
tatgcactctctcggggcactt

SEQ ID NO: 81382 - DNA, 22 bp, Artificial Sequence
  Synthetic oligonucleotide; CTA chr11 5210657 5210678 5210674 5210679 +
tgcactctctcggggcacttcc

SEQ ID NO: 81383 - DNA, 22 bp, Artificial Sequence
  Synthetic oligonucleotide; CTC chr11 5210664 5210685 5210681 5210686 +
tctcggggcacttcctaatctc

SEQ ID NO: 81384 - DNA, 22 bp, Artificial Sequence
  Synthetic oligonucleotide; CTC chr11 5210666 5210687 5210683 5210688 +
tcggggcacttcctaatctcgt

SEQ ID NO: 81385 - DNA, 22 bp, Artificial Sequence
  Synthetic oligonucleotide; CTC chr11 5210668 5210689 5210685 5210690 +
ggggcacttcctaatctcgtta

SEQ ID NO: 81386 - DNA, 22 bp, Artificial Sequence
  Synthetic oligonucleotide; CTT chr11 5210677 5210698 5210694 5210699 +
cctaatctcgttagtacctttt

SEQ ID NO: 81387 - DNA, 22 bp, Artificial Sequence
  Synthetic oligonucleotide; TTC chr11 5210678 5210699 5210695 5210700 +
ctaatctcgttagtaccttttg

SEQ ID NO: 81388 - DNA, 22 bp, Artificial Sequence
  Synthetic oligonucleotide; CTA chr11 5210681 5210702 5210698 5210703 +
atctcgttagtaccttttgaat

SEQ ID NO: 81389 - DNA, 22 bp, Artificial Sequence
  Synthetic oligonucleotide; CTC chr11 5210686 5210707 5210703 5210708 +
gttagtaccttttgaattagtt

SEQ ID NO: 81390 - DNA, 22 bp, Artificial Sequence
  Synthetic oligonucleotide; TTA chr11 5210690 5210711 5210707 5210712 +
gtaccttttgaattagttttca

SEQ ID NO: 81391 - DNA, 22 bp, Artificial Sequence
  Synthetic oligonucleotide; CTT chr11 5210697 5210718 5210714 5210719 +
ttgaattagttttcaagatagg

SEQ ID NO: 81392 - DNA, 22 bp, Artificial Sequence
  Synthetic oligonucleotide; TTT chr11 5210698 5210719 5210715 5210720 +
tgaattagttttcaagatagga

SEQ ID NO: 81393 - DNA, 22 bp, Artificial Sequence
  Synthetic oligonucleotide; TTT chr11 5210699 5210720 5210716 5210721 +
gaattagttttcaagataggac

SEQ ID NO: 81394 - DNA, 22 bp, Artificial Sequence
  Synthetic oligonucleotide; TTG chr11 5210700 5210721 5210717 5210722 +
aattagttttcaagataggact

SEQ ID NO: 81395 - DNA, 22 bp, Artificial Sequence
  Synthetic oligonucleotide; TTA chr11 5210705 5210726 5210722 5210727 +
gttttcaagataggacttgagt

SEQ ID NO: 81396 - DNA, 22 bp, Artificial Sequence
  Synthetic oligonucleotide; TTT chr11 5210709 5210730 5210726 5210731 +
tcaagataggacttgagttcct

SEQ ID NO: 81397 - DNA, 22 bp, Artificial Sequence
  Synthetic oligonucleotide; TTT chr11 5210710 5210731 5210727 5210732 +
caagataggacttgagttcctc

SEQ ID NO: 81398 - DNA, 22 bp, Artificial Sequence
  Synthetic oligonucleotide; TTC chr11 5210711 5210732 5210728 5210733 +
aagataggacttgagttcctcg

SEQ ID NO: 81399 - DNA, 22 bp, Artificial Sequence
  Synthetic oligonucleotide; CTT chr11 5210723 5210744 5210740 5210745 +
gagttcctcgaaggattagaaa

SEQ ID NO: 81400 - DNA, 22 bp, Artificial Sequence
  Synthetic oligonucleotide; TTG chr11 5210724 5210745 5210741 5210746 +
agttcctcgaaggattagaaaa

SEQ ID NO: 81401 - DNA, 22 bp, Artificial Sequence
  Synthetic oligonucleotide; TTC chr11 5210729 5210750 5210746 5210751 +
ctcgaaggattagaaaataaca

SEQ ID NO: 81402 - DNA, 22 bp, Artificial Sequence
  Synthetic oligonucleotide; CTC chr11 5210732 5210753 5210749 5210754 +
gaaggattagaaaataacagta

SEQ ID NO: 81403 - DNA, 22 bp, Artificial Sequence
  Synthetic oligonucleotide; TTA chr11 5210741 5210762 5210758 5210763 +
gaaaataacagtaacagttcat

SEQ ID NO: 81404 - DNA, 22 bp, Artificial Sequence
  Synthetic oligonucleotide; TTC chr11 5210761 5210782 5210778 5210783 +
atgttgtctgggccaagcacag

SEQ ID NO: 81405 - DNA, 22 bp, Artificial Sequence
  Synthetic oligonucleotide; TTG chr11 5210767 5210788 5210784 5210789 +
tctgggccaagcacagtggctc

SEQ ID NO: 81406 - DNA, 22 bp, Artificial Sequence
  Synthetic oligonucleotide; CTG chr11 5210771 5210792 5210788 5210793 +
ggccaagcacagtggctcacac

SEQ ID NO: 81407 - DNA, 22 bp, Artificial Sequence
  Synthetic oligonucleotide; CTC chr11 5210789 5210810 5210806 5210811 +
acacctgtaatcacagccgagg

SEQ ID NO: 81408 - DNA, 22 bp, Artificial Sequence
  Synthetic oligonucleotide; CTG chr11 5210796 5210817 5210813 5210818 +
taatcacagccgaggccggagg

SEQ ID NO: 81409 - DNA, 22 bp, Artificial Sequence
  Synthetic oligonucleotide; TTT chr11 5210829 5210850 5210846 5210851 +
gagctcaggagttggagaccag

SEQ ID NO: 81410 - DNA, 22 bp, Artificial Sequence
  Synthetic oligonucleotide; TTG chr11 5210830 5210851 5210847 5210852 +
agctcaggagttggagaccagc

SEQ ID NO: 81411 - DNA, 22 bp, Artificial Sequence
  Synthetic oligonucleotide; CTC chr11 5210835 5210856 5210852 5210857 +
aggagttggagaccagcttggg

SEQ ID NO: 81412 - DNA, 22 bp, Artificial Sequence
  Synthetic oligonucleotide; TTG chr11 5210843 5210864 5210860 5210865 +
gagaccagcttgggcaacatgg

SEQ ID NO: 81413 - DNA, 22 bp, Artificial Sequence
  Synthetic oligonucleotide; CTT chr11 5210854 5210875 5210871 5210876 +
gggcaacatggagaaacccctc

SEQ ID NO: 81414 - DNA, 22 bp, Artificial Sequence
  Synthetic oligonucleotide; TTG chr11 5210855 5210876 5210872 5210877 +
ggcaacatggagaaacccctct

SEQ ID NO: 81415 - DNA, 22 bp, Artificial Sequence
  Synthetic oligonucleotide; CTC chr11 5210876 5210897 5210893 5210898 +
tctacaaaaaattttaaaaagt

SEQ ID NO: 81416 - DNA, 22 bp, Artificial Sequence
  Synthetic oligonucleotide; CTC chr11 5210878 5210899 5210895 5210900 +
tacaaaaaattttaaaaagtag

SEQ ID NO: 81417 - DNA, 22 bp, Artificial Sequence
  Synthetic oligonucleotide; CTA chr11 5210880 5210901 5210897 5210902 +
caaaaaattttaaaaagtagcc

SEQ ID NO: 81418 - DNA, 22 bp, Artificial Sequence
  Synthetic oligonucleotide; TTT chr11 5210890 5210911 5210907 5210912 +
taaaaagtagccgaatatggtg

SEQ ID NO: 81419 - DNA, 22 bp, Artificial Sequence
  Synthetic oligonucleotide; TTT chr11 5210891 5210912 5210908 5210913 +
aaaaagtagccgaatatggtgt

SEQ ID NO: 81420 - DNA, 22 bp, Artificial Sequence
  Synthetic oligonucleotide; TTA chr11 5210892 5210913 5210909 5210914 +
aaaagtagccgaatatggtgtt

SEQ ID NO: 81421 - DNA, 22 bp, Artificial Sequence
  Synthetic oligonucleotide; TTA chr11 5210915 5210936 5210932 5210937 +
cgtgcctgtagtcccagctact

SEQ ID NO: 81422 - DNA, 22 bp, Artificial Sequence
  Synthetic oligonucleotide; CTG chr11 5210923 5210944 5210940 5210945 +
tagtcccagctacttgggaggc

SEQ ID NO: 81423 - DNA, 22 bp, Artificial Sequence
  Synthetic oligonucleotide; CTA chr11 5210935 5210956 5210952 5210957 +
cttgggaggctgaggtggaagg

SEQ ID NO: 81424 - DNA, 22 bp, Artificial Sequence
  Synthetic oligonucleotide; CTT chr11 5210938 5210959 5210955 5210960 +
gggaggctgaggtggaaggata

SEQ ID NO: 81425 - DNA, 22 bp, Artificial Sequence
  Synthetic oligonucleotide; TTG chr11 5210939 5210960 5210956 5210961 +
ggaggctgaggtggaaggatat

SEQ ID NO: 81426 - DNA, 22 bp, Artificial Sequence
  Synthetic oligonucleotide; CTG chr11 5210947 5210968 5210964 5210969 +
aggtggaaggatatcttgagcc

SEQ ID NO: 81427 - DNA, 22 bp, Artificial Sequence
  Synthetic oligonucleotide; CTT chr11 5210964 5210985 5210981 5210986 +
gagccaaggagggggagattgc

SEQ ID NO: 81428 - DNA, 22 bp, Artificial Sequence
  Synthetic oligonucleotide; TTG chr11 5210965 5210986 5210982 5210987 +
agccaaggagggggagattgca

SEQ ID NO: 81429 - DNA, 22 bp, Artificial Sequence
  Synthetic oligonucleotide; TTG chr11 5210985 5211006 5211002 5211007 +
cagtgagcaaagattgtaccac

SEQ ID NO: 81430 - DNA, 22 bp, Artificial Sequence
  Synthetic oligonucleotide; TTG chr11 5211001 5211022 5211018 5211023 +
taccactgcactccaacctggg

SEQ ID NO: 81431 - DNA, 22 bp, Artificial Sequence
  Synthetic oligonucleotide; CTG chr11 5211009 5211030 5211026 5211031 +
cactccaacctgggcaacacag

SEQ ID NO: 81432 - DNA, 22 bp, Artificial Sequence
  Synthetic oligonucleotide; CTC chr11 5211014 5211035 5211031 5211036 +
caacctgggcaacacagcgaga

SEQ ID NO: 81433 - DNA, 22 bp, Artificial Sequence
  Synthetic oligonucleotide; CTG chr11 5211021 5211042 5211038 5211043 +
ggcaacacagcgagaccctgtc

SEQ ID NO: 81434 - DNA, 22 bp, Artificial Sequence
  Synthetic oligonucleotide; CTG chr11 5211041 5211062 5211058 5211063 +
tcaaaaaaaaaaaaaagagagc

SEQ ID NO: 81435 - DNA, 22 bp, Artificial Sequence
  Synthetic oligonucleotide; CTA chr11 5211065 5211086 5211082 5211087 +
gaaagaaagaaattaacaattc

SEQ ID NO: 81436 - DNA, 22 bp, Artificial Sequence
  Synthetic oligonucleotide; TTA chr11 5211080 5211101 5211097 5211102 +
acaattcaggttgtcagaagta

SEQ ID NO: 81437 - DNA, 22 bp, Artificial Sequence
  Synthetic oligonucleotide; TTC chr11 5211087 5211108 5211104 5211109 +
aggttgtcagaagtaactgaat

SEQ ID NO: 81438 - DNA, 22 bp, Artificial Sequence
  Synthetic oligonucleotide; TTG chr11 5211093 5211114 5211110 5211115 +
tcagaagtaactgaatgtcttt

SEQ ID NO: 81439 - DNA, 22 bp, Artificial Sequence
  Synthetic oligonucleotide; CTG chr11 5211106 5211127 5211123 5211128 +
aatgtctttaacaaataggagc

SEQ ID NO: 81440 - DNA, 22 bp, Artificial Sequence
  Synthetic oligonucleotide; CTT chr11 5211114 5211135 5211131 5211136 +
taacaaataggagccataggac

SEQ ID NO: 81441 - DNA, 22 bp, Artificial Sequence
  Synthetic oligonucleotide; TTT chr11 5211115 5211136 5211132 5211137 +
aacaaataggagccataggact

SEQ ID NO: 81442 - DNA, 22 bp, Artificial Sequence
  Synthetic oligonucleotide; TTA chr11 5211116 5211137 5211133 5211138 +
acaaataggagccataggacta

SEQ ID NO: 81443 - DNA, 22 bp, Artificial Sequence
  Synthetic oligonucleotide; CTA chr11 5211138 5211159 5211155 5211160 +
aattgctcacattattttgagg

SEQ ID NO: 81444 - DNA, 22 bp, Artificial Sequence
  Synthetic oligonucleotide; TTG chr11 5211143 5211164 5211160 5211165 +
ctcacattattttgagggcaaa

SEQ ID NO: 81445 - DNA, 22 bp, Artificial Sequence
  Synthetic oligonucleotide; CTC chr11 5211146 5211167 5211163 5211168 +
acattattttgagggcaaaaat

SEQ ID NO: 81446 - DNA, 22 bp, Artificial Sequence
  Synthetic oligonucleotide; TTA chr11 5211152 5211173 5211169 5211174 +
ttttgagggcaaaaattacatt

SEQ ID NO: 81447 - DNA, 22 bp, Artificial Sequence
  Synthetic oligonucleotide; TTT chr11 5211155 5211176 5211172 5211177 +
tgagggcaaaaattacattgtc

SEQ ID NO: 81448 - DNA, 22 bp, Artificial Sequence
  Synthetic oligonucleotide; TTT chr11 5211156 5211177 5211173 5211178 +
gagggcaaaaattacattgtca

SEQ ID NO: 81449 - DNA, 22 bp, Artificial Sequence
  Synthetic oligonucleotide; TTG chr11 5211157 5211178 5211174 5211179 +
agggcaaaaattacattgtcat

SEQ ID NO: 81450 - DNA, 22 bp, Artificial Sequence
  Synthetic oligonucleotide; TTA chr11 5211170 5211191 5211187 5211192 +
cattgtcattattttttacctc

SEQ ID NO: 81451 - DNA, 22 bp, Artificial Sequence
  Synthetic oligonucleotide; TTG chr11 5211175 5211196 5211192 5211197 +
tcattattttttacctccaaca

SEQ ID NO: 81452 - DNA, 22 bp, Artificial Sequence
  Synthetic oligonucleotide; TTA chr11 5211181 5211202 5211198 5211203 +
ttttttacctccaacatatata

SEQ ID NO: 81453 - DNA, 22 bp, Artificial Sequence
  Synthetic oligonucleotide; TTT chr11 5211184 5211205 5211201 5211206 +
tttacctccaacatatatacag

SEQ ID NO: 81454 - DNA, 22 bp, Artificial Sequence
  Synthetic oligonucleotide; TTT chr11 5211185 5211206 5211202 5211207 +
ttacctccaacatatatacagt

SEQ ID NO: 81455 - DNA, 22 bp, Artificial Sequence
  Synthetic oligonucleotide; TTT chr11 5211186 5211207 5211203 5211208 +
tacctccaacatatatacagtt

SEQ ID NO: 81456 - DNA, 22 bp, Artificial Sequence
  Synthetic oligonucleotide; TTT chr11 5211187 5211208 5211204 5211209 +
acctccaacatatatacagttt

SEQ ID NO: 81457 - DNA, 22 bp, Artificial Sequence
  Synthetic oligonucleotide; TTA chr11 5211188 5211209 5211205 5211210 +
cctccaacatatatacagtttt

SEQ ID NO: 81458 - DNA, 22 bp, Artificial Sequence
  Synthetic oligonucleotide; CTC chr11 5211192 5211213 5211209 5211214 +
caacatatatacagtttttata

SEQ ID NO: 81459 - DNA, 22 bp, Artificial Sequence
  Synthetic oligonucleotide; TTT chr11 5211209 5211230 5211226 5211231 +
ttatatttactatataggaaca

SEQ ID NO: 81460 - DNA, 22 bp, Artificial Sequence
  Synthetic oligonucleotide; TTT chr11 5211210 5211231 5211227 5211232 +
tatatttactatataggaacac

SEQ ID NO: 81461 - DNA, 22 bp, Artificial Sequence
  Synthetic oligonucleotide; TTT chr11 5211211 5211232 5211228 5211233 +
atatttactatataggaacaca

SEQ ID NO: 81462 - DNA, 22 bp, Artificial Sequence
  Synthetic oligonucleotide; TTA chr11 5211212 5211233 5211229 5211234 +
tatttactatataggaacacaa

SEQ ID NO: 81463 - DNA, 22 bp, Artificial Sequence
  Synthetic oligonucleotide; TTT chr11 5211217 5211238 5211234 5211239 +
actatataggaacacaataaat

SEQ ID NO: 81464 - DNA, 22 bp, Artificial Sequence
  Synthetic oligonucleotide; TTA chr11 5211218 5211239 5211235 5211240 +
ctatataggaacacaataaatg

SEQ ID NO: 81465 - DNA, 22 bp, Artificial Sequence
  Synthetic oligonucleotide; CTA chr11 5211221 5211242 5211238 5211243 +
tataggaacacaataaatgctt

SEQ ID NO: 81466 - DNA, 22 bp, Artificial Sequence
  Synthetic oligonucleotide; CTT chr11 5211243 5211264 5211260 5211265 +
gttgcataaaatcaaattacaa

SEQ ID NO: 81467 - DNA, 22 bp, Artificial Sequence
  Synthetic oligonucleotide; TTG chr11 5211244 5211265 5211261 5211266 +
ttgcataaaatcaaattacaaa

SEQ ID NO: 81468 - DNA, 22 bp, Artificial Sequence
  Synthetic oligonucleotide; TTG chr11 5211247 5211268 5211264 5211269 +
cataaaatcaaattacaaagaa

SEQ ID NO: 81469 - DNA, 22 bp, Artificial Sequence
  Synthetic oligonucleotide; TTA chr11 5211262 5211283 5211279 5211284 +
caaagaaggacagagaatcatt

SEQ ID NO: 81470 - DNA, 22 bp, Artificial Sequence
  Synthetic oligonucleotide; TTA chr11 5211285 5211306 5211302 5211307 +
aattactttcataatgcgcata

SEQ ID NO: 81471 - DNA, 22 bp, Artificial Sequence
  Synthetic oligonucleotide; TTA chr11 5211290 5211311 5211307 5211312 +
ctttcataatgcgcataaaaca

SEQ ID NO: 81472 - DNA, 22 bp, Artificial Sequence
  Synthetic oligonucleotide; CTT chr11 5211293 5211314 5211310 5211315 +
tcataatgcgcataaaacaaca

SEQ ID NO: 81473 - DNA, 22 bp, Artificial Sequence
  Synthetic oligonucleotide; TTT chr11 5211294 5211315 5211311 5211316 +
cataatgcgcataaaacaacat

SEQ ID NO: 81474 - DNA, 22 bp, Artificial Sequence
  Synthetic oligonucleotide; TTC chr11 5211295 5211316 5211312 5211317 +
ataatgcgcataaaacaacatt

SEQ ID NO: 81475 - DNA, 22 bp, Artificial Sequence
  Synthetic oligonucleotide; TTT chr11 5211318 5211339 5211335 5211340 +
tgttagacttaaaaacaagctg

SEQ ID NO: 81476 - DNA, 22 bp, Artificial Sequence
  Synthetic oligonucleotide; TTT chr11 5211319 5211340 5211336 5211341 +
gttagacttaaaaacaagctga

SEQ ID NO: 81477 - DNA, 22 bp, Artificial Sequence
  Synthetic oligonucleotide; TTG chr11 5211320 5211341 5211337 5211342 +
ttagacttaaaaacaagctgat

SEQ ID NO: 81478 - DNA, 22 bp, Artificial Sequence
  Synthetic oligonucleotide; TTA chr11 5211323 5211344 5211340 5211345 +
gacttaaaaacaagctgattat

SEQ ID NO: 81479 - DNA, 22 bp, Artificial Sequence
  Synthetic oligonucleotide; CTT chr11 5211328 5211349 5211345 5211350 +
aaaaacaagctgattataacta

SEQ ID NO: 81480 - DNA, 22 bp, Artificial Sequence
  Synthetic oligonucleotide; TTA chr11 5211329 5211350 5211346 5211351 +
aaaacaagctgattataactat

SEQ ID NO: 81481 - DNA, 22 bp, Artificial Sequence
  Synthetic oligonucleotide; CTG chr11 5211340 5211361 5211357 5211362 +
attataactataaaaagatatg

SEQ ID NO: 81482 - DNA, 22 bp, Artificial Sequence
  Synthetic oligonucleotide; TTA chr11 5211344 5211365 5211361 5211366 +
taactataaaaagatatgtgac

SEQ ID NO: 81483 - DNA, 22 bp, Artificial Sequence
  Synthetic oligonucleotide; CTA chr11 5211350 5211371 5211367 5211372 +
taaaaagatatgtgactaatag

SEQ ID NO: 81484 - DNA, 22 bp, Artificial Sequence
  Synthetic oligonucleotide; CTA chr11 5211368 5211389 5211385 5211390 +
ataggtggaaagaggagcaagg

SEQ ID NO: 81485 - DNA, 22 bp, Artificial Sequence
  Synthetic oligonucleotide; CTG chr11 5211416 5211437 5211433 5211438 +
ctaaagactcacgatggtttgt

SEQ ID NO: 81486 - DNA, 22 bp, Artificial Sequence
  Synthetic oligonucleotide; CTA chr11 5211419 5211440 5211436 5211441 +
aagactcacgatggtttgttac

SEQ ID NO: 81487 - DNA, 22 bp, Artificial Sequence
  Synthetic oligonucleotide; CTC chr11 5211426 5211447 5211443 5211448 +
acgatggtttgttacatagcta

SEQ ID NO: 81488 - DNA, 22 bp, Artificial Sequence
  Synthetic oligonucleotide; TTT chr11 5211436 5211457 5211453 5211458 +
gttacatagctaaacacatgtc

SEQ ID NO: 81489 - DNA, 22 bp, Artificial Sequence
  Synthetic oligonucleotide; TTG chr11 5211437 5211458 5211454 5211459 +
ttacatagctaaacacatgtca

SEQ ID NO: 81490 - DNA, 22 bp, Artificial Sequence
  Synthetic oligonucleotide; TTA chr11 5211440 5211461 5211457 5211462 +
catagctaaacacatgtcatgg

SEQ ID NO: 81491 - DNA, 22 bp, Artificial Sequence
  Synthetic oligonucleotide; CTA chr11 5211448 5211469 5211465 5211470 +
aacacatgtcatgggtttgtcg

SEQ ID NO: 81492 - DNA, 22 bp, Artificial Sequence
  Synthetic oligonucleotide; TTT chr11 5211466 5211487 5211483 5211488 +
gtcgtacagattatttcatctc

SEQ ID NO: 81493 - DNA, 22 bp, Artificial Sequence
  Synthetic oligonucleotide; TTG chr11 5211467 5211488 5211484 5211489 +
tcgtacagattatttcatctcc

SEQ ID NO: 81494 - DNA, 22 bp, Artificial Sequence
  Synthetic oligonucleotide; TTA chr11 5211479 5211500 5211496 5211501 +
tttcatctcccagtactcaata

SEQ ID NO: 81495 - DNA, 22 bp, Artificial Sequence
  Synthetic oligonucleotide; TTT chr11 5211482 5211503 5211499 5211504 +
catctcccagtactcaatagtt

SEQ ID NO: 81496 - DNA, 22 bp, Artificial Sequence
  Synthetic oligonucleotide; TTC chr11 5211483 5211504 5211500 5211505 +
atctcccagtactcaatagtta

SEQ ID NO: 81497 - DNA, 22 bp, Artificial Sequence
  Synthetic oligonucleotide; CTC chr11 5211488 5211509 5211505 5211510 +
ccagtactcaatagttactttt

SEQ ID NO: 81498 - DNA, 22 bp, Artificial Sequence
  Synthetic oligonucleotide; CTC chr11 5211497 5211518 5211514 5211519 +
aatagttactttttctgctctt

SEQ ID NO: 81499 - DNA, 22 bp, Artificial Sequence
  Synthetic oligonucleotide; TTA chr11 5211505 5211526 5211522 5211527 +
ctttttctgctcttctccccgt

SEQ ID NO: 81500 - DNA, 22 bp, Artificial Sequence
  Synthetic oligonucleotide; CTT chr11 5211508 5211529 5211525 5211530 +
tttctgctcttctccccgttcc

SEQ ID NO: 81501 - DNA, 22 bp, Artificial Sequence
  Synthetic oligonucleotide; TTT chr11 5211509 5211530 5211526 5211531 +
ttctgctcttctccccgttccc

SEQ ID NO: 81502 - DNA, 22 bp, Artificial Sequence
  Synthetic oligonucleotide; TTT chr11 5211510 5211531 5211527 5211532 +
tctgctcttctccccgttccca

SEQ ID NO: 81503 - DNA, 22 bp, Artificial Sequence
  Synthetic oligonucleotide; TTT chr11 5211511 5211532 5211528 5211533 +
ctgctcttctccccgttcccac

SEQ ID NO: 81504 - DNA, 22 bp, Artificial Sequence
  Synthetic oligonucleotide; TTC chr11 5211512 5211533 5211529 5211534 +
tgctcttctccccgttcccacc

SEQ ID NO: 81505 - DNA, 22 bp, Artificial Sequence
  Synthetic oligonucleotide; CTG chr11 5211514 5211535 5211531 5211536 +
ctcttctccccgttcccaccct

SEQ ID NO: 81506 - DNA, 22 bp, Artificial Sequence
  Synthetic oligonucleotide; CTC chr11 5211517 5211538 5211534 5211539 +
ttctccccgttcccaccctcca

SEQ ID NO: 81507 - DNA, 22 bp, Artificial Sequence
  Synthetic oligonucleotide; CTT chr11 5211519 5211540 5211536 5211541 +
ctccccgttcccaccctccaaa

SEQ ID NO: 81508 - DNA, 22 bp, Artificial Sequence
  Synthetic oligonucleotide; TTC chr11 5211520 5211541 5211537 5211542 +
tccccgttcccaccctccaaac

SEQ ID NO: 81509 - DNA, 22 bp, Artificial Sequence
  Synthetic oligonucleotide; CTC chr11 5211522 5211543 5211539 5211544 +
cccgttcccaccctccaaactc

SEQ ID NO: 81510 - DNA, 22 bp, Artificial Sequence
  Synthetic oligonucleotide; TTC chr11 5211529 5211550 5211546 5211551 +
ccaccctccaaactcaattagg

SEQ ID NO: 81511 - DNA, 22 bp, Artificial Sequence
  Synthetic oligonucleotide; CTC chr11 5211537 5211558 5211554 5211559 +
caaactcaattaggctgcagtg

SEQ ID NO: 81512 - DNA, 22 bp, Artificial Sequence
  Synthetic oligonucleotide; CTC chr11 5211544 5211565 5211561 5211566 +
aattaggctgcagtgtcttttg

SEQ ID NO: 81513 - DNA, 22 bp, Artificial Sequence
  Synthetic oligonucleotide; TTA chr11 5211549 5211570 5211566 5211571 +
ggctgcagtgtcttttgttccc

SEQ ID NO: 81514 - DNA, 22 bp, Artificial Sequence
  Synthetic oligonucleotide; CTG chr11 5211554 5211575 5211571 5211576 +
cagtgtcttttgttcccgttat

SEQ ID NO: 81515 - DNA, 22 bp, Artificial Sequence
  Synthetic oligonucleotide; CTT chr11 5211563 5211584 5211580 5211585 +
ttgttcccgttatgtgtgcatg

SEQ ID NO: 81516 - DNA, 22 bp, Artificial Sequence
  Synthetic oligonucleotide; TTT chr11 5211564 5211585 5211581 5211586 +
tgttcccgttatgtgtgcatgt

SEQ ID NO: 81517 - DNA, 22 bp, Artificial Sequence
  Synthetic oligonucleotide; TTT chr11 5211565 5211586 5211582 5211587 +
gttcccgttatgtgtgcatgtt

SEQ ID NO: 81518 - DNA, 22 bp, Artificial Sequence
  Synthetic oligonucleotide; TTG chr11 5211566 5211587 5211583 5211588 +
ttcccgttatgtgtgcatgttt

SEQ ID NO: 81519 - DNA, 22 bp, Artificial Sequence
  Synthetic oligonucleotide; TTC chr11 5211569 5211590 5211586 5211591 +
ccgttatgtgtgcatgttttct

SEQ ID NO: 81520 - DNA, 22 bp, Artificial Sequence
  Synthetic oligonucleotide; TTA chr11 5211575 5211596 5211592 5211597 +
tgtgtgcatgttttctcatcat

SEQ ID NO: 81521 - DNA, 22 bp, Artificial Sequence
  Synthetic oligonucleotide; TTT chr11 5211588 5211609 5211605 5211610 +
tctcatcatttagttcctactt

SEQ ID NO: 81522 - DNA, 22 bp, Artificial Sequence
  Synthetic oligonucleotide; TTT chr11 5211589 5211610 5211606 5211611 +
ctcatcatttagttcctacttg

SEQ ID NO: 81523 - DNA, 22 bp, Artificial Sequence
  Synthetic oligonucleotide; TTC chr11 5211590 5211611 5211607 5211612 +
tcatcatttagttcctacttgt

SEQ ID NO: 81524 - DNA, 22 bp, Artificial Sequence
  Synthetic oligonucleotide; CTC chr11 5211592 5211613 5211609 5211614 +
atcatttagttcctacttgtaa

SEQ ID NO: 81525 - DNA, 22 bp, Artificial Sequence
  Synthetic oligonucleotide; TTT chr11 5211599 5211620 5211616 5211621 +
agttcctacttgtaagtgataa

SEQ ID NO: 81526 - DNA, 22 bp, Artificial Sequence
  Synthetic oligonucleotide; TTA chr11 5211600 5211621 5211617 5211622 +
gttcctacttgtaagtgataat

SEQ ID NO: 81527 - DNA, 22 bp, Artificial Sequence
  Synthetic oligonucleotide; TTC chr11 5211604 5211625 5211621 5211626 +
ctacttgtaagtgataatatgt

SEQ ID NO: 81528 - DNA, 22 bp, Artificial Sequence
  Synthetic oligonucleotide; CTA chr11 5211607 5211628 5211624 5211629 +
cttgtaagtgataatatgtagt

SEQ ID NO: 81529 - DNA, 22 bp, Artificial Sequence
  Synthetic oligonucleotide; CTT chr11 5211610 5211631 5211627 5211632 +
gtaagtgataatatgtagtatt

SEQ ID NO: 81530 - DNA, 22 bp, Artificial Sequence
  Synthetic oligonucleotide; TTG chr11 5211611 5211632 5211628 5211633 +
taagtgataatatgtagtattt

SEQ ID NO: 81531 - DNA, 22 bp, Artificial Sequence
  Synthetic oligonucleotide; TTT chr11 5211633 5211654 5211650 5211655 +
ggttttctgttcttacattagt

SEQ ID NO: 81532 - DNA, 22 bp, Artificial Sequence
  Synthetic oligonucleotide; TTG chr11 5211634 5211655 5211651 5211656 +
gttttctgttcttacattagtt

SEQ ID NO: 81533 - DNA, 22 bp, Artificial Sequence
  Synthetic oligonucleotide; TTT chr11 5211638 5211659 5211655 5211660 +
tctgttcttacattagtttgtt

SEQ ID NO: 81534 - DNA, 22 bp, Artificial Sequence
  Synthetic oligonucleotide; TTT chr11 5211639 5211660 5211656 5211661 +
ctgttcttacattagtttgtta

SEQ ID NO: 81535 - DNA, 22 bp, Artificial Sequence
  Synthetic oligonucleotide; TTC chr11 5211640 5211661 5211657 5211662 +
tgttcttacattagtttgttaa

SEQ ID NO: 81536 - DNA, 22 bp, Artificial Sequence
  Synthetic oligonucleotide; CTG chr11 5211642 5211663 5211659 5211664 +
ttcttacattagtttgttaagg

SEQ ID NO: 81537 - DNA, 22 bp, Artificial Sequence
  Synthetic oligonucleotide; TTC chr11 5211645 5211666 5211662 5211667 +
ttacattagtttgttaaggata

SEQ ID NO: 81538 - DNA, 22 bp, Artificial Sequence
  Synthetic oligonucleotide; CTT chr11 5211647 5211668 5211664 5211669 +
acattagtttgttaaggataat

SEQ ID NO: 81539 - DNA, 22 bp, Artificial Sequence
  Synthetic oligonucleotide; TTA chr11 5211648 5211669 5211665 5211670 +
cattagtttgttaaggataatg

SEQ ID NO: 81540 - DNA, 22 bp, Artificial Sequence
  Synthetic oligonucleotide; TTA chr11 5211653 5211674 5211670 5211675 +
gtttgttaaggataatggtgtc

SEQ ID NO: 81541 - DNA, 22 bp, Artificial Sequence
  Synthetic oligonucleotide; TTT chr11 5211657 5211678 5211674 5211679 +
gttaaggataatggtgtccggc

SEQ ID NO: 81542 - DNA, 22 bp, Artificial Sequence
  Synthetic oligonucleotide; TTG chr11 5211658 5211679 5211675 5211680 +
ttaaggataatggtgtccggct

SEQ ID NO: 81543 - DNA, 22 bp, Artificial Sequence
  Synthetic oligonucleotide; TTA chr11 5211661 5211682 5211678 5211683 +
aggataatggtgtccggctcca

SEQ ID NO: 81544 - DNA, 22 bp, Artificial Sequence
  Synthetic oligonucleotide; CTC chr11 5211681 5211702 5211698 5211703 +
catccatgttcctgcaaaggac

SEQ ID NO: 81545 - DNA, 22 bp, Artificial Sequence
  Synthetic oligonucleotide; TTC chr11 5211692 5211713 5211709 5211714 +
ctgcaaaggacatgatctcatt

SEQ ID NO: 81546 - DNA, 22 bp, Artificial Sequence
  Synthetic oligonucleotide; CTG chr11 5211695 5211716 5211712 5211717 +
caaaggacatgatctcattctt

SEQ ID NO: 81547 - DNA, 22 bp, Artificial Sequence
  Synthetic oligonucleotide; CTC chr11 5211711 5211732 5211728 5211733 +
attcttttttatggccacatag

SEQ ID NO: 81548 - DNA, 22 bp, Artificial Sequence
  Synthetic oligonucleotide; TTC chr11 5211715 5211736 5211732 5211737 +
ttttttatggccacatagtatt

SEQ ID NO: 81549 - DNA, 22 bp, Artificial Sequence
  Synthetic oligonucleotide; CTT chr11 5211717 5211738 5211734 5211739 +
ttttatggccacatagtattcc

SEQ ID NO: 81550 - DNA, 22 bp, Artificial Sequence
  Synthetic oligonucleotide; TTT chr11 5211718 5211739 5211735 5211740 +
tttatggccacatagtattcca

SEQ ID NO: 81551 - DNA, 22 bp, Artificial Sequence
  Synthetic oligonucleotide; TTT chr11 5211719 5211740 5211736 5211741 +
ttatggccacatagtattccat

SEQ ID NO: 81552 - DNA, 22 bp, Artificial Sequence
  Synthetic oligonucleotide; TTT chr11 5211720 5211741 5211737 5211742 +
tatggccacatagtattccatg

SEQ ID NO: 81553 - DNA, 22 bp, Artificial Sequence
  Synthetic oligonucleotide; TTT chr11 5211721 5211742 5211738 5211743 +
atggccacatagtattccatgg

SEQ ID NO: 81554 - DNA, 22 bp, Artificial Sequence
  Synthetic oligonucleotide; TTA chr11 5211722 5211743 5211739 5211744 +
tggccacatagtattccatggt

SEQ ID NO: 81555 - DNA, 22 bp, Artificial Sequence
  Synthetic oligonucleotide; TTC chr11 5211738 5211759 5211755 5211760 +
catggtgtatatgtacatgttc

SEQ ID NO: 81556 - DNA, 22 bp, Artificial Sequence
  Synthetic oligonucleotide; TTC chr11 5211760 5211781 5211777 5211782 +
tttatcggtataccactaatgg

SEQ ID NO: 81557 - DNA, 22 bp, Artificial Sequence
  Synthetic oligonucleotide; CTT chr11 5211762 5211783 5211779 5211784 +
tatcggtataccactaatgggc

SEQ ID NO: 81558 - DNA, 22 bp, Artificial Sequence
  Synthetic oligonucleotide; TTT chr11 5211763 5211784 5211780 5211785 +
atcggtataccactaatgggcc

SEQ ID NO: 81559 - DNA, 22 bp, Artificial Sequence
  Synthetic oligonucleotide; TTA chr11 5211764 5211785 5211781 5211786 +
tcggtataccactaatgggcct

SEQ ID NO: 81560 - DNA, 22 bp, Artificial Sequence
  Synthetic oligonucleotide; CTA chr11 5211778 5211799 5211795 5211800 +
atgggccttcaggttgattcta

SEQ ID NO: 81561 - DNA, 22 bp, Artificial Sequence
  Synthetic oligonucleotide; CTT chr11 5211787 5211808 5211804 5211809 +
caggttgattctatgtctttgc

SEQ ID NO: 81562 - DNA, 22 bp, Artificial Sequence
  Synthetic oligonucleotide; TTC chr11 5211788 5211809 5211805 5211810 +
aggttgattctatgtctttgct

SEQ ID NO: 81563 - DNA, 22 bp, Artificial Sequence
  Synthetic oligonucleotide; TTG chr11 5211794 5211815 5211811 5211816 +
attctatgtctttgctattgtg

SEQ ID NO: 81564 - DNA, 22 bp, Artificial Sequence
  Synthetic oligonucleotide; TTC chr11 5211798 5211819 5211815 5211820 +
tatgtctttgctattgtgatta

SEQ ID NO: 81565 - DNA, 22 bp, Artificial Sequence
  Synthetic oligonucleotide; CTA chr11 5211800 5211821 5211817 5211822 +
tgtctttgctattgtgattatg

SEQ ID NO: 81566 - DNA, 22 bp, Artificial Sequence
  Synthetic oligonucleotide; CTT chr11 5211806 5211827 5211823 5211828 +
tgctattgtgattatgctgcaa

SEQ ID NO: 81567 - DNA, 22 bp, Artificial Sequence
  Synthetic oligonucleotide; TTT chr11 5211807 5211828 5211824 5211829 +
gctattgtgattatgctgcaat

SEQ ID NO: 81568 - DNA, 22 bp, Artificial Sequence
  Synthetic oligonucleotide; TTG chr11 5211808 5211829 5211825 5211830 +
ctattgtgattatgctgcaatg

SEQ ID NO: 81569 - DNA, 22 bp, Artificial Sequence
  Synthetic oligonucleotide; CTA chr11 5211811 5211832 5211828 5211833 +
ttgtgattatgctgcaatggac

SEQ ID NO: 81570 - DNA, 22 bp, Artificial Sequence
  Synthetic oligonucleotide; TTG chr11 5211814 5211835 5211831 5211836 +
tgattatgctgcaatggacaca

SEQ ID NO: 81571 - DNA, 22 bp, Artificial Sequence
  Synthetic oligonucleotide; TTA chr11 5211820 5211841 5211837 5211842 +
tgctgcaatggacacaggtgtg

SEQ ID NO: 81572 - DNA, 22 bp, Artificial Sequence
  Synthetic oligonucleotide; CTG chr11 5211825 5211846 5211842 5211847 +
caatggacacaggtgtgcatgt

SEQ ID NO: 81573 - DNA, 22 bp, Artificial Sequence
  Synthetic oligonucleotide; CTT chr11 5211852 5211873 5211869 5211874 +
tgtgatagaatggtttattttc

SEQ ID NO: 81574 - DNA, 22 bp, Artificial Sequence
  Synthetic oligonucleotide; TTT chr11 5211853 5211874 5211870 5211875 +
gtgatagaatggtttattttcc

SEQ ID NO: 81575 - DNA, 22 bp, Artificial Sequence
  Synthetic oligonucleotide; TTG chr11 5211854 5211875 5211871 5211876 +
tgatagaatggtttattttcct

SEQ ID NO: 81576 - DNA, 22 bp, Artificial Sequence
  Synthetic oligonucleotide; TTT chr11 5211868 5211889 5211885 5211890 +
attttcctttaggtatatactc

SEQ ID NO: 81577 - DNA, 22 bp, Artificial Sequence
  Synthetic oligonucleotide; TTA chr11 5211869 5211890 5211886 5211891 +
ttttcctttaggtatatactca

SEQ ID NO: 81578 - DNA, 22 bp, Artificial Sequence
  Synthetic oligonucleotide; TTT chr11 5211872 5211893 5211889 5211894 +
tcctttaggtatatactcaata

SEQ ID NO: 81579 - DNA, 22 bp, Artificial Sequence
  Synthetic oligonucleotide; TTT chr11 5211873 5211894 5211890 5211895 +
cctttaggtatatactcaataa

SEQ ID NO: 81580 - DNA, 22 bp, Artificial Sequence
  Synthetic oligonucleotide; TTC chr11 5211874 5211895 5211891 5211896 +
ctttaggtatatactcaataat

SEQ ID NO: 81581 - DNA, 22 bp, Artificial Sequence
  Synthetic oligonucleotide; CTT chr11 5211877 5211898 5211894 5211899 +
taggtatatactcaataatagg

SEQ ID NO: 81582 - DNA, 22 bp, Artificial Sequence
  Synthetic oligonucleotide; TTT chr11 5211878 5211899 5211895 5211900 +
aggtatatactcaataatagga

SEQ ID NO: 81583 - DNA, 22 bp, Artificial Sequence
  Synthetic oligonucleotide; TTA chr11 5211879 5211900 5211896 5211901 +
ggtatatactcaataataggat

SEQ ID NO: 81584 - DNA, 22 bp, Artificial Sequence
  Synthetic oligonucleotide; CTC chr11 5211890 5211911 5211907 5211912 +
aataataggattgttgggttaa

SEQ ID NO: 81585 - DNA, 22 bp, Artificial Sequence
  Synthetic oligonucleotide; TTG chr11 5211903 5211924 5211920 5211925 +
ttgggttaaatggtatttctgt

SEQ ID NO: 81586 - DNA, 22 bp, Artificial Sequence
  Synthetic oligonucleotide; TTG chr11 5211906 5211927 5211923 5211928 +
ggttaaatggtatttctgtttt

SEQ ID NO: 81587 - DNA, 22 bp, Artificial Sequence
  Synthetic oligonucleotide; TTA chr11 5211911 5211932 5211928 5211933 +
aatggtatttctgtttttaggt

SEQ ID NO: 81588 - DNA, 22 bp, Artificial Sequence
  Synthetic oligonucleotide; TTT chr11 5211921 5211942 5211938 5211943 +
ctgtttttaggtctttagggaa

SEQ ID NO: 81589 - DNA, 22 bp, Artificial Sequence
  Synthetic oligonucleotide; TTC chr11 5211922 5211943 5211939 5211944 +
tgtttttaggtctttagggaat

SEQ ID NO: 81590 - DNA, 22 bp, Artificial Sequence
  Synthetic oligonucleotide; CTG chr11 5211924 5211945 5211941 5211946 +
tttttaggtctttagggaattg

SEQ ID NO: 81591 - DNA, 22 bp, Artificial Sequence
  Synthetic oligonucleotide; TTT chr11 5211927 5211948 5211944 5211949 +
ttaggtctttagggaattgcca

SEQ ID NO: 81592 - DNA, 22 bp, Artificial Sequence
  Synthetic oligonucleotide; TTT chr11 5211928 5211949 5211945 5211950 +
taggtctttagggaattgccac

SEQ ID NO: 81593 - DNA, 22 bp, Artificial Sequence
  Synthetic oligonucleotide; TTT chr11 5211929 5211950 5211946 5211951 +
aggtctttagggaattgccaca

SEQ ID NO: 81594 - DNA, 22 bp, Artificial Sequence
  Synthetic oligonucleotide; TTA chr11 5211930 5211951 5211947 5211952 +
ggtctttagggaattgccacac

SEQ ID NO: 81595 - DNA, 22 bp, Artificial Sequence
  Synthetic oligonucleotide; CTT chr11 5211936 5211957 5211953 5211958 +
tagggaattgccacactgctgt

SEQ ID NO: 81596 - DNA, 22 bp, Artificial Sequence
  Synthetic oligonucleotide; TTT chr11 5211937 5211958 5211954 5211959 +
agggaattgccacactgctgtc

SEQ ID NO: 81597 - DNA, 22 bp, Artificial Sequence
  Synthetic oligonucleotide; TTA chr11 5211938 5211959 5211955 5211960 +
gggaattgccacactgctgtct

SEQ ID NO: 81598 - DNA, 22 bp, Artificial Sequence
  Synthetic oligonucleotide; TTG chr11 5211946 5211967 5211963 5211968 +
ccacactgctgtctacaatggt

SEQ ID NO: 81599 - DNA, 22 bp, Artificial Sequence
  Synthetic oligonucleotide; CTG chr11 5211954 5211975 5211971 5211976 +
ctgtctacaatggtcgaactaa

SEQ ID NO: 81600 - DNA, 22 bp, Artificial Sequence
  Synthetic oligonucleotide; CTG chr11 5211957 5211978 5211974 5211979 +
tctacaatggtcgaactaattt

SEQ ID NO: 81601 - DNA, 22 bp, Artificial Sequence
  Synthetic oligonucleotide; CTA chr11 5211961 5211982 5211978 5211983 +
caatggtcgaactaatttatat

SEQ ID NO: 81602 - DNA, 22 bp, Artificial Sequence
  Synthetic oligonucleotide; CTA chr11 5211975 5211996 5211992 5211997 +
atttatattgccaccaatggtg

SEQ ID NO: 81603 - DNA, 22 bp, Artificial Sequence
  Synthetic oligonucleotide; TTT chr11 5211979 5212000 5211996 5212001 +
atattgccaccaatggtgtata

SEQ ID NO: 81604 - DNA, 22 bp, Artificial Sequence
  Synthetic oligonucleotide; TTA chr11 5211980 5212001 5211997 5212002 +
tattgccaccaatggtgtataa

SEQ ID NO: 81605 - DNA, 22 bp, Artificial Sequence
  Synthetic oligonucleotide; TTG chr11 5211985 5212006 5212002 5212007 +
ccaccaatggtgtataaacatt

SEQ ID NO: 81606 - DNA, 22 bp, Artificial Sequence
  Synthetic oligonucleotide; TTC chr11 5212008 5212029 5212025 5212030 +
ccttttctccacaaccttaccc

SEQ ID NO: 81607 - DNA, 22 bp, Artificial Sequence
  Synthetic oligonucleotide; CTT chr11 5212012 5212033 5212029 5212034 +
ttctccacaaccttacccacat

SEQ ID NO: 81608 - DNA, 22 bp, Artificial Sequence
  Synthetic oligonucleotide; TTT chr11 5212013 5212034 5212030 5212035 +
tctccacaaccttacccacatc

SEQ ID NO: 81609 - DNA, 22 bp, Artificial Sequence
  Synthetic oligonucleotide; TTT chr11 5212014 5212035 5212031 5212036 +
ctccacaaccttacccacatct

SEQ ID NO: 81610 - DNA, 22 bp, Artificial Sequence
  Synthetic oligonucleotide; TTC chr11 5212015 5212036 5212032 5212037 +
tccacaaccttacccacatctg

SEQ ID NO: 81611 - DNA, 22 bp, Artificial Sequence
  Synthetic oligonucleotide; CTC chr11 5212017 5212038 5212034 5212039 +
cacaaccttacccacatctgtt

SEQ ID NO: 81612 - DNA, 22 bp, Artificial Sequence
  Synthetic oligonucleotide; CTT chr11 5212026 5212047 5212043 5212048 +
acccacatctgttattttttga

SEQ ID NO: 81613 - DNA, 22 bp, Artificial Sequence
  Synthetic oligonucleotide; TTA chr11 5212027 5212048 5212044 5212049 +
cccacatctgttattttttgac

SEQ ID NO: 81614 - DNA, 22 bp, Artificial Sequence
  Synthetic oligonucleotide; CTG chr11 5212037 5212058 5212054 5212059 +
ttattttttgactatttaatta

SEQ ID NO: 81615 - DNA, 22 bp, Artificial Sequence
  Synthetic oligonucleotide; TTA chr11 5212040 5212061 5212057 5212062 +
ttttttgactatttaattatag

SEQ ID NO: 81616 - DNA, 22 bp, Artificial Sequence
  Synthetic oligonucleotide; TTT chr11 5212043 5212064 5212060 5212065 +
tttgactatttaattatagata

SEQ ID NO: 81617 - DNA, 22 bp, Artificial Sequence
  Synthetic oligonucleotide; TTT chr11 5212044 5212065 5212061 5212066 +
ttgactatttaattatagatat

SEQ ID NO: 81618 - DNA, 22 bp, Artificial Sequence
  Synthetic oligonucleotide; TTT chr11 5212045 5212066 5212062 5212067 +
tgactatttaattatagatatt

SEQ ID NO: 81619 - DNA, 22 bp, Artificial Sequence
  Synthetic oligonucleotide; TTT chr11 5212046 5212067 5212063 5212068 +
gactatttaattatagatattt

SEQ ID NO: 81620 - DNA, 22 bp, Artificial Sequence
  Synthetic oligonucleotide; TTG chr11 5212047 5212068 5212064 5212069 +
actatttaattatagatatttt

SEQ ID NO: 81621 - DNA, 22 bp, Artificial Sequence
  Synthetic oligonucleotide; CTA chr11 5212051 5212072 5212068 5212073 +
tttaattatagatattttaagt

SEQ ID NO: 81622 - DNA, 22 bp, Artificial Sequence
  Synthetic oligonucleotide; TTT chr11 5212054 5212075 5212071 5212076 +
aattatagatattttaagtgat

SEQ ID NO: 81623 - DNA, 22 bp, Artificial Sequence
  Synthetic oligonucleotide; TTA chr11 5212055 5212076 5212072 5212077 +
attatagatattttaagtgatg

SEQ ID NO: 81624 - DNA, 22 bp, Artificial Sequence
  Synthetic oligonucleotide; TTA chr11 5212059 5212080 5212076 5212081 +
tagatattttaagtgatgtgag

SEQ ID NO: 81625 - DNA, 22 bp, Artificial Sequence
  Synthetic oligonucleotide; TTT chr11 5212068 5212089 5212085 5212090 +
taagtgatgtgagatagtatct

SEQ ID NO: 81626 - DNA, 22 bp, Artificial Sequence
  Synthetic oligonucleotide; TTT chr11 5212069 5212090 5212086 5212091 +
aagtgatgtgagatagtatctc

SEQ ID NO: 81627 - DNA, 22 bp, Artificial Sequence
  Synthetic oligonucleotide; TTA chr11 5212070 5212091 5212087 5212092 +
agtgatgtgagatagtatctca

SEQ ID NO: 81628 - DNA, 22 bp, Artificial Sequence
  Synthetic oligonucleotide; CTC chr11 5212091 5212112 5212108 5212113 +
attttgggtttgattggcattt

SEQ ID NO: 81629 - DNA, 22 bp, Artificial Sequence
  Synthetic oligonucleotide; TTT chr11 5212095 5212116 5212112 5212117 +
tgggtttgattggcatttctct

SEQ ID NO: 81630 - DNA, 22 bp, Artificial Sequence
  Synthetic oligonucleotide; TTT chr11 5212096 5212117 5212113 5212118 +
gggtttgattggcatttctcta

SEQ ID NO: 81631 - DNA, 22 bp, Artificial Sequence
  Synthetic oligonucleotide; TTG chr11 5212097 5212118 5212114 5212119 +
ggtttgattggcatttctctaa

SEQ ID NO: 81632 - DNA, 22 bp, Artificial Sequence
  Synthetic oligonucleotide; TTT chr11 5212102 5212123 5212119 5212124 +
gattggcatttctctaatgatc

SEQ ID NO: 81633 - DNA, 22 bp, Artificial Sequence
  Synthetic oligonucleotide; TTG chr11 5212103 5212124 5212120 5212125 +
attggcatttctctaatgatca

SEQ ID NO: 81634 - DNA, 22 bp, Artificial Sequence
  Synthetic oligonucleotide; TTG chr11 5212107 5212128 5212124 5212129 +
gcatttctctaatgatcagtga

SEQ ID NO: 81635 - DNA, 22 bp, Artificial Sequence
  Synthetic oligonucleotide; TTT chr11 5212113 5212134 5212130 5212135 +
ctctaatgatcagtgacactga

SEQ ID NO: 81636 - DNA, 22 bp, Artificial Sequence
  Synthetic oligonucleotide; TTC chr11 5212114 5212135 5212131 5212136 +
tctaatgatcagtgacactgag

SEQ ID NO: 81637 - DNA, 22 bp, Artificial Sequence
  Synthetic oligonucleotide; CTC chr11 5212116 5212137 5212133 5212138 +
taatgatcagtgacactgagct

SEQ ID NO: 81638 - DNA, 22 bp, Artificial Sequence
  Synthetic oligonucleotide; CTA chr11 5212118 5212139 5212135 5212140 +
atgatcagtgacactgagcttt

SEQ ID NO: 81639 - DNA, 22 bp, Artificial Sequence
  Synthetic oligonucleotide; CTG chr11 5212134 5212155 5212151 5212156 +
agcttttttcatatgcttggtg

SEQ ID NO: 81640 - DNA, 22 bp, Artificial Sequence
  Synthetic oligonucleotide; CTT chr11 5212139 5212160 5212156 5212161 +
ttttcatatgcttggtggccac

SEQ ID NO: 81641 - DNA, 22 bp, Artificial Sequence
  Synthetic oligonucleotide; TTT chr11 5212140 5212161 5212157 5212162 +
tttcatatgcttggtggccaca

SEQ ID NO: 81642 - DNA, 22 bp, Artificial Sequence
  Synthetic oligonucleotide; TTT chr11 5212141 5212162 5212158 5212163 +
ttcatatgcttggtggccacat

SEQ ID NO: 81643 - DNA, 22 bp, Artificial Sequence
  Synthetic oligonucleotide; TTT chr11 5212142 5212163 5212159 5212164 +
tcatatgcttggtggccacatg

SEQ ID NO: 81644 - DNA, 22 bp, Artificial Sequence
  Synthetic oligonucleotide; TTT chr11 5212143 5212164 5212160 5212165 +
catatgcttggtggccacatgt

SEQ ID NO: 81645 - DNA, 22 bp, Artificial Sequence
  Synthetic oligonucleotide; TTC chr11 5212144 5212165 5212161 5212166 +
atatgcttggtggccacatgta

SEQ ID NO: 81646 - DNA, 22 bp, Artificial Sequence
  Synthetic oligonucleotide; CTT chr11 5212152 5212173 5212169 5212174 +
ggtggccacatgtatgtcttct

SEQ ID NO: 81647 - DNA, 22 bp, Artificial Sequence
  Synthetic oligonucleotide; TTG chr11 5212153 5212174 5212170 5212175 +
gtggccacatgtatgtcttctt

SEQ ID NO: 81648 - DNA, 22 bp, Artificial Sequence
  Synthetic oligonucleotide; CTT chr11 5212172 5212193 5212189 5212194 +
cttttgaatactgtctgttcat

SEQ ID NO: 81649 - DNA, 22 bp, Artificial Sequence
  Synthetic oligonucleotide; TTC chr11 5212173 5212194 5212190 5212195 +
ttttgaatactgtctgttcatg

SEQ ID NO: 81650 - DNA, 22 bp, Artificial Sequence
  Synthetic oligonucleotide; CTT chr11 5212175 5212196 5212192 5212197 +
ttgaatactgtctgttcatgtc

SEQ ID NO: 81651 - DNA, 22 bp, Artificial Sequence
  Synthetic oligonucleotide; TTT chr11 5212176 5212197 5212193 5212198 +
tgaatactgtctgttcatgtcc

SEQ ID NO: 81652 - DNA, 22 bp, Artificial Sequence
  Synthetic oligonucleotide; TTT chr11 5212177 5212198 5212194 5212199 +
gaatactgtctgttcatgtcct

SEQ ID NO: 81653 - DNA, 22 bp, Artificial Sequence
  Synthetic oligonucleotide; TTG chr11 5212178 5212199 5212195 5212200 +
aatactgtctgttcatgtcctt

SEQ ID NO: 81654 - DNA, 22 bp, Artificial Sequence
  Synthetic oligonucleotide; CTG chr11 5212185 5212206 5212202 5212207 +
tctgttcatgtcctttacccat

SEQ ID NO: 81655 - DNA, 22 bp, Artificial Sequence
  Synthetic oligonucleotide; CTG chr11 5212189 5212210 5212206 5212211 +
ttcatgtcctttacccattttt

SEQ ID NO: 81656 - DNA, 22 bp, Artificial Sequence
  Synthetic oligonucleotide; TTC chr11 5212192 5212213 5212209 5212214 +
atgtcctttacccattttttgt

SEQ ID NO: 81657 - DNA, 22 bp, Artificial Sequence
  Synthetic oligonucleotide; CTT chr11 5212200 5212221 5212217 5212222 +
tacccattttttgtggcattgt

SEQ ID NO: 81658 - DNA, 22 bp, Artificial Sequence
  Synthetic oligonucleotide; TTT chr11 5212201 5212222 5212218 5212223 +
acccattttttgtggcattgtt

SEQ ID NO: 81659 - DNA, 22 bp, Artificial Sequence
  Synthetic oligonucleotide; TTA chr11 5212202 5212223 5212219 5212224 +
cccattttttgtggcattgttt

SEQ ID NO: 81660 - DNA, 22 bp, Artificial Sequence
  Synthetic oligonucleotide; TTT chr11 5212209 5212230 5212226 5212231 +
tttgtggcattgtttgttttgt

SEQ ID NO: 81661 - DNA, 22 bp, Artificial Sequence
  Synthetic oligonucleotide; TTT chr11 5212210 5212231 5212227 5212232 +
ttgtggcattgtttgttttgtt

SEQ ID NO: 81662 - DNA, 22 bp, Artificial Sequence
  Synthetic oligonucleotide; TTT chr11 5212211 5212232 5212228 5212233 +
tgtggcattgtttgttttgttc

SEQ ID NO: 81663 - DNA, 22 bp, Artificial Sequence
  Synthetic oligonucleotide; TTT chr11 5212212 5212233 5212229 5212234 +
gtggcattgtttgttttgttct

SEQ ID NO: 81664 - DNA, 22 bp, Artificial Sequence
  Synthetic oligonucleotide; TTG chr11 5212213 5212234 5212230 5212235 +
tggcattgtttgttttgttctt

SEQ ID NO: 81665 - DNA, 22 bp, Artificial Sequence
  Synthetic oligonucleotide; TTG chr11 5212221 5212242 5212238 5212243 +
tttgttttgttcttgtagattc

SEQ ID NO: 81666 - DNA, 22 bp, Artificial Sequence
  Synthetic oligonucleotide; TTT chr11 5212224 5212245 5212241 5212246 +
gttttgttcttgtagattcatt

SEQ ID NO: 81667 - DNA, 22 bp, Artificial Sequence
  Synthetic oligonucleotide; TTG chr11 5212225 5212246 5212242 5212247 +
ttttgttcttgtagattcattt

SEQ ID NO: 81668 - DNA, 22 bp, Artificial Sequence
  Synthetic oligonucleotide; TTT chr11 5212228 5212249 5212245 5212250 +
tgttcttgtagattcatttaag

SEQ ID NO: 81669 - DNA, 22 bp, Artificial Sequence
  Synthetic oligonucleotide; TTT chr11 5212229 5212250 5212246 5212251 +
gttcttgtagattcatttaagt

SEQ ID NO: 81670 - DNA, 22 bp, Artificial Sequence
  Synthetic oligonucleotide; TTG chr11 5212230 5212251 5212247 5212252 +
ttcttgtagattcatttaagtt

SEQ ID NO: 81671 - DNA, 22 bp, Artificial Sequence
  Synthetic oligonucleotide; TTC chr11 5212233 5212254 5212250 5212255 +
ttgtagattcatttaagttcct

SEQ ID NO: 81672 - DNA, 22 bp, Artificial Sequence
  Synthetic oligonucleotide; CTT chr11 5212235 5212256 5212252 5212257 +
gtagattcatttaagttcctta

SEQ ID NO: 81673 - DNA, 22 bp, Artificial Sequence
  Synthetic oligonucleotide; TTG chr11 5212236 5212257 5212253 5212258 +
tagattcatttaagttccttat

SEQ ID NO: 81674 - DNA, 22 bp, Artificial Sequence
  Synthetic oligonucleotide; TTC chr11 5212243 5212264 5212260 5212265 +
atttaagttccttatagattct

SEQ ID NO: 81675 - DNA, 22 bp, Artificial Sequence
  Synthetic oligonucleotide; TTT chr11 5212247 5212268 5212264 5212269 +
aagttccttatagattctgaat

SEQ ID NO: 81676 - DNA, 22 bp, Artificial Sequence
  Synthetic oligonucleotide; TTA chr11 5212248 5212269 5212265 5212270 +
agttccttatagattctgaata

SEQ ID NO: 81677 - DNA, 22 bp, Artificial Sequence
  Synthetic oligonucleotide; TTC chr11 5212253 5212274 5212270 5212275 +
cttatagattctgaatattagg

SEQ ID NO: 81678 - DNA, 22 bp, Artificial Sequence
  Synthetic oligonucleotide; CTT chr11 5212256 5212277 5212273 5212278 +
atagattctgaatattaggcct

SEQ ID NO: 81679 - DNA, 22 bp, Artificial Sequence
  Synthetic oligonucleotide; TTA chr11 5212257 5212278 5212274 5212279 +
tagattctgaatattaggcctt

SEQ ID NO: 81680 - DNA, 22 bp, Artificial Sequence
  Synthetic oligonucleotide; TTC chr11 5212264 5212285 5212281 5212286 +
tgaatattaggcctttgttgga

SEQ ID NO: 81681 - DNA, 22 bp, Artificial Sequence
  Synthetic oligonucleotide; CTG chr11 5212266 5212287 5212283 5212288 +
aatattaggcctttgttggatg

SEQ ID NO: 81682 - DNA, 22 bp, Artificial Sequence
  Synthetic oligonucleotide; TTA chr11 5212273 5212294 5212290 5212295 +
ggcctttgttggatgcatagtt

SEQ ID NO: 81683 - DNA, 22 bp, Artificial Sequence
  Synthetic oligonucleotide; CTT chr11 5212279 5212300 5212296 5212301 +
tgttggatgcatagtttgcaaa

SEQ ID NO: 81684 - DNA, 22 bp, Artificial Sequence
  Synthetic oligonucleotide; TTT chr11 5212280 5212301 5212297 5212302 +
gttggatgcatagtttgcaaaa

SEQ ID NO: 81685 - DNA, 22 bp, Artificial Sequence
  Synthetic oligonucleotide; TTG chr11 5212281 5212302 5212298 5212303 +
ttggatgcatagtttgcaaaaa

SEQ ID NO: 81686 - DNA, 22 bp, Artificial Sequence
  Synthetic oligonucleotide; TTG chr11 5212284 5212305 5212301 5212306 +
gatgcatagtttgcaaaaattt

SEQ ID NO: 81687 - DNA, 22 bp, Artificial Sequence
  Synthetic oligonucleotide; TTT chr11 5212296 5212317 5212313 5212318 +
gcaaaaattttctcccattcta

SEQ ID NO: 81688 - DNA, 22 bp, Artificial Sequence
  Synthetic oligonucleotide; TTG chr11 5212297 5212318 5212314 5212319 +
caaaaattttctcccattctat

SEQ ID NO: 81689 - DNA, 22 bp, Artificial Sequence
  Synthetic oligonucleotide; TTT chr11 5212306 5212327 5212323 5212328 +
tctcccattctataggttgttt

SEQ ID NO: 81690 - DNA, 22 bp, Artificial Sequence
  Synthetic oligonucleotide; TTT chr11 5212307 5212328 5212324 5212329 +
ctcccattctataggttgttta

SEQ ID NO: 81691 - DNA, 22 bp, Artificial Sequence
  Synthetic oligonucleotide; TTC chr11 5212308 5212329 5212325 5212330 +
tcccattctataggttgtttac

SEQ ID NO: 81692 - DNA, 22 bp, Artificial Sequence
  Synthetic oligonucleotide; CTC chr11 5212310 5212331 5212327 5212332 +
ccattctataggttgtttactc

SEQ ID NO: 81693 - DNA, 22 bp, Artificial Sequence
  Synthetic oligonucleotide; TTC chr11 5212316 5212337 5212333 5212338 +
tataggttgtttactcagttga

SEQ ID NO: 81694 - DNA, 22 bp, Artificial Sequence
  Synthetic oligonucleotide; CTA chr11 5212318 5212339 5212335 5212340 +
taggttgtttactcagttgata

SEQ ID NO: 81695 - DNA, 22 bp, Artificial Sequence
  Synthetic oligonucleotide; TTG chr11 5212325 5212346 5212342 5212347 +
tttactcagttgatagtttctt

SEQ ID NO: 81696 - DNA, 22 bp, Artificial Sequence
  Synthetic oligonucleotide; TTT chr11 5212328 5212349 5212345 5212350 +
actcagttgatagtttcttttg

SEQ ID NO: 81697 - DNA, 22 bp, Artificial Sequence
  Synthetic oligonucleotide; TTA chr11 5212329 5212350 5212346 5212351 +
ctcagttgatagtttcttttgc

SEQ ID NO: 81698 - DNA, 22 bp, Artificial Sequence
  Synthetic oligonucleotide; CTC chr11 5212332 5212353 5212349 5212354 +
agttgatagtttcttttgctgt

SEQ ID NO: 81699 - DNA, 22 bp, Artificial Sequence
  Synthetic oligonucleotide; TTG chr11 5212337 5212358 5212354 5212359 +
atagtttcttttgctgtgcaga

SEQ ID NO: 81700 - DNA, 22 bp, Artificial Sequence
  Synthetic oligonucleotide; TTT chr11 5212344 5212365 5212361 5212366 +
cttttgctgtgcagaaacttta

SEQ ID NO: 81701 - DNA, 22 bp, Artificial Sequence
  Synthetic oligonucleotide; TTC chr11 5212345 5212366 5212362 5212367 +
ttttgctgtgcagaaactttat

SEQ ID NO: 81702 - DNA, 22 bp, Artificial Sequence
  Synthetic oligonucleotide; CTT chr11 5212347 5212368 5212364 5212369 +
ttgctgtgcagaaactttattt

SEQ ID NO: 81703 - DNA, 22 bp, Artificial Sequence
  Synthetic oligonucleotide; TTT chr11 5212348 5212369 5212365 5212370 +
tgctgtgcagaaactttatttt

SEQ ID NO: 81704 - DNA, 22 bp, Artificial Sequence
  Synthetic oligonucleotide; TTT chr11 5212349 5212370 5212366 5212371 +
gctgtgcagaaactttatttta

SEQ ID NO: 81705 - DNA, 22 bp, Artificial Sequence
  Synthetic oligonucleotide; TTG chr11 5212350 5212371 5212367 5212372 +
ctgtgcagaaactttattttaa

SEQ ID NO: 81706 - DNA, 22 bp, Artificial Sequence
  Synthetic oligonucleotide; CTG chr11 5212353 5212374 5212370 5212375 +
tgcagaaactttattttaatta

SEQ ID NO: 81707 - DNA, 22 bp, Artificial Sequence
  Synthetic oligonucleotide; CTT chr11 5212364 5212385 5212381 5212386 +
tattttaattagatcctatttg

SEQ ID NO: 81708 - DNA, 22 bp, Artificial Sequence
  Synthetic oligonucleotide; TTT chr11 5212365 5212386 5212382 5212387 +
attttaattagatcctatttgt

SEQ ID NO: 81709 - DNA, 22 bp, Artificial Sequence
  Synthetic oligonucleotide; TTA chr11 5212366 5212387 5212383 5212388 +
ttttaattagatcctatttgtc

SEQ ID NO: 81710 - DNA, 22 bp, Artificial Sequence
  Synthetic oligonucleotide; TTT chr11 5212369 5212390 5212386 5212391 +
taattagatcctatttgtcaat

SEQ ID NO: 81711 - DNA, 22 bp, Artificial Sequence
  Synthetic oligonucleotide; TTT chr11 5212370 5212391 5212387 5212392 +
aattagatcctatttgtcaatt

SEQ ID NO: 81712 - DNA, 22 bp, Artificial Sequence
  Synthetic oligonucleotide; TTA chr11 5212371 5212392 5212388 5212393 +
attagatcctatttgtcaattt

SEQ ID NO: 81713 - DNA, 22 bp, Artificial Sequence
  Synthetic oligonucleotide; TTA chr11 5212375 5212396 5212392 5212397 +
gatcctatttgtcaatttttgc

SEQ ID NO: 81714 - DNA, 22 bp, Artificial Sequence
  Synthetic oligonucleotide; CTA chr11 5212382 5212403 5212399 5212404 +
tttgtcaatttttgcttttgct

SEQ ID NO: 81715 - DNA, 22 bp, Artificial Sequence
  Synthetic oligonucleotide; TTT chr11 5212385 5212406 5212402 5212407 +
gtcaatttttgcttttgctgca

SEQ ID NO: 81716 - DNA, 22 bp, Artificial Sequence
  Synthetic oligonucleotide; TTG chr11 5212386 5212407 5212403 5212408 +
tcaatttttgcttttgctgcaa

SEQ ID NO: 81717 - DNA, 22 bp, Artificial Sequence
  Synthetic oligonucleotide; TTT chr11 5212393 5212414 5212410 5212415 +
ttgcttttgctgcaatgactgt

SEQ ID NO: 81718 - DNA, 22 bp, Artificial Sequence
  Synthetic oligonucleotide; TTT chr11 5212394 5212415 5212411 5212416 +
tgcttttgctgcaatgactgtt

SEQ ID NO: 81719 - DNA, 22 bp, Artificial Sequence
  Synthetic oligonucleotide; TTT chr11 5212395 5212416 5212412 5212417 +
gcttttgctgcaatgactgttg

SEQ ID NO: 81720 - DNA, 22 bp, Artificial Sequence
  Synthetic oligonucleotide; TTG chr11 5212396 5212417 5212413 5212418 +
cttttgctgcaatgactgttgg

SEQ ID NO: 81721 - DNA, 22 bp, Artificial Sequence
  Synthetic oligonucleotide; CTT chr11 5212399 5212420 5212416 5212421 +
ttgctgcaatgactgttggcat

SEQ ID NO: 81722 - DNA, 22 bp, Artificial Sequence
  Synthetic oligonucleotide; TTT chr11 5212400 5212421 5212417 5212422 +
tgctgcaatgactgttggcatc

SEQ ID NO: 81723 - DNA, 22 bp, Artificial Sequence
  Synthetic oligonucleotide; TTT chr11 5212401 5212422 5212418 5212423 +
gctgcaatgactgttggcatct

SEQ ID NO: 81724 - DNA, 22 bp, Artificial Sequence
  Synthetic oligonucleotide; TTG chr11 5212402 5212423 5212419 5212424 +
ctgcaatgactgttggcatctt

SEQ ID NO: 81725 - DNA, 22 bp, Artificial Sequence
  Synthetic oligonucleotide; CTG chr11 5212405 5212426 5212422 5212427 +
caatgactgttggcatctttgt

SEQ ID NO: 81726 - DNA, 22 bp, Artificial Sequence
  Synthetic oligonucleotide; CTG chr11 5212414 5212435 5212431 5212436 +
ttggcatctttgtcatgaaatc

SEQ ID NO: 81727 - DNA, 22 bp, Artificial Sequence
  Synthetic oligonucleotide; TTG chr11 5212417 5212438 5212434 5212439 +
gcatctttgtcatgaaatcttt

SEQ ID NO: 81728 - DNA, 22 bp, Artificial Sequence
  Synthetic oligonucleotide; CTT chr11 5212424 5212445 5212441 5212446 +
tgtcatgaaatctttgcccctg

SEQ ID NO: 81729 - DNA, 22 bp, Artificial Sequence
  Synthetic oligonucleotide; TTT chr11 5212425 5212446 5212442 5212447 +
gtcatgaaatctttgcccctgc

SEQ ID NO: 81730 - DNA, 22 bp, Artificial Sequence
  Synthetic oligonucleotide; TTG chr11 5212426 5212447 5212443 5212448 +
tcatgaaatctttgcccctgct

SEQ ID NO: 81731 - DNA, 22 bp, Artificial Sequence
  Synthetic oligonucleotide; CTT chr11 5212438 5212459 5212455 5212460 +
tgcccctgcttatgtccggaat

SEQ ID NO: 81732 - DNA, 22 bp, Artificial Sequence
  Synthetic oligonucleotide; TTT chr11 5212439 5212460 5212456 5212461 +
gcccctgcttatgtccggaatg

SEQ ID NO: 81733 - DNA, 22 bp, Artificial Sequence
  Synthetic oligonucleotide; TTG chr11 5212440 5212461 5212457 5212462 +
cccctgcttatgtccggaatgg

SEQ ID NO: 81734 - DNA, 22 bp, Artificial Sequence
  Synthetic oligonucleotide; CTG chr11 5212446 5212467 5212463 5212468 +
cttatgtccggaatggtattgc

SEQ ID NO: 81735 - DNA, 22 bp, Artificial Sequence
  Synthetic oligonucleotide; CTT chr11 5212449 5212470 5212466 5212471 +
atgtccggaatggtattgccta

SEQ ID NO: 81736 - DNA, 22 bp, Artificial Sequence
  Synthetic oligonucleotide; TTA chr11 5212450 5212471 5212467 5212472 +
tgtccggaatggtattgcctag

SEQ ID NO: 81737 - DNA, 22 bp, Artificial Sequence
  Synthetic oligonucleotide; TTG chr11 5212467 5212488 5212484 5212489 +
cctaggttgctttcaagcattt

SEQ ID NO: 81738 - DNA, 22 bp, Artificial Sequence
  Synthetic oligonucleotide; CTA chr11 5212471 5212492 5212488 5212493 +
ggttgctttcaagcatttttat

SEQ ID NO: 81739 - DNA, 22 bp, Artificial Sequence
  Synthetic oligonucleotide; TTG chr11 5212476 5212497 5212493 5212498 +
ctttcaagcatttttatagttt

SEQ ID NO: 81740 - DNA, 22 bp, Artificial Sequence
  Synthetic oligonucleotide; CTT chr11 5212479 5212500 5212496 5212501 +
tcaagcatttttatagtttggg

SEQ ID NO: 81741 - DNA, 22 bp, Artificial Sequence
  Synthetic oligonucleotide; TTT chr11 5212480 5212501 5212497 5212502 +
caagcatttttatagtttgggt

SEQ ID NO: 81742 - DNA, 22 bp, Artificial Sequence
  Synthetic oligonucleotide; TTC chr11 5212481 5212502 5212498 5212503 +
aagcatttttatagtttgggtt

SEQ ID NO: 81743 - DNA, 22 bp, Artificial Sequence
  Synthetic oligonucleotide; TTT chr11 5212489 5212510 5212506 5212511 +
ttatagtttgggttttgcattt

SEQ ID NO: 81744 - DNA, 22 bp, Artificial Sequence
  Synthetic oligonucleotide; TTT chr11 5212490 5212511 5212507 5212512 +
tatagtttgggttttgcattta

SEQ ID NO: 81745 - DNA, 22 bp, Artificial Sequence
  Synthetic oligonucleotide; TTT chr11 5212491 5212512 5212508 5212513 +
atagtttgggttttgcatttaa

SEQ ID NO: 81746 - DNA, 22 bp, Artificial Sequence
  Synthetic oligonucleotide; TTA chr11 5212492 5212513 5212509 5212514 +
tagtttgggttttgcatttaag

SEQ ID NO: 81747 - DNA, 22 bp, Artificial Sequence
  Synthetic oligonucleotide; TTT chr11 5212498 5212519 5212515 5212520 +
gggttttgcatttaagtctcta

SEQ ID NO: 81748 - DNA, 22 bp, Artificial Sequence
  Synthetic oligonucleotide; TTG chr11 5212499 5212520 5212516 5212521 +
ggttttgcatttaagtctctaa

SEQ ID NO: 81749 - DNA, 22 bp, Artificial Sequence
  Synthetic oligonucleotide; TTT chr11 5212504 5212525 5212521 5212526 +
tgcatttaagtctctaatccat

SEQ ID NO: 81750 - DNA, 22 bp, Artificial Sequence
  Synthetic oligonucleotide; TTT chr11 5212505 5212526 5212522 5212527 +
gcatttaagtctctaatccatc

SEQ ID NO: 81751 - DNA, 22 bp, Artificial Sequence
  Synthetic oligonucleotide; TTG chr11 5212506 5212527 5212523 5212528 +
catttaagtctctaatccatct

SEQ ID NO: 81752 - DNA, 22 bp, Artificial Sequence
  Synthetic oligonucleotide; TTT chr11 5212511 5212532 5212528 5212533 +
aagtctctaatccatcttgagt

SEQ ID NO: 81753 - DNA, 22 bp, Artificial Sequence
  Synthetic oligonucleotide; TTA chr11 5212512 5212533 5212529 5212534 +
agtctctaatccatcttgagtt

SEQ ID NO: 81754 - DNA, 22 bp, Artificial Sequence
  Synthetic oligonucleotide; CTC chr11 5212518 5212539 5212535 5212540 +
taatccatcttgagtttatttg

SEQ ID NO: 81755 - DNA, 22 bp, Artificial Sequence
  Synthetic oligonucleotide; CTA chr11 5212520 5212541 5212537 5212542 +
atccatcttgagtttatttgtg

SEQ ID NO: 81756 - DNA, 22 bp, Artificial Sequence
  Synthetic oligonucleotide; CTT chr11 5212529 5212550 5212546 5212551 +
gagtttatttgtgtatatgata

SEQ ID NO: 81757 - DNA, 22 bp, Artificial Sequence
  Synthetic oligonucleotide; TTG chr11 5212530 5212551 5212547 5212552 +
agtttatttgtgtatatgatat

SEQ ID NO: 81758 - DNA, 22 bp, Artificial Sequence
  Synthetic oligonucleotide; TTT chr11 5212535 5212556 5212552 5212557 +
atttgtgtatatgatatagaac

SEQ ID NO: 81759 - DNA, 22 bp, Artificial Sequence
  Synthetic oligonucleotide; TTA chr11 5212536 5212557 5212553 5212558 +
tttgtgtatatgatatagaacg

SEQ ID NO: 81760 - DNA, 22 bp, Artificial Sequence
  Synthetic oligonucleotide; TTT chr11 5212539 5212560 5212556 5212561 +
gtgtatatgatatagaacgggg

SEQ ID NO: 81761 - DNA, 22 bp, Artificial Sequence
  Synthetic oligonucleotide; TTG chr11 5212540 5212561 5212557 5212562 +
tgtatatgatatagaacggggt

SEQ ID NO: 81762 - DNA, 22 bp, Artificial Sequence
  Synthetic oligonucleotide; CTG chr11 5212565 5212586 5212582 5212587 +
gtttcaatcttctacatacggt

SEQ ID NO: 81763 - DNA, 22 bp, Artificial Sequence
  Synthetic oligonucleotide; TTT chr11 5212569 5212590 5212586 5212591 +
caatcttctacatacggttagt

SEQ ID NO: 81764 - DNA, 22 bp, Artificial Sequence
  Synthetic oligonucleotide; TTC chr11 5212570 5212591 5212587 5212592 +
aatcttctacatacggttagtc

SEQ ID NO: 81765 - DNA, 22 bp, Artificial Sequence
  Synthetic oligonucleotide; CTT chr11 5212576 5212597 5212593 5212598 +
ctacatacggttagtcagttat

SEQ ID NO: 81766 - DNA, 22 bp, Artificial Sequence
  Synthetic oligonucleotide; TTC chr11 5212577 5212598 5212594 5212599 +
tacatacggttagtcagttatc

SEQ ID NO: 81767 - DNA, 22 bp, Artificial Sequence
  Synthetic oligonucleotide; CTA chr11 5212579 5212600 5212596 5212601 +
catacggttagtcagttatccc

SEQ ID NO: 81768 - DNA, 22 bp, Artificial Sequence
  Synthetic oligonucleotide; TTA chr11 5212589 5212610 5212606 5212611 +
gtcagttatcccaacaccactt

SEQ ID NO: 81769 - DNA, 22 bp, Artificial Sequence
  Synthetic oligonucleotide; TTA chr11 5212597 5212618 5212614 5212619 +
tcccaacaccacttgttgaata

SEQ ID NO: 81770 - DNA, 22 bp, Artificial Sequence
  Synthetic oligonucleotide; CTT chr11 5212611 5212632 5212628 5212633 +
gttgaatagggtgtcttttcct

SEQ ID NO: 81771 - DNA, 22 bp, Artificial Sequence
  Synthetic oligonucleotide; TTG chr11 5212612 5212633 5212629 5212634 +
ttgaatagggtgtcttttcctc

SEQ ID NO: 81772 - DNA, 22 bp, Artificial Sequence
  Synthetic oligonucleotide; TTG chr11 5212615 5212636 5212632 5212637 +
aatagggtgtcttttcctcatt

SEQ ID NO: 81773 - DNA, 22 bp, Artificial Sequence
  Synthetic oligonucleotide; CTT chr11 5212628 5212649 5212645 5212650 +
ttcctcattgcttgtttttatc

SEQ ID NO: 81774 - DNA, 22 bp, Artificial Sequence
  Synthetic oligonucleotide; TTT chr11 5212629 5212650 5212646 5212651 +
tcctcattgcttgtttttatca

SEQ ID NO: 81775 - DNA, 22 bp, Artificial Sequence
  Synthetic oligonucleotide; TTT chr11 5212630 5212651 5212647 5212652 +
cctcattgcttgtttttatcag

SEQ ID NO: 81776 - DNA, 22 bp, Artificial Sequence
  Synthetic oligonucleotide; TTC chr11 5212631 5212652 5212648 5212653 +
ctcattgcttgtttttatcagc

SEQ ID NO: 81777 - DNA, 22 bp, Artificial Sequence
  Synthetic oligonucleotide; CTC chr11 5212634 5212655 5212651 5212656 +
attgcttgtttttatcagcttt

SEQ ID NO: 81778 - DNA, 22 bp, Artificial Sequence
  Synthetic oligonucleotide; TTG chr11 5212638 5212659 5212655 5212660 +
cttgtttttatcagctttgtca

SEQ ID NO: 81779 - DNA, 22 bp, Artificial Sequence
  Synthetic oligonucleotide; CTT chr11 5212641 5212662 5212658 5212663 +
gtttttatcagctttgtcaaag

SEQ ID NO: 81780 - DNA, 22 bp, Artificial Sequence
  Synthetic oligonucleotide; TTG chr11 5212642 5212663 5212659 5212664 +
tttttatcagctttgtcaaaga

SEQ ID NO: 81781 - DNA, 22 bp, Artificial Sequence
  Synthetic oligonucleotide; TTT chr11 5212645 5212666 5212662 5212667 +
ttatcagctttgtcaaagatca

SEQ ID NO: 81782 - DNA, 22 bp, Artificial Sequence
  Synthetic oligonucleotide; TTT chr11 5212646 5212667 5212663 5212668 +
tatcagctttgtcaaagatcag

SEQ ID NO: 81783 - DNA, 22 bp, Artificial Sequence
  Synthetic oligonucleotide; TTT chr11 5212647 5212668 5212664 5212669 +
atcagctttgtcaaagatcaga

SEQ ID NO: 81784 - DNA, 22 bp, Artificial Sequence
  Synthetic oligonucleotide; TTA chr11 5212648 5212669 5212665 5212670 +
tcagctttgtcaaagatcagat

SEQ ID NO: 81785 - DNA, 22 bp, Artificial Sequence
  Synthetic oligonucleotide; CTT chr11 5212655 5212676 5212672 5212677 +
tgtcaaagatcagatggttgta

SEQ ID NO: 81786 - DNA, 22 bp, Artificial Sequence
  Synthetic oligonucleotide; TTT chr11 5212656 5212677 5212673 5212678 +
gtcaaagatcagatggttgtag

SEQ ID NO: 81787 - DNA, 22 bp, Artificial Sequence
  Synthetic oligonucleotide; TTG chr11 5212657 5212678 5212674 5212679 +
tcaaagatcagatggttgtagg

SEQ ID NO: 81788 - DNA, 22 bp, Artificial Sequence
  Synthetic oligonucleotide; TTG chr11 5212675 5212696 5212692 5212697 +
taggcatgtggtcttatttctg

SEQ ID NO: 81789 - DNA, 22 bp, Artificial Sequence
  Synthetic oligonucleotide; CTT chr11 5212690 5212711 5212707 5212712 +
atttctgggctctctattctgt

SEQ ID NO: 81790 - DNA, 22 bp, Artificial Sequence
  Synthetic oligonucleotide; TTA chr11 5212691 5212712 5212708 5212713 +
tttctgggctctctattctgtt

SEQ ID NO: 81791 - DNA, 22 bp, Artificial Sequence
  Synthetic oligonucleotide; TTT chr11 5212694 5212715 5212711 5212716 +
ctgggctctctattctgttcca

SEQ ID NO: 81792 - DNA, 22 bp, Artificial Sequence
  Synthetic oligonucleotide; TTC chr11 5212695 5212716 5212712 5212717 +
tgggctctctattctgttccat

SEQ ID NO: 81793 - DNA, 22 bp, Artificial Sequence
  Synthetic oligonucleotide; CTG chr11 5212697 5212718 5212714 5212719 +
ggctctctattctgttccattt

SEQ ID NO: 81794 - DNA, 22 bp, Artificial Sequence
  Synthetic oligonucleotide; CTC chr11 5212702 5212723 5212719 5212724 +
tctattctgttccatttgtctg

SEQ ID NO: 81795 - DNA, 22 bp, Artificial Sequence
  Synthetic oligonucleotide; CTC chr11 5212704 5212725 5212721 5212726 +
tattctgttccatttgtctgtg

SEQ ID NO: 81796 - DNA, 22 bp, Artificial Sequence
  Synthetic oligonucleotide; CTA chr11 5212706 5212727 5212723 5212728 +
ttctgttccatttgtctgtgtg

SEQ ID NO: 81797 - DNA, 22 bp, Artificial Sequence
  Synthetic oligonucleotide; TTC chr11 5212709 5212730 5212726 5212731 +
tgttccatttgtctgtgtgtct

SEQ ID NO: 81798 - DNA, 22 bp, Artificial Sequence
  Synthetic oligonucleotide; CTG chr11 5212711 5212732 5212728 5212733 +
ttccatttgtctgtgtgtcttt

SEQ ID NO: 81799 - DNA, 22 bp, Artificial Sequence
  Synthetic oligonucleotide; TTC chr11 5212714 5212735 5212731 5212736 +
catttgtctgtgtgtcttttct

SEQ ID NO: 81800 - DNA, 22 bp, Artificial Sequence
  Synthetic oligonucleotide; TTT chr11 5212719 5212740 5212736 5212741 +
gtctgtgtgtcttttctgtaac

SEQ ID NO: 81801 - DNA, 22 bp, Artificial Sequence
  Synthetic oligonucleotide; TTG chr11 5212720 5212741 5212737 5212742 +
tctgtgtgtcttttctgtaaca

SEQ ID NO: 81802 - DNA, 22 bp, Artificial Sequence
  Synthetic oligonucleotide; CTG chr11 5212724 5212745 5212741 5212746 +
tgtgtcttttctgtaacagtac

SEQ ID NO: 81803 - DNA, 22 bp, Artificial Sequence
  Synthetic oligonucleotide; CTT chr11 5212732 5212753 5212749 5212754 +
ttctgtaacagtaccacactgt

SEQ ID NO: 81804 - DNA, 22 bp, Artificial Sequence
  Synthetic oligonucleotide; TTT chr11 5212733 5212754 5212750 5212755 +
tctgtaacagtaccacactgtt

SEQ ID NO: 81805 - DNA, 22 bp, Artificial Sequence
  Synthetic oligonucleotide; TTT chr11 5212734 5212755 5212751 5212756 +
ctgtaacagtaccacactgttt

SEQ ID NO: 81806 - DNA, 22 bp, Artificial Sequence
  Synthetic oligonucleotide; TTC chr11 5212735 5212756 5212752 5212757 +
tgtaacagtaccacactgtttt

SEQ ID NO: 81807 - DNA, 22 bp, Artificial Sequence
  Synthetic oligonucleotide; CTG chr11 5212737 5212758 5212754 5212759 +
taacagtaccacactgttttgg

SEQ ID NO: 81808 - DNA, 22 bp, Artificial Sequence
  Synthetic oligonucleotide; CTG chr11 5212753 5212774 5212770 5212775 +
ttttggttactgtagccctgtg

SEQ ID NO: 81809 - DNA, 22 bp, Artificial Sequence
  Synthetic oligonucleotide; TTT chr11 5212756 5212777 5212773 5212778 +
tggttactgtagccctgtggta

SEQ ID NO: 81810 - DNA, 22 bp, Artificial Sequence
  Synthetic oligonucleotide; TTT chr11 5212757 5212778 5212774 5212779 +
ggttactgtagccctgtggtat

SEQ ID NO: 81811 - DNA, 22 bp, Artificial Sequence
  Synthetic oligonucleotide; TTG chr11 5212758 5212779 5212775 5212780 +
gttactgtagccctgtggtatg

SEQ ID NO: 81812 - DNA, 22 bp, Artificial Sequence
  Synthetic oligonucleotide; TTA chr11 5212762 5212783 5212779 5212784 +
ctgtagccctgtggtatggttt

SEQ ID NO: 81813 - DNA, 22 bp, Artificial Sequence
  Synthetic oligonucleotide; CTG chr11 5212765 5212786 5212782 5212787 +
tagccctgtggtatggtttgaa

SEQ ID NO: 81814 - DNA, 22 bp, Artificial Sequence
  Synthetic oligonucleotide; CTG chr11 5212773 5212794 5212790 5212795 +
tggtatggtttgaagttaggca

SEQ ID NO: 81815 - DNA, 22 bp, Artificial Sequence
  Synthetic oligonucleotide; TTT chr11 5212784 5212805 5212801 5212806 +
gaagttaggcaatgtattatct

SEQ ID NO: 81816 - DNA, 22 bp, Artificial Sequence
  Synthetic oligonucleotide; TTG chr11 5212785 5212806 5212802 5212807 +
aagttaggcaatgtattatctc

SEQ ID NO: 81817 - DNA, 22 bp, Artificial Sequence
  Synthetic oligonucleotide; TTA chr11 5212791 5212812 5212808 5212813 +
ggcaatgtattatctccagctt

SEQ ID NO: 81818 - DNA, 22 bp, Artificial Sequence
  Synthetic oligonucleotide; TTA chr11 5212803 5212824 5212820 5212825 +
tctccagcttttttctttttct

SEQ ID NO: 81819 - DNA, 22 bp, Artificial Sequence
  Synthetic oligonucleotide; CTC chr11 5212807 5212828 5212824 5212829 +
cagcttttttctttttctcttt

SEQ ID NO: 81820 - DNA, 22 bp, Artificial Sequence
  Synthetic oligonucleotide; CTT chr11 5212813 5212834 5212830 5212835 +
ttttctttttctcttttttttt

SEQ ID NO: 81821 - DNA, 22 bp, Artificial Sequence
  Synthetic oligonucleotide; TTT chr11 5212814 5212835 5212831 5212836 +
tttctttttctctttttttttt

SEQ ID NO: 81822 - DNA, 22 bp, Artificial Sequence
  Synthetic oligonucleotide; TTT chr11 5212815 5212836 5212832 5212837 +
ttctttttctcttttttttttt

SEQ ID NO: 81823 - DNA, 22 bp, Artificial Sequence
  Synthetic oligonucleotide; TTT chr11 5212816 5212837 5212833 5212838 +
tctttttctctttttttttttt

SEQ ID NO: 81824 - DNA, 22 bp, Artificial Sequence
  Synthetic oligonucleotide; TTT chr11 5212817 5212838 5212834 5212839 +
ctttttctcttttttttttttt

SEQ ID NO: 81825 - DNA, 22 bp, Artificial Sequence
  Synthetic oligonucleotide; TTC chr11 5212818 5212839 5212835 5212840 +
tttttctctttttttttttttg

SEQ ID NO: 81826 - DNA, 22 bp, Artificial Sequence
  Synthetic oligonucleotide; CTT chr11 5212820 5212841 5212837 5212842 +
tttctctttttttttttttgta

SEQ ID NO: 81827 - DNA, 22 bp, Artificial Sequence
  Synthetic oligonucleotide; TTT chr11 5212821 5212842 5212838 5212843 +
ttctctttttttttttttgtac

SEQ ID NO: 81828 - DNA, 22 bp, Artificial Sequence
  Synthetic oligonucleotide; TTT chr11 5212822 5212843 5212839 5212844 +
tctctttttttttttttgtact

SEQ ID NO: 81829 - DNA, 22 bp, Artificial Sequence
  Synthetic oligonucleotide; TTT chr11 5212823 5212844 5212840 5212845 +
ctctttttttttttttgtactc

SEQ ID NO: 81830 - DNA, 22 bp, Artificial Sequence
  Synthetic oligonucleotide; TTC chr11 5212824 5212845 5212841 5212846 +
tctttttttttttttgtactct

SEQ ID NO: 81831 - DNA, 22 bp, Artificial Sequence
  Synthetic oligonucleotide; CTC chr11 5212826 5212847 5212843 5212848 +
tttttttttttttgtactctaa

SEQ ID NO: 81832 - DNA, 22 bp, Artificial Sequence
  Synthetic oligonucleotide; CTT chr11 5212828 5212849 5212845 5212850 +
tttttttttttgtactctaagt

SEQ ID NO: 81833 - DNA, 22 bp, Artificial Sequence
  Synthetic oligonucleotide; TTT chr11 5212829 5212850 5212846 5212851 +
ttttttttttgtactctaagtt

SEQ ID NO: 81834 - DNA, 22 bp, Artificial Sequence
  Synthetic oligonucleotide; TTT chr11 5212830 5212851 5212847 5212852 +
tttttttttgtactctaagttc

SEQ ID NO: 81835 - DNA, 22 bp, Artificial Sequence
  Synthetic oligonucleotide; TTT chr11 5212831 5212852 5212848 5212853 +
ttttttttgtactctaagttct

SEQ ID NO: 81836 - DNA, 22 bp, Artificial Sequence
  Synthetic oligonucleotide; TTT chr11 5212832 5212853 5212849 5212854 +
tttttttgtactctaagttcta

SEQ ID NO: 81837 - DNA, 22 bp, Artificial Sequence
  Synthetic oligonucleotide; TTT chr11 5212833 5212854 5212850 5212855 +
ttttttgtactctaagttctac

SEQ ID NO: 81838 - DNA, 22 bp, Artificial Sequence
  Synthetic oligonucleotide; TTT chr11 5212834 5212855 5212851 5212856 +
tttttgtactctaagttctacg

SEQ ID NO: 81839 - DNA, 22 bp, Artificial Sequence
  Synthetic oligonucleotide; TTT chr11 5212835 5212856 5212852 5212857 +
ttttgtactctaagttctacgg

SEQ ID NO: 81840 - DNA, 22 bp, Artificial Sequence
  Synthetic oligonucleotide; TTT chr11 5212836 5212857 5212853 5212858 +
tttgtactctaagttctacggt

SEQ ID NO: 81841 - DNA, 22 bp, Artificial Sequence
  Synthetic oligonucleotide; TTT chr11 5212837 5212858 5212854 5212859 +
ttgtactctaagttctacggta

SEQ ID NO: 81842 - DNA, 22 bp, Artificial Sequence
  Synthetic oligonucleotide; TTT chr11 5212838 5212859 5212855 5212860 +
tgtactctaagttctacggtac

SEQ ID NO: 81843 - DNA, 22 bp, Artificial Sequence
  Synthetic oligonucleotide; TTT chr11 5212839 5212860 5212856 5212861 +
gtactctaagttctacggtacc

SEQ ID NO: 81844 - DNA, 22 bp, Artificial Sequence
  Synthetic oligonucleotide; TTG chr11 5212840 5212861 5212857 5212862 +
tactctaagttctacggtacct

SEQ ID NO: 81845 - DNA, 22 bp, Artificial Sequence
  Synthetic oligonucleotide; CTC chr11 5212845 5212866 5212862 5212867 +
taagttctacggtacctgtgca

SEQ ID NO: 81846 - DNA, 22 bp, Artificial Sequence
  Synthetic oligonucleotide; CTA chr11 5212847 5212868 5212864 5212869 +
agttctacggtacctgtgcagt

SEQ ID NO: 81847 - DNA, 22 bp, Artificial Sequence
  Synthetic oligonucleotide; TTC chr11 5212852 5212873 5212869 5212874 +
tacggtacctgtgcagtttgtt

SEQ ID NO: 81848 - DNA, 22 bp, Artificial Sequence
  Synthetic oligonucleotide; CTA chr11 5212854 5212875 5212871 5212876 +
cggtacctgtgcagtttgttac

SEQ ID NO: 81849 - DNA, 22 bp, Artificial Sequence
  Synthetic oligonucleotide; CTG chr11 5212863 5212884 5212880 5212885 +
tgcagtttgttacatatgtata

SEQ ID NO: 81850 - DNA, 22 bp, Artificial Sequence
  Synthetic oligonucleotide; TTT chr11 5212871 5212892 5212888 5212893 +
gttacatatgtatacgtgtgcc

SEQ ID NO: 81851 - DNA, 22 bp, Artificial Sequence
  Synthetic oligonucleotide; TTG chr11 5212872 5212893 5212889 5212894 +
ttacatatgtatacgtgtgcca

SEQ ID NO: 81852 - DNA, 22 bp, Artificial Sequence
  Synthetic oligonucleotide; TTA chr11 5212875 5212896 5212892 5212897 +
catatgtatacgtgtgccatat

SEQ ID NO: 81853 - DNA, 22 bp, Artificial Sequence
  Synthetic oligonucleotide; TTG chr11 5212899 5212920 5212916 5212921 +
gtgtgctgcacccgttaactcg

SEQ ID NO: 81854 - DNA, 22 bp, Artificial Sequence
  Synthetic oligonucleotide; CTG chr11 5212907 5212928 5212924 5212929 +
cacccgttaactcgtcatttac

SEQ ID NO: 81855 - DNA, 22 bp, Artificial Sequence
  Synthetic oligonucleotide; TTA chr11 5212916 5212937 5212933 5212938 +
actcgtcatttacattagatat

SEQ ID NO: 81856 - DNA, 22 bp, Artificial Sequence
  Synthetic oligonucleotide; CTC chr11 5212920 5212941 5212937 5212942 +
gtcatttacattagatatatct

SEQ ID NO: 81857 - DNA, 22 bp, Artificial Sequence
  Synthetic oligonucleotide; TTT chr11 5212927 5212948 5212944 5212949 +
acattagatatatctcctaatg

SEQ ID NO: 81858 - DNA, 22 bp, Artificial Sequence
  Synthetic oligonucleotide; TTA chr11 5212928 5212949 5212945 5212950 +
cattagatatatctcctaatgt

SEQ ID NO: 81859 - DNA, 22 bp, Artificial Sequence
  Synthetic oligonucleotide; TTA chr11 5212933 5212954 5212950 5212955 +
gatatatctcctaatgttatcc

SEQ ID NO: 81860 - DNA, 22 bp, Artificial Sequence
  Synthetic oligonucleotide; CTC chr11 5212943 5212964 5212960 5212965 +
ctaatgttatccctcctctctc

SEQ ID NO: 81861 - DNA, 22 bp, Artificial Sequence
  Synthetic oligonucleotide; CTA chr11 5212946 5212967 5212963 5212968 +
atgttatccctcctctctccta

SEQ ID NO: 81862 - DNA, 22 bp, Artificial Sequence
  Synthetic oligonucleotide; TTA chr11 5212952 5212973 5212969 5212974 +
tccctcctctctcctaccaccc

SEQ ID NO: 81863 - DNA, 22 bp, Artificial Sequence
  Synthetic oligonucleotide; CTC chr11 5212958 5212979 5212975 5212980 +
ctctctcctaccaccccacgac

SEQ ID NO: 81864 - DNA, 22 bp, Artificial Sequence
  Synthetic oligonucleotide; CTC chr11 5212961 5212982 5212978 5212983 +
tctcctaccaccccacgacagg

SEQ ID NO: 81865 - DNA, 22 bp, Artificial Sequence
  Synthetic oligonucleotide; CTC chr11 5212963 5212984 5212980 5212985 +
tcctaccaccccacgacaggcc

SEQ ID NO: 81866 - DNA, 22 bp, Artificial Sequence
  Synthetic oligonucleotide; CTC chr11 5212965 5212986 5212982 5212987 +
ctaccaccccacgacaggcccc

SEQ ID NO: 81867 - DNA, 22 bp, Artificial Sequence
  Synthetic oligonucleotide; CTA chr11 5212968 5212989 5212985 5212990 +
ccaccccacgacaggccccggt

SEQ ID NO: 81868 - DNA, 22 bp, Artificial Sequence
  Synthetic oligonucleotide; TTC chr11 5213001 5213022 5213018 5213023 +
cccaccctgtgtccaagtgttc

SEQ ID NO: 81869 - DNA, 22 bp, Artificial Sequence
  Synthetic oligonucleotide; CTG chr11 5213010 5213031 5213027 5213032 +
tgtccaagtgttctcatttttc

SEQ ID NO: 81870 - DNA, 22 bp, Artificial Sequence
  Synthetic oligonucleotide; TTC chr11 5213023 5213044 5213040 5213045 +
tcatttttcaattcccacctgt

SEQ ID NO: 81871 - DNA, 22 bp, Artificial Sequence
  Synthetic oligonucleotide; CTC chr11 5213025 5213046 5213042 5213047 +
atttttcaattcccacctgtga

SEQ ID NO: 81872 - DNA, 22 bp, Artificial Sequence
  Synthetic oligonucleotide; TTT chr11 5213029 5213050 5213046 5213051 +
ttcaattcccacctgtgagtat

SEQ ID NO: 81873 - DNA, 22 bp, Artificial Sequence
  Synthetic oligonucleotide; TTT chr11 5213030 5213051 5213047 5213052 +
tcaattcccacctgtgagtatt

SEQ ID NO: 81874 - DNA, 22 bp, Artificial Sequence
  Synthetic oligonucleotide; TTT chr11 5213031 5213052 5213048 5213053 +
caattcccacctgtgagtatta

SEQ ID NO: 81875 - DNA, 22 bp, Artificial Sequence
  Synthetic oligonucleotide; TTC chr11 5213032 5213053 5213049 5213054 +
aattcccacctgtgagtattag

SEQ ID NO: 81876 - DNA, 22 bp, Artificial Sequence
  Synthetic oligonucleotide; TTC chr11 5213037 5213058 5213054 5213059 +
ccacctgtgagtattaggattt

SEQ ID NO: 81877 - DNA, 22 bp, Artificial Sequence
  Synthetic oligonucleotide; CTG chr11 5213044 5213065 5213061 5213066 +
tgagtattaggatttcctaggc

SEQ ID NO: 81878 - DNA, 22 bp, Artificial Sequence
  Synthetic oligonucleotide; TTA chr11 5213053 5213074 5213070 5213075 +
ggatttcctaggctatttggac

SEQ ID NO: 81879 - DNA, 22 bp, Artificial Sequence
  Synthetic oligonucleotide; TTT chr11 5213059 5213080 5213076 5213081 +
cctaggctatttggactttttt

SEQ ID NO: 81880 - DNA, 22 bp, Artificial Sequence
  Synthetic oligonucleotide; TTC chr11 5213060 5213081 5213077 5213082 +
ctaggctatttggacttttttt

SEQ ID NO: 81881 - DNA, 22 bp, Artificial Sequence
  Synthetic oligonucleotide; CTA chr11 5213063 5213084 5213080 5213085 +
ggctatttggactttttttgtt

SEQ ID NO: 81882 - DNA, 22 bp, Artificial Sequence
  Synthetic oligonucleotide; CTA chr11 5213068 5213089 5213085 5213090 +
tttggactttttttgttgttgt

SEQ ID NO: 81883 - DNA, 22 bp, Artificial Sequence
  Synthetic oligonucleotide; TTT chr11 5213071 5213092 5213088 5213093 +
ggactttttttgttgttgttcc

SEQ ID NO: 81884 - DNA, 22 bp, Artificial Sequence
  Synthetic oligonucleotide; TTG chr11 5213072 5213093 5213089 5213094 +
gactttttttgttgttgttcca

SEQ ID NO: 81885 - DNA, 22 bp, Artificial Sequence
  Synthetic oligonucleotide; CTT chr11 5213077 5213098 5213094 5213099 +
tttttgttgttgttccatatga

SEQ ID NO: 81886 - DNA, 22 bp, Artificial Sequence
  Synthetic oligonucleotide; TTT chr11 5213078 5213099 5213095 5213100 +
ttttgttgttgttccatatgaa

SEQ ID NO: 81887 - DNA, 22 bp, Artificial Sequence
  Synthetic oligonucleotide; TTT chr11 5213079 5213100 5213096 5213101 +
tttgttgttgttccatatgaac

SEQ ID NO: 81888 - DNA, 22 bp, Artificial Sequence
  Synthetic oligonucleotide; TTT chr11 5213080 5213101 5213097 5213102 +
ttgttgttgttccatatgaact

SEQ ID NO: 81889 - DNA, 22 bp, Artificial Sequence
  Synthetic oligonucleotide; TTT chr11 5213081 5213102 5213098 5213103 +
tgttgttgttccatatgaactt

SEQ ID NO: 81890 - DNA, 22 bp, Artificial Sequence
  Synthetic oligonucleotide; TTT chr11 5213082 5213103 5213099 5213104 +
gttgttgttccatatgaacttt

SEQ ID NO: 81891 - DNA, 22 bp, Artificial Sequence
  Synthetic oligonucleotide; TTG chr11 5213083 5213104 5213100 5213105 +
ttgttgttccatatgaacttta

SEQ ID NO: 81892 - DNA, 22 bp, Artificial Sequence
  Synthetic oligonucleotide; TTG chr11 5213086 5213107 5213103 5213108 +
ttgttccatatgaactttaaag

SEQ ID NO: 81893 - DNA, 22 bp, Artificial Sequence
  Synthetic oligonucleotide; TTG chr11 5213089 5213110 5213106 5213111 +
ttccatatgaactttaaagtgt

SEQ ID NO: 81894 - DNA, 22 bp, Artificial Sequence
  Synthetic oligonucleotide; TTC chr11 5213092 5213113 5213109 5213114 +
catatgaactttaaagtgtatt

SEQ ID NO: 81895 - DNA, 22 bp, Artificial Sequence
  Synthetic oligonucleotide; CTT chr11 5213103 5213124 5213120 5213125 +
taaagtgtatttttctagttct

SEQ ID NO: 81896 - DNA, 22 bp, Artificial Sequence
  Synthetic oligonucleotide; TTT chr11 5213104 5213125 5213121 5213126 +
aaagtgtatttttctagttctg

SEQ ID NO: 81897 - DNA, 22 bp, Artificial Sequence
  Synthetic oligonucleotide; TTA chr11 5213105 5213126 5213122 5213127 +
aagtgtatttttctagttctgt

SEQ ID NO: 81898 - DNA, 22 bp, Artificial Sequence
  Synthetic oligonucleotide; TTT chr11 5213115 5213136 5213132 5213137 +
ttctagttctgtgaagaatgtc

SEQ ID NO: 81899 - DNA, 22 bp, Artificial Sequence
  Synthetic oligonucleotide; TTT chr11 5213116 5213137 5213133 5213138 +
tctagttctgtgaagaatgtca

SEQ ID NO: 81900 - DNA, 22 bp, Artificial Sequence
  Synthetic oligonucleotide; TTT chr11 5213117 5213138 5213134 5213139 +
ctagttctgtgaagaatgtcat

SEQ ID NO: 81901 - DNA, 22 bp, Artificial Sequence
  Synthetic oligonucleotide; TTC chr11 5213118 5213139 5213135 5213140 +
tagttctgtgaagaatgtcatt

SEQ ID NO: 81902 - DNA, 22 bp, Artificial Sequence
  Synthetic oligonucleotide; CTA chr11 5213120 5213141 5213137 5213142 +
gttctgtgaagaatgtcattgg

SEQ ID NO: 81903 - DNA, 22 bp, Artificial Sequence
  Synthetic oligonucleotide; TTC chr11 5213124 5213145 5213141 5213146 +
tgtgaagaatgtcattggtagt

SEQ ID NO: 81904 - DNA, 22 bp, Artificial Sequence
  Synthetic oligonucleotide; CTG chr11 5213126 5213147 5213143 5213148 +
tgaagaatgtcattggtagttt

SEQ ID NO: 81905 - DNA, 22 bp, Artificial Sequence
  Synthetic oligonucleotide; TTG chr11 5213141 5213162 5213158 5213163 +
gtagtttgataggaatagcttt

SEQ ID NO: 81906 - DNA, 22 bp, Artificial Sequence
  Synthetic oligonucleotide; TTT chr11 5213148 5213169 5213165 5213170 +
gataggaatagctttgaaactg

SEQ ID NO: 81907 - DNA, 22 bp, Artificial Sequence
  Synthetic oligonucleotide; TTG chr11 5213149 5213170 5213166 5213171 +
ataggaatagctttgaaactgt

SEQ ID NO: 81908 - DNA, 22 bp, Artificial Sequence
  Synthetic oligonucleotide; CTT chr11 5213162 5213183 5213179 5213184 +
tgaaactgtaaattgctctagg

SEQ ID NO: 81909 - DNA, 22 bp, Artificial Sequence
  Synthetic oligonucleotide; TTT chr11 5213163 5213184 5213180 5213185 +
gaaactgtaaattgctctaggc

SEQ ID NO: 81910 - DNA, 22 bp, Artificial Sequence
  Synthetic oligonucleotide; TTG chr11 5213164 5213185 5213181 5213186 +
aaactgtaaattgctctaggca

SEQ ID NO: 81911 - DNA, 22 bp, Artificial Sequence
  Synthetic oligonucleotide; CTG chr11 5213170 5213191 5213187 5213192 +
taaattgctctaggcagtatgg

SEQ ID NO: 81912 - DNA, 22 bp, Artificial Sequence
  Synthetic oligonucleotide; TTG chr11 5213177 5213198 5213194 5213199 +
ctctaggcagtatggacatttt

SEQ ID NO: 81913 - DNA, 22 bp, Artificial Sequence
  Synthetic oligonucleotide; CTC chr11 5213180 5213201 5213197 5213202 +
taggcagtatggacattttaac

SEQ ID NO: 81914 - DNA, 22 bp, Artificial Sequence
  Synthetic oligonucleotide; CTA chr11 5213182 5213203 5213199 5213204 +
ggcagtatggacattttaacaa

SEQ ID NO: 81915 - DNA, 22 bp, Artificial Sequence
  Synthetic oligonucleotide; TTT chr11 5213198 5213219 5213215 5213220 +
taacaatattgattctttttat

SEQ ID NO: 81916 - DNA, 22 bp, Artificial Sequence
  Synthetic oligonucleotide; TTT chr11 5213199 5213220 5213216 5213221 +
aacaatattgattctttttatc

SEQ ID NO: 81917 - DNA, 22 bp, Artificial Sequence
  Synthetic oligonucleotide; TTA chr11 5213200 5213221 5213217 5213222 +
acaatattgattctttttatcc

SEQ ID NO: 81918 - DNA, 22 bp, Artificial Sequence
  Synthetic oligonucleotide; TTG chr11 5213209 5213230 5213226 5213231 +
attctttttatccatgagcatg

SEQ ID NO: 81919 - DNA, 22 bp, Artificial Sequence
  Synthetic oligonucleotide; TTC chr11 5213213 5213234 5213230 5213235 +
tttttatccatgagcatggaaa

SEQ ID NO: 81920 - DNA, 22 bp, Artificial Sequence
  Synthetic oligonucleotide; CTT chr11 5213215 5213236 5213232 5213237 +
tttatccatgagcatggaaagt

SEQ ID NO: 81921 - DNA, 22 bp, Artificial Sequence
  Synthetic oligonucleotide; TTT chr11 5213216 5213237 5213233 5213238 +
ttatccatgagcatggaaagtt

SEQ ID NO: 81922 - DNA, 22 bp, Artificial Sequence
  Synthetic oligonucleotide; TTT chr11 5213217 5213238 5213234 5213239 +
tatccatgagcatggaaagttt

SEQ ID NO: 81923 - DNA, 22 bp, Artificial Sequence
  Synthetic oligonucleotide; TTT chr11 5213218 5213239 5213235 5213240 +
atccatgagcatggaaagtttt

SEQ ID NO: 81924 - DNA, 22 bp, Artificial Sequence
  Synthetic oligonucleotide; TTA chr11 5213219 5213240 5213236 5213241 +
tccatgagcatggaaagttttt

SEQ ID NO: 81925 - DNA, 22 bp, Artificial Sequence
  Synthetic oligonucleotide; TTT chr11 5213239 5213260 5213256 5213261 +
ttccatttgtttctatcagctc

SEQ ID NO: 81926 - DNA, 22 bp, Artificial Sequence
  Synthetic oligonucleotide; TTT chr11 5213240 5213261 5213257 5213262 +
tccatttgtttctatcagctct

SEQ ID NO: 81927 - DNA, 22 bp, Artificial Sequence
  Synthetic oligonucleotide; TTT chr11 5213241 5213262 5213258 5213263 +
ccatttgtttctatcagctctg

SEQ ID NO: 81928 - DNA, 22 bp, Artificial Sequence
  Synthetic oligonucleotide; TTC chr11 5213242 5213263 5213259 5213264 +
catttgtttctatcagctctga

SEQ ID NO: 81929 - DNA, 22 bp, Artificial Sequence
  Synthetic oligonucleotide; TTT chr11 5213247 5213268 5213264 5213269 +
gtttctatcagctctgatttct

SEQ ID NO: 81930 - DNA, 22 bp, Artificial Sequence
  Synthetic oligonucleotide; TTG chr11 5213248 5213269 5213265 5213270 +
tttctatcagctctgatttctt

SEQ ID NO: 81931 - DNA, 22 bp, Artificial Sequence
  Synthetic oligonucleotide; TTT chr11 5213251 5213272 5213268 5213273 +
ctatcagctctgatttctttga

SEQ ID NO: 81932 - DNA, 22 bp, Artificial Sequence
  Synthetic oligonucleotide; TTC chr11 5213252 5213273 5213269 5213274 +
tatcagctctgatttctttgag

SEQ ID NO: 81933 - DNA, 22 bp, Artificial Sequence
  Synthetic oligonucleotide; CTA chr11 5213254 5213275 5213271 5213276 +
tcagctctgatttctttgagca

SEQ ID NO: 81934 - DNA, 22 bp, Artificial Sequence
  Synthetic oligonucleotide; CTC chr11 5213261 5213282 5213278 5213283 +
tgatttctttgagcagtgtttt

SEQ ID NO: 81935 - DNA, 22 bp, Artificial Sequence
  Synthetic oligonucleotide; CTG chr11 5213263 5213284 5213280 5213285 +
atttctttgagcagtgttttgt

SEQ ID NO: 81936 - DNA, 22 bp, Artificial Sequence
  Synthetic oligonucleotide; TTT chr11 5213267 5213288 5213284 5213289 +
ctttgagcagtgttttgtaaat

SEQ ID NO: 81937 - DNA, 22 bp, Artificial Sequence
  Synthetic oligonucleotide; TTC chr11 5213268 5213289 5213285 5213290 +
tttgagcagtgttttgtaaatc

SEQ ID NO: 81938 - DNA, 22 bp, Artificial Sequence
  Synthetic oligonucleotide; CTT chr11 5213270 5213291 5213287 5213292 +
tgagcagtgttttgtaaatctc

SEQ ID NO: 81939 - DNA, 22 bp, Artificial Sequence
  Synthetic oligonucleotide; TTT chr11 5213271 5213292 5213288 5213293 +
gagcagtgttttgtaaatctca

SEQ ID NO: 81940 - DNA, 22 bp, Artificial Sequence
  Synthetic oligonucleotide; TTG chr11 5213272 5213293 5213289 5213294 +
agcagtgttttgtaaatctcat

SEQ ID NO: 81941 - DNA, 22 bp, Artificial Sequence
  Synthetic oligonucleotide; TTT chr11 5213282 5213303 5213299 5213304 +
tgtaaatctcattgtagagatc

SEQ ID NO: 81942 - DNA, 22 bp, Artificial Sequence
  Synthetic oligonucleotide; TTT chr11 5213283 5213304 5213300 5213305 +
gtaaatctcattgtagagatct

SEQ ID NO: 81943 - DNA, 22 bp, Artificial Sequence
  Synthetic oligonucleotide; TTG chr11 5213284 5213305 5213301 5213306 +
taaatctcattgtagagatctt

SEQ ID NO: 81944 - DNA, 22 bp, Artificial Sequence
  Synthetic oligonucleotide; CTC chr11 5213292 5213313 5213309 5213314 +
attgtagagatctttcaactgc

SEQ ID NO: 81945 - DNA, 22 bp, Artificial Sequence
  Synthetic oligonucleotide; TTG chr11 5213296 5213317 5213313 5213318 +
tagagatctttcaactgcttgg

SEQ ID NO: 81946 - DNA, 22 bp, Artificial Sequence
  Synthetic oligonucleotide; CTT chr11 5213306 5213327 5213323 5213328 +
tcaactgcttggttagatatat

SEQ ID NO: 81947 - DNA, 22 bp, Artificial Sequence
  Synthetic oligonucleotide; TTT chr11 5213307 5213328 5213324 5213329 +
caactgcttggttagatatatc

SEQ ID NO: 81948 - DNA, 22 bp, Artificial Sequence
  Synthetic oligonucleotide; TTC chr11 5213308 5213329 5213325 5213330 +
aactgcttggttagatatatcc

SEQ ID NO: 81949 - DNA, 22 bp, Artificial Sequence
  Synthetic oligonucleotide; CTG chr11 5213313 5213334 5213330 5213335 +
cttggttagatatatccttagg

SEQ ID NO: 81950 - DNA, 22 bp, Artificial Sequence
  Synthetic oligonucleotide; CTT chr11 5213316 5213337 5213333 5213338 +
ggttagatatatccttaggtat

SEQ ID NO: 81951 - DNA, 22 bp, Artificial Sequence
  Synthetic oligonucleotide; TTG chr11 5213317 5213338 5213334 5213339 +
gttagatatatccttaggtatt

SEQ ID NO: 81952 - DNA, 22 bp, Artificial Sequence
  Synthetic oligonucleotide; TTA chr11 5213321 5213342 5213338 5213343 +
gatatatccttaggtattttat

SEQ ID NO: 81953 - DNA, 22 bp, Artificial Sequence
  Synthetic oligonucleotide; CTT chr11 5213332 5213353 5213349 5213354 +
aggtattttattctttttgtgg

SEQ ID NO: 81954 - DNA, 22 bp, Artificial Sequence
  Synthetic oligonucleotide; TTA chr11 5213333 5213354 5213350 5213355 +
ggtattttattctttttgtggc

SEQ ID NO: 81955 - DNA, 22 bp, Artificial Sequence
  Synthetic oligonucleotide; TTT chr11 5213340 5213361 5213357 5213362 +
tattctttttgtggcaacggta

SEQ ID NO: 81956 - DNA, 22 bp, Artificial Sequence
  Synthetic oligonucleotide; TTT chr11 5213341 5213362 5213358 5213363 +
attctttttgtggcaacggtaa

SEQ ID NO: 81957 - DNA, 22 bp, Artificial Sequence
  Synthetic oligonucleotide; TTA chr11 5213342 5213363 5213359 5213364 +
ttctttttgtggcaacggtaaa

SEQ ID NO: 81958 - DNA, 22 bp, Artificial Sequence
  Synthetic oligonucleotide; TTC chr11 5213345 5213366 5213362 5213367 +
tttttgtggcaacggtaaatgg

SEQ ID NO: 81959 - DNA, 22 bp, Artificial Sequence
  Synthetic oligonucleotide; CTT chr11 5213347 5213368 5213364 5213369 +
tttgtggcaacggtaaatggga

SEQ ID NO: 81960 - DNA, 22 bp, Artificial Sequence
  Synthetic oligonucleotide; TTT chr11 5213348 5213369 5213365 5213370 +
ttgtggcaacggtaaatgggat

SEQ ID NO: 81961 - DNA, 22 bp, Artificial Sequence
  Synthetic oligonucleotide; TTT chr11 5213349 5213370 5213366 5213371 +
tgtggcaacggtaaatgggatt

SEQ ID NO: 81962 - DNA, 22 bp, Artificial Sequence
  Synthetic oligonucleotide; TTT chr11 5213350 5213371 5213367 5213372 +
gtggcaacggtaaatgggattg

SEQ ID NO: 81963 - DNA, 22 bp, Artificial Sequence
  Synthetic oligonucleotide; TTG chr11 5213351 5213372 5213368 5213373 +
tggcaacggtaaatgggattga

SEQ ID NO: 81964 - DNA, 22 bp, Artificial Sequence
  Synthetic oligonucleotide; TTG chr11 5213372 5213393 5213389 5213394 +
acttcctgatttggctctaggc

SEQ ID NO: 81965 - DNA, 22 bp, Artificial Sequence
  Synthetic oligonucleotide; CTT chr11 5213376 5213397 5213393 5213398 +
cctgatttggctctaggcttgg

SEQ ID NO: 81966 - DNA, 22 bp, Artificial Sequence
  Synthetic oligonucleotide; TTC chr11 5213377 5213398 5213394 5213399 +
ctgatttggctctaggcttggc

SEQ ID NO: 81967 - DNA, 22 bp, Artificial Sequence
  Synthetic oligonucleotide; CTG chr11 5213380 5213401 5213397 5213402 +
atttggctctaggcttggctat

SEQ ID NO: 81968 - DNA, 22 bp, Artificial Sequence
  Synthetic oligonucleotide; TTT chr11 5213384 5213405 5213401 5213406 +
ggctctaggcttggctattgtt

SEQ ID NO: 81969 - DNA, 22 bp, Artificial Sequence
  Synthetic oligonucleotide; TTG chr11 5213385 5213406 5213402 5213407 +
gctctaggcttggctattgttg

SEQ ID NO: 81970 - DNA, 22 bp, Artificial Sequence
  Synthetic oligonucleotide; CTC chr11 5213389 5213410 5213406 5213411 +
taggcttggctattgttgatgt

SEQ ID NO: 81971 - DNA, 22 bp, Artificial Sequence
  Synthetic oligonucleotide; CTA chr11 5213391 5213412 5213408 5213413 +
ggcttggctattgttgatgtat

SEQ ID NO: 81972 - DNA, 22 bp, Artificial Sequence
  Synthetic oligonucleotide; CTT chr11 5213396 5213417 5213413 5213418 +
ggctattgttgatgtatgggaa

SEQ ID NO: 81973 - DNA, 22 bp, Artificial Sequence
  Synthetic oligonucleotide; TTG chr11 5213397 5213418 5213414 5213419 +
gctattgttgatgtatgggaat

SEQ ID NO: 81974 - DNA, 22 bp, Artificial Sequence
  Synthetic oligonucleotide; CTA chr11 5213401 5213422 5213418 5213423 +
ttgttgatgtatgggaatgcta

SEQ ID NO: 81975 - DNA, 22 bp, Artificial Sequence
  Synthetic oligonucleotide; TTG chr11 5213404 5213425 5213421 5213426 +
ttgatgtatgggaatgctagtg

SEQ ID NO: 81976 - DNA, 22 bp, Artificial Sequence
  Synthetic oligonucleotide; TTG chr11 5213407 5213428 5213424 5213429 +
atgtatgggaatgctagtgatt

SEQ ID NO: 81977 - DNA, 22 bp, Artificial Sequence
  Synthetic oligonucleotide; CTA chr11 5213423 5213444 5213440 5213445 +
gtgatttttgtacattgatttt

SEQ ID NO: 81978 - DNA, 22 bp, Artificial Sequence
  Synthetic oligonucleotide; TTT chr11 5213430 5213451 5213447 5213452 +
ttgtacattgattttatatcct

SEQ ID NO: 81979 - DNA, 22 bp, Artificial Sequence
  Synthetic oligonucleotide; TTT chr11 5213431 5213452 5213448 5213453 +
tgtacattgattttatatcctg

SEQ ID NO: 81980 - DNA, 22 bp, Artificial Sequence
  Synthetic oligonucleotide; TTT chr11 5213432 5213453 5213449 5213454 +
gtacattgattttatatcctga

SEQ ID NO: 81981 - DNA, 22 bp, Artificial Sequence
  Synthetic oligonucleotide; TTG chr11 5213433 5213454 5213450 5213455 +
tacattgattttatatcctgaa

SEQ ID NO: 81982 - DNA, 22 bp, Artificial Sequence
  Synthetic oligonucleotide; TTG chr11 5213440 5213461 5213457 5213462 +
attttatatcctgaaactttgc

SEQ ID NO: 81983 - DNA, 22 bp, Artificial Sequence
  Synthetic oligonucleotide; TTT chr11 5213444 5213465 5213461 5213466 +
tatatcctgaaactttgctgaa

SEQ ID NO: 81984 - DNA, 22 bp, Artificial Sequence
  Synthetic oligonucleotide; TTT chr11 5213445 5213466 5213462 5213467 +
atatcctgaaactttgctgaag

SEQ ID NO: 81985 - DNA, 22 bp, Artificial Sequence
  Synthetic oligonucleotide; TTA chr11 5213446 5213467 5213463 5213468 +
tatcctgaaactttgctgaagt

SEQ ID NO: 81986 - DNA, 22 bp, Artificial Sequence
  Synthetic oligonucleotide; CTG chr11 5213453 5213474 5213470 5213475 +
aaactttgctgaagttatcagc

SEQ ID NO: 81987 - DNA, 22 bp, Artificial Sequence
  Synthetic oligonucleotide; CTT chr11 5213459 5213480 5213476 5213481 +
tgctgaagttatcagctgaagg

SEQ ID NO: 81988 - DNA, 22 bp, Artificial Sequence
  Synthetic oligonucleotide; TTT chr11 5213460 5213481 5213477 5213482 +
gctgaagttatcagctgaagga

SEQ ID NO: 81989 - DNA, 22 bp, Artificial Sequence
  Synthetic oligonucleotide; TTG chr11 5213461 5213482 5213478 5213483 +
ctgaagttatcagctgaaggag

SEQ ID NO: 81990 - DNA, 22 bp, Artificial Sequence
  Synthetic oligonucleotide; CTG chr11 5213464 5213485 5213481 5213486 +
aagttatcagctgaaggagctt

SEQ ID NO: 81991 - DNA, 22 bp, Artificial Sequence
  Synthetic oligonucleotide; TTA chr11 5213470 5213491 5213487 5213492 +
tcagctgaaggagcttttgggc

SEQ ID NO: 81992 - DNA, 22 bp, Artificial Sequence
  Synthetic oligonucleotide; CTG chr11 5213477 5213498 5213494 5213499 +
aaggagcttttgggccttgact

SEQ ID NO: 81993 - DNA, 22 bp, Artificial Sequence
  Synthetic oligonucleotide; CTT chr11 5213486 5213507 5213503 5213508 +
ttgggccttgactatggtgttt

SEQ ID NO: 81994 - DNA, 22 bp, Artificial Sequence
  Synthetic oligonucleotide; TTT chr11 5213487 5213508 5213504 5213509 +
tgggccttgactatggtgtttt

SEQ ID NO: 81995 - DNA, 22 bp, Artificial Sequence
  Synthetic oligonucleotide; TTT chr11 5213488 5213509 5213505 5213510 +
gggccttgactatggtgttttc

SEQ ID NO: 81996 - DNA, 22 bp, Artificial Sequence
  Synthetic oligonucleotide; TTG chr11 5213489 5213510 5213506 5213511 +
ggccttgactatggtgttttct

SEQ ID NO: 81997 - DNA, 22 bp, Artificial Sequence
  Synthetic oligonucleotide; CTT chr11 5213495 5213516 5213512 5213517 +
gactatggtgttttctagatac

SEQ ID NO: 81998 - DNA, 22 bp, Artificial Sequence
  Synthetic oligonucleotide; TTG chr11 5213496 5213517 5213513 5213518 +
actatggtgttttctagataca

SEQ ID NO: 81999 - DNA, 22 bp, Artificial Sequence
  Synthetic oligonucleotide; CTA chr11 5213500 5213521 5213517 5213522 +
tggtgttttctagatacagaaa

SEQ ID NO: 82000 - DNA, 22 bp, Artificial Sequence
  Synthetic oligonucleotide; TTT chr11 5213508 5213529 5213525 5213530 +
tctagatacagaaaacagggat

SEQ ID NO: 82001 - DNA, 22 bp, Artificial Sequence
  Synthetic oligonucleotide; TTT chr11 5213509 5213530 5213526 5213531 +
ctagatacagaaaacagggata

SEQ ID NO: 82002 - DNA, 22 bp, Artificial Sequence
  Synthetic oligonucleotide; TTC chr11 5213510 5213531 5213527 5213532 +
tagatacagaaaacagggatac

SEQ ID NO: 82003 - DNA, 22 bp, Artificial Sequence
  Synthetic oligonucleotide; CTA chr11 5213512 5213533 5213529 5213534 +
gatacagaaaacagggatactt

SEQ ID NO: 82004 - DNA, 22 bp, Artificial Sequence
  Synthetic oligonucleotide; CTT chr11 5213534 5213555 5213551 5213556 +
tgactttctctcttcctatttg

SEQ ID NO: 82005 - DNA, 22 bp, Artificial Sequence
  Synthetic oligonucleotide; TTT chr11 5213535 5213556 5213552 5213557 +
gactttctctcttcctatttgg

SEQ ID NO: 82006 - DNA, 22 bp, Artificial Sequence
  Synthetic oligonucleotide; TTG chr11 5213536 5213557 5213553 5213558 +
actttctctcttcctatttgga

SEQ ID NO: 82007 - DNA, 22 bp, Artificial Sequence
  Synthetic oligonucleotide; CTT chr11 5213540 5213561 5213557 5213562 +
tctctcttcctatttggatgcc

SEQ ID NO: 82008 - DNA, 22 bp, Artificial Sequence
  Synthetic oligonucleotide; TTT chr11 5213541 5213562 5213558 5213563 +
ctctcttcctatttggatgccc

SEQ ID NO: 82009 - DNA, 22 bp, Artificial Sequence
  Synthetic oligonucleotide; TTC chr11 5213542 5213563 5213559 5213564 +
tctcttcctatttggatgccct

SEQ ID NO: 82010 - DNA, 22 bp, Artificial Sequence
  Synthetic oligonucleotide; CTC chr11 5213544 5213565 5213561 5213566 +
tcttcctatttggatgcccttt

SEQ ID NO: 82011 - DNA, 22 bp, Artificial Sequence
  Synthetic oligonucleotide; CTC chr11 5213546 5213567 5213563 5213568 +
ttcctatttggatgccctttat

SEQ ID NO: 82012 - DNA, 22 bp, Artificial Sequence
  Synthetic oligonucleotide; CTT chr11 5213548 5213569 5213565 5213570 +
cctatttggatgccctttattc

SEQ ID NO: 82013 - DNA, 22 bp, Artificial Sequence
  Synthetic oligonucleotide; TTC chr11 5213549 5213570 5213566 5213571 +
ctatttggatgccctttattcc

SEQ ID NO: 82014 - DNA, 22 bp, Artificial Sequence
  Synthetic oligonucleotide; CTA chr11 5213552 5213573 5213569 5213574 +
tttggatgccctttattccctt

SEQ ID NO: 82015 - DNA, 22 bp, Artificial Sequence
  Synthetic oligonucleotide; TTT chr11 5213555 5213576 5213572 5213577 +
ggatgccctttattcccttctc

SEQ ID NO: 82016 - DNA, 22 bp, Artificial Sequence
  Synthetic oligonucleotide; TTG chr11 5213556 5213577 5213573 5213578 +
gatgccctttattcccttctct

SEQ ID NO: 82017 - DNA, 22 bp, Artificial Sequence
  Synthetic oligonucleotide; CTT chr11 5213565 5213586 5213582 5213587 +
tattcccttctcttgcctgatt

SEQ ID NO: 82018 - DNA, 22 bp, Artificial Sequence
  Synthetic oligonucleotide; TTT chr11 5213566 5213587 5213583 5213588 +
attcccttctcttgcctgattg

SEQ ID NO: 82019 - DNA, 22 bp, Artificial Sequence
  Synthetic oligonucleotide; TTA chr11 5213567 5213588 5213584 5213589 +
ttcccttctcttgcctgattgc

SEQ ID NO: 82020 - DNA, 22 bp, Artificial Sequence
  Synthetic oligonucleotide; TTC chr11 5213570 5213591 5213587 5213592 +
ccttctcttgcctgattgctct

SEQ ID NO: 82021 - DNA, 22 bp, Artificial Sequence
  Synthetic oligonucleotide; CTT chr11 5213574 5213595 5213591 5213596 +
ctcttgcctgattgctctggcc

SEQ ID NO: 82022 - DNA, 22 bp, Artificial Sequence
  Synthetic oligonucleotide; TTC chr11 5213575 5213596 5213592 5213597 +
tcttgcctgattgctctggcca

SEQ ID NO: 82023 - DNA, 22 bp, Artificial Sequence
  Synthetic oligonucleotide; CTC chr11 5213577 5213598 5213594 5213599 +
ttgcctgattgctctggccagg

SEQ ID NO: 82024 - DNA, 22 bp, Artificial Sequence
  Synthetic oligonucleotide; CTT chr11 5213579 5213600 5213596 5213601 +
gcctgattgctctggccaggac

SEQ ID NO: 82025 - DNA, 22 bp, Artificial Sequence
  Synthetic oligonucleotide; TTG chr11 5213580 5213601 5213597 5213602 +
cctgattgctctggccaggact

SEQ ID NO: 82026 - DNA, 22 bp, Artificial Sequence
  Synthetic oligonucleotide; CTG chr11 5213584 5213605 5213601 5213606 +
attgctctggccaggactgcca

SEQ ID NO: 82027 - DNA, 22 bp, Artificial Sequence
  Synthetic oligonucleotide; TTG chr11 5213588 5213609 5213605 5213610 +
ctctggccaggactgccagtac

SEQ ID NO: 82028 - DNA, 22 bp, Artificial Sequence
  Synthetic oligonucleotide; CTC chr11 5213591 5213612 5213608 5213613 +
tggccaggactgccagtactat

SEQ ID NO: 82029 - DNA, 22 bp, Artificial Sequence
  Synthetic oligonucleotide; CTG chr11 5213593 5213614 5213610 5213615 +
gccaggactgccagtactatac

SEQ ID NO: 82030 - DNA, 22 bp, Artificial Sequence
  Synthetic oligonucleotide; CTG chr11 5213603 5213624 5213620 5213625 +
ccagtactatactgaatagcag

SEQ ID NO: 82031 - DNA, 22 bp, Artificial Sequence
  Synthetic oligonucleotide; CTA chr11 5213612 5213633 5213629 5213634 +
tactgaatagcagtggtgagag

SEQ ID NO: 82032 - DNA, 22 bp, Artificial Sequence
  Synthetic oligonucleotide; CTG chr11 5213617 5213638 5213634 5213639 +
aatagcagtggtgagagagggc

SEQ ID NO: 82033 - DNA, 22 bp, Artificial Sequence
  Synthetic oligonucleotide; CTT chr11 5213645 5213666 5213662 5213667 +
gtcttgtgccagttttcaagaa

SEQ ID NO: 82034 - DNA, 22 bp, Artificial Sequence
  Synthetic oligonucleotide; TTG chr11 5213646 5213667 5213663 5213668 +
tcttgtgccagttttcaagaag

SEQ ID NO: 82035 - DNA, 22 bp, Artificial Sequence
  Synthetic oligonucleotide; CTT chr11 5213650 5213671 5213667 5213672 +
gtgccagttttcaagaagaatg

SEQ ID NO: 82036 - DNA, 22 bp, Artificial Sequence
  Synthetic oligonucleotide; TTG chr11 5213651 5213672 5213668 5213673 +
tgccagttttcaagaagaatgc

SEQ ID NO: 82037 - DNA, 22 bp, Artificial Sequence
  Synthetic oligonucleotide; TTT chr11 5213660 5213681 5213677 5213682 +
tcaagaagaatgcttccaggtt

SEQ ID NO: 82038 - DNA, 22 bp, Artificial Sequence
  Synthetic oligonucleotide; TTT chr11 5213661 5213682 5213678 5213683 +
caagaagaatgcttccaggttt

SEQ ID NO: 82039 - DNA, 22 bp, Artificial Sequence
  Synthetic oligonucleotide; TTC chr11 5213662 5213683 5213679 5213684 +
aagaagaatgcttccaggtttt

SEQ ID NO: 82040 - DNA, 22 bp, Artificial Sequence
  Synthetic oligonucleotide; CTT chr11 5213675 5213696 5213692 5213697 +
ccaggttttgcccattctgtat

SEQ ID NO: 82041 - DNA, 22 bp, Artificial Sequence
  Synthetic oligonucleotide; TTC chr11 5213676 5213697 5213693 5213698 +
caggttttgcccattctgtatg

SEQ ID NO: 82042 - DNA, 22 bp, Artificial Sequence
  Synthetic oligonucleotide; TTT chr11 5213683 5213704 5213700 5213705 +
tgcccattctgtatgatgttgg

SEQ ID NO: 82043 - DNA, 22 bp, Artificial Sequence
  Synthetic oligonucleotide; TTT chr11 5213684 5213705 5213701 5213706 +
gcccattctgtatgatgttggc

SEQ ID NO: 82044 - DNA, 22 bp, Artificial Sequence
  Synthetic oligonucleotide; TTG chr11 5213685 5213706 5213702 5213707 +
cccattctgtatgatgttggct

SEQ ID NO: 82045 - DNA, 22 bp, Artificial Sequence
  Synthetic oligonucleotide; TTC chr11 5213692 5213713 5213709 5213714 +
tgtatgatgttggctgtgggtt

SEQ ID NO: 82046 - DNA, 22 bp, Artificial Sequence
  Synthetic oligonucleotide; CTG chr11 5213694 5213715 5213711 5213716 +
tatgatgttggctgtgggtttg

SEQ ID NO: 82047 - DNA, 22 bp, Artificial Sequence
  Synthetic oligonucleotide; TTG chr11 5213704 5213725 5213721 5213726 +
gctgtgggtttgtcatagatgg

SEQ ID NO: 82048 - DNA, 22 bp, Artificial Sequence
  Synthetic oligonucleotide; CTG chr11 5213708 5213729 5213725 5213730 +
tgggtttgtcatagatggctca

SEQ ID NO: 82049 - DNA, 22 bp, Artificial Sequence
  Synthetic oligonucleotide; TTT chr11 5213715 5213736 5213732 5213737 +
gtcatagatggctcatattatt

SEQ ID NO: 82050 - DNA, 22 bp, Artificial Sequence
  Synthetic oligonucleotide; TTG chr11 5213716 5213737 5213733 5213738 +
tcatagatggctcatattattt

SEQ ID NO: 82051 - DNA, 22 bp, Artificial Sequence
  Synthetic oligonucleotide; CTC chr11 5213729 5213750 5213746 5213751 +
atattattttgaggtcatgtcc

SEQ ID NO: 82052 - DNA, 22 bp, Artificial Sequence
  Synthetic oligonucleotide; TTA chr11 5213735 5213756 5213752 5213757 +
ttttgaggtcatgtccttaaat

SEQ ID NO: 82053 - DNA, 22 bp, Artificial Sequence
  Synthetic oligonucleotide; TTT chr11 5213738 5213759 5213755 5213760 +
tgaggtcatgtccttaaatagc

SEQ ID NO: 82054 - DNA, 22 bp, Artificial Sequence
  Synthetic oligonucleotide; TTT chr11 5213739 5213760 5213756 5213761 +
gaggtcatgtccttaaatagct

SEQ ID NO: 82055 - DNA, 22 bp, Artificial Sequence
  Synthetic oligonucleotide; TTG chr11 5213740 5213761 5213757 5213762 +
aggtcatgtccttaaatagcta

SEQ ID NO: 82056 - DNA, 22 bp, Artificial Sequence
  Synthetic oligonucleotide; CTT chr11 5213753 5213774 5213770 5213775 +
aaatagctagtttgttgagagg

SEQ ID NO: 82057 - DNA, 22 bp, Artificial Sequence
  Synthetic oligonucleotide; TTA chr11 5213754 5213775 5213771 5213776 +
aatagctagtttgttgagaggt

SEQ ID NO: 82058 - DNA, 22 bp, Artificial Sequence
  Synthetic oligonucleotide; CTA chr11 5213762 5213783 5213779 5213784 +
gtttgttgagaggttttaacat

SEQ ID NO: 82059 - DNA, 22 bp, Artificial Sequence
  Synthetic oligonucleotide; TTT chr11 5213766 5213787 5213783 5213788 +
gttgagaggttttaacatgaag

SEQ ID NO: 82060 - DNA, 22 bp, Artificial Sequence
  Synthetic oligonucleotide; TTG chr11 5213767 5213788 5213784 5213789 +
ttgagaggttttaacatgaagt

SEQ ID NO: 82061 - DNA, 22 bp, Artificial Sequence
  Synthetic oligonucleotide; TTG chr11 5213770 5213791 5213787 5213792 +
agaggttttaacatgaagtgaa

SEQ ID NO: 82062 - DNA, 22 bp, Artificial Sequence
  Synthetic oligonucleotide; TTT chr11 5213778 5213799 5213795 5213800 +
taacatgaagtgaagttgaatt

SEQ ID NO: 82063 - DNA, 22 bp, Artificial Sequence
  Synthetic oligonucleotide; TTT chr11 5213779 5213800 5213796 5213801 +
aacatgaagtgaagttgaattt

SEQ ID NO: 82064 - DNA, 22 bp, Artificial Sequence
  Synthetic oligonucleotide; TTA chr11 5213780 5213801 5213797 5213802 +
acatgaagtgaagttgaatttt

SEQ ID NO: 82065 - DNA, 22 bp, Artificial Sequence
  Synthetic oligonucleotide; TTG chr11 5213796 5213817 5213813 5213818 +
aattttatcaaaatcttttttt

SEQ ID NO: 82066 - DNA, 22 bp, Artificial Sequence
  Synthetic oligonucleotide; TTT chr11 5213801 5213822 5213818 5213823 +
tatcaaaatctttttttgcaca

SEQ ID NO: 82067 - DNA, 22 bp, Artificial Sequence
  Synthetic oligonucleotide; TTT chr11 5213802 5213823 5213819 5213824 +
atcaaaatctttttttgcacat

SEQ ID NO: 82068 - DNA, 22 bp, Artificial Sequence
  Synthetic oligonucleotide; TTA chr11 5213803 5213824 5213820 5213825 +
tcaaaatctttttttgcacata

SEQ ID NO: 82069 - DNA, 22 bp, Artificial Sequence
  Synthetic oligonucleotide; CTT chr11 5213813 5213834 5213830 5213835 +
tttttgcacatattgaaatgat

SEQ ID NO: 82070 - DNA, 22 bp, Artificial Sequence
  Synthetic oligonucleotide; TTT chr11 5213814 5213835 5213831 5213836 +
ttttgcacatattgaaatgatc

SEQ ID NO: 82071 - DNA, 22 bp, Artificial Sequence
  Synthetic oligonucleotide; TTT chr11 5213815 5213836 5213832 5213837 +
tttgcacatattgaaatgatca

SEQ ID NO: 82072 - DNA, 22 bp, Artificial Sequence
  Synthetic oligonucleotide; TTT chr11 5213816 5213837 5213833 5213838 +
ttgcacatattgaaatgatcat

SEQ ID NO: 82073 - DNA, 22 bp, Artificial Sequence
  Synthetic oligonucleotide; TTT chr11 5213817 5213838 5213834 5213839 +
tgcacatattgaaatgatcatg

SEQ ID NO: 82074 - DNA, 22 bp, Artificial Sequence
  Synthetic oligonucleotide; TTT chr11 5213818 5213839 5213835 5213840 +
gcacatattgaaatgatcatgt

SEQ ID NO: 82075 - DNA, 22 bp, Artificial Sequence
  Synthetic oligonucleotide; TTG chr11 5213819 5213840 5213836 5213841 +
cacatattgaaatgatcatgtg

SEQ ID NO: 82076 - DNA, 22 bp, Artificial Sequence
  Synthetic oligonucleotide; TTG chr11 5213828 5213849 5213845 5213850 +
aaatgatcatgtggtttctgtt

SEQ ID NO: 82077 - DNA, 22 bp, Artificial Sequence
  Synthetic oligonucleotide; TTT chr11 5213845 5213866 5213862 5213867 +
ctgtttttagtgctgtatatat

SEQ ID NO: 82078 - DNA, 22 bp, Artificial Sequence
  Synthetic oligonucleotide; TTC chr11 5213846 5213867 5213863 5213868 +
tgtttttagtgctgtatatatg

SEQ ID NO: 82079 - DNA, 22 bp, Artificial Sequence
  Synthetic oligonucleotide; CTG chr11 5213848 5213869 5213865 5213870 +
tttttagtgctgtatatatgat

SEQ ID NO: 82080 - DNA, 22 bp, Artificial Sequence
  Synthetic oligonucleotide; TTT chr11 5213851 5213872 5213868 5213873 +
ttagtgctgtatatatgatgaa

SEQ ID NO: 82081 - DNA, 22 bp, Artificial Sequence
  Synthetic oligonucleotide; TTT chr11 5213852 5213873 5213869 5213874 +
tagtgctgtatatatgatgaat

SEQ ID NO: 82082 - DNA, 22 bp, Artificial Sequence
  Synthetic oligonucleotide; TTT chr11 5213853 5213874 5213870 5213875 +
agtgctgtatatatgatgaatc

SEQ ID NO: 82083 - DNA, 22 bp, Artificial Sequence
  Synthetic oligonucleotide; TTA chr11 5213854 5213875 5213871 5213876 +
gtgctgtatatatgatgaatca

SEQ ID NO: 82084 - DNA, 22 bp, Artificial Sequence
  Synthetic oligonucleotide; CTG chr11 5213860 5213881 5213877 5213882 +
tatatatgatgaatcacattta

SEQ ID NO: 82085 - DNA, 22 bp, Artificial Sequence
  Synthetic oligonucleotide; TTT chr11 5213881 5213902 5213898 5213903 +
atcaatttgtatatgctgaacc

SEQ ID NO: 82086 - DNA, 22 bp, Artificial Sequence
  Synthetic oligonucleotide; TTA chr11 5213882 5213903 5213899 5213904 +
tcaatttgtatatgctgaacca

SEQ ID NO: 82087 - DNA, 22 bp, Artificial Sequence
  Synthetic oligonucleotide; TTT chr11 5213889 5213910 5213906 5213911 +
gtatatgctgaaccaatcttgc

SEQ ID NO: 82088 - DNA, 22 bp, Artificial Sequence
  Synthetic oligonucleotide; TTG chr11 5213890 5213911 5213907 5213912 +
tatatgctgaaccaatcttgct

SEQ ID NO: 82089 - DNA, 22 bp, Artificial Sequence
  Synthetic oligonucleotide; CTG chr11 5213899 5213920 5213916 5213921 +
aaccaatcttgcttctcaggga

SEQ ID NO: 82090 - DNA, 22 bp, Artificial Sequence
  Synthetic oligonucleotide; CTT chr11 5213909 5213930 5213926 5213931 +
gcttctcagggataaagcctac

SEQ ID NO: 82091 - DNA, 22 bp, Artificial Sequence
  Synthetic oligonucleotide; TTG chr11 5213910 5213931 5213927 5213932 +
cttctcagggataaagcctact

SEQ ID NO: 82092 - DNA, 22 bp, Artificial Sequence
  Synthetic oligonucleotide; CTT chr11 5213913 5213934 5213930 5213935 +
ctcagggataaagcctacttga

SEQ ID NO: 82093 - DNA, 22 bp, Artificial Sequence
  Synthetic oligonucleotide; TTC chr11 5213914 5213935 5213931 5213936 +
tcagggataaagcctacttgat

SEQ ID NO: 82094 - DNA, 22 bp, Artificial Sequence
  Synthetic oligonucleotide; CTC chr11 5213916 5213937 5213933 5213938 +
agggataaagcctacttgattg

SEQ ID NO: 82095 - DNA, 22 bp, Artificial Sequence
  Synthetic oligonucleotide; CTA chr11 5213930 5213951 5213947 5213952 +
cttgattgaggtggattagctt

SEQ ID NO: 82096 - DNA, 22 bp, Artificial Sequence
  Synthetic oligonucleotide; CTT chr11 5213933 5213954 5213950 5213955 +
gattgaggtggattagctttgt

SEQ ID NO: 82097 - DNA, 22 bp, Artificial Sequence
  Synthetic oligonucleotide; TTG chr11 5213934 5213955 5213951 5213956 +
attgaggtggattagctttgtg

SEQ ID NO: 82098 - DNA, 22 bp, Artificial Sequence
  Synthetic oligonucleotide; TTG chr11 5213938 5213959 5213955 5213960 +
aggtggattagctttgtgatgt

SEQ ID NO: 82099 - DNA, 22 bp, Artificial Sequence
  Synthetic oligonucleotide; TTA chr11 5213948 5213969 5213965 5213970 +
gctttgtgatgtgttgctggat

SEQ ID NO: 82100 - DNA, 22 bp, Artificial Sequence
  Synthetic oligonucleotide; CTT chr11 5213952 5213973 5213969 5213974 +
tgtgatgtgttgctggatttgg

SEQ ID NO: 82101 - DNA, 22 bp, Artificial Sequence
  Synthetic oligonucleotide; TTT chr11 5213953 5213974 5213970 5213975 +
gtgatgtgttgctggatttggc

SEQ ID NO: 82102 - DNA, 22 bp, Artificial Sequence
  Synthetic oligonucleotide; TTG chr11 5213954 5213975 5213971 5213976 +
tgatgtgttgctggatttggct

SEQ ID NO: 82103 - DNA, 22 bp, Artificial Sequence
  Synthetic oligonucleotide; TTG chr11 5213964 5213985 5213981 5213986 +
ctggatttggcttgctagtatt

SEQ ID NO: 82104 - DNA, 22 bp, Artificial Sequence
  Synthetic oligonucleotide; CTG chr11 5213967 5213988 5213984 5213989 +
gatttggcttgctagtattttt

SEQ ID NO: 82105 - DNA, 22 bp, Artificial Sequence
  Synthetic oligonucleotide; TTT chr11 5213972 5213993 5213989 5213994 +
ggcttgctagtatttttgcatc

SEQ ID NO: 82106 - DNA, 22 bp, Artificial Sequence
  Synthetic oligonucleotide; TTG chr11 5213973 5213994 5213990 5213995 +
gcttgctagtatttttgcatca

SEQ ID NO: 82107 - DNA, 22 bp, Artificial Sequence
  Synthetic oligonucleotide; CTT chr11 5213977 5213998 5213994 5213999 +
gctagtatttttgcatcaatgt

SEQ ID NO: 82108 - DNA, 22 bp, Artificial Sequence
  Synthetic oligonucleotide; TTG chr11 5213978 5213999 5213995 5214000 +
ctagtatttttgcatcaatgtt

SEQ ID NO: 82109 - DNA, 22 bp, Artificial Sequence
  Synthetic oligonucleotide; CTA chr11 5213981 5214002 5213998 5214003 +
gtatttttgcatcaatgttcaa

SEQ ID NO: 82110 - DNA, 22 bp, Artificial Sequence
  Synthetic oligonucleotide; TTT chr11 5213987 5214008 5214004 5214009 +
ttgcatcaatgttcaaggatat

SEQ ID NO: 82111 - DNA, 22 bp, Artificial Sequence
  Synthetic oligonucleotide; TTT chr11 5213988 5214009 5214005 5214010 +
tgcatcaatgttcaaggatatt

SEQ ID NO: 82112 - DNA, 22 bp, Artificial Sequence
  Synthetic oligonucleotide; TTT chr11 5213989 5214010 5214006 5214011 +
gcatcaatgttcaaggatattg

SEQ ID NO: 82113 - DNA, 22 bp, Artificial Sequence
  Synthetic oligonucleotide; TTG chr11 5213990 5214011 5214007 5214012 +
catcaatgttcaaggatattgg

SEQ ID NO: 82114 - DNA, 22 bp, Artificial Sequence
  Synthetic oligonucleotide; TTC chr11 5214001 5214022 5214018 5214023 +
aaggatattggcctgaagtttt

SEQ ID NO: 82115 - DNA, 22 bp, Artificial Sequence
  Synthetic oligonucleotide; TTG chr11 5214011 5214032 5214028 5214033 +
gcctgaagttttctttttttgt

SEQ ID NO: 82116 - DNA, 22 bp, Artificial Sequence
  Synthetic oligonucleotide; CTG chr11 5214016 5214037 5214033 5214038 +
aagttttctttttttgttgttg

SEQ ID NO: 82117 - DNA, 22 bp, Artificial Sequence
  Synthetic oligonucleotide; TTT chr11 5214022 5214043 5214039 5214044 +
tctttttttgttgttgtgtgtc

SEQ ID NO: 82118 - DNA, 22 bp, Artificial Sequence
  Synthetic oligonucleotide; TTT chr11 5214023 5214044 5214040 5214045 +
ctttttttgttgttgtgtgtct

SEQ ID NO: 82119 - DNA, 22 bp, Artificial Sequence
  Synthetic oligonucleotide; TTC chr11 5214024 5214045 5214041 5214046 +
tttttttgttgttgtgtgtcta

SEQ ID NO: 82120 - DNA, 22 bp, Artificial Sequence
  Synthetic oligonucleotide; CTT chr11 5214026 5214047 5214043 5214048 +
tttttgttgttgtgtgtctatc

SEQ ID NO: 82121 - DNA, 22 bp, Artificial Sequence
  Synthetic oligonucleotide; TTT chr11 5214027 5214048 5214044 5214049 +
ttttgttgttgtgtgtctatca

SEQ ID NO: 82122 - DNA, 22 bp, Artificial Sequence
  Synthetic oligonucleotide; TTT chr11 5214028 5214049 5214045 5214050 +
tttgttgttgtgtgtctatcag

SEQ ID NO: 82123 - DNA, 22 bp, Artificial Sequence
  Synthetic oligonucleotide; TTT chr11 5214029 5214050 5214046 5214051 +
ttgttgttgtgtgtctatcagg

SEQ ID NO: 82124 - DNA, 22 bp, Artificial Sequence
  Synthetic oligonucleotide; TTT chr11 5214030 5214051 5214047 5214052 +
tgttgttgtgtgtctatcaggt

SEQ ID NO: 82125 - DNA, 22 bp, Artificial Sequence
  Synthetic oligonucleotide; TTT chr11 5214031 5214052 5214048 5214053 +
gttgttgtgtgtctatcaggtt

SEQ ID NO: 82126 - DNA, 22 bp, Artificial Sequence
  Synthetic oligonucleotide; TTG chr11 5214032 5214053 5214049 5214054 +
ttgttgtgtgtctatcaggttt

SEQ ID NO: 82127 - DNA, 22 bp, Artificial Sequence
  Synthetic oligonucleotide; TTG chr11 5214035 5214056 5214052 5214057 +
ttgtgtgtctatcaggttttgg

SEQ ID NO: 82128 - DNA, 22 bp, Artificial Sequence
  Synthetic oligonucleotide; TTG chr11 5214038 5214059 5214055 5214060 +
tgtgtctatcaggttttggtat

SEQ ID NO: 82129 - DNA, 22 bp, Artificial Sequence
  Synthetic oligonucleotide; CTA chr11 5214046 5214067 5214063 5214068 +
tcaggttttggtatcaggatga

SEQ ID NO: 82130 - DNA, 22 bp, Artificial Sequence
  Synthetic oligonucleotide; TTT chr11 5214054 5214075 5214071 5214076 +
tggtatcaggatgatgctggcc

SEQ ID NO: 82131 - DNA, 22 bp, Artificial Sequence
  Synthetic oligonucleotide; TTT chr11 5214055 5214076 5214072 5214077 +
ggtatcaggatgatgctggcct

SEQ ID NO: 82132 - DNA, 22 bp, Artificial Sequence
  Synthetic oligonucleotide; TTG chr11 5214056 5214077 5214073 5214078 +
gtatcaggatgatgctggcctc

SEQ ID NO: 82133 - DNA, 22 bp, Artificial Sequence
  Synthetic oligonucleotide; CTG chr11 5214073 5214094 5214090 5214095 +
gcctcataaaatgagctgaggt

SEQ ID NO: 82134 - DNA, 22 bp, Artificial Sequence
  Synthetic oligonucleotide; CTC chr11 5214078 5214099 5214095 5214100 +
ataaaatgagctgaggttgaat

SEQ ID NO: 82135 - DNA, 22 bp, Artificial Sequence
  Synthetic oligonucleotide; CTG chr11 5214091 5214112 5214108 5214113 +
aggttgaatccctccccctcaa

SEQ ID NO: 82136 - DNA, 22 bp, Artificial Sequence
  Synthetic oligonucleotide; TTG chr11 5214097 5214118 5214114 5214119 +
aatccctccccctcaatttttt

SEQ ID NO: 82137 - DNA, 22 bp, Artificial Sequence
  Synthetic oligonucleotide; CTC chr11 5214105 5214126 5214122 5214127 +
cccctcaattttttggagtagc

SEQ ID NO: 82138 - DNA, 22 bp, Artificial Sequence
  Synthetic oligonucleotide; CTC chr11 5214111 5214132 5214128 5214133 +
aattttttggagtagcttcagt

SEQ ID NO: 82139 - DNA, 22 bp, Artificial Sequence
  Synthetic oligonucleotide; TTT chr11 5214116 5214137 5214133 5214138 +
tttggagtagcttcagtaggaa

SEQ ID NO: 82140 - DNA, 22 bp, Artificial Sequence
  Synthetic oligonucleotide; TTT chr11 5214117 5214138 5214134 5214139 +
ttggagtagcttcagtaggaat

SEQ ID NO: 82141 - DNA, 22 bp, Artificial Sequence
  Synthetic oligonucleotide; TTT chr11 5214118 5214139 5214135 5214140 +
tggagtagcttcagtaggaatt

SEQ ID NO: 82142 - DNA, 22 bp, Artificial Sequence
  Synthetic oligonucleotide; TTT chr11 5214119 5214140 5214136 5214141 +
ggagtagcttcagtaggaattt

SEQ ID NO: 82143 - DNA, 22 bp, Artificial Sequence
  Synthetic oligonucleotide; TTG chr11 5214120 5214141 5214137 5214142 +
gagtagcttcagtaggaatttt

SEQ ID NO: 82144 - DNA, 22 bp, Artificial Sequence
  Synthetic oligonucleotide; CTT chr11 5214129 5214150 5214146 5214151 +
cagtaggaatttttccaactct

SEQ ID NO: 82145 - DNA, 22 bp, Artificial Sequence
  Synthetic oligonucleotide; TTC chr11 5214130 5214151 5214147 5214152 +
agtaggaatttttccaactctt

SEQ ID NO: 82146 - DNA, 22 bp, Artificial Sequence
  Synthetic oligonucleotide; TTT chr11 5214141 5214162 5214158 5214163 +
ttccaactcttctttgtgcatc

SEQ ID NO: 82147 - DNA, 22 bp, Artificial Sequence
  Synthetic oligonucleotide; TTT chr11 5214142 5214163 5214159 5214164 +
tccaactcttctttgtgcatct

SEQ ID NO: 82148 - DNA, 22 bp, Artificial Sequence
  Synthetic oligonucleotide; TTT chr11 5214143 5214164 5214160 5214165 +
ccaactcttctttgtgcatctg

SEQ ID NO: 82149 - DNA, 22 bp, Artificial Sequence
  Synthetic oligonucleotide; TTC chr11 5214144 5214165 5214161 5214166 +
caactcttctttgtgcatctga

SEQ ID NO: 82150 - DNA, 22 bp, Artificial Sequence
  Synthetic oligonucleotide; CTC chr11 5214150 5214171 5214167 5214172 +
ttctttgtgcatctgatagaat

SEQ ID NO: 82151 - DNA, 22 bp, Artificial Sequence
  Synthetic oligonucleotide; CTT chr11 5214152 5214173 5214169 5214174 +
ctttgtgcatctgatagaattt

SEQ ID NO: 82152 - DNA, 22 bp, Artificial Sequence
  Synthetic oligonucleotide; TTC chr11 5214153 5214174 5214170 5214175 +
tttgtgcatctgatagaatttg

SEQ ID NO: 82153 - DNA, 22 bp, Artificial Sequence
  Synthetic oligonucleotide; CTT chr11 5214155 5214176 5214172 5214177 +
tgtgcatctgatagaatttggt

SEQ ID NO: 82154 - DNA, 22 bp, Artificial Sequence
  Synthetic oligonucleotide; TTT chr11 5214156 5214177 5214173 5214178 +
gtgcatctgatagaatttggtt

SEQ ID NO: 82155 - DNA, 22 bp, Artificial Sequence
  Synthetic oligonucleotide; TTG chr11 5214157 5214178 5214174 5214179 +
tgcatctgatagaatttggttg

SEQ ID NO: 82156 - DNA, 22 bp, Artificial Sequence
  Synthetic oligonucleotide; CTG chr11 5214165 5214186 5214182 5214187 +
atagaatttggttgtgaatcat

SEQ ID NO: 82157 - DNA, 22 bp, Artificial Sequence
  Synthetic oligonucleotide; TTT chr11 5214174 5214195 5214191 5214196 +
ggttgtgaatcatattgtccag

SEQ ID NO: 82158 - DNA, 22 bp, Artificial Sequence
  Synthetic oligonucleotide; TTG chr11 5214175 5214196 5214192 5214197 +
gttgtgaatcatattgtccagg

SEQ ID NO: 82159 - DNA, 22 bp, Artificial Sequence
  Synthetic oligonucleotide; TTG chr11 5214179 5214200 5214196 5214201 +
tgaatcatattgtccagggctt

SEQ ID NO: 82160 - DNA, 22 bp, Artificial Sequence
  Synthetic oligonucleotide; TTG chr11 5214191 5214212 5214208 5214213 +
tccagggctttttttgtttgat

SEQ ID NO: 82161 - DNA, 22 bp, Artificial Sequence
  Synthetic oligonucleotide; CTT chr11 5214201 5214222 5214218 5214223 +
tttttgtttgataggctattta

SEQ ID NO: 82162 - DNA, 22 bp, Artificial Sequence
  Synthetic oligonucleotide; TTT chr11 5214202 5214223 5214219 5214224 +
ttttgtttgataggctatttat

SEQ ID NO: 82163 - DNA, 22 bp, Artificial Sequence
  Synthetic oligonucleotide; TTT chr11 5214203 5214224 5214220 5214225 +
tttgtttgataggctatttatt

SEQ ID NO: 82164 - DNA, 22 bp, Artificial Sequence
  Synthetic oligonucleotide; TTT chr11 5214204 5214225 5214221 5214226 +
ttgtttgataggctatttatta

SEQ ID NO: 82165 - DNA, 22 bp, Artificial Sequence
  Synthetic oligonucleotide; TTT chr11 5214205 5214226 5214222 5214227 +
tgtttgataggctatttattac

SEQ ID NO: 82166 - DNA, 22 bp, Artificial Sequence
  Synthetic oligonucleotide; TTT chr11 5214206 5214227 5214223 5214228 +
gtttgataggctatttattact

SEQ ID NO: 82167 - DNA, 22 bp, Artificial Sequence
  Synthetic oligonucleotide; TTG chr11 5214207 5214228 5214224 5214229 +
tttgataggctatttattactg

SEQ ID NO: 82168 - DNA, 22 bp, Artificial Sequence
  Synthetic oligonucleotide; TTT chr11 5214210 5214231 5214227 5214232 +
gataggctatttattactgaat

SEQ ID NO: 82169 - DNA, 22 bp, Artificial Sequence
  Synthetic oligonucleotide; TTG chr11 5214211 5214232 5214228 5214233 +
ataggctatttattactgaatc

SEQ ID NO: 82170 - DNA, 22 bp, Artificial Sequence
  Synthetic oligonucleotide; CTA chr11 5214219 5214240 5214236 5214241 +
tttattactgaatcattttcag

SEQ ID NO: 82171 - DNA, 22 bp, Artificial Sequence
  Synthetic oligonucleotide; TTT chr11 5214222 5214243 5214239 5214244 +
attactgaatcattttcagagc

SEQ ID NO: 82172 - DNA, 22 bp, Artificial Sequence
  Synthetic oligonucleotide; TTA chr11 5214223 5214244 5214240 5214245 +
ttactgaatcattttcagagct

SEQ ID NO: 82173 - DNA, 22 bp, Artificial Sequence
  Synthetic oligonucleotide; TTA chr11 5214226 5214247 5214243 5214248 +
ctgaatcattttcagagctcat

SEQ ID NO: 82174 - DNA, 22 bp, Artificial Sequence
  Synthetic oligonucleotide; CTG chr11 5214229 5214250 5214246 5214251 +
aatcattttcagagctcatcat

SEQ ID NO: 82175 - DNA, 22 bp, Artificial Sequence
  Synthetic oligonucleotide; TTT chr11 5214237 5214258 5214254 5214259 +
tcagagctcatcatggatctct

SEQ ID NO: 82176 - DNA, 22 bp, Artificial Sequence
  Synthetic oligonucleotide; TTT chr11 5214238 5214259 5214255 5214260 +
cagagctcatcatggatctctt

SEQ ID NO: 82177 - DNA, 22 bp, Artificial Sequence
  Synthetic oligonucleotide; TTC chr11 5214239 5214260 5214256 5214261 +
agagctcatcatggatctcttc

SEQ ID NO: 82178 - DNA, 22 bp, Artificial Sequence
  Synthetic oligonucleotide; CTC chr11 5214246 5214267 5214263 5214268 +
atcatggatctcttcaggaaat

SEQ ID NO: 82179 - DNA, 22 bp, Artificial Sequence
  Synthetic oligonucleotide; CTC chr11 5214258 5214279 5214275 5214280 +
ttcaggaaattgatttcttcct

SEQ ID NO: 82180 - DNA, 22 bp, Artificial Sequence
  Synthetic oligonucleotide; CTT chr11 5214260 5214281 5214277 5214282 +
caggaaattgatttcttcctgg

SEQ ID NO: 82181 - DNA, 22 bp, Artificial Sequence
  Synthetic oligonucleotide; TTC chr11 5214261 5214282 5214278 5214283 +
aggaaattgatttcttcctggt

SEQ ID NO: 82182 - DNA, 22 bp, Artificial Sequence
  Synthetic oligonucleotide; TTG chr11 5214270 5214291 5214287 5214292 +
atttcttcctggttcagccttg

SEQ ID NO: 82183 - DNA, 22 bp, Artificial Sequence
  Synthetic oligonucleotide; TTT chr11 5214274 5214295 5214291 5214296 +
cttcctggttcagccttgggag

SEQ ID NO: 82184 - DNA, 22 bp, Artificial Sequence
  Synthetic oligonucleotide; TTC chr11 5214275 5214296 5214292 5214297 +
ttcctggttcagccttgggagg

SEQ ID NO: 82185 - DNA, 22 bp, Artificial Sequence
  Synthetic oligonucleotide; CTT chr11 5214277 5214298 5214294 5214299 +
cctggttcagccttgggaggac

SEQ ID NO: 82186 - DNA, 22 bp, Artificial Sequence
  Synthetic oligonucleotide; TTC chr11 5214278 5214299 5214295 5214300 +
ctggttcagccttgggaggacc

SEQ ID NO: 82187 - DNA, 22 bp, Artificial Sequence
  Synthetic oligonucleotide; CTG chr11 5214281 5214302 5214298 5214303 +
gttcagccttgggaggacctaa

SEQ ID NO: 82188 - DNA, 22 bp, Artificial Sequence
  Synthetic oligonucleotide; TTC chr11 5214285 5214306 5214302 5214307 +
agccttgggaggacctaaaaca

SEQ ID NO: 82189 - DNA, 22 bp, Artificial Sequence
  Synthetic oligonucleotide; CTT chr11 5214291 5214312 5214308 5214313 +
gggaggacctaaaacaatcctc

SEQ ID NO: 82190 - DNA, 22 bp, Artificial Sequence
  Synthetic oligonucleotide; TTG chr11 5214292 5214313 5214309 5214314 +
ggaggacctaaaacaatcctca

SEQ ID NO: 82191 - DNA, 22 bp, Artificial Sequence
  Synthetic oligonucleotide; CTA chr11 5214302 5214323 5214319 5214324 +
aaacaatcctcagcaaatgcaa

SEQ ID NO: 82192 - DNA, 22 bp, Artificial Sequence
  Synthetic oligonucleotide; CTC chr11 5214313 5214334 5214330 5214335 +
agcaaatgcaaaaaaaaaatca

SEQ ID NO: 82193 - DNA, 22 bp, Artificial Sequence
  Synthetic oligonucleotide; CTC chr11 5214347 5214368 5214364 5214369 +
tcagaccacagaggaataaaaa

SEQ ID NO: 82194 - DNA, 22 bp, Artificial Sequence
  Synthetic oligonucleotide; CTC chr11 5214349 5214370 5214366 5214371 +
agaccacagaggaataaaaata

SEQ ID NO: 82195 - DNA, 22 bp, Artificial Sequence
  Synthetic oligonucleotide; TTT chr11 5214376 5214397 5214393 5214398 +
caagactaatgaatagctgaaa

SEQ ID NO: 82196 - DNA, 22 bp, Artificial Sequence
  Synthetic oligonucleotide; TTC chr11 5214377 5214398 5214394 5214399 +
aagactaatgaatagctgaaaa

SEQ ID NO: 82197 - DNA, 22 bp, Artificial Sequence
  Synthetic oligonucleotide; CTA chr11 5214384 5214405 5214401 5214406 +
atgaatagctgaaaactatgca

SEQ ID NO: 82198 - DNA, 22 bp, Artificial Sequence
  Synthetic oligonucleotide; CTG chr11 5214395 5214416 5214412 5214417 +
aaaactatgcaattacatggaa

SEQ ID NO: 82199 - DNA, 22 bp, Artificial Sequence
  Synthetic oligonucleotide; CTA chr11 5214402 5214423 5214419 5214424 +
tgcaattacatggaaattaaac

SEQ ID NO: 82200 - DNA, 22 bp, Artificial Sequence
  Synthetic oligonucleotide; TTA chr11 5214410 5214431 5214427 5214432 +
catggaaattaaacaacctgct

SEQ ID NO: 82201 - DNA, 22 bp, Artificial Sequence
  Synthetic oligonucleotide; TTA chr11 5214421 5214442 5214438 5214443 +
aacaacctgctcctgaatgaat

SEQ ID NO: 82202 - DNA, 22 bp, Artificial Sequence
  Synthetic oligonucleotide; CTG chr11 5214430 5214451 5214447 5214452 +
ctcctgaatgaattttgggtaa

SEQ ID NO: 82203 - DNA, 22 bp, Artificial Sequence
  Synthetic oligonucleotide; CTC chr11 5214433 5214454 5214450 5214455 +
ctgaatgaattttgggtaaata

SEQ ID NO: 82204 - DNA, 22 bp, Artificial Sequence
  Synthetic oligonucleotide; CTG chr11 5214436 5214457 5214453 5214458 +
aatgaattttgggtaaataatg

SEQ ID NO: 82205 - DNA, 22 bp, Artificial Sequence
  Synthetic oligonucleotide; TTT chr11 5214445 5214466 5214462 5214467 +
tgggtaaataatgaaaactaag

SEQ ID NO: 82206 - DNA, 22 bp, Artificial Sequence
  Synthetic oligonucleotide; TTT chr11 5214446 5214467 5214463 5214468 +
gggtaaataatgaaaactaagg

SEQ ID NO: 82207 - DNA, 22 bp, Artificial Sequence
  Synthetic oligonucleotide; TTG chr11 5214447 5214468 5214464 5214469 +
ggtaaataatgaaaactaaggc

SEQ ID NO: 82208 - DNA, 22 bp, Artificial Sequence
  Synthetic oligonucleotide; CTA chr11 5214465 5214486 5214482 5214487 +
aggcaaaaataaaatagttctt

SEQ ID NO: 82209 - DNA, 22 bp, Artificial Sequence
  Synthetic oligonucleotide; TTC chr11 5214485 5214506 5214502 5214507 +
tttgaaactaatgagaacaaag

SEQ ID NO: 82210 - DNA, 22 bp, Artificial Sequence
  Synthetic oligonucleotide; CTT chr11 5214487 5214508 5214504 5214509 +
tgaaactaatgagaacaaagat

SEQ ID NO: 82211 - DNA, 22 bp, Artificial Sequence
  Synthetic oligonucleotide; TTT chr11 5214488 5214509 5214505 5214510 +
gaaactaatgagaacaaagata

SEQ ID NO: 82212 - DNA, 22 bp, Artificial Sequence
  Synthetic oligonucleotide; TTG chr11 5214489 5214510 5214506 5214511 +
aaactaatgagaacaaagatac

SEQ ID NO: 82213 - DNA, 22 bp, Artificial Sequence
  Synthetic oligonucleotide; CTA chr11 5214495 5214516 5214512 5214517 +
atgagaacaaagatacaatata

SEQ ID NO: 82214 - DNA, 22 bp, Artificial Sequence
  Synthetic oligonucleotide; CTC chr11 5214527 5214548 5214544 5214549 +
tgggacacagcttagacagtgt

SEQ ID NO: 82215 - DNA, 22 bp, Artificial Sequence
  Synthetic oligonucleotide; CTG chr11 5214529 5214550 5214546 5214551 +
ggacacagcttagacagtgtta

SEQ ID NO: 82216 - DNA, 22 bp, Artificial Sequence
  Synthetic oligonucleotide; CTT chr11 5214540 5214561 5214557 5214562 +
agacagtgttaagagagaaatt

SEQ ID NO: 82217 - DNA, 22 bp, Artificial Sequence
  Synthetic oligonucleotide; TTA chr11 5214541 5214562 5214558 5214563 +
gacagtgttaagagagaaattt

SEQ ID NO: 82218 - DNA, 22 bp, Artificial Sequence
  Synthetic oligonucleotide; TTA chr11 5214551 5214572 5214568 5214573 +
agagagaaatttatacactaaa

SEQ ID NO: 82219 - DNA, 22 bp, Artificial Sequence
  Synthetic oligonucleotide; TTT chr11 5214563 5214584 5214580 5214585 +
atacactaaatgcccacatcaa

SEQ ID NO: 82220 - DNA, 22 bp, Artificial Sequence
  Synthetic oligonucleotide; TTA chr11 5214564 5214585 5214581 5214586 +
tacactaaatgcccacatcaaa

SEQ ID NO: 82221 - DNA, 22 bp, Artificial Sequence
  Synthetic oligonucleotide; CTA chr11 5214571 5214592 5214588 5214593 +
aatgcccacatcaaaaagtctt

SEQ ID NO: 82222 - DNA, 22 bp, Artificial Sequence
  Synthetic oligonucleotide; CTT chr11 5214593 5214614 5214610 5214615 +
aaagccctcaaattaacaacct

SEQ ID NO: 82223 - DNA, 22 bp, Artificial Sequence
  Synthetic oligonucleotide; TTA chr11 5214594 5214615 5214611 5214616 +
aagccctcaaattaacaaccta

SEQ ID NO: 82224 - DNA, 22 bp, Artificial Sequence
  Synthetic oligonucleotide; CTC chr11 5214602 5214623 5214619 5214624 +
aaattaacaacctaatgtcaca

SEQ ID NO: 82225 - DNA, 22 bp, Artificial Sequence
  Synthetic oligonucleotide; TTA chr11 5214608 5214629 5214625 5214630 +
acaacctaatgtcacaactaaa

SEQ ID NO: 82226 - DNA, 22 bp, Artificial Sequence
  Synthetic oligonucleotide; CTA chr11 5214616 5214637 5214633 5214638 +
atgtcacaactaaaagaaccag

SEQ ID NO: 82227 - DNA, 22 bp, Artificial Sequence
  Synthetic oligonucleotide; CTA chr11 5214628 5214649 5214645 5214650 +
aaagaaccagagaaccaagagc

SEQ ID NO: 82228 - DNA, 22 bp, Artificial Sequence
  Synthetic oligonucleotide; CTA chr11 5214662 5214683 5214679 5214684 +
aatctagcagaagacaagaaat

SEQ ID NO: 82229 - DNA, 22 bp, Artificial Sequence
  Synthetic oligonucleotide; CTA chr11 5214668 5214689 5214685 5214690 +
gcagaagacaagaaataaacaa

SEQ ID NO: 82230 - DNA, 22 bp, Artificial Sequence
  Synthetic oligonucleotide; CTA chr11 5214701 5214722 5214718 5214723 +
actgaaggatattaaaacacaa

SEQ ID NO: 82231 - DNA, 22 bp, Artificial Sequence
  Synthetic oligonucleotide; CTG chr11 5214705 5214726 5214722 5214727 +
aaggatattaaaacacaaaata

SEQ ID NO: 82232 - DNA, 22 bp, Artificial Sequence
  Synthetic oligonucleotide; TTA chr11 5214715 5214736 5214732 5214737 +
aaacacaaaataccattcaaaa

SEQ ID NO: 82233 - DNA, 22 bp, Artificial Sequence
  Synthetic oligonucleotide; TTC chr11 5214733 5214754 5214750 5214755 +
aaaagattaatgagtccaagag

SEQ ID NO: 82234 - DNA, 22 bp, Artificial Sequence
  Synthetic oligonucleotide; TTA chr11 5214742 5214763 5214759 5214764 +
atgagtccaagagctggttttg

SEQ ID NO: 82235 - DNA, 22 bp, Artificial Sequence
  Synthetic oligonucleotide; CTG chr11 5214758 5214779 5214775 5214780 +
gttttgtgaaaaaattaataag

SEQ ID NO: 82236 - DNA, 22 bp, Artificial Sequence
  Synthetic oligonucleotide; TTT chr11 5214762 5214783 5214779 5214784 +
tgtgaaaaaattaataaggtag

SEQ ID NO: 82237 - DNA, 22 bp, Artificial Sequence
  Synthetic oligonucleotide; TTT chr11 5214763 5214784 5214780 5214785 +
gtgaaaaaattaataaggtaga

SEQ ID NO: 82238 - DNA, 22 bp, Artificial Sequence
  Synthetic oligonucleotide; TTG chr11 5214764 5214785 5214781 5214786 +
tgaaaaaattaataaggtagat

SEQ ID NO: 82239 - DNA, 22 bp, Artificial Sequence
  Synthetic oligonucleotide; TTA chr11 5214775 5214796 5214792 5214797 +
ataaggtagatcactagctaga

SEQ ID NO: 82240 - DNA, 22 bp, Artificial Sequence
  Synthetic oligonucleotide; CTA chr11 5214791 5214812 5214808 5214813 +
gctagactaataaagaagacaa

SEQ ID NO: 82241 - DNA, 22 bp, Artificial Sequence
  Synthetic oligonucleotide; CTA chr11 5214795 5214816 5214812 5214817 +
gactaataaagaagacaagaga

SEQ ID NO: 82242 - DNA, 22 bp, Artificial Sequence
  Synthetic oligonucleotide; CTA chr11 5214800 5214821 5214817 5214822 +
ataaagaagacaagagagaaga

SEQ ID NO: 82243 - DNA, 22 bp, Artificial Sequence
  Synthetic oligonucleotide; TTA chr11 5214840 5214861 5214857 5214862 +
gaaatgaaaaagggaatattat

SEQ ID NO: 82244 - DNA, 22 bp, Artificial Sequence
  Synthetic oligonucleotide; TTA chr11 5214861 5214882 5214878 5214883 +
tcactcaccccacagaaataca

SEQ ID NO: 82245 - DNA, 22 bp, Artificial Sequence
  Synthetic oligonucleotide; CTC chr11 5214867 5214888 5214884 5214889 +
accccacagaaatacaaataat

SEQ ID NO: 82246 - DNA, 22 bp, Artificial Sequence
  Synthetic oligonucleotide; CTA chr11 5214901 5214922 5214918 5214923 +
ctatgaacatctctatgtacat

SEQ ID NO: 82247 - DNA, 22 bp, Artificial Sequence
  Synthetic oligonucleotide; CTA chr11 5214904 5214925 5214921 5214926 +
tgaacatctctatgtacataaa

SEQ ID NO: 82248 - DNA, 22 bp, Artificial Sequence
  Synthetic oligonucleotide; CTC chr11 5214914 5214935 5214931 5214936 +
tatgtacataaactagaaaatc

SEQ ID NO: 82249 - DNA, 22 bp, Artificial Sequence
  Synthetic oligonucleotide; CTA chr11 5214916 5214937 5214933 5214938 +
tgtacataaactagaaaatcta

SEQ ID NO: 82250 - DNA, 22 bp, Artificial Sequence
  Synthetic oligonucleotide; CTA chr11 5214929 5214950 5214946 5214951 +
gaaaatctaaaagaaatggata

SEQ ID NO: 82251 - DNA, 22 bp, Artificial Sequence
  Synthetic oligonucleotide; CTA chr11 5214938 5214959 5214955 5214960 +
aaagaaatggataacttcctgg

SEQ ID NO: 82252 - DNA, 22 bp, Artificial Sequence
  Synthetic oligonucleotide; CTT chr11 5214955 5214976 5214972 5214977 +
cctggactgctcattgtcttag

SEQ ID NO: 82253 - DNA, 22 bp, Artificial Sequence
  Synthetic oligonucleotide; TTC chr11 5214956 5214977 5214973 5214978 +
ctggactgctcattgtcttagg

SEQ ID NO: 82254 - DNA, 22 bp, Artificial Sequence
  Synthetic oligonucleotide; CTG chr11 5214959 5214980 5214976 5214981 +
gactgctcattgtcttaggcaa

SEQ ID NO: 82255 - DNA, 22 bp, Artificial Sequence
  Synthetic oligonucleotide; CTG chr11 5214964 5214985 5214981 5214986 +
ctcattgtcttaggcaaagaag

SEQ ID NO: 82256 - DNA, 22 bp, Artificial Sequence
  Synthetic oligonucleotide; CTC chr11 5214967 5214988 5214984 5214989 +
attgtcttaggcaaagaagact

SEQ ID NO: 82257 - DNA, 22 bp, Artificial Sequence
  Synthetic oligonucleotide; TTG chr11 5214971 5214992 5214988 5214993 +
tcttaggcaaagaagactagcc

SEQ ID NO: 82258 - DNA, 22 bp, Artificial Sequence
  Synthetic oligonucleotide; CTT chr11 5214975 5214996 5214992 5214997 +
aggcaaagaagactagccgtac

SEQ ID NO: 82259 - DNA, 22 bp, Artificial Sequence
  Synthetic oligonucleotide; TTA chr11 5214976 5214997 5214993 5214998 +
ggcaaagaagactagccgtact

SEQ ID NO: 82260 - DNA, 22 bp, Artificial Sequence
  Synthetic oligonucleotide; CTA chr11 5214990 5215011 5215007 5215012 +
gccgtactttatttgagggctc

SEQ ID NO: 82261 - DNA, 22 bp, Artificial Sequence
  Synthetic oligonucleotide; CTT chr11 5214999 5215020 5215016 5215021 +
tatttgagggctctttgagtag

SEQ ID NO: 82262 - DNA, 22 bp, Artificial Sequence
  Synthetic oligonucleotide; TTT chr11 5215000 5215021 5215017 5215022 +
atttgagggctctttgagtaga

SEQ ID NO: 82263 - DNA, 22 bp, Artificial Sequence
  Synthetic oligonucleotide; TTA chr11 5215001 5215022 5215018 5215023 +
tttgagggctctttgagtagag

SEQ ID NO: 82264 - DNA, 22 bp, Artificial Sequence
  Synthetic oligonucleotide; TTT chr11 5215004 5215025 5215021 5215026 +
gagggctctttgagtagagtcc

SEQ ID NO: 82265 - DNA, 22 bp, Artificial Sequence
  Synthetic oligonucleotide; TTG chr11 5215005 5215026 5215022 5215027 +
agggctctttgagtagagtcct

SEQ ID NO: 82266 - DNA, 22 bp, Artificial Sequence
  Synthetic oligonucleotide; CTC chr11 5215012 5215033 5215029 5215034 +
tttgagtagagtcctataaatt

SEQ ID NO: 82267 - DNA, 22 bp, Artificial Sequence
  Synthetic oligonucleotide; CTT chr11 5215014 5215035 5215031 5215036 +
tgagtagagtcctataaattcc

SEQ ID NO: 82268 - DNA, 22 bp, Artificial Sequence
  Synthetic oligonucleotide; TTT chr11 5215015 5215036 5215032 5215037 +
gagtagagtcctataaattcct

SEQ ID NO: 82269 - DNA, 22 bp, Artificial Sequence
  Synthetic oligonucleotide; TTG chr11 5215016 5215037 5215033 5215038 +
agtagagtcctataaattcctg

SEQ ID NO: 82270 - DNA, 22 bp, Artificial Sequence
  Synthetic oligonucleotide; CTA chr11 5215028 5215049 5215045 5215050 +
taaattcctgtatttctctcaa

SEQ ID NO: 82271 - DNA, 22 bp, Artificial Sequence
  Synthetic oligonucleotide; TTC chr11 5215035 5215056 5215052 5215057 +
ctgtatttctctcaactctatg

SEQ ID NO: 82272 - DNA, 22 bp, Artificial Sequence
  Synthetic oligonucleotide; CTG chr11 5215038 5215059 5215055 5215060 +
tatttctctcaactctatgtcc

SEQ ID NO: 82273 - DNA, 22 bp, Artificial Sequence
  Synthetic oligonucleotide; TTT chr11 5215043 5215064 5215060 5215065 +
ctctcaactctatgtccccctc

SEQ ID NO: 82274 - DNA, 22 bp, Artificial Sequence
  Synthetic oligonucleotide; TTC chr11 5215044 5215065 5215061 5215066 +
tctcaactctatgtccccctcc

SEQ ID NO: 82275 - DNA, 22 bp, Artificial Sequence
  Synthetic oligonucleotide; CTC chr11 5215046 5215067 5215063 5215068 +
tcaactctatgtccccctcccc

SEQ ID NO: 82276 - DNA, 22 bp, Artificial Sequence
  Synthetic oligonucleotide; CTC chr11 5215048 5215069 5215065 5215070 +
aactctatgtccccctccccag

SEQ ID NO: 82277 - DNA, 22 bp, Artificial Sequence
  Synthetic oligonucleotide; CTC chr11 5215053 5215074 5215070 5215075 +
tatgtccccctccccagaatac

SEQ ID NO: 82278 - DNA, 22 bp, Artificial Sequence
  Synthetic oligonucleotide; CTA chr11 5215055 5215076 5215072 5215077 +
tgtccccctccccagaatacaa

SEQ ID NO: 82279 - DNA, 22 bp, Artificial Sequence
  Synthetic oligonucleotide; CTC chr11 5215065 5215086 5215082 5215087 +
cccagaatacaaagccccttct

SEQ ID NO: 82280 - DNA, 22 bp, Artificial Sequence
  Synthetic oligonucleotide; CTT chr11 5215085 5215106 5215102 5215107 +
ctgtgatgcctcctttgcttct

SEQ ID NO: 82281 - DNA, 22 bp, Artificial Sequence
  Synthetic oligonucleotide; TTC chr11 5215086 5215107 5215103 5215108 +
tgtgatgcctcctttgcttctt

SEQ ID NO: 82282 - DNA, 22 bp, Artificial Sequence
  Synthetic oligonucleotide; CTG chr11 5215088 5215109 5215105 5215110 +
tgatgcctcctttgcttctttt

SEQ ID NO: 82283 - DNA, 22 bp, Artificial Sequence
  Synthetic oligonucleotide; CTC chr11 5215097 5215118 5215114 5215119 +
ctttgcttcttttggttatatc

SEQ ID NO: 82284 - DNA, 22 bp, Artificial Sequence
  Synthetic oligonucleotide; CTT chr11 5215100 5215121 5215117 5215122 +
tgcttcttttggttatatctgt

SEQ ID NO: 82285 - DNA, 22 bp, Artificial Sequence
  Synthetic oligonucleotide; TTT chr11 5215101 5215122 5215118 5215123 +
gcttcttttggttatatctgtg

SEQ ID NO: 82286 - DNA, 22 bp, Artificial Sequence
  Synthetic oligonucleotide; TTG chr11 5215102 5215123 5215119 5215124 +
cttcttttggttatatctgtgt

SEQ ID NO: 82287 - DNA, 22 bp, Artificial Sequence
  Synthetic oligonucleotide; CTT chr11 5215105 5215126 5215122 5215127 +
cttttggttatatctgtgttat

SEQ ID NO: 82288 - DNA, 22 bp, Artificial Sequence
  Synthetic oligonucleotide; TTC chr11 5215106 5215127 5215123 5215128 +
ttttggttatatctgtgttata

SEQ ID NO: 82289 - DNA, 22 bp, Artificial Sequence
  Synthetic oligonucleotide; CTT chr11 5215108 5215129 5215125 5215130 +
ttggttatatctgtgttatatc

SEQ ID NO: 82290 - DNA, 22 bp, Artificial Sequence
  Synthetic oligonucleotide; TTT chr11 5215109 5215130 5215126 5215131 +
tggttatatctgtgttatatct

SEQ ID NO: 82291 - DNA, 22 bp, Artificial Sequence
  Synthetic oligonucleotide; TTT chr11 5215110 5215131 5215127 5215132 +
ggttatatctgtgttatatctg

SEQ ID NO: 82292 - DNA, 22 bp, Artificial Sequence
  Synthetic oligonucleotide; TTG chr11 5215111 5215132 5215128 5215133 +
gttatatctgtgttatatctga

SEQ ID NO: 82293 - DNA, 22 bp, Artificial Sequence
  Synthetic oligonucleotide; TTA chr11 5215115 5215136 5215132 5215137 +
tatctgtgttatatctgaatat

SEQ ID NO: 82294 - DNA, 22 bp, Artificial Sequence
  Synthetic oligonucleotide; CTG chr11 5215121 5215142 5215138 5215143 +
tgttatatctgaatatatggct

SEQ ID NO: 82295 - DNA, 22 bp, Artificial Sequence
  Synthetic oligonucleotide; TTA chr11 5215126 5215147 5215143 5215148 +
tatctgaatatatggctctaga

SEQ ID NO: 82296 - DNA, 22 bp, Artificial Sequence
  Synthetic oligonucleotide; CTG chr11 5215132 5215153 5215149 5215154 +
aatatatggctctagagaatcc

SEQ ID NO: 82297 - DNA, 22 bp, Artificial Sequence
  Synthetic oligonucleotide; CTC chr11 5215144 5215165 5215161 5215166 +
tagagaatcccaagaaatagaa

SEQ ID NO: 82298 - DNA, 22 bp, Artificial Sequence
  Synthetic oligonucleotide; CTA chr11 5215146 5215167 5215163 5215168 +
gagaatcccaagaaatagaaaa

SEQ ID NO: 82299 - DNA, 22 bp, Artificial Sequence
  Synthetic oligonucleotide; CTA chr11 5215173 5215194 5215190 5215195 +
gtccaaaatccaagctctgaat

SEQ ID NO: 82300 - DNA, 22 bp, Artificial Sequence
  Synthetic oligonucleotide; CTC chr11 5215190 5215211 5215207 5215212 +
tgaataagacaggtgagacctt

SEQ ID NO: 82301 - DNA, 22 bp, Artificial Sequence
  Synthetic oligonucleotide; CTG chr11 5215192 5215213 5215209 5215214 +
aataagacaggtgagacctttg

SEQ ID NO: 82302 - DNA, 22 bp, Artificial Sequence
  Synthetic oligonucleotide; CTT chr11 5215212 5215233 5215229 5215234 +
tggatgaatatcttttcacaaa

SEQ ID NO: 82303 - DNA, 22 bp, Artificial Sequence
  Synthetic oligonucleotide; TTT chr11 5215213 5215234 5215230 5215235 +
ggatgaatatcttttcacaaag

SEQ ID NO: 82304 - DNA, 22 bp, Artificial Sequence
  Synthetic oligonucleotide; TTG chr11 5215214 5215235 5215231 5215236 +
gatgaatatcttttcacaaagt

SEQ ID NO: 82305 - DNA, 22 bp, Artificial Sequence
  Synthetic oligonucleotide; CTT chr11 5215226 5215247 5215243 5215248 +
ttcacaaagttgagaagatgtg

SEQ ID NO: 82306 - DNA, 22 bp, Artificial Sequence
  Synthetic oligonucleotide; TTT chr11 5215227 5215248 5215244 5215249 +
tcacaaagttgagaagatgtga

SEQ ID NO: 82307 - DNA, 22 bp, Artificial Sequence
  Synthetic oligonucleotide; TTT chr11 5215228 5215249 5215245 5215250 +
cacaaagttgagaagatgtgaa

SEQ ID NO: 82308 - DNA, 22 bp, Artificial Sequence
  Synthetic oligonucleotide; TTC chr11 5215229 5215250 5215246 5215251 +
acaaagttgagaagatgtgaag

SEQ ID NO: 82309 - DNA, 22 bp, Artificial Sequence
  Synthetic oligonucleotide; TTG chr11 5215238 5215259 5215255 5215260 +
agaagatgtgaagaacccaaga

SEQ ID NO: 82310 - DNA, 22 bp, Artificial Sequence
  Synthetic oligonucleotide; CTG chr11 5215268 5215289 5215285 5215290 +
gagaaacagccccgaggcactg

SEQ ID NO: 82311 - DNA, 22 bp, Artificial Sequence
  Synthetic oligonucleotide; CTG chr11 5215290 5215311 5215307 5215312 +
caaggggttcagacctgtgttg

SEQ ID NO: 82312 - DNA, 22 bp, Artificial Sequence
  Synthetic oligonucleotide; TTC chr11 5215300 5215321 5215317 5215322 +
agacctgtgttggagaatatca

SEQ ID NO: 82313 - DNA, 22 bp, Artificial Sequence
  Synthetic oligonucleotide; CTG chr11 5215307 5215328 5215324 5215329 +
tgttggagaatatcatcaccgt

SEQ ID NO: 82314 - DNA, 22 bp, Artificial Sequence
  Synthetic oligonucleotide; TTG chr11 5215312 5215333 5215329 5215334 +
gagaatatcatcaccgtaacaa

SEQ ID NO: 82315 - DNA, 22 bp, Artificial Sequence
  Synthetic oligonucleotide; CTT chr11 5215339 5215360 5215356 5215361 +
ctatgttcttaatatctgtgtg

SEQ ID NO: 82316 - DNA, 22 bp, Artificial Sequence
  Synthetic oligonucleotide; TTC chr11 5215340 5215361 5215357 5215362 +
tatgttcttaatatctgtgtgt

SEQ ID NO: 82317 - DNA, 22 bp, Artificial Sequence
  Synthetic oligonucleotide; CTA chr11 5215342 5215363 5215359 5215364 +
tgttcttaatatctgtgtgttt

SEQ ID NO: 82318 - DNA, 22 bp, Artificial Sequence
  Synthetic oligonucleotide; TTC chr11 5215347 5215368 5215364 5215369 +
ttaatatctgtgtgtttgtttg

SEQ ID NO: 82319 - DNA, 22 bp, Artificial Sequence
  Synthetic oligonucleotide; CTT chr11 5215349 5215370 5215366 5215371 +
aatatctgtgtgtttgtttgtt

SEQ ID NO: 82320 - DNA, 22 bp, Artificial Sequence
  Synthetic oligonucleotide; TTA chr11 5215350 5215371 5215367 5215372 +
atatctgtgtgtttgtttgttt

SEQ ID NO: 82321 - DNA, 22 bp, Artificial Sequence
  Synthetic oligonucleotide; CTG chr11 5215357 5215378 5215374 5215379 +
tgtgtttgtttgtttgtttttt

SEQ ID NO: 82322 - DNA, 22 bp, Artificial Sequence
  Synthetic oligonucleotide; TTT chr11 5215364 5215385 5215381 5215386 +
gtttgtttgttttttgcttgtt

SEQ ID NO: 82323 - DNA, 22 bp, Artificial Sequence
  Synthetic oligonucleotide; TTG chr11 5215365 5215386 5215382 5215387 +
tttgtttgttttttgcttgttt

SEQ ID NO: 82324 - DNA, 22 bp, Artificial Sequence
  Synthetic oligonucleotide; TTT chr11 5215368 5215389 5215385 5215390 +
gtttgttttttgcttgtttgtt

SEQ ID NO: 82325 - DNA, 22 bp, Artificial Sequence
  Synthetic oligonucleotide; TTG chr11 5215369 5215390 5215386 5215391 +
tttgttttttgcttgtttgttt

SEQ ID NO: 82326 - DNA, 22 bp, Artificial Sequence
  Synthetic oligonucleotide; TTT chr11 5215372 5215393 5215389 5215394 +
gttttttgcttgtttgtttgtt

SEQ ID NO: 82327 - DNA, 22 bp, Artificial Sequence
  Synthetic oligonucleotide; TTG chr11 5215373 5215394 5215390 5215395 +
ttttttgcttgtttgtttgttt

SEQ ID NO: 82328 - DNA, 22 bp, Artificial Sequence
  Synthetic oligonucleotide; TTT chr11 5215376 5215397 5215393 5215398 +
tttgcttgtttgtttgtttttc

SEQ ID NO: 82329 - DNA, 22 bp, Artificial Sequence
  Synthetic oligonucleotide; TTT chr11 5215377 5215398 5215394 5215399 +
ttgcttgtttgtttgtttttcc

SEQ ID NO: 82330 - DNA, 22 bp, Artificial Sequence
  Synthetic oligonucleotide; TTT chr11 5215378 5215399 5215395 5215400 +
tgcttgtttgtttgtttttcct

SEQ ID NO: 82331 - DNA, 22 bp, Artificial Sequence
  Synthetic oligonucleotide; TTT chr11 5215379 5215400 5215396 5215401 +
gcttgtttgtttgtttttcctc

SEQ ID NO: 82332 - DNA, 22 bp, Artificial Sequence
  Synthetic oligonucleotide; TTG chr11 5215380 5215401 5215397 5215402 +
cttgtttgtttgtttttcctca

SEQ ID NO: 82333 - DNA, 22 bp, Artificial Sequence
  Synthetic oligonucleotide; CTT chr11 5215383 5215404 5215400 5215405 +
gtttgtttgtttttcctcagag

SEQ ID NO: 82334 - DNA, 22 bp, Artificial Sequence
  Synthetic oligonucleotide; TTG chr11 5215384 5215405 5215401 5215406 +
tttgtttgtttttcctcagaga

SEQ ID NO: 82335 - DNA, 22 bp, Artificial Sequence
  Synthetic oligonucleotide; TTT chr11 5215387 5215408 5215404 5215409 +
gtttgtttttcctcagagacag

SEQ ID NO: 82336 - DNA, 22 bp, Artificial Sequence
  Synthetic oligonucleotide; TTG chr11 5215388 5215409 5215405 5215410 +
tttgtttttcctcagagacagg

SEQ ID NO: 82337 - DNA, 22 bp, Artificial Sequence
  Synthetic oligonucleotide; TTT chr11 5215391 5215412 5215408 5215413 +
gtttttcctcagagacaggatc

SEQ ID NO: 82338 - DNA, 22 bp, Artificial Sequence
  Synthetic oligonucleotide; TTG chr11 5215392 5215413 5215409 5215414 +
tttttcctcagagacaggatct

SEQ ID NO: 82339 - DNA, 22 bp, Artificial Sequence
  Synthetic oligonucleotide; TTT chr11 5215395 5215416 5215412 5215417 +
ttcctcagagacaggatctcag

SEQ ID NO: 82340 - DNA, 22 bp, Artificial Sequence
  Synthetic oligonucleotide; TTT chr11 5215396 5215417 5215413 5215418 +
tcctcagagacaggatctcagt

SEQ ID NO: 82341 - DNA, 22 bp, Artificial Sequence
  Synthetic oligonucleotide; TTT chr11 5215397 5215418 5215414 5215419 +
cctcagagacaggatctcagtc

SEQ ID NO: 82342 - DNA, 22 bp, Artificial Sequence
  Synthetic oligonucleotide; TTC chr11 5215398 5215419 5215415 5215420 +
ctcagagacaggatctcagtca

SEQ ID NO: 82343 - DNA, 22 bp, Artificial Sequence
  Synthetic oligonucleotide; CTC chr11 5215401 5215422 5215418 5215423 +
agagacaggatctcagtcacca

SEQ ID NO: 82344 - DNA, 22 bp, Artificial Sequence
  Synthetic oligonucleotide; CTC chr11 5215415 5215436 5215432 5215437 +
agtcaccaaggctagagagcag

SEQ ID NO: 82345 - DNA, 22 bp, Artificial Sequence
  Synthetic oligonucleotide; CTA chr11 5215429 5215450 5215446 5215451 +
gagagcagtggtgtcattattg

SEQ ID NO: 82346 - DNA, 22 bp, Artificial Sequence
  Synthetic oligonucleotide; TTA chr11 5215448 5215469 5215465 5215470 +
ttgctcactgcaaccctgaaat

SEQ ID NO: 82347 - DNA, 22 bp, Artificial Sequence
  Synthetic oligonucleotide; TTG chr11 5215451 5215472 5215468 5215473 +
ctcactgcaaccctgaaatcct

SEQ ID NO: 82348 - DNA, 22 bp, Artificial Sequence
  Synthetic oligonucleotide; CTC chr11 5215454 5215475 5215471 5215476 +
actgcaaccctgaaatcctggg

SEQ ID NO: 82349 - DNA, 22 bp, Artificial Sequence
  Synthetic oligonucleotide; CTG chr11 5215458 5215479 5215475 5215480 +
caaccctgaaatcctgggctca

SEQ ID NO: 82350 - DNA, 22 bp, Artificial Sequence
  Synthetic oligonucleotide; CTG chr11 5215466 5215487 5215483 5215488 +
aaatcctgggctcaagtgatcc

SEQ ID NO: 82351 - DNA, 22 bp, Artificial Sequence
  Synthetic oligonucleotide; CTG chr11 5215474 5215495 5215491 5215496 +
ggctcaagtgatcctatcactt

SEQ ID NO: 82352 - DNA, 22 bp, Artificial Sequence
  Synthetic oligonucleotide; CTC chr11 5215479 5215500 5215496 5215501 +
aagtgatcctatcacttcagcc

SEQ ID NO: 82353 - DNA, 22 bp, Artificial Sequence
  Synthetic oligonucleotide; CTA chr11 5215490 5215511 5215507 5215512 +
tcacttcagcctcctgggttac

SEQ ID NO: 82354 - DNA, 22 bp, Artificial Sequence
  Synthetic oligonucleotide; CTT chr11 5215496 5215517 5215513 5215518 +
cagcctcctgggttactgggac

SEQ ID NO: 82355 - DNA, 22 bp, Artificial Sequence
  Synthetic oligonucleotide; TTC chr11 5215497 5215518 5215514 5215519 +
agcctcctgggttactgggact

SEQ ID NO: 82356 - DNA, 22 bp, Artificial Sequence
  Synthetic oligonucleotide; CTC chr11 5215503 5215524 5215520 5215525 +
ctgggttactgggactacagat

SEQ ID NO: 82357 - DNA, 22 bp, Artificial Sequence
  Synthetic oligonucleotide; CTG chr11 5215506 5215527 5215523 5215528 +
ggttactgggactacagatgca

SEQ ID NO: 82358 - DNA, 22 bp, Artificial Sequence
  Synthetic oligonucleotide; TTA chr11 5215511 5215532 5215528 5215533 +
ctgggactacagatgcaagcca

SEQ ID NO: 82359 - DNA, 22 bp, Artificial Sequence
  Synthetic oligonucleotide; CTG chr11 5215514 5215535 5215531 5215536 +
ggactacagatgcaagccactg

SEQ ID NO: 82360 - DNA, 22 bp, Artificial Sequence
  Synthetic oligonucleotide; CTA chr11 5215520 5215541 5215537 5215542 +
cagatgcaagccactgtgccca

SEQ ID NO: 82361 - DNA, 22 bp, Artificial Sequence
  Synthetic oligonucleotide; CTG chr11 5215536 5215557 5215553 5215558 +
tgcccagcttggctctttcttt

SEQ ID NO: 82362 - DNA, 22 bp, Artificial Sequence
  Synthetic oligonucleotide; CTT chr11 5215546 5215567 5215563 5215568 +
ggctctttctttttattttaat

SEQ ID NO: 82363 - DNA, 22 bp, Artificial Sequence
  Synthetic oligonucleotide; TTG chr11 5215547 5215568 5215564 5215569 +
gctctttctttttattttaatt

SEQ ID NO: 82364 - DNA, 22 bp, Artificial Sequence
  Synthetic oligonucleotide; CTC chr11 5215551 5215572 5215568 5215573 +
tttctttttattttaattggtc

SEQ ID NO: 82365 - DNA, 22 bp, Artificial Sequence
  Synthetic oligonucleotide; CTT chr11 5215553 5215574 5215570 5215575 +
tctttttattttaattggtcac

SEQ ID NO: 82366 - DNA, 22 bp, Artificial Sequence
  Synthetic oligonucleotide; TTT chr11 5215554 5215575 5215571 5215576 +
ctttttattttaattggtcact

SEQ ID NO: 82367 - DNA, 22 bp, Artificial Sequence
  Synthetic oligonucleotide; TTC chr11 5215555 5215576 5215572 5215577 +
tttttattttaattggtcactt

SEQ ID NO: 82368 - DNA, 22 bp, Artificial Sequence
  Synthetic oligonucleotide; CTT chr11 5215557 5215578 5215574 5215579 +
tttattttaattggtcactttg

SEQ ID NO: 82369 - DNA, 22 bp, Artificial Sequence
  Synthetic oligonucleotide; TTT chr11 5215558 5215579 5215575 5215580 +
ttattttaattggtcactttgt

SEQ ID NO: 82370 - DNA, 22 bp, Artificial Sequence
  Synthetic oligonucleotide; TTT chr11 5215559 5215580 5215576 5215581 +
tattttaattggtcactttgtt

SEQ ID NO: 82371 - DNA, 22 bp, Artificial Sequence
  Synthetic oligonucleotide; TTT chr11 5215560 5215581 5215577 5215582 +
attttaattggtcactttgttt

SEQ ID NO: 82372 - DNA, 22 bp, Artificial Sequence
  Synthetic oligonucleotide; TTA chr11 5215561 5215582 5215578 5215583 +
ttttaattggtcactttgtttt

SEQ ID NO: 82373 - DNA, 22 bp, Artificial Sequence
  Synthetic oligonucleotide; TTT chr11 5215564 5215585 5215581 5215586 +
taattggtcactttgttttcag

SEQ ID NO: 82374 - DNA, 22 bp, Artificial Sequence
  Synthetic oligonucleotide; TTT chr11 5215565 5215586 5215582 5215587 +
aattggtcactttgttttcaga

SEQ ID NO: 82375 - DNA, 22 bp, Artificial Sequence
  Synthetic oligonucleotide; TTA chr11 5215566 5215587 5215583 5215588 +
attggtcactttgttttcagac

SEQ ID NO: 82376 - DNA, 22 bp, Artificial Sequence
  Synthetic oligonucleotide; TTG chr11 5215570 5215591 5215587 5215592 +
gtcactttgttttcagacctct

SEQ ID NO: 82377 - DNA, 22 bp, Artificial Sequence
  Synthetic oligonucleotide; CTT chr11 5215577 5215598 5215594 5215599 +
tgttttcagacctcttgttatc

SEQ ID NO: 82378 - DNA, 22 bp, Artificial Sequence
  Synthetic oligonucleotide; TTT chr11 5215578 5215599 5215595 5215600 +
gttttcagacctcttgttatct

SEQ ID NO: 82379 - DNA, 22 bp, Artificial Sequence
  Synthetic oligonucleotide; TTG chr11 5215579 5215600 5215596 5215601 +
ttttcagacctcttgttatctt

SEQ ID NO: 82380 - DNA, 22 bp, Artificial Sequence
  Synthetic oligonucleotide; TTT chr11 5215582 5215603 5215599 5215604 +
tcagacctcttgttatctttaa

SEQ ID NO: 82381 - DNA, 22 bp, Artificial Sequence
  Synthetic oligonucleotide; TTT chr11 5215583 5215604 5215600 5215605 +
cagacctcttgttatctttaat

SEQ ID NO: 82382 - DNA, 22 bp, Artificial Sequence
  Synthetic oligonucleotide; TTC chr11 5215584 5215605 5215601 5215606 +
agacctcttgttatctttaatc

SEQ ID NO: 82383 - DNA, 22 bp, Artificial Sequence
  Synthetic oligonucleotide; CTC chr11 5215591 5215612 5215608 5215613 +
ttgttatctttaatcatttttc

SEQ ID NO: 82384 - DNA, 22 bp, Artificial Sequence
  Synthetic oligonucleotide; CTT chr11 5215593 5215614 5215610 5215615 +
gttatctttaatcatttttcac

SEQ ID NO: 82385 - DNA, 22 bp, Artificial Sequence
  Synthetic oligonucleotide; TTG chr11 5215594 5215615 5215611 5215616 +
ttatctttaatcatttttcacc

SEQ ID NO: 82386 - DNA, 22 bp, Artificial Sequence
  Synthetic oligonucleotide; TTA chr11 5215597 5215618 5215614 5215619 +
tctttaatcatttttcacctct

SEQ ID NO: 82387 - DNA, 22 bp, Artificial Sequence
  Synthetic oligonucleotide; CTT chr11 5215601 5215622 5215618 5215623 +
taatcatttttcacctctgact

SEQ ID NO: 82388 - DNA, 22 bp, Artificial Sequence
  Synthetic oligonucleotide; TTT chr11 5215602 5215623 5215619 5215624 +
aatcatttttcacctctgactt

SEQ ID NO: 82389 - DNA, 22 bp, Artificial Sequence
  Synthetic oligonucleotide; TTA chr11 5215603 5215624 5215620 5215625 +
atcatttttcacctctgacttg

SEQ ID NO: 82390 - DNA, 22 bp, Artificial Sequence
  Synthetic oligonucleotide; TTT chr11 5215610 5215631 5215627 5215632 +
ttcacctctgacttgacctccc

SEQ ID NO: 82391 - DNA, 22 bp, Artificial Sequence
  Synthetic oligonucleotide; TTT chr11 5215611 5215632 5215628 5215633 +
tcacctctgacttgacctccca

SEQ ID NO: 82392 - DNA, 22 bp, Artificial Sequence
  Synthetic oligonucleotide; TTT chr11 5215612 5215633 5215629 5215634 +
cacctctgacttgacctcccag

SEQ ID NO: 82393 - DNA, 22 bp, Artificial Sequence
  Synthetic oligonucleotide; TTC chr11 5215613 5215634 5215630 5215635 +
acctctgacttgacctcccagt

SEQ ID NO: 82394 - DNA, 22 bp, Artificial Sequence
  Synthetic oligonucleotide; CTC chr11 5215618 5215639 5215635 5215640 +
tgacttgacctcccagttgtca

SEQ ID NO: 82395 - DNA, 22 bp, Artificial Sequence
  Synthetic oligonucleotide; CTG chr11 5215620 5215641 5215637 5215642 +
acttgacctcccagttgtcaaa

SEQ ID NO: 82396 - DNA, 22 bp, Artificial Sequence
  Synthetic oligonucleotide; CTT chr11 5215624 5215645 5215641 5215646 +
gacctcccagttgtcaaatatt

SEQ ID NO: 82397 - DNA, 22 bp, Artificial Sequence
  Synthetic oligonucleotide; TTG chr11 5215625 5215646 5215642 5215647 +
acctcccagttgtcaaatattt

SEQ ID NO: 82398 - DNA, 22 bp, Artificial Sequence
  Synthetic oligonucleotide; CTC chr11 5215630 5215651 5215647 5215652 +
ccagttgtcaaatatttgactt

SEQ ID NO: 82399 - DNA, 22 bp, Artificial Sequence
  Synthetic oligonucleotide; TTG chr11 5215637 5215658 5215654 5215659 +
tcaaatatttgacttaatggga

SEQ ID NO: 82400 - DNA, 22 bp, Artificial Sequence
  Synthetic oligonucleotide; TTT chr11 5215647 5215668 5215664 5215669 +
gacttaatgggagactttcccc

SEQ ID NO: 82401 - DNA, 22 bp, Artificial Sequence
  Synthetic oligonucleotide; TTG chr11 5215648 5215669 5215665 5215670 +
acttaatgggagactttcccct

SEQ ID NO: 82402 - DNA, 22 bp, Artificial Sequence
  Synthetic oligonucleotide; CTT chr11 5215652 5215673 5215669 5215674 +
aatgggagactttcccctagct

SEQ ID NO: 82403 - DNA, 22 bp, Artificial Sequence
  Synthetic oligonucleotide; TTA chr11 5215653 5215674 5215670 5215675 +
atgggagactttcccctagctt

SEQ ID NO: 82404 - DNA, 22 bp, Artificial Sequence
  Synthetic oligonucleotide; CTT chr11 5215664 5215685 5215681 5215686 +
tcccctagcttgttgattccag

SEQ ID NO: 82405 - DNA, 22 bp, Artificial Sequence
  Synthetic oligonucleotide; TTT chr11 5215665 5215686 5215682 5215687 +
cccctagcttgttgattccaga

SEQ ID NO: 82406 - DNA, 22 bp, Artificial Sequence
  Synthetic oligonucleotide; TTC chr11 5215666 5215687 5215683 5215688 +
ccctagcttgttgattccagaa

SEQ ID NO: 82407 - DNA, 22 bp, Artificial Sequence
  Synthetic oligonucleotide; CTA chr11 5215671 5215692 5215688 5215693 +
gcttgttgattccagaaattca

SEQ ID NO: 82408 - DNA, 22 bp, Artificial Sequence
  Synthetic oligonucleotide; CTT chr11 5215675 5215696 5215692 5215697 +
gttgattccagaaattcaactt

SEQ ID NO: 82409 - DNA, 22 bp, Artificial Sequence
  Synthetic oligonucleotide; TTG chr11 5215676 5215697 5215693 5215698 +
ttgattccagaaattcaacttt

SEQ ID NO: 82410 - DNA, 22 bp, Artificial Sequence
  Synthetic oligonucleotide; TTG chr11 5215679 5215700 5215696 5215701 +
attccagaaattcaactttatt

SEQ ID NO: 82411 - DNA, 22 bp, Artificial Sequence
  Synthetic oligonucleotide; TTC chr11 5215683 5215704 5215700 5215705 +
cagaaattcaactttattctag

SEQ ID NO: 82412 - DNA, 22 bp, Artificial Sequence
  Synthetic oligonucleotide; TTC chr11 5215692 5215713 5215709 5215714 +
aactttattctaggcttggctc

SEQ ID NO: 82413 - DNA, 22 bp, Artificial Sequence
  Synthetic oligonucleotide; CTT chr11 5215697 5215718 5215714 5215719 +
tattctaggcttggctcctgtt

SEQ ID NO: 82414 - DNA, 22 bp, Artificial Sequence
  Synthetic oligonucleotide; TTT chr11 5215698 5215719 5215715 5215720 +
attctaggcttggctcctgttt

SEQ ID NO: 82415 - DNA, 22 bp, Artificial Sequence
  Synthetic oligonucleotide; TTA chr11 5215699 5215720 5215716 5215721 +
ttctaggcttggctcctgttta

SEQ ID NO: 82416 - DNA, 22 bp, Artificial Sequence
  Synthetic oligonucleotide; TTC chr11 5215702 5215723 5215719 5215724 +
taggcttggctcctgtttagta

SEQ ID NO: 82417 - DNA, 22 bp, Artificial Sequence
  Synthetic oligonucleotide; CTA chr11 5215704 5215725 5215721 5215726 +
ggcttggctcctgtttagtatt

SEQ ID NO: 82418 - DNA, 22 bp, Artificial Sequence
  Synthetic oligonucleotide; CTT chr11 5215709 5215730 5215726 5215731 +
ggctcctgtttagtattgctgc

SEQ ID NO: 82419 - DNA, 22 bp, Artificial Sequence
  Synthetic oligonucleotide; TTG chr11 5215710 5215731 5215727 5215732 +
gctcctgtttagtattgctgct

SEQ ID NO: 82420 - DNA, 22 bp, Artificial Sequence
  Synthetic oligonucleotide; CTC chr11 5215714 5215735 5215731 5215736 +
ctgtttagtattgctgctttga

SEQ ID NO: 82421 - DNA, 22 bp, Artificial Sequence
  Synthetic oligonucleotide; CTG chr11 5215717 5215738 5215734 5215739 +
tttagtattgctgctttgagat

SEQ ID NO: 82422 - DNA, 22 bp, Artificial Sequence
  Synthetic oligonucleotide; TTT chr11 5215720 5215741 5215737 5215742 +
agtattgctgctttgagattgt

SEQ ID NO: 82423 - DNA, 22 bp, Artificial Sequence
  Synthetic oligonucleotide; TTA chr11 5215721 5215742 5215738 5215743 +
gtattgctgctttgagattgtt

SEQ ID NO: 82424 - DNA, 22 bp, Artificial Sequence
  Synthetic oligonucleotide; TTG chr11 5215727 5215748 5215744 5215749 +
ctgctttgagattgttctggtt

SEQ ID NO: 82425 - DNA, 22 bp, Artificial Sequence
  Synthetic oligonucleotide; CTG chr11 5215730 5215751 5215747 5215752 +
ctttgagattgttctggttcat

SEQ ID NO: 82426 - DNA, 22 bp, Artificial Sequence
  Synthetic oligonucleotide; CTT chr11 5215733 5215754 5215750 5215755 +
tgagattgttctggttcatgaa

SEQ ID NO: 82427 - DNA, 22 bp, Artificial Sequence
  Synthetic oligonucleotide; TTT chr11 5215734 5215755 5215751 5215756 +
gagattgttctggttcatgaaa

SEQ ID NO: 82428 - DNA, 22 bp, Artificial Sequence
  Synthetic oligonucleotide; TTG chr11 5215735 5215756 5215752 5215757 +
agattgttctggttcatgaaaa

SEQ ID NO: 82429 - DNA, 22 bp, Artificial Sequence
  Synthetic oligonucleotide; TTG chr11 5215741 5215762 5215758 5215763 +
ttctggttcatgaaaaacaagt

SEQ ID NO: 82430 - DNA, 22 bp, Artificial Sequence
  Synthetic oligonucleotide; TTC chr11 5215744 5215765 5215761 5215766 +
tggttcatgaaaaacaagtctc

SEQ ID NO: 82431 - DNA, 22 bp, Artificial Sequence
  Synthetic oligonucleotide; CTG chr11 5215746 5215767 5215763 5215768 +
gttcatgaaaaacaagtctcca

SEQ ID NO: 82432 - DNA, 22 bp, Artificial Sequence
  Synthetic oligonucleotide; TTC chr11 5215750 5215771 5215767 5215772 +
atgaaaaacaagtctccaaaat

SEQ ID NO: 82433 - DNA, 22 bp, Artificial Sequence
  Synthetic oligonucleotide; CTC chr11 5215766 5215787 5215783 5215788 +
caaaattttctacttctcaata

SEQ ID NO: 82434 - DNA, 22 bp, Artificial Sequence
  Synthetic oligonucleotide; TTT chr11 5215774 5215795 5215791 5215796 +
tctacttctcaatattgccatt

SEQ ID NO: 82435 - DNA, 22 bp, Artificial Sequence
  Synthetic oligonucleotide; TTT chr11 5215775 5215796 5215792 5215797 +
ctacttctcaatattgccattt

SEQ ID NO: 82436 - DNA, 22 bp, Artificial Sequence
  Synthetic oligonucleotide; TTC chr11 5215776 5215797 5215793 5215798 +
tacttctcaatattgccattta

SEQ ID NO: 82437 - DNA, 22 bp, Artificial Sequence
  Synthetic oligonucleotide; CTA chr11 5215778 5215799 5215795 5215800 +
cttctcaatattgccatttact

SEQ ID NO: 82438 - DNA, 22 bp, Artificial Sequence
  Synthetic oligonucleotide; CTT chr11 5215781 5215802 5215798 5215803 +
ctcaatattgccatttactaaa

SEQ ID NO: 82439 - DNA, 22 bp, Artificial Sequence
  Synthetic oligonucleotide; TTC chr11 5215782 5215803 5215799 5215804 +
tcaatattgccatttactaaat

SEQ ID NO: 82440 - DNA, 22 bp, Artificial Sequence
  Synthetic oligonucleotide; CTC chr11 5215784 5215805 5215801 5215806 +
aatattgccatttactaaattc

SEQ ID NO: 82441 - DNA, 22 bp, Artificial Sequence
  Synthetic oligonucleotide; TTG chr11 5215791 5215812 5215808 5215813 +
ccatttactaaattcttataaa

SEQ ID NO: 82442 - DNA, 22 bp, Artificial Sequence
  Synthetic oligonucleotide; TTT chr11 5215797 5215818 5215814 5215819 +
actaaattcttataaacaaata

SEQ ID NO: 82443 - DNA, 22 bp, Artificial Sequence
  Synthetic oligonucleotide; TTA chr11 5215798 5215819 5215815 5215820 +
ctaaattcttataaacaaataa

SEQ ID NO: 82444 - DNA, 22 bp, Artificial Sequence
  Synthetic oligonucleotide; CTA chr11 5215801 5215822 5215818 5215823 +
aattcttataaacaaataagaa

SEQ ID NO: 82445 - DNA, 22 bp, Artificial Sequence
  Synthetic oligonucleotide; TTC chr11 5215806 5215827 5215823 5215828 +
ttataaacaaataagaaggaag

SEQ ID NO: 82446 - DNA, 22 bp, Artificial Sequence
  Synthetic oligonucleotide; CTT chr11 5215808 5215829 5215825 5215830 +
ataaacaaataagaaggaagac

SEQ ID NO: 82447 - DNA, 22 bp, Artificial Sequence
  Synthetic oligonucleotide; TTA chr11 5215809 5215830 5215826 5215831 +
taaacaaataagaaggaagact

SEQ ID NO: 82448 - DNA, 22 bp, Artificial Sequence
  Synthetic oligonucleotide; CTC chr11 5215832 5215853 5215849 5215854 +
tcagaaatatatggagagactg

SEQ ID NO: 82449 - DNA, 22 bp, Artificial Sequence
  Synthetic oligonucleotide; CTC chr11 5215834 5215855 5215851 5215856 +
agaaatatatggagagactgag

SEQ ID NO: 82450 - DNA, 22 bp, Artificial Sequence
  Synthetic oligonucleotide; CTG chr11 5215854 5215875 5215871 5215876 +
aggttagagttgagcaaggcct

SEQ ID NO: 82451 - DNA, 22 bp, Artificial Sequence
  Synthetic oligonucleotide; TTA chr11 5215860 5215881 5215877 5215882 +
gagttgagcaaggcctgaaatt

SEQ ID NO: 82452 - DNA, 22 bp, Artificial Sequence
  Synthetic oligonucleotide; TTG chr11 5215866 5215887 5215883 5215888 +
agcaaggcctgaaattttgtca

SEQ ID NO: 82453 - DNA, 22 bp, Artificial Sequence
  Synthetic oligonucleotide; CTG chr11 5215877 5215898 5215894 5215899 +
aaattttgtcacaactaatcta

SEQ ID NO: 82454 - DNA, 22 bp, Artificial Sequence
  Synthetic oligonucleotide; TTT chr11 5215883 5215904 5215900 5215905 +
tgtcacaactaatctagttgaa

SEQ ID NO: 82455 - DNA, 22 bp, Artificial Sequence
  Synthetic oligonucleotide; TTT chr11 5215884 5215905 5215901 5215906 +
gtcacaactaatctagttgaag

SEQ ID NO: 82456 - DNA, 22 bp, Artificial Sequence
  Synthetic oligonucleotide; TTG chr11 5215885 5215906 5215902 5215907 +
tcacaactaatctagttgaagg

SEQ ID NO: 82457 - DNA, 22 bp, Artificial Sequence
  Synthetic oligonucleotide; CTA chr11 5215894 5215915 5215911 5215916 +
atctagttgaaggaatgttaac

SEQ ID NO: 82458 - DNA, 22 bp, Artificial Sequence
  Synthetic oligonucleotide; CTA chr11 5215899 5215920 5215916 5215921 +
gttgaaggaatgttaactgact

SEQ ID NO: 82459 - DNA, 22 bp, Artificial Sequence
  Synthetic oligonucleotide; TTG chr11 5215903 5215924 5215920 5215925 +
aaggaatgttaactgactgaga

SEQ ID NO: 82460 - DNA, 22 bp, Artificial Sequence
  Synthetic oligonucleotide; TTA chr11 5215914 5215935 5215931 5215936 +
actgactgagaaaacactaaat

SEQ ID NO: 82461 - DNA, 22 bp, Artificial Sequence
  Synthetic oligonucleotide; CTG chr11 5215918 5215939 5215935 5215940 +
actgagaaaacactaaatttct

SEQ ID NO: 82462 - DNA, 22 bp, Artificial Sequence
  Synthetic oligonucleotide; CTG chr11 5215922 5215943 5215939 5215944 +
agaaaacactaaatttctgtct

SEQ ID NO: 82463 - DNA, 22 bp, Artificial Sequence
  Synthetic oligonucleotide; CTA chr11 5215933 5215954 5215950 5215955 +
aatttctgtctatttcaaagag

SEQ ID NO: 82464 - DNA, 22 bp, Artificial Sequence
  Synthetic oligonucleotide; TTT chr11 5215938 5215959 5215955 5215960 +
ctgtctatttcaaagagaaaga

SEQ ID NO: 82465 - DNA, 22 bp, Artificial Sequence
  Synthetic oligonucleotide; TTC chr11 5215939 5215960 5215956 5215961 +
tgtctatttcaaagagaaagac

SEQ ID NO: 82466 - DNA, 22 bp, Artificial Sequence
  Synthetic oligonucleotide; CTG chr11 5215941 5215962 5215958 5215963 +
tctatttcaaagagaaagactt

SEQ ID NO: 82467 - DNA, 22 bp, Artificial Sequence
  Synthetic oligonucleotide; CTA chr11 5215945 5215966 5215962 5215967 +
tttcaaagagaaagacttgata

SEQ ID NO: 82468 - DNA, 22 bp, Artificial Sequence
  Synthetic oligonucleotide; TTT chr11 5215948 5215969 5215965 5215970 +
caaagagaaagacttgataatg

SEQ ID NO: 82469 - DNA, 22 bp, Artificial Sequence
  Synthetic oligonucleotide; TTC chr11 5215949 5215970 5215966 5215971 +
aaagagaaagacttgataatgg

SEQ ID NO: 82470 - DNA, 22 bp, Artificial Sequence
  Synthetic oligonucleotide; CTT chr11 5215963 5215984 5215980 5215985 +
gataatggctctacggatgtgt

SEQ ID NO: 82471 - DNA, 22 bp, Artificial Sequence
  Synthetic oligonucleotide; TTG chr11 5215964 5215985 5215981 5215986 +
ataatggctctacggatgtgtg

SEQ ID NO: 82472 - DNA, 22 bp, Artificial Sequence
  Synthetic oligonucleotide; CTC chr11 5215974 5215995 5215991 5215996 +
tacggatgtgtgagatcagttt

SEQ ID NO: 82473 - DNA, 22 bp, Artificial Sequence
  Synthetic oligonucleotide; CTA chr11 5215976 5215997 5215993 5215998 +
cggatgtgtgagatcagtttta

SEQ ID NO: 82474 - DNA, 22 bp, Artificial Sequence
  Synthetic oligonucleotide; TTT chr11 5215996 5216017 5216013 5216018 +
taataggataacttttttttat

SEQ ID NO: 82475 - DNA, 22 bp, Artificial Sequence
  Synthetic oligonucleotide; TTT chr11 5215997 5216018 5216014 5216019 +
aataggataacttttttttatt

SEQ ID NO: 82476 - DNA, 22 bp, Artificial Sequence
  Synthetic oligonucleotide; TTA chr11 5215998 5216019 5216015 5216020 +
ataggataacttttttttatta

SEQ ID NO: 82477 - DNA, 22 bp, Artificial Sequence
  Synthetic oligonucleotide; CTT chr11 5216010 5216031 5216027 5216032 +
ttttttattattatacttcaag

SEQ ID NO: 82478 - DNA, 22 bp, Artificial Sequence
  Synthetic oligonucleotide; TTT chr11 5216011 5216032 5216028 5216033 +
tttttattattatacttcaagt

SEQ ID NO: 82479 - DNA, 22 bp, Artificial Sequence
  Synthetic oligonucleotide; TTT chr11 5216012 5216033 5216029 5216034 +
ttttattattatacttcaagtt

SEQ ID NO: 82480 - DNA, 22 bp, Artificial Sequence
  Synthetic oligonucleotide; TTT chr11 5216013 5216034 5216030 5216035 +
tttattattatacttcaagttt

SEQ ID NO: 82481 - DNA, 22 bp, Artificial Sequence
  Synthetic oligonucleotide; TTT chr11 5216014 5216035 5216031 5216036 +
ttattattatacttcaagtttt

SEQ ID NO: 82482 - DNA, 22 bp, Artificial Sequence
  Synthetic oligonucleotide; TTT chr11 5216015 5216036 5216032 5216037 +
tattattatacttcaagtttta

SEQ ID NO: 82483 - DNA, 22 bp, Artificial Sequence
  Synthetic oligonucleotide; TTT chr11 5216016 5216037 5216033 5216038 +
attattatacttcaagttttag

SEQ ID NO: 82484 - DNA, 22 bp, Artificial Sequence
  Synthetic oligonucleotide; TTA chr11 5216017 5216038 5216034 5216039 +
ttattatacttcaagttttagg

SEQ ID NO: 82485 - DNA, 22 bp, Artificial Sequence
  Synthetic oligonucleotide; TTA chr11 5216020 5216041 5216037 5216042 +
ttatacttcaagttttagggta

SEQ ID NO: 82486 - DNA, 22 bp, Artificial Sequence
  Synthetic oligonucleotide; TTA chr11 5216023 5216044 5216040 5216045 +
tacttcaagttttagggtacat

SEQ ID NO: 82487 - DNA, 22 bp, Artificial Sequence
  Synthetic oligonucleotide; CTT chr11 5216028 5216049 5216045 5216050 +
caagttttagggtacatgtgca

SEQ ID NO: 82488 - DNA, 22 bp, Artificial Sequence
  Synthetic oligonucleotide; TTC chr11 5216029 5216050 5216046 5216051 +
aagttttagggtacatgtgcac

SEQ ID NO: 82489 - DNA, 22 bp, Artificial Sequence
  Synthetic oligonucleotide; TTT chr11 5216035 5216056 5216052 5216057 +
tagggtacatgtgcacaacatg

SEQ ID NO: 82490 - DNA, 22 bp, Artificial Sequence
  Synthetic oligonucleotide; TTT chr11 5216036 5216057 5216053 5216058 +
agggtacatgtgcacaacatgc

SEQ ID NO: 82491 - DNA, 22 bp, Artificial Sequence
  Synthetic oligonucleotide; TTA chr11 5216037 5216058 5216054 5216059 +
gggtacatgtgcacaacatgca

SEQ ID NO: 82492 - DNA, 22 bp, Artificial Sequence
  Synthetic oligonucleotide; TTT chr11 5216064 5216085 5216081 5216086 +
gttatatatgtatacatgtgcc

SEQ ID NO: 82493 - DNA, 22 bp, Artificial Sequence
  Synthetic oligonucleotide; TTG chr11 5216065 5216086 5216082 5216087 +
ttatatatgtatacatgtgcca

SEQ ID NO: 82494 - DNA, 22 bp, Artificial Sequence
  Synthetic oligonucleotide; TTA chr11 5216068 5216089 5216085 5216090 +
tatatgtatacatgtgccatgt

SEQ ID NO: 82495 - DNA, 22 bp, Artificial Sequence
  Synthetic oligonucleotide; TTG chr11 5216092 5216113 5216109 5216114 +
gtgtgctgcacccattaactcg

SEQ ID NO: 82496 - DNA, 22 bp, Artificial Sequence
  Synthetic oligonucleotide; CTG chr11 5216100 5216121 5216117 5216122 +
cacccattaactcgtcatttag

SEQ ID NO: 82497 - DNA, 22 bp, Artificial Sequence
  Synthetic oligonucleotide; TTA chr11 5216109 5216130 5216126 5216131 +
actcgtcatttagcattaggta

SEQ ID NO: 82498 - DNA, 22 bp, Artificial Sequence
  Synthetic oligonucleotide; CTC chr11 5216113 5216134 5216130 5216135 +
gtcatttagcattaggtatatc

SEQ ID NO: 82499 - DNA, 22 bp, Artificial Sequence
  Synthetic oligonucleotide; TTT chr11 5216120 5216141 5216137 5216142 +
agcattaggtatatctcctagt

SEQ ID NO: 82500 - DNA, 22 bp, Artificial Sequence
  Synthetic oligonucleotide; TTA chr11 5216121 5216142 5216138 5216143 +
gcattaggtatatctcctagtg

SEQ ID NO: 82501 - DNA, 22 bp, Artificial Sequence
  Synthetic oligonucleotide; TTA chr11 5216127 5216148 5216144 5216149 +
ggtatatctcctagtgctatcc

SEQ ID NO: 82502 - DNA, 22 bp, Artificial Sequence
  Synthetic oligonucleotide; CTC chr11 5216137 5216158 5216154 5216159 +
ctagtgctatccctgcccctgc

SEQ ID NO: 82503 - DNA, 22 bp, Artificial Sequence
  Synthetic oligonucleotide; CTA chr11 5216140 5216161 5216157 5216162 +
gtgctatccctgcccctgcccc

SEQ ID NO: 82504 - DNA, 22 bp, Artificial Sequence
  Synthetic oligonucleotide; CTA chr11 5216146 5216167 5216163 5216168 +
tccctgcccctgccccccaccc

SEQ ID NO: 82505 - DNA, 22 bp, Artificial Sequence
  Synthetic oligonucleotide; CTG chr11 5216152 5216173 5216169 5216174 +
cccctgccccccaccccataac

SEQ ID NO: 82506 - DNA, 22 bp, Artificial Sequence
  Synthetic oligonucleotide; CTG chr11 5216158 5216179 5216175 5216180 +
ccccccaccccataacagtccc

SEQ ID NO: 82507 - DNA, 22 bp, Artificial Sequence
  Synthetic oligonucleotide; TTC chr11 5216195 5216216 5216212 5216217 +
ctcttcatgtgtccatgtgttc

SEQ ID NO: 82508 - DNA, 22 bp, Artificial Sequence
  Synthetic oligonucleotide; CTC chr11 5216198 5216219 5216215 5216220 +
ttcatgtgtccatgtgttctca

SEQ ID NO: 82509 - DNA, 22 bp, Artificial Sequence
  Synthetic oligonucleotide; CTT chr11 5216200 5216221 5216217 5216222 +
catgtgtccatgtgttctcatt

SEQ ID NO: 82510 - DNA, 22 bp, Artificial Sequence
  Synthetic oligonucleotide; TTC chr11 5216201 5216222 5216218 5216223 +
atgtgtccatgtgttctcattg

SEQ ID NO: 82511 - DNA, 22 bp, Artificial Sequence
  Synthetic oligonucleotide; TTC chr11 5216217 5216238 5216234 5216239 +
tcattgttcaattcccacctat

SEQ ID NO: 82512 - DNA, 22 bp, Artificial Sequence
  Synthetic oligonucleotide; CTC chr11 5216219 5216240 5216236 5216241 +
attgttcaattcccacctatga

SEQ ID NO: 82513 - DNA, 22 bp, Artificial Sequence
  Synthetic oligonucleotide; TTG chr11 5216223 5216244 5216240 5216245 +
ttcaattcccacctatgagtga

SEQ ID NO: 82514 - DNA, 22 bp, Artificial Sequence
  Synthetic oligonucleotide; TTC chr11 5216226 5216247 5216243 5216248 +
aattcccacctatgagtgagaa

SEQ ID NO: 82515 - DNA, 22 bp, Artificial Sequence
  Synthetic oligonucleotide; TTC chr11 5216231 5216252 5216248 5216253 +
ccacctatgagtgagaacatgc

SEQ ID NO: 82516 - DNA, 22 bp, Artificial Sequence
  Synthetic oligonucleotide; CTA chr11 5216238 5216259 5216255 5216260 +
tgagtgagaacatgcggtgttt

SEQ ID NO: 82517 - DNA, 22 bp, Artificial Sequence
  Synthetic oligonucleotide; TTT chr11 5216260 5216281 5216277 5216282 +
ggtttattctccttgtgatagt

SEQ ID NO: 82518 - DNA, 22 bp, Artificial Sequence
  Synthetic oligonucleotide; TTG chr11 5216261 5216282 5216278 5216283 +
gtttattctccttgtgatagtt

SEQ ID NO: 82519 - DNA, 22 bp, Artificial Sequence
  Synthetic oligonucleotide; TTT chr11 5216265 5216286 5216282 5216287 +
attctccttgtgatagtttgct

SEQ ID NO: 82520 - DNA, 22 bp, Artificial Sequence
  Synthetic oligonucleotide; TTA chr11 5216266 5216287 5216283 5216288 +
ttctccttgtgatagtttgctg

SEQ ID NO: 82521 - DNA, 22 bp, Artificial Sequence
  Synthetic oligonucleotide; TTC chr11 5216269 5216290 5216286 5216291 +
tccttgtgatagtttgctgaga

SEQ ID NO: 82522 - DNA, 22 bp, Artificial Sequence
  Synthetic oligonucleotide; CTC chr11 5216271 5216292 5216288 5216293 +
cttgtgatagtttgctgagaat

SEQ ID NO: 82523 - DNA, 22 bp, Artificial Sequence
  Synthetic oligonucleotide; CTT chr11 5216274 5216295 5216291 5216296 +
gtgatagtttgctgagaatgat

SEQ ID NO: 82524 - DNA, 22 bp, Artificial Sequence
  Synthetic oligonucleotide; TTG chr11 5216275 5216296 5216292 5216297 +
tgatagtttgctgagaatgata

SEQ ID NO: 82525 - DNA, 22 bp, Artificial Sequence
  Synthetic oligonucleotide; TTT chr11 5216284 5216305 5216301 5216306 +
gctgagaatgatagtttccagc

SEQ ID NO: 82526 - DNA, 22 bp, Artificial Sequence
  Synthetic oligonucleotide; TTG chr11 5216285 5216306 5216302 5216307 +
ctgagaatgatagtttccagct

SEQ ID NO: 82527 - DNA, 22 bp, Artificial Sequence
  Synthetic oligonucleotide; CTG chr11 5216288 5216309 5216305 5216310 +
agaatgatagtttccagcttca

SEQ ID NO: 82528 - DNA, 22 bp, Artificial Sequence
  Synthetic oligonucleotide; TTT chr11 5216301 5216322 5216318 5216323 +
ccagcttcatccatgtccctac

SEQ ID NO: 82529 - DNA, 22 bp, Artificial Sequence
  Synthetic oligonucleotide; TTC chr11 5216302 5216323 5216319 5216324 +
cagcttcatccatgtccctaca

SEQ ID NO: 82530 - DNA, 22 bp, Artificial Sequence
  Synthetic oligonucleotide; CTT chr11 5216308 5216329 5216325 5216330 +
catccatgtccctacaaaggac

SEQ ID NO: 82531 - DNA, 22 bp, Artificial Sequence
  Synthetic oligonucleotide; TTC chr11 5216309 5216330 5216326 5216331 +
atccatgtccctacaaaggaca

SEQ ID NO: 82532 - DNA, 22 bp, Artificial Sequence
  Synthetic oligonucleotide; CTA chr11 5216322 5216343 5216339 5216344 +
caaaggacatgaactcatcatt

SEQ ID NO: 82533 - DNA, 22 bp, Artificial Sequence
  Synthetic oligonucleotide; CTC chr11 5216338 5216359 5216355 5216360 +
atcattttttatggctgcatag

SEQ ID NO: 82534 - DNA, 22 bp, Artificial Sequence
  Synthetic oligonucleotide; TTT chr11 5216345 5216366 5216362 5216367 +
tttatggctgcatagtattcca

SEQ ID NO: 82535 - DNA, 22 bp, Artificial Sequence
  Synthetic oligonucleotide; TTT chr11 5216346 5216367 5216363 5216368 +
ttatggctgcatagtattccat

SEQ ID NO: 82536 - DNA, 22 bp, Artificial Sequence
  Synthetic oligonucleotide; TTT chr11 5216347 5216368 5216364 5216369 +
tatggctgcatagtattccatg

SEQ ID NO: 82537 - DNA, 22 bp, Artificial Sequence
  Synthetic oligonucleotide; TTT chr11 5216348 5216369 5216365 5216370 +
atggctgcatagtattccatgg

SEQ ID NO: 82538 - DNA, 22 bp, Artificial Sequence
  Synthetic oligonucleotide; TTA chr11 5216349 5216370 5216366 5216371 +
tggctgcatagtattccatggt

SEQ ID NO: 82539 - DNA, 22 bp, Artificial Sequence
  Synthetic oligonucleotide; CTG chr11 5216355 5216376 5216372 5216377 +
catagtattccatggtgtatat

SEQ ID NO: 82540 - DNA, 22 bp, Artificial Sequence
  Synthetic oligonucleotide; TTC chr11 5216365 5216386 5216382 5216387 +
catggtgtatatgtgccacatt

SEQ ID NO: 82541 - DNA, 22 bp, Artificial Sequence
  Synthetic oligonucleotide; TTT chr11 5216388 5216409 5216405 5216410 +
tcttaatccagtctatcgttgt

SEQ ID NO: 82542 - DNA, 22 bp, Artificial Sequence
  Synthetic oligonucleotide; TTT chr11 5216389 5216410 5216406 5216411 +
cttaatccagtctatcgttgtt

SEQ ID NO: 82543 - DNA, 22 bp, Artificial Sequence
  Synthetic oligonucleotide; TTC chr11 5216390 5216411 5216407 5216412 +
ttaatccagtctatcgttgttg

SEQ ID NO: 82544 - DNA, 22 bp, Artificial Sequence
  Synthetic oligonucleotide; CTT chr11 5216392 5216413 5216409 5216414 +
aatccagtctatcgttgttgga

SEQ ID NO: 82545 - DNA, 22 bp, Artificial Sequence
  Synthetic oligonucleotide; TTA chr11 5216393 5216414 5216410 5216415 +
atccagtctatcgttgttggac

SEQ ID NO: 82546 - DNA, 22 bp, Artificial Sequence
  Synthetic oligonucleotide; CTA chr11 5216403 5216424 5216420 5216425 +
tcgttgttggacatttgggttg

SEQ ID NO: 82547 - DNA, 22 bp, Artificial Sequence
  Synthetic oligonucleotide; TTG chr11 5216409 5216430 5216426 5216431 +
ttggacatttgggttggttcca

SEQ ID NO: 82548 - DNA, 22 bp, Artificial Sequence
  Synthetic oligonucleotide; TTG chr11 5216412 5216433 5216429 5216434 +
gacatttgggttggttccaagt

SEQ ID NO: 82549 - DNA, 22 bp, Artificial Sequence
  Synthetic oligonucleotide; TTT chr11 5216419 5216440 5216436 5216441 +
gggttggttccaagtctttgct

SEQ ID NO: 82550 - DNA, 22 bp, Artificial Sequence
  Synthetic oligonucleotide; TTG chr11 5216420 5216441 5216437 5216442 +
ggttggttccaagtctttgcta

SEQ ID NO: 82551 - DNA, 22 bp, Artificial Sequence
  Synthetic oligonucleotide; TTG chr11 5216425 5216446 5216442 5216447 +
gttccaagtctttgctattgtg

SEQ ID NO: 82552 - DNA, 22 bp, Artificial Sequence
  Synthetic oligonucleotide; TTC chr11 5216429 5216450 5216446 5216451 +
caagtctttgctattgtgaata

SEQ ID NO: 82553 - DNA, 22 bp, Artificial Sequence
  Synthetic oligonucleotide; CTT chr11 5216437 5216458 5216454 5216459 +
tgctattgtgaatagtgctgca

SEQ ID NO: 82554 - DNA, 22 bp, Artificial Sequence
  Synthetic oligonucleotide; TTT chr11 5216438 5216459 5216455 5216460 +
gctattgtgaatagtgctgcaa

SEQ ID NO: 82555 - DNA, 22 bp, Artificial Sequence
  Synthetic oligonucleotide; TTG chr11 5216439 5216460 5216456 5216461 +
ctattgtgaatagtgctgcaat

SEQ ID NO: 82556 - DNA, 22 bp, Artificial Sequence
  Synthetic oligonucleotide; CTA chr11 5216442 5216463 5216459 5216464 +
ttgtgaatagtgctgcaataaa

SEQ ID NO: 82557 - DNA, 22 bp, Artificial Sequence
  Synthetic oligonucleotide; TTG chr11 5216445 5216466 5216462 5216467 +
tgaatagtgctgcaataaacat

SEQ ID NO: 82558 - DNA, 22 bp, Artificial Sequence
  Synthetic oligonucleotide; CTG chr11 5216457 5216478 5216474 5216479 +
caataaacatacgtgtgcatgt

SEQ ID NO: 82559 - DNA, 22 bp, Artificial Sequence
  Synthetic oligonucleotide; CTT chr11 5216484 5216505 5216501 5216506 +
tatagcagcatgatttataatc

SEQ ID NO: 82560 - DNA, 22 bp, Artificial Sequence
  Synthetic oligonucleotide; TTT chr11 5216485 5216506 5216502 5216507 +
atagcagcatgatttataatcc

SEQ ID NO: 82561 - DNA, 22 bp, Artificial Sequence
  Synthetic oligonucleotide; TTA chr11 5216486 5216507 5216503 5216508 +
tagcagcatgatttataatcct

SEQ ID NO: 82562 - DNA, 22 bp, Artificial Sequence
  Synthetic oligonucleotide; TTT chr11 5216500 5216521 5216517 5216522 +
ataatcctttgggtatgtaccc

SEQ ID NO: 82563 - DNA, 22 bp, Artificial Sequence
  Synthetic oligonucleotide; TTA chr11 5216501 5216522 5216518 5216523 +
taatcctttgggtatgtaccca

SEQ ID NO: 82564 - DNA, 22 bp, Artificial Sequence
  Synthetic oligonucleotide; CTT chr11 5216509 5216530 5216526 5216531 +
tgggtatgtacccagtaatggg

SEQ ID NO: 82565 - DNA, 22 bp, Artificial Sequence
  Synthetic oligonucleotide; TTT chr11 5216510 5216531 5216527 5216532 +
gggtatgtacccagtaatggga

SEQ ID NO: 82566 - DNA, 22 bp, Artificial Sequence
  Synthetic oligonucleotide; TTG chr11 5216511 5216532 5216528 5216533 +
ggtatgtacccagtaatgggat

SEQ ID NO: 82567 - DNA, 22 bp, Artificial Sequence
  Synthetic oligonucleotide; CTG chr11 5216538 5216559 5216555 5216560 +
ggtcaaatggtatttctagttc

SEQ ID NO: 82568 - DNA, 22 bp, Artificial Sequence
  Synthetic oligonucleotide; TTT chr11 5216553 5216574 5216570 5216575 +
ctagttctagattcctgaggaa

SEQ ID NO: 82569 - DNA, 22 bp, Artificial Sequence
  Synthetic oligonucleotide; TTC chr11 5216554 5216575 5216571 5216576 +
tagttctagattcctgaggaat

SEQ ID NO: 82570 - DNA, 22 bp, Artificial Sequence
  Synthetic oligonucleotide; CTA chr11 5216556 5216577 5216573 5216578 +
gttctagattcctgaggaattg

SEQ ID NO: 82571 - DNA, 22 bp, Artificial Sequence
  Synthetic oligonucleotide; TTC chr11 5216560 5216581 5216577 5216582 +
tagattcctgaggaattgccac

SEQ ID NO: 82572 - DNA, 22 bp, Artificial Sequence
  Synthetic oligonucleotide; CTA chr11 5216562 5216583 5216579 5216584 +
gattcctgaggaattgccacac

SEQ ID NO: 82573 - DNA, 22 bp, Artificial Sequence
  Synthetic oligonucleotide; TTC chr11 5216567 5216588 5216584 5216589 +
ctgaggaattgccacactgact

SEQ ID NO: 82574 - DNA, 22 bp, Artificial Sequence
  Synthetic oligonucleotide; CTG chr11 5216570 5216591 5216587 5216592 +
aggaattgccacactgacttcc

SEQ ID NO: 82575 - DNA, 22 bp, Artificial Sequence
  Synthetic oligonucleotide; TTG chr11 5216578 5216599 5216595 5216600 +
ccacactgacttccgcaatggt

SEQ ID NO: 82576 - DNA, 22 bp, Artificial Sequence
  Synthetic oligonucleotide; CTG chr11 5216586 5216607 5216603 5216608 +
acttccgcaatggttgaactag

SEQ ID NO: 82577 - DNA, 22 bp, Artificial Sequence
  Synthetic oligonucleotide; CTT chr11 5216590 5216611 5216607 5216612 +
ccgcaatggttgaactagttta

SEQ ID NO: 82578 - DNA, 22 bp, Artificial Sequence
  Synthetic oligonucleotide; TTC chr11 5216591 5216612 5216608 5216613 +
cgcaatggttgaactagtttac

SEQ ID NO: 82579 - DNA, 22 bp, Artificial Sequence
  Synthetic oligonucleotide; TTG chr11 5216602 5216623 5216619 5216624 +
aactagtttacagtcccaccaa

SEQ ID NO: 82580 - DNA, 22 bp, Artificial Sequence
  Synthetic oligonucleotide; CTA chr11 5216607 5216628 5216624 5216629 +
gtttacagtcccaccaacagtg

SEQ ID NO: 82581 - DNA, 22 bp, Artificial Sequence
  Synthetic oligonucleotide; TTT chr11 5216611 5216632 5216628 5216633 +
acagtcccaccaacagtgtaaa

SEQ ID NO: 82582 - DNA, 22 bp, Artificial Sequence
  Synthetic oligonucleotide; TTA chr11 5216612 5216633 5216629 5216634 +
cagtcccaccaacagtgtaaaa

SEQ ID NO: 82583 - DNA, 22 bp, Artificial Sequence
  Synthetic oligonucleotide; TTG chr11 5216638 5216659 5216655 5216660 +
ttcctgtttctccacatcctct

SEQ ID NO: 82584 - DNA, 22 bp, Artificial Sequence
  Synthetic oligonucleotide; TTC chr11 5216641 5216662 5216658 5216663 +
ctgtttctccacatcctctcca

SEQ ID NO: 82585 - DNA, 22 bp, Artificial Sequence
  Synthetic oligonucleotide; CTG chr11 5216644 5216665 5216661 5216666 +
tttctccacatcctctccagca

SEQ ID NO: 82586 - DNA, 22 bp, Artificial Sequence
  Synthetic oligonucleotide; TTT chr11 5216647 5216668 5216664 5216669 +
ctccacatcctctccagcacct

SEQ ID NO: 82587 - DNA, 22 bp, Artificial Sequence
  Synthetic oligonucleotide; TTC chr11 5216648 5216669 5216665 5216670 +
tccacatcctctccagcacctg

SEQ ID NO: 82588 - DNA, 22 bp, Artificial Sequence
  Synthetic oligonucleotide; CTC chr11 5216650 5216671 5216667 5216672 +
cacatcctctccagcacctgtt

SEQ ID NO: 82589 - DNA, 22 bp, Artificial Sequence
  Synthetic oligonucleotide; CTC chr11 5216659 5216680 5216676 5216681 +
tccagcacctgttgtttcctga

SEQ ID NO: 82590 - DNA, 22 bp, Artificial Sequence
  Synthetic oligonucleotide; CTC chr11 5216661 5216682 5216678 5216683 +
cagcacctgttgtttcctgact

SEQ ID NO: 82591 - DNA, 22 bp, Artificial Sequence
  Synthetic oligonucleotide; CTG chr11 5216670 5216691 5216687 5216692 +
ttgtttcctgactttttaatga

SEQ ID NO: 82592 - DNA, 22 bp, Artificial Sequence
  Synthetic oligonucleotide; TTG chr11 5216673 5216694 5216690 5216695 +
tttcctgactttttaatgatcg

SEQ ID NO: 82593 - DNA, 22 bp, Artificial Sequence
  Synthetic oligonucleotide; TTT chr11 5216676 5216697 5216693 5216698 +
cctgactttttaatgatcgcca

SEQ ID NO: 82594 - DNA, 22 bp, Artificial Sequence
  Synthetic oligonucleotide; TTC chr11 5216677 5216698 5216694 5216699 +
ctgactttttaatgatcgccat

SEQ ID NO: 82595 - DNA, 22 bp, Artificial Sequence
  Synthetic oligonucleotide; CTG chr11 5216680 5216701 5216697 5216702 +
actttttaatgatcgccattct

SEQ ID NO: 82596 - DNA, 22 bp, Artificial Sequence
  Synthetic oligonucleotide; CTT chr11 5216684 5216705 5216701 5216706 +
tttaatgatcgccattctaact

SEQ ID NO: 82597 - DNA, 22 bp, Artificial Sequence
  Synthetic oligonucleotide; TTT chr11 5216685 5216706 5216702 5216707 +
ttaatgatcgccattctaactg

SEQ ID NO: 82598 - DNA, 22 bp, Artificial Sequence
  Synthetic oligonucleotide; TTT chr11 5216686 5216707 5216703 5216708 +
taatgatcgccattctaactgg

SEQ ID NO: 82599 - DNA, 22 bp, Artificial Sequence
  Synthetic oligonucleotide; TTT chr11 5216687 5216708 5216704 5216709 +
aatgatcgccattctaactggt

SEQ ID NO: 82600 - DNA, 22 bp, Artificial Sequence
  Synthetic oligonucleotide; TTA chr11 5216688 5216709 5216705 5216710 +
atgatcgccattctaactggtg

SEQ ID NO: 82601 - DNA, 22 bp, Artificial Sequence
  Synthetic oligonucleotide; TTC chr11 5216701 5216722 5216718 5216723 +
taactggtgtgagatggtatct

SEQ ID NO: 82602 - DNA, 22 bp, Artificial Sequence
  Synthetic oligonucleotide; CTA chr11 5216703 5216724 5216720 5216725 +
actggtgtgagatggtatctca

SEQ ID NO: 82603 - DNA, 22 bp, Artificial Sequence
  Synthetic oligonucleotide; CTG chr11 5216707 5216728 5216724 5216729 +
gtgtgagatggtatctcattgt

SEQ ID NO: 82604 - DNA, 22 bp, Artificial Sequence
  Synthetic oligonucleotide; CTC chr11 5216724 5216745 5216741 5216746 +
attgtggttttgatttgcattt

SEQ ID NO: 82605 - DNA, 22 bp, Artificial Sequence
  Synthetic oligonucleotide; TTG chr11 5216728 5216749 5216745 5216750 +
tggttttgatttgcatttctct

SEQ ID NO: 82606 - DNA, 22 bp, Artificial Sequence
  Synthetic oligonucleotide; TTT chr11 5216734 5216755 5216751 5216756 +
tgatttgcatttctctgatggc

SEQ ID NO: 82607 - DNA, 22 bp, Artificial Sequence
  Synthetic oligonucleotide; TTT chr11 5216735 5216756 5216752 5216757 +
gatttgcatttctctgatggct

SEQ ID NO: 82608 - DNA, 22 bp, Artificial Sequence
  Synthetic oligonucleotide; TTG chr11 5216736 5216757 5216753 5216758 +
atttgcatttctctgatggcta

SEQ ID NO: 82609 - DNA, 22 bp, Artificial Sequence
  Synthetic oligonucleotide; TTT chr11 5216740 5216761 5216757 5216762 +
gcatttctctgatggctagtga

SEQ ID NO: 82610 - DNA, 22 bp, Artificial Sequence
  Synthetic oligonucleotide; TTG chr11 5216741 5216762 5216758 5216763 +
catttctctgatggctagtgat

SEQ ID NO: 82611 - DNA, 22 bp, Artificial Sequence
  Synthetic oligonucleotide; TTT chr11 5216746 5216767 5216763 5216768 +
ctctgatggctagtgatgatga

SEQ ID NO: 82612 - DNA, 22 bp, Artificial Sequence
  Synthetic oligonucleotide; TTC chr11 5216747 5216768 5216764 5216769 +
tctgatggctagtgatgatgag

SEQ ID NO: 82613 - DNA, 22 bp, Artificial Sequence
  Synthetic oligonucleotide; CTC chr11 5216749 5216770 5216766 5216771 +
tgatggctagtgatgatgagca

SEQ ID NO: 82614 - DNA, 22 bp, Artificial Sequence
  Synthetic oligonucleotide; CTG chr11 5216751 5216772 5216768 5216773 +
atggctagtgatgatgagcatt

SEQ ID NO: 82615 - DNA, 22 bp, Artificial Sequence
  Synthetic oligonucleotide; CTA chr11 5216758 5216779 5216775 5216780 +
gtgatgatgagcattttttcat

SEQ ID NO: 82616 - DNA, 22 bp, Artificial Sequence
  Synthetic oligonucleotide; TTT chr11 5216774 5216795 5216791 5216796 +
tttcatgtgttttttgattaca

SEQ ID NO: 82617 - DNA, 22 bp, Artificial Sequence
  Synthetic oligonucleotide; TTT chr11 5216775 5216796 5216792 5216797 +
ttcatgtgttttttgattacat

SEQ ID NO: 82618 - DNA, 22 bp, Artificial Sequence
  Synthetic oligonucleotide; TTT chr11 5216776 5216797 5216793 5216798 +
tcatgtgttttttgattacata

SEQ ID NO: 82619 - DNA, 22 bp, Artificial Sequence
  Synthetic oligonucleotide; TTT chr11 5216777 5216798 5216794 5216799 +
catgtgttttttgattacataa

SEQ ID NO: 82620 - DNA, 22 bp, Artificial Sequence
  Synthetic oligonucleotide; TTC chr11 5216778 5216799 5216795 5216800 +
atgtgttttttgattacataaa

SEQ ID NO: 82621 - DNA, 22 bp, Artificial Sequence
  Synthetic oligonucleotide; TTT chr11 5216786 5216807 5216803 5216808 +
tttgattacataaatgtcttct

SEQ ID NO: 82622 - DNA, 22 bp, Artificial Sequence
  Synthetic oligonucleotide; TTT chr11 5216787 5216808 5216804 5216809 +
ttgattacataaatgtcttctt

SEQ ID NO: 82623 - DNA, 22 bp, Artificial Sequence
  Synthetic oligonucleotide; TTT chr11 5216788 5216809 5216805 5216810 +
tgattacataaatgtcttcttt

SEQ ID NO: 82624 - DNA, 22 bp, Artificial Sequence
  Synthetic oligonucleotide; TTT chr11 5216789 5216810 5216806 5216811 +
gattacataaatgtcttctttt

SEQ ID NO: 82625 - DNA, 22 bp, Artificial Sequence
  Synthetic oligonucleotide; TTG chr11 5216790 5216811 5216807 5216812 +
attacataaatgtcttcttttg

SEQ ID NO: 82626 - DNA, 22 bp, Artificial Sequence
  Synthetic oligonucleotide; TTA chr11 5216794 5216815 5216811 5216816 +
cataaatgtcttcttttgcgaa

SEQ ID NO: 82627 - DNA, 22 bp, Artificial Sequence
  Synthetic oligonucleotide; CTT chr11 5216806 5216827 5216823 5216828 +
cttttgcgaagtgtctgttcat

SEQ ID NO: 82628 - DNA, 22 bp, Artificial Sequence
  Synthetic oligonucleotide; TTC chr11 5216807 5216828 5216824 5216829 +
ttttgcgaagtgtctgttcata

SEQ ID NO: 82629 - DNA, 22 bp, Artificial Sequence
  Synthetic oligonucleotide; CTT chr11 5216809 5216830 5216826 5216831 +
ttgcgaagtgtctgttcatatc

SEQ ID NO: 82630 - DNA, 22 bp, Artificial Sequence
  Synthetic oligonucleotide; TTT chr11 5216810 5216831 5216827 5216832 +
tgcgaagtgtctgttcatatcc

SEQ ID NO: 82631 - DNA, 22 bp, Artificial Sequence
  Synthetic oligonucleotide; TTT chr11 5216811 5216832 5216828 5216833 +
gcgaagtgtctgttcatatcct

SEQ ID NO: 82632 - DNA, 22 bp, Artificial Sequence
  Synthetic oligonucleotide; TTG chr11 5216812 5216833 5216829 5216834 +
cgaagtgtctgttcatatcctt

SEQ ID NO: 82633 - DNA, 22 bp, Artificial Sequence
  Synthetic oligonucleotide; CTG chr11 5216823 5216844 5216840 5216845 +
ttcatatcctttgcccactttt

SEQ ID NO: 82634 - DNA, 22 bp, Artificial Sequence
  Synthetic oligonucleotide; TTC chr11 5216826 5216847 5216843 5216848 +
atatcctttgcccactttttga

SEQ ID NO: 82635 - DNA, 22 bp, Artificial Sequence
  Synthetic oligonucleotide; CTT chr11 5216834 5216855 5216851 5216856 +
tgcccactttttgatggggttg

SEQ ID NO: 82636 - DNA, 22 bp, Artificial Sequence
  Synthetic oligonucleotide; TTT chr11 5216835 5216856 5216852 5216857 +
gcccactttttgatggggttgt

SEQ ID NO: 82637 - DNA, 22 bp, Artificial Sequence
  Synthetic oligonucleotide; TTG chr11 5216836 5216857 5216853 5216858 +
cccactttttgatggggttgtt

SEQ ID NO: 82638 - DNA, 22 bp, Artificial Sequence
  Synthetic oligonucleotide; CTT chr11 5216843 5216864 5216860 5216865 +
tttgatggggttgtttgttttt

SEQ ID NO: 82639 - DNA, 22 bp, Artificial Sequence
  Synthetic oligonucleotide; TTT chr11 5216844 5216865 5216861 5216866 +
ttgatggggttgtttgtttttt

SEQ ID NO: 82640 - DNA, 22 bp, Artificial Sequence
  Synthetic oligonucleotide; TTT chr11 5216845 5216866 5216862 5216867 +
tgatggggttgtttgttttttc

SEQ ID NO: 82641 - DNA, 22 bp, Artificial Sequence
  Synthetic oligonucleotide; TTT chr11 5216846 5216867 5216863 5216868 +
gatggggttgtttgttttttct

SEQ ID NO: 82642 - DNA, 22 bp, Artificial Sequence
  Synthetic oligonucleotide; TTG chr11 5216847 5216868 5216864 5216869 +
atggggttgtttgttttttctt

SEQ ID NO: 82643 - DNA, 22 bp, Artificial Sequence
  Synthetic oligonucleotide; TTG chr11 5216856 5216877 5216873 5216878 +
tttgttttttcttgtaaatttg

SEQ ID NO: 82644 - DNA, 22 bp, Artificial Sequence
  Synthetic oligonucleotide; TTT chr11 5216859 5216880 5216876 5216881 +
gttttttcttgtaaatttgttt

SEQ ID NO: 82645 - DNA, 22 bp, Artificial Sequence
  Synthetic oligonucleotide; TTG chr11 5216860 5216881 5216877 5216882 +
ttttttcttgtaaatttgtttg

SEQ ID NO: 82646 - DNA, 22 bp, Artificial Sequence
  Synthetic oligonucleotide; TTT chr11 5216863 5216884 5216880 5216885 +
tttcttgtaaatttgtttgagt

SEQ ID NO: 82647 - DNA, 22 bp, Artificial Sequence
  Synthetic oligonucleotide; TTT chr11 5216864 5216885 5216881 5216886 +
ttcttgtaaatttgtttgagtt

SEQ ID NO: 82648 - DNA, 22 bp, Artificial Sequence
  Synthetic oligonucleotide; TTT chr11 5216865 5216886 5216882 5216887 +
tcttgtaaatttgtttgagttc

SEQ ID NO: 82649 - DNA, 22 bp, Artificial Sequence
  Synthetic oligonucleotide; TTT chr11 5216866 5216887 5216883 5216888 +
cttgtaaatttgtttgagttca

SEQ ID NO: 82650 - DNA, 22 bp, Artificial Sequence
  Synthetic oligonucleotide; TTC chr11 5216867 5216888 5216884 5216889 +
ttgtaaatttgtttgagttcat

SEQ ID NO: 82651 - DNA, 22 bp, Artificial Sequence
  Synthetic oligonucleotide; CTT chr11 5216869 5216890 5216886 5216891 +
gtaaatttgtttgagttcattg

SEQ ID NO: 82652 - DNA, 22 bp, Artificial Sequence
  Synthetic oligonucleotide; TTG chr11 5216870 5216891 5216887 5216892 +
taaatttgtttgagttcattgt

SEQ ID NO: 82653 - DNA, 22 bp, Artificial Sequence
  Synthetic oligonucleotide; TTT chr11 5216877 5216898 5216894 5216899 +
gtttgagttcattgtagattct

SEQ ID NO: 82654 - DNA, 22 bp, Artificial Sequence
  Synthetic oligonucleotide; TTG chr11 5216878 5216899 5216895 5216900 +
tttgagttcattgtagattctg

SEQ ID NO: 82655 - DNA, 22 bp, Artificial Sequence
  Synthetic oligonucleotide; TTT chr11 5216881 5216902 5216898 5216903 +
gagttcattgtagattctggat

SEQ ID NO: 82656 - DNA, 22 bp, Artificial Sequence
  Synthetic oligonucleotide; TTG chr11 5216882 5216903 5216899 5216904 +
agttcattgtagattctggata

SEQ ID NO: 82657 - DNA, 22 bp, Artificial Sequence
  Synthetic oligonucleotide; TTC chr11 5216887 5216908 5216904 5216909 +
attgtagattctggatattagc

SEQ ID NO: 82658 - DNA, 22 bp, Artificial Sequence
  Synthetic oligonucleotide; TTG chr11 5216891 5216912 5216908 5216913 +
tagattctggatattagccctt

SEQ ID NO: 82659 - DNA, 22 bp, Artificial Sequence
  Synthetic oligonucleotide; TTC chr11 5216898 5216919 5216915 5216920 +
tggatattagccctttgtcaga

SEQ ID NO: 82660 - DNA, 22 bp, Artificial Sequence
  Synthetic oligonucleotide; CTG chr11 5216900 5216921 5216917 5216922 +
gatattagccctttgtcagatg

SEQ ID NO: 82661 - DNA, 22 bp, Artificial Sequence
  Synthetic oligonucleotide; TTA chr11 5216907 5216928 5216924 5216929 +
gccctttgtcagatgagtagat

SEQ ID NO: 82662 - DNA, 22 bp, Artificial Sequence
  Synthetic oligonucleotide; CTT chr11 5216913 5216934 5216930 5216935 +
tgtcagatgagtagattgcaaa

SEQ ID NO: 82663 - DNA, 22 bp, Artificial Sequence
  Synthetic oligonucleotide; TTT chr11 5216914 5216935 5216931 5216936 +
gtcagatgagtagattgcaaaa

SEQ ID NO: 82664 - DNA, 22 bp, Artificial Sequence
  Synthetic oligonucleotide; TTG chr11 5216915 5216936 5216932 5216937 +
tcagatgagtagattgcaaaaa

SEQ ID NO: 82665 - DNA, 22 bp, Artificial Sequence
  Synthetic oligonucleotide; TTG chr11 5216931 5216952 5216948 5216953 +
caaaaattttctcccattttgt

SEQ ID NO: 82666 - DNA, 22 bp, Artificial Sequence
  Synthetic oligonucleotide; TTT chr11 5216940 5216961 5216957 5216962 +
tctcccattttgtaggttgcct

SEQ ID NO: 82667 - DNA, 22 bp, Artificial Sequence
  Synthetic oligonucleotide; TTT chr11 5216941 5216962 5216958 5216963 +
ctcccattttgtaggttgcctg

SEQ ID NO: 82668 - DNA, 22 bp, Artificial Sequence
  Synthetic oligonucleotide; TTC chr11 5216942 5216963 5216959 5216964 +
tcccattttgtaggttgcctgt

SEQ ID NO: 82669 - DNA, 22 bp, Artificial Sequence
  Synthetic oligonucleotide; CTC chr11 5216944 5216965 5216961 5216966 +
ccattttgtaggttgcctgttc

SEQ ID NO: 82670 - DNA, 22 bp, Artificial Sequence
  Synthetic oligonucleotide; TTT chr11 5216950 5216971 5216967 5216972 +
tgtaggttgcctgttcactctg

SEQ ID NO: 82671 - DNA, 22 bp, Artificial Sequence
  Synthetic oligonucleotide; TTT chr11 5216951 5216972 5216968 5216973 +
gtaggttgcctgttcactctga

SEQ ID NO: 82672 - DNA, 22 bp, Artificial Sequence
  Synthetic oligonucleotide; TTG chr11 5216952 5216973 5216969 5216974 +
taggttgcctgttcactctgat

SEQ ID NO: 82673 - DNA, 22 bp, Artificial Sequence
  Synthetic oligonucleotide; TTG chr11 5216959 5216980 5216976 5216981 +
cctgttcactctgatggtagtt

SEQ ID NO: 82674 - DNA, 22 bp, Artificial Sequence
  Synthetic oligonucleotide; CTG chr11 5216963 5216984 5216980 5216985 +
ttcactctgatggtagtttctt

SEQ ID NO: 82675 - DNA, 22 bp, Artificial Sequence
  Synthetic oligonucleotide; TTC chr11 5216966 5216987 5216983 5216988 +
actctgatggtagtttctttag

SEQ ID NO: 82676 - DNA, 22 bp, Artificial Sequence
  Synthetic oligonucleotide; CTC chr11 5216970 5216991 5216987 5216992 +
tgatggtagtttctttagctgt

SEQ ID NO: 82677 - DNA, 22 bp, Artificial Sequence
  Synthetic oligonucleotide; CTG chr11 5216972 5216993 5216989 5216994 +
atggtagtttctttagctgtgc

SEQ ID NO: 82678 - DNA, 22 bp, Artificial Sequence
  Synthetic oligonucleotide; TTT chr11 5216982 5217003 5216999 5217004 +
ctttagctgtgcagaagctctt

SEQ ID NO: 82679 - DNA, 22 bp, Artificial Sequence
  Synthetic oligonucleotide; TTC chr11 5216983 5217004 5217000 5217005 +
tttagctgtgcagaagctcttt

SEQ ID NO: 82680 - DNA, 22 bp, Artificial Sequence
  Synthetic oligonucleotide; CTT chr11 5216985 5217006 5217002 5217007 +
tagctgtgcagaagctctttag

SEQ ID NO: 82681 - DNA, 22 bp, Artificial Sequence
  Synthetic oligonucleotide; TTT chr11 5216986 5217007 5217003 5217008 +
agctgtgcagaagctctttagt

SEQ ID NO: 82682 - DNA, 22 bp, Artificial Sequence
  Synthetic oligonucleotide; TTA chr11 5216987 5217008 5217004 5217009 +
gctgtgcagaagctctttagtt

SEQ ID NO: 82683 - DNA, 22 bp, Artificial Sequence
  Synthetic oligonucleotide; CTG chr11 5216991 5217012 5217008 5217013 +
tgcagaagctctttagtttaat

SEQ ID NO: 82684 - DNA, 22 bp, Artificial Sequence
  Synthetic oligonucleotide; CTC chr11 5217002 5217023 5217019 5217024 +
tttagtttaattagatcccgtt

SEQ ID NO: 82685 - DNA, 22 bp, Artificial Sequence
  Synthetic oligonucleotide; CTT chr11 5217004 5217025 5217021 5217026 +
tagtttaattagatcccgtttg

SEQ ID NO: 82686 - DNA, 22 bp, Artificial Sequence
  Synthetic oligonucleotide; TTT chr11 5217005 5217026 5217022 5217027 +
agtttaattagatcccgtttgt

SEQ ID NO: 82687 - DNA, 22 bp, Artificial Sequence
  Synthetic oligonucleotide; TTA chr11 5217006 5217027 5217023 5217028 +
gtttaattagatcccgtttgtc

SEQ ID NO: 82688 - DNA, 22 bp, Artificial Sequence
  Synthetic oligonucleotide; TTT chr11 5217010 5217031 5217027 5217032 +
aattagatcccgtttgtccatt

SEQ ID NO: 82689 - DNA, 22 bp, Artificial Sequence
  Synthetic oligonucleotide; TTA chr11 5217011 5217032 5217028 5217033 +
attagatcccgtttgtccattt

SEQ ID NO: 82690 - DNA, 22 bp, Artificial Sequence
  Synthetic oligonucleotide; TTA chr11 5217015 5217036 5217032 5217037 +
gatcccgtttgtccattttgtc

SEQ ID NO: 82691 - DNA, 22 bp, Artificial Sequence
  Synthetic oligonucleotide; TTT chr11 5217025 5217046 5217042 5217047 +
gtccattttgtcttttgttgcc

SEQ ID NO: 82692 - DNA, 22 bp, Artificial Sequence
  Synthetic oligonucleotide; TTG chr11 5217026 5217047 5217043 5217048 +
tccattttgtcttttgttgcca

SEQ ID NO: 82693 - DNA, 22 bp, Artificial Sequence
  Synthetic oligonucleotide; TTT chr11 5217033 5217054 5217050 5217055 +
tgtcttttgttgccattgcttt

SEQ ID NO: 82694 - DNA, 22 bp, Artificial Sequence
  Synthetic oligonucleotide; TTT chr11 5217034 5217055 5217051 5217056 +
gtcttttgttgccattgctttt

SEQ ID NO: 82695 - DNA, 22 bp, Artificial Sequence
  Synthetic oligonucleotide; TTG chr11 5217035 5217056 5217052 5217057 +
tcttttgttgccattgcttttg

SEQ ID NO: 82696 - DNA, 22 bp, Artificial Sequence
  Synthetic oligonucleotide; CTT chr11 5217039 5217060 5217056 5217061 +
ttgttgccattgcttttggtgt

SEQ ID NO: 82697 - DNA, 22 bp, Artificial Sequence
  Synthetic oligonucleotide; TTT chr11 5217040 5217061 5217057 5217062 +
tgttgccattgcttttggtgtt

SEQ ID NO: 82698 - DNA, 22 bp, Artificial Sequence
  Synthetic oligonucleotide; TTT chr11 5217041 5217062 5217058 5217063 +
gttgccattgcttttggtgttt

SEQ ID NO: 82699 - DNA, 22 bp, Artificial Sequence
  Synthetic oligonucleotide; TTG chr11 5217042 5217063 5217059 5217064 +
ttgccattgcttttggtgtttt

SEQ ID NO: 82700 - DNA, 22 bp, Artificial Sequence
  Synthetic oligonucleotide; TTG chr11 5217045 5217066 5217062 5217067 +
ccattgcttttggtgttttaga

SEQ ID NO: 82701 - DNA, 22 bp, Artificial Sequence
  Synthetic oligonucleotide; TTG chr11 5217051 5217072 5217068 5217073 +
cttttggtgttttagacatgaa

SEQ ID NO: 82702 - DNA, 22 bp, Artificial Sequence
  Synthetic oligonucleotide; CTT chr11 5217054 5217075 5217071 5217076 +
ttggtgttttagacatgaagtc

SEQ ID NO: 82703 - DNA, 22 bp, Artificial Sequence
  Synthetic oligonucleotide; TTT chr11 5217055 5217076 5217072 5217077 +
tggtgttttagacatgaagtcc

SEQ ID NO: 82704 - DNA, 22 bp, Artificial Sequence
  Synthetic oligonucleotide; TTT chr11 5217056 5217077 5217073 5217078 +
ggtgttttagacatgaagtcct

SEQ ID NO: 82705 - DNA, 22 bp, Artificial Sequence
  Synthetic oligonucleotide; TTG chr11 5217057 5217078 5217074 5217079 +
gtgttttagacatgaagtcctt

SEQ ID NO: 82706 - DNA, 22 bp, Artificial Sequence
  Synthetic oligonucleotide; TTT chr11 5217063 5217084 5217080 5217085 +
tagacatgaagtccttgcccat

SEQ ID NO: 82707 - DNA, 22 bp, Artificial Sequence
  Synthetic oligonucleotide; TTT chr11 5217064 5217085 5217081 5217086 +
agacatgaagtccttgcccatg

SEQ ID NO: 82708 - DNA, 22 bp, Artificial Sequence
  Synthetic oligonucleotide; TTA chr11 5217065 5217086 5217082 5217087 +
gacatgaagtccttgcccatgc

SEQ ID NO: 82709 - DNA, 22 bp, Artificial Sequence
  Synthetic oligonucleotide; CTT chr11 5217079 5217100 5217096 5217101 +
gcccatgcctatgtcctgaatg

SEQ ID NO: 82710 - DNA, 22 bp, Artificial Sequence
  Synthetic oligonucleotide; TTG chr11 5217080 5217101 5217097 5217102 +
cccatgcctatgtcctgaatgg

SEQ ID NO: 82711 - DNA, 22 bp, Artificial Sequence
  Synthetic oligonucleotide; CTA chr11 5217090 5217111 5217107 5217112 +
tgtcctgaatggtattgcctag

SEQ ID NO: 82712 - DNA, 22 bp, Artificial Sequence
  Synthetic oligonucleotide; CTG chr11 5217097 5217118 5217114 5217119 +
aatggtattgcctaggtttttt

SEQ ID NO: 82713 - DNA, 22 bp, Artificial Sequence
  Synthetic oligonucleotide; TTG chr11 5217107 5217128 5217124 5217129 +
cctaggtttttttctagggttt

SEQ ID NO: 82714 - DNA, 22 bp, Artificial Sequence
  Synthetic oligonucleotide; CTA chr11 5217111 5217132 5217128 5217133 +
ggtttttttctagggtttttat

SEQ ID NO: 82715 - DNA, 22 bp, Artificial Sequence
  Synthetic oligonucleotide; TTT chr11 5217116 5217137 5217133 5217138 +
ttttctagggtttttatggttt

SEQ ID NO: 82716 - DNA, 22 bp, Artificial Sequence
  Synthetic oligonucleotide; TTT chr11 5217117 5217138 5217134 5217139 +
tttctagggtttttatggtttt

SEQ ID NO: 82717 - DNA, 22 bp, Artificial Sequence
  Synthetic oligonucleotide; TTT chr11 5217118 5217139 5217135 5217140 +
ttctagggtttttatggtttta

SEQ ID NO: 82718 - DNA, 22 bp, Artificial Sequence
  Synthetic oligonucleotide; TTT chr11 5217119 5217140 5217136 5217141 +
tctagggtttttatggttttag

SEQ ID NO: 82719 - DNA, 22 bp, Artificial Sequence
  Synthetic oligonucleotide; TTT chr11 5217120 5217141 5217137 5217142 +
ctagggtttttatggttttagg

SEQ ID NO: 82720 - DNA, 22 bp, Artificial Sequence
  Synthetic oligonucleotide; TTC chr11 5217121 5217142 5217138 5217143 +
tagggtttttatggttttaggt

SEQ ID NO: 82721 - DNA, 22 bp, Artificial Sequence
  Synthetic oligonucleotide; CTA chr11 5217123 5217144 5217140 5217145 +
gggtttttatggttttaggtct

SEQ ID NO: 82722 - DNA, 22 bp, Artificial Sequence
  Synthetic oligonucleotide; TTT chr11 5217129 5217150 5217146 5217151 +
ttatggttttaggtctaacatg

SEQ ID NO: 82723 - DNA, 22 bp, Artificial Sequence
  Synthetic oligonucleotide; TTT chr11 5217130 5217151 5217147 5217152 +
tatggttttaggtctaacatgt

SEQ ID NO: 82724 - DNA, 22 bp, Artificial Sequence
  Synthetic oligonucleotide; TTT chr11 5217131 5217152 5217148 5217153 +
atggttttaggtctaacatgta

SEQ ID NO: 82725 - DNA, 22 bp, Artificial Sequence
  Synthetic oligonucleotide; TTA chr11 5217132 5217153 5217149 5217154 +
tggttttaggtctaacatgtaa

SEQ ID NO: 82726 - DNA, 22 bp, Artificial Sequence
  Synthetic oligonucleotide; TTT chr11 5217138 5217159 5217155 5217160 +
taggtctaacatgtaagtcttt

SEQ ID NO: 82727 - DNA, 22 bp, Artificial Sequence
  Synthetic oligonucleotide; TTT chr11 5217139 5217160 5217156 5217161 +
aggtctaacatgtaagtcttta

SEQ ID NO: 82728 - DNA, 22 bp, Artificial Sequence
  Synthetic oligonucleotide; TTA chr11 5217140 5217161 5217157 5217162 +
ggtctaacatgtaagtctttaa

SEQ ID NO: 82729 - DNA, 22 bp, Artificial Sequence
  Synthetic oligonucleotide; CTA chr11 5217146 5217167 5217163 5217168 +
acatgtaagtctttaatccatc

SEQ ID NO: 82730 - DNA, 22 bp, Artificial Sequence
  Synthetic oligonucleotide; CTT chr11 5217159 5217180 5217176 5217181 +
taatccatcttgaattaatttt

SEQ ID NO: 82731 - DNA, 22 bp, Artificial Sequence
  Synthetic oligonucleotide; TTT chr11 5217160 5217181 5217177 5217182 +
aatccatcttgaattaattttt

SEQ ID NO: 82732 - DNA, 22 bp, Artificial Sequence
  Synthetic oligonucleotide; TTA chr11 5217161 5217182 5217178 5217183 +
atccatcttgaattaatttttg

SEQ ID NO: 82733 - DNA, 22 bp, Artificial Sequence
  Synthetic oligonucleotide; CTT chr11 5217170 5217191 5217187 5217192 +
gaattaatttttgtataaggtg

SEQ ID NO: 82734 - DNA, 22 bp, Artificial Sequence
  Synthetic oligonucleotide; TTG chr11 5217171 5217192 5217188 5217193 +
aattaatttttgtataaggtgt

SEQ ID NO: 82735 - DNA, 22 bp, Artificial Sequence
  Synthetic oligonucleotide; TTA chr11 5217176 5217197 5217193 5217198 +
atttttgtataaggtgtaagga

SEQ ID NO: 82736 - DNA, 22 bp, Artificial Sequence
  Synthetic oligonucleotide; TTT chr11 5217180 5217201 5217197 5217202 +
ttgtataaggtgtaaggaaggg

SEQ ID NO: 82737 - DNA, 22 bp, Artificial Sequence
  Synthetic oligonucleotide; TTT chr11 5217181 5217202 5217198 5217203 +
tgtataaggtgtaaggaaggga

SEQ ID NO: 82738 - DNA, 22 bp, Artificial Sequence
  Synthetic oligonucleotide; TTT chr11 5217182 5217203 5217199 5217204 +
gtataaggtgtaaggaagggat

SEQ ID NO: 82739 - DNA, 22 bp, Artificial Sequence
  Synthetic oligonucleotide; TTG chr11 5217183 5217204 5217200 5217205 +
tataaggtgtaaggaagggatc

SEQ ID NO: 82740 - DNA, 22 bp, Artificial Sequence
  Synthetic oligonucleotide; TTT chr11 5217211 5217232 5217228 5217233 +
cagctttctacatatggctagc

SEQ ID NO: 82741 - DNA, 22 bp, Artificial Sequence
  Synthetic oligonucleotide; TTC chr11 5217212 5217233 5217229 5217234 +
agctttctacatatggctagcc

SEQ ID NO: 82742 - DNA, 22 bp, Artificial Sequence
  Synthetic oligonucleotide; CTT chr11 5217217 5217238 5217234 5217239 +
tctacatatggctagccagttt

SEQ ID NO: 82743 - DNA, 22 bp, Artificial Sequence
  Synthetic oligonucleotide; TTT chr11 5217218 5217239 5217235 5217240 +
ctacatatggctagccagtttt

SEQ ID NO: 82744 - DNA, 22 bp, Artificial Sequence
  Synthetic oligonucleotide; TTC chr11 5217219 5217240 5217236 5217241 +
tacatatggctagccagttttc

SEQ ID NO: 82745 - DNA, 22 bp, Artificial Sequence
  Synthetic oligonucleotide; CTA chr11 5217221 5217242 5217238 5217243 +
catatggctagccagttttccc

SEQ ID NO: 82746 - DNA, 22 bp, Artificial Sequence
  Synthetic oligonucleotide; CTA chr11 5217231 5217252 5217248 5217253 +
gccagttttcccagcaccattt

SEQ ID NO: 82747 - DNA, 22 bp, Artificial Sequence
  Synthetic oligonucleotide; TTT chr11 5217239 5217260 5217256 5217261 +
tcccagcaccatttattaaata

SEQ ID NO: 82748 - DNA, 22 bp, Artificial Sequence
  Synthetic oligonucleotide; TTT chr11 5217240 5217261 5217257 5217262 +
cccagcaccatttattaaatag

SEQ ID NO: 82749 - DNA, 22 bp, Artificial Sequence
  Synthetic oligonucleotide; TTC chr11 5217241 5217262 5217258 5217263 +
ccagcaccatttattaaatagg

SEQ ID NO: 82750 - DNA, 22 bp, Artificial Sequence
  Synthetic oligonucleotide; TTT chr11 5217253 5217274 5217270 5217275 +
attaaatagggaatcctttccc

SEQ ID NO: 82751 - DNA, 22 bp, Artificial Sequence
  Synthetic oligonucleotide; TTA chr11 5217254 5217275 5217271 5217276 +
ttaaatagggaatcctttcccc

SEQ ID NO: 82752 - DNA, 22 bp, Artificial Sequence
  Synthetic oligonucleotide; TTA chr11 5217257 5217278 5217274 5217279 +
aatagggaatcctttccccatt

SEQ ID NO: 82753 - DNA, 22 bp, Artificial Sequence
  Synthetic oligonucleotide; CTT chr11 5217271 5217292 5217288 5217293 +
tccccattgcttgtttctctca

SEQ ID NO: 82754 - DNA, 22 bp, Artificial Sequence
  Synthetic oligonucleotide; TTT chr11 5217272 5217293 5217289 5217294 +
ccccattgcttgtttctctcag

SEQ ID NO: 82755 - DNA, 22 bp, Artificial Sequence
  Synthetic oligonucleotide; TTC chr11 5217273 5217294 5217290 5217295 +
cccattgcttgtttctctcagg

SEQ ID NO: 82756 - DNA, 22 bp, Artificial Sequence
  Synthetic oligonucleotide; TTG chr11 5217280 5217301 5217297 5217302 +
cttgtttctctcaggtttgtca

SEQ ID NO: 82757 - DNA, 22 bp, Artificial Sequence
  Synthetic oligonucleotide; CTT chr11 5217283 5217304 5217300 5217305 +
gtttctctcaggtttgtcaaag

SEQ ID NO: 82758 - DNA, 22 bp, Artificial Sequence
  Synthetic oligonucleotide; TTG chr11 5217284 5217305 5217301 5217306 +
tttctctcaggtttgtcaaaga

SEQ ID NO: 82759 - DNA, 22 bp, Artificial Sequence
  Synthetic oligonucleotide; TTT chr11 5217287 5217308 5217304 5217309 +
ctctcaggtttgtcaaagatca

SEQ ID NO: 82760 - DNA, 22 bp, Artificial Sequence
  Synthetic oligonucleotide; TTC chr11 5217288 5217309 5217305 5217310 +
tctcaggtttgtcaaagatcag

SEQ ID NO: 82761 - DNA, 22 bp, Artificial Sequence
  Synthetic oligonucleotide; CTC chr11 5217290 5217311 5217307 5217312 +
tcaggtttgtcaaagatcagat

SEQ ID NO: 82762 - DNA, 22 bp, Artificial Sequence
  Synthetic oligonucleotide; CTC chr11 5217292 5217313 5217309 5217314 +
aggtttgtcaaagatcagatag

SEQ ID NO: 82763 - DNA, 22 bp, Artificial Sequence
  Synthetic oligonucleotide; TTT chr11 5217298 5217319 5217315 5217320 +
gtcaaagatcagatagttgtag

SEQ ID NO: 82764 - DNA, 22 bp, Artificial Sequence
  Synthetic oligonucleotide; TTG chr11 5217299 5217320 5217316 5217321 +
tcaaagatcagatagttgtaga

SEQ ID NO: 82765 - DNA, 22 bp, Artificial Sequence
  Synthetic oligonucleotide; TTG chr11 5217317 5217338 5217334 5217339 +
tagatatgcggcattatttctg

SEQ ID NO: 82766 - DNA, 22 bp, Artificial Sequence
  Synthetic oligonucleotide; TTA chr11 5217333 5217354 5217350 5217355 +
tttctgagggctctgttctgtt

SEQ ID NO: 82767 - DNA, 22 bp, Artificial Sequence
  Synthetic oligonucleotide; TTT chr11 5217336 5217357 5217353 5217358 +
ctgagggctctgttctgttcca

SEQ ID NO: 82768 - DNA, 22 bp, Artificial Sequence
  Synthetic oligonucleotide; TTC chr11 5217337 5217358 5217354 5217359 +
tgagggctctgttctgttccat

SEQ ID NO: 82769 - DNA, 22 bp, Artificial Sequence
  Synthetic oligonucleotide; CTG chr11 5217339 5217360 5217356 5217361 +
agggctctgttctgttccattg

SEQ ID NO: 82770 - DNA, 22 bp, Artificial Sequence
  Synthetic oligonucleotide; CTC chr11 5217346 5217367 5217363 5217368 +
tgttctgttccattggtctaga

SEQ ID NO: 82771 - DNA, 22 bp, Artificial Sequence
  Synthetic oligonucleotide; CTG chr11 5217348 5217369 5217365 5217370 +
ttctgttccattggtctagatc

SEQ ID NO: 82772 - DNA, 22 bp, Artificial Sequence
  Synthetic oligonucleotide; TTC chr11 5217351 5217372 5217368 5217373 +
tgttccattggtctagatctct

SEQ ID NO: 82773 - DNA, 22 bp, Artificial Sequence
  Synthetic oligonucleotide; CTG chr11 5217353 5217374 5217370 5217375 +
ttccattggtctagatctctgt

SEQ ID NO: 82774 - DNA, 22 bp, Artificial Sequence
  Synthetic oligonucleotide; TTC chr11 5217356 5217377 5217373 5217378 +
cattggtctagatctctgtttt

SEQ ID NO: 82775 - DNA, 22 bp, Artificial Sequence
  Synthetic oligonucleotide; TTG chr11 5217361 5217382 5217378 5217383 +
gtctagatctctgttttggtac

SEQ ID NO: 82776 - DNA, 22 bp, Artificial Sequence
  Synthetic oligonucleotide; CTA chr11 5217366 5217387 5217383 5217388 +
gatctctgttttggtaccagta

SEQ ID NO: 82777 - DNA, 22 bp, Artificial Sequence
  Synthetic oligonucleotide; CTC chr11 5217372 5217393 5217389 5217394 +
tgttttggtaccagtaccatgc

SEQ ID NO: 82778 - DNA, 22 bp, Artificial Sequence
  Synthetic oligonucleotide; CTG chr11 5217374 5217395 5217391 5217396 +
ttttggtaccagtaccatgctg

SEQ ID NO: 82779 - DNA, 22 bp, Artificial Sequence
  Synthetic oligonucleotide; TTT chr11 5217377 5217398 5217394 5217399 +
tggtaccagtaccatgctgttt

SEQ ID NO: 82780 - DNA, 22 bp, Artificial Sequence
  Synthetic oligonucleotide; TTT chr11 5217378 5217399 5217395 5217400 +
ggtaccagtaccatgctgtttt

SEQ ID NO: 82781 - DNA, 22 bp, Artificial Sequence
  Synthetic oligonucleotide; TTG chr11 5217379 5217400 5217396 5217401 +
gtaccagtaccatgctgttttg

SEQ ID NO: 82782 - DNA, 22 bp, Artificial Sequence
  Synthetic oligonucleotide; CTG chr11 5217396 5217417 5217413 5217418 +
ttttggttaccgtagcattgta

SEQ ID NO: 82783 - DNA, 22 bp, Artificial Sequence
  Synthetic oligonucleotide; TTT chr11 5217399 5217420 5217416 5217421 +
tggttaccgtagcattgtagta

SEQ ID NO: 82784 - DNA, 22 bp, Artificial Sequence
  Synthetic oligonucleotide; TTT chr11 5217400 5217421 5217417 5217422 +
ggttaccgtagcattgtagtat

SEQ ID NO: 82785 - DNA, 22 bp, Artificial Sequence
  Synthetic oligonucleotide; TTG chr11 5217401 5217422 5217418 5217423 +
gttaccgtagcattgtagtata

SEQ ID NO: 82786 - DNA, 22 bp, Artificial Sequence
  Synthetic oligonucleotide; TTA chr11 5217405 5217426 5217422 5217427 +
ccgtagcattgtagtatagttt

SEQ ID NO: 82787 - DNA, 22 bp, Artificial Sequence
  Synthetic oligonucleotide; TTG chr11 5217416 5217437 5217433 5217438 +
tagtatagtttgaagtcaggta

SEQ ID NO: 82788 - DNA, 22 bp, Artificial Sequence
  Synthetic oligonucleotide; TTT chr11 5217427 5217448 5217444 5217449 +
gaagtcaggtagcgtgatgcct

SEQ ID NO: 82789 - DNA, 22 bp, Artificial Sequence
  Synthetic oligonucleotide; TTG chr11 5217428 5217449 5217445 5217450 +
aagtcaggtagcgtgatgcctc

SEQ ID NO: 82790 - DNA, 22 bp, Artificial Sequence
  Synthetic oligonucleotide; CTC chr11 5217450 5217471 5217467 5217472 +
cagctttgttcttttggcttag

SEQ ID NO: 82791 - DNA, 22 bp, Artificial Sequence
  Synthetic oligonucleotide; CTT chr11 5217456 5217477 5217473 5217478 +
tgttcttttggcttaggattgc

SEQ ID NO: 82792 - DNA, 22 bp, Artificial Sequence
  Synthetic oligonucleotide; TTT chr11 5217457 5217478 5217474 5217479 +
gttcttttggcttaggattgcc

SEQ ID NO: 82793 - DNA, 22 bp, Artificial Sequence
  Synthetic oligonucleotide; TTG chr11 5217458 5217479 5217475 5217480 +
ttcttttggcttaggattgcct

SEQ ID NO: 82794 - DNA, 22 bp, Artificial Sequence
  Synthetic oligonucleotide; TTC chr11 5217461 5217482 5217478 5217483 +
ttttggcttaggattgccttgg

SEQ ID NO: 82795 - DNA, 22 bp, Artificial Sequence
  Synthetic oligonucleotide; CTT chr11 5217463 5217484 5217480 5217485 +
ttggcttaggattgccttggtg

SEQ ID NO: 82796 - DNA, 22 bp, Artificial Sequence
  Synthetic oligonucleotide; TTT chr11 5217464 5217485 5217481 5217486 +
tggcttaggattgccttggtga

SEQ ID NO: 82797 - DNA, 22 bp, Artificial Sequence
  Synthetic oligonucleotide; TTT chr11 5217465 5217486 5217482 5217487 +
ggcttaggattgccttggtgat

SEQ ID NO: 82798 - DNA, 22 bp, Artificial Sequence
  Synthetic oligonucleotide; TTG chr11 5217466 5217487 5217483 5217488 +
gcttaggattgccttggtgatg

SEQ ID NO: 82799 - DNA, 22 bp, Artificial Sequence
  Synthetic oligonucleotide; CTT chr11 5217470 5217491 5217487 5217492 +
aggattgccttggtgatgtggg

SEQ ID NO: 82800 - DNA, 22 bp, Artificial Sequence
  Synthetic oligonucleotide; TTA chr11 5217471 5217492 5217488 5217493 +
ggattgccttggtgatgtgggc

SEQ ID NO: 82801 - DNA, 22 bp, Artificial Sequence
  Synthetic oligonucleotide; TTG chr11 5217477 5217498 5217494 5217499 +
ccttggtgatgtgggctctttt

SEQ ID NO: 82802 - DNA, 22 bp, Artificial Sequence
  Synthetic oligonucleotide; CTT chr11 5217481 5217502 5217498 5217503 +
ggtgatgtgggctcttttttgg

SEQ ID NO: 82803 - DNA, 22 bp, Artificial Sequence
  Synthetic oligonucleotide; TTG chr11 5217482 5217503 5217499 5217504 +
gtgatgtgggctcttttttggt

SEQ ID NO: 82804 - DNA, 22 bp, Artificial Sequence
  Synthetic oligonucleotide; CTC chr11 5217495 5217516 5217512 5217517 +
ttttttggttccatatgaactt

SEQ ID NO: 82805 - DNA, 22 bp, Artificial Sequence
  Synthetic oligonucleotide; CTT chr11 5217497 5217518 5217514 5217519 +
ttttggttccatatgaacttta

SEQ ID NO: 82806 - DNA, 22 bp, Artificial Sequence
  Synthetic oligonucleotide; TTT chr11 5217498 5217519 5217515 5217520 +
tttggttccatatgaactttaa

SEQ ID NO: 82807 - DNA, 22 bp, Artificial Sequence
  Synthetic oligonucleotide; TTT chr11 5217499 5217520 5217516 5217521 +
ttggttccatatgaactttaaa

SEQ ID NO: 82808 - DNA, 22 bp, Artificial Sequence
  Synthetic oligonucleotide; TTT chr11 5217500 5217521 5217517 5217522 +
tggttccatatgaactttaaag

SEQ ID NO: 82809 - DNA, 22 bp, Artificial Sequence
  Synthetic oligonucleotide; TTT chr11 5217501 5217522 5217518 5217523 +
ggttccatatgaactttaaagt

SEQ ID NO: 82810 - DNA, 22 bp, Artificial Sequence
  Synthetic oligonucleotide; TTG chr11 5217502 5217523 5217519 5217524 +
gttccatatgaactttaaagta

SEQ ID NO: 82811 - DNA, 22 bp, Artificial Sequence
  Synthetic oligonucleotide; TTC chr11 5217506 5217527 5217523 5217528 +
catatgaactttaaagtagttt

SEQ ID NO: 82812 - DNA, 22 bp, Artificial Sequence
  Synthetic oligonucleotide; CTT chr11 5217517 5217538 5217534 5217539 +
taaagtagttttttccagttct

SEQ ID NO: 82813 - DNA, 22 bp, Artificial Sequence
  Synthetic oligonucleotide; TTT chr11 5217518 5217539 5217535 5217540 +
aaagtagttttttccagttctg

SEQ ID NO: 82814 - DNA, 22 bp, Artificial Sequence
  Synthetic oligonucleotide; TTA chr11 5217519 5217540 5217536 5217541 +
aagtagttttttccagttctgt

SEQ ID NO: 82815 - DNA, 22 bp, Artificial Sequence
  Synthetic oligonucleotide; TTT chr11 5217528 5217549 5217545 5217550 +
tttccagttctgtgaagaaagt

SEQ ID NO: 82816 - DNA, 22 bp, Artificial Sequence
  Synthetic oligonucleotide; TTT chr11 5217529 5217550 5217546 5217551 +
ttccagttctgtgaagaaagtc

SEQ ID NO: 82817 - DNA, 22 bp, Artificial Sequence
  Synthetic oligonucleotide; TTT chr11 5217530 5217551 5217547 5217552 +
tccagttctgtgaagaaagtca

SEQ ID NO: 82818 - DNA, 22 bp, Artificial Sequence
  Synthetic oligonucleotide; TTT chr11 5217531 5217552 5217548 5217553 +
ccagttctgtgaagaaagtcat

SEQ ID NO: 82819 - DNA, 22 bp, Artificial Sequence
  Synthetic oligonucleotide; TTC chr11 5217532 5217553 5217549 5217554 +
cagttctgtgaagaaagtcatt

SEQ ID NO: 82820 - DNA, 22 bp, Artificial Sequence
  Synthetic oligonucleotide; TTC chr11 5217538 5217559 5217555 5217560 +
tgtgaagaaagtcattggtagc

SEQ ID NO: 82821 - DNA, 22 bp, Artificial Sequence
  Synthetic oligonucleotide; CTG chr11 5217540 5217561 5217557 5217562 +
tgaagaaagtcattggtagctt

SEQ ID NO: 82822 - DNA, 22 bp, Artificial Sequence
  Synthetic oligonucleotide; TTG chr11 5217555 5217576 5217572 5217577 +
gtagcttgatggggatggcatt

SEQ ID NO: 82823 - DNA, 22 bp, Artificial Sequence
  Synthetic oligonucleotide; CTT chr11 5217562 5217583 5217579 5217584 +
gatggggatggcattgaatcta

SEQ ID NO: 82824 - DNA, 22 bp, Artificial Sequence
  Synthetic oligonucleotide; TTG chr11 5217563 5217584 5217580 5217585 +
atggggatggcattgaatctat

SEQ ID NO: 82825 - DNA, 22 bp, Artificial Sequence
  Synthetic oligonucleotide; TTG chr11 5217578 5217599 5217595 5217600 +
aatctataaattaccttgggca

SEQ ID NO: 82826 - DNA, 22 bp, Artificial Sequence
  Synthetic oligonucleotide; CTA chr11 5217584 5217605 5217601 5217606 +
taaattaccttgggcagtatga

SEQ ID NO: 82827 - DNA, 22 bp, Artificial Sequence
  Synthetic oligonucleotide; TTA chr11 5217591 5217612 5217608 5217613 +
ccttgggcagtatgaccatttt

SEQ ID NO: 82828 - DNA, 22 bp, Artificial Sequence
  Synthetic oligonucleotide; CTT chr11 5217595 5217616 5217612 5217617 +
gggcagtatgaccattttcacg

SEQ ID NO: 82829 - DNA, 22 bp, Artificial Sequence
  Synthetic oligonucleotide; TTG chr11 5217596 5217617 5217613 5217618 +
ggcagtatgaccattttcacga

SEQ ID NO: 82830 - DNA, 22 bp, Artificial Sequence
  Synthetic oligonucleotide; TTT chr11 5217612 5217633 5217629 5217634 +
tcacgatattgattcttcctac

SEQ ID NO: 82831 - DNA, 22 bp, Artificial Sequence
  Synthetic oligonucleotide; TTT chr11 5217613 5217634 5217630 5217635 +
cacgatattgattcttcctacc

SEQ ID NO: 82832 - DNA, 22 bp, Artificial Sequence
  Synthetic oligonucleotide; TTC chr11 5217614 5217635 5217631 5217636 +
acgatattgattcttcctaccc

SEQ ID NO: 82833 - DNA, 22 bp, Artificial Sequence
  Synthetic oligonucleotide; TTG chr11 5217623 5217644 5217640 5217645 +
attcttcctacccatgagcatg

SEQ ID NO: 82834 - DNA, 22 bp, Artificial Sequence
  Synthetic oligonucleotide; TTC chr11 5217627 5217648 5217644 5217649 +
ttcctacccatgagcatggaat

SEQ ID NO: 82835 - DNA, 22 bp, Artificial Sequence
  Synthetic oligonucleotide; CTT chr11 5217629 5217650 5217646 5217651 +
cctacccatgagcatggaatgt

SEQ ID NO: 82836 - DNA, 22 bp, Artificial Sequence
  Synthetic oligonucleotide; TTC chr11 5217630 5217651 5217647 5217652 +
ctacccatgagcatggaatgtt

SEQ ID NO: 82837 - DNA, 22 bp, Artificial Sequence
  Synthetic oligonucleotide; CTA chr11 5217633 5217654 5217650 5217655 +
cccatgagcatggaatgttctt

SEQ ID NO: 82838 - DNA, 22 bp, Artificial Sequence
  Synthetic oligonucleotide; TTC chr11 5217653 5217674 5217670 5217675 +
ttccatttgtttgtatcctctt

SEQ ID NO: 82839 - DNA, 22 bp, Artificial Sequence
  Synthetic oligonucleotide; CTT chr11 5217655 5217676 5217672 5217677 +
ccatttgtttgtatcctctttt

SEQ ID NO: 82840 - DNA, 22 bp, Artificial Sequence
  Synthetic oligonucleotide; TTC chr11 5217656 5217677 5217673 5217678 +
catttgtttgtatcctctttta

SEQ ID NO: 82841 - DNA, 22 bp, Artificial Sequence
  Synthetic oligonucleotide; TTT chr11 5217661 5217682 5217678 5217683 +
gtttgtatcctcttttatttca

SEQ ID NO: 82842 - DNA, 22 bp, Artificial Sequence
  Synthetic oligonucleotide; TTG chr11 5217662 5217683 5217679 5217684 +
tttgtatcctcttttatttcat

SEQ ID NO: 82843 - DNA, 22 bp, Artificial Sequence
  Synthetic oligonucleotide; TTT chr11 5217665 5217686 5217682 5217687 +
gtatcctcttttatttcattga

SEQ ID NO: 82844 - DNA, 22 bp, Artificial Sequence
  Synthetic oligonucleotide; TTG chr11 5217666 5217687 5217683 5217688 +
tatcctcttttatttcattgag

SEQ ID NO: 82845 - DNA, 22 bp, Artificial Sequence
  Synthetic oligonucleotide; CTC chr11 5217673 5217694 5217690 5217695 +
ttttatttcattgagcagtggt

SEQ ID NO: 82846 - DNA, 22 bp, Artificial Sequence
  Synthetic oligonucleotide; CTT chr11 5217675 5217696 5217692 5217697 +
ttatttcattgagcagtggttt

SEQ ID NO: 82847 - DNA, 22 bp, Artificial Sequence
  Synthetic oligonucleotide; TTT chr11 5217676 5217697 5217693 5217698 +
tatttcattgagcagtggtttg

SEQ ID NO: 82848 - DNA, 22 bp, Artificial Sequence
  Synthetic oligonucleotide; TTT chr11 5217677 5217698 5217694 5217699 +
atttcattgagcagtggtttgt

SEQ ID NO: 82849 - DNA, 22 bp, Artificial Sequence
  Synthetic oligonucleotide; TTA chr11 5217678 5217699 5217695 5217700 +
tttcattgagcagtggtttgta

SEQ ID NO: 82850 - DNA, 22 bp, Artificial Sequence
  Synthetic oligonucleotide; TTT chr11 5217681 5217702 5217698 5217703 +
cattgagcagtggtttgtagtt

SEQ ID NO: 82851 - DNA, 22 bp, Artificial Sequence
  Synthetic oligonucleotide; TTC chr11 5217682 5217703 5217699 5217704 +
attgagcagtggtttgtagttc

SEQ ID NO: 82852 - DNA, 22 bp, Artificial Sequence
  Synthetic oligonucleotide; TTG chr11 5217686 5217707 5217703 5217708 +
agcagtggtttgtagttctcct

SEQ ID NO: 82853 - DNA, 22 bp, Artificial Sequence
  Synthetic oligonucleotide; TTT chr11 5217697 5217718 5217714 5217719 +
gtagttctccttgaagaggtcc

SEQ ID NO: 82854 - DNA, 22 bp, Artificial Sequence
  Synthetic oligonucleotide; TTG chr11 5217698 5217719 5217715 5217720 +
tagttctccttgaagaggtcct

SEQ ID NO: 82855 - DNA, 22 bp, Artificial Sequence
  Synthetic oligonucleotide; TTC chr11 5217704 5217725 5217721 5217726 +
tccttgaagaggtccttcacat

SEQ ID NO: 82856 - DNA, 22 bp, Artificial Sequence
  Synthetic oligonucleotide; CTC chr11 5217706 5217727 5217723 5217728 +
cttgaagaggtccttcacatcc

SEQ ID NO: 82857 - DNA, 22 bp, Artificial Sequence
  Synthetic oligonucleotide; CTT chr11 5217709 5217730 5217726 5217731 +
gaagaggtccttcacatccctt

SEQ ID NO: 82858 - DNA, 22 bp, Artificial Sequence
  Synthetic oligonucleotide; TTG chr11 5217710 5217731 5217727 5217732 +
aagaggtccttcacatcccttg

SEQ ID NO: 82859 - DNA, 22 bp, Artificial Sequence
  Synthetic oligonucleotide; CTT chr11 5217721 5217742 5217738 5217743 +
cacatcccttgtaagttggatt

SEQ ID NO: 82860 - DNA, 22 bp, Artificial Sequence
  Synthetic oligonucleotide; TTC chr11 5217722 5217743 5217739 5217744 +
acatcccttgtaagttggattc

SEQ ID NO: 82861 - DNA, 22 bp, Artificial Sequence
  Synthetic oligonucleotide; CTT chr11 5217731 5217752 5217748 5217753 +
gtaagttggattcctaggtatt

SEQ ID NO: 82862 - DNA, 22 bp, Artificial Sequence
  Synthetic oligonucleotide; TTG chr11 5217732 5217753 5217749 5217754 +
taagttggattcctaggtattt

SEQ ID NO: 82863 - DNA, 22 bp, Artificial Sequence
  Synthetic oligonucleotide; TTG chr11 5217739 5217760 5217756 5217761 +
gattcctaggtattttattctc

SEQ ID NO: 82864 - DNA, 22 bp, Artificial Sequence
  Synthetic oligonucleotide; TTC chr11 5217744 5217765 5217761 5217766 +
ctaggtattttattctctttga

SEQ ID NO: 82865 - DNA, 22 bp, Artificial Sequence
  Synthetic oligonucleotide; CTA chr11 5217747 5217768 5217764 5217769 +
ggtattttattctctttgaagc

SEQ ID NO: 82866 - DNA, 22 bp, Artificial Sequence
  Synthetic oligonucleotide; TTT chr11 5217754 5217775 5217771 5217776 +
tattctctttgaagcaattgtg

SEQ ID NO: 82867 - DNA, 22 bp, Artificial Sequence
  Synthetic oligonucleotide; TTT chr11 5217755 5217776 5217772 5217777 +
attctctttgaagcaattgtga

SEQ ID NO: 82868 - DNA, 22 bp, Artificial Sequence
  Synthetic oligonucleotide; TTA chr11 5217756 5217777 5217773 5217778 +
ttctctttgaagcaattgtgaa

SEQ ID NO: 82869 - DNA, 22 bp, Artificial Sequence
  Synthetic oligonucleotide; TTC chr11 5217759 5217780 5217776 5217781 +
tctttgaagcaattgtgaatgg

SEQ ID NO: 82870 - DNA, 22 bp, Artificial Sequence
  Synthetic oligonucleotide; CTC chr11 5217761 5217782 5217778 5217783 +
tttgaagcaattgtgaatggga

SEQ ID NO: 82871 - DNA, 22 bp, Artificial Sequence
  Synthetic oligonucleotide; CTT chr11 5217763 5217784 5217780 5217785 +
tgaagcaattgtgaatgggagt

SEQ ID NO: 82872 - DNA, 22 bp, Artificial Sequence
  Synthetic oligonucleotide; TTT chr11 5217764 5217785 5217781 5217786 +
gaagcaattgtgaatgggagtt

SEQ ID NO: 82873 - DNA, 22 bp, Artificial Sequence
  Synthetic oligonucleotide; TTG chr11 5217765 5217786 5217782 5217787 +
aagcaattgtgaatgggagttc

SEQ ID NO: 82874 - DNA, 22 bp, Artificial Sequence
  Synthetic oligonucleotide; TTG chr11 5217774 5217795 5217791 5217796 +
tgaatgggagttcactcatgat

SEQ ID NO: 82875 - DNA, 22 bp, Artificial Sequence
  Synthetic oligonucleotide; TTC chr11 5217787 5217808 5217804 5217809 +
actcatgatttggctctctgtt

SEQ ID NO: 82876 - DNA, 22 bp, Artificial Sequence
  Synthetic oligonucleotide; CTC chr11 5217791 5217812 5217808 5217813 +
atgatttggctctctgtttgtc

SEQ ID NO: 82877 - DNA, 22 bp, Artificial Sequence
  Synthetic oligonucleotide; TTT chr11 5217798 5217819 5217815 5217820 +
ggctctctgtttgtctgttatt

SEQ ID NO: 82878 - DNA, 22 bp, Artificial Sequence
  Synthetic oligonucleotide; TTG chr11 5217799 5217820 5217816 5217821 +
gctctctgtttgtctgttattg

SEQ ID NO: 82879 - DNA, 22 bp, Artificial Sequence
  Synthetic oligonucleotide; CTC chr11 5217803 5217824 5217820 5217825 +
tctgtttgtctgttattggtgc

SEQ ID NO: 82880 - DNA, 22 bp, Artificial Sequence
  Synthetic oligonucleotide; CTC chr11 5217805 5217826 5217822 5217827 +
tgtttgtctgttattggtgcat

SEQ ID NO: 82881 - DNA, 22 bp, Artificial Sequence
  Synthetic oligonucleotide; CTG chr11 5217807 5217828 5217824 5217829 +
tttgtctgttattggtgcatag

SEQ ID NO: 82882 - DNA, 22 bp, Artificial Sequence
  Synthetic oligonucleotide; TTT chr11 5217810 5217831 5217827 5217832 +
gtctgttattggtgcataggaa

SEQ ID NO: 82883 - DNA, 22 bp, Artificial Sequence
  Synthetic oligonucleotide; TTG chr11 5217811 5217832 5217828 5217833 +
tctgttattggtgcataggaat

SEQ ID NO: 82884 - DNA, 22 bp, Artificial Sequence
  Synthetic oligonucleotide; CTG chr11 5217815 5217836 5217832 5217837 +
ttattggtgcataggaatactt

SEQ ID NO: 82885 - DNA, 22 bp, Artificial Sequence
  Synthetic oligonucleotide; TTA chr11 5217818 5217839 5217835 5217840 +
ttggtgcataggaatacttgtg

SEQ ID NO: 82886 - DNA, 22 bp, Artificial Sequence
  Synthetic oligonucleotide; TTG chr11 5217821 5217842 5217838 5217843 +
gtgcataggaatacttgtgatt

SEQ ID NO: 82887 - DNA, 22 bp, Artificial Sequence
  Synthetic oligonucleotide; CTT chr11 5217837 5217858 5217854 5217859 +
gtgatttttgcacactgatttt

SEQ ID NO: 82888 - DNA, 22 bp, Artificial Sequence
  Synthetic oligonucleotide; TTG chr11 5217838 5217859 5217855 5217860 +
tgatttttgcacactgatttta

SEQ ID NO: 82889 - DNA, 22 bp, Artificial Sequence
  Synthetic oligonucleotide; TTT chr11 5217844 5217865 5217861 5217866 +
ttgcacactgattttatatcct

SEQ ID NO: 82890 - DNA, 22 bp, Artificial Sequence
  Synthetic oligonucleotide; TTT chr11 5217845 5217866 5217862 5217867 +
tgcacactgattttatatcctg

SEQ ID NO: 82891 - DNA, 22 bp, Artificial Sequence
  Synthetic oligonucleotide; TTT chr11 5217846 5217867 5217863 5217868 +
gcacactgattttatatcctga

SEQ ID NO: 82892 - DNA, 22 bp, Artificial Sequence
  Synthetic oligonucleotide; TTG chr11 5217847 5217868 5217864 5217869 +
cacactgattttatatcctgag

SEQ ID NO: 82893 - DNA, 22 bp, Artificial Sequence
  Synthetic oligonucleotide; CTG chr11 5217854 5217875 5217871 5217876 +
attttatatcctgagactttgc

SEQ ID NO: 82894 - DNA, 22 bp, Artificial Sequence
  Synthetic oligonucleotide; TTT chr11 5217858 5217879 5217875 5217880 +
tatatcctgagactttgctgaa

SEQ ID NO: 82895 - DNA, 22 bp, Artificial Sequence
  Synthetic oligonucleotide; TTT chr11 5217859 5217880 5217876 5217881 +
atatcctgagactttgctgaag

SEQ ID NO: 82896 - DNA, 22 bp, Artificial Sequence
  Synthetic oligonucleotide; TTA chr11 5217860 5217881 5217877 5217882 +
tatcctgagactttgctgaagt

SEQ ID NO: 82897 - DNA, 22 bp, Artificial Sequence
  Synthetic oligonucleotide; CTG chr11 5217867 5217888 5217884 5217889 +
agactttgctgaagttgcttat

SEQ ID NO: 82898 - DNA, 22 bp, Artificial Sequence
  Synthetic oligonucleotide; CTT chr11 5217873 5217894 5217890 5217895 +
tgctgaagttgcttatcagctt

SEQ ID NO: 82899 - DNA, 22 bp, Artificial Sequence
  Synthetic oligonucleotide; TTT chr11 5217874 5217895 5217891 5217896 +
gctgaagttgcttatcagctta

SEQ ID NO: 82900 - DNA, 22 bp, Artificial Sequence
  Synthetic oligonucleotide; TTG chr11 5217875 5217896 5217892 5217897 +
ctgaagttgcttatcagcttaa

SEQ ID NO: 82901 - DNA, 22 bp, Artificial Sequence
  Synthetic oligonucleotide; CTG chr11 5217878 5217899 5217895 5217900 +
aagttgcttatcagcttaagga

SEQ ID NO: 82902 - DNA, 22 bp, Artificial Sequence
  Synthetic oligonucleotide; TTG chr11 5217884 5217905 5217901 5217906 +
cttatcagcttaaggagatttt

SEQ ID NO: 82903 - DNA, 22 bp, Artificial Sequence
  Synthetic oligonucleotide; CTT chr11 5217887 5217908 5217904 5217909 +
atcagcttaaggagattttggg

SEQ ID NO: 82904 - DNA, 22 bp, Artificial Sequence
  Synthetic oligonucleotide; TTA chr11 5217888 5217909 5217905 5217910 +
tcagcttaaggagattttgggc

SEQ ID NO: 82905 - DNA, 22 bp, Artificial Sequence
  Synthetic oligonucleotide; CTT chr11 5217895 5217916 5217912 5217917 +
aaggagattttgggctgagaca

SEQ ID NO: 82906 - DNA, 22 bp, Artificial Sequence
  Synthetic oligonucleotide; TTA chr11 5217896 5217917 5217913 5217918 +
aggagattttgggctgagacaa

SEQ ID NO: 82907 - DNA, 22 bp, Artificial Sequence
  Synthetic oligonucleotide; TTT chr11 5217905 5217926 5217922 5217927 +
tgggctgagacaatggggtttt

SEQ ID NO: 82908 - DNA, 22 bp, Artificial Sequence
  Synthetic oligonucleotide; TTT chr11 5217906 5217927 5217923 5217928 +
gggctgagacaatggggttttc

SEQ ID NO: 82909 - DNA, 22 bp, Artificial Sequence
  Synthetic oligonucleotide; TTG chr11 5217907 5217928 5217924 5217929 +
ggctgagacaatggggttttct

SEQ ID NO: 82910 - DNA, 22 bp, Artificial Sequence
  Synthetic oligonucleotide; CTG chr11 5217912 5217933 5217929 5217934 +
agacaatggggttttctagata

SEQ ID NO: 82911 - DNA, 22 bp, Artificial Sequence
  Synthetic oligonucleotide; TTT chr11 5217926 5217947 5217943 5217948 +
tctagatatacaatcatgtcat

SEQ ID NO: 82912 - DNA, 22 bp, Artificial Sequence
  Synthetic oligonucleotide; TTT chr11 5217927 5217948 5217944 5217949 +
ctagatatacaatcatgtcatc

SEQ ID NO: 82913 - DNA, 22 bp, Artificial Sequence
  Synthetic oligonucleotide; TTC chr11 5217928 5217949 5217945 5217950 +
tagatatacaatcatgtcatct

SEQ ID NO: 82914 - DNA, 22 bp, Artificial Sequence
  Synthetic oligonucleotide; CTA chr11 5217930 5217951 5217947 5217952 +
gatatacaatcatgtcatctgc

SEQ ID NO: 82915 - DNA, 22 bp, Artificial Sequence
  Synthetic oligonucleotide; CTG chr11 5217951 5217972 5217968 5217973 +
caaacagggacaatttcacttc

SEQ ID NO: 82916 - DNA, 22 bp, Artificial Sequence
  Synthetic oligonucleotide; TTT chr11 5217967 5217988 5217984 5217989 +
cacttcctcttttcctaattga

SEQ ID NO: 82917 - DNA, 22 bp, Artificial Sequence
  Synthetic oligonucleotide; TTC chr11 5217968 5217989 5217985 5217990 +
acttcctcttttcctaattgaa

SEQ ID NO: 82918 - DNA, 22 bp, Artificial Sequence
  Synthetic oligonucleotide; CTT chr11 5217972 5217993 5217989 5217994 +
cctcttttcctaattgaatgcc

SEQ ID NO: 82919 - DNA, 22 bp, Artificial Sequence
  Synthetic oligonucleotide; TTC chr11 5217973 5217994 5217990 5217995 +
ctcttttcctaattgaatgccc

SEQ ID NO: 82920 - DNA, 22 bp, Artificial Sequence
  Synthetic oligonucleotide; CTC chr11 5217976 5217997 5217993 5217998 +
ttttcctaattgaatgcccttt

SEQ ID NO: 82921 - DNA, 22 bp, Artificial Sequence
  Synthetic oligonucleotide; CTT chr11 5217978 5217999 5217995 5218000 +
ttcctaattgaatgccctttat

SEQ ID NO: 82922 - DNA, 22 bp, Artificial Sequence
  Synthetic oligonucleotide; TTT chr11 5217979 5218000 5217996 5218001 +
tcctaattgaatgccctttatt

SEQ ID NO: 82923 - DNA, 22 bp, Artificial Sequence
  Synthetic oligonucleotide; TTT chr11 5217980 5218001 5217997 5218002 +
cctaattgaatgccctttattt

SEQ ID NO: 82924 - DNA, 22 bp, Artificial Sequence
  Synthetic oligonucleotide; TTC chr11 5217981 5218002 5217998 5218003 +
ctaattgaatgccctttatttc

SEQ ID NO: 82925 - DNA, 22 bp, Artificial Sequence
  Synthetic oligonucleotide; CTA chr11 5217984 5218005 5218001 5218006 +
attgaatgccctttatttcctt

SEQ ID NO: 82926 - DNA, 22 bp, Artificial Sequence
  Synthetic oligonucleotide; TTG chr11 5217988 5218009 5218005 5218010 +
aatgccctttatttccttctcc

SEQ ID NO: 82927 - DNA, 22 bp, Artificial Sequence
  Synthetic oligonucleotide; CTT chr11 5217997 5218018 5218014 5218019 +
tatttccttctcctgcctgatt

SEQ ID NO: 82928 - DNA, 22 bp, Artificial Sequence
  Synthetic oligonucleotide; TTT chr11 5217998 5218019 5218015 5218020 +
atttccttctcctgcctgattg

SEQ ID NO: 82929 - DNA, 22 bp, Artificial Sequence
  Synthetic oligonucleotide; TTA chr11 5217999 5218020 5218016 5218021 +
tttccttctcctgcctgattgc

SEQ ID NO: 82930 - DNA, 22 bp, Artificial Sequence
  Synthetic oligonucleotide; TTT chr11 5218002 5218023 5218019 5218024 +
ccttctcctgcctgattgccct

SEQ ID NO: 82931 - DNA, 22 bp, Artificial Sequence
  Synthetic oligonucleotide; TTC chr11 5218003 5218024 5218020 5218025 +
cttctcctgcctgattgccctg

SEQ ID NO: 82932 - DNA, 22 bp, Artificial Sequence
  Synthetic oligonucleotide; CTT chr11 5218006 5218027 5218023 5218028 +
ctcctgcctgattgccctggcc

SEQ ID NO: 82933 - DNA, 22 bp, Artificial Sequence
  Synthetic oligonucleotide; TTC chr11 5218007 5218028 5218024 5218029 +
tcctgcctgattgccctggcca

SEQ ID NO: 82934 - DNA, 22 bp, Artificial Sequence
  Synthetic oligonucleotide; CTC chr11 5218009 5218030 5218026 5218031 +
ctgcctgattgccctggccaga

SEQ ID NO: 82935 - DNA, 22 bp, Artificial Sequence
  Synthetic oligonucleotide; CTG chr11 5218012 5218033 5218029 5218034 +
cctgattgccctggccagaact

SEQ ID NO: 82936 - DNA, 22 bp, Artificial Sequence
  Synthetic oligonucleotide; CTG chr11 5218016 5218037 5218033 5218038 +
attgccctggccagaacttaca

SEQ ID NO: 82937 - DNA, 22 bp, Artificial Sequence
  Synthetic oligonucleotide; TTG chr11 5218020 5218041 5218037 5218042 +
ccctggccagaacttacaacac

SEQ ID NO: 82938 - DNA, 22 bp, Artificial Sequence
  Synthetic oligonucleotide; CTG chr11 5218025 5218046 5218042 5218047 +
gccagaacttacaacactatgt

SEQ ID NO: 82939 - DNA, 22 bp, Artificial Sequence
  Synthetic oligonucleotide; CTT chr11 5218035 5218056 5218052 5218057 +
acaacactatgttgaataggag

SEQ ID NO: 82940 - DNA, 22 bp, Artificial Sequence
  Synthetic oligonucleotide; TTA chr11 5218036 5218057 5218053 5218058 +
caacactatgttgaataggagt

SEQ ID NO: 82941 - DNA, 22 bp, Artificial Sequence
  Synthetic oligonucleotide; CTA chr11 5218044 5218065 5218061 5218066 +
tgttgaataggagtggtgagag

SEQ ID NO: 82942 - DNA, 22 bp, Artificial Sequence
  Synthetic oligonucleotide; TTG chr11 5218049 5218070 5218066 5218071 +
aataggagtggtgagagagggc

SEQ ID NO: 82943 - DNA, 22 bp, Artificial Sequence
  Synthetic oligonucleotide; CTG chr11 5218078 5218099 5218095 5218100 +
ccttgtgccagttttcaaaggg

SEQ ID NO: 82944 - DNA, 22 bp, Artificial Sequence
  Synthetic oligonucleotide; CTT chr11 5218082 5218103 5218099 5218104 +
gtgccagttttcaaagggaatg

SEQ ID NO: 82945 - DNA, 22 bp, Artificial Sequence
  Synthetic oligonucleotide; TTG chr11 5218083 5218104 5218100 5218105 +
tgccagttttcaaagggaatgc

SEQ ID NO: 82946 - DNA, 22 bp, Artificial Sequence
  Synthetic oligonucleotide; TTT chr11 5218092 5218113 5218109 5218114 +
tcaaagggaatgcttccagttt

SEQ ID NO: 82947 - DNA, 22 bp, Artificial Sequence
  Synthetic oligonucleotide; TTT chr11 5218093 5218114 5218110 5218115 +
caaagggaatgcttccagtttt

SEQ ID NO: 82948 - DNA, 22 bp, Artificial Sequence
  Synthetic oligonucleotide; TTC chr11 5218094 5218115 5218111 5218116 +
aaagggaatgcttccagttttt

SEQ ID NO: 82949 - DNA, 22 bp, Artificial Sequence
  Synthetic oligonucleotide; CTT chr11 5218107 5218128 5218124 5218129 +
ccagtttttgtccactcagtat

SEQ ID NO: 82950 - DNA, 22 bp, Artificial Sequence
  Synthetic oligonucleotide; TTC chr11 5218108 5218129 5218125 5218130 +
cagtttttgtccactcagtatg

SEQ ID NO: 82951 - DNA, 22 bp, Artificial Sequence
  Synthetic oligonucleotide; TTT chr11 5218114 5218135 5218131 5218136 +
ttgtccactcagtatgatattg

SEQ ID NO: 82952 - DNA, 22 bp, Artificial Sequence
  Synthetic oligonucleotide; TTT chr11 5218115 5218136 5218132 5218137 +
tgtccactcagtatgatattgg

SEQ ID NO: 82953 - DNA, 22 bp, Artificial Sequence
  Synthetic oligonucleotide; TTT chr11 5218116 5218137 5218133 5218138 +
gtccactcagtatgatattggc

SEQ ID NO: 82954 - DNA, 22 bp, Artificial Sequence
  Synthetic oligonucleotide; TTG chr11 5218117 5218138 5218134 5218139 +
tccactcagtatgatattggct

SEQ ID NO: 82955 - DNA, 22 bp, Artificial Sequence
  Synthetic oligonucleotide; CTC chr11 5218124 5218145 5218141 5218146 +
agtatgatattggctgtgggtt

SEQ ID NO: 82956 - DNA, 22 bp, Artificial Sequence
  Synthetic oligonucleotide; TTG chr11 5218136 5218157 5218153 5218158 +
gctgtgggtttgtcatagatag

SEQ ID NO: 82957 - DNA, 22 bp, Artificial Sequence
  Synthetic oligonucleotide; CTG chr11 5218140 5218161 5218157 5218162 +
tgggtttgtcatagatagctct

SEQ ID NO: 82958 - DNA, 22 bp, Artificial Sequence
  Synthetic oligonucleotide; TTT chr11 5218147 5218168 5218164 5218169 +
gtcatagatagctcttattatt

SEQ ID NO: 82959 - DNA, 22 bp, Artificial Sequence
  Synthetic oligonucleotide; TTG chr11 5218148 5218169 5218165 5218170 +
tcatagatagctcttattattt

SEQ ID NO: 82960 - DNA, 22 bp, Artificial Sequence
  Synthetic oligonucleotide; CTC chr11 5218161 5218182 5218178 5218183 +
ttattattttgagatatgtccc

SEQ ID NO: 82961 - DNA, 22 bp, Artificial Sequence
  Synthetic oligonucleotide; CTT chr11 5218163 5218184 5218180 5218185 +
attattttgagatatgtcccat

SEQ ID NO: 82962 - DNA, 22 bp, Artificial Sequence
  Synthetic oligonucleotide; TTA chr11 5218164 5218185 5218181 5218186 +
ttattttgagatatgtcccatc

SEQ ID NO: 82963 - DNA, 22 bp, Artificial Sequence
  Synthetic oligonucleotide; TTA chr11 5218167 5218188 5218184 5218189 +
ttttgagatatgtcccatcaat

SEQ ID NO: 82964 - DNA, 22 bp, Artificial Sequence
  Synthetic oligonucleotide; TTT chr11 5218170 5218191 5218187 5218192 +
tgagatatgtcccatcaatacc

SEQ ID NO: 82965 - DNA, 22 bp, Artificial Sequence
  Synthetic oligonucleotide; TTT chr11 5218171 5218192 5218188 5218193 +
gagatatgtcccatcaatacct

SEQ ID NO: 82966 - DNA, 22 bp, Artificial Sequence
  Synthetic oligonucleotide; TTG chr11 5218172 5218193 5218189 5218194 +
agatatgtcccatcaataccta

SEQ ID NO: 82967 - DNA, 22 bp, Artificial Sequence
  Synthetic oligonucleotide; CTA chr11 5218194 5218215 5218211 5218216 +
atttattgagagtttttagcat

SEQ ID NO: 82968 - DNA, 22 bp, Artificial Sequence
  Synthetic oligonucleotide; TTT chr11 5218198 5218219 5218215 5218220 +
attgagagtttttagcatgaag

SEQ ID NO: 82969 - DNA, 22 bp, Artificial Sequence
  Synthetic oligonucleotide; TTA chr11 5218199 5218220 5218216 5218221 +
ttgagagtttttagcatgaagc

SEQ ID NO: 82970 - DNA, 22 bp, Artificial Sequence
  Synthetic oligonucleotide; TTG chr11 5218202 5218223 5218219 5218224 +
agagtttttagcatgaagcgtt

SEQ ID NO: 82971 - DNA, 22 bp, Artificial Sequence
  Synthetic oligonucleotide; TTT chr11 5218209 5218230 5218226 5218231 +
ttagcatgaagcgttgttgaat

SEQ ID NO: 82972 - DNA, 22 bp, Artificial Sequence
  Synthetic oligonucleotide; TTT chr11 5218210 5218231 5218227 5218232 +
tagcatgaagcgttgttgaatt

SEQ ID NO: 82973 - DNA, 22 bp, Artificial Sequence
  Synthetic oligonucleotide; TTT chr11 5218211 5218232 5218228 5218233 +
agcatgaagcgttgttgaattt

SEQ ID NO: 82974 - DNA, 22 bp, Artificial Sequence
  Synthetic oligonucleotide; TTA chr11 5218212 5218233 5218229 5218234 +
gcatgaagcgttgttgaatttt

SEQ ID NO: 82975 - DNA, 22 bp, Artificial Sequence
  Synthetic oligonucleotide; TTG chr11 5218225 5218246 5218242 5218247 +
ttgaattttgtcaaaggccttt

SEQ ID NO: 82976 - DNA, 22 bp, Artificial Sequence
  Synthetic oligonucleotide; TTG chr11 5218228 5218249 5218245 5218250 +
aattttgtcaaaggccttttct

SEQ ID NO: 82977 - DNA, 22 bp, Artificial Sequence
  Synthetic oligonucleotide; TTT chr11 5218233 5218254 5218250 5218255 +
tgtcaaaggccttttctgcatc

SEQ ID NO: 82978 - DNA, 22 bp, Artificial Sequence
  Synthetic oligonucleotide; TTT chr11 5218234 5218255 5218251 5218256 +
gtcaaaggccttttctgcatct

SEQ ID NO: 82979 - DNA, 22 bp, Artificial Sequence
  Synthetic oligonucleotide; TTG chr11 5218235 5218256 5218252 5218257 +
tcaaaggccttttctgcatcta

SEQ ID NO: 82980 - DNA, 22 bp, Artificial Sequence
  Synthetic oligonucleotide; CTT chr11 5218246 5218267 5218263 5218268 +
ttctgcatctattgagataatc

SEQ ID NO: 82981 - DNA, 22 bp, Artificial Sequence
  Synthetic oligonucleotide; TTT chr11 5218247 5218268 5218264 5218269 +
tctgcatctattgagataatca

SEQ ID NO: 82982 - DNA, 22 bp, Artificial Sequence
  Synthetic oligonucleotide; TTT chr11 5218248 5218269 5218265 5218270 +
ctgcatctattgagataatcat

SEQ ID NO: 82983 - DNA, 22 bp, Artificial Sequence
  Synthetic oligonucleotide; TTC chr11 5218249 5218270 5218266 5218271 +
tgcatctattgagataatcata

SEQ ID NO: 82984 - DNA, 22 bp, Artificial Sequence
  Synthetic oligonucleotide; CTG chr11 5218251 5218272 5218268 5218273 +
catctattgagataatcatatg

SEQ ID NO: 82985 - DNA, 22 bp, Artificial Sequence
  Synthetic oligonucleotide; CTA chr11 5218257 5218278 5218274 5218279 +
ttgagataatcatatggtttgt

SEQ ID NO: 82986 - DNA, 22 bp, Artificial Sequence
  Synthetic oligonucleotide; TTG chr11 5218260 5218281 5218277 5218282 +
agataatcatatggtttgtgtc

SEQ ID NO: 82987 - DNA, 22 bp, Artificial Sequence
  Synthetic oligonucleotide; TTT chr11 5218277 5218298 5218294 5218299 +
gtgtctttggttctgtttatat

SEQ ID NO: 82988 - DNA, 22 bp, Artificial Sequence
  Synthetic oligonucleotide; TTG chr11 5218278 5218299 5218295 5218300 +
tgtctttggttctgtttatatg

SEQ ID NO: 82989 - DNA, 22 bp, Artificial Sequence
  Synthetic oligonucleotide; CTT chr11 5218284 5218305 5218301 5218306 +
tggttctgtttatatgctggat

SEQ ID NO: 82990 - DNA, 22 bp, Artificial Sequence
  Synthetic oligonucleotide; TTT chr11 5218285 5218306 5218302 5218307 +
ggttctgtttatatgctggatt

SEQ ID NO: 82991 - DNA, 22 bp, Artificial Sequence
  Synthetic oligonucleotide; TTG chr11 5218286 5218307 5218303 5218308 +
gttctgtttatatgctggatta

SEQ ID NO: 82992 - DNA, 22 bp, Artificial Sequence
  Synthetic oligonucleotide; TTC chr11 5218290 5218311 5218307 5218312 +
tgtttatatgctggattatgtt

SEQ ID NO: 82993 - DNA, 22 bp, Artificial Sequence
  Synthetic oligonucleotide; CTG chr11 5218292 5218313 5218309 5218314 +
tttatatgctggattatgttta

SEQ ID NO: 82994 - DNA, 22 bp, Artificial Sequence
  Synthetic oligonucleotide; TTT chr11 5218295 5218316 5218312 5218317 +
atatgctggattatgtttattg

SEQ ID NO: 82995 - DNA, 22 bp, Artificial Sequence
  Synthetic oligonucleotide; TTA chr11 5218296 5218317 5218313 5218318 +
tatgctggattatgtttattga

SEQ ID NO: 82996 - DNA, 22 bp, Artificial Sequence
  Synthetic oligonucleotide; CTG chr11 5218303 5218324 5218320 5218325 +
gattatgtttattgattttcgt

SEQ ID NO: 82997 - DNA, 22 bp, Artificial Sequence
  Synthetic oligonucleotide; TTA chr11 5218308 5218329 5218325 5218330 +
tgtttattgattttcgtatgtt

SEQ ID NO: 82998 - DNA, 22 bp, Artificial Sequence
  Synthetic oligonucleotide; TTT chr11 5218313 5218334 5218330 5218335 +
attgattttcgtatgttgaacc

SEQ ID NO: 82999 - DNA, 22 bp, Artificial Sequence
  Synthetic oligonucleotide; TTA chr11 5218314 5218335 5218331 5218336 +
ttgattttcgtatgttgaacca

SEQ ID NO: 83000 - DNA, 22 bp, Artificial Sequence
  Synthetic oligonucleotide; TTG chr11 5218317 5218338 5218334 5218339 +
attttcgtatgttgaaccagcc

SEQ ID NO: 83001 - DNA, 22 bp, Artificial Sequence
  Synthetic oligonucleotide; TTT chr11 5218321 5218342 5218338 5218343 +
tcgtatgttgaaccagccttgc

SEQ ID NO: 83002 - DNA, 22 bp, Artificial Sequence
  Synthetic oligonucleotide; TTT chr11 5218322 5218343 5218339 5218344 +
cgtatgttgaaccagccttgca

SEQ ID NO: 83003 - DNA, 22 bp, Artificial Sequence
  Synthetic oligonucleotide; TTC chr11 5218323 5218344 5218340 5218345 +
gtatgttgaaccagccttgcat

SEQ ID NO: 83004 - DNA, 22 bp, Artificial Sequence
  Synthetic oligonucleotide; TTG chr11 5218331 5218352 5218348 5218353 +
aaccagccttgcatggcaggga

SEQ ID NO: 83005 - DNA, 22 bp, Artificial Sequence
  Synthetic oligonucleotide; CTT chr11 5218341 5218362 5218358 5218363 +
gcatggcagggatgaagcccac

SEQ ID NO: 83006 - DNA, 22 bp, Artificial Sequence
  Synthetic oligonucleotide; TTG chr11 5218342 5218363 5218359 5218364 +
catggcagggatgaagcccact

SEQ ID NO: 83007 - DNA, 22 bp, Artificial Sequence
  Synthetic oligonucleotide; CTT chr11 5218365 5218386 5218382 5218387 +
gatcatggtggatcagtttgcc

SEQ ID NO: 83008 - DNA, 22 bp, Artificial Sequence
  Synthetic oligonucleotide; TTG chr11 5218366 5218387 5218383 5218388 +
atcatggtggatcagtttgcca

SEQ ID NO: 83009 - DNA, 22 bp, Artificial Sequence
  Synthetic oligonucleotide; TTT chr11 5218384 5218405 5218401 5218406 +
gccagtattttattgaggattt

SEQ ID NO: 83010 - DNA, 22 bp, Artificial Sequence
  Synthetic oligonucleotide; TTG chr11 5218385 5218406 5218402 5218407 +
ccagtattttattgaggatttt

SEQ ID NO: 83011 - DNA, 22 bp, Artificial Sequence
  Synthetic oligonucleotide; TTT chr11 5218394 5218415 5218411 5218416 +
tattgaggatttttgcatcaat

SEQ ID NO: 83012 - DNA, 22 bp, Artificial Sequence
  Synthetic oligonucleotide; TTT chr11 5218395 5218416 5218412 5218417 +
attgaggatttttgcatcaatg

SEQ ID NO: 83013 - DNA, 22 bp, Artificial Sequence
  Synthetic oligonucleotide; TTA chr11 5218396 5218417 5218413 5218418 +
ttgaggatttttgcatcaatgt

SEQ ID NO: 83014 - DNA, 22 bp, Artificial Sequence
  Synthetic oligonucleotide; TTG chr11 5218399 5218420 5218416 5218421 +
aggatttttgcatcaatgttca

SEQ ID NO: 83015 - DNA, 22 bp, Artificial Sequence
  Synthetic oligonucleotide; TTT chr11 5218406 5218427 5218423 5218428 +
ttgcatcaatgttcatcaagga

SEQ ID NO: 83016 - DNA, 22 bp, Artificial Sequence
  Synthetic oligonucleotide; TTT chr11 5218407 5218428 5218424 5218429 +
tgcatcaatgttcatcaaggat

SEQ ID NO: 83017 - DNA, 22 bp, Artificial Sequence
  Synthetic oligonucleotide; TTT chr11 5218408 5218429 5218425 5218430 +
gcatcaatgttcatcaaggata

SEQ ID NO: 83018 - DNA, 22 bp, Artificial Sequence
  Synthetic oligonucleotide; TTG chr11 5218409 5218430 5218426 5218431 +
catcaatgttcatcaaggatat

SEQ ID NO: 83019 - DNA, 22 bp, Artificial Sequence
  Synthetic oligonucleotide; TTC chr11 5218420 5218441 5218437 5218442 +
atcaaggatattggtgtaacat

SEQ ID NO: 83020 - DNA, 22 bp, Artificial Sequence
  Synthetic oligonucleotide; TTG chr11 5218433 5218454 5218450 5218455 +
gtgtaacattctctttttttgt

SEQ ID NO: 83021 - DNA, 22 bp, Artificial Sequence
  Synthetic oligonucleotide; TTC chr11 5218444 5218465 5218461 5218466 +
tctttttttgttgtgtctctgt

SEQ ID NO: 83022 - DNA, 22 bp, Artificial Sequence
  Synthetic oligonucleotide; CTC chr11 5218446 5218467 5218463 5218468 +
tttttttgttgtgtctctgtca

SEQ ID NO: 83023 - DNA, 22 bp, Artificial Sequence
  Synthetic oligonucleotide; CTT chr11 5218448 5218469 5218465 5218470 +
tttttgttgtgtctctgtcagg

SEQ ID NO: 83024 - DNA, 22 bp, Artificial Sequence
  Synthetic oligonucleotide; TTT chr11 5218449 5218470 5218466 5218471 +
ttttgttgtgtctctgtcaggc

SEQ ID NO: 83025 - DNA, 22 bp, Artificial Sequence
  Synthetic oligonucleotide; TTT chr11 5218450 5218471 5218467 5218472 +
tttgttgtgtctctgtcaggct

SEQ ID NO: 83026 - DNA, 22 bp, Artificial Sequence
  Synthetic oligonucleotide; TTT chr11 5218451 5218472 5218468 5218473 +
ttgttgtgtctctgtcaggctt

SEQ ID NO: 83027 - DNA, 22 bp, Artificial Sequence
  Synthetic oligonucleotide; TTT chr11 5218452 5218473 5218469 5218474 +
tgttgtgtctctgtcaggcttt

SEQ ID NO: 83028 - DNA, 22 bp, Artificial Sequence
  Synthetic oligonucleotide; TTT chr11 5218453 5218474 5218470 5218475 +
gttgtgtctctgtcaggctttg

SEQ ID NO: 83029 - DNA, 22 bp, Artificial Sequence
  Synthetic oligonucleotide; TTG chr11 5218454 5218475 5218471 5218476 +
ttgtgtctctgtcaggctttgg

SEQ ID NO: 83030 - DNA, 22 bp, Artificial Sequence
  Synthetic oligonucleotide; TTG chr11 5218457 5218478 5218474 5218479 +
tgtctctgtcaggctttggtat

SEQ ID NO: 83031 - DNA, 22 bp, Artificial Sequence
  Synthetic oligonucleotide; CTC chr11 5218463 5218484 5218480 5218485 +
tgtcaggctttggtatcaggat

SEQ ID NO: 83032 - DNA, 22 bp, Artificial Sequence
  Synthetic oligonucleotide; CTG chr11 5218465 5218486 5218482 5218487 +
tcaggctttggtatcaggatga

SEQ ID NO: 83033 - DNA, 22 bp, Artificial Sequence
  Synthetic oligonucleotide; CTT chr11 5218473 5218494 5218490 5218495 +
tggtatcaggatgatgctggcc

SEQ ID NO: 83034 - DNA, 22 bp, Artificial Sequence
  Synthetic oligonucleotide; TTT chr11 5218474 5218495 5218491 5218496 +
ggtatcaggatgatgctggcct

SEQ ID NO: 83035 - DNA, 22 bp, Artificial Sequence
  Synthetic oligonucleotide; TTG chr11 5218475 5218496 5218492 5218497 +
gtatcaggatgatgctggcctc

SEQ ID NO: 83036 - DNA, 22 bp, Artificial Sequence
  Synthetic oligonucleotide; CTG chr11 5218492 5218513 5218509 5218514 +
gcctcataaaatgagttaggga

SEQ ID NO: 83037 - DNA, 22 bp, Artificial Sequence
  Synthetic oligonucleotide; CTC chr11 5218497 5218518 5218514 5218519 +
ataaaatgagttagggaggatt

SEQ ID NO: 83038 - DNA, 22 bp, Artificial Sequence
  Synthetic oligonucleotide; TTA chr11 5218510 5218531 5218527 5218532 +
gggaggattccctctttttcta

SEQ ID NO: 83039 - DNA, 22 bp, Artificial Sequence
  Synthetic oligonucleotide; TTC chr11 5218520 5218541 5218537 5218542 +
cctctttttctattgattggaa

SEQ ID NO: 83040 - DNA, 22 bp, Artificial Sequence
  Synthetic oligonucleotide; CTC chr11 5218524 5218545 5218541 5218546 +
tttttctattgattggaatagt

SEQ ID NO: 83041 - DNA, 22 bp, Artificial Sequence
  Synthetic oligonucleotide; CTT chr11 5218526 5218547 5218543 5218548 +
tttctattgattggaatagttt

SEQ ID NO: 83042 - DNA, 22 bp, Artificial Sequence
  Synthetic oligonucleotide; TTT chr11 5218527 5218548 5218544 5218549 +
ttctattgattggaatagtttc

SEQ ID NO: 83043 - DNA, 22 bp, Artificial Sequence
  Synthetic oligonucleotide; TTT chr11 5218528 5218549 5218545 5218550 +
tctattgattggaatagtttca

SEQ ID NO: 83044 - DNA, 22 bp, Artificial Sequence
  Synthetic oligonucleotide; TTT chr11 5218529 5218550 5218546 5218551 +
ctattgattggaatagtttcag

SEQ ID NO: 83045 - DNA, 22 bp, Artificial Sequence
  Synthetic oligonucleotide; TTC chr11 5218530 5218551 5218547 5218552 +
tattgattggaatagtttcaga

SEQ ID NO: 83046 - DNA, 22 bp, Artificial Sequence
  Synthetic oligonucleotide; CTA chr11 5218532 5218553 5218549 5218554 +
ttgattggaatagtttcagaag

SEQ ID NO: 83047 - DNA, 22 bp, Artificial Sequence
  Synthetic oligonucleotide; TTG chr11 5218535 5218556 5218552 5218557 +
attggaatagtttcagaaggaa

SEQ ID NO: 83048 - DNA, 22 bp, Artificial Sequence
  Synthetic oligonucleotide; TTG chr11 5218539 5218560 5218556 5218561 +
gaatagtttcagaaggaatggt

SEQ ID NO: 83049 - DNA, 22 bp, Artificial Sequence
  Synthetic oligonucleotide; TTT chr11 5218548 5218569 5218565 5218570 +
cagaaggaatggtaccagctcc

SEQ ID NO: 83050 - DNA, 22 bp, Artificial Sequence
  Synthetic oligonucleotide; TTC chr11 5218549 5218570 5218566 5218571 +
agaaggaatggtaccagctcct

SEQ ID NO: 83051 - DNA, 22 bp, Artificial Sequence
  Synthetic oligonucleotide; CTC chr11 5218569 5218590 5218586 5218591 +
ctccttgtacctctggtagaat

SEQ ID NO: 83052 - DNA, 22 bp, Artificial Sequence
  Synthetic oligonucleotide; CTC chr11 5218572 5218593 5218589 5218594 +
cttgtacctctggtagaattcg

SEQ ID NO: 83053 - DNA, 22 bp, Artificial Sequence
  Synthetic oligonucleotide; CTT chr11 5218575 5218596 5218592 5218597 +
gtacctctggtagaattcggct

SEQ ID NO: 83054 - DNA, 22 bp, Artificial Sequence
  Synthetic oligonucleotide; TTG chr11 5218576 5218597 5218593 5218598 +
tacctctggtagaattcggcta

SEQ ID NO: 83055 - DNA, 22 bp, Artificial Sequence
  Synthetic oligonucleotide; CTC chr11 5218582 5218603 5218599 5218604 +
tggtagaattcggctatgaatc

SEQ ID NO: 83056 - DNA, 22 bp, Artificial Sequence
  Synthetic oligonucleotide; CTG chr11 5218584 5218605 5218601 5218606 +
gtagaattcggctatgaatcct

SEQ ID NO: 83057 - DNA, 22 bp, Artificial Sequence
  Synthetic oligonucleotide; TTC chr11 5218593 5218614 5218610 5218615 +
ggctatgaatcctactggtccc

SEQ ID NO: 83058 - DNA, 22 bp, Artificial Sequence
  Synthetic oligonucleotide; CTA chr11 5218598 5218619 5218615 5218620 +
tgaatcctactggtcccggact

SEQ ID NO: 83059 - DNA, 22 bp, Artificial Sequence
  Synthetic oligonucleotide; CTA chr11 5218607 5218628 5218624 5218629 +
ctggtcccggactttttttggt

SEQ ID NO: 83060 - DNA, 22 bp, Artificial Sequence
  Synthetic oligonucleotide; CTG chr11 5218610 5218631 5218627 5218632 +
gtcccggactttttttggttga

SEQ ID NO: 83061 - DNA, 22 bp, Artificial Sequence
  Synthetic oligonucleotide; CTT chr11 5218621 5218642 5218638 5218643 +
tttttggttgataagctattaa

SEQ ID NO: 83062 - DNA, 22 bp, Artificial Sequence
  Synthetic oligonucleotide; TTT chr11 5218622 5218643 5218639 5218644 +
ttttggttgataagctattaat

SEQ ID NO: 83063 - DNA, 22 bp, Artificial Sequence
  Synthetic oligonucleotide; TTT chr11 5218623 5218644 5218640 5218645 +
tttggttgataagctattaatt

SEQ ID NO: 83064 - DNA, 22 bp, Artificial Sequence
  Synthetic oligonucleotide; TTT chr11 5218624 5218645 5218641 5218646 +
ttggttgataagctattaatta

SEQ ID NO: 83065 - DNA, 22 bp, Artificial Sequence
  Synthetic oligonucleotide; TTT chr11 5218625 5218646 5218642 5218647 +
tggttgataagctattaattat

SEQ ID NO: 83066 - DNA, 22 bp, Artificial Sequence
  Synthetic oligonucleotide; TTT chr11 5218626 5218647 5218643 5218648 +
ggttgataagctattaattatt

SEQ ID NO: 83067 - DNA, 22 bp, Artificial Sequence
  Synthetic oligonucleotide; TTG chr11 5218627 5218648 5218644 5218649 +
gttgataagctattaattattg

SEQ ID NO: 83068 - DNA, 22 bp, Artificial Sequence
  Synthetic oligonucleotide; TTG chr11 5218631 5218652 5218648 5218653 +
ataagctattaattattgcctc

SEQ ID NO: 83069 - DNA, 22 bp, Artificial Sequence
  Synthetic oligonucleotide; CTA chr11 5218639 5218660 5218656 5218661 +
ttaattattgcctcaatttcag

SEQ ID NO: 83070 - DNA, 22 bp, Artificial Sequence
  Synthetic oligonucleotide; TTA chr11 5218642 5218663 5218659 5218664 +
attattgcctcaatttcagagc

SEQ ID NO: 83071 - DNA, 22 bp, Artificial Sequence
  Synthetic oligonucleotide; TTA chr11 5218646 5218667 5218663 5218668 +
ttgcctcaatttcagagcctgt

SEQ ID NO: 83072 - DNA, 22 bp, Artificial Sequence
  Synthetic oligonucleotide; TTG chr11 5218649 5218670 5218666 5218671 +
cctcaatttcagagcctgttat

SEQ ID NO: 83073 - DNA, 22 bp, Artificial Sequence
  Synthetic oligonucleotide; CTC chr11 5218653 5218674 5218670 5218675 +
aatttcagagcctgttattggt

SEQ ID NO: 83074 - DNA, 22 bp, Artificial Sequence
  Synthetic oligonucleotide; TTT chr11 5218658 5218679 5218675 5218680 +
cagagcctgttattggtctatt

SEQ ID NO: 83075 - DNA, 22 bp, Artificial Sequence
  Synthetic oligonucleotide; TTC chr11 5218659 5218680 5218676 5218681 +
agagcctgttattggtctattc

SEQ ID NO: 83076 - DNA, 22 bp, Artificial Sequence
  Synthetic oligonucleotide; CTG chr11 5218667 5218688 5218684 5218689 +
ttattggtctattcagagatac

SEQ ID NO: 83077 - DNA, 22 bp, Artificial Sequence
  Synthetic oligonucleotide; TTA chr11 5218670 5218691 5218687 5218692 +
ttggtctattcagagatacaac

SEQ ID NO: 83078 - DNA, 22 bp, Artificial Sequence
  Synthetic oligonucleotide; TTG chr11 5218673 5218694 5218690 5218695 +
gtctattcagagatacaacttc

SEQ ID NO: 83079 - DNA, 22 bp, Artificial Sequence
  Synthetic oligonucleotide; CTA chr11 5218678 5218699 5218695 5218700 +
ttcagagatacaacttcttcct

SEQ ID NO: 83080 - DNA, 22 bp, Artificial Sequence
  Synthetic oligonucleotide; TTC chr11 5218681 5218702 5218698 5218703 +
agagatacaacttcttcctggt

SEQ ID NO: 83081 - DNA, 22 bp, Artificial Sequence
  Synthetic oligonucleotide; CTT chr11 5218694 5218715 5218711 5218716 +
cttcctggtttagtcttggcag

SEQ ID NO: 83082 - DNA, 22 bp, Artificial Sequence
  Synthetic oligonucleotide; TTC chr11 5218695 5218716 5218712 5218717 +
ttcctggtttagtcttggcaga

SEQ ID NO: 83083 - DNA, 22 bp, Artificial Sequence
  Synthetic oligonucleotide; CTT chr11 5218697 5218718 5218714 5218719 +
cctggtttagtcttggcagagt

SEQ ID NO: 83084 - DNA, 22 bp, Artificial Sequence
  Synthetic oligonucleotide; TTC chr11 5218698 5218719 5218715 5218720 +
ctggtttagtcttggcagagtg

SEQ ID NO: 83085 - DNA, 22 bp, Artificial Sequence
  Synthetic oligonucleotide; CTG chr11 5218701 5218722 5218718 5218723 +
gtttagtcttggcagagtgtat

SEQ ID NO: 83086 - DNA, 22 bp, Artificial Sequence
  Synthetic oligonucleotide; TTT chr11 5218705 5218726 5218722 5218727 +
agtcttggcagagtgtatgtgt

SEQ ID NO: 83087 - DNA, 22 bp, Artificial Sequence
  Synthetic oligonucleotide; TTA chr11 5218706 5218727 5218723 5218728 +
gtcttggcagagtgtatgtgtc

SEQ ID NO: 83088 - DNA, 22 bp, Artificial Sequence
  Synthetic oligonucleotide; CTT chr11 5218711 5218732 5218728 5218733 +
ggcagagtgtatgtgtcgagga

SEQ ID NO: 83089 - DNA, 22 bp, Artificial Sequence
  Synthetic oligonucleotide; TTG chr11 5218712 5218733 5218729 5218734 +
gcagagtgtatgtgtcgaggaa

SEQ ID NO: 83090 - DNA, 22 bp, Artificial Sequence
  Synthetic oligonucleotide; TTT chr11 5218737 5218758 5218754 5218759 +
atccatttcttctagattttct

SEQ ID NO: 83091 - DNA, 22 bp, Artificial Sequence
  Synthetic oligonucleotide; TTA chr11 5218738 5218759 5218755 5218760 +
tccatttcttctagattttcta

SEQ ID NO: 83092 - DNA, 22 bp, Artificial Sequence
  Synthetic oligonucleotide; TTT chr11 5218745 5218766 5218762 5218767 +
cttctagattttctagtttatt

SEQ ID NO: 83093 - DNA, 22 bp, Artificial Sequence
  Synthetic oligonucleotide; TTC chr11 5218746 5218767 5218763 5218768 +
ttctagattttctagtttattt

SEQ ID NO: 83094 - DNA, 22 bp, Artificial Sequence
  Synthetic oligonucleotide; CTT chr11 5218748 5218769 5218765 5218770 +
ctagattttctagtttatttgc

SEQ ID NO: 83095 - DNA, 22 bp, Artificial Sequence
  Synthetic oligonucleotide; TTC chr11 5218749 5218770 5218766 5218771 +
tagattttctagtttatttgcg

SEQ ID NO: 83096 - DNA, 22 bp, Artificial Sequence
  Synthetic oligonucleotide; CTA chr11 5218751 5218772 5218768 5218773 +
gattttctagtttatttgcgta

SEQ ID NO: 83097 - DNA, 22 bp, Artificial Sequence
  Synthetic oligonucleotide; TTT chr11 5218756 5218777 5218773 5218778 +
tctagtttatttgcgtagaggt

SEQ ID NO: 83098 - DNA, 22 bp, Artificial Sequence
  Synthetic oligonucleotide; TTT chr11 5218757 5218778 5218774 5218779 +
ctagtttatttgcgtagaggtg

SEQ ID NO: 83099 - DNA, 22 bp, Artificial Sequence
  Synthetic oligonucleotide; TTC chr11 5218758 5218779 5218775 5218780 +
tagtttatttgcgtagaggtgt

SEQ ID NO: 83100 - DNA, 22 bp, Artificial Sequence
  Synthetic oligonucleotide; CTA chr11 5218760 5218781 5218777 5218782 +
gtttatttgcgtagaggtgttt

SEQ ID NO: 83101 - DNA, 22 bp, Artificial Sequence
  Synthetic oligonucleotide; TTT chr11 5218764 5218785 5218781 5218786 +
atttgcgtagaggtgtttatag

SEQ ID NO: 83102 - DNA, 22 bp, Artificial Sequence
  Synthetic oligonucleotide; TTA chr11 5218765 5218786 5218782 5218787 +
tttgcgtagaggtgtttatagt

SEQ ID NO: 83103 - DNA, 22 bp, Artificial Sequence
  Synthetic oligonucleotide; TTT chr11 5218768 5218789 5218785 5218790 +
gcgtagaggtgtttatagtatt

SEQ ID NO: 83104 - DNA, 22 bp, Artificial Sequence
  Synthetic oligonucleotide; TTG chr11 5218769 5218790 5218786 5218791 +
cgtagaggtgtttatagtattc

SEQ ID NO: 83105 - DNA, 22 bp, Artificial Sequence
  Synthetic oligonucleotide; TTT chr11 5218782 5218803 5218799 5218804 +
atagtattctctgacggtagtt

SEQ ID NO: 83106 - DNA, 22 bp, Artificial Sequence
  Synthetic oligonucleotide; TTA chr11 5218783 5218804 5218800 5218805 +
tagtattctctgacggtagttt

SEQ ID NO: 83107 - DNA, 22 bp, Artificial Sequence
  Synthetic oligonucleotide; TTC chr11 5218791 5218812 5218808 5218813 +
tctgacggtagtttgtatttct

SEQ ID NO: 83108 - DNA, 22 bp, Artificial Sequence
  Synthetic oligonucleotide; CTC chr11 5218793 5218814 5218810 5218815 +
tgacggtagtttgtatttctgt

SEQ ID NO: 83109 - DNA, 22 bp, Artificial Sequence
  Synthetic oligonucleotide; CTG chr11 5218795 5218816 5218812 5218817 +
acggtagtttgtatttctgtgg

SEQ ID NO: 83110 - DNA, 22 bp, Artificial Sequence
  Synthetic oligonucleotide; TTT chr11 5218805 5218826 5218822 5218827 +
gtatttctgtgggatcagtggt

SEQ ID NO: 83111 - DNA, 22 bp, Artificial Sequence
  Synthetic oligonucleotide; TTG chr11 5218806 5218827 5218823 5218828 +
tatttctgtgggatcagtggtg

SEQ ID NO: 83112 - DNA, 22 bp, Artificial Sequence
  Synthetic oligonucleotide; TTT chr11 5218811 5218832 5218828 5218833 +
ctgtgggatcagtggtgatacc

SEQ ID NO: 83113 - DNA, 22 bp, Artificial Sequence
  Synthetic oligonucleotide; TTC chr11 5218812 5218833 5218829 5218834 +
tgtgggatcagtggtgataccc

SEQ ID NO: 83114 - DNA, 22 bp, Artificial Sequence
  Synthetic oligonucleotide; CTG chr11 5218814 5218835 5218831 5218836 +
tgggatcagtggtgataccccg

SEQ ID NO: 83115 - DNA, 22 bp, Artificial Sequence
  Synthetic oligonucleotide; TTT chr11 5218844 5218865 5218861 5218866 +
tttattgcgtctatttgattct

SEQ ID NO: 83116 - DNA, 22 bp, Artificial Sequence
  Synthetic oligonucleotide; TTT chr11 5218845 5218866 5218862 5218867 +
ttattgcgtctatttgattctt

SEQ ID NO: 83117 - DNA, 22 bp, Artificial Sequence
  Synthetic oligonucleotide; TTT chr11 5218846 5218867 5218863 5218868 +
tattgcgtctatttgattcttc

SEQ ID NO: 83118 - DNA, 22 bp, Artificial Sequence
  Synthetic oligonucleotide; TTT chr11 5218847 5218868 5218864 5218869 +
attgcgtctatttgattcttct

SEQ ID NO: 83119 - DNA, 22 bp, Artificial Sequence
  Synthetic oligonucleotide; TTA chr11 5218848 5218869 5218865 5218870 +
ttgcgtctatttgattcttctc

SEQ ID NO: 83120 - DNA, 22 bp, Artificial Sequence
  Synthetic oligonucleotide; TTG chr11 5218851 5218872 5218868 5218873 +
cgtctatttgattcttctctct

SEQ ID NO: 83121 - DNA, 22 bp, Artificial Sequence
  Synthetic oligonucleotide; CTA chr11 5218857 5218878 5218874 5218879 +
tttgattcttctctcttttctt

SEQ ID NO: 83122 - DNA, 22 bp, Artificial Sequence
  Synthetic oligonucleotide; TTT chr11 5218860 5218881 5218877 5218882 +
gattcttctctcttttcttctt

SEQ ID NO: 83123 - DNA, 22 bp, Artificial Sequence
  Synthetic oligonucleotide; TTG chr11 5218861 5218882 5218878 5218883 +
attcttctctcttttcttcttt

SEQ ID NO: 83124 - DNA, 22 bp, Artificial Sequence
  Synthetic oligonucleotide; TTC chr11 5218865 5218886 5218882 5218887 +
ttctctcttttcttctttatta

SEQ ID NO: 83125 - DNA, 22 bp, Artificial Sequence
  Synthetic oligonucleotide; CTT chr11 5218867 5218888 5218884 5218889 +
ctctcttttcttctttattagt

SEQ ID NO: 83126 - DNA, 22 bp, Artificial Sequence
  Synthetic oligonucleotide; TTC chr11 5218868 5218889 5218885 5218890 +
tctcttttcttctttattagtc

SEQ ID NO: 83127 - DNA, 22 bp, Artificial Sequence
  Synthetic oligonucleotide; CTC chr11 5218870 5218891 5218887 5218892 +
tcttttcttctttattagtctt

SEQ ID NO: 83128 - DNA, 22 bp, Artificial Sequence
  Synthetic oligonucleotide; CTC chr11 5218872 5218893 5218889 5218894 +
ttttcttctttattagtcttgc

SEQ ID NO: 83129 - DNA, 22 bp, Artificial Sequence
  Synthetic oligonucleotide; CTT chr11 5218874 5218895 5218891 5218896 +
ttcttctttattagtcttgcta

SEQ ID NO: 83130 - DNA, 22 bp, Artificial Sequence
  Synthetic oligonucleotide; TTT chr11 5218875 5218896 5218892 5218897 +
tcttctttattagtcttgctag

SEQ ID NO: 83131 - DNA, 22 bp, Artificial Sequence
  Synthetic oligonucleotide; TTT chr11 5218876 5218897 5218893 5218898 +
cttctttattagtcttgctagc

SEQ ID NO: 83132 - DNA, 22 bp, Artificial Sequence
  Synthetic oligonucleotide; TTC chr11 5218877 5218898 5218894 5218899 +
ttctttattagtcttgctagca

SEQ ID NO: 83133 - DNA, 22 bp, Artificial Sequence
  Synthetic oligonucleotide; CTT chr11 5218879 5218900 5218896 5218901 +
ctttattagtcttgctagcagt

SEQ ID NO: 83134 - DNA, 22 bp, Artificial Sequence
  Synthetic oligonucleotide; TTC chr11 5218880 5218901 5218897 5218902 +
tttattagtcttgctagcagtc

SEQ ID NO: 83135 - DNA, 22 bp, Artificial Sequence
  Synthetic oligonucleotide; CTT chr11 5218882 5218903 5218899 5218904 +
tattagtcttgctagcagtcta

SEQ ID NO: 83136 - DNA, 22 bp, Artificial Sequence
  Synthetic oligonucleotide; TTT chr11 5218883 5218904 5218900 5218905 +
attagtcttgctagcagtctat

SEQ ID NO: 83137 - DNA, 22 bp, Artificial Sequence
  Synthetic oligonucleotide; TTA chr11 5218884 5218905 5218901 5218906 +
ttagtcttgctagcagtctatc

SEQ ID NO: 83138 - DNA, 22 bp, Artificial Sequence
  Synthetic oligonucleotide; TTA chr11 5218887 5218908 5218904 5218909 +
gtcttgctagcagtctatcaat

SEQ ID NO: 83139 - DNA, 22 bp, Artificial Sequence
  Synthetic oligonucleotide; CTT chr11 5218892 5218913 5218909 5218914 +
gctagcagtctatcaattttgt

SEQ ID NO: 83140 - DNA, 22 bp, Artificial Sequence
  Synthetic oligonucleotide; TTG chr11 5218893 5218914 5218910 5218915 +
ctagcagtctatcaattttgtt

SEQ ID NO: 83141 - DNA, 22 bp, Artificial Sequence
  Synthetic oligonucleotide; CTA chr11 5218896 5218917 5218913 5218918 +
gcagtctatcaattttgttgat

SEQ ID NO: 83142 - DNA, 22 bp, Artificial Sequence
  Synthetic oligonucleotide; CTA chr11 5218904 5218925 5218921 5218926 +
tcaattttgttgatcttttcaa

SEQ ID NO: 83143 - DNA, 22 bp, Artificial Sequence
  Synthetic oligonucleotide; TTT chr11 5218911 5218932 5218928 5218933 +
tgttgatcttttcaaaaaaaca

SEQ ID NO: 83144 - DNA, 22 bp, Artificial Sequence
  Synthetic oligonucleotide; TTT chr11 5218912 5218933 5218929 5218934 +
gttgatcttttcaaaaaaacag

SEQ ID NO: 83145 - DNA, 22 bp, Artificial Sequence
  Synthetic oligonucleotide; TTG chr11 5218913 5218934 5218930 5218935 +
ttgatcttttcaaaaaaacagc

SEQ ID NO: 83146 - DNA, 22 bp, Artificial Sequence
  Synthetic oligonucleotide; TTG chr11 5218916 5218937 5218933 5218938 +
atcttttcaaaaaaacagcttc

SEQ ID NO: 83147 - DNA, 22 bp, Artificial Sequence
  Synthetic oligonucleotide; CTT chr11 5218921 5218942 5218938 5218943 +
ttcaaaaaaacagcttctggat

SEQ ID NO: 83148 - DNA, 22 bp, Artificial Sequence
  Synthetic oligonucleotide; TTT chr11 5218922 5218943 5218939 5218944 +
tcaaaaaaacagcttctggatt

SEQ ID NO: 83149 - DNA, 22 bp, Artificial Sequence
  Synthetic oligonucleotide; TTT chr11 5218923 5218944 5218940 5218945 +
caaaaaaacagcttctggattc

SEQ ID NO: 83150 - DNA, 22 bp, Artificial Sequence
  Synthetic oligonucleotide; TTC chr11 5218924 5218945 5218941 5218946 +
aaaaaaacagcttctggattca

SEQ ID NO: 83151 - DNA, 22 bp, Artificial Sequence
  Synthetic oligonucleotide; CTT chr11 5218937 5218958 5218954 5218959 +
ctggattcattgatttttttga

SEQ ID NO: 83152 - DNA, 22 bp, Artificial Sequence
  Synthetic oligonucleotide; TTC chr11 5218938 5218959 5218955 5218960 +
tggattcattgatttttttgaa

SEQ ID NO: 83153 - DNA, 22 bp, Artificial Sequence
  Synthetic oligonucleotide; CTG chr11 5218940 5218961 5218957 5218962 +
gattcattgatttttttgaagg

SEQ ID NO: 83154 - DNA, 22 bp, Artificial Sequence
  Synthetic oligonucleotide; TTC chr11 5218945 5218966 5218962 5218967 +
attgatttttttgaagggtttt

SEQ ID NO: 83155 - DNA, 22 bp, Artificial Sequence
  Synthetic oligonucleotide; TTG chr11 5218949 5218970 5218966 5218971 +
atttttttgaagggtttttttg

SEQ ID NO: 83156 - DNA, 22 bp, Artificial Sequence
  Synthetic oligonucleotide; TTT chr11 5218953 5218974 5218970 5218975 +
ttttgaagggtttttttgtgtc

SEQ ID NO: 83157 - DNA, 22 bp, Artificial Sequence
  Synthetic oligonucleotide; TTT chr11 5218954 5218975 5218971 5218976 +
tttgaagggtttttttgtgtct

SEQ ID NO: 83158 - DNA, 22 bp, Artificial Sequence
  Synthetic oligonucleotide; TTT chr11 5218955 5218976 5218972 5218977 +
ttgaagggtttttttgtgtctc

SEQ ID NO: 83159 - DNA, 22 bp, Artificial Sequence
  Synthetic oligonucleotide; TTT chr11 5218956 5218977 5218973 5218978 +
tgaagggtttttttgtgtctct

SEQ ID NO: 83160 - DNA, 22 bp, Artificial Sequence
  Synthetic oligonucleotide; TTT chr11 5218957 5218978 5218974 5218979 +
gaagggtttttttgtgtctcta

SEQ ID NO: 83161 - DNA, 22 bp, Artificial Sequence
  Synthetic oligonucleotide; TTG chr11 5218958 5218979 5218975 5218980 +
aagggtttttttgtgtctctat

SEQ ID NO: 83162 - DNA, 22 bp, Artificial Sequence
  Synthetic oligonucleotide; TTT chr11 5218966 5218987 5218983 5218988 +
ttttgtgtctctatgtccttca

SEQ ID NO: 83163 - DNA, 22 bp, Artificial Sequence
  Synthetic oligonucleotide; TTT chr11 5218967 5218988 5218984 5218989 +
tttgtgtctctatgtccttcac

SEQ ID NO: 83164 - DNA, 22 bp, Artificial Sequence
  Synthetic oligonucleotide; TTT chr11 5218968 5218989 5218985 5218990 +
ttgtgtctctatgtccttcact

SEQ ID NO: 83165 - DNA, 22 bp, Artificial Sequence
  Synthetic oligonucleotide; TTT chr11 5218969 5218990 5218986 5218991 +
tgtgtctctatgtccttcactt

SEQ ID NO: 83166 - DNA, 22 bp, Artificial Sequence
  Synthetic oligonucleotide; TTT chr11 5218970 5218991 5218987 5218992 +
gtgtctctatgtccttcacttc

SEQ ID NO: 83167 - DNA, 22 bp, Artificial Sequence
  Synthetic oligonucleotide; TTG chr11 5218971 5218992 5218988 5218993 +
tgtctctatgtccttcacttct

SEQ ID NO: 83168 - DNA, 22 bp, Artificial Sequence
  Synthetic oligonucleotide; CTC chr11 5218977 5218998 5218994 5218999 +
tatgtccttcacttctgctctg

SEQ ID NO: 83169 - DNA, 22 bp, Artificial Sequence
  Synthetic oligonucleotide; CTA chr11 5218979 5219000 5218996 5219001 +
tgtccttcacttctgctctgat

SEQ ID NO: 83170 - DNA, 22 bp, Artificial Sequence
  Synthetic oligonucleotide; CTT chr11 5218986 5219007 5219003 5219008 +
cacttctgctctgatcttagtt

SEQ ID NO: 83171 - DNA, 22 bp, Artificial Sequence
  Synthetic oligonucleotide; TTC chr11 5218987 5219008 5219004 5219009 +
acttctgctctgatcttagtta

SEQ ID NO: 83172 - DNA, 22 bp, Artificial Sequence
  Synthetic oligonucleotide; CTT chr11 5218991 5219012 5219008 5219013 +
ctgctctgatcttagttatttc

SEQ ID NO: 83173 - DNA, 22 bp, Artificial Sequence
  Synthetic oligonucleotide; TTC chr11 5218992 5219013 5219009 5219014 +
tgctctgatcttagttatttct

SEQ ID NO: 83174 - DNA, 22 bp, Artificial Sequence
  Synthetic oligonucleotide; CTG chr11 5218994 5219015 5219011 5219016 +
ctctgatcttagttatttcttg

SEQ ID NO: 83175 - DNA, 22 bp, Artificial Sequence
  Synthetic oligonucleotide; CTC chr11 5218997 5219018 5219014 5219019 +
tgatcttagttatttcttgtct

SEQ ID NO: 83176 - DNA, 22 bp, Artificial Sequence
  Synthetic oligonucleotide; CTG chr11 5218999 5219020 5219016 5219021 +
atcttagttatttcttgtcttc

SEQ ID NO: 83177 - DNA, 22 bp, Artificial Sequence
  Synthetic oligonucleotide; CTT chr11 5219004 5219025 5219021 5219026 +
agttatttcttgtcttctgtta

SEQ ID NO: 83178 - DNA, 22 bp, Artificial Sequence
  Synthetic oligonucleotide; TTA chr11 5219005 5219026 5219022 5219027 +
gttatttcttgtcttctgttag

SEQ ID NO: 83179 - DNA, 22 bp, Artificial Sequence
  Synthetic oligonucleotide; TTA chr11 5219009 5219030 5219026 5219031 +
tttcttgtcttctgttagcttt

SEQ ID NO: 83180 - DNA, 22 bp, Artificial Sequence
  Synthetic oligonucleotide; TTT chr11 5219012 5219033 5219029 5219034 +
cttgtcttctgttagcttttga

SEQ ID NO: 83181 - DNA, 22 bp, Artificial Sequence
  Synthetic oligonucleotide; TTC chr11 5219013 5219034 5219030 5219035 +
ttgtcttctgttagcttttgaa

SEQ ID NO: 83182 - DNA, 22 bp, Artificial Sequence
  Synthetic oligonucleotide; CTT chr11 5219015 5219036 5219032 5219037 +
gtcttctgttagcttttgaatg

SEQ ID NO: 83183 - DNA, 22 bp, Artificial Sequence
  Synthetic oligonucleotide; TTG chr11 5219016 5219037 5219033 5219038 +
tcttctgttagcttttgaatgt

SEQ ID NO: 83184 - DNA, 22 bp, Artificial Sequence
  Synthetic oligonucleotide; CTT chr11 5219020 5219041 5219037 5219042 +
ctgttagcttttgaatgtgttt

SEQ ID NO: 83185 - DNA, 22 bp, Artificial Sequence
  Synthetic oligonucleotide; TTC chr11 5219021 5219042 5219038 5219043 +
tgttagcttttgaatgtgtttg

SEQ ID NO: 83186 - DNA, 22 bp, Artificial Sequence
  Synthetic oligonucleotide; CTG chr11 5219023 5219044 5219040 5219045 +
ttagcttttgaatgtgtttgct

SEQ ID NO: 83187 - DNA, 22 bp, Artificial Sequence
  Synthetic oligonucleotide; TTA chr11 5219026 5219047 5219043 5219048 +
gcttttgaatgtgtttgctcct

SEQ ID NO: 83188 - DNA, 22 bp, Artificial Sequence
  Synthetic oligonucleotide; CTT chr11 5219030 5219051 5219047 5219052 +
ttgaatgtgtttgctcctgctt

SEQ ID NO: 83189 - DNA, 22 bp, Artificial Sequence
  Synthetic oligonucleotide; TTT chr11 5219031 5219052 5219048 5219053 +
tgaatgtgtttgctcctgcttc

SEQ ID NO: 83190 - DNA, 22 bp, Artificial Sequence
  Synthetic oligonucleotide; TTT chr11 5219032 5219053 5219049 5219054 +
gaatgtgtttgctcctgcttct

SEQ ID NO: 83191 - DNA, 22 bp, Artificial Sequence
  Synthetic oligonucleotide; TTG chr11 5219033 5219054 5219050 5219055 +
aatgtgtttgctcctgcttctc

SEQ ID NO: 83192 - DNA, 22 bp, Artificial Sequence
  Synthetic oligonucleotide; TTT chr11 5219042 5219063 5219059 5219064 +
gctcctgcttctctagtttttt

SEQ ID NO: 83193 - DNA, 22 bp, Artificial Sequence
  Synthetic oligonucleotide; TTG chr11 5219043 5219064 5219060 5219065 +
ctcctgcttctctagtttttta

SEQ ID NO: 83194 - DNA, 22 bp, Artificial Sequence
  Synthetic oligonucleotide; CTC chr11 5219046 5219067 5219063 5219068 +
ctgcttctctagttttttaatt

SEQ ID NO: 83195 - DNA, 22 bp, Artificial Sequence
  Synthetic oligonucleotide; CTG chr11 5219049 5219070 5219066 5219071 +
cttctctagttttttaattgtg

SEQ ID NO: 83196 - DNA, 22 bp, Artificial Sequence
  Synthetic oligonucleotide; CTT chr11 5219052 5219073 5219069 5219074 +
ctctagttttttaattgtgatg

SEQ ID NO: 83197 - DNA, 22 bp, Artificial Sequence
  Synthetic oligonucleotide; TTC chr11 5219053 5219074 5219070 5219075 +
tctagttttttaattgtgatgt

SEQ ID NO: 83198 - DNA, 22 bp, Artificial Sequence
  Synthetic oligonucleotide; CTC chr11 5219055 5219076 5219072 5219077 +
tagttttttaattgtgatgtta

SEQ ID NO: 83199 - DNA, 22 bp, Artificial Sequence
  Synthetic oligonucleotide; CTA chr11 5219057 5219078 5219074 5219079 +
gttttttaattgtgatgttagg

SEQ ID NO: 83200 - DNA, 22 bp, Artificial Sequence
  Synthetic oligonucleotide; TTT chr11 5219061 5219082 5219078 5219083 +
tttaattgtgatgttagggtgt

SEQ ID NO: 83201 - DNA, 22 bp, Artificial Sequence
  Synthetic oligonucleotide; TTT chr11 5219062 5219083 5219079 5219084 +
ttaattgtgatgttagggtgtc

SEQ ID NO: 83202 - DNA, 22 bp, Artificial Sequence
  Synthetic oligonucleotide; TTT chr11 5219063 5219084 5219080 5219085 +
taattgtgatgttagggtgtca

SEQ ID NO: 83203 - DNA, 22 bp, Artificial Sequence
  Synthetic oligonucleotide; TTT chr11 5219064 5219085 5219081 5219086 +
aattgtgatgttagggtgtcaa

SEQ ID NO: 83204 - DNA, 22 bp, Artificial Sequence
  Synthetic oligonucleotide; TTA chr11 5219065 5219086 5219082 5219087 +
attgtgatgttagggtgtcaat

SEQ ID NO: 83205 - DNA, 22 bp, Artificial Sequence
  Synthetic oligonucleotide; TTG chr11 5219069 5219090 5219086 5219091 +
tgatgttagggtgtcaatttta

SEQ ID NO: 83206 - DNA, 22 bp, Artificial Sequence
  Synthetic oligonucleotide; TTA chr11 5219077 5219098 5219094 5219099 +
gggtgtcaattttagatctttc

SEQ ID NO: 83207 - DNA, 22 bp, Artificial Sequence
  Synthetic oligonucleotide; TTT chr11 5219089 5219110 5219106 5219111 +
tagatctttcctgctttccctt

SEQ ID NO: 83208 - DNA, 22 bp, Artificial Sequence
  Synthetic oligonucleotide; TTT chr11 5219090 5219111 5219107 5219112 +
agatctttcctgctttcccttg

SEQ ID NO: 83209 - DNA, 22 bp, Artificial Sequence
  Synthetic oligonucleotide; TTA chr11 5219091 5219112 5219108 5219113 +
gatctttcctgctttcccttgt

SEQ ID NO: 83210 - DNA, 22 bp, Artificial Sequence
  Synthetic oligonucleotide; CTT chr11 5219097 5219118 5219114 5219119 +
tcctgctttcccttgtgggcat

SEQ ID NO: 83211 - DNA, 22 bp, Artificial Sequence
  Synthetic oligonucleotide; TTT chr11 5219098 5219119 5219115 5219120 +
cctgctttcccttgtgggcatt

SEQ ID NO: 83212 - DNA, 22 bp, Artificial Sequence
  Synthetic oligonucleotide; TTC chr11 5219099 5219120 5219116 5219121 +
ctgctttcccttgtgggcattt

SEQ ID NO: 83213 - DNA, 22 bp, Artificial Sequence
  Synthetic oligonucleotide; CTG chr11 5219102 5219123 5219119 5219124 +
ctttcccttgtgggcatttagt

SEQ ID NO: 83214 - DNA, 22 bp, Artificial Sequence
  Synthetic oligonucleotide; CTT chr11 5219105 5219126 5219122 5219127 +
tcccttgtgggcatttagtgct

SEQ ID NO: 83215 - DNA, 22 bp, Artificial Sequence
  Synthetic oligonucleotide; TTT chr11 5219106 5219127 5219123 5219128 +
cccttgtgggcatttagtgcta

SEQ ID NO: 83216 - DNA, 22 bp, Artificial Sequence
  Synthetic oligonucleotide; TTC chr11 5219107 5219128 5219124 5219129 +
ccttgtgggcatttagtgctat

SEQ ID NO: 83217 - DNA, 22 bp, Artificial Sequence
  Synthetic oligonucleotide; CTT chr11 5219111 5219132 5219128 5219133 +
gtgggcatttagtgctataaat

SEQ ID NO: 83218 - DNA, 22 bp, Artificial Sequence
  Synthetic oligonucleotide; TTG chr11 5219112 5219133 5219129 5219134 +
tgggcatttagtgctataaatt

SEQ ID NO: 83219 - DNA, 22 bp, Artificial Sequence
  Synthetic oligonucleotide; TTT chr11 5219121 5219142 5219138 5219143 +
agtgctataaatttccctctac

SEQ ID NO: 83220 - DNA, 22 bp, Artificial Sequence
  Synthetic oligonucleotide; TTA chr11 5219122 5219143 5219139 5219144 +
gtgctataaatttccctctaca

SEQ ID NO: 83221 - DNA, 22 bp, Artificial Sequence
  Synthetic oligonucleotide; CTA chr11 5219128 5219149 5219145 5219150 +
taaatttccctctacacactgc

SEQ ID NO: 83222 - DNA, 22 bp, Artificial Sequence
  Synthetic oligonucleotide; TTT chr11 5219135 5219156 5219152 5219157 +
ccctctacacactgctttgaat

SEQ ID NO: 83223 - DNA, 22 bp, Artificial Sequence
  Synthetic oligonucleotide; TTC chr11 5219136 5219157 5219153 5219158 +
cctctacacactgctttgaatg

SEQ ID NO: 83224 - DNA, 22 bp, Artificial Sequence
  Synthetic oligonucleotide; CTC chr11 5219140 5219161 5219157 5219162 +
tacacactgctttgaatgtgtc

SEQ ID NO: 83225 - DNA, 22 bp, Artificial Sequence
  Synthetic oligonucleotide; CTA chr11 5219142 5219163 5219159 5219164 +
cacactgctttgaatgtgtctc

SEQ ID NO: 83226 - DNA, 22 bp, Artificial Sequence
  Synthetic oligonucleotide; CTG chr11 5219149 5219170 5219166 5219171 +
ctttgaatgtgtctcagagatt

SEQ ID NO: 83227 - DNA, 22 bp, Artificial Sequence
  Synthetic oligonucleotide; CTT chr11 5219152 5219173 5219169 5219174 +
tgaatgtgtctcagagattctg

SEQ ID NO: 83228 - DNA, 22 bp, Artificial Sequence
  Synthetic oligonucleotide; TTT chr11 5219153 5219174 5219170 5219175 +
gaatgtgtctcagagattctgg

SEQ ID NO: 83229 - DNA, 22 bp, Artificial Sequence
  Synthetic oligonucleotide; TTG chr11 5219154 5219175 5219171 5219176 +
aatgtgtctcagagattctggt

SEQ ID NO: 83230 - DNA, 22 bp, Artificial Sequence
  Synthetic oligonucleotide; CTC chr11 5219164 5219185 5219181 5219186 +
agagattctggtgtgttgtgtc

SEQ ID NO: 83231 - DNA, 22 bp, Artificial Sequence
  Synthetic oligonucleotide; TTC chr11 5219172 5219193 5219189 5219194 +
tggtgtgttgtgtctttgttct

SEQ ID NO: 83232 - DNA, 22 bp, Artificial Sequence
  Synthetic oligonucleotide; CTG chr11 5219174 5219195 5219191 5219196 +
gtgtgttgtgtctttgttctcg

SEQ ID NO: 83233 - DNA, 22 bp, Artificial Sequence
  Synthetic oligonucleotide; TTG chr11 5219182 5219203 5219199 5219204 +
tgtctttgttctcgttggtttc

SEQ ID NO: 83234 - DNA, 22 bp, Artificial Sequence
  Synthetic oligonucleotide; CTT chr11 5219188 5219209 5219205 5219210 +
tgttctcgttggtttcaaagaa

SEQ ID NO: 83235 - DNA, 22 bp, Artificial Sequence
  Synthetic oligonucleotide; TTT chr11 5219189 5219210 5219206 5219211 +
gttctcgttggtttcaaagaac

SEQ ID NO: 83236 - DNA, 22 bp, Artificial Sequence
  Synthetic oligonucleotide; TTG chr11 5219190 5219211 5219207 5219212 +
ttctcgttggtttcaaagaaca

SEQ ID NO: 83237 - DNA, 22 bp, Artificial Sequence
  Synthetic oligonucleotide; TTC chr11 5219193 5219214 5219210 5219215 +
tcgttggtttcaaagaacatct

SEQ ID NO: 83238 - DNA, 22 bp, Artificial Sequence
  Synthetic oligonucleotide; CTC chr11 5219195 5219216 5219212 5219217 +
gttggtttcaaagaacatcttt

SEQ ID NO: 83239 - DNA, 22 bp, Artificial Sequence
  Synthetic oligonucleotide; TTG chr11 5219199 5219220 5219216 5219221 +
gtttcaaagaacatctttattt

SEQ ID NO: 83240 - DNA, 22 bp, Artificial Sequence
  Synthetic oligonucleotide; TTT chr11 5219203 5219224 5219220 5219225 +
caaagaacatctttatttctgc

SEQ ID NO: 83241 - DNA, 22 bp, Artificial Sequence
  Synthetic oligonucleotide; TTC chr11 5219204 5219225 5219221 5219226 +
aaagaacatctttatttctgcc

SEQ ID NO: 83242 - DNA, 22 bp, Artificial Sequence
  Synthetic oligonucleotide; CTT chr11 5219216 5219237 5219233 5219238 +
tatttctgccttcattttgtta

SEQ ID NO: 83243 - DNA, 22 bp, Artificial Sequence
  Synthetic oligonucleotide; TTT chr11 5219217 5219238 5219234 5219239 +
atttctgccttcattttgttat

SEQ ID NO: 83244 - DNA, 22 bp, Artificial Sequence
  Synthetic oligonucleotide; TTA chr11 5219218 5219239 5219235 5219240 +
tttctgccttcattttgttatg

SEQ ID NO: 83245 - DNA, 22 bp, Artificial Sequence
  Synthetic oligonucleotide; TTT chr11 5219221 5219242 5219238 5219243 +
ctgccttcattttgttatgtac

SEQ ID NO: 83246 - DNA, 22 bp, Artificial Sequence
  Synthetic oligonucleotide; TTC chr11 5219222 5219243 5219239 5219244 +
tgccttcattttgttatgtacc

SEQ ID NO: 83247 - DNA, 22 bp, Artificial Sequence
  Synthetic oligonucleotide; CTG chr11 5219224 5219245 5219241 5219246 +
ccttcattttgttatgtaccca

SEQ ID NO: 83248 - DNA, 22 bp, Artificial Sequence
  Synthetic oligonucleotide; CTT chr11 5219228 5219249 5219245 5219250 +
cattttgttatgtacccagtag

SEQ ID NO: 83249 - DNA, 22 bp, Artificial Sequence
  Synthetic oligonucleotide; TTC chr11 5219229 5219250 5219246 5219251 +
attttgttatgtacccagtagt

SEQ ID NO: 83250 - DNA, 22 bp, Artificial Sequence
  Synthetic oligonucleotide; TTT chr11 5219233 5219254 5219250 5219255 +
tgttatgtacccagtagtcatt

SEQ ID NO: 83251 - DNA, 22 bp, Artificial Sequence
  Synthetic oligonucleotide; TTT chr11 5219234 5219255 5219251 5219256 +
gttatgtacccagtagtcattc

SEQ ID NO: 83252 - DNA, 22 bp, Artificial Sequence
  Synthetic oligonucleotide; TTG chr11 5219235 5219256 5219252 5219257 +
ttatgtacccagtagtcattca

SEQ ID NO: 83253 - DNA, 22 bp, Artificial Sequence
  Synthetic oligonucleotide; TTA chr11 5219238 5219259 5219255 5219260 +
tgtacccagtagtcattcagga

SEQ ID NO: 83254 - DNA, 22 bp, Artificial Sequence
  Synthetic oligonucleotide; TTC chr11 5219256 5219277 5219273 5219278 +
aggagcaggctgttcagtttcc

SEQ ID NO: 83255 - DNA, 22 bp, Artificial Sequence
  Synthetic oligonucleotide; CTG chr11 5219268 5219289 5219285 5219290 +
ttcagtttccatgtagctgagt

SEQ ID NO: 83256 - DNA, 22 bp, Artificial Sequence
  Synthetic oligonucleotide; TTC chr11 5219271 5219292 5219288 5219293 +
agtttccatgtagctgagtggt

SEQ ID NO: 83257 - DNA, 22 bp, Artificial Sequence
  Synthetic oligonucleotide; TTT chr11 5219276 5219297 5219293 5219298 +
ccatgtagctgagtggttttga

SEQ ID NO: 83258 - DNA, 22 bp, Artificial Sequence
  Synthetic oligonucleotide; TTC chr11 5219277 5219298 5219294 5219299 +
catgtagctgagtggttttgag

SEQ ID NO: 83259 - DNA, 22 bp, Artificial Sequence
  Synthetic oligonucleotide; CTG chr11 5219287 5219308 5219304 5219309 +
agtggttttgagtgagtttctt

SEQ ID NO: 83260 - DNA, 22 bp, Artificial Sequence
  Synthetic oligonucleotide; TTT chr11 5219295 5219316 5219312 5219317 +
tgagtgagtttcttaatcctga

SEQ ID NO: 83261 - DNA, 22 bp, Artificial Sequence
  Synthetic oligonucleotide; TTT chr11 5219296 5219317 5219313 5219318 +
gagtgagtttcttaatcctgag

SEQ ID NO: 83262 - DNA, 22 bp, Artificial Sequence
  Synthetic oligonucleotide; TTG chr11 5219297 5219318 5219314 5219319 +
agtgagtttcttaatcctgagt

SEQ ID NO: 83263 - DNA, 22 bp, Artificial Sequence
  Synthetic oligonucleotide; TTT chr11 5219306 5219327 5219323 5219328 +
cttaatcctgagttctagtttg

SEQ ID NO: 83264 - DNA, 22 bp, Artificial Sequence
  Synthetic oligonucleotide; TTC chr11 5219307 5219328 5219324 5219329 +
ttaatcctgagttctagtttga

SEQ ID NO: 83265 - DNA, 22 bp, Artificial Sequence
  Synthetic oligonucleotide; CTT chr11 5219309 5219330 5219326 5219331 +
aatcctgagttctagtttgatt

SEQ ID NO: 83266 - DNA, 22 bp, Artificial Sequence
  Synthetic oligonucleotide; TTA chr11 5219310 5219331 5219327 5219332 +
atcctgagttctagtttgattg

SEQ ID NO: 83267 - DNA, 22 bp, Artificial Sequence
  Synthetic oligonucleotide; CTG chr11 5219316 5219337 5219333 5219338 +
agttctagtttgattgcactgt

SEQ ID NO: 83268 - DNA, 22 bp, Artificial Sequence
  Synthetic oligonucleotide; TTC chr11 5219321 5219342 5219338 5219343 +
tagtttgattgcactgtggtct

SEQ ID NO: 83269 - DNA, 22 bp, Artificial Sequence
  Synthetic oligonucleotide; CTA chr11 5219323 5219344 5219340 5219345 +
gtttgattgcactgtggtctga

SEQ ID NO: 83270 - DNA, 22 bp, Artificial Sequence
  Synthetic oligonucleotide; TTT chr11 5219327 5219348 5219344 5219349 +
gattgcactgtggtctgagaga

SEQ ID NO: 83271 - DNA, 22 bp, Artificial Sequence
  Synthetic oligonucleotide; TTG chr11 5219328 5219349 5219345 5219350 +
attgcactgtggtctgagagac

SEQ ID NO: 83272 - DNA, 22 bp, Artificial Sequence
  Synthetic oligonucleotide; TTG chr11 5219332 5219353 5219349 5219354 +
cactgtggtctgagagacagtt

SEQ ID NO: 83273 - DNA, 22 bp, Artificial Sequence
  Synthetic oligonucleotide; CTG chr11 5219337 5219358 5219354 5219359 +
tggtctgagagacagtttgtta

SEQ ID NO: 83274 - DNA, 22 bp, Artificial Sequence
  Synthetic oligonucleotide; CTG chr11 5219344 5219365 5219361 5219366 +
agagacagtttgttatagtttc

SEQ ID NO: 83275 - DNA, 22 bp, Artificial Sequence
  Synthetic oligonucleotide; TTT chr11 5219355 5219376 5219372 5219377 +
gttatagtttctgttcttttac

SEQ ID NO: 83276 - DNA, 22 bp, Artificial Sequence
  Synthetic oligonucleotide; TTG chr11 5219356 5219377 5219373 5219378 +
ttatagtttctgttcttttaca

SEQ ID NO: 83277 - DNA, 22 bp, Artificial Sequence
  Synthetic oligonucleotide; TTA chr11 5219359 5219380 5219376 5219381 +
tagtttctgttcttttacattt

SEQ ID NO: 83278 - DNA, 22 bp, Artificial Sequence
  Synthetic oligonucleotide; TTT chr11 5219365 5219386 5219382 5219387 +
ctgttcttttacatttgctgag

SEQ ID NO: 83279 - DNA, 22 bp, Artificial Sequence
  Synthetic oligonucleotide; TTC chr11 5219366 5219387 5219383 5219388 +
tgttcttttacatttgctgagg

SEQ ID NO: 83280 - DNA, 22 bp, Artificial Sequence
  Synthetic oligonucleotide; CTG chr11 5219368 5219389 5219385 5219390 +
ttcttttacatttgctgaggag

SEQ ID NO: 83281 - DNA, 22 bp, Artificial Sequence
  Synthetic oligonucleotide; TTC chr11 5219371 5219392 5219388 5219393 +
ttttacatttgctgaggagagc

SEQ ID NO: 83282 - DNA, 22 bp, Artificial Sequence
  Synthetic oligonucleotide; CTT chr11 5219373 5219394 5219390 5219395 +
ttacatttgctgaggagagctt

SEQ ID NO: 83283 - DNA, 22 bp, Artificial Sequence
  Synthetic oligonucleotide; TTT chr11 5219374 5219395 5219391 5219396 +
tacatttgctgaggagagcttt

SEQ ID NO: 83284 - DNA, 22 bp, Artificial Sequence
  Synthetic oligonucleotide; TTT chr11 5219375 5219396 5219392 5219397 +
acatttgctgaggagagcttta

SEQ ID NO: 83285 - DNA, 22 bp, Artificial Sequence
  Synthetic oligonucleotide; TTA chr11 5219376 5219397 5219393 5219398 +
catttgctgaggagagctttac

SEQ ID NO: 83286 - DNA, 22 bp, Artificial Sequence
  Synthetic oligonucleotide; TTT chr11 5219381 5219402 5219398 5219403 +
gctgaggagagctttacttcca

SEQ ID NO: 83287 - DNA, 22 bp, Artificial Sequence
  Synthetic oligonucleotide; TTG chr11 5219382 5219403 5219399 5219404 +
ctgaggagagctttacttccaa

SEQ ID NO: 83288 - DNA, 22 bp, Artificial Sequence
  Synthetic oligonucleotide; CTG chr11 5219385 5219406 5219402 5219407 +
aggagagctttacttccaacta

SEQ ID NO: 83289 - DNA, 22 bp, Artificial Sequence
  Synthetic oligonucleotide; CTT chr11 5219395 5219416 5219412 5219417 +
tacttccaactatgtggtcagt

SEQ ID NO: 83290 - DNA, 22 bp, Artificial Sequence
  Synthetic oligonucleotide; TTT chr11 5219396 5219417 5219413 5219418 +
acttccaactatgtggtcagtt

SEQ ID NO: 83291 - DNA, 22 bp, Artificial Sequence
  Synthetic oligonucleotide; TTA chr11 5219397 5219418 5219414 5219419 +
cttccaactatgtggtcagttt

SEQ ID NO: 83292 - DNA, 22 bp, Artificial Sequence
  Synthetic oligonucleotide; CTT chr11 5219400 5219421 5219417 5219422 +
ccaactatgtggtcagttttgg

SEQ ID NO: 83293 - DNA, 22 bp, Artificial Sequence
  Synthetic oligonucleotide; TTC chr11 5219401 5219422 5219418 5219423 +
caactatgtggtcagttttgga

SEQ ID NO: 83294 - DNA, 22 bp, Artificial Sequence
  Synthetic oligonucleotide; CTA chr11 5219407 5219428 5219424 5219429 +
tgtggtcagttttggaataggt

SEQ ID NO: 83295 - DNA, 22 bp, Artificial Sequence
  Synthetic oligonucleotide; TTT chr11 5219419 5219440 5219436 5219441 +
tggaataggtgtggtgtggtgc

SEQ ID NO: 83296 - DNA, 22 bp, Artificial Sequence
  Synthetic oligonucleotide; TTT chr11 5219420 5219441 5219437 5219442 +
ggaataggtgtggtgtggtgct

SEQ ID NO: 83297 - DNA, 22 bp, Artificial Sequence
  Synthetic oligonucleotide; TTG chr11 5219421 5219442 5219438 5219443 +
gaataggtgtggtgtggtgctg

SEQ ID NO: 83298 - DNA, 22 bp, Artificial Sequence
  Synthetic oligonucleotide; CTG chr11 5219443 5219464 5219460 5219465 +
aaaagaatgtatattctgttga

SEQ ID NO: 83299 - DNA, 22 bp, Artificial Sequence
  Synthetic oligonucleotide; TTC chr11 5219459 5219480 5219476 5219481 +
tgttgatttggggtggagagtt

SEQ ID NO: 83300 - DNA, 22 bp, Artificial Sequence
  Synthetic oligonucleotide; CTG chr11 5219461 5219482 5219478 5219483 +
ttgatttggggtggagagttct

SEQ ID NO: 83301 - DNA, 22 bp, Artificial Sequence
  Synthetic oligonucleotide; TTG chr11 5219464 5219485 5219481 5219486 +
atttggggtggagagttctgta

SEQ ID NO: 83302 - DNA, 22 bp, Artificial Sequence
  Synthetic oligonucleotide; TTT chr11 5219468 5219489 5219485 5219490 +
ggggtggagagttctgtagatg

SEQ ID NO: 83303 - DNA, 22 bp, Artificial Sequence
  Synthetic oligonucleotide; TTG chr11 5219469 5219490 5219486 5219491 +
gggtggagagttctgtagatgt

SEQ ID NO: 83304 - DNA, 22 bp, Artificial Sequence
  Synthetic oligonucleotide; TTC chr11 5219482 5219503 5219499 5219504 +
tgtagatgtctattaggtctgc

SEQ ID NO: 83305 - DNA, 22 bp, Artificial Sequence
  Synthetic oligonucleotide; CTG chr11 5219484 5219505 5219501 5219506 +
tagatgtctattaggtctgctt

SEQ ID NO: 83306 - DNA, 22 bp, Artificial Sequence
  Synthetic oligonucleotide; CTA chr11 5219494 5219515 5219511 5219516 +
ttaggtctgcttggtgcagagc

SEQ ID NO: 83307 - DNA, 22 bp, Artificial Sequence
  Synthetic oligonucleotide; TTA chr11 5219497 5219518 5219514 5219519 +
ggtctgcttggtgcagagctga

SEQ ID NO: 83308 - DNA, 22 bp, Artificial Sequence
  Synthetic oligonucleotide; CTG chr11 5219503 5219524 5219520 5219525 +
cttggtgcagagctgagtccaa

SEQ ID NO: 83309 - DNA, 22 bp, Artificial Sequence
  Synthetic oligonucleotide; CTT chr11 5219506 5219527 5219523 5219528 +
ggtgcagagctgagtccaattc

SEQ ID NO: 83310 - DNA, 22 bp, Artificial Sequence
  Synthetic oligonucleotide; TTG chr11 5219507 5219528 5219524 5219529 +
gtgcagagctgagtccaattcc

SEQ ID NO: 83311 - DNA, 22 bp, Artificial Sequence
  Synthetic oligonucleotide; CTG chr11 5219518 5219539 5219535 5219540 +
agtccaattcctggatatcctt

SEQ ID NO: 83312 - DNA, 22 bp, Artificial Sequence
  Synthetic oligonucleotide; TTC chr11 5219528 5219549 5219545 5219550 +
ctggatatccttgttaactttc

SEQ ID NO: 83313 - DNA, 22 bp, Artificial Sequence
  Synthetic oligonucleotide; CTG chr11 5219531 5219552 5219548 5219553 +
gatatccttgttaactttctgt

SEQ ID NO: 83314 - DNA, 22 bp, Artificial Sequence
  Synthetic oligonucleotide; CTT chr11 5219540 5219561 5219557 5219562 +
gttaactttctgtctcgttgat

SEQ ID NO: 83315 - DNA, 22 bp, Artificial Sequence
  Synthetic oligonucleotide; TTG chr11 5219541 5219562 5219558 5219563 +
ttaactttctgtctcgttgatc

SEQ ID NO: 83316 - DNA, 22 bp, Artificial Sequence
  Synthetic oligonucleotide; TTA chr11 5219544 5219565 5219561 5219566 +
actttctgtctcgttgatctgt

SEQ ID NO: 83317 - DNA, 22 bp, Artificial Sequence
  Synthetic oligonucleotide; CTT chr11 5219548 5219569 5219565 5219570 +
tctgtctcgttgatctgtctaa

SEQ ID NO: 83318 - DNA, 22 bp, Artificial Sequence
  Synthetic oligonucleotide; TTT chr11 5219549 5219570 5219566 5219571 +
ctgtctcgttgatctgtctaat

SEQ ID NO: 83319 - DNA, 22 bp, Artificial Sequence
  Synthetic oligonucleotide; TTC chr11 5219550 5219571 5219567 5219572 +
tgtctcgttgatctgtctaatg

SEQ ID NO: 83320 - DNA, 22 bp, Artificial Sequence
  Synthetic oligonucleotide; CTG chr11 5219552 5219573 5219569 5219574 +
tctcgttgatctgtctaatgtt

SEQ ID NO: 83321 - DNA, 22 bp, Artificial Sequence
  Synthetic oligonucleotide; CTC chr11 5219556 5219577 5219573 5219578 +
gttgatctgtctaatgttgaca

SEQ ID NO: 83322 - DNA, 22 bp, Artificial Sequence
  Synthetic oligonucleotide; TTG chr11 5219560 5219581 5219577 5219582 +
atctgtctaatgttgacagtgg

SEQ ID NO: 83323 - DNA, 22 bp, Artificial Sequence
  Synthetic oligonucleotide; CTG chr11 5219565 5219586 5219582 5219587 +
tctaatgttgacagtggggtgt

SEQ ID NO: 83324 - DNA, 22 bp, Artificial Sequence
  Synthetic oligonucleotide; CTA chr11 5219569 5219590 5219586 5219591 +
atgttgacagtggggtgttaaa

SEQ ID NO: 83325 - DNA, 22 bp, Artificial Sequence
  Synthetic oligonucleotide; TTG chr11 5219575 5219596 5219592 5219597 +
acagtggggtgttaaagtctcc

SEQ ID NO: 83326 - DNA, 22 bp, Artificial Sequence
  Synthetic oligonucleotide; TTA chr11 5219589 5219610 5219606 5219611 +
aagtctcccattattattgtgt

SEQ ID NO: 83327 - DNA, 22 bp, Artificial Sequence
  Synthetic oligonucleotide; CTC chr11 5219596 5219617 5219613 5219618 +
ccattattattgtgtgggcatc

SEQ ID NO: 83328 - DNA, 22 bp, Artificial Sequence
  Synthetic oligonucleotide; TTA chr11 5219602 5219623 5219619 5219624 +
ttattgtgtgggcatctaagtc

SEQ ID NO: 83329 - DNA, 22 bp, Artificial Sequence
  Synthetic oligonucleotide; TTA chr11 5219605 5219626 5219622 5219627 +
ttgtgtgggcatctaagtctct

SEQ ID NO: 83330 - DNA, 22 bp, Artificial Sequence
  Synthetic oligonucleotide; TTG chr11 5219608 5219629 5219625 5219630 +
tgtgggcatctaagtctctttg

SEQ ID NO: 83331 - DNA, 22 bp, Artificial Sequence
  Synthetic oligonucleotide; CTA chr11 5219620 5219641 5219637 5219642 +
agtctctttgtaggtcactcag

SEQ ID NO: 83332 - DNA, 22 bp, Artificial Sequence
  Synthetic oligonucleotide; CTC chr11 5219626 5219647 5219643 5219648 +
tttgtaggtcactcaggacttg

SEQ ID NO: 83333 - DNA, 22 bp, Artificial Sequence
  Synthetic oligonucleotide; CTT chr11 5219628 5219649 5219645 5219650 +
tgtaggtcactcaggacttgtt

SEQ ID NO: 83334 - DNA, 22 bp, Artificial Sequence
  Synthetic oligonucleotide; TTT chr11 5219629 5219650 5219646 5219651 +
gtaggtcactcaggacttgttt

SEQ ID NO: 83335 - DNA, 22 bp, Artificial Sequence
  Synthetic oligonucleotide; TTG chr11 5219630 5219651 5219647 5219652 +
taggtcactcaggacttgtttt

SEQ ID NO: 83336 - DNA, 22 bp, Artificial Sequence
  Synthetic oligonucleotide; CTC chr11 5219640 5219661 5219657 5219662 +
aggacttgttttatgaatctgg

SEQ ID NO: 83337 - DNA, 22 bp, Artificial Sequence
  Synthetic oligonucleotide; CTT chr11 5219647 5219668 5219664 5219669 +
gttttatgaatctgggtgctcc

SEQ ID NO: 83338 - DNA, 22 bp, Artificial Sequence
  Synthetic oligonucleotide; TTG chr11 5219648 5219669 5219665 5219670 +
ttttatgaatctgggtgctcct

SEQ ID NO: 83339 - DNA, 22 bp, Artificial Sequence
  Synthetic oligonucleotide; TTT chr11 5219651 5219672 5219668 5219673 +
tatgaatctgggtgctcctgta

SEQ ID NO: 83340 - DNA, 22 bp, Artificial Sequence
  Synthetic oligonucleotide; TTT chr11 5219652 5219673 5219669 5219674 +
atgaatctgggtgctcctgtat

SEQ ID NO: 83341 - DNA, 22 bp, Artificial Sequence
  Synthetic oligonucleotide; TTA chr11 5219653 5219674 5219670 5219675 +
tgaatctgggtgctcctgtatt

SEQ ID NO: 83342 - DNA, 22 bp, Artificial Sequence
  Synthetic oligonucleotide; CTG chr11 5219661 5219682 5219678 5219683 +
ggtgctcctgtattgggtgcat

SEQ ID NO: 83343 - DNA, 22 bp, Artificial Sequence
  Synthetic oligonucleotide; CTC chr11 5219668 5219689 5219685 5219690 +
ctgtattgggtgcatatatatt

SEQ ID NO: 83344 - DNA, 22 bp, Artificial Sequence
  Synthetic oligonucleotide; CTG chr11 5219671 5219692 5219688 5219693 +
tattgggtgcatatatatttag

SEQ ID NO: 83345 - DNA, 22 bp, Artificial Sequence
  Synthetic oligonucleotide; TTG chr11 5219676 5219697 5219693 5219698 +
ggtgcatatatatttagtatag

SEQ ID NO: 83346 - DNA, 22 bp, Artificial Sequence
  Synthetic oligonucleotide; TTT chr11 5219691 5219712 5219708 5219713 +
agtatagttagttcttcttctt

SEQ ID NO: 83347 - DNA, 22 bp, Artificial Sequence
  Synthetic oligonucleotide; TTA chr11 5219692 5219713 5219709 5219714 +
gtatagttagttcttcttcttg

SEQ ID NO: 83348 - DNA, 22 bp, Artificial Sequence
  Synthetic oligonucleotide; TTA chr11 5219701 5219722 5219718 5219723 +
gttcttcttcttgaatagatcc

SEQ ID NO: 83349 - DNA, 22 bp, Artificial Sequence
  Synthetic oligonucleotide; TTC chr11 5219705 5219726 5219722 5219727 +
ttcttcttgaatagatcccttt

SEQ ID NO: 83350 - DNA, 22 bp, Artificial Sequence
  Synthetic oligonucleotide; CTT chr11 5219707 5219728 5219724 5219729 +
cttcttgaatagatccctttgc

SEQ ID NO: 83351 - DNA, 22 bp, Artificial Sequence
  Synthetic oligonucleotide; TTC chr11 5219708 5219729 5219725 5219730 +
ttcttgaatagatccctttgcc

SEQ ID NO: 83352 - DNA, 22 bp, Artificial Sequence
  Synthetic oligonucleotide; CTT chr11 5219710 5219731 5219727 5219732 +
cttgaatagatccctttgccat

SEQ ID NO: 83353 - DNA, 22 bp, Artificial Sequence
  Synthetic oligonucleotide; TTC chr11 5219711 5219732 5219728 5219733 +
ttgaatagatccctttgccatt

SEQ ID NO: 83354 - DNA, 22 bp, Artificial Sequence
  Synthetic oligonucleotide; CTT chr11 5219713 5219734 5219730 5219735 +
gaatagatccctttgccattat

SEQ ID NO: 83355 - DNA, 22 bp, Artificial Sequence
  Synthetic oligonucleotide; TTG chr11 5219714 5219735 5219731 5219736 +
aatagatccctttgccattatg

SEQ ID NO: 83356 - DNA, 22 bp, Artificial Sequence
  Synthetic oligonucleotide; CTT chr11 5219726 5219747 5219743 5219748 +
tgccattatgtaatggccttct

SEQ ID NO: 83357 - DNA, 22 bp, Artificial Sequence
  Synthetic oligonucleotide; TTT chr11 5219727 5219748 5219744 5219749 +
gccattatgtaatggccttctt

SEQ ID NO: 83358 - DNA, 22 bp, Artificial Sequence
  Synthetic oligonucleotide; TTG chr11 5219728 5219749 5219745 5219750 +
ccattatgtaatggccttcttt

SEQ ID NO: 83359 - DNA, 22 bp, Artificial Sequence
  Synthetic oligonucleotide; TTA chr11 5219734 5219755 5219751 5219756 +
tgtaatggccttctttgtctct

SEQ ID NO: 83360 - DNA, 22 bp, Artificial Sequence
  Synthetic oligonucleotide; CTT chr11 5219746 5219767 5219763 5219768 +
ctttgtctcttttgatctttgt

SEQ ID NO: 83361 - DNA, 22 bp, Artificial Sequence
  Synthetic oligonucleotide; TTC chr11 5219747 5219768 5219764 5219769 +
tttgtctcttttgatctttgtt

SEQ ID NO: 83362 - DNA, 22 bp, Artificial Sequence
  Synthetic oligonucleotide; CTT chr11 5219749 5219770 5219766 5219771 +
tgtctcttttgatctttgttgg

SEQ ID NO: 83363 - DNA, 22 bp, Artificial Sequence
  Synthetic oligonucleotide; TTT chr11 5219750 5219771 5219767 5219772 +
gtctcttttgatctttgttggt

SEQ ID NO: 83364 - DNA, 22 bp, Artificial Sequence
  Synthetic oligonucleotide; TTG chr11 5219751 5219772 5219768 5219773 +
tctcttttgatctttgttggtt

SEQ ID NO: 83365 - DNA, 22 bp, Artificial Sequence
  Synthetic oligonucleotide; CTC chr11 5219755 5219776 5219772 5219777 +
ttttgatctttgttggtttaaa

SEQ ID NO: 83366 - DNA, 22 bp, Artificial Sequence
  Synthetic oligonucleotide; CTT chr11 5219757 5219778 5219774 5219779 +
ttgatctttgttggtttaaaat

SEQ ID NO: 83367 - DNA, 22 bp, Artificial Sequence
  Synthetic oligonucleotide; TTT chr11 5219758 5219779 5219775 5219780 +
tgatctttgttggtttaaaatc

SEQ ID NO: 83368 - DNA, 22 bp, Artificial Sequence
  Synthetic oligonucleotide; TTT chr11 5219759 5219780 5219776 5219781 +
gatctttgttggtttaaaatct

SEQ ID NO: 83369 - DNA, 22 bp, Artificial Sequence
  Synthetic oligonucleotide; TTG chr11 5219760 5219781 5219777 5219782 +
atctttgttggtttaaaatctg

SEQ ID NO: 83370 - DNA, 22 bp, Artificial Sequence
  Synthetic oligonucleotide; CTT chr11 5219765 5219786 5219782 5219787 +
tgttggtttaaaatctgtttta

SEQ ID NO: 83371 - DNA, 22 bp, Artificial Sequence
  Synthetic oligonucleotide; TTT chr11 5219766 5219787 5219783 5219788 +
gttggtttaaaatctgttttat

SEQ ID NO: 83372 - DNA, 22 bp, Artificial Sequence
  Synthetic oligonucleotide; TTG chr11 5219767 5219788 5219784 5219789 +
ttggtttaaaatctgttttatc

SEQ ID NO: 83373 - DNA, 22 bp, Artificial Sequence
  Synthetic oligonucleotide; TTG chr11 5219770 5219791 5219787 5219792 +
gtttaaaatctgttttatcaga

SEQ ID NO: 83374 - DNA, 22 bp, Artificial Sequence
  Synthetic oligonucleotide; TTT chr11 5219774 5219795 5219791 5219796 +
aaaatctgttttatcagagact

SEQ ID NO: 83375 - DNA, 22 bp, Artificial Sequence
  Synthetic oligonucleotide; TTA chr11 5219775 5219796 5219792 5219797 +
aaatctgttttatcagagacta

SEQ ID NO: 83376 - DNA, 22 bp, Artificial Sequence
  Synthetic oligonucleotide; CTG chr11 5219782 5219803 5219799 5219804 +
ttttatcagagactaggattgc

SEQ ID NO: 83377 - DNA, 22 bp, Artificial Sequence
  Synthetic oligonucleotide; TTT chr11 5219785 5219806 5219802 5219807 +
tatcagagactaggattgcaac

SEQ ID NO: 83378 - DNA, 22 bp, Artificial Sequence
  Synthetic oligonucleotide; TTT chr11 5219786 5219807 5219803 5219808 +
atcagagactaggattgcaacc

SEQ ID NO: 83379 - DNA, 22 bp, Artificial Sequence
  Synthetic oligonucleotide; TTA chr11 5219787 5219808 5219804 5219809 +
tcagagactaggattgcaaccc

SEQ ID NO: 83380 - DNA, 22 bp, Artificial Sequence
  Synthetic oligonucleotide; CTA chr11 5219797 5219818 5219814 5219819 +
ggattgcaacccctgccttttt

SEQ ID NO: 83381 - DNA, 22 bp, Artificial Sequence
  Synthetic oligonucleotide; TTG chr11 5219803 5219824 5219820 5219825 +
caacccctgcctttttttgttt

SEQ ID NO: 83382 - DNA, 22 bp, Artificial Sequence
  Synthetic oligonucleotide; CTG chr11 5219812 5219833 5219829 5219834 +
cctttttttgttttccatttgc

SEQ ID NO: 83383 - DNA, 22 bp, Artificial Sequence
  Synthetic oligonucleotide; CTT chr11 5219816 5219837 5219833 5219838 +
tttttgttttccatttgcttgg

SEQ ID NO: 83384 - DNA, 22 bp, Artificial Sequence
  Synthetic oligonucleotide; TTT chr11 5219817 5219838 5219834 5219839 +
ttttgttttccatttgcttggt

SEQ ID NO: 83385 - DNA, 22 bp, Artificial Sequence
  Synthetic oligonucleotide; TTT chr11 5219818 5219839 5219835 5219840 +
tttgttttccatttgcttggta

SEQ ID NO: 83386 - DNA, 22 bp, Artificial Sequence
  Synthetic oligonucleotide; TTT chr11 5219819 5219840 5219836 5219841 +
ttgttttccatttgcttggtag

SEQ ID NO: 83387 - DNA, 22 bp, Artificial Sequence
  Synthetic oligonucleotide; TTT chr11 5219820 5219841 5219837 5219842 +
tgttttccatttgcttggtaga

SEQ ID NO: 83388 - DNA, 22 bp, Artificial Sequence
  Synthetic oligonucleotide; TTT chr11 5219821 5219842 5219838 5219843 +
gttttccatttgcttggtagat

SEQ ID NO: 83389 - DNA, 22 bp, Artificial Sequence
  Synthetic oligonucleotide; TTG chr11 5219822 5219843 5219839 5219844 +
ttttccatttgcttggtagata

SEQ ID NO: 83390 - DNA, 22 bp, Artificial Sequence
  Synthetic oligonucleotide; TTT chr11 5219825 5219846 5219842 5219847 +
tccatttgcttggtagatattc

SEQ ID NO: 83391 - DNA, 22 bp, Artificial Sequence
  Synthetic oligonucleotide; TTT chr11 5219826 5219847 5219843 5219848 +
ccatttgcttggtagatattcc

SEQ ID NO: 83392 - DNA, 22 bp, Artificial Sequence
  Synthetic oligonucleotide; TTC chr11 5219827 5219848 5219844 5219849 +
catttgcttggtagatattcct

SEQ ID NO: 83393 - DNA, 22 bp, Artificial Sequence
  Synthetic oligonucleotide; TTT chr11 5219832 5219853 5219849 5219854 +
gcttggtagatattcctccatc

SEQ ID NO: 83394 - DNA, 22 bp, Artificial Sequence
  Synthetic oligonucleotide; TTG chr11 5219833 5219854 5219850 5219855 +
cttggtagatattcctccatcc

SEQ ID NO: 83395 - DNA, 22 bp, Artificial Sequence
  Synthetic oligonucleotide; CTT chr11 5219836 5219857 5219853 5219858 +
ggtagatattcctccatccttt

SEQ ID NO: 83396 - DNA, 22 bp, Artificial Sequence
  Synthetic oligonucleotide; TTG chr11 5219837 5219858 5219854 5219859 +
gtagatattcctccatcctttt

SEQ ID NO: 83397 - DNA, 22 bp, Artificial Sequence
  Synthetic oligonucleotide; TTC chr11 5219847 5219868 5219864 5219869 +
ctccatccttttatttcgagcc

SEQ ID NO: 83398 - DNA, 22 bp, Artificial Sequence
  Synthetic oligonucleotide; CTC chr11 5219850 5219871 5219867 5219872 +
catccttttatttcgagcctat

SEQ ID NO: 83399 - DNA, 22 bp, Artificial Sequence
  Synthetic oligonucleotide; CTT chr11 5219857 5219878 5219874 5219879 +
ttatttcgagcctatgtgtgtc

SEQ ID NO: 83400 - DNA, 22 bp, Artificial Sequence
  Synthetic oligonucleotide; TTT chr11 5219858 5219879 5219875 5219880 +
tatttcgagcctatgtgtgtct

SEQ ID NO: 83401 - DNA, 22 bp, Artificial Sequence
  Synthetic oligonucleotide; TTT chr11 5219859 5219880 5219876 5219881 +
atttcgagcctatgtgtgtctc

SEQ ID NO: 83402 - DNA, 22 bp, Artificial Sequence
  Synthetic oligonucleotide; TTA chr11 5219860 5219881 5219877 5219882 +
tttcgagcctatgtgtgtctct

SEQ ID NO: 83403 - DNA, 22 bp, Artificial Sequence
  Synthetic oligonucleotide; TTT chr11 5219863 5219884 5219880 5219885 +
cgagcctatgtgtgtctctgca

SEQ ID NO: 83404 - DNA, 22 bp, Artificial Sequence
  Synthetic oligonucleotide; TTC chr11 5219864 5219885 5219881 5219886 +
gagcctatgtgtgtctctgcac

SEQ ID NO: 83405 - DNA, 22 bp, Artificial Sequence
  Synthetic oligonucleotide; CTA chr11 5219871 5219892 5219888 5219893 +
tgtgtgtctctgcacgtgagat

SEQ ID NO: 83406 - DNA, 22 bp, Artificial Sequence
  Synthetic oligonucleotide; CTC chr11 5219881 5219902 5219898 5219903 +
tgcacgtgagatgggtttcctg

SEQ ID NO: 83407 - DNA, 22 bp, Artificial Sequence
  Synthetic oligonucleotide; CTG chr11 5219883 5219904 5219900 5219905 +
cacgtgagatgggtttcctgaa

SEQ ID NO: 83408 - DNA, 22 bp, Artificial Sequence
  Synthetic oligonucleotide; TTT chr11 5219899 5219920 5219916 5219921 +
cctgaatacagaacacagatgg

SEQ ID NO: 83409 - DNA, 22 bp, Artificial Sequence
  Synthetic oligonucleotide; TTC chr11 5219900 5219921 5219917 5219922 +
ctgaatacagaacacagatggg

SEQ ID NO: 83410 - DNA, 22 bp, Artificial Sequence
  Synthetic oligonucleotide; CTG chr11 5219903 5219924 5219920 5219925 +
aatacagaacacagatgggtct

SEQ ID NO: 83411 - DNA, 22 bp, Artificial Sequence
  Synthetic oligonucleotide; CTT chr11 5219926 5219947 5219943 5219948 +
gactccttatccaatttgccag

SEQ ID NO: 83412 - DNA, 22 bp, Artificial Sequence
  Synthetic oligonucleotide; TTG chr11 5219927 5219948 5219944 5219949 +
actccttatccaatttgccagt

SEQ ID NO: 83413 - DNA, 22 bp, Artificial Sequence
  Synthetic oligonucleotide; CTC chr11 5219931 5219952 5219948 5219953 +
cttatccaatttgccagtctgt

SEQ ID NO: 83414 - DNA, 22 bp, Artificial Sequence
  Synthetic oligonucleotide; CTT chr11 5219934 5219955 5219951 5219956 +
atccaatttgccagtctgtgtc

SEQ ID NO: 83415 - DNA, 22 bp, Artificial Sequence
  Synthetic oligonucleotide; TTA chr11 5219935 5219956 5219952 5219957 +
tccaatttgccagtctgtgtct

SEQ ID NO: 83416 - DNA, 22 bp, Artificial Sequence
  Synthetic oligonucleotide; TTT chr11 5219943 5219964 5219960 5219965 +
gccagtctgtgtcttttaattg

SEQ ID NO: 83417 - DNA, 22 bp, Artificial Sequence
  Synthetic oligonucleotide; TTG chr11 5219944 5219965 5219961 5219966 +
ccagtctgtgtcttttaattgg

SEQ ID NO: 83418 - DNA, 22 bp, Artificial Sequence
  Synthetic oligonucleotide; CTG chr11 5219952 5219973 5219969 5219974 +
tgtcttttaattggagcattta

SEQ ID NO: 83419 - DNA, 22 bp, Artificial Sequence
  Synthetic oligonucleotide; CTT chr11 5219958 5219979 5219975 5219980 +
ttaattggagcatttagcctat

SEQ ID NO: 83420 - DNA, 22 bp, Artificial Sequence
  Synthetic oligonucleotide; TTT chr11 5219959 5219980 5219976 5219981 +
taattggagcatttagcctatt

SEQ ID NO: 83421 - DNA, 22 bp, Artificial Sequence
  Synthetic oligonucleotide; TTT chr11 5219960 5219981 5219977 5219982 +
aattggagcatttagcctattt

SEQ ID NO: 83422 - DNA, 22 bp, Artificial Sequence
  Synthetic oligonucleotide; TTA chr11 5219961 5219982 5219978 5219983 +
attggagcatttagcctattta

SEQ ID NO: 83423 - DNA, 22 bp, Artificial Sequence
  Synthetic oligonucleotide; TTG chr11 5219965 5219986 5219982 5219987 +
gagcatttagcctatttacatt

SEQ ID NO: 83424 - DNA, 22 bp, Artificial Sequence
  Synthetic oligonucleotide; TTT chr11 5219973 5219994 5219990 5219995 +
agcctatttacatttaaggtga

SEQ ID NO: 83425 - DNA, 22 bp, Artificial Sequence
  Synthetic oligonucleotide; TTA chr11 5219974 5219995 5219991 5219996 +
gcctatttacatttaaggtgag

SEQ ID NO: 83426 - DNA, 22 bp, Artificial Sequence
  Synthetic oligonucleotide; CTA chr11 5219979 5220000 5219996 5220001 +
tttacatttaaggtgagtattg

SEQ ID NO: 83427 - DNA, 22 bp, Artificial Sequence
  Synthetic oligonucleotide; TTT chr11 5219982 5220003 5219999 5220004 +
acatttaaggtgagtattgtta

SEQ ID NO: 83428 - DNA, 22 bp, Artificial Sequence
  Synthetic oligonucleotide; TTA chr11 5219983 5220004 5220000 5220005 +
catttaaggtgagtattgttat

SEQ ID NO: 83429 - DNA, 22 bp, Artificial Sequence
  Synthetic oligonucleotide; TTT chr11 5219988 5220009 5220005 5220010 +
aaggtgagtattgttatgtatg

SEQ ID NO: 83430 - DNA, 22 bp, Artificial Sequence
  Synthetic oligonucleotide; TTA chr11 5219989 5220010 5220006 5220011 +
aggtgagtattgttatgtatga

SEQ ID NO: 83431 - DNA, 22 bp, Artificial Sequence
  Synthetic oligonucleotide; TTG chr11 5220001 5220022 5220018 5220023 +
ttatgtatgaatttgatcctgt

SEQ ID NO: 83432 - DNA, 22 bp, Artificial Sequence
  Synthetic oligonucleotide; TTA chr11 5220004 5220025 5220021 5220026 +
tgtatgaatttgatcctgtcat

SEQ ID NO: 83433 - DNA, 22 bp, Artificial Sequence
  Synthetic oligonucleotide; TTT chr11 5220015 5220036 5220032 5220037 +
gatcctgtcattatgatgttag

SEQ ID NO: 83434 - DNA, 22 bp, Artificial Sequence
  Synthetic oligonucleotide; TTG chr11 5220016 5220037 5220033 5220038 +
atcctgtcattatgatgttagc

SEQ ID NO: 83435 - DNA, 22 bp, Artificial Sequence
  Synthetic oligonucleotide; CTG chr11 5220022 5220043 5220039 5220044 +
tcattatgatgttagctggtta

SEQ ID NO: 83436 - DNA, 22 bp, Artificial Sequence
  Synthetic oligonucleotide; TTA chr11 5220028 5220049 5220045 5220050 +
tgatgttagctggttattttgc

SEQ ID NO: 83437 - DNA, 22 bp, Artificial Sequence
  Synthetic oligonucleotide; TTA chr11 5220036 5220057 5220053 5220058 +
gctggttattttgctcgttgat

SEQ ID NO: 83438 - DNA, 22 bp, Artificial Sequence
  Synthetic oligonucleotide; CTG chr11 5220040 5220061 5220057 5220062 +
gttattttgctcgttgatgcag

SEQ ID NO: 83439 - DNA, 22 bp, Artificial Sequence
  Synthetic oligonucleotide; TTA chr11 5220044 5220065 5220061 5220066 +
ttttgctcgttgatgcagtttc

SEQ ID NO: 83440 - DNA, 22 bp, Artificial Sequence
  Synthetic oligonucleotide; TTT chr11 5220047 5220068 5220064 5220069 +
tgctcgttgatgcagtttcttc

SEQ ID NO: 83441 - DNA, 22 bp, Artificial Sequence
  Synthetic oligonucleotide; TTT chr11 5220048 5220069 5220065 5220070 +
gctcgttgatgcagtttcttcc

SEQ ID NO: 83442 - DNA, 22 bp, Artificial Sequence
  Synthetic oligonucleotide; TTG chr11 5220049 5220070 5220066 5220071 +
ctcgttgatgcagtttcttcct

SEQ ID NO: 83443 - DNA, 22 bp, Artificial Sequence
  Synthetic oligonucleotide; CTC chr11 5220052 5220073 5220069 5220074 +
gttgatgcagtttcttcctagc

SEQ ID NO: 83444 - DNA, 22 bp, Artificial Sequence
  Synthetic oligonucleotide; TTG chr11 5220056 5220077 5220073 5220078 +
atgcagtttcttcctagccttg

SEQ ID NO: 83445 - DNA, 22 bp, Artificial Sequence
  Synthetic oligonucleotide; TTT chr11 5220065 5220086 5220082 5220087 +
cttcctagccttgatggtcttt

SEQ ID NO: 83446 - DNA, 22 bp, Artificial Sequence
  Synthetic oligonucleotide; TTC chr11 5220066 5220087 5220083 5220088 +
ttcctagccttgatggtcttta

SEQ ID NO: 83447 - DNA, 22 bp, Artificial Sequence
  Synthetic oligonucleotide; CTT chr11 5220068 5220089 5220085 5220090 +
cctagccttgatggtctttaca

SEQ ID NO: 83448 - DNA, 22 bp, Artificial Sequence
  Synthetic oligonucleotide; TTC chr11 5220069 5220090 5220086 5220091 +
ctagccttgatggtctttacaa

SEQ ID NO: 83449 - DNA, 22 bp, Artificial Sequence
  Synthetic oligonucleotide; CTA chr11 5220072 5220093 5220089 5220094 +
gccttgatggtctttacaattt

SEQ ID NO: 83450 - DNA, 22 bp, Artificial Sequence
  Synthetic oligonucleotide; CTT chr11 5220077 5220098 5220094 5220099 +
gatggtctttacaatttggcat

SEQ ID NO: 83451 - DNA, 22 bp, Artificial Sequence
  Synthetic oligonucleotide; TTG chr11 5220078 5220099 5220095 5220100 +
atggtctttacaatttggcatg

SEQ ID NO: 83452 - DNA, 22 bp, Artificial Sequence
  Synthetic oligonucleotide; CTT chr11 5220086 5220107 5220103 5220108 +
tacaatttggcatgtttttgca

SEQ ID NO: 83453 - DNA, 22 bp, Artificial Sequence
  Synthetic oligonucleotide; TTT chr11 5220087 5220108 5220104 5220109 +
acaatttggcatgtttttgcag

SEQ ID NO: 83454 - DNA, 22 bp, Artificial Sequence
  Synthetic oligonucleotide; TTA chr11 5220088 5220109 5220105 5220110 +
caatttggcatgtttttgcagt

SEQ ID NO: 83455 - DNA, 22 bp, Artificial Sequence
  Synthetic oligonucleotide; TTT chr11 5220094 5220115 5220111 5220116 +
ggcatgtttttgcagtggctga

SEQ ID NO: 83456 - DNA, 22 bp, Artificial Sequence
  Synthetic oligonucleotide; TTG chr11 5220095 5220116 5220112 5220117 +
gcatgtttttgcagtggctgat

SEQ ID NO: 83457 - DNA, 22 bp, Artificial Sequence
  Synthetic oligonucleotide; TTT chr11 5220103 5220124 5220120 5220125 +
ttgcagtggctgatactagttg

SEQ ID NO: 83458 - DNA, 22 bp, Artificial Sequence
  Synthetic oligonucleotide; TTT chr11 5220104 5220125 5220121 5220126 +
tgcagtggctgatactagttgt

SEQ ID NO: 83459 - DNA, 22 bp, Artificial Sequence
  Synthetic oligonucleotide; TTT chr11 5220105 5220126 5220122 5220127 +
gcagtggctgatactagttgtt

SEQ ID NO: 83460 - DNA, 22 bp, Artificial Sequence
  Synthetic oligonucleotide; TTG chr11 5220106 5220127 5220123 5220128 +
cagtggctgatactagttgttc

SEQ ID NO: 83461 - DNA, 22 bp, Artificial Sequence
  Synthetic oligonucleotide; CTG chr11 5220115 5220136 5220132 5220137 +
atactagttgttcctttccatg

SEQ ID NO: 83462 - DNA, 22 bp, Artificial Sequence
  Synthetic oligonucleotide; CTA chr11 5220121 5220142 5220138 5220143 +
gttgttcctttccatgtttagt

SEQ ID NO: 83463 - DNA, 22 bp, Artificial Sequence
  Synthetic oligonucleotide; TTG chr11 5220125 5220146 5220142 5220147 +
ttcctttccatgtttagtgctt

SEQ ID NO: 83464 - DNA, 22 bp, Artificial Sequence
  Synthetic oligonucleotide; TTC chr11 5220128 5220149 5220145 5220150 +
ctttccatgtttagtgcttcct

SEQ ID NO: 83465 - DNA, 22 bp, Artificial Sequence
  Synthetic oligonucleotide; CTT chr11 5220131 5220152 5220148 5220153 +
tccatgtttagtgcttccttca

SEQ ID NO: 83466 - DNA, 22 bp, Artificial Sequence
  Synthetic oligonucleotide; TTT chr11 5220132 5220153 5220149 5220154 +
ccatgtttagtgcttccttcag

SEQ ID NO: 83467 - DNA, 22 bp, Artificial Sequence
  Synthetic oligonucleotide; TTC chr11 5220133 5220154 5220150 5220155 +
catgtttagtgcttccttcagg

SEQ ID NO: 83468 - DNA, 22 bp, Artificial Sequence
  Synthetic oligonucleotide; TTT chr11 5220140 5220161 5220157 5220162 +
agtgcttccttcaggagctctt

SEQ ID NO: 83469 - DNA, 22 bp, Artificial Sequence
  Synthetic oligonucleotide; TTA chr11 5220141 5220162 5220158 5220163 +
gtgcttccttcaggagctcttg

SEQ ID NO: 83470 - DNA, 22 bp, Artificial Sequence
  Synthetic oligonucleotide; CTT chr11 5220147 5220168 5220164 5220169 +
ccttcaggagctcttgtagggc

SEQ ID NO: 83471 - DNA, 22 bp, Artificial Sequence
  Synthetic oligonucleotide; TTC chr11 5220148 5220169 5220165 5220170 +
cttcaggagctcttgtagggca

SEQ ID NO: 83472 - DNA, 22 bp, Artificial Sequence
  Synthetic oligonucleotide; CTT chr11 5220151 5220172 5220168 5220173 +
caggagctcttgtagggcaggc

SEQ ID NO: 83473 - DNA, 22 bp, Artificial Sequence
  Synthetic oligonucleotide; TTC chr11 5220152 5220173 5220169 5220174 +
aggagctcttgtagggcaggcc

SEQ ID NO: 83474 - DNA, 22 bp, Artificial Sequence
  Synthetic oligonucleotide; CTC chr11 5220160 5220181 5220177 5220182 +
ttgtagggcaggcctggtggtg

SEQ ID NO: 83475 - DNA, 22 bp, Artificial Sequence
  Synthetic oligonucleotide; CTT chr11 5220162 5220183 5220179 5220184 +
gtagggcaggcctggtggtgac

SEQ ID NO: 83476 - DNA, 22 bp, Artificial Sequence
  Synthetic oligonucleotide; TTG chr11 5220163 5220184 5220180 5220185 +
tagggcaggcctggtggtgaca

SEQ ID NO: 83477 - DNA, 22 bp, Artificial Sequence
  Synthetic oligonucleotide; CTG chr11 5220176 5220197 5220193 5220198 +
gtggtgacaaaatctctcagca

SEQ ID NO: 83478 - DNA, 22 bp, Artificial Sequence
  Synthetic oligonucleotide; CTC chr11 5220192 5220213 5220209 5220214 +
tcagcatttgcttgtctgtaaa

SEQ ID NO: 83479 - DNA, 22 bp, Artificial Sequence
  Synthetic oligonucleotide; CTC chr11 5220194 5220215 5220211 5220216 +
agcatttgcttgtctgtaaagg

SEQ ID NO: 83480 - DNA, 22 bp, Artificial Sequence
  Synthetic oligonucleotide; TTT chr11 5220201 5220222 5220218 5220223 +
gcttgtctgtaaaggattttat

SEQ ID NO: 83481 - DNA, 22 bp, Artificial Sequence
  Synthetic oligonucleotide; TTG chr11 5220202 5220223 5220219 5220224 +
cttgtctgtaaaggattttatt

SEQ ID NO: 83482 - DNA, 22 bp, Artificial Sequence
  Synthetic oligonucleotide; CTT chr11 5220205 5220226 5220222 5220227 +
gtctgtaaaggattttatttct

SEQ ID NO: 83483 - DNA, 22 bp, Artificial Sequence
  Synthetic oligonucleotide; TTG chr11 5220206 5220227 5220223 5220228 +
tctgtaaaggattttatttctc

SEQ ID NO: 83484 - DNA, 22 bp, Artificial Sequence
  Synthetic oligonucleotide; CTG chr11 5220210 5220231 5220227 5220232 +
taaaggattttatttctccttc

SEQ ID NO: 83485 - DNA, 22 bp, Artificial Sequence
  Synthetic oligonucleotide; TTT chr11 5220220 5220241 5220237 5220242 +
tatttctccttcacttatgaag

SEQ ID NO: 83486 - DNA, 22 bp, Artificial Sequence
  Synthetic oligonucleotide; TTT chr11 5220221 5220242 5220238 5220243 +
atttctccttcacttatgaagc

SEQ ID NO: 83487 - DNA, 22 bp, Artificial Sequence
  Synthetic oligonucleotide; TTA chr11 5220222 5220243 5220239 5220244 +
tttctccttcacttatgaagct

SEQ ID NO: 83488 - DNA, 22 bp, Artificial Sequence
  Synthetic oligonucleotide; TTT chr11 5220225 5220246 5220242 5220247 +
ctccttcacttatgaagcttag

SEQ ID NO: 83489 - DNA, 22 bp, Artificial Sequence
  Synthetic oligonucleotide; TTC chr11 5220226 5220247 5220243 5220248 +
tccttcacttatgaagcttagt

SEQ ID NO: 83490 - DNA, 22 bp, Artificial Sequence
  Synthetic oligonucleotide; CTC chr11 5220228 5220249 5220245 5220250 +
cttcacttatgaagcttagttt

SEQ ID NO: 83491 - DNA, 22 bp, Artificial Sequence
  Synthetic oligonucleotide; CTT chr11 5220231 5220252 5220248 5220253 +
cacttatgaagcttagtttggc

SEQ ID NO: 83492 - DNA, 22 bp, Artificial Sequence
  Synthetic oligonucleotide; TTC chr11 5220232 5220253 5220249 5220254 +
acttatgaagcttagtttggct

SEQ ID NO: 83493 - DNA, 22 bp, Artificial Sequence
  Synthetic oligonucleotide; CTT chr11 5220236 5220257 5220253 5220258 +
atgaagcttagtttggctggat

SEQ ID NO: 83494 - DNA, 22 bp, Artificial Sequence
  Synthetic oligonucleotide; TTA chr11 5220237 5220258 5220254 5220259 +
tgaagcttagtttggctggata

SEQ ID NO: 83495 - DNA, 22 bp, Artificial Sequence
  Synthetic oligonucleotide; CTT chr11 5220245 5220266 5220262 5220267 +
agtttggctggatatgaaattc

SEQ ID NO: 83496 - DNA, 22 bp, Artificial Sequence
  Synthetic oligonucleotide; TTA chr11 5220246 5220267 5220263 5220268 +
gtttggctggatatgaaattct

SEQ ID NO: 83497 - DNA, 22 bp, Artificial Sequence
  Synthetic oligonucleotide; TTT chr11 5220250 5220271 5220267 5220272 +
ggctggatatgaaattctgggt

SEQ ID NO: 83498 - DNA, 22 bp, Artificial Sequence
  Synthetic oligonucleotide; TTG chr11 5220251 5220272 5220268 5220273 +
gctggatatgaaattctgggtt

SEQ ID NO: 83499 - DNA, 22 bp, Artificial Sequence
  Synthetic oligonucleotide; CTG chr11 5220255 5220276 5220272 5220277 +
gatatgaaattctgggttgaaa

SEQ ID NO: 83500 - DNA, 22 bp, Artificial Sequence
  Synthetic oligonucleotide; TTC chr11 5220267 5220288 5220284 5220289 +
tgggttgaaaattcttttcttt

SEQ ID NO: 83501 - DNA, 22 bp, Artificial Sequence
  Synthetic oligonucleotide; CTG chr11 5220269 5220290 5220286 5220291 +
ggttgaaaattcttttctttaa

SEQ ID NO: 83502 - DNA, 22 bp, Artificial Sequence
  Synthetic oligonucleotide; TTG chr11 5220274 5220295 5220291 5220296 +
aaaattcttttctttaacaatg

SEQ ID NO: 83503 - DNA, 22 bp, Artificial Sequence
  Synthetic oligonucleotide; TTC chr11 5220281 5220302 5220298 5220303 +
ttttctttaacaatgttgaata

SEQ ID NO: 83504 - DNA, 22 bp, Artificial Sequence
  Synthetic oligonucleotide; CTT chr11 5220283 5220304 5220300 5220305 +
ttctttaacaatgttgaatatt

SEQ ID NO: 83505 - DNA, 22 bp, Artificial Sequence
  Synthetic oligonucleotide; TTT chr11 5220284 5220305 5220301 5220306 +
tctttaacaatgttgaatattg

SEQ ID NO: 83506 - DNA, 22 bp, Artificial Sequence
  Synthetic oligonucleotide; TTT chr11 5220285 5220306 5220302 5220307 +
ctttaacaatgttgaatattgg

SEQ ID NO: 83507 - DNA, 22 bp, Artificial Sequence
  Synthetic oligonucleotide; TTC chr11 5220286 5220307 5220303 5220308 +
tttaacaatgttgaatattggc

SEQ ID NO: 83508 - DNA, 22 bp, Artificial Sequence
  Synthetic oligonucleotide; CTT chr11 5220288 5220309 5220305 5220310 +
taacaatgttgaatattggccc

SEQ ID NO: 83509 - DNA, 22 bp, Artificial Sequence
  Synthetic oligonucleotide; TTT chr11 5220289 5220310 5220306 5220311 +
aacaatgttgaatattggcccc

SEQ ID NO: 83510 - DNA, 22 bp, Artificial Sequence
  Synthetic oligonucleotide; TTA chr11 5220290 5220311 5220307 5220312 +
acaatgttgaatattggccccc

SEQ ID NO: 83511 - DNA, 22 bp, Artificial Sequence
  Synthetic oligonucleotide; TTG chr11 5220299 5220320 5220316 5220321 +
aatattggcccccactttcttc

SEQ ID NO: 83512 - DNA, 22 bp, Artificial Sequence
  Synthetic oligonucleotide; TTG chr11 5220306 5220327 5220323 5220328 +
gcccccactttcttctggcttg

SEQ ID NO: 83513 - DNA, 22 bp, Artificial Sequence
  Synthetic oligonucleotide; CTT chr11 5220316 5220337 5220333 5220338 +
tcttctggcttgtagagtttct

SEQ ID NO: 83514 - DNA, 22 bp, Artificial Sequence
  Synthetic oligonucleotide; TTT chr11 5220317 5220338 5220334 5220339 +
cttctggcttgtagagtttctg

SEQ ID NO: 83515 - DNA, 22 bp, Artificial Sequence
  Synthetic oligonucleotide; TTC chr11 5220318 5220339 5220335 5220340 +
ttctggcttgtagagtttctgc

SEQ ID NO: 83516 - DNA, 22 bp, Artificial Sequence
  Synthetic oligonucleotide; CTT chr11 5220320 5220341 5220337 5220342 +
ctggcttgtagagtttctgccg

SEQ ID NO: 83517 - DNA, 22 bp, Artificial Sequence
  Synthetic oligonucleotide; TTC chr11 5220321 5220342 5220338 5220343 +
tggcttgtagagtttctgccga

SEQ ID NO: 83518 - DNA, 22 bp, Artificial Sequence
  Synthetic oligonucleotide; CTG chr11 5220323 5220344 5220340 5220345 +
gcttgtagagtttctgccgata

SEQ ID NO: 83519 - DNA, 22 bp, Artificial Sequence
  Synthetic oligonucleotide; CTT chr11 5220327 5220348 5220344 5220349 +
gtagagtttctgccgatagatc

SEQ ID NO: 83520 - DNA, 22 bp, Artificial Sequence
  Synthetic oligonucleotide; TTG chr11 5220328 5220349 5220345 5220350 +
tagagtttctgccgatagatca

SEQ ID NO: 83521 - DNA, 22 bp, Artificial Sequence
  Synthetic oligonucleotide; TTT chr11 5220336 5220357 5220353 5220358 +
ctgccgatagatcagctgttag

SEQ ID NO: 83522 - DNA, 22 bp, Artificial Sequence
  Synthetic oligonucleotide; TTC chr11 5220337 5220358 5220354 5220359 +
tgccgatagatcagctgttagt

SEQ ID NO: 83523 - DNA, 22 bp, Artificial Sequence
  Synthetic oligonucleotide; CTG chr11 5220339 5220360 5220356 5220361 +
ccgatagatcagctgttagtct

SEQ ID NO: 83524 - DNA, 22 bp, Artificial Sequence
  Synthetic oligonucleotide; CTG chr11 5220354 5220375 5220371 5220376 +
ttagtctgatgggcttcccttt

SEQ ID NO: 83525 - DNA, 22 bp, Artificial Sequence
  Synthetic oligonucleotide; TTA chr11 5220357 5220378 5220374 5220379 +
gtctgatgggcttccctttgtg

SEQ ID NO: 83526 - DNA, 22 bp, Artificial Sequence
  Synthetic oligonucleotide; CTG chr11 5220362 5220383 5220379 5220384 +
atgggcttccctttgtgggtaa

SEQ ID NO: 83527 - DNA, 22 bp, Artificial Sequence
  Synthetic oligonucleotide; CTT chr11 5220370 5220391 5220387 5220392 +
ccctttgtgggtaacccgacct

SEQ ID NO: 83528 - DNA, 22 bp, Artificial Sequence
  Synthetic oligonucleotide; TTC chr11 5220371 5220392 5220388 5220393 +
cctttgtgggtaacccgacctt

SEQ ID NO: 83529 - DNA, 22 bp, Artificial Sequence
  Synthetic oligonucleotide; CTT chr11 5220375 5220396 5220392 5220397 +
tgtgggtaacccgacctttctc

SEQ ID NO: 83530 - DNA, 22 bp, Artificial Sequence
  Synthetic oligonucleotide; TTT chr11 5220376 5220397 5220393 5220398 +
gtgggtaacccgacctttctct

SEQ ID NO: 83531 - DNA, 22 bp, Artificial Sequence
  Synthetic oligonucleotide; TTG chr11 5220377 5220398 5220394 5220399 +
tgggtaacccgacctttctctc

SEQ ID NO: 83532 - DNA, 22 bp, Artificial Sequence
  Synthetic oligonucleotide; CTT chr11 5220393 5220414 5220410 5220415 +
tctctctggctgcccttaacat

SEQ ID NO: 83533 - DNA, 22 bp, Artificial Sequence
  Synthetic oligonucleotide; TTT chr11 5220394 5220415 5220411 5220416 +
ctctctggctgcccttaacatt

SEQ ID NO: 83534 - DNA, 22 bp, Artificial Sequence
  Synthetic oligonucleotide; TTC chr11 5220395 5220416 5220412 5220417 +
tctctggctgcccttaacattt

SEQ ID NO: 83535 - DNA, 22 bp, Artificial Sequence
  Synthetic oligonucleotide; CTC chr11 5220397 5220418 5220414 5220419 +
tctggctgcccttaacattttt

SEQ ID NO: 83536 - DNA, 22 bp, Artificial Sequence
  Synthetic oligonucleotide; CTC chr11 5220399 5220420 5220416 5220421 +
tggctgcccttaacattttttc

SEQ ID NO: 83537 - DNA, 22 bp, Artificial Sequence
  Synthetic oligonucleotide; CTG chr11 5220401 5220422 5220418 5220423 +
gctgcccttaacattttttcct

SEQ ID NO: 83538 - DNA, 22 bp, Artificial Sequence
  Synthetic oligonucleotide; CTG chr11 5220405 5220426 5220422 5220427 +
cccttaacattttttccttcat

SEQ ID NO: 83539 - DNA, 22 bp, Artificial Sequence
  Synthetic oligonucleotide; CTT chr11 5220410 5220431 5220427 5220432 +
aacattttttccttcatttcaa

SEQ ID NO: 83540 - DNA, 22 bp, Artificial Sequence
  Synthetic oligonucleotide; TTA chr11 5220411 5220432 5220428 5220433 +
acattttttccttcatttcaac

SEQ ID NO: 83541 - DNA, 22 bp, Artificial Sequence
  Synthetic oligonucleotide; TTT chr11 5220417 5220438 5220434 5220439 +
tttccttcatttcaactttggt

SEQ ID NO: 83542 - DNA, 22 bp, Artificial Sequence
  Synthetic oligonucleotide; TTT chr11 5220418 5220439 5220435 5220440 +
ttccttcatttcaactttggtg

SEQ ID NO: 83543 - DNA, 22 bp, Artificial Sequence
  Synthetic oligonucleotide; TTT chr11 5220419 5220440 5220436 5220441 +
tccttcatttcaactttggtga

SEQ ID NO: 83544 - DNA, 22 bp, Artificial Sequence
  Synthetic oligonucleotide; TTT chr11 5220420 5220441 5220437 5220442 +
ccttcatttcaactttggtgaa

SEQ ID NO: 83545 - DNA, 22 bp, Artificial Sequence
  Synthetic oligonucleotide; TTC chr11 5220421 5220442 5220438 5220443 +
cttcatttcaactttggtgaat

SEQ ID NO: 83546 - DNA, 22 bp, Artificial Sequence
  Synthetic oligonucleotide; CTT chr11 5220424 5220445 5220441 5220446 +
catttcaactttggtgaatctg

SEQ ID NO: 83547 - DNA, 22 bp, Artificial Sequence
  Synthetic oligonucleotide; TTC chr11 5220425 5220446 5220442 5220447 +
atttcaactttggtgaatctga

SEQ ID NO: 83548 - DNA, 22 bp, Artificial Sequence
  Synthetic oligonucleotide; TTT chr11 5220429 5220450 5220446 5220451 +
caactttggtgaatctgacagt

SEQ ID NO: 83549 - DNA, 22 bp, Artificial Sequence
  Synthetic oligonucleotide; TTC chr11 5220430 5220451 5220447 5220452 +
aactttggtgaatctgacagtt

SEQ ID NO: 83550 - DNA, 22 bp, Artificial Sequence
  Synthetic oligonucleotide; CTT chr11 5220435 5220456 5220452 5220457 +
tggtgaatctgacagttatgtg

SEQ ID NO: 83551 - DNA, 22 bp, Artificial Sequence
  Synthetic oligonucleotide; TTT chr11 5220436 5220457 5220453 5220458 +
ggtgaatctgacagttatgtgt

SEQ ID NO: 83552 - DNA, 22 bp, Artificial Sequence
  Synthetic oligonucleotide; TTG chr11 5220437 5220458 5220454 5220459 +
gtgaatctgacagttatgtgtc

SEQ ID NO: 83553 - DNA, 22 bp, Artificial Sequence
  Synthetic oligonucleotide; CTG chr11 5220446 5220467 5220463 5220468 +
acagttatgtgtcttggagttg

SEQ ID NO: 83554 - DNA, 22 bp, Artificial Sequence
  Synthetic oligonucleotide; TTA chr11 5220453 5220474 5220470 5220475 +
tgtgtcttggagttgcttttct

SEQ ID NO: 83555 - DNA, 22 bp, Artificial Sequence
  Synthetic oligonucleotide; CTT chr11 5220461 5220482 5220478 5220483 +
ggagttgcttttctctaggagt

SEQ ID NO: 83556 - DNA, 22 bp, Artificial Sequence
  Synthetic oligonucleotide; TTG chr11 5220462 5220483 5220479 5220484 +
gagttgcttttctctaggagta

SEQ ID NO: 83557 - DNA, 22 bp, Artificial Sequence
  Synthetic oligonucleotide; TTG chr11 5220468 5220489 5220485 5220490 +
cttttctctaggagtatctttg

SEQ ID NO: 83558 - DNA, 22 bp, Artificial Sequence
  Synthetic oligonucleotide; CTT chr11 5220471 5220492 5220488 5220493 +
ttctctaggagtatctttgtgg

SEQ ID NO: 83559 - DNA, 22 bp, Artificial Sequence
  Synthetic oligonucleotide; TTT chr11 5220472 5220493 5220489 5220494 +
tctctaggagtatctttgtggc

SEQ ID NO: 83560 - DNA, 22 bp, Artificial Sequence
  Synthetic oligonucleotide; TTT chr11 5220473 5220494 5220490 5220495 +
ctctaggagtatctttgtggcg

SEQ ID NO: 83561 - DNA, 22 bp, Artificial Sequence
  Synthetic oligonucleotide; TTC chr11 5220474 5220495 5220491 5220496 +
tctaggagtatctttgtggcgt

SEQ ID NO: 83562 - DNA, 22 bp, Artificial Sequence
  Synthetic oligonucleotide; CTC chr11 5220476 5220497 5220493 5220498 +
taggagtatctttgtggcgttc

SEQ ID NO: 83563 - DNA, 22 bp, Artificial Sequence
  Synthetic oligonucleotide; CTA chr11 5220478 5220499 5220495 5220500 +
ggagtatctttgtggcgttctc

SEQ ID NO: 83564 - DNA, 22 bp, Artificial Sequence
  Synthetic oligonucleotide; CTT chr11 5220488 5220509 5220505 5220510 +
tgtggcgttctctgtatttcct

SEQ ID NO: 83565 - DNA, 22 bp, Artificial Sequence
  Synthetic oligonucleotide; TTT chr11 5220489 5220510 5220506 5220511 +
gtggcgttctctgtatttcctg

SEQ ID NO: 83566 - DNA, 22 bp, Artificial Sequence
  Synthetic oligonucleotide; TTG chr11 5220490 5220511 5220507 5220512 +
tggcgttctctgtatttcctga

SEQ ID NO: 83567 - DNA, 22 bp, Artificial Sequence
  Synthetic oligonucleotide; TTC chr11 5220498 5220519 5220515 5220520 +
tctgtatttcctgaatgtgaat

SEQ ID NO: 83568 - DNA, 22 bp, Artificial Sequence
  Synthetic oligonucleotide; CTC chr11 5220500 5220521 5220517 5220522 +
tgtatttcctgaatgtgaattt

SEQ ID NO: 83569 - DNA, 22 bp, Artificial Sequence
  Synthetic oligonucleotide; CTG chr11 5220502 5220523 5220519 5220524 +
tatttcctgaatgtgaatttgg

SEQ ID NO: 83570 - DNA, 22 bp, Artificial Sequence
  Synthetic oligonucleotide; TTT chr11 5220507 5220528 5220524 5220529 +
cctgaatgtgaatttgggcttg

SEQ ID NO: 83571 - DNA, 22 bp, Artificial Sequence
  Synthetic oligonucleotide; TTC chr11 5220508 5220529 5220525 5220530 +
ctgaatgtgaatttgggcttgc

SEQ ID NO: 83572 - DNA, 22 bp, Artificial Sequence
  Synthetic oligonucleotide; CTG chr11 5220511 5220532 5220528 5220533 +
aatgtgaatttgggcttgcctt

SEQ ID NO: 83573 - DNA, 22 bp, Artificial Sequence
  Synthetic oligonucleotide; TTT chr11 5220522 5220543 5220539 5220544 +
gggcttgccttgctagattggg

SEQ ID NO: 83574 - DNA, 22 bp, Artificial Sequence
  Synthetic oligonucleotide; TTG chr11 5220523 5220544 5220540 5220545 +
ggcttgccttgctagattgggg

SEQ ID NO: 83575 - DNA, 22 bp, Artificial Sequence
  Synthetic oligonucleotide; CTT chr11 5220528 5220549 5220545 5220550 +
gccttgctagattggggaagtt

SEQ ID NO: 83576 - DNA, 22 bp, Artificial Sequence
  Synthetic oligonucleotide; TTG chr11 5220529 5220550 5220546 5220551 +
ccttgctagattggggaagttc

SEQ ID NO: 83577 - DNA, 22 bp, Artificial Sequence
  Synthetic oligonucleotide; CTT chr11 5220533 5220554 5220550 5220555 +
gctagattggggaagttctcct

SEQ ID NO: 83578 - DNA, 22 bp, Artificial Sequence
  Synthetic oligonucleotide; TTG chr11 5220534 5220555 5220551 5220556 +
ctagattggggaagttctcctg

SEQ ID NO: 83579 - DNA, 22 bp, Artificial Sequence
  Synthetic oligonucleotide; CTA chr11 5220537 5220558 5220554 5220559 +
gattggggaagttctcctggat

SEQ ID NO: 83580 - DNA, 22 bp, Artificial Sequence
  Synthetic oligonucleotide; TTG chr11 5220542 5220563 5220559 5220564 +
gggaagttctcctggataatat

SEQ ID NO: 83581 - DNA, 22 bp, Artificial Sequence
  Synthetic oligonucleotide; TTC chr11 5220551 5220572 5220568 5220573 +
tcctggataatatcctgcagag

SEQ ID NO: 83582 - DNA, 22 bp, Artificial Sequence
  Synthetic oligonucleotide; CTC chr11 5220553 5220574 5220570 5220575 +
ctggataatatcctgcagagtg

SEQ ID NO: 83583 - DNA, 22 bp, Artificial Sequence
  Synthetic oligonucleotide; CTG chr11 5220556 5220577 5220573 5220578 +
gataatatcctgcagagtgttt

SEQ ID NO: 83584 - DNA, 22 bp, Artificial Sequence
  Synthetic oligonucleotide; CTG chr11 5220568 5220589 5220585 5220590 +
cagagtgttttccaacttggtt

SEQ ID NO: 83585 - DNA, 22 bp, Artificial Sequence
  Synthetic oligonucleotide; TTT chr11 5220578 5220599 5220595 5220600 +
tccaacttggttccattctccc

SEQ ID NO: 83586 - DNA, 22 bp, Artificial Sequence
  Synthetic oligonucleotide; TTT chr11 5220579 5220600 5220596 5220601 +
ccaacttggttccattctcccc

SEQ ID NO: 83587 - DNA, 22 bp, Artificial Sequence
  Synthetic oligonucleotide; TTC chr11 5220580 5220601 5220597 5220602 +
caacttggttccattctcccca

SEQ ID NO: 83588 - DNA, 22 bp, Artificial Sequence
  Synthetic oligonucleotide; CTT chr11 5220586 5220607 5220603 5220608 +
ggttccattctccccatcactt

SEQ ID NO: 83589 - DNA, 22 bp, Artificial Sequence
  Synthetic oligonucleotide; TTG chr11 5220587 5220608 5220604 5220609 +
gttccattctccccatcacttt

SEQ ID NO: 83590 - DNA, 22 bp, Artificial Sequence
  Synthetic oligonucleotide; TTC chr11 5220591 5220612 5220608 5220613 +
cattctccccatcactttcagc

SEQ ID NO: 83591 - DNA, 22 bp, Artificial Sequence
  Synthetic oligonucleotide; TTC chr11 5220596 5220617 5220613 5220618 +
tccccatcactttcagctacac

SEQ ID NO: 83592 - DNA, 22 bp, Artificial Sequence
  Synthetic oligonucleotide; CTC chr11 5220598 5220619 5220615 5220620 +
cccatcactttcagctacacca

SEQ ID NO: 83593 - DNA, 22 bp, Artificial Sequence
  Synthetic oligonucleotide; CTT chr11 5220608 5220629 5220625 5220630 +
tcagctacaccaattagatgta

SEQ ID NO: 83594 - DNA, 22 bp, Artificial Sequence
  Synthetic oligonucleotide; TTT chr11 5220609 5220630 5220626 5220631 +
cagctacaccaattagatgtag

SEQ ID NO: 83595 - DNA, 22 bp, Artificial Sequence
  Synthetic oligonucleotide; TTC chr11 5220610 5220631 5220627 5220632 +
agctacaccaattagatgtaga

SEQ ID NO: 83596 - DNA, 22 bp, Artificial Sequence
  Synthetic oligonucleotide; CTA chr11 5220615 5220636 5220632 5220637 +
caccaattagatgtagatttgg

SEQ ID NO: 83597 - DNA, 22 bp, Artificial Sequence
  Synthetic oligonucleotide; TTA chr11 5220624 5220645 5220641 5220646 +
gatgtagatttggtcttttcac

SEQ ID NO: 83598 - DNA, 22 bp, Artificial Sequence
  Synthetic oligonucleotide; TTT chr11 5220635 5220656 5220652 5220657 +
ggtcttttcacatagtcccata

SEQ ID NO: 83599 - DNA, 22 bp, Artificial Sequence
  Synthetic oligonucleotide; TTG chr11 5220636 5220657 5220653 5220658 +
gtcttttcacatagtcccatat

SEQ ID NO: 83600 - DNA, 22 bp, Artificial Sequence
  Synthetic oligonucleotide; CTT chr11 5220641 5220662 5220658 5220663 +
ttcacatagtcccatatttctt

SEQ ID NO: 83601 - DNA, 22 bp, Artificial Sequence
  Synthetic oligonucleotide; TTT chr11 5220642 5220663 5220659 5220664 +
tcacatagtcccatatttcttg

SEQ ID NO: 83602 - DNA, 22 bp, Artificial Sequence
  Synthetic oligonucleotide; TTT chr11 5220643 5220664 5220660 5220665 +
cacatagtcccatatttcttgg

SEQ ID NO: 83603 - DNA, 22 bp, Artificial Sequence
  Synthetic oligonucleotide; TTC chr11 5220644 5220665 5220661 5220666 +
acatagtcccatatttcttgga

SEQ ID NO: 83604 - DNA, 22 bp, Artificial Sequence
  Synthetic oligonucleotide; TTT chr11 5220660 5220681 5220677 5220682 +
cttggaggctttgttcgtttct

SEQ ID NO: 83605 - DNA, 22 bp, Artificial Sequence
  Synthetic oligonucleotide; TTC chr11 5220661 5220682 5220678 5220683 +
ttggaggctttgttcgtttctt

SEQ ID NO: 83606 - DNA, 22 bp, Artificial Sequence
  Synthetic oligonucleotide; CTT chr11 5220663 5220684 5220680 5220685 +
ggaggctttgttcgtttctttt

SEQ ID NO: 83607 - DNA, 22 bp, Artificial Sequence
  Synthetic oligonucleotide; TTG chr11 5220664 5220685 5220681 5220686 +
gaggctttgttcgtttcttttt

SEQ ID NO: 83608 - DNA, 22 bp, Artificial Sequence
  Synthetic oligonucleotide; CTT chr11 5220671 5220692 5220688 5220693 +
tgttcgtttctttttattcttt

SEQ ID NO: 83609 - DNA, 22 bp, Artificial Sequence
  Synthetic oligonucleotide; TTT chr11 5220672 5220693 5220689 5220694 +
gttcgtttctttttattctttt

SEQ ID NO: 83610 - DNA, 22 bp, Artificial Sequence
  Synthetic oligonucleotide; TTG chr11 5220673 5220694 5220690 5220695 +
ttcgtttctttttattcttttt

SEQ ID NO: 83611 - DNA, 22 bp, Artificial Sequence
  Synthetic oligonucleotide; TTC chr11 5220676 5220697 5220693 5220698 +
gtttctttttattcttttttct

SEQ ID NO: 83612 - DNA, 22 bp, Artificial Sequence
  Synthetic oligonucleotide; TTT chr11 5220680 5220701 5220697 5220702 +
ctttttattcttttttctctaa

SEQ ID NO: 83613 - DNA, 22 bp, Artificial Sequence
  Synthetic oligonucleotide; TTC chr11 5220681 5220702 5220698 5220703 +
tttttattcttttttctctaaa

SEQ ID NO: 83614 - DNA, 22 bp, Artificial Sequence
  Synthetic oligonucleotide; CTT chr11 5220683 5220704 5220700 5220705 +
tttattcttttttctctaaact

SEQ ID NO: 83615 - DNA, 22 bp, Artificial Sequence
  Synthetic oligonucleotide; TTT chr11 5220684 5220705 5220701 5220706 +
ttattcttttttctctaaactt

SEQ ID NO: 83616 - DNA, 22 bp, Artificial Sequence
  Synthetic oligonucleotide; TTT chr11 5220685 5220706 5220702 5220707 +
tattcttttttctctaaacttc

SEQ ID NO: 83617 - DNA, 22 bp, Artificial Sequence
  Synthetic oligonucleotide; TTT chr11 5220686 5220707 5220703 5220708 +
attcttttttctctaaacttct

SEQ ID NO: 83618 - DNA, 22 bp, Artificial Sequence
  Synthetic oligonucleotide; TTA chr11 5220687 5220708 5220704 5220709 +
ttcttttttctctaaacttctc

SEQ ID NO: 83619 - DNA, 22 bp, Artificial Sequence
  Synthetic oligonucleotide; TTC chr11 5220690 5220711 5220707 5220712 +
ttttttctctaaacttctcttc

SEQ ID NO: 83620 - DNA, 22 bp, Artificial Sequence
  Synthetic oligonucleotide; CTT chr11 5220692 5220713 5220709 5220714 +
ttttctctaaacttctcttcat

SEQ ID NO: 83621 - DNA, 22 bp, Artificial Sequence
  Synthetic oligonucleotide; TTT chr11 5220693 5220714 5220710 5220715 +
tttctctaaacttctcttcatg

SEQ ID NO: 83622 - DNA, 22 bp, Artificial Sequence
  Synthetic oligonucleotide; TTT chr11 5220694 5220715 5220711 5220716 +
ttctctaaacttctcttcatgc

SEQ ID NO: 83623 - DNA, 22 bp, Artificial Sequence
  Synthetic oligonucleotide; TTT chr11 5220695 5220716 5220712 5220717 +
tctctaaacttctcttcatgct

SEQ ID NO: 83624 - DNA, 22 bp, Artificial Sequence
  Synthetic oligonucleotide; TTT chr11 5220696 5220717 5220713 5220718 +
ctctaaacttctcttcatgctt

SEQ ID NO: 83625 - DNA, 22 bp, Artificial Sequence
  Synthetic oligonucleotide; TTC chr11 5220697 5220718 5220714 5220719 +
tctaaacttctcttcatgcttc

SEQ ID NO: 83626 - DNA, 22 bp, Artificial Sequence
  Synthetic oligonucleotide; CTC chr11 5220699 5220720 5220716 5220721 +
taaacttctcttcatgcttcat

SEQ ID NO: 83627 - DNA, 22 bp, Artificial Sequence
  Synthetic oligonucleotide; CTA chr11 5220701 5220722 5220718 5220723 +
aacttctcttcatgcttcattt

SEQ ID NO: 83628 - DNA, 22 bp, Artificial Sequence
  Synthetic oligonucleotide; CTT chr11 5220706 5220727 5220723 5220728 +
ctcttcatgcttcatttcattc

SEQ ID NO: 83629 - DNA, 22 bp, Artificial Sequence
  Synthetic oligonucleotide; TTC chr11 5220707 5220728 5220724 5220729 +
tcttcatgcttcatttcattca

SEQ ID NO: 83630 - DNA, 22 bp, Artificial Sequence
  Synthetic oligonucleotide; CTC chr11 5220709 5220730 5220726 5220731 +
ttcatgcttcatttcattcatt

SEQ ID NO: 83631 - DNA, 22 bp, Artificial Sequence
  Synthetic oligonucleotide; CTT chr11 5220711 5220732 5220728 5220733 +
catgcttcatttcattcatttc

SEQ ID NO: 83632 - DNA, 22 bp, Artificial Sequence
  Synthetic oligonucleotide; TTC chr11 5220712 5220733 5220729 5220734 +
atgcttcatttcattcatttca

SEQ ID NO: 83633 - DNA, 22 bp, Artificial Sequence
  Synthetic oligonucleotide; CTT chr11 5220718 5220739 5220735 5220740 +
catttcattcatttcatctttc

SEQ ID NO: 83634 - DNA, 22 bp, Artificial Sequence
  Synthetic oligonucleotide; TTC chr11 5220719 5220740 5220736 5220741 +
atttcattcatttcatctttcg

SEQ ID NO: 83635 - DNA, 22 bp, Artificial Sequence
  Synthetic oligonucleotide; TTT chr11 5220723 5220744 5220740 5220745 +
cattcatttcatctttcgtcat

SEQ ID NO: 83636 - DNA, 22 bp, Artificial Sequence
  Synthetic oligonucleotide; TTC chr11 5220724 5220745 5220741 5220746 +
attcatttcatctttcgtcatt

SEQ ID NO: 83637 - DNA, 22 bp, Artificial Sequence
  Synthetic oligonucleotide; TTC chr11 5220728 5220749 5220745 5220750 +
atttcatctttcgtcattgata

SEQ ID NO: 83638 - DNA, 22 bp, Artificial Sequence
  Synthetic oligonucleotide; TTT chr11 5220732 5220753 5220749 5220754 +
catctttcgtcattgataccct

SEQ ID NO: 83639 - DNA, 22 bp, Artificial Sequence
  Synthetic oligonucleotide; TTC chr11 5220733 5220754 5220750 5220755 +
atctttcgtcattgataccctt

SEQ ID NO: 83640 - DNA, 22 bp, Artificial Sequence
  Synthetic oligonucleotide; CTT chr11 5220738 5220759 5220755 5220760 +
tcgtcattgataccctttcttc

SEQ ID NO: 83641 - DNA, 22 bp, Artificial Sequence
  Synthetic oligonucleotide; TTT chr11 5220739 5220760 5220756 5220761 +
cgtcattgataccctttcttcc

SEQ ID NO: 83642 - DNA, 22 bp, Artificial Sequence
  Synthetic oligonucleotide; TTC chr11 5220740 5220761 5220757 5220762 +
gtcattgataccctttcttcca

SEQ ID NO: 83643 - DNA, 22 bp, Artificial Sequence
  Synthetic oligonucleotide; TTG chr11 5220747 5220768 5220764 5220769 +
ataccctttcttccagttgatc

SEQ ID NO: 83644 - DNA, 22 bp, Artificial Sequence
  Synthetic oligonucleotide; CTT chr11 5220755 5220776 5220772 5220777 +
tcttccagttgatctcatcggt

SEQ ID NO: 83645 - DNA, 22 bp, Artificial Sequence
  Synthetic oligonucleotide; TTT chr11 5220756 5220777 5220773 5220778 +
cttccagttgatctcatcggtt

SEQ ID NO: 83646 - DNA, 22 bp, Artificial Sequence
  Synthetic oligonucleotide; TTC chr11 5220757 5220778 5220774 5220779 +
ttccagttgatctcatcggtta

SEQ ID NO: 83647 - DNA, 22 bp, Artificial Sequence
  Synthetic oligonucleotide; CTT chr11 5220759 5220780 5220776 5220781 +
ccagttgatctcatcggttact

SEQ ID NO: 83648 - DNA, 22 bp, Artificial Sequence
  Synthetic oligonucleotide; TTC chr11 5220760 5220781 5220777 5220782 +
cagttgatctcatcggttactg

SEQ ID NO: 83649 - DNA, 22 bp, Artificial Sequence
  Synthetic oligonucleotide; TTG chr11 5220766 5220787 5220783 5220788 +
atctcatcggttactgaggctt

SEQ ID NO: 83650 - DNA, 22 bp, Artificial Sequence
  Synthetic oligonucleotide; CTC chr11 5220771 5220792 5220788 5220793 +
atcggttactgaggcttgtgta

SEQ ID NO: 83651 - DNA, 22 bp, Artificial Sequence
  Synthetic oligonucleotide; TTA chr11 5220779 5220800 5220796 5220801 +
ctgaggcttgtgtatttgtcac

SEQ ID NO: 83652 - DNA, 22 bp, Artificial Sequence
  Synthetic oligonucleotide; CTG chr11 5220782 5220803 5220799 5220804 +
aggcttgtgtatttgtcacgta

SEQ ID NO: 83653 - DNA, 22 bp, Artificial Sequence
  Synthetic oligonucleotide; CTT chr11 5220788 5220809 5220805 5220810 +
gtgtatttgtcacgtagttctc

SEQ ID NO: 83654 - DNA, 22 bp, Artificial Sequence
  Synthetic oligonucleotide; TTG chr11 5220789 5220810 5220806 5220811 +
tgtatttgtcacgtagttctcc

SEQ ID NO: 83655 - DNA, 22 bp, Artificial Sequence
  Synthetic oligonucleotide; TTT chr11 5220796 5220817 5220813 5220818 +
gtcacgtagttctcctgccttg

SEQ ID NO: 83656 - DNA, 22 bp, Artificial Sequence
  Synthetic oligonucleotide; TTG chr11 5220797 5220818 5220814 5220819 +
tcacgtagttctcctgccttgg

SEQ ID NO: 83657 - DNA, 22 bp, Artificial Sequence
  Synthetic oligonucleotide; TTC chr11 5220808 5220829 5220825 5220830 +
tcctgccttggttttcagctcc

SEQ ID NO: 83658 - DNA, 22 bp, Artificial Sequence
  Synthetic oligonucleotide; CTC chr11 5220810 5220831 5220827 5220832 +
ctgccttggttttcagctccat

SEQ ID NO: 83659 - DNA, 22 bp, Artificial Sequence
  Synthetic oligonucleotide; CTG chr11 5220813 5220834 5220830 5220835 +
ccttggttttcagctccatcag

SEQ ID NO: 83660 - DNA, 22 bp, Artificial Sequence
  Synthetic oligonucleotide; CTT chr11 5220817 5220838 5220834 5220839 +
ggttttcagctccatcaggtcc

SEQ ID NO: 83661 - DNA, 22 bp, Artificial Sequence
  Synthetic oligonucleotide; TTG chr11 5220818 5220839 5220835 5220840 +
gttttcagctccatcaggtcct

SEQ ID NO: 83662 - DNA, 22 bp, Artificial Sequence
  Synthetic oligonucleotide; TTT chr11 5220822 5220843 5220839 5220844 +
tcagctccatcaggtcctttaa

SEQ ID NO: 83663 - DNA, 22 bp, Artificial Sequence
  Synthetic oligonucleotide; TTT chr11 5220823 5220844 5220840 5220845 +
cagctccatcaggtcctttaag

SEQ ID NO: 83664 - DNA, 22 bp, Artificial Sequence
  Synthetic oligonucleotide; TTC chr11 5220824 5220845 5220841 5220846 +
agctccatcaggtcctttaagg

SEQ ID NO: 83665 - DNA, 22 bp, Artificial Sequence
  Synthetic oligonucleotide; CTC chr11 5220829 5220850 5220846 5220851 +
catcaggtcctttaaggacttc

SEQ ID NO: 83666 - DNA, 22 bp, Artificial Sequence
  Synthetic oligonucleotide; CTT chr11 5220841 5220862 5220858 5220863 +
taaggacttctgtgcattggtt

SEQ ID NO: 83667 - DNA, 22 bp, Artificial Sequence
  Synthetic oligonucleotide; TTT chr11 5220842 5220863 5220859 5220864 +
aaggacttctgtgcattggtta

SEQ ID NO: 83668 - DNA, 22 bp, Artificial Sequence
  Synthetic oligonucleotide; TTA chr11 5220843 5220864 5220860 5220865 +
aggacttctgtgcattggttat

SEQ ID NO: 83669 - DNA, 22 bp, Artificial Sequence
  Synthetic oligonucleotide; CTT chr11 5220850 5220871 5220867 5220872 +
ctgtgcattggttattctagtt

SEQ ID NO: 83670 - DNA, 22 bp, Artificial Sequence
  Synthetic oligonucleotide; TTC chr11 5220851 5220872 5220868 5220873 +
tgtgcattggttattctagtta

SEQ ID NO: 83671 - DNA, 22 bp, Artificial Sequence
  Synthetic oligonucleotide; CTG chr11 5220853 5220874 5220870 5220875 +
tgcattggttattctagttatc

SEQ ID NO: 83672 - DNA, 22 bp, Artificial Sequence
  Synthetic oligonucleotide; TTG chr11 5220860 5220881 5220877 5220882 +
gttattctagttatccattcat

SEQ ID NO: 83673 - DNA, 22 bp, Artificial Sequence
  Synthetic oligonucleotide; TTA chr11 5220864 5220885 5220881 5220886 +
ttctagttatccattcatctaa

SEQ ID NO: 83674 - DNA, 22 bp, Artificial Sequence
  Synthetic oligonucleotide; TTC chr11 5220867 5220888 5220884 5220889 +
tagttatccattcatctaattt

SEQ ID NO: 83675 - DNA, 22 bp, Artificial Sequence
  Synthetic oligonucleotide; CTA chr11 5220869 5220890 5220886 5220891 +
gttatccattcatctaattttt

SEQ ID NO: 83676 - DNA, 22 bp, Artificial Sequence
  Synthetic oligonucleotide; TTA chr11 5220873 5220894 5220890 5220895 +
tccattcatctaattttttttc

SEQ ID NO: 83677 - DNA, 22 bp, Artificial Sequence
  Synthetic oligonucleotide; TTC chr11 5220880 5220901 5220897 5220902 +
atctaattttttttcaaagttt

SEQ ID NO: 83678 - DNA, 22 bp, Artificial Sequence
  Synthetic oligonucleotide; CTA chr11 5220885 5220906 5220902 5220907 +
attttttttcaaagttttttac

SEQ ID NO: 83679 - DNA, 22 bp, Artificial Sequence
  Synthetic oligonucleotide; TTT chr11 5220889 5220910 5220906 5220911 +
tttttcaaagttttttacttct

SEQ ID NO: 83680 - DNA, 22 bp, Artificial Sequence
  Synthetic oligonucleotide; TTT chr11 5220890 5220911 5220907 5220912 +
ttttcaaagttttttacttctt

SEQ ID NO: 83681 - DNA, 22 bp, Artificial Sequence
  Synthetic oligonucleotide; TTT chr11 5220891 5220912 5220908 5220913 +
tttcaaagttttttacttcttt

SEQ ID NO: 83682 - DNA, 22 bp, Artificial Sequence
  Synthetic oligonucleotide; TTT chr11 5220892 5220913 5220909 5220914 +
ttcaaagttttttacttctttg

SEQ ID NO: 83683 - DNA, 22 bp, Artificial Sequence
  Synthetic oligonucleotide; TTT chr11 5220893 5220914 5220910 5220915 +
tcaaagttttttacttctttgc

SEQ ID NO: 83684 - DNA, 22 bp, Artificial Sequence
  Synthetic oligonucleotide; TTT chr11 5220894 5220915 5220911 5220916 +
caaagttttttacttctttgcc

SEQ ID NO: 83685 - DNA, 22 bp, Artificial Sequence
  Synthetic oligonucleotide; TTC chr11 5220895 5220916 5220912 5220917 +
aaagttttttacttctttgccg

SEQ ID NO: 83686 - DNA, 22 bp, Artificial Sequence
  Synthetic oligonucleotide; TTT chr11 5220902 5220923 5220919 5220924 +
tttacttctttgccgtttgttc

SEQ ID NO: 83687 - DNA, 22 bp, Artificial Sequence
  Synthetic oligonucleotide; TTT chr11 5220903 5220924 5220920 5220925 +
ttacttctttgccgtttgttcg

SEQ ID NO: 83688 - DNA, 22 bp, Artificial Sequence
  Synthetic oligonucleotide; TTT chr11 5220904 5220925 5220921 5220926 +
tacttctttgccgtttgttcga

SEQ ID NO: 83689 - DNA, 22 bp, Artificial Sequence
  Synthetic oligonucleotide; TTT chr11 5220905 5220926 5220922 5220927 +
acttctttgccgtttgttcgaa

SEQ ID NO: 83690 - DNA, 22 bp, Artificial Sequence
  Synthetic oligonucleotide; TTA chr11 5220906 5220927 5220923 5220928 +
cttctttgccgtttgttcgaac

SEQ ID NO: 83691 - DNA, 22 bp, Artificial Sequence
  Synthetic oligonucleotide; CTT chr11 5220909 5220930 5220926 5220931 +
ctttgccgtttgttcgaacttc

SEQ ID NO: 83692 - DNA, 22 bp, Artificial Sequence
  Synthetic oligonucleotide; TTC chr11 5220910 5220931 5220927 5220932 +
tttgccgtttgttcgaacttcc

SEQ ID NO: 83693 - DNA, 22 bp, Artificial Sequence
  Synthetic oligonucleotide; CTT chr11 5220912 5220933 5220929 5220934 +
tgccgtttgttcgaacttcctc

SEQ ID NO: 83694 - DNA, 22 bp, Artificial Sequence
  Synthetic oligonucleotide; TTT chr11 5220913 5220934 5220930 5220935 +
gccgtttgttcgaacttcctcc

SEQ ID NO: 83695 - DNA, 22 bp, Artificial Sequence
  Synthetic oligonucleotide; TTG chr11 5220914 5220935 5220931 5220936 +
ccgtttgttcgaacttcctcct

SEQ ID NO: 83696 - DNA, 22 bp, Artificial Sequence
  Synthetic oligonucleotide; TTT chr11 5220920 5220941 5220937 5220942 +
gttcgaacttcctcctttagct

SEQ ID NO: 83697 - DNA, 22 bp, Artificial Sequence
  Synthetic oligonucleotide; TTG chr11 5220921 5220942 5220938 5220943 +
ttcgaacttcctcctttagctt

SEQ ID NO: 83698 - DNA, 22 bp, Artificial Sequence
  Synthetic oligonucleotide; TTC chr11 5220924 5220945 5220941 5220946 +
gaacttcctcctttagcttgga

SEQ ID NO: 83699 - DNA, 22 bp, Artificial Sequence
  Synthetic oligonucleotide; CTT chr11 5220930 5220951 5220947 5220952 +
cctcctttagcttggagtagtt

SEQ ID NO: 83700 - DNA, 22 bp, Artificial Sequence
  Synthetic oligonucleotide; TTC chr11 5220931 5220952 5220948 5220953 +
ctcctttagcttggagtagttt

SEQ ID NO: 83701 - DNA, 22 bp, Artificial Sequence
  Synthetic oligonucleotide; CTC chr11 5220934 5220955 5220951 5220956 +
ctttagcttggagtagtttgat

SEQ ID NO: 83702 - DNA, 22 bp, Artificial Sequence
  Synthetic oligonucleotide; CTT chr11 5220937 5220958 5220954 5220959 +
tagcttggagtagtttgatctt

SEQ ID NO: 83703 - DNA, 22 bp, Artificial Sequence
  Synthetic oligonucleotide; TTT chr11 5220938 5220959 5220955 5220960 +
agcttggagtagtttgatcttc

SEQ ID NO: 83704 - DNA, 22 bp, Artificial Sequence
  Synthetic oligonucleotide; TTA chr11 5220939 5220960 5220956 5220961 +
gcttggagtagtttgatcttct

SEQ ID NO: 83705 - DNA, 22 bp, Artificial Sequence
  Synthetic oligonucleotide; CTT chr11 5220943 5220964 5220960 5220965 +
ggagtagtttgatcttctgaag

SEQ ID NO: 83706 - DNA, 22 bp, Artificial Sequence
  Synthetic oligonucleotide; TTG chr11 5220944 5220965 5220961 5220966 +
gagtagtttgatcttctgaagc

SEQ ID NO: 83707 - DNA, 22 bp, Artificial Sequence
  Synthetic oligonucleotide; TTT chr11 5220953 5220974 5220970 5220975 +
gatcttctgaagccttcctctc

SEQ ID NO: 83708 - DNA, 22 bp, Artificial Sequence
  Synthetic oligonucleotide; TTG chr11 5220954 5220975 5220971 5220976 +
atcttctgaagccttcctctct

SEQ ID NO: 83709 - DNA, 22 bp, Artificial Sequence
  Synthetic oligonucleotide; CTT chr11 5220959 5220980 5220976 5220981 +
ctgaagccttcctctctcaact

SEQ ID NO: 83710 - DNA, 22 bp, Artificial Sequence
  Synthetic oligonucleotide; TTC chr11 5220960 5220981 5220977 5220982 +
tgaagccttcctctctcaactc

SEQ ID NO: 83711 - DNA, 22 bp, Artificial Sequence
  Synthetic oligonucleotide; CTG chr11 5220962 5220983 5220979 5220984 +
aagccttcctctctcaactcgt

SEQ ID NO: 83712 - DNA, 22 bp, Artificial Sequence
  Synthetic oligonucleotide; CTT chr11 5220969 5220990 5220986 5220991 +
cctctctcaactcgtcaaagtc

SEQ ID NO: 83713 - DNA, 22 bp, Artificial Sequence
  Synthetic oligonucleotide; TTC chr11 5220970 5220991 5220987 5220992 +
ctctctcaactcgtcaaagtca

SEQ ID NO: 83714 - DNA, 22 bp, Artificial Sequence
  Synthetic oligonucleotide; CTC chr11 5220973 5220994 5220990 5220995 +
tctcaactcgtcaaagtcattc

SEQ ID NO: 83715 - DNA, 22 bp, Artificial Sequence
  Synthetic oligonucleotide; CTC chr11 5220975 5220996 5220992 5220997 +
tcaactcgtcaaagtcattctc

SEQ ID NO: 83716 - DNA, 22 bp, Artificial Sequence
  Synthetic oligonucleotide; CTC chr11 5220977 5220998 5220994 5220999 +
aactcgtcaaagtcattctctg

SEQ ID NO: 83717 - DNA, 22 bp, Artificial Sequence
  Synthetic oligonucleotide; CTC chr11 5220982 5221003 5220999 5221004 +
gtcaaagtcattctctgcccag

SEQ ID NO: 83718 - DNA, 22 bp, Artificial Sequence
  Synthetic oligonucleotide; TTC chr11 5220995 5221016 5221012 5221017 +
tctgcccagctttgttccattg

SEQ ID NO: 83719 - DNA, 22 bp, Artificial Sequence
  Synthetic oligonucleotide; CTC chr11 5220997 5221018 5221014 5221019 +
tgcccagctttgttccattgct

SEQ ID NO: 83720 - DNA, 22 bp, Artificial Sequence
  Synthetic oligonucleotide; CTG chr11 5220999 5221020 5221016 5221021 +
cccagctttgttccattgctgg

SEQ ID NO: 83721 - DNA, 22 bp, Artificial Sequence
  Synthetic oligonucleotide; CTT chr11 5221007 5221028 5221024 5221029 +
tgttccattgctggtgaggagc

SEQ ID NO: 83722 - DNA, 22 bp, Artificial Sequence
  Synthetic oligonucleotide; TTT chr11 5221008 5221029 5221025 5221030 +
gttccattgctggtgaggagct

SEQ ID NO: 83723 - DNA, 22 bp, Artificial Sequence
  Synthetic oligonucleotide; TTG chr11 5221009 5221030 5221026 5221031 +
ttccattgctggtgaggagctg

SEQ ID NO: 83724 - DNA, 22 bp, Artificial Sequence
  Synthetic oligonucleotide; TTC chr11 5221012 5221033 5221029 5221034 +
cattgctggtgaggagctgcgt

SEQ ID NO: 83725 - DNA, 22 bp, Artificial Sequence
  Synthetic oligonucleotide; TTG chr11 5221017 5221038 5221034 5221039 +
ctggtgaggagctgcgttactt

SEQ ID NO: 83726 - DNA, 22 bp, Artificial Sequence
  Synthetic oligonucleotide; CTG chr11 5221020 5221041 5221037 5221042 +
gtgaggagctgcgttactttgg

SEQ ID NO: 83727 - DNA, 22 bp, Artificial Sequence
  Synthetic oligonucleotide; CTG chr11 5221031 5221052 5221048 5221053 +
cgttactttggaggaggagagg

SEQ ID NO: 83728 - DNA, 22 bp, Artificial Sequence
  Synthetic oligonucleotide; TTA chr11 5221036 5221057 5221053 5221058 +
ctttggaggaggagaggcactc

SEQ ID NO: 83729 - DNA, 22 bp, Artificial Sequence
  Synthetic oligonucleotide; CTT chr11 5221039 5221060 5221056 5221061 +
tggaggaggagaggcactctca

SEQ ID NO: 83730 - DNA, 22 bp, Artificial Sequence
  Synthetic oligonucleotide; TTT chr11 5221040 5221061 5221057 5221062 +
ggaggaggagaggcactctcat

SEQ ID NO: 83731 - DNA, 22 bp, Artificial Sequence
  Synthetic oligonucleotide; TTG chr11 5221041 5221062 5221058 5221063 +
gaggaggagaggcactctcatt

SEQ ID NO: 83732 - DNA, 22 bp, Artificial Sequence
  Synthetic oligonucleotide; CTC chr11 5221058 5221079 5221075 5221080 +
tcatttttagagtgtccagttt

SEQ ID NO: 83733 - DNA, 22 bp, Artificial Sequence
  Synthetic oligonucleotide; CTC chr11 5221060 5221081 5221077 5221082 +
atttttagagtgtccagttttt

SEQ ID NO: 83734 - DNA, 22 bp, Artificial Sequence
  Synthetic oligonucleotide; TTT chr11 5221064 5221085 5221081 5221086 +
ttagagtgtccagtttttctgc

SEQ ID NO: 83735 - DNA, 22 bp, Artificial Sequence
  Synthetic oligonucleotide; TTT chr11 5221065 5221086 5221082 5221087 +
tagagtgtccagtttttctgct

SEQ ID NO: 83736 - DNA, 22 bp, Artificial Sequence
  Synthetic oligonucleotide; TTT chr11 5221066 5221087 5221083 5221088 +
agagtgtccagtttttctgctc

SEQ ID NO: 83737 - DNA, 22 bp, Artificial Sequence
  Synthetic oligonucleotide; TTA chr11 5221067 5221088 5221084 5221089 +
gagtgtccagtttttctgctct

SEQ ID NO: 83738 - DNA, 22 bp, Artificial Sequence
  Synthetic oligonucleotide; TTT chr11 5221080 5221101 5221097 5221102 +
ttctgctctgctttttccccat

SEQ ID NO: 83739 - DNA, 22 bp, Artificial Sequence
  Synthetic oligonucleotide; TTT chr11 5221081 5221102 5221098 5221103 +
tctgctctgctttttccccatc

SEQ ID NO: 83740 - DNA, 22 bp, Artificial Sequence
  Synthetic oligonucleotide; TTT chr11 5221082 5221103 5221099 5221104 +
ctgctctgctttttccccatct

SEQ ID NO: 83741 - DNA, 22 bp, Artificial Sequence
  Synthetic oligonucleotide; TTC chr11 5221083 5221104 5221100 5221105 +
tgctctgctttttccccatctt

SEQ ID NO: 83742 - DNA, 22 bp, Artificial Sequence
  Synthetic oligonucleotide; CTG chr11 5221085 5221106 5221102 5221107 +
ctctgctttttccccatcttta

SEQ ID NO: 83743 - DNA, 22 bp, Artificial Sequence
  Synthetic oligonucleotide; CTC chr11 5221088 5221109 5221105 5221110 +
tgctttttccccatctttatgg

SEQ ID NO: 83744 - DNA, 22 bp, Artificial Sequence
  Synthetic oligonucleotide; CTG chr11 5221090 5221111 5221107 5221112 +
ctttttccccatctttatggtt

SEQ ID NO: 83745 - DNA, 22 bp, Artificial Sequence
  Synthetic oligonucleotide; CTT chr11 5221093 5221114 5221110 5221115 +
tttccccatctttatggtttta

SEQ ID NO: 83746 - DNA, 22 bp, Artificial Sequence
  Synthetic oligonucleotide; TTT chr11 5221094 5221115 5221111 5221116 +
ttccccatctttatggttttat

SEQ ID NO: 83747 - DNA, 22 bp, Artificial Sequence
  Synthetic oligonucleotide; TTT chr11 5221095 5221116 5221112 5221117 +
tccccatctttatggttttatc

SEQ ID NO: 83748 - DNA, 22 bp, Artificial Sequence
  Synthetic oligonucleotide; TTT chr11 5221096 5221117 5221113 5221118 +
ccccatctttatggttttatct

SEQ ID NO: 83749 - DNA, 22 bp, Artificial Sequence
  Synthetic oligonucleotide; TTC chr11 5221097 5221118 5221114 5221119 +
cccatctttatggttttatcta

SEQ ID NO: 83750 - DNA, 22 bp, Artificial Sequence
  Synthetic oligonucleotide; CTT chr11 5221105 5221126 5221122 5221127 +
tatggttttatctacctttggt

SEQ ID NO: 83751 - DNA, 22 bp, Artificial Sequence
  Synthetic oligonucleotide; TTT chr11 5221106 5221127 5221123 5221128 +
atggttttatctacctttggtc

SEQ ID NO: 83752 - DNA, 22 bp, Artificial Sequence
  Synthetic oligonucleotide; TTA chr11 5221107 5221128 5221124 5221129 +
tggttttatctacctttggtct

SEQ ID NO: 83753 - DNA, 22 bp, Artificial Sequence
  Synthetic oligonucleotide; TTT chr11 5221113 5221134 5221130 5221135 +
tatctacctttggtctttgatg

SEQ ID NO: 83754 - DNA, 22 bp, Artificial Sequence
  Synthetic oligonucleotide; TTT chr11 5221114 5221135 5221131 5221136 +
atctacctttggtctttgatga

SEQ ID NO: 83755 - DNA, 22 bp, Artificial Sequence
  Synthetic oligonucleotide; TTA chr11 5221115 5221136 5221132 5221137 +
tctacctttggtctttgatgat

SEQ ID NO: 83756 - DNA, 22 bp, Artificial Sequence
  Synthetic oligonucleotide; CTA chr11 5221119 5221140 5221136 5221141 +
cctttggtctttgatgatggcg

SEQ ID NO: 83757 - DNA, 22 bp, Artificial Sequence
  Synthetic oligonucleotide; CTT chr11 5221123 5221144 5221140 5221145 +
tggtctttgatgatggcgatgt

SEQ ID NO: 83758 - DNA, 22 bp, Artificial Sequence
  Synthetic oligonucleotide; TTT chr11 5221124 5221145 5221141 5221146 +
ggtctttgatgatggcgatgta

SEQ ID NO: 83759 - DNA, 22 bp, Artificial Sequence
  Synthetic oligonucleotide; TTG chr11 5221125 5221146 5221142 5221147 +
gtctttgatgatggcgatgtac

SEQ ID NO: 83760 - DNA, 22 bp, Artificial Sequence
  Synthetic oligonucleotide; CTT chr11 5221130 5221151 5221147 5221152 +
tgatgatggcgatgtacagatg

SEQ ID NO: 83761 - DNA, 22 bp, Artificial Sequence
  Synthetic oligonucleotide; TTT chr11 5221131 5221152 5221148 5221153 +
gatgatggcgatgtacagatgg

SEQ ID NO: 83762 - DNA, 22 bp, Artificial Sequence
  Synthetic oligonucleotide; TTG chr11 5221132 5221153 5221149 5221154 +
atgatggcgatgtacagatggg

SEQ ID NO: 83763 - DNA, 22 bp, Artificial Sequence
  Synthetic oligonucleotide; TTT chr11 5221157 5221178 5221174 5221179 +
ttggtgtggatgtcctttctgt

SEQ ID NO: 83764 - DNA, 22 bp, Artificial Sequence
  Synthetic oligonucleotide; TTT chr11 5221158 5221179 5221175 5221180 +
tggtgtggatgtcctttctgtt

SEQ ID NO: 83765 - DNA, 22 bp, Artificial Sequence
  Synthetic oligonucleotide; TTT chr11 5221159 5221180 5221176 5221181 +
ggtgtggatgtcctttctgttt

SEQ ID NO: 83766 - DNA, 22 bp, Artificial Sequence
  Synthetic oligonucleotide; TTG chr11 5221160 5221181 5221177 5221182 +
gtgtggatgtcctttctgtttg

SEQ ID NO: 83767 - DNA, 22 bp, Artificial Sequence
  Synthetic oligonucleotide; CTT chr11 5221174 5221195 5221191 5221196 +
tctgtttgttagttttccttct

SEQ ID NO: 83768 - DNA, 22 bp, Artificial Sequence
  Synthetic oligonucleotide; TTT chr11 5221175 5221196 5221192 5221197 +
ctgtttgttagttttccttcta

SEQ ID NO: 83769 - DNA, 22 bp, Artificial Sequence
  Synthetic oligonucleotide; TTC chr11 5221176 5221197 5221193 5221198 +
tgtttgttagttttccttctaa

SEQ ID NO: 83770 - DNA, 22 bp, Artificial Sequence
  Synthetic oligonucleotide; CTG chr11 5221178 5221199 5221195 5221200 +
tttgttagttttccttctaaca

SEQ ID NO: 83771 - DNA, 22 bp, Artificial Sequence
  Synthetic oligonucleotide; TTT chr11 5221181 5221202 5221198 5221203 +
gttagttttccttctaacagtc

SEQ ID NO: 83772 - DNA, 22 bp, Artificial Sequence
  Synthetic oligonucleotide; TTG chr11 5221182 5221203 5221199 5221204 +
ttagttttccttctaacagtca

SEQ ID NO: 83773 - DNA, 22 bp, Artificial Sequence
  Synthetic oligonucleotide; TTA chr11 5221185 5221206 5221202 5221207 +
gttttccttctaacagtcagga

SEQ ID NO: 83774 - DNA, 22 bp, Artificial Sequence
  Synthetic oligonucleotide; TTT chr11 5221189 5221210 5221206 5221211 +
tccttctaacagtcaggaccct

SEQ ID NO: 83775 - DNA, 22 bp, Artificial Sequence
  Synthetic oligonucleotide; TTT chr11 5221190 5221211 5221207 5221212 +
ccttctaacagtcaggaccctc

SEQ ID NO: 83776 - DNA, 22 bp, Artificial Sequence
  Synthetic oligonucleotide; TTC chr11 5221191 5221212 5221208 5221213 +
cttctaacagtcaggaccctca

SEQ ID NO: 83777 - DNA, 22 bp, Artificial Sequence
  Synthetic oligonucleotide; CTT chr11 5221194 5221215 5221211 5221216 +
ctaacagtcaggaccctcagct

SEQ ID NO: 83778 - DNA, 22 bp, Artificial Sequence
  Synthetic oligonucleotide; TTC chr11 5221195 5221216 5221212 5221217 +
taacagtcaggaccctcagctg

SEQ ID NO: 83779 - DNA, 22 bp, Artificial Sequence
  Synthetic oligonucleotide; CTA chr11 5221197 5221218 5221214 5221219 +
acagtcaggaccctcagctgca

SEQ ID NO: 83780 - DNA, 22 bp, Artificial Sequence
  Synthetic oligonucleotide; CTC chr11 5221212 5221233 5221229 5221234 +
agctgcaggtctgttggagttt

SEQ ID NO: 83781 - DNA, 22 bp, Artificial Sequence
  Synthetic oligonucleotide; CTG chr11 5221217 5221238 5221234 5221239 +
caggtctgttggagtttactgg

SEQ ID NO: 83782 - DNA, 22 bp, Artificial Sequence
  Synthetic oligonucleotide; CTG chr11 5221225 5221246 5221242 5221247 +
ttggagtttactggaggtccac

SEQ ID NO: 83783 - DNA, 22 bp, Artificial Sequence
  Synthetic oligonucleotide; TTG chr11 5221228 5221249 5221245 5221250 +
gagtttactggaggtccactcc

SEQ ID NO: 83784 - DNA, 22 bp, Artificial Sequence
  Synthetic oligonucleotide; TTT chr11 5221234 5221255 5221251 5221256 +
actggaggtccactccagaagc

SEQ ID NO: 83785 - DNA, 22 bp, Artificial Sequence
  Synthetic oligonucleotide; TTA chr11 5221235 5221256 5221252 5221257 +
ctggaggtccactccagaagct

SEQ ID NO: 83786 - DNA, 22 bp, Artificial Sequence
  Synthetic oligonucleotide; CTG chr11 5221238 5221259 5221255 5221260 +
gaggtccactccagaagctgtt

SEQ ID NO: 83787 - DNA, 22 bp, Artificial Sequence
  Synthetic oligonucleotide; CTC chr11 5221249 5221270 5221266 5221271 +
cagaagctgttttcctgggtat

SEQ ID NO: 83788 - DNA, 22 bp, Artificial Sequence
  Synthetic oligonucleotide; CTG chr11 5221258 5221279 5221275 5221280 +
ttttcctgggtatcaacagcgg

SEQ ID NO: 83789 - DNA, 22 bp, Artificial Sequence
  Synthetic oligonucleotide; TTT chr11 5221261 5221282 5221278 5221283 +
tcctgggtatcaacagcggtgg

SEQ ID NO: 83790 - DNA, 22 bp, Artificial Sequence
  Synthetic oligonucleotide; TTT chr11 5221262 5221283 5221279 5221284 +
cctgggtatcaacagcggtggc

SEQ ID NO: 83791 - DNA, 22 bp, Artificial Sequence
  Synthetic oligonucleotide; TTC chr11 5221263 5221284 5221280 5221285 +
ctgggtatcaacagcggtggct

SEQ ID NO: 83792 - DNA, 22 bp, Artificial Sequence
  Synthetic oligonucleotide; CTG chr11 5221266 5221287 5221283 5221288 +
ggtatcaacagcggtggctgca

SEQ ID NO: 83793 - DNA, 22 bp, Artificial Sequence
  Synthetic oligonucleotide; CTG chr11 5221286 5221307 5221303 5221308 +
cagaacagtggatattggtgaa

SEQ ID NO: 83794 - DNA, 22 bp, Artificial Sequence
  Synthetic oligonucleotide; TTG chr11 5221303 5221324 5221320 5221325 +
gtgaaccgcaaatgctgctgcc

SEQ ID NO: 83795 - DNA, 22 bp, Artificial Sequence
  Synthetic oligonucleotide; CTG chr11 5221320 5221341 5221337 5221342 +
ctgcctgatcattcctctggaa

SEQ ID NO: 83796 - DNA, 22 bp, Artificial Sequence
  Synthetic oligonucleotide; CTG chr11 5221323 5221344 5221340 5221345 +
cctgatcattcctctggaagtt

SEQ ID NO: 83797 - DNA, 22 bp, Artificial Sequence
  Synthetic oligonucleotide; CTG chr11 5221327 5221348 5221344 5221349 +
atcattcctctggaagttttgt

SEQ ID NO: 83798 - DNA, 22 bp, Artificial Sequence
  Synthetic oligonucleotide; TTC chr11 5221334 5221355 5221351 5221356 +
ctctggaagttttgtcttagag

SEQ ID NO: 83799 - DNA, 22 bp, Artificial Sequence
  Synthetic oligonucleotide; CTC chr11 5221337 5221358 5221354 5221359 +
tggaagttttgtcttagaggag

SEQ ID NO: 83800 - DNA, 22 bp, Artificial Sequence
  Synthetic oligonucleotide; CTG chr11 5221339 5221360 5221356 5221361 +
gaagttttgtcttagaggagta

SEQ ID NO: 83801 - DNA, 22 bp, Artificial Sequence
  Synthetic oligonucleotide; TTT chr11 5221346 5221367 5221363 5221368 +
tgtcttagaggagtaccagcca

SEQ ID NO: 83802 - DNA, 22 bp, Artificial Sequence
  Synthetic oligonucleotide; TTT chr11 5221347 5221368 5221364 5221369 +
gtcttagaggagtaccagccat

SEQ ID NO: 83803 - DNA, 22 bp, Artificial Sequence
  Synthetic oligonucleotide; TTG chr11 5221348 5221369 5221365 5221370 +
tcttagaggagtaccagccatg

SEQ ID NO: 83804 - DNA, 22 bp, Artificial Sequence
  Synthetic oligonucleotide; CTT chr11 5221352 5221373 5221369 5221374 +
agaggagtaccagccatgtgag

SEQ ID NO: 83805 - DNA, 22 bp, Artificial Sequence
  Synthetic oligonucleotide; TTA chr11 5221353 5221374 5221370 5221375 +
gaggagtaccagccatgtgagg

SEQ ID NO: 83806 - DNA, 22 bp, Artificial Sequence
  Synthetic oligonucleotide; CTG chr11 5221385 5221406 5221402 5221407 +
cccctactgggggatgcctccc

SEQ ID NO: 83807 - DNA, 22 bp, Artificial Sequence
  Synthetic oligonucleotide; CTA chr11 5221391 5221412 5221408 5221413 +
ctgggggatgcctcccagttag

SEQ ID NO: 83808 - DNA, 22 bp, Artificial Sequence
  Synthetic oligonucleotide; CTG chr11 5221394 5221415 5221411 5221416 +
ggggatgcctcccagttaggct

SEQ ID NO: 83809 - DNA, 22 bp, Artificial Sequence
  Synthetic oligonucleotide; CTC chr11 5221405 5221426 5221422 5221427 +
ccagttaggctactcgggggtc

SEQ ID NO: 83810 - DNA, 22 bp, Artificial Sequence
  Synthetic oligonucleotide; TTA chr11 5221412 5221433 5221429 5221434 +
ggctactcgggggtcagggacc

SEQ ID NO: 83811 - DNA, 22 bp, Artificial Sequence
  Synthetic oligonucleotide; CTA chr11 5221417 5221438 5221434 5221439 +
ctcgggggtcagggacccactt

SEQ ID NO: 83812 - DNA, 22 bp, Artificial Sequence
  Synthetic oligonucleotide; CTC chr11 5221420 5221441 5221437 5221442 +
gggggtcagggacccacttgag

SEQ ID NO: 83813 - DNA, 22 bp, Artificial Sequence
  Synthetic oligonucleotide; CTT chr11 5221439 5221460 5221456 5221461 +
gaggaggcagtctgcctgttct

SEQ ID NO: 83814 - DNA, 22 bp, Artificial Sequence
  Synthetic oligonucleotide; TTG chr11 5221440 5221461 5221457 5221462 +
aggaggcagtctgcctgttctc

SEQ ID NO: 83815 - DNA, 22 bp, Artificial Sequence
  Synthetic oligonucleotide; CTG chr11 5221453 5221474 5221470 5221475 +
cctgttctcagatctgaagcta

SEQ ID NO: 83816 - DNA, 22 bp, Artificial Sequence
  Synthetic oligonucleotide; CTG chr11 5221457 5221478 5221474 5221479 +
ttctcagatctgaagctatgtg

SEQ ID NO: 83817 - DNA, 22 bp, Artificial Sequence
  Synthetic oligonucleotide; TTC chr11 5221460 5221481 5221477 5221482 +
tcagatctgaagctatgtgctg

SEQ ID NO: 83818 - DNA, 22 bp, Artificial Sequence
  Synthetic oligonucleotide; CTC chr11 5221462 5221483 5221479 5221484 +
agatctgaagctatgtgctggg

SEQ ID NO: 83819 - DNA, 22 bp, Artificial Sequence
  Synthetic oligonucleotide; CTG chr11 5221469 5221490 5221486 5221491 +
aagctatgtgctgggagaacca

SEQ ID NO: 83820 - DNA, 22 bp, Artificial Sequence
  Synthetic oligonucleotide; CTA chr11 5221475 5221496 5221492 5221497 +
tgtgctgggagaaccactactc

SEQ ID NO: 83821 - DNA, 22 bp, Artificial Sequence
  Synthetic oligonucleotide; CTG chr11 5221482 5221503 5221499 5221504 +
ggagaaccactactctcttcaa

SEQ ID NO: 83822 - DNA, 22 bp, Artificial Sequence
  Synthetic oligonucleotide; CTA chr11 5221494 5221515 5221511 5221516 +
ctctcttcaaagctgtcagaca

SEQ ID NO: 83823 - DNA, 22 bp, Artificial Sequence
  Synthetic oligonucleotide; CTC chr11 5221497 5221518 5221514 5221519 +
tcttcaaagctgtcagacaggg

SEQ ID NO: 83824 - DNA, 22 bp, Artificial Sequence
  Synthetic oligonucleotide; CTC chr11 5221499 5221520 5221516 5221521 +
ttcaaagctgtcagacagggac

SEQ ID NO: 83825 - DNA, 22 bp, Artificial Sequence
  Synthetic oligonucleotide; CTT chr11 5221501 5221522 5221518 5221523 +
caaagctgtcagacagggacat

SEQ ID NO: 83826 - DNA, 22 bp, Artificial Sequence
  Synthetic oligonucleotide; TTC chr11 5221502 5221523 5221519 5221524 +
aaagctgtcagacagggacatt

SEQ ID NO: 83827 - DNA, 22 bp, Artificial Sequence
  Synthetic oligonucleotide; CTG chr11 5221509 5221530 5221526 5221531 +
tcagacagggacatttaagtct

SEQ ID NO: 83828 - DNA, 22 bp, Artificial Sequence
  Synthetic oligonucleotide; TTT chr11 5221525 5221546 5221542 5221547 +
aagtctgcagaggttcttgttg

SEQ ID NO: 83829 - DNA, 22 bp, Artificial Sequence
  Synthetic oligonucleotide; TTA chr11 5221526 5221547 5221543 5221548 +
agtctgcagaggttcttgttgt

SEQ ID NO: 83830 - DNA, 22 bp, Artificial Sequence
  Synthetic oligonucleotide; CTG chr11 5221532 5221553 5221549 5221554 +
cagaggttcttgttgtcttttg

SEQ ID NO: 83831 - DNA, 22 bp, Artificial Sequence
  Synthetic oligonucleotide; TTC chr11 5221541 5221562 5221558 5221563 +
ttgttgtcttttgtttgtctgt

SEQ ID NO: 83832 - DNA, 22 bp, Artificial Sequence
  Synthetic oligonucleotide; CTT chr11 5221543 5221564 5221560 5221565 +
gttgtcttttgtttgtctgtgc

SEQ ID NO: 83833 - DNA, 22 bp, Artificial Sequence
  Synthetic oligonucleotide; TTG chr11 5221544 5221565 5221561 5221566 +
ttgtcttttgtttgtctgtgcc

SEQ ID NO: 83834 - DNA, 22 bp, Artificial Sequence
  Synthetic oligonucleotide; TTG chr11 5221547 5221568 5221564 5221569 +
tcttttgtttgtctgtgccctg

SEQ ID NO: 83835 - DNA, 22 bp, Artificial Sequence
  Synthetic oligonucleotide; CTT chr11 5221551 5221572 5221568 5221573 +
ttgtttgtctgtgccctgcccc

SEQ ID NO: 83836 - DNA, 22 bp, Artificial Sequence
  Synthetic oligonucleotide; TTT chr11 5221552 5221573 5221569 5221574 +
tgtttgtctgtgccctgcccct

SEQ ID NO: 83837 - DNA, 22 bp, Artificial Sequence
  Synthetic oligonucleotide; TTT chr11 5221553 5221574 5221570 5221575 +
gtttgtctgtgccctgccccta

SEQ ID NO: 83838 - DNA, 22 bp, Artificial Sequence
  Synthetic oligonucleotide; TTG chr11 5221554 5221575 5221571 5221576 +
tttgtctgtgccctgcccctag

SEQ ID NO: 83839 - DNA, 22 bp, Artificial Sequence
  Synthetic oligonucleotide; TTT chr11 5221557 5221578 5221574 5221579 +
gtctgtgccctgcccctagagg

SEQ ID NO: 83840 - DNA, 22 bp, Artificial Sequence
  Synthetic oligonucleotide; TTG chr11 5221558 5221579 5221575 5221580 +
tctgtgccctgcccctagaggt

SEQ ID NO: 83841 - DNA, 22 bp, Artificial Sequence
  Synthetic oligonucleotide; CTG chr11 5221562 5221583 5221579 5221584 +
tgccctgcccctagaggtggag

SEQ ID NO: 83842 - DNA, 22 bp, Artificial Sequence
  Synthetic oligonucleotide; CTG chr11 5221569 5221590 5221586 5221591 +
cccctagaggtggagcctacag

SEQ ID NO: 83843 - DNA, 22 bp, Artificial Sequence
  Synthetic oligonucleotide; CTA chr11 5221575 5221596 5221592 5221597 +
gaggtggagcctacagaggcag

SEQ ID NO: 83844 - DNA, 22 bp, Artificial Sequence
  Synthetic oligonucleotide; CTA chr11 5221588 5221609 5221605 5221610 +
cagaggcaggcaggcctccttg

SEQ ID NO: 83845 - DNA, 22 bp, Artificial Sequence
  Synthetic oligonucleotide; CTC chr11 5221606 5221627 5221623 5221628 +
cttgagctgtggtgggctccac

SEQ ID NO: 83846 - DNA, 22 bp, Artificial Sequence
  Synthetic oligonucleotide; CTT chr11 5221609 5221630 5221626 5221631 +
gagctgtggtgggctccaccca

SEQ ID NO: 83847 - DNA, 22 bp, Artificial Sequence
  Synthetic oligonucleotide; TTG chr11 5221610 5221631 5221627 5221632 +
agctgtggtgggctccacccag

SEQ ID NO: 83848 - DNA, 22 bp, Artificial Sequence
  Synthetic oligonucleotide; CTG chr11 5221615 5221636 5221632 5221637 +
tggtgggctccacccagttcga

SEQ ID NO: 83849 - DNA, 22 bp, Artificial Sequence
  Synthetic oligonucleotide; CTC chr11 5221625 5221646 5221642 5221647 +
cacccagttcgagcttccaggc

SEQ ID NO: 83850 - DNA, 22 bp, Artificial Sequence
  Synthetic oligonucleotide; TTC chr11 5221635 5221656 5221652 5221657 +
gagcttccaggcggctttgttt

SEQ ID NO: 83851 - DNA, 22 bp, Artificial Sequence
  Synthetic oligonucleotide; CTT chr11 5221641 5221662 5221658 5221663 +
ccaggcggctttgtttacctgc

SEQ ID NO: 83852 - DNA, 22 bp, Artificial Sequence
  Synthetic oligonucleotide; TTC chr11 5221642 5221663 5221659 5221664 +
caggcggctttgtttacctgct

SEQ ID NO: 83853 - DNA, 22 bp, Artificial Sequence
  Synthetic oligonucleotide; CTT chr11 5221652 5221673 5221669 5221674 +
tgtttacctgctcaagcctgga

SEQ ID NO: 83854 - DNA, 22 bp, Artificial Sequence
  Synthetic oligonucleotide; TTT chr11 5221653 5221674 5221670 5221675 +
gtttacctgctcaagcctggac

SEQ ID NO: 83855 - DNA, 22 bp, Artificial Sequence
  Synthetic oligonucleotide; TTG chr11 5221654 5221675 5221671 5221676 +
tttacctgctcaagcctggaca

SEQ ID NO: 83856 - DNA, 22 bp, Artificial Sequence
  Synthetic oligonucleotide; TTT chr11 5221657 5221678 5221674 5221679 +
acctgctcaagcctggacaatg

SEQ ID NO: 83857 - DNA, 22 bp, Artificial Sequence
  Synthetic oligonucleotide; TTA chr11 5221658 5221679 5221675 5221680 +
cctgctcaagcctggacaatgg

SEQ ID NO: 83858 - DNA, 22 bp, Artificial Sequence
  Synthetic oligonucleotide; CTG chr11 5221662 5221683 5221679 5221684 +
ctcaagcctggacaatggtggg

SEQ ID NO: 83859 - DNA, 22 bp, Artificial Sequence
  Synthetic oligonucleotide; CTC chr11 5221665 5221686 5221682 5221687 +
aagcctggacaatggtgggcac

SEQ ID NO: 83860 - DNA, 22 bp, Artificial Sequence
  Synthetic oligonucleotide; CTG chr11 5221672 5221693 5221689 5221694 +
gacaatggtgggcacccctccc

SEQ ID NO: 83861 - DNA, 22 bp, Artificial Sequence
  Synthetic oligonucleotide; CTC chr11 5221692 5221713 5221709 5221714 +
ccccagcctcactgccaccttg

SEQ ID NO: 83862 - DNA, 22 bp, Artificial Sequence
  Synthetic oligonucleotide; CTC chr11 5221702 5221723 5221719 5221724 +
actgccaccttgcagtttgacc

SEQ ID NO: 83863 - DNA, 22 bp, Artificial Sequence
  Synthetic oligonucleotide; CTG chr11 5221706 5221727 5221723 5221728 +
ccaccttgcagtttgacctcag

SEQ ID NO: 83864 - DNA, 22 bp, Artificial Sequence
  Synthetic oligonucleotide; CTT chr11 5221713 5221734 5221730 5221735 +
gcagtttgacctcagactgctg

SEQ ID NO: 83865 - DNA, 22 bp, Artificial Sequence
  Synthetic oligonucleotide; TTG chr11 5221714 5221735 5221731 5221736 +
cagtttgacctcagactgctgt

SEQ ID NO: 83866 - DNA, 22 bp, Artificial Sequence
  Synthetic oligonucleotide; TTT chr11 5221720 5221741 5221737 5221742 +
gacctcagactgctgtgctagc

SEQ ID NO: 83867 - DNA, 22 bp, Artificial Sequence
  Synthetic oligonucleotide; TTG chr11 5221721 5221742 5221738 5221743 +
acctcagactgctgtgctagca

SEQ ID NO: 83868 - DNA, 22 bp, Artificial Sequence
  Synthetic oligonucleotide; CTC chr11 5221726 5221747 5221743 5221748 +
agactgctgtgctagcaatgag

SEQ ID NO: 83869 - DNA, 22 bp, Artificial Sequence
  Synthetic oligonucleotide; CTG chr11 5221732 5221753 5221749 5221754 +
ctgtgctagcaatgagcgaggc

SEQ ID NO: 83870 - DNA, 22 bp, Artificial Sequence
  Synthetic oligonucleotide; CTG chr11 5221735 5221756 5221752 5221757 +
tgctagcaatgagcgaggctcc

SEQ ID NO: 83871 - DNA, 22 bp, Artificial Sequence
  Synthetic oligonucleotide; CTA chr11 5221740 5221761 5221757 5221762 +
gcaatgagcgaggctccatggg

SEQ ID NO: 83872 - DNA, 22 bp, Artificial Sequence
  Synthetic oligonucleotide; CTC chr11 5221756 5221777 5221773 5221778 +
catgggcgtaggaccctctgag

SEQ ID NO: 83873 - DNA, 22 bp, Artificial Sequence
  Synthetic oligonucleotide; CTC chr11 5221774 5221795 5221791 5221796 +
tgagccaggcatgggatataat

SEQ ID NO: 83874 - DNA, 22 bp, Artificial Sequence
  Synthetic oligonucleotide; CTG chr11 5221776 5221797 5221793 5221798 +
agccaggcatgggatataatct

SEQ ID NO: 83875 - DNA, 22 bp, Artificial Sequence
  Synthetic oligonucleotide; CTC chr11 5221799 5221820 5221816 5221821 +
ctggtgtgccatttgttaagct

SEQ ID NO: 83876 - DNA, 22 bp, Artificial Sequence
  Synthetic oligonucleotide; CTG chr11 5221802 5221823 5221819 5221824 +
gtgtgccatttgttaagcttgt

SEQ ID NO: 83877 - DNA, 22 bp, Artificial Sequence
  Synthetic oligonucleotide; TTT chr11 5221813 5221834 5221830 5221835 +
gttaagcttgttggaagagcgc

SEQ ID NO: 83878 - DNA, 22 bp, Artificial Sequence
  Synthetic oligonucleotide; TTG chr11 5221814 5221835 5221831 5221836 +
ttaagcttgttggaagagcgca

SEQ ID NO: 83879 - DNA, 22 bp, Artificial Sequence
  Synthetic oligonucleotide; TTA chr11 5221817 5221838 5221834 5221839 +
agcttgttggaagagcgcagta

SEQ ID NO: 83880 - DNA, 22 bp, Artificial Sequence
  Synthetic oligonucleotide; CTT chr11 5221822 5221843 5221839 5221844 +
gttggaagagcgcagtattagg

SEQ ID NO: 83881 - DNA, 22 bp, Artificial Sequence
  Synthetic oligonucleotide; TTG chr11 5221823 5221844 5221840 5221845 +
ttggaagagcgcagtattaggg

SEQ ID NO: 83882 - DNA, 22 bp, Artificial Sequence
  Synthetic oligonucleotide; TTG chr11 5221826 5221847 5221843 5221848 +
gaagagcgcagtattagggcgg

SEQ ID NO: 83883 - DNA, 22 bp, Artificial Sequence
  Synthetic oligonucleotide; TTA chr11 5221842 5221863 5221859 5221864 +
gggcgggagtgacccgattttc

SEQ ID NO: 83884 - DNA, 22 bp, Artificial Sequence
  Synthetic oligonucleotide; TTT chr11 5221862 5221883 5221879 5221884 +
tccaggtgccatctgtcaccct

SEQ ID NO: 83885 - DNA, 22 bp, Artificial Sequence
  Synthetic oligonucleotide; TTT chr11 5221863 5221884 5221880 5221885 +
ccaggtgccatctgtcaccctt

SEQ ID NO: 83886 - DNA, 22 bp, Artificial Sequence
  Synthetic oligonucleotide; TTC chr11 5221864 5221885 5221881 5221886 +
caggtgccatctgtcacccttt

SEQ ID NO: 83887 - DNA, 22 bp, Artificial Sequence
  Synthetic oligonucleotide; CTG chr11 5221877 5221898 5221894 5221899 +
tcacccttttctttgactagga

SEQ ID NO: 83888 - DNA, 22 bp, Artificial Sequence
  Synthetic oligonucleotide; CTT chr11 5221885 5221906 5221902 5221907 +
ttctttgactaggaaagggaat

SEQ ID NO: 83889 - DNA, 22 bp, Artificial Sequence
  Synthetic oligonucleotide; TTT chr11 5221886 5221907 5221903 5221908 +
tctttgactaggaaagggaatt

SEQ ID NO: 83890 - DNA, 22 bp, Artificial Sequence
  Synthetic oligonucleotide; TTT chr11 5221887 5221908 5221904 5221909 +
ctttgactaggaaagggaattc

SEQ ID NO: 83891 - DNA, 22 bp, Artificial Sequence
  Synthetic oligonucleotide; TTC chr11 5221888 5221909 5221905 5221910 +
tttgactaggaaagggaattcc

SEQ ID NO: 83892 - DNA, 22 bp, Artificial Sequence
  Synthetic oligonucleotide; CTT chr11 5221890 5221911 5221907 5221912 +
tgactaggaaagggaattccct

SEQ ID NO: 83893 - DNA, 22 bp, Artificial Sequence
  Synthetic oligonucleotide; TTT chr11 5221891 5221912 5221908 5221913 +
gactaggaaagggaattccctg

SEQ ID NO: 83894 - DNA, 22 bp, Artificial Sequence
  Synthetic oligonucleotide; TTG chr11 5221892 5221913 5221909 5221914 +
actaggaaagggaattccctga

SEQ ID NO: 83895 - DNA, 22 bp, Artificial Sequence
  Synthetic oligonucleotide; CTA chr11 5221896 5221917 5221913 5221918 +
ggaaagggaattccctgacccc

SEQ ID NO: 83896 - DNA, 22 bp, Artificial Sequence
  Synthetic oligonucleotide; TTC chr11 5221909 5221930 5221926 5221931 +
cctgaccccttgtgcttcccgg

SEQ ID NO: 83897 - DNA, 22 bp, Artificial Sequence
  Synthetic oligonucleotide; CTG chr11 5221913 5221934 5221930 5221935 +
accccttgtgcttcccgggtga

SEQ ID NO: 83898 - DNA, 22 bp, Artificial Sequence
  Synthetic oligonucleotide; CTT chr11 5221920 5221941 5221937 5221942 +
gtgcttcccgggtgaggtgatg

SEQ ID NO: 83899 - DNA, 22 bp, Artificial Sequence
  Synthetic oligonucleotide; TTG chr11 5221921 5221942 5221938 5221943 +
tgcttcccgggtgaggtgatgc

SEQ ID NO: 83900 - DNA, 22 bp, Artificial Sequence
  Synthetic oligonucleotide; CTT chr11 5221926 5221947 5221943 5221948 +
cccgggtgaggtgatgcctcgc

SEQ ID NO: 83901 - DNA, 22 bp, Artificial Sequence
  Synthetic oligonucleotide; TTC chr11 5221927 5221948 5221944 5221949 +
ccgggtgaggtgatgcctcgcc

SEQ ID NO: 83902 - DNA, 22 bp, Artificial Sequence
  Synthetic oligonucleotide; CTC chr11 5221946 5221967 5221963 5221968 +
gccctgctttggctcatgcaca

SEQ ID NO: 83903 - DNA, 22 bp, Artificial Sequence
  Synthetic oligonucleotide; CTG chr11 5221952 5221973 5221969 5221974 +
ctttggctcatgcacagtgcac

SEQ ID NO: 83904 - DNA, 22 bp, Artificial Sequence
  Synthetic oligonucleotide; CTT chr11 5221955 5221976 5221972 5221977 +
tggctcatgcacagtgcactgc

SEQ ID NO: 83905 - DNA, 22 bp, Artificial Sequence
  Synthetic oligonucleotide; TTT chr11 5221956 5221977 5221973 5221978 +
ggctcatgcacagtgcactgca

SEQ ID NO: 83906 - DNA, 22 bp, Artificial Sequence
  Synthetic oligonucleotide; TTG chr11 5221957 5221978 5221974 5221979 +
gctcatgcacagtgcactgcac

SEQ ID NO: 83907 - DNA, 22 bp, Artificial Sequence
  Synthetic oligonucleotide; CTC chr11 5221961 5221982 5221978 5221983 +
atgcacagtgcactgcacctac

SEQ ID NO: 83908 - DNA, 22 bp, Artificial Sequence
  Synthetic oligonucleotide; CTG chr11 5221976 5221997 5221993 5221998 +
cacctactgtcctgcacccact

SEQ ID NO: 83909 - DNA, 22 bp, Artificial Sequence
  Synthetic oligonucleotide; CTA chr11 5221982 5222003 5221999 5222004 +
ctgtcctgcacccactgcctgg

SEQ ID NO: 83910 - DNA, 22 bp, Artificial Sequence
  Synthetic oligonucleotide; CTG chr11 5221985 5222006 5222002 5222007 +
tcctgcacccactgcctggcac

SEQ ID NO: 83911 - DNA, 22 bp, Artificial Sequence
  Synthetic oligonucleotide; CTG chr11 5221990 5222011 5222007 5222012 +
cacccactgcctggcacttccc

SEQ ID NO: 83912 - DNA, 22 bp, Artificial Sequence
  Synthetic oligonucleotide; CTG chr11 5221999 5222020 5222016 5222021 +
cctggcacttccctgtgagatg

SEQ ID NO: 83913 - DNA, 22 bp, Artificial Sequence
  Synthetic oligonucleotide; CTG chr11 5222003 5222024 5222020 5222025 +
gcacttccctgtgagatgaacc

SEQ ID NO: 83914 - DNA, 22 bp, Artificial Sequence
  Synthetic oligonucleotide; CTT chr11 5222009 5222030 5222026 5222031 +
ccctgtgagatgaacctggtac

SEQ ID NO: 83915 - DNA, 22 bp, Artificial Sequence
  Synthetic oligonucleotide; TTC chr11 5222010 5222031 5222027 5222032 +
cctgtgagatgaacctggtacc

SEQ ID NO: 83916 - DNA, 22 bp, Artificial Sequence
  Synthetic oligonucleotide; CTG chr11 5222014 5222035 5222031 5222036 +
tgagatgaacctggtacctcag

SEQ ID NO: 83917 - DNA, 22 bp, Artificial Sequence
  Synthetic oligonucleotide; CTG chr11 5222027 5222048 5222044 5222049 +
gtacctcagttggaaatgcaga

SEQ ID NO: 83918 - DNA, 22 bp, Artificial Sequence
  Synthetic oligonucleotide; CTC chr11 5222034 5222055 5222051 5222056 +
agttggaaatgcagaaatcacc

SEQ ID NO: 83919 - DNA, 22 bp, Artificial Sequence
  Synthetic oligonucleotide; TTG chr11 5222039 5222060 5222056 5222061 +
gaaatgcagaaatcacccgtct

SEQ ID NO: 83920 - DNA, 22 bp, Artificial Sequence
  Synthetic oligonucleotide; CTT chr11 5222062 5222083 5222079 5222084 +
ctgcgtcactcacgatgggagc

SEQ ID NO: 83921 - DNA, 22 bp, Artificial Sequence
  Synthetic oligonucleotide; TTC chr11 5222063 5222084 5222080 5222085 +
tgcgtcactcacgatgggagct

SEQ ID NO: 83922 - DNA, 22 bp, Artificial Sequence
  Synthetic oligonucleotide; CTG chr11 5222065 5222086 5222082 5222087 +
cgtcactcacgatgggagctat

SEQ ID NO: 83923 - DNA, 22 bp, Artificial Sequence
  Synthetic oligonucleotide; CTC chr11 5222073 5222094 5222090 5222095 +
acgatgggagctatagactgga

SEQ ID NO: 83924 - DNA, 22 bp, Artificial Sequence
  Synthetic oligonucleotide; CTA chr11 5222086 5222107 5222103 5222108 +
tagactggagctgttcctattc

SEQ ID NO: 83925 - DNA, 22 bp, Artificial Sequence
  Synthetic oligonucleotide; CTG chr11 5222093 5222114 5222110 5222115 +
gagctgttcctattcggtcatc

SEQ ID NO: 83926 - DNA, 22 bp, Artificial Sequence
  Synthetic oligonucleotide; CTG chr11 5222099 5222120 5222116 5222121 +
ttcctattcggtcatcttggct

SEQ ID NO: 83927 - DNA, 22 bp, Artificial Sequence
  Synthetic oligonucleotide; TTC chr11 5222102 5222123 5222119 5222124 +
ctattcggtcatcttggctcca

SEQ ID NO: 83928 - DNA, 22 bp, Artificial Sequence
  Synthetic oligonucleotide; CTA chr11 5222105 5222126 5222122 5222127 +
ttcggtcatcttggctccaccg

SEQ ID NO: 83929 - DNA, 22 bp, Artificial Sequence
  Synthetic oligonucleotide; TTC chr11 5222108 5222129 5222125 5222130 +
ggtcatcttggctccaccgctc

SEQ ID NO: 83930 - DNA, 22 bp, Artificial Sequence
  Synthetic oligonucleotide; CTT chr11 5222117 5222138 5222134 5222139 +
ggctccaccgctcccccccccc

SEQ ID NO: 83931 - DNA, 22 bp, Artificial Sequence
  Synthetic oligonucleotide; TTG chr11 5222118 5222139 5222135 5222140 +
gctccaccgctcccccccccct

SEQ ID NO: 83932 - DNA, 22 bp, Artificial Sequence
  Synthetic oligonucleotide; CTC chr11 5222122 5222143 5222139 5222144 +
caccgctccccccccccttttt

SEQ ID NO: 83933 - DNA, 22 bp, Artificial Sequence
  Synthetic oligonucleotide; CTC chr11 5222130 5222151 5222147 5222152 +
cccccccccttttttttttctt

SEQ ID NO: 83934 - DNA, 22 bp, Artificial Sequence
  Synthetic oligonucleotide; CTT chr11 5222141 5222162 5222158 5222163 +
ttttttttcttttttttttgtg

SEQ ID NO: 83935 - DNA, 22 bp, Artificial Sequence
  Synthetic oligonucleotide; TTT chr11 5222142 5222163 5222159 5222164 +
tttttttcttttttttttgtga

SEQ ID NO: 83936 - DNA, 22 bp, Artificial Sequence
  Synthetic oligonucleotide; TTT chr11 5222143 5222164 5222160 5222165 +
ttttttcttttttttttgtgac

SEQ ID NO: 83937 - DNA, 22 bp, Artificial Sequence
  Synthetic oligonucleotide; TTT chr11 5222144 5222165 5222161 5222166 +
tttttcttttttttttgtgacg

SEQ ID NO: 83938 - DNA, 22 bp, Artificial Sequence
  Synthetic oligonucleotide; TTT chr11 5222145 5222166 5222162 5222167 +
ttttcttttttttttgtgacgg

SEQ ID NO: 83939 - DNA, 22 bp, Artificial Sequence
  Synthetic oligonucleotide; TTT chr11 5222146 5222167 5222163 5222168 +
tttcttttttttttgtgacgga

SEQ ID NO: 83940 - DNA, 22 bp, Artificial Sequence
  Synthetic oligonucleotide; TTT chr11 5222147 5222168 5222164 5222169 +
ttcttttttttttgtgacggag

SEQ ID NO: 83941 - DNA, 22 bp, Artificial Sequence
  Synthetic oligonucleotide; TTT chr11 5222148 5222169 5222165 5222170 +
tcttttttttttgtgacggagt

SEQ ID NO: 83942 - DNA, 22 bp, Artificial Sequence
  Synthetic oligonucleotide; TTT chr11 5222149 5222170 5222166 5222171 +
cttttttttttgtgacggagtc

SEQ ID NO: 83943 - DNA, 22 bp, Artificial Sequence
  Synthetic oligonucleotide; TTC chr11 5222150 5222171 5222167 5222172 +
ttttttttttgtgacggagtct

SEQ ID NO: 83944 - DNA, 22 bp, Artificial Sequence
  Synthetic oligonucleotide; CTT chr11 5222152 5222173 5222169 5222174 +
ttttttttgtgacggagtctca

SEQ ID NO: 83945 - DNA, 22 bp, Artificial Sequence
  Synthetic oligonucleotide; TTT chr11 5222153 5222174 5222170 5222175 +
tttttttgtgacggagtctcat

SEQ ID NO: 83946 - DNA, 22 bp, Artificial Sequence
  Synthetic oligonucleotide; TTT chr11 5222154 5222175 5222171 5222176 +
ttttttgtgacggagtctcatg

SEQ ID NO: 83947 - DNA, 22 bp, Artificial Sequence
  Synthetic oligonucleotide; TTT chr11 5222155 5222176 5222172 5222177 +
tttttgtgacggagtctcatgc

SEQ ID NO: 83948 - DNA, 22 bp, Artificial Sequence
  Synthetic oligonucleotide; TTT chr11 5222156 5222177 5222173 5222178 +
ttttgtgacggagtctcatgct

SEQ ID NO: 83949 - DNA, 22 bp, Artificial Sequence
  Synthetic oligonucleotide; TTT chr11 5222157 5222178 5222174 5222179 +
tttgtgacggagtctcatgctg

SEQ ID NO: 83950 - DNA, 22 bp, Artificial Sequence
  Synthetic oligonucleotide; TTT chr11 5222158 5222179 5222175 5222180 +
ttgtgacggagtctcatgctgt

SEQ ID NO: 83951 - DNA, 22 bp, Artificial Sequence
  Synthetic oligonucleotide; TTT chr11 5222159 5222180 5222176 5222181 +
tgtgacggagtctcatgctgtc

SEQ ID NO: 83952 - DNA, 22 bp, Artificial Sequence
  Synthetic oligonucleotide; TTT chr11 5222160 5222181 5222177 5222182 +
gtgacggagtctcatgctgtca

SEQ ID NO: 83953 - DNA, 22 bp, Artificial Sequence
  Synthetic oligonucleotide; TTG chr11 5222161 5222182 5222178 5222183 +
tgacggagtctcatgctgtcac

SEQ ID NO: 83954 - DNA, 22 bp, Artificial Sequence
  Synthetic oligonucleotide; CTC chr11 5222173 5222194 5222190 5222195 +
atgctgtcacctgggctggaat

SEQ ID NO: 83955 - DNA, 22 bp, Artificial Sequence
  Synthetic oligonucleotide; CTG chr11 5222179 5222200 5222196 5222201 +
tcacctgggctggaatgcagtg

SEQ ID NO: 83956 - DNA, 22 bp, Artificial Sequence
  Synthetic oligonucleotide; CTG chr11 5222186 5222207 5222203 5222208 +
ggctggaatgcagtggcacaat

SEQ ID NO: 83957 - DNA, 22 bp, Artificial Sequence
  Synthetic oligonucleotide; CTG chr11 5222191 5222212 5222208 5222213 +
gaatgcagtggcacaatcttgg

SEQ ID NO: 83958 - DNA, 22 bp, Artificial Sequence
  Synthetic oligonucleotide; CTT chr11 5222211 5222232 5222228 5222233 +
ggctcactgcaacctctgcctc

SEQ ID NO: 83959 - DNA, 22 bp, Artificial Sequence
  Synthetic oligonucleotide; TTG chr11 5222212 5222233 5222229 5222234 +
gctcactgcaacctctgcctcc

SEQ ID NO: 83960 - DNA, 22 bp, Artificial Sequence
  Synthetic oligonucleotide; CTC chr11 5222216 5222237 5222233 5222238 +
actgcaacctctgcctcccagg

SEQ ID NO: 83961 - DNA, 22 bp, Artificial Sequence
  Synthetic oligonucleotide; CTG chr11 5222220 5222241 5222237 5222242 +
caacctctgcctcccaggatca

SEQ ID NO: 83962 - DNA, 22 bp, Artificial Sequence
  Synthetic oligonucleotide; CTC chr11 5222227 5222248 5222244 5222249 +
tgcctcccaggatcaagcgatt

SEQ ID NO: 83963 - DNA, 22 bp, Artificial Sequence
  Synthetic oligonucleotide; CTG chr11 5222229 5222250 5222246 5222251 +
cctcccaggatcaagcgattct

SEQ ID NO: 83964 - DNA, 22 bp, Artificial Sequence
  Synthetic oligonucleotide; CTC chr11 5222233 5222254 5222250 5222255 +
ccaggatcaagcgattctcctg

SEQ ID NO: 83965 - DNA, 22 bp, Artificial Sequence
  Synthetic oligonucleotide; TTC chr11 5222250 5222271 5222267 5222272 +
tcctgcctcagcctcccaaatt

SEQ ID NO: 83966 - DNA, 22 bp, Artificial Sequence
  Synthetic oligonucleotide; CTC chr11 5222252 5222273 5222269 5222274 +
ctgcctcagcctcccaaattgc

SEQ ID NO: 83967 - DNA, 22 bp, Artificial Sequence
  Synthetic oligonucleotide; CTG chr11 5222255 5222276 5222272 5222277 +
cctcagcctcccaaattgctgg

SEQ ID NO: 83968 - DNA, 22 bp, Artificial Sequence
  Synthetic oligonucleotide; CTC chr11 5222259 5222280 5222276 5222281 +
agcctcccaaattgctgggatt

SEQ ID NO: 83969 - DNA, 22 bp, Artificial Sequence
  Synthetic oligonucleotide; CTC chr11 5222265 5222286 5222282 5222287 +
ccaaattgctgggattacacat

SEQ ID NO: 83970 - DNA, 22 bp, Artificial Sequence
  Synthetic oligonucleotide; TTG chr11 5222273 5222294 5222290 5222295 +
ctgggattacacatgcctgcca

SEQ ID NO: 83971 - DNA, 22 bp, Artificial Sequence
  Synthetic oligonucleotide; CTG chr11 5222276 5222297 5222293 5222298 +
ggattacacatgcctgccacca

SEQ ID NO: 83972 - DNA, 22 bp, Artificial Sequence
  Synthetic oligonucleotide; TTA chr11 5222282 5222303 5222299 5222304 +
cacatgcctgccaccacgccag

SEQ ID NO: 83973 - DNA, 22 bp, Artificial Sequence
  Synthetic oligonucleotide; CTG chr11 5222292 5222313 5222309 5222314 +
ccaccacgccaggctaagtttt

SEQ ID NO: 83974 - DNA, 22 bp, Artificial Sequence
  Synthetic oligonucleotide; CTA chr11 5222308 5222329 5222325 5222330 +
agtttttatatttttagtagcg

SEQ ID NO: 83975 - DNA, 22 bp, Artificial Sequence
  Synthetic oligonucleotide; TTT chr11 5222313 5222334 5222330 5222335 +
ttatatttttagtagcgatgag

SEQ ID NO: 83976 - DNA, 22 bp, Artificial Sequence
  Synthetic oligonucleotide; TTT chr11 5222314 5222335 5222331 5222336 +
tatatttttagtagcgatgagg

SEQ ID NO: 83977 - DNA, 22 bp, Artificial Sequence
  Synthetic oligonucleotide; TTT chr11 5222315 5222336 5222332 5222337 +
atatttttagtagcgatgaggt

SEQ ID NO: 83978 - DNA, 22 bp, Artificial Sequence
  Synthetic oligonucleotide; TTA chr11 5222316 5222337 5222333 5222338 +
tatttttagtagcgatgaggtt

SEQ ID NO: 83979 - DNA, 22 bp, Artificial Sequence
  Synthetic oligonucleotide; TTT chr11 5222321 5222342 5222338 5222343 +
ttagtagcgatgaggtttcact

SEQ ID NO: 83980 - DNA, 22 bp, Artificial Sequence
  Synthetic oligonucleotide; TTT chr11 5222322 5222343 5222339 5222344 +
tagtagcgatgaggtttcacta

SEQ ID NO: 83981 - DNA, 22 bp, Artificial Sequence
  Synthetic oligonucleotide; TTT chr11 5222323 5222344 5222340 5222345 +
agtagcgatgaggtttcactat

SEQ ID NO: 83982 - DNA, 22 bp, Artificial Sequence
  Synthetic oligonucleotide; TTA chr11 5222324 5222345 5222341 5222346 +
gtagcgatgaggtttcactatg

SEQ ID NO: 83983 - DNA, 22 bp, Artificial Sequence
  Synthetic oligonucleotide; TTT chr11 5222339 5222360 5222356 5222361 +
cactatgttggccaggctgatc

SEQ ID NO: 83984 - DNA, 22 bp, Artificial Sequence
  Synthetic oligonucleotide; TTC chr11 5222340 5222361 5222357 5222362 +
actatgttggccaggctgatct

SEQ ID NO: 83985 - DNA, 22 bp, Artificial Sequence
  Synthetic oligonucleotide; CTA chr11 5222344 5222365 5222361 5222366 +
tgttggccaggctgatcttgaa

SEQ ID NO: 83986 - DNA, 22 bp, Artificial Sequence
  Synthetic oligonucleotide; TTG chr11 5222349 5222370 5222366 5222371 +
gccaggctgatcttgaactcct

SEQ ID NO: 83987 - DNA, 22 bp, Artificial Sequence
  Synthetic oligonucleotide; CTG chr11 5222358 5222379 5222375 5222380 +
atcttgaactcctgacgtcgtg

SEQ ID NO: 83988 - DNA, 22 bp, Artificial Sequence
  Synthetic oligonucleotide; CTT chr11 5222363 5222384 5222380 5222385 +
gaactcctgacgtcgtgatccg

SEQ ID NO: 83989 - DNA, 22 bp, Artificial Sequence
  Synthetic oligonucleotide; TTG chr11 5222364 5222385 5222381 5222386 +
aactcctgacgtcgtgatccgc

SEQ ID NO: 83990 - DNA, 22 bp, Artificial Sequence
  Synthetic oligonucleotide; CTC chr11 5222369 5222390 5222386 5222391 +
ctgacgtcgtgatccgcctgtc

SEQ ID NO: 83991 - DNA, 22 bp, Artificial Sequence
  Synthetic oligonucleotide; CTG chr11 5222372 5222393 5222389 5222394 +
acgtcgtgatccgcctgtctag

SEQ ID NO: 83992 - DNA, 22 bp, Artificial Sequence
  Synthetic oligonucleotide; CTG chr11 5222389 5222410 5222406 5222411 +
tctaggcctcccaaagtgctgc

SEQ ID NO: 83993 - DNA, 22 bp, Artificial Sequence
  Synthetic oligonucleotide; CTA chr11 5222393 5222414 5222410 5222415 +
ggcctcccaaagtgctgcaatt

SEQ ID NO: 83994 - DNA, 22 bp, Artificial Sequence
  Synthetic oligonucleotide; CTC chr11 5222399 5222420 5222416 5222421 +
ccaaagtgctgcaattgcaggt

SEQ ID NO: 83995 - DNA, 22 bp, Artificial Sequence
  Synthetic oligonucleotide; CTG chr11 5222410 5222431 5222427 5222432 +
caattgcaggtgtgagccaccg

SEQ ID NO: 83996 - DNA, 22 bp, Artificial Sequence
  Synthetic oligonucleotide; TTG chr11 5222416 5222437 5222433 5222438 +
caggtgtgagccaccgctccca

SEQ ID NO: 83997 - DNA, 22 bp, Artificial Sequence
  Synthetic oligonucleotide; CTC chr11 5222435 5222456 5222452 5222457 +
ccagcctagaataacttcttaa

SEQ ID NO: 83998 - DNA, 22 bp, Artificial Sequence
  Synthetic oligonucleotide; CTA chr11 5222443 5222464 5222460 5222465 +
gaataacttcttaaatgctttt

SEQ ID NO: 83999 - DNA, 22 bp, Artificial Sequence
  Synthetic oligonucleotide; CTT chr11 5222452 5222473 5222469 5222474 +
cttaaatgcttttattgttgac

SEQ ID NO: 84000 - DNA, 22 bp, Artificial Sequence
  Synthetic oligonucleotide; TTC chr11 5222453 5222474 5222470 5222475 +
ttaaatgcttttattgttgact

SEQ ID NO: 84001 - DNA, 22 bp, Artificial Sequence
  Synthetic oligonucleotide; CTT chr11 5222455 5222476 5222472 5222477 +
aaatgcttttattgttgactga

SEQ ID NO: 84002 - DNA, 22 bp, Artificial Sequence
  Synthetic oligonucleotide; TTA chr11 5222456 5222477 5222473 5222478 +
aatgcttttattgttgactgaa

SEQ ID NO: 84003 - DNA, 22 bp, Artificial Sequence
  Synthetic oligonucleotide; CTT chr11 5222463 5222484 5222480 5222485 +
ttattgttgactgaatttattt

SEQ ID NO: 84004 - DNA, 22 bp, Artificial Sequence
  Synthetic oligonucleotide; TTT chr11 5222464 5222485 5222481 5222486 +
tattgttgactgaatttatttc

SEQ ID NO: 84005 - DNA, 22 bp, Artificial Sequence
  Synthetic oligonucleotide; TTT chr11 5222465 5222486 5222482 5222487 +
attgttgactgaatttatttct

SEQ ID NO: 84006 - DNA, 22 bp, Artificial Sequence
  Synthetic oligonucleotide; TTA chr11 5222466 5222487 5222483 5222488 +
ttgttgactgaatttatttctc

SEQ ID NO: 84007 - DNA, 22 bp, Artificial Sequence
  Synthetic oligonucleotide; TTG chr11 5222469 5222490 5222486 5222491 +
ttgactgaatttatttctccct

SEQ ID NO: 84008 - DNA, 22 bp, Artificial Sequence
  Synthetic oligonucleotide; TTG chr11 5222472 5222493 5222489 5222494 +
actgaatttatttctcccttga

SEQ ID NO: 84009 - DNA, 22 bp, Artificial Sequence
  Synthetic oligonucleotide; CTG chr11 5222476 5222497 5222493 5222498 +
aatttatttctcccttgatagt

SEQ ID NO: 84010 - DNA, 22 bp, Artificial Sequence
  Synthetic oligonucleotide; TTT chr11 5222481 5222502 5222498 5222503 +
atttctcccttgatagtttcta

SEQ ID NO: 84011 - DNA, 22 bp, Artificial Sequence
  Synthetic oligonucleotide; TTA chr11 5222482 5222503 5222499 5222504 +
tttctcccttgatagtttctac

SEQ ID NO: 84012 - DNA, 22 bp, Artificial Sequence
  Synthetic oligonucleotide; TTT chr11 5222485 5222506 5222502 5222507 +
ctcccttgatagtttctacttt

SEQ ID NO: 84013 - DNA, 22 bp, Artificial Sequence
  Synthetic oligonucleotide; TTC chr11 5222486 5222507 5222503 5222508 +
tcccttgatagtttctactttg

SEQ ID NO: 84014 - DNA, 22 bp, Artificial Sequence
  Synthetic oligonucleotide; CTC chr11 5222488 5222509 5222505 5222510 +
ccttgatagtttctactttggg

SEQ ID NO: 84015 - DNA, 22 bp, Artificial Sequence
  Synthetic oligonucleotide; CTT chr11 5222492 5222513 5222509 5222514 +
gatagtttctactttgggttga

SEQ ID NO: 84016 - DNA, 22 bp, Artificial Sequence
  Synthetic oligonucleotide; TTG chr11 5222493 5222514 5222510 5222515 +
atagtttctactttgggttgat

SEQ ID NO: 84017 - DNA, 22 bp, Artificial Sequence
  Synthetic oligonucleotide; TTT chr11 5222500 5222521 5222517 5222522 +
ctactttgggttgataattaaa

SEQ ID NO: 84018 - DNA, 22 bp, Artificial Sequence
  Synthetic oligonucleotide; TTC chr11 5222501 5222522 5222518 5222523 +
tactttgggttgataattaaat

SEQ ID NO: 84019 - DNA, 22 bp, Artificial Sequence
  Synthetic oligonucleotide; CTA chr11 5222503 5222524 5222520 5222525 +
ctttgggttgataattaaataa

SEQ ID NO: 84020 - DNA, 22 bp, Artificial Sequence
  Synthetic oligonucleotide; CTT chr11 5222506 5222527 5222523 5222528 +
tgggttgataattaaataacag

SEQ ID NO: 84021 - DNA, 22 bp, Artificial Sequence
  Synthetic oligonucleotide; TTT chr11 5222507 5222528 5222524 5222529 +
gggttgataattaaataacagt

SEQ ID NO: 84022 - DNA, 22 bp, Artificial Sequence
  Synthetic oligonucleotide; TTG chr11 5222508 5222529 5222525 5222530 +
ggttgataattaaataacagtg

SEQ ID NO: 84023 - DNA, 22 bp, Artificial Sequence
  Synthetic oligonucleotide; TTG chr11 5222513 5222534 5222530 5222535 +
ataattaaataacagtgttatc

SEQ ID NO: 84024 - DNA, 22 bp, Artificial Sequence
  Synthetic oligonucleotide; TTA chr11 5222520 5222541 5222537 5222542 +
aataacagtgttatctctaaga

SEQ ID NO: 84025 - DNA, 22 bp, Artificial Sequence
  Synthetic oligonucleotide; TTA chr11 5222533 5222554 5222550 5222555 +
tctctaagattatatacatgtc

SEQ ID NO: 84026 - DNA, 22 bp, Artificial Sequence
  Synthetic oligonucleotide; CTC chr11 5222537 5222558 5222554 5222559 +
taagattatatacatgtcttcc

SEQ ID NO: 84027 - DNA, 22 bp, Artificial Sequence
  Synthetic oligonucleotide; CTA chr11 5222539 5222560 5222556 5222561 +
agattatatacatgtcttccca

SEQ ID NO: 84028 - DNA, 22 bp, Artificial Sequence
  Synthetic oligonucleotide; TTA chr11 5222545 5222566 5222562 5222567 +
tatacatgtcttcccatatttt

SEQ ID NO: 84029 - DNA, 22 bp, Artificial Sequence
  Synthetic oligonucleotide; CTT chr11 5222557 5222578 5222574 5222579 +
cccatatttttattctagtttt

SEQ ID NO: 84030 - DNA, 22 bp, Artificial Sequence
  Synthetic oligonucleotide; TTC chr11 5222558 5222579 5222575 5222580 +
ccatatttttattctagttttt

SEQ ID NO: 84031 - DNA, 22 bp, Artificial Sequence
  Synthetic oligonucleotide; TTT chr11 5222566 5222587 5222583 5222588 +
ttattctagttttttcgtgact

SEQ ID NO: 84032 - DNA, 22 bp, Artificial Sequence
  Synthetic oligonucleotide; TTT chr11 5222567 5222588 5222584 5222589 +
tattctagttttttcgtgactg

SEQ ID NO: 84033 - DNA, 22 bp, Artificial Sequence
  Synthetic oligonucleotide; TTT chr11 5222568 5222589 5222585 5222590 +
attctagttttttcgtgactga

SEQ ID NO: 84034 - DNA, 22 bp, Artificial Sequence
  Synthetic oligonucleotide; TTA chr11 5222569 5222590 5222586 5222591 +
ttctagttttttcgtgactgaa

SEQ ID NO: 84035 - DNA, 22 bp, Artificial Sequence
  Synthetic oligonucleotide; TTC chr11 5222572 5222593 5222589 5222594 +
tagttttttcgtgactgaattt

SEQ ID NO: 84036 - DNA, 22 bp, Artificial Sequence
  Synthetic oligonucleotide; CTA chr11 5222574 5222595 5222591 5222596 +
gttttttcgtgactgaatttta

SEQ ID NO: 84037 - DNA, 22 bp, Artificial Sequence
  Synthetic oligonucleotide; TTT chr11 5222578 5222599 5222595 5222600 +
tttcgtgactgaattttacctt

SEQ ID NO: 84038 - DNA, 22 bp, Artificial Sequence
  Synthetic oligonucleotide; TTT chr11 5222579 5222600 5222596 5222601 +
ttcgtgactgaattttaccttc

SEQ ID NO: 84039 - DNA, 22 bp, Artificial Sequence
  Synthetic oligonucleotide; TTT chr11 5222580 5222601 5222597 5222602 +
tcgtgactgaattttaccttca

SEQ ID NO: 84040 - DNA, 22 bp, Artificial Sequence
  Synthetic oligonucleotide; TTT chr11 5222581 5222602 5222598 5222603 +
cgtgactgaattttaccttcac

SEQ ID NO: 84041 - DNA, 22 bp, Artificial Sequence
  Synthetic oligonucleotide; TTC chr11 5222582 5222603 5222599 5222604 +
gtgactgaattttaccttcaca

SEQ ID NO: 84042 - DNA, 22 bp, Artificial Sequence
  Synthetic oligonucleotide; CTG chr11 5222589 5222610 5222606 5222611 +
aattttaccttcacacctaatt

SEQ ID NO: 84043 - DNA, 22 bp, Artificial Sequence
  Synthetic oligonucleotide; TTT chr11 5222594 5222615 5222611 5222616 +
taccttcacacctaattgtgta

SEQ ID NO: 84044 - DNA, 22 bp, Artificial Sequence
  Synthetic oligonucleotide; TTT chr11 5222595 5222616 5222612 5222617 +
accttcacacctaattgtgtaa

SEQ ID NO: 84045 - DNA, 22 bp, Artificial Sequence
  Synthetic oligonucleotide; TTA chr11 5222596 5222617 5222613 5222618 +
ccttcacacctaattgtgtaat

SEQ ID NO: 84046 - DNA, 22 bp, Artificial Sequence
  Synthetic oligonucleotide; CTT chr11 5222600 5222621 5222617 5222622 +
cacacctaattgtgtaatcgat

SEQ ID NO: 84047 - DNA, 22 bp, Artificial Sequence
  Synthetic oligonucleotide; TTC chr11 5222601 5222622 5222618 5222623 +
acacctaattgtgtaatcgatt

SEQ ID NO: 84048 - DNA, 22 bp, Artificial Sequence
  Synthetic oligonucleotide; CTA chr11 5222608 5222629 5222625 5222630 +
attgtgtaatcgattgtggtat

SEQ ID NO: 84049 - DNA, 22 bp, Artificial Sequence
  Synthetic oligonucleotide; TTG chr11 5222612 5222633 5222629 5222634 +
tgtaatcgattgtggtatatgc

SEQ ID NO: 84050 - DNA, 22 bp, Artificial Sequence
  Synthetic oligonucleotide; TTG chr11 5222624 5222645 5222641 5222646 +
tggtatatgcagttaagcattt

SEQ ID NO: 84051 - DNA, 22 bp, Artificial Sequence
  Synthetic oligonucleotide; TTA chr11 5222639 5222660 5222656 5222661 +
agcatttcactttactcttttc

SEQ ID NO: 84052 - DNA, 22 bp, Artificial Sequence
  Synthetic oligonucleotide; TTT chr11 5222646 5222667 5222663 5222668 +
cactttactcttttcaaaaagt

SEQ ID NO: 84053 - DNA, 22 bp, Artificial Sequence
  Synthetic oligonucleotide; TTC chr11 5222647 5222668 5222664 5222669 +
actttactcttttcaaaaagta

SEQ ID NO: 84054 - DNA, 22 bp, Artificial Sequence
  Synthetic oligonucleotide; CTT chr11 5222651 5222672 5222668 5222673 +
tactcttttcaaaaagtatagt

SEQ ID NO: 84055 - DNA, 22 bp, Artificial Sequence
  Synthetic oligonucleotide; TTT chr11 5222652 5222673 5222669 5222674 +
actcttttcaaaaagtatagtt

SEQ ID NO: 84056 - DNA, 22 bp, Artificial Sequence
  Synthetic oligonucleotide; TTA chr11 5222653 5222674 5222670 5222675 +
ctcttttcaaaaagtatagttg

SEQ ID NO: 84057 - DNA, 22 bp, Artificial Sequence
  Synthetic oligonucleotide; CTC chr11 5222656 5222677 5222673 5222678 +
ttttcaaaaagtatagttgttc

SEQ ID NO: 84058 - DNA, 22 bp, Artificial Sequence
  Synthetic oligonucleotide; CTT chr11 5222658 5222679 5222675 5222680 +
ttcaaaaagtatagttgttcaa

SEQ ID NO: 84059 - DNA, 22 bp, Artificial Sequence
  Synthetic oligonucleotide; TTT chr11 5222659 5222680 5222676 5222681 +
tcaaaaagtatagttgttcaat

SEQ ID NO: 84060 - DNA, 22 bp, Artificial Sequence
  Synthetic oligonucleotide; TTT chr11 5222660 5222681 5222677 5222682 +
caaaaagtatagttgttcaatt

SEQ ID NO: 84061 - DNA, 22 bp, Artificial Sequence
  Synthetic oligonucleotide; TTC chr11 5222661 5222682 5222678 5222683 +
aaaaagtatagttgttcaatta

SEQ ID NO: 84062 - DNA, 22 bp, Artificial Sequence
  Synthetic oligonucleotide; TTG chr11 5222675 5222696 5222692 5222697 +
ttcaattactgtttgtttttta

SEQ ID NO: 84063 - DNA, 22 bp, Artificial Sequence
  Synthetic oligonucleotide; TTC chr11 5222678 5222699 5222695 5222700 +
aattactgtttgttttttattt

SEQ ID NO: 84064 - DNA, 22 bp, Artificial Sequence
  Synthetic oligonucleotide; TTA chr11 5222683 5222704 5222700 5222705 +
ctgtttgttttttatttccaag

SEQ ID NO: 84065 - DNA, 22 bp, Artificial Sequence
  Synthetic oligonucleotide; CTG chr11 5222686 5222707 5222703 5222708 +
tttgttttttatttccaagcta

SEQ ID NO: 84066 - DNA, 22 bp, Artificial Sequence
  Synthetic oligonucleotide; TTT chr11 5222689 5222710 5222706 5222711 +
gttttttatttccaagctaaat

SEQ ID NO: 84067 - DNA, 22 bp, Artificial Sequence
  Synthetic oligonucleotide; TTG chr11 5222690 5222711 5222707 5222712 +
ttttttatttccaagctaaatt

SEQ ID NO: 84068 - DNA, 22 bp, Artificial Sequence
  Synthetic oligonucleotide; TTT chr11 5222693 5222714 5222710 5222715 +
tttatttccaagctaaatttaa

SEQ ID NO: 84069 - DNA, 22 bp, Artificial Sequence
  Synthetic oligonucleotide; TTT chr11 5222694 5222715 5222711 5222716 +
ttatttccaagctaaatttaaa

SEQ ID NO: 84070 - DNA, 22 bp, Artificial Sequence
  Synthetic oligonucleotide; TTT chr11 5222695 5222716 5222712 5222717 +
tatttccaagctaaatttaaaa

SEQ ID NO: 84071 - DNA, 22 bp, Artificial Sequence
  Synthetic oligonucleotide; TTT chr11 5222696 5222717 5222713 5222718 +
atttccaagctaaatttaaaag

SEQ ID NO: 84072 - DNA, 22 bp, Artificial Sequence
  Synthetic oligonucleotide; TTA chr11 5222697 5222718 5222714 5222719 +
tttccaagctaaatttaaaagc

SEQ ID NO: 84073 - DNA, 22 bp, Artificial Sequence
  Synthetic oligonucleotide; TTT chr11 5222700 5222721 5222717 5222722 +
ccaagctaaatttaaaagctat

SEQ ID NO: 84074 - DNA, 22 bp, Artificial Sequence
  Synthetic oligonucleotide; TTC chr11 5222701 5222722 5222718 5222723 +
caagctaaatttaaaagctata

SEQ ID NO: 84075 - DNA, 22 bp, Artificial Sequence
  Synthetic oligonucleotide; CTA chr11 5222708 5222729 5222725 5222730 +
aatttaaaagctatatttttat

SEQ ID NO: 84076 - DNA, 22 bp, Artificial Sequence
  Synthetic oligonucleotide; TTT chr11 5222713 5222734 5222730 5222735 +
aaaagctatatttttatatatc

SEQ ID NO: 84077 - DNA, 22 bp, Artificial Sequence
  Synthetic oligonucleotide; TTA chr11 5222714 5222735 5222731 5222736 +
aaagctatatttttatatatca

SEQ ID NO: 84078 - DNA, 22 bp, Artificial Sequence
  Synthetic oligonucleotide; CTA chr11 5222721 5222742 5222738 5222743 +
tatttttatatatcacattatt

SEQ ID NO: 84079 - DNA, 22 bp, Artificial Sequence
  Synthetic oligonucleotide; TTT chr11 5222726 5222747 5222743 5222748 +
ttatatatcacattattatatt

SEQ ID NO: 84080 - DNA, 22 bp, Artificial Sequence
  Synthetic oligonucleotide; TTT chr11 5222727 5222748 5222744 5222749 +
tatatatcacattattatattt

SEQ ID NO: 84081 - DNA, 22 bp, Artificial Sequence
  Synthetic oligonucleotide; TTT chr11 5222728 5222749 5222745 5222750 +
atatatcacattattatatttt

SEQ ID NO: 84082 - DNA, 22 bp, Artificial Sequence
  Synthetic oligonucleotide; TTA chr11 5222729 5222750 5222746 5222751 +
tatatcacattattatatttta

SEQ ID NO: 84083 - DNA, 22 bp, Artificial Sequence
  Synthetic oligonucleotide; TTA chr11 5222741 5222762 5222758 5222763 +
ttatattttagtgagatttagt

SEQ ID NO: 84084 - DNA, 22 bp, Artificial Sequence
  Synthetic oligonucleotide; TTA chr11 5222744 5222765 5222761 5222766 +
tattttagtgagatttagtttt

SEQ ID NO: 84085 - DNA, 22 bp, Artificial Sequence
  Synthetic oligonucleotide; TTT chr11 5222749 5222770 5222766 5222771 +
tagtgagatttagtttttggat

SEQ ID NO: 84086 - DNA, 22 bp, Artificial Sequence
  Synthetic oligonucleotide; TTT chr11 5222750 5222771 5222767 5222772 +
agtgagatttagtttttggatt

SEQ ID NO: 84087 - DNA, 22 bp, Artificial Sequence
  Synthetic oligonucleotide; TTA chr11 5222751 5222772 5222768 5222773 +
gtgagatttagtttttggattt

SEQ ID NO: 84088 - DNA, 22 bp, Artificial Sequence
  Synthetic oligonucleotide; TTT chr11 5222760 5222781 5222777 5222782 +
agtttttggatttctatttatt

SEQ ID NO: 84089 - DNA, 22 bp, Artificial Sequence
  Synthetic oligonucleotide; TTA chr11 5222761 5222782 5222778 5222783 +
gtttttggatttctatttattc

SEQ ID NO: 84090 - DNA, 22 bp, Artificial Sequence
  Synthetic oligonucleotide; TTT chr11 5222765 5222786 5222782 5222787 +
ttggatttctatttattccact

SEQ ID NO: 84091 - DNA, 22 bp, Artificial Sequence
  Synthetic oligonucleotide; TTT chr11 5222766 5222787 5222783 5222788 +
tggatttctatttattccacta

SEQ ID NO: 84092 - DNA, 22 bp, Artificial Sequence
  Synthetic oligonucleotide; TTT chr11 5222767 5222788 5222784 5222789 +
ggatttctatttattccactat

SEQ ID NO: 84093 - DNA, 22 bp, Artificial Sequence
  Synthetic oligonucleotide; TTG chr11 5222768 5222789 5222785 5222790 +
gatttctatttattccactatc

SEQ ID NO: 84094 - DNA, 22 bp, Artificial Sequence
  Synthetic oligonucleotide; TTT chr11 5222773 5222794 5222790 5222795 +
ctatttattccactatcttact

SEQ ID NO: 84095 - DNA, 22 bp, Artificial Sequence
  Synthetic oligonucleotide; TTC chr11 5222774 5222795 5222791 5222796 +
tatttattccactatcttactt

SEQ ID NO: 84096 - DNA, 22 bp, Artificial Sequence
  Synthetic oligonucleotide; CTA chr11 5222776 5222797 5222793 5222798 +
tttattccactatcttacttac

SEQ ID NO: 84097 - DNA, 22 bp, Artificial Sequence
  Synthetic oligonucleotide; TTT chr11 5222779 5222800 5222796 5222801 +
attccactatcttacttacaca

SEQ ID NO: 84098 - DNA, 22 bp, Artificial Sequence
  Synthetic oligonucleotide; TTA chr11 5222780 5222801 5222797 5222802 +
ttccactatcttacttacacat

SEQ ID NO: 84099 - DNA, 22 bp, Artificial Sequence
  Synthetic oligonucleotide; TTC chr11 5222783 5222804 5222800 5222805 +
cactatcttacttacacatgag

SEQ ID NO: 84100 - DNA, 22 bp, Artificial Sequence
  Synthetic oligonucleotide; CTA chr11 5222788 5222809 5222805 5222810 +
tcttacttacacatgagtggta

SEQ ID NO: 84101 - DNA, 22 bp, Artificial Sequence
  Synthetic oligonucleotide; CTT chr11 5222792 5222813 5222809 5222814 +
acttacacatgagtggtattaa

SEQ ID NO: 84102 - DNA, 22 bp, Artificial Sequence
  Synthetic oligonucleotide; TTA chr11 5222793 5222814 5222810 5222815 +
cttacacatgagtggtattaat

SEQ ID NO: 84103 - DNA, 22 bp, Artificial Sequence
  Synthetic oligonucleotide; CTT chr11 5222796 5222817 5222813 5222818 +
acacatgagtggtattaattta

SEQ ID NO: 84104 - DNA, 22 bp, Artificial Sequence
  Synthetic oligonucleotide; TTA chr11 5222797 5222818 5222814 5222819 +
cacatgagtggtattaatttaa

SEQ ID NO: 84105 - DNA, 22 bp, Artificial Sequence
  Synthetic oligonucleotide; TTA chr11 5222813 5222834 5222830 5222835 +
atttaacatgattttagaatga

SEQ ID NO: 84106 - DNA, 22 bp, Artificial Sequence
  Synthetic oligonucleotide; TTT chr11 5222817 5222838 5222834 5222839 +
aacatgattttagaatgaagaa

SEQ ID NO: 84107 - DNA, 22 bp, Artificial Sequence
  Synthetic oligonucleotide; TTA chr11 5222818 5222839 5222835 5222840 +
acatgattttagaatgaagaaa

SEQ ID NO: 84108 - DNA, 22 bp, Artificial Sequence
  Synthetic oligonucleotide; TTT chr11 5222827 5222848 5222844 5222849 +
tagaatgaagaaaatgaagcca

SEQ ID NO: 84109 - DNA, 22 bp, Artificial Sequence
  Synthetic oligonucleotide; TTT chr11 5222828 5222849 5222845 5222850 +
agaatgaagaaaatgaagccat

SEQ ID NO: 84110 - DNA, 22 bp, Artificial Sequence
  Synthetic oligonucleotide; TTA chr11 5222829 5222850 5222846 5222851 +
gaatgaagaaaatgaagccatt

SEQ ID NO: 84111 - DNA, 22 bp, Artificial Sequence
  Synthetic oligonucleotide; TTT chr11 5222852 5222873 5222869 5222874 +
ttagataaaccaaaagtaacaa

SEQ ID NO: 84112 - DNA, 22 bp, Artificial Sequence
  Synthetic oligonucleotide; TTT chr11 5222853 5222874 5222870 5222875 +
tagataaaccaaaagtaacaat

SEQ ID NO: 84113 - DNA, 22 bp, Artificial Sequence
  Synthetic oligonucleotide; TTT chr11 5222854 5222875 5222871 5222876 +
agataaaccaaaagtaacaatg

SEQ ID NO: 84114 - DNA, 22 bp, Artificial Sequence
  Synthetic oligonucleotide; TTA chr11 5222855 5222876 5222872 5222877 +
gataaaccaaaagtaacaatgt

SEQ ID NO: 84115 - DNA, 22 bp, Artificial Sequence
  Synthetic oligonucleotide; TTT chr11 5222881 5222902 5222898 5222903 +
ccagcagaaagagataatatta

SEQ ID NO: 84116 - DNA, 22 bp, Artificial Sequence
  Synthetic oligonucleotide; TTC chr11 5222882 5222903 5222899 5222904 +
cagcagaaagagataatattaa

SEQ ID NO: 84117 - DNA, 22 bp, Artificial Sequence
  Synthetic oligonucleotide; TTA chr11 5222903 5222924 5222920 5222925 +
aggataatcagaaaaaaataga

SEQ ID NO: 84118 - DNA, 22 bp, Artificial Sequence
  Synthetic oligonucleotide; CTT chr11 5222933 5222954 5222950 5222955 +
agagagaatgttagaaatgaag

SEQ ID NO: 84119 - DNA, 22 bp, Artificial Sequence
  Synthetic oligonucleotide; TTA chr11 5222934 5222955 5222951 5222956 +
gagagaatgttagaaatgaaga

SEQ ID NO: 84120 - DNA, 22 bp, Artificial Sequence
  Synthetic oligonucleotide; TTA chr11 5222946 5222967 5222963 5222968 +
gaaatgaagaaaagcatgcaaa

SEQ ID NO: 84121 - DNA, 22 bp, Artificial Sequence
  Synthetic oligonucleotide; TTT chr11 5222974 5222995 5222991 5222996 +
tgtacataagtgtaaacatttc

SEQ ID NO: 84122 - DNA, 22 bp, Artificial Sequence
  Synthetic oligonucleotide; TTT chr11 5222975 5222996 5222992 5222997 +
gtacataagtgtaaacatttct

SEQ ID NO: 84123 - DNA, 22 bp, Artificial Sequence
  Synthetic oligonucleotide; TTG chr11 5222976 5222997 5222993 5222998 +
tacataagtgtaaacatttctt

SEQ ID NO: 84124 - DNA, 22 bp, Artificial Sequence
  Synthetic oligonucleotide; TTT chr11 5222995 5223016 5223012 5223017 +
cttcactatttaataataacac

SEQ ID NO: 84125 - DNA, 22 bp, Artificial Sequence
  Synthetic oligonucleotide; TTC chr11 5222996 5223017 5223013 5223018 +
ttcactatttaataataacact

SEQ ID NO: 84126 - DNA, 22 bp, Artificial Sequence
  Synthetic oligonucleotide; CTT chr11 5222998 5223019 5223015 5223020 +
cactatttaataataacactag

SEQ ID NO: 84127 - DNA, 22 bp, Artificial Sequence
  Synthetic oligonucleotide; TTC chr11 5222999 5223020 5223016 5223021 +
actatttaataataacactaga

SEQ ID NO: 84128 - DNA, 22 bp, Artificial Sequence
  Synthetic oligonucleotide; CTA chr11 5223003 5223024 5223020 5223025 +
tttaataataacactagaaaat

SEQ ID NO: 84129 - DNA, 22 bp, Artificial Sequence
  Synthetic oligonucleotide; TTT chr11 5223006 5223027 5223023 5223028 +
aataataacactagaaaatcta

SEQ ID NO: 84130 - DNA, 22 bp, Artificial Sequence
  Synthetic oligonucleotide; TTA chr11 5223007 5223028 5223024 5223029 +
ataataacactagaaaatctag

SEQ ID NO: 84131 - DNA, 22 bp, Artificial Sequence
  Synthetic oligonucleotide; CTA chr11 5223019 5223040 5223036 5223041 +
gaaaatctagggagtaaaacta

SEQ ID NO: 84132 - DNA, 22 bp, Artificial Sequence
  Synthetic oligonucleotide; CTA chr11 5223028 5223049 5223045 5223050 +
gggagtaaaactatacaaaata

SEQ ID NO: 84133 - DNA, 22 bp, Artificial Sequence
  Synthetic oligonucleotide; CTA chr11 5223041 5223062 5223058 5223063 +
tacaaaatatctaaaatatata

SEQ ID NO: 84134 - DNA, 22 bp, Artificial Sequence
  Synthetic oligonucleotide; CTA chr11 5223054 5223075 5223071 5223076 +
aaatatatatatatataattat

SEQ ID NO: 84135 - DNA, 22 bp, Artificial Sequence
  Synthetic oligonucleotide; TTA chr11 5223075 5223096 5223092 5223097 +
tagattgggaaggggaaaatga

SEQ ID NO: 84136 - DNA, 22 bp, Artificial Sequence
  Synthetic oligonucleotide; TTG chr11 5223082 5223103 5223099 5223104 +
ggaaggggaaaatgaagataaa

SEQ ID NO: 84137 - DNA, 22 bp, Artificial Sequence
  Synthetic oligonucleotide; CTA chr11 5223110 5223131 5223127 5223132 +
aaatttattgtattgttttgga

SEQ ID NO: 84138 - DNA, 22 bp, Artificial Sequence
  Synthetic oligonucleotide; TTT chr11 5223116 5223137 5223133 5223138 +
attgtattgttttggaaaagag

SEQ ID NO: 84139 - DNA, 22 bp, Artificial Sequence
  Synthetic oligonucleotide; TTA chr11 5223117 5223138 5223134 5223139 +
ttgtattgttttggaaaagagt

SEQ ID NO: 84140 - DNA, 22 bp, Artificial Sequence
  Synthetic oligonucleotide; TTG chr11 5223120 5223141 5223137 5223142 +
tattgttttggaaaagagtaaa

SEQ ID NO: 84141 - DNA, 22 bp, Artificial Sequence
  Synthetic oligonucleotide; TTG chr11 5223125 5223146 5223142 5223147 +
ttttggaaaagagtaaacagtc

SEQ ID NO: 84142 - DNA, 22 bp, Artificial Sequence
  Synthetic oligonucleotide; TTT chr11 5223128 5223149 5223145 5223150 +
tggaaaagagtaaacagtcaaa

SEQ ID NO: 84143 - DNA, 22 bp, Artificial Sequence
  Synthetic oligonucleotide; TTT chr11 5223129 5223150 5223146 5223151 +
ggaaaagagtaaacagtcaaat

SEQ ID NO: 84144 - DNA, 22 bp, Artificial Sequence
  Synthetic oligonucleotide; TTG chr11 5223130 5223151 5223147 5223152 +
gaaaagagtaaacagtcaaatg

SEQ ID NO: 84145 - DNA, 22 bp, Artificial Sequence
  Synthetic oligonucleotide; TTT chr11 5223159 5223180 5223176 5223181 +
gtatctgaaaaatcaagaatgc

SEQ ID NO: 84146 - DNA, 22 bp, Artificial Sequence
  Synthetic oligonucleotide; TTG chr11 5223160 5223181 5223177 5223182 +
tatctgaaaaatcaagaatgca

SEQ ID NO: 84147 - DNA, 22 bp, Artificial Sequence
  Synthetic oligonucleotide; CTG chr11 5223166 5223187 5223183 5223188 +
aaaaatcaagaatgcaattcta

SEQ ID NO: 84148 - DNA, 22 bp, Artificial Sequence
  Synthetic oligonucleotide; TTC chr11 5223186 5223207 5223203 5223208 +
taatcatcaagatgcatttttt

SEQ ID NO: 84149 - DNA, 22 bp, Artificial Sequence
  Synthetic oligonucleotide; CTA chr11 5223188 5223209 5223205 5223210 +
atcatcaagatgcattttttta

SEQ ID NO: 84150 - DNA, 22 bp, Artificial Sequence
  Synthetic oligonucleotide; TTT chr11 5223205 5223226 5223222 5223227 +
ttttattttttagttttttaat

SEQ ID NO: 84151 - DNA, 22 bp, Artificial Sequence
  Synthetic oligonucleotide; TTT chr11 5223206 5223227 5223223 5223228 +
tttattttttagttttttaatt

SEQ ID NO: 84152 - DNA, 22 bp, Artificial Sequence
  Synthetic oligonucleotide; TTT chr11 5223207 5223228 5223224 5223229 +
ttattttttagttttttaattc

SEQ ID NO: 84153 - DNA, 22 bp, Artificial Sequence
  Synthetic oligonucleotide; TTT chr11 5223208 5223229 5223225 5223230 +
tattttttagttttttaattca

SEQ ID NO: 84154 - DNA, 22 bp, Artificial Sequence
  Synthetic oligonucleotide; TTT chr11 5223209 5223230 5223226 5223231 +
attttttagttttttaattcat

SEQ ID NO: 84155 - DNA, 22 bp, Artificial Sequence
  Synthetic oligonucleotide; TTA chr11 5223210 5223231 5223227 5223232 +
ttttttagttttttaattcatg

SEQ ID NO: 84156 - DNA, 22 bp, Artificial Sequence
  Synthetic oligonucleotide; TTT chr11 5223213 5223234 5223230 5223235 +
tttagttttttaattcatgtga

SEQ ID NO: 84157 - DNA, 22 bp, Artificial Sequence
  Synthetic oligonucleotide; TTT chr11 5223214 5223235 5223231 5223236 +
ttagttttttaattcatgtgat

SEQ ID NO: 84158 - DNA, 22 bp, Artificial Sequence
  Synthetic oligonucleotide; TTT chr11 5223215 5223236 5223232 5223237 +
tagttttttaattcatgtgatg

SEQ ID NO: 84159 - DNA, 22 bp, Artificial Sequence
  Synthetic oligonucleotide; TTT chr11 5223216 5223237 5223233 5223238 +
agttttttaattcatgtgatgt

SEQ ID NO: 84160 - DNA, 22 bp, Artificial Sequence
  Synthetic oligonucleotide; TTA chr11 5223217 5223238 5223234 5223239 +
gttttttaattcatgtgatgtc

SEQ ID NO: 84161 - DNA, 22 bp, Artificial Sequence
  Synthetic oligonucleotide; TTT chr11 5223221 5223242 5223238 5223243 +
tttaattcatgtgatgtctatt

SEQ ID NO: 84162 - DNA, 22 bp, Artificial Sequence
  Synthetic oligonucleotide; TTT chr11 5223222 5223243 5223239 5223244 +
ttaattcatgtgatgtctattc

SEQ ID NO: 84163 - DNA, 22 bp, Artificial Sequence
  Synthetic oligonucleotide; TTT chr11 5223223 5223244 5223240 5223245 +
taattcatgtgatgtctattct

SEQ ID NO: 84164 - DNA, 22 bp, Artificial Sequence
  Synthetic oligonucleotide; TTT chr11 5223224 5223245 5223241 5223246 +
aattcatgtgatgtctattctt

SEQ ID NO: 84165 - DNA, 22 bp, Artificial Sequence
  Synthetic oligonucleotide; TTA chr11 5223225 5223246 5223242 5223247 +
attcatgtgatgtctattcttt

SEQ ID NO: 84166 - DNA, 22 bp, Artificial Sequence
  Synthetic oligonucleotide; TTC chr11 5223229 5223250 5223246 5223251 +
atgtgatgtctattctttttta

SEQ ID NO: 84167 - DNA, 22 bp, Artificial Sequence
  Synthetic oligonucleotide; CTA chr11 5223241 5223262 5223258 5223263 +
ttcttttttattattcttcaac

SEQ ID NO: 84168 - DNA, 22 bp, Artificial Sequence
  Synthetic oligonucleotide; TTC chr11 5223244 5223265 5223261 5223266 +
ttttttattattcttcaacttt

SEQ ID NO: 84169 - DNA, 22 bp, Artificial Sequence
  Synthetic oligonucleotide; CTT chr11 5223246 5223267 5223263 5223268 +
ttttattattcttcaactttat

SEQ ID NO: 84170 - DNA, 22 bp, Artificial Sequence
  Synthetic oligonucleotide; TTT chr11 5223247 5223268 5223264 5223269 +
tttattattcttcaactttatt

SEQ ID NO: 84171 - DNA, 22 bp, Artificial Sequence
  Synthetic oligonucleotide; TTT chr11 5223248 5223269 5223265 5223270 +
ttattattcttcaactttattg

SEQ ID NO: 84172 - DNA, 22 bp, Artificial Sequence
  Synthetic oligonucleotide; TTT chr11 5223249 5223270 5223266 5223271 +
tattattcttcaactttattga

SEQ ID NO: 84173 - DNA, 22 bp, Artificial Sequence
  Synthetic oligonucleotide; TTT chr11 5223250 5223271 5223267 5223272 +
attattcttcaactttattgag

SEQ ID NO: 84174 - DNA, 22 bp, Artificial Sequence
  Synthetic oligonucleotide; TTA chr11 5223251 5223272 5223268 5223273 +
ttattcttcaactttattgagg

SEQ ID NO: 84175 - DNA, 22 bp, Artificial Sequence
  Synthetic oligonucleotide; TTA chr11 5223254 5223275 5223271 5223276 +
ttcttcaactttattgaggtat

SEQ ID NO: 84176 - DNA, 22 bp, Artificial Sequence
  Synthetic oligonucleotide; TTC chr11 5223257 5223278 5223274 5223279 +
ttcaactttattgaggtatcat

SEQ ID NO: 84177 - DNA, 22 bp, Artificial Sequence
  Synthetic oligonucleotide; CTT chr11 5223259 5223280 5223276 5223281 +
caactttattgaggtatcattc

SEQ ID NO: 84178 - DNA, 22 bp, Artificial Sequence
  Synthetic oligonucleotide; TTC chr11 5223260 5223281 5223277 5223282 +
aactttattgaggtatcattca

SEQ ID NO: 84179 - DNA, 22 bp, Artificial Sequence
  Synthetic oligonucleotide; CTT chr11 5223265 5223286 5223282 5223287 +
tattgaggtatcattcacaaat

SEQ ID NO: 84180 - DNA, 22 bp, Artificial Sequence
  Synthetic oligonucleotide; TTT chr11 5223266 5223287 5223283 5223288 +
attgaggtatcattcacaaata

SEQ ID NO: 84181 - DNA, 22 bp, Artificial Sequence
  Synthetic oligonucleotide; TTA chr11 5223267 5223288 5223284 5223289 +
ttgaggtatcattcacaaataa

SEQ ID NO: 84182 - DNA, 22 bp, Artificial Sequence
  Synthetic oligonucleotide; TTG chr11 5223270 5223291 5223287 5223292 +
aggtatcattcacaaataaaaa

SEQ ID NO: 84183 - DNA, 22 bp, Artificial Sequence
  Synthetic oligonucleotide; TTC chr11 5223281 5223302 5223298 5223303 +
acaaataaaaattgtatatatt

SEQ ID NO: 84184 - DNA, 22 bp, Artificial Sequence
  Synthetic oligonucleotide; TTG chr11 5223295 5223316 5223312 5223317 +
tatatatttaaggtgtacaaca

SEQ ID NO: 84185 - DNA, 22 bp, Artificial Sequence
  Synthetic oligonucleotide; TTT chr11 5223304 5223325 5223321 5223326 +
aaggtgtacaacatgatgtttt

SEQ ID NO: 84186 - DNA, 22 bp, Artificial Sequence
  Synthetic oligonucleotide; TTA chr11 5223305 5223326 5223322 5223327 +
aggtgtacaacatgatgtttta

SEQ ID NO: 84187 - DNA, 22 bp, Artificial Sequence
  Synthetic oligonucleotide; TTT chr11 5223325 5223346 5223342 5223347 +
taatatatgtataccttgtgaa

SEQ ID NO: 84188 - DNA, 22 bp, Artificial Sequence
  Synthetic oligonucleotide; TTT chr11 5223326 5223347 5223343 5223348 +
aatatatgtataccttgtgaaa

SEQ ID NO: 84189 - DNA, 22 bp, Artificial Sequence
  Synthetic oligonucleotide; TTA chr11 5223327 5223348 5223344 5223349 +
atatatgtataccttgtgaaat

SEQ ID NO: 84190 - DNA, 22 bp, Artificial Sequence
  Synthetic oligonucleotide; CTT chr11 5223342 5223363 5223359 5223364 +
gtgaaatgattaccacaatcaa

SEQ ID NO: 84191 - DNA, 22 bp, Artificial Sequence
  Synthetic oligonucleotide; TTG chr11 5223343 5223364 5223360 5223365 +
tgaaatgattaccacaatcaag

SEQ ID NO: 84192 - DNA, 22 bp, Artificial Sequence
  Synthetic oligonucleotide; TTA chr11 5223354 5223375 5223371 5223376 +
ccacaatcaagctaattaacat

SEQ ID NO: 84193 - DNA, 22 bp, Artificial Sequence
  Synthetic oligonucleotide; CTA chr11 5223368 5223389 5223385 5223390 +
attaacatacccattatctcac

SEQ ID NO: 84194 - DNA, 22 bp, Artificial Sequence
  Synthetic oligonucleotide; TTA chr11 5223372 5223393 5223389 5223394 +
acatacccattatctcacatag

SEQ ID NO: 84195 - DNA, 22 bp, Artificial Sequence
  Synthetic oligonucleotide; TTA chr11 5223384 5223405 5223401 5223406 +
tctcacatagttacctttttct

SEQ ID NO: 84196 - DNA, 22 bp, Artificial Sequence
  Synthetic oligonucleotide; CTC chr11 5223388 5223409 5223405 5223410 +
acatagttacctttttcttgtg

SEQ ID NO: 84197 - DNA, 22 bp, Artificial Sequence
  Synthetic oligonucleotide; TTA chr11 5223397 5223418 5223414 5223419 +
cctttttcttgtggtaaatgct

SEQ ID NO: 84198 - DNA, 22 bp, Artificial Sequence
  Synthetic oligonucleotide; CTT chr11 5223401 5223422 5223418 5223423 +
tttcttgtggtaaatgctttta

SEQ ID NO: 84199 - DNA, 22 bp, Artificial Sequence
  Synthetic oligonucleotide; TTT chr11 5223402 5223423 5223419 5223424 +
ttcttgtggtaaatgcttttaa

SEQ ID NO: 84200 - DNA, 22 bp, Artificial Sequence
  Synthetic oligonucleotide; TTT chr11 5223403 5223424 5223420 5223425 +
tcttgtggtaaatgcttttaag

SEQ ID NO: 84201 - DNA, 22 bp, Artificial Sequence
  Synthetic oligonucleotide; TTT chr11 5223404 5223425 5223421 5223426 +
cttgtggtaaatgcttttaaga

SEQ ID NO: 84202 - DNA, 22 bp, Artificial Sequence
  Synthetic oligonucleotide; TTC chr11 5223405 5223426 5223422 5223427 +
ttgtggtaaatgcttttaagat

SEQ ID NO: 84203 - DNA, 22 bp, Artificial Sequence
  Synthetic oligonucleotide; CTT chr11 5223407 5223428 5223424 5223429 +
gtggtaaatgcttttaagatct

SEQ ID NO: 84204 - DNA, 22 bp, Artificial Sequence
  Synthetic oligonucleotide; TTG chr11 5223408 5223429 5223425 5223430 +
tggtaaatgcttttaagatcta

SEQ ID NO: 84205 - DNA, 22 bp, Artificial Sequence
  Synthetic oligonucleotide; CTT chr11 5223420 5223441 5223437 5223442 +
ttaagatctactctcggccagg

SEQ ID NO: 84206 - DNA, 22 bp, Artificial Sequence
  Synthetic oligonucleotide; TTT chr11 5223421 5223442 5223438 5223443 +
taagatctactctcggccaggc

SEQ ID NO: 84207 - DNA, 22 bp, Artificial Sequence
  Synthetic oligonucleotide; TTT chr11 5223422 5223443 5223439 5223444 +
aagatctactctcggccaggcc

SEQ ID NO: 84208 - DNA, 22 bp, Artificial Sequence
  Synthetic oligonucleotide; TTA chr11 5223423 5223444 5223440 5223445 +
agatctactctcggccaggccc

SEQ ID NO: 84209 - DNA, 22 bp, Artificial Sequence
  Synthetic oligonucleotide; CTA chr11 5223430 5223451 5223447 5223452 +
ctctcggccaggcccggtggct

SEQ ID NO: 84210 - DNA, 22 bp, Artificial Sequence
  Synthetic oligonucleotide; CTC chr11 5223433 5223454 5223450 5223455 +
tcggccaggcccggtggctcac

SEQ ID NO: 84211 - DNA, 22 bp, Artificial Sequence
  Synthetic oligonucleotide; CTC chr11 5223435 5223456 5223452 5223457 +
ggccaggcccggtggctcacgc

SEQ ID NO: 84212 - DNA, 22 bp, Artificial Sequence
  Synthetic oligonucleotide; CTC chr11 5223453 5223474 5223470 5223475 +
acgcctgtaatcccagcccttt

SEQ ID NO: 84213 - DNA, 22 bp, Artificial Sequence
  Synthetic oligonucleotide; CTG chr11 5223460 5223481 5223477 5223482 +
taatcccagccctttgggtggc

SEQ ID NO: 84214 - DNA, 22 bp, Artificial Sequence
  Synthetic oligonucleotide; CTT chr11 5223474 5223495 5223491 5223496 +
tgggtggccgaggcaggcggat

SEQ ID NO: 84215 - DNA, 22 bp, Artificial Sequence
  Synthetic oligonucleotide; TTT chr11 5223475 5223496 5223492 5223497 +
gggtggccgaggcaggcggatc

SEQ ID NO: 84216 - DNA, 22 bp, Artificial Sequence
  Synthetic oligonucleotide; TTG chr11 5223476 5223497 5223493 5223498 +
ggtggccgaggcaggcggatca

SEQ ID NO: 84217 - DNA, 22 bp, Artificial Sequence
  Synthetic oligonucleotide; CTG chr11 5223503 5223524 5223520 5223525 +
accaacatggagaaaccccgtc

SEQ ID NO: 84218 - DNA, 22 bp, Artificial Sequence
  Synthetic oligonucleotide; CTC chr11 5223527 5223548 5223544 5223549 +
tactaaaaatacaaaattagct

SEQ ID NO: 84219 - DNA, 22 bp, Artificial Sequence
  Synthetic oligonucleotide; CTA chr11 5223529 5223550 5223546 5223551 +
ctaaaaatacaaaattagctgg

SEQ ID NO: 84220 - DNA, 22 bp, Artificial Sequence
  Synthetic oligonucleotide; CTA chr11 5223532 5223553 5223549 5223554 +
aaaatacaaaattagctgggca

SEQ ID NO: 84221 - DNA, 22 bp, Artificial Sequence
  Synthetic oligonucleotide; TTA chr11 5223546 5223567 5223563 5223568 +
gctgggcatggtgtcgcatgcc

SEQ ID NO: 84222 - DNA, 22 bp, Artificial Sequence
  Synthetic oligonucleotide; CTG chr11 5223550 5223571 5223567 5223572 +
ggcatggtgtcgcatgcctgta

SEQ ID NO: 84223 - DNA, 22 bp, Artificial Sequence
  Synthetic oligonucleotide; CTG chr11 5223570 5223591 5223587 5223592 +
taatcccagctactcgggaggc

SEQ ID NO: 84224 - DNA, 22 bp, Artificial Sequence
  Synthetic oligonucleotide; CTA chr11 5223582 5223603 5223599 5223604 +
ctcgggaggctgaggcaggaga

SEQ ID NO: 84225 - DNA, 22 bp, Artificial Sequence
  Synthetic oligonucleotide; CTC chr11 5223585 5223606 5223602 5223607 +
gggaggctgaggcaggagattt

SEQ ID NO: 84226 - DNA, 22 bp, Artificial Sequence
  Synthetic oligonucleotide; CTG chr11 5223594 5223615 5223611 5223616 +
aggcaggagatttgcttgaacc

SEQ ID NO: 84227 - DNA, 22 bp, Artificial Sequence
  Synthetic oligonucleotide; TTT chr11 5223607 5223628 5223624 5223629 +
gcttgaacccaggaggcggagg

SEQ ID NO: 84228 - DNA, 22 bp, Artificial Sequence
  Synthetic oligonucleotide; TTG chr11 5223608 5223629 5223625 5223630 +
cttgaacccaggaggcggaggt

SEQ ID NO: 84229 - DNA, 22 bp, Artificial Sequence
  Synthetic oligonucleotide; CTT chr11 5223611 5223632 5223628 5223633 +
gaacccaggaggcggaggttgc

SEQ ID NO: 84230 - DNA, 22 bp, Artificial Sequence
  Synthetic oligonucleotide; TTG chr11 5223612 5223633 5223629 5223634 +
aacccaggaggcggaggttgca

SEQ ID NO: 84231 - DNA, 22 bp, Artificial Sequence
  Synthetic oligonucleotide; TTG chr11 5223632 5223653 5223649 5223654 +
cagtgagccaagatcttgccat

SEQ ID NO: 84232 - DNA, 22 bp, Artificial Sequence
  Synthetic oligonucleotide; CTT chr11 5223649 5223670 5223666 5223671 +
gccattgcactccagcctggac

SEQ ID NO: 84233 - DNA, 22 bp, Artificial Sequence
  Synthetic oligonucleotide; TTG chr11 5223650 5223671 5223667 5223672 +
ccattgcactccagcctggaca

SEQ ID NO: 84234 - DNA, 22 bp, Artificial Sequence
  Synthetic oligonucleotide; TTG chr11 5223656 5223677 5223673 5223678 +
cactccagcctggacaacaaga

SEQ ID NO: 84235 - DNA, 22 bp, Artificial Sequence
  Synthetic oligonucleotide; CTC chr11 5223661 5223682 5223678 5223683 +
cagcctggacaacaagagcaaa

SEQ ID NO: 84236 - DNA, 22 bp, Artificial Sequence
  Synthetic oligonucleotide; CTG chr11 5223668 5223689 5223685 5223690 +
gacaacaagagcaaaactccat

SEQ ID NO: 84237 - DNA, 22 bp, Artificial Sequence
  Synthetic oligonucleotide; CTC chr11 5223687 5223708 5223704 5223709 +
catctaaaaaaaaaaaaaaatc

SEQ ID NO: 84238 - DNA, 22 bp, Artificial Sequence
  Synthetic oligonucleotide; CTA chr11 5223693 5223714 5223710 5223715 +
aaaaaaaaaaaaaatctactct

SEQ ID NO: 84239 - DNA, 22 bp, Artificial Sequence
  Synthetic oligonucleotide; CTA chr11 5223711 5223732 5223728 5223733 +
ctctctttgcaaattttaaata

SEQ ID NO: 84240 - DNA, 22 bp, Artificial Sequence
  Synthetic oligonucleotide; CTC chr11 5223714 5223735 5223731 5223736 +
tctttgcaaattttaaatatac

SEQ ID NO: 84241 - DNA, 22 bp, Artificial Sequence
  Synthetic oligonucleotide; CTC chr11 5223716 5223737 5223733 5223738 +
tttgcaaattttaaatatactt

SEQ ID NO: 84242 - DNA, 22 bp, Artificial Sequence
  Synthetic oligonucleotide; CTT chr11 5223718 5223739 5223735 5223740 +
tgcaaattttaaatatacttac

SEQ ID NO: 84243 - DNA, 22 bp, Artificial Sequence
  Synthetic oligonucleotide; TTT chr11 5223719 5223740 5223736 5223741 +
gcaaattttaaatatacttaca

SEQ ID NO: 84244 - DNA, 22 bp, Artificial Sequence
  Synthetic oligonucleotide; TTG chr11 5223720 5223741 5223737 5223742 +
caaattttaaatatacttacag

SEQ ID NO: 84245 - DNA, 22 bp, Artificial Sequence
  Synthetic oligonucleotide; TTT chr11 5223727 5223748 5223744 5223749 +
taaatatacttacagtacaatt

SEQ ID NO: 84246 - DNA, 22 bp, Artificial Sequence
  Synthetic oligonucleotide; TTT chr11 5223728 5223749 5223745 5223750 +
aaatatacttacagtacaatta

SEQ ID NO: 84247 - DNA, 22 bp, Artificial Sequence
  Synthetic oligonucleotide; TTA chr11 5223729 5223750 5223746 5223751 +
aatatacttacagtacaattaa

SEQ ID NO: 84248 - DNA, 22 bp, Artificial Sequence
  Synthetic oligonucleotide; CTT chr11 5223738 5223759 5223755 5223760 +
acagtacaattaactacagtca

SEQ ID NO: 84249 - DNA, 22 bp, Artificial Sequence
  Synthetic oligonucleotide; TTA chr11 5223739 5223760 5223756 5223761 +
cagtacaattaactacagtcac

SEQ ID NO: 84250 - DNA, 22 bp, Artificial Sequence
  Synthetic oligonucleotide; TTA chr11 5223750 5223771 5223767 5223772 +
actacagtcacgatgctgtaca

SEQ ID NO: 84251 - DNA, 22 bp, Artificial Sequence
  Synthetic oligonucleotide; CTA chr11 5223754 5223775 5223771 5223776 +
cagtcacgatgctgtacattag

SEQ ID NO: 84252 - DNA, 22 bp, Artificial Sequence
  Synthetic oligonucleotide; CTG chr11 5223768 5223789 5223785 5223790 +
tacattagatatctagaattta

SEQ ID NO: 84253 - DNA, 22 bp, Artificial Sequence
  Synthetic oligonucleotide; TTA chr11 5223775 5223796 5223792 5223797 +
gatatctagaatttattcatcc

SEQ ID NO: 84254 - DNA, 22 bp, Artificial Sequence
  Synthetic oligonucleotide; CTA chr11 5223783 5223804 5223800 5223805 +
gaatttattcatcccacataac

SEQ ID NO: 84255 - DNA, 22 bp, Artificial Sequence
  Synthetic oligonucleotide; TTT chr11 5223789 5223810 5223806 5223811 +
attcatcccacataactgaaat

SEQ ID NO: 84256 - DNA, 22 bp, Artificial Sequence
  Synthetic oligonucleotide; TTA chr11 5223790 5223811 5223807 5223812 +
ttcatcccacataactgaaatt

SEQ ID NO: 84257 - DNA, 22 bp, Artificial Sequence
  Synthetic oligonucleotide; TTC chr11 5223793 5223814 5223810 5223815 +
atcccacataactgaaatttta

SEQ ID NO: 84258 - DNA, 22 bp, Artificial Sequence
  Synthetic oligonucleotide; CTG chr11 5223807 5223828 5223824 5223829 +
aaattttataccctttgagtaa

SEQ ID NO: 84259 - DNA, 22 bp, Artificial Sequence
  Synthetic oligonucleotide; TTT chr11 5223813 5223834 5223830 5223835 +
tataccctttgagtaatagttt

SEQ ID NO: 84260 - DNA, 22 bp, Artificial Sequence
  Synthetic oligonucleotide; TTT chr11 5223814 5223835 5223831 5223836 +
ataccctttgagtaatagtttc

SEQ ID NO: 84261 - DNA, 22 bp, Artificial Sequence
  Synthetic oligonucleotide; TTA chr11 5223815 5223836 5223832 5223837 +
taccctttgagtaatagtttcc

SEQ ID NO: 84262 - DNA, 22 bp, Artificial Sequence
  Synthetic oligonucleotide; CTT chr11 5223822 5223843 5223839 5223844 +
tgagtaatagtttcctgattct

SEQ ID NO: 84263 - DNA, 22 bp, Artificial Sequence
  Synthetic oligonucleotide; TTT chr11 5223823 5223844 5223840 5223845 +
gagtaatagtttcctgattctc

SEQ ID NO: 84264 - DNA, 22 bp, Artificial Sequence
  Synthetic oligonucleotide; TTG chr11 5223824 5223845 5223841 5223846 +
agtaatagtttcctgattctcc

SEQ ID NO: 84265 - DNA, 22 bp, Artificial Sequence
  Synthetic oligonucleotide; TTT chr11 5223835 5223856 5223852 5223857 +
cctgattctcccacccccaacc

SEQ ID NO: 84266 - DNA, 22 bp, Artificial Sequence
  Synthetic oligonucleotide; TTC chr11 5223836 5223857 5223853 5223858 +
ctgattctcccacccccaaccc

SEQ ID NO: 84267 - DNA, 22 bp, Artificial Sequence
  Synthetic oligonucleotide; CTG chr11 5223839 5223860 5223856 5223861 +
attctcccacccccaacccctg

SEQ ID NO: 84268 - DNA, 22 bp, Artificial Sequence
  Synthetic oligonucleotide; TTC chr11 5223843 5223864 5223860 5223865 +
tcccacccccaacccctggaaa

SEQ ID NO: 84269 - DNA, 22 bp, Artificial Sequence
  Synthetic oligonucleotide; CTC chr11 5223845 5223866 5223862 5223867 +
ccacccccaacccctggaaacc

SEQ ID NO: 84270 - DNA, 22 bp, Artificial Sequence
  Synthetic oligonucleotide; CTG chr11 5223861 5223882 5223878 5223883 +
gaaaccatacctctactgtctg

SEQ ID NO: 84271 - DNA, 22 bp, Artificial Sequence
  Synthetic oligonucleotide; CTC chr11 5223874 5223895 5223891 5223896 +
tactgtctgtttccatgagagt

SEQ ID NO: 84272 - DNA, 22 bp, Artificial Sequence
  Synthetic oligonucleotide; CTA chr11 5223876 5223897 5223893 5223898 +
ctgtctgtttccatgagagtga

SEQ ID NO: 84273 - DNA, 22 bp, Artificial Sequence
  Synthetic oligonucleotide; CTG chr11 5223879 5223900 5223896 5223901 +
tctgtttccatgagagtgactt

SEQ ID NO: 84274 - DNA, 22 bp, Artificial Sequence
  Synthetic oligonucleotide; CTG chr11 5223883 5223904 5223900 5223905 +
tttccatgagagtgactttttt

SEQ ID NO: 84275 - DNA, 22 bp, Artificial Sequence
  Synthetic oligonucleotide; TTT chr11 5223886 5223907 5223903 5223908 +
ccatgagagtgacttttttatg

SEQ ID NO: 84276 - DNA, 22 bp, Artificial Sequence
  Synthetic oligonucleotide; TTC chr11 5223887 5223908 5223904 5223909 +
catgagagtgacttttttatgt

SEQ ID NO: 84277 - DNA, 22 bp, Artificial Sequence
  Synthetic oligonucleotide; CTT chr11 5223901 5223922 5223918 5223923 +
ttttatgtttcacatatgagca

SEQ ID NO: 84278 - DNA, 22 bp, Artificial Sequence
  Synthetic oligonucleotide; TTT chr11 5223902 5223923 5223919 5223924 +
tttatgtttcacatatgagcaa

SEQ ID NO: 84279 - DNA, 22 bp, Artificial Sequence
  Synthetic oligonucleotide; TTT chr11 5223903 5223924 5223920 5223925 +
ttatgtttcacatatgagcaag

SEQ ID NO: 84280 - DNA, 22 bp, Artificial Sequence
  Synthetic oligonucleotide; TTT chr11 5223904 5223925 5223921 5223926 +
tatgtttcacatatgagcaagg

SEQ ID NO: 84281 - DNA, 22 bp, Artificial Sequence
  Synthetic oligonucleotide; TTT chr11 5223905 5223926 5223922 5223927 +
atgtttcacatatgagcaaggt

SEQ ID NO: 84282 - DNA, 22 bp, Artificial Sequence
  Synthetic oligonucleotide; TTA chr11 5223906 5223927 5223923 5223928 +
tgtttcacatatgagcaaggtt

SEQ ID NO: 84283 - DNA, 22 bp, Artificial Sequence
  Synthetic oligonucleotide; TTT chr11 5223911 5223932 5223928 5223933 +
cacatatgagcaaggttgtgta

SEQ ID NO: 84284 - DNA, 22 bp, Artificial Sequence
  Synthetic oligonucleotide; TTC chr11 5223912 5223933 5223929 5223934 +
acatatgagcaaggttgtgtag

SEQ ID NO: 84285 - DNA, 22 bp, Artificial Sequence
  Synthetic oligonucleotide; TTG chr11 5223929 5223950 5223946 5223951 +
tgtagtatttgtctttttgtgt

SEQ ID NO: 84286 - DNA, 22 bp, Artificial Sequence
  Synthetic oligonucleotide; TTT chr11 5223939 5223960 5223956 5223961 +
gtctttttgtgtcaggcttatt

SEQ ID NO: 84287 - DNA, 22 bp, Artificial Sequence
  Synthetic oligonucleotide; TTG chr11 5223940 5223961 5223957 5223962 +
tctttttgtgtcaggcttattt

SEQ ID NO: 84288 - DNA, 22 bp, Artificial Sequence
  Synthetic oligonucleotide; CTT chr11 5223944 5223965 5223961 5223966 +
tttgtgtcaggcttatttttct

SEQ ID NO: 84289 - DNA, 22 bp, Artificial Sequence
  Synthetic oligonucleotide; TTT chr11 5223945 5223966 5223962 5223967 +
ttgtgtcaggcttatttttctt

SEQ ID NO: 84290 - DNA, 22 bp, Artificial Sequence
  Synthetic oligonucleotide; TTT chr11 5223946 5223967 5223963 5223968 +
tgtgtcaggcttatttttctta

SEQ ID NO: 84291 - DNA, 22 bp, Artificial Sequence
  Synthetic oligonucleotide; TTT chr11 5223947 5223968 5223964 5223969 +
gtgtcaggcttatttttcttag

SEQ ID NO: 84292 - DNA, 22 bp, Artificial Sequence
  Synthetic oligonucleotide; TTG chr11 5223948 5223969 5223965 5223970 +
tgtcaggcttatttttcttagt

SEQ ID NO: 84293 - DNA, 22 bp, Artificial Sequence
  Synthetic oligonucleotide; CTT chr11 5223958 5223979 5223975 5223980 +
atttttcttagttttacatcct

SEQ ID NO: 84294 - DNA, 22 bp, Artificial Sequence
  Synthetic oligonucleotide; TTA chr11 5223959 5223980 5223976 5223981 +
tttttcttagttttacatcctc

SEQ ID NO: 84295 - DNA, 22 bp, Artificial Sequence
  Synthetic oligonucleotide; TTT chr11 5223962 5223983 5223979 5223984 +
ttcttagttttacatcctccag

SEQ ID NO: 84296 - DNA, 22 bp, Artificial Sequence
  Synthetic oligonucleotide; TTT chr11 5223963 5223984 5223980 5223985 +
tcttagttttacatcctccagg

SEQ ID NO: 84297 - DNA, 22 bp, Artificial Sequence
  Synthetic oligonucleotide; TTT chr11 5223964 5223985 5223981 5223986 +
cttagttttacatcctccaggt

SEQ ID NO: 84298 - DNA, 22 bp, Artificial Sequence
  Synthetic oligonucleotide; TTC chr11 5223965 5223986 5223982 5223987 +
ttagttttacatcctccaggtt

SEQ ID NO: 84299 - DNA, 22 bp, Artificial Sequence
  Synthetic oligonucleotide; CTT chr11 5223967 5223988 5223984 5223989 +
agttttacatcctccaggttca

SEQ ID NO: 84300 - DNA, 22 bp, Artificial Sequence
  Synthetic oligonucleotide; TTA chr11 5223968 5223989 5223985 5223990 +
gttttacatcctccaggttcat

SEQ ID NO: 84301 - DNA, 22 bp, Artificial Sequence
  Synthetic oligonucleotide; TTT chr11 5223972 5223993 5223989 5223994 +
tacatcctccaggttcatcaat

SEQ ID NO: 84302 - DNA, 22 bp, Artificial Sequence
  Synthetic oligonucleotide; TTT chr11 5223973 5223994 5223990 5223995 +
acatcctccaggttcatcaatt

SEQ ID NO: 84303 - DNA, 22 bp, Artificial Sequence
  Synthetic oligonucleotide; TTA chr11 5223974 5223995 5223991 5223996 +
catcctccaggttcatcaattc

SEQ ID NO: 84304 - DNA, 22 bp, Artificial Sequence
  Synthetic oligonucleotide; CTC chr11 5223981 5224002 5223998 5224003 +
caggttcatcaattctgccata

SEQ ID NO: 84305 - DNA, 22 bp, Artificial Sequence
  Synthetic oligonucleotide; TTC chr11 5223988 5224009 5224005 5224010 +
atcaattctgccataaatggca

SEQ ID NO: 84306 - DNA, 22 bp, Artificial Sequence
  Synthetic oligonucleotide; TTC chr11 5223996 5224017 5224013 5224018 +
tgccataaatggcaggattttc

SEQ ID NO: 84307 - DNA, 22 bp, Artificial Sequence
  Synthetic oligonucleotide; CTG chr11 5223998 5224019 5224015 5224020 +
ccataaatggcaggattttctt

SEQ ID NO: 84308 - DNA, 22 bp, Artificial Sequence
  Synthetic oligonucleotide; TTT chr11 5224016 5224037 5224033 5224038 +
tcttctttttaatttttttatt

SEQ ID NO: 84309 - DNA, 22 bp, Artificial Sequence
  Synthetic oligonucleotide; TTT chr11 5224017 5224038 5224034 5224039 +
cttctttttaatttttttattt

SEQ ID NO: 84310 - DNA, 22 bp, Artificial Sequence
  Synthetic oligonucleotide; TTC chr11 5224018 5224039 5224035 5224040 +
ttctttttaatttttttatttt

SEQ ID NO: 84311 - DNA, 22 bp, Artificial Sequence
  Synthetic oligonucleotide; CTT chr11 5224020 5224041 5224037 5224042 +
ctttttaatttttttattttcc

SEQ ID NO: 84312 - DNA, 22 bp, Artificial Sequence
  Synthetic oligonucleotide; TTC chr11 5224021 5224042 5224038 5224043 +
tttttaatttttttattttcct

SEQ ID NO: 84313 - DNA, 22 bp, Artificial Sequence
  Synthetic oligonucleotide; CTT chr11 5224023 5224044 5224040 5224045 +
tttaatttttttattttcctat

SEQ ID NO: 84314 - DNA, 22 bp, Artificial Sequence
  Synthetic oligonucleotide; TTT chr11 5224024 5224045 5224041 5224046 +
ttaatttttttattttcctatt

SEQ ID NO: 84315 - DNA, 22 bp, Artificial Sequence
  Synthetic oligonucleotide; TTT chr11 5224025 5224046 5224042 5224047 +
taatttttttattttcctattt

SEQ ID NO: 84316 - DNA, 22 bp, Artificial Sequence
  Synthetic oligonucleotide; TTT chr11 5224026 5224047 5224043 5224048 +
aatttttttattttcctatttt

SEQ ID NO: 84317 - DNA, 22 bp, Artificial Sequence
  Synthetic oligonucleotide; TTA chr11 5224027 5224048 5224044 5224049 +
atttttttattttcctattttt

SEQ ID NO: 84318 - DNA, 22 bp, Artificial Sequence
  Synthetic oligonucleotide; TTT chr11 5224031 5224052 5224048 5224053 +
ttttattttcctatttttaatt

SEQ ID NO: 84319 - DNA, 22 bp, Artificial Sequence
  Synthetic oligonucleotide; TTT chr11 5224032 5224053 5224049 5224054 +
tttattttcctatttttaattt

SEQ ID NO: 84320 - DNA, 22 bp, Artificial Sequence
  Synthetic oligonucleotide; TTT chr11 5224033 5224054 5224050 5224055 +
ttattttcctatttttaatttt

SEQ ID NO: 84321 - DNA, 22 bp, Artificial Sequence
  Synthetic oligonucleotide; TTT chr11 5224034 5224055 5224051 5224056 +
tattttcctatttttaattttt

SEQ ID NO: 84322 - DNA, 22 bp, Artificial Sequence
  Synthetic oligonucleotide; TTT chr11 5224035 5224056 5224052 5224057 +
attttcctatttttaatttttt

SEQ ID NO: 84323 - DNA, 22 bp, Artificial Sequence
  Synthetic oligonucleotide; TTA chr11 5224036 5224057 5224053 5224058 +
ttttcctatttttaattttttg

SEQ ID NO: 84324 - DNA, 22 bp, Artificial Sequence
  Synthetic oligonucleotide; TTT chr11 5224039 5224060 5224056 5224061 +
tcctatttttaattttttgttt

SEQ ID NO: 84325 - DNA, 22 bp, Artificial Sequence
  Synthetic oligonucleotide; TTT chr11 5224040 5224061 5224057 5224062 +
cctatttttaattttttgtttg

SEQ ID NO: 84326 - DNA, 22 bp, Artificial Sequence
  Synthetic oligonucleotide; TTC chr11 5224041 5224062 5224058 5224063 +
ctatttttaattttttgtttgt

SEQ ID NO: 84327 - DNA, 22 bp, Artificial Sequence
  Synthetic oligonucleotide; CTA chr11 5224044 5224065 5224061 5224066 +
tttttaattttttgtttgttat

SEQ ID NO: 84328 - DNA, 22 bp, Artificial Sequence
  Synthetic oligonucleotide; TTT chr11 5224047 5224068 5224064 5224069 +
ttaattttttgtttgttattga

SEQ ID NO: 84329 - DNA, 22 bp, Artificial Sequence
  Synthetic oligonucleotide; TTT chr11 5224048 5224069 5224065 5224070 +
taattttttgtttgttattgaa

SEQ ID NO: 84330 - DNA, 22 bp, Artificial Sequence
  Synthetic oligonucleotide; TTT chr11 5224049 5224070 5224066 5224071 +
aattttttgtttgttattgaat

SEQ ID NO: 84331 - DNA, 22 bp, Artificial Sequence
  Synthetic oligonucleotide; TTA chr11 5224050 5224071 5224067 5224072 +
attttttgtttgttattgaatc

SEQ ID NO: 84332 - DNA, 22 bp, Artificial Sequence
  Synthetic oligonucleotide; TTT chr11 5224054 5224075 5224071 5224076 +
tttgtttgttattgaatcatct

SEQ ID NO: 84333 - DNA, 22 bp, Artificial Sequence
  Synthetic oligonucleotide; TTT chr11 5224055 5224076 5224072 5224077 +
ttgtttgttattgaatcatctg

SEQ ID NO: 84334 - DNA, 22 bp, Artificial Sequence
  Synthetic oligonucleotide; TTT chr11 5224056 5224077 5224073 5224078 +
tgtttgttattgaatcatctgt

SEQ ID NO: 84335 - DNA, 22 bp, Artificial Sequence
  Synthetic oligonucleotide; TTT chr11 5224057 5224078 5224074 5224079 +
gtttgttattgaatcatctgtg

SEQ ID NO: 84336 - DNA, 22 bp, Artificial Sequence
  Synthetic oligonucleotide; TTG chr11 5224058 5224079 5224075 5224080 +
tttgttattgaatcatctgtgt

SEQ ID NO: 84337 - DNA, 22 bp, Artificial Sequence
  Synthetic oligonucleotide; TTT chr11 5224061 5224082 5224078 5224083 +
gttattgaatcatctgtgtttc

SEQ ID NO: 84338 - DNA, 22 bp, Artificial Sequence
  Synthetic oligonucleotide; TTG chr11 5224062 5224083 5224079 5224084 +
ttattgaatcatctgtgtttct

SEQ ID NO: 84339 - DNA, 22 bp, Artificial Sequence
  Synthetic oligonucleotide; TTA chr11 5224065 5224086 5224082 5224087 +
ttgaatcatctgtgtttcttat

SEQ ID NO: 84340 - DNA, 22 bp, Artificial Sequence
  Synthetic oligonucleotide; TTG chr11 5224068 5224089 5224085 5224090 +
aatcatctgtgtttcttatata

SEQ ID NO: 84341 - DNA, 22 bp, Artificial Sequence
  Synthetic oligonucleotide; CTG chr11 5224077 5224098 5224094 5224099 +
tgtttcttatatattttggata

SEQ ID NO: 84342 - DNA, 22 bp, Artificial Sequence
  Synthetic oligonucleotide; TTT chr11 5224082 5224103 5224099 5224104 +
cttatatattttggatattaac

SEQ ID NO: 84343 - DNA, 22 bp, Artificial Sequence
  Synthetic oligonucleotide; TTC chr11 5224083 5224104 5224100 5224105 +
ttatatattttggatattaacc

SEQ ID NO: 84344 - DNA, 22 bp, Artificial Sequence
  Synthetic oligonucleotide; CTT chr11 5224085 5224106 5224102 5224107 +
atatattttggatattaaccaa

SEQ ID NO: 84345 - DNA, 22 bp, Artificial Sequence
  Synthetic oligonucleotide; TTA chr11 5224086 5224107 5224103 5224108 +
tatattttggatattaaccaaa

SEQ ID NO: 84346 - DNA, 22 bp, Artificial Sequence
  Synthetic oligonucleotide; TTT chr11 5224093 5224114 5224110 5224115 +
tggatattaaccaaaatattta

SEQ ID NO: 84347 - DNA, 22 bp, Artificial Sequence
  Synthetic oligonucleotide; TTT chr11 5224094 5224115 5224111 5224116 +
ggatattaaccaaaatatttaa

SEQ ID NO: 84348 - DNA, 22 bp, Artificial Sequence
  Synthetic oligonucleotide; TTG chr11 5224095 5224116 5224112 5224117 +
gatattaaccaaaatatttaag

SEQ ID NO: 84349 - DNA, 22 bp, Artificial Sequence
  Synthetic oligonucleotide; TTA chr11 5224102 5224123 5224119 5224124 +
accaaaatatttaagaaatatt

SEQ ID NO: 84350 - DNA, 22 bp, Artificial Sequence
  Synthetic oligonucleotide; TTT chr11 5224114 5224135 5224131 5224136 +
aagaaatatttggtttgcaaat

SEQ ID NO: 84351 - DNA, 22 bp, Artificial Sequence
  Synthetic oligonucleotide; TTA chr11 5224115 5224136 5224132 5224137 +
agaaatatttggtttgcaaata

SEQ ID NO: 84352 - DNA, 22 bp, Artificial Sequence
  Synthetic oligonucleotide; TTT chr11 5224125 5224146 5224142 5224147 +
ggtttgcaaatatgccatttca

SEQ ID NO: 84353 - DNA, 22 bp, Artificial Sequence
  Synthetic oligonucleotide; TTG chr11 5224126 5224147 5224143 5224148 +
gtttgcaaatatgccatttcat

SEQ ID NO: 84354 - DNA, 22 bp, Artificial Sequence
  Synthetic oligonucleotide; TTT chr11 5224130 5224151 5224147 5224152 +
gcaaatatgccatttcatggtt

SEQ ID NO: 84355 - DNA, 22 bp, Artificial Sequence
  Synthetic oligonucleotide; TTG chr11 5224131 5224152 5224148 5224153 +
caaatatgccatttcatggttc

SEQ ID NO: 84356 - DNA, 22 bp, Artificial Sequence
  Synthetic oligonucleotide; TTT chr11 5224145 5224166 5224162 5224167 +
catggttcacctttcatttgtt

SEQ ID NO: 84357 - DNA, 22 bp, Artificial Sequence
  Synthetic oligonucleotide; TTC chr11 5224146 5224167 5224163 5224168 +
atggttcacctttcatttgttc

SEQ ID NO: 84358 - DNA, 22 bp, Artificial Sequence
  Synthetic oligonucleotide; TTC chr11 5224153 5224174 5224170 5224175 +
acctttcatttgttcattgttt

SEQ ID NO: 84359 - DNA, 22 bp, Artificial Sequence
  Synthetic oligonucleotide; CTT chr11 5224158 5224179 5224175 5224180 +
tcatttgttcattgttttgttt

SEQ ID NO: 84360 - DNA, 22 bp, Artificial Sequence
  Synthetic oligonucleotide; TTT chr11 5224159 5224180 5224176 5224181 +
catttgttcattgttttgtttt

SEQ ID NO: 84361 - DNA, 22 bp, Artificial Sequence
  Synthetic oligonucleotide; TTC chr11 5224160 5224181 5224177 5224182 +
atttgttcattgttttgttttt

SEQ ID NO: 84362 - DNA, 22 bp, Artificial Sequence
  Synthetic oligonucleotide; TTT chr11 5224164 5224185 5224181 5224186 +
gttcattgttttgttttttgtg

SEQ ID NO: 84363 - DNA, 22 bp, Artificial Sequence
  Synthetic oligonucleotide; TTG chr11 5224165 5224186 5224182 5224187 +
ttcattgttttgttttttgtgt

SEQ ID NO: 84364 - DNA, 22 bp, Artificial Sequence
  Synthetic oligonucleotide; TTC chr11 5224168 5224189 5224185 5224190 +
attgttttgttttttgtgtgga

SEQ ID NO: 84365 - DNA, 22 bp, Artificial Sequence
  Synthetic oligonucleotide; TTG chr11 5224172 5224193 5224189 5224194 +
ttttgttttttgtgtggaaatt

SEQ ID NO: 84366 - DNA, 22 bp, Artificial Sequence
  Synthetic oligonucleotide; TTT chr11 5224175 5224196 5224192 5224197 +
tgttttttgtgtggaaattttt

SEQ ID NO: 84367 - DNA, 22 bp, Artificial Sequence
  Synthetic oligonucleotide; TTT chr11 5224176 5224197 5224193 5224198 +
gttttttgtgtggaaatttttt

SEQ ID NO: 84368 - DNA, 22 bp, Artificial Sequence
  Synthetic oligonucleotide; TTG chr11 5224177 5224198 5224194 5224199 +
ttttttgtgtggaaatttttta

SEQ ID NO: 84369 - DNA, 22 bp, Artificial Sequence
  Synthetic oligonucleotide; TTT chr11 5224180 5224201 5224197 5224202 +
tttgtgtggaaattttttagtt

SEQ ID NO: 84370 - DNA, 22 bp, Artificial Sequence
  Synthetic oligonucleotide; TTT chr11 5224181 5224202 5224198 5224203 +
ttgtgtggaaattttttagttt

SEQ ID NO: 84371 - DNA, 22 bp, Artificial Sequence
  Synthetic oligonucleotide; TTT chr11 5224182 5224203 5224199 5224204 +
tgtgtggaaattttttagtttg

SEQ ID NO: 84372 - DNA, 22 bp, Artificial Sequence
  Synthetic oligonucleotide; TTT chr11 5224183 5224204 5224200 5224205 +
gtgtggaaattttttagtttga

SEQ ID NO: 84373 - DNA, 22 bp, Artificial Sequence
  Synthetic oligonucleotide; TTG chr11 5224184 5224205 5224201 5224206 +
tgtggaaattttttagtttgat

SEQ ID NO: 84374 - DNA, 22 bp, Artificial Sequence
  Synthetic oligonucleotide; TTT chr11 5224195 5224216 5224212 5224217 +
tttagtttgatgtagcctcact

SEQ ID NO: 84375 - DNA, 22 bp, Artificial Sequence
  Synthetic oligonucleotide; TTT chr11 5224196 5224217 5224213 5224218 +
ttagtttgatgtagcctcactt

SEQ ID NO: 84376 - DNA, 22 bp, Artificial Sequence
  Synthetic oligonucleotide; TTT chr11 5224197 5224218 5224214 5224219 +
tagtttgatgtagcctcacttc

SEQ ID NO: 84377 - DNA, 22 bp, Artificial Sequence
  Synthetic oligonucleotide; TTT chr11 5224198 5224219 5224215 5224220 +
agtttgatgtagcctcacttct

SEQ ID NO: 84378 - DNA, 22 bp, Artificial Sequence
  Synthetic oligonucleotide; TTA chr11 5224199 5224220 5224216 5224221 +
gtttgatgtagcctcacttctt

SEQ ID NO: 84379 - DNA, 22 bp, Artificial Sequence
  Synthetic oligonucleotide; TTT chr11 5224203 5224224 5224220 5224225 +
gatgtagcctcacttctttatt

SEQ ID NO: 84380 - DNA, 22 bp, Artificial Sequence
  Synthetic oligonucleotide; TTG chr11 5224204 5224225 5224221 5224226 +
atgtagcctcacttctttattt

SEQ ID NO: 84381 - DNA, 22 bp, Artificial Sequence
  Synthetic oligonucleotide; CTC chr11 5224214 5224235 5224231 5224236 +
acttctttatttttccttttgt

SEQ ID NO: 84382 - DNA, 22 bp, Artificial Sequence
  Synthetic oligonucleotide; CTT chr11 5224218 5224239 5224235 5224240 +
ctttatttttccttttgttgcc

SEQ ID NO: 84383 - DNA, 22 bp, Artificial Sequence
  Synthetic oligonucleotide; TTC chr11 5224219 5224240 5224236 5224241 +
tttatttttccttttgttgcct

SEQ ID NO: 84384 - DNA, 22 bp, Artificial Sequence
  Synthetic oligonucleotide; CTT chr11 5224221 5224242 5224238 5224243 +
tatttttccttttgttgccttt

SEQ ID NO: 84385 - DNA, 22 bp, Artificial Sequence
  Synthetic oligonucleotide; TTT chr11 5224222 5224243 5224239 5224244 +
atttttccttttgttgcctttg

SEQ ID NO: 84386 - DNA, 22 bp, Artificial Sequence
  Synthetic oligonucleotide; TTA chr11 5224223 5224244 5224240 5224245 +
tttttccttttgttgcctttgc

SEQ ID NO: 84387 - DNA, 22 bp, Artificial Sequence
  Synthetic oligonucleotide; TTT chr11 5224226 5224247 5224243 5224248 +
ttccttttgttgcctttgcttc

SEQ ID NO: 84388 - DNA, 22 bp, Artificial Sequence
  Synthetic oligonucleotide; TTT chr11 5224227 5224248 5224244 5224249 +
tccttttgttgcctttgcttct

SEQ ID NO: 84389 - DNA, 22 bp, Artificial Sequence
  Synthetic oligonucleotide; TTT chr11 5224228 5224249 5224245 5224250 +
ccttttgttgcctttgcttctc

SEQ ID NO: 84390 - DNA, 22 bp, Artificial Sequence
  Synthetic oligonucleotide; TTC chr11 5224229 5224250 5224246 5224251 +
cttttgttgcctttgcttctca

SEQ ID NO: 84391 - DNA, 22 bp, Artificial Sequence
  Synthetic oligonucleotide; CTT chr11 5224232 5224253 5224249 5224254 +
ttgttgcctttgcttctcatat

SEQ ID NO: 84392 - DNA, 22 bp, Artificial Sequence
  Synthetic oligonucleotide; TTT chr11 5224233 5224254 5224250 5224255 +
tgttgcctttgcttctcatatc

SEQ ID NO: 84393 - DNA, 22 bp, Artificial Sequence
  Synthetic oligonucleotide; TTT chr11 5224234 5224255 5224251 5224256 +
gttgcctttgcttctcatatca

SEQ ID NO: 84394 - DNA, 22 bp, Artificial Sequence
  Synthetic oligonucleotide; TTG chr11 5224235 5224256 5224252 5224257 +
ttgcctttgcttctcatatcaa

SEQ ID NO: 84395 - DNA, 22 bp, Artificial Sequence
  Synthetic oligonucleotide; TTG chr11 5224238 5224259 5224255 5224260 +
cctttgcttctcatatcaaatt

SEQ ID NO: 84396 - DNA, 22 bp, Artificial Sequence
  Synthetic oligonucleotide; CTT chr11 5224242 5224263 5224259 5224264 +
tgcttctcatatcaaattcaaa

SEQ ID NO: 84397 - DNA, 22 bp, Artificial Sequence
  Synthetic oligonucleotide; TTT chr11 5224243 5224264 5224260 5224265 +
gcttctcatatcaaattcaaaa

SEQ ID NO: 84398 - DNA, 22 bp, Artificial Sequence
  Synthetic oligonucleotide; TTG chr11 5224244 5224265 5224261 5224266 +
cttctcatatcaaattcaaaaa

SEQ ID NO: 84399 - DNA, 22 bp, Artificial Sequence
  Synthetic oligonucleotide; CTT chr11 5224247 5224268 5224264 5224269 +
ctcatatcaaattcaaaaaacg

SEQ ID NO: 84400 - DNA, 22 bp, Artificial Sequence
  Synthetic oligonucleotide; TTC chr11 5224248 5224269 5224265 5224270 +
tcatatcaaattcaaaaaacgg

SEQ ID NO: 84401 - DNA, 22 bp, Artificial Sequence
  Synthetic oligonucleotide; CTC chr11 5224250 5224271 5224267 5224272 +
atatcaaattcaaaaaacggct

SEQ ID NO: 84402 - DNA, 22 bp, Artificial Sequence
  Synthetic oligonucleotide; TTC chr11 5224261 5224282 5224278 5224283 +
aaaaaacggctgcaacgtgaat

SEQ ID NO: 84403 - DNA, 22 bp, Artificial Sequence
  Synthetic oligonucleotide; CTG chr11 5224273 5224294 5224290 5224295 +
caacgtgaatattagaattttc

SEQ ID NO: 84404 - DNA, 22 bp, Artificial Sequence
  Synthetic oligonucleotide; TTA chr11 5224287 5224308 5224304 5224309 +
gaattttcttcttttgatttct

SEQ ID NO: 84405 - DNA, 22 bp, Artificial Sequence
  Synthetic oligonucleotide; TTT chr11 5224293 5224314 5224310 5224315 +
tcttcttttgatttctttaaaa

SEQ ID NO: 84406 - DNA, 22 bp, Artificial Sequence
  Synthetic oligonucleotide; TTT chr11 5224294 5224315 5224311 5224316 +
cttcttttgatttctttaaaaa

SEQ ID NO: 84407 - DNA, 22 bp, Artificial Sequence
  Synthetic oligonucleotide; TTC chr11 5224295 5224316 5224312 5224317 +
ttcttttgatttctttaaaaat

SEQ ID NO: 84408 - DNA, 22 bp, Artificial Sequence
  Synthetic oligonucleotide; CTT chr11 5224297 5224318 5224314 5224319 +
cttttgatttctttaaaaattt

SEQ ID NO: 84409 - DNA, 22 bp, Artificial Sequence
  Synthetic oligonucleotide; TTC chr11 5224298 5224319 5224315 5224320 +
ttttgatttctttaaaaatttt

SEQ ID NO: 84410 - DNA, 22 bp, Artificial Sequence
  Synthetic oligonucleotide; CTT chr11 5224300 5224321 5224317 5224322 +
ttgatttctttaaaaattttta

SEQ ID NO: 84411 - DNA, 22 bp, Artificial Sequence
  Synthetic oligonucleotide; TTT chr11 5224301 5224322 5224318 5224323 +
tgatttctttaaaaatttttat

SEQ ID NO: 84412 - DNA, 22 bp, Artificial Sequence
  Synthetic oligonucleotide; TTT chr11 5224302 5224323 5224319 5224324 +
gatttctttaaaaatttttatg

SEQ ID NO: 84413 - DNA, 22 bp, Artificial Sequence
  Synthetic oligonucleotide; TTG chr11 5224303 5224324 5224320 5224325 +
atttctttaaaaatttttatgg

SEQ ID NO: 84414 - DNA, 22 bp, Artificial Sequence
  Synthetic oligonucleotide; TTT chr11 5224307 5224328 5224324 5224329 +
ctttaaaaatttttatggtttt

SEQ ID NO: 84415 - DNA, 22 bp, Artificial Sequence
  Synthetic oligonucleotide; TTC chr11 5224308 5224329 5224325 5224330 +
tttaaaaatttttatggtttta

SEQ ID NO: 84416 - DNA, 22 bp, Artificial Sequence
  Synthetic oligonucleotide; CTT chr11 5224310 5224331 5224327 5224332 +
taaaaatttttatggttttagg

SEQ ID NO: 84417 - DNA, 22 bp, Artificial Sequence
  Synthetic oligonucleotide; TTT chr11 5224311 5224332 5224328 5224333 +
aaaaatttttatggttttaggt

SEQ ID NO: 84418 - DNA, 22 bp, Artificial Sequence
  Synthetic oligonucleotide; TTA chr11 5224312 5224333 5224329 5224334 +
aaaatttttatggttttaggtc

SEQ ID NO: 84419 - DNA, 22 bp, Artificial Sequence
  Synthetic oligonucleotide; TTT chr11 5224319 5224340 5224336 5224341 +
ttatggttttaggtcttagttt

SEQ ID NO: 84420 - DNA, 22 bp, Artificial Sequence
  Synthetic oligonucleotide; TTT chr11 5224320 5224341 5224337 5224342 +
tatggttttaggtcttagttta

SEQ ID NO: 84421 - DNA, 22 bp, Artificial Sequence
  Synthetic oligonucleotide; TTT chr11 5224321 5224342 5224338 5224343 +
atggttttaggtcttagtttaa

SEQ ID NO: 84422 - DNA, 22 bp, Artificial Sequence
  Synthetic oligonucleotide; TTA chr11 5224322 5224343 5224339 5224344 +
tggttttaggtcttagtttaat

SEQ ID NO: 84423 - DNA, 22 bp, Artificial Sequence
  Synthetic oligonucleotide; TTT chr11 5224328 5224349 5224345 5224350 +
taggtcttagtttaattcttta

SEQ ID NO: 84424 - DNA, 22 bp, Artificial Sequence
  Synthetic oligonucleotide; TTT chr11 5224329 5224350 5224346 5224351 +
aggtcttagtttaattctttaa

SEQ ID NO: 84425 - DNA, 22 bp, Artificial Sequence
  Synthetic oligonucleotide; TTA chr11 5224330 5224351 5224347 5224352 +
ggtcttagtttaattctttaac

SEQ ID NO: 84426 - DNA, 22 bp, Artificial Sequence
  Synthetic oligonucleotide; CTT chr11 5224336 5224357 5224353 5224358 +
agtttaattctttaacccattc

SEQ ID NO: 84427 - DNA, 22 bp, Artificial Sequence
  Synthetic oligonucleotide; TTA chr11 5224337 5224358 5224354 5224359 +
gtttaattctttaacccattca

SEQ ID NO: 84428 - DNA, 22 bp, Artificial Sequence
  Synthetic oligonucleotide; TTT chr11 5224341 5224362 5224358 5224363 +
aattctttaacccattcaaatt

SEQ ID NO: 84429 - DNA, 22 bp, Artificial Sequence
  Synthetic oligonucleotide; TTA chr11 5224342 5224363 5224359 5224364 +
attctttaacccattcaaattt

SEQ ID NO: 84430 - DNA, 22 bp, Artificial Sequence
  Synthetic oligonucleotide; TTC chr11 5224346 5224367 5224363 5224368 +
tttaacccattcaaatttattt

SEQ ID NO: 84431 - DNA, 22 bp, Artificial Sequence
  Synthetic oligonucleotide; CTT chr11 5224348 5224369 5224365 5224370 +
taacccattcaaatttattttt

SEQ ID NO: 84432 - DNA, 22 bp, Artificial Sequence
  Synthetic oligonucleotide; TTT chr11 5224349 5224370 5224366 5224371 +
aacccattcaaatttatttttg

SEQ ID NO: 84433 - DNA, 22 bp, Artificial Sequence
  Synthetic oligonucleotide; TTA chr11 5224350 5224371 5224367 5224372 +
acccattcaaatttatttttgt

SEQ ID NO: 84434 - DNA, 22 bp, Artificial Sequence
  Synthetic oligonucleotide; TTC chr11 5224358 5224379 5224375 5224380 +
aaatttatttttgtttatggtg

SEQ ID NO: 84435 - DNA, 22 bp, Artificial Sequence
  Synthetic oligonucleotide; TTT chr11 5224364 5224385 5224381 5224386 +
atttttgtttatggtgtaagac

SEQ ID NO: 84436 - DNA, 22 bp, Artificial Sequence
  Synthetic oligonucleotide; TTA chr11 5224365 5224386 5224382 5224387 +
tttttgtttatggtgtaagaca

SEQ ID NO: 84437 - DNA, 22 bp, Artificial Sequence
  Synthetic oligonucleotide; TTT chr11 5224368 5224389 5224385 5224390 +
ttgtttatggtgtaagacaagg

SEQ ID NO: 84438 - DNA, 22 bp, Artificial Sequence
  Synthetic oligonucleotide; TTT chr11 5224369 5224390 5224386 5224391 +
tgtttatggtgtaagacaaggg

SEQ ID NO: 84439 - DNA, 22 bp, Artificial Sequence
  Synthetic oligonucleotide; TTT chr11 5224370 5224391 5224387 5224392 +
gtttatggtgtaagacaagggt

SEQ ID NO: 84440 - DNA, 22 bp, Artificial Sequence
  Synthetic oligonucleotide; TTG chr11 5224371 5224392 5224388 5224393 +
tttatggtgtaagacaagggtc

SEQ ID NO: 84441 - DNA, 22 bp, Artificial Sequence
  Synthetic oligonucleotide; TTT chr11 5224374 5224395 5224391 5224396 +
atggtgtaagacaagggtctga

SEQ ID NO: 84442 - DNA, 22 bp, Artificial Sequence
  Synthetic oligonucleotide; TTA chr11 5224375 5224396 5224392 5224397 +
tggtgtaagacaagggtctgat

SEQ ID NO: 84443 - DNA, 22 bp, Artificial Sequence
  Synthetic oligonucleotide; CTG chr11 5224395 5224416 5224412 5224417 +
atttcatttcattttgagggtt

SEQ ID NO: 84444 - DNA, 22 bp, Artificial Sequence
  Synthetic oligonucleotide; TTT chr11 5224399 5224420 5224416 5224421 +
catttcattttgagggtttcac

SEQ ID NO: 84445 - DNA, 22 bp, Artificial Sequence
  Synthetic oligonucleotide; TTC chr11 5224400 5224421 5224417 5224422 +
atttcattttgagggtttcacc

SEQ ID NO: 84446 - DNA, 22 bp, Artificial Sequence
  Synthetic oligonucleotide; TTT chr11 5224404 5224425 5224421 5224426 +
cattttgagggtttcaccctct

SEQ ID NO: 84447 - DNA, 22 bp, Artificial Sequence
  Synthetic oligonucleotide; TTC chr11 5224405 5224426 5224422 5224427 +
attttgagggtttcaccctctc

SEQ ID NO: 84448 - DNA, 22 bp, Artificial Sequence
  Synthetic oligonucleotide; TTT chr11 5224409 5224430 5224426 5224431 +
tgagggtttcaccctctcatat

SEQ ID NO: 84449 - DNA, 22 bp, Artificial Sequence
  Synthetic oligonucleotide; TTT chr11 5224410 5224431 5224427 5224432 +
gagggtttcaccctctcatata

SEQ ID NO: 84450 - DNA, 22 bp, Artificial Sequence
  Synthetic oligonucleotide; TTG chr11 5224411 5224432 5224428 5224433 +
agggtttcaccctctcatataa

SEQ ID NO: 84451 - DNA, 22 bp, Artificial Sequence
  Synthetic oligonucleotide; TTT chr11 5224418 5224439 5224435 5224440 +
caccctctcatataataaaatt

SEQ ID NO: 84452 - DNA, 22 bp, Artificial Sequence
  Synthetic oligonucleotide; TTC chr11 5224419 5224440 5224436 5224441 +
accctctcatataataaaattc

SEQ ID NO: 84453 - DNA, 22 bp, Artificial Sequence
  Synthetic oligonucleotide; CTC chr11 5224425 5224446 5224442 5224447 +
tcatataataaaattcttctat

SEQ ID NO: 84454 - DNA, 22 bp, Artificial Sequence
  Synthetic oligonucleotide; CTC chr11 5224427 5224448 5224444 5224449 +
atataataaaattcttctatat

SEQ ID NO: 84455 - DNA, 22 bp, Artificial Sequence
  Synthetic oligonucleotide; TTC chr11 5224441 5224462 5224458 5224463 +
ttctatatacccttctatcatc

SEQ ID NO: 84456 - DNA, 22 bp, Artificial Sequence
  Synthetic oligonucleotide; CTT chr11 5224443 5224464 5224460 5224465 +
ctatatacccttctatcatcac

SEQ ID NO: 84457 - DNA, 22 bp, Artificial Sequence
  Synthetic oligonucleotide; TTC chr11 5224444 5224465 5224461 5224466 +
tatatacccttctatcatcact

SEQ ID NO: 84458 - DNA, 22 bp, Artificial Sequence
  Synthetic oligonucleotide; CTA chr11 5224446 5224467 5224463 5224468 +
tatacccttctatcatcactta

SEQ ID NO: 84459 - DNA, 22 bp, Artificial Sequence
  Synthetic oligonucleotide; CTT chr11 5224455 5224476 5224472 5224477 +
ctatcatcacttattactgatt

SEQ ID NO: 84460 - DNA, 22 bp, Artificial Sequence
  Synthetic oligonucleotide; TTC chr11 5224456 5224477 5224473 5224478 +
tatcatcacttattactgatta

SEQ ID NO: 84461 - DNA, 22 bp, Artificial Sequence
  Synthetic oligonucleotide; CTA chr11 5224458 5224479 5224475 5224480 +
tcatcacttattactgattata

SEQ ID NO: 84462 - DNA, 22 bp, Artificial Sequence
  Synthetic oligonucleotide; CTT chr11 5224467 5224488 5224484 5224489 +
attactgattatatgccttgat

SEQ ID NO: 84463 - DNA, 22 bp, Artificial Sequence
  Synthetic oligonucleotide; TTA chr11 5224468 5224489 5224485 5224490 +
ttactgattatatgccttgatt

SEQ ID NO: 84464 - DNA, 22 bp, Artificial Sequence
  Synthetic oligonucleotide; TTA chr11 5224471 5224492 5224488 5224493 +
ctgattatatgccttgatttca

SEQ ID NO: 84465 - DNA, 22 bp, Artificial Sequence
  Synthetic oligonucleotide; CTG chr11 5224474 5224495 5224491 5224496 +
attatatgccttgatttcagaa

SEQ ID NO: 84466 - DNA, 22 bp, Artificial Sequence
  Synthetic oligonucleotide; TTA chr11 5224478 5224499 5224495 5224500 +
tatgccttgatttcagaatctt

SEQ ID NO: 84467 - DNA, 22 bp, Artificial Sequence
  Synthetic oligonucleotide; CTT chr11 5224486 5224507 5224503 5224508 +
gatttcagaatcttgccaacta

SEQ ID NO: 84468 - DNA, 22 bp, Artificial Sequence
  Synthetic oligonucleotide; TTG chr11 5224487 5224508 5224504 5224509 +
atttcagaatcttgccaactag

SEQ ID NO: 84469 - DNA, 22 bp, Artificial Sequence
  Synthetic oligonucleotide; TTT chr11 5224491 5224512 5224508 5224513 +
cagaatcttgccaactagattc

SEQ ID NO: 84470 - DNA, 22 bp, Artificial Sequence
  Synthetic oligonucleotide; TTC chr11 5224492 5224513 5224509 5224514 +
agaatcttgccaactagattca

SEQ ID NO: 84471 - DNA, 22 bp, Artificial Sequence
  Synthetic oligonucleotide; CTT chr11 5224500 5224521 5224517 5224522 +
gccaactagattcagaatttga

SEQ ID NO: 84472 - DNA, 22 bp, Artificial Sequence
  Synthetic oligonucleotide; TTG chr11 5224501 5224522 5224518 5224523 +
ccaactagattcagaatttgac

SEQ ID NO: 84473 - DNA, 22 bp, Artificial Sequence
  Synthetic oligonucleotide; CTA chr11 5224508 5224529 5224525 5224530 +
gattcagaatttgactgggaga

SEQ ID NO: 84474 - DNA, 22 bp, Artificial Sequence
  Synthetic oligonucleotide; TTC chr11 5224513 5224534 5224530 5224535 +
agaatttgactgggagagagga

SEQ ID NO: 84475 - DNA, 22 bp, Artificial Sequence
  Synthetic oligonucleotide; TTT chr11 5224520 5224541 5224537 5224542 +
gactgggagagaggacaaggac

SEQ ID NO: 84476 - DNA, 22 bp, Artificial Sequence
  Synthetic oligonucleotide; TTG chr11 5224521 5224542 5224538 5224543 +
actgggagagaggacaaggacc

SEQ ID NO: 84477 - DNA, 22 bp, Artificial Sequence
  Synthetic oligonucleotide; CTG chr11 5224525 5224546 5224542 5224547 +
ggagagaggacaaggaccactt

SEQ ID NO: 84478 - DNA, 22 bp, Artificial Sequence
  Synthetic oligonucleotide; CTT chr11 5224547 5224568 5224564 5224569 +
gagactcatattttatttccag

SEQ ID NO: 84479 - DNA, 22 bp, Artificial Sequence
  Synthetic oligonucleotide; TTG chr11 5224548 5224569 5224565 5224570 +
agactcatattttatttccaga

SEQ ID NO: 84480 - DNA, 22 bp, Artificial Sequence
  Synthetic oligonucleotide; CTC chr11 5224554 5224575 5224571 5224576 +
atattttatttccagaatctag

SEQ ID NO: 84481 - DNA, 22 bp, Artificial Sequence
  Synthetic oligonucleotide; TTT chr11 5224560 5224581 5224577 5224582 +
tatttccagaatctagcatcta

SEQ ID NO: 84482 - DNA, 22 bp, Artificial Sequence
  Synthetic oligonucleotide; TTT chr11 5224561 5224582 5224578 5224583 +
atttccagaatctagcatctac

SEQ ID NO: 84483 - DNA, 22 bp, Artificial Sequence
  Synthetic oligonucleotide; TTA chr11 5224562 5224583 5224579 5224584 +
tttccagaatctagcatctacc

SEQ ID NO: 84484 - DNA, 22 bp, Artificial Sequence
  Synthetic oligonucleotide; TTT chr11 5224565 5224586 5224582 5224587 +
ccagaatctagcatctacctac

SEQ ID NO: 84485 - DNA, 22 bp, Artificial Sequence
  Synthetic oligonucleotide; TTC chr11 5224566 5224587 5224583 5224588 +
cagaatctagcatctacctacc

SEQ ID NO: 84486 - DNA, 22 bp, Artificial Sequence
  Synthetic oligonucleotide; CTA chr11 5224575 5224596 5224592 5224597 +
gcatctacctacctaggtattg

SEQ ID NO: 84487 - DNA, 22 bp, Artificial Sequence
  Synthetic oligonucleotide; CTA chr11 5224582 5224603 5224599 5224604 +
cctacctaggtattgaataaga

SEQ ID NO: 84488 - DNA, 22 bp, Artificial Sequence
  Synthetic oligonucleotide; CTA chr11 5224586 5224607 5224603 5224608 +
cctaggtattgaataagaaaaa

SEQ ID NO: 84489 - DNA, 22 bp, Artificial Sequence
  Synthetic oligonucleotide; CTA chr11 5224590 5224611 5224607 5224612 +
ggtattgaataagaaaaatgaa

SEQ ID NO: 84490 - DNA, 22 bp, Artificial Sequence
  Synthetic oligonucleotide; TTG chr11 5224597 5224618 5224614 5224619 +
aataagaaaaatgaagttaagg

SEQ ID NO: 84491 - DNA, 22 bp, Artificial Sequence
  Synthetic oligonucleotide; TTA chr11 5224616 5224637 5224633 5224638 +
aggtggttgatggtaacactat

SEQ ID NO: 84492 - DNA, 22 bp, Artificial Sequence
  Synthetic oligonucleotide; TTG chr11 5224625 5224646 5224642 5224647 +
atggtaacactatgctaataac

SEQ ID NO: 84493 - DNA, 22 bp, Artificial Sequence
  Synthetic oligonucleotide; CTA chr11 5224637 5224658 5224654 5224659 +
tgctaataactgcagagccaga

SEQ ID NO: 84494 - DNA, 22 bp, Artificial Sequence
  Synthetic oligonucleotide; CTA chr11 5224642 5224663 5224659 5224664 +
ataactgcagagccagaagcac

SEQ ID NO: 84495 - DNA, 22 bp, Artificial Sequence
  Synthetic oligonucleotide; CTG chr11 5224649 5224670 5224666 5224671 +
cagagccagaagcaccataagg

SEQ ID NO: 84496 - DNA, 22 bp, Artificial Sequence
  Synthetic oligonucleotide; CTC chr11 5224698 5224719 5224715 5224720 +
tgatctcttcctgaatgctaat

SEQ ID NO: 84497 - DNA, 22 bp, Artificial Sequence
  Synthetic oligonucleotide; CTG chr11 5224700 5224721 5224717 5224722 +
atctcttcctgaatgctaatct

SEQ ID NO: 84498 - DNA, 22 bp, Artificial Sequence
  Synthetic oligonucleotide; CTC chr11 5224705 5224726 5224722 5224727 +
ttcctgaatgctaatcttaaac

SEQ ID NO: 84499 - DNA, 22 bp, Artificial Sequence
  Synthetic oligonucleotide; CTT chr11 5224707 5224728 5224724 5224729 +
cctgaatgctaatcttaaacat

SEQ ID NO: 84500 - DNA, 22 bp, Artificial Sequence
  Synthetic oligonucleotide; TTC chr11 5224708 5224729 5224725 5224730 +
ctgaatgctaatcttaaacatc

SEQ ID NO: 84501 - DNA, 22 bp, Artificial Sequence
  Synthetic oligonucleotide; CTG chr11 5224711 5224732 5224728 5224733 +
aatgctaatcttaaacatcctg

SEQ ID NO: 84502 - DNA, 22 bp, Artificial Sequence
  Synthetic oligonucleotide; CTA chr11 5224718 5224739 5224735 5224740 +
atcttaaacatcctgaggaaga

SEQ ID NO: 84503 - DNA, 22 bp, Artificial Sequence
  Synthetic oligonucleotide; CTT chr11 5224723 5224744 5224740 5224745 +
aaacatcctgaggaagaatggg

SEQ ID NO: 84504 - DNA, 22 bp, Artificial Sequence
  Synthetic oligonucleotide; TTA chr11 5224724 5224745 5224741 5224746 +
aacatcctgaggaagaatggga

SEQ ID NO: 84505 - DNA, 22 bp, Artificial Sequence
  Synthetic oligonucleotide; CTG chr11 5224733 5224754 5224750 5224755 +
aggaagaatgggacttccattt

SEQ ID NO: 84506 - DNA, 22 bp, Artificial Sequence
  Synthetic oligonucleotide; CTT chr11 5224749 5224770 5224766 5224771 +
ccatttggggtgggcctatgac

SEQ ID NO: 84507 - DNA, 22 bp, Artificial Sequence
  Synthetic oligonucleotide; TTC chr11 5224750 5224771 5224767 5224772 +
catttggggtgggcctatgaca

SEQ ID NO: 84508 - DNA, 22 bp, Artificial Sequence
  Synthetic oligonucleotide; TTT chr11 5224755 5224776 5224772 5224777 +
ggggtgggcctatgacagggta

SEQ ID NO: 84509 - DNA, 22 bp, Artificial Sequence
  Synthetic oligonucleotide; TTG chr11 5224756 5224777 5224773 5224778 +
gggtgggcctatgacagggtaa

SEQ ID NO: 84510 - DNA, 22 bp, Artificial Sequence
  Synthetic oligonucleotide; CTA chr11 5224767 5224788 5224784 5224789 +
tgacagggtaataagacagtag

SEQ ID NO: 84511 - DNA, 22 bp, Artificial Sequence
  Synthetic oligonucleotide; CTA chr11 5224803 5224824 5224820 5224825 +
caaaaagccgcctttcaaattc

SEQ ID NO: 84512 - DNA, 22 bp, Artificial Sequence
  Synthetic oligonucleotide; CTT chr11 5224817 5224838 5224834 5224839 +
tcaaattcttctcagtcctaac

SEQ ID NO: 84513 - DNA, 22 bp, Artificial Sequence
  Synthetic oligonucleotide; TTT chr11 5224818 5224839 5224835 5224840 +
caaattcttctcagtcctaact

SEQ ID NO: 84514 - DNA, 22 bp, Artificial Sequence
  Synthetic oligonucleotide; TTC chr11 5224819 5224840 5224836 5224841 +
aaattcttctcagtcctaactt

SEQ ID NO: 84515 - DNA, 22 bp, Artificial Sequence
  Synthetic oligonucleotide; TTC chr11 5224825 5224846 5224842 5224847 +
ttctcagtcctaacttttcata

SEQ ID NO: 84516 - DNA, 22 bp, Artificial Sequence
  Synthetic oligonucleotide; CTT chr11 5224827 5224848 5224844 5224849 +
ctcagtcctaacttttcatact

SEQ ID NO: 84517 - DNA, 22 bp, Artificial Sequence
  Synthetic oligonucleotide; TTC chr11 5224828 5224849 5224845 5224850 +
tcagtcctaacttttcatacta

SEQ ID NO: 84518 - DNA, 22 bp, Artificial Sequence
  Synthetic oligonucleotide; CTC chr11 5224830 5224851 5224847 5224852 +
agtcctaacttttcatactaag

SEQ ID NO: 84519 - DNA, 22 bp, Artificial Sequence
  Synthetic oligonucleotide; CTA chr11 5224837 5224858 5224854 5224859 +
acttttcatactaagcccagtc

SEQ ID NO: 84520 - DNA, 22 bp, Artificial Sequence
  Synthetic oligonucleotide; CTT chr11 5224841 5224862 5224858 5224863 +
ttcatactaagcccagtccttc

SEQ ID NO: 84521 - DNA, 22 bp, Artificial Sequence
  Synthetic oligonucleotide; TTT chr11 5224842 5224863 5224859 5224864 +
tcatactaagcccagtccttcc

SEQ ID NO: 84522 - DNA, 22 bp, Artificial Sequence
  Synthetic oligonucleotide; TTT chr11 5224843 5224864 5224860 5224865 +
catactaagcccagtccttcca

SEQ ID NO: 84523 - DNA, 22 bp, Artificial Sequence
  Synthetic oligonucleotide; TTC chr11 5224844 5224865 5224861 5224866 +
atactaagcccagtccttccaa

SEQ ID NO: 84524 - DNA, 22 bp, Artificial Sequence
  Synthetic oligonucleotide; CTA chr11 5224850 5224871 5224867 5224872 +
agcccagtccttccaaagcaga

SEQ ID NO: 84525 - DNA, 22 bp, Artificial Sequence
  Synthetic oligonucleotide; CTT chr11 5224862 5224883 5224879 5224884 +
ccaaagcagactgtgaaagagt

SEQ ID NO: 84526 - DNA, 22 bp, Artificial Sequence
  Synthetic oligonucleotide; TTC chr11 5224863 5224884 5224880 5224885 +
caaagcagactgtgaaagagtg

SEQ ID NO: 84527 - DNA, 22 bp, Artificial Sequence
  Synthetic oligonucleotide; CTG chr11 5224875 5224896 5224892 5224897 +
tgaaagagtgatagttccggga

SEQ ID NO: 84528 - DNA, 22 bp, Artificial Sequence
  Synthetic oligonucleotide; TTC chr11 5224892 5224913 5224909 5224914 +
cgggagactagcactgcagatt

SEQ ID NO: 84529 - DNA, 22 bp, Artificial Sequence
  Synthetic oligonucleotide; CTA chr11 5224902 5224923 5224919 5224924 +
gcactgcagattccgggtcact

SEQ ID NO: 84530 - DNA, 22 bp, Artificial Sequence
  Synthetic oligonucleotide; CTG chr11 5224908 5224929 5224925 5224930 +
cagattccgggtcactgtgagt

SEQ ID NO: 84531 - DNA, 22 bp, Artificial Sequence
  Synthetic oligonucleotide; TTC chr11 5224915 5224936 5224932 5224937 +
cgggtcactgtgagtgggggag

SEQ ID NO: 84532 - DNA, 22 bp, Artificial Sequence
  Synthetic oligonucleotide; CTG chr11 5224925 5224946 5224942 5224947 +
tgagtgggggaggcagggaaga

SEQ ID NO: 84533 - DNA, 22 bp, Artificial Sequence
  Synthetic oligonucleotide; CTC chr11 5224954 5224975 5224971 5224976 +
acaggacagtcaaaccatgacc

SEQ ID NO: 84534 - DNA, 22 bp, Artificial Sequence
  Synthetic oligonucleotide; CTG chr11 5224980 5225001 5224997 5225002 +
tttttccttcttcaagtagacc

SEQ ID NO: 84535 - DNA, 22 bp, Artificial Sequence
  Synthetic oligonucleotide; TTT chr11 5224983 5225004 5225000 5225005 +
ttccttcttcaagtagacctct

SEQ ID NO: 84536 - DNA, 22 bp, Artificial Sequence
  Synthetic oligonucleotide; TTT chr11 5224984 5225005 5225001 5225006 +
tccttcttcaagtagacctcta

SEQ ID NO: 84537 - DNA, 22 bp, Artificial Sequence
  Synthetic oligonucleotide; TTT chr11 5224985 5225006 5225002 5225007 +
ccttcttcaagtagacctctat

SEQ ID NO: 84538 - DNA, 22 bp, Artificial Sequence
  Synthetic oligonucleotide; TTC chr11 5224986 5225007 5225003 5225008 +
cttcttcaagtagacctctata

SEQ ID NO: 84539 - DNA, 22 bp, Artificial Sequence
  Synthetic oligonucleotide; CTT chr11 5224989 5225010 5225006 5225011 +
cttcaagtagacctctataaga

SEQ ID NO: 84540 - DNA, 22 bp, Artificial Sequence
  Synthetic oligonucleotide; TTC chr11 5224990 5225011 5225007 5225012 +
ttcaagtagacctctataagac

SEQ ID NO: 84541 - DNA, 22 bp, Artificial Sequence
  Synthetic oligonucleotide; CTT chr11 5224992 5225013 5225009 5225014 +
caagtagacctctataagacaa

SEQ ID NO: 84542 - DNA, 22 bp, Artificial Sequence
  Synthetic oligonucleotide; TTC chr11 5224993 5225014 5225010 5225015 +
aagtagacctctataagacaac

SEQ ID NO: 84543 - DNA, 22 bp, Artificial Sequence
  Synthetic oligonucleotide; CTC chr11 5225004 5225025 5225021 5225026 +
tataagacaacagagacaacta

SEQ ID NO: 84544 - DNA, 22 bp, Artificial Sequence
  Synthetic oligonucleotide; CTA chr11 5225006 5225027 5225023 5225028 +
taagacaacagagacaactaag

SEQ ID NO: 84545 - DNA, 22 bp, Artificial Sequence
  Synthetic oligonucleotide; CTA chr11 5225026 5225047 5225043 5225048 +
aggctgagtggccaggcgagga

SEQ ID NO: 84546 - DNA, 22 bp, Artificial Sequence
  Synthetic oligonucleotide; CTG chr11 5225032 5225053 5225049 5225054 +
agtggccaggcgaggagaaacc

SEQ ID NO: 84547 - DNA, 22 bp, Artificial Sequence
  Synthetic oligonucleotide; CTC chr11 5225059 5225080 5225076 5225081 +
gccgtaaaacatggaaggaaca

SEQ ID NO: 84548 - DNA, 22 bp, Artificial Sequence
  Synthetic oligonucleotide; CTT chr11 5225084 5225105 5225101 5225106 +
caggggaaaggtggtatctcta

SEQ ID NO: 84549 - DNA, 22 bp, Artificial Sequence
  Synthetic oligonucleotide; TTC chr11 5225085 5225106 5225102 5225107 +
aggggaaaggtggtatctctaa

SEQ ID NO: 84550 - DNA, 22 bp, Artificial Sequence
  Synthetic oligonucleotide; CTC chr11 5225104 5225125 5225121 5225126 +
taagcaagagaactgagtggag

SEQ ID NO: 84551 - DNA, 22 bp, Artificial Sequence
  Synthetic oligonucleotide; CTA chr11 5225106 5225127 5225123 5225128 +
agcaagagaactgagtggagtc

SEQ ID NO: 84552 - DNA, 22 bp, Artificial Sequence
  Synthetic oligonucleotide; CTG chr11 5225119 5225140 5225136 5225141 +
agtggagtcaaggctgagagat

SEQ ID NO: 84553 - DNA, 22 bp, Artificial Sequence
  Synthetic oligonucleotide; CTG chr11 5225135 5225156 5225152 5225157 +
agagatgcaggataagcaaatg

SEQ ID NO: 84554 - DNA, 22 bp, Artificial Sequence
  Synthetic oligonucleotide; TTC chr11 5225175 5225196 5225192 5225197 +
atgaggacagctaaaacaataa

SEQ ID NO: 84555 - DNA, 22 bp, Artificial Sequence
  Synthetic oligonucleotide; CTA chr11 5225188 5225209 5225205 5225210 +
aaacaataagtaatgtaaaata

SEQ ID NO: 84556 - DNA, 22 bp, Artificial Sequence
  Synthetic oligonucleotide; CTT chr11 5225226 5225247 5225243 5225248 +
taacctccaaatcaagcctcta

SEQ ID NO: 84557 - DNA, 22 bp, Artificial Sequence
  Synthetic oligonucleotide; TTT chr11 5225227 5225248 5225244 5225249 +
aacctccaaatcaagcctctac

SEQ ID NO: 84558 - DNA, 22 bp, Artificial Sequence
  Synthetic oligonucleotide; TTA chr11 5225228 5225249 5225245 5225250 +
acctccaaatcaagcctctact

SEQ ID NO: 84559 - DNA, 22 bp, Artificial Sequence
  Synthetic oligonucleotide; CTC chr11 5225233 5225254 5225250 5225255 +
caaatcaagcctctacttgaat

SEQ ID NO: 84560 - DNA, 22 bp, Artificial Sequence
  Synthetic oligonucleotide; CTC chr11 5225246 5225267 5225263 5225268 +
tacttgaatccttttctgaggg

SEQ ID NO: 84561 - DNA, 22 bp, Artificial Sequence
  Synthetic oligonucleotide; CTA chr11 5225248 5225269 5225265 5225270 +
cttgaatccttttctgagggat

SEQ ID NO: 84562 - DNA, 22 bp, Artificial Sequence
  Synthetic oligonucleotide; CTT chr11 5225251 5225272 5225268 5225273 +
gaatccttttctgagggatgaa

SEQ ID NO: 84563 - DNA, 22 bp, Artificial Sequence
  Synthetic oligonucleotide; TTG chr11 5225252 5225273 5225269 5225274 +
aatccttttctgagggatgaat

SEQ ID NO: 84564 - DNA, 22 bp, Artificial Sequence
  Synthetic oligonucleotide; CTT chr11 5225259 5225280 5225276 5225281 +
ttctgagggatgaataaggcat

SEQ ID NO: 84565 - DNA, 22 bp, Artificial Sequence
  Synthetic oligonucleotide; TTT chr11 5225260 5225281 5225277 5225282 +
tctgagggatgaataaggcata

SEQ ID NO: 84566 - DNA, 22 bp, Artificial Sequence
  Synthetic oligonucleotide; TTT chr11 5225261 5225282 5225278 5225283 +
ctgagggatgaataaggcatat

SEQ ID NO: 84567 - DNA, 22 bp, Artificial Sequence
  Synthetic oligonucleotide; TTC chr11 5225262 5225283 5225279 5225284 +
tgagggatgaataaggcatatg

SEQ ID NO: 84568 - DNA, 22 bp, Artificial Sequence
  Synthetic oligonucleotide; CTG chr11 5225264 5225285 5225281 5225286 +
agggatgaataaggcatatgca

SEQ ID NO: 84569 - DNA, 22 bp, Artificial Sequence
  Synthetic oligonucleotide; CTG chr11 5225296 5225317 5225313 5225318 +
ttgccaatgtgcattagctgtt

SEQ ID NO: 84570 - DNA, 22 bp, Artificial Sequence
  Synthetic oligonucleotide; TTG chr11 5225299 5225320 5225316 5225321 +
ccaatgtgcattagctgtttgc

SEQ ID NO: 84571 - DNA, 22 bp, Artificial Sequence
  Synthetic oligonucleotide; TTA chr11 5225312 5225333 5225329 5225334 +
gctgtttgcagcctcaccttct

SEQ ID NO: 84572 - DNA, 22 bp, Artificial Sequence
  Synthetic oligonucleotide; CTG chr11 5225316 5225337 5225333 5225338 +
tttgcagcctcaccttctttca

SEQ ID NO: 84573 - DNA, 22 bp, Artificial Sequence
  Synthetic oligonucleotide; TTT chr11 5225319 5225340 5225336 5225341 +
gcagcctcaccttctttcatgg

SEQ ID NO: 84574 - DNA, 22 bp, Artificial Sequence
  Synthetic oligonucleotide; TTG chr11 5225320 5225341 5225337 5225342 +
cagcctcaccttctttcatgga

SEQ ID NO: 84575 - DNA, 22 bp, Artificial Sequence
  Synthetic oligonucleotide; CTC chr11 5225327 5225348 5225344 5225349 +
accttctttcatggagtttaag

SEQ ID NO: 84576 - DNA, 22 bp, Artificial Sequence
  Synthetic oligonucleotide; CTT chr11 5225332 5225353 5225349 5225354 +
ctttcatggagtttaagatata

SEQ ID NO: 84577 - DNA, 22 bp, Artificial Sequence
  Synthetic oligonucleotide; TTC chr11 5225333 5225354 5225350 5225355 +
tttcatggagtttaagatatag

SEQ ID NO: 84578 - DNA, 22 bp, Artificial Sequence
  Synthetic oligonucleotide; CTT chr11 5225335 5225356 5225352 5225357 +
tcatggagtttaagatatagtg

SEQ ID NO: 84579 - DNA, 22 bp, Artificial Sequence
  Synthetic oligonucleotide; TTT chr11 5225336 5225357 5225353 5225358 +
catggagtttaagatatagtgt

SEQ ID NO: 84580 - DNA, 22 bp, Artificial Sequence
  Synthetic oligonucleotide; TTC chr11 5225337 5225358 5225354 5225359 +
atggagtttaagatatagtgta

SEQ ID NO: 84581 - DNA, 22 bp, Artificial Sequence
  Synthetic oligonucleotide; TTT chr11 5225346 5225367 5225363 5225368 +
aagatatagtgtattttcccaa

SEQ ID NO: 84582 - DNA, 22 bp, Artificial Sequence
  Synthetic oligonucleotide; TTA chr11 5225347 5225368 5225364 5225369 +
agatatagtgtattttcccaag

SEQ ID NO: 84583 - DNA, 22 bp, Artificial Sequence
  Synthetic oligonucleotide; TTT chr11 5225362 5225383 5225379 5225384 +
tcccaaggtttgaactagctct

SEQ ID NO: 84584 - DNA, 22 bp, Artificial Sequence
  Synthetic oligonucleotide; TTT chr11 5225363 5225384 5225380 5225385 +
cccaaggtttgaactagctctt

SEQ ID NO: 84585 - DNA, 22 bp, Artificial Sequence
  Synthetic oligonucleotide; TTC chr11 5225364 5225385 5225381 5225386 +
ccaaggtttgaactagctcttc

SEQ ID NO: 84586 - DNA, 22 bp, Artificial Sequence
  Synthetic oligonucleotide; TTT chr11 5225373 5225394 5225390 5225395 +
gaactagctcttcatttcttta

SEQ ID NO: 84587 - DNA, 22 bp, Artificial Sequence
  Synthetic oligonucleotide; TTG chr11 5225374 5225395 5225391 5225396 +
aactagctcttcatttctttat

SEQ ID NO: 84588 - DNA, 22 bp, Artificial Sequence
  Synthetic oligonucleotide; CTA chr11 5225379 5225400 5225396 5225401 +
gctcttcatttctttatgtttt

SEQ ID NO: 84589 - DNA, 22 bp, Artificial Sequence
  Synthetic oligonucleotide; CTC chr11 5225383 5225404 5225400 5225405 +
ttcatttctttatgttttaaat

SEQ ID NO: 84590 - DNA, 22 bp, Artificial Sequence
  Synthetic oligonucleotide; CTT chr11 5225385 5225406 5225402 5225407 +
catttctttatgttttaaatgc

SEQ ID NO: 84591 - DNA, 22 bp, Artificial Sequence
  Synthetic oligonucleotide; TTC chr11 5225386 5225407 5225403 5225408 +
atttctttatgttttaaatgca

SEQ ID NO: 84592 - DNA, 22 bp, Artificial Sequence
  Synthetic oligonucleotide; TTT chr11 5225390 5225411 5225407 5225412 +
ctttatgttttaaatgcactga

SEQ ID NO: 84593 - DNA, 22 bp, Artificial Sequence
  Synthetic oligonucleotide; TTC chr11 5225391 5225412 5225408 5225413 +
tttatgttttaaatgcactgac

SEQ ID NO: 84594 - DNA, 22 bp, Artificial Sequence
  Synthetic oligonucleotide; CTT chr11 5225393 5225414 5225410 5225415 +
tatgttttaaatgcactgacct

SEQ ID NO: 84595 - DNA, 22 bp, Artificial Sequence
  Synthetic oligonucleotide; TTT chr11 5225394 5225415 5225411 5225416 +
atgttttaaatgcactgacctc

SEQ ID NO: 84596 - DNA, 22 bp, Artificial Sequence
  Synthetic oligonucleotide; TTA chr11 5225395 5225416 5225412 5225417 +
tgttttaaatgcactgacctcc

SEQ ID NO: 84597 - DNA, 22 bp, Artificial Sequence
  Synthetic oligonucleotide; TTT chr11 5225400 5225421 5225417 5225422 +
taaatgcactgacctcccacat

SEQ ID NO: 84598 - DNA, 22 bp, Artificial Sequence
  Synthetic oligonucleotide; TTT chr11 5225401 5225422 5225418 5225423 +
aaatgcactgacctcccacatt

SEQ ID NO: 84599 - DNA, 22 bp, Artificial Sequence
  Synthetic oligonucleotide; TTA chr11 5225402 5225423 5225419 5225424 +
aatgcactgacctcccacattc

SEQ ID NO: 84600 - DNA, 22 bp, Artificial Sequence
  Synthetic oligonucleotide; CTG chr11 5225411 5225432 5225428 5225433 +
acctcccacattccctttttag

SEQ ID NO: 84601 - DNA, 22 bp, Artificial Sequence
  Synthetic oligonucleotide; CTC chr11 5225416 5225437 5225433 5225438 +
ccacattccctttttagtaaaa

SEQ ID NO: 84602 - DNA, 22 bp, Artificial Sequence
  Synthetic oligonucleotide; TTC chr11 5225424 5225445 5225441 5225446 +
cctttttagtaaaatattcaga

SEQ ID NO: 84603 - DNA, 22 bp, Artificial Sequence
  Synthetic oligonucleotide; CTT chr11 5225428 5225449 5225445 5225450 +
tttagtaaaatattcagaaata

SEQ ID NO: 84604 - DNA, 22 bp, Artificial Sequence
  Synthetic oligonucleotide; TTT chr11 5225429 5225450 5225446 5225451 +
ttagtaaaatattcagaaataa

SEQ ID NO: 84605 - DNA, 22 bp, Artificial Sequence
  Synthetic oligonucleotide; TTT chr11 5225430 5225451 5225447 5225452 +
tagtaaaatattcagaaataat

SEQ ID NO: 84606 - DNA, 22 bp, Artificial Sequence
  Synthetic oligonucleotide; TTT chr11 5225431 5225452 5225448 5225453 +
agtaaaatattcagaaataatt

SEQ ID NO: 84607 - DNA, 22 bp, Artificial Sequence
  Synthetic oligonucleotide; TTA chr11 5225432 5225453 5225449 5225454 +
gtaaaatattcagaaataattt

SEQ ID NO: 84608 - DNA, 22 bp, Artificial Sequence
  Synthetic oligonucleotide; TTC chr11 5225443 5225464 5225460 5225465 +
agaaataatttaaatacatcat

SEQ ID NO: 84609 - DNA, 22 bp, Artificial Sequence
  Synthetic oligonucleotide; TTT chr11 5225454 5225475 5225471 5225476 +
aaatacatcattgcaatgaaaa

SEQ ID NO: 84610 - DNA, 22 bp, Artificial Sequence
  Synthetic oligonucleotide; TTA chr11 5225455 5225476 5225472 5225477 +
aatacatcattgcaatgaaaat

SEQ ID NO: 84611 - DNA, 22 bp, Artificial Sequence
  Synthetic oligonucleotide; TTG chr11 5225467 5225488 5225484 5225489 +
caatgaaaataaatgtttttta

SEQ ID NO: 84612 - DNA, 22 bp, Artificial Sequence
  Synthetic oligonucleotide; TTT chr11 5225485 5225506 5225502 5225507 +
tttattaggcagaatccagatg

SEQ ID NO: 84613 - DNA, 22 bp, Artificial Sequence
  Synthetic oligonucleotide; TTT chr11 5225486 5225507 5225503 5225508 +
ttattaggcagaatccagatgc

SEQ ID NO: 84614 - DNA, 22 bp, Artificial Sequence
  Synthetic oligonucleotide; TTT chr11 5225487 5225508 5225504 5225509 +
tattaggcagaatccagatgct

SEQ ID NO: 84615 - DNA, 22 bp, Artificial Sequence
  Synthetic oligonucleotide; TTT chr11 5225488 5225509 5225505 5225510 +
attaggcagaatccagatgctc

SEQ ID NO: 84616 - DNA, 22 bp, Artificial Sequence
  Synthetic oligonucleotide; TTA chr11 5225489 5225510 5225506 5225511 +
ttaggcagaatccagatgctca

SEQ ID NO: 84617 - DNA, 22 bp, Artificial Sequence
  Synthetic oligonucleotide; TTA chr11 5225492 5225513 5225509 5225514 +
ggcagaatccagatgctcaagg

SEQ ID NO: 84618 - DNA, 22 bp, Artificial Sequence
  Synthetic oligonucleotide; CTC chr11 5225510 5225531 5225527 5225532 +
aaggcccttcataatatccccc

SEQ ID NO: 84619 - DNA, 22 bp, Artificial Sequence
  Synthetic oligonucleotide; CTT chr11 5225519 5225540 5225536 5225541 +
cataatatcccccagtttagta

SEQ ID NO: 84620 - DNA, 22 bp, Artificial Sequence
  Synthetic oligonucleotide; TTC chr11 5225520 5225541 5225537 5225542 +
ataatatcccccagtttagtag

SEQ ID NO: 84621 - DNA, 22 bp, Artificial Sequence
  Synthetic oligonucleotide; TTT chr11 5225537 5225558 5225554 5225559 +
agtagttggacttagggaacaa

SEQ ID NO: 84622 - DNA, 22 bp, Artificial Sequence
  Synthetic oligonucleotide; TTA chr11 5225538 5225559 5225555 5225560 +
gtagttggacttagggaacaaa

SEQ ID NO: 84623 - DNA, 22 bp, Artificial Sequence
  Synthetic oligonucleotide; TTG chr11 5225545 5225566 5225562 5225567 +
gacttagggaacaaaggaacct

SEQ ID NO: 84624 - DNA, 22 bp, Artificial Sequence
  Synthetic oligonucleotide; CTT chr11 5225550 5225571 5225567 5225572 +
agggaacaaaggaacctttaat

SEQ ID NO: 84625 - DNA, 22 bp, Artificial Sequence
  Synthetic oligonucleotide; TTA chr11 5225551 5225572 5225568 5225573 +
gggaacaaaggaacctttaata

SEQ ID NO: 84626 - DNA, 22 bp, Artificial Sequence
  Synthetic oligonucleotide; CTT chr11 5225568 5225589 5225585 5225590 +
taatagaaattggacagcaaga

SEQ ID NO: 84627 - DNA, 22 bp, Artificial Sequence
  Synthetic oligonucleotide; TTT chr11 5225569 5225590 5225586 5225591 +
aatagaaattggacagcaagaa

SEQ ID NO: 84628 - DNA, 22 bp, Artificial Sequence
  Synthetic oligonucleotide; TTA chr11 5225570 5225591 5225587 5225592 +
atagaaattggacagcaagaaa

SEQ ID NO: 84629 - DNA, 22 bp, Artificial Sequence
  Synthetic oligonucleotide; TTG chr11 5225580 5225601 5225597 5225602 +
gacagcaagaaagcgagcttag

SEQ ID NO: 84630 - DNA, 22 bp, Artificial Sequence
  Synthetic oligonucleotide; CTT chr11 5225600 5225621 5225617 5225622 +
agtgatacttgtgggccagggc

SEQ ID NO: 84631 - DNA, 22 bp, Artificial Sequence
  Synthetic oligonucleotide; TTA chr11 5225601 5225622 5225618 5225623 +
gtgatacttgtgggccagggca

SEQ ID NO: 84632 - DNA, 22 bp, Artificial Sequence
  Synthetic oligonucleotide; CTT chr11 5225610 5225631 5225627 5225632 +
gtgggccagggcattagccaca

SEQ ID NO: 84633 - DNA, 22 bp, Artificial Sequence
  Synthetic oligonucleotide; TTG chr11 5225611 5225632 5225628 5225633 +
tgggccagggcattagccacac

SEQ ID NO: 84634 - DNA, 22 bp, Artificial Sequence
  Synthetic oligonucleotide; TTA chr11 5225626 5225647 5225643 5225648 +
gccacaccagccaccactttct

SEQ ID NO: 84635 - DNA, 22 bp, Artificial Sequence
  Synthetic oligonucleotide; CTT chr11 5225645 5225666 5225662 5225667 +
tctgataggcagcctgcactgg

SEQ ID NO: 84636 - DNA, 22 bp, Artificial Sequence
  Synthetic oligonucleotide; TTT chr11 5225646 5225667 5225663 5225668 +
ctgataggcagcctgcactggt

SEQ ID NO: 84637 - DNA, 22 bp, Artificial Sequence
  Synthetic oligonucleotide; TTC chr11 5225647 5225668 5225664 5225669 +
tgataggcagcctgcactggtg

SEQ ID NO: 84638 - DNA, 22 bp, Artificial Sequence
  Synthetic oligonucleotide; CTG chr11 5225649 5225670 5225666 5225671 +
ataggcagcctgcactggtggg

SEQ ID NO: 84639 - DNA, 22 bp, Artificial Sequence
  Synthetic oligonucleotide; CTG chr11 5225661 5225682 5225678 5225683 +
cactggtggggtgaattctttg

SEQ ID NO: 84640 - DNA, 22 bp, Artificial Sequence
  Synthetic oligonucleotide; CTG chr11 5225666 5225687 5225683 5225688 +
gtggggtgaattctttgccaaa

SEQ ID NO: 84641 - DNA, 22 bp, Artificial Sequence
  Synthetic oligonucleotide; TTC chr11 5225679 5225700 5225696 5225701 +
tttgccaaagtgatgggccagc

SEQ ID NO: 84642 - DNA, 22 bp, Artificial Sequence
  Synthetic oligonucleotide; CTT chr11 5225681 5225702 5225698 5225703 +
tgccaaagtgatgggccagcac

SEQ ID NO: 84643 - DNA, 22 bp, Artificial Sequence
  Synthetic oligonucleotide; TTT chr11 5225682 5225703 5225699 5225704 +
gccaaagtgatgggccagcaca

SEQ ID NO: 84644 - DNA, 22 bp, Artificial Sequence
  Synthetic oligonucleotide; TTG chr11 5225683 5225704 5225700 5225705 +
ccaaagtgatgggccagcacac

SEQ ID NO: 84645 - DNA, 22 bp, Artificial Sequence
  Synthetic oligonucleotide; TTG chr11 5225719 5225740 5225736 5225741 +
cccaggagctgtgggaggaaga

SEQ ID NO: 84646 - DNA, 22 bp, Artificial Sequence
  Synthetic oligonucleotide; CTG chr11 5225730 5225751 5225747 5225752 +
tgggaggaagataagaggtatg

SEQ ID NO: 84647 - DNA, 22 bp, Artificial Sequence
  Synthetic oligonucleotide; TTA chr11 5225762 5225783 5225779 5225784 +
gcaaaagggcctagcttggact

SEQ ID NO: 84648 - DNA, 22 bp, Artificial Sequence
  Synthetic oligonucleotide; CTA chr11 5225775 5225796 5225792 5225797 +
gcttggactcagaataatccag

SEQ ID NO: 84649 - DNA, 22 bp, Artificial Sequence
  Synthetic oligonucleotide; CTT chr11 5225779 5225800 5225796 5225801 +
ggactcagaataatccagcctt

SEQ ID NO: 84650 - DNA, 22 bp, Artificial Sequence
  Synthetic oligonucleotide; TTG chr11 5225780 5225801 5225797 5225802 +
gactcagaataatccagcctta

SEQ ID NO: 84651 - DNA, 22 bp, Artificial Sequence
  Synthetic oligonucleotide; CTC chr11 5225785 5225806 5225802 5225807 +
agaataatccagccttatccca

SEQ ID NO: 84652 - DNA, 22 bp, Artificial Sequence
  Synthetic oligonucleotide; CTT chr11 5225801 5225822 5225818 5225823 +
atcccaaccataaaataaaagc

SEQ ID NO: 84653 - DNA, 22 bp, Artificial Sequence
  Synthetic oligonucleotide; TTA chr11 5225802 5225823 5225819 5225824 +
tcccaaccataaaataaaagca

SEQ ID NO: 84654 - DNA, 22 bp, Artificial Sequence
  Synthetic oligonucleotide; CTG chr11 5225836 5225857 5225853 5225858 +
gattgtagctgctattagcaat

SEQ ID NO: 84655 - DNA, 22 bp, Artificial Sequence
  Synthetic oligonucleotide; TTG chr11 5225841 5225862 5225858 5225863 +
tagctgctattagcaatatgaa

SEQ ID NO: 84656 - DNA, 22 bp, Artificial Sequence
  Synthetic oligonucleotide; CTG chr11 5225847 5225868 5225864 5225869 +
ctattagcaatatgaaacctct

SEQ ID NO: 84657 - DNA, 22 bp, Artificial Sequence
  Synthetic oligonucleotide; CTA chr11 5225850 5225871 5225867 5225872 +
ttagcaatatgaaacctcttac

SEQ ID NO: 84658 - DNA, 22 bp, Artificial Sequence
  Synthetic oligonucleotide; TTA chr11 5225853 5225874 5225870 5225875 +
gcaatatgaaacctcttacatc

SEQ ID NO: 84659 - DNA, 22 bp, Artificial Sequence
  Synthetic oligonucleotide; CTC chr11 5225868 5225889 5225885 5225890 +
ttacatcagttacaatttatat

SEQ ID NO: 84660 - DNA, 22 bp, Artificial Sequence
  Synthetic oligonucleotide; CTT chr11 5225870 5225891 5225887 5225892 +
acatcagttacaatttatatgc

SEQ ID NO: 84661 - DNA, 22 bp, Artificial Sequence
  Synthetic oligonucleotide; TTA chr11 5225871 5225892 5225888 5225893 +
catcagttacaatttatatgca

SEQ ID NO: 84662 - DNA, 22 bp, Artificial Sequence
  Synthetic oligonucleotide; TTA chr11 5225880 5225901 5225897 5225902 +
caatttatatgcagaaatattt

SEQ ID NO: 84663 - DNA, 22 bp, Artificial Sequence
  Synthetic oligonucleotide; TTT chr11 5225886 5225907 5225903 5225908 +
atatgcagaaatatttatatgc

SEQ ID NO: 84664 - DNA, 22 bp, Artificial Sequence
  Synthetic oligonucleotide; TTA chr11 5225887 5225908 5225904 5225909 +
tatgcagaaatatttatatgca

SEQ ID NO: 84665 - DNA, 22 bp, Artificial Sequence
  Synthetic oligonucleotide; TTT chr11 5225902 5225923 5225919 5225924 +
atatgcagagatattgctattg

SEQ ID NO: 84666 - DNA, 22 bp, Artificial Sequence
  Synthetic oligonucleotide; TTA chr11 5225903 5225924 5225920 5225925 +
tatgcagagatattgctattgc

SEQ ID NO: 84667 - DNA, 22 bp, Artificial Sequence
  Synthetic oligonucleotide; TTG chr11 5225918 5225939 5225935 5225940 +
ctattgccttaacccagaaatt

SEQ ID NO: 84668 - DNA, 22 bp, Artificial Sequence
  Synthetic oligonucleotide; CTA chr11 5225921 5225942 5225938 5225943 +
ttgccttaacccagaaattatc

SEQ ID NO: 84669 - DNA, 22 bp, Artificial Sequence
  Synthetic oligonucleotide; TTG chr11 5225924 5225945 5225941 5225946 +
ccttaacccagaaattatcact

SEQ ID NO: 84670 - DNA, 22 bp, Artificial Sequence
  Synthetic oligonucleotide; CTT chr11 5225928 5225949 5225945 5225950 +
aacccagaaattatcactgtta

SEQ ID NO: 84671 - DNA, 22 bp, Artificial Sequence
  Synthetic oligonucleotide; TTA chr11 5225929 5225950 5225946 5225951 +
acccagaaattatcactgttat

SEQ ID NO: 84672 - DNA, 22 bp, Artificial Sequence
  Synthetic oligonucleotide; TTA chr11 5225941 5225962 5225958 5225963 +
tcactgttattctttagaatgg

SEQ ID NO: 84673 - DNA, 22 bp, Artificial Sequence
  Synthetic oligonucleotide; CTG chr11 5225947 5225968 5225964 5225969 +
ttattctttagaatggtgcaaa

SEQ ID NO: 84674 - DNA, 22 bp, Artificial Sequence
  Synthetic oligonucleotide; TTA chr11 5225950 5225971 5225967 5225972 +
ttctttagaatggtgcaaagag

SEQ ID NO: 84675 - DNA, 22 bp, Artificial Sequence
  Synthetic oligonucleotide; TTC chr11 5225953 5225974 5225970 5225975 +
tttagaatggtgcaaagaggca

SEQ ID NO: 84676 - DNA, 22 bp, Artificial Sequence
  Synthetic oligonucleotide; CTT chr11 5225955 5225976 5225972 5225977 +
tagaatggtgcaaagaggcatg

SEQ ID NO: 84677 - DNA, 22 bp, Artificial Sequence
  Synthetic oligonucleotide; TTT chr11 5225956 5225977 5225973 5225978 +
agaatggtgcaaagaggcatga

SEQ ID NO: 84678 - DNA, 22 bp, Artificial Sequence
  Synthetic oligonucleotide; TTA chr11 5225957 5225978 5225974 5225979 +
gaatggtgcaaagaggcatgat

SEQ ID NO: 84679 - DNA, 22 bp, Artificial Sequence
  Synthetic oligonucleotide; TTG chr11 5225985 5226006 5226002 5226007 +
tatcattattgccctgaaagaa

SEQ ID NO: 84680 - DNA, 22 bp, Artificial Sequence
  Synthetic oligonucleotide; TTA chr11 5225993 5226014 5226010 5226015 +
ttgccctgaaagaaagagatta

SEQ ID NO: 84681 - DNA, 22 bp, Artificial Sequence
  Synthetic oligonucleotide; TTG chr11 5225996 5226017 5226013 5226018 +
ccctgaaagaaagagattaggg

SEQ ID NO: 84682 - DNA, 22 bp, Artificial Sequence
  Synthetic oligonucleotide; CTG chr11 5226001 5226022 5226018 5226023 +
aaagaaagagattagggaaagt

SEQ ID NO: 84683 - DNA, 22 bp, Artificial Sequence
  Synthetic oligonucleotide; TTA chr11 5226015 5226036 5226032 5226037 +
gggaaagtattagaaataagat

SEQ ID NO: 84684 - DNA, 22 bp, Artificial Sequence
  Synthetic oligonucleotide; TTA chr11 5226027 5226048 5226044 5226049 +
gaaataagataaacaaaaaagt

SEQ ID NO: 84685 - DNA, 22 bp, Artificial Sequence
  Synthetic oligonucleotide; TTA chr11 5226055 5226076 5226072 5226077 +
aaagaagaaagcattttttaaa

SEQ ID NO: 84686 - DNA, 22 bp, Artificial Sequence
  Synthetic oligonucleotide; TTT chr11 5226071 5226092 5226088 5226093 +
tttaaaattacaaatgcaaaat

SEQ ID NO: 84687 - DNA, 22 bp, Artificial Sequence
  Synthetic oligonucleotide; TTT chr11 5226072 5226093 5226089 5226094 +
ttaaaattacaaatgcaaaatt

SEQ ID NO: 84688 - DNA, 22 bp, Artificial Sequence
  Synthetic oligonucleotide; TTT chr11 5226073 5226094 5226090 5226095 +
taaaattacaaatgcaaaatta

SEQ ID NO: 84689 - DNA, 22 bp, Artificial Sequence
  Synthetic oligonucleotide; TTT chr11 5226074 5226095 5226091 5226096 +
aaaattacaaatgcaaaattac

SEQ ID NO: 84690 - DNA, 22 bp, Artificial Sequence
  Synthetic oligonucleotide; TTA chr11 5226075 5226096 5226092 5226097 +
aaattacaaatgcaaaattacc

SEQ ID NO: 84691 - DNA, 22 bp, Artificial Sequence
  Synthetic oligonucleotide; TTA chr11 5226081 5226102 5226098 5226103 +
caaatgcaaaattaccctgatt

SEQ ID NO: 84692 - DNA, 22 bp, Artificial Sequence
  Synthetic oligonucleotide; TTA chr11 5226095 5226116 5226112 5226117 +
ccctgatttggtcaatatgtgt

SEQ ID NO: 84693 - DNA, 22 bp, Artificial Sequence
  Synthetic oligonucleotide; CTG chr11 5226100 5226121 5226117 5226122 +
atttggtcaatatgtgtacaca

SEQ ID NO: 84694 - DNA, 22 bp, Artificial Sequence
  Synthetic oligonucleotide; TTT chr11 5226104 5226125 5226121 5226126 +
ggtcaatatgtgtacacatatt

SEQ ID NO: 84695 - DNA, 22 bp, Artificial Sequence
  Synthetic oligonucleotide; TTG chr11 5226105 5226126 5226122 5226127 +
gtcaatatgtgtacacatatta

SEQ ID NO: 84696 - DNA, 22 bp, Artificial Sequence
  Synthetic oligonucleotide; TTA chr11 5226127 5226148 5226144 5226149 +
aaacattacactttaacccata

SEQ ID NO: 84697 - DNA, 22 bp, Artificial Sequence
  Synthetic oligonucleotide; TTA chr11 5226135 5226156 5226152 5226157 +
cactttaacccataaatatgta

SEQ ID NO: 84698 - DNA, 22 bp, Artificial Sequence
  Synthetic oligonucleotide; CTT chr11 5226140 5226161 5226157 5226162 +
taacccataaatatgtataatg

SEQ ID NO: 84699 - DNA, 22 bp, Artificial Sequence
  Synthetic oligonucleotide; TTT chr11 5226141 5226162 5226158 5226163 +
aacccataaatatgtataatga

SEQ ID NO: 84700 - DNA, 22 bp, Artificial Sequence
  Synthetic oligonucleotide; TTA chr11 5226142 5226163 5226159 5226164 +
acccataaatatgtataatgat

SEQ ID NO: 84701 - DNA, 22 bp, Artificial Sequence
  Synthetic oligonucleotide; TTA chr11 5226166 5226187 5226183 5226188 +
tgtatcaattaaaaataaaaga

SEQ ID NO: 84702 - DNA, 22 bp, Artificial Sequence
  Synthetic oligonucleotide; TTA chr11 5226177 5226198 5226194 5226199 +
aaaataaaagaaaataaagtag

SEQ ID NO: 84703 - DNA, 22 bp, Artificial Sequence
  Synthetic oligonucleotide; TTA chr11 5226207 5226228 5226224 5226229 +
tgaatatgcaaataagcacaca

SEQ ID NO: 84704 - DNA, 22 bp, Artificial Sequence
  Synthetic oligonucleotide; TTC chr11 5226236 5226257 5226253 5226258 +
caaatagtaatgtactaggcag

SEQ ID NO: 84705 - DNA, 22 bp, Artificial Sequence
  Synthetic oligonucleotide; CTA chr11 5226253 5226274 5226270 5226275 +
ggcagactgtgtaaagtttttt

SEQ ID NO: 84706 - DNA, 22 bp, Artificial Sequence
  Synthetic oligonucleotide; CTG chr11 5226262 5226283 5226279 5226284 +
tgtaaagtttttttttaagtta

SEQ ID NO: 84707 - DNA, 22 bp, Artificial Sequence
  Synthetic oligonucleotide; TTT chr11 5226272 5226293 5226289 5226294 +
ttttttaagttacttaatgtat

SEQ ID NO: 84708 - DNA, 22 bp, Artificial Sequence
  Synthetic oligonucleotide; TTT chr11 5226273 5226294 5226290 5226295 +
tttttaagttacttaatgtatc

SEQ ID NO: 84709 - DNA, 22 bp, Artificial Sequence
  Synthetic oligonucleotide; TTT chr11 5226274 5226295 5226291 5226296 +
ttttaagttacttaatgtatct

SEQ ID NO: 84710 - DNA, 22 bp, Artificial Sequence
  Synthetic oligonucleotide; TTT chr11 5226275 5226296 5226292 5226297 +
tttaagttacttaatgtatctc

SEQ ID NO: 84711 - DNA, 22 bp, Artificial Sequence
  Synthetic oligonucleotide; TTT chr11 5226276 5226297 5226293 5226298 +
ttaagttacttaatgtatctca

SEQ ID NO: 84712 - DNA, 22 bp, Artificial Sequence
  Synthetic oligonucleotide; TTT chr11 5226277 5226298 5226294 5226299 +
taagttacttaatgtatctcag

SEQ ID NO: 84713 - DNA, 22 bp, Artificial Sequence
  Synthetic oligonucleotide; TTT chr11 5226278 5226299 5226295 5226300 +
aagttacttaatgtatctcaga

SEQ ID NO: 84714 - DNA, 22 bp, Artificial Sequence
  Synthetic oligonucleotide; TTA chr11 5226279 5226300 5226296 5226301 +
agttacttaatgtatctcagag

SEQ ID NO: 84715 - DNA, 22 bp, Artificial Sequence
  Synthetic oligonucleotide; TTA chr11 5226284 5226305 5226301 5226306 +
cttaatgtatctcagagatatt

SEQ ID NO: 84716 - DNA, 22 bp, Artificial Sequence
  Synthetic oligonucleotide; CTT chr11 5226287 5226308 5226304 5226309 +
aatgtatctcagagatatttcc

SEQ ID NO: 84717 - DNA, 22 bp, Artificial Sequence
  Synthetic oligonucleotide; TTA chr11 5226288 5226309 5226305 5226310 +
atgtatctcagagatatttcct

SEQ ID NO: 84718 - DNA, 22 bp, Artificial Sequence
  Synthetic oligonucleotide; CTC chr11 5226297 5226318 5226314 5226319 +
agagatatttccttttgttata

SEQ ID NO: 84719 - DNA, 22 bp, Artificial Sequence
  Synthetic oligonucleotide; TTT chr11 5226307 5226328 5226324 5226329 +
ccttttgttatacacaatgtta

SEQ ID NO: 84720 - DNA, 22 bp, Artificial Sequence
  Synthetic oligonucleotide; TTC chr11 5226308 5226329 5226325 5226330 +
cttttgttatacacaatgttaa

SEQ ID NO: 84721 - DNA, 22 bp, Artificial Sequence
  Synthetic oligonucleotide; CTT chr11 5226311 5226332 5226328 5226333 +
ttgttatacacaatgttaaggc

SEQ ID NO: 84722 - DNA, 22 bp, Artificial Sequence
  Synthetic oligonucleotide; TTT chr11 5226312 5226333 5226329 5226334 +
tgttatacacaatgttaaggca

SEQ ID NO: 84723 - DNA, 22 bp, Artificial Sequence
  Synthetic oligonucleotide; TTT chr11 5226313 5226334 5226330 5226335 +
gttatacacaatgttaaggcat

SEQ ID NO: 84724 - DNA, 22 bp, Artificial Sequence
  Synthetic oligonucleotide; TTG chr11 5226314 5226335 5226331 5226336 +
ttatacacaatgttaaggcatt

SEQ ID NO: 84725 - DNA, 22 bp, Artificial Sequence
  Synthetic oligonucleotide; TTA chr11 5226317 5226338 5226334 5226339 +
tacacaatgttaaggcattaag

SEQ ID NO: 84726 - DNA, 22 bp, Artificial Sequence
  Synthetic oligonucleotide; TTA chr11 5226329 5226350 5226346 5226351 +
aggcattaagtataatagtaaa

SEQ ID NO: 84727 - DNA, 22 bp, Artificial Sequence
  Synthetic oligonucleotide; TTA chr11 5226337 5226358 5226354 5226359 +
agtataatagtaaaaattgcgg

SEQ ID NO: 84728 - DNA, 22 bp, Artificial Sequence
  Synthetic oligonucleotide; TTG chr11 5226356 5226377 5226373 5226378 +
cggagaagaaaaaaaaagaaag

SEQ ID NO: 84729 - DNA, 22 bp, Artificial Sequence
  Synthetic oligonucleotide; TTA chr11 5226387 5226408 5226404 5226409 +
aacaaaagaaaacaattgttat

SEQ ID NO: 84730 - DNA, 22 bp, Artificial Sequence
  Synthetic oligonucleotide; TTG chr11 5226405 5226426 5226422 5226427 +
ttatgaacagcaaataaaagaa

SEQ ID NO: 84731 - DNA, 22 bp, Artificial Sequence
  Synthetic oligonucleotide; TTA chr11 5226408 5226429 5226425 5226430 +
tgaacagcaaataaaagaaact

SEQ ID NO: 84732 - DNA, 22 bp, Artificial Sequence
  Synthetic oligonucleotide; CTA chr11 5226431 5226452 5226448 5226453 +
aaacgatcctgagacttccaca

SEQ ID NO: 84733 - DNA, 22 bp, Artificial Sequence
  Synthetic oligonucleotide; CTG chr11 5226442 5226463 5226459 5226464 +
agacttccacactgatgcaatc

SEQ ID NO: 84734 - DNA, 22 bp, Artificial Sequence
  Synthetic oligonucleotide; CTT chr11 5226448 5226469 5226465 5226470 +
ccacactgatgcaatcattcgt

SEQ ID NO: 84735 - DNA, 22 bp, Artificial Sequence
  Synthetic oligonucleotide; TTC chr11 5226449 5226470 5226466 5226471 +
cacactgatgcaatcattcgtc

SEQ ID NO: 84736 - DNA, 22 bp, Artificial Sequence
  Synthetic oligonucleotide; CTG chr11 5226456 5226477 5226473 5226478 +
atgcaatcattcgtctgtttcc

SEQ ID NO: 84737 - DNA, 22 bp, Artificial Sequence
  Synthetic oligonucleotide; TTC chr11 5226468 5226489 5226485 5226490 +
gtctgtttcccattctaaactg

SEQ ID NO: 84738 - DNA, 22 bp, Artificial Sequence
  Synthetic oligonucleotide; CTG chr11 5226473 5226494 5226490 5226495 +
tttcccattctaaactgtaccc

SEQ ID NO: 84739 - DNA, 22 bp, Artificial Sequence
  Synthetic oligonucleotide; TTT chr11 5226476 5226497 5226493 5226498 +
cccattctaaactgtaccctgt

SEQ ID NO: 84740 - DNA, 22 bp, Artificial Sequence
  Synthetic oligonucleotide; TTC chr11 5226477 5226498 5226494 5226499 +
ccattctaaactgtaccctgtt

SEQ ID NO: 84741 - DNA, 22 bp, Artificial Sequence
  Synthetic oligonucleotide; TTC chr11 5226483 5226504 5226500 5226505 +
taaactgtaccctgttacttat

SEQ ID NO: 84742 - DNA, 22 bp, Artificial Sequence
  Synthetic oligonucleotide; CTA chr11 5226485 5226506 5226502 5226507 +
aactgtaccctgttacttatcc

SEQ ID NO: 84743 - DNA, 22 bp, Artificial Sequence
  Synthetic oligonucleotide; CTG chr11 5226490 5226511 5226507 5226512 +
taccctgttacttatccccttc

SEQ ID NO: 84744 - DNA, 22 bp, Artificial Sequence
  Synthetic oligonucleotide; CTG chr11 5226497 5226518 5226514 5226519 +
ttacttatccccttcctatgac

SEQ ID NO: 84745 - DNA, 22 bp, Artificial Sequence
  Synthetic oligonucleotide; TTA chr11 5226500 5226521 5226517 5226522 +
cttatccccttcctatgacatg

SEQ ID NO: 84746 - DNA, 22 bp, Artificial Sequence
  Synthetic oligonucleotide; CTT chr11 5226503 5226524 5226520 5226525 +
atccccttcctatgacatgaac

SEQ ID NO: 84747 - DNA, 22 bp, Artificial Sequence
  Synthetic oligonucleotide; TTA chr11 5226504 5226525 5226521 5226526 +
tccccttcctatgacatgaact

SEQ ID NO: 84748 - DNA, 22 bp, Artificial Sequence
  Synthetic oligonucleotide; CTT chr11 5226511 5226532 5226528 5226533 +
cctatgacatgaacttaaccat

SEQ ID NO: 84749 - DNA, 22 bp, Artificial Sequence
  Synthetic oligonucleotide; TTC chr11 5226512 5226533 5226529 5226534 +
ctatgacatgaacttaaccata

SEQ ID NO: 84750 - DNA, 22 bp, Artificial Sequence
  Synthetic oligonucleotide; CTA chr11 5226515 5226536 5226532 5226537 +
tgacatgaacttaaccatagaa

SEQ ID NO: 84751 - DNA, 22 bp, Artificial Sequence
  Synthetic oligonucleotide; CTT chr11 5226527 5226548 5226544 5226549 +
aaccatagaaaagaaggggaaa

SEQ ID NO: 84752 - DNA, 22 bp, Artificial Sequence
  Synthetic oligonucleotide; TTA chr11 5226528 5226549 5226545 5226550 +
accatagaaaagaaggggaaag

SEQ ID NO: 84753 - DNA, 22 bp, Artificial Sequence
  Synthetic oligonucleotide; CTC chr11 5226575 5226596 5226592 5226597 +
accctgaagttctcaggatcca

SEQ ID NO: 84754 - DNA, 22 bp, Artificial Sequence
  Synthetic oligonucleotide; CTG chr11 5226581 5226602 5226598 5226603 +
aagttctcaggatccacgtgca

SEQ ID NO: 84755 - DNA, 22 bp, Artificial Sequence
  Synthetic oligonucleotide; TTC chr11 5226587 5226608 5226604 5226609 +
tcaggatccacgtgcagcttgt

SEQ ID NO: 84756 - DNA, 22 bp, Artificial Sequence
  Synthetic oligonucleotide; CTC chr11 5226589 5226610 5226606 5226611 +
aggatccacgtgcagcttgtca

SEQ ID NO: 84757 - DNA, 22 bp, Artificial Sequence
  Synthetic oligonucleotide; CTT chr11 5226607 5226628 5226624 5226629 +
gtcacagtgcagctcactcagt

SEQ ID NO: 84758 - DNA, 22 bp, Artificial Sequence
  Synthetic oligonucleotide; TTG chr11 5226608 5226629 5226625 5226630 +
tcacagtgcagctcactcagtg

SEQ ID NO: 84759 - DNA, 22 bp, Artificial Sequence
  Synthetic oligonucleotide; CTC chr11 5226622 5226643 5226639 5226644 +
actcagtgtggcaaaggtgccc

SEQ ID NO: 84760 - DNA, 22 bp, Artificial Sequence
  Synthetic oligonucleotide; CTC chr11 5226626 5226647 5226643 5226648 +
agtgtggcaaaggtgcccttga

SEQ ID NO: 84761 - DNA, 22 bp, Artificial Sequence
  Synthetic oligonucleotide; CTT chr11 5226646 5226667 5226663 5226668 +
gaggttgtccaggtgagccagg

SEQ ID NO: 84762 - DNA, 22 bp, Artificial Sequence
  Synthetic oligonucleotide; TTG chr11 5226647 5226668 5226664 5226669 +
aggttgtccaggtgagccaggc

SEQ ID NO: 84763 - DNA, 22 bp, Artificial Sequence
  Synthetic oligonucleotide; TTG chr11 5226653 5226674 5226670 5226675 +
tccaggtgagccaggccatcac

SEQ ID NO: 84764 - DNA, 22 bp, Artificial Sequence
  Synthetic oligonucleotide; CTA chr11 5226677 5226698 5226694 5226699 +
aaggcaccgagcactttcttgc

SEQ ID NO: 84765 - DNA, 22 bp, Artificial Sequence
  Synthetic oligonucleotide; CTT chr11 5226693 5226714 5226710 5226715 +
tcttgccatgagccttcacctt

SEQ ID NO: 84766 - DNA, 22 bp, Artificial Sequence
  Synthetic oligonucleotide; TTT chr11 5226694 5226715 5226711 5226716 +
cttgccatgagccttcacctta

SEQ ID NO: 84767 - DNA, 22 bp, Artificial Sequence
  Synthetic oligonucleotide; TTC chr11 5226695 5226716 5226712 5226717 +
ttgccatgagccttcaccttag

SEQ ID NO: 84768 - DNA, 22 bp, Artificial Sequence
  Synthetic oligonucleotide; CTT chr11 5226697 5226718 5226714 5226719 +
gccatgagccttcaccttaggg

SEQ ID NO: 84769 - DNA, 22 bp, Artificial Sequence
  Synthetic oligonucleotide; TTG chr11 5226698 5226719 5226715 5226720 +
ccatgagccttcaccttagggt

SEQ ID NO: 84770 - DNA, 22 bp, Artificial Sequence
  Synthetic oligonucleotide; CTT chr11 5226709 5226730 5226726 5226731 +
caccttagggttgcccataaca

SEQ ID NO: 84771 - DNA, 22 bp, Artificial Sequence
  Synthetic oligonucleotide; TTC chr11 5226710 5226731 5226727 5226732 +
accttagggttgcccataacag

SEQ ID NO: 84772 - DNA, 22 bp, Artificial Sequence
  Synthetic oligonucleotide; CTT chr11 5226715 5226736 5226732 5226737 +
agggttgcccataacagcatca

SEQ ID NO: 84773 - DNA, 22 bp, Artificial Sequence
  Synthetic oligonucleotide; TTA chr11 5226716 5226737 5226733 5226738 +
gggttgcccataacagcatcag

SEQ ID NO: 84774 - DNA, 22 bp, Artificial Sequence
  Synthetic oligonucleotide; TTG chr11 5226722 5226743 5226739 5226744 +
cccataacagcatcaggagtgg

SEQ ID NO: 84775 - DNA, 22 bp, Artificial Sequence
  Synthetic oligonucleotide; CTC chr11 5226763 5226784 5226780 5226785 +
aaagaacctctgggtccaaggg

SEQ ID NO: 84776 - DNA, 22 bp, Artificial Sequence
  Synthetic oligonucleotide; CTC chr11 5226773 5226794 5226790 5226795 +
tgggtccaagggtagaccacca

SEQ ID NO: 84777 - DNA, 22 bp, Artificial Sequence
  Synthetic oligonucleotide; CTG chr11 5226775 5226796 5226792 5226797 +
ggtccaagggtagaccaccagc

SEQ ID NO: 84778 - DNA, 22 bp, Artificial Sequence
  Synthetic oligonucleotide; CTA chr11 5226803 5226824 5226820 5226825 +
agggtgggaaaatagaccaata

SEQ ID NO: 84779 - DNA, 22 bp, Artificial Sequence
  Synthetic oligonucleotide; CTA chr11 5226846 5226867 5226863 5226868 +
tcagaaacccaagagtcttctc

SEQ ID NO: 84780 - DNA, 22 bp, Artificial Sequence
  Synthetic oligonucleotide; CTT chr11 5226865 5226886 5226882 5226887 +
ctctgtctccacatgcccagtt

SEQ ID NO: 84781 - DNA, 22 bp, Artificial Sequence
  Synthetic oligonucleotide; TTC chr11 5226866 5226887 5226883 5226888 +
tctgtctccacatgcccagttt

SEQ ID NO: 84782 - DNA, 22 bp, Artificial Sequence
  Synthetic oligonucleotide; CTC chr11 5226868 5226889 5226885 5226890 +
tgtctccacatgcccagtttct

SEQ ID NO: 84783 - DNA, 22 bp, Artificial Sequence
  Synthetic oligonucleotide; CTG chr11 5226870 5226891 5226887 5226892 +
tctccacatgcccagtttctat

SEQ ID NO: 84784 - DNA, 22 bp, Artificial Sequence
  Synthetic oligonucleotide; CTC chr11 5226874 5226895 5226891 5226896 +
cacatgcccagtttctattggt

SEQ ID NO: 84785 - DNA, 22 bp, Artificial Sequence
  Synthetic oligonucleotide; TTT chr11 5226888 5226909 5226905 5226910 +
ctattggtctccttaaacctgt

SEQ ID NO: 84786 - DNA, 22 bp, Artificial Sequence
  Synthetic oligonucleotide; TTC chr11 5226889 5226910 5226906 5226911 +
tattggtctccttaaacctgtc

SEQ ID NO: 84787 - DNA, 22 bp, Artificial Sequence
  Synthetic oligonucleotide; CTA chr11 5226891 5226912 5226908 5226913 +
ttggtctccttaaacctgtctt

SEQ ID NO: 84788 - DNA, 22 bp, Artificial Sequence
  Synthetic oligonucleotide; TTG chr11 5226894 5226915 5226911 5226916 +
gtctccttaaacctgtcttgta

SEQ ID NO: 84789 - DNA, 22 bp, Artificial Sequence
  Synthetic oligonucleotide; CTC chr11 5226899 5226920 5226916 5226921 +
cttaaacctgtcttgtaacctt

SEQ ID NO: 84790 - DNA, 22 bp, Artificial Sequence
  Synthetic oligonucleotide; CTT chr11 5226902 5226923 5226919 5226924 +
aaacctgtcttgtaaccttgat

SEQ ID NO: 84791 - DNA, 22 bp, Artificial Sequence
  Synthetic oligonucleotide; TTA chr11 5226903 5226924 5226920 5226925 +
aacctgtcttgtaaccttgata

SEQ ID NO: 84792 - DNA, 22 bp, Artificial Sequence
  Synthetic oligonucleotide; CTG chr11 5226909 5226930 5226926 5226931 +
tcttgtaaccttgataccaacc

SEQ ID NO: 84793 - DNA, 22 bp, Artificial Sequence
  Synthetic oligonucleotide; CTT chr11 5226913 5226934 5226930 5226935 +
gtaaccttgataccaacctgcc

SEQ ID NO: 84794 - DNA, 22 bp, Artificial Sequence
  Synthetic oligonucleotide; TTG chr11 5226914 5226935 5226931 5226936 +
taaccttgataccaacctgccc

SEQ ID NO: 84795 - DNA, 22 bp, Artificial Sequence
  Synthetic oligonucleotide; CTT chr11 5226921 5226942 5226938 5226943 +
gataccaacctgcccagggcct

SEQ ID NO: 84796 - DNA, 22 bp, Artificial Sequence
  Synthetic oligonucleotide; TTG chr11 5226922 5226943 5226939 5226944 +
ataccaacctgcccagggcctc

SEQ ID NO: 84797 - DNA, 22 bp, Artificial Sequence
  Synthetic oligonucleotide; CTG chr11 5226933 5226954 5226950 5226955 +
cccagggcctcaccaccaactt

SEQ ID NO: 84798 - DNA, 22 bp, Artificial Sequence
  Synthetic oligonucleotide; CTC chr11 5226944 5226965 5226961 5226966 +
accaccaacttcatccacgttc

SEQ ID NO: 84799 - DNA, 22 bp, Artificial Sequence
  Synthetic oligonucleotide; CTT chr11 5226955 5226976 5226972 5226977 +
catccacgttcaccttgcccca

SEQ ID NO: 84800 - DNA, 22 bp, Artificial Sequence
  Synthetic oligonucleotide; TTC chr11 5226956 5226977 5226973 5226978 +
atccacgttcaccttgccccac

SEQ ID NO: 84801 - DNA, 22 bp, Artificial Sequence
  Synthetic oligonucleotide; TTC chr11 5226966 5226987 5226983 5226988 +
accttgccccacagggcagtaa

SEQ ID NO: 84802 - DNA, 22 bp, Artificial Sequence
  Synthetic oligonucleotide; CTT chr11 5226971 5226992 5226988 5226993 +
gccccacagggcagtaacggca

SEQ ID NO: 84803 - DNA, 22 bp, Artificial Sequence
  Synthetic oligonucleotide; TTG chr11 5226972 5226993 5226989 5226994 +
ccccacagggcagtaacggcag

SEQ ID NO: 84804 - DNA, 22 bp, Artificial Sequence
  Synthetic oligonucleotide; CTT chr11 5226998 5227019 5227015 5227020 +
ctcctcaggagtcagatgcacc

SEQ ID NO: 84805 - DNA, 22 bp, Artificial Sequence
  Synthetic oligonucleotide; TTC chr11 5226999 5227020 5227016 5227021 +
tcctcaggagtcagatgcacca

SEQ ID NO: 84806 - DNA, 22 bp, Artificial Sequence
  Synthetic oligonucleotide; CTC chr11 5227001 5227022 5227018 5227023 +
ctcaggagtcagatgcaccatg

SEQ ID NO: 84807 - DNA, 22 bp, Artificial Sequence
  Synthetic oligonucleotide; CTC chr11 5227004 5227025 5227021 5227026 +
aggagtcagatgcaccatggtg

SEQ ID NO: 84808 - DNA, 22 bp, Artificial Sequence
  Synthetic oligonucleotide; CTG chr11 5227030 5227051 5227047 5227052 +
tttgaggttgctagtgaacaca

SEQ ID NO: 84809 - DNA, 22 bp, Artificial Sequence
  Synthetic oligonucleotide; TTT chr11 5227033 5227054 5227050 5227055 +
gaggttgctagtgaacacagtt

SEQ ID NO: 84810 - DNA, 22 bp, Artificial Sequence
  Synthetic oligonucleotide; TTG chr11 5227034 5227055 5227051 5227056 +
aggttgctagtgaacacagttg

SEQ ID NO: 84811 - DNA, 22 bp, Artificial Sequence
  Synthetic oligonucleotide; TTG chr11 5227040 5227061 5227057 5227062 +
ctagtgaacacagttgtgtcag

SEQ ID NO: 84812 - DNA, 22 bp, Artificial Sequence
  Synthetic oligonucleotide; CTA chr11 5227043 5227064 5227060 5227065 +
gtgaacacagttgtgtcagaag

SEQ ID NO: 84813 - DNA, 22 bp, Artificial Sequence
  Synthetic oligonucleotide; TTG chr11 5227056 5227077 5227073 5227078 +
tgtcagaagcaaatgtaagcaa

SEQ ID NO: 84814 - DNA, 22 bp, Artificial Sequence
  Synthetic oligonucleotide; CTC chr11 5227088 5227109 5227105 5227110 +
tgccctgacttttatgcccagc

SEQ ID NO: 84815 - DNA, 22 bp, Artificial Sequence
  Synthetic oligonucleotide; CTG chr11 5227090 5227111 5227107 5227112 +
ccctgacttttatgcccagccc

SEQ ID NO: 84816 - DNA, 22 bp, Artificial Sequence
  Synthetic oligonucleotide; CTG chr11 5227095 5227116 5227112 5227117 +
acttttatgcccagccctggct

SEQ ID NO: 84817 - DNA, 22 bp, Artificial Sequence
  Synthetic oligonucleotide; CTT chr11 5227099 5227120 5227116 5227121 +
ttatgcccagccctggctcctg

SEQ ID NO: 84818 - DNA, 22 bp, Artificial Sequence
  Synthetic oligonucleotide; TTT chr11 5227100 5227121 5227117 5227122 +
tatgcccagccctggctcctgc

SEQ ID NO: 84819 - DNA, 22 bp, Artificial Sequence
  Synthetic oligonucleotide; TTT chr11 5227101 5227122 5227118 5227123 +
atgcccagccctggctcctgcc

SEQ ID NO: 84820 - DNA, 22 bp, Artificial Sequence
  Synthetic oligonucleotide; TTA chr11 5227102 5227123 5227119 5227124 +
tgcccagccctggctcctgccc

SEQ ID NO: 84821 - DNA, 22 bp, Artificial Sequence
  Synthetic oligonucleotide; CTG chr11 5227114 5227135 5227131 5227136 +
gctcctgccctccctgctcctg

SEQ ID NO: 84822 - DNA, 22 bp, Artificial Sequence
  Synthetic oligonucleotide; CTC chr11 5227118 5227139 5227135 5227140 +
ctgccctccctgctcctgggag

SEQ ID NO: 84823 - DNA, 22 bp, Artificial Sequence
  Synthetic oligonucleotide; CTG chr11 5227121 5227142 5227138 5227143 +
ccctccctgctcctgggagtag

SEQ ID NO: 84824 - DNA, 22 bp, Artificial Sequence
  Synthetic oligonucleotide; CTC chr11 5227126 5227147 5227143 5227148 +
cctgctcctgggagtagattgg

SEQ ID NO: 84825 - DNA, 22 bp, Artificial Sequence
  Synthetic oligonucleotide; CTG chr11 5227130 5227151 5227147 5227152 +
ctcctgggagtagattggccaa

SEQ ID NO: 84826 - DNA, 22 bp, Artificial Sequence
  Synthetic oligonucleotide; CTC chr11 5227133 5227154 5227150 5227155 +
ctgggagtagattggccaaccc

SEQ ID NO: 84827 - DNA, 22 bp, Artificial Sequence
  Synthetic oligonucleotide; CTG chr11 5227136 5227157 5227153 5227158 +
ggagtagattggccaaccctag

SEQ ID NO: 84828 - DNA, 22 bp, Artificial Sequence
  Synthetic oligonucleotide; TTG chr11 5227147 5227168 5227164 5227169 +
gccaaccctagggtgtggctcc

SEQ ID NO: 84829 - DNA, 22 bp, Artificial Sequence
  Synthetic oligonucleotide; CTA chr11 5227157 5227178 5227174 5227179 +
gggtgtggctccacagggtgag

SEQ ID NO: 84830 - DNA, 22 bp, Artificial Sequence
  Synthetic oligonucleotide; CTC chr11 5227168 5227189 5227185 5227190 +
cacagggtgaggtctaagtgat

SEQ ID NO: 84831 - DNA, 22 bp, Artificial Sequence
  Synthetic oligonucleotide; CTA chr11 5227184 5227205 5227201 5227206 +
agtgatgacagccgtacctgtc

SEQ ID NO: 84832 - DNA, 22 bp, Artificial Sequence
  Synthetic oligonucleotide; CTG chr11 5227204 5227225 5227221 5227226 +
tccttggctcttctggcactgg

SEQ ID NO: 84833 - DNA, 22 bp, Artificial Sequence
  Synthetic oligonucleotide; CTT chr11 5227209 5227230 5227226 5227231 +
ggctcttctggcactggcttag

SEQ ID NO: 84834 - DNA, 22 bp, Artificial Sequence
  Synthetic oligonucleotide; TTG chr11 5227210 5227231 5227227 5227232 +
gctcttctggcactggcttagg

SEQ ID NO: 84835 - DNA, 22 bp, Artificial Sequence
  Synthetic oligonucleotide; CTC chr11 5227214 5227235 5227231 5227236 +
ttctggcactggcttaggagtt

SEQ ID NO: 84836 - DNA, 22 bp, Artificial Sequence
  Synthetic oligonucleotide; CTT chr11 5227216 5227237 5227233 5227238 +
ctggcactggcttaggagttgg

SEQ ID NO: 84837 - DNA, 22 bp, Artificial Sequence
  Synthetic oligonucleotide; TTC chr11 5227217 5227238 5227234 5227239 +
tggcactggcttaggagttgga

SEQ ID NO: 84838 - DNA, 22 bp, Artificial Sequence
  Synthetic oligonucleotide; CTG chr11 5227219 5227240 5227236 5227241 +
gcactggcttaggagttggact

SEQ ID NO: 84839 - DNA, 22 bp, Artificial Sequence
  Synthetic oligonucleotide; CTG chr11 5227225 5227246 5227242 5227247 +
gcttaggagttggacttcaaac

SEQ ID NO: 84840 - DNA, 22 bp, Artificial Sequence
  Synthetic oligonucleotide; CTT chr11 5227229 5227250 5227246 5227251 +
aggagttggacttcaaaccctc

SEQ ID NO: 84841 - DNA, 22 bp, Artificial Sequence
  Synthetic oligonucleotide; TTA chr11 5227230 5227251 5227247 5227252 +
ggagttggacttcaaaccctca

SEQ ID NO: 84842 - DNA, 22 bp, Artificial Sequence
  Synthetic oligonucleotide; TTG chr11 5227237 5227258 5227254 5227259 +
gacttcaaaccctcagccctcc

SEQ ID NO: 84843 - DNA, 22 bp, Artificial Sequence
  Synthetic oligonucleotide; CTT chr11 5227242 5227263 5227259 5227264 +
caaaccctcagccctccctcta

SEQ ID NO: 84844 - DNA, 22 bp, Artificial Sequence
  Synthetic oligonucleotide; TTC chr11 5227243 5227264 5227260 5227265 +
aaaccctcagccctccctctaa

SEQ ID NO: 84845 - DNA, 22 bp, Artificial Sequence
  Synthetic oligonucleotide; CTC chr11 5227251 5227272 5227268 5227273 +
agccctccctctaagatatatc

SEQ ID NO: 84846 - DNA, 22 bp, Artificial Sequence
  Synthetic oligonucleotide; CTC chr11 5227258 5227279 5227275 5227280 +
cctctaagatatatctcttggc

SEQ ID NO: 84847 - DNA, 22 bp, Artificial Sequence
  Synthetic oligonucleotide; CTC chr11 5227262 5227283 5227279 5227284 +
taagatatatctcttggcccca

SEQ ID NO: 84848 - DNA, 22 bp, Artificial Sequence
  Synthetic oligonucleotide; CTA chr11 5227264 5227285 5227281 5227286 +
agatatatctcttggccccata

SEQ ID NO: 84849 - DNA, 22 bp, Artificial Sequence
  Synthetic oligonucleotide; CTC chr11 5227275 5227296 5227292 5227297 +
ttggccccataccatcagtaca

SEQ ID NO: 84850 - DNA, 22 bp, Artificial Sequence
  Synthetic oligonucleotide; CTT chr11 5227277 5227298 5227294 5227299 +
ggccccataccatcagtacaaa

SEQ ID NO: 84851 - DNA, 22 bp, Artificial Sequence
  Synthetic oligonucleotide; TTG chr11 5227278 5227299 5227295 5227300 +
gccccataccatcagtacaaat

SEQ ID NO: 84852 - DNA, 22 bp, Artificial Sequence
  Synthetic oligonucleotide; TTG chr11 5227302 5227323 5227319 5227324 +
ctactaaaaacatcctcctttg

SEQ ID NO: 84853 - DNA, 22 bp, Artificial Sequence
  Synthetic oligonucleotide; CTA chr11 5227305 5227326 5227322 5227327 +
ctaaaaacatcctcctttgcaa

SEQ ID NO: 84854 - DNA, 22 bp, Artificial Sequence
  Synthetic oligonucleotide; CTA chr11 5227308 5227329 5227325 5227330 +
aaaacatcctcctttgcaagtg

SEQ ID NO: 84855 - DNA, 22 bp, Artificial Sequence
  Synthetic oligonucleotide; CTC chr11 5227319 5227340 5227336 5227341 +
ctttgcaagtgtatttacgtaa

SEQ ID NO: 84856 - DNA, 22 bp, Artificial Sequence
  Synthetic oligonucleotide; CTT chr11 5227322 5227343 5227339 5227344 +
tgcaagtgtatttacgtaatat

SEQ ID NO: 84857 - DNA, 22 bp, Artificial Sequence
  Synthetic oligonucleotide; TTT chr11 5227323 5227344 5227340 5227345 +
gcaagtgtatttacgtaatatt

SEQ ID NO: 84858 - DNA, 22 bp, Artificial Sequence
  Synthetic oligonucleotide; TTG chr11 5227324 5227345 5227341 5227346 +
caagtgtatttacgtaatattt

SEQ ID NO: 84859 - DNA, 22 bp, Artificial Sequence
  Synthetic oligonucleotide; TTT chr11 5227335 5227356 5227352 5227357 +
acgtaatatttggaatcacagc

SEQ ID NO: 84860 - DNA, 22 bp, Artificial Sequence
  Synthetic oligonucleotide; TTA chr11 5227336 5227357 5227353 5227358 +
cgtaatatttggaatcacagct

SEQ ID NO: 84861 - DNA, 22 bp, Artificial Sequence
  Synthetic oligonucleotide; TTT chr11 5227346 5227367 5227363 5227368 +
ggaatcacagcttggtaagcat

SEQ ID NO: 84862 - DNA, 22 bp, Artificial Sequence
  Synthetic oligonucleotide; TTG chr11 5227347 5227368 5227364 5227369 +
gaatcacagcttggtaagcata

SEQ ID NO: 84863 - DNA, 22 bp, Artificial Sequence
  Synthetic oligonucleotide; CTT chr11 5227359 5227380 5227376 5227381 +
ggtaagcatattgaagatcgtt

SEQ ID NO: 84864 - DNA, 22 bp, Artificial Sequence
  Synthetic oligonucleotide; TTG chr11 5227360 5227381 5227377 5227382 +
gtaagcatattgaagatcgttt

SEQ ID NO: 84865 - DNA, 22 bp, Artificial Sequence
  Synthetic oligonucleotide; TTG chr11 5227372 5227393 5227389 5227394 +
aagatcgttttcccaattttct

SEQ ID NO: 84866 - DNA, 22 bp, Artificial Sequence
  Synthetic oligonucleotide; TTT chr11 5227382 5227403 5227399 5227404 +
tcccaattttcttattacacaa

SEQ ID NO: 84867 - DNA, 22 bp, Artificial Sequence
  Synthetic oligonucleotide; TTT chr11 5227383 5227404 5227400 5227405 +
cccaattttcttattacacaaa

SEQ ID NO: 84868 - DNA, 22 bp, Artificial Sequence
  Synthetic oligonucleotide; TTC chr11 5227384 5227405 5227401 5227406 +
ccaattttcttattacacaaat

SEQ ID NO: 84869 - DNA, 22 bp, Artificial Sequence
  Synthetic oligonucleotide; TTT chr11 5227391 5227412 5227408 5227413 +
tcttattacacaaataagaagt

SEQ ID NO: 84870 - DNA, 22 bp, Artificial Sequence
  Synthetic oligonucleotide; TTT chr11 5227392 5227413 5227409 5227414 +
cttattacacaaataagaagtt

SEQ ID NO: 84871 - DNA, 22 bp, Artificial Sequence
  Synthetic oligonucleotide; TTC chr11 5227393 5227414 5227410 5227415 +
ttattacacaaataagaagttg

SEQ ID NO: 84872 - DNA, 22 bp, Artificial Sequence
  Synthetic oligonucleotide; CTT chr11 5227395 5227416 5227412 5227417 +
attacacaaataagaagttgat

SEQ ID NO: 84873 - DNA, 22 bp, Artificial Sequence
  Synthetic oligonucleotide; TTA chr11 5227396 5227417 5227413 5227418 +
ttacacaaataagaagttgatg

SEQ ID NO: 84874 - DNA, 22 bp, Artificial Sequence
  Synthetic oligonucleotide; TTA chr11 5227399 5227420 5227416 5227421 +
cacaaataagaagttgatgcac

SEQ ID NO: 84875 - DNA, 22 bp, Artificial Sequence
  Synthetic oligonucleotide; TTG chr11 5227415 5227436 5227432 5227437 +
atgcactaaaagtggaagagtt

SEQ ID NO: 84876 - DNA, 22 bp, Artificial Sequence
  Synthetic oligonucleotide; CTA chr11 5227423 5227444 5227440 5227445 +
aaagtggaagagttttgtctac

SEQ ID NO: 84877 - DNA, 22 bp, Artificial Sequence
  Synthetic oligonucleotide; TTT chr11 5227438 5227459 5227455 5227460 +
tgtctaccataattcagctttg

SEQ ID NO: 84878 - DNA, 22 bp, Artificial Sequence
  Synthetic oligonucleotide; TTT chr11 5227439 5227460 5227456 5227461 +
gtctaccataattcagctttgg

SEQ ID NO: 84879 - DNA, 22 bp, Artificial Sequence
  Synthetic oligonucleotide; TTG chr11 5227440 5227461 5227457 5227462 +
tctaccataattcagctttggg

SEQ ID NO: 84880 - DNA, 22 bp, Artificial Sequence
  Synthetic oligonucleotide; CTA chr11 5227444 5227465 5227461 5227466 +
ccataattcagctttgggatat

SEQ ID NO: 84881 - DNA, 22 bp, Artificial Sequence
  Synthetic oligonucleotide; TTC chr11 5227453 5227474 5227470 5227475 +
agctttgggatatgtagatgga

SEQ ID NO: 84882 - DNA, 22 bp, Artificial Sequence
  Synthetic oligonucleotide; CTT chr11 5227458 5227479 5227475 5227480 +
tgggatatgtagatggatctct

SEQ ID NO: 84883 - DNA, 22 bp, Artificial Sequence
  Synthetic oligonucleotide; TTT chr11 5227459 5227480 5227476 5227481 +
gggatatgtagatggatctctt

SEQ ID NO: 84884 - DNA, 22 bp, Artificial Sequence
  Synthetic oligonucleotide; TTG chr11 5227460 5227481 5227477 5227482 +
ggatatgtagatggatctcttc

SEQ ID NO: 84885 - DNA, 22 bp, Artificial Sequence
  Synthetic oligonucleotide; CTC chr11 5227479 5227500 5227496 5227501 +
ttcctgcgtctccagaatatgc

SEQ ID NO: 84886 - DNA, 22 bp, Artificial Sequence
  Synthetic oligonucleotide; CTT chr11 5227481 5227502 5227498 5227503 +
cctgcgtctccagaatatgcaa

SEQ ID NO: 84887 - DNA, 22 bp, Artificial Sequence
  Synthetic oligonucleotide; TTC chr11 5227482 5227503 5227499 5227504 +
ctgcgtctccagaatatgcaaa

SEQ ID NO: 84888 - DNA, 22 bp, Artificial Sequence
  Synthetic oligonucleotide; CTG chr11 5227485 5227506 5227502 5227507 +
cgtctccagaatatgcaaaata

SEQ ID NO: 84889 - DNA, 22 bp, Artificial Sequence
  Synthetic oligonucleotide; CTC chr11 5227491 5227512 5227508 5227513 +
cagaatatgcaaaatacttaca

SEQ ID NO: 84890 - DNA, 22 bp, Artificial Sequence
  Synthetic oligonucleotide; CTT chr11 5227510 5227531 5227527 5227532 +
acaggacagaatggatgaaaac

SEQ ID NO: 84891 - DNA, 22 bp, Artificial Sequence
  Synthetic oligonucleotide; TTA chr11 5227511 5227532 5227528 5227533 +
caggacagaatggatgaaaact

SEQ ID NO: 84892 - DNA, 22 bp, Artificial Sequence
  Synthetic oligonucleotide; CTC chr11 5227534 5227555 5227551 5227556 +
tacctcggttctaagcatatct

SEQ ID NO: 84893 - DNA, 22 bp, Artificial Sequence
  Synthetic oligonucleotide; CTA chr11 5227536 5227557 5227553 5227558 +
cctcggttctaagcatatcttc

SEQ ID NO: 84894 - DNA, 22 bp, Artificial Sequence
  Synthetic oligonucleotide; CTC chr11 5227540 5227561 5227557 5227562 +
ggttctaagcatatcttctcct

SEQ ID NO: 84895 - DNA, 22 bp, Artificial Sequence
  Synthetic oligonucleotide; TTC chr11 5227545 5227566 5227562 5227567 +
taagcatatcttctccttattt

SEQ ID NO: 84896 - DNA, 22 bp, Artificial Sequence
  Synthetic oligonucleotide; CTA chr11 5227547 5227568 5227564 5227569 +
agcatatcttctccttatttgg

SEQ ID NO: 84897 - DNA, 22 bp, Artificial Sequence
  Synthetic oligonucleotide; CTT chr11 5227557 5227578 5227574 5227579 +
ctccttatttggattaaaacct

SEQ ID NO: 84898 - DNA, 22 bp, Artificial Sequence
  Synthetic oligonucleotide; TTC chr11 5227558 5227579 5227575 5227580 +
tccttatttggattaaaacctt

SEQ ID NO: 84899 - DNA, 22 bp, Artificial Sequence
  Synthetic oligonucleotide; CTC chr11 5227560 5227581 5227577 5227582 +
cttatttggattaaaaccttct

SEQ ID NO: 84900 - DNA, 22 bp, Artificial Sequence
  Synthetic oligonucleotide; CTT chr11 5227563 5227584 5227580 5227585 +
atttggattaaaaccttctggt

SEQ ID NO: 84901 - DNA, 22 bp, Artificial Sequence
  Synthetic oligonucleotide; TTA chr11 5227564 5227585 5227581 5227586 +
tttggattaaaaccttctggta

SEQ ID NO: 84902 - DNA, 22 bp, Artificial Sequence
  Synthetic oligonucleotide; TTT chr11 5227567 5227588 5227584 5227589 +
ggattaaaaccttctggtaaga

SEQ ID NO: 84903 - DNA, 22 bp, Artificial Sequence
  Synthetic oligonucleotide; TTG chr11 5227568 5227589 5227585 5227590 +
gattaaaaccttctggtaagaa

SEQ ID NO: 84904 - DNA, 22 bp, Artificial Sequence
  Synthetic oligonucleotide; TTA chr11 5227573 5227594 5227590 5227595 +
aaaccttctggtaagaaaagaa

SEQ ID NO: 84905 - DNA, 22 bp, Artificial Sequence
  Synthetic oligonucleotide; CTT chr11 5227580 5227601 5227597 5227602 +
ctggtaagaaaagaaaaaatat

SEQ ID NO: 84906 - DNA, 22 bp, Artificial Sequence
  Synthetic oligonucleotide; TTC chr11 5227581 5227602 5227598 5227603 +
tggtaagaaaagaaaaaatata

SEQ ID NO: 84907 - DNA, 22 bp, Artificial Sequence
  Synthetic oligonucleotide; CTG chr11 5227583 5227604 5227600 5227605 +
gtaagaaaagaaaaaatatata

SEQ ID NO: 84908 - DNA, 22 bp, Artificial Sequence
  Synthetic oligonucleotide; TTC chr11 5227654 5227675 5227671 5227676 +
atttgttgttgtttttcttaat

SEQ ID NO: 84909 - DNA, 22 bp, Artificial Sequence
  Synthetic oligonucleotide; TTT chr11 5227658 5227679 5227675 5227680 +
gttgttgtttttcttaatttgc

SEQ ID NO: 84910 - DNA, 22 bp, Artificial Sequence
  Synthetic oligonucleotide; TTG chr11 5227659 5227680 5227676 5227681 +
ttgttgtttttcttaatttgct

SEQ ID NO: 84911 - DNA, 22 bp, Artificial Sequence
  Synthetic oligonucleotide; TTG chr11 5227662 5227683 5227679 5227684 +
ttgtttttcttaatttgctcat

SEQ ID NO: 84912 - DNA, 22 bp, Artificial Sequence
  Synthetic oligonucleotide; TTG chr11 5227665 5227686 5227682 5227687 +
tttttcttaatttgctcatgca

SEQ ID NO: 84913 - DNA, 22 bp, Artificial Sequence
  Synthetic oligonucleotide; TTT chr11 5227668 5227689 5227685 5227690 +
ttcttaatttgctcatgcatgc

SEQ ID NO: 84914 - DNA, 22 bp, Artificial Sequence
  Synthetic oligonucleotide; TTT chr11 5227669 5227690 5227686 5227691 +
tcttaatttgctcatgcatgct

SEQ ID NO: 84915 - DNA, 22 bp, Artificial Sequence
  Synthetic oligonucleotide; TTT chr11 5227670 5227691 5227687 5227692 +
cttaatttgctcatgcatgcta

SEQ ID NO: 84916 - DNA, 22 bp, Artificial Sequence
  Synthetic oligonucleotide; TTC chr11 5227671 5227692 5227688 5227693 +
ttaatttgctcatgcatgctaa

SEQ ID NO: 84917 - DNA, 22 bp, Artificial Sequence
  Synthetic oligonucleotide; CTT chr11 5227673 5227694 5227690 5227695 +
aatttgctcatgcatgctaata

SEQ ID NO: 84918 - DNA, 22 bp, Artificial Sequence
  Synthetic oligonucleotide; TTA chr11 5227674 5227695 5227691 5227696 +
atttgctcatgcatgctaataa

SEQ ID NO: 84919 - DNA, 22 bp, Artificial Sequence
  Synthetic oligonucleotide; TTT chr11 5227678 5227699 5227695 5227700 +
gctcatgcatgctaataaatta

SEQ ID NO: 84920 - DNA, 22 bp, Artificial Sequence
  Synthetic oligonucleotide; TTG chr11 5227679 5227700 5227696 5227701 +
ctcatgcatgctaataaattat

SEQ ID NO: 84921 - DNA, 22 bp, Artificial Sequence
  Synthetic oligonucleotide; CTC chr11 5227682 5227703 5227699 5227704 +
atgcatgctaataaattatgtc

SEQ ID NO: 84922 - DNA, 22 bp, Artificial Sequence
  Synthetic oligonucleotide; CTA chr11 5227692 5227713 5227709 5227714 +
ataaattatgtctaaaaataga

SEQ ID NO: 84923 - DNA, 22 bp, Artificial Sequence
  Synthetic oligonucleotide; TTA chr11 5227700 5227721 5227717 5227722 +
tgtctaaaaatagaataaatac

SEQ ID NO: 84924 - DNA, 22 bp, Artificial Sequence
  Synthetic oligonucleotide; CTA chr11 5227706 5227727 5227723 5227728 +
aaaatagaataaatacaaatca

SEQ ID NO: 84925 - DNA, 22 bp, Artificial Sequence
  Synthetic oligonucleotide; CTC chr11 5227736 5227757 5227753 5227758 +
tgtgcattagttacttattagg

SEQ ID NO: 84926 - DNA, 22 bp, Artificial Sequence
  Synthetic oligonucleotide; CTG chr11 5227738 5227759 5227755 5227760 +
tgcattagttacttattaggtt

SEQ ID NO: 84927 - DNA, 22 bp, Artificial Sequence
  Synthetic oligonucleotide; TTA chr11 5227745 5227766 5227762 5227767 +
gttacttattaggttttgggaa

SEQ ID NO: 84928 - DNA, 22 bp, Artificial Sequence
  Synthetic oligonucleotide; TTA chr11 5227749 5227770 5227766 5227771 +
cttattaggttttgggaaacaa

SEQ ID NO: 84929 - DNA, 22 bp, Artificial Sequence
  Synthetic oligonucleotide; CTT chr11 5227752 5227773 5227769 5227774 +
attaggttttgggaaacaagag

SEQ ID NO: 84930 - DNA, 22 bp, Artificial Sequence
  Synthetic oligonucleotide; TTA chr11 5227753 5227774 5227770 5227775 +
ttaggttttgggaaacaagaga

SEQ ID NO: 84931 - DNA, 22 bp, Artificial Sequence
  Synthetic oligonucleotide; TTA chr11 5227756 5227777 5227773 5227778 +
ggttttgggaaacaagagataa

SEQ ID NO: 84932 - DNA, 22 bp, Artificial Sequence
  Synthetic oligonucleotide; TTT chr11 5227761 5227782 5227778 5227783 +
tgggaaacaagagataaaaaac

SEQ ID NO: 84933 - DNA, 22 bp, Artificial Sequence
  Synthetic oligonucleotide; TTT chr11 5227762 5227783 5227779 5227784 +
gggaaacaagagataaaaaact

SEQ ID NO: 84934 - DNA, 22 bp, Artificial Sequence
  Synthetic oligonucleotide; TTG chr11 5227763 5227784 5227780 5227785 +
ggaaacaagagataaaaaacta

SEQ ID NO: 84935 - DNA, 22 bp, Artificial Sequence
  Synthetic oligonucleotide; CTA chr11 5227785 5227806 5227802 5227807 +
gagacctcttaatgcagtcaaa

SEQ ID NO: 84936 - DNA, 22 bp, Artificial Sequence
  Synthetic oligonucleotide; CTC chr11 5227793 5227814 5227810 5227815 +
ttaatgcagtcaaaaatacaaa

SEQ ID NO: 84937 - DNA, 22 bp, Artificial Sequence
  Synthetic oligonucleotide; CTT chr11 5227795 5227816 5227812 5227817 +
aatgcagtcaaaaatacaaata

SEQ ID NO: 84938 - DNA, 22 bp, Artificial Sequence
  Synthetic oligonucleotide; TTA chr11 5227796 5227817 5227813 5227818 +
atgcagtcaaaaatacaaataa

SEQ ID NO: 84939 - DNA, 22 bp, Artificial Sequence
  Synthetic oligonucleotide; CTT chr11 5227832 5227853 5227849 5227854 +
acaacccaaagtgtgactatca

SEQ ID NO: 84940 - DNA, 22 bp, Artificial Sequence
  Synthetic oligonucleotide; TTA chr11 5227833 5227854 5227850 5227855 +
caacccaaagtgtgactatcaa

SEQ ID NO: 84941 - DNA, 22 bp, Artificial Sequence
  Synthetic oligonucleotide; CTA chr11 5227851 5227872 5227868 5227873 +
tcaatggggtaatcagtggtgt

SEQ ID NO: 84942 - DNA, 22 bp, Artificial Sequence
  Synthetic oligonucleotide; TTA chr11 5227887 5227908 5227904 5227909 +
actggggacatctaactgtttc

SEQ ID NO: 84943 - DNA, 22 bp, Artificial Sequence
  Synthetic oligonucleotide; CTG chr11 5227891 5227912 5227908 5227913 +
gggacatctaactgtttctgcc

SEQ ID NO: 84944 - DNA, 22 bp, Artificial Sequence
  Synthetic oligonucleotide; CTA chr11 5227901 5227922 5227918 5227923 +
actgtttctgcctggactaatc

SEQ ID NO: 84945 - DNA, 22 bp, Artificial Sequence
  Synthetic oligonucleotide; CTG chr11 5227905 5227926 5227922 5227927 +
tttctgcctggactaatctgca

SEQ ID NO: 84946 - DNA, 22 bp, Artificial Sequence
  Synthetic oligonucleotide; TTT chr11 5227908 5227929 5227925 5227930 +
ctgcctggactaatctgcaaga

SEQ ID NO: 84947 - DNA, 22 bp, Artificial Sequence
  Synthetic oligonucleotide; TTC chr11 5227909 5227930 5227926 5227931 +
tgcctggactaatctgcaagag

SEQ ID NO: 84948 - DNA, 22 bp, Artificial Sequence
  Synthetic oligonucleotide; CTG chr11 5227911 5227932 5227928 5227933 +
cctggactaatctgcaagagtg

SEQ ID NO: 84949 - DNA, 22 bp, Artificial Sequence
  Synthetic oligonucleotide; CTG chr11 5227915 5227936 5227932 5227937 +
gactaatctgcaagagtgtctg

SEQ ID NO: 84950 - DNA, 22 bp, Artificial Sequence
  Synthetic oligonucleotide; CTA chr11 5227920 5227941 5227937 5227942 +
atctgcaagagtgtctggggga

SEQ ID NO: 84951 - DNA, 22 bp, Artificial Sequence
  Synthetic oligonucleotide; CTG chr11 5227925 5227946 5227942 5227947 +
caagagtgtctgggggaacaaa

SEQ ID NO: 84952 - DNA, 22 bp, Artificial Sequence
  Synthetic oligonucleotide; CTG chr11 5227937 5227958 5227954 5227959 +
ggggaacaaaaagcctctgtga

SEQ ID NO: 84953 - DNA, 22 bp, Artificial Sequence
  Synthetic oligonucleotide; CTC chr11 5227954 5227975 5227971 5227976 +
tgtgacttagaaagtaggggta

SEQ ID NO: 84954 - DNA, 22 bp, Artificial Sequence
  Synthetic oligonucleotide; CTG chr11 5227956 5227977 5227973 5227978 +
tgacttagaaagtaggggtagg

SEQ ID NO: 84955 - DNA, 22 bp, Artificial Sequence
  Synthetic oligonucleotide; CTT chr11 5227962 5227983 5227979 5227984 +
agaaagtaggggtaggagggga

SEQ ID NO: 84956 - DNA, 22 bp, Artificial Sequence
  Synthetic oligonucleotide; TTA chr11 5227963 5227984 5227980 5227985 +
gaaagtaggggtaggaggggaa

SEQ ID NO: 84957 - DNA, 22 bp, Artificial Sequence
  Synthetic oligonucleotide; CTT chr11 5227993 5228014 5228010 5228015 +
ctacttggctcagattattttt

SEQ ID NO: 84958 - DNA, 22 bp, Artificial Sequence
  Synthetic oligonucleotide; TTC chr11 5227994 5228015 5228011 5228016 +
tacttggctcagattatttttt

SEQ ID NO: 84959 - DNA, 22 bp, Artificial Sequence
  Synthetic oligonucleotide; CTA chr11 5227996 5228017 5228013 5228018 +
cttggctcagattatttttttc

SEQ ID NO: 84960 - DNA, 22 bp, Artificial Sequence
  Synthetic oligonucleotide; CTT chr11 5227999 5228020 5228016 5228021 +
ggctcagattatttttttcctc

SEQ ID NO: 84961 - DNA, 22 bp, Artificial Sequence
  Synthetic oligonucleotide; TTG chr11 5228000 5228021 5228017 5228022 +
gctcagattatttttttcctct

SEQ ID NO: 84962 - DNA, 22 bp, Artificial Sequence
  Synthetic oligonucleotide; CTC chr11 5228004 5228025 5228021 5228026 +
agattatttttttcctctagtc

SEQ ID NO: 84963 - DNA, 22 bp, Artificial Sequence
  Synthetic oligonucleotide; TTA chr11 5228010 5228031 5228027 5228032 +
tttttttcctctagtccactaa

SEQ ID NO: 84964 - DNA, 22 bp, Artificial Sequence
  Synthetic oligonucleotide; TTT chr11 5228013 5228034 5228030 5228035 +
ttttcctctagtccactaagaa

SEQ ID NO: 84965 - DNA, 22 bp, Artificial Sequence
  Synthetic oligonucleotide; TTT chr11 5228014 5228035 5228031 5228036 +
tttcctctagtccactaagaat

SEQ ID NO: 84966 - DNA, 22 bp, Artificial Sequence
  Synthetic oligonucleotide; TTT chr11 5228015 5228036 5228032 5228037 +
ttcctctagtccactaagaata

SEQ ID NO: 84967 - DNA, 22 bp, Artificial Sequence
  Synthetic oligonucleotide; TTT chr11 5228016 5228037 5228033 5228038 +
tcctctagtccactaagaatac

SEQ ID NO: 84968 - DNA, 22 bp, Artificial Sequence
  Synthetic oligonucleotide; TTT chr11 5228017 5228038 5228034 5228039 +
cctctagtccactaagaatact

SEQ ID NO: 84969 - DNA, 22 bp, Artificial Sequence
  Synthetic oligonucleotide; TTC chr11 5228018 5228039 5228035 5228040 +
ctctagtccactaagaatactg

SEQ ID NO: 84970 - DNA, 22 bp, Artificial Sequence
  Synthetic oligonucleotide; CTC chr11 5228021 5228042 5228038 5228043 +
tagtccactaagaatactgcgt

SEQ ID NO: 84971 - DNA, 22 bp, Artificial Sequence
  Synthetic oligonucleotide; CTA chr11 5228023 5228044 5228040 5228045 +
gtccactaagaatactgcgttt

SEQ ID NO: 84972 - DNA, 22 bp, Artificial Sequence
  Synthetic oligonucleotide; CTA chr11 5228031 5228052 5228048 5228053 +
agaatactgcgttttaaaatca

SEQ ID NO: 84973 - DNA, 22 bp, Artificial Sequence
  Synthetic oligonucleotide; CTG chr11 5228040 5228061 5228057 5228062 +
cgttttaaaatcatttccttga

SEQ ID NO: 84974 - DNA, 22 bp, Artificial Sequence
  Synthetic oligonucleotide; TTT chr11 5228045 5228066 5228062 5228067 +
taaaatcatttccttgattcaa

SEQ ID NO: 84975 - DNA, 22 bp, Artificial Sequence
  Synthetic oligonucleotide; TTT chr11 5228046 5228067 5228063 5228068 +
aaaatcatttccttgattcaag

SEQ ID NO: 84976 - DNA, 22 bp, Artificial Sequence
  Synthetic oligonucleotide; TTA chr11 5228047 5228068 5228064 5228069 +
aaatcatttccttgattcaagt

SEQ ID NO: 84977 - DNA, 22 bp, Artificial Sequence
  Synthetic oligonucleotide; TTT chr11 5228056 5228077 5228073 5228078 +
ccttgattcaagttcctatttc

SEQ ID NO: 84978 - DNA, 22 bp, Artificial Sequence
  Synthetic oligonucleotide; TTC chr11 5228057 5228078 5228074 5228079 +
cttgattcaagttcctatttct

SEQ ID NO: 84979 - DNA, 22 bp, Artificial Sequence
  Synthetic oligonucleotide; CTT chr11 5228060 5228081 5228077 5228082 +
gattcaagttcctatttctctt

SEQ ID NO: 84980 - DNA, 22 bp, Artificial Sequence
  Synthetic oligonucleotide; TTG chr11 5228061 5228082 5228078 5228083 +
attcaagttcctatttctcttt

SEQ ID NO: 84981 - DNA, 22 bp, Artificial Sequence
  Synthetic oligonucleotide; TTC chr11 5228065 5228086 5228082 5228087 +
aagttcctatttctctttatat

SEQ ID NO: 84982 - DNA, 22 bp, Artificial Sequence
  Synthetic oligonucleotide; TTC chr11 5228071 5228092 5228088 5228093 +
ctatttctctttatattttgtt

SEQ ID NO: 84983 - DNA, 22 bp, Artificial Sequence
  Synthetic oligonucleotide; CTA chr11 5228074 5228095 5228091 5228096 +
tttctctttatattttgtttgt

SEQ ID NO: 84984 - DNA, 22 bp, Artificial Sequence
  Synthetic oligonucleotide; TTT chr11 5228077 5228098 5228094 5228099 +
ctctttatattttgtttgttta

SEQ ID NO: 84985 - DNA, 22 bp, Artificial Sequence
  Synthetic oligonucleotide; TTC chr11 5228078 5228099 5228095 5228100 +
tctttatattttgtttgtttaa

SEQ ID NO: 84986 - DNA, 22 bp, Artificial Sequence
  Synthetic oligonucleotide; CTC chr11 5228080 5228101 5228097 5228102 +
tttatattttgtttgtttaaac

SEQ ID NO: 84987 - DNA, 22 bp, Artificial Sequence
  Synthetic oligonucleotide; CTT chr11 5228082 5228103 5228099 5228104 +
tatattttgtttgtttaaacct

SEQ ID NO: 84988 - DNA, 22 bp, Artificial Sequence
  Synthetic oligonucleotide; TTT chr11 5228083 5228104 5228100 5228105 +
atattttgtttgtttaaacctc

SEQ ID NO: 84989 - DNA, 22 bp, Artificial Sequence
  Synthetic oligonucleotide; TTA chr11 5228084 5228105 5228101 5228106 +
tattttgtttgtttaaacctcc

SEQ ID NO: 84990 - DNA, 22 bp, Artificial Sequence
  Synthetic oligonucleotide; TTT chr11 5228089 5228110 5228106 5228111 +
tgtttgtttaaacctcctttac

SEQ ID NO: 84991 - DNA, 22 bp, Artificial Sequence
  Synthetic oligonucleotide; TTT chr11 5228090 5228111 5228107 5228112 +
gtttgtttaaacctcctttact

SEQ ID NO: 84992 - DNA, 22 bp, Artificial Sequence
  Synthetic oligonucleotide; TTG chr11 5228091 5228112 5228108 5228113 +
tttgtttaaacctcctttacta

SEQ ID NO: 84993 - DNA, 22 bp, Artificial Sequence
  Synthetic oligonucleotide; TTT chr11 5228094 5228115 5228111 5228116 +
gtttaaacctcctttactaaaa

SEQ ID NO: 84994 - DNA, 22 bp, Artificial Sequence
  Synthetic oligonucleotide; TTG chr11 5228095 5228116 5228112 5228117 +
tttaaacctcctttactaaaat

SEQ ID NO: 84995 - DNA, 22 bp, Artificial Sequence
  Synthetic oligonucleotide; TTT chr11 5228098 5228119 5228115 5228120 +
aaacctcctttactaaaattta

SEQ ID NO: 84996 - DNA, 22 bp, Artificial Sequence
  Synthetic oligonucleotide; TTA chr11 5228099 5228120 5228116 5228121 +
aacctcctttactaaaatttac

SEQ ID NO: 84997 - DNA, 22 bp, Artificial Sequence
  Synthetic oligonucleotide; CTC chr11 5228105 5228126 5228122 5228127 +
ctttactaaaatttactcttct

SEQ ID NO: 84998 - DNA, 22 bp, Artificial Sequence
  Synthetic oligonucleotide; CTT chr11 5228108 5228129 5228125 5228130 +
tactaaaatttactcttctttc

SEQ ID NO: 84999 - DNA, 22 bp, Artificial Sequence
  Synthetic oligonucleotide; TTT chr11 5228109 5228130 5228126 5228131 +
actaaaatttactcttctttct

SEQ ID NO: 85000 - DNA, 22 bp, Artificial Sequence
  Synthetic oligonucleotide; TTA chr11 5228110 5228131 5228127 5228132 +
ctaaaatttactcttctttctc

SEQ ID NO: 85001 - DNA, 22 bp, Artificial Sequence
  Synthetic oligonucleotide; CTA chr11 5228113 5228134 5228130 5228135 +
aaatttactcttctttctctat

SEQ ID NO: 85002 - DNA, 22 bp, Artificial Sequence
  Synthetic oligonucleotide; TTT chr11 5228119 5228140 5228136 5228141 +
actcttctttctctatagcttc

SEQ ID NO: 85003 - DNA, 22 bp, Artificial Sequence
  Synthetic oligonucleotide; TTA chr11 5228120 5228141 5228137 5228142 +
ctcttctttctctatagcttcc

SEQ ID NO: 85004 - DNA, 22 bp, Artificial Sequence
  Synthetic oligonucleotide; CTC chr11 5228123 5228144 5228140 5228145 +
ttctttctctatagcttcccaa

SEQ ID NO: 85005 - DNA, 22 bp, Artificial Sequence
  Synthetic oligonucleotide; CTT chr11 5228125 5228146 5228142 5228147 +
ctttctctatagcttcccaacg

SEQ ID NO: 85006 - DNA, 22 bp, Artificial Sequence
  Synthetic oligonucleotide; TTC chr11 5228126 5228147 5228143 5228148 +
tttctctatagcttcccaacgt

SEQ ID NO: 85007 - DNA, 22 bp, Artificial Sequence
  Synthetic oligonucleotide; CTT chr11 5228128 5228149 5228145 5228150 +
tctctatagcttcccaacgtga

SEQ ID NO: 85008 - DNA, 22 bp, Artificial Sequence
  Synthetic oligonucleotide; TTT chr11 5228129 5228150 5228146 5228151 +
ctctatagcttcccaacgtgat

SEQ ID NO: 85009 - DNA, 22 bp, Artificial Sequence
  Synthetic oligonucleotide; TTC chr11 5228130 5228151 5228147 5228152 +
tctatagcttcccaacgtgatc

SEQ ID NO: 85010 - DNA, 22 bp, Artificial Sequence
  Synthetic oligonucleotide; CTC chr11 5228132 5228153 5228149 5228154 +
tatagcttcccaacgtgatcgc

SEQ ID NO: 85011 - DNA, 22 bp, Artificial Sequence
  Synthetic oligonucleotide; CTA chr11 5228134 5228155 5228151 5228156 +
tagcttcccaacgtgatcgcct

SEQ ID NO: 85012 - DNA, 22 bp, Artificial Sequence
  Synthetic oligonucleotide; CTT chr11 5228140 5228161 5228157 5228162 +
cccaacgtgatcgcctttctcc

SEQ ID NO: 85013 - DNA, 22 bp, Artificial Sequence
  Synthetic oligonucleotide; TTC chr11 5228141 5228162 5228158 5228163 +
ccaacgtgatcgcctttctccc

SEQ ID NO: 85014 - DNA, 22 bp, Artificial Sequence
  Synthetic oligonucleotide; CTT chr11 5228157 5228178 5228174 5228179 +
tctcccatccccctgtactttt

SEQ ID NO: 85015 - DNA, 22 bp, Artificial Sequence
  Synthetic oligonucleotide; TTT chr11 5228158 5228179 5228175 5228180 +
ctcccatccccctgtacttttt

SEQ ID NO: 85016 - DNA, 22 bp, Artificial Sequence
  Synthetic oligonucleotide; TTC chr11 5228159 5228180 5228176 5228181 +
tcccatccccctgtactttttc

SEQ ID NO: 85017 - DNA, 22 bp, Artificial Sequence
  Synthetic oligonucleotide; CTC chr11 5228161 5228182 5228178 5228183 +
ccatccccctgtactttttccc

SEQ ID NO: 85018 - DNA, 22 bp, Artificial Sequence
  Synthetic oligonucleotide; CTG chr11 5228172 5228193 5228189 5228194 +
tactttttccccttgtactaaa

SEQ ID NO: 85019 - DNA, 22 bp, Artificial Sequence
  Synthetic oligonucleotide; CTT chr11 5228177 5228198 5228194 5228199 +
tttccccttgtactaaattaac

SEQ ID NO: 85020 - DNA, 22 bp, Artificial Sequence
  Synthetic oligonucleotide; TTT chr11 5228178 5228199 5228195 5228200 +
ttccccttgtactaaattaact

SEQ ID NO: 85021 - DNA, 22 bp, Artificial Sequence
  Synthetic oligonucleotide; TTT chr11 5228179 5228200 5228196 5228201 +
tccccttgtactaaattaactc

SEQ ID NO: 85022 - DNA, 22 bp, Artificial Sequence
  Synthetic oligonucleotide; TTT chr11 5228180 5228201 5228197 5228202 +
ccccttgtactaaattaactcc

SEQ ID NO: 85023 - DNA, 22 bp, Artificial Sequence
  Synthetic oligonucleotide; TTC chr11 5228181 5228202 5228198 5228203 +
cccttgtactaaattaactcct

SEQ ID NO: 85024 - DNA, 22 bp, Artificial Sequence
  Synthetic oligonucleotide; CTT chr11 5228186 5228207 5228203 5228208 +
gtactaaattaactcctcaggt

SEQ ID NO: 85025 - DNA, 22 bp, Artificial Sequence
  Synthetic oligonucleotide; TTG chr11 5228187 5228208 5228204 5228209 +
tactaaattaactcctcaggtg

SEQ ID NO: 85026 - DNA, 22 bp, Artificial Sequence
  Synthetic oligonucleotide; CTA chr11 5228192 5228213 5228209 5228214 +
aattaactcctcaggtgaggaa

SEQ ID NO: 85027 - DNA, 22 bp, Artificial Sequence
  Synthetic oligonucleotide; TTA chr11 5228197 5228218 5228214 5228219 +
actcctcaggtgaggaaaaact

SEQ ID NO: 85028 - DNA, 22 bp, Artificial Sequence
  Synthetic oligonucleotide; CTC chr11 5228201 5228222 5228218 5228223 +
ctcaggtgaggaaaaacttttg

SEQ ID NO: 85029 - DNA, 22 bp, Artificial Sequence
  Synthetic oligonucleotide; CTC chr11 5228204 5228225 5228221 5228226 +
aggtgaggaaaaacttttgaag

SEQ ID NO: 85030 - DNA, 22 bp, Artificial Sequence
  Synthetic oligonucleotide; CTT chr11 5228220 5228241 5228237 5228242 +
ttgaagtgcagagttctgcttc

SEQ ID NO: 85031 - DNA, 22 bp, Artificial Sequence
  Synthetic oligonucleotide; TTT chr11 5228221 5228242 5228238 5228243 +
tgaagtgcagagttctgcttcc

SEQ ID NO: 85032 - DNA, 22 bp, Artificial Sequence
  Synthetic oligonucleotide; TTT chr11 5228222 5228243 5228239 5228244 +
gaagtgcagagttctgcttcct

SEQ ID NO: 85033 - DNA, 22 bp, Artificial Sequence
  Synthetic oligonucleotide; TTG chr11 5228223 5228244 5228240 5228245 +
aagtgcagagttctgcttcctg

SEQ ID NO: 85034 - DNA, 22 bp, Artificial Sequence
  Synthetic oligonucleotide; TTC chr11 5228236 5228257 5228253 5228258 +
tgcttcctgctattaaaagatg

SEQ ID NO: 85035 - DNA, 22 bp, Artificial Sequence
  Synthetic oligonucleotide; CTG chr11 5228238 5228259 5228255 5228260 +
cttcctgctattaaaagatgta

SEQ ID NO: 85036 - DNA, 22 bp, Artificial Sequence
  Synthetic oligonucleotide; CTT chr11 5228241 5228262 5228258 5228263 +
cctgctattaaaagatgtaatt

SEQ ID NO: 85037 - DNA, 22 bp, Artificial Sequence
  Synthetic oligonucleotide; TTC chr11 5228242 5228263 5228259 5228264 +
ctgctattaaaagatgtaatta

SEQ ID NO: 85038 - DNA, 22 bp, Artificial Sequence
  Synthetic oligonucleotide; CTG chr11 5228245 5228266 5228262 5228267 +
ctattaaaagatgtaattaaaa

SEQ ID NO: 85039 - DNA, 22 bp, Artificial Sequence
  Synthetic oligonucleotide; CTA chr11 5228248 5228269 5228265 5228270 +
ttaaaagatgtaattaaaacag

SEQ ID NO: 85040 - DNA, 22 bp, Artificial Sequence
  Synthetic oligonucleotide; TTA chr11 5228251 5228272 5228268 5228273 +
aaagatgtaattaaaacagcaa

SEQ ID NO: 85041 - DNA, 22 bp, Artificial Sequence
  Synthetic oligonucleotide; TTA chr11 5228264 5228285 5228281 5228286 +
aaacagcaaaggtagcaagcat

SEQ ID NO: 85042 - DNA, 22 bp, Artificial Sequence
  Synthetic oligonucleotide; TTT chr11 5228288 5228309 5228305 5228310 +
atgaggtcagcgtagggtctca

SEQ ID NO: 85043 - DNA, 22 bp, Artificial Sequence
  Synthetic oligonucleotide; TTA chr11 5228289 5228310 5228306 5228311 +
tgaggtcagcgtagggtctcag

SEQ ID NO: 85044 - DNA, 22 bp, Artificial Sequence
  Synthetic oligonucleotide; CTC chr11 5228309 5228330 5228326 5228331 +
agtgttccctaagggccctgtc

SEQ ID NO: 85045 - DNA, 22 bp, Artificial Sequence
  Synthetic oligonucleotide; TTC chr11 5228316 5228337 5228333 5228338 +
cctaagggccctgtcagtcatc

SEQ ID NO: 85046 - DNA, 22 bp, Artificial Sequence
  Synthetic oligonucleotide; CTA chr11 5228320 5228341 5228337 5228342 +
agggccctgtcagtcatcctga

SEQ ID NO: 85047 - DNA, 22 bp, Artificial Sequence
  Synthetic oligonucleotide; CTG chr11 5228329 5228350 5228346 5228351 +
tcagtcatcctgaatcctgccc

SEQ ID NO: 85048 - DNA, 22 bp, Artificial Sequence
  Synthetic oligonucleotide; CTG chr11 5228341 5228362 5228358 5228363 +
aatcctgcccctacctggaaac

SEQ ID NO: 85049 - DNA, 22 bp, Artificial Sequence
  Synthetic oligonucleotide; CTG chr11 5228348 5228369 5228365 5228370 +
cccctacctggaaacccatgtc

SEQ ID NO: 85050 - DNA, 22 bp, Artificial Sequence
  Synthetic oligonucleotide; CTA chr11 5228354 5228375 5228371 5228376 +
cctggaaacccatgtcggttta

SEQ ID NO: 85051 - DNA, 22 bp, Artificial Sequence
  Synthetic oligonucleotide; CTG chr11 5228358 5228379 5228375 5228380 +
gaaacccatgtcggtttagtaa

SEQ ID NO: 85052 - DNA, 22 bp, Artificial Sequence
  Synthetic oligonucleotide; TTT chr11 5228375 5228396 5228392 5228397 +
agtaaggaaagtgttatacttt

SEQ ID NO: 85053 - DNA, 22 bp, Artificial Sequence
  Synthetic oligonucleotide; TTA chr11 5228376 5228397 5228393 5228398 +
gtaaggaaagtgttatactttt

SEQ ID NO: 85054 - DNA, 22 bp, Artificial Sequence
  Synthetic oligonucleotide; TTA chr11 5228391 5228412 5228408 5228413 +
tacttttactttgcatgtttct

SEQ ID NO: 85055 - DNA, 22 bp, Artificial Sequence
  Synthetic oligonucleotide; CTT chr11 5228396 5228417 5228413 5228418 +
ttactttgcatgtttctcctac

SEQ ID NO: 85056 - DNA, 22 bp, Artificial Sequence
  Synthetic oligonucleotide; TTT chr11 5228397 5228418 5228414 5228419 +
tactttgcatgtttctcctact

SEQ ID NO: 85057 - DNA, 22 bp, Artificial Sequence
  Synthetic oligonucleotide; TTT chr11 5228398 5228419 5228415 5228420 +
actttgcatgtttctcctactt

SEQ ID NO: 85058 - DNA, 22 bp, Artificial Sequence
  Synthetic oligonucleotide; TTA chr11 5228399 5228420 5228416 5228421 +
ctttgcatgtttctcctacttc

SEQ ID NO: 85059 - DNA, 22 bp, Artificial Sequence
  Synthetic oligonucleotide; CTT chr11 5228402 5228423 5228419 5228424 +
tgcatgtttctcctacttcttc

SEQ ID NO: 85060 - DNA, 22 bp, Artificial Sequence
  Synthetic oligonucleotide; TTT chr11 5228403 5228424 5228420 5228425 +
gcatgtttctcctacttcttcc

SEQ ID NO: 85061 - DNA, 22 bp, Artificial Sequence
  Synthetic oligonucleotide; TTG chr11 5228404 5228425 5228421 5228426 +
catgtttctcctacttcttcct

SEQ ID NO: 85062 - DNA, 22 bp, Artificial Sequence
  Synthetic oligonucleotide; TTT chr11 5228411 5228432 5228428 5228433 +
ctcctacttcttcctttcagct

SEQ ID NO: 85063 - DNA, 22 bp, Artificial Sequence
  Synthetic oligonucleotide; TTC chr11 5228412 5228433 5228429 5228434 +
tcctacttcttcctttcagctc

SEQ ID NO: 85064 - DNA, 22 bp, Artificial Sequence
  Synthetic oligonucleotide; CTC chr11 5228414 5228435 5228431 5228436 +
ctacttcttcctttcagctcta

SEQ ID NO: 85065 - DNA, 22 bp, Artificial Sequence
  Synthetic oligonucleotide; CTA chr11 5228417 5228438 5228434 5228439 +
cttcttcctttcagctctaaca

SEQ ID NO: 85066 - DNA, 22 bp, Artificial Sequence
  Synthetic oligonucleotide; CTT chr11 5228420 5228441 5228437 5228442 +
cttcctttcagctctaacactc

SEQ ID NO: 85067 - DNA, 22 bp, Artificial Sequence
  Synthetic oligonucleotide; TTC chr11 5228421 5228442 5228438 5228443 +
ttcctttcagctctaacactct

SEQ ID NO: 85068 - DNA, 22 bp, Artificial Sequence
  Synthetic oligonucleotide; CTT chr11 5228423 5228444 5228440 5228445 +
cctttcagctctaacactctga

SEQ ID NO: 85069 - DNA, 22 bp, Artificial Sequence
  Synthetic oligonucleotide; TTC chr11 5228424 5228445 5228441 5228446 +
ctttcagctctaacactctgaa

SEQ ID NO: 85070 - DNA, 22 bp, Artificial Sequence
  Synthetic oligonucleotide; CTT chr11 5228427 5228448 5228444 5228449 +
tcagctctaacactctgaaact

SEQ ID NO: 85071 - DNA, 22 bp, Artificial Sequence
  Synthetic oligonucleotide; TTT chr11 5228428 5228449 5228445 5228450 +
cagctctaacactctgaaacta

SEQ ID NO: 85072 - DNA, 22 bp, Artificial Sequence
  Synthetic oligonucleotide; TTC chr11 5228429 5228450 5228446 5228451 +
agctctaacactctgaaactac

SEQ ID NO: 85073 - DNA, 22 bp, Artificial Sequence
  Synthetic oligonucleotide; CTC chr11 5228434 5228455 5228451 5228456 +
taacactctgaaactacgatta

SEQ ID NO: 85074 - DNA, 22 bp, Artificial Sequence
  Synthetic oligonucleotide; CTA chr11 5228436 5228457 5228453 5228458 +
acactctgaaactacgattaca

SEQ ID NO: 85075 - DNA, 22 bp, Artificial Sequence
  Synthetic oligonucleotide; CTC chr11 5228442 5228463 5228459 5228464 +
tgaaactacgattacacaaaat

SEQ ID NO: 85076 - DNA, 22 bp, Artificial Sequence
  Synthetic oligonucleotide; CTG chr11 5228444 5228465 5228461 5228466 +
aaactacgattacacaaaataa

SEQ ID NO: 85077 - DNA, 22 bp, Artificial Sequence
  Synthetic oligonucleotide; CTA chr11 5228450 5228471 5228467 5228472 +
cgattacacaaaataaaataaa

SEQ ID NO: 85078 - DNA, 22 bp, Artificial Sequence
  Synthetic oligonucleotide; TTA chr11 5228456 5228477 5228473 5228478 +
cacaaaataaaataaaataaaa

SEQ ID NO: 85079 - DNA, 22 bp, Artificial Sequence
  Synthetic oligonucleotide; TTT chr11 5228509 5228530 5228526 5228531 +
aggttaaccaaaagaaactgga

SEQ ID NO: 85080 - DNA, 22 bp, Artificial Sequence
  Synthetic oligonucleotide; TTA chr11 5228510 5228531 5228527 5228532 +
ggttaaccaaaagaaactggat

SEQ ID NO: 85081 - DNA, 22 bp, Artificial Sequence
  Synthetic oligonucleotide; TTA chr11 5228515 5228536 5228532 5228537 +
accaaaagaaactggatcctct

SEQ ID NO: 85082 - DNA, 22 bp, Artificial Sequence
  Synthetic oligonucleotide; CTG chr11 5228529 5228550 5228546 5228551 +
gatcctctatttctagttatca

SEQ ID NO: 85083 - DNA, 22 bp, Artificial Sequence
  Synthetic oligonucleotide; CTC chr11 5228536 5228557 5228553 5228558 +
tatttctagttatcagaaggaa

SEQ ID NO: 85084 - DNA, 22 bp, Artificial Sequence
  Synthetic oligonucleotide; CTA chr11 5228538 5228559 5228555 5228560 +
tttctagttatcagaaggaaat

SEQ ID NO: 85085 - DNA, 22 bp, Artificial Sequence
  Synthetic oligonucleotide; TTT chr11 5228541 5228562 5228558 5228563 +
ctagttatcagaaggaaattta

SEQ ID NO: 85086 - DNA, 22 bp, Artificial Sequence
  Synthetic oligonucleotide; TTC chr11 5228542 5228563 5228559 5228564 +
tagttatcagaaggaaatttac

SEQ ID NO: 85087 - DNA, 22 bp, Artificial Sequence
  Synthetic oligonucleotide; CTA chr11 5228544 5228565 5228561 5228566 +
gttatcagaaggaaatttacaa

SEQ ID NO: 85088 - DNA, 22 bp, Artificial Sequence
  Synthetic oligonucleotide; TTA chr11 5228548 5228569 5228565 5228570 +
tcagaaggaaatttacaaattt

SEQ ID NO: 85089 - DNA, 22 bp, Artificial Sequence
  Synthetic oligonucleotide; TTT chr11 5228562 5228583 5228579 5228584 +
acaaatttcttatttccattgc

SEQ ID NO: 85090 - DNA, 22 bp, Artificial Sequence
  Synthetic oligonucleotide; TTA chr11 5228563 5228584 5228580 5228585 +
caaatttcttatttccattgct

SEQ ID NO: 85091 - DNA, 22 bp, Artificial Sequence
  Synthetic oligonucleotide; TTT chr11 5228570 5228591 5228587 5228592 +
cttatttccattgctttattct

SEQ ID NO: 85092 - DNA, 22 bp, Artificial Sequence
  Synthetic oligonucleotide; TTC chr11 5228571 5228592 5228588 5228593 +
ttatttccattgctttattctc

SEQ ID NO: 85093 - DNA, 22 bp, Artificial Sequence
  Synthetic oligonucleotide; CTT chr11 5228573 5228594 5228590 5228595 +
atttccattgctttattctctt

SEQ ID NO: 85094 - DNA, 22 bp, Artificial Sequence
  Synthetic oligonucleotide; TTA chr11 5228574 5228595 5228591 5228596 +
tttccattgctttattctctta

SEQ ID NO: 85095 - DNA, 22 bp, Artificial Sequence
  Synthetic oligonucleotide; TTT chr11 5228577 5228598 5228594 5228599 +
ccattgctttattctcttaaat

SEQ ID NO: 85096 - DNA, 22 bp, Artificial Sequence
  Synthetic oligonucleotide; TTC chr11 5228578 5228599 5228595 5228600 +
cattgctttattctcttaaatg

SEQ ID NO: 85097 - DNA, 22 bp, Artificial Sequence
  Synthetic oligonucleotide; TTG chr11 5228583 5228604 5228600 5228605 +
ctttattctcttaaatgctttc

SEQ ID NO: 85098 - DNA, 22 bp, Artificial Sequence
  Synthetic oligonucleotide; CTT chr11 5228586 5228607 5228603 5228608 +
tattctcttaaatgctttctct

SEQ ID NO: 85099 - DNA, 22 bp, Artificial Sequence
  Synthetic oligonucleotide; TTT chr11 5228587 5228608 5228604 5228609 +
attctcttaaatgctttctcta

SEQ ID NO: 85100 - DNA, 22 bp, Artificial Sequence
  Synthetic oligonucleotide; TTA chr11 5228588 5228609 5228605 5228610 +
ttctcttaaatgctttctctat

SEQ ID NO: 85101 - DNA, 22 bp, Artificial Sequence
  Synthetic oligonucleotide; TTC chr11 5228591 5228612 5228608 5228613 +
tcttaaatgctttctctattat

SEQ ID NO: 85102 - DNA, 22 bp, Artificial Sequence
  Synthetic oligonucleotide; CTC chr11 5228593 5228614 5228610 5228615 +
ttaaatgctttctctattattg

SEQ ID NO: 85103 - DNA, 22 bp, Artificial Sequence
  Synthetic oligonucleotide; CTT chr11 5228595 5228616 5228612 5228617 +
aaatgctttctctattattgct

SEQ ID NO: 85104 - DNA, 22 bp, Artificial Sequence
  Synthetic oligonucleotide; TTA chr11 5228596 5228617 5228613 5228618 +
aatgctttctctattattgcta

SEQ ID NO: 85105 - DNA, 22 bp, Artificial Sequence
  Synthetic oligonucleotide; CTT chr11 5228603 5228624 5228620 5228625 +
tctctattattgctaaataaat

SEQ ID NO: 85106 - DNA, 22 bp, Artificial Sequence
  Synthetic oligonucleotide; TTT chr11 5228604 5228625 5228621 5228626 +
ctctattattgctaaataaata

SEQ ID NO: 85107 - DNA, 22 bp, Artificial Sequence
  Synthetic oligonucleotide; TTC chr11 5228605 5228626 5228622 5228627 +
tctattattgctaaataaatag

SEQ ID NO: 85108 - DNA, 22 bp, Artificial Sequence
  Synthetic oligonucleotide; CTC chr11 5228607 5228628 5228624 5228629 +
tattattgctaaataaatagag

SEQ ID NO: 85109 - DNA, 22 bp, Artificial Sequence
  Synthetic oligonucleotide; CTA chr11 5228609 5228630 5228626 5228631 +
ttattgctaaataaatagagat

SEQ ID NO: 85110 - DNA, 22 bp, Artificial Sequence
  Synthetic oligonucleotide; TTA chr11 5228612 5228633 5228629 5228634 +
ttgctaaataaatagagatctc

SEQ ID NO: 85111 - DNA, 22 bp, Artificial Sequence
  Synthetic oligonucleotide; TTG chr11 5228615 5228636 5228632 5228637 +
ctaaataaatagagatctctca

SEQ ID NO: 85112 - DNA, 22 bp, Artificial Sequence
  Synthetic oligonucleotide; CTA chr11 5228618 5228639 5228635 5228640 +
aataaatagagatctctcactt

SEQ ID NO: 85113 - DNA, 22 bp, Artificial Sequence
  Synthetic oligonucleotide; CTC chr11 5228634 5228655 5228651 5228656 +
tcactttttctacctgtctcaa

SEQ ID NO: 85114 - DNA, 22 bp, Artificial Sequence
  Synthetic oligonucleotide; CTC chr11 5228636 5228657 5228653 5228658 +
actttttctacctgtctcaacc

SEQ ID NO: 85115 - DNA, 22 bp, Artificial Sequence
  Synthetic oligonucleotide; CTT chr11 5228640 5228661 5228657 5228662 +
tttctacctgtctcaaccctca

SEQ ID NO: 85116 - DNA, 22 bp, Artificial Sequence
  Synthetic oligonucleotide; TTT chr11 5228641 5228662 5228658 5228663 +
ttctacctgtctcaaccctcat

SEQ ID NO: 85117 - DNA, 22 bp, Artificial Sequence
  Synthetic oligonucleotide; TTT chr11 5228642 5228663 5228659 5228664 +
tctacctgtctcaaccctcatc

SEQ ID NO: 85118 - DNA, 22 bp, Artificial Sequence
  Synthetic oligonucleotide; TTT chr11 5228643 5228664 5228660 5228665 +
ctacctgtctcaaccctcatca

SEQ ID NO: 85119 - DNA, 22 bp, Artificial Sequence
  Synthetic oligonucleotide; TTC chr11 5228644 5228665 5228661 5228666 +
tacctgtctcaaccctcatcag

SEQ ID NO: 85120 - DNA, 22 bp, Artificial Sequence
  Synthetic oligonucleotide; CTA chr11 5228646 5228667 5228663 5228668 +
cctgtctcaaccctcatcaggt

SEQ ID NO: 85121 - DNA, 22 bp, Artificial Sequence
  Synthetic oligonucleotide; CTG chr11 5228650 5228671 5228667 5228672 +
tctcaaccctcatcaggtactt

SEQ ID NO: 85122 - DNA, 22 bp, Artificial Sequence
  Synthetic oligonucleotide; CTC chr11 5228654 5228675 5228671 5228676 +
aaccctcatcaggtacttgtga

SEQ ID NO: 85123 - DNA, 22 bp, Artificial Sequence
  Synthetic oligonucleotide; CTC chr11 5228661 5228682 5228678 5228683 +
atcaggtacttgtgaaaaaatc

SEQ ID NO: 85124 - DNA, 22 bp, Artificial Sequence
  Synthetic oligonucleotide; CTT chr11 5228672 5228693 5228689 5228694 +
gtgaaaaaatctcactctgatt

SEQ ID NO: 85125 - DNA, 22 bp, Artificial Sequence
  Synthetic oligonucleotide; TTG chr11 5228673 5228694 5228690 5228695 +
tgaaaaaatctcactctgatta

SEQ ID NO: 85126 - DNA, 22 bp, Artificial Sequence
  Synthetic oligonucleotide; CTC chr11 5228685 5228706 5228702 5228707 +
actctgattattctcacacacg

SEQ ID NO: 85127 - DNA, 22 bp, Artificial Sequence
  Synthetic oligonucleotide; CTC chr11 5228689 5228710 5228706 5228711 +
tgattattctcacacacgcaga

SEQ ID NO: 85128 - DNA, 22 bp, Artificial Sequence
  Synthetic oligonucleotide; CTG chr11 5228691 5228712 5228708 5228713 +
attattctcacacacgcagaaa

SEQ ID NO: 85129 - DNA, 22 bp, Artificial Sequence
  Synthetic oligonucleotide; TTA chr11 5228695 5228716 5228712 5228717 +
ttctcacacacgcagaaagtgt

SEQ ID NO: 85130 - DNA, 22 bp, Artificial Sequence
  Synthetic oligonucleotide; TTC chr11 5228698 5228719 5228715 5228720 +
tcacacacgcagaaagtgtttg

SEQ ID NO: 85131 - DNA, 22 bp, Artificial Sequence
  Synthetic oligonucleotide; CTC chr11 5228700 5228721 5228717 5228722 +
acacacgcagaaagtgtttggt

SEQ ID NO: 85132 - DNA, 22 bp, Artificial Sequence
  Synthetic oligonucleotide; TTT chr11 5228719 5228740 5228736 5228741 +
ggttcttctatggctatctgga

SEQ ID NO: 85133 - DNA, 22 bp, Artificial Sequence
  Synthetic oligonucleotide; TTG chr11 5228720 5228741 5228737 5228742 +
gttcttctatggctatctggag

SEQ ID NO: 85134 - DNA, 22 bp, Artificial Sequence
  Synthetic oligonucleotide; TTC chr11 5228724 5228745 5228741 5228746 +
ttctatggctatctggagccta

SEQ ID NO: 85135 - DNA, 22 bp, Artificial Sequence
  Synthetic oligonucleotide; CTT chr11 5228726 5228747 5228743 5228748 +
ctatggctatctggagcctagg

SEQ ID NO: 85136 - DNA, 22 bp, Artificial Sequence
  Synthetic oligonucleotide; TTC chr11 5228727 5228748 5228744 5228749 +
tatggctatctggagcctaggt

SEQ ID NO: 85137 - DNA, 22 bp, Artificial Sequence
  Synthetic oligonucleotide; CTA chr11 5228729 5228750 5228746 5228751 +
tggctatctggagcctaggtta

SEQ ID NO: 85138 - DNA, 22 bp, Artificial Sequence
  Synthetic oligonucleotide; CTA chr11 5228735 5228756 5228752 5228757 +
tctggagcctaggttaaaaaat

SEQ ID NO: 85139 - DNA, 22 bp, Artificial Sequence
  Synthetic oligonucleotide; CTG chr11 5228739 5228760 5228756 5228761 +
gagcctaggttaaaaaattatg

SEQ ID NO: 85140 - DNA, 22 bp, Artificial Sequence
  Synthetic oligonucleotide; CTA chr11 5228746 5228767 5228763 5228768 +
ggttaaaaaattatgcctatgt

SEQ ID NO: 85141 - DNA, 22 bp, Artificial Sequence
  Synthetic oligonucleotide; TTA chr11 5228751 5228772 5228768 5228773 +
aaaaattatgcctatgtatgat

SEQ ID NO: 85142 - DNA, 22 bp, Artificial Sequence
  Synthetic oligonucleotide; TTA chr11 5228759 5228780 5228776 5228781 +
tgcctatgtatgattatagagg

SEQ ID NO: 85143 - DNA, 22 bp, Artificial Sequence
  Synthetic oligonucleotide; CTA chr11 5228765 5228786 5228782 5228787 +
tgtatgattatagaggtaagag

SEQ ID NO: 85144 - DNA, 22 bp, Artificial Sequence
  Synthetic oligonucleotide; TTA chr11 5228775 5228796 5228792 5228797 +
tagaggtaagagggataaaatt

SEQ ID NO: 85145 - DNA, 22 bp, Artificial Sequence
  Synthetic oligonucleotide; TTT chr11 5228798 5228819 5228815 5228820 +
aagtattttctttttatattca

SEQ ID NO: 85146 - DNA, 22 bp, Artificial Sequence
  Synthetic oligonucleotide; TTA chr11 5228799 5228820 5228816 5228821 +
agtattttctttttatattcat

SEQ ID NO: 85147 - DNA, 22 bp, Artificial Sequence
  Synthetic oligonucleotide; TTT chr11 5228806 5228827 5228823 5228828 +
tctttttatattcattcctctg

SEQ ID NO: 85148 - DNA, 22 bp, Artificial Sequence
  Synthetic oligonucleotide; TTT chr11 5228807 5228828 5228824 5228829 +
ctttttatattcattcctctgt

SEQ ID NO: 85149 - DNA, 22 bp, Artificial Sequence
  Synthetic oligonucleotide; TTC chr11 5228808 5228829 5228825 5228830 +
tttttatattcattcctctgta

SEQ ID NO: 85150 - DNA, 22 bp, Artificial Sequence
  Synthetic oligonucleotide; CTT chr11 5228810 5228831 5228827 5228832 +
tttatattcattcctctgtaaa

SEQ ID NO: 85151 - DNA, 22 bp, Artificial Sequence
  Synthetic oligonucleotide; TTT chr11 5228811 5228832 5228828 5228833 +
ttatattcattcctctgtaaaa

SEQ ID NO: 85152 - DNA, 22 bp, Artificial Sequence
  Synthetic oligonucleotide; TTT chr11 5228812 5228833 5228829 5228834 +
tatattcattcctctgtaaaaa

SEQ ID NO: 85153 - DNA, 22 bp, Artificial Sequence
  Synthetic oligonucleotide; TTT chr11 5228813 5228834 5228830 5228835 +
atattcattcctctgtaaaaaa

SEQ ID NO: 85154 - DNA, 22 bp, Artificial Sequence
  Synthetic oligonucleotide; TTA chr11 5228814 5228835 5228831 5228836 +
tattcattcctctgtaaaaaac

SEQ ID NO: 85155 - DNA, 22 bp, Artificial Sequence
  Synthetic oligonucleotide; TTC chr11 5228819 5228840 5228836 5228841 +
attcctctgtaaaaaactaaag

SEQ ID NO: 85156 - DNA, 22 bp, Artificial Sequence
  Synthetic oligonucleotide; TTC chr11 5228823 5228844 5228840 5228845 +
ctctgtaaaaaactaaagcaat

SEQ ID NO: 85157 - DNA, 22 bp, Artificial Sequence
  Synthetic oligonucleotide; CTC chr11 5228826 5228847 5228843 5228848 +
tgtaaaaaactaaagcaatgag

SEQ ID NO: 85158 - DNA, 22 bp, Artificial Sequence
  Synthetic oligonucleotide; CTG chr11 5228828 5228849 5228845 5228850 +
taaaaaactaaagcaatgagga

SEQ ID NO: 85159 - DNA, 22 bp, Artificial Sequence
  Synthetic oligonucleotide; CTA chr11 5228838 5228859 5228855 5228860 +
aagcaatgaggatctaggcaca

SEQ ID NO: 85160 - DNA, 22 bp, Artificial Sequence
  Synthetic oligonucleotide; CTA chr11 5228854 5228875 5228871 5228876 +
ggcacacgtgtatccctgagaa

SEQ ID NO: 85161 - DNA, 22 bp, Artificial Sequence
  Synthetic oligonucleotide; CTG chr11 5228872 5228893 5228889 5228894 +
agaaaagatttcacatgttgaa

SEQ ID NO: 85162 - DNA, 22 bp, Artificial Sequence
  Synthetic oligonucleotide; TTT chr11 5228883 5228904 5228900 5228905 +
cacatgttgaatcctgggaaaa

SEQ ID NO: 85163 - DNA, 22 bp, Artificial Sequence
  Synthetic oligonucleotide; TTC chr11 5228884 5228905 5228901 5228906 +
acatgttgaatcctgggaaaag

SEQ ID NO: 85164 - DNA, 22 bp, Artificial Sequence
  Synthetic oligonucleotide; TTG chr11 5228892 5228913 5228909 5228914 +
aatcctgggaaaagacgtcttt

SEQ ID NO: 85165 - DNA, 22 bp, Artificial Sequence
  Synthetic oligonucleotide; CTG chr11 5228899 5228920 5228916 5228921 +
ggaaaagacgtctttaaaatat

SEQ ID NO: 85166 - DNA, 22 bp, Artificial Sequence
  Synthetic oligonucleotide; CTT chr11 5228913 5228934 5228930 5228935 +
taaaatattttaaatgttaaaa

SEQ ID NO: 85167 - DNA, 22 bp, Artificial Sequence
  Synthetic oligonucleotide; TTT chr11 5228914 5228935 5228931 5228936 +
aaaatattttaaatgttaaaac

SEQ ID NO: 85168 - DNA, 22 bp, Artificial Sequence
  Synthetic oligonucleotide; TTA chr11 5228915 5228936 5228932 5228937 +
aaatattttaaatgttaaaaca

SEQ ID NO: 85169 - DNA, 22 bp, Artificial Sequence
  Synthetic oligonucleotide; TTT chr11 5228923 5228944 5228940 5228945 +
taaatgttaaaacatgcagatt

SEQ ID NO: 85170 - DNA, 22 bp, Artificial Sequence
  Synthetic oligonucleotide; TTT chr11 5228924 5228945 5228941 5228946 +
aaatgttaaaacatgcagattt

SEQ ID NO: 85171 - DNA, 22 bp, Artificial Sequence
  Synthetic oligonucleotide; TTA chr11 5228925 5228946 5228942 5228947 +
aatgttaaaacatgcagatttg

SEQ ID NO: 85172 - DNA, 22 bp, Artificial Sequence
  Synthetic oligonucleotide; TTA chr11 5228932 5228953 5228949 5228954 +
aaacatgcagatttgacttggc

SEQ ID NO: 85173 - DNA, 22 bp, Artificial Sequence
  Synthetic oligonucleotide; TTT chr11 5228946 5228967 5228963 5228968 +
gacttggctgttagattttgga

SEQ ID NO: 85174 - DNA, 22 bp, Artificial Sequence
  Synthetic oligonucleotide; TTG chr11 5228947 5228968 5228964 5228969 +
acttggctgttagattttggat

SEQ ID NO: 85175 - DNA, 22 bp, Artificial Sequence
  Synthetic oligonucleotide; CTT chr11 5228951 5228972 5228968 5228973 +
ggctgttagattttggatttta

SEQ ID NO: 85176 - DNA, 22 bp, Artificial Sequence
  Synthetic oligonucleotide; TTG chr11 5228952 5228973 5228969 5228974 +
gctgttagattttggattttat

SEQ ID NO: 85177 - DNA, 22 bp, Artificial Sequence
  Synthetic oligonucleotide; CTG chr11 5228956 5228977 5228973 5228978 +
ttagattttggattttatttta

SEQ ID NO: 85178 - DNA, 22 bp, Artificial Sequence
  Synthetic oligonucleotide; TTA chr11 5228959 5228980 5228976 5228981 +
gattttggattttattttatta

SEQ ID NO: 85179 - DNA, 22 bp, Artificial Sequence
  Synthetic oligonucleotide; TTT chr11 5228964 5228985 5228981 5228986 +
tggattttattttattaaattt

SEQ ID NO: 85180 - DNA, 22 bp, Artificial Sequence
  Synthetic oligonucleotide; TTT chr11 5228965 5228986 5228982 5228987 +
ggattttattttattaaattta

SEQ ID NO: 85181 - DNA, 22 bp, Artificial Sequence
  Synthetic oligonucleotide; TTG chr11 5228966 5228987 5228983 5228988 +
gattttattttattaaatttaa

SEQ ID NO: 85182 - DNA, 22 bp, Artificial Sequence
  Synthetic oligonucleotide; TTT chr11 5228971 5228992 5228988 5228993 +
tattttattaaatttaaacctg

SEQ ID NO: 85183 - DNA, 22 bp, Artificial Sequence
  Synthetic oligonucleotide; TTT chr11 5228972 5228993 5228989 5228994 +
attttattaaatttaaacctgc

SEQ ID NO: 85184 - DNA, 22 bp, Artificial Sequence
  Synthetic oligonucleotide; TTA chr11 5228973 5228994 5228990 5228995 +
ttttattaaatttaaacctgca

SEQ ID NO: 85185 - DNA, 22 bp, Artificial Sequence
  Synthetic oligonucleotide; TTT chr11 5228976 5228997 5228993 5228998 +
tattaaatttaaacctgcatta

SEQ ID NO: 85186 - DNA, 22 bp, Artificial Sequence
  Synthetic oligonucleotide; TTT chr11 5228977 5228998 5228994 5228999 +
attaaatttaaacctgcattag

SEQ ID NO: 85187 - DNA, 22 bp, Artificial Sequence
  Synthetic oligonucleotide; TTA chr11 5228978 5228999 5228995 5229000 +
ttaaatttaaacctgcattagc

SEQ ID NO: 85188 - DNA, 22 bp, Artificial Sequence
  Synthetic oligonucleotide; TTA chr11 5228981 5229002 5228998 5229003 +
aatttaaacctgcattagcatt

SEQ ID NO: 85189 - DNA, 22 bp, Artificial Sequence
  Synthetic oligonucleotide; TTT chr11 5228986 5229007 5229003 5229008 +
aaacctgcattagcattgtttt

SEQ ID NO: 85190 - DNA, 22 bp, Artificial Sequence
  Synthetic oligonucleotide; TTA chr11 5228987 5229008 5229004 5229009 +
aacctgcattagcattgtttta

SEQ ID NO: 85191 - DNA, 22 bp, Artificial Sequence
  Synthetic oligonucleotide; CTG chr11 5228993 5229014 5229010 5229015 +
cattagcattgttttagattta

SEQ ID NO: 85192 - DNA, 22 bp, Artificial Sequence
  Synthetic oligonucleotide; TTA chr11 5228998 5229019 5229015 5229020 +
gcattgttttagatttagacag

SEQ ID NO: 85193 - DNA, 22 bp, Artificial Sequence
  Synthetic oligonucleotide; TTG chr11 5229004 5229025 5229021 5229026 +
ttttagatttagacagttttca

SEQ ID NO: 85194 - DNA, 22 bp, Artificial Sequence
  Synthetic oligonucleotide; TTT chr11 5229007 5229028 5229024 5229029 +
tagatttagacagttttcaaga

SEQ ID NO: 85195 - DNA, 22 bp, Artificial Sequence
  Synthetic oligonucleotide; TTT chr11 5229008 5229029 5229025 5229030 +
agatttagacagttttcaagac

SEQ ID NO: 85196 - DNA, 22 bp, Artificial Sequence
  Synthetic oligonucleotide; TTA chr11 5229009 5229030 5229026 5229031 +
gatttagacagttttcaagacc

SEQ ID NO: 85197 - DNA, 22 bp, Artificial Sequence
  Synthetic oligonucleotide; TTT chr11 5229014 5229035 5229031 5229036 +
agacagttttcaagaccctgtt

SEQ ID NO: 85198 - DNA, 22 bp, Artificial Sequence
  Synthetic oligonucleotide; TTA chr11 5229015 5229036 5229032 5229037 +
gacagttttcaagaccctgttt

SEQ ID NO: 85199 - DNA, 22 bp, Artificial Sequence
  Synthetic oligonucleotide; TTT chr11 5229023 5229044 5229040 5229045 +
tcaagaccctgtttcacatccc

SEQ ID NO: 85200 - DNA, 22 bp, Artificial Sequence
  Synthetic oligonucleotide; TTT chr11 5229024 5229045 5229041 5229046 +
caagaccctgtttcacatccct

SEQ ID NO: 85201 - DNA, 22 bp, Artificial Sequence
  Synthetic oligonucleotide; TTC chr11 5229025 5229046 5229042 5229047 +
aagaccctgtttcacatccctg

SEQ ID NO: 85202 - DNA, 22 bp, Artificial Sequence
  Synthetic oligonucleotide; CTG chr11 5229034 5229055 5229051 5229056 +
tttcacatccctgatataagag

SEQ ID NO: 85203 - DNA, 22 bp, Artificial Sequence
  Synthetic oligonucleotide; TTT chr11 5229037 5229058 5229054 5229059 +
cacatccctgatataagaggca

SEQ ID NO: 85204 - DNA, 22 bp, Artificial Sequence
  Synthetic oligonucleotide; TTC chr11 5229038 5229059 5229055 5229060 +
acatccctgatataagaggcat

SEQ ID NO: 85205 - DNA, 22 bp, Artificial Sequence
  Synthetic oligonucleotide; CTG chr11 5229047 5229068 5229064 5229069 +
atataagaggcatgtatatgtg

SEQ ID NO: 85206 - DNA, 22 bp, Artificial Sequence
  Synthetic oligonucleotide; TTC chr11 5229082 5229103 5229099 5229104 +
tgcggaagtttgaatatgtctt

SEQ ID NO: 85207 - DNA, 22 bp, Artificial Sequence
  Synthetic oligonucleotide; CTG chr11 5229084 5229105 5229101 5229106 +
cggaagtttgaatatgtctttt

SEQ ID NO: 85208 - DNA, 22 bp, Artificial Sequence
  Synthetic oligonucleotide; TTT chr11 5229093 5229114 5229110 5229115 +
gaatatgtcttttgcaaatatc

SEQ ID NO: 85209 - DNA, 22 bp, Artificial Sequence
  Synthetic oligonucleotide; TTG chr11 5229094 5229115 5229111 5229116 +
aatatgtcttttgcaaatatcc

SEQ ID NO: 85210 - DNA, 22 bp, Artificial Sequence
  Synthetic oligonucleotide; CTT chr11 5229104 5229125 5229121 5229126 +
ttgcaaatatcctgggtcaaag

SEQ ID NO: 85211 - DNA, 22 bp, Artificial Sequence
  Synthetic oligonucleotide; TTT chr11 5229105 5229126 5229122 5229127 +
tgcaaatatcctgggtcaaaga

SEQ ID NO: 85212 - DNA, 22 bp, Artificial Sequence
  Synthetic oligonucleotide; TTT chr11 5229106 5229127 5229123 5229128 +
gcaaatatcctgggtcaaagaa

SEQ ID NO: 85213 - DNA, 22 bp, Artificial Sequence
  Synthetic oligonucleotide; TTG chr11 5229107 5229128 5229124 5229129 +
caaatatcctgggtcaaagaaa

SEQ ID NO: 85214 - DNA, 22 bp, Artificial Sequence
  Synthetic oligonucleotide; CTG chr11 5229118 5229139 5229135 5229140 +
ggtcaaagaaaatgcacagact

SEQ ID NO: 85215 - DNA, 22 bp, Artificial Sequence
  Synthetic oligonucleotide; CTT chr11 5229141 5229162 5229158 5229163 +
tatgaaattataatataggtta

SEQ ID NO: 85216 - DNA, 22 bp, Artificial Sequence
  Synthetic oligonucleotide; TTT chr11 5229142 5229163 5229159 5229164 +
atgaaattataatataggttat

SEQ ID NO: 85217 - DNA, 22 bp, Artificial Sequence
  Synthetic oligonucleotide; TTA chr11 5229143 5229164 5229160 5229165 +
tgaaattataatataggttata

SEQ ID NO: 85218 - DNA, 22 bp, Artificial Sequence
  Synthetic oligonucleotide; TTA chr11 5229151 5229172 5229168 5229173 +
taatataggttatatttatagt

SEQ ID NO: 85219 - DNA, 22 bp, Artificial Sequence
  Synthetic oligonucleotide; TTA chr11 5229163 5229184 5229180 5229185 +
tatttatagtattctgaaagac

SEQ ID NO: 85220 - DNA, 22 bp, Artificial Sequence
  Synthetic oligonucleotide; TTT chr11 5229168 5229189 5229185 5229190 +
atagtattctgaaagaccaaaa

SEQ ID NO: 85221 - DNA, 22 bp, Artificial Sequence
  Synthetic oligonucleotide; TTA chr11 5229169 5229190 5229186 5229191 +
tagtattctgaaagaccaaaat

SEQ ID NO: 85222 - DNA, 22 bp, Artificial Sequence
  Synthetic oligonucleotide; TTC chr11 5229177 5229198 5229194 5229199 +
tgaaagaccaaaattgtcaaag

SEQ ID NO: 85223 - DNA, 22 bp, Artificial Sequence
  Synthetic oligonucleotide; CTG chr11 5229179 5229200 5229196 5229201 +
aaagaccaaaattgtcaaagca

SEQ ID NO: 85224 - DNA, 22 bp, Artificial Sequence
  Synthetic oligonucleotide; TTG chr11 5229193 5229214 5229210 5229215 +
tcaaagcaagagctttgaaatc

SEQ ID NO: 85225 - DNA, 22 bp, Artificial Sequence
  Synthetic oligonucleotide; CTT chr11 5229208 5229229 5229225 5229230 +
tgaaatcctgattggcagaaat

SEQ ID NO: 85226 - DNA, 22 bp, Artificial Sequence
  Synthetic oligonucleotide; TTT chr11 5229209 5229230 5229226 5229231 +
gaaatcctgattggcagaaatt

SEQ ID NO: 85227 - DNA, 22 bp, Artificial Sequence
  Synthetic oligonucleotide; TTG chr11 5229210 5229231 5229227 5229232 +
aaatcctgattggcagaaattg

SEQ ID NO: 85228 - DNA, 22 bp, Artificial Sequence
  Synthetic oligonucleotide; CTG chr11 5229218 5229239 5229235 5229240 +
attggcagaaattgtcaccttc

SEQ ID NO: 85229 - DNA, 22 bp, Artificial Sequence
  Synthetic oligonucleotide; TTG chr11 5229222 5229243 5229239 5229244 +
gcagaaattgtcaccttcttaa

SEQ ID NO: 85230 - DNA, 22 bp, Artificial Sequence
  Synthetic oligonucleotide; TTG chr11 5229232 5229253 5229249 5229254 +
tcaccttcttaaagacttaccc

SEQ ID NO: 85231 - DNA, 22 bp, Artificial Sequence
  Synthetic oligonucleotide; CTT chr11 5229239 5229260 5229256 5229261 +
cttaaagacttaccctacaact

SEQ ID NO: 85232 - DNA, 22 bp, Artificial Sequence
  Synthetic oligonucleotide; TTC chr11 5229240 5229261 5229257 5229262 +
ttaaagacttaccctacaactt

SEQ ID NO: 85233 - DNA, 22 bp, Artificial Sequence
  Synthetic oligonucleotide; CTT chr11 5229242 5229263 5229259 5229264 +
aaagacttaccctacaacttct

SEQ ID NO: 85234 - DNA, 22 bp, Artificial Sequence
  Synthetic oligonucleotide; TTA chr11 5229243 5229264 5229260 5229265 +
aagacttaccctacaacttctt

SEQ ID NO: 85235 - DNA, 22 bp, Artificial Sequence
  Synthetic oligonucleotide; CTT chr11 5229250 5229271 5229267 5229272 +
accctacaacttcttatgctca

SEQ ID NO: 85236 - DNA, 22 bp, Artificial Sequence
  Synthetic oligonucleotide; TTA chr11 5229251 5229272 5229268 5229273 +
ccctacaacttcttatgctcag

SEQ ID NO: 85237 - DNA, 22 bp, Artificial Sequence
  Synthetic oligonucleotide; CTA chr11 5229256 5229277 5229273 5229278 +
caacttcttatgctcagaaata

SEQ ID NO: 85238 - DNA, 22 bp, Artificial Sequence
  Synthetic oligonucleotide; CTT chr11 5229262 5229283 5229279 5229284 +
cttatgctcagaaatagttttc

SEQ ID NO: 85239 - DNA, 22 bp, Artificial Sequence
  Synthetic oligonucleotide; TTC chr11 5229263 5229284 5229280 5229285 +
ttatgctcagaaatagttttcc

SEQ ID NO: 85240 - DNA, 22 bp, Artificial Sequence
  Synthetic oligonucleotide; CTT chr11 5229265 5229286 5229282 5229287 +
atgctcagaaatagttttcctt

SEQ ID NO: 85241 - DNA, 22 bp, Artificial Sequence
  Synthetic oligonucleotide; TTA chr11 5229266 5229287 5229283 5229288 +
tgctcagaaatagttttccttt

SEQ ID NO: 85242 - DNA, 22 bp, Artificial Sequence
  Synthetic oligonucleotide; CTC chr11 5229271 5229292 5229288 5229293 +
agaaatagttttcctttttcta

SEQ ID NO: 85243 - DNA, 22 bp, Artificial Sequence
  Synthetic oligonucleotide; TTT chr11 5229282 5229303 5229299 5229304 +
tcctttttctattttgttttct

SEQ ID NO: 85244 - DNA, 22 bp, Artificial Sequence
  Synthetic oligonucleotide; TTT chr11 5229283 5229304 5229300 5229305 +
cctttttctattttgttttctt

SEQ ID NO: 85245 - DNA, 22 bp, Artificial Sequence
  Synthetic oligonucleotide; TTC chr11 5229284 5229305 5229301 5229306 +
ctttttctattttgttttcttt

SEQ ID NO: 85246 - DNA, 22 bp, Artificial Sequence
  Synthetic oligonucleotide; CTT chr11 5229287 5229308 5229304 5229309 +
tttctattttgttttctttttt

SEQ ID NO: 85247 - DNA, 22 bp, Artificial Sequence
  Synthetic oligonucleotide; TTT chr11 5229288 5229309 5229305 5229310 +
ttctattttgttttctttttta

SEQ ID NO: 85248 - DNA, 22 bp, Artificial Sequence
  Synthetic oligonucleotide; TTT chr11 5229289 5229310 5229306 5229311 +
tctattttgttttcttttttaa

SEQ ID NO: 85249 - DNA, 22 bp, Artificial Sequence
  Synthetic oligonucleotide; TTT chr11 5229290 5229311 5229307 5229312 +
ctattttgttttcttttttaaa

SEQ ID NO: 85250 - DNA, 22 bp, Artificial Sequence
  Synthetic oligonucleotide; TTC chr11 5229291 5229312 5229308 5229313 +
tattttgttttcttttttaaat

SEQ ID NO: 85251 - DNA, 22 bp, Artificial Sequence
  Synthetic oligonucleotide; CTA chr11 5229293 5229314 5229310 5229315 +
ttttgttttcttttttaaatga

SEQ ID NO: 85252 - DNA, 22 bp, Artificial Sequence
  Synthetic oligonucleotide; TTT chr11 5229296 5229317 5229313 5229318 +
tgttttcttttttaaatgatga

SEQ ID NO: 85253 - DNA, 22 bp, Artificial Sequence
  Synthetic oligonucleotide; TTT chr11 5229297 5229318 5229314 5229319 +
gttttcttttttaaatgatgaa

SEQ ID NO: 85254 - DNA, 22 bp, Artificial Sequence
  Synthetic oligonucleotide; TTG chr11 5229298 5229319 5229315 5229320 +
ttttcttttttaaatgatgaac

SEQ ID NO: 85255 - DNA, 22 bp, Artificial Sequence
  Synthetic oligonucleotide; TTT chr11 5229301 5229322 5229318 5229323 +
tcttttttaaatgatgaactat

SEQ ID NO: 85256 - DNA, 22 bp, Artificial Sequence
  Synthetic oligonucleotide; TTT chr11 5229302 5229323 5229319 5229324 +
cttttttaaatgatgaactatg

SEQ ID NO: 85257 - DNA, 22 bp, Artificial Sequence
  Synthetic oligonucleotide; TTC chr11 5229303 5229324 5229320 5229325 +
ttttttaaatgatgaactatgg

SEQ ID NO: 85258 - DNA, 22 bp, Artificial Sequence
  Synthetic oligonucleotide; CTT chr11 5229305 5229326 5229322 5229327 +
ttttaaatgatgaactatggat

SEQ ID NO: 85259 - DNA, 22 bp, Artificial Sequence
  Synthetic oligonucleotide; TTT chr11 5229306 5229327 5229323 5229328 +
tttaaatgatgaactatggatc

SEQ ID NO: 85260 - DNA, 22 bp, Artificial Sequence
  Synthetic oligonucleotide; TTT chr11 5229307 5229328 5229324 5229329 +
ttaaatgatgaactatggatcc

SEQ ID NO: 85261 - DNA, 22 bp, Artificial Sequence
  Synthetic oligonucleotide; TTT chr11 5229308 5229329 5229325 5229330 +
taaatgatgaactatggatcct

SEQ ID NO: 85262 - DNA, 22 bp, Artificial Sequence
  Synthetic oligonucleotide; TTT chr11 5229309 5229330 5229326 5229331 +
aaatgatgaactatggatcctt

SEQ ID NO: 85263 - DNA, 22 bp, Artificial Sequence
  Synthetic oligonucleotide; TTA chr11 5229310 5229331 5229327 5229332 +
aatgatgaactatggatccttc

SEQ ID NO: 85264 - DNA, 22 bp, Artificial Sequence
  Synthetic oligonucleotide; CTA chr11 5229322 5229343 5229339 5229344 +
tggatccttctcttgtgttggc

SEQ ID NO: 85265 - DNA, 22 bp, Artificial Sequence
  Synthetic oligonucleotide; CTT chr11 5229331 5229352 5229348 5229353 +
ctcttgtgttggcaactgctgc

SEQ ID NO: 85266 - DNA, 22 bp, Artificial Sequence
  Synthetic oligonucleotide; TTC chr11 5229332 5229353 5229349 5229354 +
tcttgtgttggcaactgctgca

SEQ ID NO: 85267 - DNA, 22 bp, Artificial Sequence
  Synthetic oligonucleotide; CTC chr11 5229334 5229355 5229351 5229356 +
ttgtgttggcaactgctgcaga

SEQ ID NO: 85268 - DNA, 22 bp, Artificial Sequence
  Synthetic oligonucleotide; CTT chr11 5229336 5229357 5229353 5229358 +
gtgttggcaactgctgcagata

SEQ ID NO: 85269 - DNA, 22 bp, Artificial Sequence
  Synthetic oligonucleotide; TTG chr11 5229337 5229358 5229354 5229359 +
tgttggcaactgctgcagatac

SEQ ID NO: 85270 - DNA, 22 bp, Artificial Sequence
  Synthetic oligonucleotide; TTG chr11 5229342 5229363 5229359 5229364 +
gcaactgctgcagataccatca

SEQ ID NO: 85271 - DNA, 22 bp, Artificial Sequence
  Synthetic oligonucleotide; CTG chr11 5229349 5229370 5229366 5229371 +
ctgcagataccatcatcctggc

SEQ ID NO: 85272 - DNA, 22 bp, Artificial Sequence
  Synthetic oligonucleotide; CTG chr11 5229352 5229373 5229369 5229374 +
cagataccatcatcctggcttc

SEQ ID NO: 85273 - DNA, 22 bp, Artificial Sequence
  Synthetic oligonucleotide; CTG chr11 5229369 5229390 5229386 5229391 +
gcttcaaggcaggggttgcttt

SEQ ID NO: 85274 - DNA, 22 bp, Artificial Sequence
  Synthetic oligonucleotide; CTT chr11 5229373 5229394 5229390 5229395 +
caaggcaggggttgcttttcca

SEQ ID NO: 85275 - DNA, 22 bp, Artificial Sequence
  Synthetic oligonucleotide; TTC chr11 5229374 5229395 5229391 5229396 +
aaggcaggggttgcttttccaa

SEQ ID NO: 85276 - DNA, 22 bp, Artificial Sequence
  Synthetic oligonucleotide; TTG chr11 5229387 5229408 5229404 5229409 +
cttttccaatggtagttactta

SEQ ID NO: 85277 - DNA, 22 bp, Artificial Sequence
  Synthetic oligonucleotide; CTT chr11 5229390 5229411 5229407 5229412 +
ttccaatggtagttacttagtg

SEQ ID NO: 85278 - DNA, 22 bp, Artificial Sequence
  Synthetic oligonucleotide; TTT chr11 5229391 5229412 5229408 5229413 +
tccaatggtagttacttagtgt

SEQ ID NO: 85279 - DNA, 22 bp, Artificial Sequence
  Synthetic oligonucleotide; TTT chr11 5229392 5229413 5229409 5229414 +
ccaatggtagttacttagtgtg

SEQ ID NO: 85280 - DNA, 22 bp, Artificial Sequence
  Synthetic oligonucleotide; TTC chr11 5229393 5229414 5229410 5229415 +
caatggtagttacttagtgtga

SEQ ID NO: 85281 - DNA, 22 bp, Artificial Sequence
  Synthetic oligonucleotide; TTA chr11 5229405 5229426 5229422 5229427 +
cttagtgtgactagagtgtaac

SEQ ID NO: 85282 - DNA, 22 bp, Artificial Sequence
  Synthetic oligonucleotide; CTT chr11 5229408 5229429 5229425 5229430 +
agtgtgactagagtgtaacgca

SEQ ID NO: 85283 - DNA, 22 bp, Artificial Sequence
  Synthetic oligonucleotide; TTA chr11 5229409 5229430 5229426 5229431 +
gtgtgactagagtgtaacgcag

SEQ ID NO: 85284 - DNA, 22 bp, Artificial Sequence
  Synthetic oligonucleotide; CTA chr11 5229418 5229439 5229435 5229440 +
gagtgtaacgcagacttttctt

SEQ ID NO: 85285 - DNA, 22 bp, Artificial Sequence
  Synthetic oligonucleotide; CTT chr11 5229435 5229456 5229452 5229457 +
ttctttctattacccataatac

SEQ ID NO: 85286 - DNA, 22 bp, Artificial Sequence
  Synthetic oligonucleotide; TTT chr11 5229436 5229457 5229453 5229458 +
tctttctattacccataatacc

SEQ ID NO: 85287 - DNA, 22 bp, Artificial Sequence
  Synthetic oligonucleotide; TTT chr11 5229437 5229458 5229454 5229459 +
ctttctattacccataataccc

SEQ ID NO: 85288 - DNA, 22 bp, Artificial Sequence
  Synthetic oligonucleotide; TTC chr11 5229438 5229459 5229455 5229460 +
tttctattacccataataccct

SEQ ID NO: 85289 - DNA, 22 bp, Artificial Sequence
  Synthetic oligonucleotide; CTT chr11 5229440 5229461 5229457 5229462 +
tctattacccataataccctgc

SEQ ID NO: 85290 - DNA, 22 bp, Artificial Sequence
  Synthetic oligonucleotide; TTT chr11 5229441 5229462 5229458 5229463 +
ctattacccataataccctgca

SEQ ID NO: 85291 - DNA, 22 bp, Artificial Sequence
  Synthetic oligonucleotide; TTC chr11 5229442 5229463 5229459 5229464 +
tattacccataataccctgcag

SEQ ID NO: 85292 - DNA, 22 bp, Artificial Sequence
  Synthetic oligonucleotide; CTA chr11 5229444 5229465 5229461 5229466 +
ttacccataataccctgcaggg

SEQ ID NO: 85293 - DNA, 22 bp, Artificial Sequence
  Synthetic oligonucleotide; TTA chr11 5229447 5229468 5229464 5229469 +
cccataataccctgcagggaca

SEQ ID NO: 85294 - DNA, 22 bp, Artificial Sequence
  Synthetic oligonucleotide; CTG chr11 5229461 5229482 5229478 5229483 +
cagggacaaggctgcaagctat

SEQ ID NO: 85295 - DNA, 22 bp, Artificial Sequence
  Synthetic oligonucleotide; CTG chr11 5229475 5229496 5229492 5229497 +
caagctatactaagaccatcaa

SEQ ID NO: 85296 - DNA, 22 bp, Artificial Sequence
  Synthetic oligonucleotide; CTA chr11 5229482 5229503 5229499 5229504 +
tactaagaccatcaaaagccca

SEQ ID NO: 85297 - DNA, 22 bp, Artificial Sequence
  Synthetic oligonucleotide; CTA chr11 5229487 5229508 5229504 5229509 +
agaccatcaaaagcccaggcat

SEQ ID NO: 85298 - DNA, 22 bp, Artificial Sequence
  Synthetic oligonucleotide; TTT chr11 5229526 5229547 5229543 5229548 +
caagaagcaataaatagtgcaa

SEQ ID NO: 85299 - DNA, 22 bp, Artificial Sequence
  Synthetic oligonucleotide; TTC chr11 5229527 5229548 5229544 5229549 +
aagaagcaataaatagtgcaaa

SEQ ID NO: 85300 - DNA, 22 bp, Artificial Sequence
  Synthetic oligonucleotide; TTT chr11 5229552 5229573 5229569 5229574 +
ggttatggtcagagcctcagtt

SEQ ID NO: 85301 - DNA, 22 bp, Artificial Sequence
  Synthetic oligonucleotide; TTG chr11 5229553 5229574 5229570 5229575 +
gttatggtcagagcctcagttt

SEQ ID NO: 85302 - DNA, 22 bp, Artificial Sequence
  Synthetic oligonucleotide; TTA chr11 5229557 5229578 5229574 5229579 +
tggtcagagcctcagtttcaaa

SEQ ID NO: 85303 - DNA, 22 bp, Artificial Sequence
  Synthetic oligonucleotide; CTC chr11 5229570 5229591 5229587 5229592 +
agtttcaaatctaaatcagcat

SEQ ID NO: 85304 - DNA, 22 bp, Artificial Sequence
  Synthetic oligonucleotide; TTT chr11 5229575 5229596 5229592 5229597 +
caaatctaaatcagcattcaaa

SEQ ID NO: 85305 - DNA, 22 bp, Artificial Sequence
  Synthetic oligonucleotide; TTC chr11 5229576 5229597 5229593 5229598 +
aaatctaaatcagcattcaaag

SEQ ID NO: 85306 - DNA, 22 bp, Artificial Sequence
  Synthetic oligonucleotide; CTA chr11 5229583 5229604 5229600 5229605 +
aatcagcattcaaagttcctga

SEQ ID NO: 85307 - DNA, 22 bp, Artificial Sequence
  Synthetic oligonucleotide; TTC chr11 5229594 5229615 5229611 5229616 +
aaagttcctgaaaaactattca

SEQ ID NO: 85308 - DNA, 22 bp, Artificial Sequence
  Synthetic oligonucleotide; TTC chr11 5229601 5229622 5229618 5229623 +
ctgaaaaactattcaagcttac

SEQ ID NO: 85309 - DNA, 22 bp, Artificial Sequence
  Synthetic oligonucleotide; CTG chr11 5229604 5229625 5229621 5229626 +
aaaaactattcaagcttactga

SEQ ID NO: 85310 - DNA, 22 bp, Artificial Sequence
  Synthetic oligonucleotide; CTA chr11 5229612 5229633 5229629 5229634 +
ttcaagcttactgacatcttca

SEQ ID NO: 85311 - DNA, 22 bp, Artificial Sequence
  Synthetic oligonucleotide; TTC chr11 5229615 5229636 5229632 5229637 +
aagcttactgacatcttcacta

SEQ ID NO: 85312 - DNA, 22 bp, Artificial Sequence
  Synthetic oligonucleotide; CTT chr11 5229621 5229642 5229638 5229643 +
actgacatcttcactattgtga

SEQ ID NO: 85313 - DNA, 22 bp, Artificial Sequence
  Synthetic oligonucleotide; TTA chr11 5229622 5229643 5229639 5229644 +
ctgacatcttcactattgtgag

SEQ ID NO: 85314 - DNA, 22 bp, Artificial Sequence
  Synthetic oligonucleotide; CTG chr11 5229625 5229646 5229642 5229647 +
acatcttcactattgtgagctt

SEQ ID NO: 85315 - DNA, 22 bp, Artificial Sequence
  Synthetic oligonucleotide; CTT chr11 5229632 5229653 5229649 5229654 +
cactattgtgagcttgcttcta

SEQ ID NO: 85316 - DNA, 22 bp, Artificial Sequence
  Synthetic oligonucleotide; TTC chr11 5229633 5229654 5229650 5229655 +
actattgtgagcttgcttctac

SEQ ID NO: 85317 - DNA, 22 bp, Artificial Sequence
  Synthetic oligonucleotide; CTA chr11 5229637 5229658 5229654 5229659 +
ttgtgagcttgcttctactctg

SEQ ID NO: 85318 - DNA, 22 bp, Artificial Sequence
  Synthetic oligonucleotide; TTG chr11 5229640 5229661 5229657 5229662 +
tgagcttgcttctactctgtga

SEQ ID NO: 85319 - DNA, 22 bp, Artificial Sequence
  Synthetic oligonucleotide; CTT chr11 5229647 5229668 5229664 5229669 +
gcttctactctgtgaatggatg

SEQ ID NO: 85320 - DNA, 22 bp, Artificial Sequence
  Synthetic oligonucleotide; TTG chr11 5229648 5229669 5229665 5229670 +
cttctactctgtgaatggatgc

SEQ ID NO: 85321 - DNA, 22 bp, Artificial Sequence
  Synthetic oligonucleotide; CTT chr11 5229651 5229672 5229668 5229673 +
ctactctgtgaatggatgccac

SEQ ID NO: 85322 - DNA, 22 bp, Artificial Sequence
  Synthetic oligonucleotide; TTC chr11 5229652 5229673 5229669 5229674 +
tactctgtgaatggatgccaca

SEQ ID NO: 85323 - DNA, 22 bp, Artificial Sequence
  Synthetic oligonucleotide; CTA chr11 5229654 5229675 5229671 5229676 +
ctctgtgaatggatgccacagc

SEQ ID NO: 85324 - DNA, 22 bp, Artificial Sequence
  Synthetic oligonucleotide; CTC chr11 5229657 5229678 5229674 5229679 +
tgtgaatggatgccacagcagg

SEQ ID NO: 85325 - DNA, 22 bp, Artificial Sequence
  Synthetic oligonucleotide; CTG chr11 5229659 5229680 5229676 5229681 +
tgaatggatgccacagcaggtg

SEQ ID NO: 85326 - DNA, 22 bp, Artificial Sequence
  Synthetic oligonucleotide; CTA chr11 5229689 5229710 5229706 5229711 +
ttctacttttattccagcccca

SEQ ID NO: 85327 - DNA, 22 bp, Artificial Sequence
  Synthetic oligonucleotide; TTC chr11 5229692 5229713 5229709 5229714 +
tacttttattccagccccactg

SEQ ID NO: 85328 - DNA, 22 bp, Artificial Sequence
  Synthetic oligonucleotide; CTA chr11 5229694 5229715 5229711 5229716 +
cttttattccagccccactgac

SEQ ID NO: 85329 - DNA, 22 bp, Artificial Sequence
  Synthetic oligonucleotide; CTT chr11 5229697 5229718 5229714 5229719 +
ttattccagccccactgaccac

SEQ ID NO: 85330 - DNA, 22 bp, Artificial Sequence
  Synthetic oligonucleotide; TTT chr11 5229698 5229719 5229715 5229720 +
tattccagccccactgaccaca

SEQ ID NO: 85331 - DNA, 22 bp, Artificial Sequence
  Synthetic oligonucleotide; TTT chr11 5229699 5229720 5229716 5229721 +
attccagccccactgaccacaa

SEQ ID NO: 85332 - DNA, 22 bp, Artificial Sequence
  Synthetic oligonucleotide; TTA chr11 5229700 5229721 5229717 5229722 +
ttccagccccactgaccacaac

SEQ ID NO: 85333 - DNA, 22 bp, Artificial Sequence
  Synthetic oligonucleotide; TTC chr11 5229703 5229724 5229720 5229725 +
cagccccactgaccacaacaca

SEQ ID NO: 85334 - DNA, 22 bp, Artificial Sequence
  Synthetic oligonucleotide; CTG chr11 5229714 5229735 5229731 5229736 +
accacaacacacacacacacac

SEQ ID NO: 85335 - DNA, 22 bp, Artificial Sequence
  Synthetic oligonucleotide; CTC chr11 5229762 5229783 5229779 5229784 +
aaaaaagagacagcgagagaga

SEQ ID NO: 85336 - DNA, 22 bp, Artificial Sequence
  Synthetic oligonucleotide; TTT chr11 5229797 5229818 5229814 5229819 +
cctttactccagtctattaatc

SEQ ID NO: 85337 - DNA, 22 bp, Artificial Sequence
  Synthetic oligonucleotide; TTC chr11 5229798 5229819 5229815 5229820 +
ctttactccagtctattaatct

SEQ ID NO: 85338 - DNA, 22 bp, Artificial Sequence
  Synthetic oligonucleotide; CTT chr11 5229801 5229822 5229818 5229823 +
tactccagtctattaatctttc

SEQ ID NO: 85339 - DNA, 22 bp, Artificial Sequence
  Synthetic oligonucleotide; TTT chr11 5229802 5229823 5229819 5229824 +
actccagtctattaatctttct

SEQ ID NO: 85340 - DNA, 22 bp, Artificial Sequence
  Synthetic oligonucleotide; TTA chr11 5229803 5229824 5229820 5229825 +
ctccagtctattaatctttctt

SEQ ID NO: 85341 - DNA, 22 bp, Artificial Sequence
  Synthetic oligonucleotide; CTC chr11 5229806 5229827 5229823 5229828 +
cagtctattaatctttcttaag

SEQ ID NO: 85342 - DNA, 22 bp, Artificial Sequence
  Synthetic oligonucleotide; CTA chr11 5229813 5229834 5229830 5229835 +
ttaatctttcttaagtcctaat

SEQ ID NO: 85343 - DNA, 22 bp, Artificial Sequence
  Synthetic oligonucleotide; TTA chr11 5229816 5229837 5229833 5229838 +
atctttcttaagtcctaatgtt

SEQ ID NO: 85344 - DNA, 22 bp, Artificial Sequence
  Synthetic oligonucleotide; CTT chr11 5229821 5229842 5229838 5229843 +
tcttaagtcctaatgttttata

SEQ ID NO: 85345 - DNA, 22 bp, Artificial Sequence
  Synthetic oligonucleotide; TTT chr11 5229822 5229843 5229839 5229844 +
cttaagtcctaatgttttatat

SEQ ID NO: 85346 - DNA, 22 bp, Artificial Sequence
  Synthetic oligonucleotide; TTC chr11 5229823 5229844 5229840 5229845 +
ttaagtcctaatgttttatatc

SEQ ID NO: 85347 - DNA, 22 bp, Artificial Sequence
  Synthetic oligonucleotide; CTT chr11 5229825 5229846 5229842 5229847 +
aagtcctaatgttttatatcag

SEQ ID NO: 85348 - DNA, 22 bp, Artificial Sequence
  Synthetic oligonucleotide; TTA chr11 5229826 5229847 5229843 5229848 +
agtcctaatgttttatatcaga

SEQ ID NO: 85349 - DNA, 22 bp, Artificial Sequence
  Synthetic oligonucleotide; CTA chr11 5229833 5229854 5229850 5229855 +
atgttttatatcagaatggccc

SEQ ID NO: 85350 - DNA, 22 bp, Artificial Sequence
  Synthetic oligonucleotide; TTT chr11 5229839 5229860 5229856 5229861 +
tatatcagaatggccctagtct

SEQ ID NO: 85351 - DNA, 22 bp, Artificial Sequence
  Synthetic oligonucleotide; TTT chr11 5229840 5229861 5229857 5229862 +
atatcagaatggccctagtctg

SEQ ID NO: 85352 - DNA, 22 bp, Artificial Sequence
  Synthetic oligonucleotide; TTA chr11 5229841 5229862 5229858 5229863 +
tatcagaatggccctagtctgg

SEQ ID NO: 85353 - DNA, 22 bp, Artificial Sequence
  Synthetic oligonucleotide; CTA chr11 5229857 5229878 5229874 5229879 +
gtctgggtatacttagaggatg

SEQ ID NO: 85354 - DNA, 22 bp, Artificial Sequence
  Synthetic oligonucleotide; CTG chr11 5229862 5229883 5229879 5229884 +
ggtatacttagaggatgaatat

SEQ ID NO: 85355 - DNA, 22 bp, Artificial Sequence
  Synthetic oligonucleotide; CTT chr11 5229871 5229892 5229888 5229893 +
agaggatgaatattaacttcct

SEQ ID NO: 85356 - DNA, 22 bp, Artificial Sequence
  Synthetic oligonucleotide; TTA chr11 5229872 5229893 5229889 5229894 +
gaggatgaatattaacttcctc

SEQ ID NO: 85357 - DNA, 22 bp, Artificial Sequence
  Synthetic oligonucleotide; TTA chr11 5229886 5229907 5229903 5229908 +
acttcctccatgaaaatcatga

SEQ ID NO: 85358 - DNA, 22 bp, Artificial Sequence
  Synthetic oligonucleotide; CTT chr11 5229890 5229911 5229907 5229912 +
cctccatgaaaatcatgacact

SEQ ID NO: 85359 - DNA, 22 bp, Artificial Sequence
  Synthetic oligonucleotide; TTC chr11 5229891 5229912 5229908 5229913 +
ctccatgaaaatcatgacactc

SEQ ID NO: 85360 - DNA, 22 bp, Artificial Sequence
  Synthetic oligonucleotide; CTC chr11 5229894 5229915 5229911 5229916 +
catgaaaatcatgacactcatc

SEQ ID NO: 85361 - DNA, 22 bp, Artificial Sequence
  Synthetic oligonucleotide; CTC chr11 5229913 5229934 5229930 5229935 +
atctatgggagtgtggttttat

SEQ ID NO: 85362 - DNA, 22 bp, Artificial Sequence
  Synthetic oligonucleotide; CTA chr11 5229918 5229939 5229935 5229940 +
tgggagtgtggttttatcattt

SEQ ID NO: 85363 - DNA, 22 bp, Artificial Sequence
  Synthetic oligonucleotide; TTT chr11 5229932 5229953 5229949 5229954 +
tatcatttgtttcaaaagcagc

SEQ ID NO: 85364 - DNA, 22 bp, Artificial Sequence
  Synthetic oligonucleotide; TTT chr11 5229933 5229954 5229950 5229955 +
atcatttgtttcaaaagcagca

SEQ ID NO: 85365 - DNA, 22 bp, Artificial Sequence
  Synthetic oligonucleotide; TTA chr11 5229934 5229955 5229951 5229956 +
tcatttgtttcaaaagcagcac

SEQ ID NO: 85366 - DNA, 22 bp, Artificial Sequence
  Synthetic oligonucleotide; TTT chr11 5229940 5229961 5229957 5229962 +
gtttcaaaagcagcacttgact

SEQ ID NO: 85367 - DNA, 22 bp, Artificial Sequence
  Synthetic oligonucleotide; TTG chr11 5229941 5229962 5229958 5229963 +
tttcaaaagcagcacttgacta

SEQ ID NO: 85368 - DNA, 22 bp, Artificial Sequence
  Synthetic oligonucleotide; TTT chr11 5229944 5229965 5229961 5229966 +
caaaagcagcacttgactagag

SEQ ID NO: 85369 - DNA, 22 bp, Artificial Sequence
  Synthetic oligonucleotide; TTC chr11 5229945 5229966 5229962 5229967 +
aaaagcagcacttgactagagt

SEQ ID NO: 85370 - DNA, 22 bp, Artificial Sequence
  Synthetic oligonucleotide; CTT chr11 5229958 5229979 5229975 5229980 +
gactagagtatttttatacatg

SEQ ID NO: 85371 - DNA, 22 bp, Artificial Sequence
  Synthetic oligonucleotide; TTG chr11 5229959 5229980 5229976 5229981 +
actagagtatttttatacatgc

SEQ ID NO: 85372 - DNA, 22 bp, Artificial Sequence
  Synthetic oligonucleotide; CTA chr11 5229963 5229984 5229980 5229985 +
gagtatttttatacatgctcta

SEQ ID NO: 85373 - DNA, 22 bp, Artificial Sequence
  Synthetic oligonucleotide; TTT chr11 5229971 5229992 5229988 5229993 +
ttatacatgctctactgtttag

SEQ ID NO: 85374 - DNA, 22 bp, Artificial Sequence
  Synthetic oligonucleotide; TTT chr11 5229972 5229993 5229989 5229994 +
tatacatgctctactgtttagt

SEQ ID NO: 85375 - DNA, 22 bp, Artificial Sequence
  Synthetic oligonucleotide; TTT chr11 5229973 5229994 5229990 5229995 +
atacatgctctactgtttagtc

SEQ ID NO: 85376 - DNA, 22 bp, Artificial Sequence
  Synthetic oligonucleotide; TTA chr11 5229974 5229995 5229991 5229996 +
tacatgctctactgtttagtct

SEQ ID NO: 85377 - DNA, 22 bp, Artificial Sequence
  Synthetic oligonucleotide; CTC chr11 5229983 5230004 5230000 5230005 +
tactgtttagtctaaaattccc

SEQ ID NO: 85378 - DNA, 22 bp, Artificial Sequence
  Synthetic oligonucleotide; CTA chr11 5229985 5230006 5230002 5230007 +
ctgtttagtctaaaattcccca

SEQ ID NO: 85379 - DNA, 22 bp, Artificial Sequence
  Synthetic oligonucleotide; CTG chr11 5229988 5230009 5230005 5230010 +
tttagtctaaaattccccaagt

SEQ ID NO: 85380 - DNA, 22 bp, Artificial Sequence
  Synthetic oligonucleotide; TTT chr11 5229991 5230012 5230008 5230013 +
agtctaaaattccccaagtgag

SEQ ID NO: 85381 - DNA, 22 bp, Artificial Sequence
  Synthetic oligonucleotide; TTA chr11 5229992 5230013 5230009 5230014 +
gtctaaaattccccaagtgaga

SEQ ID NO: 85382 - DNA, 22 bp, Artificial Sequence
  Synthetic oligonucleotide; CTA chr11 5229997 5230018 5230014 5230019 +
aaattccccaagtgagacattt

SEQ ID NO: 85383 - DNA, 22 bp, Artificial Sequence
  Synthetic oligonucleotide; TTC chr11 5230003 5230024 5230020 5230025 +
cccaagtgagacattttagcaa

SEQ ID NO: 85384 - DNA, 22 bp, Artificial Sequence
  Synthetic oligonucleotide; TTT chr11 5230019 5230040 5230036 5230041 +
tagcaatctactgtatatgttc

SEQ ID NO: 85385 - DNA, 22 bp, Artificial Sequence
  Synthetic oligonucleotide; TTT chr11 5230020 5230041 5230037 5230042 +
agcaatctactgtatatgttcc

SEQ ID NO: 85386 - DNA, 22 bp, Artificial Sequence
  Synthetic oligonucleotide; TTA chr11 5230021 5230042 5230038 5230043 +
gcaatctactgtatatgttcct

SEQ ID NO: 85387 - DNA, 22 bp, Artificial Sequence
  Synthetic oligonucleotide; CTA chr11 5230029 5230050 5230046 5230051 +
ctgtatatgttcctaggtcaag

SEQ ID NO: 85388 - DNA, 22 bp, Artificial Sequence
  Synthetic oligonucleotide; CTG chr11 5230032 5230053 5230049 5230054 +
tatatgttcctaggtcaagcac

SEQ ID NO: 85389 - DNA, 22 bp, Artificial Sequence
  Synthetic oligonucleotide; TTC chr11 5230041 5230062 5230058 5230063 +
ctaggtcaagcacagtctagct

SEQ ID NO: 85390 - DNA, 22 bp, Artificial Sequence
  Synthetic oligonucleotide; CTA chr11 5230044 5230065 5230061 5230066 +
ggtcaagcacagtctagctact

SEQ ID NO: 85391 - DNA, 22 bp, Artificial Sequence
  Synthetic oligonucleotide; CTA chr11 5230060 5230081 5230077 5230082 +
gctacttgctacagacttctct

SEQ ID NO: 85392 - DNA, 22 bp, Artificial Sequence
  Synthetic oligonucleotide; CTA chr11 5230064 5230085 5230081 5230086 +
cttgctacagacttctctcgca

SEQ ID NO: 85393 - DNA, 22 bp, Artificial Sequence
  Synthetic oligonucleotide; CTT chr11 5230067 5230088 5230084 5230089 +
gctacagacttctctcgcagat

SEQ ID NO: 85394 - DNA, 22 bp, Artificial Sequence
  Synthetic oligonucleotide; TTG chr11 5230068 5230089 5230085 5230090 +
ctacagacttctctcgcagata

SEQ ID NO: 85395 - DNA, 22 bp, Artificial Sequence
  Synthetic oligonucleotide; CTA chr11 5230071 5230092 5230088 5230093 +
cagacttctctcgcagatacac

SEQ ID NO: 85396 - DNA, 22 bp, Artificial Sequence
  Synthetic oligonucleotide; CTT chr11 5230078 5230099 5230095 5230100 +
ctctcgcagatacacaatctct

SEQ ID NO: 85397 - DNA, 22 bp, Artificial Sequence
  Synthetic oligonucleotide; TTC chr11 5230079 5230100 5230096 5230101 +
tctcgcagatacacaatctctc

SEQ ID NO: 85398 - DNA, 22 bp, Artificial Sequence
  Synthetic oligonucleotide; CTC chr11 5230081 5230102 5230098 5230103 +
tcgcagatacacaatctctcag

SEQ ID NO: 85399 - DNA, 22 bp, Artificial Sequence
  Synthetic oligonucleotide; CTC chr11 5230083 5230104 5230100 5230105 +
gcagatacacaatctctcagta

SEQ ID NO: 85400 - DNA, 22 bp, Artificial Sequence
  Synthetic oligonucleotide; CTC chr11 5230099 5230120 5230116 5230121 +
tcagtaaacacaactcagcagc

SEQ ID NO: 85401 - DNA, 22 bp, Artificial Sequence
  Synthetic oligonucleotide; CTC chr11 5230101 5230122 5230118 5230123 +
agtaaacacaactcagcagctc

SEQ ID NO: 85402 - DNA, 22 bp, Artificial Sequence
  Synthetic oligonucleotide; CTC chr11 5230115 5230136 5230132 5230137 +
agcagctctcagaattaattaa

SEQ ID NO: 85403 - DNA, 22 bp, Artificial Sequence
  Synthetic oligonucleotide; CTC chr11 5230123 5230144 5230140 5230145 +
tcagaattaattaattaaaatg

SEQ ID NO: 85404 - DNA, 22 bp, Artificial Sequence
  Synthetic oligonucleotide; CTC chr11 5230125 5230146 5230142 5230147 +
agaattaattaattaaaatgaa

SEQ ID NO: 85405 - DNA, 22 bp, Artificial Sequence
  Synthetic oligonucleotide; TTA chr11 5230132 5230153 5230149 5230154 +
attaattaaaatgaaataaaaa

SEQ ID NO: 85406 - DNA, 22 bp, Artificial Sequence
  Synthetic oligonucleotide; TTA chr11 5230136 5230157 5230153 5230158 +
attaaaatgaaataaaaatgct

SEQ ID NO: 85407 - DNA, 22 bp, Artificial Sequence
  Synthetic oligonucleotide; TTA chr11 5230140 5230161 5230157 5230162 +
aaatgaaataaaaatgctccaa

SEQ ID NO: 85408 - DNA, 22 bp, Artificial Sequence
  Synthetic oligonucleotide; CTC chr11 5230159 5230180 5230176 5230181 +
caagaaaaccagaacccataga

SEQ ID NO: 85409 - DNA, 22 bp, Artificial Sequence
  Synthetic oligonucleotide; TTT chr11 5230209 5230230 5230226 5230231 +
ggaaataggatagtttagttca

SEQ ID NO: 85410 - DNA, 22 bp, Artificial Sequence
  Synthetic oligonucleotide; TTG chr11 5230210 5230231 5230227 5230232 +
gaaataggatagtttagttcac

SEQ ID NO: 85411 - DNA, 22 bp, Artificial Sequence
  Synthetic oligonucleotide; TTT chr11 5230225 5230246 5230242 5230247 +
agttcactttaaaaagttgtat

SEQ ID NO: 85412 - DNA, 22 bp, Artificial Sequence
  Synthetic oligonucleotide; TTA chr11 5230226 5230247 5230243 5230248 +
gttcactttaaaaagttgtatt

SEQ ID NO: 85413 - DNA, 22 bp, Artificial Sequence
  Synthetic oligonucleotide; TTC chr11 5230230 5230251 5230247 5230252 +
actttaaaaagttgtatttctt

SEQ ID NO: 85414 - DNA, 22 bp, Artificial Sequence
  Synthetic oligonucleotide; CTT chr11 5230234 5230255 5230251 5230256 +
taaaaagttgtatttcttacca

SEQ ID NO: 85415 - DNA, 22 bp, Artificial Sequence
  Synthetic oligonucleotide; TTT chr11 5230235 5230256 5230252 5230257 +
aaaaagttgtatttcttaccaa

SEQ ID NO: 85416 - DNA, 22 bp, Artificial Sequence
  Synthetic oligonucleotide; TTA chr11 5230236 5230257 5230253 5230258 +
aaaagttgtatttcttaccaaa

SEQ ID NO: 85417 - DNA, 22 bp, Artificial Sequence
  Synthetic oligonucleotide; TTG chr11 5230244 5230265 5230261 5230266 +
tatttcttaccaaaaagcaata

SEQ ID NO: 85418 - DNA, 22 bp, Artificial Sequence
  Synthetic oligonucleotide; TTT chr11 5230249 5230270 5230266 5230271 +
cttaccaaaaagcaataaagtc

SEQ ID NO: 85419 - DNA, 22 bp, Artificial Sequence
  Synthetic oligonucleotide; TTC chr11 5230250 5230271 5230267 5230272 +
ttaccaaaaagcaataaagtca

SEQ ID NO: 85420 - DNA, 22 bp, Artificial Sequence
  Synthetic oligonucleotide; CTT chr11 5230252 5230273 5230269 5230274 +
accaaaaagcaataaagtcaac

SEQ ID NO: 85421 - DNA, 22 bp, Artificial Sequence
  Synthetic oligonucleotide; TTA chr11 5230253 5230274 5230270 5230275 +
ccaaaaagcaataaagtcaaca

SEQ ID NO: 85422 - DNA, 22 bp, Artificial Sequence
  Synthetic oligonucleotide; CTT chr11 5230287 5230308 5230304 5230309 +
tgctaaagtatatgcataatta

SEQ ID NO: 85423 - DNA, 22 bp, Artificial Sequence
  Synthetic oligonucleotide; TTT chr11 5230288 5230309 5230305 5230310 +
gctaaagtatatgcataattat

SEQ ID NO: 85424 - DNA, 22 bp, Artificial Sequence
  Synthetic oligonucleotide; TTG chr11 5230289 5230310 5230306 5230311 +
ctaaagtatatgcataattatt

SEQ ID NO: 85425 - DNA, 22 bp, Artificial Sequence
  Synthetic oligonucleotide; CTA chr11 5230292 5230313 5230309 5230314 +
aagtatatgcataattattaca

SEQ ID NO: 85426 - DNA, 22 bp, Artificial Sequence
  Synthetic oligonucleotide; TTA chr11 5230309 5230330 5230326 5230331 +
ttacagaaaaatttatatttca

SEQ ID NO: 85427 - DNA, 22 bp, Artificial Sequence
  Synthetic oligonucleotide; TTA chr11 5230312 5230333 5230329 5230334 +
cagaaaaatttatatttcagtc

SEQ ID NO: 85428 - DNA, 22 bp, Artificial Sequence
  Synthetic oligonucleotide; TTT chr11 5230323 5230344 5230340 5230345 +
atatttcagtctgcaccttgtt

SEQ ID NO: 85429 - DNA, 22 bp, Artificial Sequence
  Synthetic oligonucleotide; TTA chr11 5230324 5230345 5230341 5230346 +
tatttcagtctgcaccttgttc

SEQ ID NO: 85430 - DNA, 22 bp, Artificial Sequence
  Synthetic oligonucleotide; TTT chr11 5230329 5230350 5230346 5230351 +
cagtctgcaccttgttcattaa

SEQ ID NO: 85431 - DNA, 22 bp, Artificial Sequence
  Synthetic oligonucleotide; TTC chr11 5230330 5230351 5230347 5230352 +
agtctgcaccttgttcattaat

SEQ ID NO: 85432 - DNA, 22 bp, Artificial Sequence
  Synthetic oligonucleotide; CTG chr11 5230336 5230357 5230353 5230358 +
caccttgttcattaatatttcc

SEQ ID NO: 85433 - DNA, 22 bp, Artificial Sequence
  Synthetic oligonucleotide; CTT chr11 5230342 5230363 5230359 5230364 +
gttcattaatatttcctccact

SEQ ID NO: 85434 - DNA, 22 bp, Artificial Sequence
  Synthetic oligonucleotide; TTG chr11 5230343 5230364 5230360 5230365 +
ttcattaatatttcctccactg

SEQ ID NO: 85435 - DNA, 22 bp, Artificial Sequence
  Synthetic oligonucleotide; TTC chr11 5230346 5230367 5230363 5230368 +
attaatatttcctccactgggc

SEQ ID NO: 85436 - DNA, 22 bp, Artificial Sequence
  Synthetic oligonucleotide; TTA chr11 5230350 5230371 5230367 5230372 +
atatttcctccactgggctcag

SEQ ID NO: 85437 - DNA, 22 bp, Artificial Sequence
  Synthetic oligonucleotide; TTT chr11 5230356 5230377 5230373 5230378 +
cctccactgggctcagattttc

SEQ ID NO: 85438 - DNA, 22 bp, Artificial Sequence
  Synthetic oligonucleotide; TTC chr11 5230357 5230378 5230374 5230379 +
ctccactgggctcagattttca

SEQ ID NO: 85439 - DNA, 22 bp, Artificial Sequence
  Synthetic oligonucleotide; CTC chr11 5230360 5230381 5230377 5230382 +
cactgggctcagattttcattc

SEQ ID NO: 85440 - DNA, 22 bp, Artificial Sequence
  Synthetic oligonucleotide; CTG chr11 5230365 5230386 5230382 5230387 +
ggctcagattttcattcagaat

SEQ ID NO: 85441 - DNA, 22 bp, Artificial Sequence
  Synthetic oligonucleotide; CTC chr11 5230370 5230391 5230387 5230392 +
agattttcattcagaattagct

SEQ ID NO: 85442 - DNA, 22 bp, Artificial Sequence
  Synthetic oligonucleotide; TTT chr11 5230376 5230397 5230393 5230398 +
tcattcagaattagcttttttt

SEQ ID NO: 85443 - DNA, 22 bp, Artificial Sequence
  Synthetic oligonucleotide; TTT chr11 5230377 5230398 5230394 5230399 +
cattcagaattagctttttttt

SEQ ID NO: 85444 - DNA, 22 bp, Artificial Sequence
  Synthetic oligonucleotide; TTC chr11 5230378 5230399 5230395 5230400 +
attcagaattagctttttttta

SEQ ID NO: 85445 - DNA, 22 bp, Artificial Sequence
  Synthetic oligonucleotide; TTC chr11 5230382 5230403 5230399 5230404 +
agaattagcttttttttaacct

SEQ ID NO: 85446 - DNA, 22 bp, Artificial Sequence
  Synthetic oligonucleotide; TTA chr11 5230389 5230410 5230406 5230411 +
gcttttttttaacctcattaag

SEQ ID NO: 85447 - DNA, 22 bp, Artificial Sequence
  Synthetic oligonucleotide; CTT chr11 5230393 5230414 5230410 5230415 +
ttttttaacctcattaagtggg

SEQ ID NO: 85448 - DNA, 22 bp, Artificial Sequence
  Synthetic oligonucleotide; TTT chr11 5230394 5230415 5230411 5230416 +
tttttaacctcattaagtgggc

SEQ ID NO: 85449 - DNA, 22 bp, Artificial Sequence
  Synthetic oligonucleotide; TTT chr11 5230395 5230416 5230412 5230417 +
ttttaacctcattaagtgggcc

SEQ ID NO: 85450 - DNA, 22 bp, Artificial Sequence
  Synthetic oligonucleotide; TTT chr11 5230396 5230417 5230413 5230418 +
tttaacctcattaagtgggcca

SEQ ID NO: 85451 - DNA, 22 bp, Artificial Sequence
  Synthetic oligonucleotide; TTT chr11 5230397 5230418 5230414 5230419 +
ttaacctcattaagtgggccat

SEQ ID NO: 85452 - DNA, 22 bp, Artificial Sequence
  Synthetic oligonucleotide; TTT chr11 5230398 5230419 5230415 5230420 +
taacctcattaagtgggccatg

SEQ ID NO: 85453 - DNA, 22 bp, Artificial Sequence
  Synthetic oligonucleotide; TTT chr11 5230399 5230420 5230416 5230421 +
aacctcattaagtgggccatgg

SEQ ID NO: 85454 - DNA, 22 bp, Artificial Sequence
  Synthetic oligonucleotide; TTA chr11 5230400 5230421 5230417 5230422 +
acctcattaagtgggccatggt

SEQ ID NO: 85455 - DNA, 22 bp, Artificial Sequence
  Synthetic oligonucleotide; CTC chr11 5230405 5230426 5230422 5230427 +
attaagtgggccatggtgtcaa

SEQ ID NO: 85456 - DNA, 22 bp, Artificial Sequence
  Synthetic oligonucleotide; TTA chr11 5230409 5230430 5230426 5230431 +
agtgggccatggtgtcaattta

SEQ ID NO: 85457 - DNA, 22 bp, Artificial Sequence
  Synthetic oligonucleotide; TTT chr11 5230430 5230451 5230447 5230452 +
atggagagcagaggtacagtct

SEQ ID NO: 85458 - DNA, 22 bp, Artificial Sequence
  Synthetic oligonucleotide; TTA chr11 5230431 5230452 5230448 5230453 +
tggagagcagaggtacagtctt

SEQ ID NO: 85459 - DNA, 22 bp, Artificial Sequence
  Synthetic oligonucleotide; CTT chr11 5230453 5230474 5230470 5230475 +
cagataaatttgagattgcatc

SEQ ID NO: 85460 - DNA, 22 bp, Artificial Sequence
  Synthetic oligonucleotide; TTC chr11 5230454 5230475 5230471 5230476 +
agataaatttgagattgcatct

SEQ ID NO: 85461 - DNA, 22 bp, Artificial Sequence
  Synthetic oligonucleotide; TTT chr11 5230464 5230485 5230481 5230486 +
gagattgcatctctttagaggt

SEQ ID NO: 85462 - DNA, 22 bp, Artificial Sequence
  Synthetic oligonucleotide; TTG chr11 5230465 5230486 5230482 5230487 +
agattgcatctctttagaggta

SEQ ID NO: 85463 - DNA, 22 bp, Artificial Sequence
  Synthetic oligonucleotide; TTG chr11 5230471 5230492 5230488 5230493 +
catctctttagaggtagaatct

SEQ ID NO: 85464 - DNA, 22 bp, Artificial Sequence
  Synthetic oligonucleotide; CTC chr11 5230477 5230498 5230494 5230499 +
tttagaggtagaatcttggctt

SEQ ID NO: 85465 - DNA, 22 bp, Artificial Sequence
  Synthetic oligonucleotide; CTT chr11 5230479 5230500 5230496 5230501 +
tagaggtagaatcttggcttca

SEQ ID NO: 85466 - DNA, 22 bp, Artificial Sequence
  Synthetic oligonucleotide; TTT chr11 5230480 5230501 5230497 5230502 +
agaggtagaatcttggcttcag

SEQ ID NO: 85467 - DNA, 22 bp, Artificial Sequence
  Synthetic oligonucleotide; TTA chr11 5230481 5230502 5230498 5230503 +
gaggtagaatcttggcttcagt

SEQ ID NO: 85468 - DNA, 22 bp, Artificial Sequence
  Synthetic oligonucleotide; CTT chr11 5230494 5230515 5230511 5230516 +
ggcttcagtctgaacacccttt

SEQ ID NO: 85469 - DNA, 22 bp, Artificial Sequence
  Synthetic oligonucleotide; TTG chr11 5230495 5230516 5230512 5230517 +
gcttcagtctgaacacccttta

SEQ ID NO: 85470 - DNA, 22 bp, Artificial Sequence
  Synthetic oligonucleotide; CTT chr11 5230499 5230520 5230516 5230521 +
cagtctgaacaccctttacaaa

SEQ ID NO: 85471 - DNA, 22 bp, Artificial Sequence
  Synthetic oligonucleotide; TTC chr11 5230500 5230521 5230517 5230522 +
agtctgaacaccctttacaaac

SEQ ID NO: 85472 - DNA, 22 bp, Artificial Sequence
  Synthetic oligonucleotide; CTG chr11 5230506 5230527 5230523 5230528 +
aacaccctttacaaacatgtag

SEQ ID NO: 85473 - DNA, 22 bp, Artificial Sequence
  Synthetic oligonucleotide; CTT chr11 5230515 5230536 5230532 5230537 +
tacaaacatgtaggcattaatt

SEQ ID NO: 85474 - DNA, 22 bp, Artificial Sequence
  Synthetic oligonucleotide; TTT chr11 5230516 5230537 5230533 5230538 +
acaaacatgtaggcattaattc

SEQ ID NO: 85475 - DNA, 22 bp, Artificial Sequence
  Synthetic oligonucleotide; TTA chr11 5230517 5230538 5230534 5230539 +
caaacatgtaggcattaattca

SEQ ID NO: 85476 - DNA, 22 bp, Artificial Sequence
  Synthetic oligonucleotide; TTA chr11 5230534 5230555 5230551 5230556 +
attcagaggactgctctgaagc

SEQ ID NO: 85477 - DNA, 22 bp, Artificial Sequence
  Synthetic oligonucleotide; TTC chr11 5230538 5230559 5230555 5230560 +
agaggactgctctgaagctcaa

SEQ ID NO: 85478 - DNA, 22 bp, Artificial Sequence
  Synthetic oligonucleotide; CTG chr11 5230547 5230568 5230564 5230569 +
ctctgaagctcaagagatggat

SEQ ID NO: 85479 - DNA, 22 bp, Artificial Sequence
  Synthetic oligonucleotide; CTC chr11 5230550 5230571 5230567 5230572 +
tgaagctcaagagatggatgat

SEQ ID NO: 85480 - DNA, 22 bp, Artificial Sequence
  Synthetic oligonucleotide; CTG chr11 5230552 5230573 5230569 5230574 +
aagctcaagagatggatgattt

SEQ ID NO: 85481 - DNA, 22 bp, Artificial Sequence
  Synthetic oligonucleotide; CTC chr11 5230558 5230579 5230575 5230580 +
aagagatggatgatttaggaga

SEQ ID NO: 85482 - DNA, 22 bp, Artificial Sequence
  Synthetic oligonucleotide; TTT chr11 5230574 5230595 5230591 5230596 +
aggagactattaggcttaattc

SEQ ID NO: 85483 - DNA, 22 bp, Artificial Sequence
  Synthetic oligonucleotide; TTA chr11 5230575 5230596 5230592 5230597 +
ggagactattaggcttaattct

SEQ ID NO: 85484 - DNA, 22 bp, Artificial Sequence
  Synthetic oligonucleotide; CTA chr11 5230583 5230604 5230600 5230605 +
ttaggcttaattctcctgacat

SEQ ID NO: 85485 - DNA, 22 bp, Artificial Sequence
  Synthetic oligonucleotide; TTA chr11 5230586 5230607 5230603 5230608 +
ggcttaattctcctgacattaa

SEQ ID NO: 85486 - DNA, 22 bp, Artificial Sequence
  Synthetic oligonucleotide; CTT chr11 5230591 5230612 5230608 5230613 +
aattctcctgacattaaattat

SEQ ID NO: 85487 - DNA, 22 bp, Artificial Sequence
  Synthetic oligonucleotide; TTA chr11 5230592 5230613 5230609 5230614 +
attctcctgacattaaattatt

SEQ ID NO: 85488 - DNA, 22 bp, Artificial Sequence
  Synthetic oligonucleotide; TTC chr11 5230596 5230617 5230613 5230618 +
tcctgacattaaattattttat

SEQ ID NO: 85489 - DNA, 22 bp, Artificial Sequence
  Synthetic oligonucleotide; CTC chr11 5230598 5230619 5230615 5230620 +
ctgacattaaattattttattg

SEQ ID NO: 85490 - DNA, 22 bp, Artificial Sequence
  Synthetic oligonucleotide; CTG chr11 5230601 5230622 5230618 5230623 +
acattaaattattttattgaaa

SEQ ID NO: 85491 - DNA, 22 bp, Artificial Sequence
  Synthetic oligonucleotide; TTA chr11 5230607 5230628 5230624 5230629 +
aattattttattgaaaaatttt

SEQ ID NO: 85492 - DNA, 22 bp, Artificial Sequence
  Synthetic oligonucleotide; TTA chr11 5230612 5230633 5230629 5230634 +
ttttattgaaaaattttcatga

SEQ ID NO: 85493 - DNA, 22 bp, Artificial Sequence
  Synthetic oligonucleotide; TTT chr11 5230615 5230636 5230632 5230637 +
tattgaaaaattttcatgaact

SEQ ID NO: 85494 - DNA, 22 bp, Artificial Sequence
  Synthetic oligonucleotide; TTT chr11 5230616 5230637 5230633 5230638 +
attgaaaaattttcatgaactc

SEQ ID NO: 85495 - DNA, 22 bp, Artificial Sequence
  Synthetic oligonucleotide; TTA chr11 5230617 5230638 5230634 5230639 +
ttgaaaaattttcatgaactca

SEQ ID NO: 85496 - DNA, 22 bp, Artificial Sequence
  Synthetic oligonucleotide; TTG chr11 5230620 5230641 5230637 5230642 +
aaaaattttcatgaactcaaat

SEQ ID NO: 85497 - DNA, 22 bp, Artificial Sequence
  Synthetic oligonucleotide; TTT chr11 5230628 5230649 5230645 5230650 +
tcatgaactcaaattcacatta

SEQ ID NO: 85498 - DNA, 22 bp, Artificial Sequence
  Synthetic oligonucleotide; TTT chr11 5230629 5230650 5230646 5230651 +
catgaactcaaattcacattat

SEQ ID NO: 85499 - DNA, 22 bp, Artificial Sequence
  Synthetic oligonucleotide; TTC chr11 5230630 5230651 5230647 5230652 +
atgaactcaaattcacattatt

SEQ ID NO: 85500 - DNA, 22 bp, Artificial Sequence
  Synthetic oligonucleotide; CTC chr11 5230638 5230659 5230655 5230660 +
aaattcacattattacgtcctc

SEQ ID NO: 85501 - DNA, 22 bp, Artificial Sequence
  Synthetic oligonucleotide; TTC chr11 5230644 5230665 5230661 5230666 +
acattattacgtcctctcttcc

SEQ ID NO: 85502 - DNA, 22 bp, Artificial Sequence
  Synthetic oligonucleotide; TTA chr11 5230650 5230671 5230667 5230672 +
ttacgtcctctcttcccttcct

SEQ ID NO: 85503 - DNA, 22 bp, Artificial Sequence
  Synthetic oligonucleotide; TTA chr11 5230653 5230674 5230670 5230675 +
cgtcctctcttcccttcctctc

SEQ ID NO: 85504 - DNA, 22 bp, Artificial Sequence
  Synthetic oligonucleotide; CTC chr11 5230660 5230681 5230677 5230682 +
tcttcccttcctctctccctct

SEQ ID NO: 85505 - DNA, 22 bp, Artificial Sequence
  Synthetic oligonucleotide; CTC chr11 5230662 5230683 5230679 5230684 +
ttcccttcctctctccctctct

SEQ ID NO: 85506 - DNA, 22 bp, Artificial Sequence
  Synthetic oligonucleotide; CTT chr11 5230664 5230685 5230681 5230686 +
cccttcctctctccctctcttt

SEQ ID NO: 85507 - DNA, 22 bp, Artificial Sequence
  Synthetic oligonucleotide; TTC chr11 5230665 5230686 5230682 5230687 +
ccttcctctctccctctctttc

SEQ ID NO: 85508 - DNA, 22 bp, Artificial Sequence
  Synthetic oligonucleotide; CTT chr11 5230669 5230690 5230686 5230691 +
cctctctccctctctttcacac

SEQ ID NO: 85509 - DNA, 22 bp, Artificial Sequence
  Synthetic oligonucleotide; TTC chr11 5230670 5230691 5230687 5230692 +
ctctctccctctctttcacaca

SEQ ID NO: 85510 - DNA, 22 bp, Artificial Sequence
  Synthetic oligonucleotide; CTC chr11 5230673 5230694 5230690 5230695 +
tctccctctctttcacacacac

SEQ ID NO: 85511 - DNA, 22 bp, Artificial Sequence
  Synthetic oligonucleotide; CTC chr11 5230675 5230696 5230692 5230697 +
tccctctctttcacacacacac

SEQ ID NO: 85512 - DNA, 22 bp, Artificial Sequence
  Synthetic oligonucleotide; CTC chr11 5230677 5230698 5230694 5230699 +
cctctctttcacacacacacac

SEQ ID NO: 85513 - DNA, 22 bp, Artificial Sequence
  Synthetic oligonucleotide; CTC chr11 5230681 5230702 5230698 5230703 +
tctttcacacacacacacaccc

SEQ ID NO: 85514 - DNA, 22 bp, Artificial Sequence
  Synthetic oligonucleotide; CTC chr11 5230683 5230704 5230700 5230705 +
tttcacacacacacacaccctt

SEQ ID NO: 85515 - DNA, 22 bp, Artificial Sequence
  Synthetic oligonucleotide; CTT chr11 5230685 5230706 5230702 5230707 +
tcacacacacacacaccctttc

SEQ ID NO: 85516 - DNA, 22 bp, Artificial Sequence
  Synthetic oligonucleotide; TTT chr11 5230686 5230707 5230703 5230708 +
cacacacacacacaccctttca

SEQ ID NO: 85517 - DNA, 22 bp, Artificial Sequence
  Synthetic oligonucleotide; TTC chr11 5230687 5230708 5230704 5230709 +
acacacacacacaccctttcat

SEQ ID NO: 85518 - DNA, 22 bp, Artificial Sequence
  Synthetic oligonucleotide; CTT chr11 5230705 5230726 5230722 5230727 +
tcattcagacatactgaacata

SEQ ID NO: 85519 - DNA, 22 bp, Artificial Sequence
  Synthetic oligonucleotide; TTT chr11 5230706 5230727 5230723 5230728 +
cattcagacatactgaacatag

SEQ ID NO: 85520 - DNA, 22 bp, Artificial Sequence
  Synthetic oligonucleotide; TTC chr11 5230707 5230728 5230724 5230729 +
attcagacatactgaacatagt

SEQ ID NO: 85521 - DNA, 22 bp, Artificial Sequence
  Synthetic oligonucleotide; TTC chr11 5230711 5230732 5230728 5230733 +
agacatactgaacatagtttat

SEQ ID NO: 85522 - DNA, 22 bp, Artificial Sequence
  Synthetic oligonucleotide; CTG chr11 5230721 5230742 5230738 5230743 +
aacatagtttataaagcaacgc

SEQ ID NO: 85523 - DNA, 22 bp, Artificial Sequence
  Synthetic oligonucleotide; TTT chr11 5230731 5230752 5230748 5230753 +
ataaagcaacgccatagtgaga

SEQ ID NO: 85524 - DNA, 22 bp, Artificial Sequence
  Synthetic oligonucleotide; TTA chr11 5230732 5230753 5230749 5230754 +
taaagcaacgccatagtgagaa

SEQ ID NO: 85525 - DNA, 22 bp, Artificial Sequence
  Synthetic oligonucleotide; TTT chr11 5230771 5230792 5230788 5230793 +
gataaattatcaaataaaatta

SEQ ID NO: 85526 - DNA, 22 bp, Artificial Sequence
  Synthetic oligonucleotide; TTG chr11 5230772 5230793 5230789 5230794 +
ataaattatcaaataaaattaa

SEQ ID NO: 85527 - DNA, 22 bp, Artificial Sequence
  Synthetic oligonucleotide; TTA chr11 5230780 5230801 5230797 5230802 +
tcaaataaaattaaagccaaat

SEQ ID NO: 85528 - DNA, 22 bp, Artificial Sequence
  Synthetic oligonucleotide; TTA chr11 5230793 5230814 5230810 5230815 +
aagccaaatcttgaggaattaa

SEQ ID NO: 85529 - DNA, 22 bp, Artificial Sequence
  Synthetic oligonucleotide; CTT chr11 5230805 5230826 5230822 5230827 +
gaggaattaattccattcctat

SEQ ID NO: 85530 - DNA, 22 bp, Artificial Sequence
  Synthetic oligonucleotide; TTG chr11 5230806 5230827 5230823 5230828 +
aggaattaattccattcctata

SEQ ID NO: 85531 - DNA, 22 bp, Artificial Sequence
  Synthetic oligonucleotide; TTA chr11 5230814 5230835 5230831 5230836 +
attccattcctatactttgttt

SEQ ID NO: 85532 - DNA, 22 bp, Artificial Sequence
  Synthetic oligonucleotide; TTC chr11 5230818 5230839 5230835 5230840 +
cattcctatactttgttttaac

SEQ ID NO: 85533 - DNA, 22 bp, Artificial Sequence
  Synthetic oligonucleotide; TTC chr11 5230823 5230844 5230840 5230845 +
ctatactttgttttaactttca

SEQ ID NO: 85534 - DNA, 22 bp, Artificial Sequence
  Synthetic oligonucleotide; CTA chr11 5230826 5230847 5230843 5230848 +
tactttgttttaactttcattt

SEQ ID NO: 85535 - DNA, 22 bp, Artificial Sequence
  Synthetic oligonucleotide; CTT chr11 5230831 5230852 5230848 5230853 +
tgttttaactttcattttaaat

SEQ ID NO: 85536 - DNA, 22 bp, Artificial Sequence
  Synthetic oligonucleotide; TTT chr11 5230832 5230853 5230849 5230854 +
gttttaactttcattttaaatt

SEQ ID NO: 85537 - DNA, 22 bp, Artificial Sequence
  Synthetic oligonucleotide; TTG chr11 5230833 5230854 5230850 5230855 +
ttttaactttcattttaaattt

SEQ ID NO: 85538 - DNA, 22 bp, Artificial Sequence
  Synthetic oligonucleotide; TTT chr11 5230836 5230857 5230853 5230858 +
taactttcattttaaatttggg

SEQ ID NO: 85539 - DNA, 22 bp, Artificial Sequence
  Synthetic oligonucleotide; TTT chr11 5230837 5230858 5230854 5230859 +
aactttcattttaaatttgggg

SEQ ID NO: 85540 - DNA, 22 bp, Artificial Sequence
  Synthetic oligonucleotide; TTA chr11 5230838 5230859 5230855 5230860 +
actttcattttaaatttggggg

SEQ ID NO: 85541 - DNA, 22 bp, Artificial Sequence
  Synthetic oligonucleotide; CTT chr11 5230842 5230863 5230859 5230864 +
tcattttaaatttgggggtaca

SEQ ID NO: 85542 - DNA, 22 bp, Artificial Sequence
  Synthetic oligonucleotide; TTT chr11 5230843 5230864 5230860 5230865 +
cattttaaatttgggggtacat

SEQ ID NO: 85543 - DNA, 22 bp, Artificial Sequence
  Synthetic oligonucleotide; TTC chr11 5230844 5230865 5230861 5230866 +
attttaaatttgggggtacatg

SEQ ID NO: 85544 - DNA, 22 bp, Artificial Sequence
  Synthetic oligonucleotide; TTT chr11 5230848 5230869 5230865 5230870 +
taaatttgggggtacatgtaca

SEQ ID NO: 85545 - DNA, 22 bp, Artificial Sequence
  Synthetic oligonucleotide; TTT chr11 5230849 5230870 5230866 5230871 +
aaatttgggggtacatgtacaa

SEQ ID NO: 85546 - DNA, 22 bp, Artificial Sequence
  Synthetic oligonucleotide; TTA chr11 5230850 5230871 5230867 5230872 +
aatttgggggtacatgtacaag

SEQ ID NO: 85547 - DNA, 22 bp, Artificial Sequence
  Synthetic oligonucleotide; TTT chr11 5230855 5230876 5230872 5230877 +
gggggtacatgtacaagttata

SEQ ID NO: 85548 - DNA, 22 bp, Artificial Sequence
  Synthetic oligonucleotide; TTG chr11 5230856 5230877 5230873 5230878 +
ggggtacatgtacaagttatat

SEQ ID NO: 85549 - DNA, 22 bp, Artificial Sequence
  Synthetic oligonucleotide; TTA chr11 5230875 5230896 5230892 5230897 +
tataggtaaattgcatatcact

SEQ ID NO: 85550 - DNA, 22 bp, Artificial Sequence
  Synthetic oligonucleotide; TTG chr11 5230888 5230909 5230905 5230910 +
catatcactgggtcttgatgta

SEQ ID NO: 85551 - DNA, 22 bp, Artificial Sequence
  Synthetic oligonucleotide; CTG chr11 5230898 5230919 5230915 5230920 +
ggtcttgatgtacagattattt

SEQ ID NO: 85552 - DNA, 22 bp, Artificial Sequence
  Synthetic oligonucleotide; CTT chr11 5230904 5230925 5230921 5230926 +
gatgtacagattatttcatcac

SEQ ID NO: 85553 - DNA, 22 bp, Artificial Sequence
  Synthetic oligonucleotide; TTG chr11 5230905 5230926 5230922 5230927 +
atgtacagattatttcatcact

SEQ ID NO: 85554 - DNA, 22 bp, Artificial Sequence
  Synthetic oligonucleotide; TTA chr11 5230917 5230938 5230934 5230939 +
tttcatcactcagtgatgaact

SEQ ID NO: 85555 - DNA, 22 bp, Artificial Sequence
  Synthetic oligonucleotide; TTT chr11 5230920 5230941 5230937 5230942 +
catcactcagtgatgaacttaa

SEQ ID NO: 85556 - DNA, 22 bp, Artificial Sequence
  Synthetic oligonucleotide; TTC chr11 5230921 5230942 5230938 5230943 +
atcactcagtgatgaacttaat

SEQ ID NO: 85557 - DNA, 22 bp, Artificial Sequence
  Synthetic oligonucleotide; CTC chr11 5230928 5230949 5230945 5230950 +
agtgatgaacttaatacccaat

SEQ ID NO: 85558 - DNA, 22 bp, Artificial Sequence
  Synthetic oligonucleotide; CTT chr11 5230940 5230961 5230957 5230962 +
aatacccaataggttctttttc

SEQ ID NO: 85559 - DNA, 22 bp, Artificial Sequence
  Synthetic oligonucleotide; TTA chr11 5230941 5230962 5230958 5230963 +
atacccaataggttctttttca

SEQ ID NO: 85560 - DNA, 22 bp, Artificial Sequence
  Synthetic oligonucleotide; TTC chr11 5230956 5230977 5230973 5230978 +
tttttcatcgtctccctcttcc

SEQ ID NO: 85561 - DNA, 22 bp, Artificial Sequence
  Synthetic oligonucleotide; CTT chr11 5230958 5230979 5230975 5230980 +
tttcatcgtctccctcttccca

SEQ ID NO: 85562 - DNA, 22 bp, Artificial Sequence
  Synthetic oligonucleotide; TTT chr11 5230959 5230980 5230976 5230981 +
ttcatcgtctccctcttcccac

SEQ ID NO: 85563 - DNA, 22 bp, Artificial Sequence
  Synthetic oligonucleotide; TTT chr11 5230960 5230981 5230977 5230982 +
tcatcgtctccctcttcccacc

SEQ ID NO: 85564 - DNA, 22 bp, Artificial Sequence
  Synthetic oligonucleotide; TTT chr11 5230961 5230982 5230978 5230983 +
catcgtctccctcttcccaccc

SEQ ID NO: 85565 - DNA, 22 bp, Artificial Sequence
  Synthetic oligonucleotide; TTC chr11 5230962 5230983 5230979 5230984 +
atcgtctccctcttcccaccct

SEQ ID NO: 85566 - DNA, 22 bp, Artificial Sequence
  Synthetic oligonucleotide; CTC chr11 5230970 5230991 5230987 5230992 +
cctcttcccaccctcaaccctc

SEQ ID NO: 85567 - DNA, 22 bp, Artificial Sequence
  Synthetic oligonucleotide; CTC chr11 5230974 5230995 5230991 5230996 +
ttcccaccctcaaccctcaagt

SEQ ID NO: 85568 - DNA, 22 bp, Artificial Sequence
  Synthetic oligonucleotide; CTT chr11 5230976 5230997 5230993 5230998 +
cccaccctcaaccctcaagtag

SEQ ID NO: 85569 - DNA, 22 bp, Artificial Sequence
  Synthetic oligonucleotide; TTC chr11 5230977 5230998 5230994 5230999 +
ccaccctcaaccctcaagtagg

SEQ ID NO: 85570 - DNA, 22 bp, Artificial Sequence
  Synthetic oligonucleotide; CTC chr11 5230985 5231006 5231002 5231007 +
aaccctcaagtaggcctgggtg

SEQ ID NO: 85571 - DNA, 22 bp, Artificial Sequence
  Synthetic oligonucleotide; CTC chr11 5230992 5231013 5231009 5231014 +
aagtaggcctgggtgtctgttg

SEQ ID NO: 85572 - DNA, 22 bp, Artificial Sequence
  Synthetic oligonucleotide; CTG chr11 5231003 5231024 5231020 5231025 +
ggtgtctgttgatctatttttt

SEQ ID NO: 85573 - DNA, 22 bp, Artificial Sequence
  Synthetic oligonucleotide; CTG chr11 5231011 5231032 5231028 5231033 +
ttgatctattttttgtgtccat

SEQ ID NO: 85574 - DNA, 22 bp, Artificial Sequence
  Synthetic oligonucleotide; TTG chr11 5231014 5231035 5231031 5231036 +
atctattttttgtgtccatgtg

SEQ ID NO: 85575 - DNA, 22 bp, Artificial Sequence
  Synthetic oligonucleotide; CTA chr11 5231019 5231040 5231036 5231041 +
ttttttgtgtccatgtgtatca

SEQ ID NO: 85576 - DNA, 22 bp, Artificial Sequence
  Synthetic oligonucleotide; TTT chr11 5231022 5231043 5231039 5231044 +
tttgtgtccatgtgtatcatca

SEQ ID NO: 85577 - DNA, 22 bp, Artificial Sequence
  Synthetic oligonucleotide; TTT chr11 5231023 5231044 5231040 5231045 +
ttgtgtccatgtgtatcatcat

SEQ ID NO: 85578 - DNA, 22 bp, Artificial Sequence
  Synthetic oligonucleotide; TTT chr11 5231024 5231045 5231041 5231046 +
tgtgtccatgtgtatcatcatt

SEQ ID NO: 85579 - DNA, 22 bp, Artificial Sequence
  Synthetic oligonucleotide; TTT chr11 5231025 5231046 5231042 5231047 +
gtgtccatgtgtatcatcattt

SEQ ID NO: 85580 - DNA, 22 bp, Artificial Sequence
  Synthetic oligonucleotide; TTG chr11 5231026 5231047 5231043 5231048 +
tgtccatgtgtatcatcattta

SEQ ID NO: 85581 - DNA, 22 bp, Artificial Sequence
  Synthetic oligonucleotide; TTT chr11 5231047 5231068 5231064 5231069 +
agctcccacactcctagactct

SEQ ID NO: 85582 - DNA, 22 bp, Artificial Sequence
  Synthetic oligonucleotide; TTA chr11 5231048 5231069 5231065 5231070 +
gctcccacactcctagactctt

SEQ ID NO: 85583 - DNA, 22 bp, Artificial Sequence
  Synthetic oligonucleotide; CTC chr11 5231052 5231073 5231069 5231074 +
ccacactcctagactcttacaa

SEQ ID NO: 85584 - DNA, 22 bp, Artificial Sequence
  Synthetic oligonucleotide; CTC chr11 5231060 5231081 5231077 5231082 +
ctagactcttacaaaagctcta

SEQ ID NO: 85585 - DNA, 22 bp, Artificial Sequence
  Synthetic oligonucleotide; CTA chr11 5231063 5231084 5231080 5231085 +
gactcttacaaaagctctactc

SEQ ID NO: 85586 - DNA, 22 bp, Artificial Sequence
  Synthetic oligonucleotide; CTC chr11 5231068 5231089 5231085 5231090 +
ttacaaaagctctactctaaca

SEQ ID NO: 85587 - DNA, 22 bp, Artificial Sequence
  Synthetic oligonucleotide; CTT chr11 5231070 5231091 5231087 5231092 +
acaaaagctctactctaacaaa

SEQ ID NO: 85588 - DNA, 22 bp, Artificial Sequence
  Synthetic oligonucleotide; TTA chr11 5231071 5231092 5231088 5231093 +
caaaagctctactctaacaaat

SEQ ID NO: 85589 - DNA, 22 bp, Artificial Sequence
  Synthetic oligonucleotide; CTC chr11 5231080 5231101 5231097 5231102 +
tactctaacaaataattttaat

SEQ ID NO: 85590 - DNA, 22 bp, Artificial Sequence
  Synthetic oligonucleotide; CTA chr11 5231082 5231103 5231099 5231104 +
ctctaacaaataattttaatat

SEQ ID NO: 85591 - DNA, 22 bp, Artificial Sequence
  Synthetic oligonucleotide; CTC chr11 5231085 5231106 5231102 5231107 +
taacaaataattttaatataac

SEQ ID NO: 85592 - DNA, 22 bp, Artificial Sequence
  Synthetic oligonucleotide; CTA chr11 5231087 5231108 5231104 5231109 +
acaaataattttaatataacaa

SEQ ID NO: 85593 - DNA, 22 bp, Artificial Sequence
  Synthetic oligonucleotide; TTT chr11 5231098 5231119 5231115 5231120 +
taatataacaacaaggtgccaa

SEQ ID NO: 85594 - DNA, 22 bp, Artificial Sequence
  Synthetic oligonucleotide; TTT chr11 5231099 5231120 5231116 5231121 +
aatataacaacaaggtgccaag

SEQ ID NO: 85595 - DNA, 22 bp, Artificial Sequence
  Synthetic oligonucleotide; TTA chr11 5231100 5231121 5231117 5231122 +
atataacaacaaggtgccaagt

SEQ ID NO: 85596 - DNA, 22 bp, Artificial Sequence
  Synthetic oligonucleotide; CTT chr11 5231125 5231146 5231142 5231147 +
ttttcatctcttgacctcctca

SEQ ID NO: 85597 - DNA, 22 bp, Artificial Sequence
  Synthetic oligonucleotide; TTT chr11 5231126 5231147 5231143 5231148 +
tttcatctcttgacctcctcat

SEQ ID NO: 85598 - DNA, 22 bp, Artificial Sequence
  Synthetic oligonucleotide; TTT chr11 5231127 5231148 5231144 5231149 +
ttcatctcttgacctcctcatc

SEQ ID NO: 85599 - DNA, 22 bp, Artificial Sequence
  Synthetic oligonucleotide; TTT chr11 5231128 5231149 5231145 5231150 +
tcatctcttgacctcctcatct

SEQ ID NO: 85600 - DNA, 22 bp, Artificial Sequence
  Synthetic oligonucleotide; TTT chr11 5231129 5231150 5231146 5231151 +
catctcttgacctcctcatctt

SEQ ID NO: 85601 - DNA, 22 bp, Artificial Sequence
  Synthetic oligonucleotide; TTC chr11 5231130 5231151 5231147 5231152 +
atctcttgacctcctcatcttc

SEQ ID NO: 85602 - DNA, 22 bp, Artificial Sequence
  Synthetic oligonucleotide; CTC chr11 5231135 5231156 5231152 5231157 +
ttgacctcctcatcttcaatat

SEQ ID NO: 85603 - DNA, 22 bp, Artificial Sequence
  Synthetic oligonucleotide; CTT chr11 5231137 5231158 5231154 5231159 +
gacctcctcatcttcaatatga

SEQ ID NO: 85604 - DNA, 22 bp, Artificial Sequence
  Synthetic oligonucleotide; TTG chr11 5231138 5231159 5231155 5231160 +
acctcctcatcttcaatatgaa

SEQ ID NO: 85605 - DNA, 22 bp, Artificial Sequence
  Synthetic oligonucleotide; CTC chr11 5231143 5231164 5231160 5231165 +
ctcatcttcaatatgaagatag

SEQ ID NO: 85606 - DNA, 22 bp, Artificial Sequence
  Synthetic oligonucleotide; CTC chr11 5231146 5231167 5231163 5231168 +
atcttcaatatgaagatagcaa

SEQ ID NO: 85607 - DNA, 22 bp, Artificial Sequence
  Synthetic oligonucleotide; CTT chr11 5231151 5231172 5231168 5231173 +
caatatgaagatagcaatgcct

SEQ ID NO: 85608 - DNA, 22 bp, Artificial Sequence
  Synthetic oligonucleotide; TTC chr11 5231152 5231173 5231169 5231174 +
aatatgaagatagcaatgccta

SEQ ID NO: 85609 - DNA, 22 bp, Artificial Sequence
  Synthetic oligonucleotide; CTA chr11 5231174 5231195 5231191 5231196 +
gcatatagtaattgtgtgtgct

SEQ ID NO: 85610 - DNA, 22 bp, Artificial Sequence
  Synthetic oligonucleotide; TTG chr11 5231188 5231209 5231205 5231210 +
tgtgtgctcggcacatgtccca

SEQ ID NO: 85611 - DNA, 22 bp, Artificial Sequence
  Synthetic oligonucleotide; CTC chr11 5231197 5231218 5231214 5231219 +
ggcacatgtcccatccaggtga

SEQ ID NO: 85612 - DNA, 22 bp, Artificial Sequence
  Synthetic oligonucleotide; TTC chr11 5231224 5231245 5231241 5231246 +
tcatgaattctctggtatttgg

SEQ ID NO: 85613 - DNA, 22 bp, Artificial Sequence
  Synthetic oligonucleotide; CTC chr11 5231226 5231247 5231243 5231248 +
atgaattctctggtatttggat

SEQ ID NO: 85614 - DNA, 22 bp, Artificial Sequence
  Synthetic oligonucleotide; TTC chr11 5231234 5231255 5231251 5231256 +
tctggtatttggatttttaggg

SEQ ID NO: 85615 - DNA, 22 bp, Artificial Sequence
  Synthetic oligonucleotide; CTC chr11 5231236 5231257 5231253 5231258 +
tggtatttggatttttagggcc

SEQ ID NO: 85616 - DNA, 22 bp, Artificial Sequence
  Synthetic oligonucleotide; CTG chr11 5231238 5231259 5231255 5231260 +
gtatttggatttttagggccaa

SEQ ID NO: 85617 - DNA, 22 bp, Artificial Sequence
  Synthetic oligonucleotide; TTT chr11 5231244 5231265 5231261 5231266 +
ggatttttagggccaacatctt

SEQ ID NO: 85618 - DNA, 22 bp, Artificial Sequence
  Synthetic oligonucleotide; TTG chr11 5231245 5231266 5231262 5231267 +
gatttttagggccaacatcttg

SEQ ID NO: 85619 - DNA, 22 bp, Artificial Sequence
  Synthetic oligonucleotide; TTT chr11 5231250 5231271 5231267 5231272 +
ttagggccaacatcttgcctag

SEQ ID NO: 85620 - DNA, 22 bp, Artificial Sequence
  Synthetic oligonucleotide; TTT chr11 5231251 5231272 5231268 5231273 +
tagggccaacatcttgcctaga

SEQ ID NO: 85621 - DNA, 22 bp, Artificial Sequence
  Synthetic oligonucleotide; TTT chr11 5231252 5231273 5231269 5231274 +
agggccaacatcttgcctagac

SEQ ID NO: 85622 - DNA, 22 bp, Artificial Sequence
  Synthetic oligonucleotide; TTA chr11 5231253 5231274 5231270 5231275 +
gggccaacatcttgcctagact

SEQ ID NO: 85623 - DNA, 22 bp, Artificial Sequence
  Synthetic oligonucleotide; CTT chr11 5231266 5231287 5231283 5231288 +
gcctagactcactgactacttc

SEQ ID NO: 85624 - DNA, 22 bp, Artificial Sequence
  Synthetic oligonucleotide; TTG chr11 5231267 5231288 5231284 5231289 +
cctagactcactgactacttct

SEQ ID NO: 85625 - DNA, 22 bp, Artificial Sequence
  Synthetic oligonucleotide; CTA chr11 5231271 5231292 5231288 5231293 +
gactcactgactacttctaatg

SEQ ID NO: 85626 - DNA, 22 bp, Artificial Sequence
  Synthetic oligonucleotide; CTC chr11 5231276 5231297 5231293 5231298 +
actgactacttctaatggtgta

SEQ ID NO: 85627 - DNA, 22 bp, Artificial Sequence
  Synthetic oligonucleotide; CTG chr11 5231280 5231301 5231297 5231302 +
actacttctaatggtgtaggaa

SEQ ID NO: 85628 - DNA, 22 bp, Artificial Sequence
  Synthetic oligonucleotide; CTA chr11 5231284 5231305 5231301 5231306 +
cttctaatggtgtaggaataga

SEQ ID NO: 85629 - DNA, 22 bp, Artificial Sequence
  Synthetic oligonucleotide; CTT chr11 5231287 5231308 5231304 5231309 +
ctaatggtgtaggaatagaagg

SEQ ID NO: 85630 - DNA, 22 bp, Artificial Sequence
  Synthetic oligonucleotide; TTC chr11 5231288 5231309 5231305 5231310 +
taatggtgtaggaatagaaggt

SEQ ID NO: 85631 - DNA, 22 bp, Artificial Sequence
  Synthetic oligonucleotide; CTA chr11 5231290 5231311 5231307 5231312 +
atggtgtaggaatagaaggtat

SEQ ID NO: 85632 - DNA, 22 bp, Artificial Sequence
  Synthetic oligonucleotide; CTA chr11 5231321 5231342 5231338 5231343 +
tatttgctctttttttttgact

SEQ ID NO: 85633 - DNA, 22 bp, Artificial Sequence
  Synthetic oligonucleotide; TTT chr11 5231326 5231347 5231343 5231348 +
gctctttttttttgacttttgg

SEQ ID NO: 85634 - DNA, 22 bp, Artificial Sequence
  Synthetic oligonucleotide; TTG chr11 5231327 5231348 5231344 5231349 +
ctctttttttttgacttttgga

SEQ ID NO: 85635 - DNA, 22 bp, Artificial Sequence
  Synthetic oligonucleotide; CTC chr11 5231330 5231351 5231347 5231352 +
tttttttttgacttttggagaa

SEQ ID NO: 85636 - DNA, 22 bp, Artificial Sequence
  Synthetic oligonucleotide; CTT chr11 5231332 5231353 5231349 5231354 +
tttttttgacttttggagaaag

SEQ ID NO: 85637 - DNA, 22 bp, Artificial Sequence
  Synthetic oligonucleotide; TTT chr11 5231333 5231354 5231350 5231355 +
ttttttgacttttggagaaagg

SEQ ID NO: 85638 - DNA, 22 bp, Artificial Sequence
  Synthetic oligonucleotide; TTT chr11 5231334 5231355 5231351 5231356 +
tttttgacttttggagaaagga

SEQ ID NO: 85639 - DNA, 22 bp, Artificial Sequence
  Synthetic oligonucleotide; TTT chr11 5231335 5231356 5231352 5231357 +
ttttgacttttggagaaaggaa

SEQ ID NO: 85640 - DNA, 22 bp, Artificial Sequence
  Synthetic oligonucleotide; TTT chr11 5231336 5231357 5231353 5231358 +
tttgacttttggagaaaggaat

SEQ ID NO: 85641 - DNA, 22 bp, Artificial Sequence
  Synthetic oligonucleotide; TTT chr11 5231337 5231358 5231354 5231359 +
ttgacttttggagaaaggaatg

SEQ ID NO: 85642 - DNA, 22 bp, Artificial Sequence
  Synthetic oligonucleotide; TTT chr11 5231338 5231359 5231355 5231360 +
tgacttttggagaaaggaatgt

SEQ ID NO: 85643 - DNA, 22 bp, Artificial Sequence
  Synthetic oligonucleotide; TTT chr11 5231339 5231360 5231356 5231361 +
gacttttggagaaaggaatgta

SEQ ID NO: 85644 - DNA, 22 bp, Artificial Sequence
  Synthetic oligonucleotide; TTG chr11 5231340 5231361 5231357 5231362 +
acttttggagaaaggaatgtag

SEQ ID NO: 85645 - DNA, 22 bp, Artificial Sequence
  Synthetic oligonucleotide; CTT chr11 5231344 5231365 5231361 5231366 +
ttggagaaaggaatgtagtttg

SEQ ID NO: 85646 - DNA, 22 bp, Artificial Sequence
  Synthetic oligonucleotide; TTT chr11 5231345 5231366 5231362 5231367 +
tggagaaaggaatgtagtttgt

SEQ ID NO: 85647 - DNA, 22 bp, Artificial Sequence
  Synthetic oligonucleotide; TTT chr11 5231346 5231367 5231363 5231368 +
ggagaaaggaatgtagtttgtt

SEQ ID NO: 85648 - DNA, 22 bp, Artificial Sequence
  Synthetic oligonucleotide; TTG chr11 5231347 5231368 5231364 5231369 +
gagaaaggaatgtagtttgttt

SEQ ID NO: 85649 - DNA, 22 bp, Artificial Sequence
  Synthetic oligonucleotide; TTT chr11 5231365 5231386 5231382 5231387 +
gttttccctatcaagatcataa

SEQ ID NO: 85650 - DNA, 22 bp, Artificial Sequence
  Synthetic oligonucleotide; TTG chr11 5231366 5231387 5231383 5231388 +
ttttccctatcaagatcataag

SEQ ID NO: 85651 - DNA, 22 bp, Artificial Sequence
  Synthetic oligonucleotide; TTT chr11 5231369 5231390 5231386 5231391 +
tccctatcaagatcataaggtc

SEQ ID NO: 85652 - DNA, 22 bp, Artificial Sequence
  Synthetic oligonucleotide; TTT chr11 5231370 5231391 5231387 5231392 +
ccctatcaagatcataaggtct

SEQ ID NO: 85653 - DNA, 22 bp, Artificial Sequence
  Synthetic oligonucleotide; TTC chr11 5231371 5231392 5231388 5231393 +
cctatcaagatcataaggtcta

SEQ ID NO: 85654 - DNA, 22 bp, Artificial Sequence
  Synthetic oligonucleotide; CTA chr11 5231375 5231396 5231392 5231397 +
tcaagatcataaggtctacaat

SEQ ID NO: 85655 - DNA, 22 bp, Artificial Sequence
  Synthetic oligonucleotide; CTA chr11 5231393 5231414 5231410 5231415 +
caatctctcttactgtctttcg

SEQ ID NO: 85656 - DNA, 22 bp, Artificial Sequence
  Synthetic oligonucleotide; CTC chr11 5231400 5231421 5231417 5231422 +
tcttactgtctttcgaatacca

SEQ ID NO: 85657 - DNA, 22 bp, Artificial Sequence
  Synthetic oligonucleotide; CTC chr11 5231402 5231423 5231419 5231424 +
ttactgtctttcgaataccaca

SEQ ID NO: 85658 - DNA, 22 bp, Artificial Sequence
  Synthetic oligonucleotide; CTT chr11 5231404 5231425 5231421 5231426 +
actgtctttcgaataccacaca

SEQ ID NO: 85659 - DNA, 22 bp, Artificial Sequence
  Synthetic oligonucleotide; TTA chr11 5231405 5231426 5231422 5231427 +
ctgtctttcgaataccacacaa

SEQ ID NO: 85660 - DNA, 22 bp, Artificial Sequence
  Synthetic oligonucleotide; CTG chr11 5231408 5231429 5231425 5231430 +
tctttcgaataccacacaagta

SEQ ID NO: 85661 - DNA, 22 bp, Artificial Sequence
  Synthetic oligonucleotide; CTT chr11 5231412 5231433 5231429 5231434 +
tcgaataccacacaagtatctc

SEQ ID NO: 85662 - DNA, 22 bp, Artificial Sequence
  Synthetic oligonucleotide; TTT chr11 5231413 5231434 5231430 5231435 +
cgaataccacacaagtatctcc

SEQ ID NO: 85663 - DNA, 22 bp, Artificial Sequence
  Synthetic oligonucleotide; TTC chr11 5231414 5231435 5231431 5231436 +
gaataccacacaagtatctcct

SEQ ID NO: 85664 - DNA, 22 bp, Artificial Sequence
  Synthetic oligonucleotide; CTC chr11 5231434 5231455 5231451 5231456 +
cttttaatatcttactcttatg

SEQ ID NO: 85665 - DNA, 22 bp, Artificial Sequence
  Synthetic oligonucleotide; CTT chr11 5231437 5231458 5231454 5231459 +
ttaatatcttactcttatgaga

SEQ ID NO: 85666 - DNA, 22 bp, Artificial Sequence
  Synthetic oligonucleotide; TTT chr11 5231438 5231459 5231455 5231460 +
taatatcttactcttatgagaa

SEQ ID NO: 85667 - DNA, 22 bp, Artificial Sequence
  Synthetic oligonucleotide; TTT chr11 5231439 5231460 5231456 5231461 +
aatatcttactcttatgagaac

SEQ ID NO: 85668 - DNA, 22 bp, Artificial Sequence
  Synthetic oligonucleotide; TTA chr11 5231440 5231461 5231457 5231462 +
atatcttactcttatgagaact

SEQ ID NO: 85669 - DNA, 22 bp, Artificial Sequence
  Synthetic oligonucleotide; CTT chr11 5231447 5231468 5231464 5231469 +
actcttatgagaacttccctat

SEQ ID NO: 85670 - DNA, 22 bp, Artificial Sequence
  Synthetic oligonucleotide; TTA chr11 5231448 5231469 5231465 5231470 +
ctcttatgagaacttccctatg

SEQ ID NO: 85671 - DNA, 22 bp, Artificial Sequence
  Synthetic oligonucleotide; CTC chr11 5231451 5231472 5231468 5231473 +
ttatgagaacttccctatgctc

SEQ ID NO: 85672 - DNA, 22 bp, Artificial Sequence
  Synthetic oligonucleotide; CTT chr11 5231453 5231474 5231470 5231475 +
atgagaacttccctatgctcag

SEQ ID NO: 85673 - DNA, 22 bp, Artificial Sequence
  Synthetic oligonucleotide; TTA chr11 5231454 5231475 5231471 5231476 +
tgagaacttccctatgctcagg

SEQ ID NO: 85674 - DNA, 22 bp, Artificial Sequence
  Synthetic oligonucleotide; CTT chr11 5231463 5231484 5231480 5231485 +
ccctatgctcaggaatgtgaaa

SEQ ID NO: 85675 - DNA, 22 bp, Artificial Sequence
  Synthetic oligonucleotide; TTC chr11 5231464 5231485 5231481 5231486 +
cctatgctcaggaatgtgaaag

SEQ ID NO: 85676 - DNA, 22 bp, Artificial Sequence
  Synthetic oligonucleotide; CTA chr11 5231468 5231489 5231485 5231490 +
tgctcaggaatgtgaaagtgat

SEQ ID NO: 85677 - DNA, 22 bp, Artificial Sequence
  Synthetic oligonucleotide; CTC chr11 5231473 5231494 5231490 5231495 +
aggaatgtgaaagtgatcttcc

SEQ ID NO: 85678 - DNA, 22 bp, Artificial Sequence
  Synthetic oligonucleotide; CTT chr11 5231493 5231514 5231510 5231515 +
ccccaaaatgccctgagtagct

SEQ ID NO: 85679 - DNA, 22 bp, Artificial Sequence
  Synthetic oligonucleotide; TTC chr11 5231494 5231515 5231511 5231516 +
cccaaaatgccctgagtagctc

SEQ ID NO: 85680 - DNA, 22 bp, Artificial Sequence
  Synthetic oligonucleotide; CTG chr11 5231508 5231529 5231525 5231530 +
agtagctctgcttctgatatgt

SEQ ID NO: 85681 - DNA, 22 bp, Artificial Sequence
  Synthetic oligonucleotide; CTC chr11 5231516 5231537 5231533 5231538 +
tgcttctgatatgtaaaccagt

SEQ ID NO: 85682 - DNA, 22 bp, Artificial Sequence
  Synthetic oligonucleotide; CTG chr11 5231518 5231539 5231535 5231540 +
cttctgatatgtaaaccagtgg

SEQ ID NO: 85683 - DNA, 22 bp, Artificial Sequence
  Synthetic oligonucleotide; CTT chr11 5231521 5231542 5231538 5231543 +
ctgatatgtaaaccagtggttc

SEQ ID NO: 85684 - DNA, 22 bp, Artificial Sequence
  Synthetic oligonucleotide; TTC chr11 5231522 5231543 5231539 5231544 +
tgatatgtaaaccagtggttcc

SEQ ID NO: 85685 - DNA, 22 bp, Artificial Sequence
  Synthetic oligonucleotide; CTG chr11 5231524 5231545 5231541 5231546 +
atatgtaaaccagtggttccta

SEQ ID NO: 85686 - DNA, 22 bp, Artificial Sequence
  Synthetic oligonucleotide; TTC chr11 5231543 5231564 5231560 5231565 +
ctaaatatcttattcagatata

SEQ ID NO: 85687 - DNA, 22 bp, Artificial Sequence
  Synthetic oligonucleotide; CTA chr11 5231546 5231567 5231563 5231568 +
aatatcttattcagatataaag

SEQ ID NO: 85688 - DNA, 22 bp, Artificial Sequence
  Synthetic oligonucleotide; CTT chr11 5231554 5231575 5231571 5231576 +
attcagatataaagagttctca

SEQ ID NO: 85689 - DNA, 22 bp, Artificial Sequence
  Synthetic oligonucleotide; TTA chr11 5231555 5231576 5231572 5231577 +
ttcagatataaagagttctcag

SEQ ID NO: 85690 - DNA, 22 bp, Artificial Sequence
  Synthetic oligonucleotide; TTC chr11 5231558 5231579 5231575 5231580 +
agatataaagagttctcagtgc

SEQ ID NO: 85691 - DNA, 22 bp, Artificial Sequence
  Synthetic oligonucleotide; TTC chr11 5231573 5231594 5231590 5231595 +
tcagtgcctactatgtataatg

SEQ ID NO: 85692 - DNA, 22 bp, Artificial Sequence
  Synthetic oligonucleotide; CTC chr11 5231575 5231596 5231592 5231597 +
agtgcctactatgtataatgac

SEQ ID NO: 85693 - DNA, 22 bp, Artificial Sequence
  Synthetic oligonucleotide; CTA chr11 5231583 5231604 5231600 5231605 +
ctatgtataatgacttaaggaa

SEQ ID NO: 85694 - DNA, 22 bp, Artificial Sequence
  Synthetic oligonucleotide; CTA chr11 5231586 5231607 5231603 5231608 +
tgtataatgacttaaggaaaac

SEQ ID NO: 85695 - DNA, 22 bp, Artificial Sequence
  Synthetic oligonucleotide; CTT chr11 5231599 5231620 5231616 5231621 +
aaggaaaacacatggatataaa

SEQ ID NO: 85696 - DNA, 22 bp, Artificial Sequence
  Synthetic oligonucleotide; TTA chr11 5231600 5231621 5231617 5231622 +
aggaaaacacatggatataaaa

SEQ ID NO: 85697 - DNA, 22 bp, Artificial Sequence
  Synthetic oligonucleotide; CTT chr11 5231628 5231649 5231645 5231650 +
ctgctgccagtcaattcaaaat

SEQ ID NO: 85698 - DNA, 22 bp, Artificial Sequence
  Synthetic oligonucleotide; TTC chr11 5231629 5231650 5231646 5231651 +
tgctgccagtcaattcaaaatg

SEQ ID NO: 85699 - DNA, 22 bp, Artificial Sequence
  Synthetic oligonucleotide; CTG chr11 5231631 5231652 5231648 5231653 +
ctgccagtcaattcaaaatgtt

SEQ ID NO: 85700 - DNA, 22 bp, Artificial Sequence
  Synthetic oligonucleotide; CTG chr11 5231634 5231655 5231651 5231656 +
ccagtcaattcaaaatgttgtg

SEQ ID NO: 85701 - DNA, 22 bp, Artificial Sequence
  Synthetic oligonucleotide; TTC chr11 5231645 5231666 5231662 5231667 +
aaaatgttgtgatcaaaacagt

SEQ ID NO: 85702 - DNA, 22 bp, Artificial Sequence
  Synthetic oligonucleotide; TTG chr11 5231654 5231675 5231671 5231676 +
tgatcaaaacagttaactataa

SEQ ID NO: 85703 - DNA, 22 bp, Artificial Sequence
  Synthetic oligonucleotide; TTA chr11 5231669 5231690 5231686 5231691 +
actataacacattgtcagtata

SEQ ID NO: 85704 - DNA, 22 bp, Artificial Sequence
  Synthetic oligonucleotide; CTA chr11 5231673 5231694 5231690 5231695 +
taacacattgtcagtatattct

SEQ ID NO: 85705 - DNA, 22 bp, Artificial Sequence
  Synthetic oligonucleotide; TTG chr11 5231683 5231704 5231700 5231705 +
tcagtatattctggcagtacag

SEQ ID NO: 85706 - DNA, 22 bp, Artificial Sequence
  Synthetic oligonucleotide; TTC chr11 5231694 5231715 5231711 5231716 +
tggcagtacagacagagttact

SEQ ID NO: 85707 - DNA, 22 bp, Artificial Sequence
  Synthetic oligonucleotide; CTG chr11 5231696 5231717 5231713 5231718 +
gcagtacagacagagttactgt

SEQ ID NO: 85708 - DNA, 22 bp, Artificial Sequence
  Synthetic oligonucleotide; TTA chr11 5231714 5231735 5231731 5231736 +
ctgtgaaagcactttcaaacac

SEQ ID NO: 85709 - DNA, 22 bp, Artificial Sequence
  Synthetic oligonucleotide; CTG chr11 5231717 5231738 5231734 5231739 +
tgaaagcactttcaaacacaag

SEQ ID NO: 85710 - DNA, 22 bp, Artificial Sequence
  Synthetic oligonucleotide; CTT chr11 5231728 5231749 5231745 5231750 +
tcaaacacaaggaaacaacaga

SEQ ID NO: 85711 - DNA, 22 bp, Artificial Sequence
  Synthetic oligonucleotide; TTT chr11 5231729 5231750 5231746 5231751 +
caaacacaaggaaacaacagat

SEQ ID NO: 85712 - DNA, 22 bp, Artificial Sequence
  Synthetic oligonucleotide; TTC chr11 5231730 5231751 5231747 5231752 +
aaacacaaggaaacaacagatt

SEQ ID NO: 85713 - DNA, 22 bp, Artificial Sequence
  Synthetic oligonucleotide; TTC chr11 5231753 5231774 5231770 5231775 +
tgtttaggtattcaagtaagtt

SEQ ID NO: 85714 - DNA, 22 bp, Artificial Sequence
  Synthetic oligonucleotide; CTG chr11 5231755 5231776 5231772 5231777 +
tttaggtattcaagtaagttta

SEQ ID NO: 85715 - DNA, 22 bp, Artificial Sequence
  Synthetic oligonucleotide; TTT chr11 5231758 5231779 5231775 5231780 +
aggtattcaagtaagtttaaaa

SEQ ID NO: 85716 - DNA, 22 bp, Artificial Sequence
  Synthetic oligonucleotide; TTA chr11 5231759 5231780 5231776 5231781 +
ggtattcaagtaagtttaaaat

SEQ ID NO: 85717 - DNA, 22 bp, Artificial Sequence
  Synthetic oligonucleotide; TTC chr11 5231766 5231787 5231783 5231788 +
aagtaagtttaaaattaatcaa

SEQ ID NO: 85718 - DNA, 22 bp, Artificial Sequence
  Synthetic oligonucleotide; TTT chr11 5231776 5231797 5231793 5231798 +
aaaattaatcaacatgcatata

SEQ ID NO: 85719 - DNA, 22 bp, Artificial Sequence
  Synthetic oligonucleotide; TTA chr11 5231777 5231798 5231794 5231799 +
aaattaatcaacatgcatataa

SEQ ID NO: 85720 - DNA, 22 bp, Artificial Sequence
  Synthetic oligonucleotide; TTA chr11 5231783 5231804 5231800 5231805 +
atcaacatgcatataatacaga

SEQ ID NO: 85721 - DNA, 22 bp, Artificial Sequence
  Synthetic oligonucleotide; TTT chr11 5231808 5231829 5231825 5231830 +
ttaaaaatgtatacaactgaga

SEQ ID NO: 85722 - DNA, 22 bp, Artificial Sequence
  Synthetic oligonucleotide; TTT chr11 5231809 5231830 5231826 5231831 +
taaaaatgtatacaactgagaa

SEQ ID NO: 85723 - DNA, 22 bp, Artificial Sequence
  Synthetic oligonucleotide; TTT chr11 5231810 5231831 5231827 5231832 +
aaaaatgtatacaactgagaaa

SEQ ID NO: 85724 - DNA, 22 bp, Artificial Sequence
  Synthetic oligonucleotide; TTA chr11 5231811 5231832 5231828 5231833 +
aaaatgtatacaactgagaaag

SEQ ID NO: 85725 - DNA, 22 bp, Artificial Sequence
  Synthetic oligonucleotide; CTG chr11 5231827 5231848 5231844 5231849 +
agaaagttctaaaaatccttct

SEQ ID NO: 85726 - DNA, 22 bp, Artificial Sequence
  Synthetic oligonucleotide; TTC chr11 5231836 5231857 5231853 5231858 +
taaaaatccttctaattttacc

SEQ ID NO: 85727 - DNA, 22 bp, Artificial Sequence
  Synthetic oligonucleotide; CTA chr11 5231838 5231859 5231855 5231860 +
aaaatccttctaattttaccta

SEQ ID NO: 85728 - DNA, 22 bp, Artificial Sequence
  Synthetic oligonucleotide; CTT chr11 5231847 5231868 5231864 5231869 +
ctaattttacctatggcaaaaa

SEQ ID NO: 85729 - DNA, 22 bp, Artificial Sequence
  Synthetic oligonucleotide; TTC chr11 5231848 5231869 5231865 5231870 +
taattttacctatggcaaaaat

SEQ ID NO: 85730 - DNA, 22 bp, Artificial Sequence
  Synthetic oligonucleotide; CTA chr11 5231850 5231871 5231867 5231872 +
attttacctatggcaaaaatgg

SEQ ID NO: 85731 - DNA, 22 bp, Artificial Sequence
  Synthetic oligonucleotide; TTT chr11 5231854 5231875 5231871 5231876 +
tacctatggcaaaaatggtgct

SEQ ID NO: 85732 - DNA, 22 bp, Artificial Sequence
  Synthetic oligonucleotide; TTT chr11 5231855 5231876 5231872 5231877 +
acctatggcaaaaatggtgctc

SEQ ID NO: 85733 - DNA, 22 bp, Artificial Sequence
  Synthetic oligonucleotide; TTA chr11 5231856 5231877 5231873 5231878 +
cctatggcaaaaatggtgctca

SEQ ID NO: 85734 - DNA, 22 bp, Artificial Sequence
  Synthetic oligonucleotide; CTA chr11 5231860 5231881 5231877 5231882 +
tggcaaaaatggtgctcaagga

SEQ ID NO: 85735 - DNA, 22 bp, Artificial Sequence
  Synthetic oligonucleotide; CTC chr11 5231877 5231898 5231894 5231899 +
aaggaaaaaaatattactccta

SEQ ID NO: 85736 - DNA, 22 bp, Artificial Sequence
  Synthetic oligonucleotide; TTA chr11 5231893 5231914 5231910 5231915 +
ctcctatgatcagaaaggaaat

SEQ ID NO: 85737 - DNA, 22 bp, Artificial Sequence
  Synthetic oligonucleotide; CTC chr11 5231896 5231917 5231913 5231918 +
ctatgatcagaaaggaaataac

SEQ ID NO: 85738 - DNA, 22 bp, Artificial Sequence
  Synthetic oligonucleotide; CTA chr11 5231899 5231920 5231916 5231921 +
tgatcagaaaggaaataactgt

SEQ ID NO: 85739 - DNA, 22 bp, Artificial Sequence
  Synthetic oligonucleotide; CTG chr11 5231920 5231941 5231937 5231942 +
ttcggttgtttactgcatgctt

SEQ ID NO: 85740 - DNA, 22 bp, Artificial Sequence
  Synthetic oligonucleotide; TTC chr11 5231923 5231944 5231940 5231945 +
ggttgtttactgcatgcttcct

SEQ ID NO: 85741 - DNA, 22 bp, Artificial Sequence
  Synthetic oligonucleotide; TTG chr11 5231928 5231949 5231945 5231950 +
tttactgcatgcttcctctttg

SEQ ID NO: 85742 - DNA, 22 bp, Artificial Sequence
  Synthetic oligonucleotide; TTT chr11 5231931 5231952 5231948 5231953 +
actgcatgcttcctctttgtat

SEQ ID NO: 85743 - DNA, 22 bp, Artificial Sequence
  Synthetic oligonucleotide; TTA chr11 5231932 5231953 5231949 5231954 +
ctgcatgcttcctctttgtatg

SEQ ID NO: 85744 - DNA, 22 bp, Artificial Sequence
  Synthetic oligonucleotide; CTG chr11 5231935 5231956 5231952 5231957 +
catgcttcctctttgtatgttg

SEQ ID NO: 85745 - DNA, 22 bp, Artificial Sequence
  Synthetic oligonucleotide; CTT chr11 5231942 5231963 5231959 5231964 +
cctctttgtatgttgtagcatt

SEQ ID NO: 85746 - DNA, 22 bp, Artificial Sequence
  Synthetic oligonucleotide; TTC chr11 5231943 5231964 5231960 5231965 +
ctctttgtatgttgtagcatta

SEQ ID NO: 85747 - DNA, 22 bp, Artificial Sequence
  Synthetic oligonucleotide; CTC chr11 5231946 5231967 5231963 5231968 +
tttgtatgttgtagcattaaca

SEQ ID NO: 85748 - DNA, 22 bp, Artificial Sequence
  Synthetic oligonucleotide; CTT chr11 5231948 5231969 5231965 5231970 +
tgtatgttgtagcattaacaac

SEQ ID NO: 85749 - DNA, 22 bp, Artificial Sequence
  Synthetic oligonucleotide; TTT chr11 5231949 5231970 5231966 5231971 +
gtatgttgtagcattaacaaca

SEQ ID NO: 85750 - DNA, 22 bp, Artificial Sequence
  Synthetic oligonucleotide; TTG chr11 5231950 5231971 5231967 5231972 +
tatgttgtagcattaacaacaa

SEQ ID NO: 85751 - DNA, 22 bp, Artificial Sequence
  Synthetic oligonucleotide; TTG chr11 5231957 5231978 5231974 5231979 +
tagcattaacaacaaagaaaca

SEQ ID NO: 85752 - DNA, 22 bp, Artificial Sequence
  Synthetic oligonucleotide; TTA chr11 5231965 5231986 5231982 5231987 +
acaacaaagaaacactgtgcga

SEQ ID NO: 85753 - DNA, 22 bp, Artificial Sequence
  Synthetic oligonucleotide; CTG chr11 5231982 5232003 5231999 5232004 +
tgcgatggtattattaatattg

SEQ ID NO: 85754 - DNA, 22 bp, Artificial Sequence
  Synthetic oligonucleotide; TTA chr11 5231995 5232016 5232012 5232017 +
ttaatattgtcctctaattcca

SEQ ID NO: 85755 - DNA, 22 bp, Artificial Sequence
  Synthetic oligonucleotide; TTA chr11 5231998 5232019 5232015 5232020 +
atattgtcctctaattccagaa

SEQ ID NO: 85756 - DNA, 22 bp, Artificial Sequence
  Synthetic oligonucleotide; TTG chr11 5232004 5232025 5232021 5232026 +
tcctctaattccagaagttcta

SEQ ID NO: 85757 - DNA, 22 bp, Artificial Sequence
  Synthetic oligonucleotide; CTC chr11 5232009 5232030 5232026 5232031 +
taattccagaagttctaaagca

SEQ ID NO: 85758 - DNA, 22 bp, Artificial Sequence
  Synthetic oligonucleotide; CTA chr11 5232011 5232032 5232028 5232033 +
attccagaagttctaaagcaag

SEQ ID NO: 85759 - DNA, 22 bp, Artificial Sequence
  Synthetic oligonucleotide; TTC chr11 5232015 5232036 5232032 5232037 +
cagaagttctaaagcaaggaat

SEQ ID NO: 85760 - DNA, 22 bp, Artificial Sequence
  Synthetic oligonucleotide; TTC chr11 5232024 5232045 5232041 5232046 +
taaagcaaggaataatcattcc

SEQ ID NO: 85761 - DNA, 22 bp, Artificial Sequence
  Synthetic oligonucleotide; CTA chr11 5232026 5232047 5232043 5232048 +
aagcaaggaataatcattcctt

SEQ ID NO: 85762 - DNA, 22 bp, Artificial Sequence
  Synthetic oligonucleotide; TTC chr11 5232045 5232066 5232062 5232067 +
cttcatttactcatttactcat

SEQ ID NO: 85763 - DNA, 22 bp, Artificial Sequence
  Synthetic oligonucleotide; CTT chr11 5232048 5232069 5232065 5232070 +
catttactcatttactcattcg

SEQ ID NO: 85764 - DNA, 22 bp, Artificial Sequence
  Synthetic oligonucleotide; TTC chr11 5232049 5232070 5232066 5232071 +
atttactcatttactcattcgt

SEQ ID NO: 85765 - DNA, 22 bp, Artificial Sequence
  Synthetic oligonucleotide; TTT chr11 5232053 5232074 5232070 5232075 +
actcatttactcattcgttcat

SEQ ID NO: 85766 - DNA, 22 bp, Artificial Sequence
  Synthetic oligonucleotide; TTA chr11 5232054 5232075 5232071 5232076 +
ctcatttactcattcgttcatt

SEQ ID NO: 85767 - DNA, 22 bp, Artificial Sequence
  Synthetic oligonucleotide; CTC chr11 5232057 5232078 5232074 5232079 +
atttactcattcgttcattcat

SEQ ID NO: 85768 - DNA, 22 bp, Artificial Sequence
  Synthetic oligonucleotide; TTT chr11 5232061 5232082 5232078 5232083 +
actcattcgttcattcattcac

SEQ ID NO: 85769 - DNA, 22 bp, Artificial Sequence
  Synthetic oligonucleotide; TTA chr11 5232062 5232083 5232079 5232084 +
ctcattcgttcattcattcact

SEQ ID NO: 85770 - DNA, 22 bp, Artificial Sequence
  Synthetic oligonucleotide; CTC chr11 5232065 5232086 5232082 5232087 +
attcgttcattcattcactgtt

SEQ ID NO: 85771 - DNA, 22 bp, Artificial Sequence
  Synthetic oligonucleotide; TTC chr11 5232069 5232090 5232086 5232091 +
gttcattcattcactgttttct

SEQ ID NO: 85772 - DNA, 22 bp, Artificial Sequence
  Synthetic oligonucleotide; TTC chr11 5232073 5232094 5232090 5232095 +
attcattcactgttttcttgaa

SEQ ID NO: 85773 - DNA, 22 bp, Artificial Sequence
  Synthetic oligonucleotide; TTC chr11 5232077 5232098 5232094 5232099 +
attcactgttttcttgaataaa

SEQ ID NO: 85774 - DNA, 22 bp, Artificial Sequence
  Synthetic oligonucleotide; TTC chr11 5232081 5232102 5232098 5232103 +
actgttttcttgaataaatatt

SEQ ID NO: 85775 - DNA, 22 bp, Artificial Sequence
  Synthetic oligonucleotide; CTG chr11 5232085 5232106 5232102 5232107 +
ttttcttgaataaatattttct

SEQ ID NO: 85776 - DNA, 22 bp, Artificial Sequence
  Synthetic oligonucleotide; TTT chr11 5232088 5232109 5232105 5232110 +
tcttgaataaatattttctttc

SEQ ID NO: 85777 - DNA, 22 bp, Artificial Sequence
  Synthetic oligonucleotide; TTT chr11 5232089 5232110 5232106 5232111 +
cttgaataaatattttctttct

SEQ ID NO: 85778 - DNA, 22 bp, Artificial Sequence
  Synthetic oligonucleotide; TTC chr11 5232090 5232111 5232107 5232112 +
ttgaataaatattttctttctg

SEQ ID NO: 85779 - DNA, 22 bp, Artificial Sequence
  Synthetic oligonucleotide; CTT chr11 5232092 5232113 5232109 5232114 +
gaataaatattttctttctgcc

SEQ ID NO: 85780 - DNA, 22 bp, Artificial Sequence
  Synthetic oligonucleotide; TTG chr11 5232093 5232114 5232110 5232115 +
aataaatattttctttctgccc

SEQ ID NO: 85781 - DNA, 22 bp, Artificial Sequence
  Synthetic oligonucleotide; TTT chr11 5232104 5232125 5232121 5232126 +
tctttctgcccattgatgaatt

SEQ ID NO: 85782 - DNA, 22 bp, Artificial Sequence
  Synthetic oligonucleotide; TTT chr11 5232105 5232126 5232122 5232127 +
ctttctgcccattgatgaattt

SEQ ID NO: 85783 - DNA, 22 bp, Artificial Sequence
  Synthetic oligonucleotide; TTC chr11 5232106 5232127 5232123 5232128 +
tttctgcccattgatgaattta

SEQ ID NO: 85784 - DNA, 22 bp, Artificial Sequence
  Synthetic oligonucleotide; CTT chr11 5232108 5232129 5232125 5232130 +
tctgcccattgatgaatttaat

SEQ ID NO: 85785 - DNA, 22 bp, Artificial Sequence
  Synthetic oligonucleotide; TTT chr11 5232109 5232130 5232126 5232131 +
ctgcccattgatgaatttaata

SEQ ID NO: 85786 - DNA, 22 bp, Artificial Sequence
  Synthetic oligonucleotide; TTC chr11 5232110 5232131 5232127 5232132 +
tgcccattgatgaatttaatat

SEQ ID NO: 85787 - DNA, 22 bp, Artificial Sequence
  Synthetic oligonucleotide; CTG chr11 5232112 5232133 5232129 5232134 +
cccattgatgaatttaatatga

SEQ ID NO: 85788 - DNA, 22 bp, Artificial Sequence
  Synthetic oligonucleotide; TTG chr11 5232119 5232140 5232136 5232141 +
atgaatttaatatgaggcacag

SEQ ID NO: 85789 - DNA, 22 bp, Artificial Sequence
  Synthetic oligonucleotide; TTT chr11 5232127 5232148 5232144 5232149 +
aatatgaggcacagtaggcatg

SEQ ID NO: 85790 - DNA, 22 bp, Artificial Sequence
  Synthetic oligonucleotide; TTA chr11 5232128 5232149 5232145 5232150 +
atatgaggcacagtaggcatgt

SEQ ID NO: 85791 - DNA, 22 bp, Artificial Sequence
  Synthetic oligonucleotide; TTG chr11 5232176 5232197 5232193 5232198 +
cttataaagcacggagtgtgtg

SEQ ID NO: 85792 - DNA, 22 bp, Artificial Sequence
  Synthetic oligonucleotide; CTT chr11 5232179 5232200 5232196 5232201 +
ataaagcacggagtgtgtgtgt

SEQ ID NO: 85793 - DNA, 22 bp, Artificial Sequence
  Synthetic oligonucleotide; TTA chr11 5232180 5232201 5232197 5232202 +
taaagcacggagtgtgtgtgtg

SEQ ID NO: 85794 - DNA, 22 bp, Artificial Sequence
  Synthetic oligonucleotide; TTT chr11 5232259 5232280 5232276 5232281 +
ggaaagattttttgggtagtat

SEQ ID NO: 85795 - DNA, 22 bp, Artificial Sequence
  Synthetic oligonucleotide; TTG chr11 5232260 5232281 5232277 5232282 +
gaaagattttttgggtagtata

SEQ ID NO: 85796 - DNA, 22 bp, Artificial Sequence
  Synthetic oligonucleotide; TTT chr11 5232269 5232290 5232286 5232291 +
tttgggtagtatagagaagttt

SEQ ID NO: 85797 - DNA, 22 bp, Artificial Sequence
  Synthetic oligonucleotide; TTT chr11 5232270 5232291 5232287 5232292 +
ttgggtagtatagagaagttta

SEQ ID NO: 85798 - DNA, 22 bp, Artificial Sequence
  Synthetic oligonucleotide; TTT chr11 5232271 5232292 5232288 5232293 +
tgggtagtatagagaagtttat

SEQ ID NO: 85799 - DNA, 22 bp, Artificial Sequence
  Synthetic oligonucleotide; TTT chr11 5232272 5232293 5232289 5232294 +
gggtagtatagagaagtttatt

SEQ ID NO: 85800 - DNA, 22 bp, Artificial Sequence
  Synthetic oligonucleotide; TTG chr11 5232273 5232294 5232290 5232295 +
ggtagtatagagaagtttattg

SEQ ID NO: 85801 - DNA, 22 bp, Artificial Sequence
  Synthetic oligonucleotide; TTT chr11 5232291 5232312 5232308 5232313 +
attgtggctggggtcaagagag

SEQ ID NO: 85802 - DNA, 22 bp, Artificial Sequence
  Synthetic oligonucleotide; TTA chr11 5232292 5232313 5232309 5232314 +
ttgtggctggggtcaagagagg

SEQ ID NO: 85803 - DNA, 22 bp, Artificial Sequence
  Synthetic oligonucleotide; TTG chr11 5232295 5232316 5232312 5232317 +
tggctggggtcaagagaggtca

SEQ ID NO: 85804 - DNA, 22 bp, Artificial Sequence
  Synthetic oligonucleotide; CTG chr11 5232301 5232322 5232318 5232323 +
gggtcaagagaggtcacaagta

SEQ ID NO: 85805 - DNA, 22 bp, Artificial Sequence
  Synthetic oligonucleotide; CTT chr11 5232343 5232364 5232360 5232365 +
gactgaaatatgggaagataag

SEQ ID NO: 85806 - DNA, 22 bp, Artificial Sequence
  Synthetic oligonucleotide; TTG chr11 5232344 5232365 5232361 5232366 +
actgaaatatgggaagataaga

SEQ ID NO: 85807 - DNA, 22 bp, Artificial Sequence
  Synthetic oligonucleotide; CTG chr11 5232348 5232369 5232365 5232370 +
aaatatgggaagataagaggaa

SEQ ID NO: 85808 - DNA, 22 bp, Artificial Sequence
  Synthetic oligonucleotide; TTC chr11 5232374 5232395 5232391 5232396 +
tttacagagatgttctggggca

SEQ ID NO: 85809 - DNA, 22 bp, Artificial Sequence
  Synthetic oligonucleotide; CTT chr11 5232376 5232397 5232393 5232398 +
tacagagatgttctggggcaag

SEQ ID NO: 85810 - DNA, 22 bp, Artificial Sequence
  Synthetic oligonucleotide; TTT chr11 5232377 5232398 5232394 5232399 +
acagagatgttctggggcaagt

SEQ ID NO: 85811 - DNA, 22 bp, Artificial Sequence
  Synthetic oligonucleotide; TTA chr11 5232378 5232399 5232395 5232400 +
cagagatgttctggggcaagta

SEQ ID NO: 85812 - DNA, 22 bp, Artificial Sequence
  Synthetic oligonucleotide; TTC chr11 5232389 5232410 5232406 5232411 +
tggggcaagtaagaggaggaag

SEQ ID NO: 85813 - DNA, 22 bp, Artificial Sequence
  Synthetic oligonucleotide; CTG chr11 5232391 5232412 5232408 5232413 +
gggcaagtaagaggaggaagct

SEQ ID NO: 85814 - DNA, 22 bp, Artificial Sequence
  Synthetic oligonucleotide; CTA chr11 5232414 5232435 5232431 5232436 +
tttcttggagcaggaacacttg

SEQ ID NO: 85815 - DNA, 22 bp, Artificial Sequence
  Synthetic oligonucleotide; TTT chr11 5232417 5232438 5232434 5232439 +
cttggagcaggaacacttgatg

SEQ ID NO: 85816 - DNA, 22 bp, Artificial Sequence
  Synthetic oligonucleotide; TTC chr11 5232418 5232439 5232435 5232440 +
ttggagcaggaacacttgatgg

SEQ ID NO: 85817 - DNA, 22 bp, Artificial Sequence
  Synthetic oligonucleotide; CTT chr11 5232420 5232441 5232437 5232442 +
ggagcaggaacacttgatgggg

SEQ ID NO: 85818 - DNA, 22 bp, Artificial Sequence
  Synthetic oligonucleotide; TTG chr11 5232421 5232442 5232438 5232443 +
gagcaggaacacttgatggggt

SEQ ID NO: 85819 - DNA, 22 bp, Artificial Sequence
  Synthetic oligonucleotide; CTT chr11 5232435 5232456 5232452 5232457 +
gatggggtatagtattatgggc

SEQ ID NO: 85820 - DNA, 22 bp, Artificial Sequence
  Synthetic oligonucleotide; TTG chr11 5232436 5232457 5232453 5232458 +
atggggtatagtattatgggct

SEQ ID NO: 85821 - DNA, 22 bp, Artificial Sequence
  Synthetic oligonucleotide; TTA chr11 5232452 5232473 5232469 5232474 +
tgggctacaatgtgcaggcaaa

SEQ ID NO: 85822 - DNA, 22 bp, Artificial Sequence
  Synthetic oligonucleotide; CTA chr11 5232459 5232480 5232476 5232481 +
caatgtgcaggcaaaggaagga

SEQ ID NO: 85823 - DNA, 22 bp, Artificial Sequence
  Synthetic oligonucleotide; TTG chr11 5232504 5232525 5232521 5232526 +
tcttgagtaatcattatgcctt

SEQ ID NO: 85824 - DNA, 22 bp, Artificial Sequence
  Synthetic oligonucleotide; CTT chr11 5232508 5232529 5232525 5232530 +
gagtaatcattatgcctttaat

SEQ ID NO: 85825 - DNA, 22 bp, Artificial Sequence
  Synthetic oligonucleotide; TTG chr11 5232509 5232530 5232526 5232531 +
agtaatcattatgcctttaatt

SEQ ID NO: 85826 - DNA, 22 bp, Artificial Sequence
  Synthetic oligonucleotide; TTA chr11 5232520 5232541 5232537 5232542 +
tgcctttaattgagcacattat

SEQ ID NO: 85827 - DNA, 22 bp, Artificial Sequence
  Synthetic oligonucleotide; CTT chr11 5232526 5232547 5232543 5232548 +
taattgagcacattattttctc

SEQ ID NO: 85828 - DNA, 22 bp, Artificial Sequence
  Synthetic oligonucleotide; TTT chr11 5232527 5232548 5232544 5232549 +
aattgagcacattattttctca

SEQ ID NO: 85829 - DNA, 22 bp, Artificial Sequence
  Synthetic oligonucleotide; TTA chr11 5232528 5232549 5232545 5232550 +
attgagcacattattttctcag

SEQ ID NO: 85830 - DNA, 22 bp, Artificial Sequence
  Synthetic oligonucleotide; TTG chr11 5232532 5232553 5232549 5232554 +
agcacattattttctcagtaat

SEQ ID NO: 85831 - DNA, 22 bp, Artificial Sequence
  Synthetic oligonucleotide; TTA chr11 5232541 5232562 5232558 5232563 +
ttttctcagtaattgttggagt

SEQ ID NO: 85832 - DNA, 22 bp, Artificial Sequence
  Synthetic oligonucleotide; TTT chr11 5232544 5232565 5232561 5232566 +
tctcagtaattgttggagttta

SEQ ID NO: 85833 - DNA, 22 bp, Artificial Sequence
  Synthetic oligonucleotide; TTT chr11 5232545 5232566 5232562 5232567 +
ctcagtaattgttggagtttaa

SEQ ID NO: 85834 - DNA, 22 bp, Artificial Sequence
  Synthetic oligonucleotide; TTC chr11 5232546 5232567 5232563 5232568 +
tcagtaattgttggagtttaat

SEQ ID NO: 85835 - DNA, 22 bp, Artificial Sequence
  Synthetic oligonucleotide; CTC chr11 5232548 5232569 5232565 5232570 +
agtaattgttggagtttaatcg

SEQ ID NO: 85836 - DNA, 22 bp, Artificial Sequence
  Synthetic oligonucleotide; TTG chr11 5232556 5232577 5232573 5232578 +
ttggagtttaatcgtagcatta

SEQ ID NO: 85837 - DNA, 22 bp, Artificial Sequence
  Synthetic oligonucleotide; TTG chr11 5232559 5232580 5232576 5232581 +
gagtttaatcgtagcattaccc

SEQ ID NO: 85838 - DNA, 22 bp, Artificial Sequence
  Synthetic oligonucleotide; TTT chr11 5232565 5232586 5232582 5232587 +
aatcgtagcattacccttgagg

SEQ ID NO: 85839 - DNA, 22 bp, Artificial Sequence
  Synthetic oligonucleotide; TTA chr11 5232566 5232587 5232583 5232588 +
atcgtagcattacccttgaggc

SEQ ID NO: 85840 - DNA, 22 bp, Artificial Sequence
  Synthetic oligonucleotide; TTA chr11 5232578 5232599 5232595 5232600 +
cccttgaggctatgtcttaggg

SEQ ID NO: 85841 - DNA, 22 bp, Artificial Sequence
  Synthetic oligonucleotide; CTT chr11 5232583 5232604 5232600 5232605 +
gaggctatgtcttagggttgag

SEQ ID NO: 85842 - DNA, 22 bp, Artificial Sequence
  Synthetic oligonucleotide; TTG chr11 5232584 5232605 5232601 5232606 +
aggctatgtcttagggttgagg

SEQ ID NO: 85843 - DNA, 22 bp, Artificial Sequence
  Synthetic oligonucleotide; CTA chr11 5232590 5232611 5232607 5232612 +
tgtcttagggttgaggtcttcc

SEQ ID NO: 85844 - DNA, 22 bp, Artificial Sequence
  Synthetic oligonucleotide; CTT chr11 5232596 5232617 5232613 5232618 +
agggttgaggtcttccctagaa

SEQ ID NO: 85845 - DNA, 22 bp, Artificial Sequence
  Synthetic oligonucleotide; TTA chr11 5232597 5232618 5232614 5232619 +
gggttgaggtcttccctagaac

SEQ ID NO: 85846 - DNA, 22 bp, Artificial Sequence
  Synthetic oligonucleotide; TTG chr11 5232603 5232624 5232620 5232625 +
aggtcttccctagaacctctgc

SEQ ID NO: 85847 - DNA, 22 bp, Artificial Sequence
  Synthetic oligonucleotide; CTT chr11 5232610 5232631 5232627 5232632 +
ccctagaacctctgcagtgcca

SEQ ID NO: 85848 - DNA, 22 bp, Artificial Sequence
  Synthetic oligonucleotide; TTC chr11 5232611 5232632 5232628 5232633 +
cctagaacctctgcagtgccag

SEQ ID NO: 85849 - DNA, 22 bp, Artificial Sequence
  Synthetic oligonucleotide; CTA chr11 5232615 5232636 5232632 5232637 +
gaacctctgcagtgccagtatt

SEQ ID NO: 85850 - DNA, 22 bp, Artificial Sequence
  Synthetic oligonucleotide; CTC chr11 5232622 5232643 5232639 5232644 +
tgcagtgccagtattatctttg

SEQ ID NO: 85851 - DNA, 22 bp, Artificial Sequence
  Synthetic oligonucleotide; CTG chr11 5232624 5232645 5232641 5232646 +
cagtgccagtattatctttgta

SEQ ID NO: 85852 - DNA, 22 bp, Artificial Sequence
  Synthetic oligonucleotide; TTA chr11 5232638 5232659 5232655 5232660 +
tctttgtatcaagagttcttga

SEQ ID NO: 85853 - DNA, 22 bp, Artificial Sequence
  Synthetic oligonucleotide; CTT chr11 5232642 5232663 5232659 5232664 +
tgtatcaagagttcttgataat

SEQ ID NO: 85854 - DNA, 22 bp, Artificial Sequence
  Synthetic oligonucleotide; TTT chr11 5232643 5232664 5232660 5232665 +
gtatcaagagttcttgataatt

SEQ ID NO: 85855 - DNA, 22 bp, Artificial Sequence
  Synthetic oligonucleotide; TTG chr11 5232644 5232665 5232661 5232666 +
tatcaagagttcttgataattt

SEQ ID NO: 85856 - DNA, 22 bp, Artificial Sequence
  Synthetic oligonucleotide; TTC chr11 5232656 5232677 5232673 5232678 +
ttgataatttctgctctttgga

SEQ ID NO: 85857 - DNA, 22 bp, Artificial Sequence
  Synthetic oligonucleotide; CTT chr11 5232658 5232679 5232675 5232680 +
gataatttctgctctttggagg

SEQ ID NO: 85858 - DNA, 22 bp, Artificial Sequence
  Synthetic oligonucleotide; TTG chr11 5232659 5232680 5232676 5232681 +
ataatttctgctctttggaggt

SEQ ID NO: 85859 - DNA, 22 bp, Artificial Sequence
  Synthetic oligonucleotide; TTT chr11 5232666 5232687 5232683 5232688 +
ctgctctttggaggtagaagtg

SEQ ID NO: 85860 - DNA, 22 bp, Artificial Sequence
  Synthetic oligonucleotide; TTC chr11 5232667 5232688 5232684 5232689 +
tgctctttggaggtagaagtgt

SEQ ID NO: 85861 - DNA, 22 bp, Artificial Sequence
  Synthetic oligonucleotide; CTG chr11 5232669 5232690 5232686 5232691 +
ctctttggaggtagaagtgtca

SEQ ID NO: 85862 - DNA, 22 bp, Artificial Sequence
  Synthetic oligonucleotide; CTC chr11 5232672 5232693 5232689 5232694 +
tttggaggtagaagtgtcaccc

SEQ ID NO: 85863 - DNA, 22 bp, Artificial Sequence
  Synthetic oligonucleotide; CTT chr11 5232674 5232695 5232691 5232696 +
tggaggtagaagtgtcacccat

SEQ ID NO: 85864 - DNA, 22 bp, Artificial Sequence
  Synthetic oligonucleotide; TTT chr11 5232675 5232696 5232692 5232697 +
ggaggtagaagtgtcacccatt

SEQ ID NO: 85865 - DNA, 22 bp, Artificial Sequence
  Synthetic oligonucleotide; TTG chr11 5232676 5232697 5232693 5232698 +
gaggtagaagtgtcacccatta

SEQ ID NO: 85866 - DNA, 22 bp, Artificial Sequence
  Synthetic oligonucleotide; TTA chr11 5232698 5232719 5232715 5232720 +
atgccttgtacggttcccttgc

SEQ ID NO: 85867 - DNA, 22 bp, Artificial Sequence
  Synthetic oligonucleotide; CTT chr11 5232705 5232726 5232722 5232727 +
gtacggttcccttgcttttctc

SEQ ID NO: 85868 - DNA, 22 bp, Artificial Sequence
  Synthetic oligonucleotide; TTG chr11 5232706 5232727 5232723 5232728 +
tacggttcccttgcttttctct

SEQ ID NO: 85869 - DNA, 22 bp, Artificial Sequence
  Synthetic oligonucleotide; TTC chr11 5232714 5232735 5232731 5232736 +
ccttgcttttctcttttcccat

SEQ ID NO: 85870 - DNA, 22 bp, Artificial Sequence
  Synthetic oligonucleotide; CTT chr11 5232718 5232739 5232735 5232740 +
gcttttctcttttcccatgtac

SEQ ID NO: 85871 - DNA, 22 bp, Artificial Sequence
  Synthetic oligonucleotide; TTG chr11 5232719 5232740 5232736 5232741 +
cttttctcttttcccatgtact

SEQ ID NO: 85872 - DNA, 22 bp, Artificial Sequence
  Synthetic oligonucleotide; CTT chr11 5232722 5232743 5232739 5232744 +
ttctcttttcccatgtactctt

SEQ ID NO: 85873 - DNA, 22 bp, Artificial Sequence
  Synthetic oligonucleotide; TTT chr11 5232723 5232744 5232740 5232745 +
tctcttttcccatgtactcttt

SEQ ID NO: 85874 - DNA, 22 bp, Artificial Sequence
  Synthetic oligonucleotide; TTT chr11 5232724 5232745 5232741 5232746 +
ctcttttcccatgtactctttg

SEQ ID NO: 85875 - DNA, 22 bp, Artificial Sequence
  Synthetic oligonucleotide; TTC chr11 5232725 5232746 5232742 5232747 +
tcttttcccatgtactctttgt

SEQ ID NO: 85876 - DNA, 22 bp, Artificial Sequence
  Synthetic oligonucleotide; CTC chr11 5232727 5232748 5232744 5232749 +
ttttcccatgtactctttgtaa

SEQ ID NO: 85877 - DNA, 22 bp, Artificial Sequence
  Synthetic oligonucleotide; CTT chr11 5232729 5232750 5232746 5232751 +
ttcccatgtactctttgtaaaa

SEQ ID NO: 85878 - DNA, 22 bp, Artificial Sequence
  Synthetic oligonucleotide; TTT chr11 5232730 5232751 5232747 5232752 +
tcccatgtactctttgtaaaat

SEQ ID NO: 85879 - DNA, 22 bp, Artificial Sequence
  Synthetic oligonucleotide; TTT chr11 5232731 5232752 5232748 5232753 +
cccatgtactctttgtaaaata

SEQ ID NO: 85880 - DNA, 22 bp, Artificial Sequence
  Synthetic oligonucleotide; TTC chr11 5232732 5232753 5232749 5232754 +
ccatgtactctttgtaaaataa

SEQ ID NO: 85881 - DNA, 22 bp, Artificial Sequence
  Synthetic oligonucleotide; CTC chr11 5232742 5232763 5232759 5232764 +
tttgtaaaataaacaagtgctc

SEQ ID NO: 85882 - DNA, 22 bp, Artificial Sequence
  Synthetic oligonucleotide; CTT chr11 5232744 5232765 5232761 5232766 +
tgtaaaataaacaagtgctccc

SEQ ID NO: 85883 - DNA, 22 bp, Artificial Sequence
  Synthetic oligonucleotide; TTT chr11 5232745 5232766 5232762 5232767 +
gtaaaataaacaagtgctccct

SEQ ID NO: 85884 - DNA, 22 bp, Artificial Sequence
  Synthetic oligonucleotide; TTG chr11 5232746 5232767 5232763 5232768 +
taaaataaacaagtgctcccta

SEQ ID NO: 85885 - DNA, 22 bp, Artificial Sequence
  Synthetic oligonucleotide; CTC chr11 5232764 5232785 5232781 5232786 +
cctatctgtagagcctcaggaa

SEQ ID NO: 85886 - DNA, 22 bp, Artificial Sequence
  Synthetic oligonucleotide; CTA chr11 5232768 5232789 5232785 5232790 +
tctgtagagcctcaggaacctt

SEQ ID NO: 85887 - DNA, 22 bp, Artificial Sequence
  Synthetic oligonucleotide; CTG chr11 5232772 5232793 5232789 5232794 +
tagagcctcaggaaccttctta

SEQ ID NO: 85888 - DNA, 22 bp, Artificial Sequence
  Synthetic oligonucleotide; CTC chr11 5232781 5232802 5232798 5232803 +
aggaaccttcttacacacctgg

SEQ ID NO: 85889 - DNA, 22 bp, Artificial Sequence
  Synthetic oligonucleotide; CTT chr11 5232790 5232811 5232807 5232812 +
cttacacacctggacaaaaaaa

SEQ ID NO: 85890 - DNA, 22 bp, Artificial Sequence
  Synthetic oligonucleotide; TTC chr11 5232791 5232812 5232808 5232813 +
ttacacacctggacaaaaaaat

SEQ ID NO: 85891 - DNA, 22 bp, Artificial Sequence
  Synthetic oligonucleotide; CTT chr11 5232793 5232814 5232810 5232815 +
acacacctggacaaaaaaatga

SEQ ID NO: 85892 - DNA, 22 bp, Artificial Sequence
  Synthetic oligonucleotide; TTA chr11 5232794 5232815 5232811 5232816 +
cacacctggacaaaaaaatgaa

SEQ ID NO: 85893 - DNA, 22 bp, Artificial Sequence
  Synthetic oligonucleotide; CTG chr11 5232802 5232823 5232819 5232824 +
gacaaaaaaatgaaataagtga

SEQ ID NO: 85894 - DNA, 22 bp, Artificial Sequence
  Synthetic oligonucleotide; TTA chr11 5232829 5232850 5232846 5232851 +
atcaggaagttgagctgaacat

SEQ ID NO: 85895 - DNA, 22 bp, Artificial Sequence
  Synthetic oligonucleotide; TTG chr11 5232841 5232862 5232858 5232863 +
agctgaacattctttattaggc

SEQ ID NO: 85896 - DNA, 22 bp, Artificial Sequence
  Synthetic oligonucleotide; CTG chr11 5232846 5232867 5232863 5232868 +
aacattctttattaggcagaag

SEQ ID NO: 85897 - DNA, 22 bp, Artificial Sequence
  Synthetic oligonucleotide; TTC chr11 5232853 5232874 5232870 5232875 +
tttattaggcagaagccatacc

SEQ ID NO: 85898 - DNA, 22 bp, Artificial Sequence
  Synthetic oligonucleotide; CTT chr11 5232855 5232876 5232872 5232877 +
tattaggcagaagccataccct

SEQ ID NO: 85899 - DNA, 22 bp, Artificial Sequence
  Synthetic oligonucleotide; TTT chr11 5232856 5232877 5232873 5232878 +
attaggcagaagccataccctt

SEQ ID NO: 85900 - DNA, 22 bp, Artificial Sequence
  Synthetic oligonucleotide; TTA chr11 5232857 5232878 5232874 5232879 +
ttaggcagaagccatacccttg

SEQ ID NO: 85901 - DNA, 22 bp, Artificial Sequence
  Synthetic oligonucleotide; TTA chr11 5232860 5232881 5232877 5232882 +
ggcagaagccatacccttgaag

SEQ ID NO: 85902 - DNA, 22 bp, Artificial Sequence
  Synthetic oligonucleotide; CTT chr11 5232878 5232899 5232895 5232900 +
gaagtaggcattgtgttcccaa

SEQ ID NO: 85903 - DNA, 22 bp, Artificial Sequence
  Synthetic oligonucleotide; TTG chr11 5232879 5232900 5232896 5232901 +
aagtaggcattgtgttcccaag

SEQ ID NO: 85904 - DNA, 22 bp, Artificial Sequence
  Synthetic oligonucleotide; TTG chr11 5232891 5232912 5232908 5232913 +
tgttcccaagttcagaaaatag

SEQ ID NO: 85905 - DNA, 22 bp, Artificial Sequence
  Synthetic oligonucleotide; TTC chr11 5232896 5232917 5232913 5232918 +
ccaagttcagaaaatagaatct

SEQ ID NO: 85906 - DNA, 22 bp, Artificial Sequence
  Synthetic oligonucleotide; TTC chr11 5232904 5232925 5232921 5232926 +
agaaaatagaatctagggaaat

SEQ ID NO: 85907 - DNA, 22 bp, Artificial Sequence
  Synthetic oligonucleotide; CTA chr11 5232919 5232940 5232936 5232941 +
gggaaatagggtcttcttatgg

SEQ ID NO: 85908 - DNA, 22 bp, Artificial Sequence
  Synthetic oligonucleotide; CTT chr11 5232934 5232955 5232951 5232956 +
cttatggttatcaggaaacagt

SEQ ID NO: 85909 - DNA, 22 bp, Artificial Sequence
  Synthetic oligonucleotide; TTC chr11 5232935 5232956 5232952 5232957 +
ttatggttatcaggaaacagtc

SEQ ID NO: 85910 - DNA, 22 bp, Artificial Sequence
  Synthetic oligonucleotide; CTT chr11 5232937 5232958 5232954 5232959 +
atggttatcaggaaacagtcca

SEQ ID NO: 85911 - DNA, 22 bp, Artificial Sequence
  Synthetic oligonucleotide; TTA chr11 5232938 5232959 5232955 5232960 +
tggttatcaggaaacagtccag

SEQ ID NO: 85912 - DNA, 22 bp, Artificial Sequence
  Synthetic oligonucleotide; TTA chr11 5232944 5232965 5232961 5232966 +
tcaggaaacagtccaggatctc

SEQ ID NO: 85913 - DNA, 22 bp, Artificial Sequence
  Synthetic oligonucleotide; CTC chr11 5232966 5232987 5232983 5232988 +
aatggtacttgtgagccagggc

SEQ ID NO: 85914 - DNA, 22 bp, Artificial Sequence
  Synthetic oligonucleotide; CTT chr11 5232976 5232997 5232993 5232998 +
gtgagccagggcattagccaca

SEQ ID NO: 85915 - DNA, 22 bp, Artificial Sequence
  Synthetic oligonucleotide; TTG chr11 5232977 5232998 5232994 5232999 +
tgagccagggcattagccacac

SEQ ID NO: 85916 - DNA, 22 bp, Artificial Sequence
  Synthetic oligonucleotide; TTA chr11 5232992 5233013 5233009 5233014 +
gccacaccagccaccaccttct

SEQ ID NO: 85917 - DNA, 22 bp, Artificial Sequence
  Synthetic oligonucleotide; CTT chr11 5233012 5233033 5233029 5233034 +
ctgataggcagcctgcatttgt

SEQ ID NO: 85918 - DNA, 22 bp, Artificial Sequence
  Synthetic oligonucleotide; TTC chr11 5233013 5233034 5233030 5233035 +
tgataggcagcctgcatttgtg

SEQ ID NO: 85919 - DNA, 22 bp, Artificial Sequence
  Synthetic oligonucleotide; CTG chr11 5233015 5233036 5233032 5233037 +
ataggcagcctgcatttgtggg

SEQ ID NO: 85920 - DNA, 22 bp, Artificial Sequence
  Synthetic oligonucleotide; CTG chr11 5233027 5233048 5233044 5233049 +
catttgtggggtgaattccttg

SEQ ID NO: 85921 - DNA, 22 bp, Artificial Sequence
  Synthetic oligonucleotide; TTT chr11 5233032 5233053 5233049 5233054 +
gtggggtgaattccttgccaaa

SEQ ID NO: 85922 - DNA, 22 bp, Artificial Sequence
  Synthetic oligonucleotide; TTG chr11 5233033 5233054 5233050 5233055 +
tggggtgaattccttgccaaag

SEQ ID NO: 85923 - DNA, 22 bp, Artificial Sequence
  Synthetic oligonucleotide; TTC chr11 5233045 5233066 5233062 5233067 +
cttgccaaagttgcgggccagc

SEQ ID NO: 85924 - DNA, 22 bp, Artificial Sequence
  Synthetic oligonucleotide; CTT chr11 5233048 5233069 5233065 5233070 +
gccaaagttgcgggccagcaca

SEQ ID NO: 85925 - DNA, 22 bp, Artificial Sequence
  Synthetic oligonucleotide; TTG chr11 5233049 5233070 5233066 5233071 +
ccaaagttgcgggccagcacac

SEQ ID NO: 85926 - DNA, 22 bp, Artificial Sequence
  Synthetic oligonucleotide; TTG chr11 5233058 5233079 5233075 5233080 +
cgggccagcacacacaccagca

SEQ ID NO: 85927 - DNA, 22 bp, Artificial Sequence
  Synthetic oligonucleotide; TTG chr11 5233085 5233106 5233102 5233107 +
cccaagagctgcggagaagagg

SEQ ID NO: 85928 - DNA, 22 bp, Artificial Sequence
  Synthetic oligonucleotide; CTG chr11 5233096 5233117 5233113 5233118 +
cggagaagaggtaggcagatac

SEQ ID NO: 85929 - DNA, 22 bp, Artificial Sequence
  Synthetic oligonucleotide; TTA chr11 5233131 5233152 5233148 5233153 +
acagagaaataaagactggctt

SEQ ID NO: 85930 - DNA, 22 bp, Artificial Sequence
  Synthetic oligonucleotide; CTG chr11 5233149 5233170 5233166 5233171 +
gcttctgagaaactgagccaac

SEQ ID NO: 85931 - DNA, 22 bp, Artificial Sequence
  Synthetic oligonucleotide; CTT chr11 5233153 5233174 5233170 5233175 +
ctgagaaactgagccaacaccc

SEQ ID NO: 85932 - DNA, 22 bp, Artificial Sequence
  Synthetic oligonucleotide; TTC chr11 5233154 5233175 5233171 5233176 +
tgagaaactgagccaacaccca

SEQ ID NO: 85933 - DNA, 22 bp, Artificial Sequence
  Synthetic oligonucleotide; CTG chr11 5233156 5233177 5233173 5233178 +
agaaactgagccaacacccatt

SEQ ID NO: 85934 - DNA, 22 bp, Artificial Sequence
  Synthetic oligonucleotide; CTG chr11 5233164 5233185 5233181 5233186 +
agccaacacccatttttttctg

SEQ ID NO: 85935 - DNA, 22 bp, Artificial Sequence
  Synthetic oligonucleotide; TTT chr11 5233179 5233200 5233196 5233201 +
ttttctgcccaaatcttagaca

SEQ ID NO: 85936 - DNA, 22 bp, Artificial Sequence
  Synthetic oligonucleotide; TTT chr11 5233180 5233201 5233197 5233202 +
tttctgcccaaatcttagacaa

SEQ ID NO: 85937 - DNA, 22 bp, Artificial Sequence
  Synthetic oligonucleotide; TTT chr11 5233181 5233202 5233198 5233203 +
ttctgcccaaatcttagacaaa

SEQ ID NO: 85938 - DNA, 22 bp, Artificial Sequence
  Synthetic oligonucleotide; TTT chr11 5233182 5233203 5233199 5233204 +
tctgcccaaatcttagacaaaa

SEQ ID NO: 85939 - DNA, 22 bp, Artificial Sequence
  Synthetic oligonucleotide; TTT chr11 5233183 5233204 5233200 5233205 +
ctgcccaaatcttagacaaaac

SEQ ID NO: 85940 - DNA, 22 bp, Artificial Sequence
  Synthetic oligonucleotide; TTC chr11 5233184 5233205 5233201 5233206 +
tgcccaaatcttagacaaaact

SEQ ID NO: 85941 - DNA, 22 bp, Artificial Sequence
  Synthetic oligonucleotide; CTG chr11 5233186 5233207 5233203 5233208 +
cccaaatcttagacaaaactga

SEQ ID NO: 85942 - DNA, 22 bp, Artificial Sequence
  Synthetic oligonucleotide; CTT chr11 5233196 5233217 5233213 5233218 +
agacaaaactgatccccaggtt

SEQ ID NO: 85943 - DNA, 22 bp, Artificial Sequence
  Synthetic oligonucleotide; TTA chr11 5233197 5233218 5233214 5233219 +
gacaaaactgatccccaggtta

SEQ ID NO: 85944 - DNA, 22 bp, Artificial Sequence
  Synthetic oligonucleotide; CTG chr11 5233207 5233228 5233224 5233229 +
atccccaggttattcccatcag

SEQ ID NO: 85945 - DNA, 22 bp, Artificial Sequence
  Synthetic oligonucleotide; TTA chr11 5233219 5233240 5233236 5233241 +
ttcccatcagcataaataagta

SEQ ID NO: 85946 - DNA, 22 bp, Artificial Sequence
  Synthetic oligonucleotide; TTC chr11 5233222 5233243 5233239 5233244 +
ccatcagcataaataagtacat

SEQ ID NO: 85947 - DNA, 22 bp, Artificial Sequence
  Synthetic oligonucleotide; CTA chr11 5233274 5233295 5233291 5233296 +
tacacacacatcctctatgtac

SEQ ID NO: 85948 - DNA, 22 bp, Artificial Sequence
  Synthetic oligonucleotide; CTC chr11 5233289 5233310 5233306 5233311 +
tatgtacttaactagcatgtag

SEQ ID NO: 85949 - DNA, 22 bp, Artificial Sequence
  Synthetic oligonucleotide; CTA chr11 5233291 5233312 5233308 5233313 +
tgtacttaactagcatgtagtc

SEQ ID NO: 85950 - DNA, 22 bp, Artificial Sequence
  Synthetic oligonucleotide; CTT chr11 5233298 5233319 5233315 5233320 +
aactagcatgtagtctatatat

SEQ ID NO: 85951 - DNA, 22 bp, Artificial Sequence
  Synthetic oligonucleotide; TTA chr11 5233299 5233320 5233316 5233321 +
actagcatgtagtctatatatg

SEQ ID NO: 85952 - DNA, 22 bp, Artificial Sequence
  Synthetic oligonucleotide; CTA chr11 5233303 5233324 5233320 5233325 +
gcatgtagtctatatatgtaca

SEQ ID NO: 85953 - DNA, 22 bp, Artificial Sequence
  Synthetic oligonucleotide; CTA chr11 5233315 5233336 5233332 5233337 +
tatatgtacatatatgctatat

SEQ ID NO: 85954 - DNA, 22 bp, Artificial Sequence
  Synthetic oligonucleotide; CTA chr11 5233334 5233355 5233351 5233356 +
tatatgctgtataatactatat

SEQ ID NO: 85955 - DNA, 22 bp, Artificial Sequence
  Synthetic oligonucleotide; CTG chr11 5233343 5233364 5233360 5233365 +
tataatactatatacaaattaa

SEQ ID NO: 85956 - DNA, 22 bp, Artificial Sequence
  Synthetic oligonucleotide; CTA chr11 5233353 5233374 5233370 5233375 +
tatacaaattaattccaaatta

SEQ ID NO: 85957 - DNA, 22 bp, Artificial Sequence
  Synthetic oligonucleotide; TTA chr11 5233364 5233385 5233381 5233386 +
attccaaattagttttaatttt

SEQ ID NO: 85958 - DNA, 22 bp, Artificial Sequence
  Synthetic oligonucleotide; TTC chr11 5233368 5233389 5233385 5233390 +
caaattagttttaattttgtat

SEQ ID NO: 85959 - DNA, 22 bp, Artificial Sequence
  Synthetic oligonucleotide; TTA chr11 5233375 5233396 5233392 5233397 +
gttttaattttgtatgtgtata

SEQ ID NO: 85960 - DNA, 22 bp, Artificial Sequence
  Synthetic oligonucleotide; TTT chr11 5233379 5233400 5233396 5233401 +
taattttgtatgtgtatatagc

SEQ ID NO: 85961 - DNA, 22 bp, Artificial Sequence
  Synthetic oligonucleotide; TTT chr11 5233380 5233401 5233397 5233402 +
aattttgtatgtgtatatagca

SEQ ID NO: 85962 - DNA, 22 bp, Artificial Sequence
  Synthetic oligonucleotide; TTA chr11 5233381 5233402 5233398 5233403 +
attttgtatgtgtatatagcat

SEQ ID NO: 85963 - DNA, 22 bp, Artificial Sequence
  Synthetic oligonucleotide; TTT chr11 5233385 5233406 5233402 5233407 +
tgtatgtgtatatagcatatac

SEQ ID NO: 85964 - DNA, 22 bp, Artificial Sequence
  Synthetic oligonucleotide; TTT chr11 5233386 5233407 5233403 5233408 +
gtatgtgtatatagcatataca

SEQ ID NO: 85965 - DNA, 22 bp, Artificial Sequence
  Synthetic oligonucleotide; TTG chr11 5233387 5233408 5233404 5233409 +
tatgtgtatatagcatatacaa

SEQ ID NO: 85966 - DNA, 22 bp, Artificial Sequence
  Synthetic oligonucleotide; TTA chr11 5233413 5233434 5233430 5233435 +
attactataaacagattaatag

SEQ ID NO: 85967 - DNA, 22 bp, Artificial Sequence
  Synthetic oligonucleotide; TTA chr11 5233417 5233438 5233434 5233439 +
ctataaacagattaatagatac

SEQ ID NO: 85968 - DNA, 22 bp, Artificial Sequence
  Synthetic oligonucleotide; CTA chr11 5233420 5233441 5233437 5233442 +
taaacagattaatagatacaaa

SEQ ID NO: 85969 - DNA, 22 bp, Artificial Sequence
  Synthetic oligonucleotide; TTA chr11 5233431 5233452 5233448 5233453 +
atagatacaaattaattgatta

SEQ ID NO: 85970 - DNA, 22 bp, Artificial Sequence
  Synthetic oligonucleotide; TTA chr11 5233445 5233466 5233462 5233467 +
attgattaatcagtgtgatgat

SEQ ID NO: 85971 - DNA, 22 bp, Artificial Sequence
  Synthetic oligonucleotide; TTG chr11 5233449 5233470 5233466 5233471 +
attaatcagtgtgatgatgggc

SEQ ID NO: 85972 - DNA, 22 bp, Artificial Sequence
  Synthetic oligonucleotide; TTA chr11 5233453 5233474 5233470 5233475 +
atcagtgtgatgatgggctgtc

SEQ ID NO: 85973 - DNA, 22 bp, Artificial Sequence
  Synthetic oligonucleotide; CTG chr11 5233473 5233494 5233490 5233495 +
tctcctagcaacgacttctgcc

SEQ ID NO: 85974 - DNA, 22 bp, Artificial Sequence
  Synthetic oligonucleotide; CTC chr11 5233477 5233498 5233494 5233499 +
ctagcaacgacttctgccccac

SEQ ID NO: 85975 - DNA, 22 bp, Artificial Sequence
  Synthetic oligonucleotide; CTA chr11 5233480 5233501 5233497 5233502 +
gcaacgacttctgccccacctc

SEQ ID NO: 85976 - DNA, 22 bp, Artificial Sequence
  Synthetic oligonucleotide; CTT chr11 5233490 5233511 5233507 5233512 +
ctgccccacctccagtgtaact

SEQ ID NO: 85977 - DNA, 22 bp, Artificial Sequence
  Synthetic oligonucleotide; TTC chr11 5233491 5233512 5233508 5233513 +
tgccccacctccagtgtaactg

SEQ ID NO: 85978 - DNA, 22 bp, Artificial Sequence
  Synthetic oligonucleotide; CTG chr11 5233493 5233514 5233510 5233515 +
ccccacctccagtgtaactgcc

SEQ ID NO: 85979 - DNA, 22 bp, Artificial Sequence
  Synthetic oligonucleotide; CTC chr11 5233502 5233523 5233519 5233524 +
cagtgtaactgcctagtctttc

SEQ ID NO: 85980 - DNA, 22 bp, Artificial Sequence
  Synthetic oligonucleotide; CTG chr11 5233513 5233534 5233530 5233535 +
cctagtctttcataatcaaata

SEQ ID NO: 85981 - DNA, 22 bp, Artificial Sequence
  Synthetic oligonucleotide; CTA chr11 5233517 5233538 5233534 5233539 +
gtctttcataatcaaatattca

SEQ ID NO: 85982 - DNA, 22 bp, Artificial Sequence
  Synthetic oligonucleotide; CTT chr11 5233522 5233543 5233539 5233544 +
tcataatcaaatattcactttc

SEQ ID NO: 85983 - DNA, 22 bp, Artificial Sequence
  Synthetic oligonucleotide; TTT chr11 5233523 5233544 5233540 5233545 +
cataatcaaatattcactttcc

SEQ ID NO: 85984 - DNA, 22 bp, Artificial Sequence
  Synthetic oligonucleotide; TTC chr11 5233524 5233545 5233541 5233546 +
ataatcaaatattcactttcct

SEQ ID NO: 85985 - DNA, 22 bp, Artificial Sequence
  Synthetic oligonucleotide; TTC chr11 5233538 5233559 5233555 5233560 +
actttcctttccattccattta

SEQ ID NO: 85986 - DNA, 22 bp, Artificial Sequence
  Synthetic oligonucleotide; CTT chr11 5233542 5233563 5233559 5233564 +
tcctttccattccatttactac

SEQ ID NO: 85987 - DNA, 22 bp, Artificial Sequence
  Synthetic oligonucleotide; TTT chr11 5233543 5233564 5233560 5233565 +
cctttccattccatttactaca

SEQ ID NO: 85988 - DNA, 22 bp, Artificial Sequence
  Synthetic oligonucleotide; TTC chr11 5233544 5233565 5233561 5233566 +
ctttccattccatttactacag

SEQ ID NO: 85989 - DNA, 22 bp, Artificial Sequence
  Synthetic oligonucleotide; CTT chr11 5233547 5233568 5233564 5233569 +
tccattccatttactacagaat

SEQ ID NO: 85990 - DNA, 22 bp, Artificial Sequence
  Synthetic oligonucleotide; TTT chr11 5233548 5233569 5233565 5233570 +
ccattccatttactacagaatt

SEQ ID NO: 85991 - DNA, 22 bp, Artificial Sequence
  Synthetic oligonucleotide; TTC chr11 5233549 5233570 5233566 5233571 +
cattccatttactacagaattt

SEQ ID NO: 85992 - DNA, 22 bp, Artificial Sequence
  Synthetic oligonucleotide; TTC chr11 5233554 5233575 5233571 5233576 +
catttactacagaatttataaa

SEQ ID NO: 85993 - DNA, 22 bp, Artificial Sequence
  Synthetic oligonucleotide; TTT chr11 5233559 5233580 5233576 5233581 +
actacagaatttataaaattcc

SEQ ID NO: 85994 - DNA, 22 bp, Artificial Sequence
  Synthetic oligonucleotide; TTA chr11 5233560 5233581 5233577 5233582 +
ctacagaatttataaaattcca

SEQ ID NO: 85995 - DNA, 22 bp, Artificial Sequence
  Synthetic oligonucleotide; CTA chr11 5233563 5233584 5233580 5233585 +
cagaatttataaaattccaatt

SEQ ID NO: 85996 - DNA, 22 bp, Artificial Sequence
  Synthetic oligonucleotide; TTT chr11 5233571 5233592 5233588 5233593 +
ataaaattccaattattcctta

SEQ ID NO: 85997 - DNA, 22 bp, Artificial Sequence
  Synthetic oligonucleotide; TTA chr11 5233572 5233593 5233589 5233594 +
taaaattccaattattccttat

SEQ ID NO: 85998 - DNA, 22 bp, Artificial Sequence
  Synthetic oligonucleotide; TTC chr11 5233580 5233601 5233597 5233602 +
caattattccttattgtaaaat

SEQ ID NO: 85999 - DNA, 22 bp, Artificial Sequence
  Synthetic oligonucleotide; TTA chr11 5233586 5233607 5233603 5233608 +
ttccttattgtaaaatgattta

SEQ ID NO: 86000 - DNA, 22 bp, Artificial Sequence
  Synthetic oligonucleotide; TTC chr11 5233589 5233610 5233606 5233611 +
cttattgtaaaatgatttatag

SEQ ID NO: 86001 - DNA, 22 bp, Artificial Sequence
  Synthetic oligonucleotide; CTT chr11 5233592 5233613 5233609 5233614 +
attgtaaaatgatttatagcct

SEQ ID NO: 86002 - DNA, 22 bp, Artificial Sequence
  Synthetic oligonucleotide; TTA chr11 5233593 5233614 5233610 5233615 +
ttgtaaaatgatttatagcctc

SEQ ID NO: 86003 - DNA, 22 bp, Artificial Sequence
  Synthetic oligonucleotide; TTG chr11 5233596 5233617 5233613 5233618 +
taaaatgatttatagcctctaa

SEQ ID NO: 86004 - DNA, 22 bp, Artificial Sequence
  Synthetic oligonucleotide; TTT chr11 5233607 5233628 5233624 5233629 +
atagcctctaaaacagtattct

SEQ ID NO: 86005 - DNA, 22 bp, Artificial Sequence
  Synthetic oligonucleotide; TTA chr11 5233608 5233629 5233625 5233630 +
tagcctctaaaacagtattcta

SEQ ID NO: 86006 - DNA, 22 bp, Artificial Sequence
  Synthetic oligonucleotide; CTC chr11 5233615 5233636 5233632 5233637 +
taaaacagtattctatgcctct

SEQ ID NO: 86007 - DNA, 22 bp, Artificial Sequence
  Synthetic oligonucleotide; CTA chr11 5233617 5233638 5233634 5233639 +
aaacagtattctatgcctctca

SEQ ID NO: 86008 - DNA, 22 bp, Artificial Sequence
  Synthetic oligonucleotide; TTC chr11 5233628 5233649 5233645 5233650 +
tatgcctctcatctttgagttg

SEQ ID NO: 86009 - DNA, 22 bp, Artificial Sequence
  Synthetic oligonucleotide; CTA chr11 5233630 5233651 5233647 5233652 +
tgcctctcatctttgagttgga

SEQ ID NO: 86010 - DNA, 22 bp, Artificial Sequence
  Synthetic oligonucleotide; CTC chr11 5233636 5233657 5233653 5233658 +
tcatctttgagttggagcctct

SEQ ID NO: 86011 - DNA, 22 bp, Artificial Sequence
  Synthetic oligonucleotide; CTC chr11 5233638 5233659 5233655 5233660 +
atctttgagttggagcctctcc

SEQ ID NO: 86012 - DNA, 22 bp, Artificial Sequence
  Synthetic oligonucleotide; CTT chr11 5233643 5233664 5233660 5233665 +
tgagttggagcctctcccatac

SEQ ID NO: 86013 - DNA, 22 bp, Artificial Sequence
  Synthetic oligonucleotide; TTT chr11 5233644 5233665 5233661 5233666 +
gagttggagcctctcccatacc

SEQ ID NO: 86014 - DNA, 22 bp, Artificial Sequence
  Synthetic oligonucleotide; TTG chr11 5233645 5233666 5233662 5233667 +
agttggagcctctcccataccc

SEQ ID NO: 86015 - DNA, 22 bp, Artificial Sequence
  Synthetic oligonucleotide; TTG chr11 5233650 5233671 5233667 5233672 +
gagcctctcccatacccatgtg

SEQ ID NO: 86016 - DNA, 22 bp, Artificial Sequence
  Synthetic oligonucleotide; CTC chr11 5233657 5233678 5233674 5233679 +
tcccatacccatgtggagagac

SEQ ID NO: 86017 - DNA, 22 bp, Artificial Sequence
  Synthetic oligonucleotide; CTC chr11 5233659 5233680 5233676 5233681 +
ccatacccatgtggagagacaa

SEQ ID NO: 86018 - DNA, 22 bp, Artificial Sequence
  Synthetic oligonucleotide; TTA chr11 5233689 5233710 5233706 5233711 +
ttctaagtgcagaattagcagg

SEQ ID NO: 86019 - DNA, 22 bp, Artificial Sequence
  Synthetic oligonucleotide; TTC chr11 5233692 5233713 5233709 5233714 +
taagtgcagaattagcaggtga

SEQ ID NO: 86020 - DNA, 22 bp, Artificial Sequence
  Synthetic oligonucleotide; CTA chr11 5233694 5233715 5233711 5233716 +
agtgcagaattagcaggtgaga

SEQ ID NO: 86021 - DNA, 22 bp, Artificial Sequence
  Synthetic oligonucleotide; TTA chr11 5233706 5233727 5233723 5233728 +
gcaggtgagagctggtatgcat

SEQ ID NO: 86022 - DNA, 22 bp, Artificial Sequence
  Synthetic oligonucleotide; CTG chr11 5233720 5233741 5233737 5233742 +
gtatgcataatttgagttgttg

SEQ ID NO: 86023 - DNA, 22 bp, Artificial Sequence
  Synthetic oligonucleotide; TTT chr11 5233733 5233754 5233750 5233755 +
gagttgttgttagagaaggaaa

SEQ ID NO: 86024 - DNA, 22 bp, Artificial Sequence
  Synthetic oligonucleotide; TTG chr11 5233734 5233755 5233751 5233756 +
agttgttgttagagaaggaaaa

SEQ ID NO: 86025 - DNA, 22 bp, Artificial Sequence
  Synthetic oligonucleotide; TTG chr11 5233739 5233760 5233756 5233761 +
ttgttagagaaggaaaaatgaa

SEQ ID NO: 86026 - DNA, 22 bp, Artificial Sequence
  Synthetic oligonucleotide; TTG chr11 5233742 5233763 5233759 5233764 +
ttagagaaggaaaaatgaaggg

SEQ ID NO: 86027 - DNA, 22 bp, Artificial Sequence
  Synthetic oligonucleotide; TTA chr11 5233745 5233766 5233762 5233767 +
gagaaggaaaaatgaagggagg

SEQ ID NO: 86028 - DNA, 22 bp, Artificial Sequence
  Synthetic oligonucleotide; TTG chr11 5233773 5233794 5233790 5233795 +
ggagagaaagacaggatattaa

SEQ ID NO: 86029 - DNA, 22 bp, Artificial Sequence
  Synthetic oligonucleotide; TTA chr11 5233794 5233815 5233811 5233816 +
aataatttaaaatagcaagatt

SEQ ID NO: 86030 - DNA, 22 bp, Artificial Sequence
  Synthetic oligonucleotide; TTT chr11 5233802 5233823 5233819 5233824 +
aaaatagcaagattgtgaggaa

SEQ ID NO: 86031 - DNA, 22 bp, Artificial Sequence
  Synthetic oligonucleotide; TTA chr11 5233803 5233824 5233820 5233825 +
aaatagcaagattgtgaggaag

SEQ ID NO: 86032 - DNA, 22 bp, Artificial Sequence
  Synthetic oligonucleotide; TTG chr11 5233817 5233838 5233834 5233839 +
tgaggaaggaaaaaatgcagaa

SEQ ID NO: 86033 - DNA, 22 bp, Artificial Sequence
  Synthetic oligonucleotide; TTT chr11 5233844 5233865 5233861 5233866 +
aaataaaaaattaacaaaattt

SEQ ID NO: 86034 - DNA, 22 bp, Artificial Sequence
  Synthetic oligonucleotide; TTA chr11 5233845 5233866 5233862 5233867 +
aataaaaaattaacaaaatttt

SEQ ID NO: 86035 - DNA, 22 bp, Artificial Sequence
  Synthetic oligonucleotide; TTA chr11 5233857 5233878 5233874 5233879 +
acaaaattttagaagcattaaa

SEQ ID NO: 86036 - DNA, 22 bp, Artificial Sequence
  Synthetic oligonucleotide; TTT chr11 5233866 5233887 5233883 5233888 +
tagaagcattaaatgataaaat

SEQ ID NO: 86037 - DNA, 22 bp, Artificial Sequence
  Synthetic oligonucleotide; TTT chr11 5233867 5233888 5233884 5233889 +
agaagcattaaatgataaaata

SEQ ID NO: 86038 - DNA, 22 bp, Artificial Sequence
  Synthetic oligonucleotide; TTA chr11 5233868 5233889 5233885 5233890 +
gaagcattaaatgataaaatat

SEQ ID NO: 86039 - DNA, 22 bp, Artificial Sequence
  Synthetic oligonucleotide; TTA chr11 5233877 5233898 5233894 5233899 +
aatgataaaatatagtaaaatg

SEQ ID NO: 86040 - DNA, 22 bp, Artificial Sequence
  Synthetic oligonucleotide; TTA chr11 5233951 5233972 5233968 5233973 +
gaaagtaaaaagagaaaagtga

SEQ ID NO: 86041 - DNA, 22 bp, Artificial Sequence
  Synthetic oligonucleotide; CTC chr11 5233981 5234002 5233998 5234003 +
ctggactcaccctgaagttctc

SEQ ID NO: 86042 - DNA, 22 bp, Artificial Sequence
  Synthetic oligonucleotide; CTG chr11 5233984 5234005 5234001 5234006 +
gactcaccctgaagttctcagg

SEQ ID NO: 86043 - DNA, 22 bp, Artificial Sequence
  Synthetic oligonucleotide; CTC chr11 5233989 5234010 5234006 5234011 +
accctgaagttctcaggatcca

SEQ ID NO: 86044 - DNA, 22 bp, Artificial Sequence
  Synthetic oligonucleotide; CTG chr11 5233995 5234016 5234012 5234017 +
aagttctcaggatccacgtgca

SEQ ID NO: 86045 - DNA, 22 bp, Artificial Sequence
  Synthetic oligonucleotide; TTC chr11 5234001 5234022 5234018 5234023 +
tcaggatccacgtgcagcttgt

SEQ ID NO: 86046 - DNA, 22 bp, Artificial Sequence
  Synthetic oligonucleotide; CTC chr11 5234003 5234024 5234020 5234025 +
aggatccacgtgcagcttgtca

SEQ ID NO: 86047 - DNA, 22 bp, Artificial Sequence
  Synthetic oligonucleotide; CTT chr11 5234021 5234042 5234038 5234043 +
gtcacagtgcagctcactcagc

SEQ ID NO: 86048 - DNA, 22 bp, Artificial Sequence
  Synthetic oligonucleotide; TTG chr11 5234022 5234043 5234039 5234044 +
tcacagtgcagctcactcagct

SEQ ID NO: 86049 - DNA, 22 bp, Artificial Sequence
  Synthetic oligonucleotide; CTC chr11 5234036 5234057 5234053 5234058 +
actcagctgagaaaaagtgccc

SEQ ID NO: 86050 - DNA, 22 bp, Artificial Sequence
  Synthetic oligonucleotide; CTC chr11 5234040 5234061 5234057 5234062 +
agctgagaaaaagtgcccttga

SEQ ID NO: 86051 - DNA, 22 bp, Artificial Sequence
  Synthetic oligonucleotide; CTG chr11 5234045 5234066 5234062 5234067 +
agaaaaagtgcccttgaggttg

SEQ ID NO: 86052 - DNA, 22 bp, Artificial Sequence
  Synthetic oligonucleotide; CTT chr11 5234060 5234081 5234077 5234082 +
gaggttgtccaggtgagccagg

SEQ ID NO: 86053 - DNA, 22 bp, Artificial Sequence
  Synthetic oligonucleotide; TTG chr11 5234061 5234082 5234078 5234083 +
aggttgtccaggtgagccaggc

SEQ ID NO: 86054 - DNA, 22 bp, Artificial Sequence
  Synthetic oligonucleotide; TTG chr11 5234067 5234088 5234084 5234089 +
tccaggtgagccaggccatcac

SEQ ID NO: 86055 - DNA, 22 bp, Artificial Sequence
  Synthetic oligonucleotide; CTA chr11 5234091 5234112 5234108 5234113 +
aaggcacctagcaccttcttgc

SEQ ID NO: 86056 - DNA, 22 bp, Artificial Sequence
  Synthetic oligonucleotide; CTA chr11 5234101 5234122 5234118 5234123 +
gcaccttcttgccatgagcctt

SEQ ID NO: 86057 - DNA, 22 bp, Artificial Sequence
  Synthetic oligonucleotide; CTT chr11 5234108 5234129 5234125 5234130 +
cttgccatgagccttcacctta

SEQ ID NO: 86058 - DNA, 22 bp, Artificial Sequence
  Synthetic oligonucleotide; TTC chr11 5234109 5234130 5234126 5234131 +
ttgccatgagccttcaccttag

SEQ ID NO: 86059 - DNA, 22 bp, Artificial Sequence
  Synthetic oligonucleotide; CTT chr11 5234111 5234132 5234128 5234133 +
gccatgagccttcaccttaggg

SEQ ID NO: 86060 - DNA, 22 bp, Artificial Sequence
  Synthetic oligonucleotide; TTG chr11 5234112 5234133 5234129 5234134 +
ccatgagccttcaccttagggt

SEQ ID NO: 86061 - DNA, 22 bp, Artificial Sequence
  Synthetic oligonucleotide; CTT chr11 5234123 5234144 5234140 5234145 +
caccttagggttgcccataaca

SEQ ID NO: 86062 - DNA, 22 bp, Artificial Sequence
  Synthetic oligonucleotide; TTC chr11 5234124 5234145 5234141 5234146 +
accttagggttgcccataacag

SEQ ID NO: 86063 - DNA, 22 bp, Artificial Sequence
  Synthetic oligonucleotide; CTT chr11 5234129 5234150 5234146 5234151 +
agggttgcccataacagcatca

SEQ ID NO: 86064 - DNA, 22 bp, Artificial Sequence
  Synthetic oligonucleotide; TTA chr11 5234130 5234151 5234147 5234152 +
gggttgcccataacagcatcag

SEQ ID NO: 86065 - DNA, 22 bp, Artificial Sequence
  Synthetic oligonucleotide; TTG chr11 5234136 5234157 5234153 5234158 +
cccataacagcatcaggagagg

SEQ ID NO: 86066 - DNA, 22 bp, Artificial Sequence
  Synthetic oligonucleotide; CTC chr11 5234177 5234198 5234194 5234199 +
aaagaacctctgggtccaaggg

SEQ ID NO: 86067 - DNA, 22 bp, Artificial Sequence
  Synthetic oligonucleotide; CTC chr11 5234187 5234208 5234204 5234209 +
tgggtccaagggtagaccacca

SEQ ID NO: 86068 - DNA, 22 bp, Artificial Sequence
  Synthetic oligonucleotide; CTG chr11 5234189 5234210 5234206 5234211 +
ggtccaagggtagaccaccagt

SEQ ID NO: 86069 - DNA, 22 bp, Artificial Sequence
  Synthetic oligonucleotide; CTG chr11 5234217 5234238 5234234 5234239 +
agggtaggaaaacagcccaagg

SEQ ID NO: 86070 - DNA, 22 bp, Artificial Sequence
  Synthetic oligonucleotide; CTA chr11 5234258 5234279 5234275 5234280 +
tcagaaacccaagagtcttctc

SEQ ID NO: 86071 - DNA, 22 bp, Artificial Sequence
  Synthetic oligonucleotide; CTT chr11 5234277 5234298 5234294 5234299 +
ctctgtctacacatgcccagtt

SEQ ID NO: 86072 - DNA, 22 bp, Artificial Sequence
  Synthetic oligonucleotide; TTC chr11 5234278 5234299 5234295 5234300 +
tctgtctacacatgcccagttt

SEQ ID NO: 86073 - DNA, 22 bp, Artificial Sequence
  Synthetic oligonucleotide; CTC chr11 5234280 5234301 5234297 5234302 +
tgtctacacatgcccagtttcc

SEQ ID NO: 86074 - DNA, 22 bp, Artificial Sequence
  Synthetic oligonucleotide; CTG chr11 5234282 5234303 5234299 5234304 +
tctacacatgcccagtttccat

SEQ ID NO: 86075 - DNA, 22 bp, Artificial Sequence
  Synthetic oligonucleotide; CTA chr11 5234286 5234307 5234303 5234308 +
cacatgcccagtttccatttgc

SEQ ID NO: 86076 - DNA, 22 bp, Artificial Sequence
  Synthetic oligonucleotide; TTT chr11 5234300 5234321 5234317 5234322 +
ccatttgcctccttgagcctct

SEQ ID NO: 86077 - DNA, 22 bp, Artificial Sequence
  Synthetic oligonucleotide; TTC chr11 5234301 5234322 5234318 5234323 +
catttgcctccttgagcctctc

SEQ ID NO: 86078 - DNA, 22 bp, Artificial Sequence
  Synthetic oligonucleotide; TTT chr11 5234306 5234327 5234323 5234328 +
gcctccttgagcctctcttata

SEQ ID NO: 86079 - DNA, 22 bp, Artificial Sequence
  Synthetic oligonucleotide; TTG chr11 5234307 5234328 5234324 5234329 +
cctccttgagcctctcttataa

SEQ ID NO: 86080 - DNA, 22 bp, Artificial Sequence
  Synthetic oligonucleotide; CTC chr11 5234311 5234332 5234328 5234333 +
cttgagcctctcttataacctt

SEQ ID NO: 86081 - DNA, 22 bp, Artificial Sequence
  Synthetic oligonucleotide; CTT chr11 5234314 5234335 5234331 5234336 +
gagcctctcttataaccttgat

SEQ ID NO: 86082 - DNA, 22 bp, Artificial Sequence
  Synthetic oligonucleotide; TTG chr11 5234315 5234336 5234332 5234337 +
agcctctcttataaccttgata

SEQ ID NO: 86083 - DNA, 22 bp, Artificial Sequence
  Synthetic oligonucleotide; CTC chr11 5234321 5234342 5234338 5234343 +
tcttataaccttgataccaacc

SEQ ID NO: 86084 - DNA, 22 bp, Artificial Sequence
  Synthetic oligonucleotide; CTC chr11 5234323 5234344 5234340 5234345 +
ttataaccttgataccaacctg

SEQ ID NO: 86085 - DNA, 22 bp, Artificial Sequence
  Synthetic oligonucleotide; CTT chr11 5234325 5234346 5234342 5234347 +
ataaccttgataccaacctgcc

SEQ ID NO: 86086 - DNA, 22 bp, Artificial Sequence
  Synthetic oligonucleotide; TTA chr11 5234326 5234347 5234343 5234348 +
taaccttgataccaacctgccc

SEQ ID NO: 86087 - DNA, 22 bp, Artificial Sequence
  Synthetic oligonucleotide; CTT chr11 5234333 5234354 5234350 5234355 +
gataccaacctgcccagggcct

SEQ ID NO: 86088 - DNA, 22 bp, Artificial Sequence
  Synthetic oligonucleotide; TTG chr11 5234334 5234355 5234351 5234356 +
ataccaacctgcccagggcctc

SEQ ID NO: 86089 - DNA, 22 bp, Artificial Sequence
  Synthetic oligonucleotide; CTG chr11 5234345 5234366 5234362 5234367 +
cccagggcctcaccaccaactg

SEQ ID NO: 86090 - DNA, 22 bp, Artificial Sequence
  Synthetic oligonucleotide; CTC chr11 5234356 5234377 5234373 5234378 +
accaccaactgcatccacgttc

SEQ ID NO: 86091 - DNA, 22 bp, Artificial Sequence
  Synthetic oligonucleotide; CTG chr11 5234367 5234388 5234384 5234389 +
catccacgttcactttgcccca

SEQ ID NO: 86092 - DNA, 22 bp, Artificial Sequence
  Synthetic oligonucleotide; TTC chr11 5234378 5234399 5234395 5234400 +
actttgccccacagggcattga

SEQ ID NO: 86093 - DNA, 22 bp, Artificial Sequence
  Synthetic oligonucleotide; CTT chr11 5234382 5234403 5234399 5234404 +
tgccccacagggcattgacagc

SEQ ID NO: 86094 - DNA, 22 bp, Artificial Sequence
  Synthetic oligonucleotide; TTT chr11 5234383 5234404 5234400 5234405 +
gccccacagggcattgacagca

SEQ ID NO: 86095 - DNA, 22 bp, Artificial Sequence
  Synthetic oligonucleotide; TTG chr11 5234384 5234405 5234401 5234406 +
ccccacagggcattgacagcag

SEQ ID NO: 86096 - DNA, 22 bp, Artificial Sequence
  Synthetic oligonucleotide; TTG chr11 5234399 5234420 5234416 5234421 +
acagcagtcttctcctcaggag

SEQ ID NO: 86097 - DNA, 22 bp, Artificial Sequence
  Synthetic oligonucleotide; CTT chr11 5234410 5234431 5234427 5234432 +
ctcctcaggagtcagatgcacc

SEQ ID NO: 86098 - DNA, 22 bp, Artificial Sequence
  Synthetic oligonucleotide; TTC chr11 5234411 5234432 5234428 5234433 +
tcctcaggagtcagatgcacca

SEQ ID NO: 86099 - DNA, 22 bp, Artificial Sequence
  Synthetic oligonucleotide; CTC chr11 5234413 5234434 5234430 5234435 +
ctcaggagtcagatgcaccatg

SEQ ID NO: 86100 - DNA, 22 bp, Artificial Sequence
  Synthetic oligonucleotide; CTC chr11 5234416 5234437 5234433 5234438 +
aggagtcagatgcaccatggtg

SEQ ID NO: 86101 - DNA, 22 bp, Artificial Sequence
  Synthetic oligonucleotide; CTG chr11 5234442 5234463 5234459 5234464 +
tttgaggttgctagtgaacact

SEQ ID NO: 86102 - DNA, 22 bp, Artificial Sequence
  Synthetic oligonucleotide; TTT chr11 5234445 5234466 5234462 5234467 +
gaggttgctagtgaacactgtt

SEQ ID NO: 86103 - DNA, 22 bp, Artificial Sequence
  Synthetic oligonucleotide; TTG chr11 5234446 5234467 5234463 5234468 +
aggttgctagtgaacactgtta

SEQ ID NO: 86104 - DNA, 22 bp, Artificial Sequence
  Synthetic oligonucleotide; TTG chr11 5234452 5234473 5234469 5234474 +
ctagtgaacactgttatgtcag

SEQ ID NO: 86105 - DNA, 22 bp, Artificial Sequence
  Synthetic oligonucleotide; CTA chr11 5234455 5234476 5234472 5234477 +
gtgaacactgttatgtcagaag

SEQ ID NO: 86106 - DNA, 22 bp, Artificial Sequence
  Synthetic oligonucleotide; CTG chr11 5234465 5234486 5234482 5234487 +
ttatgtcagaagaaagtgtaag

SEQ ID NO: 86107 - DNA, 22 bp, Artificial Sequence
  Synthetic oligonucleotide; TTA chr11 5234468 5234489 5234485 5234490 +
tgtcagaagaaagtgtaagcaa

SEQ ID NO: 86108 - DNA, 22 bp, Artificial Sequence
  Synthetic oligonucleotide; CTC chr11 5234500 5234521 5234517 5234522 +
tgccctgccttttatgctggtc

SEQ ID NO: 86109 - DNA, 22 bp, Artificial Sequence
  Synthetic oligonucleotide; CTG chr11 5234502 5234523 5234519 5234524 +
ccctgccttttatgctggtcct

SEQ ID NO: 86110 - DNA, 22 bp, Artificial Sequence
  Synthetic oligonucleotide; CTG chr11 5234507 5234528 5234524 5234529 +
ccttttatgctggtcctgtcct

SEQ ID NO: 86111 - DNA, 22 bp, Artificial Sequence
  Synthetic oligonucleotide; CTT chr11 5234511 5234532 5234528 5234533 +
ttatgctggtcctgtcctccct

SEQ ID NO: 86112 - DNA, 22 bp, Artificial Sequence
  Synthetic oligonucleotide; TTT chr11 5234512 5234533 5234529 5234534 +
tatgctggtcctgtcctccctg

SEQ ID NO: 86113 - DNA, 22 bp, Artificial Sequence
  Synthetic oligonucleotide; TTT chr11 5234513 5234534 5234530 5234535 +
atgctggtcctgtcctccctgc

SEQ ID NO: 86114 - DNA, 22 bp, Artificial Sequence
  Synthetic oligonucleotide; TTA chr11 5234514 5234535 5234531 5234536 +
tgctggtcctgtcctccctgct

SEQ ID NO: 86115 - DNA, 22 bp, Artificial Sequence
  Synthetic oligonucleotide; CTG chr11 5234519 5234540 5234536 5234541 +
gtcctgtcctccctgctccagt

SEQ ID NO: 86116 - DNA, 22 bp, Artificial Sequence
  Synthetic oligonucleotide; CTG chr11 5234525 5234546 5234542 5234547 +
tcctccctgctccagtgagcag

SEQ ID NO: 86117 - DNA, 22 bp, Artificial Sequence
  Synthetic oligonucleotide; CTC chr11 5234530 5234551 5234547 5234552 +
cctgctccagtgagcaggttgg

SEQ ID NO: 86118 - DNA, 22 bp, Artificial Sequence
  Synthetic oligonucleotide; CTG chr11 5234534 5234555 5234551 5234556 +
ctccagtgagcaggttggttta

SEQ ID NO: 86119 - DNA, 22 bp, Artificial Sequence
  Synthetic oligonucleotide; CTC chr11 5234537 5234558 5234554 5234559 +
cagtgagcaggttggtttaaga

SEQ ID NO: 86120 - DNA, 22 bp, Artificial Sequence
  Synthetic oligonucleotide; TTG chr11 5234551 5234572 5234568 5234573 +
gtttaagataagcagggtttca

SEQ ID NO: 86121 - DNA, 22 bp, Artificial Sequence
  Synthetic oligonucleotide; TTT chr11 5234555 5234576 5234572 5234577 +
aagataagcagggtttcattag

SEQ ID NO: 86122 - DNA, 22 bp, Artificial Sequence
  Synthetic oligonucleotide; TTA chr11 5234556 5234577 5234573 5234578 +
agataagcagggtttcattagt

SEQ ID NO: 86123 - DNA, 22 bp, Artificial Sequence
  Synthetic oligonucleotide; TTT chr11 5234571 5234592 5234588 5234593 +
cattagtttgtgagaatgaaaa

SEQ ID NO: 86124 - DNA, 22 bp, Artificial Sequence
  Synthetic oligonucleotide; TTC chr11 5234572 5234593 5234589 5234594 +
attagtttgtgagaatgaaaaa

SEQ ID NO: 86125 - DNA, 22 bp, Artificial Sequence
  Synthetic oligonucleotide; TTA chr11 5234576 5234597 5234593 5234598 +
gtttgtgagaatgaaaaatgaa

SEQ ID NO: 86126 - DNA, 22 bp, Artificial Sequence
  Synthetic oligonucleotide; TTT chr11 5234580 5234601 5234597 5234602 +
gtgagaatgaaaaatgaacctt

SEQ ID NO: 86127 - DNA, 22 bp, Artificial Sequence
  Synthetic oligonucleotide; TTG chr11 5234581 5234602 5234598 5234603 +
tgagaatgaaaaatgaaccttc

SEQ ID NO: 86128 - DNA, 22 bp, Artificial Sequence
  Synthetic oligonucleotide; CTT chr11 5234602 5234623 5234619 5234624 +
cattccactattcccttaactt

SEQ ID NO: 86129 - DNA, 22 bp, Artificial Sequence
  Synthetic oligonucleotide; TTC chr11 5234603 5234624 5234620 5234625 +
attccactattcccttaacttg

SEQ ID NO: 86130 - DNA, 22 bp, Artificial Sequence
  Synthetic oligonucleotide; TTC chr11 5234607 5234628 5234624 5234629 +
cactattcccttaacttgccct

SEQ ID NO: 86131 - DNA, 22 bp, Artificial Sequence
  Synthetic oligonucleotide; CTA chr11 5234612 5234633 5234629 5234634 +
ttcccttaacttgccctgagat

SEQ ID NO: 86132 - DNA, 22 bp, Artificial Sequence
  Synthetic oligonucleotide; TTC chr11 5234615 5234636 5234632 5234637 +
ccttaacttgccctgagattgg

SEQ ID NO: 86133 - DNA, 22 bp, Artificial Sequence
  Synthetic oligonucleotide; CTT chr11 5234619 5234640 5234636 5234641 +
aacttgccctgagattggctgt

SEQ ID NO: 86134 - DNA, 22 bp, Artificial Sequence
  Synthetic oligonucleotide; TTA chr11 5234620 5234641 5234637 5234642 +
acttgccctgagattggctgtt

SEQ ID NO: 86135 - DNA, 22 bp, Artificial Sequence
  Synthetic oligonucleotide; CTT chr11 5234624 5234645 5234641 5234646 +
gccctgagattggctgttctgt

SEQ ID NO: 86136 - DNA, 22 bp, Artificial Sequence
  Synthetic oligonucleotide; TTG chr11 5234625 5234646 5234642 5234647 +
ccctgagattggctgttctgtc

SEQ ID NO: 86137 - DNA, 22 bp, Artificial Sequence
  Synthetic oligonucleotide; CTG chr11 5234630 5234651 5234647 5234652 +
agattggctgttctgtcatgtg

SEQ ID NO: 86138 - DNA, 22 bp, Artificial Sequence
  Synthetic oligonucleotide; TTG chr11 5234636 5234657 5234653 5234658 +
gctgttctgtcatgtgtgtctt

SEQ ID NO: 86139 - DNA, 22 bp, Artificial Sequence
  Synthetic oligonucleotide; CTG chr11 5234640 5234661 5234657 5234662 +
ttctgtcatgtgtgtcttgact

SEQ ID NO: 86140 - DNA, 22 bp, Artificial Sequence
  Synthetic oligonucleotide; TTC chr11 5234643 5234664 5234660 5234665 +
tgtcatgtgtgtcttgactcag

SEQ ID NO: 86141 - DNA, 22 bp, Artificial Sequence
  Synthetic oligonucleotide; CTG chr11 5234645 5234666 5234662 5234667 +
tcatgtgtgtcttgactcagaa

SEQ ID NO: 86142 - DNA, 22 bp, Artificial Sequence
  Synthetic oligonucleotide; CTT chr11 5234658 5234679 5234675 5234680 +
gactcagaaaccctgttctcct

SEQ ID NO: 86143 - DNA, 22 bp, Artificial Sequence
  Synthetic oligonucleotide; TTG chr11 5234659 5234680 5234676 5234681 +
actcagaaaccctgttctcctc

SEQ ID NO: 86144 - DNA, 22 bp, Artificial Sequence
  Synthetic oligonucleotide; CTC chr11 5234663 5234684 5234680 5234685 +
agaaaccctgttctcctctaca

SEQ ID NO: 86145 - DNA, 22 bp, Artificial Sequence
  Synthetic oligonucleotide; CTG chr11 5234673 5234694 5234690 5234695 +
ttctcctctacatatctcccca

SEQ ID NO: 86146 - DNA, 22 bp, Artificial Sequence
  Synthetic oligonucleotide; TTC chr11 5234676 5234697 5234693 5234698 +
tcctctacatatctccccaccg

SEQ ID NO: 86147 - DNA, 22 bp, Artificial Sequence
  Synthetic oligonucleotide; CTC chr11 5234678 5234699 5234695 5234700 +
ctctacatatctccccaccgca

SEQ ID NO: 86148 - DNA, 22 bp, Artificial Sequence
  Synthetic oligonucleotide; CTC chr11 5234681 5234702 5234698 5234703 +
tacatatctccccaccgcatct

SEQ ID NO: 86149 - DNA, 22 bp, Artificial Sequence
  Synthetic oligonucleotide; CTA chr11 5234683 5234704 5234700 5234705 +
catatctccccaccgcatctct

SEQ ID NO: 86150 - DNA, 22 bp, Artificial Sequence
  Synthetic oligonucleotide; CTC chr11 5234691 5234712 5234708 5234713 +
cccaccgcatctctttcagcag

SEQ ID NO: 86151 - DNA, 22 bp, Artificial Sequence
  Synthetic oligonucleotide; CTC chr11 5234704 5234725 5234721 5234726 +
tttcagcagttgtttctaaaaa

SEQ ID NO: 86152 - DNA, 22 bp, Artificial Sequence
  Synthetic oligonucleotide; CTT chr11 5234706 5234727 5234723 5234728 +
tcagcagttgtttctaaaaata

SEQ ID NO: 86153 - DNA, 22 bp, Artificial Sequence
  Synthetic oligonucleotide; TTT chr11 5234707 5234728 5234724 5234729 +
cagcagttgtttctaaaaatat

SEQ ID NO: 86154 - DNA, 22 bp, Artificial Sequence
  Synthetic oligonucleotide; TTC chr11 5234708 5234729 5234725 5234730 +
agcagttgtttctaaaaatatc

SEQ ID NO: 86155 - DNA, 22 bp, Artificial Sequence
  Synthetic oligonucleotide; TTG chr11 5234716 5234737 5234733 5234738 +
tttctaaaaatatcctcctagt

SEQ ID NO: 86156 - DNA, 22 bp, Artificial Sequence
  Synthetic oligonucleotide; TTT chr11 5234719 5234740 5234736 5234741 +
ctaaaaatatcctcctagtttc

SEQ ID NO: 86157 - DNA, 22 bp, Artificial Sequence
  Synthetic oligonucleotide; TTC chr11 5234720 5234741 5234737 5234742 +
taaaaatatcctcctagtttca

SEQ ID NO: 86158 - DNA, 22 bp, Artificial Sequence
  Synthetic oligonucleotide; CTA chr11 5234722 5234743 5234739 5234744 +
aaaatatcctcctagtttcatt

SEQ ID NO: 86159 - DNA, 22 bp, Artificial Sequence
  Synthetic oligonucleotide; CTC chr11 5234733 5234754 5234750 5234755 +
ctagtttcatttttgcagaagt

SEQ ID NO: 86160 - DNA, 22 bp, Artificial Sequence
  Synthetic oligonucleotide; CTA chr11 5234736 5234757 5234753 5234758 +
gtttcatttttgcagaagtgtt

SEQ ID NO: 86161 - DNA, 22 bp, Artificial Sequence
  Synthetic oligonucleotide; TTT chr11 5234740 5234761 5234757 5234762 +
catttttgcagaagtgttttag

SEQ ID NO: 86162 - DNA, 22 bp, Artificial Sequence
  Synthetic oligonucleotide; TTC chr11 5234741 5234762 5234758 5234763 +
atttttgcagaagtgttttagg

SEQ ID NO: 86163 - DNA, 22 bp, Artificial Sequence
  Synthetic oligonucleotide; TTT chr11 5234745 5234766 5234762 5234767 +
ttgcagaagtgttttaggctaa

SEQ ID NO: 86164 - DNA, 22 bp, Artificial Sequence
  Synthetic oligonucleotide; TTT chr11 5234746 5234767 5234763 5234768 +
tgcagaagtgttttaggctaat

SEQ ID NO: 86165 - DNA, 22 bp, Artificial Sequence
  Synthetic oligonucleotide; TTT chr11 5234747 5234768 5234764 5234769 +
gcagaagtgttttaggctaata

SEQ ID NO: 86166 - DNA, 22 bp, Artificial Sequence
  Synthetic oligonucleotide; TTG chr11 5234748 5234769 5234765 5234770 +
cagaagtgttttaggctaatat

SEQ ID NO: 86167 - DNA, 22 bp, Artificial Sequence
  Synthetic oligonucleotide; TTT chr11 5234759 5234780 5234776 5234781 +
taggctaatatagtggaatgta

SEQ ID NO: 86168 - DNA, 22 bp, Artificial Sequence
  Synthetic oligonucleotide; TTT chr11 5234760 5234781 5234777 5234782 +
aggctaatatagtggaatgtat

SEQ ID NO: 86169 - DNA, 22 bp, Artificial Sequence
  Synthetic oligonucleotide; TTA chr11 5234761 5234782 5234778 5234783 +
ggctaatatagtggaatgtatc

SEQ ID NO: 86170 - DNA, 22 bp, Artificial Sequence
  Synthetic oligonucleotide; CTA chr11 5234766 5234787 5234783 5234788 +
atatagtggaatgtatcttaga

SEQ ID NO: 86171 - DNA, 22 bp, Artificial Sequence
  Synthetic oligonucleotide; CTT chr11 5234785 5234806 5234802 5234807 +
agagtttaacttatttgtttct

SEQ ID NO: 86172 - DNA, 22 bp, Artificial Sequence
  Synthetic oligonucleotide; TTA chr11 5234786 5234807 5234803 5234808 +
gagtttaacttatttgtttctg

SEQ ID NO: 86173 - DNA, 22 bp, Artificial Sequence
  Synthetic oligonucleotide; TTT chr11 5234792 5234813 5234809 5234814 +
aacttatttgtttctgtcactt

SEQ ID NO: 86174 - DNA, 22 bp, Artificial Sequence
  Synthetic oligonucleotide; TTA chr11 5234793 5234814 5234810 5234815 +
acttatttgtttctgtcacttt

SEQ ID NO: 86175 - DNA, 22 bp, Artificial Sequence
  Synthetic oligonucleotide; CTT chr11 5234797 5234818 5234814 5234819 +
atttgtttctgtcactttatac

SEQ ID NO: 86176 - DNA, 22 bp, Artificial Sequence
  Synthetic oligonucleotide; TTA chr11 5234798 5234819 5234815 5234820 +
tttgtttctgtcactttatact

SEQ ID NO: 86177 - DNA, 22 bp, Artificial Sequence
  Synthetic oligonucleotide; TTT chr11 5234801 5234822 5234818 5234823 +
gtttctgtcactttatactaag

SEQ ID NO: 86178 - DNA, 22 bp, Artificial Sequence
  Synthetic oligonucleotide; TTG chr11 5234802 5234823 5234819 5234824 +
tttctgtcactttatactaaga

SEQ ID NO: 86179 - DNA, 22 bp, Artificial Sequence
  Synthetic oligonucleotide; TTT chr11 5234805 5234826 5234822 5234827 +
ctgtcactttatactaagaaaa

SEQ ID NO: 86180 - DNA, 22 bp, Artificial Sequence
  Synthetic oligonucleotide; TTC chr11 5234806 5234827 5234823 5234828 +
tgtcactttatactaagaaaac

SEQ ID NO: 86181 - DNA, 22 bp, Artificial Sequence
  Synthetic oligonucleotide; CTG chr11 5234808 5234829 5234825 5234830 +
tcactttatactaagaaaactt

SEQ ID NO: 86182 - DNA, 22 bp, Artificial Sequence
  Synthetic oligonucleotide; CTT chr11 5234814 5234835 5234831 5234836 +
tatactaagaaaacttatctaa

SEQ ID NO: 86183 - DNA, 22 bp, Artificial Sequence
  Synthetic oligonucleotide; TTT chr11 5234815 5234836 5234832 5234837 +
atactaagaaaacttatctaaa

SEQ ID NO: 86184 - DNA, 22 bp, Artificial Sequence
  Synthetic oligonucleotide; TTA chr11 5234816 5234837 5234833 5234838 +
tactaagaaaacttatctaaaa

SEQ ID NO: 86185 - DNA, 22 bp, Artificial Sequence
  Synthetic oligonucleotide; CTA chr11 5234821 5234842 5234838 5234843 +
agaaaacttatctaaaagcaga

SEQ ID NO: 86186 - DNA, 22 bp, Artificial Sequence
  Synthetic oligonucleotide; CTT chr11 5234830 5234851 5234847 5234852 +
atctaaaagcagatgttttaac

SEQ ID NO: 86187 - DNA, 22 bp, Artificial Sequence
  Synthetic oligonucleotide; TTA chr11 5234831 5234852 5234848 5234853 +
tctaaaagcagatgttttaaca

SEQ ID NO: 86188 - DNA, 22 bp, Artificial Sequence
  Synthetic oligonucleotide; CTA chr11 5234835 5234856 5234852 5234857 +
aaagcagatgttttaacaagtt

SEQ ID NO: 86189 - DNA, 22 bp, Artificial Sequence
  Synthetic oligonucleotide; TTT chr11 5234848 5234869 5234865 5234870 +
taacaagttgactcaatataaa

SEQ ID NO: 86190 - DNA, 22 bp, Artificial Sequence
  Synthetic oligonucleotide; TTT chr11 5234849 5234870 5234866 5234871 +
aacaagttgactcaatataaag

SEQ ID NO: 86191 - DNA, 22 bp, Artificial Sequence
  Synthetic oligonucleotide; TTA chr11 5234850 5234871 5234867 5234872 +
acaagttgactcaatataaagt

SEQ ID NO: 86192 - DNA, 22 bp, Artificial Sequence
  Synthetic oligonucleotide; TTG chr11 5234858 5234879 5234875 5234880 +
actcaatataaagttcttcttt

SEQ ID NO: 86193 - DNA, 22 bp, Artificial Sequence
  Synthetic oligonucleotide; CTC chr11 5234862 5234883 5234879 5234884 +
aatataaagttcttctttgcct

SEQ ID NO: 86194 - DNA, 22 bp, Artificial Sequence
  Synthetic oligonucleotide; TTC chr11 5234874 5234895 5234891 5234896 +
ttctttgcctctagagattttt

SEQ ID NO: 86195 - DNA, 22 bp, Artificial Sequence
  Synthetic oligonucleotide; CTT chr11 5234876 5234897 5234893 5234898 +
ctttgcctctagagatttttgt

SEQ ID NO: 86196 - DNA, 22 bp, Artificial Sequence
  Synthetic oligonucleotide; TTC chr11 5234877 5234898 5234894 5234899 +
tttgcctctagagatttttgtc

SEQ ID NO: 86197 - DNA, 22 bp, Artificial Sequence
  Synthetic oligonucleotide; CTT chr11 5234879 5234900 5234896 5234901 +
tgcctctagagatttttgtctc

SEQ ID NO: 86198 - DNA, 22 bp, Artificial Sequence
  Synthetic oligonucleotide; TTT chr11 5234880 5234901 5234897 5234902 +
gcctctagagatttttgtctcc

SEQ ID NO: 86199 - DNA, 22 bp, Artificial Sequence
  Synthetic oligonucleotide; TTG chr11 5234881 5234902 5234898 5234903 +
cctctagagatttttgtctcca

SEQ ID NO: 86200 - DNA, 22 bp, Artificial Sequence
  Synthetic oligonucleotide; CTC chr11 5234885 5234906 5234902 5234907 +
tagagatttttgtctccaaggg

SEQ ID NO: 86201 - DNA, 22 bp, Artificial Sequence
  Synthetic oligonucleotide; CTA chr11 5234887 5234908 5234904 5234909 +
gagatttttgtctccaagggaa

SEQ ID NO: 86202 - DNA, 22 bp, Artificial Sequence
  Synthetic oligonucleotide; TTT chr11 5234894 5234915 5234911 5234916 +
ttgtctccaagggaattttgag

SEQ ID NO: 86203 - DNA, 22 bp, Artificial Sequence
  Synthetic oligonucleotide; TTT chr11 5234895 5234916 5234912 5234917 +
tgtctccaagggaattttgaga

SEQ ID NO: 86204 - DNA, 22 bp, Artificial Sequence
  Synthetic oligonucleotide; TTT chr11 5234896 5234917 5234913 5234918 +
gtctccaagggaattttgagag

SEQ ID NO: 86205 - DNA, 22 bp, Artificial Sequence
  Synthetic oligonucleotide; TTG chr11 5234897 5234918 5234914 5234919 +
tctccaagggaattttgagagg

SEQ ID NO: 86206 - DNA, 22 bp, Artificial Sequence
  Synthetic oligonucleotide; CTC chr11 5234901 5234922 5234918 5234923 +
caagggaattttgagaggttgg

SEQ ID NO: 86207 - DNA, 22 bp, Artificial Sequence
  Synthetic oligonucleotide; TTT chr11 5234912 5234933 5234929 5234934 +
tgagaggttggaatggacaaat

SEQ ID NO: 86208 - DNA, 22 bp, Artificial Sequence
  Synthetic oligonucleotide; TTT chr11 5234913 5234934 5234930 5234935 +
gagaggttggaatggacaaatc

SEQ ID NO: 86209 - DNA, 22 bp, Artificial Sequence
  Synthetic oligonucleotide; TTG chr11 5234914 5234935 5234931 5234936 +
agaggttggaatggacaaatct

SEQ ID NO: 86210 - DNA, 22 bp, Artificial Sequence
  Synthetic oligonucleotide; TTG chr11 5234922 5234943 5234939 5234944 +
gaatggacaaatctattgctgc

SEQ ID NO: 86211 - DNA, 22 bp, Artificial Sequence
  Synthetic oligonucleotide; CTA chr11 5234937 5234958 5234954 5234959 +
ttgctgcagtttaaacttgctt

SEQ ID NO: 86212 - DNA, 22 bp, Artificial Sequence
  Synthetic oligonucleotide; TTG chr11 5234940 5234961 5234957 5234962 +
ctgcagtttaaacttgcttgct

SEQ ID NO: 86213 - DNA, 22 bp, Artificial Sequence
  Synthetic oligonucleotide; CTG chr11 5234943 5234964 5234960 5234965 +
cagtttaaacttgcttgcttcc

SEQ ID NO: 86214 - DNA, 22 bp, Artificial Sequence
  Synthetic oligonucleotide; TTT chr11 5234949 5234970 5234966 5234971 +
aaacttgcttgcttcctccttc

SEQ ID NO: 86215 - DNA, 22 bp, Artificial Sequence
  Synthetic oligonucleotide; TTA chr11 5234950 5234971 5234967 5234972 +
aacttgcttgcttcctccttct

SEQ ID NO: 86216 - DNA, 22 bp, Artificial Sequence
  Synthetic oligonucleotide; CTT chr11 5234955 5234976 5234972 5234977 +
gcttgcttcctccttcttttgg

SEQ ID NO: 86217 - DNA, 22 bp, Artificial Sequence
  Synthetic oligonucleotide; TTG chr11 5234956 5234977 5234973 5234978 +
cttgcttcctccttcttttggt

SEQ ID NO: 86218 - DNA, 22 bp, Artificial Sequence
  Synthetic oligonucleotide; CTT chr11 5234959 5234980 5234976 5234981 +
gcttcctccttcttttggtaaa

SEQ ID NO: 86219 - DNA, 22 bp, Artificial Sequence
  Synthetic oligonucleotide; TTG chr11 5234960 5234981 5234977 5234982 +
cttcctccttcttttggtaaat

SEQ ID NO: 86220 - DNA, 22 bp, Artificial Sequence
  Synthetic oligonucleotide; CTT chr11 5234963 5234984 5234980 5234985 +
cctccttcttttggtaaattct

SEQ ID NO: 86221 - DNA, 22 bp, Artificial Sequence
  Synthetic oligonucleotide; TTC chr11 5234964 5234985 5234981 5234986 +
ctccttcttttggtaaattctt

SEQ ID NO: 86222 - DNA, 22 bp, Artificial Sequence
  Synthetic oligonucleotide; CTC chr11 5234967 5234988 5234984 5234989 +
cttcttttggtaaattcttcct

SEQ ID NO: 86223 - DNA, 22 bp, Artificial Sequence
  Synthetic oligonucleotide; CTT chr11 5234970 5234991 5234987 5234992 +
cttttggtaaattcttcctata

SEQ ID NO: 86224 - DNA, 22 bp, Artificial Sequence
  Synthetic oligonucleotide; TTC chr11 5234971 5234992 5234988 5234993 +
ttttggtaaattcttcctataa

SEQ ID NO: 86225 - DNA, 22 bp, Artificial Sequence
  Synthetic oligonucleotide; CTT chr11 5234973 5234994 5234990 5234995 +
ttggtaaattcttcctataata

SEQ ID NO: 86226 - DNA, 22 bp, Artificial Sequence
  Synthetic oligonucleotide; TTT chr11 5234974 5234995 5234991 5234996 +
tggtaaattcttcctataataa

SEQ ID NO: 86227 - DNA, 22 bp, Artificial Sequence
  Synthetic oligonucleotide; TTT chr11 5234975 5234996 5234992 5234997 +
ggtaaattcttcctataataaa

SEQ ID NO: 86228 - DNA, 22 bp, Artificial Sequence
  Synthetic oligonucleotide; TTG chr11 5234976 5234997 5234993 5234998 +
gtaaattcttcctataataaaa

SEQ ID NO: 86229 - DNA, 22 bp, Artificial Sequence
  Synthetic oligonucleotide; TTC chr11 5234984 5235005 5235001 5235006 +
ttcctataataaaactctaatt

SEQ ID NO: 86230 - DNA, 22 bp, Artificial Sequence
  Synthetic oligonucleotide; CTT chr11 5234986 5235007 5235003 5235008 +
cctataataaaactctaatttt

SEQ ID NO: 86231 - DNA, 22 bp, Artificial Sequence
  Synthetic oligonucleotide; TTC chr11 5234987 5235008 5235004 5235009 +
ctataataaaactctaattttt

SEQ ID NO: 86232 - DNA, 22 bp, Artificial Sequence
  Synthetic oligonucleotide; CTA chr11 5234990 5235011 5235007 5235012 +
taataaaactctaattttttat

SEQ ID NO: 86233 - DNA, 22 bp, Artificial Sequence
  Synthetic oligonucleotide; CTC chr11 5235001 5235022 5235018 5235023 +
taattttttattatattgaaat

SEQ ID NO: 86234 - DNA, 22 bp, Artificial Sequence
  Synthetic oligonucleotide; CTA chr11 5235003 5235024 5235020 5235025 +
attttttattatattgaaataa

SEQ ID NO: 86235 - DNA, 22 bp, Artificial Sequence
  Synthetic oligonucleotide; TTT chr11 5235007 5235028 5235024 5235029 +
tttattatattgaaataaatat

SEQ ID NO: 86236 - DNA, 22 bp, Artificial Sequence
  Synthetic oligonucleotide; TTT chr11 5235008 5235029 5235025 5235030 +
ttattatattgaaataaatatc

SEQ ID NO: 86237 - DNA, 22 bp, Artificial Sequence
  Synthetic oligonucleotide; TTT chr11 5235009 5235030 5235026 5235031 +
tattatattgaaataaatatcc

SEQ ID NO: 86238 - DNA, 22 bp, Artificial Sequence
  Synthetic oligonucleotide; TTT chr11 5235010 5235031 5235027 5235032 +
attatattgaaataaatatcca

SEQ ID NO: 86239 - DNA, 22 bp, Artificial Sequence
  Synthetic oligonucleotide; TTA chr11 5235011 5235032 5235028 5235033 +
ttatattgaaataaatatccat

SEQ ID NO: 86240 - DNA, 22 bp, Artificial Sequence
  Synthetic oligonucleotide; TTA chr11 5235014 5235035 5235031 5235036 +
tattgaaataaatatccattaa

SEQ ID NO: 86241 - DNA, 22 bp, Artificial Sequence
  Synthetic oligonucleotide; TTG chr11 5235019 5235040 5235036 5235041 +
aaataaatatccattaaaagaa

SEQ ID NO: 86242 - DNA, 22 bp, Artificial Sequence
  Synthetic oligonucleotide; TTA chr11 5235035 5235056 5235052 5235057 +
aaagaatatttaaaaaatgaat

SEQ ID NO: 86243 - DNA, 22 bp, Artificial Sequence
  Synthetic oligonucleotide; TTT chr11 5235046 5235067 5235063 5235068 +
aaaaaatgaatagtgtttattt

SEQ ID NO: 86244 - DNA, 22 bp, Artificial Sequence
  Synthetic oligonucleotide; TTA chr11 5235047 5235068 5235064 5235069 +
aaaaatgaatagtgtttattta

SEQ ID NO: 86245 - DNA, 22 bp, Artificial Sequence
  Synthetic oligonucleotide; TTT chr11 5235064 5235085 5235081 5235086 +
atttaccagttattgaaatagg

SEQ ID NO: 86246 - DNA, 22 bp, Artificial Sequence
  Synthetic oligonucleotide; TTA chr11 5235065 5235086 5235082 5235087 +
tttaccagttattgaaataggt

SEQ ID NO: 86247 - DNA, 22 bp, Artificial Sequence
  Synthetic oligonucleotide; TTT chr11 5235068 5235089 5235085 5235090 +
accagttattgaaataggttct

SEQ ID NO: 86248 - DNA, 22 bp, Artificial Sequence
  Synthetic oligonucleotide; TTA chr11 5235069 5235090 5235086 5235091 +
ccagttattgaaataggttctg

SEQ ID NO: 86249 - DNA, 22 bp, Artificial Sequence
  Synthetic oligonucleotide; TTA chr11 5235076 5235097 5235093 5235098 +
ttgaaataggttctggaaacat

SEQ ID NO: 86250 - DNA, 22 bp, Artificial Sequence
  Synthetic oligonucleotide; TTG chr11 5235079 5235100 5235096 5235101 +
aaataggttctggaaacatgaa

SEQ ID NO: 86251 - DNA, 22 bp, Artificial Sequence
  Synthetic oligonucleotide; TTC chr11 5235089 5235110 5235106 5235111 +
tggaaacatgaattttaaggtt

SEQ ID NO: 86252 - DNA, 22 bp, Artificial Sequence
  Synthetic oligonucleotide; CTG chr11 5235091 5235112 5235108 5235113 +
gaaacatgaattttaaggttaa

SEQ ID NO: 86253 - DNA, 22 bp, Artificial Sequence
  Synthetic oligonucleotide; TTT chr11 5235104 5235125 5235121 5235126 +
taaggttaacattttaatgaca

SEQ ID NO: 86254 - DNA, 22 bp, Artificial Sequence
  Synthetic oligonucleotide; TTT chr11 5235105 5235126 5235122 5235127 +
aaggttaacattttaatgacag

SEQ ID NO: 86255 - DNA, 22 bp, Artificial Sequence
  Synthetic oligonucleotide; TTA chr11 5235106 5235127 5235123 5235128 +
aggttaacattttaatgacaga

SEQ ID NO: 86256 - DNA, 22 bp, Artificial Sequence
  Synthetic oligonucleotide; TTA chr11 5235112 5235133 5235129 5235134 +
acattttaatgacagataaaat

SEQ ID NO: 86257 - DNA, 22 bp, Artificial Sequence
  Synthetic oligonucleotide; TTT chr11 5235118 5235139 5235135 5235140 +
taatgacagataaaatcaaata

SEQ ID NO: 86258 - DNA, 22 bp, Artificial Sequence
  Synthetic oligonucleotide; TTT chr11 5235119 5235140 5235136 5235141 +
aatgacagataaaatcaaatat

SEQ ID NO: 86259 - DNA, 22 bp, Artificial Sequence
  Synthetic oligonucleotide; TTA chr11 5235120 5235141 5235137 5235142 +
atgacagataaaatcaaatatt

SEQ ID NO: 86260 - DNA, 22 bp, Artificial Sequence
  Synthetic oligonucleotide; TTA chr11 5235143 5235164 5235160 5235165 +
tatacaaatattttgaatgttt

SEQ ID NO: 86261 - DNA, 22 bp, Artificial Sequence
  Synthetic oligonucleotide; TTT chr11 5235156 5235177 5235173 5235178 +
tgaatgtttaaaattatggtat

SEQ ID NO: 86262 - DNA, 22 bp, Artificial Sequence
  Synthetic oligonucleotide; TTT chr11 5235157 5235178 5235174 5235179 +
gaatgtttaaaattatggtatg

SEQ ID NO: 86263 - DNA, 22 bp, Artificial Sequence
  Synthetic oligonucleotide; TTG chr11 5235158 5235179 5235175 5235180 +
aatgtttaaaattatggtatga

SEQ ID NO: 86264 - DNA, 22 bp, Artificial Sequence
  Synthetic oligonucleotide; TTT chr11 5235165 5235186 5235182 5235187 +
aaaattatggtatgactaaaga

SEQ ID NO: 86265 - DNA, 22 bp, Artificial Sequence
  Synthetic oligonucleotide; TTA chr11 5235166 5235187 5235183 5235188 +
aaattatggtatgactaaagaa

SEQ ID NO: 86266 - DNA, 22 bp, Artificial Sequence
  Synthetic oligonucleotide; TTA chr11 5235172 5235193 5235189 5235194 +
tggtatgactaaagaaagaatg

SEQ ID NO: 86267 - DNA, 22 bp, Artificial Sequence
  Synthetic oligonucleotide; CTA chr11 5235183 5235204 5235200 5235205 +
aagaaagaatgcaaagtgaaaa

SEQ ID NO: 86268 - DNA, 22 bp, Artificial Sequence
  Synthetic oligonucleotide; TTT chr11 5235213 5235234 5235230 5235235 +
accatattcagccagattaaat

SEQ ID NO: 86269 - DNA, 22 bp, Artificial Sequence
  Synthetic oligonucleotide; TTA chr11 5235214 5235235 5235231 5235236 +
ccatattcagccagattaaatt

SEQ ID NO: 86270 - DNA, 22 bp, Artificial Sequence
  Synthetic oligonucleotide; TTC chr11 5235222 5235243 5235239 5235244 +
agccagattaaatttaacgaag

SEQ ID NO: 86271 - DNA, 22 bp, Artificial Sequence
  Synthetic oligonucleotide; TTA chr11 5235232 5235253 5235249 5235254 +
aatttaacgaagttcctgggaa

SEQ ID NO: 86272 - DNA, 22 bp, Artificial Sequence
  Synthetic oligonucleotide; TTT chr11 5235237 5235258 5235254 5235259 +
aacgaagttcctgggaatatgc

SEQ ID NO: 86273 - DNA, 22 bp, Artificial Sequence
  Synthetic oligonucleotide; TTA chr11 5235238 5235259 5235255 5235260 +
acgaagttcctgggaatatgct

SEQ ID NO: 86274 - DNA, 22 bp, Artificial Sequence
  Synthetic oligonucleotide; TTC chr11 5235247 5235268 5235264 5235269 +
ctgggaatatgctagtacagaa

SEQ ID NO: 86275 - DNA, 22 bp, Artificial Sequence
  Synthetic oligonucleotide; CTG chr11 5235250 5235271 5235267 5235272 +
ggaatatgctagtacagaacat

SEQ ID NO: 86276 - DNA, 22 bp, Artificial Sequence
  Synthetic oligonucleotide; CTA chr11 5235261 5235282 5235278 5235283 +
gtacagaacatttttacagatg

SEQ ID NO: 86277 - DNA, 22 bp, Artificial Sequence
  Synthetic oligonucleotide; TTT chr11 5235274 5235295 5235291 5235296 +
ttacagatgtgttcttaaaaaa

SEQ ID NO: 86278 - DNA, 22 bp, Artificial Sequence
  Synthetic oligonucleotide; TTT chr11 5235275 5235296 5235292 5235297 +
tacagatgtgttcttaaaaaaa

SEQ ID NO: 86279 - DNA, 22 bp, Artificial Sequence
  Synthetic oligonucleotide; TTT chr11 5235276 5235297 5235293 5235298 +
acagatgtgttcttaaaaaaaa

SEQ ID NO: 86280 - DNA, 22 bp, Artificial Sequence
  Synthetic oligonucleotide; TTA chr11 5235277 5235298 5235294 5235299 +
cagatgtgttcttaaaaaaaaa

SEQ ID NO: 86281 - DNA, 22 bp, Artificial Sequence
  Synthetic oligonucleotide; TTC chr11 5235288 5235309 5235305 5235310 +
ttaaaaaaaaatgtggaattag

SEQ ID NO: 86282 - DNA, 22 bp, Artificial Sequence
  Synthetic oligonucleotide; CTT chr11 5235290 5235311 5235307 5235312 +
aaaaaaaaatgtggaattagac

SEQ ID NO: 86283 - DNA, 22 bp, Artificial Sequence
  Synthetic oligonucleotide; TTA chr11 5235291 5235312 5235308 5235313 +
aaaaaaaatgtggaattagacc

SEQ ID NO: 86284 - DNA, 22 bp, Artificial Sequence
  Synthetic oligonucleotide; TTA chr11 5235309 5235330 5235326 5235331 +
gacccaggaatgaagatcccag

SEQ ID NO: 86285 - DNA, 22 bp, Artificial Sequence
  Synthetic oligonucleotide; TTT chr11 5235337 5235358 5235354 5235359 +
ttcactcttttctgaattcaaa

SEQ ID NO: 86286 - DNA, 22 bp, Artificial Sequence
  Synthetic oligonucleotide; TTT chr11 5235338 5235359 5235355 5235360 +
tcactcttttctgaattcaaat

SEQ ID NO: 86287 - DNA, 22 bp, Artificial Sequence
  Synthetic oligonucleotide; TTT chr11 5235339 5235360 5235356 5235361 +
cactcttttctgaattcaaata

SEQ ID NO: 86288 - DNA, 22 bp, Artificial Sequence
  Synthetic oligonucleotide; TTC chr11 5235340 5235361 5235357 5235362 +
actcttttctgaattcaaataa

SEQ ID NO: 86289 - DNA, 22 bp, Artificial Sequence
  Synthetic oligonucleotide; CTC chr11 5235344 5235365 5235361 5235366 +
ttttctgaattcaaataatgcc

SEQ ID NO: 86290 - DNA, 22 bp, Artificial Sequence
  Synthetic oligonucleotide; CTT chr11 5235346 5235367 5235363 5235368 +
ttctgaattcaaataatgccac

SEQ ID NO: 86291 - DNA, 22 bp, Artificial Sequence
  Synthetic oligonucleotide; TTT chr11 5235347 5235368 5235364 5235369 +
tctgaattcaaataatgccaca

SEQ ID NO: 86292 - DNA, 22 bp, Artificial Sequence
  Synthetic oligonucleotide; TTT chr11 5235348 5235369 5235365 5235370 +
ctgaattcaaataatgccacaa

SEQ ID NO: 86293 - DNA, 22 bp, Artificial Sequence
  Synthetic oligonucleotide; TTC chr11 5235349 5235370 5235366 5235371 +
tgaattcaaataatgccacaat

SEQ ID NO: 86294 - DNA, 22 bp, Artificial Sequence
  Synthetic oligonucleotide; CTG chr11 5235351 5235372 5235368 5235373 +
aattcaaataatgccacaatgg

SEQ ID NO: 86295 - DNA, 22 bp, Artificial Sequence
  Synthetic oligonucleotide; TTC chr11 5235356 5235377 5235373 5235378 +
aaataatgccacaatggcagac

SEQ ID NO: 86296 - DNA, 22 bp, Artificial Sequence
  Synthetic oligonucleotide; TTG chr11 5235416 5235437 5235433 5235438 +
aaggaaagaggaggaagaaatg

SEQ ID NO: 86297 - DNA, 22 bp, Artificial Sequence
  Synthetic oligonucleotide; CTG chr11 5235680 5235701 5235697 5235702 +
acagttcaaattttggtggtga

SEQ ID NO: 86298 - DNA, 22 bp, Artificial Sequence
  Synthetic oligonucleotide; TTC chr11 5235687 5235708 5235704 5235709 +
aaattttggtggtgatatggat

SEQ ID NO: 86299 - DNA, 22 bp, Artificial Sequence
  Synthetic oligonucleotide; TTT chr11 5235693 5235714 5235710 5235715 +
tggtggtgatatggatcaatag

SEQ ID NO: 86300 - DNA, 22 bp, Artificial Sequence
  Synthetic oligonucleotide; TTT chr11 5235694 5235715 5235711 5235716 +
ggtggtgatatggatcaataga

SEQ ID NO: 86301 - DNA, 22 bp, Artificial Sequence
  Synthetic oligonucleotide; TTG chr11 5235695 5235716 5235712 5235717 +
gtggtgatatggatcaatagaa

SEQ ID NO: 86302 - DNA, 22 bp, Artificial Sequence
  Synthetic oligonucleotide; CTC chr11 5235721 5235742 5235738 5235743 +
aaactctgttggtgacactgta

SEQ ID NO: 86303 - DNA, 22 bp, Artificial Sequence
  Synthetic oligonucleotide; CTC chr11 5235727 5235748 5235744 5235749 +
tgttggtgacactgtacaatag

SEQ ID NO: 86304 - DNA, 22 bp, Artificial Sequence
  Synthetic oligonucleotide; CTG chr11 5235729 5235750 5235746 5235751 +
ttggtgacactgtacaatagta

SEQ ID NO: 86305 - DNA, 22 bp, Artificial Sequence
  Synthetic oligonucleotide; TTG chr11 5235732 5235753 5235749 5235754 +
gtgacactgtacaatagtataa

SEQ ID NO: 86306 - DNA, 22 bp, Artificial Sequence
  Synthetic oligonucleotide; CTG chr11 5235741 5235762 5235758 5235763 +
tacaatagtataacccctttgg

SEQ ID NO: 86307 - DNA, 22 bp, Artificial Sequence
  Synthetic oligonucleotide; CTT chr11 5235760 5235781 5235777 5235782 +
tggaaaacctttaatagtatcc

SEQ ID NO: 86308 - DNA, 22 bp, Artificial Sequence
  Synthetic oligonucleotide; TTT chr11 5235761 5235782 5235778 5235783 +
ggaaaacctttaatagtatcca

SEQ ID NO: 86309 - DNA, 22 bp, Artificial Sequence
  Synthetic oligonucleotide; TTG chr11 5235762 5235783 5235779 5235784 +
gaaaacctttaatagtatccac

SEQ ID NO: 86310 - DNA, 22 bp, Artificial Sequence
  Synthetic oligonucleotide; CTT chr11 5235771 5235792 5235788 5235793 +
taatagtatccacaaatgctgg

SEQ ID NO: 86311 - DNA, 22 bp, Artificial Sequence
  Synthetic oligonucleotide; TTT chr11 5235772 5235793 5235789 5235794 +
aatagtatccacaaatgctgga

SEQ ID NO: 86312 - DNA, 22 bp, Artificial Sequence
  Synthetic oligonucleotide; TTA chr11 5235773 5235794 5235790 5235795 +
atagtatccacaaatgctggat

SEQ ID NO: 86313 - DNA, 22 bp, Artificial Sequence
  Synthetic oligonucleotide; CTG chr11 5235792 5235813 5235809 5235814 +
gatgcttgataagtctattacc

SEQ ID NO: 86314 - DNA, 22 bp, Artificial Sequence
  Synthetic oligonucleotide; CTT chr11 5235799 5235820 5235816 5235821 +
gataagtctattacctagcaat

SEQ ID NO: 86315 - DNA, 22 bp, Artificial Sequence
  Synthetic oligonucleotide; TTG chr11 5235800 5235821 5235817 5235822 +
ataagtctattacctagcaatt

SEQ ID NO: 86316 - DNA, 22 bp, Artificial Sequence
  Synthetic oligonucleotide; CTA chr11 5235809 5235830 5235826 5235831 +
ttacctagcaattacattttta

SEQ ID NO: 86317 - DNA, 22 bp, Artificial Sequence
  Synthetic oligonucleotide; TTA chr11 5235812 5235833 5235829 5235834 +
cctagcaattacatttttagat

SEQ ID NO: 86318 - DNA, 22 bp, Artificial Sequence
  Synthetic oligonucleotide; CTA chr11 5235816 5235837 5235833 5235838 +
gcaattacatttttagatattc

SEQ ID NO: 86319 - DNA, 22 bp, Artificial Sequence
  Synthetic oligonucleotide; TTA chr11 5235823 5235844 5235840 5235845 +
catttttagatattcagaaaca

SEQ ID NO: 86320 - DNA, 22 bp, Artificial Sequence
  Synthetic oligonucleotide; TTT chr11 5235828 5235849 5235845 5235850 +
ttagatattcagaaacacatgc

SEQ ID NO: 86321 - DNA, 22 bp, Artificial Sequence
  Synthetic oligonucleotide; TTT chr11 5235829 5235850 5235846 5235851 +
tagatattcagaaacacatgca

SEQ ID NO: 86322 - DNA, 22 bp, Artificial Sequence
  Synthetic oligonucleotide; TTT chr11 5235830 5235851 5235847 5235852 +
agatattcagaaacacatgcat

SEQ ID NO: 86323 - DNA, 22 bp, Artificial Sequence
  Synthetic oligonucleotide; TTA chr11 5235831 5235852 5235848 5235853 +
gatattcagaaacacatgcatg

SEQ ID NO: 86324 - DNA, 22 bp, Artificial Sequence
  Synthetic oligonucleotide; TTC chr11 5235838 5235859 5235855 5235860 +
agaaacacatgcatgtgtgtat

SEQ ID NO: 86325 - DNA, 22 bp, Artificial Sequence
  Synthetic oligonucleotide; CTT chr11 5235884 5235905 5235901 5235906 +
atgacagcaataatcataaaaa

SEQ ID NO: 86326 - DNA, 22 bp, Artificial Sequence
  Synthetic oligonucleotide; TTA chr11 5235885 5235906 5235902 5235907 +
tgacagcaataatcataaaaac

SEQ ID NO: 86327 - DNA, 22 bp, Artificial Sequence
  Synthetic oligonucleotide; CTC chr11 5235910 5235931 5235927 5235932 +
aaaccggtagccacttaaatgc

SEQ ID NO: 86328 - DNA, 22 bp, Artificial Sequence
  Synthetic oligonucleotide; CTT chr11 5235926 5235947 5235943 5235948 +
aaatgcttaccaacagtagaat

SEQ ID NO: 86329 - DNA, 22 bp, Artificial Sequence
  Synthetic oligonucleotide; TTA chr11 5235927 5235948 5235944 5235949 +
aatgcttaccaacagtagaatt

SEQ ID NO: 86330 - DNA, 22 bp, Artificial Sequence
  Synthetic oligonucleotide; CTT chr11 5235934 5235955 5235951 5235956 +
accaacagtagaattgataaat

SEQ ID NO: 86331 - DNA, 22 bp, Artificial Sequence
  Synthetic oligonucleotide; TTA chr11 5235935 5235956 5235952 5235957 +
ccaacagtagaattgataaatt

SEQ ID NO: 86332 - DNA, 22 bp, Artificial Sequence
  Synthetic oligonucleotide; TTG chr11 5235950 5235971 5235967 5235972 +
ataaattacggtatagtcaaag

SEQ ID NO: 86333 - DNA, 22 bp, Artificial Sequence
  Synthetic oligonucleotide; TTA chr11 5235958 5235979 5235975 5235980 +
cggtatagtcaaagaatagaat

SEQ ID NO: 86334 - DNA, 22 bp, Artificial Sequence
  Synthetic oligonucleotide; TTA chr11 5235984 5236005 5236001 5236006 +
cacagaaatgaaaagaatcaac

SEQ ID NO: 86335 - DNA, 22 bp, Artificial Sequence
  Synthetic oligonucleotide; CTA chr11 5236008 5236029 5236025 5236030 +
ctgcttaacacgtagcgataca

SEQ ID NO: 86336 - DNA, 22 bp, Artificial Sequence
  Synthetic oligonucleotide; CTG chr11 5236011 5236032 5236028 5236033 +
cttaacacgtagcgatacaaat

SEQ ID NO: 86337 - DNA, 22 bp, Artificial Sequence
  Synthetic oligonucleotide; CTT chr11 5236014 5236035 5236031 5236036 +
aacacgtagcgatacaaatgca

SEQ ID NO: 86338 - DNA, 22 bp, Artificial Sequence
  Synthetic oligonucleotide; TTA chr11 5236015 5236036 5236032 5236037 +
acacgtagcgatacaaatgcat

SEQ ID NO: 86339 - DNA, 22 bp, Artificial Sequence
  Synthetic oligonucleotide; TTT chr11 5236039 5236060 5236056 5236061 +
tacagcatttggttgattaaaa

SEQ ID NO: 86340 - DNA, 22 bp, Artificial Sequence
  Synthetic oligonucleotide; TTT chr11 5236040 5236061 5236057 5236062 +
acagcatttggttgattaaaag

SEQ ID NO: 86341 - DNA, 22 bp, Artificial Sequence
  Synthetic oligonucleotide; TTA chr11 5236041 5236062 5236058 5236063 +
cagcatttggttgattaaaagt

SEQ ID NO: 86342 - DNA, 22 bp, Artificial Sequence
  Synthetic oligonucleotide; TTT chr11 5236049 5236070 5236066 5236071 +
ggttgattaaaagtaaccagag

SEQ ID NO: 86343 - DNA, 22 bp, Artificial Sequence
  Synthetic oligonucleotide; TTG chr11 5236050 5236071 5236067 5236072 +
gttgattaaaagtaaccagagg

SEQ ID NO: 86344 - DNA, 22 bp, Artificial Sequence
  Synthetic oligonucleotide; TTG chr11 5236054 5236075 5236071 5236076 +
attaaaagtaaccagaggtgag

SEQ ID NO: 86345 - DNA, 22 bp, Artificial Sequence
  Synthetic oligonucleotide; TTA chr11 5236058 5236079 5236075 5236080 +
aaagtaaccagaggtgagttca

SEQ ID NO: 86346 - DNA, 22 bp, Artificial Sequence
  Synthetic oligonucleotide; TTC chr11 5236079 5236100 5236096 5236101 +
aaactatatgactttatttgta

SEQ ID NO: 86347 - DNA, 22 bp, Artificial Sequence
  Synthetic oligonucleotide; CTA chr11 5236085 5236106 5236102 5236107 +
tatgactttatttgtatataga

SEQ ID NO: 86348 - DNA, 22 bp, Artificial Sequence
  Synthetic oligonucleotide; CTT chr11 5236093 5236114 5236110 5236115 +
tatttgtatatagaaagatgga

SEQ ID NO: 86349 - DNA, 22 bp, Artificial Sequence
  Synthetic oligonucleotide; TTT chr11 5236094 5236115 5236111 5236116 +
atttgtatatagaaagatggat

SEQ ID NO: 86350 - DNA, 22 bp, Artificial Sequence
  Synthetic oligonucleotide; TTA chr11 5236095 5236116 5236112 5236117 +
tttgtatatagaaagatggatg

SEQ ID NO: 86351 - DNA, 22 bp, Artificial Sequence
  Synthetic oligonucleotide; TTT chr11 5236098 5236119 5236115 5236120 +
gtatatagaaagatggatgatg

SEQ ID NO: 86352 - DNA, 22 bp, Artificial Sequence
  Synthetic oligonucleotide; TTG chr11 5236099 5236120 5236116 5236121 +
tatatagaaagatggatgatgt

SEQ ID NO: 86353 - DNA, 22 bp, Artificial Sequence
  Synthetic oligonucleotide; CTG chr11 5236126 5236147 5236143 5236148 +
agattctgatcacaaggggaaa

SEQ ID NO: 86354 - DNA, 22 bp, Artificial Sequence
  Synthetic oligonucleotide; TTC chr11 5236132 5236153 5236149 5236154 +
tgatcacaaggggaaatgttat

SEQ ID NO: 86355 - DNA, 22 bp, Artificial Sequence
  Synthetic oligonucleotide; CTG chr11 5236134 5236155 5236151 5236156 +
atcacaaggggaaatgttataa

SEQ ID NO: 86356 - DNA, 22 bp, Artificial Sequence
  Synthetic oligonucleotide; TTA chr11 5236153 5236174 5236170 5236175 +
taaaatagggtagagaggagcc

SEQ ID NO: 86357 - DNA, 22 bp, Artificial Sequence
  Synthetic oligonucleotide; CTT chr11 5236187 5236208 5236204 5236209 +
taaactttgttacaagttattt

SEQ ID NO: 86358 - DNA, 22 bp, Artificial Sequence
  Synthetic oligonucleotide; TTT chr11 5236188 5236209 5236205 5236210 +
aaactttgttacaagttatttt

SEQ ID NO: 86359 - DNA, 22 bp, Artificial Sequence
  Synthetic oligonucleotide; TTA chr11 5236189 5236210 5236206 5236211 +
aactttgttacaagttattttt

SEQ ID NO: 86360 - DNA, 22 bp, Artificial Sequence
  Synthetic oligonucleotide; CTT chr11 5236194 5236215 5236211 5236216 +
tgttacaagttatttttctgta

SEQ ID NO: 86361 - DNA, 22 bp, Artificial Sequence
  Synthetic oligonucleotide; TTT chr11 5236195 5236216 5236212 5236217 +
gttacaagttatttttctgtaa

SEQ ID NO: 86362 - DNA, 22 bp, Artificial Sequence
  Synthetic oligonucleotide; TTG chr11 5236196 5236217 5236213 5236218 +
ttacaagttatttttctgtaac

SEQ ID NO: 86363 - DNA, 22 bp, Artificial Sequence
  Synthetic oligonucleotide; TTA chr11 5236199 5236220 5236216 5236221 +
caagttatttttctgtaacctg

SEQ ID NO: 86364 - DNA, 22 bp, Artificial Sequence
  Synthetic oligonucleotide; TTA chr11 5236206 5236227 5236223 5236228 +
tttttctgtaacctggaagcca

SEQ ID NO: 86365 - DNA, 22 bp, Artificial Sequence
  Synthetic oligonucleotide; TTT chr11 5236209 5236230 5236226 5236231 +
ttctgtaacctggaagccaacg

SEQ ID NO: 86366 - DNA, 22 bp, Artificial Sequence
  Synthetic oligonucleotide; TTT chr11 5236210 5236231 5236227 5236232 +
tctgtaacctggaagccaacga

SEQ ID NO: 86367 - DNA, 22 bp, Artificial Sequence
  Synthetic oligonucleotide; TTT chr11 5236211 5236232 5236228 5236233 +
ctgtaacctggaagccaacgaa

SEQ ID NO: 86368 - DNA, 22 bp, Artificial Sequence
  Synthetic oligonucleotide; TTC chr11 5236212 5236233 5236229 5236234 +
tgtaacctggaagccaacgaaa

SEQ ID NO: 86369 - DNA, 22 bp, Artificial Sequence
  Synthetic oligonucleotide; CTG chr11 5236214 5236235 5236231 5236236 +
taacctggaagccaacgaaaga

SEQ ID NO: 86370 - DNA, 22 bp, Artificial Sequence
  Synthetic oligonucleotide; CTG chr11 5236221 5236242 5236238 5236243 +
gaagccaacgaaagatattgaa

SEQ ID NO: 86371 - DNA, 22 bp, Artificial Sequence
  Synthetic oligonucleotide; TTG chr11 5236241 5236262 5236258 5236263 +
aataattcaagaaaggtggtgg

SEQ ID NO: 86372 - DNA, 22 bp, Artificial Sequence
  Synthetic oligonucleotide; TTC chr11 5236249 5236270 5236266 5236271 +
aagaaaggtggtggcatggttt

SEQ ID NO: 86373 - DNA, 22 bp, Artificial Sequence
  Synthetic oligonucleotide; TTT chr11 5236271 5236292 5236288 5236293 +
gatttgtgtctttaaaagatta

SEQ ID NO: 86374 - DNA, 22 bp, Artificial Sequence
  Synthetic oligonucleotide; TTG chr11 5236272 5236293 5236289 5236294 +
atttgtgtctttaaaagattat

SEQ ID NO: 86375 - DNA, 22 bp, Artificial Sequence
  Synthetic oligonucleotide; TTT chr11 5236276 5236297 5236293 5236298 +
gtgtctttaaaagattattctc

SEQ ID NO: 86376 - DNA, 22 bp, Artificial Sequence
  Synthetic oligonucleotide; TTG chr11 5236277 5236298 5236294 5236299 +
tgtctttaaaagattattctca

SEQ ID NO: 86377 - DNA, 22 bp, Artificial Sequence
  Synthetic oligonucleotide; CTT chr11 5236283 5236304 5236300 5236305 +
taaaagattattctcacttagt

SEQ ID NO: 86378 - DNA, 22 bp, Artificial Sequence
  Synthetic oligonucleotide; TTT chr11 5236284 5236305 5236301 5236306 +
aaaagattattctcacttagtg

SEQ ID NO: 86379 - DNA, 22 bp, Artificial Sequence
  Synthetic oligonucleotide; TTA chr11 5236285 5236306 5236302 5236307 +
aaagattattctcacttagtga

SEQ ID NO: 86380 - DNA, 22 bp, Artificial Sequence
  Synthetic oligonucleotide; TTA chr11 5236293 5236314 5236310 5236315 +
ttctcacttagtgaagaaatgt

SEQ ID NO: 86381 - DNA, 22 bp, Artificial Sequence
  Synthetic oligonucleotide; TTC chr11 5236296 5236317 5236313 5236318 +
tcacttagtgaagaaatgtatt

SEQ ID NO: 86382 - DNA, 22 bp, Artificial Sequence
  Synthetic oligonucleotide; CTC chr11 5236298 5236319 5236315 5236320 +
acttagtgaagaaatgtatttt

SEQ ID NO: 86383 - DNA, 22 bp, Artificial Sequence
  Synthetic oligonucleotide; CTT chr11 5236302 5236323 5236319 5236324 +
agtgaagaaatgtattttagaa

SEQ ID NO: 86384 - DNA, 22 bp, Artificial Sequence
  Synthetic oligonucleotide; TTA chr11 5236303 5236324 5236320 5236325 +
gtgaagaaatgtattttagaag

SEQ ID NO: 86385 - DNA, 22 bp, Artificial Sequence
  Synthetic oligonucleotide; TTT chr11 5236319 5236340 5236336 5236341 +
tagaagtagagaaaatgggaga

SEQ ID NO: 86386 - DNA, 22 bp, Artificial Sequence
  Synthetic oligonucleotide; TTT chr11 5236320 5236341 5236337 5236342 +
agaagtagagaaaatgggagac

SEQ ID NO: 86387 - DNA, 22 bp, Artificial Sequence
  Synthetic oligonucleotide; TTA chr11 5236321 5236342 5236338 5236343 +
gaagtagagaaaatgggagaca

SEQ ID NO: 86388 - DNA, 22 bp, Artificial Sequence
  Synthetic oligonucleotide; CTG chr11 5236351 5236372 5236368 5236373 +
ggcttctgttgcagtagggaag

SEQ ID NO: 86389 - DNA, 22 bp, Artificial Sequence
  Synthetic oligonucleotide; CTT chr11 5236356 5236377 5236373 5236378 +
ctgttgcagtagggaagaaagt

SEQ ID NO: 86390 - DNA, 22 bp, Artificial Sequence
  Synthetic oligonucleotide; TTC chr11 5236357 5236378 5236374 5236379 +
tgttgcagtagggaagaaagtg

SEQ ID NO: 86391 - DNA, 22 bp, Artificial Sequence
  Synthetic oligonucleotide; CTG chr11 5236359 5236380 5236376 5236381 +
ttgcagtagggaagaaagtgac

SEQ ID NO: 86392 - DNA, 22 bp, Artificial Sequence
  Synthetic oligonucleotide; TTG chr11 5236362 5236383 5236379 5236384 +
cagtagggaagaaagtgacaat

SEQ ID NO: 86393 - DNA, 22 bp, Artificial Sequence
  Synthetic oligonucleotide; TTT chr11 5236391 5236412 5236408 5236413 +
ctattatcagacttggaccatg

SEQ ID NO: 86394 - DNA, 22 bp, Artificial Sequence
  Synthetic oligonucleotide; TTC chr11 5236392 5236413 5236409 5236414 +
tattatcagacttggaccatga

SEQ ID NO: 86395 - DNA, 22 bp, Artificial Sequence
  Synthetic oligonucleotide; CTA chr11 5236394 5236415 5236411 5236416 +
ttatcagacttggaccatgacg

SEQ ID NO: 86396 - DNA, 22 bp, Artificial Sequence
  Synthetic oligonucleotide; TTA chr11 5236397 5236418 5236414 5236419 +
tcagacttggaccatgacggtg

SEQ ID NO: 86397 - DNA, 22 bp, Artificial Sequence
  Synthetic oligonucleotide; CTT chr11 5236405 5236426 5236422 5236427 +
ggaccatgacggtgatgtcagt

SEQ ID NO: 86398 - DNA, 22 bp, Artificial Sequence
  Synthetic oligonucleotide; TTG chr11 5236406 5236427 5236423 5236428 +
gaccatgacggtgatgtcagtc

SEQ ID NO: 86399 - DNA, 22 bp, Artificial Sequence
  Synthetic oligonucleotide; TTT chr11 5236454 5236475 5236471 5236476 +
gtgagtttagtggtacgataaa

SEQ ID NO: 86400 - DNA, 22 bp, Artificial Sequence
  Synthetic oligonucleotide; TTG chr11 5236455 5236476 5236472 5236477 +
tgagtttagtggtacgataaaa

SEQ ID NO: 86401 - DNA, 22 bp, Artificial Sequence
  Synthetic oligonucleotide; TTT chr11 5236462 5236483 5236479 5236484 +
agtggtacgataaaatcagaaa

SEQ ID NO: 86402 - DNA, 22 bp, Artificial Sequence
  Synthetic oligonucleotide; TTA chr11 5236463 5236484 5236480 5236485 +
gtggtacgataaaatcagaaat

SEQ ID NO: 86403 - DNA, 22 bp, Artificial Sequence
  Synthetic oligonucleotide; CTT chr11 5236493 5236514 5236510 5236515 +
ggatacattgtattgtatgcac

SEQ ID NO: 86404 - DNA, 22 bp, Artificial Sequence
  Synthetic oligonucleotide; TTG chr11 5236494 5236515 5236511 5236516 +
gatacattgtattgtatgcact

SEQ ID NO: 86405 - DNA, 22 bp, Artificial Sequence
  Synthetic oligonucleotide; TTG chr11 5236503 5236524 5236520 5236525 +
tattgtatgcactcttgtaaaa

SEQ ID NO: 86406 - DNA, 22 bp, Artificial Sequence
  Synthetic oligonucleotide; TTG chr11 5236508 5236529 5236525 5236530 +
tatgcactcttgtaaaatgcaa

SEQ ID NO: 86407 - DNA, 22 bp, Artificial Sequence
  Synthetic oligonucleotide; CTC chr11 5236517 5236538 5236534 5236539 +
ttgtaaaatgcaaaaagatgta

SEQ ID NO: 86408 - DNA, 22 bp, Artificial Sequence
  Synthetic oligonucleotide; CTT chr11 5236519 5236540 5236536 5236541 +
gtaaaatgcaaaaagatgtact

SEQ ID NO: 86409 - DNA, 22 bp, Artificial Sequence
  Synthetic oligonucleotide; TTG chr11 5236520 5236541 5236537 5236542 +
taaaatgcaaaaagatgtactt

SEQ ID NO: 86410 - DNA, 22 bp, Artificial Sequence
  Synthetic oligonucleotide; CTT chr11 5236542 5236563 5236559 5236564 +
agatatgtggatctggagctca

SEQ ID NO: 86411 - DNA, 22 bp, Artificial Sequence
  Synthetic oligonucleotide; TTA chr11 5236543 5236564 5236560 5236565 +
gatatgtggatctggagctcag

SEQ ID NO: 86412 - DNA, 22 bp, Artificial Sequence
  Synthetic oligonucleotide; CTG chr11 5236557 5236578 5236574 5236579 +
gagctcagaaagaatacaacca

SEQ ID NO: 86413 - DNA, 22 bp, Artificial Sequence
  Synthetic oligonucleotide; CTC chr11 5236563 5236584 5236580 5236585 +
agaaagaatacaaccaggtcaa

SEQ ID NO: 86414 - DNA, 22 bp, Artificial Sequence
  Synthetic oligonucleotide; CTG chr11 5236632 5236653 5236649 5236654 +
tgtgaatcactaccactacctg

SEQ ID NO: 86415 - DNA, 22 bp, Artificial Sequence
  Synthetic oligonucleotide; CTA chr11 5236644 5236665 5236661 5236666 +
ccactacctgttaaaaatgaca

SEQ ID NO: 86416 - DNA, 22 bp, Artificial Sequence
  Synthetic oligonucleotide; CTA chr11 5236650 5236671 5236667 5236672 +
cctgttaaaaatgacagatgat

SEQ ID NO: 86417 - DNA, 22 bp, Artificial Sequence
  Synthetic oligonucleotide; CTG chr11 5236654 5236675 5236671 5236676 +
ttaaaaatgacagatgatgtac

SEQ ID NO: 86418 - DNA, 22 bp, Artificial Sequence
  Synthetic oligonucleotide; TTA chr11 5236657 5236678 5236674 5236679 +
aaaatgacagatgatgtacttc

SEQ ID NO: 86419 - DNA, 22 bp, Artificial Sequence
  Synthetic oligonucleotide; CTT chr11 5236678 5236699 5236695 5236700 +
catcaatatctccttaaaatct

SEQ ID NO: 86420 - DNA, 22 bp, Artificial Sequence
  Synthetic oligonucleotide; TTC chr11 5236679 5236700 5236696 5236701 +
atcaatatctccttaaaatctt

SEQ ID NO: 86421 - DNA, 22 bp, Artificial Sequence
  Synthetic oligonucleotide; CTC chr11 5236690 5236711 5236707 5236712 +
cttaaaatcttagaatgtgttt

SEQ ID NO: 86422 - DNA, 22 bp, Artificial Sequence
  Synthetic oligonucleotide; CTT chr11 5236693 5236714 5236710 5236715 +
aaaatcttagaatgtgtttgtg

SEQ ID NO: 86423 - DNA, 22 bp, Artificial Sequence
  Synthetic oligonucleotide; TTA chr11 5236694 5236715 5236711 5236716 +
aaatcttagaatgtgtttgtga

SEQ ID NO: 86424 - DNA, 22 bp, Artificial Sequence
  Synthetic oligonucleotide; CTT chr11 5236701 5236722 5236718 5236723 +
agaatgtgtttgtgagggagga

SEQ ID NO: 86425 - DNA, 22 bp, Artificial Sequence
  Synthetic oligonucleotide; TTA chr11 5236702 5236723 5236719 5236724 +
gaatgtgtttgtgagggaggaa

SEQ ID NO: 86426 - DNA, 22 bp, Artificial Sequence
  Synthetic oligonucleotide; TTT chr11 5236712 5236733 5236729 5236734 +
gtgagggaggaattatgtttcc

SEQ ID NO: 86427 - DNA, 22 bp, Artificial Sequence
  Synthetic oligonucleotide; TTG chr11 5236713 5236734 5236730 5236735 +
tgagggaggaattatgtttcca

SEQ ID NO: 86428 - DNA, 22 bp, Artificial Sequence
  Synthetic oligonucleotide; TTA chr11 5236727 5236748 5236744 5236749 +
tgtttccaattcatatataaga

SEQ ID NO: 86429 - DNA, 22 bp, Artificial Sequence
  Synthetic oligonucleotide; TTT chr11 5236732 5236753 5236749 5236754 +
ccaattcatatataagaaaatt

SEQ ID NO: 86430 - DNA, 22 bp, Artificial Sequence
  Synthetic oligonucleotide; TTC chr11 5236733 5236754 5236750 5236755 +
caattcatatataagaaaattg

SEQ ID NO: 86431 - DNA, 22 bp, Artificial Sequence
  Synthetic oligonucleotide; TTC chr11 5236739 5236760 5236756 5236761 +
atatataagaaaattgattcta

SEQ ID NO: 86432 - DNA, 22 bp, Artificial Sequence
  Synthetic oligonucleotide; TTG chr11 5236755 5236776 5236772 5236777 +
attctaaaaaaaatgttaggta

SEQ ID NO: 86433 - DNA, 22 bp, Artificial Sequence
  Synthetic oligonucleotide; TTC chr11 5236759 5236780 5236776 5236781 +
taaaaaaaatgttaggtaaatt

SEQ ID NO: 86434 - DNA, 22 bp, Artificial Sequence
  Synthetic oligonucleotide; CTA chr11 5236761 5236782 5236778 5236783 +
aaaaaaatgttaggtaaattct

SEQ ID NO: 86435 - DNA, 22 bp, Artificial Sequence
  Synthetic oligonucleotide; TTA chr11 5236773 5236794 5236790 5236795 +
ggtaaattcttaaggccatgag

SEQ ID NO: 86436 - DNA, 22 bp, Artificial Sequence
  Synthetic oligonucleotide; TTC chr11 5236782 5236803 5236799 5236804 +
ttaaggccatgaggactgttat

SEQ ID NO: 86437 - DNA, 22 bp, Artificial Sequence
  Synthetic oligonucleotide; CTT chr11 5236784 5236805 5236801 5236806 +
aaggccatgaggactgttattt

SEQ ID NO: 86438 - DNA, 22 bp, Artificial Sequence
  Synthetic oligonucleotide; TTA chr11 5236785 5236806 5236802 5236807 +
aggccatgaggactgttatttg

SEQ ID NO: 86439 - DNA, 22 bp, Artificial Sequence
  Synthetic oligonucleotide; CTG chr11 5236800 5236821 5236817 5236822 +
ttatttgatctttgtctgttaa

SEQ ID NO: 86440 - DNA, 22 bp, Artificial Sequence
  Synthetic oligonucleotide; TTA chr11 5236803 5236824 5236820 5236825 +
tttgatctttgtctgttaattc

SEQ ID NO: 86441 - DNA, 22 bp, Artificial Sequence
  Synthetic oligonucleotide; TTT chr11 5236806 5236827 5236823 5236828 +
gatctttgtctgttaattccaa

SEQ ID NO: 86442 - DNA, 22 bp, Artificial Sequence
  Synthetic oligonucleotide; TTG chr11 5236807 5236828 5236824 5236829 +
atctttgtctgttaattccaaa

SEQ ID NO: 86443 - DNA, 22 bp, Artificial Sequence
  Synthetic oligonucleotide; CTT chr11 5236812 5236833 5236829 5236834 +
tgtctgttaattccaaagactt

SEQ ID NO: 86444 - DNA, 22 bp, Artificial Sequence
  Synthetic oligonucleotide; TTT chr11 5236813 5236834 5236830 5236835 +
gtctgttaattccaaagacttg

SEQ ID NO: 86445 - DNA, 22 bp, Artificial Sequence
  Synthetic oligonucleotide; TTG chr11 5236814 5236835 5236831 5236836 +
tctgttaattccaaagacttgg

SEQ ID NO: 86446 - DNA, 22 bp, Artificial Sequence
  Synthetic oligonucleotide; CTG chr11 5236818 5236839 5236835 5236840 +
ttaattccaaagacttggcttt

SEQ ID NO: 86447 - DNA, 22 bp, Artificial Sequence
  Synthetic oligonucleotide; TTA chr11 5236821 5236842 5236838 5236843 +
attccaaagacttggcttttca

SEQ ID NO: 86448 - DNA, 22 bp, Artificial Sequence
  Synthetic oligonucleotide; TTC chr11 5236825 5236846 5236842 5236847 +
caaagacttggcttttcacttt

SEQ ID NO: 86449 - DNA, 22 bp, Artificial Sequence
  Synthetic oligonucleotide; CTT chr11 5236834 5236855 5236851 5236856 +
ggcttttcactttaattctgtt

SEQ ID NO: 86450 - DNA, 22 bp, Artificial Sequence
  Synthetic oligonucleotide; TTG chr11 5236835 5236856 5236852 5236857 +
gcttttcactttaattctgttc

SEQ ID NO: 86451 - DNA, 22 bp, Artificial Sequence
  Synthetic oligonucleotide; CTT chr11 5236839 5236860 5236856 5236861 +
ttcactttaattctgttctacc

SEQ ID NO: 86452 - DNA, 22 bp, Artificial Sequence
  Synthetic oligonucleotide; TTT chr11 5236840 5236861 5236857 5236862 +
tcactttaattctgttctacct

SEQ ID NO: 86453 - DNA, 22 bp, Artificial Sequence
  Synthetic oligonucleotide; TTT chr11 5236841 5236862 5236858 5236863 +
cactttaattctgttctacctg

SEQ ID NO: 86454 - DNA, 22 bp, Artificial Sequence
  Synthetic oligonucleotide; TTC chr11 5236842 5236863 5236859 5236864 +
actttaattctgttctacctga

SEQ ID NO: 86455 - DNA, 22 bp, Artificial Sequence
  Synthetic oligonucleotide; CTT chr11 5236846 5236867 5236863 5236868 +
taattctgttctacctgaaatg

SEQ ID NO: 86456 - DNA, 22 bp, Artificial Sequence
  Synthetic oligonucleotide; TTT chr11 5236847 5236868 5236864 5236869 +
aattctgttctacctgaaatga

SEQ ID NO: 86457 - DNA, 22 bp, Artificial Sequence
  Synthetic oligonucleotide; TTA chr11 5236848 5236869 5236865 5236870 +
attctgttctacctgaaatgat

SEQ ID NO: 86458 - DNA, 22 bp, Artificial Sequence
  Synthetic oligonucleotide; TTC chr11 5236852 5236873 5236869 5236874 +
tgttctacctgaaatgatttta

SEQ ID NO: 86459 - DNA, 22 bp, Artificial Sequence
  Synthetic oligonucleotide; CTG chr11 5236854 5236875 5236871 5236876 +
ttctacctgaaatgattttaca

SEQ ID NO: 86460 - DNA, 22 bp, Artificial Sequence
  Synthetic oligonucleotide; TTC chr11 5236857 5236878 5236874 5236879 +
tacctgaaatgattttacacat

SEQ ID NO: 86461 - DNA, 22 bp, Artificial Sequence
  Synthetic oligonucleotide; CTA chr11 5236859 5236880 5236876 5236881 +
cctgaaatgattttacacattg

SEQ ID NO: 86462 - DNA, 22 bp, Artificial Sequence
  Synthetic oligonucleotide; CTG chr11 5236863 5236884 5236880 5236885 +
aaatgattttacacattgggag

SEQ ID NO: 86463 - DNA, 22 bp, Artificial Sequence
  Synthetic oligonucleotide; TTT chr11 5236872 5236893 5236889 5236894 +
tacacattgggagatctggtta

SEQ ID NO: 86464 - DNA, 22 bp, Artificial Sequence
  Synthetic oligonucleotide; TTT chr11 5236873 5236894 5236890 5236895 +
acacattgggagatctggttac

SEQ ID NO: 86465 - DNA, 22 bp, Artificial Sequence
  Synthetic oligonucleotide; TTA chr11 5236874 5236895 5236891 5236896 +
cacattgggagatctggttaca

SEQ ID NO: 86466 - DNA, 22 bp, Artificial Sequence
  Synthetic oligonucleotide; TTG chr11 5236881 5236902 5236898 5236903 +
ggagatctggttacatgtttat

SEQ ID NO: 86467 - DNA, 22 bp, Artificial Sequence
  Synthetic oligonucleotide; CTG chr11 5236890 5236911 5236907 5236912 +
gttacatgtttattctatatgg

SEQ ID NO: 86468 - DNA, 22 bp, Artificial Sequence
  Synthetic oligonucleotide; TTA chr11 5236894 5236915 5236911 5236916 +
catgtttattctatatggattg

SEQ ID NO: 86469 - DNA, 22 bp, Artificial Sequence
  Synthetic oligonucleotide; TTT chr11 5236901 5236922 5236918 5236923 +
attctatatggattgcattgag

SEQ ID NO: 86470 - DNA, 22 bp, Artificial Sequence
  Synthetic oligonucleotide; TTA chr11 5236902 5236923 5236919 5236924 +
ttctatatggattgcattgaga

SEQ ID NO: 86471 - DNA, 22 bp, Artificial Sequence
  Synthetic oligonucleotide; TTC chr11 5236905 5236926 5236922 5236927 +
tatatggattgcattgagagga

SEQ ID NO: 86472 - DNA, 22 bp, Artificial Sequence
  Synthetic oligonucleotide; CTA chr11 5236907 5236928 5236924 5236929 +
tatggattgcattgagaggatt

SEQ ID NO: 86473 - DNA, 22 bp, Artificial Sequence
  Synthetic oligonucleotide; TTG chr11 5236916 5236937 5236933 5236938 +
cattgagaggatttgtataaca

SEQ ID NO: 86474 - DNA, 22 bp, Artificial Sequence
  Synthetic oligonucleotide; TTG chr11 5236921 5236942 5236938 5236943 +
agaggatttgtataacagaata

SEQ ID NO: 86475 - DNA, 22 bp, Artificial Sequence
  Synthetic oligonucleotide; TTT chr11 5236930 5236951 5236947 5236952 +
gtataacagaataaggtctttt

SEQ ID NO: 86476 - DNA, 22 bp, Artificial Sequence
  Synthetic oligonucleotide; TTG chr11 5236931 5236952 5236948 5236953 +
tataacagaataaggtcttttt

SEQ ID NO: 86477 - DNA, 22 bp, Artificial Sequence
  Synthetic oligonucleotide; CTT chr11 5236950 5236971 5236967 5236972 +
tttttcttttctcttctgagat

SEQ ID NO: 86478 - DNA, 22 bp, Artificial Sequence
  Synthetic oligonucleotide; TTT chr11 5236951 5236972 5236968 5236973 +
ttttcttttctcttctgagatg

SEQ ID NO: 86479 - DNA, 22 bp, Artificial Sequence
  Synthetic oligonucleotide; TTT chr11 5236952 5236973 5236969 5236974 +
tttcttttctcttctgagatgg

SEQ ID NO: 86480 - DNA, 22 bp, Artificial Sequence
  Synthetic oligonucleotide; TTT chr11 5236953 5236974 5236970 5236975 +
ttcttttctcttctgagatgga

SEQ ID NO: 86481 - DNA, 22 bp, Artificial Sequence
  Synthetic oligonucleotide; TTT chr11 5236954 5236975 5236971 5236976 +
tcttttctcttctgagatggag

SEQ ID NO: 86482 - DNA, 22 bp, Artificial Sequence
  Synthetic oligonucleotide; TTT chr11 5236955 5236976 5236972 5236977 +
cttttctcttctgagatggagt

SEQ ID NO: 86483 - DNA, 22 bp, Artificial Sequence
  Synthetic oligonucleotide; TTC chr11 5236956 5236977 5236973 5236978 +
ttttctcttctgagatggagtt

SEQ ID NO: 86484 - DNA, 22 bp, Artificial Sequence
  Synthetic oligonucleotide; CTT chr11 5236958 5236979 5236975 5236980 +
ttctcttctgagatggagtttc

SEQ ID NO: 86485 - DNA, 22 bp, Artificial Sequence
  Synthetic oligonucleotide; TTT chr11 5236959 5236980 5236976 5236981 +
tctcttctgagatggagtttca

SEQ ID NO: 86486 - DNA, 22 bp, Artificial Sequence
  Synthetic oligonucleotide; TTT chr11 5236960 5236981 5236977 5236982 +
ctcttctgagatggagtttcat

SEQ ID NO: 86487 - DNA, 22 bp, Artificial Sequence
  Synthetic oligonucleotide; TTC chr11 5236961 5236982 5236978 5236983 +
tcttctgagatggagtttcatc

SEQ ID NO: 86488 - DNA, 22 bp, Artificial Sequence
  Synthetic oligonucleotide; CTC chr11 5236963 5236984 5236980 5236985 +
ttctgagatggagtttcatccc

SEQ ID NO: 86489 - DNA, 22 bp, Artificial Sequence
  Synthetic oligonucleotide; CTT chr11 5236965 5236986 5236982 5236987 +
ctgagatggagtttcatcccta

SEQ ID NO: 86490 - DNA, 22 bp, Artificial Sequence
  Synthetic oligonucleotide; TTC chr11 5236966 5236987 5236983 5236988 +
tgagatggagtttcatccctat

SEQ ID NO: 86491 - DNA, 22 bp, Artificial Sequence
  Synthetic oligonucleotide; CTG chr11 5236968 5236989 5236985 5236990 +
agatggagtttcatccctattg

SEQ ID NO: 86492 - DNA, 22 bp, Artificial Sequence
  Synthetic oligonucleotide; TTT chr11 5236979 5237000 5236996 5237001 +
catccctattgcccaagctaga

SEQ ID NO: 86493 - DNA, 22 bp, Artificial Sequence
  Synthetic oligonucleotide; TTC chr11 5236980 5237001 5236997 5237002 +
atccctattgcccaagctagag

SEQ ID NO: 86494 - DNA, 22 bp, Artificial Sequence
  Synthetic oligonucleotide; CTA chr11 5236987 5237008 5237004 5237009 +
ttgcccaagctagagtgcaatg

SEQ ID NO: 86495 - DNA, 22 bp, Artificial Sequence
  Synthetic oligonucleotide; TTG chr11 5236990 5237011 5237007 5237012 +
cccaagctagagtgcaatggtg

SEQ ID NO: 86496 - DNA, 22 bp, Artificial Sequence
  Synthetic oligonucleotide; CTA chr11 5236999 5237020 5237016 5237021 +
gagtgcaatggtgcaatctagg

SEQ ID NO: 86497 - DNA, 22 bp, Artificial Sequence
  Synthetic oligonucleotide; CTA chr11 5237019 5237040 5237036 5237041 +
ggctcaccgcaacctctgcctc

SEQ ID NO: 86498 - DNA, 22 bp, Artificial Sequence
  Synthetic oligonucleotide; CTC chr11 5237024 5237045 5237041 5237046 +
accgcaacctctgcctcctggg

SEQ ID NO: 86499 - DNA, 22 bp, Artificial Sequence
  Synthetic oligonucleotide; CTC chr11 5237035 5237056 5237052 5237057 +
tgcctcctgggttcaagcaatt

SEQ ID NO: 86500 - DNA, 22 bp, Artificial Sequence
  Synthetic oligonucleotide; CTG chr11 5237037 5237058 5237054 5237059 +
cctcctgggttcaagcaattct

SEQ ID NO: 86501 - DNA, 22 bp, Artificial Sequence
  Synthetic oligonucleotide; CTC chr11 5237041 5237062 5237058 5237063 +
ctgggttcaagcaattctcctg

SEQ ID NO: 86502 - DNA, 22 bp, Artificial Sequence
  Synthetic oligonucleotide; CTG chr11 5237044 5237065 5237061 5237066 +
ggttcaagcaattctcctgcct

SEQ ID NO: 86503 - DNA, 22 bp, Artificial Sequence
  Synthetic oligonucleotide; TTC chr11 5237049 5237070 5237066 5237071 +
aagcaattctcctgcctcagcc

SEQ ID NO: 86504 - DNA, 22 bp, Artificial Sequence
  Synthetic oligonucleotide; TTC chr11 5237058 5237079 5237075 5237080 +
tcctgcctcagccacctgaata

SEQ ID NO: 86505 - DNA, 22 bp, Artificial Sequence
  Synthetic oligonucleotide; CTC chr11 5237060 5237081 5237077 5237082 +
ctgcctcagccacctgaatagc

SEQ ID NO: 86506 - DNA, 22 bp, Artificial Sequence
  Synthetic oligonucleotide; CTG chr11 5237063 5237084 5237080 5237085 +
cctcagccacctgaatagctgg

SEQ ID NO: 86507 - DNA, 22 bp, Artificial Sequence
  Synthetic oligonucleotide; CTC chr11 5237067 5237088 5237084 5237089 +
agccacctgaatagctgggact

SEQ ID NO: 86508 - DNA, 22 bp, Artificial Sequence
  Synthetic oligonucleotide; CTG chr11 5237076 5237097 5237093 5237098 +
aatagctgggactgcaggcatg

SEQ ID NO: 86509 - DNA, 22 bp, Artificial Sequence
  Synthetic oligonucleotide; CTG chr11 5237084 5237105 5237101 5237106 +
ggactgcaggcatgcaccacac

SEQ ID NO: 86510 - DNA, 22 bp, Artificial Sequence
  Synthetic oligonucleotide; CTG chr11 5237090 5237111 5237107 5237112 +
caggcatgcaccacacgcccgg

SEQ ID NO: 86511 - DNA, 22 bp, Artificial Sequence
  Synthetic oligonucleotide; CTG chr11 5237115 5237136 5237132 5237137 +
attttgtatttttagtagagat

SEQ ID NO: 86512 - DNA, 22 bp, Artificial Sequence
  Synthetic oligonucleotide; TTT chr11 5237119 5237140 5237136 5237141 +
tgtatttttagtagagatgggg

SEQ ID NO: 86513 - DNA, 22 bp, Artificial Sequence
  Synthetic oligonucleotide; TTT chr11 5237120 5237141 5237137 5237142 +
gtatttttagtagagatggggt

SEQ ID NO: 86514 - DNA, 22 bp, Artificial Sequence
  Synthetic oligonucleotide; TTG chr11 5237121 5237142 5237138 5237143 +
tatttttagtagagatggggtt

SEQ ID NO: 86515 - DNA, 22 bp, Artificial Sequence
  Synthetic oligonucleotide; TTT chr11 5237126 5237147 5237143 5237148 +
ttagtagagatggggtttcacc

SEQ ID NO: 86516 - DNA, 22 bp, Artificial Sequence
  Synthetic oligonucleotide; TTT chr11 5237127 5237148 5237144 5237149 +
tagtagagatggggtttcacca

SEQ ID NO: 86517 - DNA, 22 bp, Artificial Sequence
  Synthetic oligonucleotide; TTT chr11 5237128 5237149 5237145 5237150 +
agtagagatggggtttcaccat

SEQ ID NO: 86518 - DNA, 22 bp, Artificial Sequence
  Synthetic oligonucleotide; TTA chr11 5237129 5237150 5237146 5237151 +
gtagagatggggtttcaccatg

SEQ ID NO: 86519 - DNA, 22 bp, Artificial Sequence
  Synthetic oligonucleotide; TTT chr11 5237144 5237165 5237161 5237166 +
caccatgttggtcaggctggtc

SEQ ID NO: 86520 - DNA, 22 bp, Artificial Sequence
  Synthetic oligonucleotide; TTC chr11 5237145 5237166 5237162 5237167 +
accatgttggtcaggctggtct

SEQ ID NO: 86521 - DNA, 22 bp, Artificial Sequence
  Synthetic oligonucleotide; TTG chr11 5237154 5237175 5237171 5237176 +
gtcaggctggtcttgaactcct

SEQ ID NO: 86522 - DNA, 22 bp, Artificial Sequence
  Synthetic oligonucleotide; CTG chr11 5237163 5237184 5237180 5237185 +
gtcttgaactcctgacctcaag

SEQ ID NO: 86523 - DNA, 22 bp, Artificial Sequence
  Synthetic oligonucleotide; CTT chr11 5237168 5237189 5237185 5237190 +
gaactcctgacctcaagtgatc

SEQ ID NO: 86524 - DNA, 22 bp, Artificial Sequence
  Synthetic oligonucleotide; TTG chr11 5237169 5237190 5237186 5237191 +
aactcctgacctcaagtgatct

SEQ ID NO: 86525 - DNA, 22 bp, Artificial Sequence
  Synthetic oligonucleotide; CTC chr11 5237174 5237195 5237191 5237196 +
ctgacctcaagtgatctgcctg

SEQ ID NO: 86526 - DNA, 22 bp, Artificial Sequence
  Synthetic oligonucleotide; CTG chr11 5237177 5237198 5237194 5237199 +
acctcaagtgatctgcctgcct

SEQ ID NO: 86527 - DNA, 22 bp, Artificial Sequence
  Synthetic oligonucleotide; CTC chr11 5237182 5237203 5237199 5237204 +
aagtgatctgcctgccttggcc

SEQ ID NO: 86528 - DNA, 22 bp, Artificial Sequence
  Synthetic oligonucleotide; CTG chr11 5237192 5237213 5237209 5237214 +
cctgccttggcctcccaaagtg

SEQ ID NO: 86529 - DNA, 22 bp, Artificial Sequence
  Synthetic oligonucleotide; CTG chr11 5237196 5237217 5237213 5237218 +
ccttggcctcccaaagtgctgg

SEQ ID NO: 86530 - DNA, 22 bp, Artificial Sequence
  Synthetic oligonucleotide; CTT chr11 5237200 5237221 5237217 5237222 +
ggcctcccaaagtgctgggttt

SEQ ID NO: 86531 - DNA, 22 bp, Artificial Sequence
  Synthetic oligonucleotide; TTG chr11 5237201 5237222 5237218 5237223 +
gcctcccaaagtgctgggttta

SEQ ID NO: 86532 - DNA, 22 bp, Artificial Sequence
  Synthetic oligonucleotide; CTC chr11 5237206 5237227 5237223 5237228 +
ccaaagtgctgggtttacaagc

SEQ ID NO: 86533 - DNA, 22 bp, Artificial Sequence
  Synthetic oligonucleotide; CTG chr11 5237217 5237238 5237234 5237239 +
ggtttacaagcctgagccaccg

SEQ ID NO: 86534 - DNA, 22 bp, Artificial Sequence
  Synthetic oligonucleotide; TTT chr11 5237222 5237243 5237239 5237244 +
acaagcctgagccaccgcatcc

SEQ ID NO: 86535 - DNA, 22 bp, Artificial Sequence
  Synthetic oligonucleotide; TTA chr11 5237223 5237244 5237240 5237245 +
caagcctgagccaccgcatcca

SEQ ID NO: 86536 - DNA, 22 bp, Artificial Sequence
  Synthetic oligonucleotide; CTG chr11 5237231 5237252 5237248 5237253 +
agccaccgcatccagccaggat

SEQ ID NO: 86537 - DNA, 22 bp, Artificial Sequence
  Synthetic oligonucleotide; CTA chr11 5237261 5237282 5237278 5237283 +
aaagtggaaagaatagcatcta

SEQ ID NO: 86538 - DNA, 22 bp, Artificial Sequence
  Synthetic oligonucleotide; CTA chr11 5237283 5237304 5237300 5237305 +
ctcttgttcaggaaacaatgag

SEQ ID NO: 86539 - DNA, 22 bp, Artificial Sequence
  Synthetic oligonucleotide; CTC chr11 5237286 5237307 5237303 5237308 +
ttgttcaggaaacaatgaggac

SEQ ID NO: 86540 - DNA, 22 bp, Artificial Sequence
  Synthetic oligonucleotide; CTT chr11 5237288 5237309 5237305 5237310 +
gttcaggaaacaatgaggacct

SEQ ID NO: 86541 - DNA, 22 bp, Artificial Sequence
  Synthetic oligonucleotide; TTG chr11 5237289 5237310 5237306 5237311 +
ttcaggaaacaatgaggacctg

SEQ ID NO: 86542 - DNA, 22 bp, Artificial Sequence
  Synthetic oligonucleotide; TTC chr11 5237292 5237313 5237309 5237314 +
aggaaacaatgaggacctgact

SEQ ID NO: 86543 - DNA, 22 bp, Artificial Sequence
  Synthetic oligonucleotide; CTG chr11 5237311 5237332 5237328 5237333 +
actgggcagtaagagtggtgat

SEQ ID NO: 86544 - DNA, 22 bp, Artificial Sequence
  Synthetic oligonucleotide; CTG chr11 5237315 5237336 5237332 5237337 +
ggcagtaagagtggtgattaat

SEQ ID NO: 86545 - DNA, 22 bp, Artificial Sequence
  Synthetic oligonucleotide; TTA chr11 5237335 5237356 5237352 5237357 +
atagatagggacaaattgaagc

SEQ ID NO: 86546 - DNA, 22 bp, Artificial Sequence
  Synthetic oligonucleotide; TTG chr11 5237353 5237374 5237370 5237375 +
aagcagaatcgaactgttgatt

SEQ ID NO: 86547 - DNA, 22 bp, Artificial Sequence
  Synthetic oligonucleotide; CTG chr11 5237369 5237390 5237386 5237391 +
ttgattagaggtagggaaatga

SEQ ID NO: 86548 - DNA, 22 bp, Artificial Sequence
  Synthetic oligonucleotide; TTG chr11 5237372 5237393 5237389 5237394 +
attagaggtagggaaatgattt

SEQ ID NO: 86549 - DNA, 22 bp, Artificial Sequence
  Synthetic oligonucleotide; TTA chr11 5237376 5237397 5237393 5237398 +
gaggtagggaaatgattttaat

SEQ ID NO: 86550 - DNA, 22 bp, Artificial Sequence
  Synthetic oligonucleotide; TTT chr11 5237394 5237415 5237411 5237416 +
taatctgtgaccttggtgaatg

SEQ ID NO: 86551 - DNA, 22 bp, Artificial Sequence
  Synthetic oligonucleotide; TTT chr11 5237395 5237416 5237412 5237417 +
aatctgtgaccttggtgaatgg

SEQ ID NO: 86552 - DNA, 22 bp, Artificial Sequence
  Synthetic oligonucleotide; TTA chr11 5237396 5237417 5237413 5237418 +
atctgtgaccttggtgaatggg

SEQ ID NO: 86553 - DNA, 22 bp, Artificial Sequence
  Synthetic oligonucleotide; CTG chr11 5237401 5237422 5237418 5237423 +
tgaccttggtgaatgggcaagt

SEQ ID NO: 86554 - DNA, 22 bp, Artificial Sequence
  Synthetic oligonucleotide; CTT chr11 5237408 5237429 5237425 5237430 +
ggtgaatgggcaagtagctatc

SEQ ID NO: 86555 - DNA, 22 bp, Artificial Sequence
  Synthetic oligonucleotide; TTG chr11 5237409 5237430 5237426 5237431 +
gtgaatgggcaagtagctatct

SEQ ID NO: 86556 - DNA, 22 bp, Artificial Sequence
  Synthetic oligonucleotide; CTA chr11 5237428 5237449 5237445 5237450 +
tctaatgactaaaatggaaaac

SEQ ID NO: 86557 - DNA, 22 bp, Artificial Sequence
  Synthetic oligonucleotide; CTA chr11 5237432 5237453 5237449 5237454 +
atgactaaaatggaaaacactg

SEQ ID NO: 86558 - DNA, 22 bp, Artificial Sequence
  Synthetic oligonucleotide; CTA chr11 5237439 5237460 5237456 5237461 +
aaatggaaaacactggaagaga

SEQ ID NO: 86559 - DNA, 22 bp, Artificial Sequence
  Synthetic oligonucleotide; CTG chr11 5237454 5237475 5237471 5237476 +
gaagagaaacagttttagtata

SEQ ID NO: 86560 - DNA, 22 bp, Artificial Sequence
  Synthetic oligonucleotide; TTT chr11 5237469 5237490 5237486 5237491 +
tagtataacaagtgaaataccc

SEQ ID NO: 86561 - DNA, 22 bp, Artificial Sequence
  Synthetic oligonucleotide; TTT chr11 5237470 5237491 5237487 5237492 +
agtataacaagtgaaataccca

SEQ ID NO: 86562 - DNA, 22 bp, Artificial Sequence
  Synthetic oligonucleotide; TTA chr11 5237471 5237492 5237488 5237493 +
gtataacaagtgaaatacccat

SEQ ID NO: 86563 - DNA, 22 bp, Artificial Sequence
  Synthetic oligonucleotide; CTG chr11 5237497 5237518 5237514 5237519 +
agtctgaggtgcctataggaca

SEQ ID NO: 86564 - DNA, 22 bp, Artificial Sequence
  Synthetic oligonucleotide; CTG chr11 5237503 5237524 5237520 5237525 +
aggtgcctataggacatctata

SEQ ID NO: 86565 - DNA, 22 bp, Artificial Sequence
  Synthetic oligonucleotide; CTA chr11 5237512 5237533 5237529 5237534 +
taggacatctatataaataagc

SEQ ID NO: 86566 - DNA, 22 bp, Artificial Sequence
  Synthetic oligonucleotide; CTA chr11 5237523 5237544 5237540 5237545 +
tataaataagcccagtacattg

SEQ ID NO: 86567 - DNA, 22 bp, Artificial Sequence
  Synthetic oligonucleotide; TTG chr11 5237545 5237566 5237562 5237567 +
tttgatatatgggtttggcact

SEQ ID NO: 86568 - DNA, 22 bp, Artificial Sequence
  Synthetic oligonucleotide; TTT chr11 5237548 5237569 5237565 5237570 +
gatatatgggtttggcactgag

SEQ ID NO: 86569 - DNA, 22 bp, Artificial Sequence
  Synthetic oligonucleotide; TTG chr11 5237549 5237570 5237566 5237571 +
atatatgggtttggcactgagg

SEQ ID NO: 86570 - DNA, 22 bp, Artificial Sequence
  Synthetic oligonucleotide; TTT chr11 5237561 5237582 5237578 5237583 +
ggcactgaggttggaggtcaga

SEQ ID NO: 86571 - DNA, 22 bp, Artificial Sequence
  Synthetic oligonucleotide; TTG chr11 5237562 5237583 5237579 5237584 +
gcactgaggttggaggtcagag

SEQ ID NO: 86572 - DNA, 22 bp, Artificial Sequence
  Synthetic oligonucleotide; CTG chr11 5237568 5237589 5237585 5237590 +
aggttggaggtcagaggttaga

SEQ ID NO: 86573 - DNA, 22 bp, Artificial Sequence
  Synthetic oligonucleotide; TTG chr11 5237574 5237595 5237591 5237596 +
gaggtcagaggttagaaatcag

SEQ ID NO: 86574 - DNA, 22 bp, Artificial Sequence
  Synthetic oligonucleotide; TTA chr11 5237588 5237609 5237605 5237610 +
gaaatcagagttgggaattggg

SEQ ID NO: 86575 - DNA, 22 bp, Artificial Sequence
  Synthetic oligonucleotide; TTG chr11 5237601 5237622 5237618 5237623 +
ggaattgggattatacaggctg

SEQ ID NO: 86576 - DNA, 22 bp, Artificial Sequence
  Synthetic oligonucleotide; TTG chr11 5237608 5237629 5237625 5237630 +
ggattatacaggctgtatttaa

SEQ ID NO: 86577 - DNA, 22 bp, Artificial Sequence
  Synthetic oligonucleotide; TTA chr11 5237614 5237635 5237631 5237636 +
tacaggctgtatttaagagttt

SEQ ID NO: 86578 - DNA, 22 bp, Artificial Sequence
  Synthetic oligonucleotide; CTG chr11 5237623 5237644 5237640 5237645 +
tatttaagagtttagatataac

SEQ ID NO: 86579 - DNA, 22 bp, Artificial Sequence
  Synthetic oligonucleotide; TTT chr11 5237628 5237649 5237645 5237650 +
aagagtttagatataactgtga

SEQ ID NO: 86580 - DNA, 22 bp, Artificial Sequence
  Synthetic oligonucleotide; TTA chr11 5237629 5237650 5237646 5237651 +
agagtttagatataactgtgaa

SEQ ID NO: 86581 - DNA, 22 bp, Artificial Sequence
  Synthetic oligonucleotide; TTT chr11 5237636 5237657 5237653 5237658 +
agatataactgtgaatccaaga

SEQ ID NO: 86582 - DNA, 22 bp, Artificial Sequence
  Synthetic oligonucleotide; TTA chr11 5237637 5237658 5237654 5237659 +
gatataactgtgaatccaagag

SEQ ID NO: 86583 - DNA, 22 bp, Artificial Sequence
  Synthetic oligonucleotide; CTG chr11 5237647 5237668 5237664 5237669 +
tgaatccaagagtgtgatgaat

SEQ ID NO: 86584 - DNA, 22 bp, Artificial Sequence
  Synthetic oligonucleotide; TTA chr11 5237678 5237699 5237695 5237700 +
aatgaaggacctttaatgaaca

SEQ ID NO: 86585 - DNA, 22 bp, Artificial Sequence
  Synthetic oligonucleotide; CTT chr11 5237691 5237712 5237708 5237713 +
taatgaacaccaacatttaatg

SEQ ID NO: 86586 - DNA, 22 bp, Artificial Sequence
  Synthetic oligonucleotide; TTT chr11 5237692 5237713 5237709 5237714 +
aatgaacaccaacatttaatgt

SEQ ID NO: 86587 - DNA, 22 bp, Artificial Sequence
  Synthetic oligonucleotide; TTA chr11 5237693 5237714 5237710 5237715 +
atgaacaccaacatttaatgtg

SEQ ID NO: 86588 - DNA, 22 bp, Artificial Sequence
  Synthetic oligonucleotide; TTT chr11 5237709 5237730 5237726 5237731 +
aatgtgaaatctcaaggaagta

SEQ ID NO: 86589 - DNA, 22 bp, Artificial Sequence
  Synthetic oligonucleotide; TTA chr11 5237710 5237731 5237727 5237732 +
atgtgaaatctcaaggaagtat

SEQ ID NO: 86590 - DNA, 22 bp, Artificial Sequence
  Synthetic oligonucleotide; CTC chr11 5237722 5237743 5237739 5237744 +
aaggaagtatgaagtaagacat

SEQ ID NO: 86591 - DNA, 22 bp, Artificial Sequence
  Synthetic oligonucleotide; TTT chr11 5237768 5237789 5237785 5237790 +
tagaactcagtatcgattttaa

SEQ ID NO: 86592 - DNA, 22 bp, Artificial Sequence
  Synthetic oligonucleotide; TTT chr11 5237769 5237790 5237786 5237791 +
agaactcagtatcgattttaat

SEQ ID NO: 86593 - DNA, 22 bp, Artificial Sequence
  Synthetic oligonucleotide; TTA chr11 5237770 5237791 5237787 5237792 +
gaactcagtatcgattttaatt

SEQ ID NO: 86594 - DNA, 22 bp, Artificial Sequence
  Synthetic oligonucleotide; CTC chr11 5237776 5237797 5237793 5237798 +
agtatcgattttaattagtgta

SEQ ID NO: 86595 - DNA, 22 bp, Artificial Sequence
  Synthetic oligonucleotide; TTT chr11 5237787 5237808 5237804 5237809 +
taattagtgtaatgccaatgtg

SEQ ID NO: 86596 - DNA, 22 bp, Artificial Sequence
  Synthetic oligonucleotide; TTT chr11 5237788 5237809 5237805 5237810 +
aattagtgtaatgccaatgtgg

SEQ ID NO: 86597 - DNA, 22 bp, Artificial Sequence
  Synthetic oligonucleotide; TTA chr11 5237789 5237810 5237806 5237811 +
attagtgtaatgccaatgtggg

SEQ ID NO: 86598 - DNA, 22 bp, Artificial Sequence
  Synthetic oligonucleotide; TTA chr11 5237793 5237814 5237810 5237815 +
gtgtaatgccaatgtgggttag

SEQ ID NO: 86599 - DNA, 22 bp, Artificial Sequence
  Synthetic oligonucleotide; TTA chr11 5237814 5237835 5237831 5237836 +
gaatggaagtcaacttgctgtt

SEQ ID NO: 86600 - DNA, 22 bp, Artificial Sequence
  Synthetic oligonucleotide; CTT chr11 5237830 5237851 5237847 5237852 +
gctgttggtttcagagcaggta

SEQ ID NO: 86601 - DNA, 22 bp, Artificial Sequence
  Synthetic oligonucleotide; TTG chr11 5237831 5237852 5237848 5237853 +
ctgttggtttcagagcaggtag

SEQ ID NO: 86602 - DNA, 22 bp, Artificial Sequence
  Synthetic oligonucleotide; CTG chr11 5237834 5237855 5237851 5237856 +
ttggtttcagagcaggtaggag

SEQ ID NO: 86603 - DNA, 22 bp, Artificial Sequence
  Synthetic oligonucleotide; TTG chr11 5237837 5237858 5237854 5237859 +
gtttcagagcaggtaggagata

SEQ ID NO: 86604 - DNA, 22 bp, Artificial Sequence
  Synthetic oligonucleotide; TTT chr11 5237841 5237862 5237858 5237863 +
cagagcaggtaggagataaggt

SEQ ID NO: 86605 - DNA, 22 bp, Artificial Sequence
  Synthetic oligonucleotide; TTC chr11 5237842 5237863 5237859 5237864 +
agagcaggtaggagataaggtt

SEQ ID NO: 86606 - DNA, 22 bp, Artificial Sequence
  Synthetic oligonucleotide; TTC chr11 5237865 5237886 5237882 5237887 +
tagattttgacacagtgaaaag

SEQ ID NO: 86607 - DNA, 22 bp, Artificial Sequence
  Synthetic oligonucleotide; CTA chr11 5237867 5237888 5237884 5237889 +
gattttgacacagtgaaaagct

SEQ ID NO: 86608 - DNA, 22 bp, Artificial Sequence
  Synthetic oligonucleotide; TTT chr11 5237872 5237893 5237889 5237894 +
tgacacagtgaaaagctgaaac

SEQ ID NO: 86609 - DNA, 22 bp, Artificial Sequence
  Synthetic oligonucleotide; TTT chr11 5237873 5237894 5237890 5237895 +
gacacagtgaaaagctgaaaca

SEQ ID NO: 86610 - DNA, 22 bp, Artificial Sequence
  Synthetic oligonucleotide; TTG chr11 5237874 5237895 5237891 5237896 +
acacagtgaaaagctgaaacaa

SEQ ID NO: 86611 - DNA, 22 bp, Artificial Sequence
  Synthetic oligonucleotide; CTG chr11 5237890 5237911 5237907 5237912 +
aaacaaaaaggaaaaggtaggg

SEQ ID NO: 86612 - DNA, 22 bp, Artificial Sequence
  Synthetic oligonucleotide; CTA chr11 5237969 5237990 5237986 5237991 +
aggactctagggtcagagaaat

SEQ ID NO: 86613 - DNA, 22 bp, Artificial Sequence
  Synthetic oligonucleotide; CTC chr11 5237976 5237997 5237993 5237998 +
tagggtcagagaaatatgggtt

SEQ ID NO: 86614 - DNA, 22 bp, Artificial Sequence
  Synthetic oligonucleotide; CTA chr11 5237978 5237999 5237995 5238000 +
gggtcagagaaatatgggttat

SEQ ID NO: 86615 - DNA, 22 bp, Artificial Sequence
  Synthetic oligonucleotide; TTA chr11 5237999 5238020 5238016 5238021 +
tatccttctacaaaattcacat

SEQ ID NO: 86616 - DNA, 22 bp, Artificial Sequence
  Synthetic oligonucleotide; CTT chr11 5238006 5238027 5238023 5238028 +
ctacaaaattcacattcttggc

SEQ ID NO: 86617 - DNA, 22 bp, Artificial Sequence
  Synthetic oligonucleotide; TTC chr11 5238007 5238028 5238024 5238029 +
tacaaaattcacattcttggct

SEQ ID NO: 86618 - DNA, 22 bp, Artificial Sequence
  Synthetic oligonucleotide; CTA chr11 5238009 5238030 5238026 5238031 +
caaaattcacattcttggctgg

SEQ ID NO: 86619 - DNA, 22 bp, Artificial Sequence
  Synthetic oligonucleotide; TTC chr11 5238017 5238038 5238034 5238039 +
acattcttggctgggtgtggtg

SEQ ID NO: 86620 - DNA, 22 bp, Artificial Sequence
  Synthetic oligonucleotide; TTC chr11 5238023 5238044 5238040 5238045 +
ttggctgggtgtggtggctcac

SEQ ID NO: 86621 - DNA, 22 bp, Artificial Sequence
  Synthetic oligonucleotide; CTT chr11 5238025 5238046 5238042 5238047 +
ggctgggtgtggtggctcacgc

SEQ ID NO: 86622 - DNA, 22 bp, Artificial Sequence
  Synthetic oligonucleotide; TTG chr11 5238026 5238047 5238043 5238048 +
gctgggtgtggtggctcacgcc

SEQ ID NO: 86623 - DNA, 22 bp, Artificial Sequence
  Synthetic oligonucleotide; CTG chr11 5238030 5238051 5238047 5238052 +
ggtgtggtggctcacgcctgtg

SEQ ID NO: 86624 - DNA, 22 bp, Artificial Sequence
  Synthetic oligonucleotide; CTC chr11 5238043 5238064 5238060 5238065 +
acgcctgtgatcccagcacttt

SEQ ID NO: 86625 - DNA, 22 bp, Artificial Sequence
  Synthetic oligonucleotide; CTG chr11 5238050 5238071 5238067 5238072 +
tgatcccagcactttcagaggc

SEQ ID NO: 86626 - DNA, 22 bp, Artificial Sequence
  Synthetic oligonucleotide; CTT chr11 5238064 5238085 5238081 5238086 +
tcagaggccgaggagggtggat

SEQ ID NO: 86627 - DNA, 22 bp, Artificial Sequence
  Synthetic oligonucleotide; TTT chr11 5238065 5238086 5238082 5238087 +
cagaggccgaggagggtggatc

SEQ ID NO: 86628 - DNA, 22 bp, Artificial Sequence
  Synthetic oligonucleotide; TTC chr11 5238066 5238087 5238083 5238088 +
agaggccgaggagggtggatca

SEQ ID NO: 86629 - DNA, 22 bp, Artificial Sequence
  Synthetic oligonucleotide; CTG chr11 5238092 5238113 5238109 5238114 +
atgttaggagttcgagatcagc

SEQ ID NO: 86630 - DNA, 22 bp, Artificial Sequence
  Synthetic oligonucleotide; TTA chr11 5238098 5238119 5238115 5238120 +
ggagttcgagatcagcctgacc

SEQ ID NO: 86631 - DNA, 22 bp, Artificial Sequence
  Synthetic oligonucleotide; TTC chr11 5238105 5238126 5238122 5238127 +
gagatcagcctgaccaacatgg

SEQ ID NO: 86632 - DNA, 22 bp, Artificial Sequence
  Synthetic oligonucleotide; CTG chr11 5238117 5238138 5238134 5238139 +
accaacatggtgaaacccccta

SEQ ID NO: 86633 - DNA, 22 bp, Artificial Sequence
  Synthetic oligonucleotide; CTA chr11 5238139 5238160 5238156 5238161 +
tctactaaaaatagaaaattag

SEQ ID NO: 86634 - DNA, 22 bp, Artificial Sequence
  Synthetic oligonucleotide; CTA chr11 5238143 5238164 5238160 5238165 +
ctaaaaatagaaaattagccag

SEQ ID NO: 86635 - DNA, 22 bp, Artificial Sequence
  Synthetic oligonucleotide; CTA chr11 5238146 5238167 5238163 5238168 +
aaaatagaaaattagccaggca

SEQ ID NO: 86636 - DNA, 22 bp, Artificial Sequence
  Synthetic oligonucleotide; TTA chr11 5238160 5238181 5238177 5238182 +
gccaggcatggtggtggcacat

SEQ ID NO: 86637 - DNA, 22 bp, Artificial Sequence
  Synthetic oligonucleotide; CTG chr11 5238187 5238208 5238204 5238209 +
tagtgccagctacttgggaggc

SEQ ID NO: 86638 - DNA, 22 bp, Artificial Sequence
  Synthetic oligonucleotide; CTA chr11 5238199 5238220 5238216 5238221 +
cttgggaggctgaggcaggaga

SEQ ID NO: 86639 - DNA, 22 bp, Artificial Sequence
  Synthetic oligonucleotide; CTT chr11 5238202 5238223 5238219 5238224 +
gggaggctgaggcaggagaatc

SEQ ID NO: 86640 - DNA, 22 bp, Artificial Sequence
  Synthetic oligonucleotide; TTG chr11 5238203 5238224 5238220 5238225 +
ggaggctgaggcaggagaatcg

SEQ ID NO: 86641 - DNA, 22 bp, Artificial Sequence
  Synthetic oligonucleotide; CTG chr11 5238211 5238232 5238228 5238233 +
aggcaggagaatcgcttgaacc

SEQ ID NO: 86642 - DNA, 22 bp, Artificial Sequence
  Synthetic oligonucleotide; CTT chr11 5238228 5238249 5238245 5238250 +
gaacctgggaggcagatgttgc

SEQ ID NO: 86643 - DNA, 22 bp, Artificial Sequence
  Synthetic oligonucleotide; TTG chr11 5238229 5238250 5238246 5238251 +
aacctgggaggcagatgttgca

SEQ ID NO: 86644 - DNA, 22 bp, Artificial Sequence
  Synthetic oligonucleotide; CTG chr11 5238235 5238256 5238252 5238257 +
ggaggcagatgttgcagtgagc

SEQ ID NO: 86645 - DNA, 22 bp, Artificial Sequence
  Synthetic oligonucleotide; TTG chr11 5238249 5238270 5238266 5238271 +
cagtgagcctggatcatgccat

SEQ ID NO: 86646 - DNA, 22 bp, Artificial Sequence
  Synthetic oligonucleotide; CTG chr11 5238260 5238281 5238277 5238282 +
gatcatgccattgcactccagc

SEQ ID NO: 86647 - DNA, 22 bp, Artificial Sequence
  Synthetic oligonucleotide; TTG chr11 5238273 5238294 5238290 5238295 +
cactccagcctgggcaaccata

SEQ ID NO: 86648 - DNA, 22 bp, Artificial Sequence
  Synthetic oligonucleotide; CTC chr11 5238278 5238299 5238295 5238300 +
cagcctgggcaaccatagcaat

SEQ ID NO: 86649 - DNA, 22 bp, Artificial Sequence
  Synthetic oligonucleotide; CTG chr11 5238285 5238306 5238302 5238307 +
ggcaaccatagcaatgctctat

SEQ ID NO: 86650 - DNA, 22 bp, Artificial Sequence
  Synthetic oligonucleotide; CTC chr11 5238304 5238325 5238321 5238326 +
tatctcagaaaaaaaaaaaaaa

SEQ ID NO: 86651 - DNA, 22 bp, Artificial Sequence
  Synthetic oligonucleotide; CTA chr11 5238306 5238327 5238323 5238328 +
tctcagaaaaaaaaaaaaaaag

SEQ ID NO: 86652 - DNA, 22 bp, Artificial Sequence
  Synthetic oligonucleotide; CTC chr11 5238310 5238331 5238327 5238332 +
agaaaaaaaaaaaaaaagttct

SEQ ID NO: 86653 - DNA, 22 bp, Artificial Sequence
  Synthetic oligonucleotide; TTC chr11 5238331 5238352 5238348 5238353 +
ttgctaacctgaaaaaataaat

SEQ ID NO: 86654 - DNA, 22 bp, Artificial Sequence
  Synthetic oligonucleotide; CTT chr11 5238333 5238354 5238350 5238355 +
gctaacctgaaaaaataaatta

SEQ ID NO: 86655 - DNA, 22 bp, Artificial Sequence
  Synthetic oligonucleotide; TTG chr11 5238334 5238355 5238351 5238356 +
ctaacctgaaaaaataaattat

SEQ ID NO: 86656 - DNA, 22 bp, Artificial Sequence
  Synthetic oligonucleotide; CTA chr11 5238337 5238358 5238354 5238359 +
acctgaaaaaataaattatttg

SEQ ID NO: 86657 - DNA, 22 bp, Artificial Sequence
  Synthetic oligonucleotide; CTG chr11 5238342 5238363 5238359 5238364 +
aaaaaataaattatttgagctt

SEQ ID NO: 86658 - DNA, 22 bp, Artificial Sequence
  Synthetic oligonucleotide; TTA chr11 5238355 5238376 5238372 5238377 +
tttgagctttgtacctaattca

SEQ ID NO: 86659 - DNA, 22 bp, Artificial Sequence
  Synthetic oligonucleotide; TTT chr11 5238358 5238379 5238375 5238380 +
gagctttgtacctaattcataa

SEQ ID NO: 86660 - DNA, 22 bp, Artificial Sequence
  Synthetic oligonucleotide; TTG chr11 5238359 5238380 5238376 5238381 +
agctttgtacctaattcataat

SEQ ID NO: 86661 - DNA, 22 bp, Artificial Sequence
  Synthetic oligonucleotide; CTT chr11 5238364 5238385 5238381 5238386 +
tgtacctaattcataattttca

SEQ ID NO: 86662 - DNA, 22 bp, Artificial Sequence
  Synthetic oligonucleotide; TTT chr11 5238365 5238386 5238382 5238387 +
gtacctaattcataattttcag

SEQ ID NO: 86663 - DNA, 22 bp, Artificial Sequence
  Synthetic oligonucleotide; TTG chr11 5238366 5238387 5238383 5238388 +
tacctaattcataattttcaga

SEQ ID NO: 86664 - DNA, 22 bp, Artificial Sequence
  Synthetic oligonucleotide; CTA chr11 5238372 5238393 5238389 5238394 +
attcataattttcagataatga

SEQ ID NO: 86665 - DNA, 22 bp, Artificial Sequence
  Synthetic oligonucleotide; TTC chr11 5238376 5238397 5238393 5238398 +
ataattttcagataatgaatat

SEQ ID NO: 86666 - DNA, 22 bp, Artificial Sequence
  Synthetic oligonucleotide; TTT chr11 5238383 5238404 5238400 5238405 +
tcagataatgaatattgagatg

SEQ ID NO: 86667 - DNA, 22 bp, Artificial Sequence
  Synthetic oligonucleotide; TTT chr11 5238384 5238405 5238401 5238406 +
cagataatgaatattgagatga

SEQ ID NO: 86668 - DNA, 22 bp, Artificial Sequence
  Synthetic oligonucleotide; TTC chr11 5238385 5238406 5238402 5238407 +
agataatgaatattgagatgat

SEQ ID NO: 86669 - DNA, 22 bp, Artificial Sequence
  Synthetic oligonucleotide; TTG chr11 5238400 5238421 5238417 5238422 +
agatgatatatgcacagaacaa

SEQ ID NO: 86670 - DNA, 22 bp, Artificial Sequence
  Synthetic oligonucleotide; CTA chr11 5238428 5238449 5238445 5238450 +
gagacacattctaagtgtgaca

SEQ ID NO: 86671 - DNA, 22 bp, Artificial Sequence
  Synthetic oligonucleotide; TTC chr11 5238439 5238460 5238456 5238461 +
taagtgtgacattcttaaatgc

SEQ ID NO: 86672 - DNA, 22 bp, Artificial Sequence
  Synthetic oligonucleotide; CTA chr11 5238441 5238462 5238458 5238463 +
agtgtgacattcttaaatgcca

SEQ ID NO: 86673 - DNA, 22 bp, Artificial Sequence
  Synthetic oligonucleotide; TTC chr11 5238453 5238474 5238470 5238475 +
ttaaatgccagtgctctccaca

SEQ ID NO: 86674 - DNA, 22 bp, Artificial Sequence
  Synthetic oligonucleotide; CTT chr11 5238455 5238476 5238472 5238477 +
aaatgccagtgctctccacaat

SEQ ID NO: 86675 - DNA, 22 bp, Artificial Sequence
  Synthetic oligonucleotide; TTA chr11 5238456 5238477 5238473 5238478 +
aatgccagtgctctccacaatt

SEQ ID NO: 86676 - DNA, 22 bp, Artificial Sequence
  Synthetic oligonucleotide; CTC chr11 5238469 5238490 5238486 5238491 +
tccacaattctaatctcagttc

SEQ ID NO: 86677 - DNA, 22 bp, Artificial Sequence
  Synthetic oligonucleotide; CTC chr11 5238471 5238492 5238488 5238493 +
cacaattctaatctcagttcac

SEQ ID NO: 86678 - DNA, 22 bp, Artificial Sequence
  Synthetic oligonucleotide; TTC chr11 5238479 5238500 5238496 5238501 +
taatctcagttcactgctgttt

SEQ ID NO: 86679 - DNA, 22 bp, Artificial Sequence
  Synthetic oligonucleotide; CTA chr11 5238481 5238502 5238498 5238503 +
atctcagttcactgctgtttga

SEQ ID NO: 86680 - DNA, 22 bp, Artificial Sequence
  Synthetic oligonucleotide; CTC chr11 5238486 5238507 5238503 5238508 +
agttcactgctgtttgaattct

SEQ ID NO: 86681 - DNA, 22 bp, Artificial Sequence
  Synthetic oligonucleotide; TTC chr11 5238491 5238512 5238508 5238513 +
actgctgtttgaattctgtgtt

SEQ ID NO: 86682 - DNA, 22 bp, Artificial Sequence
  Synthetic oligonucleotide; CTG chr11 5238495 5238516 5238512 5238517 +
ctgtttgaattctgtgttttca

SEQ ID NO: 86683 - DNA, 22 bp, Artificial Sequence
  Synthetic oligonucleotide; CTG chr11 5238498 5238519 5238515 5238520 +
tttgaattctgtgttttcatat

SEQ ID NO: 86684 - DNA, 22 bp, Artificial Sequence
  Synthetic oligonucleotide; TTT chr11 5238501 5238522 5238518 5238523 +
gaattctgtgttttcatattat

SEQ ID NO: 86685 - DNA, 22 bp, Artificial Sequence
  Synthetic oligonucleotide; TTG chr11 5238502 5238523 5238519 5238524 +
aattctgtgttttcatattatc

SEQ ID NO: 86686 - DNA, 22 bp, Artificial Sequence
  Synthetic oligonucleotide; TTC chr11 5238507 5238528 5238524 5238529 +
tgtgttttcatattatcttatc

SEQ ID NO: 86687 - DNA, 22 bp, Artificial Sequence
  Synthetic oligonucleotide; CTG chr11 5238509 5238530 5238526 5238531 +
tgttttcatattatcttatcaa

SEQ ID NO: 86688 - DNA, 22 bp, Artificial Sequence
  Synthetic oligonucleotide; TTT chr11 5238514 5238535 5238531 5238536 +
tcatattatcttatcaatacat

SEQ ID NO: 86689 - DNA, 22 bp, Artificial Sequence
  Synthetic oligonucleotide; TTT chr11 5238515 5238536 5238532 5238537 +
catattatcttatcaatacatt

SEQ ID NO: 86690 - DNA, 22 bp, Artificial Sequence
  Synthetic oligonucleotide; TTC chr11 5238516 5238537 5238533 5238538 +
atattatcttatcaatacatta

SEQ ID NO: 86691 - DNA, 22 bp, Artificial Sequence
  Synthetic oligonucleotide; TTA chr11 5238522 5238543 5238539 5238544 +
tcttatcaatacattaatcatt

SEQ ID NO: 86692 - DNA, 22 bp, Artificial Sequence
  Synthetic oligonucleotide; CTT chr11 5238526 5238547 5238543 5238548 +
atcaatacattaatcattgcaa

SEQ ID NO: 86693 - DNA, 22 bp, Artificial Sequence
  Synthetic oligonucleotide; TTA chr11 5238527 5238548 5238544 5238549 +
tcaatacattaatcattgcaat

SEQ ID NO: 86694 - DNA, 22 bp, Artificial Sequence
  Synthetic oligonucleotide; TTA chr11 5238538 5238559 5238555 5238560 +
atcattgcaataatcactgcac

SEQ ID NO: 86695 - DNA, 22 bp, Artificial Sequence
  Synthetic oligonucleotide; TTG chr11 5238545 5238566 5238562 5238567 +
caataatcactgcacactgtaa

SEQ ID NO: 86696 - DNA, 22 bp, Artificial Sequence
  Synthetic oligonucleotide; CTG chr11 5238557 5238578 5238574 5238579 +
cacactgtaattattcatttac

SEQ ID NO: 86697 - DNA, 22 bp, Artificial Sequence
  Synthetic oligonucleotide; CTG chr11 5238564 5238585 5238581 5238586 +
taattattcatttactggacac

SEQ ID NO: 86698 - DNA, 22 bp, Artificial Sequence
  Synthetic oligonucleotide; TTA chr11 5238570 5238591 5238587 5238592 +
ttcatttactggacacatccta

SEQ ID NO: 86699 - DNA, 22 bp, Artificial Sequence
  Synthetic oligonucleotide; TTC chr11 5238573 5238594 5238590 5238595 +
atttactggacacatcctagtt

SEQ ID NO: 86700 - DNA, 22 bp, Artificial Sequence
  Synthetic oligonucleotide; TTT chr11 5238577 5238598 5238594 5238599 +
actggacacatcctagtttcct

SEQ ID NO: 86701 - DNA, 22 bp, Artificial Sequence
  Synthetic oligonucleotide; TTA chr11 5238578 5238599 5238595 5238600 +
ctggacacatcctagtttcctt

SEQ ID NO: 86702 - DNA, 22 bp, Artificial Sequence
  Synthetic oligonucleotide; CTG chr11 5238581 5238602 5238598 5238603 +
gacacatcctagtttccttctg

SEQ ID NO: 86703 - DNA, 22 bp, Artificial Sequence
  Synthetic oligonucleotide; CTA chr11 5238592 5238613 5238609 5238614 +
gtttccttctgtcaattaccat

SEQ ID NO: 86704 - DNA, 22 bp, Artificial Sequence
  Synthetic oligonucleotide; TTT chr11 5238596 5238617 5238613 5238618 +
ccttctgtcaattaccattcat

SEQ ID NO: 86705 - DNA, 22 bp, Artificial Sequence
  Synthetic oligonucleotide; TTC chr11 5238597 5238618 5238614 5238619 +
cttctgtcaattaccattcatg

SEQ ID NO: 86706 - DNA, 22 bp, Artificial Sequence
  Synthetic oligonucleotide; CTT chr11 5238600 5238621 5238617 5238622 +
ctgtcaattaccattcatgtct

SEQ ID NO: 86707 - DNA, 22 bp, Artificial Sequence
  Synthetic oligonucleotide; TTC chr11 5238601 5238622 5238618 5238623 +
tgtcaattaccattcatgtctg

SEQ ID NO: 86708 - DNA, 22 bp, Artificial Sequence
  Synthetic oligonucleotide; CTG chr11 5238603 5238624 5238620 5238625 +
tcaattaccattcatgtctgct

SEQ ID NO: 86709 - DNA, 22 bp, Artificial Sequence
  Synthetic oligonucleotide; TTA chr11 5238610 5238631 5238627 5238632 +
ccattcatgtctgctttcacat

SEQ ID NO: 86710 - DNA, 22 bp, Artificial Sequence
  Synthetic oligonucleotide; TTC chr11 5238616 5238637 5238633 5238638 +
atgtctgctttcacatttattt

SEQ ID NO: 86711 - DNA, 22 bp, Artificial Sequence
  Synthetic oligonucleotide; CTG chr11 5238623 5238644 5238640 5238645 +
ctttcacatttatttctcatcc

SEQ ID NO: 86712 - DNA, 22 bp, Artificial Sequence
  Synthetic oligonucleotide; CTT chr11 5238626 5238647 5238643 5238648 +
tcacatttatttctcatccttc

SEQ ID NO: 86713 - DNA, 22 bp, Artificial Sequence
  Synthetic oligonucleotide; TTT chr11 5238627 5238648 5238644 5238649 +
cacatttatttctcatccttcc

SEQ ID NO: 86714 - DNA, 22 bp, Artificial Sequence
  Synthetic oligonucleotide; TTC chr11 5238628 5238649 5238645 5238650 +
acatttatttctcatccttccc

SEQ ID NO: 86715 - DNA, 22 bp, Artificial Sequence
  Synthetic oligonucleotide; TTT chr11 5238634 5238655 5238651 5238656 +
atttctcatccttccctcagtg

SEQ ID NO: 86716 - DNA, 22 bp, Artificial Sequence
  Synthetic oligonucleotide; TTA chr11 5238635 5238656 5238652 5238657 +
tttctcatccttccctcagtgt

SEQ ID NO: 86717 - DNA, 22 bp, Artificial Sequence
  Synthetic oligonucleotide; TTT chr11 5238638 5238659 5238655 5238660 +
ctcatccttccctcagtgttct

SEQ ID NO: 86718 - DNA, 22 bp, Artificial Sequence
  Synthetic oligonucleotide; TTC chr11 5238639 5238660 5238656 5238661 +
tcatccttccctcagtgttctc

SEQ ID NO: 86719 - DNA, 22 bp, Artificial Sequence
  Synthetic oligonucleotide; CTC chr11 5238641 5238662 5238658 5238663 +
atccttccctcagtgttctctg

SEQ ID NO: 86720 - DNA, 22 bp, Artificial Sequence
  Synthetic oligonucleotide; CTT chr11 5238647 5238668 5238664 5238669 +
ccctcagtgttctctgtatttg

SEQ ID NO: 86721 - DNA, 22 bp, Artificial Sequence
  Synthetic oligonucleotide; TTC chr11 5238648 5238669 5238665 5238670 +
cctcagtgttctctgtatttga

SEQ ID NO: 86722 - DNA, 22 bp, Artificial Sequence
  Synthetic oligonucleotide; CTC chr11 5238652 5238673 5238669 5238674 +
agtgttctctgtatttgaggaa

SEQ ID NO: 86723 - DNA, 22 bp, Artificial Sequence
  Synthetic oligonucleotide; TTC chr11 5238659 5238680 5238676 5238681 +
tctgtatttgaggaactgacat

SEQ ID NO: 86724 - DNA, 22 bp, Artificial Sequence
  Synthetic oligonucleotide; CTC chr11 5238661 5238682 5238678 5238683 +
tgtatttgaggaactgacattt

SEQ ID NO: 86725 - DNA, 22 bp, Artificial Sequence
  Synthetic oligonucleotide; CTG chr11 5238663 5238684 5238680 5238685 +
tatttgaggaactgacatttcc

SEQ ID NO: 86726 - DNA, 22 bp, Artificial Sequence
  Synthetic oligonucleotide; TTT chr11 5238668 5238689 5238685 5238690 +
gaggaactgacatttcccaggt

SEQ ID NO: 86727 - DNA, 22 bp, Artificial Sequence
  Synthetic oligonucleotide; TTG chr11 5238669 5238690 5238686 5238691 +
aggaactgacatttcccaggtt

SEQ ID NO: 86728 - DNA, 22 bp, Artificial Sequence
  Synthetic oligonucleotide; CTG chr11 5238677 5238698 5238694 5238699 +
acatttcccaggtttcctcacc

SEQ ID NO: 86729 - DNA, 22 bp, Artificial Sequence
  Synthetic oligonucleotide; TTT chr11 5238683 5238704 5238700 5238705 +
cccaggtttcctcaccctttca

SEQ ID NO: 86730 - DNA, 22 bp, Artificial Sequence
  Synthetic oligonucleotide; TTC chr11 5238684 5238705 5238701 5238706 +
ccaggtttcctcaccctttcag

SEQ ID NO: 86731 - DNA, 22 bp, Artificial Sequence
  Synthetic oligonucleotide; TTT chr11 5238692 5238713 5238709 5238714 +
cctcaccctttcagtcgcatgt

SEQ ID NO: 86732 - DNA, 22 bp, Artificial Sequence
  Synthetic oligonucleotide; TTC chr11 5238693 5238714 5238710 5238715 +
ctcaccctttcagtcgcatgta

SEQ ID NO: 86733 - DNA, 22 bp, Artificial Sequence
  Synthetic oligonucleotide; CTC chr11 5238696 5238717 5238713 5238718 +
accctttcagtcgcatgtacat

SEQ ID NO: 86734 - DNA, 22 bp, Artificial Sequence
  Synthetic oligonucleotide; CTT chr11 5238702 5238723 5238719 5238724 +
tcagtcgcatgtacattctgca

SEQ ID NO: 86735 - DNA, 22 bp, Artificial Sequence
  Synthetic oligonucleotide; TTT chr11 5238703 5238724 5238720 5238725 +
cagtcgcatgtacattctgcaa

SEQ ID NO: 86736 - DNA, 22 bp, Artificial Sequence
  Synthetic oligonucleotide; TTC chr11 5238704 5238725 5238721 5238726 +
agtcgcatgtacattctgcaat

SEQ ID NO: 86737 - DNA, 22 bp, Artificial Sequence
  Synthetic oligonucleotide; TTC chr11 5238720 5238741 5238737 5238742 +
tgcaatggtaaacactggctga

SEQ ID NO: 86738 - DNA, 22 bp, Artificial Sequence
  Synthetic oligonucleotide; CTG chr11 5238722 5238743 5238739 5238744 +
caatggtaaacactggctgagg

SEQ ID NO: 86739 - DNA, 22 bp, Artificial Sequence
  Synthetic oligonucleotide; CTG chr11 5238737 5238758 5238754 5238759 +
gctgagggaaagcataagcaag

SEQ ID NO: 86740 - DNA, 22 bp, Artificial Sequence
  Synthetic oligonucleotide; CTG chr11 5238741 5238762 5238758 5238763 +
agggaaagcataagcaagatta

SEQ ID NO: 86741 - DNA, 22 bp, Artificial Sequence
  Synthetic oligonucleotide; TTA chr11 5238763 5238784 5238780 5238785 +
tttctggtctctctctctctct

SEQ ID NO: 86742 - DNA, 22 bp, Artificial Sequence
  Synthetic oligonucleotide; TTT chr11 5238766 5238787 5238783 5238788 +
ctggtctctctctctctctgaa

SEQ ID NO: 86743 - DNA, 22 bp, Artificial Sequence
  Synthetic oligonucleotide; TTC chr11 5238767 5238788 5238784 5238789 +
tggtctctctctctctctgaac

SEQ ID NO: 86744 - DNA, 22 bp, Artificial Sequence
  Synthetic oligonucleotide; CTG chr11 5238769 5238790 5238786 5238791 +
gtctctctctctctctgaacgg

SEQ ID NO: 86745 - DNA, 22 bp, Artificial Sequence
  Synthetic oligonucleotide; CTC chr11 5238774 5238795 5238791 5238796 +
tctctctctctgaacggatctc

SEQ ID NO: 86746 - DNA, 22 bp, Artificial Sequence
  Synthetic oligonucleotide; CTC chr11 5238776 5238797 5238793 5238798 +
tctctctctgaacggatctcct

SEQ ID NO: 86747 - DNA, 22 bp, Artificial Sequence
  Synthetic oligonucleotide; CTC chr11 5238778 5238799 5238795 5238800 +
tctctctgaacggatctcctac

SEQ ID NO: 86748 - DNA, 22 bp, Artificial Sequence
  Synthetic oligonucleotide; CTC chr11 5238780 5238801 5238797 5238802 +
tctctgaacggatctcctacag

SEQ ID NO: 86749 - DNA, 22 bp, Artificial Sequence
  Synthetic oligonucleotide; CTC chr11 5238782 5238803 5238799 5238804 +
tctgaacggatctcctacagca

SEQ ID NO: 86750 - DNA, 22 bp, Artificial Sequence
  Synthetic oligonucleotide; CTC chr11 5238784 5238805 5238801 5238806 +
tgaacggatctcctacagcaga

SEQ ID NO: 86751 - DNA, 22 bp, Artificial Sequence
  Synthetic oligonucleotide; CTG chr11 5238786 5238807 5238803 5238808 +
aacggatctcctacagcagaca

SEQ ID NO: 86752 - DNA, 22 bp, Artificial Sequence
  Synthetic oligonucleotide; CTC chr11 5238796 5238817 5238813 5238818 +
ctacagcagacagtctttttta

SEQ ID NO: 86753 - DNA, 22 bp, Artificial Sequence
  Synthetic oligonucleotide; CTA chr11 5238799 5238820 5238816 5238821 +
cagcagacagtcttttttatgg

SEQ ID NO: 86754 - DNA, 22 bp, Artificial Sequence
  Synthetic oligonucleotide; CTT chr11 5238813 5238834 5238830 5238835 +
ttttatggttttttatggctga

SEQ ID NO: 86755 - DNA, 22 bp, Artificial Sequence
  Synthetic oligonucleotide; TTT chr11 5238814 5238835 5238831 5238836 +
tttatggttttttatggctgat

SEQ ID NO: 86756 - DNA, 22 bp, Artificial Sequence
  Synthetic oligonucleotide; TTT chr11 5238815 5238836 5238832 5238837 +
ttatggttttttatggctgata

SEQ ID NO: 86757 - DNA, 22 bp, Artificial Sequence
  Synthetic oligonucleotide; TTT chr11 5238816 5238837 5238833 5238838 +
tatggttttttatggctgatac

SEQ ID NO: 86758 - DNA, 22 bp, Artificial Sequence
  Synthetic oligonucleotide; TTT chr11 5238817 5238838 5238834 5238839 +
atggttttttatggctgatact

SEQ ID NO: 86759 - DNA, 22 bp, Artificial Sequence
  Synthetic oligonucleotide; TTA chr11 5238818 5238839 5238835 5238840 +
tggttttttatggctgatactt

SEQ ID NO: 86760 - DNA, 22 bp, Artificial Sequence
  Synthetic oligonucleotide; TTT chr11 5238824 5238845 5238841 5238846 +
tttatggctgatactttgatgc

SEQ ID NO: 86761 - DNA, 22 bp, Artificial Sequence
  Synthetic oligonucleotide; TTT chr11 5238825 5238846 5238842 5238847 +
ttatggctgatactttgatgcc

SEQ ID NO: 86762 - DNA, 22 bp, Artificial Sequence
  Synthetic oligonucleotide; TTT chr11 5238826 5238847 5238843 5238848 +
tatggctgatactttgatgccc

SEQ ID NO: 86763 - DNA, 22 bp, Artificial Sequence
  Synthetic oligonucleotide; TTT chr11 5238827 5238848 5238844 5238849 +
atggctgatactttgatgcccc

SEQ ID NO: 86764 - DNA, 22 bp, Artificial Sequence
  Synthetic oligonucleotide; TTA chr11 5238828 5238849 5238845 5238850 +
tggctgatactttgatgccccc

SEQ ID NO: 86765 - DNA, 22 bp, Artificial Sequence
  Synthetic oligonucleotide; CTG chr11 5238834 5238855 5238851 5238856 +
atactttgatgcccccattaga

SEQ ID NO: 86766 - DNA, 22 bp, Artificial Sequence
  Synthetic oligonucleotide; CTT chr11 5238840 5238861 5238857 5238862 +
tgatgcccccattagacagttc

SEQ ID NO: 86767 - DNA, 22 bp, Artificial Sequence
  Synthetic oligonucleotide; TTT chr11 5238841 5238862 5238858 5238863 +
gatgcccccattagacagttct

SEQ ID NO: 86768 - DNA, 22 bp, Artificial Sequence
  Synthetic oligonucleotide; TTG chr11 5238842 5238863 5238859 5238864 +
atgcccccattagacagttctg

SEQ ID NO: 86769 - DNA, 22 bp, Artificial Sequence
  Synthetic oligonucleotide; TTA chr11 5238854 5238875 5238871 5238876 +
gacagttctggctctctccaag

SEQ ID NO: 86770 - DNA, 22 bp, Artificial Sequence
  Synthetic oligonucleotide; TTC chr11 5238862 5238883 5238879 5238884 +
tggctctctccaaggagcaccc

SEQ ID NO: 86771 - DNA, 22 bp, Artificial Sequence
  Synthetic oligonucleotide; CTG chr11 5238864 5238885 5238881 5238886 +
gctctctccaaggagcacccac

SEQ ID NO: 86772 - DNA, 22 bp, Artificial Sequence
  Synthetic oligonucleotide; CTC chr11 5238868 5238889 5238885 5238890 +
tctccaaggagcacccactagc

SEQ ID NO: 86773 - DNA, 22 bp, Artificial Sequence
  Synthetic oligonucleotide; CTC chr11 5238870 5238891 5238887 5238892 +
tccaaggagcacccactagctc

SEQ ID NO: 86774 - DNA, 22 bp, Artificial Sequence
  Synthetic oligonucleotide; CTC chr11 5238872 5238893 5238889 5238894 +
caaggagcacccactagctcac

SEQ ID NO: 86775 - DNA, 22 bp, Artificial Sequence
  Synthetic oligonucleotide; CTA chr11 5238888 5238909 5238905 5238910 +
gctcactgaatccagtggacct

SEQ ID NO: 86776 - DNA, 22 bp, Artificial Sequence
  Synthetic oligonucleotide; CTC chr11 5238892 5238913 5238909 5238914 +
actgaatccagtggacctctgg

SEQ ID NO: 86777 - DNA, 22 bp, Artificial Sequence
  Synthetic oligonucleotide; CTG chr11 5238896 5238917 5238913 5238918 +
aatccagtggacctctggttat

SEQ ID NO: 86778 - DNA, 22 bp, Artificial Sequence
  Synthetic oligonucleotide; CTC chr11 5238911 5238932 5238928 5238933 +
tggttatgggctctggttctgg

SEQ ID NO: 86779 - DNA, 22 bp, Artificial Sequence
  Synthetic oligonucleotide; CTG chr11 5238913 5238934 5238930 5238935 +
gttatgggctctggttctggac

SEQ ID NO: 86780 - DNA, 22 bp, Artificial Sequence
  Synthetic oligonucleotide; TTA chr11 5238917 5238938 5238934 5238939 +
tgggctctggttctggactctg

SEQ ID NO: 86781 - DNA, 22 bp, Artificial Sequence
  Synthetic oligonucleotide; CTC chr11 5238924 5238945 5238941 5238946 +
tggttctggactctggtggtat

SEQ ID NO: 86782 - DNA, 22 bp, Artificial Sequence
  Synthetic oligonucleotide; CTG chr11 5238926 5238947 5238943 5238948 +
gttctggactctggtggtataa

SEQ ID NO: 86783 - DNA, 22 bp, Artificial Sequence
  Synthetic oligonucleotide; TTC chr11 5238930 5238951 5238947 5238952 +
tggactctggtggtataaacat

SEQ ID NO: 86784 - DNA, 22 bp, Artificial Sequence
  Synthetic oligonucleotide; CTG chr11 5238932 5238953 5238949 5238954 +
gactctggtggtataaacattt

SEQ ID NO: 86785 - DNA, 22 bp, Artificial Sequence
  Synthetic oligonucleotide; CTC chr11 5238937 5238958 5238954 5238959 +
tggtggtataaacattttctcc

SEQ ID NO: 86786 - DNA, 22 bp, Artificial Sequence
  Synthetic oligonucleotide; CTG chr11 5238939 5238960 5238956 5238961 +
gtggtataaacattttctcctt

SEQ ID NO: 86787 - DNA, 22 bp, Artificial Sequence
  Synthetic oligonucleotide; TTT chr11 5238954 5238975 5238971 5238976 +
tctccttctgcccttctaggcc

SEQ ID NO: 86788 - DNA, 22 bp, Artificial Sequence
  Synthetic oligonucleotide; TTT chr11 5238955 5238976 5238972 5238977 +
ctccttctgcccttctaggcct

SEQ ID NO: 86789 - DNA, 22 bp, Artificial Sequence
  Synthetic oligonucleotide; TTC chr11 5238956 5238977 5238973 5238978 +
tccttctgcccttctaggccta

SEQ ID NO: 86790 - DNA, 22 bp, Artificial Sequence
  Synthetic oligonucleotide; CTC chr11 5238958 5238979 5238975 5238980 +
cttctgcccttctaggcctaat

SEQ ID NO: 86791 - DNA, 22 bp, Artificial Sequence
  Synthetic oligonucleotide; CTT chr11 5238961 5238982 5238978 5238983 +
ctgcccttctaggcctaatggc

SEQ ID NO: 86792 - DNA, 22 bp, Artificial Sequence
  Synthetic oligonucleotide; TTC chr11 5238962 5238983 5238979 5238984 +
tgcccttctaggcctaatggcg

SEQ ID NO: 86793 - DNA, 22 bp, Artificial Sequence
  Synthetic oligonucleotide; CTG chr11 5238964 5238985 5238981 5238986 +
cccttctaggcctaatggcgga

SEQ ID NO: 86794 - DNA, 22 bp, Artificial Sequence
  Synthetic oligonucleotide; CTT chr11 5238969 5238990 5238986 5238991 +
ctaggcctaatggcggaagagg

SEQ ID NO: 86795 - DNA, 22 bp, Artificial Sequence
  Synthetic oligonucleotide; TTC chr11 5238970 5238991 5238987 5238992 +
taggcctaatggcggaagaggt

SEQ ID NO: 86796 - DNA, 22 bp, Artificial Sequence
  Synthetic oligonucleotide; CTA chr11 5238972 5238993 5238989 5238994 +
ggcctaatggcggaagaggttt

SEQ ID NO: 86797 - DNA, 22 bp, Artificial Sequence
  Synthetic oligonucleotide; CTA chr11 5238978 5238999 5238995 5239000 +
atggcggaagaggttttctgat

SEQ ID NO: 86798 - DNA, 22 bp, Artificial Sequence
  Synthetic oligonucleotide; TTT chr11 5238994 5239015 5239011 5239016 +
tctgatgttactaacatctaga

SEQ ID NO: 86799 - DNA, 22 bp, Artificial Sequence
  Synthetic oligonucleotide; TTT chr11 5238995 5239016 5239012 5239017 +
ctgatgttactaacatctagat

SEQ ID NO: 86800 - DNA, 22 bp, Artificial Sequence
  Synthetic oligonucleotide; TTC chr11 5238996 5239017 5239013 5239018 +
tgatgttactaacatctagatt

SEQ ID NO: 86801 - DNA, 22 bp, Artificial Sequence
  Synthetic oligonucleotide; CTG chr11 5238998 5239019 5239015 5239020 +
atgttactaacatctagatttc

SEQ ID NO: 86802 - DNA, 22 bp, Artificial Sequence
  Synthetic oligonucleotide; TTA chr11 5239004 5239025 5239021 5239026 +
ctaacatctagatttctgcact

SEQ ID NO: 86803 - DNA, 22 bp, Artificial Sequence
  Synthetic oligonucleotide; CTA chr11 5239007 5239028 5239024 5239029 +
acatctagatttctgcactgtc

SEQ ID NO: 86804 - DNA, 22 bp, Artificial Sequence
  Synthetic oligonucleotide; CTA chr11 5239014 5239035 5239031 5239036 +
gatttctgcactgtcctttatt

SEQ ID NO: 86805 - DNA, 22 bp, Artificial Sequence
  Synthetic oligonucleotide; TTT chr11 5239019 5239040 5239036 5239041 +
ctgcactgtcctttatttgata

SEQ ID NO: 86806 - DNA, 22 bp, Artificial Sequence
  Synthetic oligonucleotide; TTC chr11 5239020 5239041 5239037 5239042 +
tgcactgtcctttatttgatat

SEQ ID NO: 86807 - DNA, 22 bp, Artificial Sequence
  Synthetic oligonucleotide; CTG chr11 5239022 5239043 5239039 5239044 +
cactgtcctttatttgatattt

SEQ ID NO: 86808 - DNA, 22 bp, Artificial Sequence
  Synthetic oligonucleotide; CTG chr11 5239027 5239048 5239044 5239049 +
tcctttatttgatattttagct

SEQ ID NO: 86809 - DNA, 22 bp, Artificial Sequence
  Synthetic oligonucleotide; CTT chr11 5239032 5239053 5239049 5239054 +
tatttgatattttagctcttcc

SEQ ID NO: 86810 - DNA, 22 bp, Artificial Sequence
  Synthetic oligonucleotide; TTT chr11 5239033 5239054 5239050 5239055 +
atttgatattttagctcttcca

SEQ ID NO: 86811 - DNA, 22 bp, Artificial Sequence
  Synthetic oligonucleotide; TTA chr11 5239034 5239055 5239051 5239056 +
tttgatattttagctcttccaa

SEQ ID NO: 86812 - DNA, 22 bp, Artificial Sequence
  Synthetic oligonucleotide; TTT chr11 5239037 5239058 5239054 5239059 +
gatattttagctcttccaatac

SEQ ID NO: 86813 - DNA, 22 bp, Artificial Sequence
  Synthetic oligonucleotide; TTG chr11 5239038 5239059 5239055 5239060 +
atattttagctcttccaataca

SEQ ID NO: 86814 - DNA, 22 bp, Artificial Sequence
  Synthetic oligonucleotide; TTT chr11 5239044 5239065 5239061 5239066 +
tagctcttccaatacaaggata

SEQ ID NO: 86815 - DNA, 22 bp, Artificial Sequence
  Synthetic oligonucleotide; TTT chr11 5239045 5239066 5239062 5239067 +
agctcttccaatacaaggataa

SEQ ID NO: 86816 - DNA, 22 bp, Artificial Sequence
  Synthetic oligonucleotide; TTA chr11 5239046 5239067 5239063 5239068 +
gctcttccaatacaaggataat

SEQ ID NO: 86817 - DNA, 22 bp, Artificial Sequence
  Synthetic oligonucleotide; CTC chr11 5239050 5239071 5239067 5239072 +
ttccaatacaaggataattaac

SEQ ID NO: 86818 - DNA, 22 bp, Artificial Sequence
  Synthetic oligonucleotide; CTT chr11 5239052 5239073 5239069 5239074 +
ccaatacaaggataattaacta

SEQ ID NO: 86819 - DNA, 22 bp, Artificial Sequence
  Synthetic oligonucleotide; TTC chr11 5239053 5239074 5239070 5239075 +
caatacaaggataattaactat

SEQ ID NO: 86820 - DNA, 22 bp, Artificial Sequence
  Synthetic oligonucleotide; TTA chr11 5239070 5239091 5239087 5239092 +
actattaagagctgtatttaat

SEQ ID NO: 86821 - DNA, 22 bp, Artificial Sequence
  Synthetic oligonucleotide; CTA chr11 5239074 5239095 5239091 5239096 +
ttaagagctgtatttaattcta

SEQ ID NO: 86822 - DNA, 22 bp, Artificial Sequence
  Synthetic oligonucleotide; TTA chr11 5239077 5239098 5239094 5239099 +
agagctgtatttaattctaggt

SEQ ID NO: 86823 - DNA, 22 bp, Artificial Sequence
  Synthetic oligonucleotide; CTG chr11 5239084 5239105 5239101 5239106 +
tatttaattctaggttgagtaa

SEQ ID NO: 86824 - DNA, 22 bp, Artificial Sequence
  Synthetic oligonucleotide; TTT chr11 5239089 5239110 5239106 5239111 +
aattctaggttgagtaactgat

SEQ ID NO: 86825 - DNA, 22 bp, Artificial Sequence
  Synthetic oligonucleotide; TTA chr11 5239090 5239111 5239107 5239112 +
attctaggttgagtaactgata

SEQ ID NO: 86826 - DNA, 22 bp, Artificial Sequence
  Synthetic oligonucleotide; TTC chr11 5239094 5239115 5239111 5239116 +
taggttgagtaactgataatgg

SEQ ID NO: 86827 - DNA, 22 bp, Artificial Sequence
  Synthetic oligonucleotide; CTA chr11 5239096 5239117 5239113 5239118 +
ggttgagtaactgataatggtt

SEQ ID NO: 86828 - DNA, 22 bp, Artificial Sequence
  Synthetic oligonucleotide; TTG chr11 5239101 5239122 5239118 5239123 +
agtaactgataatggtttgtcc

SEQ ID NO: 86829 - DNA, 22 bp, Artificial Sequence
  Synthetic oligonucleotide; CTG chr11 5239109 5239130 5239126 5239131 +
ataatggtttgtcctttccttg

SEQ ID NO: 86830 - DNA, 22 bp, Artificial Sequence
  Synthetic oligonucleotide; TTT chr11 5239119 5239140 5239136 5239141 +
gtcctttccttgatggacccta

SEQ ID NO: 86831 - DNA, 22 bp, Artificial Sequence
  Synthetic oligonucleotide; TTG chr11 5239120 5239141 5239137 5239142 +
tcctttccttgatggaccctaa

SEQ ID NO: 86832 - DNA, 22 bp, Artificial Sequence
  Synthetic oligonucleotide; CTT chr11 5239125 5239146 5239142 5239147 +
tccttgatggaccctaactgat

SEQ ID NO: 86833 - DNA, 22 bp, Artificial Sequence
  Synthetic oligonucleotide; TTT chr11 5239126 5239147 5239143 5239148 +
ccttgatggaccctaactgata

SEQ ID NO: 86834 - DNA, 22 bp, Artificial Sequence
  Synthetic oligonucleotide; TTC chr11 5239127 5239148 5239144 5239149 +
cttgatggaccctaactgatat

SEQ ID NO: 86835 - DNA, 22 bp, Artificial Sequence
  Synthetic oligonucleotide; CTT chr11 5239130 5239151 5239147 5239152 +
gatggaccctaactgatataac

SEQ ID NO: 86836 - DNA, 22 bp, Artificial Sequence
  Synthetic oligonucleotide; TTG chr11 5239131 5239152 5239148 5239153 +
atggaccctaactgatataact

SEQ ID NO: 86837 - DNA, 22 bp, Artificial Sequence
  Synthetic oligonucleotide; CTA chr11 5239141 5239162 5239158 5239163 +
actgatataactaataaactga

SEQ ID NO: 86838 - DNA, 22 bp, Artificial Sequence
  Synthetic oligonucleotide; CTG chr11 5239145 5239166 5239162 5239167 +
atataactaataaactgacttc

SEQ ID NO: 86839 - DNA, 22 bp, Artificial Sequence
  Synthetic oligonucleotide; CTA chr11 5239154 5239175 5239171 5239176 +
ataaactgacttctgatactat

SEQ ID NO: 86840 - DNA, 22 bp, Artificial Sequence
  Synthetic oligonucleotide; CTG chr11 5239162 5239183 5239179 5239184 +
acttctgatactatgtcttatt

SEQ ID NO: 86841 - DNA, 22 bp, Artificial Sequence
  Synthetic oligonucleotide; CTT chr11 5239166 5239187 5239183 5239188 +
ctgatactatgtcttattagtg

SEQ ID NO: 86842 - DNA, 22 bp, Artificial Sequence
  Synthetic oligonucleotide; TTC chr11 5239167 5239188 5239184 5239189 +
tgatactatgtcttattagtgt

SEQ ID NO: 86843 - DNA, 22 bp, Artificial Sequence
  Synthetic oligonucleotide; CTG chr11 5239169 5239190 5239186 5239191 +
atactatgtcttattagtgtat

SEQ ID NO: 86844 - DNA, 22 bp, Artificial Sequence
  Synthetic oligonucleotide; CTA chr11 5239175 5239196 5239192 5239197 +
tgtcttattagtgtatgaaatt

SEQ ID NO: 86845 - DNA, 22 bp, Artificial Sequence
  Synthetic oligonucleotide; CTT chr11 5239181 5239202 5239198 5239203 +
attagtgtatgaaattctgatg

SEQ ID NO: 86846 - DNA, 22 bp, Artificial Sequence
  Synthetic oligonucleotide; TTA chr11 5239182 5239203 5239199 5239204 +
ttagtgtatgaaattctgatgt

SEQ ID NO: 86847 - DNA, 22 bp, Artificial Sequence
  Synthetic oligonucleotide; TTA chr11 5239185 5239206 5239202 5239207 +
gtgtatgaaattctgatgtgaa

SEQ ID NO: 86848 - DNA, 22 bp, Artificial Sequence
  Synthetic oligonucleotide; TTC chr11 5239198 5239219 5239215 5239220 +
tgatgtgaataaatgcatgaca

SEQ ID NO: 86849 - DNA, 22 bp, Artificial Sequence
  Synthetic oligonucleotide; CTG chr11 5239200 5239221 5239217 5239222 +
atgtgaataaatgcatgacaca

SEQ ID NO: 86850 - DNA, 22 bp, Artificial Sequence
  Synthetic oligonucleotide; CTT chr11 5239227 5239248 5239244 5239249 +
gttgactaatcaaactatagca

SEQ ID NO: 86851 - DNA, 22 bp, Artificial Sequence
  Synthetic oligonucleotide; TTG chr11 5239228 5239249 5239245 5239250 +
ttgactaatcaaactatagcag

SEQ ID NO: 86852 - DNA, 22 bp, Artificial Sequence
  Synthetic oligonucleotide; TTG chr11 5239231 5239252 5239248 5239253 +
actaatcaaactatagcagagg

SEQ ID NO: 86853 - DNA, 22 bp, Artificial Sequence
  Synthetic oligonucleotide; CTA chr11 5239235 5239256 5239252 5239257 +
atcaaactatagcagaggcaga

SEQ ID NO: 86854 - DNA, 22 bp, Artificial Sequence
  Synthetic oligonucleotide; CTA chr11 5239244 5239265 5239261 5239266 +
tagcagaggcagaggaaggaac

SEQ ID NO: 86855 - DNA, 22 bp, Artificial Sequence
  Synthetic oligonucleotide; CTC chr11 5239269 5239290 5239286 5239291 +
atgacctataaatactaagata

SEQ ID NO: 86856 - DNA, 22 bp, Artificial Sequence
  Synthetic oligonucleotide; CTA chr11 5239277 5239298 5239294 5239299 +
taaatactaagatatcacatag

SEQ ID NO: 86857 - DNA, 22 bp, Artificial Sequence
  Synthetic oligonucleotide; CTA chr11 5239286 5239307 5239303 5239308 +
agatatcacatagtcattttag

SEQ ID NO: 86858 - DNA, 22 bp, Artificial Sequence
  Synthetic oligonucleotide; TTT chr11 5239305 5239326 5239322 5239327 +
tagaaccaaaggttcctcagtt

SEQ ID NO: 86859 - DNA, 22 bp, Artificial Sequence
  Synthetic oligonucleotide; TTT chr11 5239306 5239327 5239323 5239328 +
agaaccaaaggttcctcagttt

SEQ ID NO: 86860 - DNA, 22 bp, Artificial Sequence
  Synthetic oligonucleotide; TTA chr11 5239307 5239328 5239324 5239329 +
gaaccaaaggttcctcagttta

SEQ ID NO: 86861 - DNA, 22 bp, Artificial Sequence
  Synthetic oligonucleotide; TTC chr11 5239320 5239341 5239337 5239342 +
ctcagtttaggtctcaaacaaa

SEQ ID NO: 86862 - DNA, 22 bp, Artificial Sequence
  Synthetic oligonucleotide; CTC chr11 5239323 5239344 5239340 5239345 +
agtttaggtctcaaacaaactt

SEQ ID NO: 86863 - DNA, 22 bp, Artificial Sequence
  Synthetic oligonucleotide; TTT chr11 5239328 5239349 5239345 5239350 +
aggtctcaaacaaacttctcta

SEQ ID NO: 86864 - DNA, 22 bp, Artificial Sequence
  Synthetic oligonucleotide; TTA chr11 5239329 5239350 5239346 5239351 +
ggtctcaaacaaacttctctat

SEQ ID NO: 86865 - DNA, 22 bp, Artificial Sequence
  Synthetic oligonucleotide; CTC chr11 5239335 5239356 5239352 5239357 +
aaacaaacttctctatggatag

SEQ ID NO: 86866 - DNA, 22 bp, Artificial Sequence
  Synthetic oligonucleotide; CTT chr11 5239345 5239366 5239362 5239367 +
ctctatggatagtgtaatactc

SEQ ID NO: 86867 - DNA, 22 bp, Artificial Sequence
  Synthetic oligonucleotide; TTC chr11 5239346 5239367 5239363 5239368 +
tctatggatagtgtaatactca

SEQ ID NO: 86868 - DNA, 22 bp, Artificial Sequence
  Synthetic oligonucleotide; CTC chr11 5239348 5239369 5239365 5239370 +
tatggatagtgtaatactcata

SEQ ID NO: 86869 - DNA, 22 bp, Artificial Sequence
  Synthetic oligonucleotide; CTA chr11 5239350 5239371 5239367 5239372 +
tggatagtgtaatactcataat

SEQ ID NO: 86870 - DNA, 22 bp, Artificial Sequence
  Synthetic oligonucleotide; CTC chr11 5239367 5239388 5239384 5239389 +
ataatgtagaaaagagagatct

SEQ ID NO: 86871 - DNA, 22 bp, Artificial Sequence
  Synthetic oligonucleotide; CTA chr11 5239390 5239411 5239407 5239412 +
attttggataatttaatctttt

SEQ ID NO: 86872 - DNA, 22 bp, Artificial Sequence
  Synthetic oligonucleotide; TTT chr11 5239394 5239415 5239411 5239416 +
tggataatttaatctttttttt

SEQ ID NO: 86873 - DNA, 22 bp, Artificial Sequence
  Synthetic oligonucleotide; TTT chr11 5239395 5239416 5239412 5239417 +
ggataatttaatcttttttttc

SEQ ID NO: 86874 - DNA, 22 bp, Artificial Sequence
  Synthetic oligonucleotide; TTG chr11 5239396 5239417 5239413 5239418 +
gataatttaatcttttttttca

SEQ ID NO: 86875 - DNA, 22 bp, Artificial Sequence
  Synthetic oligonucleotide; TTT chr11 5239404 5239425 5239421 5239426 +
aatcttttttttcatctccaaa

SEQ ID NO: 86876 - DNA, 22 bp, Artificial Sequence
  Synthetic oligonucleotide; TTA chr11 5239405 5239426 5239422 5239427 +
atcttttttttcatctccaaat

SEQ ID NO: 86877 - DNA, 22 bp, Artificial Sequence
  Synthetic oligonucleotide; CTT chr11 5239410 5239431 5239427 5239432 +
ttttttcatctccaaatactag

SEQ ID NO: 86878 - DNA, 22 bp, Artificial Sequence
  Synthetic oligonucleotide; TTT chr11 5239411 5239432 5239428 5239433 +
tttttcatctccaaatactagg

SEQ ID NO: 86879 - DNA, 22 bp, Artificial Sequence
  Synthetic oligonucleotide; TTT chr11 5239412 5239433 5239429 5239434 +
ttttcatctccaaatactaggg

SEQ ID NO: 86880 - DNA, 22 bp, Artificial Sequence
  Synthetic oligonucleotide; TTT chr11 5239413 5239434 5239430 5239435 +
tttcatctccaaatactaggga

SEQ ID NO: 86881 - DNA, 22 bp, Artificial Sequence
  Synthetic oligonucleotide; TTT chr11 5239414 5239435 5239431 5239436 +
ttcatctccaaatactagggaa

SEQ ID NO: 86882 - DNA, 22 bp, Artificial Sequence
  Synthetic oligonucleotide; TTT chr11 5239415 5239436 5239432 5239437 +
tcatctccaaatactagggaaa

SEQ ID NO: 86883 - DNA, 22 bp, Artificial Sequence
  Synthetic oligonucleotide; TTT chr11 5239416 5239437 5239433 5239438 +
catctccaaatactagggaaat

SEQ ID NO: 86884 - DNA, 22 bp, Artificial Sequence
  Synthetic oligonucleotide; TTC chr11 5239417 5239438 5239434 5239439 +
atctccaaatactagggaaata

SEQ ID NO: 86885 - DNA, 22 bp, Artificial Sequence
  Synthetic oligonucleotide; CTC chr11 5239422 5239443 5239439 5239444 +
caaatactagggaaataagagt

SEQ ID NO: 86886 - DNA, 22 bp, Artificial Sequence
  Synthetic oligonucleotide; CTA chr11 5239431 5239452 5239448 5239453 +
gggaaataagagtttacaagac

SEQ ID NO: 86887 - DNA, 22 bp, Artificial Sequence
  Synthetic oligonucleotide; TTT chr11 5239446 5239467 5239463 5239468 +
acaagacaatgtctctaccata

SEQ ID NO: 86888 - DNA, 22 bp, Artificial Sequence
  Synthetic oligonucleotide; TTA chr11 5239447 5239468 5239464 5239469 +
caagacaatgtctctaccataa

SEQ ID NO: 86889 - DNA, 22 bp, Artificial Sequence
  Synthetic oligonucleotide; CTC chr11 5239461 5239482 5239478 5239483 +
taccataaaagaggttaaaatt

SEQ ID NO: 86890 - DNA, 22 bp, Artificial Sequence
  Synthetic oligonucleotide; CTA chr11 5239463 5239484 5239480 5239485 +
ccataaaagaggttaaaattta

SEQ ID NO: 86891 - DNA, 22 bp, Artificial Sequence
  Synthetic oligonucleotide; TTA chr11 5239478 5239499 5239495 5239500 +
aaatttagtggtaggaatatac

SEQ ID NO: 86892 - DNA, 22 bp, Artificial Sequence
  Synthetic oligonucleotide; TTT chr11 5239484 5239505 5239501 5239506 +
agtggtaggaatatacaatgag

SEQ ID NO: 86893 - DNA, 22 bp, Artificial Sequence
  Synthetic oligonucleotide; TTA chr11 5239485 5239506 5239502 5239507 +
gtggtaggaatatacaatgagc

SEQ ID NO: 86894 - DNA, 22 bp, Artificial Sequence
  Synthetic oligonucleotide; TTA chr11 5239513 5239534 5239530 5239535 +
agtacattagtaggaaaaacac

SEQ ID NO: 86895 - DNA, 22 bp, Artificial Sequence
  Synthetic oligonucleotide; TTA chr11 5239522 5239543 5239539 5239544 +
gtaggaaaaacactaaatatta

SEQ ID NO: 86896 - DNA, 22 bp, Artificial Sequence
  Synthetic oligonucleotide; CTA chr11 5239537 5239558 5239554 5239559 +
aatattataagaaagagcccat

SEQ ID NO: 86897 - DNA, 22 bp, Artificial Sequence
  Synthetic oligonucleotide; TTA chr11 5239544 5239565 5239561 5239566 +
taagaaagagcccataattgta

SEQ ID NO: 86898 - DNA, 22 bp, Artificial Sequence
  Synthetic oligonucleotide; TTG chr11 5239564 5239585 5239581 5239586 +
tagcagagtttatagacagggc

SEQ ID NO: 86899 - DNA, 22 bp, Artificial Sequence
  Synthetic oligonucleotide; TTT chr11 5239575 5239596 5239592 5239597 +
atagacagggctttaagcccag

SEQ ID NO: 86900 - DNA, 22 bp, Artificial Sequence
  Synthetic oligonucleotide; TTA chr11 5239576 5239597 5239593 5239598 +
tagacagggctttaagcccagt

SEQ ID NO: 86901 - DNA, 22 bp, Artificial Sequence
  Synthetic oligonucleotide; CTT chr11 5239588 5239609 5239605 5239610 +
taagcccagttaaaattaaaaa

SEQ ID NO: 86902 - DNA, 22 bp, Artificial Sequence
  Synthetic oligonucleotide; TTT chr11 5239589 5239610 5239606 5239611 +
aagcccagttaaaattaaaaaa

SEQ ID NO: 86903 - DNA, 22 bp, Artificial Sequence
  Synthetic oligonucleotide; TTA chr11 5239590 5239611 5239607 5239612 +
agcccagttaaaattaaaaaaa

SEQ ID NO: 86904 - DNA, 22 bp, Artificial Sequence
  Synthetic oligonucleotide; TTA chr11 5239600 5239621 5239617 5239622 +
aaattaaaaaaaaatagcttct

SEQ ID NO: 86905 - DNA, 22 bp, Artificial Sequence
  Synthetic oligonucleotide; TTA chr11 5239606 5239627 5239623 5239628 +
aaaaaaaatagcttcttagttg

SEQ ID NO: 86906 - DNA, 22 bp, Artificial Sequence
  Synthetic oligonucleotide; CTT chr11 5239620 5239641 5239637 5239642 +
cttagttgagataacatataag

SEQ ID NO: 86907 - DNA, 22 bp, Artificial Sequence
  Synthetic oligonucleotide; TTC chr11 5239621 5239642 5239638 5239643 +
ttagttgagataacatataagt

SEQ ID NO: 86908 - DNA, 22 bp, Artificial Sequence
  Synthetic oligonucleotide; CTT chr11 5239623 5239644 5239640 5239645 +
agttgagataacatataagtta

SEQ ID NO: 86909 - DNA, 22 bp, Artificial Sequence
  Synthetic oligonucleotide; TTA chr11 5239624 5239645 5239641 5239646 +
gttgagataacatataagttag

SEQ ID NO: 86910 - DNA, 22 bp, Artificial Sequence
  Synthetic oligonucleotide; TTG chr11 5239628 5239649 5239645 5239650 +
agataacatataagttaggact

SEQ ID NO: 86911 - DNA, 22 bp, Artificial Sequence
  Synthetic oligonucleotide; TTA chr11 5239645 5239666 5239662 5239667 +
ggacttaaagtatgagtacaag

SEQ ID NO: 86912 - DNA, 22 bp, Artificial Sequence
  Synthetic oligonucleotide; CTT chr11 5239651 5239672 5239668 5239673 +
aaagtatgagtacaagatagac

SEQ ID NO: 86913 - DNA, 22 bp, Artificial Sequence
  Synthetic oligonucleotide; TTA chr11 5239652 5239673 5239669 5239674 +
aagtatgagtacaagatagaca

SEQ ID NO: 86914 - DNA, 22 bp, Artificial Sequence
  Synthetic oligonucleotide; CTA chr11 5239730 5239751 5239747 5239752 +
acagagtcaaatgcagaaatcc

SEQ ID NO: 86915 - DNA, 22 bp, Artificial Sequence
  Synthetic oligonucleotide; TTC chr11 5239758 5239779 5239775 5239780 +
tctagattgactggggtaattt

SEQ ID NO: 86916 - DNA, 22 bp, Artificial Sequence
  Synthetic oligonucleotide; CTC chr11 5239760 5239781 5239777 5239782 +
tagattgactggggtaattttg

SEQ ID NO: 86917 - DNA, 22 bp, Artificial Sequence
  Synthetic oligonucleotide; CTA chr11 5239762 5239783 5239779 5239784 +
gattgactggggtaattttgtc

SEQ ID NO: 86918 - DNA, 22 bp, Artificial Sequence
  Synthetic oligonucleotide; TTG chr11 5239767 5239788 5239784 5239789 +
actggggtaattttgtcaatgc

SEQ ID NO: 86919 - DNA, 22 bp, Artificial Sequence
  Synthetic oligonucleotide; CTG chr11 5239771 5239792 5239788 5239793 +
gggtaattttgtcaatgcactc

SEQ ID NO: 86920 - DNA, 22 bp, Artificial Sequence
  Synthetic oligonucleotide; TTT chr11 5239780 5239801 5239797 5239802 +
tgtcaatgcactcaagtatgca

SEQ ID NO: 86921 - DNA, 22 bp, Artificial Sequence
  Synthetic oligonucleotide; TTT chr11 5239781 5239802 5239798 5239803 +
gtcaatgcactcaagtatgcat

SEQ ID NO: 86922 - DNA, 22 bp, Artificial Sequence
  Synthetic oligonucleotide; TTG chr11 5239782 5239803 5239799 5239804 +
tcaatgcactcaagtatgcatc

SEQ ID NO: 86923 - DNA, 22 bp, Artificial Sequence
  Synthetic oligonucleotide; CTC chr11 5239793 5239814 5239810 5239815 +
aagtatgcatctgtaacagtgt

SEQ ID NO: 86924 - DNA, 22 bp, Artificial Sequence
  Synthetic oligonucleotide; CTG chr11 5239806 5239827 5239823 5239828 +
taacagtgtgtgttcttatgtg

SEQ ID NO: 86925 - DNA, 22 bp, Artificial Sequence
  Synthetic oligonucleotide; TTC chr11 5239821 5239842 5239838 5239843 +
ttatgtgtgcatggaatgtttg

SEQ ID NO: 86926 - DNA, 22 bp, Artificial Sequence
  Synthetic oligonucleotide; CTT chr11 5239823 5239844 5239840 5239845 +
atgtgtgcatggaatgtttgtt

SEQ ID NO: 86927 - DNA, 22 bp, Artificial Sequence
  Synthetic oligonucleotide; TTA chr11 5239824 5239845 5239841 5239846 +
tgtgtgcatggaatgtttgttc

SEQ ID NO: 86928 - DNA, 22 bp, Artificial Sequence
  Synthetic oligonucleotide; TTT chr11 5239842 5239863 5239859 5239864 +
gttcatggagcataagaaattg

SEQ ID NO: 86929 - DNA, 22 bp, Artificial Sequence
  Synthetic oligonucleotide; TTG chr11 5239843 5239864 5239860 5239865 +
ttcatggagcataagaaattgt

SEQ ID NO: 86930 - DNA, 22 bp, Artificial Sequence
  Synthetic oligonucleotide; TTC chr11 5239846 5239867 5239863 5239868 +
atggagcataagaaattgtgta

SEQ ID NO: 86931 - DNA, 22 bp, Artificial Sequence
  Synthetic oligonucleotide; TTG chr11 5239864 5239885 5239881 5239886 +
tgtagacatatagacacatctg

SEQ ID NO: 86932 - DNA, 22 bp, Artificial Sequence
  Synthetic oligonucleotide; CTG chr11 5239886 5239907 5239903 5239908 +
tatgtgtatatcagagaatgtt

SEQ ID NO: 86933 - DNA, 22 bp, Artificial Sequence
  Synthetic oligonucleotide; TTT chr11 5239909 5239930 5239926 5239931 +
acattgctacaagattttatat

SEQ ID NO: 86934 - DNA, 22 bp, Artificial Sequence
  Synthetic oligonucleotide; TTA chr11 5239910 5239931 5239927 5239932 +
cattgctacaagattttatatg

SEQ ID NO: 86935 - DNA, 22 bp, Artificial Sequence
  Synthetic oligonucleotide; TTG chr11 5239915 5239936 5239932 5239937 +
ctacaagattttatatgactac

SEQ ID NO: 86936 - DNA, 22 bp, Artificial Sequence
  Synthetic oligonucleotide; CTA chr11 5239918 5239939 5239935 5239940 +
caagattttatatgactacatg

SEQ ID NO: 86937 - DNA, 22 bp, Artificial Sequence
  Synthetic oligonucleotide; TTT chr11 5239926 5239947 5239943 5239948 +
tatatgactacatgcacaagca

SEQ ID NO: 86938 - DNA, 22 bp, Artificial Sequence
  Synthetic oligonucleotide; TTT chr11 5239927 5239948 5239944 5239949 +
atatgactacatgcacaagcat

SEQ ID NO: 86939 - DNA, 22 bp, Artificial Sequence
  Synthetic oligonucleotide; TTA chr11 5239928 5239949 5239945 5239950 +
tatgactacatgcacaagcatt

SEQ ID NO: 86940 - DNA, 22 bp, Artificial Sequence
  Synthetic oligonucleotide; CTA chr11 5239936 5239957 5239953 5239958 +
catgcacaagcattcatgctac

SEQ ID NO: 86941 - DNA, 22 bp, Artificial Sequence
  Synthetic oligonucleotide; TTC chr11 5239951 5239972 5239968 5239973 +
atgctacatgtcagtttggtat

SEQ ID NO: 86942 - DNA, 22 bp, Artificial Sequence
  Synthetic oligonucleotide; CTA chr11 5239957 5239978 5239974 5239979 +
catgtcagtttggtatattttt

SEQ ID NO: 86943 - DNA, 22 bp, Artificial Sequence
  Synthetic oligonucleotide; TTT chr11 5239968 5239989 5239985 5239990 +
ggtatatttttcctgtaagatg

SEQ ID NO: 86944 - DNA, 22 bp, Artificial Sequence
  Synthetic oligonucleotide; TTG chr11 5239969 5239990 5239986 5239991 +
gtatatttttcctgtaagatgt

SEQ ID NO: 86945 - DNA, 22 bp, Artificial Sequence
  Synthetic oligonucleotide; TTT chr11 5239977 5239998 5239994 5239999 +
ttcctgtaagatgtgtacttat

SEQ ID NO: 86946 - DNA, 22 bp, Artificial Sequence
  Synthetic oligonucleotide; TTT chr11 5239978 5239999 5239995 5240000 +
tcctgtaagatgtgtacttatg

SEQ ID NO: 86947 - DNA, 22 bp, Artificial Sequence
  Synthetic oligonucleotide; TTT chr11 5239979 5240000 5239996 5240001 +
cctgtaagatgtgtacttatgt

SEQ ID NO: 86948 - DNA, 22 bp, Artificial Sequence
  Synthetic oligonucleotide; TTC chr11 5239980 5240001 5239997 5240002 +
ctgtaagatgtgtacttatgtg

SEQ ID NO: 86949 - DNA, 22 bp, Artificial Sequence
  Synthetic oligonucleotide; CTG chr11 5239983 5240004 5240000 5240005 +
taagatgtgtacttatgtgttt

SEQ ID NO: 86950 - DNA, 22 bp, Artificial Sequence
  Synthetic oligonucleotide; CTT chr11 5239997 5240018 5240014 5240019 +
atgtgttttccactaaaggtga

SEQ ID NO: 86951 - DNA, 22 bp, Artificial Sequence
  Synthetic oligonucleotide; TTA chr11 5239998 5240019 5240015 5240020 +
tgtgttttccactaaaggtgaa

SEQ ID NO: 86952 - DNA, 22 bp, Artificial Sequence
  Synthetic oligonucleotide; TTT chr11 5240005 5240026 5240022 5240027 +
tccactaaaggtgaatgtgaaa

SEQ ID NO: 86953 - DNA, 22 bp, Artificial Sequence
  Synthetic oligonucleotide; TTT chr11 5240006 5240027 5240023 5240028 +
ccactaaaggtgaatgtgaaaa

SEQ ID NO: 86954 - DNA, 22 bp, Artificial Sequence
  Synthetic oligonucleotide; TTC chr11 5240007 5240028 5240024 5240029 +
cactaaaggtgaatgtgaaaac

SEQ ID NO: 86955 - DNA, 22 bp, Artificial Sequence
  Synthetic oligonucleotide; CTA chr11 5240012 5240033 5240029 5240034 +
aaggtgaatgtgaaaactcctc

SEQ ID NO: 86956 - DNA, 22 bp, Artificial Sequence
  Synthetic oligonucleotide; CTC chr11 5240031 5240052 5240048 5240053 +
ctcatcgagaaatgaacaataa

SEQ ID NO: 86957 - DNA, 22 bp, Artificial Sequence
  Synthetic oligonucleotide; CTC chr11 5240034 5240055 5240051 5240056 +
atcgagaaatgaacaataagta

SEQ ID NO: 86958 - DNA, 22 bp, Artificial Sequence
  Synthetic oligonucleotide; TTC chr11 5240069 5240090 5240086 5240091 +
aaccctcatctcttcatttaaa

SEQ ID NO: 86959 - DNA, 22 bp, Artificial Sequence
  Synthetic oligonucleotide; CTC chr11 5240076 5240097 5240093 5240098 +
atctcttcatttaaaatacaga

SEQ ID NO: 86960 - DNA, 22 bp, Artificial Sequence
  Synthetic oligonucleotide; CTC chr11 5240081 5240102 5240098 5240103 +
ttcatttaaaatacagagtgac

SEQ ID NO: 86961 - DNA, 22 bp, Artificial Sequence
  Synthetic oligonucleotide; CTT chr11 5240083 5240104 5240100 5240105 +
catttaaaatacagagtgacat

SEQ ID NO: 86962 - DNA, 22 bp, Artificial Sequence
  Synthetic oligonucleotide; TTC chr11 5240084 5240105 5240101 5240106 +
atttaaaatacagagtgacatt

SEQ ID NO: 86963 - DNA, 22 bp, Artificial Sequence
  Synthetic oligonucleotide; TTT chr11 5240088 5240109 5240105 5240110 +
aaaatacagagtgacattcaga

SEQ ID NO: 86964 - DNA, 22 bp, Artificial Sequence
  Synthetic oligonucleotide; TTA chr11 5240089 5240110 5240106 5240111 +
aaatacagagtgacattcagaa

SEQ ID NO: 86965 - DNA, 22 bp, Artificial Sequence
  Synthetic oligonucleotide; TTC chr11 5240107 5240128 5240124 5240129 +
agaagggcaagggatagcacaa

SEQ ID NO: 86966 - DNA, 22 bp, Artificial Sequence
  Synthetic oligonucleotide; TTT chr11 5240140 5240161 5240157 5240162 +
taaagtgtgattgtttggacac

SEQ ID NO: 86967 - DNA, 22 bp, Artificial Sequence
  Synthetic oligonucleotide; TTT chr11 5240141 5240162 5240158 5240163 +
aaagtgtgattgtttggacaca

SEQ ID NO: 86968 - DNA, 22 bp, Artificial Sequence
  Synthetic oligonucleotide; TTA chr11 5240142 5240163 5240159 5240164 +
aagtgtgattgtttggacacag

SEQ ID NO: 86969 - DNA, 22 bp, Artificial Sequence
  Synthetic oligonucleotide; TTG chr11 5240153 5240174 5240170 5240175 +
tttggacacagtaattattcaa

SEQ ID NO: 86970 - DNA, 22 bp, Artificial Sequence
  Synthetic oligonucleotide; TTT chr11 5240156 5240177 5240173 5240178 +
ggacacagtaattattcaaaga

SEQ ID NO: 86971 - DNA, 22 bp, Artificial Sequence
  Synthetic oligonucleotide; TTG chr11 5240157 5240178 5240174 5240179 +
gacacagtaattattcaaagaa

SEQ ID NO: 86972 - DNA, 22 bp, Artificial Sequence
  Synthetic oligonucleotide; TTA chr11 5240170 5240191 5240187 5240192 +
ttcaaagaatgtgcttaattaa

SEQ ID NO: 86973 - DNA, 22 bp, Artificial Sequence
  Synthetic oligonucleotide; TTC chr11 5240173 5240194 5240190 5240195 +
aaagaatgtgcttaattaatgt

SEQ ID NO: 86974 - DNA, 22 bp, Artificial Sequence
  Synthetic oligonucleotide; CTT chr11 5240186 5240207 5240203 5240208 +
aattaatgtatgctacaagaca

SEQ ID NO: 86975 - DNA, 22 bp, Artificial Sequence
  Synthetic oligonucleotide; TTA chr11 5240187 5240208 5240204 5240209 +
attaatgtatgctacaagacag

SEQ ID NO: 86976 - DNA, 22 bp, Artificial Sequence
  Synthetic oligonucleotide; TTA chr11 5240191 5240212 5240208 5240213 +
atgtatgctacaagacagcagt

SEQ ID NO: 86977 - DNA, 22 bp, Artificial Sequence
  Synthetic oligonucleotide; CTA chr11 5240201 5240222 5240218 5240223 +
caagacagcagttgagtgatta

SEQ ID NO: 86978 - DNA, 22 bp, Artificial Sequence
  Synthetic oligonucleotide; TTG chr11 5240215 5240236 5240232 5240237 +
agtgattattgtacatgagcaa

SEQ ID NO: 86979 - DNA, 22 bp, Artificial Sequence
  Synthetic oligonucleotide; TTA chr11 5240223 5240244 5240240 5240245 +
ttgtacatgagcaactggtatt

SEQ ID NO: 86980 - DNA, 22 bp, Artificial Sequence
  Synthetic oligonucleotide; TTG chr11 5240226 5240247 5240243 5240248 +
tacatgagcaactggtatttat

SEQ ID NO: 86981 - DNA, 22 bp, Artificial Sequence
  Synthetic oligonucleotide; CTG chr11 5240240 5240261 5240257 5240262 +
gtatttattctgctttgtgggt

SEQ ID NO: 86982 - DNA, 22 bp, Artificial Sequence
  Synthetic oligonucleotide; TTT chr11 5240246 5240267 5240263 5240268 +
attctgctttgtgggttattag

SEQ ID NO: 86983 - DNA, 22 bp, Artificial Sequence
  Synthetic oligonucleotide; TTA chr11 5240247 5240268 5240264 5240269 +
ttctgctttgtgggttattagt

SEQ ID NO: 86984 - DNA, 22 bp, Artificial Sequence
  Synthetic oligonucleotide; TTC chr11 5240250 5240271 5240267 5240272 +
tgctttgtgggttattagtggg

SEQ ID NO: 86985 - DNA, 22 bp, Artificial Sequence
  Synthetic oligonucleotide; CTG chr11 5240252 5240273 5240269 5240274 +
ctttgtgggttattagtgggga

SEQ ID NO: 86986 - DNA, 22 bp, Artificial Sequence
  Synthetic oligonucleotide; CTT chr11 5240255 5240276 5240272 5240277 +
tgtgggttattagtggggactc

SEQ ID NO: 86987 - DNA, 22 bp, Artificial Sequence
  Synthetic oligonucleotide; TTT chr11 5240256 5240277 5240273 5240278 +
gtgggttattagtggggactca

SEQ ID NO: 86988 - DNA, 22 bp, Artificial Sequence
  Synthetic oligonucleotide; TTG chr11 5240257 5240278 5240274 5240279 +
tgggttattagtggggactcaa

SEQ ID NO: 86989 - DNA, 22 bp, Artificial Sequence
  Synthetic oligonucleotide; TTA chr11 5240264 5240285 5240281 5240286 +
ttagtggggactcaaaaatatg

SEQ ID NO: 86990 - DNA, 22 bp, Artificial Sequence
  Synthetic oligonucleotide; TTA chr11 5240267 5240288 5240284 5240289 +
gtggggactcaaaaatatgaca

SEQ ID NO: 86991 - DNA, 22 bp, Artificial Sequence
  Synthetic oligonucleotide; CTC chr11 5240277 5240298 5240294 5240299 +
aaaaatatgacaaaggaatttc

SEQ ID NO: 86992 - DNA, 22 bp, Artificial Sequence
  Synthetic oligonucleotide; TTT chr11 5240298 5240319 5240315 5240320 +
cagaagctgttagatggtagca

SEQ ID NO: 86993 - DNA, 22 bp, Artificial Sequence
  Synthetic oligonucleotide; TTC chr11 5240299 5240320 5240316 5240321 +
agaagctgttagatggtagcac

SEQ ID NO: 86994 - DNA, 22 bp, Artificial Sequence
  Synthetic oligonucleotide; CTG chr11 5240307 5240328 5240324 5240329 +
ttagatggtagcaccgcctatc

SEQ ID NO: 86995 - DNA, 22 bp, Artificial Sequence
  Synthetic oligonucleotide; TTA chr11 5240310 5240331 5240327 5240332 +
gatggtagcaccgcctatctat

SEQ ID NO: 86996 - DNA, 22 bp, Artificial Sequence
  Synthetic oligonucleotide; CTA chr11 5240327 5240348 5240344 5240349 +
tctatgtgctcccactcaagag

SEQ ID NO: 86997 - DNA, 22 bp, Artificial Sequence
  Synthetic oligonucleotide; CTA chr11 5240331 5240352 5240348 5240353 +
tgtgctcccactcaagagatat

SEQ ID NO: 86998 - DNA, 22 bp, Artificial Sequence
  Synthetic oligonucleotide; CTC chr11 5240338 5240359 5240355 5240360 +
ccactcaagagatatggtgagg

SEQ ID NO: 86999 - DNA, 22 bp, Artificial Sequence
  Synthetic oligonucleotide; CTC chr11 5240344 5240365 5240361 5240366 +
aagagatatggtgaggtgagct

SEQ ID NO: 87000 - DNA, 22 bp, Artificial Sequence
  Synthetic oligonucleotide; CTC chr11 5240367 5240388 5240384 5240389 +
tttggggtggacacatagagga

SEQ ID NO: 87001 - DNA, 22 bp, Artificial Sequence
  Synthetic oligonucleotide; CTT chr11 5240369 5240390 5240386 5240391 +
tggggtggacacatagaggaaa

SEQ ID NO: 87002 - DNA, 22 bp, Artificial Sequence
  Synthetic oligonucleotide; TTT chr11 5240370 5240391 5240387 5240392 +
ggggtggacacatagaggaaat

SEQ ID NO: 87003 - DNA, 22 bp, Artificial Sequence
  Synthetic oligonucleotide; TTG chr11 5240371 5240392 5240388 5240393 +
gggtggacacatagaggaaata

SEQ ID NO: 87004 - DNA, 22 bp, Artificial Sequence
  Synthetic oligonucleotide; CTT chr11 5240396 5240417 5240413 5240418 +
tgagaaagaggttttgggatta

SEQ ID NO: 87005 - DNA, 22 bp, Artificial Sequence
  Synthetic oligonucleotide; TTT chr11 5240397 5240418 5240414 5240419 +
gagaaagaggttttgggattaa

SEQ ID NO: 87006 - DNA, 22 bp, Artificial Sequence
  Synthetic oligonucleotide; TTG chr11 5240398 5240419 5240415 5240420 +
agaaagaggttttgggattaat

SEQ ID NO: 87007 - DNA, 22 bp, Artificial Sequence
  Synthetic oligonucleotide; TTT chr11 5240410 5240431 5240427 5240432 +
tgggattaatgaaactggagaa

SEQ ID NO: 87008 - DNA, 22 bp, Artificial Sequence
  Synthetic oligonucleotide; TTT chr11 5240411 5240432 5240428 5240433 +
gggattaatgaaactggagaag

SEQ ID NO: 87009 - DNA, 22 bp, Artificial Sequence
  Synthetic oligonucleotide; TTG chr11 5240412 5240433 5240429 5240434 +
ggattaatgaaactggagaaga

SEQ ID NO: 87010 - DNA, 22 bp, Artificial Sequence
  Synthetic oligonucleotide; TTA chr11 5240418 5240439 5240435 5240440 +
atgaaactggagaagaaagggt

SEQ ID NO: 87011 - DNA, 22 bp, Artificial Sequence
  Synthetic oligonucleotide; CTG chr11 5240427 5240448 5240444 5240449 +
gagaagaaagggtattatatct

SEQ ID NO: 87012 - DNA, 22 bp, Artificial Sequence
  Synthetic oligonucleotide; TTA chr11 5240444 5240465 5240461 5240466 +
tatcttctaaaacctctttctt

SEQ ID NO: 87013 - DNA, 22 bp, Artificial Sequence
  Synthetic oligonucleotide; CTT chr11 5240450 5240471 5240467 5240472 +
ctaaaacctctttctttgaggt

SEQ ID NO: 87014 - DNA, 22 bp, Artificial Sequence
  Synthetic oligonucleotide; TTC chr11 5240451 5240472 5240468 5240473 +
taaaacctctttctttgaggtt

SEQ ID NO: 87015 - DNA, 22 bp, Artificial Sequence
  Synthetic oligonucleotide; CTA chr11 5240453 5240474 5240470 5240475 +
aaacctctttctttgaggtttt

SEQ ID NO: 87016 - DNA, 22 bp, Artificial Sequence
  Synthetic oligonucleotide; CTC chr11 5240460 5240481 5240477 5240482 +
tttctttgaggttttaggtttg

SEQ ID NO: 87017 - DNA, 22 bp, Artificial Sequence
  Synthetic oligonucleotide; CTT chr11 5240462 5240483 5240479 5240484 +
tctttgaggttttaggtttgag

SEQ ID NO: 87018 - DNA, 22 bp, Artificial Sequence
  Synthetic oligonucleotide; TTT chr11 5240463 5240484 5240480 5240485 +
ctttgaggttttaggtttgagg

SEQ ID NO: 87019 - DNA, 22 bp, Artificial Sequence
  Synthetic oligonucleotide; TTC chr11 5240464 5240485 5240481 5240486 +
tttgaggttttaggtttgaggg

SEQ ID NO: 87020 - DNA, 22 bp, Artificial Sequence
  Synthetic oligonucleotide; CTT chr11 5240466 5240487 5240483 5240488 +
tgaggttttaggtttgagggtg

SEQ ID NO: 87021 - DNA, 22 bp, Artificial Sequence
  Synthetic oligonucleotide; TTT chr11 5240467 5240488 5240484 5240489 +
gaggttttaggtttgagggtgc

SEQ ID NO: 87022 - DNA, 22 bp, Artificial Sequence
  Synthetic oligonucleotide; TTG chr11 5240468 5240489 5240485 5240490 +
aggttttaggtttgagggtgct

SEQ ID NO: 87023 - DNA, 22 bp, Artificial Sequence
  Synthetic oligonucleotide; TTT chr11 5240474 5240495 5240491 5240496 +
taggtttgagggtgctacatac

SEQ ID NO: 87024 - DNA, 22 bp, Artificial Sequence
  Synthetic oligonucleotide; TTT chr11 5240475 5240496 5240492 5240497 +
aggtttgagggtgctacatact

SEQ ID NO: 87025 - DNA, 22 bp, Artificial Sequence
  Synthetic oligonucleotide; TTA chr11 5240476 5240497 5240493 5240498 +
ggtttgagggtgctacatactt

SEQ ID NO: 87026 - DNA, 22 bp, Artificial Sequence
  Synthetic oligonucleotide; TTT chr11 5240481 5240502 5240498 5240503 +
gagggtgctacatacttcctaa

SEQ ID NO: 87027 - DNA, 22 bp, Artificial Sequence
  Synthetic oligonucleotide; TTG chr11 5240482 5240503 5240499 5240504 +
agggtgctacatacttcctaag

SEQ ID NO: 87028 - DNA, 22 bp, Artificial Sequence
  Synthetic oligonucleotide; CTA chr11 5240491 5240512 5240508 5240513 +
catacttcctaagggtcttggg

SEQ ID NO: 87029 - DNA, 22 bp, Artificial Sequence
  Synthetic oligonucleotide; CTT chr11 5240498 5240519 5240515 5240520 +
cctaagggtcttgggtacagga

SEQ ID NO: 87030 - DNA, 22 bp, Artificial Sequence
  Synthetic oligonucleotide; TTC chr11 5240499 5240520 5240516 5240521 +
ctaagggtcttgggtacaggag

SEQ ID NO: 87031 - DNA, 22 bp, Artificial Sequence
  Synthetic oligonucleotide; CTA chr11 5240502 5240523 5240519 5240524 +
agggtcttgggtacaggagttt

SEQ ID NO: 87032 - DNA, 22 bp, Artificial Sequence
  Synthetic oligonucleotide; CTT chr11 5240510 5240531 5240527 5240532 +
gggtacaggagtttgaagtgat

SEQ ID NO: 87033 - DNA, 22 bp, Artificial Sequence
  Synthetic oligonucleotide; TTG chr11 5240511 5240532 5240528 5240533 +
ggtacaggagtttgaagtgatt

SEQ ID NO: 87034 - DNA, 22 bp, Artificial Sequence
  Synthetic oligonucleotide; TTT chr11 5240524 5240545 5240541 5240546 +
gaagtgattgccacagaatggc

SEQ ID NO: 87035 - DNA, 22 bp, Artificial Sequence
  Synthetic oligonucleotide; TTG chr11 5240525 5240546 5240542 5240547 +
aagtgattgccacagaatggct

SEQ ID NO: 87036 - DNA, 22 bp, Artificial Sequence
  Synthetic oligonucleotide; TTG chr11 5240534 5240555 5240551 5240556 +
ccacagaatggctacgttcatt

SEQ ID NO: 87037 - DNA, 22 bp, Artificial Sequence
  Synthetic oligonucleotide; CTA chr11 5240548 5240569 5240565 5240570 +
cgttcattgccagatccaaaca

SEQ ID NO: 87038 - DNA, 22 bp, Artificial Sequence
  Synthetic oligonucleotide; TTC chr11 5240553 5240574 5240570 5240575 +
attgccagatccaaacaggggg

SEQ ID NO: 87039 - DNA, 22 bp, Artificial Sequence
  Synthetic oligonucleotide; TTG chr11 5240557 5240578 5240574 5240579 +
ccagatccaaacagggggcttg

SEQ ID NO: 87040 - DNA, 22 bp, Artificial Sequence
  Synthetic oligonucleotide; CTT chr11 5240578 5240599 5240595 5240600 +
gtaggcatttgctgttctgtca

SEQ ID NO: 87041 - DNA, 22 bp, Artificial Sequence
  Synthetic oligonucleotide; TTG chr11 5240579 5240600 5240596 5240601 +
taggcatttgctgttctgtcaa

SEQ ID NO: 87042 - DNA, 22 bp, Artificial Sequence
  Synthetic oligonucleotide; TTT chr11 5240588 5240609 5240605 5240610 +
gctgttctgtcaataaatttcc

SEQ ID NO: 87043 - DNA, 22 bp, Artificial Sequence
  Synthetic oligonucleotide; TTG chr11 5240589 5240610 5240606 5240611 +
ctgttctgtcaataaatttcct

SEQ ID NO: 87044 - DNA, 22 bp, Artificial Sequence
  Synthetic oligonucleotide; CTG chr11 5240592 5240613 5240609 5240614 +
ttctgtcaataaatttccttct

SEQ ID NO: 87045 - DNA, 22 bp, Artificial Sequence
  Synthetic oligonucleotide; TTC chr11 5240595 5240616 5240612 5240617 +
tgtcaataaatttccttctttt

SEQ ID NO: 87046 - DNA, 22 bp, Artificial Sequence
  Synthetic oligonucleotide; CTG chr11 5240597 5240618 5240614 5240619 +
tcaataaatttccttcttttca

SEQ ID NO: 87047 - DNA, 22 bp, Artificial Sequence
  Synthetic oligonucleotide; TTT chr11 5240608 5240629 5240625 5240630 +
ccttcttttcattcacagacag

SEQ ID NO: 87048 - DNA, 22 bp, Artificial Sequence
  Synthetic oligonucleotide; TTC chr11 5240609 5240630 5240626 5240631 +
cttcttttcattcacagacagg

SEQ ID NO: 87049 - DNA, 22 bp, Artificial Sequence
  Synthetic oligonucleotide; CTT chr11 5240612 5240633 5240629 5240634 +
cttttcattcacagacagggat

SEQ ID NO: 87050 - DNA, 22 bp, Artificial Sequence
  Synthetic oligonucleotide; TTC chr11 5240613 5240634 5240630 5240635 +
ttttcattcacagacagggatt

SEQ ID NO: 87051 - DNA, 22 bp, Artificial Sequence
  Synthetic oligonucleotide; CTT chr11 5240615 5240636 5240632 5240637 +
ttcattcacagacagggatttt

SEQ ID NO: 87052 - DNA, 22 bp, Artificial Sequence
  Synthetic oligonucleotide; TTT chr11 5240616 5240637 5240633 5240638 +
tcattcacagacagggatttta

SEQ ID NO: 87053 - DNA, 22 bp, Artificial Sequence
  Synthetic oligonucleotide; TTT chr11 5240617 5240638 5240634 5240639 +
cattcacagacagggattttag

SEQ ID NO: 87054 - DNA, 22 bp, Artificial Sequence
  Synthetic oligonucleotide; TTC chr11 5240618 5240639 5240635 5240640 +
attcacagacagggattttagc

SEQ ID NO: 87055 - DNA, 22 bp, Artificial Sequence
  Synthetic oligonucleotide; TTC chr11 5240622 5240643 5240639 5240644 +
acagacagggattttagctgtc

SEQ ID NO: 87056 - DNA, 22 bp, Artificial Sequence
  Synthetic oligonucleotide; TTT chr11 5240636 5240657 5240653 5240658 +
tagctgtcatctctgactctct

SEQ ID NO: 87057 - DNA, 22 bp, Artificial Sequence
  Synthetic oligonucleotide; TTT chr11 5240637 5240658 5240654 5240659 +
agctgtcatctctgactctctg

SEQ ID NO: 87058 - DNA, 22 bp, Artificial Sequence
  Synthetic oligonucleotide; TTA chr11 5240638 5240659 5240655 5240660 +
gctgtcatctctgactctctgt

SEQ ID NO: 87059 - DNA, 22 bp, Artificial Sequence
  Synthetic oligonucleotide; CTG chr11 5240642 5240663 5240659 5240664 +
tcatctctgactctctgtttca

SEQ ID NO: 87060 - DNA, 22 bp, Artificial Sequence
  Synthetic oligonucleotide; CTC chr11 5240649 5240670 5240666 5240671 +
tgactctctgtttcacaatgtt

SEQ ID NO: 87061 - DNA, 22 bp, Artificial Sequence
  Synthetic oligonucleotide; CTG chr11 5240651 5240672 5240668 5240673 +
actctctgtttcacaatgtttt

SEQ ID NO: 87062 - DNA, 22 bp, Artificial Sequence
  Synthetic oligonucleotide; CTC chr11 5240655 5240676 5240672 5240677 +
tctgtttcacaatgttttccag

SEQ ID NO: 87063 - DNA, 22 bp, Artificial Sequence
  Synthetic oligonucleotide; CTC chr11 5240657 5240678 5240674 5240679 +
tgtttcacaatgttttccagtt

SEQ ID NO: 87064 - DNA, 22 bp, Artificial Sequence
  Synthetic oligonucleotide; CTG chr11 5240659 5240680 5240676 5240681 +
tttcacaatgttttccagttct

SEQ ID NO: 87065 - DNA, 22 bp, Artificial Sequence
  Synthetic oligonucleotide; TTT chr11 5240662 5240683 5240679 5240684 +
cacaatgttttccagttctgtg

SEQ ID NO: 87066 - DNA, 22 bp, Artificial Sequence
  Synthetic oligonucleotide; TTC chr11 5240663 5240684 5240680 5240685 +
acaatgttttccagttctgtgc

SEQ ID NO: 87067 - DNA, 22 bp, Artificial Sequence
  Synthetic oligonucleotide; TTT chr11 5240672 5240693 5240689 5240694 +
tccagttctgtgcaatcactgc

SEQ ID NO: 87068 - DNA, 22 bp, Artificial Sequence
  Synthetic oligonucleotide; TTT chr11 5240673 5240694 5240690 5240695 +
ccagttctgtgcaatcactgcc

SEQ ID NO: 87069 - DNA, 22 bp, Artificial Sequence
  Synthetic oligonucleotide; TTC chr11 5240674 5240695 5240691 5240696 +
cagttctgtgcaatcactgcca

SEQ ID NO: 87070 - DNA, 22 bp, Artificial Sequence
  Synthetic oligonucleotide; TTC chr11 5240680 5240701 5240697 5240702 +
tgtgcaatcactgccacaatgg

SEQ ID NO: 87071 - DNA, 22 bp, Artificial Sequence
  Synthetic oligonucleotide; CTG chr11 5240682 5240703 5240699 5240704 +
tgcaatcactgccacaatggtc

SEQ ID NO: 87072 - DNA, 22 bp, Artificial Sequence
  Synthetic oligonucleotide; CTG chr11 5240693 5240714 5240710 5240715 +
ccacaatggtctcttactcgat

SEQ ID NO: 87073 - DNA, 22 bp, Artificial Sequence
  Synthetic oligonucleotide; CTC chr11 5240706 5240727 5240723 5240728 +
ttactcgattttttttcttaac

SEQ ID NO: 87074 - DNA, 22 bp, Artificial Sequence
  Synthetic oligonucleotide; CTT chr11 5240708 5240729 5240725 5240730 +
actcgattttttttcttaactt

SEQ ID NO: 87075 - DNA, 22 bp, Artificial Sequence
  Synthetic oligonucleotide; TTA chr11 5240709 5240730 5240726 5240731 +
ctcgattttttttcttaacttc

SEQ ID NO: 87076 - DNA, 22 bp, Artificial Sequence
  Synthetic oligonucleotide; CTC chr11 5240712 5240733 5240729 5240734 +
gattttttttcttaacttcatt

SEQ ID NO: 87077 - DNA, 22 bp, Artificial Sequence
  Synthetic oligonucleotide; TTT chr11 5240717 5240738 5240734 5240739 +
tttttcttaacttcattgtttc

SEQ ID NO: 87078 - DNA, 22 bp, Artificial Sequence
  Synthetic oligonucleotide; TTT chr11 5240718 5240739 5240735 5240740 +
ttttcttaacttcattgtttcc

SEQ ID NO: 87079 - DNA, 22 bp, Artificial Sequence
  Synthetic oligonucleotide; TTT chr11 5240719 5240740 5240736 5240741 +
tttcttaacttcattgtttcca

SEQ ID NO: 87080 - DNA, 22 bp, Artificial Sequence
  Synthetic oligonucleotide; TTT chr11 5240720 5240741 5240737 5240742 +
ttcttaacttcattgtttccat

SEQ ID NO: 87081 - DNA, 22 bp, Artificial Sequence
  Synthetic oligonucleotide; TTT chr11 5240721 5240742 5240738 5240743 +
tcttaacttcattgtttccatc

SEQ ID NO: 87082 - DNA, 22 bp, Artificial Sequence
  Synthetic oligonucleotide; TTT chr11 5240722 5240743 5240739 5240744 +
cttaacttcattgtttccatca

SEQ ID NO: 87083 - DNA, 22 bp, Artificial Sequence
  Synthetic oligonucleotide; TTC chr11 5240723 5240744 5240740 5240745 +
ttaacttcattgtttccatcaa

SEQ ID NO: 87084 - DNA, 22 bp, Artificial Sequence
  Synthetic oligonucleotide; CTT chr11 5240725 5240746 5240742 5240747 +
aacttcattgtttccatcaact

SEQ ID NO: 87085 - DNA, 22 bp, Artificial Sequence
  Synthetic oligonucleotide; TTA chr11 5240726 5240747 5240743 5240748 +
acttcattgtttccatcaactt

SEQ ID NO: 87086 - DNA, 22 bp, Artificial Sequence
  Synthetic oligonucleotide; CTT chr11 5240730 5240751 5240747 5240752 +
cattgtttccatcaacttcagt

SEQ ID NO: 87087 - DNA, 22 bp, Artificial Sequence
  Synthetic oligonucleotide; TTC chr11 5240731 5240752 5240748 5240753 +
attgtttccatcaacttcagtt

SEQ ID NO: 87088 - DNA, 22 bp, Artificial Sequence
  Synthetic oligonucleotide; TTG chr11 5240735 5240756 5240752 5240757 +
tttccatcaacttcagttcttt

SEQ ID NO: 87089 - DNA, 22 bp, Artificial Sequence
  Synthetic oligonucleotide; TTT chr11 5240738 5240759 5240755 5240760 +
ccatcaacttcagttctttatc

SEQ ID NO: 87090 - DNA, 22 bp, Artificial Sequence
  Synthetic oligonucleotide; TTC chr11 5240739 5240760 5240756 5240761 +
catcaacttcagttctttatcc

SEQ ID NO: 87091 - DNA, 22 bp, Artificial Sequence
  Synthetic oligonucleotide; CTT chr11 5240748 5240769 5240765 5240770 +
cagttctttatccatcacctca

SEQ ID NO: 87092 - DNA, 22 bp, Artificial Sequence
  Synthetic oligonucleotide; TTC chr11 5240749 5240770 5240766 5240771 +
agttctttatccatcacctcaa

SEQ ID NO: 87093 - DNA, 22 bp, Artificial Sequence
  Synthetic oligonucleotide; TTC chr11 5240754 5240775 5240771 5240776 +
tttatccatcacctcaatataa

SEQ ID NO: 87094 - DNA, 22 bp, Artificial Sequence
  Synthetic oligonucleotide; CTT chr11 5240756 5240777 5240773 5240778 +
tatccatcacctcaatataatt

SEQ ID NO: 87095 - DNA, 22 bp, Artificial Sequence
  Synthetic oligonucleotide; TTT chr11 5240757 5240778 5240774 5240779 +
atccatcacctcaatataatta

SEQ ID NO: 87096 - DNA, 22 bp, Artificial Sequence
  Synthetic oligonucleotide; TTA chr11 5240758 5240779 5240775 5240780 +
tccatcacctcaatataattac

SEQ ID NO: 87097 - DNA, 22 bp, Artificial Sequence
  Synthetic oligonucleotide; CTC chr11 5240769 5240790 5240786 5240791 +
aatataattacagcaagctcct

SEQ ID NO: 87098 - DNA, 22 bp, Artificial Sequence
  Synthetic oligonucleotide; TTA chr11 5240779 5240800 5240796 5240801 +
cagcaagctcctctgactatac

SEQ ID NO: 87099 - DNA, 22 bp, Artificial Sequence
  Synthetic oligonucleotide; CTC chr11 5240789 5240810 5240806 5240811 +
ctctgactatacccaagttaga

SEQ ID NO: 87100 - DNA, 22 bp, Artificial Sequence
  Synthetic oligonucleotide; CTC chr11 5240792 5240813 5240809 5240814 +
tgactatacccaagttagactt

SEQ ID NO: 87101 - DNA, 22 bp, Artificial Sequence
  Synthetic oligonucleotide; CTG chr11 5240794 5240815 5240811 5240816 +
actatacccaagttagactttg

SEQ ID NO: 87102 - DNA, 22 bp, Artificial Sequence
  Synthetic oligonucleotide; CTA chr11 5240798 5240819 5240815 5240820 +
tacccaagttagactttgtcta

SEQ ID NO: 87103 - DNA, 22 bp, Artificial Sequence
  Synthetic oligonucleotide; TTA chr11 5240809 5240830 5240826 5240831 +
gactttgtctaatcagttctat

SEQ ID NO: 87104 - DNA, 22 bp, Artificial Sequence
  Synthetic oligonucleotide; CTT chr11 5240814 5240835 5240831 5240836 +
tgtctaatcagttctatatata

SEQ ID NO: 87105 - DNA, 22 bp, Artificial Sequence
  Synthetic oligonucleotide; TTT chr11 5240815 5240836 5240832 5240837 +
gtctaatcagttctatatatat

SEQ ID NO: 87106 - DNA, 22 bp, Artificial Sequence
  Synthetic oligonucleotide; TTG chr11 5240816 5240837 5240833 5240838 +
tctaatcagttctatatatata

SEQ ID NO: 87107 - DNA, 22 bp, Artificial Sequence
  Synthetic oligonucleotide; CTA chr11 5240820 5240841 5240837 5240842 +
atcagttctatatatatatata

SEQ ID NO: 87108 - DNA, 22 bp, Artificial Sequence
  Synthetic oligonucleotide; TTC chr11 5240828 5240849 5240845 5240850 +
tatatatatatatacatgtgaa

SEQ ID NO: 87109 - DNA, 22 bp, Artificial Sequence
  Synthetic oligonucleotide; CTA chr11 5240830 5240851 5240847 5240852 +
tatatatatatacatgtgaatc

SEQ ID NO: 87110 - DNA, 22 bp, Artificial Sequence
  Synthetic oligonucleotide; TTT chr11 5240857 5240878 5240874 5240879 +
tctacgtttccctatttattat

SEQ ID NO: 87111 - DNA, 22 bp, Artificial Sequence
  Synthetic oligonucleotide; TTT chr11 5240858 5240879 5240875 5240880 +
ctacgtttccctatttattatg

SEQ ID NO: 87112 - DNA, 22 bp, Artificial Sequence
  Synthetic oligonucleotide; TTC chr11 5240859 5240880 5240876 5240881 +
tacgtttccctatttattatgt

SEQ ID NO: 87113 - DNA, 22 bp, Artificial Sequence
  Synthetic oligonucleotide; CTA chr11 5240861 5240882 5240878 5240883 +
cgtttccctatttattatgtca

SEQ ID NO: 87114 - DNA, 22 bp, Artificial Sequence
  Synthetic oligonucleotide; TTT chr11 5240866 5240887 5240883 5240888 +
ccctatttattatgtcactctc

SEQ ID NO: 87115 - DNA, 22 bp, Artificial Sequence
  Synthetic oligonucleotide; TTC chr11 5240867 5240888 5240884 5240889 +
cctatttattatgtcactctca

SEQ ID NO: 87116 - DNA, 22 bp, Artificial Sequence
  Synthetic oligonucleotide; CTA chr11 5240871 5240892 5240888 5240893 +
tttattatgtcactctcatatg

SEQ ID NO: 87117 - DNA, 22 bp, Artificial Sequence
  Synthetic oligonucleotide; TTT chr11 5240874 5240895 5240891 5240896 +
attatgtcactctcatatgcaa

SEQ ID NO: 87118 - DNA, 22 bp, Artificial Sequence
  Synthetic oligonucleotide; TTA chr11 5240875 5240896 5240892 5240897 +
ttatgtcactctcatatgcaag

SEQ ID NO: 87119 - DNA, 22 bp, Artificial Sequence
  Synthetic oligonucleotide; TTA chr11 5240878 5240899 5240895 5240900 +
tgtcactctcatatgcaagaaa

SEQ ID NO: 87120 - DNA, 22 bp, Artificial Sequence
  Synthetic oligonucleotide; CTC chr11 5240886 5240907 5240903 5240908 +
tcatatgcaagaaacttcagtg

SEQ ID NO: 87121 - DNA, 22 bp, Artificial Sequence
  Synthetic oligonucleotide; CTC chr11 5240888 5240909 5240905 5240910 +
atatgcaagaaacttcagtgat

SEQ ID NO: 87122 - DNA, 22 bp, Artificial Sequence
  Synthetic oligonucleotide; CTT chr11 5240903 5240924 5240920 5240925 +
cagtgatttttgctcaaaacga

SEQ ID NO: 87123 - DNA, 22 bp, Artificial Sequence
  Synthetic oligonucleotide; TTC chr11 5240904 5240925 5240921 5240926 +
agtgatttttgctcaaaacgat

SEQ ID NO: 87124 - DNA, 22 bp, Artificial Sequence
  Synthetic oligonucleotide; TTT chr11 5240912 5240933 5240929 5240934 +
ttgctcaaaacgatagctattt

SEQ ID NO: 87125 - DNA, 22 bp, Artificial Sequence
  Synthetic oligonucleotide; TTT chr11 5240913 5240934 5240930 5240935 +
tgctcaaaacgatagctatttt

SEQ ID NO: 87126 - DNA, 22 bp, Artificial Sequence
  Synthetic oligonucleotide; TTT chr11 5240914 5240935 5240931 5240936 +
gctcaaaacgatagctattttt

SEQ ID NO: 87127 - DNA, 22 bp, Artificial Sequence
  Synthetic oligonucleotide; TTG chr11 5240915 5240936 5240932 5240937 +
ctcaaaacgatagctatttttc

SEQ ID NO: 87128 - DNA, 22 bp, Artificial Sequence
  Synthetic oligonucleotide; CTC chr11 5240918 5240939 5240935 5240940 +
aaaacgatagctatttttctta

SEQ ID NO: 87129 - DNA, 22 bp, Artificial Sequence
  Synthetic oligonucleotide; CTA chr11 5240931 5240952 5240948 5240953 +
tttttcttacttcatctggtct

SEQ ID NO: 87130 - DNA, 22 bp, Artificial Sequence
  Synthetic oligonucleotide; TTT chr11 5240934 5240955 5240951 5240956 +
ttcttacttcatctggtctctg

SEQ ID NO: 87131 - DNA, 22 bp, Artificial Sequence
  Synthetic oligonucleotide; TTT chr11 5240935 5240956 5240952 5240957 +
tcttacttcatctggtctctgc

SEQ ID NO: 87132 - DNA, 22 bp, Artificial Sequence
  Synthetic oligonucleotide; TTT chr11 5240936 5240957 5240953 5240958 +
cttacttcatctggtctctgca

SEQ ID NO: 87133 - DNA, 22 bp, Artificial Sequence
  Synthetic oligonucleotide; TTC chr11 5240937 5240958 5240954 5240959 +
ttacttcatctggtctctgcat

SEQ ID NO: 87134 - DNA, 22 bp, Artificial Sequence
  Synthetic oligonucleotide; CTT chr11 5240939 5240960 5240956 5240961 +
acttcatctggtctctgcatcc

SEQ ID NO: 87135 - DNA, 22 bp, Artificial Sequence
  Synthetic oligonucleotide; TTA chr11 5240940 5240961 5240957 5240962 +
cttcatctggtctctgcatcca

SEQ ID NO: 87136 - DNA, 22 bp, Artificial Sequence
  Synthetic oligonucleotide; CTT chr11 5240943 5240964 5240960 5240965 +
catctggtctctgcatccagtt

SEQ ID NO: 87137 - DNA, 22 bp, Artificial Sequence
  Synthetic oligonucleotide; TTC chr11 5240944 5240965 5240961 5240966 +
atctggtctctgcatccagttt

SEQ ID NO: 87138 - DNA, 22 bp, Artificial Sequence
  Synthetic oligonucleotide; CTG chr11 5240949 5240970 5240966 5240971 +
gtctctgcatccagtttcccta

SEQ ID NO: 87139 - DNA, 22 bp, Artificial Sequence
  Synthetic oligonucleotide; CTC chr11 5240954 5240975 5240971 5240976 +
tgcatccagtttccctaatttt

SEQ ID NO: 87140 - DNA, 22 bp, Artificial Sequence
  Synthetic oligonucleotide; CTG chr11 5240956 5240977 5240973 5240978 +
catccagtttccctaattttat

SEQ ID NO: 87141 - DNA, 22 bp, Artificial Sequence
  Synthetic oligonucleotide; TTT chr11 5240966 5240987 5240983 5240988 +
ccctaattttatatcatcctgc

SEQ ID NO: 87142 - DNA, 22 bp, Artificial Sequence
  Synthetic oligonucleotide; TTC chr11 5240967 5240988 5240984 5240989 +
cctaattttatatcatcctgcc

SEQ ID NO: 87143 - DNA, 22 bp, Artificial Sequence
  Synthetic oligonucleotide; CTA chr11 5240971 5240992 5240988 5240993 +
attttatatcatcctgcctctt

SEQ ID NO: 87144 - DNA, 22 bp, Artificial Sequence
  Synthetic oligonucleotide; TTT chr11 5240975 5240996 5240992 5240997 +
tatatcatcctgcctcttttaa

SEQ ID NO: 87145 - DNA, 22 bp, Artificial Sequence
  Synthetic oligonucleotide; TTT chr11 5240976 5240997 5240993 5240998 +
atatcatcctgcctcttttaaa

SEQ ID NO: 87146 - DNA, 22 bp, Artificial Sequence
  Synthetic oligonucleotide; TTA chr11 5240977 5240998 5240994 5240999 +
tatcatcctgcctcttttaaat

SEQ ID NO: 87147 - DNA, 22 bp, Artificial Sequence
  Synthetic oligonucleotide; CTG chr11 5240987 5241008 5241004 5241009 +
cctcttttaaatgtccatattc

SEQ ID NO: 87148 - DNA, 22 bp, Artificial Sequence
  Synthetic oligonucleotide; CTC chr11 5240991 5241012 5241008 5241013 +
ttttaaatgtccatattctcct

SEQ ID NO: 87149 - DNA, 22 bp, Artificial Sequence
  Synthetic oligonucleotide; CTT chr11 5240993 5241014 5241010 5241015 +
ttaaatgtccatattctcctct

SEQ ID NO: 87150 - DNA, 22 bp, Artificial Sequence
  Synthetic oligonucleotide; TTT chr11 5240994 5241015 5241011 5241016 +
taaatgtccatattctcctcta

SEQ ID NO: 87151 - DNA, 22 bp, Artificial Sequence
  Synthetic oligonucleotide; TTT chr11 5240995 5241016 5241012 5241017 +
aaatgtccatattctcctctat

SEQ ID NO: 87152 - DNA, 22 bp, Artificial Sequence
  Synthetic oligonucleotide; TTA chr11 5240996 5241017 5241013 5241018 +
aatgtccatattctcctctatc

SEQ ID NO: 87153 - DNA, 22 bp, Artificial Sequence
  Synthetic oligonucleotide; TTC chr11 5241009 5241030 5241026 5241031 +
tcctctatcaacttgacttaac

SEQ ID NO: 87154 - DNA, 22 bp, Artificial Sequence
  Synthetic oligonucleotide; CTC chr11 5241011 5241032 5241028 5241033 +
ctctatcaacttgacttaacgt

SEQ ID NO: 87155 - DNA, 22 bp, Artificial Sequence
  Synthetic oligonucleotide; CTC chr11 5241014 5241035 5241031 5241036 +
tatcaacttgacttaacgtgct

SEQ ID NO: 87156 - DNA, 22 bp, Artificial Sequence
  Synthetic oligonucleotide; CTA chr11 5241016 5241037 5241033 5241038 +
tcaacttgacttaacgtgctgt

SEQ ID NO: 87157 - DNA, 22 bp, Artificial Sequence
  Synthetic oligonucleotide; CTT chr11 5241023 5241044 5241040 5241045 +
gacttaacgtgctgtttcctaa

SEQ ID NO: 87158 - DNA, 22 bp, Artificial Sequence
  Synthetic oligonucleotide; TTG chr11 5241024 5241045 5241041 5241046 +
acttaacgtgctgtttcctaaa

SEQ ID NO: 87159 - DNA, 22 bp, Artificial Sequence
  Synthetic oligonucleotide; CTT chr11 5241028 5241049 5241045 5241050 +
aacgtgctgtttcctaaatctc

SEQ ID NO: 87160 - DNA, 22 bp, Artificial Sequence
  Synthetic oligonucleotide; TTA chr11 5241029 5241050 5241046 5241051 +
acgtgctgtttcctaaatctca

SEQ ID NO: 87161 - DNA, 22 bp, Artificial Sequence
  Synthetic oligonucleotide; CTG chr11 5241037 5241058 5241054 5241059 +
tttcctaaatctcagcctttta

SEQ ID NO: 87162 - DNA, 22 bp, Artificial Sequence
  Synthetic oligonucleotide; TTT chr11 5241040 5241061 5241057 5241062 +
cctaaatctcagccttttaatc

SEQ ID NO: 87163 - DNA, 22 bp, Artificial Sequence
  Synthetic oligonucleotide; TTC chr11 5241041 5241062 5241058 5241063 +
ctaaatctcagccttttaatct

SEQ ID NO: 87164 - DNA, 22 bp, Artificial Sequence
  Synthetic oligonucleotide; CTA chr11 5241044 5241065 5241061 5241066 +
aatctcagccttttaatctgct

SEQ ID NO: 87165 - DNA, 22 bp, Artificial Sequence
  Synthetic oligonucleotide; CTC chr11 5241050 5241071 5241067 5241072 +
agccttttaatctgctgtttgc

SEQ ID NO: 87166 - DNA, 22 bp, Artificial Sequence
  Synthetic oligonucleotide; CTT chr11 5241056 5241077 5241073 5241078 +
ttaatctgctgtttgctcacat

SEQ ID NO: 87167 - DNA, 22 bp, Artificial Sequence
  Synthetic oligonucleotide; TTT chr11 5241057 5241078 5241074 5241079 +
taatctgctgtttgctcacata

SEQ ID NO: 87168 - DNA, 22 bp, Artificial Sequence
  Synthetic oligonucleotide; TTT chr11 5241058 5241079 5241075 5241080 +
aatctgctgtttgctcacataa

SEQ ID NO: 87169 - DNA, 22 bp, Artificial Sequence
  Synthetic oligonucleotide; TTA chr11 5241059 5241080 5241076 5241081 +
atctgctgtttgctcacataaa

SEQ ID NO: 87170 - DNA, 22 bp, Artificial Sequence
  Synthetic oligonucleotide; CTG chr11 5241064 5241085 5241081 5241086 +
ctgtttgctcacataaacaaaa

SEQ ID NO: 87171 - DNA, 22 bp, Artificial Sequence
  Synthetic oligonucleotide; CTG chr11 5241067 5241088 5241084 5241089 +
tttgctcacataaacaaaaatc

SEQ ID NO: 87172 - DNA, 22 bp, Artificial Sequence
  Synthetic oligonucleotide; TTT chr11 5241070 5241091 5241087 5241092 +
gctcacataaacaaaaatcagt

SEQ ID NO: 87173 - DNA, 22 bp, Artificial Sequence
  Synthetic oligonucleotide; TTG chr11 5241071 5241092 5241088 5241093 +
ctcacataaacaaaaatcagtg

SEQ ID NO: 87174 - DNA, 22 bp, Artificial Sequence
  Synthetic oligonucleotide; CTC chr11 5241074 5241095 5241091 5241096 +
acataaacaaaaatcagtggtt

SEQ ID NO: 87175 - DNA, 22 bp, Artificial Sequence
  Synthetic oligonucleotide; TTT chr11 5241097 5241118 5241114 5241119 +
tcaatattgattgctaataatt

SEQ ID NO: 87176 - DNA, 22 bp, Artificial Sequence
  Synthetic oligonucleotide; TTT chr11 5241098 5241119 5241115 5241120 +
caatattgattgctaataattt

SEQ ID NO: 87177 - DNA, 22 bp, Artificial Sequence
  Synthetic oligonucleotide; TTC chr11 5241099 5241120 5241116 5241121 +
aatattgattgctaataatttt

SEQ ID NO: 87178 - DNA, 22 bp, Artificial Sequence
  Synthetic oligonucleotide; TTG chr11 5241106 5241127 5241123 5241128 +
attgctaataattttttattca

SEQ ID NO: 87179 - DNA, 22 bp, Artificial Sequence
  Synthetic oligonucleotide; TTG chr11 5241110 5241131 5241127 5241132 +
ctaataattttttattcataaa

SEQ ID NO: 87180 - DNA, 22 bp, Artificial Sequence
  Synthetic oligonucleotide; CTA chr11 5241113 5241134 5241130 5241135 +
ataattttttattcataaaaat

SEQ ID NO: 87181 - DNA, 22 bp, Artificial Sequence
  Synthetic oligonucleotide; TTT chr11 5241120 5241141 5241137 5241142 +
tttattcataaaaattgtatat

SEQ ID NO: 87182 - DNA, 22 bp, Artificial Sequence
  Synthetic oligonucleotide; TTT chr11 5241121 5241142 5241138 5241143 +
ttattcataaaaattgtatata

SEQ ID NO: 87183 - DNA, 22 bp, Artificial Sequence
  Synthetic oligonucleotide; TTT chr11 5241122 5241143 5241139 5241144 +
tattcataaaaattgtatatat

SEQ ID NO: 87184 - DNA, 22 bp, Artificial Sequence
  Synthetic oligonucleotide; TTT chr11 5241123 5241144 5241140 5241145 +
attcataaaaattgtatatatt

SEQ ID NO: 87185 - DNA, 22 bp, Artificial Sequence
  Synthetic oligonucleotide; TTA chr11 5241124 5241145 5241141 5241146 +
ttcataaaaattgtatatattt

SEQ ID NO: 87186 - DNA, 22 bp, Artificial Sequence
  Synthetic oligonucleotide; TTC chr11 5241127 5241148 5241144 5241149 +
ataaaaattgtatatatttatg

SEQ ID NO: 87187 - DNA, 22 bp, Artificial Sequence
  Synthetic oligonucleotide; TTG chr11 5241137 5241158 5241154 5241159 +
tatatatttatgaatgcacaca

SEQ ID NO: 87188 - DNA, 22 bp, Artificial Sequence
  Synthetic oligonucleotide; TTT chr11 5241146 5241167 5241163 5241168 +
atgaatgcacacatgtgtgtgt

SEQ ID NO: 87189 - DNA, 22 bp, Artificial Sequence
  Synthetic oligonucleotide; TTA chr11 5241147 5241168 5241164 5241169 +
tgaatgcacacatgtgtgtgta

SEQ ID NO: 87190 - DNA, 22 bp, Artificial Sequence
  Synthetic oligonucleotide; CTA chr11 5241197 5241218 5241214 5241219 +
ccactaaaaacaataaaacttg

SEQ ID NO: 87191 - DNA, 22 bp, Artificial Sequence
  Synthetic oligonucleotide; CTA chr11 5241203 5241224 5241220 5241225 +
aaaacaataaaacttgtacata

SEQ ID NO: 87192 - DNA, 22 bp, Artificial Sequence
  Synthetic oligonucleotide; CTT chr11 5241218 5241239 5241235 5241240 +
gtacatatttatagaaacagag

SEQ ID NO: 87193 - DNA, 22 bp, Artificial Sequence
  Synthetic oligonucleotide; TTG chr11 5241219 5241240 5241236 5241241 +
tacatatttatagaaacagaga

SEQ ID NO: 87194 - DNA, 22 bp, Artificial Sequence
  Synthetic oligonucleotide; TTT chr11 5241228 5241249 5241245 5241250 +
atagaaacagagagctgaacaa

SEQ ID NO: 87195 - DNA, 22 bp, Artificial Sequence
  Synthetic oligonucleotide; TTA chr11 5241229 5241250 5241246 5241251 +
tagaaacagagagctgaacaaa

SEQ ID NO: 87196 - DNA, 22 bp, Artificial Sequence
  Synthetic oligonucleotide; CTG chr11 5241245 5241266 5241262 5241267 +
aacaaagagatttattatttat

SEQ ID NO: 87197 - DNA, 22 bp, Artificial Sequence
  Synthetic oligonucleotide; TTT chr11 5241258 5241279 5241275 5241280 +
attatttattgggtagtgtgat

SEQ ID NO: 87198 - DNA, 22 bp, Artificial Sequence
  Synthetic oligonucleotide; TTA chr11 5241259 5241280 5241276 5241281 +
ttatttattgggtagtgtgata

SEQ ID NO: 87199 - DNA, 22 bp, Artificial Sequence
  Synthetic oligonucleotide; TTA chr11 5241262 5241283 5241279 5241284 +
tttattgggtagtgtgataaag

SEQ ID NO: 87200 - DNA, 22 bp, Artificial Sequence
  Synthetic oligonucleotide; TTT chr11 5241265 5241286 5241282 5241287 +
attgggtagtgtgataaagact

SEQ ID NO: 87201 - DNA, 22 bp, Artificial Sequence
  Synthetic oligonucleotide; TTA chr11 5241266 5241287 5241283 5241288 +
ttgggtagtgtgataaagactt

SEQ ID NO: 87202 - DNA, 22 bp, Artificial Sequence
  Synthetic oligonucleotide; TTG chr11 5241269 5241290 5241286 5241291 +
ggtagtgtgataaagactttac

SEQ ID NO: 87203 - DNA, 22 bp, Artificial Sequence
  Synthetic oligonucleotide; CTT chr11 5241288 5241309 5241305 5241310 +
tacaggtatcaattcaattagt

SEQ ID NO: 87204 - DNA, 22 bp, Artificial Sequence
  Synthetic oligonucleotide; TTT chr11 5241289 5241310 5241306 5241311 +
acaggtatcaattcaattagtt

SEQ ID NO: 87205 - DNA, 22 bp, Artificial Sequence
  Synthetic oligonucleotide; TTA chr11 5241290 5241311 5241307 5241312 +
caggtatcaattcaattagttc

SEQ ID NO: 87206 - DNA, 22 bp, Artificial Sequence
  Synthetic oligonucleotide; TTC chr11 5241303 5241324 5241320 5241325 +
aattagttcttacaaaaatcct

SEQ ID NO: 87207 - DNA, 22 bp, Artificial Sequence
  Synthetic oligonucleotide; TTA chr11 5241308 5241329 5241325 5241330 +
gttcttacaaaaatcctttaag

SEQ ID NO: 87208 - DNA, 22 bp, Artificial Sequence
  Synthetic oligonucleotide; TTC chr11 5241312 5241333 5241329 5241334 +
ttacaaaaatcctttaaggaaa

SEQ ID NO: 87209 - DNA, 22 bp, Artificial Sequence
  Synthetic oligonucleotide; CTT chr11 5241314 5241335 5241331 5241336 +
acaaaaatcctttaaggaaaat

SEQ ID NO: 87210 - DNA, 22 bp, Artificial Sequence
  Synthetic oligonucleotide; TTA chr11 5241315 5241336 5241332 5241337 +
caaaaatcctttaaggaaaata

SEQ ID NO: 87211 - DNA, 22 bp, Artificial Sequence
  Synthetic oligonucleotide; CTT chr11 5241326 5241347 5241343 5241348 +
taaggaaaatacatatgataaa

SEQ ID NO: 87212 - DNA, 22 bp, Artificial Sequence
  Synthetic oligonucleotide; TTT chr11 5241327 5241348 5241344 5241349 +
aaggaaaatacatatgataaat

SEQ ID NO: 87213 - DNA, 22 bp, Artificial Sequence
  Synthetic oligonucleotide; TTA chr11 5241328 5241349 5241345 5241350 +
aggaaaatacatatgataaatc

SEQ ID NO: 87214 - DNA, 22 bp, Artificial Sequence
  Synthetic oligonucleotide; CTA chr11 5241352 5241373 5241369 5241374 +
tcatatgcacagcttaatggaa

SEQ ID NO: 87215 - DNA, 22 bp, Artificial Sequence
  Synthetic oligonucleotide; CTT chr11 5241367 5241388 5241384 5241389 +
aatggaattataaatatgtttc

SEQ ID NO: 87216 - DNA, 22 bp, Artificial Sequence
  Synthetic oligonucleotide; TTA chr11 5241368 5241389 5241385 5241390 +
atggaattataaatatgtttca

SEQ ID NO: 87217 - DNA, 22 bp, Artificial Sequence
  Synthetic oligonucleotide; TTA chr11 5241377 5241398 5241394 5241399 +
taaatatgtttcaggtcacaga

SEQ ID NO: 87218 - DNA, 22 bp, Artificial Sequence
  Synthetic oligonucleotide; TTT chr11 5241388 5241409 5241405 5241410 +
caggtcacagaggtagcagatg

SEQ ID NO: 87219 - DNA, 22 bp, Artificial Sequence
  Synthetic oligonucleotide; TTC chr11 5241389 5241410 5241406 5241411 +
aggtcacagaggtagcagatga

SEQ ID NO: 87220 - DNA, 22 bp, Artificial Sequence
  Synthetic oligonucleotide; TTC chr11 5241441 5241462 5241458 5241463 +
acatgccttagagataattctc

SEQ ID NO: 87221 - DNA, 22 bp, Artificial Sequence
  Synthetic oligonucleotide; CTT chr11 5241450 5241471 5241467 5241472 +
agagataattctctattaatac

SEQ ID NO: 87222 - DNA, 22 bp, Artificial Sequence
  Synthetic oligonucleotide; TTA chr11 5241451 5241472 5241468 5241473 +
gagataattctctattaatacc

SEQ ID NO: 87223 - DNA, 22 bp, Artificial Sequence
  Synthetic oligonucleotide; TTC chr11 5241461 5241482 5241478 5241483 +
tctattaataccattgaagacg

SEQ ID NO: 87224 - DNA, 22 bp, Artificial Sequence
  Synthetic oligonucleotide; CTC chr11 5241463 5241484 5241480 5241485 +
tattaataccattgaagacgtt

SEQ ID NO: 87225 - DNA, 22 bp, Artificial Sequence
  Synthetic oligonucleotide; CTA chr11 5241465 5241486 5241482 5241487 +
ttaataccattgaagacgttaa

SEQ ID NO: 87226 - DNA, 22 bp, Artificial Sequence
  Synthetic oligonucleotide; TTA chr11 5241468 5241489 5241485 5241490 +
ataccattgaagacgttaagag

SEQ ID NO: 87227 - DNA, 22 bp, Artificial Sequence
  Synthetic oligonucleotide; TTG chr11 5241477 5241498 5241494 5241499 +
aagacgttaagagaaagttcaa

SEQ ID NO: 87228 - DNA, 22 bp, Artificial Sequence
  Synthetic oligonucleotide; TTA chr11 5241486 5241507 5241503 5241508 +
agagaaagttcaaggtttggcc

SEQ ID NO: 87229 - DNA, 22 bp, Artificial Sequence
  Synthetic oligonucleotide; TTC chr11 5241497 5241518 5241514 5241519 +
aaggtttggcccttgattggtc

SEQ ID NO: 87230 - DNA, 22 bp, Artificial Sequence
  Synthetic oligonucleotide; TTT chr11 5241504 5241525 5241521 5241526 +
ggcccttgattggtctctagga

SEQ ID NO: 87231 - DNA, 22 bp, Artificial Sequence
  Synthetic oligonucleotide; TTG chr11 5241505 5241526 5241522 5241527 +
gcccttgattggtctctaggaa

SEQ ID NO: 87232 - DNA, 22 bp, Artificial Sequence
  Synthetic oligonucleotide; CTT chr11 5241511 5241532 5241528 5241533 +
gattggtctctaggaagcccca

SEQ ID NO: 87233 - DNA, 22 bp, Artificial Sequence
  Synthetic oligonucleotide; TTG chr11 5241512 5241533 5241529 5241534 +
attggtctctaggaagccccat

SEQ ID NO: 87234 - DNA, 22 bp, Artificial Sequence
  Synthetic oligonucleotide; TTG chr11 5241516 5241537 5241533 5241538 +
gtctctaggaagccccatcccc

SEQ ID NO: 87235 - DNA, 22 bp, Artificial Sequence
  Synthetic oligonucleotide; CTC chr11 5241521 5241542 5241538 5241543 +
taggaagccccatccccacttc

SEQ ID NO: 87236 - DNA, 22 bp, Artificial Sequence
  Synthetic oligonucleotide; CTA chr11 5241523 5241544 5241540 5241545 +
ggaagccccatccccacttcat

SEQ ID NO: 87237 - DNA, 22 bp, Artificial Sequence
  Synthetic oligonucleotide; CTT chr11 5241542 5241563 5241559 5241564 +
cattataaataataaaaaatat

SEQ ID NO: 87238 - DNA, 22 bp, Artificial Sequence
  Synthetic oligonucleotide; TTC chr11 5241543 5241564 5241560 5241565 +
attataaataataaaaaatatg

SEQ ID NO: 87239 - DNA, 22 bp, Artificial Sequence
  Synthetic oligonucleotide; TTA chr11 5241547 5241568 5241564 5241569 +
taaataataaaaaatatgttgt

SEQ ID NO: 87240 - DNA, 22 bp, Artificial Sequence
  Synthetic oligonucleotide; TTG chr11 5241568 5241589 5241585 5241590 +
tttaaaataagtagaagtgaac

SEQ ID NO: 87241 - DNA, 22 bp, Artificial Sequence
  Synthetic oligonucleotide; TTT chr11 5241571 5241592 5241588 5241593 +
aaaataagtagaagtgaactgc

SEQ ID NO: 87242 - DNA, 22 bp, Artificial Sequence
  Synthetic oligonucleotide; TTA chr11 5241572 5241593 5241589 5241594 +
aaataagtagaagtgaactgca

SEQ ID NO: 87243 - DNA, 22 bp, Artificial Sequence
  Synthetic oligonucleotide; CTG chr11 5241592 5241613 5241609 5241614 +
cagtcaccaaatgagctatatc

SEQ ID NO: 87244 - DNA, 22 bp, Artificial Sequence
  Synthetic oligonucleotide; CTA chr11 5241610 5241631 5241627 5241632 +
tatcctgagtttcatacaaata

SEQ ID NO: 87245 - DNA, 22 bp, Artificial Sequence
  Synthetic oligonucleotide; CTG chr11 5241617 5241638 5241634 5241639 +
agtttcatacaaataatagcct

SEQ ID NO: 87246 - DNA, 22 bp, Artificial Sequence
  Synthetic oligonucleotide; TTT chr11 5241622 5241643 5241639 5241644 +
catacaaataatagcctataca

SEQ ID NO: 87247 - DNA, 22 bp, Artificial Sequence
  Synthetic oligonucleotide; TTC chr11 5241623 5241644 5241640 5241645 +
atacaaataatagcctatacag

SEQ ID NO: 87248 - DNA, 22 bp, Artificial Sequence
  Synthetic oligonucleotide; CTA chr11 5241640 5241661 5241657 5241662 +
tacagaacttctaatttgagtc

SEQ ID NO: 87249 - DNA, 22 bp, Artificial Sequence
  Synthetic oligonucleotide; CTT chr11 5241650 5241671 5241667 5241672 +
ctaatttgagtcctaacatacc

SEQ ID NO: 87250 - DNA, 22 bp, Artificial Sequence
  Synthetic oligonucleotide; TTC chr11 5241651 5241672 5241668 5241673 +
taatttgagtcctaacatacct

SEQ ID NO: 87251 - DNA, 22 bp, Artificial Sequence
  Synthetic oligonucleotide; CTA chr11 5241653 5241674 5241670 5241675 +
atttgagtcctaacatacctct

SEQ ID NO: 87252 - DNA, 22 bp, Artificial Sequence
  Synthetic oligonucleotide; TTT chr11 5241657 5241678 5241674 5241679 +
gagtcctaacatacctctacac

SEQ ID NO: 87253 - DNA, 22 bp, Artificial Sequence
  Synthetic oligonucleotide; TTG chr11 5241658 5241679 5241675 5241680 +
agtcctaacatacctctacaca

SEQ ID NO: 87254 - DNA, 22 bp, Artificial Sequence
  Synthetic oligonucleotide; CTA chr11 5241665 5241686 5241682 5241687 +
acatacctctacacactaccaa

SEQ ID NO: 87255 - DNA, 22 bp, Artificial Sequence
  Synthetic oligonucleotide; CTC chr11 5241674 5241695 5241691 5241696 +
tacacactaccaacaatcctct

SEQ ID NO: 87256 - DNA, 22 bp, Artificial Sequence
  Synthetic oligonucleotide; CTA chr11 5241676 5241697 5241693 5241698 +
cacactaccaacaatcctctta

SEQ ID NO: 87257 - DNA, 22 bp, Artificial Sequence
  Synthetic oligonucleotide; CTA chr11 5241683 5241704 5241700 5241705 +
ccaacaatcctcttacacctcc

SEQ ID NO: 87258 - DNA, 22 bp, Artificial Sequence
  Synthetic oligonucleotide; CTC chr11 5241695 5241716 5241712 5241717 +
ttacacctccaaagagtacctc

SEQ ID NO: 87259 - DNA, 22 bp, Artificial Sequence
  Synthetic oligonucleotide; CTT chr11 5241697 5241718 5241714 5241719 +
acacctccaaagagtacctcca

SEQ ID NO: 87260 - DNA, 22 bp, Artificial Sequence
  Synthetic oligonucleotide; TTA chr11 5241698 5241719 5241715 5241720 +
cacctccaaagagtacctccat

SEQ ID NO: 87261 - DNA, 22 bp, Artificial Sequence
  Synthetic oligonucleotide; CTC chr11 5241704 5241725 5241721 5241726 +
caaagagtacctccattgacct

SEQ ID NO: 87262 - DNA, 22 bp, Artificial Sequence
  Synthetic oligonucleotide; CTC chr11 5241717 5241738 5241734 5241739 +
cattgacctccctttctgtaaa

SEQ ID NO: 87263 - DNA, 22 bp, Artificial Sequence
  Synthetic oligonucleotide; TTG chr11 5241722 5241743 5241739 5241744 +
acctccctttctgtaaaaacat

SEQ ID NO: 87264 - DNA, 22 bp, Artificial Sequence
  Synthetic oligonucleotide; CTC chr11 5241727 5241748 5241744 5241749 +
cctttctgtaaaaacattgtct

SEQ ID NO: 87265 - DNA, 22 bp, Artificial Sequence
  Synthetic oligonucleotide; CTT chr11 5241731 5241752 5241748 5241753 +
tctgtaaaaacattgtcttatt

SEQ ID NO: 87266 - DNA, 22 bp, Artificial Sequence
  Synthetic oligonucleotide; TTT chr11 5241732 5241753 5241749 5241754 +
ctgtaaaaacattgtcttattc

SEQ ID NO: 87267 - DNA, 22 bp, Artificial Sequence
  Synthetic oligonucleotide; TTC chr11 5241733 5241754 5241750 5241755 +
tgtaaaaacattgtcttattct

SEQ ID NO: 87268 - DNA, 22 bp, Artificial Sequence
  Synthetic oligonucleotide; CTG chr11 5241735 5241756 5241752 5241757 +
taaaaacattgtcttattctag

SEQ ID NO: 87269 - DNA, 22 bp, Artificial Sequence
  Synthetic oligonucleotide; TTG chr11 5241746 5241767 5241763 5241768 +
tcttattctagagacgatttcc

SEQ ID NO: 87270 - DNA, 22 bp, Artificial Sequence
  Synthetic oligonucleotide; CTT chr11 5241750 5241771 5241767 5241772 +
attctagagacgatttcccctt

SEQ ID NO: 87271 - DNA, 22 bp, Artificial Sequence
  Synthetic oligonucleotide; TTA chr11 5241751 5241772 5241768 5241773 +
ttctagagacgatttccccttc

SEQ ID NO: 87272 - DNA, 22 bp, Artificial Sequence
  Synthetic oligonucleotide; TTC chr11 5241754 5241775 5241771 5241776 +
tagagacgatttccccttccta

SEQ ID NO: 87273 - DNA, 22 bp, Artificial Sequence
  Synthetic oligonucleotide; CTA chr11 5241756 5241777 5241773 5241778 +
gagacgatttccccttcctagg

SEQ ID NO: 87274 - DNA, 22 bp, Artificial Sequence
  Synthetic oligonucleotide; TTT chr11 5241766 5241787 5241783 5241788 +
ccccttcctaggagtaactacc

SEQ ID NO: 87275 - DNA, 22 bp, Artificial Sequence
  Synthetic oligonucleotide; TTC chr11 5241767 5241788 5241784 5241789 +
cccttcctaggagtaactaccc

SEQ ID NO: 87276 - DNA, 22 bp, Artificial Sequence
  Synthetic oligonucleotide; CTT chr11 5241772 5241793 5241789 5241794 +
cctaggagtaactaccccacta

SEQ ID NO: 87277 - DNA, 22 bp, Artificial Sequence
  Synthetic oligonucleotide; TTC chr11 5241773 5241794 5241790 5241795 +
ctaggagtaactaccccactaa

SEQ ID NO: 87278 - DNA, 22 bp, Artificial Sequence
  Synthetic oligonucleotide; CTA chr11 5241776 5241797 5241793 5241798 +
ggagtaactaccccactaaatc

SEQ ID NO: 87279 - DNA, 22 bp, Artificial Sequence
  Synthetic oligonucleotide; CTA chr11 5241786 5241807 5241803 5241808 +
ccccactaaatccacccacgag

SEQ ID NO: 87280 - DNA, 22 bp, Artificial Sequence
  Synthetic oligonucleotide; CTA chr11 5241794 5241815 5241811 5241816 +
aatccacccacgagttctctct

SEQ ID NO: 87281 - DNA, 22 bp, Artificial Sequence
  Synthetic oligonucleotide; TTC chr11 5241811 5241832 5241828 5241833 +
tctcttttcttgcaggattgca

SEQ ID NO: 87282 - DNA, 22 bp, Artificial Sequence
  Synthetic oligonucleotide; CTC chr11 5241813 5241834 5241830 5241835 +
tcttttcttgcaggattgcaag

SEQ ID NO: 87283 - DNA, 22 bp, Artificial Sequence
  Synthetic oligonucleotide; CTC chr11 5241815 5241836 5241832 5241837 +
ttttcttgcaggattgcaagaa

SEQ ID NO: 87284 - DNA, 22 bp, Artificial Sequence
  Synthetic oligonucleotide; CTT chr11 5241817 5241838 5241834 5241839 +
ttcttgcaggattgcaagaaag

SEQ ID NO: 87285 - DNA, 22 bp, Artificial Sequence
  Synthetic oligonucleotide; TTT chr11 5241818 5241839 5241835 5241840 +
tcttgcaggattgcaagaaagt

SEQ ID NO: 87286 - DNA, 22 bp, Artificial Sequence
  Synthetic oligonucleotide; TTT chr11 5241819 5241840 5241836 5241841 +
cttgcaggattgcaagaaagta

SEQ ID NO: 87287 - DNA, 22 bp, Artificial Sequence
  Synthetic oligonucleotide; TTC chr11 5241820 5241841 5241837 5241842 +
ttgcaggattgcaagaaagtat

SEQ ID NO: 87288 - DNA, 22 bp, Artificial Sequence
  Synthetic oligonucleotide; CTT chr11 5241822 5241843 5241839 5241844 +
gcaggattgcaagaaagtatct

SEQ ID NO: 87289 - DNA, 22 bp, Artificial Sequence
  Synthetic oligonucleotide; TTG chr11 5241823 5241844 5241840 5241845 +
caggattgcaagaaagtatctt

SEQ ID NO: 87290 - DNA, 22 bp, Artificial Sequence
  Synthetic oligonucleotide; TTG chr11 5241831 5241852 5241848 5241853 +
caagaaagtatcttctctgtcc

SEQ ID NO: 87291 - DNA, 22 bp, Artificial Sequence
  Synthetic oligonucleotide; CTT chr11 5241845 5241866 5241862 5241867 +
ctctgtccttaaactcccattc

SEQ ID NO: 87292 - DNA, 22 bp, Artificial Sequence
  Synthetic oligonucleotide; TTC chr11 5241846 5241867 5241863 5241868 +
tctgtccttaaactcccattct

SEQ ID NO: 87293 - DNA, 22 bp, Artificial Sequence
  Synthetic oligonucleotide; CTC chr11 5241848 5241869 5241865 5241870 +
tgtccttaaactcccattctcc

SEQ ID NO: 87294 - DNA, 22 bp, Artificial Sequence
  Synthetic oligonucleotide; CTG chr11 5241850 5241871 5241867 5241872 +
tccttaaactcccattctccaa

SEQ ID NO: 87295 - DNA, 22 bp, Artificial Sequence
  Synthetic oligonucleotide; CTT chr11 5241855 5241876 5241872 5241877 +
aaactcccattctccaacattc

SEQ ID NO: 87296 - DNA, 22 bp, Artificial Sequence
  Synthetic oligonucleotide; TTA chr11 5241856 5241877 5241873 5241878 +
aactcccattctccaacattct

SEQ ID NO: 87297 - DNA, 22 bp, Artificial Sequence
  Synthetic oligonucleotide; CTC chr11 5241861 5241882 5241878 5241883 +
ccattctccaacattctcattt

SEQ ID NO: 87298 - DNA, 22 bp, Artificial Sequence
  Synthetic oligonucleotide; TTC chr11 5241867 5241888 5241884 5241889 +
tccaacattctcatttccatca

SEQ ID NO: 87299 - DNA, 22 bp, Artificial Sequence
  Synthetic oligonucleotide; CTC chr11 5241869 5241890 5241886 5241891 +
caacattctcatttccatcaga

SEQ ID NO: 87300 - DNA, 22 bp, Artificial Sequence
  Synthetic oligonucleotide; TTC chr11 5241877 5241898 5241894 5241899 +
tcatttccatcagaaatagtgc

SEQ ID NO: 87301 - DNA, 22 bp, Artificial Sequence
  Synthetic oligonucleotide; CTC chr11 5241879 5241900 5241896 5241901 +
atttccatcagaaatagtgcgt

SEQ ID NO: 87302 - DNA, 22 bp, Artificial Sequence
  Synthetic oligonucleotide; TTT chr11 5241883 5241904 5241900 5241905 +
ccatcagaaatagtgcgtcctt

SEQ ID NO: 87303 - DNA, 22 bp, Artificial Sequence
  Synthetic oligonucleotide; TTC chr11 5241884 5241905 5241901 5241906 +
catcagaaatagtgcgtccttt

SEQ ID NO: 87304 - DNA, 22 bp, Artificial Sequence
  Synthetic oligonucleotide; CTT chr11 5241905 5241926 5241922 5241927 +
ttggctgaatcagggtaaaata

SEQ ID NO: 87305 - DNA, 22 bp, Artificial Sequence
  Synthetic oligonucleotide; TTT chr11 5241906 5241927 5241923 5241928 +
tggctgaatcagggtaaaatat

SEQ ID NO: 87306 - DNA, 22 bp, Artificial Sequence
  Synthetic oligonucleotide; TTT chr11 5241907 5241928 5241924 5241929 +
ggctgaatcagggtaaaatata

SEQ ID NO: 87307 - DNA, 22 bp, Artificial Sequence
  Synthetic oligonucleotide; TTG chr11 5241908 5241929 5241925 5241930 +
gctgaatcagggtaaaatataa

SEQ ID NO: 87308 - DNA, 22 bp, Artificial Sequence
  Synthetic oligonucleotide; CTG chr11 5241912 5241933 5241929 5241934 +
aatcagggtaaaatataaagac

SEQ ID NO: 87309 - DNA, 22 bp, Artificial Sequence
  Synthetic oligonucleotide; TTT chr11 5241957 5241978 5241974 5241979 +
cttagagagcatatttctttat

SEQ ID NO: 87310 - DNA, 22 bp, Artificial Sequence
  Synthetic oligonucleotide; TTC chr11 5241958 5241979 5241975 5241980 +
ttagagagcatatttctttatt

SEQ ID NO: 87311 - DNA, 22 bp, Artificial Sequence
  Synthetic oligonucleotide; CTT chr11 5241960 5241981 5241977 5241982 +
agagagcatatttctttattct

SEQ ID NO: 87312 - DNA, 22 bp, Artificial Sequence
  Synthetic oligonucleotide; TTA chr11 5241961 5241982 5241978 5241983 +
gagagcatatttctttattcta

SEQ ID NO: 87313 - DNA, 22 bp, Artificial Sequence
  Synthetic oligonucleotide; TTT chr11 5241973 5241994 5241990 5241995 +
ctttattctatttttatcatgc

SEQ ID NO: 87314 - DNA, 22 bp, Artificial Sequence
  Synthetic oligonucleotide; TTC chr11 5241974 5241995 5241991 5241996 +
tttattctatttttatcatgca

SEQ ID NO: 87315 - DNA, 22 bp, Artificial Sequence
  Synthetic oligonucleotide; CTT chr11 5241976 5241997 5241993 5241998 +
tattctatttttatcatgcagg

SEQ ID NO: 87316 - DNA, 22 bp, Artificial Sequence
  Synthetic oligonucleotide; TTT chr11 5241977 5241998 5241994 5241999 +
attctatttttatcatgcagga

SEQ ID NO: 87317 - DNA, 22 bp, Artificial Sequence
  Synthetic oligonucleotide; TTA chr11 5241978 5241999 5241995 5242000 +
ttctatttttatcatgcaggaa

SEQ ID NO: 87318 - DNA, 22 bp, Artificial Sequence
  Synthetic oligonucleotide; TTC chr11 5241981 5242002 5241998 5242003 +
tatttttatcatgcaggaactg

SEQ ID NO: 87319 - DNA, 22 bp, Artificial Sequence
  Synthetic oligonucleotide; CTA chr11 5241983 5242004 5242000 5242005 +
tttttatcatgcaggaactgaa

SEQ ID NO: 87320 - DNA, 22 bp, Artificial Sequence
  Synthetic oligonucleotide; TTT chr11 5241986 5242007 5242003 5242008 +
ttatcatgcaggaactgaatca

SEQ ID NO: 87321 - DNA, 22 bp, Artificial Sequence
  Synthetic oligonucleotide; TTT chr11 5241987 5242008 5242004 5242009 +
tatcatgcaggaactgaatcag

SEQ ID NO: 87322 - DNA, 22 bp, Artificial Sequence
  Synthetic oligonucleotide; TTT chr11 5241988 5242009 5242005 5242010 +
atcatgcaggaactgaatcagc

SEQ ID NO: 87323 - DNA, 22 bp, Artificial Sequence
  Synthetic oligonucleotide; TTA chr11 5241989 5242010 5242006 5242011 +
tcatgcaggaactgaatcagca

SEQ ID NO: 87324 - DNA, 22 bp, Artificial Sequence
  Synthetic oligonucleotide; CTG chr11 5242003 5242024 5242020 5242025 +
aatcagcaggcaggatactgct

SEQ ID NO: 87325 - DNA, 22 bp, Artificial Sequence
  Synthetic oligonucleotide; CTG chr11 5242023 5242044 5242040 5242045 +
ctcttctccccaacctccccca

SEQ ID NO: 87326 - DNA, 22 bp, Artificial Sequence
  Synthetic oligonucleotide; CTC chr11 5242026 5242047 5242043 5242048 +
ttctccccaacctcccccatct

SEQ ID NO: 87327 - DNA, 22 bp, Artificial Sequence
  Synthetic oligonucleotide; CTT chr11 5242028 5242049 5242045 5242050 +
ctccccaacctcccccatctaa

SEQ ID NO: 87328 - DNA, 22 bp, Artificial Sequence
  Synthetic oligonucleotide; TTC chr11 5242029 5242050 5242046 5242051 +
tccccaacctcccccatctaaa

SEQ ID NO: 87329 - DNA, 22 bp, Artificial Sequence
  Synthetic oligonucleotide; CTC chr11 5242031 5242052 5242048 5242053 +
cccaacctcccccatctaaagg

SEQ ID NO: 87330 - DNA, 22 bp, Artificial Sequence
  Synthetic oligonucleotide; CTC chr11 5242040 5242061 5242057 5242062 +
ccccatctaaaggagatgagat

SEQ ID NO: 87331 - DNA, 22 bp, Artificial Sequence
  Synthetic oligonucleotide; CTA chr11 5242049 5242070 5242066 5242071 +
aaggagatgagattttgggaca

SEQ ID NO: 87332 - DNA, 22 bp, Artificial Sequence
  Synthetic oligonucleotide; TTT chr11 5242064 5242085 5242081 5242086 +
tgggacataggtacaaacatag

SEQ ID NO: 87333 - DNA, 22 bp, Artificial Sequence
  Synthetic oligonucleotide; TTT chr11 5242065 5242086 5242082 5242087 +
gggacataggtacaaacatagt

SEQ ID NO: 87334 - DNA, 22 bp, Artificial Sequence
  Synthetic oligonucleotide; TTG chr11 5242066 5242087 5242083 5242088 +
ggacataggtacaaacatagtg

SEQ ID NO: 87335 - DNA, 22 bp, Artificial Sequence
  Synthetic oligonucleotide; CTC chr11 5242122 5242143 5242139 5242144 +
agtggtcttgtgggctacagca

SEQ ID NO: 87336 - DNA, 22 bp, Artificial Sequence
  Synthetic oligonucleotide; CTT chr11 5242131 5242152 5242148 5242153 +
gtgggctacagcattaaccaca

SEQ ID NO: 87337 - DNA, 22 bp, Artificial Sequence
  Synthetic oligonucleotide; TTG chr11 5242132 5242153 5242149 5242154 +
tgggctacagcattaaccacag

SEQ ID NO: 87338 - DNA, 22 bp, Artificial Sequence
  Synthetic oligonucleotide; CTA chr11 5242139 5242160 5242156 5242161 +
cagcattaaccacagcatttgt

SEQ ID NO: 87339 - DNA, 22 bp, Artificial Sequence
  Synthetic oligonucleotide; TTA chr11 5242147 5242168 5242164 5242169 +
accacagcatttgttagttact

SEQ ID NO: 87340 - DNA, 22 bp, Artificial Sequence
  Synthetic oligonucleotide; TTT chr11 5242159 5242180 5242176 5242181 +
gttagttactgccaagaagcct

SEQ ID NO: 87341 - DNA, 22 bp, Artificial Sequence
  Synthetic oligonucleotide; TTG chr11 5242160 5242181 5242177 5242182 +
ttagttactgccaagaagcctg

SEQ ID NO: 87342 - DNA, 22 bp, Artificial Sequence
  Synthetic oligonucleotide; TTA chr11 5242163 5242184 5242180 5242185 +
gttactgccaagaagcctgtat

SEQ ID NO: 87343 - DNA, 22 bp, Artificial Sequence
  Synthetic oligonucleotide; TTA chr11 5242167 5242188 5242184 5242189 +
ctgccaagaagcctgtatctgt

SEQ ID NO: 87344 - DNA, 22 bp, Artificial Sequence
  Synthetic oligonucleotide; CTG chr11 5242170 5242191 5242187 5242192 +
ccaagaagcctgtatctgtagg

SEQ ID NO: 87345 - DNA, 22 bp, Artificial Sequence
  Synthetic oligonucleotide; CTG chr11 5242182 5242203 5242199 5242204 +
tatctgtagggtaaaatcctcg

SEQ ID NO: 87346 - DNA, 22 bp, Artificial Sequence
  Synthetic oligonucleotide; CTG chr11 5242188 5242209 5242205 5242210 +
tagggtaaaatcctcgctgaag

SEQ ID NO: 87347 - DNA, 22 bp, Artificial Sequence
  Synthetic oligonucleotide; CTC chr11 5242203 5242224 5242220 5242225 +
gctgaagtgggttgccaaaaca

SEQ ID NO: 87348 - DNA, 22 bp, Artificial Sequence
  Synthetic oligonucleotide; CTG chr11 5242207 5242228 5242224 5242229 +
aagtgggttgccaaaacaatca

SEQ ID NO: 87349 - DNA, 22 bp, Artificial Sequence
  Synthetic oligonucleotide; TTG chr11 5242217 5242238 5242234 5242239 +
ccaaaacaatcaatatcacgtt

SEQ ID NO: 87350 - DNA, 22 bp, Artificial Sequence
  Synthetic oligonucleotide; TTG chr11 5242240 5242261 5242257 5242262 +
cctaagagctggggagggagtg

SEQ ID NO: 87351 - DNA, 22 bp, Artificial Sequence
  Synthetic oligonucleotide; CTA chr11 5242244 5242265 5242261 5242266 +
agagctggggagggagtgaaga

SEQ ID NO: 87352 - DNA, 22 bp, Artificial Sequence
  Synthetic oligonucleotide; CTG chr11 5242251 5242272 5242268 5242273 +
gggagggagtgaagataaaaaa

SEQ ID NO: 87353 - DNA, 22 bp, Artificial Sequence
  Synthetic oligonucleotide; CTC chr11 5242303 5242324 5242320 5242325 +
aagctggacttgcagtaaatag

SEQ ID NO: 87354 - DNA, 22 bp, Artificial Sequence
  Synthetic oligonucleotide; CTG chr11 5242309 5242330 5242326 5242331 +
gacttgcagtaaatagatataa

SEQ ID NO: 87355 - DNA, 22 bp, Artificial Sequence
  Synthetic oligonucleotide; CTT chr11 5242314 5242335 5242331 5242336 +
gcagtaaatagatataacactt

SEQ ID NO: 87356 - DNA, 22 bp, Artificial Sequence
  Synthetic oligonucleotide; TTG chr11 5242315 5242336 5242332 5242337 +
cagtaaatagatataacactta

SEQ ID NO: 87357 - DNA, 22 bp, Artificial Sequence
  Synthetic oligonucleotide; CTT chr11 5242336 5242357 5242353 5242358 +
acatcctttttcaccagagttt

SEQ ID NO: 87358 - DNA, 22 bp, Artificial Sequence
  Synthetic oligonucleotide; TTA chr11 5242337 5242358 5242354 5242359 +
catcctttttcaccagagtttg

SEQ ID NO: 87359 - DNA, 22 bp, Artificial Sequence
  Synthetic oligonucleotide; CTT chr11 5242344 5242365 5242361 5242366 +
tttcaccagagtttgagcaact

SEQ ID NO: 87360 - DNA, 22 bp, Artificial Sequence
  Synthetic oligonucleotide; TTT chr11 5242345 5242366 5242362 5242367 +
ttcaccagagtttgagcaactc

SEQ ID NO: 87361 - DNA, 22 bp, Artificial Sequence
  Synthetic oligonucleotide; TTT chr11 5242346 5242367 5242363 5242368 +
tcaccagagtttgagcaactct

SEQ ID NO: 87362 - DNA, 22 bp, Artificial Sequence
  Synthetic oligonucleotide; TTT chr11 5242347 5242368 5242364 5242369 +
caccagagtttgagcaactctc

SEQ ID NO: 87363 - DNA, 22 bp, Artificial Sequence
  Synthetic oligonucleotide; TTC chr11 5242348 5242369 5242365 5242370 +
accagagtttgagcaactctca

SEQ ID NO: 87364 - DNA, 22 bp, Artificial Sequence
  Synthetic oligonucleotide; TTT chr11 5242358 5242379 5242375 5242380 +
gagcaactctcaccattatggg

SEQ ID NO: 87365 - DNA, 22 bp, Artificial Sequence
  Synthetic oligonucleotide; TTG chr11 5242359 5242380 5242376 5242381 +
agcaactctcaccattatgggc

SEQ ID NO: 87366 - DNA, 22 bp, Artificial Sequence
  Synthetic oligonucleotide; CTC chr11 5242367 5242388 5242384 5242389 +
tcaccattatgggctagatatc

SEQ ID NO: 87367 - DNA, 22 bp, Artificial Sequence
  Synthetic oligonucleotide; CTC chr11 5242369 5242390 5242386 5242391 +
accattatgggctagatatcag

SEQ ID NO: 87368 - DNA, 22 bp, Artificial Sequence
  Synthetic oligonucleotide; TTA chr11 5242376 5242397 5242393 5242398 +
tgggctagatatcagcttcaat

SEQ ID NO: 87369 - DNA, 22 bp, Artificial Sequence
  Synthetic oligonucleotide; CTA chr11 5242383 5242404 5242400 5242405 +
gatatcagcttcaatatgactg

SEQ ID NO: 87370 - DNA, 22 bp, Artificial Sequence
  Synthetic oligonucleotide; CTT chr11 5242394 5242415 5242411 5242416 +
caatatgactggcagccctgca

SEQ ID NO: 87371 - DNA, 22 bp, Artificial Sequence
  Synthetic oligonucleotide; TTC chr11 5242395 5242416 5242412 5242417 +
aatatgactggcagccctgcac

SEQ ID NO: 87372 - DNA, 22 bp, Artificial Sequence
  Synthetic oligonucleotide; CTG chr11 5242405 5242426 5242422 5242427 +
gcagccctgcacctcccattgt

SEQ ID NO: 87373 - DNA, 22 bp, Artificial Sequence
  Synthetic oligonucleotide; CTG chr11 5242414 5242435 5242431 5242436 +
cacctcccattgtgtcctatcc

SEQ ID NO: 87374 - DNA, 22 bp, Artificial Sequence
  Synthetic oligonucleotide; CTC chr11 5242420 5242441 5242437 5242442 +
ccattgtgtcctatccttctct

SEQ ID NO: 87375 - DNA, 22 bp, Artificial Sequence
  Synthetic oligonucleotide; TTG chr11 5242426 5242447 5242443 5242448 +
tgtcctatccttctcttacttg

SEQ ID NO: 87376 - DNA, 22 bp, Artificial Sequence
  Synthetic oligonucleotide; CTA chr11 5242433 5242454 5242450 5242455 +
tccttctcttacttgctatgcc

SEQ ID NO: 87377 - DNA, 22 bp, Artificial Sequence
  Synthetic oligonucleotide; CTT chr11 5242438 5242459 5242455 5242460 +
ctcttacttgctatgccaactc

SEQ ID NO: 87378 - DNA, 22 bp, Artificial Sequence
  Synthetic oligonucleotide; TTC chr11 5242439 5242460 5242456 5242461 +
tcttacttgctatgccaactca

SEQ ID NO: 87379 - DNA, 22 bp, Artificial Sequence
  Synthetic oligonucleotide; CTC chr11 5242441 5242462 5242458 5242463 +
ttacttgctatgccaactcact

SEQ ID NO: 87380 - DNA, 22 bp, Artificial Sequence
  Synthetic oligonucleotide; CTT chr11 5242443 5242464 5242460 5242465 +
acttgctatgccaactcactac

SEQ ID NO: 87381 - DNA, 22 bp, Artificial Sequence
  Synthetic oligonucleotide; TTA chr11 5242444 5242465 5242461 5242466 +
cttgctatgccaactcactacc

SEQ ID NO: 87382 - DNA, 22 bp, Artificial Sequence
  Synthetic oligonucleotide; CTT chr11 5242447 5242468 5242464 5242469 +
gctatgccaactcactacccca

SEQ ID NO: 87383 - DNA, 22 bp, Artificial Sequence
  Synthetic oligonucleotide; TTG chr11 5242448 5242469 5242465 5242470 +
ctatgccaactcactaccccaa

SEQ ID NO: 87384 - DNA, 22 bp, Artificial Sequence
  Synthetic oligonucleotide; CTA chr11 5242451 5242472 5242468 5242473 +
tgccaactcactaccccaacat

SEQ ID NO: 87385 - DNA, 22 bp, Artificial Sequence
  Synthetic oligonucleotide; CTC chr11 5242460 5242481 5242477 5242482 +
actaccccaacatattgtgatt

SEQ ID NO: 87386 - DNA, 22 bp, Artificial Sequence
  Synthetic oligonucleotide; CTA chr11 5242464 5242485 5242481 5242486 +
ccccaacatattgtgattgttt

SEQ ID NO: 87387 - DNA, 22 bp, Artificial Sequence
  Synthetic oligonucleotide; TTG chr11 5242477 5242498 5242494 5242499 +
tgattgtttcatttttttttta

SEQ ID NO: 87388 - DNA, 22 bp, Artificial Sequence
  Synthetic oligonucleotide; TTG chr11 5242483 5242504 5242500 5242505 +
tttcattttttttttagagact

SEQ ID NO: 87389 - DNA, 22 bp, Artificial Sequence
  Synthetic oligonucleotide; TTT chr11 5242486 5242507 5242503 5242508 +
cattttttttttagagacttcg

SEQ ID NO: 87390 - DNA, 22 bp, Artificial Sequence
  Synthetic oligonucleotide; TTC chr11 5242487 5242508 5242504 5242509 +
attttttttttagagacttcgt

SEQ ID NO: 87391 - DNA, 22 bp, Artificial Sequence
  Synthetic oligonucleotide; TTT chr11 5242491 5242512 5242508 5242513 +
tttttttagagacttcgtcctt

SEQ ID NO: 87392 - DNA, 22 bp, Artificial Sequence
  Synthetic oligonucleotide; TTT chr11 5242492 5242513 5242509 5242514 +
ttttttagagacttcgtccttt

SEQ ID NO: 87393 - DNA, 22 bp, Artificial Sequence
  Synthetic oligonucleotide; TTT chr11 5242493 5242514 5242510 5242515 +
tttttagagacttcgtcctttt

SEQ ID NO: 87394 - DNA, 22 bp, Artificial Sequence
  Synthetic oligonucleotide; TTT chr11 5242494 5242515 5242511 5242516 +
ttttagagacttcgtcctttta

SEQ ID NO: 87395 - DNA, 22 bp, Artificial Sequence
  Synthetic oligonucleotide; TTT chr11 5242495 5242516 5242512 5242517 +
tttagagacttcgtccttttaa

SEQ ID NO: 87396 - DNA, 22 bp, Artificial Sequence
  Synthetic oligonucleotide; TTT chr11 5242496 5242517 5242513 5242518 +
ttagagacttcgtccttttaaa

SEQ ID NO: 87397 - DNA, 22 bp, Artificial Sequence
  Synthetic oligonucleotide; TTT chr11 5242497 5242518 5242514 5242519 +
tagagacttcgtccttttaaaa

SEQ ID NO: 87398 - DNA, 22 bp, Artificial Sequence
  Synthetic oligonucleotide; TTT chr11 5242498 5242519 5242515 5242520 +
agagacttcgtccttttaaaaa

SEQ ID NO: 87399 - DNA, 22 bp, Artificial Sequence
  Synthetic oligonucleotide; TTA chr11 5242499 5242520 5242516 5242521 +
gagacttcgtccttttaaaaag

SEQ ID NO: 87400 - DNA, 22 bp, Artificial Sequence
  Synthetic oligonucleotide; CTT chr11 5242506 5242527 5242523 5242528 +
cgtccttttaaaaagtaggata

SEQ ID NO: 87401 - DNA, 22 bp, Artificial Sequence
  Synthetic oligonucleotide; TTC chr11 5242507 5242528 5242524 5242529 +
gtccttttaaaaagtaggataa

SEQ ID NO: 87402 - DNA, 22 bp, Artificial Sequence
  Synthetic oligonucleotide; CTT chr11 5242513 5242534 5242530 5242535 +
ttaaaaagtaggataatagtac

SEQ ID NO: 87403 - DNA, 22 bp, Artificial Sequence
  Synthetic oligonucleotide; TTT chr11 5242514 5242535 5242531 5242536 +
taaaaagtaggataatagtact

SEQ ID NO: 87404 - DNA, 22 bp, Artificial Sequence
  Synthetic oligonucleotide; TTT chr11 5242515 5242536 5242532 5242537 +
aaaaagtaggataatagtactt

SEQ ID NO: 87405 - DNA, 22 bp, Artificial Sequence
  Synthetic oligonucleotide; TTA chr11 5242516 5242537 5242533 5242538 +
aaaagtaggataatagtacttc

SEQ ID NO: 87406 - DNA, 22 bp, Artificial Sequence
  Synthetic oligonucleotide; CTT chr11 5242537 5242558 5242554 5242559 +
caaggaacagtaatggatagga

SEQ ID NO: 87407 - DNA, 22 bp, Artificial Sequence
  Synthetic oligonucleotide; TTC chr11 5242538 5242559 5242555 5242560 +
aaggaacagtaatggataggat

SEQ ID NO: 87408 - DNA, 22 bp, Artificial Sequence
  Synthetic oligonucleotide; TTT chr11 5242606 5242627 5242623 5242628 +
tcccaaacactcataacaaaga

SEQ ID NO: 87409 - DNA, 22 bp, Artificial Sequence
  Synthetic oligonucleotide; TTT chr11 5242607 5242628 5242624 5242629 +
cccaaacactcataacaaagaa

SEQ ID NO: 87410 - DNA, 22 bp, Artificial Sequence
  Synthetic oligonucleotide; TTC chr11 5242608 5242629 5242625 5242630 +
ccaaacactcataacaaagaat

SEQ ID NO: 87411 - DNA, 22 bp, Artificial Sequence
  Synthetic oligonucleotide; CTC chr11 5242618 5242639 5242635 5242640 +
ataacaaagaatcctgtaccat

SEQ ID NO: 87412 - DNA, 22 bp, Artificial Sequence
  Synthetic oligonucleotide; CTG chr11 5242634 5242655 5242651 5242656 +
taccatgcgtacaaaagtatac

SEQ ID NO: 87413 - DNA, 22 bp, Artificial Sequence
  Synthetic oligonucleotide; TTC chr11 5242667 5242688 5242684 5242689 +
ggagggaaacaatcctcttttt

SEQ ID NO: 87414 - DNA, 22 bp, Artificial Sequence
  Synthetic oligonucleotide; CTC chr11 5242684 5242705 5242701 5242706 +
tttttaacagcttcccactact

SEQ ID NO: 87415 - DNA, 22 bp, Artificial Sequence
  Synthetic oligonucleotide; CTT chr11 5242686 5242707 5242703 5242708 +
tttaacagcttcccactacttt

SEQ ID NO: 87416 - DNA, 22 bp, Artificial Sequence
  Synthetic oligonucleotide; TTT chr11 5242687 5242708 5242704 5242709 +
ttaacagcttcccactactttg

SEQ ID NO: 87417 - DNA, 22 bp, Artificial Sequence
  Synthetic oligonucleotide; TTT chr11 5242688 5242709 5242705 5242710 +
taacagcttcccactactttgt

SEQ ID NO: 87418 - DNA, 22 bp, Artificial Sequence
  Synthetic oligonucleotide; TTT chr11 5242689 5242710 5242706 5242711 +
aacagcttcccactactttgtt

SEQ ID NO: 87419 - DNA, 22 bp, Artificial Sequence
  Synthetic oligonucleotide; TTA chr11 5242690 5242711 5242707 5242712 +
acagcttcccactactttgttc

SEQ ID NO: 87420 - DNA, 22 bp, Artificial Sequence
  Synthetic oligonucleotide; CTT chr11 5242697 5242718 5242714 5242719 +
cccactactttgttcagttgat

SEQ ID NO: 87421 - DNA, 22 bp, Artificial Sequence
  Synthetic oligonucleotide; TTC chr11 5242698 5242719 5242715 5242720 +
ccactactttgttcagttgatc

SEQ ID NO: 87422 - DNA, 22 bp, Artificial Sequence
  Synthetic oligonucleotide; CTA chr11 5242704 5242725 5242721 5242726 +
ctttgttcagttgatctttttc

SEQ ID NO: 87423 - DNA, 22 bp, Artificial Sequence
  Synthetic oligonucleotide; CTT chr11 5242707 5242728 5242724 5242729 +
tgttcagttgatctttttctaa

SEQ ID NO: 87424 - DNA, 22 bp, Artificial Sequence
  Synthetic oligonucleotide; TTT chr11 5242708 5242729 5242725 5242730 +
gttcagttgatctttttctaac

SEQ ID NO: 87425 - DNA, 22 bp, Artificial Sequence
  Synthetic oligonucleotide; TTG chr11 5242709 5242730 5242726 5242731 +
ttcagttgatctttttctaacc

SEQ ID NO: 87426 - DNA, 22 bp, Artificial Sequence
  Synthetic oligonucleotide; TTC chr11 5242712 5242733 5242729 5242734 +
agttgatctttttctaacctcc

SEQ ID NO: 87427 - DNA, 22 bp, Artificial Sequence
  Synthetic oligonucleotide; TTG chr11 5242717 5242738 5242734 5242739 +
atctttttctaacctccaggac

SEQ ID NO: 87428 - DNA, 22 bp, Artificial Sequence
  Synthetic oligonucleotide; CTT chr11 5242722 5242743 5242739 5242744 +
tttctaacctccaggactatgc

SEQ ID NO: 87429 - DNA, 22 bp, Artificial Sequence
  Synthetic oligonucleotide; TTT chr11 5242723 5242744 5242740 5242745 +
ttctaacctccaggactatgca

SEQ ID NO: 87430 - DNA, 22 bp, Artificial Sequence
  Synthetic oligonucleotide; TTT chr11 5242724 5242745 5242741 5242746 +
tctaacctccaggactatgcag

SEQ ID NO: 87431 - DNA, 22 bp, Artificial Sequence
  Synthetic oligonucleotide; TTT chr11 5242725 5242746 5242742 5242747 +
ctaacctccaggactatgcaga

SEQ ID NO: 87432 - DNA, 22 bp, Artificial Sequence
  Synthetic oligonucleotide; TTC chr11 5242726 5242747 5242743 5242748 +
taacctccaggactatgcagaa

SEQ ID NO: 87433 - DNA, 22 bp, Artificial Sequence
  Synthetic oligonucleotide; CTA chr11 5242728 5242749 5242745 5242750 +
acctccaggactatgcagaaaa

SEQ ID NO: 87434 - DNA, 22 bp, Artificial Sequence
  Synthetic oligonucleotide; CTC chr11 5242733 5242754 5242750 5242755 +
caggactatgcagaaaagtgac

SEQ ID NO: 87435 - DNA, 22 bp, Artificial Sequence
  Synthetic oligonucleotide; CTA chr11 5242741 5242762 5242758 5242763 +
tgcagaaaagtgactattaatt

SEQ ID NO: 87436 - DNA, 22 bp, Artificial Sequence
  Synthetic oligonucleotide; CTA chr11 5242757 5242778 5242774 5242779 +
ttaatttttatagaaaatttcg

SEQ ID NO: 87437 - DNA, 22 bp, Artificial Sequence
  Synthetic oligonucleotide; TTA chr11 5242760 5242781 5242777 5242782 +
atttttatagaaaatttcgctg

SEQ ID NO: 87438 - DNA, 22 bp, Artificial Sequence
  Synthetic oligonucleotide; TTT chr11 5242764 5242785 5242781 5242786 +
ttatagaaaatttcgctgacca

SEQ ID NO: 87439 - DNA, 22 bp, Artificial Sequence
  Synthetic oligonucleotide; TTT chr11 5242765 5242786 5242782 5242787 +
tatagaaaatttcgctgaccaa

SEQ ID NO: 87440 - DNA, 22 bp, Artificial Sequence
  Synthetic oligonucleotide; TTT chr11 5242766 5242787 5242783 5242788 +
atagaaaatttcgctgaccaaa

SEQ ID NO: 87441 - DNA, 22 bp, Artificial Sequence
  Synthetic oligonucleotide; TTA chr11 5242767 5242788 5242784 5242789 +
tagaaaatttcgctgaccaaag

SEQ ID NO: 87442 - DNA, 22 bp, Artificial Sequence
  Synthetic oligonucleotide; TTT chr11 5242777 5242798 5242794 5242799 +
cgctgaccaaaggaaagatgtt

SEQ ID NO: 87443 - DNA, 22 bp, Artificial Sequence
  Synthetic oligonucleotide; TTC chr11 5242778 5242799 5242795 5242800 +
gctgaccaaaggaaagatgtta

SEQ ID NO: 87444 - DNA, 22 bp, Artificial Sequence
  Synthetic oligonucleotide; CTG chr11 5242782 5242803 5242799 5242804 +
accaaaggaaagatgttatttt

SEQ ID NO: 87445 - DNA, 22 bp, Artificial Sequence
  Synthetic oligonucleotide; TTA chr11 5242800 5242821 5242817 5242822 +
ttttctctatctcaacttctgt

SEQ ID NO: 87446 - DNA, 22 bp, Artificial Sequence
  Synthetic oligonucleotide; TTT chr11 5242803 5242824 5242820 5242825 +
tctctatctcaacttctgttcc

SEQ ID NO: 87447 - DNA, 22 bp, Artificial Sequence
  Synthetic oligonucleotide; TTT chr11 5242804 5242825 5242821 5242826 +
ctctatctcaacttctgttccc

SEQ ID NO: 87448 - DNA, 22 bp, Artificial Sequence
  Synthetic oligonucleotide; TTC chr11 5242805 5242826 5242822 5242827 +
tctatctcaacttctgttccct

SEQ ID NO: 87449 - DNA, 22 bp, Artificial Sequence
  Synthetic oligonucleotide; CTC chr11 5242807 5242828 5242824 5242829 +
tatctcaacttctgttccctca

SEQ ID NO: 87450 - DNA, 22 bp, Artificial Sequence
  Synthetic oligonucleotide; CTA chr11 5242809 5242830 5242826 5242831 +
tctcaacttctgttccctcatc

SEQ ID NO: 87451 - DNA, 22 bp, Artificial Sequence
  Synthetic oligonucleotide; CTC chr11 5242813 5242834 5242830 5242835 +
aacttctgttccctcatccaaa

SEQ ID NO: 87452 - DNA, 22 bp, Artificial Sequence
  Synthetic oligonucleotide; CTT chr11 5242818 5242839 5242835 5242840 +
ctgttccctcatccaaaaacac

SEQ ID NO: 87453 - DNA, 22 bp, Artificial Sequence
  Synthetic oligonucleotide; TTC chr11 5242819 5242840 5242836 5242841 +
tgttccctcatccaaaaacact

SEQ ID NO: 87454 - DNA, 22 bp, Artificial Sequence
  Synthetic oligonucleotide; CTG chr11 5242821 5242842 5242838 5242843 +
ttccctcatccaaaaacactca

SEQ ID NO: 87455 - DNA, 22 bp, Artificial Sequence
  Synthetic oligonucleotide; TTC chr11 5242824 5242845 5242841 5242846 +
cctcatccaaaaacactcagtt

SEQ ID NO: 87456 - DNA, 22 bp, Artificial Sequence
  Synthetic oligonucleotide; CTC chr11 5242828 5242849 5242845 5242850 +
atccaaaaacactcagtttgat

SEQ ID NO: 87457 - DNA, 22 bp, Artificial Sequence
  Synthetic oligonucleotide; CTC chr11 5242842 5242863 5242859 5242864 +
agtttgattttggccagaattt

SEQ ID NO: 87458 - DNA, 22 bp, Artificial Sequence
  Synthetic oligonucleotide; TTT chr11 5242847 5242868 5242864 5242869 +
gattttggccagaattttttat

SEQ ID NO: 87459 - DNA, 22 bp, Artificial Sequence
  Synthetic oligonucleotide; TTG chr11 5242848 5242869 5242865 5242870 +
attttggccagaattttttata

SEQ ID NO: 87460 - DNA, 22 bp, Artificial Sequence
  Synthetic oligonucleotide; TTT chr11 5242852 5242873 5242869 5242874 +
tggccagaattttttataagat

SEQ ID NO: 87461 - DNA, 22 bp, Artificial Sequence
  Synthetic oligonucleotide; TTT chr11 5242853 5242874 5242870 5242875 +
ggccagaattttttataagatg

SEQ ID NO: 87462 - DNA, 22 bp, Artificial Sequence
  Synthetic oligonucleotide; TTG chr11 5242854 5242875 5242871 5242876 +
gccagaattttttataagatgt

SEQ ID NO: 87463 - DNA, 22 bp, Artificial Sequence
  Synthetic oligonucleotide; TTT chr11 5242864 5242885 5242881 5242886 +
tttataagatgtgtttttcaga

SEQ ID NO: 87464 - DNA, 22 bp, Artificial Sequence
  Synthetic oligonucleotide; TTT chr11 5242865 5242886 5242882 5242887 +
ttataagatgtgtttttcagag

SEQ ID NO: 87465 - DNA, 22 bp, Artificial Sequence
  Synthetic oligonucleotide; TTT chr11 5242866 5242887 5242883 5242888 +
tataagatgtgtttttcagagc

SEQ ID NO: 87466 - DNA, 22 bp, Artificial Sequence
  Synthetic oligonucleotide; TTT chr11 5242867 5242888 5242884 5242889 +
ataagatgtgtttttcagagct

SEQ ID NO: 87467 - DNA, 22 bp, Artificial Sequence
  Synthetic oligonucleotide; TTA chr11 5242868 5242889 5242885 5242890 +
taagatgtgtttttcagagcta

SEQ ID NO: 87468 - DNA, 22 bp, Artificial Sequence
  Synthetic oligonucleotide; TTT chr11 5242880 5242901 5242897 5242902 +
ttcagagctatcaaatggtaag

SEQ ID NO: 87469 - DNA, 22 bp, Artificial Sequence
  Synthetic oligonucleotide; TTT chr11 5242881 5242902 5242898 5242903 +
tcagagctatcaaatggtaagt

SEQ ID NO: 87470 - DNA, 22 bp, Artificial Sequence
  Synthetic oligonucleotide; TTT chr11 5242882 5242903 5242899 5242904 +
cagagctatcaaatggtaagtg

SEQ ID NO: 87471 - DNA, 22 bp, Artificial Sequence
  Synthetic oligonucleotide; TTC chr11 5242883 5242904 5242900 5242905 +
agagctatcaaatggtaagtgg

SEQ ID NO: 87472 - DNA, 22 bp, Artificial Sequence
  Synthetic oligonucleotide; CTA chr11 5242890 5242911 5242907 5242912 +
tcaaatggtaagtggccttcca

SEQ ID NO: 87473 - DNA, 22 bp, Artificial Sequence
  Synthetic oligonucleotide; CTT chr11 5242909 5242930 5242926 5242931 +
ccattattcatagtccttgctc

SEQ ID NO: 87474 - DNA, 22 bp, Artificial Sequence
  Synthetic oligonucleotide; TTC chr11 5242910 5242931 5242927 5242932 +
cattattcatagtccttgctct

SEQ ID NO: 87475 - DNA, 22 bp, Artificial Sequence
  Synthetic oligonucleotide; TTA chr11 5242915 5242936 5242932 5242937 +
ttcatagtccttgctctaccaa

SEQ ID NO: 87476 - DNA, 22 bp, Artificial Sequence
  Synthetic oligonucleotide; TTC chr11 5242918 5242939 5242935 5242940 +
atagtccttgctctaccaaatt

SEQ ID NO: 87477 - DNA, 22 bp, Artificial Sequence
  Synthetic oligonucleotide; CTT chr11 5242927 5242948 5242944 5242949 +
gctctaccaaattttagttatg

SEQ ID NO: 87478 - DNA, 22 bp, Artificial Sequence
  Synthetic oligonucleotide; TTG chr11 5242928 5242949 5242945 5242950 +
ctctaccaaattttagttatgt

SEQ ID NO: 87479 - DNA, 22 bp, Artificial Sequence
  Synthetic oligonucleotide; CTC chr11 5242931 5242952 5242948 5242953 +
taccaaattttagttatgttat

SEQ ID NO: 87480 - DNA, 22 bp, Artificial Sequence
  Synthetic oligonucleotide; CTA chr11 5242933 5242954 5242950 5242955 +
ccaaattttagttatgttattt

SEQ ID NO: 87481 - DNA, 22 bp, Artificial Sequence
  Synthetic oligonucleotide; TTT chr11 5242941 5242962 5242958 5242963 +
tagttatgttatttacagcaac

SEQ ID NO: 87482 - DNA, 22 bp, Artificial Sequence
  Synthetic oligonucleotide; TTT chr11 5242942 5242963 5242959 5242964 +
agttatgttatttacagcaaca

SEQ ID NO: 87483 - DNA, 22 bp, Artificial Sequence
  Synthetic oligonucleotide; TTA chr11 5242943 5242964 5242960 5242965 +
gttatgttatttacagcaacat

SEQ ID NO: 87484 - DNA, 22 bp, Artificial Sequence
  Synthetic oligonucleotide; TTA chr11 5242947 5242968 5242964 5242969 +
tgttatttacagcaacataact

SEQ ID NO: 87485 - DNA, 22 bp, Artificial Sequence
  Synthetic oligonucleotide; TTA chr11 5242952 5242973 5242969 5242974 +
tttacagcaacataactctcaa

SEQ ID NO: 87486 - DNA, 22 bp, Artificial Sequence
  Synthetic oligonucleotide; TTT chr11 5242955 5242976 5242972 5242977 +
acagcaacataactctcaaaat

SEQ ID NO: 87487 - DNA, 22 bp, Artificial Sequence
  Synthetic oligonucleotide; TTA chr11 5242956 5242977 5242973 5242978 +
cagcaacataactctcaaaatc

SEQ ID NO: 87488 - DNA, 22 bp, Artificial Sequence
  Synthetic oligonucleotide; CTC chr11 5242970 5242991 5242987 5242992 +
tcaaaatcccactgctgaaata

SEQ ID NO: 87489 - DNA, 22 bp, Artificial Sequence
  Synthetic oligonucleotide; CTC chr11 5242972 5242993 5242989 5242994 +
aaaatcccactgctgaaatatc

SEQ ID NO: 87490 - DNA, 22 bp, Artificial Sequence
  Synthetic oligonucleotide; CTG chr11 5242984 5243005 5243001 5243006 +
ctgaaatatcatatcccatagc

SEQ ID NO: 87491 - DNA, 22 bp, Artificial Sequence
  Synthetic oligonucleotide; CTG chr11 5242987 5243008 5243004 5243009 +
aaatatcatatcccatagctga

SEQ ID NO: 87492 - DNA, 22 bp, Artificial Sequence
  Synthetic oligonucleotide; CTG chr11 5243008 5243029 5243025 5243030 +
actcataacacaagagaaagcc

SEQ ID NO: 87493 - DNA, 22 bp, Artificial Sequence
  Synthetic oligonucleotide; CTC chr11 5243012 5243033 5243029 5243034 +
ataacacaagagaaagccacct

SEQ ID NO: 87494 - DNA, 22 bp, Artificial Sequence
  Synthetic oligonucleotide; CTC chr11 5243035 5243056 5243052 5243057 +
tgctttcaaaagtacccatagt

SEQ ID NO: 87495 - DNA, 22 bp, Artificial Sequence
  Synthetic oligonucleotide; CTG chr11 5243037 5243058 5243054 5243059 +
ctttcaaaagtacccatagtgc

SEQ ID NO: 87496 - DNA, 22 bp, Artificial Sequence
  Synthetic oligonucleotide; CTT chr11 5243040 5243061 5243057 5243062 +
tcaaaagtacccatagtgcaaa

SEQ ID NO: 87497 - DNA, 22 bp, Artificial Sequence
  Synthetic oligonucleotide; TTT chr11 5243041 5243062 5243058 5243063 +
caaaagtacccatagtgcaaat

SEQ ID NO: 87498 - DNA, 22 bp, Artificial Sequence
  Synthetic oligonucleotide; TTC chr11 5243042 5243063 5243059 5243064 +
aaaagtacccatagtgcaaata

SEQ ID NO: 87499 - DNA, 22 bp, Artificial Sequence
  Synthetic oligonucleotide; CTA chr11 5243068 5243089 5243085 5243090 +
agggtaaagaagaaagcgtgag

SEQ ID NO: 87500 - DNA, 22 bp, Artificial Sequence
  Synthetic oligonucleotide; CTT chr11 5243097 5243118 5243114 5243119 +
actactcaccaggaagttctca

SEQ ID NO: 87501 - DNA, 22 bp, Artificial Sequence
  Synthetic oligonucleotide; TTA chr11 5243098 5243119 5243115 5243120 +
ctactcaccaggaagttctcag

SEQ ID NO: 87502 - DNA, 22 bp, Artificial Sequence
  Synthetic oligonucleotide; CTA chr11 5243101 5243122 5243118 5243123 +
ctcaccaggaagttctcagggt

SEQ ID NO: 87503 - DNA, 22 bp, Artificial Sequence
  Synthetic oligonucleotide; CTC chr11 5243104 5243125 5243121 5243126 +
accaggaagttctcagggtcca

SEQ ID NO: 87504 - DNA, 22 bp, Artificial Sequence
  Synthetic oligonucleotide; TTC chr11 5243116 5243137 5243133 5243138 +
tcagggtccacgtgcagcttgt

SEQ ID NO: 87505 - DNA, 22 bp, Artificial Sequence
  Synthetic oligonucleotide; CTC chr11 5243118 5243139 5243135 5243140 +
agggtccacgtgcagcttgtta

SEQ ID NO: 87506 - DNA, 22 bp, Artificial Sequence
  Synthetic oligonucleotide; CTT chr11 5243136 5243157 5243153 5243158 +
gttacagtgcaggtcactcagt

SEQ ID NO: 87507 - DNA, 22 bp, Artificial Sequence
  Synthetic oligonucleotide; TTG chr11 5243137 5243158 5243154 5243159 +
ttacagtgcaggtcactcagtg

SEQ ID NO: 87508 - DNA, 22 bp, Artificial Sequence
  Synthetic oligonucleotide; TTA chr11 5243140 5243161 5243157 5243162 +
cagtgcaggtcactcagtgtag

SEQ ID NO: 87509 - DNA, 22 bp, Artificial Sequence
  Synthetic oligonucleotide; CTC chr11 5243155 5243176 5243172 5243177 +
agtgtagcaaaggtgcctttga

SEQ ID NO: 87510 - DNA, 22 bp, Artificial Sequence
  Synthetic oligonucleotide; CTT chr11 5243174 5243195 5243191 5243196 +
tgaggtcatccgtgagcataac

SEQ ID NO: 87511 - DNA, 22 bp, Artificial Sequence
  Synthetic oligonucleotide; TTT chr11 5243175 5243196 5243192 5243197 +
gaggtcatccgtgagcataaca

SEQ ID NO: 87512 - DNA, 22 bp, Artificial Sequence
  Synthetic oligonucleotide; TTG chr11 5243176 5243197 5243193 5243198 +
aggtcatccgtgagcataacag

SEQ ID NO: 87513 - DNA, 22 bp, Artificial Sequence
  Synthetic oligonucleotide; CTT chr11 5243201 5243222 5243218 5243223 +
ttccgaaggagatcagcacctt

SEQ ID NO: 87514 - DNA, 22 bp, Artificial Sequence
  Synthetic oligonucleotide; TTT chr11 5243202 5243223 5243219 5243224 +
tccgaaggagatcagcaccttc

SEQ ID NO: 87515 - DNA, 22 bp, Artificial Sequence
  Synthetic oligonucleotide; TTT chr11 5243203 5243224 5243220 5243225 +
ccgaaggagatcagcaccttct

SEQ ID NO: 87516 - DNA, 22 bp, Artificial Sequence
  Synthetic oligonucleotide; TTC chr11 5243204 5243225 5243221 5243226 +
cgaaggagatcagcaccttctt

SEQ ID NO: 87517 - DNA, 22 bp, Artificial Sequence
  Synthetic oligonucleotide; CTT chr11 5243223 5243244 5243240 5243245 +
cttgccatgtgccttgactttg

SEQ ID NO: 87518 - DNA, 22 bp, Artificial Sequence
  Synthetic oligonucleotide; TTC chr11 5243224 5243245 5243241 5243246 +
ttgccatgtgccttgactttgg

SEQ ID NO: 87519 - DNA, 22 bp, Artificial Sequence
  Synthetic oligonucleotide; CTT chr11 5243226 5243247 5243243 5243248 +
gccatgtgccttgactttgggg

SEQ ID NO: 87520 - DNA, 22 bp, Artificial Sequence
  Synthetic oligonucleotide; TTG chr11 5243227 5243248 5243244 5243249 +
ccatgtgccttgactttggggt

SEQ ID NO: 87521 - DNA, 22 bp, Artificial Sequence
  Synthetic oligonucleotide; CTT chr11 5243238 5243259 5243255 5243260 +
gactttggggttgcccattatt

SEQ ID NO: 87522 - DNA, 22 bp, Artificial Sequence
  Synthetic oligonucleotide; TTG chr11 5243239 5243260 5243256 5243261 +
actttggggttgcccattattg

SEQ ID NO: 87523 - DNA, 22 bp, Artificial Sequence
  Synthetic oligonucleotide; CTT chr11 5243243 5243264 5243260 5243265 +
tggggttgcccattattgcaca

SEQ ID NO: 87524 - DNA, 22 bp, Artificial Sequence
  Synthetic oligonucleotide; TTT chr11 5243244 5243265 5243261 5243266 +
ggggttgcccattattgcacag

SEQ ID NO: 87525 - DNA, 22 bp, Artificial Sequence
  Synthetic oligonucleotide; TTG chr11 5243245 5243266 5243262 5243267 +
gggttgcccattattgcacagt

SEQ ID NO: 87526 - DNA, 22 bp, Artificial Sequence
  Synthetic oligonucleotide; TTG chr11 5243251 5243272 5243268 5243273 +
cccattattgcacagtcagagc

SEQ ID NO: 87527 - DNA, 22 bp, Artificial Sequence
  Synthetic oligonucleotide; TTA chr11 5243258 5243279 5243275 5243280 +
ttgcacagtcagagcccagata

SEQ ID NO: 87528 - DNA, 22 bp, Artificial Sequence
  Synthetic oligonucleotide; TTG chr11 5243261 5243282 5243278 5243283 +
cacagtcagagcccagatatcc

SEQ ID NO: 87529 - DNA, 22 bp, Artificial Sequence
  Synthetic oligonucleotide; CTT chr11 5243290 5243311 5243307 5243312 +
tcaaagtacctctaggtccatg

SEQ ID NO: 87530 - DNA, 22 bp, Artificial Sequence
  Synthetic oligonucleotide; TTT chr11 5243291 5243312 5243308 5243313 +
caaagtacctctaggtccatgg

SEQ ID NO: 87531 - DNA, 22 bp, Artificial Sequence
  Synthetic oligonucleotide; TTC chr11 5243292 5243313 5243309 5243314 +
aaagtacctctaggtccatggg

SEQ ID NO: 87532 - DNA, 22 bp, Artificial Sequence
  Synthetic oligonucleotide; CTC chr11 5243302 5243323 5243319 5243324 +
taggtccatgggtagacaacca

SEQ ID NO: 87533 - DNA, 22 bp, Artificial Sequence
  Synthetic oligonucleotide; CTA chr11 5243304 5243325 5243321 5243326 +
ggtccatgggtagacaaccagg

SEQ ID NO: 87534 - DNA, 22 bp, Artificial Sequence
  Synthetic oligonucleotide; CTG chr11 5243332 5243353 5243349 5243354 +
tgggatagtcataatcacagag

SEQ ID NO: 87535 - DNA, 22 bp, Artificial Sequence
  Synthetic oligonucleotide; CTA chr11 5243373 5243394 5243390 5243395 +
tgtaagacaacgggctaatccc

SEQ ID NO: 87536 - DNA, 22 bp, Artificial Sequence
  Synthetic oligonucleotide; CTA chr11 5243390 5243411 5243407 5243412 +
atccctctttcagaaacacttt

SEQ ID NO: 87537 - DNA, 22 bp, Artificial Sequence
  Synthetic oligonucleotide; CTC chr11 5243397 5243418 5243414 5243419 +
tttcagaaacactttctgcctt

SEQ ID NO: 87538 - DNA, 22 bp, Artificial Sequence
  Synthetic oligonucleotide; CTT chr11 5243399 5243420 5243416 5243421 +
tcagaaacactttctgcctttc

SEQ ID NO: 87539 - DNA, 22 bp, Artificial Sequence
  Synthetic oligonucleotide; TTT chr11 5243400 5243421 5243417 5243422 +
cagaaacactttctgcctttct

SEQ ID NO: 87540 - DNA, 22 bp, Artificial Sequence
  Synthetic oligonucleotide; TTC chr11 5243401 5243422 5243418 5243423 +
agaaacactttctgcctttctg

SEQ ID NO: 87541 - DNA, 22 bp, Artificial Sequence
  Synthetic oligonucleotide; CTT chr11 5243411 5243432 5243428 5243433 +
tctgcctttctgcaccttgtcc

SEQ ID NO: 87542 - DNA, 22 bp, Artificial Sequence
  Synthetic oligonucleotide; TTT chr11 5243412 5243433 5243429 5243434 +
ctgcctttctgcaccttgtccc

SEQ ID NO: 87543 - DNA, 22 bp, Artificial Sequence
  Synthetic oligonucleotide; TTC chr11 5243413 5243434 5243430 5243435 +
tgcctttctgcaccttgtcccg

SEQ ID NO: 87544 - DNA, 22 bp, Artificial Sequence
  Synthetic oligonucleotide; CTG chr11 5243415 5243436 5243432 5243437 +
cctttctgcaccttgtcccggc

SEQ ID NO: 87545 - DNA, 22 bp, Artificial Sequence
  Synthetic oligonucleotide; CTT chr11 5243419 5243440 5243436 5243441 +
tctgcaccttgtcccggcttcc

SEQ ID NO: 87546 - DNA, 22 bp, Artificial Sequence
  Synthetic oligonucleotide; TTT chr11 5243420 5243441 5243437 5243442 +
ctgcaccttgtcccggcttcca

SEQ ID NO: 87547 - DNA, 22 bp, Artificial Sequence
  Synthetic oligonucleotide; TTC chr11 5243421 5243442 5243438 5243443 +
tgcaccttgtcccggcttccag

SEQ ID NO: 87548 - DNA, 22 bp, Artificial Sequence
  Synthetic oligonucleotide; CTG chr11 5243423 5243444 5243440 5243445 +
caccttgtcccggcttccagta

SEQ ID NO: 87549 - DNA, 22 bp, Artificial Sequence
  Synthetic oligonucleotide; CTT chr11 5243429 5243450 5243446 5243451 +
gtcccggcttccagtacctacc

SEQ ID NO: 87550 - DNA, 22 bp, Artificial Sequence
  Synthetic oligonucleotide; TTG chr11 5243430 5243451 5243447 5243452 +
tcccggcttccagtacctacct

SEQ ID NO: 87551 - DNA, 22 bp, Artificial Sequence
  Synthetic oligonucleotide; CTT chr11 5243439 5243460 5243456 5243461 +
ccagtacctacctgcccagaat

SEQ ID NO: 87552 - DNA, 22 bp, Artificial Sequence
  Synthetic oligonucleotide; TTC chr11 5243440 5243461 5243457 5243462 +
cagtacctacctgcccagaatc

SEQ ID NO: 87553 - DNA, 22 bp, Artificial Sequence
  Synthetic oligonucleotide; CTA chr11 5243449 5243470 5243466 5243471 +
cctgcccagaatctcacctcca

SEQ ID NO: 87554 - DNA, 22 bp, Artificial Sequence
  Synthetic oligonucleotide; CTG chr11 5243453 5243474 5243470 5243475 +
cccagaatctcacctccagcct

SEQ ID NO: 87555 - DNA, 22 bp, Artificial Sequence
  Synthetic oligonucleotide; CTC chr11 5243464 5243485 5243481 5243486 +
acctccagccttctcaccttaa

SEQ ID NO: 87556 - DNA, 22 bp, Artificial Sequence
  Synthetic oligonucleotide; CTC chr11 5243469 5243490 5243486 5243491 +
cagccttctcaccttaaccttg

SEQ ID NO: 87557 - DNA, 22 bp, Artificial Sequence
  Synthetic oligonucleotide; CTT chr11 5243476 5243497 5243493 5243498 +
ctcaccttaaccttgcttcaca

SEQ ID NO: 87558 - DNA, 22 bp, Artificial Sequence
  Synthetic oligonucleotide; TTC chr11 5243477 5243498 5243494 5243499 +
tcaccttaaccttgcttcacag

SEQ ID NO: 87559 - DNA, 22 bp, Artificial Sequence
  Synthetic oligonucleotide; CTC chr11 5243479 5243500 5243496 5243501 +
accttaaccttgcttcacaggc

SEQ ID NO: 87560 - DNA, 22 bp, Artificial Sequence
  Synthetic oligonucleotide; CTT chr11 5243484 5243505 5243501 5243506 +
aaccttgcttcacaggctggtg

SEQ ID NO: 87561 - DNA, 22 bp, Artificial Sequence
  Synthetic oligonucleotide; TTA chr11 5243485 5243506 5243502 5243507 +
accttgcttcacaggctggtgg

SEQ ID NO: 87562 - DNA, 22 bp, Artificial Sequence
  Synthetic oligonucleotide; CTT chr11 5243490 5243511 5243507 5243512 +
gcttcacaggctggtggcagca

SEQ ID NO: 87563 - DNA, 22 bp, Artificial Sequence
  Synthetic oligonucleotide; TTG chr11 5243491 5243512 5243508 5243513 +
cttcacaggctggtggcagcag

SEQ ID NO: 87564 - DNA, 22 bp, Artificial Sequence
  Synthetic oligonucleotide; CTT chr11 5243494 5243515 5243511 5243516 +
cacaggctggtggcagcagcct

SEQ ID NO: 87565 - DNA, 22 bp, Artificial Sequence
  Synthetic oligonucleotide; TTC chr11 5243495 5243516 5243512 5243517 +
acaggctggtggcagcagcctt

SEQ ID NO: 87566 - DNA, 22 bp, Artificial Sequence
  Synthetic oligonucleotide; CTG chr11 5243503 5243524 5243520 5243525 +
gtggcagcagccttcttgtcag

SEQ ID NO: 87567 - DNA, 22 bp, Artificial Sequence
  Synthetic oligonucleotide; CTT chr11 5243517 5243538 5243534 5243539 +
cttgtcagcagtgaaatgcact

SEQ ID NO: 87568 - DNA, 22 bp, Artificial Sequence
  Synthetic oligonucleotide; TTC chr11 5243518 5243539 5243535 5243540 +
ttgtcagcagtgaaatgcacta

SEQ ID NO: 87569 - DNA, 22 bp, Artificial Sequence
  Synthetic oligonucleotide; CTT chr11 5243520 5243541 5243537 5243542 +
gtcagcagtgaaatgcactaca

SEQ ID NO: 87570 - DNA, 22 bp, Artificial Sequence
  Synthetic oligonucleotide; TTG chr11 5243521 5243542 5243538 5243543 +
tcagcagtgaaatgcactacag

SEQ ID NO: 87571 - DNA, 22 bp, Artificial Sequence
  Synthetic oligonucleotide; CTA chr11 5243540 5243561 5243557 5243562 +
cagtgtcagatctgggagtttc

SEQ ID NO: 87572 - DNA, 22 bp, Artificial Sequence
  Synthetic oligonucleotide; CTG chr11 5243554 5243575 5243571 5243576 +
ggagtttcctggtgatcacaga

SEQ ID NO: 87573 - DNA, 22 bp, Artificial Sequence
  Synthetic oligonucleotide; TTT chr11 5243561 5243582 5243578 5243583 +
cctggtgatcacagatgagcca

SEQ ID NO: 87574 - DNA, 22 bp, Artificial Sequence
  Synthetic oligonucleotide; TTC chr11 5243562 5243583 5243579 5243584 +
ctggtgatcacagatgagccag

SEQ ID NO: 87575 - DNA, 22 bp, Artificial Sequence
  Synthetic oligonucleotide; CTG chr11 5243565 5243586 5243582 5243587 +
gtgatcacagatgagccagaag

SEQ ID NO: 87576 - DNA, 22 bp, Artificial Sequence
  Synthetic oligonucleotide; CTG chr11 5243595 5243616 5243612 5243617 +
cattgctgcttcatgtgtggct

SEQ ID NO: 87577 - DNA, 22 bp, Artificial Sequence
  Synthetic oligonucleotide; TTG chr11 5243600 5243621 5243617 5243622 +
ctgcttcatgtgtggcttttta

SEQ ID NO: 87578 - DNA, 22 bp, Artificial Sequence
  Synthetic oligonucleotide; CTG chr11 5243603 5243624 5243620 5243625 +
cttcatgtgtggctttttactt

SEQ ID NO: 87579 - DNA, 22 bp, Artificial Sequence
  Synthetic oligonucleotide; CTT chr11 5243606 5243627 5243623 5243628 +
catgtgtggctttttacttctc

SEQ ID NO: 87580 - DNA, 22 bp, Artificial Sequence
  Synthetic oligonucleotide; TTC chr11 5243607 5243628 5243624 5243629 +
atgtgtggctttttacttctcc

SEQ ID NO: 87581 - DNA, 22 bp, Artificial Sequence
  Synthetic oligonucleotide; CTT chr11 5243618 5243639 5243635 5243640 +
tttacttctcctctctggcccc

SEQ ID NO: 87582 - DNA, 22 bp, Artificial Sequence
  Synthetic oligonucleotide; TTT chr11 5243619 5243640 5243636 5243641 +
ttacttctcctctctggccccc

SEQ ID NO: 87583 - DNA, 22 bp, Artificial Sequence
  Synthetic oligonucleotide; TTT chr11 5243620 5243641 5243637 5243642 +
tacttctcctctctggccccca

SEQ ID NO: 87584 - DNA, 22 bp, Artificial Sequence
  Synthetic oligonucleotide; TTT chr11 5243621 5243642 5243638 5243643 +
acttctcctctctggcccccag

SEQ ID NO: 87585 - DNA, 22 bp, Artificial Sequence
  Synthetic oligonucleotide; TTA chr11 5243622 5243643 5243639 5243644 +
cttctcctctctggcccccagc

SEQ ID NO: 87586 - DNA, 22 bp, Artificial Sequence
  Synthetic oligonucleotide; CTT chr11 5243625 5243646 5243642 5243647 +
ctcctctctggcccccagccct

SEQ ID NO: 87587 - DNA, 22 bp, Artificial Sequence
  Synthetic oligonucleotide; TTC chr11 5243626 5243647 5243643 5243648 +
tcctctctggcccccagccctt

SEQ ID NO: 87588 - DNA, 22 bp, Artificial Sequence
  Synthetic oligonucleotide; CTC chr11 5243628 5243649 5243645 5243650 +
ctctctggcccccagccctttg

SEQ ID NO: 87589 - DNA, 22 bp, Artificial Sequence
  Synthetic oligonucleotide; CTC chr11 5243631 5243652 5243648 5243653 +
tctggcccccagccctttgcct

SEQ ID NO: 87590 - DNA, 22 bp, Artificial Sequence
  Synthetic oligonucleotide; CTC chr11 5243633 5243654 5243650 5243655 +
tggcccccagccctttgcctct

SEQ ID NO: 87591 - DNA, 22 bp, Artificial Sequence
  Synthetic oligonucleotide; CTG chr11 5243635 5243656 5243652 5243657 +
gcccccagccctttgcctctcc

SEQ ID NO: 87592 - DNA, 22 bp, Artificial Sequence
  Synthetic oligonucleotide; CTT chr11 5243648 5243669 5243665 5243670 +
tgcctctcccagtgaaatgaat

SEQ ID NO: 87593 - DNA, 22 bp, Artificial Sequence
  Synthetic oligonucleotide; TTT chr11 5243649 5243670 5243666 5243671 +
gcctctcccagtgaaatgaatc

SEQ ID NO: 87594 - DNA, 22 bp, Artificial Sequence
  Synthetic oligonucleotide; TTG chr11 5243650 5243671 5243667 5243672 +
cctctcccagtgaaatgaatct

SEQ ID NO: 87595 - DNA, 22 bp, Artificial Sequence
  Synthetic oligonucleotide; CTC chr11 5243654 5243675 5243671 5243676 +
tcccagtgaaatgaatctattg

SEQ ID NO: 87596 - DNA, 22 bp, Artificial Sequence
  Synthetic oligonucleotide; CTC chr11 5243656 5243677 5243673 5243678 +
ccagtgaaatgaatctattgac

SEQ ID NO: 87597 - DNA, 22 bp, Artificial Sequence
  Synthetic oligonucleotide; CTA chr11 5243673 5243694 5243690 5243695 +
ttgaccagccctttgcctccct

SEQ ID NO: 87598 - DNA, 22 bp, Artificial Sequence
  Synthetic oligonucleotide; TTG chr11 5243676 5243697 5243693 5243698 +
accagccctttgcctccctcag

SEQ ID NO: 87599 - DNA, 22 bp, Artificial Sequence
  Synthetic oligonucleotide; CTT chr11 5243686 5243707 5243703 5243708 +
tgcctccctcagtaaaatgaat

SEQ ID NO: 87600 - DNA, 22 bp, Artificial Sequence
  Synthetic oligonucleotide; TTT chr11 5243687 5243708 5243704 5243709 +
gcctccctcagtaaaatgaatc

SEQ ID NO: 87601 - DNA, 22 bp, Artificial Sequence
  Synthetic oligonucleotide; TTG chr11 5243688 5243709 5243705 5243710 +
cctccctcagtaaaatgaatct

SEQ ID NO: 87602 - DNA, 22 bp, Artificial Sequence
  Synthetic oligonucleotide; CTC chr11 5243692 5243713 5243709 5243714 +
cctcagtaaaatgaatctattg

SEQ ID NO: 87603 - DNA, 22 bp, Artificial Sequence
  Synthetic oligonucleotide; CTC chr11 5243696 5243717 5243713 5243718 +
agtaaaatgaatctattggtca

SEQ ID NO: 87604 - DNA, 22 bp, Artificial Sequence
  Synthetic oligonucleotide; CTA chr11 5243711 5243732 5243728 5243733 +
ttggtcaagggtgggttgtgac

SEQ ID NO: 87605 - DNA, 22 bp, Artificial Sequence
  Synthetic oligonucleotide; TTG chr11 5243714 5243735 5243731 5243736 +
gtcaagggtgggttgtgactcc

SEQ ID NO: 87606 - DNA, 22 bp, Artificial Sequence
  Synthetic oligonucleotide; TTG chr11 5243729 5243750 5243746 5243751 +
tgactccaggggtggggtttgg

SEQ ID NO: 87607 - DNA, 22 bp, Artificial Sequence
  Synthetic oligonucleotide; CTC chr11 5243735 5243756 5243752 5243757 +
caggggtggggtttgggcaagg

SEQ ID NO: 87608 - DNA, 22 bp, Artificial Sequence
  Synthetic oligonucleotide; TTT chr11 5243749 5243770 5243766 5243771 +
gggcaaggaagttttgcaagat

SEQ ID NO: 87609 - DNA, 22 bp, Artificial Sequence
  Synthetic oligonucleotide; TTG chr11 5243750 5243771 5243767 5243772 +
ggcaaggaagttttgcaagatg

SEQ ID NO: 87610 - DNA, 22 bp, Artificial Sequence
  Synthetic oligonucleotide; TTT chr11 5243763 5243784 5243780 5243785 +
tgcaagatggacattcgagttt

SEQ ID NO: 87611 - DNA, 22 bp, Artificial Sequence
  Synthetic oligonucleotide; TTT chr11 5243764 5243785 5243781 5243786 +
gcaagatggacattcgagtttc

SEQ ID NO: 87612 - DNA, 22 bp, Artificial Sequence
  Synthetic oligonucleotide; TTG chr11 5243765 5243786 5243782 5243787 +
caagatggacattcgagtttct

SEQ ID NO: 87613 - DNA, 22 bp, Artificial Sequence
  Synthetic oligonucleotide; TTC chr11 5243779 5243800 5243796 5243801 +
gagtttctgatagaatccaggt

SEQ ID NO: 87614 - DNA, 22 bp, Artificial Sequence
  Synthetic oligonucleotide; TTT chr11 5243785 5243806 5243802 5243807 +
ctgatagaatccaggtggcctt

SEQ ID NO: 87615 - DNA, 22 bp, Artificial Sequence
  Synthetic oligonucleotide; TTC chr11 5243786 5243807 5243803 5243808 +
tgatagaatccaggtggccttc

SEQ ID NO: 87616 - DNA, 22 bp, Artificial Sequence
  Synthetic oligonucleotide; CTG chr11 5243788 5243809 5243805 5243810 +
atagaatccaggtggccttctc

SEQ ID NO: 87617 - DNA, 22 bp, Artificial Sequence
  Synthetic oligonucleotide; CTT chr11 5243807 5243828 5243824 5243829 +
ctcaggggaactttgctgttca

SEQ ID NO: 87618 - DNA, 22 bp, Artificial Sequence
  Synthetic oligonucleotide; TTC chr11 5243808 5243829 5243825 5243830 +
tcaggggaactttgctgttcag

SEQ ID NO: 87619 - DNA, 22 bp, Artificial Sequence
  Synthetic oligonucleotide; CTC chr11 5243810 5243831 5243827 5243832 +
aggggaactttgctgttcaggc

SEQ ID NO: 87620 - DNA, 22 bp, Artificial Sequence
  Synthetic oligonucleotide; CTT chr11 5243820 5243841 5243837 5243842 +
tgctgttcaggcttaatttgaa

SEQ ID NO: 87621 - DNA, 22 bp, Artificial Sequence
  Synthetic oligonucleotide; TTT chr11 5243821 5243842 5243838 5243843 +
gctgttcaggcttaatttgaaa

SEQ ID NO: 87622 - DNA, 22 bp, Artificial Sequence
  Synthetic oligonucleotide; TTG chr11 5243822 5243843 5243839 5243844 +
ctgttcaggcttaatttgaaac

SEQ ID NO: 87623 - DNA, 22 bp, Artificial Sequence
  Synthetic oligonucleotide; CTG chr11 5243825 5243846 5243842 5243847 +
ttcaggcttaatttgaaacttt

SEQ ID NO: 87624 - DNA, 22 bp, Artificial Sequence
  Synthetic oligonucleotide; TTC chr11 5243828 5243849 5243845 5243850 +
aggcttaatttgaaactttact

SEQ ID NO: 87625 - DNA, 22 bp, Artificial Sequence
  Synthetic oligonucleotide; CTT chr11 5243834 5243855 5243851 5243856 +
aatttgaaactttacttccttc

SEQ ID NO: 87626 - DNA, 22 bp, Artificial Sequence
  Synthetic oligonucleotide; TTA chr11 5243835 5243856 5243852 5243857 +
atttgaaactttacttccttcc

SEQ ID NO: 87627 - DNA, 22 bp, Artificial Sequence
  Synthetic oligonucleotide; TTT chr11 5243839 5243860 5243856 5243861 +
gaaactttacttccttcccctc

SEQ ID NO: 87628 - DNA, 22 bp, Artificial Sequence
  Synthetic oligonucleotide; TTG chr11 5243840 5243861 5243857 5243862 +
aaactttacttccttcccctcc

SEQ ID NO: 87629 - DNA, 22 bp, Artificial Sequence
  Synthetic oligonucleotide; CTT chr11 5243846 5243867 5243863 5243868 +
tacttccttcccctccattttc

SEQ ID NO: 87630 - DNA, 22 bp, Artificial Sequence
  Synthetic oligonucleotide; TTT chr11 5243847 5243868 5243864 5243869 +
acttccttcccctccattttcc

SEQ ID NO: 87631 - DNA, 22 bp, Artificial Sequence
  Synthetic oligonucleotide; TTA chr11 5243848 5243869 5243865 5243870 +
cttccttcccctccattttcct

SEQ ID NO: 87632 - DNA, 22 bp, Artificial Sequence
  Synthetic oligonucleotide; CTT chr11 5243851 5243872 5243868 5243873 +
ccttcccctccattttcctaca

SEQ ID NO: 87633 - DNA, 22 bp, Artificial Sequence
  Synthetic oligonucleotide; TTC chr11 5243852 5243873 5243869 5243874 +
cttcccctccattttcctacac

SEQ ID NO: 87634 - DNA, 22 bp, Artificial Sequence
  Synthetic oligonucleotide; CTT chr11 5243855 5243876 5243872 5243877 +
cccctccattttcctacactac

SEQ ID NO: 87635 - DNA, 22 bp, Artificial Sequence
  Synthetic oligonucleotide; TTC chr11 5243856 5243877 5243873 5243878 +
ccctccattttcctacactacc

SEQ ID NO: 87636 - DNA, 22 bp, Artificial Sequence
  Synthetic oligonucleotide; CTC chr11 5243861 5243882 5243878 5243883 +
cattttcctacactacccccac

SEQ ID NO: 87637 - DNA, 22 bp, Artificial Sequence
  Synthetic oligonucleotide; TTT chr11 5243866 5243887 5243883 5243888 +
tcctacactacccccaccatcc

SEQ ID NO: 87638 - DNA, 22 bp, Artificial Sequence
  Synthetic oligonucleotide; TTT chr11 5243867 5243888 5243884 5243889 +
cctacactacccccaccatcca

SEQ ID NO: 87639 - DNA, 22 bp, Artificial Sequence
  Synthetic oligonucleotide; TTC chr11 5243868 5243889 5243885 5243890 +
ctacactacccccaccatccag

SEQ ID NO: 87640 - DNA, 22 bp, Artificial Sequence
  Synthetic oligonucleotide; CTA chr11 5243871 5243892 5243888 5243893 +
cactacccccaccatccagtgt

SEQ ID NO: 87641 - DNA, 22 bp, Artificial Sequence
  Synthetic oligonucleotide; CTA chr11 5243876 5243897 5243893 5243898 +
cccccaccatccagtgtgcagt

SEQ ID NO: 87642 - DNA, 22 bp, Artificial Sequence
  Synthetic oligonucleotide; TTT chr11 5243900 5243921 5243917 5243922 +
atttctcaaggacttcgccagc

SEQ ID NO: 87643 - DNA, 22 bp, Artificial Sequence
  Synthetic oligonucleotide; TTA chr11 5243901 5243922 5243918 5243923 +
tttctcaaggacttcgccagca

SEQ ID NO: 87644 - DNA, 22 bp, Artificial Sequence
  Synthetic oligonucleotide; TTT chr11 5243904 5243925 5243921 5243926 +
ctcaaggacttcgccagcagcc

SEQ ID NO: 87645 - DNA, 22 bp, Artificial Sequence
  Synthetic oligonucleotide; TTC chr11 5243905 5243926 5243922 5243927 +
tcaaggacttcgccagcagccg

SEQ ID NO: 87646 - DNA, 22 bp, Artificial Sequence
  Synthetic oligonucleotide; CTC chr11 5243907 5243928 5243924 5243929 +
aaggacttcgccagcagccgct

SEQ ID NO: 87647 - DNA, 22 bp, Artificial Sequence
  Synthetic oligonucleotide; CTT chr11 5243915 5243936 5243932 5243937 +
cgccagcagccgctaataacct

SEQ ID NO: 87648 - DNA, 22 bp, Artificial Sequence
  Synthetic oligonucleotide; TTC chr11 5243916 5243937 5243933 5243938 +
gccagcagccgctaataacctg

SEQ ID NO: 87649 - DNA, 22 bp, Artificial Sequence
  Synthetic oligonucleotide; CTA chr11 5243930 5243951 5243947 5243952 +
ataacctgaatgctgacaaata

SEQ ID NO: 87650 - DNA, 22 bp, Artificial Sequence
  Synthetic oligonucleotide; CTG chr11 5243938 5243959 5243955 5243960 +
aatgctgacaaataggaataag

SEQ ID NO: 87651 - DNA, 22 bp, Artificial Sequence
  Synthetic oligonucleotide; CTG chr11 5243945 5243966 5243962 5243967 +
acaaataggaataagttacaac

SEQ ID NO: 87652 - DNA, 22 bp, Artificial Sequence
  Synthetic oligonucleotide; TTA chr11 5243963 5243984 5243980 5243985 +
caactgaaaaggataagaatta

SEQ ID NO: 87653 - DNA, 22 bp, Artificial Sequence
  Synthetic oligonucleotide; CTG chr11 5243969 5243990 5243986 5243991 +
aaaaggataagaattacgaata

SEQ ID NO: 87654 - DNA, 22 bp, Artificial Sequence
  Synthetic oligonucleotide; TTA chr11 5243985 5244006 5244002 5244007 +
cgaatatcttagccatcaattc

SEQ ID NO: 87655 - DNA, 22 bp, Artificial Sequence
  Synthetic oligonucleotide; CTT chr11 5243995 5244016 5244012 5244017 +
agccatcaattcctggatcagg

SEQ ID NO: 87656 - DNA, 22 bp, Artificial Sequence
  Synthetic oligonucleotide; TTA chr11 5243996 5244017 5244013 5244018 +
gccatcaattcctggatcagga

SEQ ID NO: 87657 - DNA, 22 bp, Artificial Sequence
  Synthetic oligonucleotide; TTC chr11 5244007 5244028 5244024 5244029 +
ctggatcaggagttgtgacaat

SEQ ID NO: 87658 - DNA, 22 bp, Artificial Sequence
  Synthetic oligonucleotide; CTG chr11 5244010 5244031 5244027 5244032 +
gatcaggagttgtgacaatgta

SEQ ID NO: 87659 - DNA, 22 bp, Artificial Sequence
  Synthetic oligonucleotide; TTG chr11 5244022 5244043 5244039 5244044 +
tgacaatgtaacaacgtgttat

SEQ ID NO: 87660 - DNA, 22 bp, Artificial Sequence
  Synthetic oligonucleotide; TTA chr11 5244043 5244064 5244060 5244065 +
tcctgttattcatccaggcttt

SEQ ID NO: 87661 - DNA, 22 bp, Artificial Sequence
  Synthetic oligonucleotide; CTG chr11 5244048 5244069 5244065 5244070 +
ttattcatccaggctttatgtg

SEQ ID NO: 87662 - DNA, 22 bp, Artificial Sequence
  Synthetic oligonucleotide; TTA chr11 5244051 5244072 5244068 5244073 +
ttcatccaggctttatgtggaa

SEQ ID NO: 87663 - DNA, 22 bp, Artificial Sequence
  Synthetic oligonucleotide; TTC chr11 5244054 5244075 5244071 5244076 +
atccaggctttatgtggaagaa

SEQ ID NO: 87664 - DNA, 22 bp, Artificial Sequence
  Synthetic oligonucleotide; CTT chr11 5244064 5244085 5244081 5244086 +
tatgtggaagaagccacagcct

SEQ ID NO: 87665 - DNA, 22 bp, Artificial Sequence
  Synthetic oligonucleotide; TTT chr11 5244065 5244086 5244082 5244087 +
atgtggaagaagccacagcctt

SEQ ID NO: 87666 - DNA, 22 bp, Artificial Sequence
  Synthetic oligonucleotide; TTA chr11 5244066 5244087 5244083 5244088 +
tgtggaagaagccacagccttt

SEQ ID NO: 87667 - DNA, 22 bp, Artificial Sequence
  Synthetic oligonucleotide; CTT chr11 5244087 5244108 5244104 5244109 +
tcttggttttcaattctcttga

SEQ ID NO: 87668 - DNA, 22 bp, Artificial Sequence
  Synthetic oligonucleotide; TTT chr11 5244088 5244109 5244105 5244110 +
cttggttttcaattctcttgag

SEQ ID NO: 87669 - DNA, 22 bp, Artificial Sequence
  Synthetic oligonucleotide; TTC chr11 5244089 5244110 5244106 5244111 +
ttggttttcaattctcttgaga

SEQ ID NO: 87670 - DNA, 22 bp, Artificial Sequence
  Synthetic oligonucleotide; CTT chr11 5244091 5244112 5244108 5244113 +
ggttttcaattctcttgagact

SEQ ID NO: 87671 - DNA, 22 bp, Artificial Sequence
  Synthetic oligonucleotide; TTG chr11 5244092 5244113 5244109 5244114 +
gttttcaattctcttgagacta

SEQ ID NO: 87672 - DNA, 22 bp, Artificial Sequence
  Synthetic oligonucleotide; TTT chr11 5244096 5244117 5244113 5244118 +
tcaattctcttgagactacatt

SEQ ID NO: 87673 - DNA, 22 bp, Artificial Sequence
  Synthetic oligonucleotide; TTT chr11 5244097 5244118 5244114 5244119 +
caattctcttgagactacattg

SEQ ID NO: 87674 - DNA, 22 bp, Artificial Sequence
  Synthetic oligonucleotide; TTC chr11 5244098 5244119 5244115 5244120 +
aattctcttgagactacattga

SEQ ID NO: 87675 - DNA, 22 bp, Artificial Sequence
  Synthetic oligonucleotide; TTC chr11 5244103 5244124 5244120 5244125 +
tcttgagactacattgaataca

SEQ ID NO: 87676 - DNA, 22 bp, Artificial Sequence
  Synthetic oligonucleotide; CTC chr11 5244105 5244126 5244122 5244127 +
ttgagactacattgaatacaca

SEQ ID NO: 87677 - DNA, 22 bp, Artificial Sequence
  Synthetic oligonucleotide; CTT chr11 5244107 5244128 5244124 5244129 +
gagactacattgaatacacaat

SEQ ID NO: 87678 - DNA, 22 bp, Artificial Sequence
  Synthetic oligonucleotide; TTG chr11 5244108 5244129 5244125 5244130 +
agactacattgaatacacaatt

SEQ ID NO: 87679 - DNA, 22 bp, Artificial Sequence
  Synthetic oligonucleotide; CTA chr11 5244114 5244135 5244131 5244136 +
cattgaatacacaatttcatca

SEQ ID NO: 87680 - DNA, 22 bp, Artificial Sequence
  Synthetic oligonucleotide; TTG chr11 5244119 5244140 5244136 5244141 +
aatacacaatttcatcagtttt

SEQ ID NO: 87681 - DNA, 22 bp, Artificial Sequence
  Synthetic oligonucleotide; TTT chr11 5244131 5244152 5244148 5244153 +
catcagtttttttttctttctt

SEQ ID NO: 87682 - DNA, 22 bp, Artificial Sequence
  Synthetic oligonucleotide; TTC chr11 5244132 5244153 5244149 5244154 +
atcagtttttttttctttcttt

SEQ ID NO: 87683 - DNA, 22 bp, Artificial Sequence
  Synthetic oligonucleotide; TTT chr11 5244140 5244161 5244157 5244162 +
ttttttctttctttctttcttt

SEQ ID NO: 87684 - DNA, 22 bp, Artificial Sequence
  Synthetic oligonucleotide; TTT chr11 5244141 5244162 5244158 5244163 +
tttttctttctttctttctttt

SEQ ID NO: 87685 - DNA, 22 bp, Artificial Sequence
  Synthetic oligonucleotide; TTT chr11 5244142 5244163 5244159 5244164 +
ttttctttctttctttcttttt

SEQ ID NO: 87686 - DNA, 22 bp, Artificial Sequence
  Synthetic oligonucleotide; TTT chr11 5244143 5244164 5244160 5244165 +
tttctttctttctttctttttc

SEQ ID NO: 87687 - DNA, 22 bp, Artificial Sequence
  Synthetic oligonucleotide; TTT chr11 5244144 5244165 5244161 5244166 +
ttctttctttctttctttttct

SEQ ID NO: 87688 - DNA, 22 bp, Artificial Sequence
  Synthetic oligonucleotide; TTT chr11 5244145 5244166 5244162 5244167 +
tctttctttctttctttttctt

SEQ ID NO: 87689 - DNA, 22 bp, Artificial Sequence
  Synthetic oligonucleotide; TTT chr11 5244146 5244167 5244163 5244168 +
ctttctttctttctttttcttt

SEQ ID NO: 87690 - DNA, 22 bp, Artificial Sequence
  Synthetic oligonucleotide; TTC chr11 5244147 5244168 5244164 5244169 +
tttctttctttctttttctttt

SEQ ID NO: 87691 - DNA, 22 bp, Artificial Sequence
  Synthetic oligonucleotide; CTT chr11 5244149 5244170 5244166 5244171 +
tctttctttctttttctttttt

SEQ ID NO: 87692 - DNA, 22 bp, Artificial Sequence
  Synthetic oligonucleotide; TTT chr11 5244150 5244171 5244167 5244172 +
ctttctttctttttcttttttt

SEQ ID NO: 87693 - DNA, 22 bp, Artificial Sequence
  Synthetic oligonucleotide; TTC chr11 5244151 5244172 5244168 5244173 +
tttctttctttttctttttttt

SEQ ID NO: 87694 - DNA, 22 bp, Artificial Sequence
  Synthetic oligonucleotide; CTT chr11 5244153 5244174 5244170 5244175 +
tctttctttttctttttttttt

SEQ ID NO: 87695 - DNA, 22 bp, Artificial Sequence
  Synthetic oligonucleotide; TTT chr11 5244154 5244175 5244171 5244176 +
ctttctttttcttttttttttt

SEQ ID NO: 87696 - DNA, 22 bp, Artificial Sequence
  Synthetic oligonucleotide; TTC chr11 5244155 5244176 5244172 5244177 +
tttctttttctttttttttttt

SEQ ID NO: 87697 - DNA, 22 bp, Artificial Sequence
  Synthetic oligonucleotide; CTT chr11 5244157 5244178 5244174 5244179 +
tctttttctttttttttttttt

SEQ ID NO: 87698 - DNA, 22 bp, Artificial Sequence
  Synthetic oligonucleotide; TTT chr11 5244158 5244179 5244175 5244180 +
ctttttcttttttttttttttt

SEQ ID NO: 87699 - DNA, 22 bp, Artificial Sequence
  Synthetic oligonucleotide; TTC chr11 5244159 5244180 5244176 5244181 +
tttttctttttttttttttttt

SEQ ID NO: 87700 - DNA, 22 bp, Artificial Sequence
  Synthetic oligonucleotide; CTT chr11 5244161 5244182 5244178 5244183 +
tttctttttttttttttttttt

SEQ ID NO: 87701 - DNA, 22 bp, Artificial Sequence
  Synthetic oligonucleotide; TTT chr11 5244162 5244183 5244179 5244184 +
ttcttttttttttttttttttt

SEQ ID NO: 87702 - DNA, 22 bp, Artificial Sequence
  Synthetic oligonucleotide; TTT chr11 5244163 5244184 5244180 5244185 +
tctttttttttttttttttttt

SEQ ID NO: 87703 - DNA, 22 bp, Artificial Sequence
  Synthetic oligonucleotide; TTT chr11 5244164 5244185 5244181 5244186 +
cttttttttttttttttttttg

SEQ ID NO: 87704 - DNA, 22 bp, Artificial Sequence
  Synthetic oligonucleotide; TTC chr11 5244165 5244186 5244182 5244187 +
ttttttttttttttttttttga

SEQ ID NO: 87705 - DNA, 22 bp, Artificial Sequence
  Synthetic oligonucleotide; CTT chr11 5244167 5244188 5244184 5244189 +
ttttttttttttttttttgaga

SEQ ID NO: 87706 - DNA, 22 bp, Artificial Sequence
  Synthetic oligonucleotide; TTT chr11 5244168 5244189 5244185 5244190 +
tttttttttttttttttgagat

SEQ ID NO: 87707 - DNA, 22 bp, Artificial Sequence
  Synthetic oligonucleotide; TTT chr11 5244169 5244190 5244186 5244191 +
ttttttttttttttttgagatg

SEQ ID NO: 87708 - DNA, 22 bp, Artificial Sequence
  Synthetic oligonucleotide; TTT chr11 5244170 5244191 5244187 5244192 +
tttttttttttttttgagatgg

SEQ ID NO: 87709 - DNA, 22 bp, Artificial Sequence
  Synthetic oligonucleotide; TTT chr11 5244171 5244192 5244188 5244193 +
ttttttttttttttgagatgga

SEQ ID NO: 87710 - DNA, 22 bp, Artificial Sequence
  Synthetic oligonucleotide; TTT chr11 5244172 5244193 5244189 5244194 +
tttttttttttttgagatggag

SEQ ID NO: 87711 - DNA, 22 bp, Artificial Sequence
  Synthetic oligonucleotide; TTT chr11 5244173 5244194 5244190 5244195 +
ttttttttttttgagatggagt

SEQ ID NO: 87712 - DNA, 22 bp, Artificial Sequence
  Synthetic oligonucleotide; TTT chr11 5244174 5244195 5244191 5244196 +
tttttttttttgagatggagtc

SEQ ID NO: 87713 - DNA, 22 bp, Artificial Sequence
  Synthetic oligonucleotide; TTT chr11 5244175 5244196 5244192 5244197 +
ttttttttttgagatggagtct

SEQ ID NO: 87714 - DNA, 22 bp, Artificial Sequence
  Synthetic oligonucleotide; TTT chr11 5244176 5244197 5244193 5244198 +
tttttttttgagatggagtctc

SEQ ID NO: 87715 - DNA, 22 bp, Artificial Sequence
  Synthetic oligonucleotide; TTT chr11 5244177 5244198 5244194 5244199 +
ttttttttgagatggagtctcg

SEQ ID NO: 87716 - DNA, 22 bp, Artificial Sequence
  Synthetic oligonucleotide; TTT chr11 5244178 5244199 5244195 5244200 +
tttttttgagatggagtctcgc

SEQ ID NO: 87717 - DNA, 22 bp, Artificial Sequence
  Synthetic oligonucleotide; TTT chr11 5244179 5244200 5244196 5244201 +
ttttttgagatggagtctcgct

SEQ ID NO: 87718 - DNA, 22 bp, Artificial Sequence
  Synthetic oligonucleotide; TTT chr11 5244180 5244201 5244197 5244202 +
tttttgagatggagtctcgctt

SEQ ID NO: 87719 - DNA, 22 bp, Artificial Sequence
  Synthetic oligonucleotide; TTT chr11 5244181 5244202 5244198 5244203 +
ttttgagatggagtctcgcttt

SEQ ID NO: 87720 - DNA, 22 bp, Artificial Sequence
  Synthetic oligonucleotide; TTT chr11 5244182 5244203 5244199 5244204 +
tttgagatggagtctcgctttg

SEQ ID NO: 87721 - DNA, 22 bp, Artificial Sequence
  Synthetic oligonucleotide; TTT chr11 5244183 5244204 5244200 5244205 +
ttgagatggagtctcgctttgt

SEQ ID NO: 87722 - DNA, 22 bp, Artificial Sequence
  Synthetic oligonucleotide; TTT chr11 5244184 5244205 5244201 5244206 +
tgagatggagtctcgctttgtc

SEQ ID NO: 87723 - DNA, 22 bp, Artificial Sequence
  Synthetic oligonucleotide; TTT chr11 5244185 5244206 5244202 5244207 +
gagatggagtctcgctttgtca

SEQ ID NO: 87724 - DNA, 22 bp, Artificial Sequence
  Synthetic oligonucleotide; TTG chr11 5244186 5244207 5244203 5244208 +
agatggagtctcgctttgtcac

SEQ ID NO: 87725 - DNA, 22 bp, Artificial Sequence
  Synthetic oligonucleotide; CTC chr11 5244198 5244219 5244215 5244220 +
gctttgtcacccaggctggagt

SEQ ID NO: 87726 - DNA, 22 bp, Artificial Sequence
  Synthetic oligonucleotide; CTT chr11 5244202 5244223 5244219 5244224 +
tgtcacccaggctggagtgtgc

SEQ ID NO: 87727 - DNA, 22 bp, Artificial Sequence
  Synthetic oligonucleotide; TTT chr11 5244203 5244224 5244220 5244225 +
gtcacccaggctggagtgtgca

SEQ ID NO: 87728 - DNA, 22 bp, Artificial Sequence
  Synthetic oligonucleotide; TTG chr11 5244204 5244225 5244221 5244226 +
tcacccaggctggagtgtgcag

SEQ ID NO: 87729 - DNA, 22 bp, Artificial Sequence
  Synthetic oligonucleotide; CTG chr11 5244216 5244237 5244233 5244238 +
gagtgtgcagtggcgcgatctc

SEQ ID NO: 87730 - DNA, 22 bp, Artificial Sequence
  Synthetic oligonucleotide; CTC chr11 5244238 5244259 5244255 5244260 +
tgctcaccgcaagctctgcctc

SEQ ID NO: 87731 - DNA, 22 bp, Artificial Sequence
  Synthetic oligonucleotide; CTG chr11 5244240 5244261 5244257 5244262 +
ctcaccgcaagctctgcctccc

SEQ ID NO: 87732 - DNA, 22 bp, Artificial Sequence
  Synthetic oligonucleotide; CTC chr11 5244243 5244264 5244260 5244265 +
accgcaagctctgcctcccagg

SEQ ID NO: 87733 - DNA, 22 bp, Artificial Sequence
  Synthetic oligonucleotide; CTC chr11 5244254 5244275 5244271 5244276 +
tgcctcccaggttcacgccatt

SEQ ID NO: 87734 - DNA, 22 bp, Artificial Sequence
  Synthetic oligonucleotide; CTG chr11 5244256 5244277 5244273 5244278 +
cctcccaggttcacgccattct

SEQ ID NO: 87735 - DNA, 22 bp, Artificial Sequence
  Synthetic oligonucleotide; CTC chr11 5244260 5244281 5244277 5244282 +
ccaggttcacgccattctcctg

SEQ ID NO: 87736 - DNA, 22 bp, Artificial Sequence
  Synthetic oligonucleotide; TTC chr11 5244268 5244289 5244285 5244290 +
acgccattctcctgcctcagcc

SEQ ID NO: 87737 - DNA, 22 bp, Artificial Sequence
  Synthetic oligonucleotide; TTC chr11 5244277 5244298 5244294 5244299 +
tcctgcctcagcctcccgagta

SEQ ID NO: 87738 - DNA, 22 bp, Artificial Sequence
  Synthetic oligonucleotide; CTC chr11 5244279 5244300 5244296 5244301 +
ctgcctcagcctcccgagtagc

SEQ ID NO: 87739 - DNA, 22 bp, Artificial Sequence
  Synthetic oligonucleotide; CTG chr11 5244282 5244303 5244299 5244304 +
cctcagcctcccgagtagctgg

SEQ ID NO: 87740 - DNA, 22 bp, Artificial Sequence
  Synthetic oligonucleotide; CTC chr11 5244286 5244307 5244303 5244308 +
agcctcccgagtagctgggact

SEQ ID NO: 87741 - DNA, 22 bp, Artificial Sequence
  Synthetic oligonucleotide; CTC chr11 5244292 5244313 5244309 5244314 +
ccgagtagctgggactacaggc

SEQ ID NO: 87742 - DNA, 22 bp, Artificial Sequence
  Synthetic oligonucleotide; CTG chr11 5244303 5244324 5244320 5244325 +
ggactacaggcacccgccactg

SEQ ID NO: 87743 - DNA, 22 bp, Artificial Sequence
  Synthetic oligonucleotide; CTA chr11 5244309 5244330 5244326 5244331 +
caggcacccgccactgtctctg

SEQ ID NO: 87744 - DNA, 22 bp, Artificial Sequence
  Synthetic oligonucleotide; CTG chr11 5244325 5244346 5244342 5244347 +
tctctggctaattttttgtatt

SEQ ID NO: 87745 - DNA, 22 bp, Artificial Sequence
  Synthetic oligonucleotide; CTC chr11 5244329 5244350 5244346 5244351 +
tggctaattttttgtattttta

SEQ ID NO: 87746 - DNA, 22 bp, Artificial Sequence
  Synthetic oligonucleotide; CTG chr11 5244331 5244352 5244348 5244353 +
gctaattttttgtatttttagt

SEQ ID NO: 87747 - DNA, 22 bp, Artificial Sequence
  Synthetic oligonucleotide; CTA chr11 5244335 5244356 5244352 5244357 +
attttttgtatttttagtagag

SEQ ID NO: 87748 - DNA, 22 bp, Artificial Sequence
  Synthetic oligonucleotide; TTT chr11 5244339 5244360 5244356 5244361 +
tttgtatttttagtagagatgg

SEQ ID NO: 87749 - DNA, 22 bp, Artificial Sequence
  Synthetic oligonucleotide; TTT chr11 5244340 5244361 5244357 5244362 +
ttgtatttttagtagagatggg

SEQ ID NO: 87750 - DNA, 22 bp, Artificial Sequence
  Synthetic oligonucleotide; TTT chr11 5244341 5244362 5244358 5244363 +
tgtatttttagtagagatgggg

SEQ ID NO: 87751 - DNA, 22 bp, Artificial Sequence
  Synthetic oligonucleotide; TTT chr11 5244342 5244363 5244359 5244364 +
gtatttttagtagagatggggt

SEQ ID NO: 87752 - DNA, 22 bp, Artificial Sequence
  Synthetic oligonucleotide; TTG chr11 5244343 5244364 5244360 5244365 +
tatttttagtagagatggggtt

SEQ ID NO: 87753 - DNA, 22 bp, Artificial Sequence
  Synthetic oligonucleotide; TTT chr11 5244348 5244369 5244365 5244370 +
ttagtagagatggggtttcacc

SEQ ID NO: 87754 - DNA, 22 bp, Artificial Sequence
  Synthetic oligonucleotide; TTT chr11 5244349 5244370 5244366 5244371 +
tagtagagatggggtttcacca

SEQ ID NO: 87755 - DNA, 22 bp, Artificial Sequence
  Synthetic oligonucleotide; TTT chr11 5244350 5244371 5244367 5244372 +
agtagagatggggtttcaccat

SEQ ID NO: 87756 - DNA, 22 bp, Artificial Sequence
  Synthetic oligonucleotide; TTA chr11 5244351 5244372 5244368 5244373 +
gtagagatggggtttcaccatg

SEQ ID NO: 87757 - DNA, 22 bp, Artificial Sequence
  Synthetic oligonucleotide; TTT chr11 5244366 5244387 5244383 5244388 +
caccatgttagccaggatggtc

SEQ ID NO: 87758 - DNA, 22 bp, Artificial Sequence
  Synthetic oligonucleotide; TTC chr11 5244367 5244388 5244384 5244389 +
accatgttagccaggatggtct

SEQ ID NO: 87759 - DNA, 22 bp, Artificial Sequence
  Synthetic oligonucleotide; TTA chr11 5244376 5244397 5244393 5244398 +
gccaggatggtcttgatctcct

SEQ ID NO: 87760 - DNA, 22 bp, Artificial Sequence
  Synthetic oligonucleotide; CTT chr11 5244390 5244411 5244407 5244412 +
gatctcctgacctcgtgatccg

SEQ ID NO: 87761 - DNA, 22 bp, Artificial Sequence
  Synthetic oligonucleotide; TTG chr11 5244391 5244412 5244408 5244413 +
atctcctgacctcgtgatccgc

SEQ ID NO: 87762 - DNA, 22 bp, Artificial Sequence
  Synthetic oligonucleotide; CTC chr11 5244396 5244417 5244413 5244418 +
ctgacctcgtgatccgcccacc

SEQ ID NO: 87763 - DNA, 22 bp, Artificial Sequence
  Synthetic oligonucleotide; CTG chr11 5244399 5244420 5244416 5244421 +
acctcgtgatccgcccacctca

SEQ ID NO: 87764 - DNA, 22 bp, Artificial Sequence
  Synthetic oligonucleotide; CTC chr11 5244404 5244425 5244421 5244426 +
gtgatccgcccacctcagcctc

SEQ ID NO: 87765 - DNA, 22 bp, Artificial Sequence
  Synthetic oligonucleotide; CTC chr11 5244420 5244441 5244437 5244442 +
agcctcccaaagtgctgggatt

SEQ ID NO: 87766 - DNA, 22 bp, Artificial Sequence
  Synthetic oligonucleotide; CTC chr11 5244426 5244447 5244443 5244448 +
ccaaagtgctgggattacaggt

SEQ ID NO: 87767 - DNA, 22 bp, Artificial Sequence
  Synthetic oligonucleotide; CTG chr11 5244437 5244458 5244454 5244459 +
ggattacaggtgtgagccaccg

SEQ ID NO: 87768 - DNA, 22 bp, Artificial Sequence
  Synthetic oligonucleotide; TTA chr11 5244443 5244464 5244460 5244465 +
caggtgtgagccaccgcgcccg

SEQ ID NO: 87769 - DNA, 22 bp, Artificial Sequence
  Synthetic oligonucleotide; TTT chr11 5244473 5244494 5244490 5244495 +
catcactttttagaatagaaat

SEQ ID NO: 87770 - DNA, 22 bp, Artificial Sequence
  Synthetic oligonucleotide; TTC chr11 5244474 5244495 5244491 5244496 +
atcactttttagaatagaaata

SEQ ID NO: 87771 - DNA, 22 bp, Artificial Sequence
  Synthetic oligonucleotide; CTT chr11 5244481 5244502 5244498 5244503 +
tttagaatagaaataaacacct

SEQ ID NO: 87772 - DNA, 22 bp, Artificial Sequence
  Synthetic oligonucleotide; TTT chr11 5244482 5244503 5244499 5244504 +
ttagaatagaaataaacacctc

SEQ ID NO: 87773 - DNA, 22 bp, Artificial Sequence
  Synthetic oligonucleotide; TTT chr11 5244483 5244504 5244500 5244505 +
tagaatagaaataaacacctct

SEQ ID NO: 87774 - DNA, 22 bp, Artificial Sequence
  Synthetic oligonucleotide; TTT chr11 5244484 5244505 5244501 5244506 +
agaatagaaataaacacctcta

SEQ ID NO: 87775 - DNA, 22 bp, Artificial Sequence
  Synthetic oligonucleotide; TTA chr11 5244485 5244506 5244502 5244507 +
gaatagaaataaacacctctat

SEQ ID NO: 87776 - DNA, 22 bp, Artificial Sequence
  Synthetic oligonucleotide; CTC chr11 5244504 5244525 5244521 5244526 +
tatccagcatcaacttggaaga

SEQ ID NO: 87777 - DNA, 22 bp, Artificial Sequence
  Synthetic oligonucleotide; CTA chr11 5244506 5244527 5244523 5244528 +
tccagcatcaacttggaagaaa

SEQ ID NO: 87778 - DNA, 22 bp, Artificial Sequence
  Synthetic oligonucleotide; CTT chr11 5244520 5244541 5244537 5244542 +
ggaagaaagcagaataagaaac

SEQ ID NO: 87779 - DNA, 22 bp, Artificial Sequence
  Synthetic oligonucleotide; TTG chr11 5244521 5244542 5244538 5244543 +
gaagaaagcagaataagaaaca

SEQ ID NO: 87780 - DNA, 22 bp, Artificial Sequence
  Synthetic oligonucleotide; CTA chr11 5244548 5244569 5244565 5244570 +
gggaagtaaggggaaaactggg

SEQ ID NO: 87781 - DNA, 22 bp, Artificial Sequence
  Synthetic oligonucleotide; CTG chr11 5244568 5244589 5244585 5244590 +
ggttttattactgtgtttttta

SEQ ID NO: 87782 - DNA, 22 bp, Artificial Sequence
  Synthetic oligonucleotide; TTT chr11 5244573 5244594 5244590 5244595 +
tattactgtgttttttaatcca

SEQ ID NO: 87783 - DNA, 22 bp, Artificial Sequence
  Synthetic oligonucleotide; TTT chr11 5244574 5244595 5244591 5244596 +
attactgtgttttttaatccat

SEQ ID NO: 87784 - DNA, 22 bp, Artificial Sequence
  Synthetic oligonucleotide; TTA chr11 5244575 5244596 5244592 5244597 +
ttactgtgttttttaatccatt

SEQ ID NO: 87785 - DNA, 22 bp, Artificial Sequence
  Synthetic oligonucleotide; TTA chr11 5244578 5244599 5244595 5244600 +
ctgtgttttttaatccatttag

SEQ ID NO: 87786 - DNA, 22 bp, Artificial Sequence
  Synthetic oligonucleotide; CTG chr11 5244581 5244602 5244598 5244603 +
tgttttttaatccatttagtag

SEQ ID NO: 87787 - DNA, 22 bp, Artificial Sequence
  Synthetic oligonucleotide; TTT chr11 5244586 5244607 5244603 5244608 +
tttaatccatttagtagtcagt

SEQ ID NO: 87788 - DNA, 22 bp, Artificial Sequence
  Synthetic oligonucleotide; TTT chr11 5244587 5244608 5244604 5244609 +
ttaatccatttagtagtcagtg

SEQ ID NO: 87789 - DNA, 22 bp, Artificial Sequence
  Synthetic oligonucleotide; TTT chr11 5244588 5244609 5244605 5244610 +
taatccatttagtagtcagtgt

SEQ ID NO: 87790 - DNA, 22 bp, Artificial Sequence
  Synthetic oligonucleotide; TTT chr11 5244589 5244610 5244606 5244611 +
aatccatttagtagtcagtgta

SEQ ID NO: 87791 - DNA, 22 bp, Artificial Sequence
  Synthetic oligonucleotide; TTA chr11 5244590 5244611 5244607 5244612 +
atccatttagtagtcagtgtac

SEQ ID NO: 87792 - DNA, 22 bp, Artificial Sequence
  Synthetic oligonucleotide; TTT chr11 5244598 5244619 5244615 5244620 +
agtagtcagtgtacttatctga

SEQ ID NO: 87793 - DNA, 22 bp, Artificial Sequence
  Synthetic oligonucleotide; TTA chr11 5244599 5244620 5244616 5244621 +
gtagtcagtgtacttatctgaa

SEQ ID NO: 87794 - DNA, 22 bp, Artificial Sequence
  Synthetic oligonucleotide; CTT chr11 5244614 5244635 5244631 5244636 +
atctgaacaaaggagatttcct

SEQ ID NO: 87795 - DNA, 22 bp, Artificial Sequence
  Synthetic oligonucleotide; TTA chr11 5244615 5244636 5244632 5244637 +
tctgaacaaaggagatttcctc

SEQ ID NO: 87796 - DNA, 22 bp, Artificial Sequence
  Synthetic oligonucleotide; CTG chr11 5244619 5244640 5244636 5244641 +
aacaaaggagatttcctctgaa

SEQ ID NO: 87797 - DNA, 22 bp, Artificial Sequence
  Synthetic oligonucleotide; TTT chr11 5244633 5244654 5244650 5244655 +
cctctgaatcattgaacaatag

SEQ ID NO: 87798 - DNA, 22 bp, Artificial Sequence
  Synthetic oligonucleotide; TTC chr11 5244634 5244655 5244651 5244656 +
ctctgaatcattgaacaatagt

SEQ ID NO: 87799 - DNA, 22 bp, Artificial Sequence
  Synthetic oligonucleotide; CTC chr11 5244637 5244658 5244654 5244659 +
tgaatcattgaacaatagtcca

SEQ ID NO: 87800 - DNA, 22 bp, Artificial Sequence
  Synthetic oligonucleotide; CTG chr11 5244639 5244660 5244656 5244661 +
aatcattgaacaatagtccatg

SEQ ID NO: 87801 - DNA, 22 bp, Artificial Sequence
  Synthetic oligonucleotide; TTG chr11 5244647 5244668 5244664 5244669 +
aacaatagtccatgtcaaatcc

SEQ ID NO: 87802 - DNA, 22 bp, Artificial Sequence
  Synthetic oligonucleotide; CTA chr11 5244671 5244692 5244688 5244693 +
catatctacaaaattatgccag

SEQ ID NO: 87803 - DNA, 22 bp, Artificial Sequence
  Synthetic oligonucleotide; CTA chr11 5244679 5244700 5244696 5244701 +
caaaattatgccagaacatcta

SEQ ID NO: 87804 - DNA, 22 bp, Artificial Sequence
  Synthetic oligonucleotide; TTA chr11 5244687 5244708 5244704 5244709 +
tgccagaacatctaatagtgtt

SEQ ID NO: 87805 - DNA, 22 bp, Artificial Sequence
  Synthetic oligonucleotide; CTA chr11 5244701 5244722 5244718 5244723 +
atagtgttgggggagaagtgtg

SEQ ID NO: 87806 - DNA, 22 bp, Artificial Sequence
  Synthetic oligonucleotide; TTG chr11 5244710 5244731 5244727 5244732 +
ggggagaagtgtgctgctctgt

SEQ ID NO: 87807 - DNA, 22 bp, Artificial Sequence
  Synthetic oligonucleotide; CTG chr11 5244726 5244747 5244743 5244748 +
ctctgttcaagcaagaggatag

SEQ ID NO: 87808 - DNA, 22 bp, Artificial Sequence
  Synthetic oligonucleotide; CTC chr11 5244729 5244750 5244746 5244751 +
tgttcaagcaagaggataggag

SEQ ID NO: 87809 - DNA, 22 bp, Artificial Sequence
  Synthetic oligonucleotide; CTG chr11 5244731 5244752 5244748 5244753 +
ttcaagcaagaggataggagat

SEQ ID NO: 87810 - DNA, 22 bp, Artificial Sequence
  Synthetic oligonucleotide; TTC chr11 5244734 5244755 5244751 5244756 +
aagcaagaggataggagattcc

SEQ ID NO: 87811 - DNA, 22 bp, Artificial Sequence
  Synthetic oligonucleotide; TTC chr11 5244755 5244776 5244772 5244777 +
cgtggcccgtgctgggcattag

SEQ ID NO: 87812 - DNA, 22 bp, Artificial Sequence
  Synthetic oligonucleotide; CTG chr11 5244769 5244790 5244786 5244791 +
ggcattaggtcatttgtgtctg

SEQ ID NO: 87813 - DNA, 22 bp, Artificial Sequence
  Synthetic oligonucleotide; TTA chr11 5244776 5244797 5244793 5244798 +
ggtcatttgtgtctggcacagg

SEQ ID NO: 87814 - DNA, 22 bp, Artificial Sequence
  Synthetic oligonucleotide; TTT chr11 5244784 5244805 5244801 5244806 +
gtgtctggcacaggcttgatct

SEQ ID NO: 87815 - DNA, 22 bp, Artificial Sequence
  Synthetic oligonucleotide; TTG chr11 5244785 5244806 5244802 5244807 +
tgtctggcacaggcttgatcta

SEQ ID NO: 87816 - DNA, 22 bp, Artificial Sequence
  Synthetic oligonucleotide; CTG chr11 5244791 5244812 5244808 5244813 +
gcacaggcttgatctatagtct

SEQ ID NO: 87817 - DNA, 22 bp, Artificial Sequence
  Synthetic oligonucleotide; CTT chr11 5244801 5244822 5244818 5244823 +
gatctatagtctaatgctgtgt

SEQ ID NO: 87818 - DNA, 22 bp, Artificial Sequence
  Synthetic oligonucleotide; TTG chr11 5244802 5244823 5244819 5244824 +
atctatagtctaatgctgtgtt

SEQ ID NO: 87819 - DNA, 22 bp, Artificial Sequence
  Synthetic oligonucleotide; CTA chr11 5244807 5244828 5244824 5244829 +
tagtctaatgctgtgtttaact

SEQ ID NO: 87820 - DNA, 22 bp, Artificial Sequence
  Synthetic oligonucleotide; CTA chr11 5244814 5244835 5244831 5244836 +
atgctgtgtttaacttgtcttt

SEQ ID NO: 87821 - DNA, 22 bp, Artificial Sequence
  Synthetic oligonucleotide; CTG chr11 5244820 5244841 5244837 5244842 +
tgtttaacttgtctttatatct

SEQ ID NO: 87822 - DNA, 22 bp, Artificial Sequence
  Synthetic oligonucleotide; TTT chr11 5244825 5244846 5244842 5244847 +
aacttgtctttatatctaatca

SEQ ID NO: 87823 - DNA, 22 bp, Artificial Sequence
  Synthetic oligonucleotide; TTA chr11 5244826 5244847 5244843 5244848 +
acttgtctttatatctaatcag

SEQ ID NO: 87824 - DNA, 22 bp, Artificial Sequence
  Synthetic oligonucleotide; CTT chr11 5244830 5244851 5244847 5244852 +
gtctttatatctaatcaggcaa

SEQ ID NO: 87825 - DNA, 22 bp, Artificial Sequence
  Synthetic oligonucleotide; TTG chr11 5244831 5244852 5244848 5244853 +
tctttatatctaatcaggcaaa

SEQ ID NO: 87826 - DNA, 22 bp, Artificial Sequence
  Synthetic oligonucleotide; CTT chr11 5244835 5244856 5244852 5244857 +
tatatctaatcaggcaaagaca

SEQ ID NO: 87827 - DNA, 22 bp, Artificial Sequence
  Synthetic oligonucleotide; TTT chr11 5244836 5244857 5244853 5244858 +
atatctaatcaggcaaagacat

SEQ ID NO: 87828 - DNA, 22 bp, Artificial Sequence
  Synthetic oligonucleotide; TTA chr11 5244837 5244858 5244854 5244859 +
tatctaatcaggcaaagacatt

SEQ ID NO: 87829 - DNA, 22 bp, Artificial Sequence
  Synthetic oligonucleotide; CTA chr11 5244843 5244864 5244860 5244865 +
atcaggcaaagacattcttcac

SEQ ID NO: 87830 - DNA, 22 bp, Artificial Sequence
  Synthetic oligonucleotide; TTC chr11 5244860 5244881 5244877 5244882 +
ttcactgacaatattccacagg

SEQ ID NO: 87831 - DNA, 22 bp, Artificial Sequence
  Synthetic oligonucleotide; CTT chr11 5244862 5244883 5244879 5244884 +
cactgacaatattccacaggct

SEQ ID NO: 87832 - DNA, 22 bp, Artificial Sequence
  Synthetic oligonucleotide; TTC chr11 5244863 5244884 5244880 5244885 +
actgacaatattccacaggctg

SEQ ID NO: 87833 - DNA, 22 bp, Artificial Sequence
  Synthetic oligonucleotide; CTG chr11 5244867 5244888 5244884 5244889 +
acaatattccacaggctgctgc

SEQ ID NO: 87834 - DNA, 22 bp, Artificial Sequence
  Synthetic oligonucleotide; TTC chr11 5244876 5244897 5244893 5244898 +
cacaggctgctgcacgtgtctc

SEQ ID NO: 87835 - DNA, 22 bp, Artificial Sequence
  Synthetic oligonucleotide; CTG chr11 5244885 5244906 5244902 5244907 +
ctgcacgtgtctcatgtgctgc

SEQ ID NO: 87836 - DNA, 22 bp, Artificial Sequence
  Synthetic oligonucleotide; CTG chr11 5244888 5244909 5244905 5244910 +
cacgtgtctcatgtgctgcacg

SEQ ID NO: 87837 - DNA, 22 bp, Artificial Sequence
  Synthetic oligonucleotide; CTC chr11 5244898 5244919 5244915 5244920 +
atgtgctgcacgtctcatgcgt

SEQ ID NO: 87838 - DNA, 22 bp, Artificial Sequence
  Synthetic oligonucleotide; CTG chr11 5244906 5244927 5244923 5244928 +
cacgtctcatgcgtctcaaaca

SEQ ID NO: 87839 - DNA, 22 bp, Artificial Sequence
  Synthetic oligonucleotide; CTC chr11 5244914 5244935 5244931 5244936 +
atgcgtctcaaacaagcaattt

SEQ ID NO: 87840 - DNA, 22 bp, Artificial Sequence
  Synthetic oligonucleotide; CTC chr11 5244923 5244944 5244940 5244945 +
aaacaagcaatttcaggaatag

SEQ ID NO: 87841 - DNA, 22 bp, Artificial Sequence
  Synthetic oligonucleotide; TTT chr11 5244936 5244957 5244953 5244958 +
caggaatagacagggcacactt

SEQ ID NO: 87842 - DNA, 22 bp, Artificial Sequence
  Synthetic oligonucleotide; TTC chr11 5244937 5244958 5244954 5244959 +
aggaatagacagggcacacttc

SEQ ID NO: 87843 - DNA, 22 bp, Artificial Sequence
  Synthetic oligonucleotide; CTT chr11 5244958 5244979 5244975 5244980 +
ccaccggcagagagaagaacag

SEQ ID NO: 87844 - DNA, 22 bp, Artificial Sequence
  Synthetic oligonucleotide; TTC chr11 5244959 5244980 5244976 5244981 +
caccggcagagagaagaacagt

SEQ ID NO: 87845 - DNA, 22 bp, Artificial Sequence
  Synthetic oligonucleotide; TTT chr11 5244983 5245004 5245000 5245005 +
attttatattcttaaggcttac

SEQ ID NO: 87846 - DNA, 22 bp, Artificial Sequence
  Synthetic oligonucleotide; TTA chr11 5244984 5245005 5245001 5245006 +
ttttatattcttaaggcttact

SEQ ID NO: 87847 - DNA, 22 bp, Artificial Sequence
  Synthetic oligonucleotide; TTT chr11 5244987 5245008 5245004 5245009 +
tatattcttaaggcttactgtc

SEQ ID NO: 87848 - DNA, 22 bp, Artificial Sequence
  Synthetic oligonucleotide; TTT chr11 5244988 5245009 5245005 5245010 +
atattcttaaggcttactgtcc

SEQ ID NO: 87849 - DNA, 22 bp, Artificial Sequence
  Synthetic oligonucleotide; TTA chr11 5244989 5245010 5245006 5245011 +
tattcttaaggcttactgtcct

SEQ ID NO: 87850 - DNA, 22 bp, Artificial Sequence
  Synthetic oligonucleotide; TTC chr11 5244994 5245015 5245011 5245016 +
ttaaggcttactgtcctcatac

SEQ ID NO: 87851 - DNA, 22 bp, Artificial Sequence
  Synthetic oligonucleotide; CTT chr11 5244996 5245017 5245013 5245018 +
aaggcttactgtcctcatactt

SEQ ID NO: 87852 - DNA, 22 bp, Artificial Sequence
  Synthetic oligonucleotide; TTA chr11 5244997 5245018 5245014 5245019 +
aggcttactgtcctcatactta

SEQ ID NO: 87853 - DNA, 22 bp, Artificial Sequence
  Synthetic oligonucleotide; CTT chr11 5245003 5245024 5245020 5245025 +
actgtcctcatacttagaggtt

SEQ ID NO: 87854 - DNA, 22 bp, Artificial Sequence
  Synthetic oligonucleotide; TTA chr11 5245004 5245025 5245021 5245026 +
ctgtcctcatacttagaggttc

SEQ ID NO: 87855 - DNA, 22 bp, Artificial Sequence
  Synthetic oligonucleotide; CTG chr11 5245007 5245028 5245024 5245029 +
tcctcatacttagaggttcagg

SEQ ID NO: 87856 - DNA, 22 bp, Artificial Sequence
  Synthetic oligonucleotide; CTC chr11 5245012 5245033 5245029 5245034 +
atacttagaggttcaggatgct

SEQ ID NO: 87857 - DNA, 22 bp, Artificial Sequence
  Synthetic oligonucleotide; CTT chr11 5245018 5245039 5245035 5245040 +
agaggttcaggatgctggtttg

SEQ ID NO: 87858 - DNA, 22 bp, Artificial Sequence
  Synthetic oligonucleotide; TTA chr11 5245019 5245040 5245036 5245041 +
gaggttcaggatgctggtttgt

SEQ ID NO: 87859 - DNA, 22 bp, Artificial Sequence
  Synthetic oligonucleotide; TTC chr11 5245026 5245047 5245043 5245048 +
aggatgctggtttgtgtgttac

SEQ ID NO: 87860 - DNA, 22 bp, Artificial Sequence
  Synthetic oligonucleotide; CTG chr11 5245035 5245056 5245052 5245057 +
gtttgtgtgttacccctgagat

SEQ ID NO: 87861 - DNA, 22 bp, Artificial Sequence
  Synthetic oligonucleotide; TTT chr11 5245039 5245060 5245056 5245061 +
gtgtgttacccctgagataaat

SEQ ID NO: 87862 - DNA, 22 bp, Artificial Sequence
  Synthetic oligonucleotide; TTG chr11 5245040 5245061 5245057 5245062 +
tgtgttacccctgagataaatc

SEQ ID NO: 87863 - DNA, 22 bp, Artificial Sequence
  Synthetic oligonucleotide; TTA chr11 5245047 5245068 5245064 5245069 +
cccctgagataaatccttacaa

SEQ ID NO: 87864 - DNA, 22 bp, Artificial Sequence
  Synthetic oligonucleotide; CTG chr11 5245053 5245074 5245070 5245075 +
agataaatccttacaagaaata

SEQ ID NO: 87865 - DNA, 22 bp, Artificial Sequence
  Synthetic oligonucleotide; CTT chr11 5245065 5245086 5245082 5245087 +
acaagaaataaagtttaggaaa

SEQ ID NO: 87866 - DNA, 22 bp, Artificial Sequence
  Synthetic oligonucleotide; TTA chr11 5245066 5245087 5245083 5245088 +
caagaaataaagtttaggaaat

SEQ ID NO: 87867 - DNA, 22 bp, Artificial Sequence
  Synthetic oligonucleotide; TTT chr11 5245081 5245102 5245098 5245103 +
aggaaatcacccccatgtgtat

SEQ ID NO: 87868 - DNA, 22 bp, Artificial Sequence
  Synthetic oligonucleotide; TTA chr11 5245082 5245103 5245099 5245104 +
ggaaatcacccccatgtgtatt

SEQ ID NO: 87869 - DNA, 22 bp, Artificial Sequence
  Synthetic oligonucleotide; TTT chr11 5245105 5245126 5245122 5245127 +
caaggagactctaaatttcaaa

SEQ ID NO: 87870 - DNA, 22 bp, Artificial Sequence
  Synthetic oligonucleotide; TTC chr11 5245106 5245127 5245123 5245128 +
aaggagactctaaatttcaaag

SEQ ID NO: 87871 - DNA, 22 bp, Artificial Sequence
  Synthetic oligonucleotide; CTC chr11 5245116 5245137 5245133 5245138 +
taaatttcaaagagttaaaccc

SEQ ID NO: 87872 - DNA, 22 bp, Artificial Sequence
  Synthetic oligonucleotide; CTA chr11 5245118 5245139 5245135 5245140 +
aatttcaaagagttaaacccaa

SEQ ID NO: 87873 - DNA, 22 bp, Artificial Sequence
  Synthetic oligonucleotide; TTT chr11 5245123 5245144 5245140 5245145 +
caaagagttaaacccaatatat

SEQ ID NO: 87874 - DNA, 22 bp, Artificial Sequence
  Synthetic oligonucleotide; TTC chr11 5245124 5245145 5245141 5245146 +
aaagagttaaacccaatatatt

SEQ ID NO: 87875 - DNA, 22 bp, Artificial Sequence
  Synthetic oligonucleotide; TTA chr11 5245133 5245154 5245150 5245155 +
aacccaatatattaaagctgaa

SEQ ID NO: 87876 - DNA, 22 bp, Artificial Sequence
  Synthetic oligonucleotide; TTA chr11 5245147 5245168 5245164 5245169 +
aagctgaatttctgatattaga

SEQ ID NO: 87877 - DNA, 22 bp, Artificial Sequence
  Synthetic oligonucleotide; CTG chr11 5245153 5245174 5245170 5245175 +
aatttctgatattagagacaca

SEQ ID NO: 87878 - DNA, 22 bp, Artificial Sequence
  Synthetic oligonucleotide; TTT chr11 5245158 5245179 5245175 5245180 +
ctgatattagagacacaatatt

SEQ ID NO: 87879 - DNA, 22 bp, Artificial Sequence
  Synthetic oligonucleotide; TTC chr11 5245159 5245180 5245176 5245181 +
tgatattagagacacaatattt

SEQ ID NO: 87880 - DNA, 22 bp, Artificial Sequence
  Synthetic oligonucleotide; CTG chr11 5245161 5245182 5245178 5245183 +
atattagagacacaatatttta

SEQ ID NO: 87881 - DNA, 22 bp, Artificial Sequence
  Synthetic oligonucleotide; TTA chr11 5245167 5245188 5245184 5245189 +
gagacacaatattttagtctac

SEQ ID NO: 87882 - DNA, 22 bp, Artificial Sequence
  Synthetic oligonucleotide; TTT chr11 5245181 5245202 5245198 5245203 +
tagtctacttgatatagttgag

SEQ ID NO: 87883 - DNA, 22 bp, Artificial Sequence
  Synthetic oligonucleotide; TTT chr11 5245182 5245203 5245199 5245204 +
agtctacttgatatagttgaga

SEQ ID NO: 87884 - DNA, 22 bp, Artificial Sequence
  Synthetic oligonucleotide; TTA chr11 5245183 5245204 5245200 5245205 +
gtctacttgatatagttgagag

SEQ ID NO: 87885 - DNA, 22 bp, Artificial Sequence
  Synthetic oligonucleotide; CTA chr11 5245188 5245209 5245205 5245210 +
cttgatatagttgagaggcagt

SEQ ID NO: 87886 - DNA, 22 bp, Artificial Sequence
  Synthetic oligonucleotide; CTT chr11 5245191 5245212 5245208 5245213 +
gatatagttgagaggcagttac

SEQ ID NO: 87887 - DNA, 22 bp, Artificial Sequence
  Synthetic oligonucleotide; TTG chr11 5245192 5245213 5245209 5245214 +
atatagttgagaggcagttacc

SEQ ID NO: 87888 - DNA, 22 bp, Artificial Sequence
  Synthetic oligonucleotide; TTG chr11 5245201 5245222 5245218 5245223 +
agaggcagttacctgttttact

SEQ ID NO: 87889 - DNA, 22 bp, Artificial Sequence
  Synthetic oligonucleotide; TTA chr11 5245212 5245233 5245229 5245234 +
cctgttttacttaggaacatgg

SEQ ID NO: 87890 - DNA, 22 bp, Artificial Sequence
  Synthetic oligonucleotide; CTG chr11 5245216 5245237 5245233 5245238 +
ttttacttaggaacatggggaa

SEQ ID NO: 87891 - DNA, 22 bp, Artificial Sequence
  Synthetic oligonucleotide; TTT chr11 5245219 5245240 5245236 5245241 +
tacttaggaacatggggaaagt

SEQ ID NO: 87892 - DNA, 22 bp, Artificial Sequence
  Synthetic oligonucleotide; TTT chr11 5245220 5245241 5245237 5245242 +
acttaggaacatggggaaagtt

SEQ ID NO: 87893 - DNA, 22 bp, Artificial Sequence
  Synthetic oligonucleotide; TTA chr11 5245221 5245242 5245238 5245243 +
cttaggaacatggggaaagttt

SEQ ID NO: 87894 - DNA, 22 bp, Artificial Sequence
  Synthetic oligonucleotide; CTT chr11 5245224 5245245 5245241 5245246 +
aggaacatggggaaagtttgta

SEQ ID NO: 87895 - DNA, 22 bp, Artificial Sequence
  Synthetic oligonucleotide; TTA chr11 5245225 5245246 5245242 5245247 +
ggaacatggggaaagtttgtag

SEQ ID NO: 87896 - DNA, 22 bp, Artificial Sequence
  Synthetic oligonucleotide; TTT chr11 5245243 5245264 5245260 5245265 +
gtagtgacaaacagtttgaggc

SEQ ID NO: 87897 - DNA, 22 bp, Artificial Sequence
  Synthetic oligonucleotide; TTG chr11 5245244 5245265 5245261 5245266 +
tagtgacaaacagtttgaggca

SEQ ID NO: 87898 - DNA, 22 bp, Artificial Sequence
  Synthetic oligonucleotide; TTT chr11 5245260 5245281 5245277 5245282 +
gaggcaaaaccaagattatctt

SEQ ID NO: 87899 - DNA, 22 bp, Artificial Sequence
  Synthetic oligonucleotide; TTG chr11 5245261 5245282 5245278 5245283 +
aggcaaaaccaagattatcttt

SEQ ID NO: 87900 - DNA, 22 bp, Artificial Sequence
  Synthetic oligonucleotide; TTA chr11 5245278 5245299 5245295 5245300 +
tctttaagagcagagatcgatg

SEQ ID NO: 87901 - DNA, 22 bp, Artificial Sequence
  Synthetic oligonucleotide; CTT chr11 5245282 5245303 5245299 5245304 +
taagagcagagatcgatgatat

SEQ ID NO: 87902 - DNA, 22 bp, Artificial Sequence
  Synthetic oligonucleotide; TTT chr11 5245283 5245304 5245300 5245305 +
aagagcagagatcgatgatatg

SEQ ID NO: 87903 - DNA, 22 bp, Artificial Sequence
  Synthetic oligonucleotide; TTA chr11 5245284 5245305 5245301 5245306 +
agagcagagatcgatgatatga

SEQ ID NO: 87904 - DNA, 22 bp, Artificial Sequence
  Synthetic oligonucleotide; CTT chr11 5245326 5245347 5245343 5245348 +
tgactatatgcaggaaacacat

SEQ ID NO: 87905 - DNA, 22 bp, Artificial Sequence
  Synthetic oligonucleotide; TTT chr11 5245327 5245348 5245344 5245349 +
gactatatgcaggaaacacatt

SEQ ID NO: 87906 - DNA, 22 bp, Artificial Sequence
  Synthetic oligonucleotide; TTG chr11 5245328 5245349 5245345 5245350 +
actatatgcaggaaacacattt

SEQ ID NO: 87907 - DNA, 22 bp, Artificial Sequence
  Synthetic oligonucleotide; CTA chr11 5245332 5245353 5245349 5245354 +
tatgcaggaaacacatttatat

SEQ ID NO: 87908 - DNA, 22 bp, Artificial Sequence
  Synthetic oligonucleotide; TTT chr11 5245350 5245371 5245367 5245372 +
atattgagttgtggggactggc

SEQ ID NO: 87909 - DNA, 22 bp, Artificial Sequence
  Synthetic oligonucleotide; TTA chr11 5245351 5245372 5245368 5245373 +
tattgagttgtggggactggcc

SEQ ID NO: 87910 - DNA, 22 bp, Artificial Sequence
  Synthetic oligonucleotide; TTG chr11 5245356 5245377 5245373 5245378 +
agttgtggggactggcctcaga

SEQ ID NO: 87911 - DNA, 22 bp, Artificial Sequence
  Synthetic oligonucleotide; TTG chr11 5245361 5245382 5245378 5245383 +
tggggactggcctcagaggaaa

SEQ ID NO: 87912 - DNA, 22 bp, Artificial Sequence
  Synthetic oligonucleotide; CTG chr11 5245370 5245391 5245387 5245392 +
gcctcagaggaaacttcaggtc

SEQ ID NO: 87913 - DNA, 22 bp, Artificial Sequence
  Synthetic oligonucleotide; CTC chr11 5245375 5245396 5245392 5245397 +
agaggaaacttcaggtcatgtc

SEQ ID NO: 87914 - DNA, 22 bp, Artificial Sequence
  Synthetic oligonucleotide; CTT chr11 5245386 5245407 5245403 5245408 +
caggtcatgtcctttaatggcc

SEQ ID NO: 87915 - DNA, 22 bp, Artificial Sequence
  Synthetic oligonucleotide; TTC chr11 5245387 5245408 5245404 5245409 +
aggtcatgtcctttaatggccc

SEQ ID NO: 87916 - DNA, 22 bp, Artificial Sequence
  Synthetic oligonucleotide; CTT chr11 5245400 5245421 5245417 5245422 +
taatggccctaaaactcattcc

SEQ ID NO: 87917 - DNA, 22 bp, Artificial Sequence
  Synthetic oligonucleotide; TTT chr11 5245401 5245422 5245418 5245423 +
aatggccctaaaactcattccc

SEQ ID NO: 87918 - DNA, 22 bp, Artificial Sequence
  Synthetic oligonucleotide; TTA chr11 5245402 5245423 5245419 5245424 +
atggccctaaaactcattccca

SEQ ID NO: 87919 - DNA, 22 bp, Artificial Sequence
  Synthetic oligonucleotide; CTA chr11 5245411 5245432 5245428 5245433 +
aaactcattcccaaaagaattt

SEQ ID NO: 87920 - DNA, 22 bp, Artificial Sequence
  Synthetic oligonucleotide; CTC chr11 5245417 5245438 5245434 5245439 +
attcccaaaagaatttctgttc

SEQ ID NO: 87921 - DNA, 22 bp, Artificial Sequence
  Synthetic oligonucleotide; TTC chr11 5245421 5245442 5245438 5245443 +
ccaaaagaatttctgttcattg

SEQ ID NO: 87922 - DNA, 22 bp, Artificial Sequence
  Synthetic oligonucleotide; TTT chr11 5245433 5245454 5245450 5245455 +
ctgttcattgccatacctcata

SEQ ID NO: 87923 - DNA, 22 bp, Artificial Sequence
  Synthetic oligonucleotide; TTC chr11 5245434 5245455 5245451 5245456 +
tgttcattgccatacctcatat

SEQ ID NO: 87924 - DNA, 22 bp, Artificial Sequence
  Synthetic oligonucleotide; CTG chr11 5245436 5245457 5245453 5245458 +
ttcattgccatacctcatatcc

SEQ ID NO: 87925 - DNA, 22 bp, Artificial Sequence
  Synthetic oligonucleotide; TTC chr11 5245439 5245460 5245456 5245461 +
attgccatacctcatatcctta

SEQ ID NO: 87926 - DNA, 22 bp, Artificial Sequence
  Synthetic oligonucleotide; TTG chr11 5245443 5245464 5245460 5245465 +
ccatacctcatatccttaggta

SEQ ID NO: 87927 - DNA, 22 bp, Artificial Sequence
  Synthetic oligonucleotide; CTC chr11 5245452 5245473 5245469 5245474 +
atatccttaggtacatacatct

SEQ ID NO: 87928 - DNA, 22 bp, Artificial Sequence
  Synthetic oligonucleotide; CTT chr11 5245460 5245481 5245477 5245482 +
aggtacatacatctaaaaccct

SEQ ID NO: 87929 - DNA, 22 bp, Artificial Sequence
  Synthetic oligonucleotide; TTA chr11 5245461 5245482 5245478 5245483 +
ggtacatacatctaaaaccctg

SEQ ID NO: 87930 - DNA, 22 bp, Artificial Sequence
  Synthetic oligonucleotide; CTA chr11 5245475 5245496 5245492 5245497 +
aaaccctgcgtaccagtgaaca

SEQ ID NO: 87931 - DNA, 22 bp, Artificial Sequence
  Synthetic oligonucleotide; CTG chr11 5245483 5245504 5245500 5245505 +
cgtaccagtgaacagctgcccc

SEQ ID NO: 87932 - DNA, 22 bp, Artificial Sequence
  Synthetic oligonucleotide; CTG chr11 5245501 5245522 5245518 5245523 +
ccccatctttccatcagccaac

SEQ ID NO: 87933 - DNA, 22 bp, Artificial Sequence
  Synthetic oligonucleotide; CTT chr11 5245510 5245531 5245527 5245532 +
tccatcagccaaccaggaattc

SEQ ID NO: 87934 - DNA, 22 bp, Artificial Sequence
  Synthetic oligonucleotide; TTT chr11 5245511 5245532 5245528 5245533 +
ccatcagccaaccaggaattca

SEQ ID NO: 87935 - DNA, 22 bp, Artificial Sequence
  Synthetic oligonucleotide; TTC chr11 5245512 5245533 5245529 5245534 +
catcagccaaccaggaattcag

SEQ ID NO: 87936 - DNA, 22 bp, Artificial Sequence
  Synthetic oligonucleotide; TTC chr11 5245532 5245553 5245549 5245554 +
agcagttactgctaacttccac

SEQ ID NO: 87937 - DNA, 22 bp, Artificial Sequence
  Synthetic oligonucleotide; TTA chr11 5245540 5245561 5245557 5245562 +
ctgctaacttccacttttctct

SEQ ID NO: 87938 - DNA, 22 bp, Artificial Sequence
  Synthetic oligonucleotide; CTG chr11 5245543 5245564 5245560 5245565 +
ctaacttccacttttctctcac

SEQ ID NO: 87939 - DNA, 22 bp, Artificial Sequence
  Synthetic oligonucleotide; CTA chr11 5245546 5245567 5245563 5245568 +
acttccacttttctctcacccg

SEQ ID NO: 87940 - DNA, 22 bp, Artificial Sequence
  Synthetic oligonucleotide; CTT chr11 5245550 5245571 5245567 5245572 +
ccacttttctctcacccgctcc

SEQ ID NO: 87941 - DNA, 22 bp, Artificial Sequence
  Synthetic oligonucleotide; TTC chr11 5245551 5245572 5245568 5245573 +
cacttttctctcacccgctcca

SEQ ID NO: 87942 - DNA, 22 bp, Artificial Sequence
  Synthetic oligonucleotide; CTT chr11 5245556 5245577 5245573 5245578 +
ttctctcacccgctccaggaaa

SEQ ID NO: 87943 - DNA, 22 bp, Artificial Sequence
  Synthetic oligonucleotide; TTT chr11 5245557 5245578 5245574 5245579 +
tctctcacccgctccaggaaaa

SEQ ID NO: 87944 - DNA, 22 bp, Artificial Sequence
  Synthetic oligonucleotide; TTT chr11 5245558 5245579 5245575 5245580 +
ctctcacccgctccaggaaaag

SEQ ID NO: 87945 - DNA, 22 bp, Artificial Sequence
  Synthetic oligonucleotide; TTC chr11 5245559 5245580 5245576 5245581 +
tctcacccgctccaggaaaagt

SEQ ID NO: 87946 - DNA, 22 bp, Artificial Sequence
  Synthetic oligonucleotide; CTC chr11 5245561 5245582 5245578 5245583 +
tcacccgctccaggaaaagtga

SEQ ID NO: 87947 - DNA, 22 bp, Artificial Sequence
  Synthetic oligonucleotide; CTC chr11 5245563 5245584 5245580 5245585 +
acccgctccaggaaaagtgacc

SEQ ID NO: 87948 - DNA, 22 bp, Artificial Sequence
  Synthetic oligonucleotide; CTC chr11 5245571 5245592 5245588 5245593 +
caggaaaagtgacctgcagtca

SEQ ID NO: 87949 - DNA, 22 bp, Artificial Sequence
  Synthetic oligonucleotide; CTG chr11 5245587 5245608 5245604 5245609 +
cagtcactttcctggaagtatt

SEQ ID NO: 87950 - DNA, 22 bp, Artificial Sequence
  Synthetic oligonucleotide; CTT chr11 5245596 5245617 5245613 5245618 +
tcctggaagtattgattctttc

SEQ ID NO: 87951 - DNA, 22 bp, Artificial Sequence
  Synthetic oligonucleotide; TTT chr11 5245597 5245618 5245614 5245619 +
cctggaagtattgattctttct

SEQ ID NO: 87952 - DNA, 22 bp, Artificial Sequence
  Synthetic oligonucleotide; TTC chr11 5245598 5245619 5245615 5245620 +
ctggaagtattgattctttctt

SEQ ID NO: 87953 - DNA, 22 bp, Artificial Sequence
  Synthetic oligonucleotide; CTG chr11 5245601 5245622 5245618 5245623 +
gaagtattgattctttcttgtt

SEQ ID NO: 87954 - DNA, 22 bp, Artificial Sequence
  Synthetic oligonucleotide; TTG chr11 5245610 5245631 5245627 5245632 +
attctttcttgtttgtggctgt

SEQ ID NO: 87955 - DNA, 22 bp, Artificial Sequence
  Synthetic oligonucleotide; TTC chr11 5245614 5245635 5245631 5245636 +
tttcttgtttgtggctgttccc

SEQ ID NO: 87956 - DNA, 22 bp, Artificial Sequence
  Synthetic oligonucleotide; CTT chr11 5245616 5245637 5245633 5245638 +
tcttgtttgtggctgttcccca

SEQ ID NO: 87957 - DNA, 22 bp, Artificial Sequence
  Synthetic oligonucleotide; TTT chr11 5245617 5245638 5245634 5245639 +
cttgtttgtggctgttccccat

SEQ ID NO: 87958 - DNA, 22 bp, Artificial Sequence
  Synthetic oligonucleotide; TTC chr11 5245618 5245639 5245635 5245640 +
ttgtttgtggctgttccccatt

SEQ ID NO: 87959 - DNA, 22 bp, Artificial Sequence
  Synthetic oligonucleotide; CTT chr11 5245620 5245641 5245637 5245642 +
gtttgtggctgttccccatttc

SEQ ID NO: 87960 - DNA, 22 bp, Artificial Sequence
  Synthetic oligonucleotide; TTG chr11 5245621 5245642 5245638 5245643 +
tttgtggctgttccccatttcc

SEQ ID NO: 87961 - DNA, 22 bp, Artificial Sequence
  Synthetic oligonucleotide; TTT chr11 5245624 5245645 5245641 5245646 +
gtggctgttccccatttccaat

SEQ ID NO: 87962 - DNA, 22 bp, Artificial Sequence
  Synthetic oligonucleotide; TTG chr11 5245625 5245646 5245642 5245647 +
tggctgttccccatttccaatt

SEQ ID NO: 87963 - DNA, 22 bp, Artificial Sequence
  Synthetic oligonucleotide; CTG chr11 5245631 5245652 5245648 5245653 +
ttccccatttccaattgttttc

SEQ ID NO: 87964 - DNA, 22 bp, Artificial Sequence
  Synthetic oligonucleotide; TTC chr11 5245634 5245655 5245651 5245656 +
cccatttccaattgttttccat

SEQ ID NO: 87965 - DNA, 22 bp, Artificial Sequence
  Synthetic oligonucleotide; TTT chr11 5245641 5245662 5245658 5245663 +
ccaattgttttccatgattatt

SEQ ID NO: 87966 - DNA, 22 bp, Artificial Sequence
  Synthetic oligonucleotide; TTC chr11 5245642 5245663 5245659 5245664 +
caattgttttccatgattattg

SEQ ID NO: 87967 - DNA, 22 bp, Artificial Sequence
  Synthetic oligonucleotide; TTG chr11 5245648 5245669 5245665 5245670 +
ttttccatgattattgcttcta

SEQ ID NO: 87968 - DNA, 22 bp, Artificial Sequence
  Synthetic oligonucleotide; TTT chr11 5245651 5245672 5245668 5245673 +
tccatgattattgcttctactg

SEQ ID NO: 87969 - DNA, 22 bp, Artificial Sequence
  Synthetic oligonucleotide; TTT chr11 5245652 5245673 5245669 5245674 +
ccatgattattgcttctactgt

SEQ ID NO: 87970 - DNA, 22 bp, Artificial Sequence
  Synthetic oligonucleotide; TTC chr11 5245653 5245674 5245670 5245675 +
catgattattgcttctactgtg

SEQ ID NO: 87971 - DNA, 22 bp, Artificial Sequence
  Synthetic oligonucleotide; TTA chr11 5245661 5245682 5245678 5245683 +
ttgcttctactgtgatctatag

SEQ ID NO: 87972 - DNA, 22 bp, Artificial Sequence
  Synthetic oligonucleotide; TTG chr11 5245664 5245685 5245681 5245686 +
cttctactgtgatctatagact

SEQ ID NO: 87973 - DNA, 22 bp, Artificial Sequence
  Synthetic oligonucleotide; CTT chr11 5245667 5245688 5245684 5245689 +
ctactgtgatctatagactctt

SEQ ID NO: 87974 - DNA, 22 bp, Artificial Sequence
  Synthetic oligonucleotide; TTC chr11 5245668 5245689 5245685 5245690 +
tactgtgatctatagactctta

SEQ ID NO: 87975 - DNA, 22 bp, Artificial Sequence
  Synthetic oligonucleotide; CTA chr11 5245670 5245691 5245687 5245692 +
ctgtgatctatagactcttata

SEQ ID NO: 87976 - DNA, 22 bp, Artificial Sequence
  Synthetic oligonucleotide; CTG chr11 5245673 5245694 5245690 5245695 +
tgatctatagactcttatatca

SEQ ID NO: 87977 - DNA, 22 bp, Artificial Sequence
  Synthetic oligonucleotide; CTA chr11 5245680 5245701 5245697 5245702 +
tagactcttatatcatcaatac

SEQ ID NO: 87978 - DNA, 22 bp, Artificial Sequence
  Synthetic oligonucleotide; CTC chr11 5245687 5245708 5245704 5245709 +
ttatatcatcaataccaggtta

SEQ ID NO: 87979 - DNA, 22 bp, Artificial Sequence
  Synthetic oligonucleotide; CTT chr11 5245689 5245710 5245706 5245711 +
atatcatcaataccaggttatc

SEQ ID NO: 87980 - DNA, 22 bp, Artificial Sequence
  Synthetic oligonucleotide; TTA chr11 5245690 5245711 5245707 5245712 +
tatcatcaataccaggttatca

SEQ ID NO: 87981 - DNA, 22 bp, Artificial Sequence
  Synthetic oligonucleotide; TTA chr11 5245709 5245730 5245726 5245731 +
tcattgcagttgtcaacttctc

SEQ ID NO: 87982 - DNA, 22 bp, Artificial Sequence
  Synthetic oligonucleotide; TTG chr11 5245715 5245736 5245732 5245737 +
cagttgtcaacttctctctgtt

SEQ ID NO: 87983 - DNA, 22 bp, Artificial Sequence
  Synthetic oligonucleotide; TTG chr11 5245721 5245742 5245738 5245743 +
tcaacttctctctgttgcatct

SEQ ID NO: 87984 - DNA, 22 bp, Artificial Sequence
  Synthetic oligonucleotide; CTT chr11 5245728 5245749 5245745 5245750 +
ctctctgttgcatcttatgcat

SEQ ID NO: 87985 - DNA, 22 bp, Artificial Sequence
  Synthetic oligonucleotide; TTC chr11 5245729 5245750 5245746 5245751 +
tctctgttgcatcttatgcatt

SEQ ID NO: 87986 - DNA, 22 bp, Artificial Sequence
  Synthetic oligonucleotide; CTC chr11 5245731 5245752 5245748 5245753 +
tctgttgcatcttatgcattaa

SEQ ID NO: 87987 - DNA, 22 bp, Artificial Sequence
  Synthetic oligonucleotide; CTC chr11 5245733 5245754 5245750 5245755 +
tgttgcatcttatgcattaatt

SEQ ID NO: 87988 - DNA, 22 bp, Artificial Sequence
  Synthetic oligonucleotide; CTG chr11 5245735 5245756 5245752 5245757 +
ttgcatcttatgcattaattca

SEQ ID NO: 87989 - DNA, 22 bp, Artificial Sequence
  Synthetic oligonucleotide; TTG chr11 5245738 5245759 5245755 5245760 +
catcttatgcattaattcaaca

SEQ ID NO: 87990 - DNA, 22 bp, Artificial Sequence
  Synthetic oligonucleotide; CTT chr11 5245744 5245765 5245761 5245766 +
atgcattaattcaacaaataca

SEQ ID NO: 87991 - DNA, 22 bp, Artificial Sequence
  Synthetic oligonucleotide; TTA chr11 5245745 5245766 5245762 5245767 +
tgcattaattcaacaaatacat

SEQ ID NO: 87992 - DNA, 22 bp, Artificial Sequence
  Synthetic oligonucleotide; TTA chr11 5245752 5245773 5245769 5245774 +
attcaacaaatacatattagat

SEQ ID NO: 87993 - DNA, 22 bp, Artificial Sequence
  Synthetic oligonucleotide; TTC chr11 5245756 5245777 5245773 5245778 +
aacaaatacatattagattcca

SEQ ID NO: 87994 - DNA, 22 bp, Artificial Sequence
  Synthetic oligonucleotide; TTA chr11 5245771 5245792 5245788 5245793 +
gattccatatgtcatccatgaa

SEQ ID NO: 87995 - DNA, 22 bp, Artificial Sequence
  Synthetic oligonucleotide; TTC chr11 5245776 5245797 5245793 5245798 +
catatgtcatccatgaagtttc

SEQ ID NO: 87996 - DNA, 22 bp, Artificial Sequence
  Synthetic oligonucleotide; TTT chr11 5245797 5245818 5245814 5245819 +
cattcatatgccatccattttt

SEQ ID NO: 87997 - DNA, 22 bp, Artificial Sequence
  Synthetic oligonucleotide; TTC chr11 5245798 5245819 5245815 5245820 +
attcatatgccatccatttttc

SEQ ID NO: 87998 - DNA, 22 bp, Artificial Sequence
  Synthetic oligonucleotide; TTC chr11 5245802 5245823 5245819 5245824 +
atatgccatccatttttcttaa

SEQ ID NO: 87999 - DNA, 22 bp, Artificial Sequence
  Synthetic oligonucleotide; TTT chr11 5245817 5245838 5245834 5245839 +
ttcttaattctgagaatcttac

SEQ ID NO: 88000 - DNA, 22 bp, Artificial Sequence
  Synthetic oligonucleotide; TTT chr11 5245818 5245839 5245835 5245840 +
tcttaattctgagaatcttaca

SEQ ID NO: 88001 - DNA, 22 bp, Artificial Sequence
  Synthetic oligonucleotide; TTT chr11 5245819 5245840 5245836 5245841 +
cttaattctgagaatcttacat

SEQ ID NO: 88002 - DNA, 22 bp, Artificial Sequence
  Synthetic oligonucleotide; TTC chr11 5245820 5245841 5245837 5245842 +
ttaattctgagaatcttacatg

SEQ ID NO: 88003 - DNA, 22 bp, Artificial Sequence
  Synthetic oligonucleotide; CTT chr11 5245822 5245843 5245839 5245844 +
aattctgagaatcttacatgaa

SEQ ID NO: 88004 - DNA, 22 bp, Artificial Sequence
  Synthetic oligonucleotide; TTA chr11 5245823 5245844 5245840 5245845 +
attctgagaatcttacatgaac

SEQ ID NO: 88005 - DNA, 22 bp, Artificial Sequence
  Synthetic oligonucleotide; TTC chr11 5245827 5245848 5245844 5245849 +
tgagaatcttacatgaactaga

SEQ ID NO: 88006 - DNA, 22 bp, Artificial Sequence
  Synthetic oligonucleotide; CTG chr11 5245829 5245850 5245846 5245851 +
agaatcttacatgaactagaca

SEQ ID NO: 88007 - DNA, 22 bp, Artificial Sequence
  Synthetic oligonucleotide; CTT chr11 5245837 5245858 5245854 5245859 +
acatgaactagacagacagatt

SEQ ID NO: 88008 - DNA, 22 bp, Artificial Sequence
  Synthetic oligonucleotide; TTA chr11 5245838 5245859 5245855 5245860 +
catgaactagacagacagattc

SEQ ID NO: 88009 - DNA, 22 bp, Artificial Sequence
  Synthetic oligonucleotide; CTA chr11 5245847 5245868 5245864 5245869 +
gacagacagattctctggctaa

SEQ ID NO: 88010 - DNA, 22 bp, Artificial Sequence
  Synthetic oligonucleotide; TTC chr11 5245860 5245881 5245877 5245882 +
tctggctaatggtgccctcact

SEQ ID NO: 88011 - DNA, 22 bp, Artificial Sequence
  Synthetic oligonucleotide; CTC chr11 5245862 5245883 5245879 5245884 +
tggctaatggtgccctcactat

SEQ ID NO: 88012 - DNA, 22 bp, Artificial Sequence
  Synthetic oligonucleotide; CTG chr11 5245864 5245885 5245881 5245886 +
gctaatggtgccctcactatag

SEQ ID NO: 88013 - DNA, 22 bp, Artificial Sequence
  Synthetic oligonucleotide; CTA chr11 5245868 5245889 5245885 5245890 +
atggtgccctcactatagtgag

SEQ ID NO: 88014 - DNA, 22 bp, Artificial Sequence
  Synthetic oligonucleotide; CTC chr11 5245879 5245900 5245896 5245901 +
actatagtgagcagaggagacc

SEQ ID NO: 88015 - DNA, 22 bp, Artificial Sequence
  Synthetic oligonucleotide; CTA chr11 5245883 5245904 5245900 5245905 +
tagtgagcagaggagaccagca

SEQ ID NO: 88016 - DNA, 22 bp, Artificial Sequence
  Synthetic oligonucleotide; CTA chr11 5245914 5245935 5245931 5245936 +
aaagaaatgaattaataagaga

SEQ ID NO: 88017 - DNA, 22 bp, Artificial Sequence
  Synthetic oligonucleotide; TTA chr11 5245928 5245949 5245945 5245950 +
ataagagatttcagatggtatt

SEQ ID NO: 88018 - DNA, 22 bp, Artificial Sequence
  Synthetic oligonucleotide; TTT chr11 5245939 5245960 5245956 5245961 +
cagatggtattatatgacttga

SEQ ID NO: 88019 - DNA, 22 bp, Artificial Sequence
  Synthetic oligonucleotide; TTC chr11 5245940 5245961 5245957 5245962 +
agatggtattatatgacttgaa

SEQ ID NO: 88020 - DNA, 22 bp, Artificial Sequence
  Synthetic oligonucleotide; TTA chr11 5245951 5245972 5245968 5245973 +
tatgacttgaagaaactgcata

SEQ ID NO: 88021 - DNA, 22 bp, Artificial Sequence
  Synthetic oligonucleotide; CTT chr11 5245959 5245980 5245976 5245981 +
gaagaaactgcatattgtacct

SEQ ID NO: 88022 - DNA, 22 bp, Artificial Sequence
  Synthetic oligonucleotide; TTG chr11 5245960 5245981 5245977 5245982 +
aagaaactgcatattgtaccta

SEQ ID NO: 88023 - DNA, 22 bp, Artificial Sequence
  Synthetic oligonucleotide; CTG chr11 5245969 5245990 5245986 5245991 +
catattgtacctacaaccatct

SEQ ID NO: 88024 - DNA, 22 bp, Artificial Sequence
  Synthetic oligonucleotide; TTG chr11 5245976 5245997 5245993 5245998 +
tacctacaaccatctggtcttt

SEQ ID NO: 88025 - DNA, 22 bp, Artificial Sequence
  Synthetic oligonucleotide; CTA chr11 5245982 5246003 5245999 5246004 +
caaccatctggtcttttagaaa

SEQ ID NO: 88026 - DNA, 22 bp, Artificial Sequence
  Synthetic oligonucleotide; CTG chr11 5245992 5246013 5246009 5246014 +
gtcttttagaaacctgacaaaa

SEQ ID NO: 88027 - DNA, 22 bp, Artificial Sequence
  Synthetic oligonucleotide; CTT chr11 5245997 5246018 5246014 5246019 +
ttagaaacctgacaaaagcaag

SEQ ID NO: 88028 - DNA, 22 bp, Artificial Sequence
  Synthetic oligonucleotide; TTT chr11 5245998 5246019 5246015 5246020 +
tagaaacctgacaaaagcaagc

SEQ ID NO: 88029 - DNA, 22 bp, Artificial Sequence
  Synthetic oligonucleotide; TTT chr11 5245999 5246020 5246016 5246021 +
agaaacctgacaaaagcaagca

SEQ ID NO: 88030 - DNA, 22 bp, Artificial Sequence
  Synthetic oligonucleotide; TTA chr11 5246000 5246021 5246017 5246022 +
gaaacctgacaaaagcaagcaa

SEQ ID NO: 88031 - DNA, 22 bp, Artificial Sequence
  Synthetic oligonucleotide; CTG chr11 5246008 5246029 5246025 5246030 +
acaaaagcaagcaatggggaaa

SEQ ID NO: 88032 - DNA, 22 bp, Artificial Sequence
  Synthetic oligonucleotide; TTT chr11 5246036 5246057 5246053 5246058 +
tcaatttaataaatgatggggg

SEQ ID NO: 88033 - DNA, 22 bp, Artificial Sequence
  Synthetic oligonucleotide; TTT chr11 5246037 5246058 5246054 5246059 +
caatttaataaatgatggggga

SEQ ID NO: 88034 - DNA, 22 bp, Artificial Sequence
  Synthetic oligonucleotide; TTC chr11 5246038 5246059 5246055 5246060 +
aatttaataaatgatgggggag

SEQ ID NO: 88035 - DNA, 22 bp, Artificial Sequence
  Synthetic oligonucleotide; TTT chr11 5246043 5246064 5246060 5246065 +
aataaatgatgggggagaactg

SEQ ID NO: 88036 - DNA, 22 bp, Artificial Sequence
  Synthetic oligonucleotide; TTA chr11 5246044 5246065 5246061 5246066 +
ataaatgatgggggagaactgg

SEQ ID NO: 88037 - DNA, 22 bp, Artificial Sequence
  Synthetic oligonucleotide; CTG chr11 5246065 5246086 5246082 5246087 +
gctagccatatgctgaaaaatg

SEQ ID NO: 88038 - DNA, 22 bp, Artificial Sequence
  Synthetic oligonucleotide; CTA chr11 5246069 5246090 5246086 5246091 +
gccatatgctgaaaaatgaaac

SEQ ID NO: 88039 - DNA, 22 bp, Artificial Sequence
  Synthetic oligonucleotide; CTG chr11 5246080 5246101 5246097 5246102 +
aaaaatgaaactggactccttc

SEQ ID NO: 88040 - DNA, 22 bp, Artificial Sequence
  Synthetic oligonucleotide; CTG chr11 5246093 5246114 5246110 5246115 +
gactccttccttataccttatc

SEQ ID NO: 88041 - DNA, 22 bp, Artificial Sequence
  Synthetic oligonucleotide; CTC chr11 5246098 5246119 5246115 5246120 +
cttccttataccttatccaaaa

SEQ ID NO: 88042 - DNA, 22 bp, Artificial Sequence
  Synthetic oligonucleotide; CTT chr11 5246101 5246122 5246118 5246123 +
ccttataccttatccaaaatta

SEQ ID NO: 88043 - DNA, 22 bp, Artificial Sequence
  Synthetic oligonucleotide; TTC chr11 5246102 5246123 5246119 5246124 +
cttataccttatccaaaattaa

SEQ ID NO: 88044 - DNA, 22 bp, Artificial Sequence
  Synthetic oligonucleotide; CTT chr11 5246105 5246126 5246122 5246127 +
ataccttatccaaaattaactc

SEQ ID NO: 88045 - DNA, 22 bp, Artificial Sequence
  Synthetic oligonucleotide; TTA chr11 5246106 5246127 5246123 5246128 +
taccttatccaaaattaactcc

SEQ ID NO: 88046 - DNA, 22 bp, Artificial Sequence
  Synthetic oligonucleotide; CTT chr11 5246112 5246133 5246129 5246134 +
atccaaaattaactccagatgg

SEQ ID NO: 88047 - DNA, 22 bp, Artificial Sequence
  Synthetic oligonucleotide; TTA chr11 5246113 5246134 5246130 5246135 +
tccaaaattaactccagatgga

SEQ ID NO: 88048 - DNA, 22 bp, Artificial Sequence
  Synthetic oligonucleotide; TTA chr11 5246123 5246144 5246140 5246145 +
actccagatggattagagactt

SEQ ID NO: 88049 - DNA, 22 bp, Artificial Sequence
  Synthetic oligonucleotide; CTC chr11 5246127 5246148 5246144 5246149 +
cagatggattagagacttaaat

SEQ ID NO: 88050 - DNA, 22 bp, Artificial Sequence
  Synthetic oligonucleotide; TTA chr11 5246138 5246159 5246155 5246160 +
gagacttaaatgaaaaacccca

SEQ ID NO: 88051 - DNA, 22 bp, Artificial Sequence
  Synthetic oligonucleotide; CTT chr11 5246145 5246166 5246162 5246167 +
aaatgaaaaaccccaaactata

SEQ ID NO: 88052 - DNA, 22 bp, Artificial Sequence
  Synthetic oligonucleotide; TTA chr11 5246146 5246167 5246163 5246168 +
aatgaaaaaccccaaactataa

SEQ ID NO: 88053 - DNA, 22 bp, Artificial Sequence
  Synthetic oligonucleotide; CTA chr11 5246165 5246186 5246182 5246187 +
taaaaagcctagaaaaaaatca

SEQ ID NO: 88054 - DNA, 22 bp, Artificial Sequence
  Synthetic oligonucleotide; CTA chr11 5246176 5246197 5246193 5246198 +
gaaaaaaatcaaggcaatacta

SEQ ID NO: 88055 - DNA, 22 bp, Artificial Sequence
  Synthetic oligonucleotide; CTA chr11 5246198 5246219 5246215 5246220 +
ttcatgatataaacacgggcac

SEQ ID NO: 88056 - DNA, 22 bp, Artificial Sequence
  Synthetic oligonucleotide; TTC chr11 5246201 5246222 5246218 5246223 +
atgatataaacacgggcacaga

SEQ ID NO: 88057 - DNA, 22 bp, Artificial Sequence
  Synthetic oligonucleotide; TTT chr11 5246226 5246247 5246243 5246248 +
catgatgaaagcgtgaaaagca

SEQ ID NO: 88058 - DNA, 22 bp, Artificial Sequence
  Synthetic oligonucleotide; TTC chr11 5246227 5246248 5246244 5246249 +
atgatgaaagcgtgaaaagcaa

SEQ ID NO: 88059 - DNA, 22 bp, Artificial Sequence
  Synthetic oligonucleotide; TTG chr11 5246252 5246273 5246269 5246274 +
cagcaaaagcaaaaattgacca

SEQ ID NO: 88060 - DNA, 22 bp, Artificial Sequence
  Synthetic oligonucleotide; TTG chr11 5246270 5246291 5246287 5246292 +
accaatggaatctaattaaact

SEQ ID NO: 88061 - DNA, 22 bp, Artificial Sequence
  Synthetic oligonucleotide; CTA chr11 5246284 5246305 5246301 5246306 +
attaaactaaagagctcctgct

SEQ ID NO: 88062 - DNA, 22 bp, Artificial Sequence
  Synthetic oligonucleotide; TTA chr11 5246288 5246309 5246305 5246310 +
aactaaagagctcctgctcagc

SEQ ID NO: 88063 - DNA, 22 bp, Artificial Sequence
  Synthetic oligonucleotide; CTA chr11 5246293 5246314 5246310 5246315 +
aagagctcctgctcagcaaaag

SEQ ID NO: 88064 - DNA, 22 bp, Artificial Sequence
  Synthetic oligonucleotide; CTC chr11 5246301 5246322 5246318 5246323 +
ctgctcagcaaaagaaactacc

SEQ ID NO: 88065 - DNA, 22 bp, Artificial Sequence
  Synthetic oligonucleotide; CTG chr11 5246304 5246325 5246321 5246326 +
ctcagcaaaagaaactaccatc

SEQ ID NO: 88066 - DNA, 22 bp, Artificial Sequence
  Synthetic oligonucleotide; CTC chr11 5246307 5246328 5246324 5246329 +
agcaaaagaaactaccatcaga

SEQ ID NO: 88067 - DNA, 22 bp, Artificial Sequence
  Synthetic oligonucleotide; CTA chr11 5246321 5246342 5246338 5246343 +
ccatcagagcgaaagacaatct

SEQ ID NO: 88068 - DNA, 22 bp, Artificial Sequence
  Synthetic oligonucleotide; CTA chr11 5246344 5246365 5246361 5246366 +
cagaatgggaaaaagattttcc

SEQ ID NO: 88069 - DNA, 22 bp, Artificial Sequence
  Synthetic oligonucleotide; TTT chr11 5246363 5246384 5246380 5246385 +
tccaatctattcttctgacaaa

SEQ ID NO: 88070 - DNA, 22 bp, Artificial Sequence
  Synthetic oligonucleotide; TTT chr11 5246364 5246385 5246381 5246386 +
ccaatctattcttctgacaaag

SEQ ID NO: 88071 - DNA, 22 bp, Artificial Sequence
  Synthetic oligonucleotide; TTC chr11 5246365 5246386 5246382 5246387 +
caatctattcttctgacaaagg

SEQ ID NO: 88072 - DNA, 22 bp, Artificial Sequence
  Synthetic oligonucleotide; CTA chr11 5246372 5246393 5246389 5246394 +
ttcttctgacaaaggcctaata

SEQ ID NO: 88073 - DNA, 22 bp, Artificial Sequence
  Synthetic oligonucleotide; TTC chr11 5246375 5246396 5246392 5246397 +
ttctgacaaaggcctaatatcc

SEQ ID NO: 88074 - DNA, 22 bp, Artificial Sequence
  Synthetic oligonucleotide; CTT chr11 5246377 5246398 5246394 5246399 +
ctgacaaaggcctaatatccag

SEQ ID NO: 88075 - DNA, 22 bp, Artificial Sequence
  Synthetic oligonucleotide; TTC chr11 5246378 5246399 5246395 5246400 +
tgacaaaggcctaatatccaga

SEQ ID NO: 88076 - DNA, 22 bp, Artificial Sequence
  Synthetic oligonucleotide; CTG chr11 5246380 5246401 5246397 5246402 +
acaaaggcctaatatccagagt

SEQ ID NO: 88077 - DNA, 22 bp, Artificial Sequence
  Synthetic oligonucleotide; CTA chr11 5246391 5246412 5246408 5246413 +
atatccagagtaaacaagaaac

SEQ ID NO: 88078 - DNA, 22 bp, Artificial Sequence
  Synthetic oligonucleotide; CTT chr11 5246415 5246436 5246432 5246437 +
aaacaactttacaagaaaaaaa

SEQ ID NO: 88079 - DNA, 22 bp, Artificial Sequence
  Synthetic oligonucleotide; TTA chr11 5246416 5246437 5246433 5246438 +
aacaactttacaagaaaaaaaa

SEQ ID NO: 88080 - DNA, 22 bp, Artificial Sequence
  Synthetic oligonucleotide; CTT chr11 5246424 5246445 5246441 5246446 +
tacaagaaaaaaaaaacccatt

SEQ ID NO: 88081 - DNA, 22 bp, Artificial Sequence
  Synthetic oligonucleotide; TTT chr11 5246425 5246446 5246442 5246447 +
acaagaaaaaaaaaacccatta

SEQ ID NO: 88082 - DNA, 22 bp, Artificial Sequence
  Synthetic oligonucleotide; TTA chr11 5246426 5246447 5246443 5246448 +
caagaaaaaaaaaacccattaa

SEQ ID NO: 88083 - DNA, 22 bp, Artificial Sequence
  Synthetic oligonucleotide; TTA chr11 5246447 5246468 5246464 5246469 +
aaaccatggcacacttttacct

SEQ ID NO: 88084 - DNA, 22 bp, Artificial Sequence
  Synthetic oligonucleotide; CTT chr11 5246463 5246484 5246480 5246485 +
ttacctataaaacaaacctgca

SEQ ID NO: 88085 - DNA, 22 bp, Artificial Sequence
  Synthetic oligonucleotide; TTT chr11 5246464 5246485 5246481 5246486 +
tacctataaaacaaacctgcat

SEQ ID NO: 88086 - DNA, 22 bp, Artificial Sequence
  Synthetic oligonucleotide; TTT chr11 5246465 5246486 5246482 5246487 +
acctataaaacaaacctgcata

SEQ ID NO: 88087 - DNA, 22 bp, Artificial Sequence
  Synthetic oligonucleotide; TTA chr11 5246466 5246487 5246483 5246488 +
cctataaaacaaacctgcatat

SEQ ID NO: 88088 - DNA, 22 bp, Artificial Sequence
  Synthetic oligonucleotide; CTA chr11 5246470 5246491 5246487 5246492 +
taaaacaaacctgcatatcctg

SEQ ID NO: 88089 - DNA, 22 bp, Artificial Sequence
  Synthetic oligonucleotide; CTG chr11 5246483 5246504 5246500 5246505 +
catatcctgtacgtgtacccct

SEQ ID NO: 88090 - DNA, 22 bp, Artificial Sequence
  Synthetic oligonucleotide; CTG chr11 5246492 5246513 5246509 5246514 +
tacgtgtacccctgaatttaag

SEQ ID NO: 88091 - DNA, 22 bp, Artificial Sequence
  Synthetic oligonucleotide; CTG chr11 5246506 5246527 5246523 5246528 +
aatttaaggtaacagtaaatta

SEQ ID NO: 88092 - DNA, 22 bp, Artificial Sequence
  Synthetic oligonucleotide; TTT chr11 5246511 5246532 5246528 5246533 +
aaggtaacagtaaattaaatta

SEQ ID NO: 88093 - DNA, 22 bp, Artificial Sequence
  Synthetic oligonucleotide; TTA chr11 5246512 5246533 5246529 5246534 +
aggtaacagtaaattaaattaa

SEQ ID NO: 88094 - DNA, 22 bp, Artificial Sequence
  Synthetic oligonucleotide; TTA chr11 5246528 5246549 5246545 5246550 +
aattaaaagaaaaatgccatgg

SEQ ID NO: 88095 - DNA, 22 bp, Artificial Sequence
  Synthetic oligonucleotide; TTA chr11 5246533 5246554 5246550 5246555 +
aaagaaaaatgccatggcaatg

SEQ ID NO: 88096 - DNA, 22 bp, Artificial Sequence
  Synthetic oligonucleotide; TTA chr11 5246566 5246587 5246583 5246588 +
ccctatatggcctaaaaagaga

SEQ ID NO: 88097 - DNA, 22 bp, Artificial Sequence
  Synthetic oligonucleotide; CTA chr11 5246571 5246592 5246588 5246593 +
tatggcctaaaaagagaaggca

SEQ ID NO: 88098 - DNA, 22 bp, Artificial Sequence
  Synthetic oligonucleotide; CTA chr11 5246580 5246601 5246597 5246602 +
aaaagagaaggcataaataatc

SEQ ID NO: 88099 - DNA, 22 bp, Artificial Sequence
  Synthetic oligonucleotide; CTT chr11 5246610 5246631 5246627 5246632 +
gtttaacatatcatcaagaaat

SEQ ID NO: 88100 - DNA, 22 bp, Artificial Sequence
  Synthetic oligonucleotide; TTG chr11 5246611 5246632 5246628 5246633 +
tttaacatatcatcaagaaata

SEQ ID NO: 88101 - DNA, 22 bp, Artificial Sequence
  Synthetic oligonucleotide; TTT chr11 5246614 5246635 5246631 5246636 +
aacatatcatcaagaaataacc

SEQ ID NO: 88102 - DNA, 22 bp, Artificial Sequence
  Synthetic oligonucleotide; TTA chr11 5246615 5246636 5246632 5246637 +
acatatcatcaagaaataacca

SEQ ID NO: 88103 - DNA, 22 bp, Artificial Sequence
  Synthetic oligonucleotide; CTC chr11 5246661 5246682 5246678 5246683 +
ggggctgctctgcctatgcagt

SEQ ID NO: 88104 - DNA, 22 bp, Artificial Sequence
  Synthetic oligonucleotide; CTG chr11 5246668 5246689 5246685 5246690 +
ctctgcctatgcagtagtcatt

SEQ ID NO: 88105 - DNA, 22 bp, Artificial Sequence
  Synthetic oligonucleotide; CTC chr11 5246671 5246692 5246688 5246693 +
tgcctatgcagtagtcattcgt

SEQ ID NO: 88106 - DNA, 22 bp, Artificial Sequence
  Synthetic oligonucleotide; CTG chr11 5246673 5246694 5246690 5246695 +
cctatgcagtagtcattcgttt

SEQ ID NO: 88107 - DNA, 22 bp, Artificial Sequence
  Synthetic oligonucleotide; CTA chr11 5246677 5246698 5246694 5246699 +
tgcagtagtcattcgtttattt

SEQ ID NO: 88108 - DNA, 22 bp, Artificial Sequence
  Synthetic oligonucleotide; TTC chr11 5246691 5246712 5246708 5246713 +
gtttatttctttactctctcaa

SEQ ID NO: 88109 - DNA, 22 bp, Artificial Sequence
  Synthetic oligonucleotide; TTT chr11 5246695 5246716 5246712 5246717 +
atttctttactctctcaagaaa

SEQ ID NO: 88110 - DNA, 22 bp, Artificial Sequence
  Synthetic oligonucleotide; TTA chr11 5246696 5246717 5246713 5246718 +
tttctttactctctcaagaaat

SEQ ID NO: 88111 - DNA, 22 bp, Artificial Sequence
  Synthetic oligonucleotide; TTT chr11 5246699 5246720 5246716 5246721 +
ctttactctctcaagaaatttg

SEQ ID NO: 88112 - DNA, 22 bp, Artificial Sequence
  Synthetic oligonucleotide; TTC chr11 5246700 5246721 5246717 5246722 +
tttactctctcaagaaatttgc

SEQ ID NO: 88113 - DNA, 22 bp, Artificial Sequence
  Synthetic oligonucleotide; CTT chr11 5246702 5246723 5246719 5246724 +
tactctctcaagaaatttgctt

SEQ ID NO: 88114 - DNA, 22 bp, Artificial Sequence
  Synthetic oligonucleotide; TTT chr11 5246703 5246724 5246720 5246725 +
actctctcaagaaatttgcttt

SEQ ID NO: 88115 - DNA, 22 bp, Artificial Sequence
  Synthetic oligonucleotide; TTA chr11 5246704 5246725 5246721 5246726 +
ctctctcaagaaatttgctttg

SEQ ID NO: 88116 - DNA, 22 bp, Artificial Sequence
  Synthetic oligonucleotide; CTC chr11 5246707 5246728 5246724 5246729 +
tctcaagaaatttgctttgact

SEQ ID NO: 88117 - DNA, 22 bp, Artificial Sequence
  Synthetic oligonucleotide; CTC chr11 5246709 5246730 5246726 5246731 +
tcaagaaatttgctttgactta

SEQ ID NO: 88118 - DNA, 22 bp, Artificial Sequence
  Synthetic oligonucleotide; CTC chr11 5246711 5246732 5246728 5246733 +
aagaaatttgctttgacttaaa

SEQ ID NO: 88119 - DNA, 22 bp, Artificial Sequence
  Synthetic oligonucleotide; TTT chr11 5246720 5246741 5246737 5246742 +
gctttgacttaaaaaaaacaaa

SEQ ID NO: 88120 - DNA, 22 bp, Artificial Sequence
  Synthetic oligonucleotide; TTG chr11 5246721 5246742 5246738 5246743 +
ctttgacttaaaaaaaacaaaa

SEQ ID NO: 88121 - DNA, 22 bp, Artificial Sequence
  Synthetic oligonucleotide; CTT chr11 5246724 5246745 5246741 5246746 +
tgacttaaaaaaaacaaaaaac

SEQ ID NO: 88122 - DNA, 22 bp, Artificial Sequence
  Synthetic oligonucleotide; TTT chr11 5246725 5246746 5246742 5246747 +
gacttaaaaaaaacaaaaaaca

SEQ ID NO: 88123 - DNA, 22 bp, Artificial Sequence
  Synthetic oligonucleotide; TTG chr11 5246726 5246747 5246743 5246748 +
acttaaaaaaaacaaaaaacaa

SEQ ID NO: 88124 - DNA, 22 bp, Artificial Sequence
  Synthetic oligonucleotide; CTT chr11 5246730 5246751 5246747 5246752 +
aaaaaaaacaaaaaacaaaaaa

SEQ ID NO: 88125 - DNA, 22 bp, Artificial Sequence
  Synthetic oligonucleotide; TTA chr11 5246731 5246752 5246748 5246753 +
aaaaaaacaaaaaacaaaaaag

SEQ ID NO: 88126 - DNA, 22 bp, Artificial Sequence
  Synthetic oligonucleotide; TTC chr11 5246770 5246791 5246787 5246792 +
tgaaacggtagtgactgcattt

SEQ ID NO: 88127 - DNA, 22 bp, Artificial Sequence
  Synthetic oligonucleotide; CTG chr11 5246772 5246793 5246789 5246794 +
aaacggtagtgactgcatttga

SEQ ID NO: 88128 - DNA, 22 bp, Artificial Sequence
  Synthetic oligonucleotide; CTG chr11 5246787 5246808 5246804 5246809 +
catttgaagtgggacctttatg

SEQ ID NO: 88129 - DNA, 22 bp, Artificial Sequence
  Synthetic oligonucleotide; TTT chr11 5246792 5246813 5246809 5246814 +
gaagtgggacctttatgatatg

SEQ ID NO: 88130 - DNA, 22 bp, Artificial Sequence
  Synthetic oligonucleotide; TTG chr11 5246793 5246814 5246810 5246815 +
aagtgggacctttatgatatga

SEQ ID NO: 88131 - DNA, 22 bp, Artificial Sequence
  Synthetic oligonucleotide; CTT chr11 5246805 5246826 5246822 5246827 +
tatgatatgatggagccaggca

SEQ ID NO: 88132 - DNA, 22 bp, Artificial Sequence
  Synthetic oligonucleotide; TTT chr11 5246806 5246827 5246823 5246828 +
atgatatgatggagccaggcag

SEQ ID NO: 88133 - DNA, 22 bp, Artificial Sequence
  Synthetic oligonucleotide; TTA chr11 5246807 5246828 5246824 5246829 +
tgatatgatggagccaggcaga

SEQ ID NO: 88134 - DNA, 22 bp, Artificial Sequence
  Synthetic oligonucleotide; TTG chr11 5246836 5246857 5246853 5246858 +
gagaagttcctgaaagaaggaa

SEQ ID NO: 88135 - DNA, 22 bp, Artificial Sequence
  Synthetic oligonucleotide; TTC chr11 5246845 5246866 5246862 5246867 +
ctgaaagaaggaagggcatgtg

SEQ ID NO: 88136 - DNA, 22 bp, Artificial Sequence
  Synthetic oligonucleotide; CTG chr11 5246848 5246869 5246865 5246870 +
aaagaaggaagggcatgtgcca

SEQ ID NO: 88137 - DNA, 22 bp, Artificial Sequence
  Synthetic oligonucleotide; TTC chr11 5246875 5246896 5246892 5246897 +
tgaggctgaggagaaaaaagaa

SEQ ID NO: 88138 - DNA, 22 bp, Artificial Sequence
  Synthetic oligonucleotide; CTG chr11 5246877 5246898 5246894 5246899 +
aggctgaggagaaaaaagaaag

SEQ ID NO: 88139 - DNA, 22 bp, Artificial Sequence
  Synthetic oligonucleotide; CTG chr11 5246883 5246904 5246900 5246905 +
aggagaaaaaagaaagaaagaa

SEQ ID NO: 88140 - DNA, 22 bp, Artificial Sequence
  Synthetic oligonucleotide; CTT chr11 5246923 5246944 5246940 5246945 +
tacatttcactgtatgtaaaga

SEQ ID NO: 88141 - DNA, 22 bp, Artificial Sequence
  Synthetic oligonucleotide; TTT chr11 5246924 5246945 5246941 5246946 +
acatttcactgtatgtaaagac

SEQ ID NO: 88142 - DNA, 22 bp, Artificial Sequence
  Synthetic oligonucleotide; TTA chr11 5246925 5246946 5246942 5246947 +
catttcactgtatgtaaagaca

SEQ ID NO: 88143 - DNA, 22 bp, Artificial Sequence
  Synthetic oligonucleotide; TTT chr11 5246930 5246951 5246947 5246952 +
cactgtatgtaaagacattaca

SEQ ID NO: 88144 - DNA, 22 bp, Artificial Sequence
  Synthetic oligonucleotide; TTC chr11 5246931 5246952 5246948 5246953 +
actgtatgtaaagacattacaa

SEQ ID NO: 88145 - DNA, 22 bp, Artificial Sequence
  Synthetic oligonucleotide; CTG chr11 5246935 5246956 5246952 5246957 +
tatgtaaagacattacaaggct

SEQ ID NO: 88146 - DNA, 22 bp, Artificial Sequence
  Synthetic oligonucleotide; TTA chr11 5246950 5246971 5246967 5246972 +
caaggctagagtaaagcatgtt

SEQ ID NO: 88147 - DNA, 22 bp, Artificial Sequence
  Synthetic oligonucleotide; CTA chr11 5246958 5246979 5246975 5246980 +
gagtaaagcatgttgaagtaaa

SEQ ID NO: 88148 - DNA, 22 bp, Artificial Sequence
  Synthetic oligonucleotide; TTG chr11 5246973 5246994 5246990 5246995 +
aagtaaaaataggagaaatcaa

SEQ ID NO: 88149 - DNA, 22 bp, Artificial Sequence
  Synthetic oligonucleotide; TTA chr11 5247000 5247021 5247017 5247022 +
gagagaagggcgcaggcttatt

SEQ ID NO: 88150 - DNA, 22 bp, Artificial Sequence
  Synthetic oligonucleotide; CTT chr11 5247019 5247040 5247036 5247041 +
attatttgggtcttatagatga

SEQ ID NO: 88151 - DNA, 22 bp, Artificial Sequence
  Synthetic oligonucleotide; TTA chr11 5247020 5247041 5247037 5247042 +
ttatttgggtcttatagatgag

SEQ ID NO: 88152 - DNA, 22 bp, Artificial Sequence
  Synthetic oligonucleotide; TTA chr11 5247023 5247044 5247040 5247045 +
tttgggtcttatagatgagagt

SEQ ID NO: 88153 - DNA, 22 bp, Artificial Sequence
  Synthetic oligonucleotide; TTT chr11 5247026 5247047 5247043 5247048 +
gggtcttatagatgagagtagt

SEQ ID NO: 88154 - DNA, 22 bp, Artificial Sequence
  Synthetic oligonucleotide; TTG chr11 5247027 5247048 5247044 5247049 +
ggtcttatagatgagagtagta

SEQ ID NO: 88155 - DNA, 22 bp, Artificial Sequence
  Synthetic oligonucleotide; CTT chr11 5247033 5247054 5247050 5247055 +
atagatgagagtagtagagtag

SEQ ID NO: 88156 - DNA, 22 bp, Artificial Sequence
  Synthetic oligonucleotide; TTA chr11 5247034 5247055 5247051 5247056 +
tagatgagagtagtagagtagg

SEQ ID NO: 88157 - DNA, 22 bp, Artificial Sequence
  Synthetic oligonucleotide; TTT chr11 5247061 5247082 5247078 5247083 +
tatactgaaacataggggacga

SEQ ID NO: 88158 - DNA, 22 bp, Artificial Sequence
  Synthetic oligonucleotide; TTT chr11 5247062 5247083 5247079 5247084 +
atactgaaacataggggacgag

SEQ ID NO: 88159 - DNA, 22 bp, Artificial Sequence
  Synthetic oligonucleotide; TTA chr11 5247063 5247084 5247080 5247085 +
tactgaaacataggggacgagg

SEQ ID NO: 88160 - DNA, 22 bp, Artificial Sequence
  Synthetic oligonucleotide; CTG chr11 5247068 5247089 5247085 5247090 +
aaacataggggacgaggggagc

SEQ ID NO: 88161 - DNA, 22 bp, Artificial Sequence
  Synthetic oligonucleotide; CTT chr11 5247092 5247113 5247109 5247114 +
tgcaaacctgagataaacatgg

SEQ ID NO: 88162 - DNA, 22 bp, Artificial Sequence
  Synthetic oligonucleotide; TTT chr11 5247093 5247114 5247110 5247115 +
gcaaacctgagataaacatggt

SEQ ID NO: 88163 - DNA, 22 bp, Artificial Sequence
  Synthetic oligonucleotide; TTG chr11 5247094 5247115 5247111 5247116 +
caaacctgagataaacatggtc

SEQ ID NO: 88164 - DNA, 22 bp, Artificial Sequence
  Synthetic oligonucleotide; CTG chr11 5247102 5247123 5247119 5247124 +
agataaacatggtctgtagtcc

SEQ ID NO: 88165 - DNA, 22 bp, Artificial Sequence
  Synthetic oligonucleotide; CTG chr11 5247118 5247139 5247135 5247140 +
tagtccactcaaaacccaagct

SEQ ID NO: 88166 - DNA, 22 bp, Artificial Sequence
  Synthetic oligonucleotide; CTC chr11 5247128 5247149 5247145 5247150 +
aaaacccaagcttatttttttc

SEQ ID NO: 88167 - DNA, 22 bp, Artificial Sequence
  Synthetic oligonucleotide; CTT chr11 5247141 5247162 5247158 5247163 +
atttttttctccttcttcatct

SEQ ID NO: 88168 - DNA, 22 bp, Artificial Sequence
  Synthetic oligonucleotide; TTA chr11 5247142 5247163 5247159 5247164 +
tttttttctccttcttcatctg

SEQ ID NO: 88169 - DNA, 22 bp, Artificial Sequence
  Synthetic oligonucleotide; TTT chr11 5247145 5247166 5247162 5247167 +
ttttctccttcttcatctgcct

SEQ ID NO: 88170 - DNA, 22 bp, Artificial Sequence
  Synthetic oligonucleotide; TTT chr11 5247146 5247167 5247163 5247168 +
tttctccttcttcatctgcctt

SEQ ID NO: 88171 - DNA, 22 bp, Artificial Sequence
  Synthetic oligonucleotide; TTT chr11 5247147 5247168 5247164 5247169 +
ttctccttcttcatctgcctta

SEQ ID NO: 88172 - DNA, 22 bp, Artificial Sequence
  Synthetic oligonucleotide; TTT chr11 5247148 5247169 5247165 5247170 +
tctccttcttcatctgccttac

SEQ ID NO: 88173 - DNA, 22 bp, Artificial Sequence
  Synthetic oligonucleotide; TTT chr11 5247149 5247170 5247166 5247171 +
ctccttcttcatctgccttact

SEQ ID NO: 88174 - DNA, 22 bp, Artificial Sequence
  Synthetic oligonucleotide; TTC chr11 5247150 5247171 5247167 5247172 +
tccttcttcatctgccttactc

SEQ ID NO: 88175 - DNA, 22 bp, Artificial Sequence
  Synthetic oligonucleotide; CTC chr11 5247152 5247173 5247169 5247174 +
cttcttcatctgccttactcag

SEQ ID NO: 88176 - DNA, 22 bp, Artificial Sequence
  Synthetic oligonucleotide; CTT chr11 5247155 5247176 5247172 5247177 +
cttcatctgccttactcagtgc

SEQ ID NO: 88177 - DNA, 22 bp, Artificial Sequence
  Synthetic oligonucleotide; TTC chr11 5247156 5247177 5247173 5247178 +
ttcatctgccttactcagtgca

SEQ ID NO: 88178 - DNA, 22 bp, Artificial Sequence
  Synthetic oligonucleotide; CTT chr11 5247158 5247179 5247175 5247180 +
catctgccttactcagtgcaag

SEQ ID NO: 88179 - DNA, 22 bp, Artificial Sequence
  Synthetic oligonucleotide; TTC chr11 5247159 5247180 5247176 5247181 +
atctgccttactcagtgcaagg

SEQ ID NO: 88180 - DNA, 22 bp, Artificial Sequence
  Synthetic oligonucleotide; CTG chr11 5247164 5247185 5247181 5247186 +
ccttactcagtgcaaggtgcta

SEQ ID NO: 88181 - DNA, 22 bp, Artificial Sequence
  Synthetic oligonucleotide; CTT chr11 5247168 5247189 5247185 5247190 +
actcagtgcaaggtgctataac

SEQ ID NO: 88182 - DNA, 22 bp, Artificial Sequence
  Synthetic oligonucleotide; TTA chr11 5247169 5247190 5247186 5247191 +
ctcagtgcaaggtgctataaca

SEQ ID NO: 88183 - DNA, 22 bp, Artificial Sequence
  Synthetic oligonucleotide; CTC chr11 5247172 5247193 5247189 5247194 +
agtgcaaggtgctataacaaaa

SEQ ID NO: 88184 - DNA, 22 bp, Artificial Sequence
  Synthetic oligonucleotide; CTA chr11 5247186 5247207 5247203 5247208 +
taacaaaatacaaaagactggg

SEQ ID NO: 88185 - DNA, 22 bp, Artificial Sequence
  Synthetic oligonucleotide; CTG chr11 5247206 5247227 5247223 5247228 +
ggtggcttcaacaacagagttt

SEQ ID NO: 88186 - DNA, 22 bp, Artificial Sequence
  Synthetic oligonucleotide; CTT chr11 5247214 5247235 5247231 5247236 +
caacaacagagttttttctcac

SEQ ID NO: 88187 - DNA, 22 bp, Artificial Sequence
  Synthetic oligonucleotide; TTC chr11 5247215 5247236 5247232 5247237 +
aacaacagagttttttctcaca

SEQ ID NO: 88188 - DNA, 22 bp, Artificial Sequence
  Synthetic oligonucleotide; TTT chr11 5247228 5247249 5247245 5247250 +
tttctcacatttctgaaggctg

SEQ ID NO: 88189 - DNA, 22 bp, Artificial Sequence
  Synthetic oligonucleotide; TTT chr11 5247229 5247250 5247246 5247251 +
ttctcacatttctgaaggctga

SEQ ID NO: 88190 - DNA, 22 bp, Artificial Sequence
  Synthetic oligonucleotide; TTT chr11 5247230 5247251 5247247 5247252 +
tctcacatttctgaaggctgac

SEQ ID NO: 88191 - DNA, 22 bp, Artificial Sequence
  Synthetic oligonucleotide; TTT chr11 5247231 5247252 5247248 5247253 +
ctcacatttctgaaggctgact

SEQ ID NO: 88192 - DNA, 22 bp, Artificial Sequence
  Synthetic oligonucleotide; TTC chr11 5247232 5247253 5247249 5247254 +
tcacatttctgaaggctgactc

SEQ ID NO: 88193 - DNA, 22 bp, Artificial Sequence
  Synthetic oligonucleotide; CTC chr11 5247234 5247255 5247251 5247256 +
acatttctgaaggctgactcgt

SEQ ID NO: 88194 - DNA, 22 bp, Artificial Sequence
  Synthetic oligonucleotide; TTT chr11 5247240 5247261 5247257 5247262 +
ctgaaggctgactcgtggtcag

SEQ ID NO: 88195 - DNA, 22 bp, Artificial Sequence
  Synthetic oligonucleotide; TTC chr11 5247241 5247262 5247258 5247263 +
tgaaggctgactcgtggtcagg

SEQ ID NO: 88196 - DNA, 22 bp, Artificial Sequence
  Synthetic oligonucleotide; CTG chr11 5247243 5247264 5247260 5247265 +
aaggctgactcgtggtcagggt

SEQ ID NO: 88197 - DNA, 22 bp, Artificial Sequence
  Synthetic oligonucleotide; CTG chr11 5247250 5247271 5247267 5247272 +
actcgtggtcagggttctcttc

SEQ ID NO: 88198 - DNA, 22 bp, Artificial Sequence
  Synthetic oligonucleotide; CTC chr11 5247254 5247275 5247271 5247276 +
gtggtcagggttctcttcctgg

SEQ ID NO: 88199 - DNA, 22 bp, Artificial Sequence
  Synthetic oligonucleotide; TTC chr11 5247267 5247288 5247284 5247289 +
tcttcctggattgcagatggcg

SEQ ID NO: 88200 - DNA, 22 bp, Artificial Sequence
  Synthetic oligonucleotide; CTC chr11 5247269 5247290 5247286 5247291 +
ttcctggattgcagatggcgga

SEQ ID NO: 88201 - DNA, 22 bp, Artificial Sequence
  Synthetic oligonucleotide; CTT chr11 5247271 5247292 5247288 5247293 +
cctggattgcagatggcggact

SEQ ID NO: 88202 - DNA, 22 bp, Artificial Sequence
  Synthetic oligonucleotide; TTC chr11 5247272 5247293 5247289 5247294 +
ctggattgcagatggcggactt

SEQ ID NO: 88203 - DNA, 22 bp, Artificial Sequence
  Synthetic oligonucleotide; CTG chr11 5247275 5247296 5247292 5247297 +
gattgcagatggcggacttctc

SEQ ID NO: 88204 - DNA, 22 bp, Artificial Sequence
  Synthetic oligonucleotide; TTG chr11 5247280 5247301 5247297 5247302 +
cagatggcggacttctcactgt

SEQ ID NO: 88205 - DNA, 22 bp, Artificial Sequence
  Synthetic oligonucleotide; CTT chr11 5247294 5247315 5247311 5247316 +
ctcactgtgtcctcaccgggag

SEQ ID NO: 88206 - DNA, 22 bp, Artificial Sequence
  Synthetic oligonucleotide; TTC chr11 5247295 5247316 5247312 5247317 +
tcactgtgtcctcaccgggagg

SEQ ID NO: 88207 - DNA, 22 bp, Artificial Sequence
  Synthetic oligonucleotide; CTC chr11 5247297 5247318 5247314 5247319 +
actgtgtcctcaccgggaggaa

SEQ ID NO: 88208 - DNA, 22 bp, Artificial Sequence
  Synthetic oligonucleotide; CTG chr11 5247301 5247322 5247318 5247323 +
tgtcctcaccgggaggaaagag

SEQ ID NO: 88209 - DNA, 22 bp, Artificial Sequence
  Synthetic oligonucleotide; CTC chr11 5247308 5247329 5247325 5247330 +
accgggaggaaagagaaatggc

SEQ ID NO: 88210 - DNA, 22 bp, Artificial Sequence
  Synthetic oligonucleotide; CTT chr11 5247332 5247353 5247349 5247354 +
gtctctctgcttctgataagga

SEQ ID NO: 88211 - DNA, 22 bp, Artificial Sequence
  Synthetic oligonucleotide; TTG chr11 5247333 5247354 5247350 5247355 +
tctctctgcttctgataaggaa

SEQ ID NO: 88212 - DNA, 22 bp, Artificial Sequence
  Synthetic oligonucleotide; CTC chr11 5247337 5247358 5247354 5247359 +
tctgcttctgataaggaaaata

SEQ ID NO: 88213 - DNA, 22 bp, Artificial Sequence
  Synthetic oligonucleotide; CTC chr11 5247339 5247360 5247356 5247361 +
tgcttctgataaggaaaataat

SEQ ID NO: 88214 - DNA, 22 bp, Artificial Sequence
  Synthetic oligonucleotide; CTG chr11 5247341 5247362 5247358 5247363 +
cttctgataaggaaaataattt

SEQ ID NO: 88215 - DNA, 22 bp, Artificial Sequence
  Synthetic oligonucleotide; CTT chr11 5247344 5247365 5247361 5247366 +
ctgataaggaaaataattttat

SEQ ID NO: 88216 - DNA, 22 bp, Artificial Sequence
  Synthetic oligonucleotide; TTC chr11 5247345 5247366 5247362 5247367 +
tgataaggaaaataattttatg

SEQ ID NO: 88217 - DNA, 22 bp, Artificial Sequence
  Synthetic oligonucleotide; CTG chr11 5247347 5247368 5247364 5247369 +
ataaggaaaataattttatgat

SEQ ID NO: 88218 - DNA, 22 bp, Artificial Sequence
  Synthetic oligonucleotide; TTT chr11 5247363 5247384 5247380 5247385 +
tatgatggggatctgctcttat

SEQ ID NO: 88219 - DNA, 22 bp, Artificial Sequence
  Synthetic oligonucleotide; TTT chr11 5247364 5247385 5247381 5247386 +
atgatggggatctgctcttatg

SEQ ID NO: 88220 - DNA, 22 bp, Artificial Sequence
  Synthetic oligonucleotide; TTA chr11 5247365 5247386 5247382 5247387 +
tgatggggatctgctcttatga

SEQ ID NO: 88221 - DNA, 22 bp, Artificial Sequence
  Synthetic oligonucleotide; CTG chr11 5247378 5247399 5247395 5247400 +
ctcttatgagctcatctaaacc

SEQ ID NO: 88222 - DNA, 22 bp, Artificial Sequence
  Synthetic oligonucleotide; CTC chr11 5247381 5247402 5247398 5247403 +
ttatgagctcatctaaacctaa

SEQ ID NO: 88223 - DNA, 22 bp, Artificial Sequence
  Synthetic oligonucleotide; CTT chr11 5247383 5247404 5247400 5247405 +
atgagctcatctaaacctaatt

SEQ ID NO: 88224 - DNA, 22 bp, Artificial Sequence
  Synthetic oligonucleotide; TTA chr11 5247384 5247405 5247401 5247406 +
tgagctcatctaaacctaatta

SEQ ID NO: 88225 - DNA, 22 bp, Artificial Sequence
  Synthetic oligonucleotide; CTC chr11 5247391 5247412 5247408 5247413 +
atctaaacctaattacttttca

SEQ ID NO: 88226 - DNA, 22 bp, Artificial Sequence
  Synthetic oligonucleotide; CTA chr11 5247396 5247417 5247413 5247418 +
aacctaattacttttcaaaagc

SEQ ID NO: 88227 - DNA, 22 bp, Artificial Sequence
  Synthetic oligonucleotide; CTA chr11 5247402 5247423 5247419 5247424 +
attacttttcaaaagcctcccc

SEQ ID NO: 88228 - DNA, 22 bp, Artificial Sequence
  Synthetic oligonucleotide; TTA chr11 5247406 5247427 5247423 5247428 +
cttttcaaaagcctcccccaca

SEQ ID NO: 88229 - DNA, 22 bp, Artificial Sequence
  Synthetic oligonucleotide; CTT chr11 5247409 5247430 5247426 5247431 +
ttcaaaagcctcccccacagat

SEQ ID NO: 88230 - DNA, 22 bp, Artificial Sequence
  Synthetic oligonucleotide; TTT chr11 5247410 5247431 5247427 5247432 +
tcaaaagcctcccccacagata

SEQ ID NO: 88231 - DNA, 22 bp, Artificial Sequence
  Synthetic oligonucleotide; TTT chr11 5247411 5247432 5247428 5247433 +
caaaagcctcccccacagataa

SEQ ID NO: 88232 - DNA, 22 bp, Artificial Sequence
  Synthetic oligonucleotide; TTC chr11 5247412 5247433 5247429 5247434 +
aaaagcctcccccacagataag

SEQ ID NO: 88233 - DNA, 22 bp, Artificial Sequence
  Synthetic oligonucleotide; CTC chr11 5247421 5247442 5247438 5247443 +
ccccacagataaggtcagttgg

SEQ ID NO: 88234 - DNA, 22 bp, Artificial Sequence
  Synthetic oligonucleotide; TTG chr11 5247442 5247463 5247459 5247464 +
ggagttggggattcagcatgtg

SEQ ID NO: 88235 - DNA, 22 bp, Artificial Sequence
  Synthetic oligonucleotide; TTG chr11 5247449 5247470 5247466 5247471 +
gggattcagcatgtgaattttg

SEQ ID NO: 88236 - DNA, 22 bp, Artificial Sequence
  Synthetic oligonucleotide; TTC chr11 5247456 5247477 5247473 5247478 +
agcatgtgaattttgaggagac

SEQ ID NO: 88237 - DNA, 22 bp, Artificial Sequence
  Synthetic oligonucleotide; TTT chr11 5247469 5247490 5247486 5247491 +
tgaggagacacaaacattaggt

SEQ ID NO: 88238 - DNA, 22 bp, Artificial Sequence
  Synthetic oligonucleotide; TTT chr11 5247470 5247491 5247487 5247492 +
gaggagacacaaacattaggtc

SEQ ID NO: 88239 - DNA, 22 bp, Artificial Sequence
  Synthetic oligonucleotide; TTG chr11 5247471 5247492 5247488 5247493 +
aggagacacaaacattaggtcc

SEQ ID NO: 88240 - DNA, 22 bp, Artificial Sequence
  Synthetic oligonucleotide; TTA chr11 5247488 5247509 5247505 5247510 +
ggtccgtaacaccatcatatta

SEQ ID NO: 88241 - DNA, 22 bp, Artificial Sequence
  Synthetic oligonucleotide; TTA chr11 5247510 5247531 5247527 5247532 +
aactcttacttatagagatgca

SEQ ID NO: 88242 - DNA, 22 bp, Artificial Sequence
  Synthetic oligonucleotide; CTC chr11 5247515 5247536 5247532 5247537 +
ttacttatagagatgcactaac

SEQ ID NO: 88243 - DNA, 22 bp, Artificial Sequence
  Synthetic oligonucleotide; CTT chr11 5247517 5247538 5247534 5247539 +
acttatagagatgcactaacat

SEQ ID NO: 88244 - DNA, 22 bp, Artificial Sequence
  Synthetic oligonucleotide; TTA chr11 5247518 5247539 5247535 5247540 +
cttatagagatgcactaacatc

SEQ ID NO: 88245 - DNA, 22 bp, Artificial Sequence
  Synthetic oligonucleotide; CTT chr11 5247521 5247542 5247538 5247543 +
atagagatgcactaacatccaa

SEQ ID NO: 88246 - DNA, 22 bp, Artificial Sequence
  Synthetic oligonucleotide; TTA chr11 5247522 5247543 5247539 5247544 +
tagagatgcactaacatccaac

SEQ ID NO: 88247 - DNA, 22 bp, Artificial Sequence
  Synthetic oligonucleotide; CTA chr11 5247535 5247556 5247552 5247557 +
acatccaactatacaaaaattc

SEQ ID NO: 88248 - DNA, 22 bp, Artificial Sequence
  Synthetic oligonucleotide; CTA chr11 5247546 5247567 5247563 5247568 +
tacaaaaattccattaagtaag

SEQ ID NO: 88249 - DNA, 22 bp, Artificial Sequence
  Synthetic oligonucleotide; TTC chr11 5247557 5247578 5247574 5247579 +
cattaagtaagccttccaatta

SEQ ID NO: 88250 - DNA, 22 bp, Artificial Sequence
  Synthetic oligonucleotide; TTA chr11 5247562 5247583 5247579 5247584 +
agtaagccttccaattaatgtt

SEQ ID NO: 88251 - DNA, 22 bp, Artificial Sequence
  Synthetic oligonucleotide; CTT chr11 5247572 5247593 5247589 5247594 +
ccaattaatgttgtacaaattc

SEQ ID NO: 88252 - DNA, 22 bp, Artificial Sequence
  Synthetic oligonucleotide; TTC chr11 5247573 5247594 5247590 5247595 +
caattaatgttgtacaaattct

SEQ ID NO: 88253 - DNA, 22 bp, Artificial Sequence
  Synthetic oligonucleotide; TTA chr11 5247579 5247600 5247596 5247601 +
atgttgtacaaattcttcccac

SEQ ID NO: 88254 - DNA, 22 bp, Artificial Sequence
  Synthetic oligonucleotide; TTG chr11 5247585 5247606 5247602 5247607 +
tacaaattcttcccactacatt

SEQ ID NO: 88255 - DNA, 22 bp, Artificial Sequence
  Synthetic oligonucleotide; TTC chr11 5247594 5247615 5247611 5247616 +
ttcccactacattttgatctca

SEQ ID NO: 88256 - DNA, 22 bp, Artificial Sequence
  Synthetic oligonucleotide; CTT chr11 5247596 5247617 5247613 5247618 +
cccactacattttgatctcaca

SEQ ID NO: 88257 - DNA, 22 bp, Artificial Sequence
  Synthetic oligonucleotide; TTC chr11 5247597 5247618 5247614 5247619 +
ccactacattttgatctcacag

SEQ ID NO: 88258 - DNA, 22 bp, Artificial Sequence
  Synthetic oligonucleotide; CTA chr11 5247603 5247624 5247620 5247625 +
cattttgatctcacagtgctgg

SEQ ID NO: 88259 - DNA, 22 bp, Artificial Sequence
  Synthetic oligonucleotide; TTT chr11 5247608 5247629 5247625 5247630 +
tgatctcacagtgctggtctgt

SEQ ID NO: 88260 - DNA, 22 bp, Artificial Sequence
  Synthetic oligonucleotide; TTT chr11 5247609 5247630 5247626 5247631 +
gatctcacagtgctggtctgtt

SEQ ID NO: 88261 - DNA, 22 bp, Artificial Sequence
  Synthetic oligonucleotide; TTG chr11 5247610 5247631 5247627 5247632 +
atctcacagtgctggtctgttt

SEQ ID NO: 88262 - DNA, 22 bp, Artificial Sequence
  Synthetic oligonucleotide; CTC chr11 5247615 5247636 5247632 5247637 +
acagtgctggtctgtttctcag

SEQ ID NO: 88263 - DNA, 22 bp, Artificial Sequence
  Synthetic oligonucleotide; CTG chr11 5247624 5247645 5247641 5247646 +
gtctgtttctcagacataacat

SEQ ID NO: 88264 - DNA, 22 bp, Artificial Sequence
  Synthetic oligonucleotide; CTG chr11 5247629 5247650 5247646 5247651 +
tttctcagacataacatgctca

SEQ ID NO: 88265 - DNA, 22 bp, Artificial Sequence
  Synthetic oligonucleotide; TTT chr11 5247632 5247653 5247649 5247654 +
ctcagacataacatgctcatgc

SEQ ID NO: 88266 - DNA, 22 bp, Artificial Sequence
  Synthetic oligonucleotide; TTC chr11 5247633 5247654 5247650 5247655 +
tcagacataacatgctcatgct

SEQ ID NO: 88267 - DNA, 22 bp, Artificial Sequence
  Synthetic oligonucleotide; CTC chr11 5247635 5247656 5247652 5247657 +
agacataacatgctcatgctga

SEQ ID NO: 88268 - DNA, 22 bp, Artificial Sequence
  Synthetic oligonucleotide; CTC chr11 5247650 5247671 5247667 5247672 +
atgctgacttgtgagcctctgc

SEQ ID NO: 88269 - DNA, 22 bp, Artificial Sequence
  Synthetic oligonucleotide; CTG chr11 5247656 5247677 5247673 5247678 +
acttgtgagcctctgctgattc

SEQ ID NO: 88270 - DNA, 22 bp, Artificial Sequence
  Synthetic oligonucleotide; CTT chr11 5247660 5247681 5247677 5247682 +
gtgagcctctgctgattcattt

SEQ ID NO: 88271 - DNA, 22 bp, Artificial Sequence
  Synthetic oligonucleotide; TTG chr11 5247661 5247682 5247678 5247683 +
tgagcctctgctgattcatttc

SEQ ID NO: 88272 - DNA, 22 bp, Artificial Sequence
  Synthetic oligonucleotide; CTC chr11 5247669 5247690 5247686 5247691 +
tgctgattcatttcttacacct

SEQ ID NO: 88273 - DNA, 22 bp, Artificial Sequence
  Synthetic oligonucleotide; CTG chr11 5247671 5247692 5247688 5247693 +
ctgattcatttcttacacctaa

SEQ ID NO: 88274 - DNA, 22 bp, Artificial Sequence
  Synthetic oligonucleotide; CTG chr11 5247674 5247695 5247691 5247696 +
attcatttcttacacctaagtc

SEQ ID NO: 88275 - DNA, 22 bp, Artificial Sequence
  Synthetic oligonucleotide; TTC chr11 5247678 5247699 5247695 5247700 +
atttcttacacctaagtcccca

SEQ ID NO: 88276 - DNA, 22 bp, Artificial Sequence
  Synthetic oligonucleotide; TTT chr11 5247682 5247703 5247699 5247704 +
cttacacctaagtccccacctc

SEQ ID NO: 88277 - DNA, 22 bp, Artificial Sequence
  Synthetic oligonucleotide; TTC chr11 5247683 5247704 5247700 5247705 +
ttacacctaagtccccacctcc

SEQ ID NO: 88278 - DNA, 22 bp, Artificial Sequence
  Synthetic oligonucleotide; CTT chr11 5247685 5247706 5247702 5247707 +
acacctaagtccccacctcccc

SEQ ID NO: 88279 - DNA, 22 bp, Artificial Sequence
  Synthetic oligonucleotide; TTA chr11 5247686 5247707 5247703 5247708 +
cacctaagtccccacctccccc

SEQ ID NO: 88280 - DNA, 22 bp, Artificial Sequence
  Synthetic oligonucleotide; CTA chr11 5247692 5247713 5247709 5247714 +
agtccccacctcccccagagtc

SEQ ID NO: 88281 - DNA, 22 bp, Artificial Sequence
  Synthetic oligonucleotide; CTC chr11 5247704 5247725 5247721 5247726 +
ccccagagtcttacaatgaggt

SEQ ID NO: 88282 - DNA, 22 bp, Artificial Sequence
  Synthetic oligonucleotide; CTT chr11 5247716 5247737 5247733 5247738 +
acaatgaggtctctcccttgaa

SEQ ID NO: 88283 - DNA, 22 bp, Artificial Sequence
  Synthetic oligonucleotide; TTA chr11 5247717 5247738 5247734 5247739 +
caatgaggtctctcccttgaaa

SEQ ID NO: 88284 - DNA, 22 bp, Artificial Sequence
  Synthetic oligonucleotide; CTC chr11 5247729 5247750 5247746 5247751 +
tcccttgaaatgctgtgaccaa

SEQ ID NO: 88285 - DNA, 22 bp, Artificial Sequence
  Synthetic oligonucleotide; CTC chr11 5247731 5247752 5247748 5247753 +
ccttgaaatgctgtgaccaatc

SEQ ID NO: 88286 - DNA, 22 bp, Artificial Sequence
  Synthetic oligonucleotide; CTT chr11 5247735 5247756 5247752 5247757 +
gaaatgctgtgaccaatctgca

SEQ ID NO: 88287 - DNA, 22 bp, Artificial Sequence
  Synthetic oligonucleotide; TTG chr11 5247736 5247757 5247753 5247758 +
aaatgctgtgaccaatctgcac

SEQ ID NO: 88288 - DNA, 22 bp, Artificial Sequence
  Synthetic oligonucleotide; CTG chr11 5247744 5247765 5247761 5247766 +
tgaccaatctgcacacttgagg

SEQ ID NO: 88289 - DNA, 22 bp, Artificial Sequence
  Synthetic oligonucleotide; CTG chr11 5247755 5247776 5247772 5247777 +
cacacttgagggcatgggatta

SEQ ID NO: 88290 - DNA, 22 bp, Artificial Sequence
  Synthetic oligonucleotide; CTT chr11 5247762 5247783 5247779 5247784 +
gagggcatgggattaatttcac

SEQ ID NO: 88291 - DNA, 22 bp, Artificial Sequence
  Synthetic oligonucleotide; TTG chr11 5247763 5247784 5247780 5247785 +
agggcatgggattaatttcact

SEQ ID NO: 88292 - DNA, 22 bp, Artificial Sequence
  Synthetic oligonucleotide; TTA chr11 5247777 5247798 5247794 5247799 +
atttcactttcttaggcatcca

SEQ ID NO: 88293 - DNA, 22 bp, Artificial Sequence
  Synthetic oligonucleotide; TTT chr11 5247781 5247802 5247798 5247803 +
cactttcttaggcatccacaag

SEQ ID NO: 88294 - DNA, 22 bp, Artificial Sequence
  Synthetic oligonucleotide; TTC chr11 5247782 5247803 5247799 5247804 +
actttcttaggcatccacaagg

SEQ ID NO: 88295 - DNA, 22 bp, Artificial Sequence
  Synthetic oligonucleotide; CTT chr11 5247786 5247807 5247803 5247808 +
tcttaggcatccacaagggctg

SEQ ID NO: 88296 - DNA, 22 bp, Artificial Sequence
  Synthetic oligonucleotide; TTT chr11 5247787 5247808 5247804 5247809 +
cttaggcatccacaagggctgt

SEQ ID NO: 88297 - DNA, 22 bp, Artificial Sequence
  Synthetic oligonucleotide; TTC chr11 5247788 5247809 5247805 5247810 +
ttaggcatccacaagggctgtg

SEQ ID NO: 88298 - DNA, 22 bp, Artificial Sequence
  Synthetic oligonucleotide; CTT chr11 5247790 5247811 5247807 5247812 +
aggcatccacaagggctgtgaa

SEQ ID NO: 88299 - DNA, 22 bp, Artificial Sequence
  Synthetic oligonucleotide; TTA chr11 5247791 5247812 5247808 5247813 +
ggcatccacaagggctgtgaaa

SEQ ID NO: 88300 - DNA, 22 bp, Artificial Sequence
  Synthetic oligonucleotide; CTG chr11 5247808 5247829 5247825 5247830 +
tgaaaagctaagtgccattaga

SEQ ID NO: 88301 - DNA, 22 bp, Artificial Sequence
  Synthetic oligonucleotide; CTA chr11 5247818 5247839 5247835 5247840 +
agtgccattagaaatagtattc

SEQ ID NO: 88302 - DNA, 22 bp, Artificial Sequence
  Synthetic oligonucleotide; TTA chr11 5247828 5247849 5247845 5247850 +
gaaatagtattcctcctaataa

SEQ ID NO: 88303 - DNA, 22 bp, Artificial Sequence
  Synthetic oligonucleotide; TTC chr11 5247840 5247861 5247857 5247862 +
ctcctaataaaatagaattgct

SEQ ID NO: 88304 - DNA, 22 bp, Artificial Sequence
  Synthetic oligonucleotide; CTC chr11 5247843 5247864 5247860 5247865 +
ctaataaaatagaattgctaca

SEQ ID NO: 88305 - DNA, 22 bp, Artificial Sequence
  Synthetic oligonucleotide; CTA chr11 5247846 5247867 5247863 5247868 +
ataaaatagaattgctacacct

SEQ ID NO: 88306 - DNA, 22 bp, Artificial Sequence
  Synthetic oligonucleotide; TTG chr11 5247860 5247881 5247877 5247882 +
ctacacctgactaaaccttgaa

SEQ ID NO: 88307 - DNA, 22 bp, Artificial Sequence
  Synthetic oligonucleotide; CTA chr11 5247863 5247884 5247880 5247885 +
cacctgactaaaccttgaattc

SEQ ID NO: 88308 - DNA, 22 bp, Artificial Sequence
  Synthetic oligonucleotide; CTG chr11 5247869 5247890 5247886 5247891 +
actaaaccttgaattcctaaag

SEQ ID NO: 88309 - DNA, 22 bp, Artificial Sequence
  Synthetic oligonucleotide; CTA chr11 5247873 5247894 5247890 5247895 +
aaccttgaattcctaaagcttg

SEQ ID NO: 88310 - DNA, 22 bp, Artificial Sequence
  Synthetic oligonucleotide; CTT chr11 5247879 5247900 5247896 5247901 +
gaattcctaaagcttggaacac

SEQ ID NO: 88311 - DNA, 22 bp, Artificial Sequence
  Synthetic oligonucleotide; TTG chr11 5247880 5247901 5247897 5247902 +
aattcctaaagcttggaacact

SEQ ID NO: 88312 - DNA, 22 bp, Artificial Sequence
  Synthetic oligonucleotide; TTC chr11 5247885 5247906 5247902 5247907 +
ctaaagcttggaacactttccc

SEQ ID NO: 88313 - DNA, 22 bp, Artificial Sequence
  Synthetic oligonucleotide; CTA chr11 5247888 5247909 5247905 5247910 +
aagcttggaacactttcccttc

SEQ ID NO: 88314 - DNA, 22 bp, Artificial Sequence
  Synthetic oligonucleotide; CTT chr11 5247894 5247915 5247911 5247916 +
ggaacactttcccttccttaag

SEQ ID NO: 88315 - DNA, 22 bp, Artificial Sequence
  Synthetic oligonucleotide; TTG chr11 5247895 5247916 5247912 5247917 +
gaacactttcccttccttaaga

SEQ ID NO: 88316 - DNA, 22 bp, Artificial Sequence
  Synthetic oligonucleotide; CTT chr11 5247903 5247924 5247920 5247925 +
tcccttccttaagaaccatcct

SEQ ID NO: 88317 - DNA, 22 bp, Artificial Sequence
  Synthetic oligonucleotide; TTT chr11 5247904 5247925 5247921 5247926 +
cccttccttaagaaccatcctt

SEQ ID NO: 88318 - DNA, 22 bp, Artificial Sequence
  Synthetic oligonucleotide; TTC chr11 5247905 5247926 5247922 5247927 +
ccttccttaagaaccatccttg

SEQ ID NO: 88319 - DNA, 22 bp, Artificial Sequence
  Synthetic oligonucleotide; CTT chr11 5247909 5247930 5247926 5247931 +
ccttaagaaccatccttgctac

SEQ ID NO: 88320 - DNA, 22 bp, Artificial Sequence
  Synthetic oligonucleotide; TTC chr11 5247910 5247931 5247927 5247932 +
cttaagaaccatccttgctact

SEQ ID NO: 88321 - DNA, 22 bp, Artificial Sequence
  Synthetic oligonucleotide; CTT chr11 5247913 5247934 5247930 5247935 +
aagaaccatccttgctactcag

SEQ ID NO: 88322 - DNA, 22 bp, Artificial Sequence
  Synthetic oligonucleotide; TTA chr11 5247914 5247935 5247931 5247936 +
agaaccatccttgctactcagc

SEQ ID NO: 88323 - DNA, 22 bp, Artificial Sequence
  Synthetic oligonucleotide; CTT chr11 5247926 5247947 5247943 5247948 +
gctactcagctgcaatcaatcc

SEQ ID NO: 88324 - DNA, 22 bp, Artificial Sequence
  Synthetic oligonucleotide; TTG chr11 5247927 5247948 5247944 5247949 +
ctactcagctgcaatcaatcca

SEQ ID NO: 88325 - DNA, 22 bp, Artificial Sequence
  Synthetic oligonucleotide; CTA chr11 5247930 5247951 5247947 5247952 +
ctcagctgcaatcaatccagcc

SEQ ID NO: 88326 - DNA, 22 bp, Artificial Sequence
  Synthetic oligonucleotide; CTC chr11 5247933 5247954 5247950 5247955 +
agctgcaatcaatccagccccc

SEQ ID NO: 88327 - DNA, 22 bp, Artificial Sequence
  Synthetic oligonucleotide; CTG chr11 5247938 5247959 5247955 5247960 +
caatcaatccagcccccaggtc

SEQ ID NO: 88328 - DNA, 22 bp, Artificial Sequence
  Synthetic oligonucleotide; CTT chr11 5247962 5247983 5247979 5247984 +
cactgaaccttttcccatctct

SEQ ID NO: 88329 - DNA, 22 bp, Artificial Sequence
  Synthetic oligonucleotide; TTC chr11 5247963 5247984 5247980 5247985 +
actgaaccttttcccatctctt

SEQ ID NO: 88330 - DNA, 22 bp, Artificial Sequence
  Synthetic oligonucleotide; CTG chr11 5247967 5247988 5247984 5247989 +
aaccttttcccatctcttccaa

SEQ ID NO: 88331 - DNA, 22 bp, Artificial Sequence
  Synthetic oligonucleotide; CTT chr11 5247973 5247994 5247990 5247995 +
ttcccatctcttccaaaacatc

SEQ ID NO: 88332 - DNA, 22 bp, Artificial Sequence
  Synthetic oligonucleotide; TTT chr11 5247974 5247995 5247991 5247996 +
tcccatctcttccaaaacatct

SEQ ID NO: 88333 - DNA, 22 bp, Artificial Sequence
  Synthetic oligonucleotide; TTT chr11 5247975 5247996 5247992 5247997 +
cccatctcttccaaaacatctg

SEQ ID NO: 88334 - DNA, 22 bp, Artificial Sequence
  Synthetic oligonucleotide; TTC chr11 5247976 5247997 5247993 5247998 +
ccatctcttccaaaacatctgt

SEQ ID NO: 88335 - DNA, 22 bp, Artificial Sequence
  Synthetic oligonucleotide; CTC chr11 5247983 5248004 5248000 5248005 +
ttccaaaacatctgtttctgag

SEQ ID NO: 88336 - DNA, 22 bp, Artificial Sequence
  Synthetic oligonucleotide; CTT chr11 5247985 5248006 5248002 5248007 +
ccaaaacatctgtttctgagaa

SEQ ID NO: 88337 - DNA, 22 bp, Artificial Sequence
  Synthetic oligonucleotide; TTC chr11 5247986 5248007 5248003 5248008 +
caaaacatctgtttctgagaag

SEQ ID NO: 88338 - DNA, 22 bp, Artificial Sequence
  Synthetic oligonucleotide; CTG chr11 5247997 5248018 5248014 5248019 +
tttctgagaagtcctgtcctat

SEQ ID NO: 88339 - DNA, 22 bp, Artificial Sequence
  Synthetic oligonucleotide; TTT chr11 5248000 5248021 5248017 5248022 +
ctgagaagtcctgtcctataga

SEQ ID NO: 88340 - DNA, 22 bp, Artificial Sequence
  Synthetic oligonucleotide; TTC chr11 5248001 5248022 5248018 5248023 +
tgagaagtcctgtcctatagag

SEQ ID NO: 88341 - DNA, 22 bp, Artificial Sequence
  Synthetic oligonucleotide; CTG chr11 5248003 5248024 5248020 5248025 +
agaagtcctgtcctatagaggt

SEQ ID NO: 88342 - DNA, 22 bp, Artificial Sequence
  Synthetic oligonucleotide; CTG chr11 5248013 5248034 5248030 5248035 +
tcctatagaggtctttcttccc

SEQ ID NO: 88343 - DNA, 22 bp, Artificial Sequence
  Synthetic oligonucleotide; CTA chr11 5248018 5248039 5248035 5248040 +
tagaggtctttcttcccaccgg

SEQ ID NO: 88344 - DNA, 22 bp, Artificial Sequence
  Synthetic oligonucleotide; CTT chr11 5248028 5248049 5248045 5248050 +
tcttcccaccggatttctccta

SEQ ID NO: 88345 - DNA, 22 bp, Artificial Sequence
  Synthetic oligonucleotide; TTT chr11 5248029 5248050 5248046 5248051 +
cttcccaccggatttctcctac

SEQ ID NO: 88346 - DNA, 22 bp, Artificial Sequence
  Synthetic oligonucleotide; TTC chr11 5248030 5248051 5248047 5248052 +
ttcccaccggatttctcctaca

SEQ ID NO: 88347 - DNA, 22 bp, Artificial Sequence
  Synthetic oligonucleotide; CTT chr11 5248032 5248053 5248049 5248054 +
cccaccggatttctcctacacc

SEQ ID NO: 88348 - DNA, 22 bp, Artificial Sequence
  Synthetic oligonucleotide; TTC chr11 5248033 5248054 5248050 5248055 +
ccaccggatttctcctacacca

SEQ ID NO: 88349 - DNA, 22 bp, Artificial Sequence
  Synthetic oligonucleotide; TTT chr11 5248044 5248065 5248061 5248066 +
ctcctacaccatttactcccac

SEQ ID NO: 88350 - DNA, 22 bp, Artificial Sequence
  Synthetic oligonucleotide; TTC chr11 5248045 5248066 5248062 5248067 +
tcctacaccatttactcccact

SEQ ID NO: 88351 - DNA, 22 bp, Artificial Sequence
  Synthetic oligonucleotide; CTC chr11 5248047 5248068 5248064 5248069 +
ctacaccatttactcccacttg

SEQ ID NO: 88352 - DNA, 22 bp, Artificial Sequence
  Synthetic oligonucleotide; CTA chr11 5248050 5248071 5248067 5248072 +
caccatttactcccacttgcag

SEQ ID NO: 88353 - DNA, 22 bp, Artificial Sequence
  Synthetic oligonucleotide; TTT chr11 5248058 5248079 5248075 5248080 +
actcccacttgcagaactcccg

SEQ ID NO: 88354 - DNA, 22 bp, Artificial Sequence
  Synthetic oligonucleotide; TTA chr11 5248059 5248080 5248076 5248081 +
ctcccacttgcagaactcccgt

SEQ ID NO: 88355 - DNA, 22 bp, Artificial Sequence
  Synthetic oligonucleotide; CTC chr11 5248062 5248083 5248079 5248084 +
ccacttgcagaactcccgtgta

SEQ ID NO: 88356 - DNA, 22 bp, Artificial Sequence
  Synthetic oligonucleotide; CTT chr11 5248068 5248089 5248085 5248090 +
gcagaactcccgtgtacaagtg

SEQ ID NO: 88357 - DNA, 22 bp, Artificial Sequence
  Synthetic oligonucleotide; TTG chr11 5248069 5248090 5248086 5248091 +
cagaactcccgtgtacaagtgt

SEQ ID NO: 88358 - DNA, 22 bp, Artificial Sequence
  Synthetic oligonucleotide; CTC chr11 5248077 5248098 5248094 5248099 +
ccgtgtacaagtgtctttactg

SEQ ID NO: 88359 - DNA, 22 bp, Artificial Sequence
  Synthetic oligonucleotide; CTT chr11 5248094 5248115 5248111 5248116 +
tactgcttttatttgctcatca

SEQ ID NO: 88360 - DNA, 22 bp, Artificial Sequence
  Synthetic oligonucleotide; TTT chr11 5248095 5248116 5248112 5248117 +
actgcttttatttgctcatcaa

SEQ ID NO: 88361 - DNA, 22 bp, Artificial Sequence
  Synthetic oligonucleotide; TTA chr11 5248096 5248117 5248113 5248118 +
ctgcttttatttgctcatcaaa

SEQ ID NO: 88362 - DNA, 22 bp, Artificial Sequence
  Synthetic oligonucleotide; CTG chr11 5248099 5248120 5248116 5248121 +
cttttatttgctcatcaaaatg

SEQ ID NO: 88363 - DNA, 22 bp, Artificial Sequence
  Synthetic oligonucleotide; CTT chr11 5248102 5248123 5248119 5248124 +
ttatttgctcatcaaaatgcac

SEQ ID NO: 88364 - DNA, 22 bp, Artificial Sequence
  Synthetic oligonucleotide; TTT chr11 5248103 5248124 5248120 5248125 +
tatttgctcatcaaaatgcaca

SEQ ID NO: 88365 - DNA, 22 bp, Artificial Sequence
  Synthetic oligonucleotide; TTT chr11 5248104 5248125 5248121 5248126 +
atttgctcatcaaaatgcacat

SEQ ID NO: 88366 - DNA, 22 bp, Artificial Sequence
  Synthetic oligonucleotide; TTA chr11 5248105 5248126 5248122 5248127 +
tttgctcatcaaaatgcacatc

SEQ ID NO: 88367 - DNA, 22 bp, Artificial Sequence
  Synthetic oligonucleotide; TTT chr11 5248108 5248129 5248125 5248130 +
gctcatcaaaatgcacatctca

SEQ ID NO: 88368 - DNA, 22 bp, Artificial Sequence
  Synthetic oligonucleotide; TTG chr11 5248109 5248130 5248126 5248131 +
ctcatcaaaatgcacatctcat

SEQ ID NO: 88369 - DNA, 22 bp, Artificial Sequence
  Synthetic oligonucleotide; CTC chr11 5248112 5248133 5248129 5248134 +
atcaaaatgcacatctcatata

SEQ ID NO: 88370 - DNA, 22 bp, Artificial Sequence
  Synthetic oligonucleotide; CTC chr11 5248129 5248150 5248146 5248151 +
atataaaaataaatgaggagca

SEQ ID NO: 88371 - DNA, 22 bp, Artificial Sequence
  Synthetic oligonucleotide; CTT chr11 5248201 5248222 5248218 5248223 +
ccctcaatataaaccctttgtg

SEQ ID NO: 88372 - DNA, 22 bp, Artificial Sequence
  Synthetic oligonucleotide; TTC chr11 5248202 5248223 5248219 5248224 +
cctcaatataaaccctttgtgg

SEQ ID NO: 88373 - DNA, 22 bp, Artificial Sequence
  Synthetic oligonucleotide; CTC chr11 5248206 5248227 5248223 5248228 +
aatataaaccctttgtggctca

SEQ ID NO: 88374 - DNA, 22 bp, Artificial Sequence
  Synthetic oligonucleotide; CTT chr11 5248219 5248240 5248236 5248241 +
tgtggctcatatatttaaaaag

SEQ ID NO: 88375 - DNA, 22 bp, Artificial Sequence
  Synthetic oligonucleotide; TTT chr11 5248220 5248241 5248237 5248242 +
gtggctcatatatttaaaaaga

SEQ ID NO: 88376 - DNA, 22 bp, Artificial Sequence
  Synthetic oligonucleotide; TTG chr11 5248221 5248242 5248238 5248243 +
tggctcatatatttaaaaagat

SEQ ID NO: 88377 - DNA, 22 bp, Artificial Sequence
  Synthetic oligonucleotide; CTC chr11 5248227 5248248 5248244 5248249 +
atatatttaaaaagatgtaaaa

SEQ ID NO: 88378 - DNA, 22 bp, Artificial Sequence
  Synthetic oligonucleotide; TTT chr11 5248235 5248256 5248252 5248257 +
aaaaagatgtaaaaaaaagagc

SEQ ID NO: 88379 - DNA, 22 bp, Artificial Sequence
  Synthetic oligonucleotide; TTA chr11 5248236 5248257 5248253 5248258 +
aaaagatgtaaaaaaaagagct

SEQ ID NO: 88380 - DNA, 22 bp, Artificial Sequence
  Synthetic oligonucleotide; CTG chr11 5248259 5248280 5248276 5248281 +
aagaaaatcatgtgtgatctct

SEQ ID NO: 88381 - DNA, 22 bp, Artificial Sequence
  Synthetic oligonucleotide; CTC chr11 5248280 5248301 5248297 5248302 +
tcagcagaatagatttattatt

SEQ ID NO: 88382 - DNA, 22 bp, Artificial Sequence
  Synthetic oligonucleotide; CTC chr11 5248282 5248303 5248299 5248304 +
agcagaatagatttattatttg

SEQ ID NO: 88383 - DNA, 22 bp, Artificial Sequence
  Synthetic oligonucleotide; TTT chr11 5248296 5248317 5248313 5248318 +
attatttgtattgcttgcagaa

SEQ ID NO: 88384 - DNA, 22 bp, Artificial Sequence
  Synthetic oligonucleotide; TTA chr11 5248297 5248318 5248314 5248319 +
ttatttgtattgcttgcagaat

SEQ ID NO: 88385 - DNA, 22 bp, Artificial Sequence
  Synthetic oligonucleotide; TTA chr11 5248300 5248321 5248317 5248322 +
tttgtattgcttgcagaataaa

SEQ ID NO: 88386 - DNA, 22 bp, Artificial Sequence
  Synthetic oligonucleotide; TTT chr11 5248303 5248324 5248320 5248325 +
gtattgcttgcagaataaagcc

SEQ ID NO: 88387 - DNA, 22 bp, Artificial Sequence
  Synthetic oligonucleotide; TTG chr11 5248304 5248325 5248321 5248326 +
tattgcttgcagaataaagcct

SEQ ID NO: 88388 - DNA, 22 bp, Artificial Sequence
  Synthetic oligonucleotide; TTG chr11 5248309 5248330 5248326 5248331 +
cttgcagaataaagcctatcct

SEQ ID NO: 88389 - DNA, 22 bp, Artificial Sequence
  Synthetic oligonucleotide; CTT chr11 5248312 5248333 5248329 5248334 +
gcagaataaagcctatccttga

SEQ ID NO: 88390 - DNA, 22 bp, Artificial Sequence
  Synthetic oligonucleotide; TTG chr11 5248313 5248334 5248330 5248335 +
cagaataaagcctatccttgaa

SEQ ID NO: 88391 - DNA, 22 bp, Artificial Sequence
  Synthetic oligonucleotide; CTA chr11 5248327 5248348 5248344 5248349 +
tccttgaaagctctgaatcatg

SEQ ID NO: 88392 - DNA, 22 bp, Artificial Sequence
  Synthetic oligonucleotide; CTT chr11 5248332 5248353 5248349 5248354 +
gaaagctctgaatcatgggcag

SEQ ID NO: 88393 - DNA, 22 bp, Artificial Sequence
  Synthetic oligonucleotide; TTG chr11 5248333 5248354 5248350 5248355 +
aaagctctgaatcatgggcagt

SEQ ID NO: 88394 - DNA, 22 bp, Artificial Sequence
  Synthetic oligonucleotide; CTC chr11 5248340 5248361 5248357 5248362 +
tgaatcatgggcagtgagctca

SEQ ID NO: 88395 - DNA, 22 bp, Artificial Sequence
  Synthetic oligonucleotide; CTG chr11 5248342 5248363 5248359 5248364 +
aatcatgggcagtgagctcagt

SEQ ID NO: 88396 - DNA, 22 bp, Artificial Sequence
  Synthetic oligonucleotide; CTC chr11 5248361 5248382 5248378 5248383 +
agtggtatctggaggacagggc

SEQ ID NO: 88397 - DNA, 22 bp, Artificial Sequence
  Synthetic oligonucleotide; CTG chr11 5248372 5248393 5248389 5248394 +
gaggacagggcactggccactg

SEQ ID NO: 88398 - DNA, 22 bp, Artificial Sequence
  Synthetic oligonucleotide; CTG chr11 5248387 5248408 5248404 5248409 +
gccactgcagtcaccatcttct

SEQ ID NO: 88399 - DNA, 22 bp, Artificial Sequence
  Synthetic oligonucleotide; CTG chr11 5248394 5248415 5248411 5248416 +
cagtcaccatcttctgccagga

SEQ ID NO: 88400 - DNA, 22 bp, Artificial Sequence
  Synthetic oligonucleotide; CTT chr11 5248407 5248428 5248424 5248429 +
ctgccaggaagcctgcacctca

SEQ ID NO: 88401 - DNA, 22 bp, Artificial Sequence
  Synthetic oligonucleotide; TTC chr11 5248408 5248429 5248425 5248430 +
tgccaggaagcctgcacctcag

SEQ ID NO: 88402 - DNA, 22 bp, Artificial Sequence
  Synthetic oligonucleotide; CTG chr11 5248410 5248431 5248427 5248432 +
ccaggaagcctgcacctcaggg

SEQ ID NO: 88403 - DNA, 22 bp, Artificial Sequence
  Synthetic oligonucleotide; CTG chr11 5248422 5248443 5248439 5248444 +
cacctcaggggtgaattctttg

SEQ ID NO: 88404 - DNA, 22 bp, Artificial Sequence
  Synthetic oligonucleotide; CTC chr11 5248428 5248449 5248445 5248450 +
aggggtgaattctttgccgaaa

SEQ ID NO: 88405 - DNA, 22 bp, Artificial Sequence
  Synthetic oligonucleotide; TTC chr11 5248440 5248461 5248457 5248462 +
tttgccgaaatggattgccaaa

SEQ ID NO: 88406 - DNA, 22 bp, Artificial Sequence
  Synthetic oligonucleotide; CTT chr11 5248442 5248463 5248459 5248464 +
tgccgaaatggattgccaaaac

SEQ ID NO: 88407 - DNA, 22 bp, Artificial Sequence
  Synthetic oligonucleotide; TTT chr11 5248443 5248464 5248460 5248465 +
gccgaaatggattgccaaaacg

SEQ ID NO: 88408 - DNA, 22 bp, Artificial Sequence
  Synthetic oligonucleotide; TTG chr11 5248444 5248465 5248461 5248466 +
ccgaaatggattgccaaaacgg

SEQ ID NO: 88409 - DNA, 22 bp, Artificial Sequence
  Synthetic oligonucleotide; TTG chr11 5248457 5248478 5248474 5248479 +
ccaaaacggtcaccagcacatt

SEQ ID NO: 88410 - DNA, 22 bp, Artificial Sequence
  Synthetic oligonucleotide; TTT chr11 5248480 5248501 5248497 5248502 +
cccaggagctgttgagatgaaa

SEQ ID NO: 88411 - DNA, 22 bp, Artificial Sequence
  Synthetic oligonucleotide; TTC chr11 5248481 5248502 5248498 5248503 +
ccaggagctgttgagatgaaag

SEQ ID NO: 88412 - DNA, 22 bp, Artificial Sequence
  Synthetic oligonucleotide; CTG chr11 5248491 5248512 5248508 5248513 +
ttgagatgaaaggagacaataa

SEQ ID NO: 88413 - DNA, 22 bp, Artificial Sequence
  Synthetic oligonucleotide; TTG chr11 5248494 5248515 5248511 5248516 +
agatgaaaggagacaataaaga

SEQ ID NO: 88414 - DNA, 22 bp, Artificial Sequence
  Synthetic oligonucleotide; CTG chr11 5248534 5248555 5248551 5248556 +
agagctccagcctggcctccag

SEQ ID NO: 88415 - DNA, 22 bp, Artificial Sequence
  Synthetic oligonucleotide; CTC chr11 5248541 5248562 5248558 5248563 +
cagcctggcctccagataacta

SEQ ID NO: 88416 - DNA, 22 bp, Artificial Sequence
  Synthetic oligonucleotide; CTG chr11 5248548 5248569 5248565 5248570 +
gcctccagataactacacacca

SEQ ID NO: 88417 - DNA, 22 bp, Artificial Sequence
  Synthetic oligonucleotide; CTC chr11 5248553 5248574 5248570 5248575 +
cagataactacacaccaagctt

SEQ ID NO: 88418 - DNA, 22 bp, Artificial Sequence
  Synthetic oligonucleotide; CTA chr11 5248563 5248584 5248580 5248585 +
cacaccaagcttccacccagaa

SEQ ID NO: 88419 - DNA, 22 bp, Artificial Sequence
  Synthetic oligonucleotide; CTT chr11 5248575 5248596 5248592 5248597 +
ccacccagaatcaagcctatgt

SEQ ID NO: 88420 - DNA, 22 bp, Artificial Sequence
  Synthetic oligonucleotide; TTC chr11 5248576 5248597 5248593 5248598 +
cacccagaatcaagcctatgtt

SEQ ID NO: 88421 - DNA, 22 bp, Artificial Sequence
  Synthetic oligonucleotide; CTA chr11 5248594 5248615 5248611 5248616 +
tgttaacttccctcaaagcctg

SEQ ID NO: 88422 - DNA, 22 bp, Artificial Sequence
  Synthetic oligonucleotide; TTA chr11 5248599 5248620 5248616 5248621 +
acttccctcaaagcctgagatt

SEQ ID NO: 88423 - DNA, 22 bp, Artificial Sequence
  Synthetic oligonucleotide; CTT chr11 5248603 5248624 5248620 5248625 +
ccctcaaagcctgagattttgc

SEQ ID NO: 88424 - DNA, 22 bp, Artificial Sequence
  Synthetic oligonucleotide; TTC chr11 5248604 5248625 5248621 5248626 +
cctcaaagcctgagattttgcc

SEQ ID NO: 88425 - DNA, 22 bp, Artificial Sequence
  Synthetic oligonucleotide; CTC chr11 5248608 5248629 5248625 5248630 +
aaagcctgagattttgccttcc

SEQ ID NO: 88426 - DNA, 22 bp, Artificial Sequence
  Synthetic oligonucleotide; CTG chr11 5248616 5248637 5248633 5248638 +
agattttgccttcccattaaat

SEQ ID NO: 88427 - DNA, 22 bp, Artificial Sequence
  Synthetic oligonucleotide; TTT chr11 5248622 5248643 5248639 5248644 +
tgccttcccattaaatgcaggt

SEQ ID NO: 88428 - DNA, 22 bp, Artificial Sequence
  Synthetic oligonucleotide; TTT chr11 5248623 5248644 5248640 5248645 +
gccttcccattaaatgcaggta

SEQ ID NO: 88429 - DNA, 22 bp, Artificial Sequence
  Synthetic oligonucleotide; TTG chr11 5248624 5248645 5248641 5248646 +
ccttcccattaaatgcaggtag

SEQ ID NO: 88430 - DNA, 22 bp, Artificial Sequence
  Synthetic oligonucleotide; CTT chr11 5248628 5248649 5248645 5248650 +
cccattaaatgcaggtagttgt

SEQ ID NO: 88431 - DNA, 22 bp, Artificial Sequence
  Synthetic oligonucleotide; TTC chr11 5248629 5248650 5248646 5248651 +
ccattaaatgcaggtagttgtt

SEQ ID NO: 88432 - DNA, 22 bp, Artificial Sequence
  Synthetic oligonucleotide; TTA chr11 5248635 5248656 5248652 5248657 +
aatgcaggtagttgttcccctt

SEQ ID NO: 88433 - DNA, 22 bp, Artificial Sequence
  Synthetic oligonucleotide; TTG chr11 5248649 5248670 5248666 5248671 +
ttccccttcaagcactagtcac

SEQ ID NO: 88434 - DNA, 22 bp, Artificial Sequence
  Synthetic oligonucleotide; TTC chr11 5248652 5248673 5248669 5248674 +
cccttcaagcactagtcactgg

SEQ ID NO: 88435 - DNA, 22 bp, Artificial Sequence
  Synthetic oligonucleotide; CTT chr11 5248657 5248678 5248674 5248679 +
caagcactagtcactggccata

SEQ ID NO: 88436 - DNA, 22 bp, Artificial Sequence
  Synthetic oligonucleotide; TTC chr11 5248658 5248679 5248675 5248680 +
aagcactagtcactggccataa

SEQ ID NO: 88437 - DNA, 22 bp, Artificial Sequence
  Synthetic oligonucleotide; CTA chr11 5248666 5248687 5248683 5248688 +
gtcactggccataatttaaatc

SEQ ID NO: 88438 - DNA, 22 bp, Artificial Sequence
  Synthetic oligonucleotide; CTG chr11 5248673 5248694 5248690 5248695 +
gccataatttaaatcttgctat

SEQ ID NO: 88439 - DNA, 22 bp, Artificial Sequence
  Synthetic oligonucleotide; TTT chr11 5248683 5248704 5248700 5248705 +
aaatcttgctatcttcttgcca

SEQ ID NO: 88440 - DNA, 22 bp, Artificial Sequence
  Synthetic oligonucleotide; TTA chr11 5248684 5248705 5248701 5248706 +
aatcttgctatcttcttgccac

SEQ ID NO: 88441 - DNA, 22 bp, Artificial Sequence
  Synthetic oligonucleotide; CTT chr11 5248690 5248711 5248707 5248712 +
gctatcttcttgccaccatgaa

SEQ ID NO: 88442 - DNA, 22 bp, Artificial Sequence
  Synthetic oligonucleotide; TTG chr11 5248691 5248712 5248708 5248713 +
ctatcttcttgccaccatgaac

SEQ ID NO: 88443 - DNA, 22 bp, Artificial Sequence
  Synthetic oligonucleotide; CTA chr11 5248694 5248715 5248711 5248716 +
tcttcttgccaccatgaaccct

SEQ ID NO: 88444 - DNA, 22 bp, Artificial Sequence
  Synthetic oligonucleotide; CTT chr11 5248698 5248719 5248715 5248720 +
cttgccaccatgaaccctgtat

SEQ ID NO: 88445 - DNA, 22 bp, Artificial Sequence
  Synthetic oligonucleotide; TTC chr11 5248699 5248720 5248716 5248721 +
ttgccaccatgaaccctgtatg

SEQ ID NO: 88446 - DNA, 22 bp, Artificial Sequence
  Synthetic oligonucleotide; CTT chr11 5248701 5248722 5248718 5248723 +
gccaccatgaaccctgtatgtt

SEQ ID NO: 88447 - DNA, 22 bp, Artificial Sequence
  Synthetic oligonucleotide; TTG chr11 5248702 5248723 5248719 5248724 +
ccaccatgaaccctgtatgttg

SEQ ID NO: 88448 - DNA, 22 bp, Artificial Sequence
  Synthetic oligonucleotide; CTG chr11 5248717 5248738 5248734 5248739 +
tatgttgtaggctgaagacgtt

SEQ ID NO: 88449 - DNA, 22 bp, Artificial Sequence
  Synthetic oligonucleotide; TTG chr11 5248724 5248745 5248741 5248746 +
taggctgaagacgttaaaagaa

SEQ ID NO: 88450 - DNA, 22 bp, Artificial Sequence
  Synthetic oligonucleotide; CTG chr11 5248731 5248752 5248748 5248753 +
aagacgttaaaagaaacacacg

SEQ ID NO: 88451 - DNA, 22 bp, Artificial Sequence
  Synthetic oligonucleotide; TTA chr11 5248740 5248761 5248757 5248762 +
aaagaaacacacgctgacacac

SEQ ID NO: 88452 - DNA, 22 bp, Artificial Sequence
  Synthetic oligonucleotide; CTG chr11 5248756 5248777 5248773 5248778 +
acacacacacacacacgcgcgc

SEQ ID NO: 88453 - DNA, 22 bp, Artificial Sequence
  Synthetic oligonucleotide; CTG chr11 5248807 5248828 5248824 5248829 +
actttcaaaatctactccagcc

SEQ ID NO: 88454 - DNA, 22 bp, Artificial Sequence
  Synthetic oligonucleotide; CTT chr11 5248811 5248832 5248828 5248833 +
tcaaaatctactccagcccaaa

SEQ ID NO: 88455 - DNA, 22 bp, Artificial Sequence
  Synthetic oligonucleotide; TTT chr11 5248812 5248833 5248829 5248834 +
caaaatctactccagcccaaat

SEQ ID NO: 88456 - DNA, 22 bp, Artificial Sequence
  Synthetic oligonucleotide; TTC chr11 5248813 5248834 5248830 5248835 +
aaaatctactccagcccaaatg

SEQ ID NO: 88457 - DNA, 22 bp, Artificial Sequence
  Synthetic oligonucleotide; CTA chr11 5248821 5248842 5248838 5248843 +
ctccagcccaaatgtttcaatt

SEQ ID NO: 88458 - DNA, 22 bp, Artificial Sequence
  Synthetic oligonucleotide; CTC chr11 5248824 5248845 5248841 5248846 +
cagcccaaatgtttcaattgtt

SEQ ID NO: 88459 - DNA, 22 bp, Artificial Sequence
  Synthetic oligonucleotide; TTT chr11 5248838 5248859 5248855 5248860 +
caattgttcctcacccctggac

SEQ ID NO: 88460 - DNA, 22 bp, Artificial Sequence
  Synthetic oligonucleotide; TTC chr11 5248839 5248860 5248856 5248861 +
aattgttcctcacccctggaca

SEQ ID NO: 88461 - DNA, 22 bp, Artificial Sequence
  Synthetic oligonucleotide; TTG chr11 5248844 5248865 5248861 5248866 +
ttcctcacccctggacatactt

SEQ ID NO: 88462 - DNA, 22 bp, Artificial Sequence
  Synthetic oligonucleotide; TTC chr11 5248847 5248868 5248864 5248869 +
ctcacccctggacatactttgc

SEQ ID NO: 88463 - DNA, 22 bp, Artificial Sequence
  Synthetic oligonucleotide; CTC chr11 5248850 5248871 5248867 5248872 +
acccctggacatactttgcccc

SEQ ID NO: 88464 - DNA, 22 bp, Artificial Sequence
  Synthetic oligonucleotide; CTG chr11 5248857 5248878 5248874 5248879 +
gacatactttgcccccatctgg

SEQ ID NO: 88465 - DNA, 22 bp, Artificial Sequence
  Synthetic oligonucleotide; CTT chr11 5248866 5248887 5248883 5248888 +
tgcccccatctggaattaaagg

SEQ ID NO: 88466 - DNA, 22 bp, Artificial Sequence
  Synthetic oligonucleotide; TTT chr11 5248867 5248888 5248884 5248889 +
gcccccatctggaattaaagga

SEQ ID NO: 88467 - DNA, 22 bp, Artificial Sequence
  Synthetic oligonucleotide; TTG chr11 5248868 5248889 5248885 5248890 +
cccccatctggaattaaaggat

SEQ ID NO: 88468 - DNA, 22 bp, Artificial Sequence
  Synthetic oligonucleotide; CTG chr11 5248878 5248899 5248895 5248900 +
gaattaaaggatataagtttgt

SEQ ID NO: 88469 - DNA, 22 bp, Artificial Sequence
  Synthetic oligonucleotide; TTA chr11 5248884 5248905 5248901 5248906 +
aaggatataagtttgtaatgaa

SEQ ID NO: 88470 - DNA, 22 bp, Artificial Sequence
  Synthetic oligonucleotide; TTT chr11 5248898 5248919 5248915 5248920 +
gtaatgaagcattagcagcatt

SEQ ID NO: 88471 - DNA, 22 bp, Artificial Sequence
  Synthetic oligonucleotide; TTG chr11 5248899 5248920 5248916 5248921 +
taatgaagcattagcagcattt

SEQ ID NO: 88472 - DNA, 22 bp, Artificial Sequence
  Synthetic oligonucleotide; TTA chr11 5248912 5248933 5248929 5248934 +
gcagcattttatatgtgtccag

SEQ ID NO: 88473 - DNA, 22 bp, Artificial Sequence
  Synthetic oligonucleotide; TTT chr11 5248921 5248942 5248938 5248943 +
tatatgtgtccagctgatatag

SEQ ID NO: 88474 - DNA, 22 bp, Artificial Sequence
  Synthetic oligonucleotide; TTT chr11 5248922 5248943 5248939 5248944 +
atatgtgtccagctgatatagg

SEQ ID NO: 88475 - DNA, 22 bp, Artificial Sequence
  Synthetic oligonucleotide; TTA chr11 5248923 5248944 5248940 5248945 +
tatgtgtccagctgatatagga

SEQ ID NO: 88476 - DNA, 22 bp, Artificial Sequence
  Synthetic oligonucleotide; CTG chr11 5248937 5248958 5248954 5248959 +
atataggaatagccttagcaat

SEQ ID NO: 88477 - DNA, 22 bp, Artificial Sequence
  Synthetic oligonucleotide; CTT chr11 5248953 5248974 5248970 5248975 +
agcaatgtatgtttggccacca

SEQ ID NO: 88478 - DNA, 22 bp, Artificial Sequence
  Synthetic oligonucleotide; TTA chr11 5248954 5248975 5248971 5248976 +
gcaatgtatgtttggccaccaa

SEQ ID NO: 88479 - DNA, 22 bp, Artificial Sequence
  Synthetic oligonucleotide; TTT chr11 5248967 5248988 5248984 5248989 +
ggccaccaaagttccccacttt

SEQ ID NO: 88480 - DNA, 22 bp, Artificial Sequence
  Synthetic oligonucleotide; TTG chr11 5248968 5248989 5248985 5248990 +
gccaccaaagttccccactttg

SEQ ID NO: 88481 - DNA, 22 bp, Artificial Sequence
  Synthetic oligonucleotide; TTC chr11 5248981 5249002 5248998 5249003 +
cccactttgactgagccaatat

SEQ ID NO: 88482 - DNA, 22 bp, Artificial Sequence
  Synthetic oligonucleotide; CTT chr11 5248988 5249009 5249005 5249010 +
tgactgagccaatatatgcctt

SEQ ID NO: 88483 - DNA, 22 bp, Artificial Sequence
  Synthetic oligonucleotide; TTT chr11 5248989 5249010 5249006 5249011 +
gactgagccaatatatgccttc

SEQ ID NO: 88484 - DNA, 22 bp, Artificial Sequence
  Synthetic oligonucleotide; TTG chr11 5248990 5249011 5249007 5249012 +
actgagccaatatatgccttct

SEQ ID NO: 88485 - DNA, 22 bp, Artificial Sequence
  Synthetic oligonucleotide; CTG chr11 5248994 5249015 5249011 5249016 +
agccaatatatgccttctgcct

SEQ ID NO: 88486 - DNA, 22 bp, Artificial Sequence
  Synthetic oligonucleotide; CTT chr11 5249010 5249031 5249027 5249032 +
ctgcctgcatctttttaacgac

SEQ ID NO: 88487 - DNA, 22 bp, Artificial Sequence
  Synthetic oligonucleotide; TTC chr11 5249011 5249032 5249028 5249033 +
tgcctgcatctttttaacgacc

SEQ ID NO: 88488 - DNA, 22 bp, Artificial Sequence
  Synthetic oligonucleotide; CTG chr11 5249013 5249034 5249030 5249035 +
cctgcatctttttaacgaccat

SEQ ID NO: 88489 - DNA, 22 bp, Artificial Sequence
  Synthetic oligonucleotide; CTG chr11 5249017 5249038 5249034 5249039 +
catctttttaacgaccatactt

SEQ ID NO: 88490 - DNA, 22 bp, Artificial Sequence
  Synthetic oligonucleotide; CTT chr11 5249023 5249044 5249040 5249045 +
tttaacgaccatacttgtcctg

SEQ ID NO: 88491 - DNA, 22 bp, Artificial Sequence
  Synthetic oligonucleotide; TTT chr11 5249024 5249045 5249041 5249046 +
ttaacgaccatacttgtcctgc

SEQ ID NO: 88492 - DNA, 22 bp, Artificial Sequence
  Synthetic oligonucleotide; TTT chr11 5249025 5249046 5249042 5249047 +
taacgaccatacttgtcctgcc

SEQ ID NO: 88493 - DNA, 22 bp, Artificial Sequence
  Synthetic oligonucleotide; TTT chr11 5249026 5249047 5249043 5249048 +
aacgaccatacttgtcctgcct

SEQ ID NO: 88494 - DNA, 22 bp, Artificial Sequence
  Synthetic oligonucleotide; TTA chr11 5249027 5249048 5249044 5249049 +
acgaccatacttgtcctgcctc

SEQ ID NO: 88495 - DNA, 22 bp, Artificial Sequence
  Synthetic oligonucleotide; CTT chr11 5249039 5249060 5249056 5249061 +
gtcctgcctccagatagatgtt

SEQ ID NO: 88496 - DNA, 22 bp, Artificial Sequence
  Synthetic oligonucleotide; TTG chr11 5249040 5249061 5249057 5249062 +
tcctgcctccagatagatgttt

SEQ ID NO: 88497 - DNA, 22 bp, Artificial Sequence
  Synthetic oligonucleotide; CTG chr11 5249045 5249066 5249062 5249067 +
cctccagatagatgttttaaaa

SEQ ID NO: 88498 - DNA, 22 bp, Artificial Sequence
  Synthetic oligonucleotide; CTC chr11 5249049 5249070 5249066 5249071 +
cagatagatgttttaaaacaac

SEQ ID NO: 88499 - DNA, 22 bp, Artificial Sequence
  Synthetic oligonucleotide; TTT chr11 5249062 5249083 5249079 5249084 +
taaaacaacaaaaatgagggaa

SEQ ID NO: 88500 - DNA, 22 bp, Artificial Sequence
  Synthetic oligonucleotide; TTT chr11 5249063 5249084 5249080 5249085 +
aaaacaacaaaaatgagggaaa

SEQ ID NO: 88501 - DNA, 22 bp, Artificial Sequence
  Synthetic oligonucleotide; TTA chr11 5249064 5249085 5249081 5249086 +
aaacaacaaaaatgagggaaag

SEQ ID NO: 88502 - DNA, 22 bp, Artificial Sequence
  Synthetic oligonucleotide; TTC chr11 5249096 5249117 5249113 5249118 +
tttctactggaatctaataaag

SEQ ID NO: 88503 - DNA, 22 bp, Artificial Sequence
  Synthetic oligonucleotide; CTT chr11 5249098 5249119 5249115 5249120 +
tctactggaatctaataaagaa

SEQ ID NO: 88504 - DNA, 22 bp, Artificial Sequence
  Synthetic oligonucleotide; TTT chr11 5249099 5249120 5249116 5249121 +
ctactggaatctaataaagaaa

SEQ ID NO: 88505 - DNA, 22 bp, Artificial Sequence
  Synthetic oligonucleotide; TTC chr11 5249100 5249121 5249117 5249122 +
tactggaatctaataaagaaaa

SEQ ID NO: 88506 - DNA, 22 bp, Artificial Sequence
  Synthetic oligonucleotide; CTA chr11 5249102 5249123 5249119 5249124 +
ctggaatctaataaagaaaagt

SEQ ID NO: 88507 - DNA, 22 bp, Artificial Sequence
  Synthetic oligonucleotide; CTG chr11 5249105 5249126 5249122 5249127 +
gaatctaataaagaaaagtcat

SEQ ID NO: 88508 - DNA, 22 bp, Artificial Sequence
  Synthetic oligonucleotide; CTA chr11 5249112 5249133 5249129 5249134 +
ataaagaaaagtcattttcctc

SEQ ID NO: 88509 - DNA, 22 bp, Artificial Sequence
  Synthetic oligonucleotide; TTT chr11 5249129 5249150 5249146 5249151 +
tcctcatttccacctctctttt

SEQ ID NO: 88510 - DNA, 22 bp, Artificial Sequence
  Synthetic oligonucleotide; TTT chr11 5249130 5249151 5249147 5249152 +
cctcatttccacctctcttttc

SEQ ID NO: 88511 - DNA, 22 bp, Artificial Sequence
  Synthetic oligonucleotide; TTC chr11 5249131 5249152 5249148 5249153 +
ctcatttccacctctcttttct

SEQ ID NO: 88512 - DNA, 22 bp, Artificial Sequence
  Synthetic oligonucleotide; CTC chr11 5249134 5249155 5249151 5249156 +
atttccacctctcttttctcaa

SEQ ID NO: 88513 - DNA, 22 bp, Artificial Sequence
  Synthetic oligonucleotide; TTT chr11 5249138 5249159 5249155 5249160 +
ccacctctcttttctcaaagtc

SEQ ID NO: 88514 - DNA, 22 bp, Artificial Sequence
  Synthetic oligonucleotide; TTC chr11 5249139 5249160 5249156 5249161 +
cacctctcttttctcaaagtca

SEQ ID NO: 88515 - DNA, 22 bp, Artificial Sequence
  Synthetic oligonucleotide; CTC chr11 5249145 5249166 5249162 5249167 +
tcttttctcaaagtcaaaattg

SEQ ID NO: 88516 - DNA, 22 bp, Artificial Sequence
  Synthetic oligonucleotide; CTC chr11 5249147 5249168 5249164 5249169 +
ttttctcaaagtcaaaattgtc

SEQ ID NO: 88517 - DNA, 22 bp, Artificial Sequence
  Synthetic oligonucleotide; CTT chr11 5249149 5249170 5249166 5249171 +
ttctcaaagtcaaaattgtcca

SEQ ID NO: 88518 - DNA, 22 bp, Artificial Sequence
  Synthetic oligonucleotide; TTT chr11 5249150 5249171 5249167 5249172 +
tctcaaagtcaaaattgtccat

SEQ ID NO: 88519 - DNA, 22 bp, Artificial Sequence
  Synthetic oligonucleotide; TTT chr11 5249151 5249172 5249168 5249173 +
ctcaaagtcaaaattgtccatc

SEQ ID NO: 88520 - DNA, 22 bp, Artificial Sequence
  Synthetic oligonucleotide; TTC chr11 5249152 5249173 5249169 5249174 +
tcaaagtcaaaattgtccatct

SEQ ID NO: 88521 - DNA, 22 bp, Artificial Sequence
  Synthetic oligonucleotide; CTC chr11 5249154 5249175 5249171 5249176 +
aaagtcaaaattgtccatctag

SEQ ID NO: 88522 - DNA, 22 bp, Artificial Sequence
  Synthetic oligonucleotide; TTG chr11 5249167 5249188 5249184 5249189 +
tccatctagatttttagaggca

SEQ ID NO: 88523 - DNA, 22 bp, Artificial Sequence
  Synthetic oligonucleotide; CTA chr11 5249175 5249196 5249192 5249197 +
gatttttagaggcactccttag

SEQ ID NO: 88524 - DNA, 22 bp, Artificial Sequence
  Synthetic oligonucleotide; TTT chr11 5249180 5249201 5249197 5249202 +
ttagaggcactccttaggccct

SEQ ID NO: 88525 - DNA, 22 bp, Artificial Sequence
  Synthetic oligonucleotide; TTT chr11 5249181 5249202 5249198 5249203 +
tagaggcactccttaggcccta

SEQ ID NO: 88526 - DNA, 22 bp, Artificial Sequence
  Synthetic oligonucleotide; TTT chr11 5249182 5249203 5249199 5249204 +
agaggcactccttaggccctaa

SEQ ID NO: 88527 - DNA, 22 bp, Artificial Sequence
  Synthetic oligonucleotide; TTA chr11 5249183 5249204 5249200 5249205 +
gaggcactccttaggccctaaa

SEQ ID NO: 88528 - DNA, 22 bp, Artificial Sequence
  Synthetic oligonucleotide; CTC chr11 5249192 5249213 5249209 5249214 +
cttaggccctaaaacattacca

SEQ ID NO: 88529 - DNA, 22 bp, Artificial Sequence
  Synthetic oligonucleotide; CTT chr11 5249195 5249216 5249212 5249217 +
aggccctaaaacattaccactg

SEQ ID NO: 88530 - DNA, 22 bp, Artificial Sequence
  Synthetic oligonucleotide; TTA chr11 5249196 5249217 5249213 5249218 +
ggccctaaaacattaccactgg

SEQ ID NO: 88531 - DNA, 22 bp, Artificial Sequence
  Synthetic oligonucleotide; CTA chr11 5249203 5249224 5249220 5249225 +
aaacattaccactgggtctcag

SEQ ID NO: 88532 - DNA, 22 bp, Artificial Sequence
  Synthetic oligonucleotide; TTA chr11 5249211 5249232 5249228 5249233 +
ccactgggtctcagcccagtta

SEQ ID NO: 88533 - DNA, 22 bp, Artificial Sequence
  Synthetic oligonucleotide; CTG chr11 5249217 5249238 5249234 5249239 +
ggtctcagcccagttagtcctc

SEQ ID NO: 88534 - DNA, 22 bp, Artificial Sequence
  Synthetic oligonucleotide; CTC chr11 5249223 5249244 5249240 5249245 +
agcccagttagtcctctgcagt

SEQ ID NO: 88535 - DNA, 22 bp, Artificial Sequence
  Synthetic oligonucleotide; TTA chr11 5249233 5249254 5249250 5249255 +
gtcctctgcagtttcttcaccc

SEQ ID NO: 88536 - DNA, 22 bp, Artificial Sequence
  Synthetic oligonucleotide; CTC chr11 5249239 5249260 5249256 5249261 +
tgcagtttcttcacccccaacc

SEQ ID NO: 88537 - DNA, 22 bp, Artificial Sequence
  Synthetic oligonucleotide; CTG chr11 5249241 5249262 5249258 5249263 +
cagtttcttcacccccaacccc

SEQ ID NO: 88538 - DNA, 22 bp, Artificial Sequence
  Synthetic oligonucleotide; TTT chr11 5249247 5249268 5249264 5249269 +
cttcacccccaaccccagtatc

SEQ ID NO: 88539 - DNA, 22 bp, Artificial Sequence
  Synthetic oligonucleotide; TTC chr11 5249248 5249269 5249265 5249270 +
ttcacccccaaccccagtatct

SEQ ID NO: 88540 - DNA, 22 bp, Artificial Sequence
  Synthetic oligonucleotide; CTT chr11 5249250 5249271 5249267 5249272 +
cacccccaaccccagtatcttc

SEQ ID NO: 88541 - DNA, 22 bp, Artificial Sequence
  Synthetic oligonucleotide; TTC chr11 5249251 5249272 5249268 5249273 +
acccccaaccccagtatcttca

SEQ ID NO: 88542 - DNA, 22 bp, Artificial Sequence
  Synthetic oligonucleotide; CTT chr11 5249271 5249292 5249288 5249293 +
caaacagctcacaccctgctgt

SEQ ID NO: 88543 - DNA, 22 bp, Artificial Sequence
  Synthetic oligonucleotide; TTC chr11 5249272 5249293 5249289 5249294 +
aaacagctcacaccctgctgtg

SEQ ID NO: 88544 - DNA, 22 bp, Artificial Sequence
  Synthetic oligonucleotide; CTC chr11 5249281 5249302 5249298 5249303 +
acaccctgctgtgctcagatca

SEQ ID NO: 88545 - DNA, 22 bp, Artificial Sequence
  Synthetic oligonucleotide; CTG chr11 5249289 5249310 5249306 5249311 +
ctgtgctcagatcaatactccg

SEQ ID NO: 88546 - DNA, 22 bp, Artificial Sequence
  Synthetic oligonucleotide; CTG chr11 5249292 5249313 5249309 5249314 +
tgctcagatcaatactccgttg

SEQ ID NO: 88547 - DNA, 22 bp, Artificial Sequence
  Synthetic oligonucleotide; CTC chr11 5249297 5249318 5249314 5249319 +
agatcaatactccgttgtctaa

SEQ ID NO: 88548 - DNA, 22 bp, Artificial Sequence
  Synthetic oligonucleotide; CTC chr11 5249309 5249330 5249326 5249331 +
cgttgtctaagttgcctcgaga

SEQ ID NO: 88549 - DNA, 22 bp, Artificial Sequence
  Synthetic oligonucleotide; TTG chr11 5249314 5249335 5249331 5249336 +
tctaagttgcctcgagactaaa

SEQ ID NO: 88550 - DNA, 22 bp, Artificial Sequence
  Synthetic oligonucleotide; CTA chr11 5249318 5249339 5249335 5249340 +
agttgcctcgagactaaaggca

SEQ ID NO: 88551 - DNA, 22 bp, Artificial Sequence
  Synthetic oligonucleotide; TTG chr11 5249323 5249344 5249340 5249345 +
cctcgagactaaaggcaacagg

SEQ ID NO: 88552 - DNA, 22 bp, Artificial Sequence
  Synthetic oligonucleotide; CTC chr11 5249327 5249348 5249344 5249349 +
gagactaaaggcaacagggctg

SEQ ID NO: 88553 - DNA, 22 bp, Artificial Sequence
  Synthetic oligonucleotide; CTA chr11 5249334 5249355 5249351 5249356 +
aaggcaacagggctgaaacatc

SEQ ID NO: 88554 - DNA, 22 bp, Artificial Sequence
  Synthetic oligonucleotide; CTG chr11 5249349 5249370 5249366 5249371 +
aaacatctcctggactcacctt

SEQ ID NO: 88555 - DNA, 22 bp, Artificial Sequence
  Synthetic oligonucleotide; CTC chr11 5249358 5249379 5249375 5249380 +
ctggactcaccttgaagttctc

SEQ ID NO: 88556 - DNA, 22 bp, Artificial Sequence
  Synthetic oligonucleotide; CTG chr11 5249361 5249382 5249378 5249383 +
gactcaccttgaagttctcagg

SEQ ID NO: 88557 - DNA, 22 bp, Artificial Sequence
  Synthetic oligonucleotide; CTC chr11 5249366 5249387 5249383 5249388 +
accttgaagttctcaggatcca

SEQ ID NO: 88558 - DNA, 22 bp, Artificial Sequence
  Synthetic oligonucleotide; CTT chr11 5249371 5249392 5249388 5249393 +
gaagttctcaggatccacatgc

SEQ ID NO: 88559 - DNA, 22 bp, Artificial Sequence
  Synthetic oligonucleotide; TTG chr11 5249372 5249393 5249389 5249394 +
aagttctcaggatccacatgca

SEQ ID NO: 88560 - DNA, 22 bp, Artificial Sequence
  Synthetic oligonucleotide; TTC chr11 5249378 5249399 5249395 5249400 +
tcaggatccacatgcagcttgt

SEQ ID NO: 88561 - DNA, 22 bp, Artificial Sequence
  Synthetic oligonucleotide; CTC chr11 5249380 5249401 5249397 5249402 +
aggatccacatgcagcttgtca

SEQ ID NO: 88562 - DNA, 22 bp, Artificial Sequence
  Synthetic oligonucleotide; CTT chr11 5249398 5249419 5249415 5249420 +
gtcacagtgcagttcactcagc

SEQ ID NO: 88563 - DNA, 22 bp, Artificial Sequence
  Synthetic oligonucleotide; TTG chr11 5249399 5249420 5249416 5249421 +
tcacagtgcagttcactcagct

SEQ ID NO: 88564 - DNA, 22 bp, Artificial Sequence
  Synthetic oligonucleotide; TTC chr11 5249413 5249434 5249430 5249435 +
actcagctgggcaaaggtgccc

SEQ ID NO: 88565 - DNA, 22 bp, Artificial Sequence
  Synthetic oligonucleotide; CTC chr11 5249417 5249438 5249434 5249439 +
agctgggcaaaggtgcccttga

SEQ ID NO: 88566 - DNA, 22 bp, Artificial Sequence
  Synthetic oligonucleotide; CTG chr11 5249422 5249443 5249439 5249444 +
ggcaaaggtgcccttgagatca

SEQ ID NO: 88567 - DNA, 22 bp, Artificial Sequence
  Synthetic oligonucleotide; CTT chr11 5249437 5249458 5249454 5249459 +
gagatcatccaggtgctttgtg

SEQ ID NO: 88568 - DNA, 22 bp, Artificial Sequence
  Synthetic oligonucleotide; TTG chr11 5249438 5249459 5249455 5249460 +
agatcatccaggtgctttgtgg

SEQ ID NO: 88569 - DNA, 22 bp, Artificial Sequence
  Synthetic oligonucleotide; CTT chr11 5249455 5249476 5249472 5249477 +
tgtggcatctcccaaggaagtc

SEQ ID NO: 88570 - DNA, 22 bp, Artificial Sequence
  Synthetic oligonucleotide; TTT chr11 5249456 5249477 5249473 5249478 +
gtggcatctcccaaggaagtca

SEQ ID NO: 88571 - DNA, 22 bp, Artificial Sequence
  Synthetic oligonucleotide; TTG chr11 5249457 5249478 5249474 5249479 +
tggcatctcccaaggaagtcag

SEQ ID NO: 88572 - DNA, 22 bp, Artificial Sequence
  Synthetic oligonucleotide; CTC chr11 5249466 5249487 5249483 5249488 +
ccaaggaagtcagcaccttctt

SEQ ID NO: 88573 - DNA, 22 bp, Artificial Sequence
  Synthetic oligonucleotide; CTT chr11 5249485 5249506 5249502 5249507 +
cttgccatgtgccttgactttg

SEQ ID NO: 88574 - DNA, 22 bp, Artificial Sequence
  Synthetic oligonucleotide; TTC chr11 5249486 5249507 5249503 5249508 +
ttgccatgtgccttgactttgg

SEQ ID NO: 88575 - DNA, 22 bp, Artificial Sequence
  Synthetic oligonucleotide; CTT chr11 5249488 5249509 5249505 5249510 +
gccatgtgccttgactttgggg

SEQ ID NO: 88576 - DNA, 22 bp, Artificial Sequence
  Synthetic oligonucleotide; TTG chr11 5249489 5249510 5249506 5249511 +
ccatgtgccttgactttggggt

SEQ ID NO: 88577 - DNA, 22 bp, Artificial Sequence
  Synthetic oligonucleotide; CTT chr11 5249500 5249521 5249517 5249522 +
gactttggggttgcccatgatg

SEQ ID NO: 88578 - DNA, 22 bp, Artificial Sequence
  Synthetic oligonucleotide; TTG chr11 5249501 5249522 5249518 5249523 +
actttggggttgcccatgatgg

SEQ ID NO: 88579 - DNA, 22 bp, Artificial Sequence
  Synthetic oligonucleotide; CTT chr11 5249505 5249526 5249522 5249527 +
tggggttgcccatgatggcaga

SEQ ID NO: 88580 - DNA, 22 bp, Artificial Sequence
  Synthetic oligonucleotide; TTT chr11 5249506 5249527 5249523 5249528 +
ggggttgcccatgatggcagag

SEQ ID NO: 88581 - DNA, 22 bp, Artificial Sequence
  Synthetic oligonucleotide; TTG chr11 5249507 5249528 5249524 5249529 +
gggttgcccatgatggcagagg

SEQ ID NO: 88582 - DNA, 22 bp, Artificial Sequence
  Synthetic oligonucleotide; TTG chr11 5249513 5249534 5249530 5249535 +
cccatgatggcagaggcagagg

SEQ ID NO: 88583 - DNA, 22 bp, Artificial Sequence
  Synthetic oligonucleotide; TTG chr11 5249543 5249564 5249560 5249565 +
ccaaagctgtcaaagaacctct

SEQ ID NO: 88584 - DNA, 22 bp, Artificial Sequence
  Synthetic oligonucleotide; CTG chr11 5249552 5249573 5249569 5249574 +
tcaaagaacctctgggtccatg

SEQ ID NO: 88585 - DNA, 22 bp, Artificial Sequence
  Synthetic oligonucleotide; CTC chr11 5249564 5249585 5249581 5249586 +
tgggtccatgggtagacaacca

SEQ ID NO: 88586 - DNA, 22 bp, Artificial Sequence
  Synthetic oligonucleotide; CTG chr11 5249566 5249587 5249583 5249588 +
ggtccatgggtagacaaccagg

SEQ ID NO: 88587 - DNA, 22 bp, Artificial Sequence
  Synthetic oligonucleotide; CTG chr11 5249594 5249615 5249611 5249616 +
tgagattgacaagaacagtttg

SEQ ID NO: 88588 - DNA, 22 bp, Artificial Sequence
  Synthetic oligonucleotide; TTG chr11 5249602 5249623 5249619 5249624 +
acaagaacagtttgacagtcag

SEQ ID NO: 88589 - DNA, 22 bp, Artificial Sequence
  Synthetic oligonucleotide; TTT chr11 5249615 5249636 5249632 5249637 +
gacagtcagaaggtgccacaaa

SEQ ID NO: 88590 - DNA, 22 bp, Artificial Sequence
  Synthetic oligonucleotide; TTG chr11 5249616 5249637 5249633 5249638 +
acagtcagaaggtgccacaaat

SEQ ID NO: 88591 - DNA, 22 bp, Artificial Sequence
  Synthetic oligonucleotide; CTG chr11 5249642 5249663 5249659 5249664 +
agaagcgacctggacttttgcc

SEQ ID NO: 88592 - DNA, 22 bp, Artificial Sequence
  Synthetic oligonucleotide; CTG chr11 5249654 5249675 5249671 5249676 +
gacttttgccaggcacagggtc

SEQ ID NO: 88593 - DNA, 22 bp, Artificial Sequence
  Synthetic oligonucleotide; CTT chr11 5249659 5249680 5249676 5249681 +
ttgccaggcacagggtccttcc

SEQ ID NO: 88594 - DNA, 22 bp, Artificial Sequence
  Synthetic oligonucleotide; TTT chr11 5249660 5249681 5249677 5249682 +
tgccaggcacagggtccttcct

SEQ ID NO: 88595 - DNA, 22 bp, Artificial Sequence
  Synthetic oligonucleotide; TTT chr11 5249661 5249682 5249678 5249683 +
gccaggcacagggtccttcctt

SEQ ID NO: 88596 - DNA, 22 bp, Artificial Sequence
  Synthetic oligonucleotide; TTG chr11 5249662 5249683 5249679 5249684 +
ccaggcacagggtccttccttc

SEQ ID NO: 88597 - DNA, 22 bp, Artificial Sequence
  Synthetic oligonucleotide; CTT chr11 5249679 5249700 5249696 5249701 +
ccttccctcccttgtcctggtc

SEQ ID NO: 88598 - DNA, 22 bp, Artificial Sequence
  Synthetic oligonucleotide; TTC chr11 5249680 5249701 5249697 5249702 +
cttccctcccttgtcctggtca

SEQ ID NO: 88599 - DNA, 22 bp, Artificial Sequence
  Synthetic oligonucleotide; CTT chr11 5249683 5249704 5249700 5249705 +
ccctcccttgtcctggtcacca

SEQ ID NO: 88600 - DNA, 22 bp, Artificial Sequence
  Synthetic oligonucleotide; TTC chr11 5249684 5249705 5249701 5249706 +
cctcccttgtcctggtcaccag

SEQ ID NO: 88601 - DNA, 22 bp, Artificial Sequence
  Synthetic oligonucleotide; CTC chr11 5249688 5249709 5249705 5249710 +
ccttgtcctggtcaccagagcc

SEQ ID NO: 88602 - DNA, 22 bp, Artificial Sequence
  Synthetic oligonucleotide; CTT chr11 5249692 5249713 5249709 5249714 +
gtcctggtcaccagagcctacc

SEQ ID NO: 88603 - DNA, 22 bp, Artificial Sequence
  Synthetic oligonucleotide; TTG chr11 5249693 5249714 5249710 5249715 +
tcctggtcaccagagcctacct

SEQ ID NO: 88604 - DNA, 22 bp, Artificial Sequence
  Synthetic oligonucleotide; CTG chr11 5249698 5249719 5249715 5249720 +
gtcaccagagcctaccttccca

SEQ ID NO: 88605 - DNA, 22 bp, Artificial Sequence
  Synthetic oligonucleotide; CTA chr11 5249712 5249733 5249729 5249734 +
ccttcccagggtttctcctcca

SEQ ID NO: 88606 - DNA, 22 bp, Artificial Sequence
  Synthetic oligonucleotide; CTT chr11 5249716 5249737 5249733 5249738 +
cccagggtttctcctccagcat

SEQ ID NO: 88607 - DNA, 22 bp, Artificial Sequence
  Synthetic oligonucleotide; TTC chr11 5249717 5249738 5249734 5249739 +
ccagggtttctcctccagcatc

SEQ ID NO: 88608 - DNA, 22 bp, Artificial Sequence
  Synthetic oligonucleotide; TTT chr11 5249726 5249747 5249743 5249748 +
ctcctccagcatcttccacatt

SEQ ID NO: 88609 - DNA, 22 bp, Artificial Sequence
  Synthetic oligonucleotide; TTC chr11 5249727 5249748 5249744 5249749 +
tcctccagcatcttccacattc

SEQ ID NO: 88610 - DNA, 22 bp, Artificial Sequence
  Synthetic oligonucleotide; CTC chr11 5249729 5249750 5249746 5249751 +
ctccagcatcttccacattcac

SEQ ID NO: 88611 - DNA, 22 bp, Artificial Sequence
  Synthetic oligonucleotide; CTC chr11 5249732 5249753 5249749 5249754 +
cagcatcttccacattcacctt

SEQ ID NO: 88612 - DNA, 22 bp, Artificial Sequence
  Synthetic oligonucleotide; CTT chr11 5249741 5249762 5249758 5249763 +
ccacattcaccttgccccacag

SEQ ID NO: 88613 - DNA, 22 bp, Artificial Sequence
  Synthetic oligonucleotide; TTC chr11 5249742 5249763 5249759 5249764 +
cacattcaccttgccccacagg

SEQ ID NO: 88614 - DNA, 22 bp, Artificial Sequence
  Synthetic oligonucleotide; TTC chr11 5249749 5249770 5249766 5249771 +
accttgccccacaggcttgtga

SEQ ID NO: 88615 - DNA, 22 bp, Artificial Sequence
  Synthetic oligonucleotide; CTT chr11 5249754 5249775 5249771 5249776 +
gccccacaggcttgtgatagta

SEQ ID NO: 88616 - DNA, 22 bp, Artificial Sequence
  Synthetic oligonucleotide; TTG chr11 5249755 5249776 5249772 5249777 +
ccccacaggcttgtgatagtag

SEQ ID NO: 88617 - DNA, 22 bp, Artificial Sequence
  Synthetic oligonucleotide; CTT chr11 5249767 5249788 5249784 5249789 +
gtgatagtagccttgtcctcct

SEQ ID NO: 88618 - DNA, 22 bp, Artificial Sequence
  Synthetic oligonucleotide; TTG chr11 5249768 5249789 5249785 5249790 +
tgatagtagccttgtcctcctc

SEQ ID NO: 88619 - DNA, 22 bp, Artificial Sequence
  Synthetic oligonucleotide; CTT chr11 5249781 5249802 5249798 5249803 +
gtcctcctctgtgaaatgaccc

SEQ ID NO: 88620 - DNA, 22 bp, Artificial Sequence
  Synthetic oligonucleotide; TTG chr11 5249782 5249803 5249799 5249804 +
tcctcctctgtgaaatgaccca

SEQ ID NO: 88621 - DNA, 22 bp, Artificial Sequence
  Synthetic oligonucleotide; CTC chr11 5249787 5249808 5249804 5249809 +
ctctgtgaaatgacccatggcg

SEQ ID NO: 88622 - DNA, 22 bp, Artificial Sequence
  Synthetic oligonucleotide; CTC chr11 5249790 5249811 5249807 5249812 +
tgtgaaatgacccatggcgtct

SEQ ID NO: 88623 - DNA, 22 bp, Artificial Sequence
  Synthetic oligonucleotide; CTG chr11 5249792 5249813 5249809 5249814 +
tgaaatgacccatggcgtctgg

SEQ ID NO: 88624 - DNA, 22 bp, Artificial Sequence
  Synthetic oligonucleotide; CTG chr11 5249813 5249834 5249830 5249835 +
gactaggagcttattgataacc

SEQ ID NO: 88625 - DNA, 22 bp, Artificial Sequence
  Synthetic oligonucleotide; CTA chr11 5249818 5249839 5249835 5249840 +
ggagcttattgataacctcaga

SEQ ID NO: 88626 - DNA, 22 bp, Artificial Sequence
  Synthetic oligonucleotide; CTT chr11 5249825 5249846 5249842 5249847 +
attgataacctcagacgttcca

SEQ ID NO: 88627 - DNA, 22 bp, Artificial Sequence
  Synthetic oligonucleotide; TTA chr11 5249826 5249847 5249843 5249848 +
ttgataacctcagacgttccag

SEQ ID NO: 88628 - DNA, 22 bp, Artificial Sequence
  Synthetic oligonucleotide; TTG chr11 5249829 5249850 5249846 5249851 +
ataacctcagacgttccagaag

SEQ ID NO: 88629 - DNA, 22 bp, Artificial Sequence
  Synthetic oligonucleotide; CTC chr11 5249837 5249858 5249854 5249859 +
agacgttccagaagcgagtgtg

SEQ ID NO: 88630 - DNA, 22 bp, Artificial Sequence
  Synthetic oligonucleotide; TTC chr11 5249845 5249866 5249862 5249867 +
cagaagcgagtgtgtggaactg

SEQ ID NO: 88631 - DNA, 22 bp, Artificial Sequence
  Synthetic oligonucleotide; CTG chr11 5249867 5249888 5249884 5249889 +
ctgaagggtgcttccttttatt

SEQ ID NO: 88632 - DNA, 22 bp, Artificial Sequence
  Synthetic oligonucleotide; CTG chr11 5249870 5249891 5249887 5249892 +
aagggtgcttccttttattctt

SEQ ID NO: 88633 - DNA, 22 bp, Artificial Sequence
  Synthetic oligonucleotide; CTT chr11 5249880 5249901 5249897 5249902 +
ccttttattcttcatccctagc

SEQ ID NO: 88634 - DNA, 22 bp, Artificial Sequence
  Synthetic oligonucleotide; TTC chr11 5249881 5249902 5249898 5249903 +
cttttattcttcatccctagcc

SEQ ID NO: 88635 - DNA, 22 bp, Artificial Sequence
  Synthetic oligonucleotide; CTT chr11 5249884 5249905 5249901 5249906 +
ttattcttcatccctagccagc

SEQ ID NO: 88636 - DNA, 22 bp, Artificial Sequence
  Synthetic oligonucleotide; TTT chr11 5249885 5249906 5249902 5249907 +
tattcttcatccctagccagcc

SEQ ID NO: 88637 - DNA, 22 bp, Artificial Sequence
  Synthetic oligonucleotide; TTT chr11 5249886 5249907 5249903 5249908 +
attcttcatccctagccagccg

SEQ ID NO: 88638 - DNA, 22 bp, Artificial Sequence
  Synthetic oligonucleotide; TTA chr11 5249887 5249908 5249904 5249909 +
ttcttcatccctagccagccgc

SEQ ID NO: 88639 - DNA, 22 bp, Artificial Sequence
  Synthetic oligonucleotide; TTC chr11 5249890 5249911 5249907 5249912 +
ttcatccctagccagccgccgg

SEQ ID NO: 88640 - DNA, 22 bp, Artificial Sequence
  Synthetic oligonucleotide; CTT chr11 5249892 5249913 5249909 5249914 +
catccctagccagccgccggcc

SEQ ID NO: 88641 - DNA, 22 bp, Artificial Sequence
  Synthetic oligonucleotide; TTC chr11 5249893 5249914 5249910 5249915 +
atccctagccagccgccggccc

SEQ ID NO: 88642 - DNA, 22 bp, Artificial Sequence
  Synthetic oligonucleotide; CTA chr11 5249900 5249921 5249917 5249922 +
gccagccgccggcccctggcct

SEQ ID NO: 88643 - DNA, 22 bp, Artificial Sequence
  Synthetic oligonucleotide; CTG chr11 5249918 5249939 5249935 5249940 +
gcctcactggatactctaagac

SEQ ID NO: 88644 - DNA, 22 bp, Artificial Sequence
  Synthetic oligonucleotide; CTC chr11 5249923 5249944 5249940 5249945 +
actggatactctaagactattg

SEQ ID NO: 88645 - DNA, 22 bp, Artificial Sequence
  Synthetic oligonucleotide; CTG chr11 5249927 5249948 5249944 5249949 +
gatactctaagactattggtca

SEQ ID NO: 88646 - DNA, 22 bp, Artificial Sequence
  Synthetic oligonucleotide; CTC chr11 5249934 5249955 5249951 5249956 +
taagactattggtcaagtttgc

SEQ ID NO: 88647 - DNA, 22 bp, Artificial Sequence
  Synthetic oligonucleotide; CTA chr11 5249936 5249957 5249953 5249958 +
agactattggtcaagtttgcct

SEQ ID NO: 88648 - DNA, 22 bp, Artificial Sequence
  Synthetic oligonucleotide; CTA chr11 5249942 5249963 5249959 5249964 +
ttggtcaagtttgccttgtcaa

SEQ ID NO: 88649 - DNA, 22 bp, Artificial Sequence
  Synthetic oligonucleotide; TTG chr11 5249945 5249966 5249962 5249967 +
gtcaagtttgccttgtcaaggc

SEQ ID NO: 88650 - DNA, 22 bp, Artificial Sequence
  Synthetic oligonucleotide; TTT chr11 5249954 5249975 5249971 5249976 +
gccttgtcaaggctattggtca

SEQ ID NO: 88651 - DNA, 22 bp, Artificial Sequence
  Synthetic oligonucleotide; TTG chr11 5249955 5249976 5249972 5249977 +
ccttgtcaaggctattggtcaa

SEQ ID NO: 88652 - DNA, 22 bp, Artificial Sequence
  Synthetic oligonucleotide; CTT chr11 5249959 5249980 5249976 5249981 +
gtcaaggctattggtcaaggca

SEQ ID NO: 88653 - DNA, 22 bp, Artificial Sequence
  Synthetic oligonucleotide; TTG chr11 5249960 5249981 5249977 5249982 +
tcaaggctattggtcaaggcaa

SEQ ID NO: 88654 - DNA, 22 bp, Artificial Sequence
  Synthetic oligonucleotide; CTA chr11 5249969 5249990 5249986 5249991 +
ttggtcaaggcaaggctggcca

SEQ ID NO: 88655 - DNA, 22 bp, Artificial Sequence
  Synthetic oligonucleotide; TTG chr11 5249972 5249993 5249989 5249994 +
gtcaaggcaaggctggccaacc

SEQ ID NO: 88656 - DNA, 22 bp, Artificial Sequence
  Synthetic oligonucleotide; CTG chr11 5249987 5250008 5250004 5250009 +
gccaacccatgggtggagttta

SEQ ID NO: 88657 - DNA, 22 bp, Artificial Sequence
  Synthetic oligonucleotide; TTT chr11 5250008 5250029 5250025 5250030 +
agccagggaccgtttcagacag

SEQ ID NO: 88658 - DNA, 22 bp, Artificial Sequence
  Synthetic oligonucleotide; TTA chr11 5250009 5250030 5250026 5250031 +
gccagggaccgtttcagacaga

SEQ ID NO: 88659 - DNA, 22 bp, Artificial Sequence
  Synthetic oligonucleotide; TTT chr11 5250023 5250044 5250040 5250045 +
cagacagatatttgcattgaga

SEQ ID NO: 88660 - DNA, 22 bp, Artificial Sequence
  Synthetic oligonucleotide; TTC chr11 5250024 5250045 5250041 5250046 +
agacagatatttgcattgagat

SEQ ID NO: 88661 - DNA, 22 bp, Artificial Sequence
  Synthetic oligonucleotide; TTT chr11 5250036 5250057 5250053 5250058 +
gcattgagatagtgtggggaag

SEQ ID NO: 88662 - DNA, 22 bp, Artificial Sequence
  Synthetic oligonucleotide; TTG chr11 5250037 5250058 5250054 5250059 +
cattgagatagtgtggggaagg

SEQ ID NO: 88663 - DNA, 22 bp, Artificial Sequence
  Synthetic oligonucleotide; TTG chr11 5250042 5250063 5250059 5250064 +
agatagtgtggggaaggggccc

SEQ ID NO: 88664 - DNA, 22 bp, Artificial Sequence
  Synthetic oligonucleotide; CTG chr11 5250078 5250099 5250095 5250100 +
ctaattttttttatagcctttg

SEQ ID NO: 88665 - DNA, 22 bp, Artificial Sequence
  Synthetic oligonucleotide; CTA chr11 5250081 5250102 5250098 5250103 +
attttttttatagcctttgcct

SEQ ID NO: 88666 - DNA, 22 bp, Artificial Sequence
  Synthetic oligonucleotide; TTT chr11 5250085 5250106 5250102 5250107 +
tttttatagcctttgccttgtt

SEQ ID NO: 88667 - DNA, 22 bp, Artificial Sequence
  Synthetic oligonucleotide; TTT chr11 5250086 5250107 5250103 5250108 +
ttttatagcctttgccttgttc

SEQ ID NO: 88668 - DNA, 22 bp, Artificial Sequence
  Synthetic oligonucleotide; TTT chr11 5250087 5250108 5250104 5250109 +
tttatagcctttgccttgttcc

SEQ ID NO: 88669 - DNA, 22 bp, Artificial Sequence
  Synthetic oligonucleotide; TTT chr11 5250088 5250109 5250105 5250110 +
ttatagcctttgccttgttccg

SEQ ID NO: 88670 - DNA, 22 bp, Artificial Sequence
  Synthetic oligonucleotide; TTT chr11 5250089 5250110 5250106 5250111 +
tatagcctttgccttgttccga

SEQ ID NO: 88671 - DNA, 22 bp, Artificial Sequence
  Synthetic oligonucleotide; TTT chr11 5250090 5250111 5250107 5250112 +
atagcctttgccttgttccgat

SEQ ID NO: 88672 - DNA, 22 bp, Artificial Sequence
  Synthetic oligonucleotide; TTA chr11 5250091 5250112 5250108 5250113 +
tagcctttgccttgttccgatt

SEQ ID NO: 88673 - DNA, 22 bp, Artificial Sequence
  Synthetic oligonucleotide; CTT chr11 5250098 5250119 5250115 5250120 +
tgccttgttccgattcagtcat

SEQ ID NO: 88674 - DNA, 22 bp, Artificial Sequence
  Synthetic oligonucleotide; TTT chr11 5250099 5250120 5250116 5250121 +
gccttgttccgattcagtcatt

SEQ ID NO: 88675 - DNA, 22 bp, Artificial Sequence
  Synthetic oligonucleotide; TTG chr11 5250100 5250121 5250117 5250122 +
ccttgttccgattcagtcattc

SEQ ID NO: 88676 - DNA, 22 bp, Artificial Sequence
  Synthetic oligonucleotide; CTT chr11 5250104 5250125 5250121 5250126 +
gttccgattcagtcattccagt

SEQ ID NO: 88677 - DNA, 22 bp, Artificial Sequence
  Synthetic oligonucleotide; TTG chr11 5250105 5250126 5250122 5250127 +
ttccgattcagtcattccagtt

SEQ ID NO: 88678 - DNA, 22 bp, Artificial Sequence
  Synthetic oligonucleotide; TTC chr11 5250108 5250129 5250125 5250130 +
cgattcagtcattccagttttt

SEQ ID NO: 88679 - DNA, 22 bp, Artificial Sequence
  Synthetic oligonucleotide; TTC chr11 5250114 5250135 5250131 5250136 +
agtcattccagtttttctctaa

SEQ ID NO: 88680 - DNA, 22 bp, Artificial Sequence
  Synthetic oligonucleotide; TTC chr11 5250122 5250143 5250139 5250144 +
cagtttttctctaatttattct

SEQ ID NO: 88681 - DNA, 22 bp, Artificial Sequence
  Synthetic oligonucleotide; TTT chr11 5250128 5250149 5250145 5250150 +
ttctctaatttattcttccctt

SEQ ID NO: 88682 - DNA, 22 bp, Artificial Sequence
  Synthetic oligonucleotide; TTT chr11 5250129 5250150 5250146 5250151 +
tctctaatttattcttcccttt

SEQ ID NO: 88683 - DNA, 22 bp, Artificial Sequence
  Synthetic oligonucleotide; TTT chr11 5250130 5250151 5250147 5250152 +
ctctaatttattcttcccttta

SEQ ID NO: 88684 - DNA, 22 bp, Artificial Sequence
  Synthetic oligonucleotide; TTC chr11 5250131 5250152 5250148 5250153 +
tctaatttattcttccctttag

SEQ ID NO: 88685 - DNA, 22 bp, Artificial Sequence
  Synthetic oligonucleotide; CTC chr11 5250133 5250154 5250150 5250155 +
taatttattcttccctttagct

SEQ ID NO: 88686 - DNA, 22 bp, Artificial Sequence
  Synthetic oligonucleotide; CTA chr11 5250135 5250156 5250152 5250157 +
atttattcttccctttagctag

SEQ ID NO: 88687 - DNA, 22 bp, Artificial Sequence
  Synthetic oligonucleotide; TTT chr11 5250139 5250160 5250156 5250161 +
attcttccctttagctagtttc

SEQ ID NO: 88688 - DNA, 22 bp, Artificial Sequence
  Synthetic oligonucleotide; TTA chr11 5250140 5250161 5250157 5250162 +
ttcttccctttagctagtttcc

SEQ ID NO: 88689 - DNA, 22 bp, Artificial Sequence
  Synthetic oligonucleotide; TTC chr11 5250143 5250164 5250160 5250165 +
ttccctttagctagtttccttc

SEQ ID NO: 88690 - DNA, 22 bp, Artificial Sequence
  Synthetic oligonucleotide; CTT chr11 5250145 5250166 5250162 5250167 +
ccctttagctagtttccttctc

SEQ ID NO: 88691 - DNA, 22 bp, Artificial Sequence
  Synthetic oligonucleotide; TTC chr11 5250146 5250167 5250163 5250168 +
cctttagctagtttccttctcc

SEQ ID NO: 88692 - DNA, 22 bp, Artificial Sequence
  Synthetic oligonucleotide; CTT chr11 5250150 5250171 5250167 5250172 +
tagctagtttccttctcccatc

SEQ ID NO: 88693 - DNA, 22 bp, Artificial Sequence
  Synthetic oligonucleotide; TTT chr11 5250151 5250172 5250168 5250173 +
agctagtttccttctcccatca

SEQ ID NO: 88694 - DNA, 22 bp, Artificial Sequence
  Synthetic oligonucleotide; TTA chr11 5250152 5250173 5250169 5250174 +
gctagtttccttctcccatcat

SEQ ID NO: 88695 - DNA, 22 bp, Artificial Sequence
  Synthetic oligonucleotide; CTA chr11 5250156 5250177 5250173 5250178 +
gtttccttctcccatcatagag

SEQ ID NO: 88696 - DNA, 22 bp, Artificial Sequence
  Synthetic oligonucleotide; TTT chr11 5250160 5250181 5250177 5250182 +
ccttctcccatcatagaggata

SEQ ID NO: 88697 - DNA, 22 bp, Artificial Sequence
  Synthetic oligonucleotide; TTC chr11 5250161 5250182 5250178 5250183 +
cttctcccatcatagaggatac

SEQ ID NO: 88698 - DNA, 22 bp, Artificial Sequence
  Synthetic oligonucleotide; CTT chr11 5250164 5250185 5250181 5250186 +
ctcccatcatagaggataccag

SEQ ID NO: 88699 - DNA, 22 bp, Artificial Sequence
  Synthetic oligonucleotide; TTC chr11 5250165 5250186 5250182 5250187 +
tcccatcatagaggataccagg

SEQ ID NO: 88700 - DNA, 22 bp, Artificial Sequence
  Synthetic oligonucleotide; CTC chr11 5250167 5250188 5250184 5250189 +
ccatcatagaggataccaggac

SEQ ID NO: 88701 - DNA, 22 bp, Artificial Sequence
  Synthetic oligonucleotide; CTT chr11 5250191 5250212 5250208 5250213 +
cttttgtcagccgttttttacc

SEQ ID NO: 88702 - DNA, 22 bp, Artificial Sequence
  Synthetic oligonucleotide; TTC chr11 5250192 5250213 5250209 5250214 +
ttttgtcagccgttttttacct

SEQ ID NO: 88703 - DNA, 22 bp, Artificial Sequence
  Synthetic oligonucleotide; CTT chr11 5250194 5250215 5250211 5250216 +
ttgtcagccgttttttaccttc

SEQ ID NO: 88704 - DNA, 22 bp, Artificial Sequence
  Synthetic oligonucleotide; TTT chr11 5250195 5250216 5250212 5250217 +
tgtcagccgttttttaccttct

SEQ ID NO: 88705 - DNA, 22 bp, Artificial Sequence
  Synthetic oligonucleotide; TTT chr11 5250196 5250217 5250213 5250218 +
gtcagccgttttttaccttctt

SEQ ID NO: 88706 - DNA, 22 bp, Artificial Sequence
  Synthetic oligonucleotide; TTG chr11 5250197 5250218 5250214 5250219 +
tcagccgttttttaccttcttg

SEQ ID NO: 88707 - DNA, 22 bp, Artificial Sequence
  Synthetic oligonucleotide; TTT chr11 5250207 5250228 5250224 5250229 +
tttaccttcttgtctctagctc

SEQ ID NO: 88708 - DNA, 22 bp, Artificial Sequence
  Synthetic oligonucleotide; TTT chr11 5250208 5250229 5250225 5250230 +
ttaccttcttgtctctagctcc

SEQ ID NO: 88709 - DNA, 22 bp, Artificial Sequence
  Synthetic oligonucleotide; TTT chr11 5250209 5250230 5250226 5250231 +
taccttcttgtctctagctcca

SEQ ID NO: 88710 - DNA, 22 bp, Artificial Sequence
  Synthetic oligonucleotide; TTT chr11 5250210 5250231 5250227 5250232 +
accttcttgtctctagctccag

SEQ ID NO: 88711 - DNA, 22 bp, Artificial Sequence
  Synthetic oligonucleotide; TTA chr11 5250211 5250232 5250228 5250233 +
ccttcttgtctctagctccagt

SEQ ID NO: 88712 - DNA, 22 bp, Artificial Sequence
  Synthetic oligonucleotide; CTT chr11 5250215 5250236 5250232 5250237 +
cttgtctctagctccagtgagg

SEQ ID NO: 88713 - DNA, 22 bp, Artificial Sequence
  Synthetic oligonucleotide; TTC chr11 5250216 5250237 5250233 5250238 +
ttgtctctagctccagtgaggc

SEQ ID NO: 88714 - DNA, 22 bp, Artificial Sequence
  Synthetic oligonucleotide; CTT chr11 5250218 5250239 5250235 5250240 +
gtctctagctccagtgaggcct

SEQ ID NO: 88715 - DNA, 22 bp, Artificial Sequence
  Synthetic oligonucleotide; TTG chr11 5250219 5250240 5250236 5250241 +
tctctagctccagtgaggcctg

SEQ ID NO: 88716 - DNA, 22 bp, Artificial Sequence
  Synthetic oligonucleotide; CTC chr11 5250223 5250244 5250240 5250245 +
tagctccagtgaggcctgtagt

SEQ ID NO: 88717 - DNA, 22 bp, Artificial Sequence
  Synthetic oligonucleotide; CTA chr11 5250225 5250246 5250242 5250247 +
gctccagtgaggcctgtagttt

SEQ ID NO: 88718 - DNA, 22 bp, Artificial Sequence
  Synthetic oligonucleotide; CTC chr11 5250229 5250250 5250246 5250251 +
cagtgaggcctgtagtttaaag

SEQ ID NO: 88719 - DNA, 22 bp, Artificial Sequence
  Synthetic oligonucleotide; CTG chr11 5250241 5250262 5250258 5250263 +
tagtttaaagctaaagcatgta

SEQ ID NO: 88720 - DNA, 22 bp, Artificial Sequence
  Synthetic oligonucleotide; TTT chr11 5250247 5250268 5250264 5250269 +
aaagctaaagcatgtaccaatt

SEQ ID NO: 88721 - DNA, 22 bp, Artificial Sequence
  Synthetic oligonucleotide; TTA chr11 5250248 5250269 5250265 5250270 +
aagctaaagcatgtaccaattt

SEQ ID NO: 88722 - DNA, 22 bp, Artificial Sequence
  Synthetic oligonucleotide; CTA chr11 5250254 5250275 5250271 5250276 +
aagcatgtaccaatttttgaaa

SEQ ID NO: 88723 - DNA, 22 bp, Artificial Sequence
  Synthetic oligonucleotide; TTT chr11 5250270 5250291 5250287 5250292 +
ttgaaaagttcagggattgtga

SEQ ID NO: 88724 - DNA, 22 bp, Artificial Sequence
  Synthetic oligonucleotide; TTT chr11 5250271 5250292 5250288 5250293 +
tgaaaagttcagggattgtgaa

SEQ ID NO: 88725 - DNA, 22 bp, Artificial Sequence
  Synthetic oligonucleotide; TTT chr11 5250272 5250293 5250289 5250294 +
gaaaagttcagggattgtgaaa

SEQ ID NO: 88726 - DNA, 22 bp, Artificial Sequence
  Synthetic oligonucleotide; TTG chr11 5250273 5250294 5250290 5250295 +
aaaagttcagggattgtgaaat

SEQ ID NO: 88727 - DNA, 22 bp, Artificial Sequence
  Synthetic oligonucleotide; TTC chr11 5250281 5250302 5250298 5250303 +
agggattgtgaaatgtgtttta

SEQ ID NO: 88728 - DNA, 22 bp, Artificial Sequence
  Synthetic oligonucleotide; TTG chr11 5250289 5250310 5250306 5250311 +
tgaaatgtgttttaggcatagg

SEQ ID NO: 88729 - DNA, 22 bp, Artificial Sequence
  Synthetic oligonucleotide; TTT chr11 5250301 5250322 5250318 5250323 +
taggcataggtccaggattttt

SEQ ID NO: 88730 - DNA, 22 bp, Artificial Sequence
  Synthetic oligonucleotide; TTT chr11 5250302 5250323 5250319 5250324 +
aggcataggtccaggatttttg

SEQ ID NO: 88731 - DNA, 22 bp, Artificial Sequence
  Synthetic oligonucleotide; TTA chr11 5250303 5250324 5250320 5250325 +
ggcataggtccaggatttttga

SEQ ID NO: 88732 - DNA, 22 bp, Artificial Sequence
  Synthetic oligonucleotide; TTT chr11 5250321 5250342 5250338 5250343 +
ttgacgggacaaatcttagtct

SEQ ID NO: 88733 - DNA, 22 bp, Artificial Sequence
  Synthetic oligonucleotide; TTT chr11 5250322 5250343 5250339 5250344 +
tgacgggacaaatcttagtctc

SEQ ID NO: 88734 - DNA, 22 bp, Artificial Sequence
  Synthetic oligonucleotide; TTT chr11 5250323 5250344 5250340 5250345 +
gacgggacaaatcttagtctct

SEQ ID NO: 88735 - DNA, 22 bp, Artificial Sequence
  Synthetic oligonucleotide; TTG chr11 5250324 5250345 5250341 5250346 +
acgggacaaatcttagtctctt

SEQ ID NO: 88736 - DNA, 22 bp, Artificial Sequence
  Synthetic oligonucleotide; CTT chr11 5250338 5250359 5250355 5250360 +
agtctctttcagttagcagtgg

SEQ ID NO: 88737 - DNA, 22 bp, Artificial Sequence
  Synthetic oligonucleotide; TTA chr11 5250339 5250360 5250356 5250361 +
gtctctttcagttagcagtggt

SEQ ID NO: 88738 - DNA, 22 bp, Artificial Sequence
  Synthetic oligonucleotide; CTC chr11 5250344 5250365 5250361 5250366 +
tttcagttagcagtggtttcta

SEQ ID NO: 88739 - DNA, 22 bp, Artificial Sequence
  Synthetic oligonucleotide; CTT chr11 5250346 5250367 5250363 5250368 +
tcagttagcagtggtttctaag

SEQ ID NO: 88740 - DNA, 22 bp, Artificial Sequence
  Synthetic oligonucleotide; TTT chr11 5250347 5250368 5250364 5250369 +
cagttagcagtggtttctaagg

SEQ ID NO: 88741 - DNA, 22 bp, Artificial Sequence
  Synthetic oligonucleotide; TTC chr11 5250348 5250369 5250365 5250370 +
agttagcagtggtttctaagga

SEQ ID NO: 88742 - DNA, 22 bp, Artificial Sequence
  Synthetic oligonucleotide; TTA chr11 5250353 5250374 5250370 5250375 +
gcagtggtttctaaggaaaaag

SEQ ID NO: 88743 - DNA, 22 bp, Artificial Sequence
  Synthetic oligonucleotide; TTT chr11 5250363 5250384 5250380 5250385 +
ctaaggaaaaagtgctatactt

SEQ ID NO: 88744 - DNA, 22 bp, Artificial Sequence
  Synthetic oligonucleotide; TTC chr11 5250364 5250385 5250381 5250386 +
taaggaaaaagtgctatacttc

SEQ ID NO: 88745 - DNA, 22 bp, Artificial Sequence
  Synthetic oligonucleotide; CTA chr11 5250366 5250387 5250383 5250388 +
aggaaaaagtgctatacttctt

SEQ ID NO: 88746 - DNA, 22 bp, Artificial Sequence
  Synthetic oligonucleotide; CTA chr11 5250380 5250401 5250397 5250402 +
tacttctttttgaatatactct

SEQ ID NO: 88747 - DNA, 22 bp, Artificial Sequence
  Synthetic oligonucleotide; CTT chr11 5250385 5250406 5250402 5250407 +
ctttttgaatatactctttgtg

SEQ ID NO: 88748 - DNA, 22 bp, Artificial Sequence
  Synthetic oligonucleotide; TTC chr11 5250386 5250407 5250403 5250408 +
tttttgaatatactctttgtga

SEQ ID NO: 88749 - DNA, 22 bp, Artificial Sequence
  Synthetic oligonucleotide; CTT chr11 5250388 5250409 5250405 5250410 +
tttgaatatactctttgtgact

SEQ ID NO: 88750 - DNA, 22 bp, Artificial Sequence
  Synthetic oligonucleotide; TTT chr11 5250389 5250410 5250406 5250411 +
ttgaatatactctttgtgactt

SEQ ID NO: 88751 - DNA, 22 bp, Artificial Sequence
  Synthetic oligonucleotide; TTT chr11 5250390 5250411 5250407 5250412 +
tgaatatactctttgtgacttt

SEQ ID NO: 88752 - DNA, 22 bp, Artificial Sequence
  Synthetic oligonucleotide; TTT chr11 5250391 5250412 5250408 5250413 +
gaatatactctttgtgactttt

SEQ ID NO: 88753 - DNA, 22 bp, Artificial Sequence
  Synthetic oligonucleotide; TTG chr11 5250392 5250413 5250409 5250414 +
aatatactctttgtgacttttg

SEQ ID NO: 88754 - DNA, 22 bp, Artificial Sequence
  Synthetic oligonucleotide; CTC chr11 5250401 5250422 5250418 5250423 +
tttgtgacttttgccattatct

SEQ ID NO: 88755 - DNA, 22 bp, Artificial Sequence
  Synthetic oligonucleotide; CTT chr11 5250403 5250424 5250420 5250425 +
tgtgacttttgccattatctct

SEQ ID NO: 88756 - DNA, 22 bp, Artificial Sequence
  Synthetic oligonucleotide; TTT chr11 5250404 5250425 5250421 5250426 +
gtgacttttgccattatctctt

SEQ ID NO: 88757 - DNA, 22 bp, Artificial Sequence
  Synthetic oligonucleotide; TTG chr11 5250405 5250426 5250422 5250427 +
tgacttttgccattatctctta

SEQ ID NO: 88758 - DNA, 22 bp, Artificial Sequence
  Synthetic oligonucleotide; CTT chr11 5250411 5250432 5250428 5250433 +
ttgccattatctcttaatttct

SEQ ID NO: 88759 - DNA, 22 bp, Artificial Sequence
  Synthetic oligonucleotide; TTT chr11 5250412 5250433 5250429 5250434 +
tgccattatctcttaatttctc

SEQ ID NO: 88760 - DNA, 22 bp, Artificial Sequence
  Synthetic oligonucleotide; TTT chr11 5250413 5250434 5250430 5250435 +
gccattatctcttaatttctca

SEQ ID NO: 88761 - DNA, 22 bp, Artificial Sequence
  Synthetic oligonucleotide; TTG chr11 5250414 5250435 5250431 5250436 +
ccattatctcttaatttctcaa

SEQ ID NO: 88762 - DNA, 22 bp, Artificial Sequence
  Synthetic oligonucleotide; TTA chr11 5250420 5250441 5250437 5250442 +
tctcttaatttctcaatagtgc

SEQ ID NO: 88763 - DNA, 22 bp, Artificial Sequence
  Synthetic oligonucleotide; CTC chr11 5250424 5250445 5250441 5250446 +
ttaatttctcaatagtgcagtg

SEQ ID NO: 88764 - DNA, 22 bp, Artificial Sequence
  Synthetic oligonucleotide; CTT chr11 5250426 5250447 5250443 5250448 +
aatttctcaatagtgcagtgaa

SEQ ID NO: 88765 - DNA, 22 bp, Artificial Sequence
  Synthetic oligonucleotide; TTA chr11 5250427 5250448 5250444 5250449 +
atttctcaatagtgcagtgaaa

SEQ ID NO: 88766 - DNA, 22 bp, Artificial Sequence
  Synthetic oligonucleotide; TTT chr11 5250431 5250452 5250448 5250453 +
ctcaatagtgcagtgaaaacaa

SEQ ID NO: 88767 - DNA, 22 bp, Artificial Sequence
  Synthetic oligonucleotide; TTC chr11 5250432 5250453 5250449 5250454 +
tcaatagtgcagtgaaaacaat

SEQ ID NO: 88768 - DNA, 22 bp, Artificial Sequence
  Synthetic oligonucleotide; CTC chr11 5250434 5250455 5250451 5250456 +
aatagtgcagtgaaaacaattt

SEQ ID NO: 88769 - DNA, 22 bp, Artificial Sequence
  Synthetic oligonucleotide; TTT chr11 5250456 5250477 5250473 5250478 +
ctataaagccacagtttcagcg

SEQ ID NO: 88770 - DNA, 22 bp, Artificial Sequence
  Synthetic oligonucleotide; TTC chr11 5250457 5250478 5250474 5250479 +
tataaagccacagtttcagcgc

SEQ ID NO: 88771 - DNA, 22 bp, Artificial Sequence
  Synthetic oligonucleotide; CTA chr11 5250459 5250480 5250476 5250481 +
taaagccacagtttcagcgcag

SEQ ID NO: 88772 - DNA, 22 bp, Artificial Sequence
  Synthetic oligonucleotide; TTT chr11 5250473 5250494 5250490 5250495 +
cagcgcagtaatagattagtgt

SEQ ID NO: 88773 - DNA, 22 bp, Artificial Sequence
  Synthetic oligonucleotide; TTC chr11 5250474 5250495 5250491 5250496 +
agcgcagtaatagattagtgtt

SEQ ID NO: 88774 - DNA, 22 bp, Artificial Sequence
  Synthetic oligonucleotide; TTA chr11 5250491 5250512 5250508 5250513 +
gtgttacataatataagaccta

SEQ ID NO: 88775 - DNA, 22 bp, Artificial Sequence
  Synthetic oligonucleotide; TTA chr11 5250497 5250518 5250514 5250519 +
cataatataagacctaatgctt

SEQ ID NO: 88776 - DNA, 22 bp, Artificial Sequence
  Synthetic oligonucleotide; CTA chr11 5250513 5250534 5250530 5250535 +
atgcttacctcaatatctactt

SEQ ID NO: 88777 - DNA, 22 bp, Artificial Sequence
  Synthetic oligonucleotide; CTT chr11 5250519 5250540 5250536 5250541 +
acctcaatatctacttatccgt

SEQ ID NO: 88778 - DNA, 22 bp, Artificial Sequence
  Synthetic oligonucleotide; TTA chr11 5250520 5250541 5250537 5250542 +
cctcaatatctacttatccgta

SEQ ID NO: 88779 - DNA, 22 bp, Artificial Sequence
  Synthetic oligonucleotide; CTC chr11 5250524 5250545 5250541 5250546 +
aatatctacttatccgtaccta

SEQ ID NO: 88780 - DNA, 22 bp, Artificial Sequence
  Synthetic oligonucleotide; CTA chr11 5250532 5250553 5250549 5250554 +
cttatccgtacctatttgaaat

SEQ ID NO: 88781 - DNA, 22 bp, Artificial Sequence
  Synthetic oligonucleotide; CTT chr11 5250535 5250556 5250552 5250557 +
atccgtacctatttgaaataaa

SEQ ID NO: 88782 - DNA, 22 bp, Artificial Sequence
  Synthetic oligonucleotide; TTA chr11 5250536 5250557 5250553 5250558 +
tccgtacctatttgaaataaat

SEQ ID NO: 88783 - DNA, 22 bp, Artificial Sequence
  Synthetic oligonucleotide; CTA chr11 5250546 5250567 5250563 5250568 +
tttgaaataaatcatgactgtt

SEQ ID NO: 88784 - DNA, 22 bp, Artificial Sequence
  Synthetic oligonucleotide; TTT chr11 5250549 5250570 5250566 5250571 +
gaaataaatcatgactgtttca

SEQ ID NO: 88785 - DNA, 22 bp, Artificial Sequence
  Synthetic oligonucleotide; TTG chr11 5250550 5250571 5250567 5250572 +
aaataaatcatgactgtttcat

SEQ ID NO: 88786 - DNA, 22 bp, Artificial Sequence
  Synthetic oligonucleotide; CTG chr11 5250566 5250587 5250583 5250588 +
tttcatcttagaaaaatatttg

SEQ ID NO: 88787 - DNA, 22 bp, Artificial Sequence
  Synthetic oligonucleotide; TTT chr11 5250569 5250590 5250586 5250591 +
catcttagaaaaatatttgatt

SEQ ID NO: 88788 - DNA, 22 bp, Artificial Sequence
  Synthetic oligonucleotide; TTC chr11 5250570 5250591 5250587 5250592 +
atcttagaaaaatatttgattc
